United States Patent 9,328,346 (POLYCOMB-ASSOCIATED NON-CODING RNAS) - sequence listing, part 114

SEQ ID NO: 81365 - RNA, 46 nt, Mus musculus
guguguacauguguacaagugugcauucuacaaaguauagguggag

SEQ ID NO: 81366 - RNA, 41 nt, Mus musculus
auacagaugaaccagaagucaggucuagcuaaucuuggugg

SEQ ID NO: 81367 - RNA, 46 nt, Mus musculus
uauauauuuauauaaccaguuggaaauuauauaaauaggggcccac

SEQ ID NO: 81368 - RNA, 41 nt, Mus musculus
uggaagcuucuuauucugcaggguaagaaagauuuggggaa

SEQ ID NO: 81369 - RNA, 45 nt, Mus musculus
auauuagagguacaagugagagaccggcuauagauagauagauag

SEQ ID NO: 81370 - RNA, 45 nt, Mus musculus
ucuguauuggucaggcucuggcagagccucucagggggcagcuau

SEQ ID NO: 81371 - RNA, 46 nt, Mus musculus
ccagccuaacuccaaguugagugagagauccuaucuuaaaggauaa

SEQ ID NO: 81372 - RNA, 46 nt, Mus musculus
gacugaacuuauacaagaaauuaaaaguagggcagaaugcacccag

SEQ ID NO: 81373 - RNA, 46 nt, Mus musculus
agucaagaaucucagaucuccaguuaugaggaagaacuguugaaag

SEQ ID NO: 81374 - RNA, 46 nt, Mus musculus
cgccuacaacaagaaacagcacaauuggaagaaaguguggagucag

SEQ ID NO: 81375 - RNA, 46 nt, Mus musculus
ugaggcugugacuguggcugguaaugagaaaguuacuccgagauuu

SEQ ID NO: 81376 - RNA, 42 nt, Mus musculus
uccuuuuaccacuucaaguacggacccuuucagugcauccag

SEQ ID NO: 81377 - RNA, 83 nt, Mus musculus
aucugggggugagauacuaacucccagcgugaguagcaagagugagugauaaagcaaauuggagcaaacaaguuacuuuaaug

SEQ ID NO: 81378 - RNA, 46 nt, Mus musculus
uagccagggauauacaaagaaauugucuuaaaaaaagagcaggaag

SEQ ID NO: 81379 - RNA, 46 nt, Mus musculus
ucuaccagcagugugaccauugcaaaaccuauguuagaggaaacag

SEQ ID NO: 81380 - RNA, 45 nt, Mus musculus
gaagaagauaugauugaaugggcaaaaagggaaagugagcgggaa

SEQ ID NO: 81381 - RNA, 41 nt, Mus musculus
gcaaguauucucccugagcugagugcuugaaggagggggag

SEQ ID NO: 81382 - RNA, 42 nt, Mus musculus
uucaaacaagccagagacaucuggauagucauuuagcaacag

SEQ ID NO: 81383 - RNA, 46 nt, Mus musculus
cacugcuucuugcuccaaggagacgccaagggccuuaaagggagag

SEQ ID NO: 81384 - RNA, 41 nt, Mus musculus
acacugagguuuggucuccuuguccuaaugauggcccagau

SEQ ID NO: 81385 - RNA, 46 nt, Mus musculus
uuaagaguauacacagccaguuacguuuuaguaguuaaaacuaggg

SEQ ID NO: 81386 - RNA, 45 nt, Mus musculus
gaaacgucauuaagaaaauguacauaagucaaaaaauuuagugaa

SEQ ID NO: 81387 - RNA, 45 nt, Mus musculus
ggagguuauggaggugguggaccaggauauggaagggugguggau

SEQ ID NO: 81388 - RNA, 42 nt, Mus musculus
uugcgagccaccaugugguugcugggauuugaacccaggacu

SEQ ID NO: 81389 - RNA, 41 nt, Mus musculus
uuuuuggugaaguugugaagauuuuugacaaagaaggcuaa

SEQ ID NO: 81390 - RNA, 78 nt, Mus musculus
cuugaaucaacgaaaccaauuauugacuuauaugaagaaauggggaaagucaagaagauagaugcuucuaagucuguu

SEQ ID NO: 81391 - RNA, 53 nt, Mus musculus
acgaugucuugaaaggggaaaaaguagugguaggagugacgacaacagagaga

SEQ ID NO: 81392 - RNA, 66 nt, Mus musculus
agcaaccacauggugucucacaaccaccuguaaugagaucugauucccucuucugguauaucugaa

SEQ ID NO: 81393 - RNA, 41 nt, Mus musculus
uuucggggcuggugagauggcucaguggguaagggcacccg

SEQ ID NO: 81394 - RNA, 48 nt, Mus musculus
aaaagcagauguaucuuuuguucuguuuuuugacuguaauaaugaggu

SEQ ID NO: 81395 - RNA, 46 nt, Mus musculus
cuauaggacaucuuucauaagauauagaagcuacagaaguggggga

SEQ ID NO: 81396 - RNA, 45 nt, Mus musculus
aaaggaagaauccagacucacaguauggugaacuuauugaaaagu

SEQ ID NO: 81397 - RNA, 45 nt, Mus musculus
cuugaacuucugacccucuugccuccaccuccuaagugcugagau

SEQ ID NO: 81398 - RNA, 46 nt, Mus musculus
ucaauaaauccauuguuuuuuuuuaagcaaacaaacauguccugug

SEQ ID NO: 81399 - RNA, 46 nt, Mus musculus
uagcacaggcuaaucucaaacugaagguaguccuccugccucagcc

SEQ ID NO: 81400 - RNA, 46 nt, Mus musculus
aacaggagaaucaaagaagcugguggugucauuuagaguuugaaga

SEQ ID NO: 81401 - RNA, 46 nt, Mus musculus
aaauucaucaacugucaucaaagcaaauuugguucacaggguaccu

SEQ ID NO: 81402 - RNA, 44 nt, Mus musculus
gauaaguggaauggaaagucauuaauggagaguugagucgguua

SEQ ID NO: 81403 - RNA, 46 nt, Mus musculus
aagacagugaugucacccugagagauugcacauucguguugggggu

SEQ ID NO: 81404 - RNA, 46 nt, Mus musculus
acucaccaaauauagagccuguaguuccuucagccuguaauuccag

SEQ ID NO: 81405 - RNA, 46 nt, Mus musculus
uguccugaaacucacuauguagacgagauuggcuucaaacucagag

SEQ ID NO: 81406 - RNA, 42 nt, Mus musculus
cccuugugcuugugugguaggaaccauuuccccagacuguaa

SEQ ID NO: 81407 - RNA, 42 nt, Mus musculus
ucuuuuguguuagagauuucugaaaagaaacaguugugucag

SEQ ID NO: 81408 - RNA, 44 nt, Mus musculus
auuuuucaauaauacuaauuccuauagucaguuuacaggucaga

SEQ ID NO: 81409 - RNA, 46 nt, Mus musculus
acucaaagucaggugauauucacacagagagagagagagagagaga

SEQ ID NO: 81410 - RNA, 46 nt, Mus musculus
acacacacacacacacacacacacagagcuaaaucuauauccaaau

SEQ ID NO: 81411 - RNA, 42 nt, Mus musculus
auuuagguugguucauaucuucuauuguuaacagugcuacag

SEQ ID NO: 81412 - RNA, 45 nt, Mus musculus
uuaucauuugacuucaacccauuuuuggcucucgugugucugugu

SEQ ID NO: 81413 - RNA, 41 nt, Mus musculus
ugugacgauacugucauugcuuuauugcaguaccuugcaca

SEQ ID NO: 81414 - RNA, 46 nt, Mus musculus
uuggugcuuuugucaaccaugaagacucagcauucugugucaccag

SEQ ID NO: 81415 - RNA, 43 nt, Mus musculus
aucgaucugggaggccagcaugagcgacaaagcaagguuuaga

SEQ ID NO: 81416 - RNA, 45 nt, Mus musculus
gggucagcucaaugagcauagucauacggugguauucagcaguca

SEQ ID NO: 81417 - RNA, 74 nt, Mus musculus
cacuuagcuuaguucuguguguaugaaauguccaaaaucagagagcuggaagguguguuaguggguccaagggu

SEQ ID NO: 81418 - RNA, 46 nt, Mus musculus
cugcuuguugggucuuuaggagggcacucauuuucuucuuuugcag

SEQ ID NO: 81419 - RNA, 46 nt, Mus musculus
ucugagccaguguuuggacagcuuucauugaaauaucaagguguug

SEQ ID NO: 81420 - RNA, 45 nt, Mus musculus
gaaccaccuaccaaagcgguaguuaccaaccgugaaugcgccaag

SEQ ID NO: 81421 - RNA, 45 nt, Mus musculus
auuccuuuucuuucuguuuuugcuuucuguucuguuguacuuugu

SEQ ID NO: 81422 - RNA, 45 nt, Mus musculus
agcagugacaauagugaggaugaagaggagccucccagccacgca

SEQ ID NO: 81423 - RNA, 47 nt, Mus musculus
aaugaaagagacauugcaguuuuucccggaaccuugccaucuccuga

SEQ ID NO: 81424 - RNA, 46 nt, Mus musculus
guggugugaggacuggguguguauugauggcacuuaagaaauccag

SEQ ID NO: 81425 - RNA, 45 nt, Mus musculus
ggguuucucuguguagcccuggcuguccgggaacucaauccauag

SEQ ID NO: 81426 - RNA, 46 nt, Mus musculus
aaugggcucauagcccaagaaggaauuaaaaagguuacucauggag

SEQ ID NO: 81427 - RNA, 46 nt, Mus musculus
uucuucugacuuucugguccaggguugggacuggguaaguccacag

SEQ ID NO: 81428 - RNA, 46 nt, Mus musculus
cacacauaagcgcacacacaagaaagagaaagaaaacaaagacaag

SEQ ID NO: 81429 - RNA, 42 nt, Mus musculus
ucaugaaagccuguuauuuagaaugcaauccuauggcagcaa

SEQ ID NO: 81430 - RNA, 46 nt, Mus musculus
aauggaacaaauaaaaaagaaagaaaaagaaaauugaaacucaaag

SEQ ID NO: 81431 - RNA, 61 nt, Mus musculus
cagccuucucugagaccauaaaguuccuaagauacuucugacuaguucugccauagccuca

SEQ ID NO: 81432 - RNA, 46 nt, Mus musculus
aucucagccagaaggaugagagcaaggaaugccuagagcuggacag

SEQ ID NO: 81433 - RNA, 46 nt, Mus musculus
aaagagugaauguuuaugauuuuuguuaauuuuuuucagcauaugu

SEQ ID NO: 81434 - RNA, 45 nt, Mus musculus
guggacucauuggucugcaggcugugagucaaacaguuaaggaag

SEQ ID NO: 81435 - RNA, 65 nt, Mus musculus
auauacuuaggucucuacaaagacacuagagcaguggggaggaaaaggaagagucacucuccagu

SEQ ID NO: 81436 - RNA, 42 nt, Mus musculus
ucaguuagcaauuaagacaaagccccaugcacauauccacag

SEQ ID NO: 81437 - RNA, 46 nt, Mus musculus
uccuguuaaguccuguugagauaaagggagagccaggaagauugag

SEQ ID NO: 81438 - RNA, 48 nt, Mus musculus
agugcucucacaaacaaaccugaaagcaacaggccuccggagaccaca

SEQ ID NO: 81439 - RNA, 46 nt, Mus musculus
gguuuuucuuguuuaaaaaugaaagcauaucuaaugaacuagagag

SEQ ID NO: 81440 - RNA, 46 nt, Mus musculus
ccaggugugauggcacacuuacaguuccagcacugggaauaugcag

SEQ ID NO: 81441 - RNA, 45 nt, Mus musculus
ugccuaauagcacuuacagccuaaugaucuaaggucaguccccag

SEQ ID NO: 81442 - RNA, 77 nt, Mus musculus
cucugggaggcaaccaauagcaaugguagcuguuugggggaguuuggaagagucucuugaacaaaccugaccaacaa

SEQ ID NO: 81443 - RNA, 48 nt, Mus musculus
gaaguuaucuuagguguucucuuggagggaccauugucagccuagacg

SEQ ID NO: 81444 - RNA, 45 nt, Mus musculus
ugaauaguuaaucaugauuccuaugacuucuucacacguccuuac

SEQ ID NO: 81445 - RNA, 46 nt, Mus musculus
uuuaucucccucccaauuccugauucuucaacuacuuaauuucuag

SEQ ID NO: 81446 - RNA, 50 nt, Mus musculus
guucugccaugccaagaccagagagcuugagagcauuugauucgaaugga

SEQ ID NO: 81447 - RNA, 48 nt, Mus musculus
agaaaaaaacaaaaacaaaaaccuucuugacuaacucuucagcccucc

SEQ ID NO: 81448 - RNA, 42 nt, Mus musculus
guagcuuguccuuuuuaguuucaaguucucauuuguaggcag

SEQ ID NO: 81449 - RNA, 47 nt, Mus musculus
ccuucucucauauucaagccagaacacauuuggguauuccugagacu

SEQ ID NO: 81450 - RNA, 46 nt, Mus musculus
cuugccuaaagucacaucucugcagacucuuugggucuuuccacag

SEQ ID NO: 81451 - RNA, 46 nt, Mus musculus
aaccaggguuccuaaggcgucagcuuccagaagguaaaccgugaag

SEQ ID NO: 81452 - RNA, 39 nt, Mus musculus
cuugcuuacuaugcacugggccuugaguuccaucuccag

SEQ ID NO: 81453 - RNA, 41 nt, Mus musculus
uugucaggucugacccagcggccuuugagucccgccuggag

SEQ ID NO: 81454 - RNA, 42 nt, Mus musculus
gggcacuccaaacaaagugauuuuaucaaguguauggagcag

SEQ ID NO: 81455 - RNA, 46 nt, Mus musculus
cuucaacguugagauggugaaagacaaaacugcggaggaaauaaaa

SEQ ID NO: 81456 - RNA, 46 nt, Mus musculus
uaaaaagaucugacgcccucuucuggagugucugaagacagcuaaa

SEQ ID NO: 81457 - RNA, 46 nt, Mus musculus
aaaaggaaaauuccaguaaaaacccucaaugugaaaagccacagag

SEQ ID NO: 81458 - RNA, 46 nt, Mus musculus
uuauuaaccacugcuguuagccauaucuccagcucccagacuugau

SEQ ID NO: 81459 - RNA, 45 nt, Mus musculus
acagaucauucauuuguuuguuuguuuauugcagauuuggcagca

SEQ ID NO: 81460 - RNA, 46 nt, Mus musculus
uuuaaaggugauugcuagccauugcuuuacuauagcuaagaaccag

SEQ ID NO: 81461 - RNA, 46 nt, Mus musculus
ccuucaugaacuccacaaccugugcaguuuguacuugcuguuuuag

SEQ ID NO: 81462 - RNA, 46 nt, Mus musculus
uucaaaucccagcaaccacaugguggcucucaaccauccguaguga

SEQ ID NO: 81463 - RNA, 46 nt, Mus musculus
guuccaggccacccagggcuauauagaaagaaccugccucaauaag

SEQ ID NO: 81464 - RNA, 46 nt, Mus musculus
augcugaaguagugauccaccacacaguuccagggaaagggaaugg

SEQ ID NO: 81465 - RNA, 46 nt, Mus musculus
cuaccaagaagggaugguuaugaguucuuuguaggacaauggacag

SEQ ID NO: 81466 - RNA, 45 nt, Mus musculus
accuguaguuauuuagguauuacucuuuuugaugccucgggucua

SEQ ID NO: 81467 - RNA, 45 nt, Mus musculus
gguaaaauuacggacacauaggugacuuaugaagugugggaugag

SEQ ID NO: 81468 - RNA, 46 nt, Mus musculus
caccaugggaccuccuuuccuccuuuuccaguugaaucacugagac

SEQ ID NO: 81469 - RNA, 46 nt, Mus musculus
uaguuagccaacucuaacuugcuuauagggcaaaugagauaaaaga

SEQ ID NO: 81470 - RNA, 47 nt, Mus musculus
uucagagaaauguugugauuauaagagcaugauuaaauuuaagaaag

SEQ ID NO: 81471 - RNA, 41 nt, Mus musculus
gggagagagagaaagggaaagaaaagaaaaaaagaaaggga

SEQ ID NO: 81472 - RNA, 45 nt, Mus musculus
guucccguucuuguauugguuuucuucuguuauuaaccuuugaag

SEQ ID NO: 81473 - RNA, 25 nt, Mus musculus
cagugcaucgccaaucagguucagc

SEQ ID NO: 81474 - RNA, 46 nt, Mus musculus
gagcaaaguggacuuggagccgaacugaaacgugcccagaaccaag

SEQ ID NO: 81475 - RNA, 46 nt, Mus musculus
ugugugugugugugugugugugugugugugugugugugggcauagc

SEQ ID NO: 81476 - RNA, 46 nt, Mus musculus
uaggcuagcccacaauuaaauguuuucuuuuauaaaaguggccuug

SEQ ID NO: 81477 - RNA, 46 nt, Mus musculus
uauaacuugggcgcugaguucaguucccagcauuucagauguacag

SEQ ID NO: 81478 - RNA, 45 nt, Mus musculus
ccaguuacauuguguuauauuuauuucuguguguuuaccccacua

SEQ ID NO: 81479 - RNA, 45 nt, Mus musculus
aggaacaggacuugcucucccggcaucucggcuuucuuucccuaa

SEQ ID NO: 81480 - RNA, 45 nt, Mus musculus
gauggaauuauacuucuguauuccagcaugaaaucuuacagagag

SEQ ID NO: 81481 - RNA, 44 nt, Mus musculus
uacgcauccaagugucuaugggcaacacaaacuggauuugauaa

SEQ ID NO: 81482 - RNA, 45 nt, Mus musculus
cccuggcuaggcuaccucuccagucaucagugcucacccacacgu

SEQ ID NO: 81483 - RNA, 46 nt, Mus musculus
agcaagaucagcccaagcgcaacaauauaucacuuguucuggagag

SEQ ID NO: 81484 - RNA, 41 nt, Mus musculus
ugcacacaacacugcaggaaaugguagcaacagcuggggag

SEQ ID NO: 81485 - RNA, 46 nt, Mus musculus; identical to SEQ ID NO: 75908

SEQ ID NO: 81486 - RNA, 42 nt, Mus musculus
gaccgcaugaugaagaagcuggaccucaacugugacgggcag

SEQ ID NO: 81487 - RNA, 45 nt, Mus musculus
gucaucaccucccccgaccccauccacaccugcacugagcccagc

SEQ ID NO: 81488 - RNA, 42 nt, Mus musculus
gacuaagagagccccgggaggugcuuuguugagcuagguccc

SEQ ID NO: 81489 - RNA, 45 nt, Mus musculus
ucuccagauccagugagcaucuuucguucguccucuagucccaug

SEQ ID NO: 81490 - RNA, 56 nt, Mus musculus
uccaagaugguagcuuuggaaacaggaccugggagggguaagaugggucuggccac

SEQ ID NO: 81491 - RNA, 76 nt, Mus musculus
uuacagacuuuacugucugucugcaaacccacaguuccauccuuagacccacuacccagucaacaccccaaagccc

SEQ ID NO: 81492 - RNA, 42 nt, Mus musculus
ugcuggugaccgucauugucaacaucaaguugauccuggaca

SEQ ID NO: 81493 - RNA, 46 nt, Mus musculus
cgagaaacauucuaaaucuccugcccucuccuccuggggugaccca

SEQ ID NO: 81494 - RNA, 46 nt, Mus musculus
ccaaguuugcugugguucuggaagaggaccuggacauugccgugga

SEQ ID NO: 81495 - RNA, 46 nt, Mus musculus
ggaagaugacagccuguacugcaucucugccuggaaugaccaggua

SEQ ID NO: 81496 - RNA, 46 nt, Mus musculus
aagagcuugccaaagacagcaacucggagggcccugggucuuguag

SEQ ID NO: 81497 - RNA, 42 nt, Mus musculus
agaagccaccaucagucaccccuauuuuccuggagccacccc

SEQ ID NO: 81498 - RNA, 46 nt, Mus musculus
cagauuuccaaaacuggauaaagauggucauugauuaaaaaagaag

SEQ ID NO: 81499 - RNA, 50 nt, Mus musculus
uuuggaauugcucuguagaccaggcuggccuugaacucacagagauccac

SEQ ID NO: 81500 - RNA, 45 nt, Mus musculus
cgccugucucccuugccagucuuuaaggucuaccaggccaggccc

SEQ ID NO: 81501 - RNA, 42 nt, Mus musculus
ucauccacacuggguccuggccaugcuggucuagaagagucu

SEQ ID NO: 81502 - RNA, 46 nt, Mus musculus
auuauuugacauaguaaauauuuuacuuauuuauaauuugcccauu

SEQ ID NO: 81503 - RNA, 48 nt, Mus musculus
ccaaacaguuauugacaaauagugcucaacuaaccuuugaagaugcuc

SEQ ID NO: 81504 - RNA, 88 nt, Mus musculus
guacugggaugacaggccugugccgccaugcuguucccuucucuaaacaauguguaccacagagcagaaaugugcuuuuaaggaagcc

SEQ ID NO: 81505 - RNA, 49 nt, Mus musculus
uguggguuguucuagguuccuuuaccuaguagucauaucaugcucaaga

SEQ ID NO: 81506 - RNA, 68 nt, Mus musculus
uguguauaucuucagguuuucugugcaggccgcauuuggaucggugcaccccacccccucuugguguu

SEQ ID NO: 81507 - RNA, 41 nt, Mus musculus
auauaggaaauguuauucuugcagccuugauauucagggug

SEQ ID NO: 81508 - RNA, 41 nt, Mus musculus
ucccagcaaccacaugguggcucacaaccauccgugacgcc

SEQ ID NO: 81509 - RNA, 47 nt, Mus musculus
aaaaaaaaaaaaaagagcagugcagggaaaauccaucuuggaguuag

SEQ ID NO: 81510 - RNA, 48 nt, Mus musculus
uucagagaggacuuugagacagaacagcugaguugagucagccagcuu

SEQ ID NO: 81511 - RNA, 45 nt, Mus musculus
agaagaugaagggcuucuagccacacuugaucaccuccacauuag

SEQ ID NO: 81512 - RNA, 45 nt, Mus musculus
ugacaagaugggaaauaucagucacacaauuugaugaggaagcgc

SEQ ID NO: 81513 - RNA, 46 nt, Mus musculus
aggcaccagcuccacuaggagugaaaccggaaguagagcucuccac

SEQ ID NO: 81514 - RNA, 27 nt, Mus musculus
uucuaucuucucucgaauuucagguag

SEQ ID NO: 81515 - RNA, 46 nt, Mus musculus
cuaagguagaauggaaaggaagcuaauccaaggcagucagcaucug

SEQ ID NO: 81516 - RNA, 65 nt, Mus musculus
agcagcuaucuuaaauuugucuucaggugcuuucuccguggcccucugggcuaccuuggucucaa

SEQ ID NO: 81517 - RNA, 64 nt, Mus musculus
ccccaucuccagcugccucagacucuucuacagguagcauagcuuccuccuguucaggaaccag

SEQ ID NO: 81518 - RNA, 46 nt, Mus musculus
ggaauaacuguaaucuccugcccuggcuucucagagacuucagcuc

SEQ ID NO: 81519 - RNA, 45 nt, Mus musculus
uaagaacagccuuaccuaguucacucucagagguagcuaccugau

SEQ ID NO: 81520 - RNA, 45 nt, Mus musculus
acuuuccuguucuuuaucaguuucaggcuuugucagagacuugcc

SEQ ID NO: 81521 - RNA, 45 nt, Mus musculus
agaaauacauucccuuuaagccuaaguuuuaucagaugcccccau

SEQ ID NO: 81522 - RNA, 46 nt, Mus musculus
cuagcaaagcaacauacugcaaaagaaaugaguaaucugauaccag

SEQ ID NO: 81523 - RNA, 46 nt, Mus musculus
uaagauauagaaaacagaaguccuccaaggacuccuaauaacugag

SEQ ID NO: 81524 - RNA, 45 nt, Mus musculus
aggaaaaaagaaagaaagagaaaggagagaaagaaagaaagaaag

SEQ ID NO: 81525 - RNA, 44 nt, Mus musculus
aggaagggaaaggaagggaaaggaaaggaaaggaaaggaaagga

SEQ ID NO: 81526 - RNA, 42 nt, Mus musculus
gaaaagaaaagaaaagaaaagaaaagaaaagaggagagagag

SEQ ID NO: 81527 - RNA, 46 nt, Mus musculus
cucuggacagguggucaugauaguauaagaaagcagggggcccaag

SEQ ID NO: 81528 - RNA, 45 nt, Mus musculus
cauuguucugcaugcugaaagaaggaaucgggcacagggcuagag

SEQ ID NO: 81529 - RNA, 46 nt, Mus musculus
ucaaaucccaacaaccacauaggggcuuacaaccaucuguaaugag

SEQ ID NO: 81530 - RNA, 46 nt, Mus musculus
acaaaagacuagcugcuuccuggaaugcauuaacagcugcuggaau

SEQ ID NO: 81531 - RNA, 41 nt, Mus musculus
uuaccucuccauuuuaucugccgagguagaaggagcaggag

SEQ ID NO: 81532 - RNA, 45 nt, Mus musculus
acagagaaauccugcuucaaaaaaacaaaggagggggcuggugag

SEQ ID NO: 81533 - RNA, 45 nt, Mus musculus
cagccgcugcugccaucgccgcggagcugguuuccgcugacaagu

SEQ ID NO: 81534 - RNA, 46 nt, Mus musculus
uugucagcggaaaccagcuccgcggcgauggcagcagcggcuguag

SEQ ID NO: 81535 - RNA, 46 nt, Mus musculus
gagaauuccggacagcagagacucacucagguagagaaaauggcag

SEQ ID NO: 81536 - RNA, 46 nt, Mus musculus
uuggugggacgaguuugugcuggaacuuaccgcgcgcacugggcug

SEQ ID NO: 81537 - RNA, 45 nt, Mus musculus
ugaaacugccccgaccuacagugugcuauuacuaaaggcucaggc

SEQ ID NO: 81538 - RNA, 46 nt, Mus musculus
uaaaauuauuuuuguugcuaccuaauaauuuugcuaguuaugaauc

SEQ ID NO: 81539 - RNA, 47 nt, Mus musculus
ccgugaugcugugacuccugaagaacgguacuccgaagaacagaaga

SEQ ID NO: 81540 - RNA, 42 nt, Mus musculus
uguugcugccagggauugaagugccaaauuugccacccagaa

SEQ ID NO: 81541 - RNA, 45 nt, Mus musculus
auaaaauaaguaacuaaaucuuuuuuuaaaagucagaauuuggag

SEQ ID NO: 81542 - RNA, 45 nt, Mus musculus
ccauaugguggcucccaaccaucuguaacaaaaucugaugcccuc

SEQ ID NO: 81543 - RNA, 46 nt, Mus musculus
agauugggaagacccuaaaggaaauuaugagccgcuuaccggaaga

SEQ ID NO: 81544 - RNA, 45 nt, Mus musculus
uggcugucucgaagccagucagauauuuuuucucauaagccccca

SEQ ID NO: 81545 - RNA, 45 nt, Mus musculus
gggggacaaggcaaugugguggucaaggaucuuuuagcuaaccua

SEQ ID NO: 81546 - RNA, 26 nt, Mus musculus
uagccuuauuuguacccaggccucug

SEQ ID NO: 81547 - RNA, 45 nt, Mus musculus
ggccuaguuaccaggcagauguuggagucagcugcugccccaagc

SEQ ID NO: 81548 - RNA, 44 nt, Mus musculus
agguucagagcugcagaguugaagucccuggcucaggcccacau

SEQ ID NO: 81549 - RNA, 46 nt, Mus musculus
acugaggacacuguggucccagaggacaccagccauaggccuggag

SEQ ID NO: 81550 - RNA, 41 nt, Mus musculus
ugcuucacuagcauauaaguuccaccagaacaggggggguu

SEQ ID NO: 81551 - RNA, 45 nt, Mus musculus
cucaugccaggccccaccccuucccaucaaccauguucucaccau

SEQ ID NO: 81552 - RNA, 46 nt, Mus musculus
gggcccuggcugcuuccucuugcaccgacugccauagugcccugau

SEQ ID NO: 81553 - RNA, 42 nt, Mus musculus
cagcgcauaagcauaggggagcugccggaggugcaggccaag

SEQ ID NO: 81554 - RNA, 44 nt, Mus musculus
cugaacccgggcaggaaggauccgcgauagccagcacgcugcag

SEQ ID NO: 81555 - RNA, 44 nt, Mus musculus
uuuaauuccagcacuugagaggcagguagguggaucuuugugag

SEQ ID NO: 81556 - RNA, 42 nt, Mus musculus
cugaugaccuccguucaaucacuaggacccguacaaagguag

SEQ ID NO: 81557 - RNA, 48 nt, Mus musculus
ucuuaauggcucuggaaagcuggguccuuugccagguaccauggucac

SEQ ID NO: 81558 - RNA, 46 nt, Mus musculus
gccgaaacggguaguagucuaugggggugaaggggacaaccugaag

SEQ ID NO: 81559 - RNA, 45 nt, Mus musculus
gucuguguauuagaggacaugaccguccaccuuccaaucauugag

SEQ ID NO: 81560 - RNA, 59 nt, Mus musculus
gccuuuuguaaaaaagcauauuuguguguguguguguguguguguguaagagaaagaaa

SEQ ID NO: 81561 - RNA, 46 nt, Mus musculus
acaccauauuuuucaggcugcuuugcauuuacuuauucauuuagag

SEQ ID NO: 81562 - RNA, 46 nt, Mus musculus
augguuuccacauuauuuauucgucccacauuuauuugggcucaag

SEQ ID NO: 81563 - RNA, 47 nt, Mus musculus
uaugauugguuagguucauaaguauucuuguuucuuagguugcgucu

SEQ ID NO: 81564 - RNA, 44 nt, Mus musculus
aaaauggaguuucaagcggugguuauggccguuggugggggauc

SEQ ID NO: 81565 - RNA, 45 nt, Mus musculus
cugcuuccaguuggaaacaaaccuuuaauuugguacccgcugaac

SEQ ID NO: 81566 - RNA, 46 nt, Mus musculus
ccacagugauccaagaugggucuucuaaggguaucagaaaggugag

SEQ ID NO: 81567 - RNA, 46 nt, Mus musculus
ccugcauuuaugaauaugcaccaagugcaugccuggugcccacaga

SEQ ID NO: 81568 - RNA, 46 nt, Mus musculus
uaauuaauuuauuuauuauaugugaguacacuguagcuguccucag

SEQ ID NO: 81569 - RNA, 46 nt, Mus musculus
gguuacaaccaaagauguccaaaaggcucucugcgcagaauucaag

SEQ ID NO: 81570 - RNA, 46 nt, Mus musculus
gucaggucuacagugugaguuccaggaucuccauuuuacagauagg

SEQ ID NO: 81571 - RNA, 24 nt, Mus musculus
uaaaaguggcagaauugguaauug

SEQ ID NO: 81572 - RNA, 46 nt, Mus musculus
caaaucucauuuacccucugccucaguuuuacaauucagaaagcag

SEQ ID NO: 81573 - RNA, 41 nt, Mus musculus
uucucuaguacaagagaugaaaauuguccuaucgugggcug

SEQ ID NO: 81574 - RNA, 46 nt, Mus musculus
auucuuuaaauuggugugugcaugugugugugugugugugugugug

SEQ ID NO: 81575 - RNA, 46 nt, Mus musculus
guauacauauaucuguuugugcauaucuguauacauauauguguag

SEQ ID NO: 81576 - RNA, 46 nt, Mus musculus
uauaguuaacuguggagcuuguaaaagcuuacagauacuuucagag

SEQ ID NO: 81577 - RNA, 46 nt, Mus musculus
ggcagggauggaguggggagugguguuuuggaucguagccauuguu

SEQ ID NO: 81578 - RNA, 46 nt, Mus musculus
agcuuaugaugcgucacuggccaugcuaaugaggaaaggacaagag

SEQ ID NO: 81579 - RNA, 46 nt, Mus musculus
gaacuuuuuaauucaagaaguuauauaauuauccaaacuaugguag

SEQ ID NO: 81580 - RNA, 34 nt, Mus musculus
uuuucgagacaggguuucucuguguagcuggccu

SEQ ID NO: 81581 - RNA, 46 nt, Mus musculus
gagaacagaccuauagcuuauuaugaccuagauuauuuggaaagag

SEQ ID NO: 81582 - RNA, 46 nt, Mus musculus
agcacaggaaaaaggcugcucuuuauggcuaaugaagcagacuugg

SEQ ID NO: 81583 - RNA, 45 nt, Mus musculus
caaaaaacauggccaaaucuauuuugaggacuaaaguuagcgggg

SEQ ID NO: 81584 - RNA, 45 nt, Mus musculus
uacauaaccagucccaauuccaaaauacuucucucauuuuaugau

SEQ ID NO: 81585 - RNA, 46 nt, Mus musculus
cacaaccaucugaugaccucuucuggugugucugaaggcagcuaca

SEQ ID NO: 81586 - RNA, 45 nt, Mus musculus
ucuguucuuuguccggaggaaucaaugauccauucaucagcccag

SEQ ID NO: 81587 - RNA, 45 nt, Mus musculus
gaaacucgauuuaaaaccaauaaaagcacgguuccucaguagcac

SEQ ID NO: 81588 - RNA, 46 nt, Mus musculus
cacucaauaaauaaauguauaauaauaagguagggaguaauugaag

SEQ ID NO: 81589 - RNA, 43 nt, Mus musculus
gagagaaagagaaagaaggaggaaaggaaagcaggggggggag

SEQ ID NO: 81590 - RNA, 46 nt, Mus musculus
cugccuuugcuaggauuaaaggcaauuuuugauaacugcaaugaaa

SEQ ID NO: 81591 - RNA, 46 nt, Mus musculus
gcucugccugacagcacccucagucuuuacuggaaacucgggcuuc

SEQ ID NO: 81592 - RNA, 45 nt, Mus musculus
caaaucccagcaaccacaugguggcucacaaccauacgcaacaag

SEQ ID NO: 81593 - RNA, 46 nt, Mus musculus
ccacggcagugucaucugcaacaacgcagugaucgagacgggcgca

SEQ ID NO: 81594 - RNA, 45 nt, Mus musculus
uacuccauuguagccuuuggggaucucucuauuuauuuguguuga

SEQ ID NO: 81595 - RNA, 46 nt, Mus musculus
cugguggccuuuggggcucuggcacugggucuccgaguggcuguaa

SEQ ID NO: 81596 - RNA, 46 nt, Mus musculus
uacaucagaguuuacaaauggaacaagauguauuuuucaauagcca

SEQ ID NO: 81597 - RNA, 89 nt, Mus musculus
ucuaacuacucaaggggcugaggcaagagaaauacuuucagucuaagaauuuaacaauagccugugucagagagagagagagagagagg

SEQ ID NO: 81598 - RNA, 94 nt, Mus musculus
gcuggguggcauggcagacugccugucgagcaugcuguggugggggagagagauggaggaggagcaagaagaaaaagaaaaguuagugcuuggu

SEQ ID NO: 81599 - RNA, 47 nt, Mus musculus
ggcagcagugguggugcacagcuuuaauguuuaaccucagugcuugg

SEQ ID NO: 81600 - RNA, 46 nt, Mus musculus
ccagagcugcaugaaaauacucucucucgaaaaaccaaaaagaaag

SEQ ID NO: 81601 - RNA, 45 nt, Mus musculus
gacagccagggcuauacagagaaacccugucucagaaaaagaaaa

SEQ ID NO: 81602 - RNA, 42 nt, Mus musculus
ugcagccacaugaaagagaaagaaaggggguucauagagcag

SEQ ID NO: 81603 - RNA, 78 nt, Mus musculus
gugggcagcagggugagccaggagcugcacuacaccaaggagaagcugggggaagaggcugcguacaccucccagaug

SEQ ID NO: 81604 - RNA, 69 nt, Mus musculus
uugauucagacugcgcaccaggaagggggaaacguccucacccccgaggcacuugacuugcaccuccag

SEQ ID NO: 81605 - RNA, 45 nt, Mus musculus
aaaucagggguuccccuuauugaaaaugggaugaucgagcgggug

SEQ ID NO: 81606 - RNA, 45 nt, Mus musculus
gacccccugggccucgcagccucucaggccaacuucuacccccca

SEQ ID NO: 81607 - RNA, 42 nt, Mus musculus
gccaucgaaggggccagggcggcaugcacagaggcaggccag

SEQ ID NO: 81608 - RNA, 45 nt, Mus musculus
gcagucugcaucuugcuggugugcaccuuccucgucugugcccug

SEQ ID NO: 81609 - RNA, 46 nt, Mus musculus
cauucaacuacugcaguauaccagccccagcuuuuauuacagccag

SEQ ID NO: 81610 - RNA, 45 nt, Mus musculus
ggaaccugcgggcugcuagcgcucuggaacagaccuuugccccug

SEQ ID NO: 81611 - RNA, 42 nt, Mus musculus
caaagguuacagcaaccugagagcagaguaugauuaggcuag

SEQ ID NO: 81612 - RNA, 42 nt, Mus musculus
ucgcagugcuuguacuuaccucgcuucccaccuccggcagcu

SEQ ID NO: 81613 - RNA, 46 nt, Mus musculus
gcugugugacagucccagaucugacaccccccaacccugcgaggag

SEQ ID NO: 81614 - RNA, 42 nt, Mus musculus
gugggggauuuugggcuggcagcucgauuagagcccccagag

SEQ ID NO: 81615 - RNA, 45 nt, Mus musculus
gaacaggcuagcaaacaaauaaacagcaagaaacggcaccaauga

SEQ ID NO: 81616 - RNA, 41 nt, Mus musculus
gcugucuucccagauguccagcuuuaaugaagccaugacuc

SEQ ID NO: 81617 - RNA, 45 nt, Mus musculus
gauggaagccagcucuaaugggacgucucugacuggcaauguaag

SEQ ID NO: 81618 - RNA, 81 nt, Mus musculus
guuugaucugcucaacaaaaaggccaaguuacgugugcuggaggacagcaggcagcaggugcagguugugggacugcagga

SEQ ID NO: 81619 - RNA, 71 nt, Mus musculus
gaugucuuccuucugaagaaccagccucgguaccggaacuuaaaccuggaaguuuaugugacauucuucga

SEQ ID NO: 81620 - RNA, 59 nt, Mus musculus
agugggaagacacaugugaguauuucagucaggagagaaagcuuuacuaaguucuugag

SEQ ID NO: 81621 - RNA, 45 nt, Mus musculus
uccuaaacauaguucuuuucauuuuucccccugaacaguagagug

SEQ ID NO: 81622 - RNA, 41 nt, Mus musculus
ucuuuugcccuuuguaauacauccugagcaguggggucaga

SEQ ID NO: 81623 - RNA, 65 nt, Mus musculus
ucccagcaagugucuccuccuggugcaugaacccaaguuaaaaguggacuuaacgaaguaccugg

SEQ ID NO: 81624 - RNA, 44 nt, Mus musculus
aagagcacaggaucugugucugugucaggaaacgcccacugaau

SEQ ID NO: 81625 - RNA, 46 nt, Mus musculus
auuucggguuacuauggaauguagcccgcuuacugugacagacccu

SEQ ID NO: 81626 - RNA, 46 nt, Mus musculus
cucccccacaguccugccucagaacuuugugccuggcuucucagac

SEQ ID NO: 81627 - RNA, 84 nt, Mus musculus
uaucgugaaggagauggagaaaaugaagaacaagcgugaagagaagagggcccagaacucggagcuaagaauaaagcgagcaca

SEQ ID NO: 81628 - RNA, 45 nt, Mus musculus
cacuccacccgcaguaccucaucugcaaacccugggaacucaggu

SEQ ID NO: 81629 - RNA, 42 nt, Mus musculus
ucgggaugagggcagaggaaaagccuaaauacggcccuuggc

SEQ ID NO: 81630 - RNA, 45 nt, Mus musculus
gugugccacaguccugacaaccugaguuuaaucuuaaauggagaa

SEQ ID NO: 81631 - RNA, 46 nt, Mus musculus
ugcuuacacaauuuaugauguaaaccgccagggcaaaaaggacgag

SEQ ID NO: 81632 - RNA, 43 nt, Mus musculus
guguauguauguguguguguguauguguauggugugugugugu

SEQ ID NO: 81633 - RNA, 47 nt, Mus musculus
aucaggcaaucaaggucaucuugucacauauagaguuugaggcaagc

SEQ ID NO: 81634 - RNA, 46 nt, Mus musculus
ucucagcacuugaaaaagcaggaagagagggagagaaagagggaga

SEQ ID NO: 81635 - RNA, 43 nt, Mus musculus
acgcuacagaagauuagauauuuuauacacuuaaaacuaugag

SEQ ID NO: 81636 - RNA, 42 nt, Mus musculus
gagacugcaggcaucaaguuuccagauuuuaagucggcaggu

SEQ ID NO: 81637 - RNA, 46 nt, Mus musculus
aggaguaccuccuacaggagcugcguaagauugaggcccggaaaaa

SEQ ID NO: 81638 - RNA, 46 nt, Mus musculus
cuguggaggaccugaaagagagguacuaccacauuugugccaagcu

SEQ ID NO: 81639 - RNA, 24 nt, Mus musculus
gggaggggccucugacuaauuaga

SEQ ID NO: 81640 - RNA, 46 nt, Mus musculus
ucaauuguggugagauugguaacucugagagggcacccgggcagga

SEQ ID NO: 81641 - RNA, 47 nt, Mus musculus
ugcuggcuuuggugacaguggcugagguguggauuggggauguuuga

SEQ ID NO: 81642 - RNA, 121 nt, Mus musculus
ggggauucuggaggcaaaauuaaggaaaaagaaggauugaaagaugcuuccaaugucagguguggugaugugugcuuguaaucccaguguuugggagacugaggcaggaggacugcuguga

SEQ ID NO: 81643 - RNA, 58 nt, Mus musculus
ccauucuuacuguaggucugcccuguacggagggagcaugguguagacguuugcagac

SEQ ID NO: 81644 - RNA, 47 nt, Mus musculus
gauuuuaagagaauacaaguucauguuuauauuucaugaguggacac

SEQ ID NO: 81645 - RNA, 91 nt, Mus musculus
cugggaaacuagauuuuccagaaggaugucugaguggucaaaggaugaggauguucaguugguagaaggaauauggaauuaagaauaaacu

SEQ ID NO: 81646 - RNA, 46 nt, Mus musculus
agucacaucuuccucaacacacacacaggauuaaauuacuaggagg

SEQ ID NO: 81647 - RNA, 45 nt, Mus musculus
cgagaggaccgagggaaccugacacuuguaaguuguugggaagag

SEQ ID NO: 81648 - RNA, 47 nt, Mus musculus
gccacuuaauguauguuaccaaaaaauaaauauaucuaccccagacu

SEQ ID NO: 81649 - RNA, 46 nt, Mus musculus
gugaauuaggcuguaacuacuuuauaacuaacauguccugccuacu

SEQ ID NO: 81650 - RNA, 46 nt, Mus musculus
auaauuuaccuaagauuacaaaucagaagucaucuugcuaccagua

SEQ ID NO: 81651 - RNA, 46 nt, Mus musculus
gcucugcaagcuagacgugggaagaaaaagucugggugccucaucu

SEQ ID NO: 81652 - RNA, 104 nt, Mus musculus
aguuagccaaaaugaagcaggagccgguaaaaccugaagaaggcagagauauggcaaacaggauuggcgcuuuuggguacauggaguguucagcaaagaccaaa

SEQ ID NO: 81653 - RNA, 45 nt, Mus musculus
acacugauguuauauugauguguuuuuccauugacagcccugaua

SEQ ID NO: 81654 - RNA, 48 nt, Mus musculus
aggucuaugugcccacaguguuugaaaacuauguggcggauaucgagg

SEQ ID NO: 81655 - RNA, 42 nt, Mus musculus
ccgcccgcgguccuccgucgguucucuccuuagcccgccauc

SEQ ID NO: 81656 - RNA, 47 nt, Mus musculus
caccaaguuuuuuugagaugccaaaaccauaggauaucugcugagga

SEQ ID NO: 81657 - RNA, 25 nt, Mus musculus
uaauggcacuggcggcaggucuguc

SEQ ID NO: 81658 - RNA, 46 nt, Mus musculus
ccaucuuccuaguguuugugaaauaaacuugguauuugucccaguc

SEQ ID NO: 81659 - RNA, 44 nt, Mus musculus
gggggcacaggugcacagcuguacacagucaccaucagcagccc

SEQ ID NO: 81660 - RNA, 45 nt, Mus musculus
gucccaggaaaaccagcaauaaauaacaguagggcacggccccac

SEQ ID NO: 81661 - RNA, 72 nt, Mus musculus
uguucuguggagucugcgugggcaucgugggcaguggggccgcccuggcggaugcacagaaccccagccucu

SEQ ID NO: 81662 - RNA, 24 nt, Mus musculus
ccagguguguacgugugguagaag

SEQ ID NO: 81663 - RNA, 36 nt, Mus musculus
agcggggacggguauccauugaaaugccuaugcuuu

SEQ ID NO: 81664 - RNA, 41 nt, Mus musculus
acguugcaucucuagauuuucuauuucccaaagguccgugu

SEQ ID NO: 81665 - RNA, 45 nt, Mus musculus
cgucgccgcugccaugacggggcuggaguugcucuaccucgggau

SEQ ID NO: 81666 - RNA, 46 nt, Mus musculus
acguaugaacucuauaaaccaaauuauuuugaaaaccggugcauua

SEQ ID NO: 81667 - RNA, 46 nt, Mus musculus
aacucgaacuuggaacuucacuucgaaagugaagcuguacacagaa

SEQ ID NO: 81668 - RNA, 42 nt, Mus musculus
aucaacucgcgguaccgggaggauuacaucgagccagcgcug

SEQ ID NO: 81669 - RNA, 42 nt, Mus musculus
gguggcuucagacaugcgcuucaaugagauuuucacagagaa

SEQ ID NO: 81670 - RNA, 39 nt, Mus musculus
ugguuaagagagaugauguauacacacucgaugaagagc

SEQ ID NO: 81671 - RNA, 44 nt, Mus musculus
gguucaagucagauggacagauggccaagucuauggggcuaagu

SEQ ID NO: 81672 - RNA, 46 nt, Mus musculus
accugagguguacacauuagaauguauuauuugguuaguuccaggg

SEQ ID NO: 81673 - RNA, 42 nt, Mus musculus
uggaugugcucucgauguucagccaaugcccuggaggaagug

SEQ ID NO: 81674 - RNA, 45 nt, Mus musculus
ugccuagaagcuugagcaggggcuggaggugggacagaggagcag

SEQ ID NO: 81675 - RNA, 45 nt, Mus musculus
ucagaaacccaagguuacuguggauagagaaaauugaugugggaa

SEQ ID NO: 81676 - RNA, 41 nt, Mus musculus
ucagagcaugauacgugugcucugcaggcugugcuuggaga

SEQ ID NO: 81677 - RNA, 46 nt, Mus musculus
uuuggagagcuuccaguaagucaauaaauaccagucgucuccuuuu

SEQ ID NO: 81678 - RNA, 45 nt, Mus musculus
ugagccauucauggcucucccuccucuugucuuuaguacccagau

SEQ ID NO: 81679 - RNA, 46 nt, Mus musculus
cuuuucugcucccuaauucuggcuccugccucauacacagcaccuc

SEQ ID NO: 81680 - RNA, 45 nt, Mus musculus
ucuuacaaauacuuacaagagauaauuacaauauuuacaagagau

SEQ ID NO: 81681 - RNA, 45 nt, Mus musculus
gccaagagaaaacgggaguucucaccgugcacagcuaugccagag

SEQ ID NO: 81682 - RNA, 41 nt, Mus musculus
guugugguguuuguucucugggaggcuggaggaccuggguu

SEQ ID NO: 81683 - RNA, 46 nt, Mus musculus
gacaguaugagaugacagagugcccggccacccucgccccagugag

SEQ ID NO: 81684 - RNA, 46 nt, Mus musculus
ggacaaagagacacagagucugucuggaaauaccccaggaggucag

SEQ ID NO: 81685 - RNA, 42 nt, Mus musculus
ccagaggaucugugcacauuggggaaagacuggggcggcugu

SEQ ID NO: 81686 - RNA, 41 nt, Mus musculus
gaggacguggaagcagcggaucagggagaggagggggaugu

SEQ ID NO: 81687 - RNA, 41 nt, Mus musculus
ggacacgggugugugugugugugugugugugugugugugac

SEQ ID NO: 81688 - RNA, 45 nt, Mus musculus
acuuggucagauucuucucccaagugucaagugugaaagccagau

SEQ ID NO: 81689 - RNA, 45 nt, Mus musculus
gucccauugugcugaguugaaauagccuccaguauaagccgugaa

SEQ ID NO: 81690 - RNA, 41 nt, Mus musculus
cagaucuuguuauggaugguugugagccaccauguggcugc

SEQ ID NO: 81691 - RNA, 46 nt, Mus musculus
ucaccauugagggggugaacacccccuaccuuuacuucggcaugug

SEQ ID NO: 81692 - RNA, 46 nt, Mus musculus
ccgcgauacagugaauuugaagaacuugagcguaaauacuggaaaa

SEQ ID NO: 81693 - RNA, 41 nt, Mus musculus
guggcaggaacagcugagcacucacauccuaaauggcaggc

SEQ ID NO: 81694 - RNA, 45 nt, Mus musculus
ccugcagcgcuggccagcgagugaauuuaugcaaaugucugucug

SEQ ID NO: 81695 - RNA, 45 nt, Mus musculus
gcguuuuugacuauggaaaauugcauagucguagaggagagaguc

SEQ ID NO: 81696 - RNA, 42 nt, Mus musculus
caggucaucagacucagggguagugacuuuuaccugccagac

SEQ ID NO: 81697 - RNA, 45 nt, Mus musculus
ggccucuacuucccagugcuggaauuacucuaucugugcccuuuu

SEQ ID NO: 81698 - RNA, 73 nt, Mus musculus
cuggccagucuggccucuucacucaguacaacauacagaagaaagccaugaccguucgugaguuccgcaagau

SEQ ID NO: 81699 - RNA, 47 nt, Mus musculus
uaaaauaaguuuugcgauugguucuuuccaaucucuaguggccaaug

SEQ ID NO: 81700 - RNA, 42 nt, Mus musculus
gggagggugauugggcugaggacaccggggaguuggggcugu

SEQ ID NO: 81701 - RNA, 46 nt, Mus musculus
aagagaauguugucuacugggagaggcaguguuugagagcugggag

SEQ ID NO: 81702 - RNA, 42 nt, Mus musculus
uaaccaaacacacuguugaugcagagggaggagaagcagcuu

SEQ ID NO: 81703 - RNA, 47 nt, Mus musculus
gccaugaggucguuccugaccacuugagaaccaagccugacccugaa

SEQ ID NO: 81704 - RNA, 86 nt, Mus musculus
cuugaauaaaaugugcucaaaccuuuuagagaaaaucagcaaagaagaacgagaaucagagagcggagguaaggagggauguggca

SEQ ID NO: 81705 - RNA, 45 nt, Mus musculus
aggauuaccgcagguucagaugccaggugcuccaaaccagcagca

SEQ ID NO: 81706 - RNA, 42 nt, Mus musculus
augacaugauuuuuugcucaaggcuuauuuagauggggacaa

SEQ ID NO: 81707 - RNA, 42 nt, Mus musculus
gcgggcagcagugaaggguucaaagggaucagggccggagag

SEQ ID NO: 81708 - RNA, 42 nt, Mus musculus
uggauggaaaagaaaaagggcaccggcauggggcaggaaggg

SEQ ID NO: 81709 - RNA, 47 nt, Mus musculus
uaggccccacuccaacauaagccaccaaccaaagucuaacuguagga

SEQ ID NO: 81710 - RNA, 67 nt, Mus musculus
gguuaaugcaaucccugacaggugugaaguuuaggagccuggcauguccgaguccaguagggaggcc

SEQ ID NO: 81711 - RNA, 46 nt, Mus musculus
gagagcguggauguggaugguagaacucaagccccaaggcuggaga

SEQ ID NO: 81712 - RNA, 46 nt, Mus musculus
accuagcccaugaggcucccucccagaagagggaaagauuccugag

SEQ ID NO: 81713 - RNA, 45 nt, Mus musculus
aaaccuaggguuccacuucuguggugaacaccagugcccccgggc

SEQ ID NO: 81714 - RNA, 41 nt, Mus musculus
aggagagucuuggaaaagggccagagggacuuuaccuggga

SEQ ID NO: 81715 - RNA, 45 nt, Mus musculus
ggagaaaggcuccaggagaccuggaaggcaggucucagagggaag

SEQ ID NO: 81716 - RNA, 46 nt, Mus musculus
ccacaggacaagauacagaaucagacagcugcugccucacugacaa

SEQ ID NO: 81717 - RNA, 53 nt, Mus musculus
cagaggguagcuuuggauccggggaucugugaauaggaugucaaaggagugag

SEQ ID NO: 81718 - RNA, 60 nt, Mus musculus
uacagccuaggcauuccagccuaccucauagacaauguagagggagaguaucaccaguga

SEQ ID NO: 81719 - RNA, 45 nt, Mus musculus
ucccagcaaccccuccccuucacuaacugaaccucggcaacagau

SEQ ID NO: 81720 - RNA, 46 nt, Mus musculus
gggucacagcgccagguguagguacucagccaaccagacaucagaa

SEQ ID NO: 81721 - RNA, 41 nt, Mus musculus
cugagaagcauggccuagacauugcccaccuaagugccuca

SEQ ID NO: 81722 - RNA, 42 nt, Mus musculus
uaugucccagcauccuuccuacaugcuuccccuacucugacu

SEQ ID NO: 81723 - RNA, 46 nt, Mus musculus
aaccuuguaaauacaguaacaccacugaauuauaaaagggugagug

SEQ ID NO: 81724 - RNA, 41 nt, Mus musculus
agucuccaggagaugguggaggaggagcagccagggcgaga

SEQ ID NO: 81725 - RNA, 27 nt, Mus musculus
cugaucaaccuguagcuggggaggaga

SEQ ID NO: 81726 - RNA, 46 nt, Mus musculus
uggcaaugauaacauugucaacguguggccuagugguccuggagaa

SEQ ID NO: 81727 - RNA, 41 nt, Mus musculus
aauggagcagccuggagacuacauauccucgguggccugga

SEQ ID NO: 81728 - RNA, 87 nt, Mus musculus
uacagucagaaagccacgccuggcuccagcaggaagacuugcagauacaucccuucucugccagacaggauccuugaugcccccgaa

SEQ ID NO: 81729 - RNA, 45 nt, Mus musculus
ucaaauggagguggccagcuuccucuuaagcaaggaaaaccagcc

SEQ ID NO: 81730 - RNA, 45 nt, Mus musculus
guuugcuagggguggucugaaccuuggaacuagauuugccugggg

SEQ ID NO: 81731 - RNA, 55 nt, Mus musculus
gcgcaaagcaaaggaagccacaggcccagcccccucgcccaugcgggccgccaac

SEQ ID NO: 81732 - RNA, 46 nt, Mus musculus
cggcaggcgcacugacgcgcugcgaggagcuggggguuuguguucg

SEQ ID NO: 81733 - RNA, 45 nt, Mus musculus
aggaauuuggguugggcccuguugcaucagagacgaccagcacug

SEQ ID NO: 81734 - RNA, 45 nt, Mus musculus
gaagccccugccccucagaacagagcaugccaugcugucccagga

SEQ ID NO: 81735 - RNA, 45 nt, Mus musculus
guccuucuagggacucauucugggggucuaccacagccuguuacc

SEQ ID NO: 81736 - RNA, 46 nt, Mus musculus
agaugcaccaacaucuggggcauggugguggugacauagcccauau

SEQ ID NO: 81737 - RNA, 44 nt, Mus musculus
cagcaugaugaugagcccauugcccaggacugagcucagguaca

SEQ ID NO: 81738 - RNA, 46 nt, Mus musculus; identical to SEQ ID NO: 81736

SEQ ID NO: 81739 - RNA, 45 nt, Mus musculus
cagcaugaugaugagcccguugcccaggacugagcucagguagau

SEQ ID NO: 81740 - RNA, 46 nt, Mus musculus
aggcuaaacaggcaagcacuagagcccuugucuaguguacccagga

SEQ ID NO: 81741 - RNA, 42 nt, Mus musculus
guggaaucaccuaauaacacauuucucagaaugggcccccuu

SEQ ID NO: 81742 - RNA, 46 nt, Mus musculus
cguuuccauucagaacuagcugcugagcccugcacugucuggcuuc

SEQ ID NO: 81743 - RNA, 42 nt, Mus musculus
ccaagcagggguaaagaugaugagggacgagggccgccccac

SEQ ID NO: 81744 - RNA, 51 nt, Mus musculus
uuucugcugcacuugaggguguagaucaggacuggaaauggaauggcugug

SEQ ID NO: 81745 - RNA, 42 nt, Mus musculus
cuucgagaaggcaggugugcagcagccuguguacgccaccau

SEQ ID NO: 81746 - RNA, 45 nt, Mus musculus
ucuccugaagcugaaccuuacagagccuuuaccuagaaagccuca

SEQ ID NO: 81747 - RNA, 46 nt, Mus musculus
cagugguccccuuacugccacagaggugcacaaacacgccugucuc

SEQ ID NO: 81748 - RNA, 94 nt, Mus musculus
cacaugguauguuuaucaugucuguauuuugacuggcaucagacguggucagguagacuuuucccucuggagucaugugacuugcucagacagc

SEQ ID NO: 81749 - RNA, 65 nt, Mus musculus
cugcacacacuccuccccugaguccaacccaagcaaggaaaagcccccuggaguccaagagcacg

SEQ ID NO: 81750 - RNA, 45 nt, Mus musculus
ccugggguaauuacugagaaugacacaccuccaacaaagccacac

SEQ ID NO: 81751 - RNA, 46 nt, Mus musculus
agugcacagcaaauccaggugaccccaggccuaccucucagcccag

SEQ ID NO: 81752 - RNA, 98 nt, Mus musculus
ucuucaccuacuucaaagucccugagaccaaaggccgaaccuucgaugagaucgcuuccggcuuccggcaggggggugccagccaaagugacaagaca

SEQ ID NO: 81753 - RNA, 46 nt, Mus musculus
ggccugcucccugcagcccaaggaucucucuggagcacaggcagcu

SEQ ID NO: 81754 - RNA, 104 nt, Mus musculus
gaucucgggcaagccgggccugggcgccuuuccucagccagcagugaaguccaggaggauauucaggacuuugauggcuccagaauuuuuaaugaaagcaagac

SEQ ID NO: 81755 - RNA, 63 nt, Mus musculus
ccuucuuugccaagcuaaucuguagggcuggaccuauggccaaggacacacuaauaccgaacu

SEQ ID NO: 81756 - RNA, 46 nt, Mus musculus
uccauuuuaggauucgcccauuccugucucuuccuacccaaccacu

SEQ ID NO: 81757 - RNA, 50 nt, Mus musculus
cugagaacuuaacugcugaagacacggacacuccugcccugcuguguaua

SEQ ID NO: 81758 - RNA, 45 nt, Mus musculus
ccacuuguaaauacaccaacaaacuccuguaacuuuaccuaagca

SEQ ID NO: 81759 - RNA, 42 nt, Mus musculus
cuggaaugugccccaggcgagcagucccguuaaguggaggag

SEQ ID NO: 81760 - RNA, 42 nt, Mus musculus
gggcgccgccgcccugcacgaccugcgcuucuucggagccgu

SEQ ID NO: 81761 - RNA, 51 nt, Mus musculus
acuugcugagugaagaacuggaccuggaguucaacaagcggagcccguaca

SEQ ID NO: 81762 - RNA, 43 nt, Mus musculus
gauugccacgucgccagcaggggcugccuggcuccgcccugug

SEQ ID NO: 81763 - RNA, 42 nt, Mus musculus
guggcugcggcacacaccuucuuugugggcaauccugagcac

SEQ ID NO: 81764 - RNA, 42 nt, Mus musculus
gugaaggaggcagacuucagggaucucgaggccaagccccau

SEQ ID NO: 81765 - RNA, 45 nt, Mus musculus
agggagucagagcaaagcacaucaggaguucaaggucauccccag

SEQ ID NO: 81766 - RNA, 42 nt, Mus musculus
ccuggaagggacucaguuucccagcucuggguaagccccacc

SEQ ID NO: 81767 - RNA, 47 nt, Mus musculus
uaggacucauggacuccagaagaggugauucccaagagacugcagga

SEQ ID NO: 81768 - RNA, 48 nt, Mus musculus
cgaaaccgcaguccgcaucucccaggagauuggcaaccuuaugaagga

SEQ ID NO: 81769 - RNA, 46 nt, Mus musculus
acuucgggagauggcuaccgaggucagaccuccccacacaccccaa

SEQ ID NO: 81770 - RNA, 41 nt, Mus musculus
gggauccccaggugugugggcuggcugugagucggggcuga

SEQ ID NO: 81771 - RNA, 45 nt, Mus musculus
gugcggcgcgucauggaguccuacuuccgccuggacacgccccuc

SEQ ID NO: 81772 - RNA, 46 nt, Mus musculus
guguuuccuguauacucuacucuaacguggauuaucuuggccacag

SEQ ID NO: 81773 - RNA, 41 nt, Mus musculus
acuuuuacuucacagaacuagaugccaagacugugacggug

SEQ ID NO: 81774 - RNA, 46 nt, Mus musculus
ucagacagagggucgcugcacaaggaugagcuaugacaacagcuag

SEQ ID NO: 81775 - RNA, 46 nt, Mus musculus
gaauaaaugauuuguguuuuuuucacuuagugguuuguuccaagag

SEQ ID NO: 81776 - RNA, 43 nt, Mus musculus
accuucuuguccccgccggcgggcgccgccgaugugaggccac

SEQ ID NO: 81777 - RNA, 41 nt, Mus musculus
acacccgggaggagccgcagccgucgccgccggccccaguc

SEQ ID NO: 81778 - RNA, 71 nt, Mus musculus
ggugugauggugacuaggccggcggcggcgguggggcucucagggcucucugggguccgcucuccgcuccc

SEQ ID NO: 81779 - RNA, 29 nt, Mus musculus
cgucccgccauucucgcuaguucgaucgg

SEQ ID NO: 81780 - RNA, 46 nt, Mus musculus
aacuaggugauuuugaugauaauauucaugagagcccacuuaagau

SEQ ID NO: 81781 - RNA, 48 nt, Mus musculus
ucaagugccuaccaugugccagggccuuugugagcugugagggucuga

SEQ ID NO: 81782 - RNA, 41 nt, Mus musculus
cgcucuccuggaucuggaaagugaacaagaguucacaaaga

SEQ ID NO: 81783 - RNA, 45 nt, Mus musculus
uucccaugcaagcugcccucauuuccuauucugaccaggcuggag

SEQ ID NO: 81784 - RNA, 42 nt, Mus musculus
agagugguuugcugucuugggagauacagauagguugggaag

SEQ ID NO: 81785 - RNA, 42 nt, Mus musculus
agaucuugagccauaguggccaugaaaaguuuacacccaggc

SEQ ID NO: 81786 - RNA, 45 nt, Mus musculus
gaaugaacuacaaucagaauuggagggcacaccugugaugcagau

SEQ ID NO: 81787 - RNA, 46 nt, Mus musculus
aauugugguuagaacaucccugugaguguuagaaguagcgaggguc

SEQ ID NO: 81788 - RNA, 38 nt, Mus musculus
cugccugggugagccacaauaauaaggcaacuugaauc

SEQ ID NO: 81789 - RNA, 46 nt, Mus musculus
ggagaggaugacgcggcagggguaaugacaagaugacaugccuggg

SEQ ID NO: 81790 - RNA, 43 nt, Mus musculus
uuuaaaaagcaaaaggcucauguaagugucuuugagggaagug

SEQ ID NO: 81791 - RNA, 42 nt, Mus musculus
gauuaacccagauguggcaaggguaaagggcagaaaccagau

SEQ ID NO: 81792 - RNA, 45 nt, Mus musculus
acuauuuucaaguuagccuauacaaauauaucuuugaugccaugg

SEQ ID NO: 81793 - RNA, 46 nt, Mus musculus
caguuaaguuucugaacauacuagcaaugauuccugcccuacaguc

SEQ ID NO: 81794 - RNA, 46 nt, Mus musculus
aggguuuucagacuugagugacucagaguuaguugaauuucuggau

SEQ ID NO: 81795 - RNA, 46 nt, Mus musculus
cagggccuccgaccucaggcugcggcugggaaccuggagagcagaa

SEQ ID NO: 81796 - RNA, 46 nt, Mus musculus
ccacgguuucucuccagcacccuuuccugugacuucaugcucagau

SEQ ID NO: 81797 - RNA, 42 nt, Mus musculus
cuugacugcuucaaaugucuguccacguccuaagugagaguc

SEQ ID NO: 81798 - RNA, 46 nt, Mus musculus
uuucccuaacauaagaucucacucuaguccuugcuggccccaaauu

SEQ ID NO: 81799 - RNA, 55 nt, Mus musculus
gaauuuguuuuuaccuacguguuguuauaauuuagcccagccaaucaguguuuua

SEQ ID NO: 81800 - RNA, 46 nt, Mus musculus
augcacaacuuguuuuauuucugcacuauguggaaucugcauagag

SEQ ID NO: 81801 - RNA, 46 nt, Mus musculus
aaagcauaucagagaccgaacgugagcacaggucugacugugagau

SEQ ID NO: 81802 - RNA, 46 nt, Mus musculus
aaguggguauuucacuagugagcuuagaagcuaaucaggagcagau

SEQ ID NO: 81803 - RNA, 45 nt, Mus musculus
aacuuuuugccgccuuugguuuuuaugacagccaacccacucuga

SEQ ID NO: 81804 - RNA, 63 nt, Mus musculus
uagaagaguacucuguaccaaacaaagacaaccaggaggagucuggcauggaagcccgcaaug

SEQ ID NO: 81805 - RNA, 42 nt, Mus musculus
aagucccauaaacaccuguaucugcagcuccaaggaucgucu

SEQ ID NO: 81806 - RNA, 46 nt, Mus musculus
acacacacacacucuucacacacaucucacauacauacacacacac

SEQ ID NO: 81807 - RNA, 45 nt, Mus musculus
augggugguuaugggcucagacucauagaguggagccaguaugga

SEQ ID NO: 81808 - RNA, 46 nt, Mus musculus
uucccuuugacuaagguguauguuguugaagguaaggcuaccugga

SEQ ID NO: 81809 - RNA, 42 nt, Mus musculus
aaauucacaccucuaccggagggaaagcuuaagcaggaaauu

SEQ ID NO: 81810 - RNA, 46 nt, Mus musculus
aauuugaguauuuuaguuagcaggugacuuuguucugugugcugag

SEQ ID NO: 81811 - RNA, 45 nt, Mus musculus
agacuuucugggcaguucuguaguucugcuggcuuuggaccagaa

SEQ ID NO: 81812 - RNA, 45 nt, Mus musculus
aaaucuuuuuaaagauuaauuaauuuguuguugguagugguggug

SEQ ID NO: 81813 - RNA, 45 nt, Mus musculus
auguaaaagauagauaguauaaaaugugugugaaguuguagaaag

SEQ ID NO: 81814 - RNA, 45 nt, Mus musculus
gucgaccaugaggggaaaggggucccaguuuuuauaggcccucag

SEQ ID NO: 81815 - RNA, 44 nt, Mus musculus
uauacaaaacgacgacucgcguaccagcagaguuagaacagauc

SEQ ID NO: 81816 - RNA, 43 nt, Mus musculus
uggacgguguaucuuugggagaccuuccuagcacagcggcagg

SEQ ID NO: 81817 - RNA, 47 nt, Mus musculus
agggacgcgugucgcugaggcaccggugcacgcuaaaggagcgggug

SEQ ID NO: 81818 - RNA, 42 nt, Mus musculus
uggggcgucuuauucuagcagaaauaaguagguccuugaaga

SEQ ID NO: 81819 - RNA, 46 nt, Mus musculus
agaaacacuagcuuuccugcuuuguccauuuucuuuagccccaggc

SEQ ID NO: 81820 - RNA, 68 nt, Mus musculus
gagaagggcugguugcaggcuagauuagaguucagggcugagcaugaacuauguacauggcuuggaag

SEQ ID NO: 81821 - RNA, 80 nt, Mus musculus
cauauggugauagcaggcggcaaaggauaagauugagaucuuagaucuuuccaaguaggguauguuagaugauaagagga

SEQ ID NO: 81822 - RNA, 44 nt, Mus musculus
ugcgcaggaaccugacuaggacuaugaccuccacggcggcuguu

SEQ ID NO: 81823 - RNA, 43 nt, Mus musculus
ucacugaaauauaccucaggcugagacgggcgggacagcaggu

SEQ ID NO: 81824 - RNA, 44 nt, Mus musculus
cugugcccucucccuucacaccaugggauacaucuguauggaga

SEQ ID NO: 81825 - RNA, 45 nt, Mus musculus
ugugagcuaccaugugguugcugagaauugaacucaggaagagca

SEQ ID NO: 81826 - RNA, 46 nt, Mus musculus
agaagcuuggccugguguuugaugacguggugggcauuguggagau

SEQ ID NO: 81827 - RNA, 46 nt, Mus musculus
agcagguggcuuacaucuacaagugugucaacacaacauugcaaau

SEQ ID NO: 81828 - RNA, 46 nt, Mus musculus
cagccacaaagaaggaaccagcucugcuggaacuggaaggcaagaa

SEQ ID NO: 81829 - RNA, 46 nt, Mus musculus
auccaauguccaugcucugcuggaguuuggucuaauuagaguaaga

SEQ ID NO: 81830 - RNA, 41 nt, Mus musculus
cuauuauaugccccaguacaggggaauaccagggccaaaaa

SEQ ID NO: 81831 - RNA, 45 nt, Mus musculus
uggcuuugaauggcagcaucacggacugcauuugaaucaccagau

SEQ ID NO: 81832 - RNA, 47 nt, Mus musculus
ggucauaaaauacaacuguguucaucuuugugguggagaagguccug

SEQ ID NO: 81833 - RNA, 45 nt, Mus musculus
gcuugccaaucccguggcagaguacuugaagaugaguaaggagau

SEQ ID NO: 81834 - RNA, 49 nt, Mus musculus
caggaaggacugauaccugaaguuguccucugaugaccacguaagugcc

SEQ ID NO: 81835 - RNA, 53 nt, Mus musculus
ggacaggagaguccgggaaccucguggacuacguagccagguguguguagugg

SEQ ID NO: 81836 - RNA, 46 nt, Mus musculus
aguaagugcuugccguacaagcuugauggccugcccgaguucagau

SEQ ID NO: 81837 - RNA, 42 nt, Mus musculus
gccuggaggcagugucacauacuucagacaugcacuguggau

SEQ ID NO: 81838 - RNA, 41 nt, Mus musculus
aaguccaaguaaguugguugcugaagugugguuaagguaga

SEQ ID NO: 81839 - RNA, 46 nt, Mus musculus
caauaaguacauaaaggacaauaagaauuccugagauggggcaaag

SEQ ID NO: 81840 - RNA, 46 nt, Mus musculus
gaagagggugucagaucuuguuacgacggaugguugugagccacca

SEQ ID NO: 81841 - RNA, 46 nt, Mus musculus
uuacaacuccuauauuuaaauuaauuauagacuuagaaucacagau

SEQ ID NO: 81842 - RNA, 53 nt, Mus musculus
agauaucaaggcuggaauccaaggaacuggaggcuuguuauuuaugggaguga

SEQ ID NO: 81843 - RNA, 48 nt, Mus musculus
cguguugugguuccaguauuacuuggagaaguggagaaaaugagaggu

SEQ ID NO: 81844 - RNA, 46 nt, Mus musculus
aggcauauaaugagccuaggaaacggauuucuaggcagaacuagau

SEQ ID NO: 81845 - RNA, 45 nt, Mus musculus
ucuggcuaggaauacacuuguucucuggugauauguacaguaugg

SEQ ID NO: 81846 - RNA, 50 nt, Mus musculus
uguacugcuuucccuugaagugaaaauccaggguuagaacagcacguuca

SEQ ID NO: 81847 - RNA, 61 nt, Mus musculus
caaauguggugagggugcuguggaaggacgcagcaagggagucagaagcguuuugaaagau

SEQ ID NO: 81848 - RNA, 55 nt, Mus musculus
ccaagugccuguggucguaggaucgcuguguuuauucuguguuggcaacauggaa

SEQ ID NO: 81849 - RNA, 45 nt, Mus musculus
agacugccacuguucacucgcaauccaagcuaacuuuaugggagg

SEQ ID NO: 81850 - RNA, 45 nt, Mus musculus
aguuaauuauucccaaauuuugccauaauucuaauucuagcccaa

SEQ ID NO: 81851 - RNA, 40 nt, Mus musculus
gagcuacuuauagagcauuuucaggugggcggguucagaa

SEQ ID NO: 81852 - RNA, 46 nt, Mus musculus
cugcauguauaucggcacaccacaagcaugcagugacuguggaagc

SEQ ID NO: 81853 - RNA, 45 nt, Mus musculus
ucuuggguguaugcaggcacauucagaauuguacauugugacuag

SEQ ID NO: 81854 - RNA, 47 nt, Mus musculus
gcccggcuauuucucuccuuuuaugucuagugauuuuccucuuuagg

SEQ ID NO: 81855 - RNA, 42 nt, Mus musculus
ucccaugaguaugaggcuaccucggcagaaaaaggaagggag

SEQ ID NO: 81856 - RNA, 79 nt, Mus musculus
cagaagugaccucuuauacugauagucugguuuuuccaaaccccaacuguuucucaauguauagaaacauaaauauucu

SEQ ID NO: 81857 - RNA, 87 nt, Mus musculus
cauccagcagugagagucagaauucaaggggaggccaguaguaacacaaucccugcuuuccaggauggaaaaacugagguacagaaa

SEQ ID NO: 81858 - RNA, 41 nt, Mus musculus
gaucuucaaaugcauuugcagagucugauccagugcaggaa

SEQ ID NO: 81859 - RNA, 48 nt, Mus musculus
auacugucugccugccugagaagagagacugccaaguguaggcuagga

SEQ ID NO: 81860 - RNA, 90 nt, Mus musculus
agaccuaggagcacaguuccugcuguguuuucucaaagcuauaggagaggagcaaaugacuuuuggcagacugacuaggcagcaggcucu

SEQ ID NO: 81861 - RNA, 84 nt, Mus musculus
aacaguguuuuguacuaaaggacugucugucugauagugcucaagggagaucugggaggcacaggggaaggauaugaaaggaga

SEQ ID NO: 81862 - RNA, 47 nt, Mus musculus
cucuuuaucacagcuggcagacacaaucuuuaaaaugacugaccaug

SEQ ID NO: 81863 - RNA, 46 nt, Mus musculus
aauugauggauuuacugugacagucuauaguuccuguguuugguag

SEQ ID NO: 81864 - RNA, 46 nt, Mus musculus
gaaauuccagcuccuuagggaucagaugucaggagucucuuggcca

SEQ ID NO: 81865 - RNA, 65 nt, Mus musculus
ccugaguuugauccccuagaaaaccacaugguagaaggagaaaaccaacuucugaaguugcccuc

SEQ ID NO: 81866 - RNA, 87 nt, Mus musculus
auuaaauauaaugucaugcaauuaauguaguacuuacugucugcuggcacuguucuaaacacuuuacauauauuaacucauuaucag

SEQ ID NO: 81867 - RNA, 46 nt, Mus musculus
aggggaaaaaauaaugcccauguaacgacacuaaguuuaagagaug

SEQ ID NO: 81868 - RNA, 46 nt, Mus musculus
auaaaaaguaauaaauucagauaaaauauacauggcucagugggag

SEQ ID NO: 81869 - RNA, 42 nt, Mus musculus
augaauguauguaugauuacacgugccagggcaugaauagag

SEQ ID NO: 81870 - RNA, 46 nt, Mus musculus
guuuucugucagcuuacacaggaugaggucauaaguaaagccagag

SEQ ID NO: 81871 - RNA, 45 nt, Mus musculus
aggcugagggacagucacagaaguguucuuuguggccaggucugg

SEQ ID NO: 81872 - RNA, 45 nt, Mus musculus
uuccguucagacaaagaacucuugcacuuuuaguagaauuggcag

SEQ ID NO: 81873 - RNA, 42 nt, Mus musculus
aaagcaacggcccugauauccuuaaggaaacuuagcacccag

SEQ ID NO: 81874 - RNA, 42 nt, Mus musculus
ugaacauguaaaauagaugugguagcccaguuaaacaagcag

SEQ ID NO: 81875 - RNA, 45 nt, Mus musculus
cuuugauguccuagccccaggagaugggcacugggaaagugguug

SEQ ID NO: 81876 - RNA, 45 nt, Mus musculus
cuaagccagguggacccagaaauggccgccaagcuacacccgcau

SEQ ID NO: 81877 - RNA, 42 nt, Mus musculus
uauugaggcucugaaacaaguaacuaagagauaugcccggaa

SEQ ID NO: 81878 - RNA, 45 nt, Mus musculus
aguuuccauugaagaugugucuucacccuggaacagaugguggug

SEQ ID NO: 81879 - RNA, 41 nt, Mus musculus
gaugcguggggucuuuuccuucucccuccagucucaugucu

SEQ ID NO: 81880 - RNA, 45 nt, Mus musculus
ccucugugaccggaucaucauuggggaccgggaaugggcagguag

SEQ ID NO: 81881 - RNA, 45 nt, Mus musculus
cuagauaacuuguugaacuggugauggcucagacugugacagaag

SEQ ID NO: 81882 - RNA, 45 nt, Mus musculus
ucccuuguuguucuggacauuuuuaguuuucagcuguuuugucug

SEQ ID NO: 81883 - RNA, 46 nt, Mus musculus
ucuugggaggugguuccagcagaggccaccgggcuaguacacagag

SEQ ID NO: 81884 - RNA, 42 nt, Mus musculus
cacucacagggguuuccugggacauuuccuuaugucgggcag

SEQ ID NO: 81885 - RNA, 30 nt, Mus musculus
gagguggcgggcaggggucacucuaaguua

SEQ ID NO: 81886 - RNA, 46 nt, Mus musculus
accuggucuuucucucucugucccggagcugggagcccgauggcug

SEQ ID NO: 81887 - RNA, 42 nt, Mus musculus
ugggcguggacgacuucggccugggcaucuugcuggccucca

SEQ ID NO: 81888 - RNA, 45 nt, Mus musculus
gguauuuggggaggucacggaaggccuggaugucuugcggcagau

SEQ ID NO: 81889 - RNA, 46 nt, Mus musculus
agggaagcagcuuccaccgcaucaucccccaguucaugugucaggg

SEQ ID NO: 81890 - RNA, 46 nt, Mus musculus
uccucagguguacauggacaucaagauugggaacaagccagcaggc

SEQ ID NO: 81891 - RNA, 46 nt, Mus musculus
aagaagaaggacccgagccucccaaagcugaagcccaggaggugag

SEQ ID NO: 81892 - RNA, 46 nt, Mus musculus
aggguuucaugaaauaguagaccaguuaauaacagagaagagagau

SEQ ID NO: 81893 - RNA, 42 nt, Mus musculus
aaacaccgaggguuugcuuuuguugaguuugaguuggcagag

SEQ ID NO: 81894 - RNA, 42 nt, Mus musculus
guggcacaugccuguaaaccuagcaauucagaggcugcagcg

SEQ ID NO: 81895 - RNA, 87 nt, Mus musculus
gaggggcagagacacacacagagacacacacagagaggcagaggggcagagacacacacagagacacacacagagaggcagaggggc

SEQ ID NO: 81896 - RNA, 50 nt, Mus musculus
ccaccauaugaggcuuugguuucaguucccagcacuaaucacacagagac

SEQ ID NO: 81897 - RNA, 46 nt, Mus musculus
ugaaacaggugggucauuugagugucuuuaacgcucauuacccucc

SEQ ID NO: 81898 - RNA, 68 nt, Mus musculus
acaagaguuggagaucgaaucagaacuguuuaaaaggagauugaagaaaggaaaguaguguggguagg

SEQ ID NO: 81899 - RNA, 46 nt, Mus musculus
gcguuguaauagggacuaacaaugaugacaggaacuugggugaggg

SEQ ID NO: 81900 - RNA, 45 nt, Mus musculus
auuuugggcuuccaaaucccucccgcccauucguuuuacaaacau

SEQ ID NO: 81901 - RNA, 46 nt, Mus musculus
cgcgagcaagauggccaccaccaagcgugugcuguacgugggugag

SEQ ID NO: 81902 - RNA, 46 nt, Mus musculus
ugugugaaugcauuuagcaaaauccagcuucuauugacugaccuua

SEQ ID NO: 81903 - RNA, 46 nt, Mus musculus
uaagcuuuauaagaagugaagggggacucacucugucuuugcucag

SEQ ID NO: 81904 - RNA, 45 nt, Mus musculus
gccggggagcaggggagacagccuauaaggaauaagaggucccag

SEQ ID NO: 81905 - RNA, 46 nt, Mus musculus
gauaacugcugagcccagguaguggaccagggacaggaacagagca

SEQ ID NO: 81906 - RNA, 45 nt, Mus musculus
uagucuaggagacucagacagaaugacugaaguccagcuggagga

SEQ ID NO: 81907 - RNA, 42 nt, Mus musculus
gaggaaggggaggaggaggaggguuacaacuuguggugucug

SEQ ID NO: 81908 - RNA, 45 nt, Mus musculus
gaagagaaggaaaaggagagggagagggaguagggggaggaggag

SEQ ID NO: 81909 - RNA, 42 nt, Mus musculus
gguggcggcacaugucuuuaaugccagcacucagaggcagag

SEQ ID NO: 81910 - RNA, 41 nt, Mus musculus
ucagcuguguucaauuguacugucacaucagagccuguaga

SEQ ID NO: 81911 - RNA, 42 nt, Mus musculus
uaggaugaaguugucaacacagugcaaacuccuggccccggu

SEQ ID NO: 81912 - RNA, 25 nt, Mus musculus
cgccugugaggagaugcugcggcag

SEQ ID NO: 81913 - RNA, 42 nt, Mus musculus
ggcgcggggggcggacugcggagggguggugagcggguggca

SEQ ID NO: 81914 - RNA, 42 nt, Mus musculus
ccgcuuaaagggaccgcgacccccaggcgacuugaaggagaa

SEQ ID NO: 81915 - RNA, 46 nt, Mus musculus
ccuuuccuggggacuuaaggcagaugcuggagagggguccccuucg

SEQ ID NO: 81916 - RNA, 46 nt, Mus musculus
caugaaggcauggucaggaauccggaugccaacaagcugggaagca

SEQ ID NO: 81917 - RNA, 46 nt, Mus musculus
auggucgggagaucugacaccaucaccaacuccauggucgggagau

SEQ ID NO: 81918 - RNA, 42 nt, Mus musculus
cacuguuaaacaaacuugaugaaucuuaaaaagccagcuaua

SEQ ID NO: 81919 - RNA, 61 nt, Mus musculus
gccagccagaagcugcagggugagccuuguccccgggggaagguuauauuuauuuauucug

SEQ ID NO: 81920 - RNA, 60 nt, Mus musculus
uacauuuauuugucagccaagaauuaaauggagggaaggauguucuuagaguggccuuau

SEQ ID NO: 81921 - RNA, 50 nt, Mus musculus
ggaccaacgcagcaaagucuaggagccgagggcaaagcugucuggguaca

SEQ ID NO: 81922 - RNA, 48 nt, Mus musculus
ccaagugaaauauugaaaaauaaaaucuugacuuuuuucagccgguga

SEQ ID NO: 81923 - RNA, 42 nt, Mus musculus
gauuuaacccugcauauauauuguggauacagcaaggcagca

SEQ ID NO: 81924 - RNA, 46 nt, Mus musculus
cacugcaaggacaaccagcccagucaccgacacuuaacccccgaga

SEQ ID NO: 81925 - RNA, 45 nt, Mus musculus
aauggcugaugugagggacucucacgcaaacaaaccuuaacagau

SEQ ID NO: 81926 - RNA, 45 nt, Mus musculus
acacaagacccuguaucaaauaaaauauugaugaugauguuagau

SEQ ID NO: 81927 - RNA, 42 nt, Mus musculus
gcgccgcgggcucccguaccacgaauaguaaaaagcaugcag

SEQ ID NO: 81928 - RNA, 24 nt, Mus musculus
agcgcggcggcgggcaccgcggga

SEQ ID NO: 81929 - RNA, 46 nt, Mus musculus
uuuuugguuuuuuuggagacaggguuucucuguauaguccuggcug

SEQ ID NO: 81930 - RNA, 45 nt, Mus musculus
agggggacugcauagugucagauguggugaguguuaaauaaggca

SEQ ID NO: 81931 - RNA, 42 nt, Mus musculus
gacauccugagacaaugaugcucacagcauuugagccaaguu

SEQ ID NO: 81932 - RNA, 42 nt, Mus musculus
gcagugcugauaaacaguguccaccaaggcaggaaagggcag

SEQ ID NO: 81933 - RNA, 46 nt, Mus musculus
cugaguccuuaauggcuuaaagauaggagugggucugggaguccag

SEQ ID NO: 81934 - RNA, 41 nt, Mus musculus
gggggacaaagucaaucaccugcaaaaccccaaaaaggaaa

SEQ ID NO: 81935 - RNA, 46 nt, Mus musculus
gccggcugugaugguugguuuuuaugguccacuugacaaagccacc

SEQ ID NO: 81936 - RNA, 45 nt, Mus musculus
ugugaccagcagcugcuucagguuccugccacugacucuccugua

SEQ ID NO: 81937 - RNA, 45 nt, Mus musculus
agacacacacagagagagagagagagagagagagagagagaggca

SEQ ID NO: 81938 - RNA, 41 nt, Mus musculus
agaggagguggaggagaaagaaggagaaggaggagaaggag

SEQ ID NO: 81939 - RNA, 44 nt, Mus musculus
agaggauuucagaggaugaggugcuaauccgggucuggagagag

SEQ ID NO: 81940 - RNA, 44 nt, Mus musculus
ugagugaaauauagucacuguauuauaacugugggaaguagauu

SEQ ID NO: 81941 - RNA, 46 nt, Mus musculus
cgcuuucccggcugggaagucgugaagugguuuaccucgcgaguag

SEQ ID NO: 81942 - RNA, 40 nt, Mus musculus
cggagcaccaucaaccgcucggcggccagcaccaacccag

SEQ ID NO: 81943 - RNA, 42 nt, Mus musculus
gucacgccagccucuggcagccccgaggccucucaggaggag

SEQ ID NO: 81944 - RNA, 46 nt, Mus musculus
auguuucuaagcagggguuaaguuuaucaacagcugaaaaauguag

SEQ ID NO: 81945 - RNA, 41 nt, Mus musculus
gcuacacagagaaaccuugucuugaaaaaccaaaaaggaga

SEQ ID NO: 81946 - RNA, 83 nt, Mus musculus
cuagaucgaguacagggagcuggcggccaaaacaugagggaucggggcacaauucggcgccugaauauguacaggcaaaagga

SEQ ID NO: 81947 - RNA, 41 nt, Mus musculus
uauaguuaauaugguuaaagucauggguaguagauggugaa

SEQ ID NO: 81948 - RNA, 45 nt, Mus musculus
aguggagccgaauauuaaaugguuugguaaguauccuccugugau

SEQ ID NO: 81949 - RNA, 42 nt, Mus musculus
ugccugucacuguauuaaugccuuuugaugggcugcccccug

SEQ ID NO: 81950 - RNA, 63 nt, Mus musculus
gucuauccccaucuccggaaaaggagaugaauguuggugugagugugugugugugugugugug

SEQ ID NO: 81951 - RNA, 54 nt, Mus musculus
ugugugugugagugugugugugugaguguaugugugugugagugugugugugag

SEQ ID NO: 81952 - RNA, 68 nt, Mus musculus
ugugugcgugugugugagcgugugugugugugugugagcgugugagugugagugugugugugugagug

SEQ ID NO: 81953 - RNA, 45 nt, Mus musculus
gugugagugugugugugugugagugugucagggaagacuggaggg

SEQ ID NO: 81954 - RNA, 26 nt, Mus musculus
gcaggcaucauuacaaaaauuucaag

SEQ ID NO: 81955 - RNA, 42 nt, Mus musculus
ugugugugugagagagagagagagagagagagagagaugugu

SEQ ID NO: 81956 - RNA, 44 nt, Mus musculus
agguaucagauucccugguuuagauguguuacaugcagugguga

SEQ ID NO: 81957 - RNA, 74 nt, Mus musculus
gaaguuacugaaggugagccagcgucuuggggauuggcacugggauacacggaccugccauugugagagcggug

SEQ ID NO: 81958 - RNA, 46 nt, Mus musculus
ccugacaugcugacugugagcaagaugguucucaaugacuggcaga

SEQ ID NO: 81959 - RNA, 53 nt, Mus musculus
gaggccgaaucccuuucuuugucaagccgcccaaugcagagcuaccgaccgau

SEQ ID NO: 81960 - RNA, 42 nt, Mus musculus
cauuuuugguacgugugugucauccauuauauagacuugcug

SEQ ID NO: 81961 - RNA, 26 nt, Mus musculus
ucugugggagcagagguguugccaaa

SEQ ID NO: 81962 - RNA, 45 nt, Mus musculus
uaaauaggagcccuugcucuaaagagaacugggagcucacaggca

SEQ ID NO: 81963 - RNA, 52 nt, Mus musculus
ccaccauccucaccauuggaaguucccacagaaacaacccagaacaacccag

SEQ ID NO: 81964 - RNA, 89 nt, Mus musculus
ucaguuuucugcggaugaccuggugccuguggagaugucagacuuggaagaucuggaaagcucuggggaagaggaagaacaggagcagg

SEQ ID NO: 81965 - RNA, 101 nt, Mus musculus
ccagugggaaacgacaccaaggccgugcucagagcccuggaugagaagauugccaaguaccagagguuucuaaauaaagcuaaagcuaaaaaguucucugc

SEQ ID NO: 81966 - RNA, 46 nt, Mus musculus
gcugcuuuaaggaaaaucuguacauuguucaccuuuaggcaccuga

SEQ ID NO: 81967 - RNA, 48 nt, Mus musculus
gaauauccaaggacuuaagugaaaagguuuuugcaaaauacaaagaag

SEQ ID NO: 81968 - RNA, 41 nt, Mus musculus
auaaagcacccaccaaaaaggcaaggaagugggaugcacag

SEQ ID NO: 81969 - RNA, 46 nt, Mus musculus
ugcguuacuacgagacacacaaugugaaaaacaggaacaggaacaa

SEQ ID NO: 81970 - RNA, 47 nt, Mus musculus
guaacugcgagaaagcuguuuauuaaauuauacaaaaauaugccauu

SEQ ID NO: 81971 - RNA, 42 nt, Mus musculus
ucucuaugaggacucuugauggagggaccaaagaauggaguu

SEQ ID NO: 81972 - RNA, 46 nt, Mus musculus
gcaacaaaaacaaaaacaaaacagccagcauaucuggaauugagag

SEQ ID NO: 81973 - RNA, 48 nt, Mus musculus
ugguaggaaggaugugggauggaggacagggcagggcccugagaccug

SEQ ID NO: 81974 - RNA, 41 nt, Mus musculus
aaagguuucugaggcguugggguuggagaauaagguugucu

SEQ ID NO: 81975 - RNA, 96 nt, Mus musculus
uuacucccacauugaaacucagucagguauaugucuauccaugcagacucgauuacugcacuugcauaguaagucucaaacugaauguccucuuug

SEQ ID NO: 81976 - RNA, 46 nt, Mus musculus
ccucuggaagaacagaaagugcucuaacuguagaguuaccuucuag

SEQ ID NO: 81977 - RNA, 44 nt, Mus musculus
aggugacugagguuugucgccuuguuuugagggaucuggaugug

SEQ ID NO: 81978 - RNA, 42 nt, Mus musculus
ugagccggacugaaggaguacuguacgucuuaacaaccugug

SEQ ID NO: 81979 - RNA, 45 nt, Mus musculus
uguauuuuugagauuaaaaaaauaaaauuuguaaauauagccuca

SEQ ID NO: 81980 - RNA, 52 nt, Mus musculus
auuauaggcauguacuacuggagaggaacaagagauuagugaagagguuugu

SEQ ID NO: 81981 - RNA, 46 nt, Mus musculus
cgccggcuccacuccgacggucuugcggugaauuagcccguuguag

SEQ ID NO: 81982 - RNA, 49 nt, Mus musculus
acugcagaugcgcggacauggcggcggcuccucucccuauggcggccgg

SEQ ID NO: 81983 - RNA, 42 nt, Mus musculus
gggggugccggcugccucuacuaggucuaggaaggucuggaa

SEQ ID NO: 81984 - RNA, 41 nt, Mus musculus
aggagccaggcacaggaaaguaguuuggagccugcgcgcua

SEQ ID NO: 81985 - RNA, 45 nt, Mus musculus
acagagcccgacgggccccuuagugucaaugucuucacgucagca

SEQ ID NO: 81986 - RNA, 42 nt, Mus musculus
ccgcuccuggcgcuggcgcucagcuucuucccgggaccgggc

SEQ ID NO: 81987 - RNA, 46 nt, Mus musculus
aacaugccacuucuuuggggaaguguucccuuaaaaaaauauauau

SEQ ID NO: 81988 - RNA, 28 nt, Mus musculus
agcugcuuacuuagauucuugaguuuua

SEQ ID NO: 81989 - RNA, 45 nt, Mus musculus
uuuuuccccauggacuugagucacuuccuggguguaugaguugcu

SEQ ID NO: 81990 - RNA, 99 nt, Mus musculus
ccagugggagcugcuuaggauucguggcagucuucagggcaggaggugugucugggggagugucaggaaccaaggcugacaucgguguuggcggcggag

SEQ ID NO: 81991 - RNA, 45 nt, Mus musculus
ccaggagccccuaaauggacuucugacaucauuggggucugcuga

SEQ ID NO: 81992 - RNA, 41 nt, Mus musculus
ccgugcuucccggcgcggagguuggggggaggaggcagcug

SEQ ID NO: 81993 - RNA, 46 nt, Mus musculus
guagaggccgguggcuaacgaagcucugaguagccagcuacccgag

SEQ ID NO: 81994 - RNA, 41 nt, Mus musculus
cugggaucuggguugugaggaggugaggugaggcggcacug

SEQ ID NO: 81995 - RNA, 46 nt, Mus musculus
uuaguuucuuuagcuacaaaaugggggcugugguaccaaagacuag

SEQ ID NO: 81996 - RNA, 32 nt, Mus musculus
uuuucuuacauagauuuacuuauuuauucgca

SEQ ID NO: 81997 - RNA, 41 nt, Mus musculus
gccagcauauuugucuguauaccaugugugugucuggagga

SEQ ID NO: 81998 - RNA, 45 nt, Mus musculus
aaaaugggccaggcgugguggugcacgccuuuaaucccagcacau

SEQ ID NO: 81999 - RNA, 48 nt, Mus musculus
cuauggagcgcuugucacccagcugugcaaggacuaugaaaacgacga

SEQ ID NO: 82000 - RNA, 79 nt, Mus musculus
acaacauuggaguccgacugauugaagauuuuuuggcacggucaaauguuggaagaugucaugacuuucgggaaacugc

SEQ ID NO: 82001 - RNA, 45 nt, Mus musculus
acguauugggagacuguuuaaacauaaacguaauuccaucuggua

SEQ ID NO: 82002 - RNA, 46 nt, Mus musculus
aguccaaagauaaagugacuaauccaaaaacccaaaacggggaggg

SEQ ID NO: 82003 - RNA, 45 nt, Mus musculus
gagaauguccggcgggucuuaggcacguucaccauguucgcagga

SEQ ID NO: 82004 - RNA, 42 nt, Mus musculus
ccauccuguguaggugacucucagaucuguguccagcccaga

SEQ ID NO: 82005 - RNA, 41 nt, Mus musculus
ggagaacaggccacagcccucagaucuaugacagugggaga

SEQ ID NO: 82006 - RNA, 45 nt, Mus musculus
uuguacaguaauaagcaaaauaaacaaaaagcaaccaccccaaau

SEQ ID NO: 82007 - RNA, 42 nt, Mus musculus
uucccggcaccauggaguaccucauuggcauccagggcccag

SEQ ID NO: 82008 - RNA, 42 nt, Mus musculus
gagcacacugggcuccaucuuccaagcugcccagagggaggc

SEQ ID NO: 82009 - RNA, 46 nt, Mus musculus
uucugggucagaugaggcuugcuaggugagaguugcucagcgugag

SEQ ID NO: 82010 - RNA, 46 nt, Mus musculus
gcucaagugugugcccggcgccuccaauuucugaauuucuggcaag

SEQ ID NO: 82011 - RNA, 44 nt, Mus musculus
auuccacuauuuaacgacaaguaaaaucuagcagccagggaaag

SEQ ID NO: 82012 - RNA, 45 nt, Mus musculus
auuugcucugugaguuuuguacguuauuuuuuuucccgugcccag

SEQ ID NO: 82013 - RNA, 50 nt, Mus musculus
uguuaaaaguuuggcucuacuaugugcccuucuugcaguuaguuuuggag

SEQ ID NO: 82014 - RNA, 46 nt, Mus musculus
uguguguguguauauguguguauauguacaaaacuuucuuaaggag

SEQ ID NO: 82015 - RNA, 46 nt, Mus musculus
ugcuuuugcccaggcuucacaaccggaguuuggucccagaacccag

SEQ ID NO: 82016 - RNA, 46 nt, Mus musculus
aucauuuugcauaaugucuacuaacuuguuuuuggagugcugaggc

SEQ ID NO: 82017 - RNA, 44 nt, Mus musculus
gacugaaaagaggaagaaaaaaaagaauacuauguaguugggaa

SEQ ID NO: 82018 - RNA, 46 nt, Mus musculus
ugucacacauaaguguauggguguaccugucucacccgggacagag

SEQ ID NO: 82019 - RNA, 45 nt, Mus musculus
ccuaaagucuccuccucuucuucuuaagucuccaaagcuugacug

SEQ ID NO: 82020 - RNA, 98 nt, Mus musculus
ugagcuuugcuugcauucuguucuuucugaaggacuugaaaucagaccucuaugguauuaauugucucucaagagacuuuaugaaauuuuaugauuag

SEQ ID NO: 82021 - RNA, 104 nt, Mus musculus
uuuguagaaguuauuuugugagccagucuccaaagguuuaaguucauuuugagaguaaauugguccauugcuuugacagcaggugauuuuagcaugaagaguag

SEQ ID NO: 82022 - RNA, 75 nt, Mus musculus
uccaugccuuuauccauaaauguuacacgggauucaagccaagacaaggagagccaggcauagcgcguuccuaua

SEQ ID NO: 82023 - RNA, 71 nt, Mus musculus
auuucaucccauagacaggaaugcugauuucuaguuggaggcuagccugguuucacagacauuguaggagu

SEQ ID NO: 82024 - RNA, 38 nt, Mus musculus
uucuucgauguuugcuucuuuuaaagacagacagagac

SEQ ID NO: 82025 - RNA, 68 nt, Mus musculus
uaguuaguguuaggcuaguuuuuaaauuaaugauguuagaaguaaguuguuagaauaggcccagagaa

SEQ ID NO: 82026 - RNA, 50 nt, Mus musculus
gucugagggaauuuguguggcauaguuaagaaugcugaacagaaguaauu

SEQ ID NO: 82027 - RNA, 46 nt, Mus musculus
gauuauucagcacuauuagaaaaaugaaaagugaaagucggguaag

SEQ ID NO: 82028 - RNA, 46 nt, Mus musculus
cccauaaucuggauuccuucgcuguuucucaccuucccauucccug

SEQ ID NO: 82029 - RNA, 42 nt, Mus musculus
agagcaagcuagacacagguaaaaacagaacaagccagagaa

SEQ ID NO: 82030 - RNA, 46 nt, Mus musculus
auaggugcauguaugucuguauccaacauguaugcaauacucugag

SEQ ID NO: 82031 - RNA, 42 nt, Mus musculus
aucccagcaaccacauggugacucauaaccauccguaaugac

SEQ ID NO: 82032 - RNA, 45 nt, Mus musculus
aaaucccagcacccacaugguggcucacaaccaucuguaauagga

SEQ ID NO: 82033 - RNA, 46 nt, Mus musculus
aaaaacaaaaacaaacaaacaaaaaaaccuuccuuuugggccagag

SEQ ID NO: 82034 - RNA, 46 nt, Mus musculus
cuagauuuccuaccacccagaagugccugaauucuugaaggagugu

SEQ ID NO: 82035 - RNA, 46 nt, Mus musculus
cuuuucguuauuuuuauuguuuauuugcuaaguauucaugagaaag

SEQ ID NO: 82036 - RNA, 48 nt, Mus musculus
auaaacauaaagaucugaugucaacacuugauacaguuuuuucaguga

SEQ ID NO: 82037 - RNA, 45 nt, Mus musculus
cuuuuccuuucacugaaaaaacuguaucaaguguugacaucagau

SEQ ID NO: 82038 - RNA, 45 nt, Mus musculus
guaagccagcucugucugucaagaugcccaggcuguguggcagug

SEQ ID NO: 82039 - RNA, 45 nt, Mus musculus
gacaucgguagaacagacuaaaagcuggaacagggcuccauuuag

SEQ ID NO: 82040 - RNA, 45 nt, Mus musculus
cugagcauguccauauuauccagcaaugcugaauguguaacagau

SEQ ID NO: 82041 - RNA, 41 nt, Mus musculus
uguuucgccugcauguguaucugcauaccacaugugugccu

SEQ ID NO: 82042 - RNA, 46 nt, Mus musculus
ugaggcaaaauuuauauauuuuuaauuauguguauugggggcaggu

SEQ ID NO: 82043 - RNA, 46 nt, Mus musculus
gaacuacacagagaaaccuuguuugggggaagaaagaaaagaagga

SEQ ID NO: 82044 - RNA, 45 nt, Mus musculus
guguacuauauacauaaaauaaauaaaucuuugugaaaaggagga

SEQ ID NO: 82045 - RNA, 23 nt, Mus musculus
ugcuaguauaaaaaauuggggaa

SEQ ID NO: 82046 - RNA, 42 nt, Mus musculus
aguaauacagcugauucccccaccaaaauaaccagcagccac

SEQ ID NO: 82047 - RNA, 46 nt, Mus musculus
auuagagucaggcauggaaguacaugccuuuagucccagcagucaa

SEQ ID NO: 82048 - RNA, 46 nt, Mus musculus
uuaagagaacaaccacuauccagauaaacgacuguaucgggcuuca

SEQ ID NO: 82049 - RNA, 42 nt, Mus musculus
ugaagacgacgaggccccagugggaguggagauggcagagaa

SEQ ID NO: 82050 - RNA, 46 nt, Mus musculus
ucuugcccuuuccccuggugucugucucuggccauagcgugguacu

SEQ ID NO: 82051 - RNA, 46 nt, Mus musculus
aaaucccaacaaccacaugguagcucacaaccaucuguaaugagau

SEQ ID NO: 82052 - RNA, 46 nt, Mus musculus
ucgguuuccucugggagggguuuauaguuuucucuggccagcauag

SEQ ID NO: 82053 - RNA, 44 nt, Mus musculus
uacuaucaccugaaaucccccuucucugucacaacacuccagau

SEQ ID NO: 82054 - RNA, 42 nt, Mus musculus
cucucaugcuggaauuaaaagcacacaccauugcacccaacu

SEQ ID NO: 82055 - RNA, 45 nt, Mus musculus
cuugacaacuuagacucaaacuuaaaaacaaaauguggguggaaa

SEQ ID NO: 82056 - RNA, 46 nt, Mus musculus
uuacaagugggugauuaucagguuuugacuuuuauugcuaguaguc

SEQ ID NO: 82057 - RNA, 44 nt, Mus musculus
ccccugccucacaccugaccuaagugucucuccuuagcagcaga

SEQ ID NO: 82058 - RNA, 45 nt, Mus musculus
uuaggaagugcucaagaccaugcccucucucaagaauccucagag

SEQ ID NO: 82059 - RNA, 57 nt, Mus musculus
agaacuggguucaguggaaaaaugccaaggaugaacaaggagaucugaagugcgggg

SEQ ID NO: 82060 - RNA, 45 nt, Mus musculus
aaguaaguuuaauagguugaauuuuuuggaauucucacaggggag

SEQ ID NO: 82061 - RNA, 45 nt, Mus musculus
uguuuaaaaaugggauauuauuuuauugugucuuuuguugggagg

SEQ ID NO: 82062 - RNA, 23 nt, Mus musculus
augagaugguuuuagagggugaa

SEQ ID NO: 82063 - RNA, 42 nt, Mus musculus
uuuauuaguuuucugauuaaaagcuuuguaggagcccaaauu

SEQ ID NO: 82064 - RNA, 36 nt, Mus musculus
gcugaaggucgucauagacggcugaagucagaagau

SEQ ID NO: 82065 - RNA, 46 nt, Mus musculus
uggugaucuugagucagaagcaguaucaacuccacacagcugggaa

SEQ ID NO: 82066 - RNA, 42 nt, Mus musculus
aaguaaagcccuucuuccuguggcuucuuaugauguccagaa

SEQ ID NO: 82067 - RNA, 42 nt, Mus musculus
cgauuacaucuguucuaagucuguuggccuucgggggcaagu

SEQ ID NO: 82068 - RNA, 41 nt, Mus musculus
caggagaucugugccuuccucugaccucugugguacacaga

SEQ ID NO: 82069 - RNA, 24 nt, Mus musculus
uuugguuuaguuucucuggccagu

SEQ ID NO: 82070 - RNA, 45 nt, Mus musculus
uaaugugguaucuuuagcaagugcuccugcugcccagcccacagc

SEQ ID NO: 82071 - RNA, 80 nt, Mus musculus
caaccacaugguggcucacaaccacccguaaugggaucugccacccucuucuggugugucugaagacagcuacaguguac

SEQ ID NO: 82072 - RNA, 46 nt, Mus musculus
uaggauugcauagagagacccugucucaaaacagcagcagccacaa

SEQ ID NO: 82073 - RNA, 45 nt, Mus musculus
gaugagcuugaguucaacugacagacacuccuuuaaugaguaaga

SEQ ID NO: 82074 - RNA, 37 nt, Mus musculus
agcacauacaugucgguguaggugcaugcaugccgug

SEQ ID NO: 82075 - RNA, 46 nt, Mus musculus
uuguaaaaccucagcaaucccucaguaucaucuagccaugucagau

SEQ ID NO: 82076 - RNA, 45 nt, Mus musculus
guacugaugaucauuugaaaacuacuguuuuaaaauacuucauga

SEQ ID NO: 82077 - RNA, 46 nt, Mus musculus
caauuauuuugcuguuggggaagggguauuuuugcuuuguuuugag

SEQ ID NO: 82078 - RNA, 46 nt, Mus musculus
augcagacauacagacauacaagauaaauaaacaugaaagagaaaa

SEQ ID NO: 82079 - RNA, 46 nt, Mus musculus
aaaucccagcgaccacaugguggcucacaaccaucuguaacgagau

SEQ ID NO: 82080 - RNA, 47 nt, Mus musculus
uuuuuggccaaaaacaugcaaauuuauuuuauaggaaauaaagaaga

SEQ ID NO: 82081 - RNA, 45 nt, Mus musculus
uaugaaacuaugucaggggugguaaauuaaguauaguuuguagaa

SEQ ID NO: 82082 - RNA, 46 nt, Mus musculus
aacaaaagaaaaucugugguuuuuauaucuuuuaauggggcagcag

SEQ ID NO: 82083 - RNA, 45 nt, Mus musculus
ggccuuaaaggaaaagaaagacuucccuuuaaaaucuggagagga

SEQ ID NO: 82084 - RNA, 46 nt, Mus musculus
uggaagaaagaagcugcgcugcgggcuguaguuacugugaaaugua

SEQ ID NO: 82085 - RNA, 46 nt, Mus musculus
gugagugauucuugauuccguguuugagauauuuggguaguaagau

SEQ ID NO: 82086 - RNA, 41 nt, Mus musculus
guagcagaaauuacaugaaaauguuucugaaggggaguaga

SEQ ID NO: 82087 - RNA, 46 nt, Mus musculus
uugcaucaaauauuagaauuaaagaagaaccuuuggaugaugagua

SEQ ID NO: 82088 - RNA, 36 nt, Mus musculus
uuaaacuauuauuugcauaaugacaucuugggagau

SEQ ID NO: 82089 - RNA, 46 nt, Mus musculus
ucagaaaauccuaggaaaaauguauuuuagaaagagggaaccagua

SEQ ID NO: 82090 - RNA, 45 nt, Mus musculus
uaggacagauuugaguauguaguuaugaaggcuagcaggauagcu

SEQ ID NO: 82091 - RNA, 46 nt, Mus musculus
gagaaaugaaauauuacaguugauagaacuuauucaugggagaguu

SEQ ID NO: 82092 - RNA, 45 nt, Mus musculus
aauccugguccucugaaagaacaguaaguucuuuuaacugcagag

SEQ ID NO: 82093 - RNA, 41 nt, Mus musculus
caggugugugugugugugugugugugugugugugcaagcau

SEQ ID NO: 82094 - RNA, 46 nt, Mus musculus
gcugaagugacugguuaaaaguguaguuuugagccccaaauuggag

SEQ ID NO: 82095 - RNA, 46 nt, Mus musculus
uuuaaaagccacacaaaaaaaaaaaccauaguagugugugagagug

SEQ ID NO: 82096 - RNA, 68 nt, Mus musculus
cucggcuacccugucuuguaaaacagaaaaacauaagaaagagagagagagagagagagagagagaga

SEQ ID NO: 82097 - RNA, 42 nt, Mus musculus
gaaagcaguuuuguuuggacuuucagaugggugggcccucac

SEQ ID NO: 82098 - RNA, 46 nt, Mus musculus
cccuguccuaauaaauuaaaaggaaacgaaggaaucuaggcaaaua

SEQ ID NO: 82099 - RNA, 45 nt, Mus musculus
agcagucagugcucuuaaccacugagccauuucuucagcacuucu

SEQ ID NO: 82100 - RNA, 45 nt, Mus musculus
gcugguuaguuucaugucaacuugauacaaguuaauaguccucaa

SEQ ID NO: 82101 - RNA, 45 nt, Mus musculus
gagguaccauaggacuauuguaccuacuugcuuuacuguuuugca

SEQ ID NO: 82102 - RNA, 45 nt, Mus musculus
auucucucauauaccugaagaaguaaucccaucauuugugccaga

SEQ ID NO: 82103 - RNA, 45 nt, Mus musculus
gcagccaaugcucuuaaccccuaaaccaucucucuagccccaaau

SEQ ID NO: 82104 - RNA, 46 nt, Mus musculus
aaauuguguauaggugucucauuuuccuguguguguggaguuagaa

SEQ ID NO: 82105 - RNA, 45 nt, Mus musculus
aagugggguugucgucuugaaguugggggaauguguucugauagc

SEQ ID NO: 82106 - RNA, 43 nt, Mus musculus
auccucgaggaaaagggagucuauggaaguuucucuggggaga

SEQ ID NO: 82107 - RNA, 43 nt, Mus musculus
uggggccgcgguucugguugaggcccaugcccggcggcggaga

SEQ ID NO: 82108 - RNA, 42 nt, Mus musculus
ggggacaaaauggaggcccucuaggcugcgggcgggggggaa

SEQ ID NO: 82109 - RNA, 48 nt, Mus musculus
ucuugcugcuggcuuggaagcaaacucaacaaugccuuucccuguaga

SEQ ID NO: 82110 - RNA, 46 nt, Mus musculus
gucaucuaacuguucaagugguuccacaaugacugggcgaggaguc

SEQ ID NO: 82111 - RNA, 46 nt, Mus musculus
auaguucuagaauagccagaacuaggcaaagaaacccugugggggg

SEQ ID NO: 82112 - RNA, 46 nt, Mus musculus
acccugucucaaaagaaaacaagagucauagggauaugguccaguu

SEQ ID NO: 82113 - RNA, 48 nt, Mus musculus
aagugucauccaugccuaaaacuuaagaagccaagugugaugauggcc

SEQ ID NO: 82114 - RNA, 47 nt, Mus musculus
aguauaaacauucagacaagccacauaacuugaacuuuuuguaagau

SEQ ID NO: 82115 - RNA, 45 nt, Mus musculus
uucguuuacauucaaaaucgcugagccacgguaacaggcaccugc

SEQ ID NO: 82116 - RNA, 46 nt, Mus musculus
ucaaauuaacuagcaguacucuaccuuaagucaauaguuucuagau

SEQ ID NO: 82117 - RNA, 45 nt, Mus musculus
aacagcccaaaacaaacaccccauagcucuaaaaccuguccaaga

SEQ ID NO: 82118 - RNA, 46 nt, Mus musculus
cuaaaaguguauucuuccaucuuguggguuuuuaaaagaacaaguu

SEQ ID NO: 82119 - RNA, 49 nt, Mus musculus
gggugggcacgggucuggaaggaaaggaggaaggggagaugagaucagg

SEQ ID NO: 82120 - RNA, 43 nt, Mus musculus
aucccagcaaccacaugguggcucaaccauccguuaacgagau

SEQ ID NO: 82121 - RNA, 24 nt, Mus musculus
agaaaccggucuuaaaaaaacaaa

SEQ ID NO: 82122 - RNA, 42 nt, Mus musculus
cacacauuuuauuccagacuuggaaagcagaggcaggcagau

SEQ ID NO: 82123 - RNA, 45 nt, Mus musculus
agacuaaauagauuucaugggugugaucgucuccuucuggaaaca

SEQ ID NO: 82124 - RNA, 45 nt, Mus musculus
uucccagcaaccacaugguggcucacaaccaucugcaaugcaauc

SEQ ID NO: 82125 - RNA, 41 nt, Mus musculus
cacuugcuuagcaugcacacagcucuggaucaggccucaga

SEQ ID NO: 82126 - RNA, 24 nt, Mus musculus
gugaguaggaggcugugcugaucu

SEQ ID NO: 82127 - RNA, 73 nt, Mus musculus
uguguacauuucuuacacuagaggaaacaguccucagcaugcgucuagauagaauuauaccuuuagucccagu

SEQ ID NO: 82128 - RNA, 46 nt, Mus musculus
aggcugauugagcuuugguucucagcuaccugccuuguugaaagaa

SEQ ID NO: 82129 - RNA, 43 nt, Mus musculus
ugguaacauacuuaacgucccuagaaugcauaaggcccagauu

SEQ ID NO: 82130 - RNA, 45 nt, Mus musculus
cuguugagcaggaacugguaaauaaacugauggaaccugaaagac

SEQ ID NO: 82131 - RNA, 46 nt, Mus musculus
uacuucagcagaugaacaauauaaauuuaauauuuacuaccaaggu

SEQ ID NO: 82132 - RNA, 45 nt, Mus musculus
aaacccucuuuucaaaaaagaagaaaaguucaaagaacaguagau

SEQ ID NO: 82133 - RNA, 90 nt, Mus musculus
cuguggcugccgagcuggaggaccuguuggccaugguuaccaaguuugaauuuauauuuuguuugaaauuucuuuaucgaguacucagua

SEQ ID NO: 82134 - RNA, 46 nt, Mus musculus
cccacgaccauuugcugcuggccgugacggacugccuuccggaggu

SEQ ID NO: 82135 - RNA, 46 nt, Mus musculus
ugacugccgaggaggugacugggguccacgugcaugggcggaucaa

SEQ ID NO: 82136 - RNA, 45 nt, Mus musculus
uucccacguggacuucuauagcagcacgcuuguccaggaggagau

SEQ ID NO: 82137 - RNA, 49 nt, Mus musculus
auaaaggcaguuuuuuggaauugcuagaacuuagagcaagagauagagg

SEQ ID NO: 82138 - RNA, 46 nt, Mus musculus
ugcugacugggagaaaaugcugggaaauuucagaaagcaugaagaa

SEQ ID NO: 82139 - RNA, 45 nt, Mus musculus
gcugugucucucaaaguccacauuaacagaacagaacauuaagac

SEQ ID NO: 82140 - RNA, 57 nt, Mus musculus
uucaguaugaguuauauguuauuguuuuuucaagauaugguuucuugggggggggag

SEQ ID NO: 82141 - RNA, 32 nt, Mus musculus
uuagagacauuuuaagucuaaaggauaugaag

SEQ ID NO: 82142 - RNA, 45 nt, Mus musculus
uaaaugcuuguuaauagaacaauaaauauauaaaguaacuuauga

SEQ ID NO: 82143 - RNA, 46 nt, Mus musculus
caggucauaaucuaccacugaaggaagggcaggaacugagaccaca

SEQ ID NO: 82144 - RNA, 45 nt, Mus musculus
ugucucgaaaaaccaaaaaaaaaaaagagagagagagagagagaa

SEQ ID NO: 82145 - RNA, 71 nt, Mus musculus
cuccucucaaaaggaugugcuuaaauugcucaagguauggaagucuaagcaaggccuuuuauuuugcugca

SEQ ID NO: 82146 - RNA, 105 nt, Mus musculus
aggaggccagaagcugggguuaaaucucuugaaacuggaguuacaggugcugggaacugaacccagguccucuguaagagcaacaaagugcccuuaaccaaugaa

SEQ ID NO: 82147 - RNA, 46 nt, Mus musculus
cuacuuaaugagaccuggauucaaaaaacaaaaacaucgggcugga

SEQ ID NO: 82148 - RNA, 45 nt, Mus musculus
cucuuuuuuuuuuuuuaauauaaaugcuuuauuuaacaguugcag

SEQ ID NO: 82149 - RNA, 41 nt, Mus musculus
caugcucacccuauuggagucagaaagagaagcucgaaggu

SEQ ID NO: 82150 - RNA, 42 nt, Mus musculus; identical to SEQ ID NO: 66281

SEQ ID NO: 82151 - RNA, 42 nt, Mus musculus
agcuugaugggcugcacgugacucguguccaugauggcggcg

SEQ ID NO: 82152 - RNA, 41 nt, Mus musculus
aguagccugcuggcuguggggggaagucgugguguugggga

SEQ ID NO: 82153 - RNA, 45 nt, Mus musculus
ugagcgugcaugugaugagggugucaccgugugggucugugggug

SEQ ID NO: 82154 - RNA, 46 nt, Mus musculus
guggggucuacuucuguacccagcugucagugccuaaaagagagag

SEQ ID NO: 82155 - RNA, 49 nt, Mus musculus
ccuugucaucccagggggaugagagccaaaugucaggacaugcagauga

SEQ ID NO: 82156 - RNA, 44 nt, Mus musculus
ccugggggaugggggaagcuuccuguauuaugagugggucugug

SEQ ID NO: 82157 - RNA, 24 nt, Mus musculus
augcugugauguuuagggguguuu

SEQ ID NO: 82158 - RNA, 45 nt, Mus musculus
gagguaaaaggugagugggcgguuugagguauguguguggccaug

SEQ ID NO: 82159 - RNA, 33 nt, Mus musculus
aagaggcguuagcaucugcucugucuugggcuu

SEQ ID NO: 82160 - RNA, 46 nt, Mus musculus
agaaagaaagagagagagagagagagagagagagagagagugagug

SEQ ID NO: 82161 - RNA, 42 nt, Mus musculus
uucuagaucacagacgaacacaggccuagucacugcccccuu

SEQ ID NO: 82162 - RNA, 46 nt, Mus musculus
agaacccaggggaagauaagguuagacuuucguuagagugagcggu

SEQ ID NO: 82163 - RNA, 45 nt, Mus musculus
gucuugggcugguuuggcugaaacagagagagcaaguaagggugg

SEQ ID NO: 82164 - RNA, 45 nt, Mus musculus
gacagccacagaaucauacagauuuaaaauggcaacuagauaaga

SEQ ID NO: 82165 - RNA, 54 nt, Mus musculus
gagaaagcgucccugaagaaaugacaaccgagcugagaucugaaggggaaaccg

SEQ ID NO: 82166 - RNA, 50 nt, Mus musculus
agggaucauggaacugaaaaagggcuggcuuggcugaagcagagagagcg

SEQ ID NO: 82167 - RNA, 46 nt, Mus musculus
ucuccuugauugguucucccucccauucacuguauuuagcgaugag

SEQ ID NO: 82168 - RNA, 42 nt, Mus musculus
caaggucauuuuuggcuguguaaggaauucagagcuggcuug

SEQ ID NO: 82169 - RNA, 41 nt, Mus musculus
uugcuugaacaccuguaaucccaacacucaagcggcggggg

SEQ ID NO: 82170 - RNA, 45 nt, Mus musculus
cugagaccaaagcuaagggaacauggauuggugagaacgagagag

SEQ ID NO: 82171 - RNA, 43 nt, Mus musculus
ugucugacugugucucuuucacuauuauuaaucaugcccccaa

SEQ ID NO: 82172 - RNA, 46 nt, Mus musculus
auccaagccagacuaauauuuugucaccucuccugcacagccacuu

SEQ ID NO: 82173 - RNA, 45 nt, Mus musculus
cucguuucugugacauggcauccuccugacucccucccaccccuc

SEQ ID NO: 82174 - RNA, 59 nt, Mus musculus
aucucuuugugucugccuccagcuggucuuuaccaguaaaccccaagacuuugcauaac

SEQ ID NO: 82175 - RNA, 45 nt, Mus musculus
ccuggcccaacucagggugcuuaacucugaaccugucaccccucc

SEQ ID NO: 82176 - RNA, 52 nt, Mus musculus
gccaucuuggauuccucccaggcuccucuuccucccccacuaaucaggcuca

SEQ ID NO: 82177 - RNA, 42 nt, Mus musculus
cgcaggaugcggagcggcagcuacaucaaagccaugggggau

SEQ ID NO: 82178 - RNA, 42 nt, Mus musculus
cgggcucugucuaggcugugaugucagucucuguguggagag

SEQ ID NO: 82179 - RNA, 46 nt, Mus musculus
ccuugcacaucugugguaauacuguacuacugcguuauagccccag

SEQ ID NO: 82180 - RNA, 46 nt, Mus musculus
uuuaacuuuuuuauuuaaagaaaaugauuuuuguuguugccacugu

SEQ ID NO: 82181 - RNA, 41 nt, Mus musculus
ugagccacgaugugguugcuugagauucgaacucaggacca

SEQ ID NO: 82182 - RNA, 46 nt, Mus musculus
ugaaauuuuguuuuaauauaaaaugaaaucuccacuuuaacccaag

SEQ ID NO: 82183 - RNA, 45 nt, Mus musculus
uugcacacauugaggaaauacucuacuacggagcuacacccccag

SEQ ID NO: 82184 - RNA, 46 nt, Mus musculus
agacaggguguuucgaauuugaccuugaacucagucugcagcccag

SEQ ID NO: 82185 - RNA, 84 nt, Mus musculus
ccacuccauuggcguucagguggaagaggacaagagguaggucagagugugucucucgggugucguugggguuugagggugaag

SEQ ID NO: 82186 - RNA, 46 nt, Mus musculus
uuuugccuacuuauauauccauauaccgugugcaugcaggaucccu

SEQ ID NO: 82187 - RNA, 46 nt, Mus musculus
gaacaaccaguguucuuaaccauugacccaucucuccagcccccaa

SEQ ID NO: 82188 - RNA, 89 nt, Mus musculus
ggcugauagcagccaagccagggagaaguuggaccaaguggagcaguugaaaggcaaggggaagcugggcugacagggaaugugguaag

SEQ ID NO: 82189 - RNA, 46 nt, Mus musculus
auagcauuuuaccuugccuguauuagccaccccaccccaccccccg

SEQ ID NO: 82190 - RNA, 45 nt, Mus musculus
aucccaagaggccaccuguccagcuuaaaaucaugggauccuguu

SEQ ID NO: 82191 - RNA, 46 nt, Mus musculus
uggaaggaagcaggcaggcaggcuuggagagaaggccugggccaca

SEQ ID NO: 82192 - RNA, 46 nt, Mus musculus
ucccauaggacccuggucuguuuugaccaugaggagguggagguag

SEQ ID NO: 82193 - RNA, 46 nt, Mus musculus
cuauuucaacuucuguuccccuuugcccucccuacccgccaccuaa

SEQ ID NO: 82194 - RNA, 24 nt, Mus musculus
uacgcaacuucuccugucucagaa

SEQ ID NO: 82195 - RNA, 42 nt, Mus musculus
uuaccgaagagaagguuguguuguauacauggaugacuggaa

SEQ ID NO: 82196 - RNA, 37 nt, Mus musculus
ggaccugugaucacaagcacuuggcacuggaaacagg

SEQ ID NO: 82197 - RNA, 46 nt, Mus musculus
ugugcuuucccccaggagaaggaacuacuuaucaucagggagccag

SEQ ID NO: 82198 - RNA, 45 nt, Mus musculus
aagauguugacagauaucuggaagagaggaccugaggucauacca

SEQ ID NO: 82199 - RNA, 42 nt, Mus musculus
gaaugguucaucaggggaaagacuccucagccuguggaggag

SEQ ID NO: 82200 - RNA, 45 nt, Mus musculus
ccaggaccuuggaggcaugcguauccugucauauccccggcguau

SEQ ID NO: 82201 - RNA, 46 nt, Mus musculus
ggaucucagaggagaggugcuggcuuuggacuggggacagccagcc

SEQ ID NO: 82202 - RNA, 73 nt, Mus musculus
cguguccgucuaugcuggucauccugcauguagccuaccgcgaggagcgggaacggaagcaucgccagaagca

SEQ ID NO: 82203 - RNA, 42 nt, Mus musculus
gcauagacggacacgugacgaagaugagcugcagggcccaga

SEQ ID NO: 82204 - RNA, 45 nt, Mus musculus
gucaaagucuuuuugcucgucaccccacacacgcucggcagccac

SEQ ID NO: 82205 - RNA, 46 nt, Mus musculus
ugcugguguaugugguggcugccgagcguguguggggugacgagca

SEQ ID NO: 82206 - RNA, 42 nt, Mus musculus
caggugggcacagccccccgaacccugagcaggcaccaugga

SEQ ID NO: 82207 - RNA, 105 nt, Mus musculus
guaacuguaguuccaggggaccugacacccaacuccugccuccaccgacgccaggcacacaugcggagcauagaaaugcaugcaggcaaaacucaugcacauaaa

SEQ ID NO: 82208 - RNA, 47 nt, Mus musculus
gcauuccaggcgggaggaaucaaggccaggucugagcagagagaggc

SEQ ID NO: 82209 - RNA, 45 nt, Mus musculus
gcuugagaguggaguucucagagaggcugugggagggcugggcag

SEQ ID NO: 82210 - RNA, 46 nt, Mus musculus
cacuuacuuuuaaaccuuccagggagggccaaagauuagcaccugg

SEQ ID NO: 82211 - RNA, 46 nt, Mus musculus
ggguaccggguggaaggaacuccuccuccccuucacucuccuugag

SEQ ID NO: 82212 - RNA, 41 nt, Mus musculus
uuuggugcaggcuaccuagucccuucuaagacacaccccga

SEQ ID NO: 82213 - RNA, 45 nt, Mus musculus
cguuugcaguugcgugcuucucuguugcugugauaaaacacagau

SEQ ID NO: 82214 - RNA, 46 nt, Mus musculus
cauagucaugcuaccuagaggaugagggucacaggaaggggcauuu

SEQ ID NO: 82215 - RNA, 46 nt, Mus musculus
uuauuuauuauauguaagugcacuguaacugucuucagacacucaa

SEQ ID NO: 82216 - RNA, 46 nt, Mus musculus
ggaaagaaaauaauggggaaaaggggguuaaagggaugagggaggg

SEQ ID NO: 82217 - RNA, 50 nt, Mus musculus
gggauaugucaaguugacaggugaaggugacugagagaagggagaaucuc

SEQ ID NO: 82218 - RNA, 45 nt, Mus musculus
uaacagcaagguaaguaacuugucugaauuugugagugguagagc

SEQ ID NO: 82219 - RNA, 88 nt, Mus musculus
uacccagggaggugcagaccugggugcaggcacgacaccccgagagcggagaggaggcgguggcccugguggaggauuggcaccgaga

SEQ ID NO: 82220 - RNA, 41 nt, Mus musculus
acccgagaaggagagccacagccccgucccuggccccgagg

SEQ ID NO: 82221 - RNA, 41 nt, Mus musculus
ccccuugaaggacacauugucaaugcaggaagcagccagau

SEQ ID NO: 82222 - RNA, 41 nt, Mus musculus
uaauaaaagauagugccacgggaaggugggagucggggaga

SEQ ID NO: 82223 - RNA, 24 nt, Mus musculus
agcagggaugguggccgggcauga

SEQ ID NO: 82224 - RNA, 43 nt, Mus musculus
uguggagaugggcagggucaccgaggggucgggaugaagagug

SEQ ID NO: 82225 - RNA, 47 nt, Mus musculus
aggugagaggggaaagcaagcaucguggcgugugugugugugugugu

SEQ ID NO: 82226 - RNA, 42 nt, Mus musculus
uugagaagugggugucucugugggugagucuggguggcggau

SEQ ID NO: 82227 - RNA, 44 nt, Mus musculus
uauguacagaacccagagaagcccccuuccacaucacccccaga

SEQ ID NO: 82228 - RNA, 85 nt, Mus musculus
uuuguuuuggaaauaacaaaaaggauauuuauuggccagaauguuggugcugcuaagaacgggaaauuaaaaggacuggacagac

SEQ ID NO: 82229 - RNA, 46 nt, Mus musculus
uucacugaccacugagccagacacuaaggagacagaaaacgcagau

SEQ ID NO: 82230 - RNA, 46 nt, Mus musculus
auccuggcugcgaaaaggcuuucacucagcucuccaaccuccaggu

SEQ ID NO: 82231 - RNA, 46 nt, Mus musculus
aagaaguaguggaagugugauucacuacauggccugggcuucagga

SEQ ID NO: 82232 - RNA, 45 nt, Mus musculus
caggaagcaaaacaacauaauggagucugucaacauuuagaagau

SEQ ID NO: 82233 - RNA, 39 nt, Mus musculus
cuuuggauaggacugcauggcucugccccaucagcaaga

SEQ ID NO: 82234 - RNA, 45 nt, Mus musculus
ggucacgguuacaaauuugauuuagacaguuguauccuguuagga

SEQ ID NO: 82235 - RNA, 45 nt, Mus musculus
gagaaaggcuuagaaggucuaguugguguguuccaugcguucgga

SEQ ID NO: 82236 - RNA, 46 nt, Mus musculus
gaacaggcaccaguaccccguccacacccaccaccaccagccagag

SEQ ID NO: 82237 - RNA, 45 nt, Mus musculus
gacccuucaugggcccagguggcucugaagggaauggccuggugg

SEQ ID NO: 82238 - RNA, 42 nt, Mus musculus
cuacaacccacuaugggcuguguguccucuguguccccagga

SEQ ID NO: 82239 - RNA, 46 nt, Mus musculus
ggagugugccacacuucagaaauguccacagcaucuuucuugagag

SEQ ID NO: 82240 - RNA, 46 nt, Mus musculus
ggaaguauggguauggaggagucagagagcuuaucucuguggaguu

SEQ ID NO: 82241 - RNA, 46 nt, Mus musculus
gggggcaguugaacucauuuuaaaauuaagaaacugaggcuuagag

SEQ ID NO: 82242 - RNA, 46 nt, Mus musculus
aaguuuugguagcccccucuuggggcaagucugguugauugcagug

SEQ ID NO: 82243 - RNA, 66 nt, Mus musculus
aaauuugcaguuagccggguauuggugacacauaccuuugaucccagcacuugggaggcaaaagca

SEQ ID NO: 82244 - RNA, 45 nt, Mus musculus
ccuaaacuguggcagaacugcacugauacuuugguugcccagaga

SEQ ID NO: 82245 - RNA, 48 nt, Mus musculus
ggagcagcuggcaugugaccaguacugcagcaggcagagcaaggggcc

SEQ ID NO: 82246 - RNA, 42 nt, Mus musculus
accucugaaccuaaagaaagcacggcacacuuggugucagac

SEQ ID NO: 82247 - RNA, 45 nt, Mus musculus
cagcaguagcugggggcuuuacauccugauucccaggcagagaga

SEQ ID NO: 82248 - RNA, 45 nt, Mus musculus
cccccuaaauucucugacuucugagccauggccuucugaccaggu

SEQ ID NO: 82249 - RNA, 48 nt, Mus musculus
aggaagggugagaauuacuggugcagacaaauauuuagaaggcauuuu

SEQ ID NO: 82250 - RNA, 42 nt, Mus musculus
uucuggaccaggccagcagggaagguggguguggugccagau

SEQ ID NO: 82251 - RNA, 45 nt, Mus musculus
aaccaaaucaaauccacucccugauuucauaagcguugaccagau

SEQ ID NO: 82252 - RNA, 28 nt, Mus musculus
gacagaucugcaucugggaugugagcug

SEQ ID NO: 82253 - RNA, 46 nt, Mus musculus
accuguccacuuguuuggugcacagucucauauccucacccccacc

SEQ ID NO: 82254 - RNA, 42 nt, Mus musculus
uuuucugcaaaugaucucacucucgaaacagcgcugcgaggu

SEQ ID NO: 82255 - RNA, 23 nt, Mus musculus
agguggaggaugaguggaagaac

SEQ ID NO: 82256 - RNA, 47 nt, Mus musculus
cuuucuagaaaacucaacaaugagcaugugugcuguuguagguggga

SEQ ID NO: 82257 - RNA, 41 nt, Mus musculus
accuggcagggggcauggugggaacacaggaggcuugggau

SEQ ID NO: 82258 - RNA, 41 nt, Mus musculus
uggcugcugggcgcgcggggcgcaggccgcggggccggagc

SEQ ID NO: 82259 - RNA, 46 nt, Mus musculus
uccccugugagauccuaacuaacacuauccucacuuuuuuucagac

SEQ ID NO: 82260 - RNA, 46 nt, Mus musculus
uagggauagugugaauauucacacaaaaggggaguaggggguggaa

SEQ ID NO: 82261 - RNA, 47 nt, Mus musculus
gagugagugagggaaagagggaggagggaaagaaagauagaggaaaa

SEQ ID NO: 82262 - RNA, 45 nt, Mus musculus
aagcaggugugaugucauagaugccaagacaauuuguuugcaaga

SEQ ID NO: 82263 - RNA, 46 nt, Mus musculus
aggcuuacagugauucacuugucuagcaugccuuaaggagaugggg

SEQ ID NO: 82264 - RNA, 45 nt, Mus musculus
aaaacaacaaaaacaaaacucaaaaccacacacacaaacucagaa

SEQ ID NO: 82265 - RNA, 52 nt, Mus musculus
cuggaguuacucuguugcuuaaguucuuucaaugagagagagagagagagag

SEQ ID NO: 82266 - RNA, 46 nt, Mus musculus
uuggucuugcaaagauuauauaccccaauacaggggaacaccaggg

SEQ ID NO: 82267 - RNA, 46 nt, Mus musculus
augucaucuucucuauaaaauguacucuccaggcugauagcgagcu

SEQ ID NO: 82268 - RNA, 31 nt, Mus musculus
ugcagugguagcagaacucagucuggcagcc

SEQ ID NO: 82269 - RNA, 44 nt, Mus musculus
agagaucucuuucaugcaaagccagcagaauucacagccacaca

SEQ ID NO: 82270 - RNA, 45 nt, Mus musculus
ugccgaugaccauggcgggaauugcaaugccagcaaugagugaga

SEQ ID NO: 82271 - RNA, 42 nt, Mus musculus
aagagagcacagcagugaauacuccagcaugugggggcaggg

SEQ ID NO: 82272 - RNA, 45 nt, Mus musculus
guugcaacagcuagacaaaagaaggaaaaggugggaaagagaugg

SEQ ID NO: 82273 - RNA, 41 nt, Mus musculus
aaggagcugcuacgcggcuggcuucacaaaggggggcggaa

SEQ ID NO: 82274 - RNA, 45 nt, Mus musculus
gcuuccuggcuagggggcgcuggcucgauggcaucaccaguagcc

SEQ ID NO: 82275 - RNA, 42 nt, Mus musculus
agcggccuucccuucuugggcagugcccucgucgcugcaggc

SEQ ID NO: 82276 - RNA, 46 nt, Mus musculus
guguggggccacucucugggcccgagggaguggauggcucugcagc

SEQ ID NO: 82277 - RNA, 67 nt, Mus musculus
cagugaccucacaaggacagcacaguuuuugcagcuuagagaucacccaccuguccccaccccuacu

SEQ ID NO: 82278 - RNA, 46 nt, Mus musculus
uggccuuaagaguaagaccaaauggcugaugggagaauccacagga

SEQ ID NO: 82279 - RNA, 48 nt, Mus musculus
ggcucaggggguugagaagcaggauaaacaaaacgaacuuggaaaaga

SEQ ID NO: 82280 - RNA, 52 nt, Mus musculus
cuugaguaagacauuuauaaaaacccagauggggcaauguccuccccagccc

SEQ ID NO: 82281 - RNA, 70 nt, Mus musculus
auuuacaacaaugggagggggaaaaaaaaagacaacaagaaguuguuucacauuacagaccucccucccu

SEQ ID NO: 82282 - RNA, 45 nt, Mus musculus
uggcugaaggugggauuuggggacagaaguuacaucagaauguca

SEQ ID NO: 82283 - RNA, 45 nt, Mus musculus
gccccgcaaguagacagcugugugccggacaccaccuagcugcag

SEQ ID NO: 82284 - RNA, 46 nt, Mus musculus
cugaucuaccuagugagauccaggcuagccagaguuagaaagugag

SEQ ID NO: 82285 - RNA, 41 nt, Mus musculus
ugcgaggauuaugggccuacaguaguuauuagccugccucc

SEQ ID NO: 82286 - RNA, 50 nt, Mus musculus
gccuccuucagcaucuccugggccugcuggagcuuggcguccacuagcug

SEQ ID NO: 82287 - RNA, 44 nt, Mus musculus
aaucccagcaaccacauggguggcucacaaccaucuguaacgag

SEQ ID NO: 82288 - RNA, 46 nt, Mus musculus
uugcuugguuucuauuauuuugguugccaauuauucagcuggucag

SEQ ID NO: 82289 - RNA, 45 nt, Mus musculus
ggucuccuucucgccguugacgacuggaaugccugguucaggcuc

SEQ ID NO: 82290 - RNA, 46 nt, Mus musculus
uccaacugccggcucagcuccucagagacgucacagagggccccag

SEQ ID NO: 82291 - RNA, 46 nt, Mus musculus
uucccaggagccuggcuuguggaaccuucggcuuccgccccaggag

SEQ ID NO: 82292 - RNA, 42 nt, Mus musculus
cuugguucuucauugugaucugcaaggccagaaauggggcag

SEQ ID NO: 82293 - RNA, 44 nt, Mus musculus
cggucccauggaagguuuccgagaagcugccccugagugaguga

SEQ ID NO: 82294 - RNA, 42 nt, Mus musculus
cgaauuaguuguuccucuacggccaacgcguccugggccaca

SEQ ID NO: 82295 - RNA, 46 nt, Mus musculus
gagaaugaaugaaugccagggacugggugugauccuguacuuuaug

SEQ ID NO: 82296 - RNA, 46 nt, Mus musculus
ccucaacuucagaucugcaaauguggggcacagagagaucugcugg

SEQ ID NO: 82297 - RNA, 42 nt, Mus musculus
cugagguacugaacugucuuuauucaagaaggagggagggag

SEQ ID NO: 82298 - RNA, 46 nt, Mus musculus
gcugauuuacuucauaaagguuccagaagugagaguuggucccaag

SEQ ID NO: 82299 - RNA, 45 nt, Mus musculus
gcagagggaccaggcauggugaaauaugcuugugugauuccaaua

SEQ ID NO: 82300 - RNA, 45 nt, Mus musculus
gagcuacgcagcuugcuugcccuuugccuugccccuaguuucuaa

SEQ ID NO: 82301 - RNA, 45 nt, Mus musculus
auaggguuucauauagucgacuauggcccugaacuagcugagccu

SEQ ID NO: 82302 - RNA, 45 nt, Mus musculus
agacagagacacagagagagagacagagagagagagagacagaga

SEQ ID NO: 82303 - RNA, 45 nt, Mus musculus
gggaauacacccacuugacauauucaaagaaaaccuggccagcaa

SEQ ID NO: 82304 - RNA, 48 nt, Mus musculus
uaacgaaaucugacucccucuucuggagugucugaagacaguguacuu

SEQ ID NO: 82305 - RNA, 45 nt, Mus musculus
uucauggcacacaguauaccaguagagugauccuccuagccccag

SEQ ID NO: 82306 - RNA, 46 nt, Mus musculus
ucccugccauugccgugacgguuacuuugccaggcugccugggcuu

SEQ ID NO: 82307 - RNA, 46 nt, Mus musculus
cccuggucagccaggccaagaccacaggagcuaagacaccccaacc

SEQ ID NO: 82308 - RNA, 51 nt, Mus musculus
cgcgcuaaggcagaaucccaccuaggagacaaagaugcaccaggcuggcgg

SEQ ID NO: 82309 - RNA, 47 nt, Mus musculus
uggcccccaaggccucuucuguggcuguggaucccaccucgccuagu

SEQ ID NO: 82310 - RNA, 41 nt, Mus musculus
gcacgauccggaaguggccccuuucaccccaccaugggccc

SEQ ID NO: 82311 - RNA, 47 nt, Mus musculus
guacugcuccggccuccccuggcuuacagguguguggcuguagaugc

SEQ ID NO: 82312 - RNA, 46 nt, Mus musculus
aggaugggugucaugugucccaaagaauggauagagacgcgaucag

SEQ ID NO: 82313 - RNA, 46 nt, Mus musculus
ugggcacaauccgcccauccuccacugucaugaauaugaaugagau

SEQ ID NO: 82314 - RNA, 41 nt, Mus musculus
uccagggucaugccccagaaggcacugugguucccagccug

SEQ ID NO: 82315 - RNA, 45 nt, Mus musculus
cucacguaucgaaagcuggccuugaacucucuauuuugccccaag

SEQ ID NO: 82316 - RNA, 46 nt, Mus musculus
ucugggacagggaugcugagugagcugaccugguuuggcaucagag

SEQ ID NO: 82317 - RNA, 45 nt, Mus musculus
acagggagaccauguguccgugggugcuggcaugugucuggguga

SEQ ID NO: 82318 - RNA, 41 nt, Mus musculus
caacucagaugcgucagagagguagagggaccaagggcagg

SEQ ID NO: 82319 - RNA, 45 nt, Mus musculus
gcacacugagggagaaggacccagggcagagaggcacagaggaga

SEQ ID NO: 82320 - RNA, 44 nt, Mus musculus
caauauaagaauaaaaccacagcgaauuaaaaaacaaggcggca

SEQ ID NO: 82321 - RNA, 45 nt, Mus musculus
agccacuccacuccaccccaccccaccccggccuccugggagggg

SEQ ID NO: 82322 - RNA, 46 nt, Mus musculus
cggccagccucccgcccuucuuucccuccccuuuccaccuccggau

SEQ ID NO: 82323 - RNA, 74 nt, Mus musculus
gcgggaggcuggccgcaggagaaggcaaagaggagcauggugguccagaaauugaauuccgaaagggaauagag

SEQ ID NO: 82324 - RNA, 59 nt, Mus musculus
ccaggcagucagcaacaagcccuaccccuccauguugggguagugaagaggccucucuc

SEQ ID NO: 82325 - RNA, 54 nt, Mus musculus
agugcuggggauagggugaagaaagccugggaucgagcagagggugucagaaga

SEQ ID NO: 82326 - RNA, 45 nt, Mus musculus
gagugcugguuaaaggcguugugucaccgcccacaccacacaauu

SEQ ID NO: 82327 - RNA, 120 nt, Mus musculus
gcuuggggcuggggaaauuguguggugugggcggugacacaacgccuuuaaccagcacucugggaagcagaggcaggugaaucucccgaguucuaggccuggucuauacagagagaauuc

SEQ ID NO: 82328 - RNA, 45 nt, Mus musculus
aguccuggcuguccuggaauucucucuguauagaccaggccuaga

SEQ ID NO: 82329 - RNA, 88 nt, Mus musculus
uacuuaauaggaagacagcuugggacacaugagcucaucgccucauaggaaagcccaggauuucuuuuugaagacugaacuagagccu

SEQ ID NO: 82330 - RNA, 46 nt, Mus musculus
cagggacuccgcagguagaggucuuuaucuaagcucaaggcaagaa

SEQ ID NO: 82331 - RNA, 44 nt, Mus musculus
uccccaaaccaaaaggacaaauugcuuugugggccuguuucaga

SEQ ID NO: 82332 - RNA, 49 nt, Mus musculus
gaaauucuauuuagccuaaaaauaucgacaggcugaaggccaguaaagu

SEQ ID NO: 82333 - RNA, 46 nt, Mus musculus
ugggaaaacagcuugguucacugcugaagcccaacucacacagaua

SEQ ID NO: 82334 - RNA, 46 nt, Mus musculus
cuuauccuauagaaccaaagguucuuaggacaaagcagcccagccu

SEQ ID NO: 82335 - RNA, 45 nt, Mus musculus
cuaugucacuaaacucggauuauuuauuuacuuagccuuuuugag

SEQ ID NO: 82336 - RNA, 46 nt, Mus musculus
auaugagacauguggaugcagggcagggucggcaacagcggcaagg

SEQ ID NO: 82337 - RNA, 45 nt, Mus musculus
gcuagcaugaccaagccuacuaccaucaucgagaagaacggggau

SEQ ID NO: 82338 - RNA, 43 nt, Mus musculus
uauggugauaguauccccguucuucucgaugaugguaguaggc

SEQ ID NO: 82339 - RNA, 42 nt, Mus musculus
cuuuuguuucuaccaugugaccucccuuaacuggcaaaagag

SEQ ID NO: 82340 - RNA, 46 nt, Mus musculus
cucugacauuuuguauaaacauucuuggguugggauuuuucuggag

SEQ ID NO: 82341 - RNA, 46 nt, Mus musculus
aggcgaggcauucaucaaaagacagcaaggccaccaagaagaaaaa

SEQ ID NO: 82342 - RNA, 46 nt, Mus musculus
gagaggaugcguggguuugcaggcagagcugacagggucugcugag

SEQ ID NO: 82343 - RNA, 46 nt, Mus musculus
guacucauaguucuggggccacguacagaacugaacauguacagau

SEQ ID NO: 82344 - RNA, 35 nt, Mus musculus
cuguuccuguacucucuaaaucuccuuuucccuuu

SEQ ID NO: 82345 - RNA, 47 nt, Mus musculus
acuugagaagccugaucccacgaagaauucuuccaggaagagaaaga

SEQ ID NO: 82346 - RNA, 46 nt, Mus musculus
gaauuugugggguuuuauaagccucuacuuuuauuagugaagagag

SEQ ID NO: 82347 - RNA, 42 nt, Mus musculus
guaagcugcugccacguuggugcugggaauagaaucugaguc

SEQ ID NO: 82348 - RNA, 41 nt, Mus musculus
uuauuuauuuuuaguauagaauagaguuuauuugggggcau

SEQ ID NO: 82349 - RNA, 46 nt, Mus musculus
uggcucgugagcacggcggucugucuuacccuccucguccccugua

SEQ ID NO: 82350 - RNA, 44 nt, Mus musculus
cuagccugcugcccaggcaaggugcagagccugcuuugagcaga

SEQ ID NO: 82351 - RNA, 23 nt, Mus musculus
cuguccccacccugucugccagc

SEQ ID NO: 82352 - RNA, 41 nt, Mus musculus
gguggcucacaaccauccgugacgagaucugacgcccucau

SEQ ID NO: 82353 - RNA, 23 nt, Mus musculus
auugaucugagguccucaagcuu

SEQ ID NO: 82354 - RNA, 46 nt, Mus musculus
uucagaauccuuuaacuacuaucaaguuaaagacugguauucagau

SEQ ID NO: 82355 - RNA, 46 nt, Mus musculus
gaccauggagaacuugccugcacuguauacuauuuuucaaggagag

SEQ ID NO: 82356 - RNA, 45 nt, Mus musculus
uaaccugcugaagcuuuaacagccuaauucugcaaggagccacuu

SEQ ID NO: 82357 - RNA, 45 nt, Mus musculus
aguuacauacuguuaugagccaccgugugggugcugggaaugaac

SEQ ID NO: 82358 - RNA, 42 nt, Mus musculus
ucuugagacagagaaucgugucucgagagaggaugggggggu

SEQ ID NO: 82359 - RNA, 46 nt, Mus musculus
gugcaaaagaggacuugaucccucaggcuuaauggugugaugagau

SEQ ID NO: 82360 - RNA, 90 nt, Mus musculus
acguucugcacagaacagcagguucuaucagucggaaagaugagggagacacaaagagccgguguggggggagagagagagcgagagcga

SEQ ID NO: 82361 - RNA, 48 nt, Mus musculus
ucuugcugugaguuacuaauauaaacuugaaggcuuuuuaaaggaaaa

SEQ ID NO: 82362 - RNA, 46 nt, Mus musculus
cuuuuuaaaagggcuuuaauuuauguccccgagacagccagugaug

SEQ ID NO: 82363 - RNA, 42 nt, Mus musculus
cuaucccuugacagcugcucugcaggaugccaauucugcguc

SEQ ID NO: 82364 - RNA, 50 nt, Mus musculus
cugcccuuuucagcuaucagccuuagcagcaugggguggcaggagguguc

SEQ ID NO: 82365 - RNA, 43 nt, Mus musculus
uuccuagcuaugaagcggcuguccugcuaggcgcggacgcgga

SEQ ID NO: 82366 - RNA, 32 nt, Mus musculus
auguagccaauuucccacuuucccuucaacuc

SEQ ID NO: 82367 - RNA, 46 nt, Mus musculus
aaagccccuuggagagggaagcacaccaacacagggaggaucagag

SEQ ID NO: 82368 - RNA, 46 nt, Mus musculus
acaaaccuucuguggacauaaauuuaucuuaaagcaguucacagac

SEQ ID NO: 82369 - RNA, 42 nt, Mus musculus
uuacccaaugaggcaaggcaguuucucaaacacgggagagcc

SEQ ID NO: 82370 - RNA, 45 nt, Mus musculus
augauaagagauugucccugaaagcaaucucauucuaaaauauaa

SEQ ID NO: 82371 - RNA, 36 nt, Mus musculus
cucaaagcaaacuguaauuaauucugguauguguug

SEQ ID NO: 82372 - RNA, 42 nt, Mus musculus
agaaaaguacuucaaagcuggaaauauagcugggcggcagua

SEQ ID NO: 82373 - RNA, 45 nt, Mus musculus
gccagagcuacacagagaauaauauuguaaaacaaggaggguagg

SEQ ID NO: 82374 - RNA, 41 nt, Mus musculus
uucugcaguauuauuuuaaauaaaaagggaagggggcuaga

SEQ ID NO: 82375 - RNA, 56 nt, Mus musculus
aaauucugugacugccccuugcagaguaaucaagggaaagaaauggggaagagaac

SEQ ID NO: 82376 - RNA, 45 nt, Mus musculus
aauucccagcaaccacaugguggcucacaaccaucuguguaauag

SEQ ID NO: 82377 - RNA, 45 nt, Mus musculus
uuaaggucauacuuggugauuauauauguacgugugggggggggg

SEQ ID NO: 82378 - RNA, 42 nt, Mus musculus
ccaagcaaccacauggugucucacaaccaucuguaaugggau

SEQ ID NO: 82379 - RNA, 45 nt, Mus musculus
caggauuucacucuguagcccccggcuguccugggacucagagau

SEQ ID NO: 82380 - RNA, 46 nt, Mus musculus
cuuacucuaugcuuauccagaggguaaauuuuagucauccccagaa

SEQ ID NO: 82381 - RNA, 46 nt, Mus musculus
aggagccaaucacugggcgaguaggugggacuucuggguuggacag

SEQ ID NO: 82382 - RNA, 42 nt, Mus musculus
aaaucccagcaaccacaugguggcucacaaccaucacaacca

SEQ ID NO: 82383 - RNA, 46 nt, Mus musculus
ccuuccagagcaagugcuugaaaaucaugauucaauucauccauag

SEQ ID NO: 82384 - RNA, 42 nt, Mus musculus
cugcagagguaacuugugugagucaucugagcuugaggaggg

SEQ ID NO: 82385 - RNA, 46 nt, Mus musculus
ucccaccauaaaggcagauauauugcugugaguuaaaaggcaagcc

SEQ ID NO: 82386 - RNA, 48 nt, Mus musculus
aaagaaggggaggaggaggacggaggacaugcgguuacacaagucagg

SEQ ID NO: 82387 - RNA, 45 nt, Mus musculus
gaacguccccauggguggugguccacaccuuuaaucucagcaauu

SEQ ID NO: 82388 - RNA, 42 nt, Mus musculus
ugcuagaaaaauggcucagcuguuacaaucacuaggugagcu

SEQ ID NO: 82389 - RNA, 46 nt, Mus musculus
accaagugucccuuaauguucuggggucuauuaacuggaguggguu

SEQ ID NO: 82390 - RNA, 44 nt, Mus musculus
ccacagcauagguuccuacacaaacccaagaugguugcuaccuu

SEQ ID NO: 82391 - RNA, 45 nt, Mus musculus
cgccaacacaggccuggucacaaucacccaguccugcugugcaga

SEQ ID NO: 82392 - RNA, 46 nt, Mus musculus
cccuaucacauuccucacagcaaacaaaacaucaccgcugcuagcc

SEQ ID NO: 82393 - RNA, 45 nt, Mus musculus
caccagcuggacuccgguaggacuuaguggagcagaguagcaggc

SEQ ID NO: 82394 - RNA, 45 nt, Mus musculus
aagucaaguaucuguggacucaauauggcagaaagcuuugcagac

SEQ ID NO: 82395 - RNA, 47 nt, Mus musculus
ugccuuuuaaagaaugugacugugucuccucuuagcagcacccagca

SEQ ID NO: 82396 - RNA, 45 nt, Mus musculus
uuguuuucacuuuuugagucagguuuuuacugucccuugcuagau

SEQ ID NO: 82397 - RNA, 41 nt, Mus musculus
uugcacauaaauaaaggaaaguggugcaacuggcccugaga

SEQ ID NO: 82398 - RNA, 46 nt, Mus musculus
gcaugauggucucaucucucuuuguuauuuuagaauguguguggau

SEQ ID NO: 82399 - RNA, 46 nt, Mus musculus
cuuucauaucuacucaaauuaccagcugguuaaacacacuccagau

SEQ ID NO: 82400 - RNA, 46 nt, Mus musculus
aauguuagugaguuacugguuuucccagcauccaccacuccuaggu

SEQ ID NO: 82401 - RNA, 46 nt, Mus musculus
cauuucucuaguaaauuauuuaaauccugauuugggaguagggggg

SEQ ID NO: 82402 - RNA, 45 nt, Mus musculus
agagcuuuguagugcuaaucccaaggaccaaccaucguccccuca

SEQ ID NO: 82403 - RNA, 45 nt, Mus musculus
cauugguaagcucugcacacaagucaucgagagaggaugccagcu

SEQ ID NO: 82404 - RNA, 46 nt, Mus musculus
agagguuguuugcugccuuuguucucauauugaaaugaagccacuu

SEQ ID NO: 82405 - RNA, 46 nt, Mus musculus
acagggcugugcugucuagcucccaaaggcaaguaggcugccaugc

SEQ ID NO: 82406 - RNA, 42 nt, Mus musculus
agaauggucucuauaggccauuugaauacuugguccccaguu

SEQ ID NO: 82407 - RNA, 44 nt, Mus musculus
cgaggccauuucuugccccugcauucaccacaagggcaccaguu

SEQ ID NO: 82408 - RNA, 46 nt, Mus musculus
ggccaagcugcucgauguccucuuauaaaggucacugcugccaguc

SEQ ID NO: 82409 - RNA, 23 nt, Mus musculus
gacaacgggaggggggguggggg

SEQ ID NO: 82410 - RNA, 42 nt, Mus musculus
uuaagcucugagaaggcuccccacauguggaauggggugcua

SEQ ID NO: 82411 - RNA, 46 nt, Mus musculus
gucuacaaaggaagacccugucucaacaaaaauacaaagccccuaa

SEQ ID NO: 82412 - RNA, 45 nt, Mus musculus
agacaauagcaaccccuccgcugagaaggcugagggagcucagau

SEQ ID NO: 82413 - RNA, 46 nt, Mus musculus
agccucaagugcuccaggcucuaccagccuucaacugccaccaucu

SEQ ID NO: 82414 - RNA, 42 nt, Mus musculus
acaaaagugggaagaggaagaaucggagaaaaggacagagag

SEQ ID NO: 82415 - RNA, 45 nt, Mus musculus
caagagggaggugagugggaacaccucgcaaugcccacccaaggg

SEQ ID NO: 82416 - RNA, 45 nt, Mus musculus
ggugagggcaggaaggggaagcagagaccacagugacuccacaca

SEQ ID NO: 82417 - RNA, 25 nt, Mus musculus
gugaacaagaggaagaaugaaggaa

SEQ ID NO: 82418 - RNA, 42 nt, Mus musculus
cuccugucuaacucuccccagccuugauucugcaguggaggc

SEQ ID NO: 82419 - RNA, 45 nt, Mus musculus
agacaauagcaaccccuccgcugagaaggcugagggagcucagag

SEQ ID NO: 82420 - RNA, 46 nt, Mus musculus
aggagaggggugaagccuacaaggucagcaguuagucugcucaacu

SEQ ID NO: 82421 - RNA, 42 nt, Mus musculus
cggacgcacacgcuucccggcggggaggggaccccaugagac

SEQ ID NO: 82422 - RNA, 45 nt, Mus musculus
cccaaaaaacagggcuucucuguguagcguugacugucccagaac

SEQ ID NO: 82423 - RNA, 46 nt, Mus musculus
gccucccaauugcugggauuaaaggcauguuccaccaccaccccac

SEQ ID NO: 82424 - RNA, 25 nt, Mus musculus
accucuguuuugcccugcagcggag

SEQ ID NO: 82425 - RNA, 43 nt, Mus musculus
ucauacaggggagggccaaggagaaaagacaagguguuagagu

SEQ ID NO: 82426 - RNA, 45 nt, Mus musculus
auggagggauguguguguguguguguguguguguguguguguggu

SEQ ID NO: 82427 - RNA, 42 nt, Mus musculus
ggaaugaauaaauaagagaauaauuaaaugagggagggaacu

SEQ ID NO: 82428 - RNA, 42 nt, Mus musculus
caucaucaggaaacgagucgucauccccugagcccucaagau

SEQ ID NO: 82429 - RNA, 45 nt, Mus musculus
ccucaccacccacuacuguggcuaccuuggacacagaggccccga

SEQ ID NO: 82430 - RNA, 45 nt, Mus musculus
ugccguuggggaccacggcuccuggacccacggagauggcucagg

SEQ ID NO: 82431 - RNA, 45 nt, Mus musculus
ccugcuccuggacaggaaucgaccaagauuguucuaaggcagcug

SEQ ID NO: 82432 - RNA, 42 nt, Mus musculus
gcagcgugaccaggaaggcagcgaagagggcgcccaccaccc

SEQ ID NO: 82433 - RNA, 82 nt, Mus musculus
ucuucgcugccuuccuggucacgcugcucaucuaccgcaugaagaagaaggacgaaggcagcuacaccuuggaagaacccaa

SEQ ID NO: 82434 - RNA, 46 nt, Mus musculus
ggccugggauggagccuggcccugcuucuuucugcucaggcugcua

SEQ ID NO: 82435 - RNA, 90 nt, Mus musculus
cacagucuggggcagauggcagcaccucugcuccuuaggacagucuguguuacgcuagcagccugagcagaaagaagcagggccaggcuc

SEQ ID NO: 82436 - RNA, 58 nt, Mus musculus
cagcaagcacugugggccaucuuaacccugccccugccccuguuucaaccagcaaccc

SEQ ID NO: 82437 - RNA, 49 nt, Mus musculus
ggcuucuagaaccaauaauacaugguacaucuagcccuccaauucaaaa

SEQ ID NO: 82438 - RNA, 46 nt, Mus musculus
gcucaugauggggucaccgcccccucccccugccaaaugcacaggu

SEQ ID NO: 82439 - RNA, 47 nt, Mus musculus
gcaaugcaggaagaggugcagccuggggaccugugcauuuggcaggg

SEQ ID NO: 82440 - RNA, 46 nt, Mus musculus
uuaggauucuaguagugguugacggaggcuauguggcauccccucu

SEQ ID NO: 82441 - RNA, 73 nt, Mus musculus
uccgucaaccacuacuagaauccuaaaaugcauucacacaggagacaaaaacauacccaguccugaccaccca

SEQ ID NO: 82442 - RNA, 46 nt, Mus musculus
uggcgaccacaccaccuuccucccaaucuauucucuuuacacacau

SEQ ID NO: 82443 - RNA, 46 nt, Mus musculus
agaggagccagaugcaggaccaauguguguaaagagaauagauugg

SEQ ID NO: 82444 - RNA, 46 nt, Mus musculus
aggcaggaccgaguuguaggcaucagcccauauugggucccccaga

SEQ ID NO: 82445 - RNA, 42 nt, Mus musculus
agagccugacagggggacacccccuccacccccaccccagaa

SEQ ID NO: 82446 - RNA, 73 nt, Mus musculus
uucugucuuccagaccuccaugacucccuugaugggacuuuagaguuuuguaagccagucggccuggucuuua

SEQ ID NO: 82447 - RNA, 94 nt, Mus musculus
agugggggggaaggaaugagaggcguccuaaacccaugagauguggaggagggagcuuggccaagaucuucccugcagcaggggcuggguaggg

SEQ ID NO: 82448 - RNA, 67 nt, Mus musculus
agugucccagacccucccacuccucccugguaagcugcagucuuggggacuagagcuuuggaaagag

SEQ ID NO: 82449 - RNA, 45 nt, Mus musculus
ccuugggcugaguaccuggagguugccucgcccagcugcugagcc

SEQ ID NO: 82450 - RNA, 46 nt, Mus musculus
auggguuuggcauccugauaccagcauccuuaaugugucagcaucu

SEQ ID NO: 82451 - RNA, 46 nt, Mus musculus
uaggcuucauggccauggcguuugaccugaagguuaauggugugag

SEQ ID NO: 82452 - RNA, 46 nt, Mus musculus
acaccucagugcuccugggaagguauucaggacaccggcuugccug

SEQ ID NO: 82453 - RNA, 42 nt, Mus musculus
cagcguuggcucugcucucugaagcucgagccccagccagga

SEQ ID NO: 82454 - RNA, 42 nt, Mus musculus
guaaauagaagcccacacuguacagaucuacagagaggccca

SEQ ID NO: 82455 - RNA, 42 nt, Mus musculus
uguaaauacuucguagacaguguggcuccagagagcccccug

SEQ ID NO: 82456 - RNA, 51 nt, Mus musculus
ugguggcccaggggcugggagggcucuguacaggagagaggaugaaccagu

SEQ ID NO: 82457 - RNA, 60 nt, Mus musculus
cccuauaaccuguuuauuaaccaacccuguccugaguucauggccaaaacuuaaauaaga

SEQ ID NO: 82458 - RNA, 46 nt, Mus musculus
guuuuggccaugaacucaggacaggguugguuaauaaacagguuau

SEQ ID NO: 82459 - RNA, 57 nt, Mus musculus
uguuaguuuuuguuuuuuaacauuucccugugcugugcccauuuauaagaggaaaua

SEQ ID NO: 82460 - RNA, 45 nt, Mus musculus
ccaugguugccauagaccagcgcccgcacccgugacggcucagag

SEQ ID NO: 82461 - RNA, 46 nt, Mus musculus
gggaacacaccugcaaucucagcacuuggaaguuaagagcccagcc

SEQ ID NO: 82462 - RNA, 42 nt, Mus musculus
uaagaaugaacaaaugucacuccaccaaaaagccccggaagu

SEQ ID NO: 82463 - RNA, 46 nt, Mus musculus
gaaaauggaggccugcucauaaggacuuuaucaccucacugcagca

SEQ ID NO: 82464 - RNA, 46 nt, Mus musculus
cuagccaguauagguggagaccuugaugucaggcucuggcauauuu

SEQ ID NO: 82465 - RNA, 46 nt, Mus musculus
ccuuggaucauauuuaugucagauggauugauaggggcugccagca

SEQ ID NO: 82466 - RNA, 46 nt, Mus musculus
uuucauguaacagcucaccucucugggucuguucccucgcugauga

SEQ ID NO: 82467 - RNA, 33 nt, Mus musculus
uccagggcacuugaggguaucaugcaaacacac

SEQ ID NO: 82468 - RNA, 44 nt, Mus musculus
caaccuaugagugcacacacccuagagccaucugugcccgggga

SEQ ID NO: 82469 - RNA, 47 nt, Mus musculus
cacaaucaggucacacuggcuaacuagccucccucaagcucccagaa

SEQ ID NO: 82470 - RNA, 46 nt, Mus musculus
uggacugugguucuucuuccacugggacaaccaaaagccccgaagu

SEQ ID NO: 82471 - RNA, 46 nt, Mus musculus
guagcagucagagaccuaugcugacguuagcagcuccauuccagag

SEQ ID NO: 82472 - RNA, 46 nt, Mus musculus
ucccucccucccugagacagggacccauucuuuacauugcccagau

SEQ ID NO: 82473 - RNA, 46 nt, Mus musculus
cugcuaggaugacaagacacugaaaugugugcugacacugacacgc

SEQ ID NO: 82474 - RNA, 42 nt, Mus musculus
uugcucuacugucucacugcaccacaugauacaugcccugag

SEQ ID NO: 82475 - RNA, 46 nt, Mus musculus
ggcccuagggccguguagcccuggcuguugggggaacucugcagac

SEQ ID NO: 82476 - RNA, 41 nt, Mus musculus
aggcggcgggaaagggggaugauucauccccgggagcccga

SEQ ID NO: 82477 - RNA, 42 nt, Mus musculus
guacaugcaugcgaggcaggaggugcugggauccuuggaguu

SEQ ID NO: 82478 - RNA, 45 nt, Mus musculus
guugagaugacuuauaggcaacuguaggguuccuguaacuguguu

SEQ ID NO: 82479 - RNA, 42 nt, Mus musculus
cccgccuggcucauuugcagaggcguucucauaaaggcagaa

SEQ ID NO: 82480 - RNA, 42 nt, Mus musculus
uuuaauuccagcuuuacaaggaucuguagcgcggacggagac

SEQ ID NO: 82481 - RNA, 46 nt, Mus musculus
guaaucccagcuucuggcuuacacuaggaugugaacucuggccuuc

SEQ ID NO: 82482 - RNA, 41 nt, Mus musculus
cuuggaccuuguaaacaguaauagaaauaaaagugcugagg

SEQ ID NO: 82483 - RNA, 43 nt, Mus musculus
ugcgagaaaaaucagucugcugcugaugguuuggccagagagc

SEQ ID NO: 82484 - RNA, 46 nt, Mus musculus
ccgccuucccuccuuccucauucuccaguuucaucagccccccaac

SEQ ID NO: 82485 - RNA, 45 nt, Mus musculus
cccuauuucuaaccaguccagagaaauguacaacccagggccuga

SEQ ID NO: 82486 - RNA, 42 nt, Mus musculus
cugaggccucagggaauggacacagccuuacaaaaacuaaag

SEQ ID NO: 82487 - RNA, 46 nt, Mus musculus
aaaaaaaaauacaccagcuggccagggcuggagagauggcucagcg

SEQ ID NO: 82488 - RNA, 46 nt, Mus musculus
auagaacuuugggguguacgcuguuacauaagucugcucccaagcc

SEQ ID NO: 82489 - RNA, 42 nt, Mus musculus
ugauucccaguaucaaagauuagagagagugaggggggggaa

SEQ ID NO: 82490 - RNA, 54 nt, Mus musculus
auaauaauaaauaaaaaaucuuuaaaaaaaaaaaaaaaaaaaaaaaaaaagaau

SEQ ID NO: 82491 - RNA, 23 nt, Mus musculus
uccaggaaaugcaacagaucugg

SEQ ID NO: 82492 - RNA, 46 nt, Mus musculus
augguguccacacagaacagcagcuugacauggagugcugagaaag

SEQ ID NO: 82493 - RNA, 26 nt, Mus musculus
ggugagaaucuguauaugugagugug

SEQ ID NO: 82494 - RNA, 44 nt, Mus musculus
auggacaacugcagggaagagaagucaggcgcaucagaggcuca

SEQ ID NO: 82495 - RNA, 42 nt, Mus musculus
gcaugcuaggcaagcacugagcuacacacucagcccccaggg

SEQ ID NO: 82496 - RNA, 45 nt, Mus musculus
caguguguuccacguauucuuuuccugccugaauuacauccaggg

SEQ ID NO: 82497 - RNA, 46 nt, Mus musculus
acuggggggaaaaaacagagagagagagagagagagagagagagag

SEQ ID NO: 82498 - RNA, 46 nt, Mus musculus
cacacuccuccauaggcauagagaggguaagaggaaggcaagagcc

SEQ ID NO: 82499 - RNA, 42 nt, Mus musculus
aacugaacccauacacaccauacguguaacacauacccagau

SEQ ID NO: 82500 - RNA, 41 nt, Mus musculus
ccgcucucauggcgcaggagucucaaggaagauggcgauaa

SEQ ID NO: 82501 - RNA, 39 nt, Mus musculus
guguguauguauguauauauguauguauaugugucugag

SEQ ID NO: 82502 - RNA, 69 nt, Mus musculus
cuuuccuuuuaaucuccagcucagcaaacagcuucauggucuguuuguagacugccuguuugaacugua

SEQ ID NO: 82503 - RNA, 41 nt, Mus musculus
uacuuuaauuuuguauaauuuuugggcuugccucaggaccu

SEQ ID NO: 82504 - RNA, 42 nt, Mus musculus
ucucauucacaaaucccgggaacacuuggccagccgggaguc

SEQ ID NO: 82505 - RNA, 42 nt, Mus musculus
agaacauauaugcauguguuuaacaguauuaaagccucauga

SEQ ID NO: 82506 - RNA, 45 nt, Mus musculus
aucgccuuguucucagcugucuuccccuacuauguggcccugcau

SEQ ID NO: 82507 - RNA, 46 nt, Mus musculus
gcugucacgauggcugugggaagagguaggaacuuggccuggaguu

SEQ ID NO: 82508 - RNA, 47 nt, Mus musculus
gcuuacaaucagucgggucucucccaccugucugcauagaacggaag

SEQ ID NO: 82509 - RNA, 44 nt, Mus musculus
ggacgaugacacuugcaguacuacuuagaacuguggacuugaga

SEQ ID NO: 82510 - RNA, 46 nt, Mus musculus
uuacagauagcauagaagccaauguggaaagcucggaggugcaugu

SEQ ID NO: 82511 - RNA, 45 nt, Mus musculus
augccuguagccucugcacucaguggcugcaugacggucgggagu

SEQ ID NO: 82512 - RNA, 46 nt, Mus musculus
aauagauaguuuucuauucauggagaaaccuuuaaaaugcauguga

SEQ ID NO: 82513 - RNA, 46 nt, Mus musculus
gcagucagugcucuuaaccauugagccaucucuccagccccccaau

SEQ ID NO: 82514 - RNA, 32 nt, Mus musculus
auuuguuucuuacucaagacagauugccagag

SEQ ID NO: 82515 - RNA, 45 nt, Mus musculus
aaaaacccugucuugcaaaaucauuaaaaaaagaagagucagagg

SEQ ID NO: 82516 - RNA, 45 nt, Mus musculus
uguuuuuguuuuuuguuuuuagacauuuacuguaggaaggcagag

SEQ ID NO: 82517 - RNA, 46 nt, Mus musculus
guugugagccaccauguguuugcuggaauuugaacucaggacuuuu

SEQ ID NO: 82518 - RNA, 75 nt, Mus musculus
cauacaaggagcauguggacaagugguccaaaggggagagagagagagagagagagagagagagagaaggaggga

SEQ ID NO: 82519 - RNA, 46 nt, Mus musculus
auaacuguggucccaugggauccaauuugcaaauauacaugcaggc

SEQ ID NO: 82520 - RNA, 46 nt, Mus musculus
guguguauguauguguucugcaugcaugccugguacccucauaggu

SEQ ID NO: 82521 - RNA, 45 nt, Mus musculus
gcuggggauguagcucagucucaauaaauauguguaucugugaug

SEQ ID NO: 82522 - RNA, 64 nt, Mus musculus
gagacugaggcaagaggaucaggaguuugagucuagcccaucaggaaauggaaauaacuuguuc

SEQ ID NO: 82523 - RNA, 45 nt, Mus musculus
gacucucaagugcugaagauauguacuauaucacuccugacaaac

SEQ ID NO: 82524 - RNA, 30 nt, Mus musculus
guguucuuaacagccacaugugcugucacu

SEQ ID NO: 82525 - RNA, 50 nt, Mus musculus
cuagccuacauagagaguuccaggcuaugcagggcuacauauggagagag

SEQ ID NO: 82526 - RNA, 59 nt, Mus musculus
gcaaggacuuucaugugacaaagaauagcaaggaggaagguguggcugcguuaaaggua

SEQ ID NO: 82527 - RNA, 63 nt, Mus musculus
aggugauccagggccacauugugagucuguuuucaaagggaaaaagggagaaagggaaggagg

SEQ ID NO: 82528 - RNA, 42 nt, Mus musculus
gccaggggcuacacagagaaaccuuguuuugaaccaccagaa

SEQ ID NO: 82529 - RNA, 46 nt, Mus musculus
uugaguuucagaaucaucccagagcccuguaaacagaacaacagaa

SEQ ID NO: 82530 - RNA, 41 nt, Mus musculus
caauuacacaccaaguaagagauggcaggguugggccaagu

SEQ ID NO: 82531 - RNA, 88 nt, Mus musculus
ccuggacgucagucagugccuggcauuuaagggacgggaggacugcugcuuuauggcacagaaugcaccgggaacauuuuagguuagg

SEQ ID NO: 82532 - RNA, 45 nt, Mus musculus
ucagcgguuggguccucagacaucagcaacuuucaauuaagggaa

SEQ ID NO: 82533 - RNA, 42 nt, Mus musculus
aguucacgguguugggggucaacagagccgacagccccgaug

SEQ ID NO: 82534 - RNA, 46 nt, Mus musculus
ccuugacccccagggcucgaauaugauauucacauucuucggccag

SEQ ID NO: 82535 - RNA, 46 nt, Mus musculus
agacuuugacaaauguguguuaauaaaacuucauacugacucagau

SEQ ID NO: 82536 - RNA, 46 nt, Mus musculus
cucguucaguauuuuucaaaugcauuugcauuggcuguggggaaaa

SEQ ID NO: 82537 - RNA, 44 nt, Mus musculus
gcucuguagucugggauuacguucuccaaagagucacaugcaca

SEQ ID NO: 82538 - RNA, 46 nt, Mus musculus
uggaucuuugguuuuguuuuuuaacuugagcagauucaagcgggau

SEQ ID NO: 82539 - RNA, 46 nt, Mus musculus
cgguugcugaguauggccagucugucuuuaaguagggcagaaagau

SEQ ID NO: 82540 - RNA, 48 nt, Mus musculus
gguaauguuggaggcguacguguggagcuaagugccuuuuggaggacc

SEQ ID NO: 82541 - RNA, 53 nt, Mus musculus
agaagaugcugcaucagaaggaucaaaugauccuagagaaagagaagaaggua

SEQ ID NO: 82542 - RNA, 45 nt, Mus musculus
guuuucugaugaccuccuuuccuaugcaguucaagccuagcagau

SEQ ID NO: 82543 - RNA, 45 nt, Mus musculus
uguguagagaaaugcugcacauuagcugccauguaagauucaggg

SEQ ID NO: 82544 - RNA, 46 nt, Mus musculus
gccuuugcuugugagaguuauaaguuuaaauagacacuguuggguu

SEQ ID NO: 82545 - RNA, 46 nt, Mus musculus
gcccacgccuuuaaucccagcauucaggaggcagaggcagacggau

SEQ ID NO: 82546 - RNA, 46 nt, Mus musculus
gagguuccagcggcauuguuuaaacugauccuggaacugagaagau

SEQ ID NO: 82547 - RNA, 49 nt, Mus musculus
gugauucucaggguucucacguggaugaaugcauagauccuaacuuaag

SEQ ID NO: 82548 - RNA, 41 nt, Mus musculus
aaccauccugaugaugccuugcgacaguaagaagggacugg

SEQ ID NO: 82549 - RNA, 46 nt, Mus musculus
gcuuuagguuuaauuguguaucuagcagguuuucucauggacggug

SEQ ID NO: 82550 - RNA, 45 nt, Mus musculus
uaugcuggcugugcacgcugucguacaagcguguccuucagaaga

SEQ ID NO: 82551 - RNA, 24 nt, Mus musculus
gccugcaucaccaugcccggcuug

SEQ ID NO: 82552 - RNA, 26 nt, Mus musculus
cuucuuucuggcuguguuuuuagaga

SEQ ID NO: 82553 - RNA, 45 nt, Mus musculus
ccucaggucugcuuucuacuucucuuucuccuguggccuugagau

SEQ ID NO: 82554 - RNA, 46 nt, Mus musculus
uugagugugucuguuggaugguccaugccugucuuuggugucaauc

SEQ ID NO: 82555 - RNA, 45 nt, Mus musculus
accaaggccagcaucacauaaguccgaguuaccguugucucugag

SEQ ID NO: 82556 - RNA, 46 nt, Mus musculus
gugugcccucaauaggcucaugaauaggggagggaaacacgucaag

SEQ ID NO: 82557 - RNA, 42 nt, Mus musculus
gcccccuucuuccuccuaaccacugggucuccguagcagaca

SEQ ID NO: 82558 - RNA, 45 nt, Mus musculus
agcacguagaccacacugagaggccggcuccgcgcgcagccccga

SEQ ID NO: 82559 - RNA, 46 nt, Mus musculus
agugagccagcagcaacacaccccuccuuaagaccccggugcagag

SEQ ID NO: 82560 - RNA, 46 nt, Mus musculus
cuggaacucggcuaaaggggagggguaaggagccugggcuaaagac

SEQ ID NO: 82561 - RNA, 54 nt, Mus musculus
acuaaggaggaaaccgaaaggaucuagaacuucaggcugagagaaggaaaucgg

SEQ ID NO: 82562 - RNA, 42 nt, Mus musculus
gugccguggugacauccccaauugagcguucccggggugguu

SEQ ID NO: 82563 - RNA, 42 nt, Mus musculus
gagguccuucguccccauucccucuacucuuuagccccagaa

SEQ ID NO: 82564 - RNA, 46 nt, Mus musculus
uauggcuggggguggagggauacaacuuuaacccaaguacucagga

SEQ ID NO: 82565 - RNA, 42 nt, Mus musculus
aaagaaagaaagaaagaaagaaagaaagaaagacaagcggga

SEQ ID NO: 82566 - RNA, 46 nt, Mus musculus
cuggucuuauuuuauuuauuuauguaaaaauaaaucuggcacagaa

SEQ ID NO: 82567 - RNA, 46 nt, Mus musculus
auaguugugagccaccaugugguugcugggauuugaacucacgacc

SEQ ID NO: 82568 - RNA, 76 nt, Mus musculus
uugaacucacagggggaaaagggaagggaaggggaagaaaggagaggggaggggagggggaaagagaggagggaag

SEQ ID NO: 82569 - RNA, 45 nt, Mus musculus
uugcaccaaccagaaaauucacugggugacaagugucucaaugau

SEQ ID NO: 82570 - RNA, 46 nt, Mus musculus
aucucugcacaccucaccucuaacccaaaauagacugccagcauga

SEQ ID NO: 82571 - RNA, 45 nt, Mus musculus
uauggagacaccuuacaguaguauggcugugcccagaccacaguu

SEQ ID NO: 82572 - RNA, 41 nt, Mus musculus
uuuuaaaaaguuuaaaaauucucuuuaaaugugcagucagu

SEQ ID NO: 82573 - RNA, 44 nt, Mus musculus
caggaaguagccugcauccaggaugauggguggcagcaggaaga

SEQ ID NO: 82574 - RNA, 42 nt, Mus musculus
cagagucacugugcaaaccagauaggguagcaggcauccaaa

SEQ ID NO: 82575 - RNA, 46 nt, Mus musculus
ggcggggccugccucagcagcccagccguccgccaaauggauggau

SEQ ID NO: 82576 - RNA, 45 nt, Mus musculus
agccaguggcucuuugguuagaaaugaugaucaaggauggagagu

SEQ ID NO: 82577 - RNA, 42 nt, Mus musculus
ucccagucaggaaaaucugaaugaaaauucuaacccacaggg

SEQ ID NO: 82578 - RNA, 41 nt, Mus musculus
cgucagccugaggcuucacaaguucuguccaucaaggugcu

SEQ ID NO: 82579 - RNA, 62 nt, Mus musculus
acaguacuaaggaaggaauagaacaguacuaaggaaggaauaaaacaguacuaaggaaggaa

SEQ ID NO: 82580 - RNA, 85 nt, Mus musculus
uagaacaguacuaaggaaggaauagaacaguacuaaggaaggaauagaacaguacuaaggaaggaauagaacaguacuaaggaag

SEQ ID NO: 82581 - RNA, 46 nt, Mus musculus
cagacccagccaaguucaucuccguccuguguaccucccuggccac

SEQ ID NO: 82582 - RNA, 42 nt, Mus musculus
cagcgaaauaacgacaaagagacaaagaagacacagccccag

SEQ ID NO: 82583 - RNA, 45 nt, Mus musculus
gaaaauaauuuuauggcuggcggucagcacagccugagggacugg

SEQ ID NO: 82584 - RNA, 48 nt, Mus musculus
ggguguaauuaggaguagcagaguucuuaagagucuugcuagauaagg

SEQ ID NO: 82585 - RNA, 47 nt, Mus musculus
gugugagguuucgugccuguaaaccagcaguugagaaacaggaagau

SEQ ID NO: 82586 - RNA, 45 nt, Mus musculus
uuauuaaaacaguuagugacagagcugucagggaguggagaagag

SEQ ID NO: 82587 - RNA, 45 nt, Mus musculus
gaccagccacacauaguauagaauagagauuauucagggcauggc

SEQ ID NO: 82588 - RNA, 42 nt, Mus musculus
cuggugagcuacauccccagccagagagugacuacagcagau

SEQ ID NO: 82589 - RNA, 47 nt, Mus musculus
gcaguaaacacuuuuuguuguuuauaaaaagauaaagagggaauugg

SEQ ID NO: 82590 - RNA, 41 nt, Mus musculus
gcccuaggguaucucggaaaugggcuccagucgugccaugu

SEQ ID NO: 82591 - RNA, 42 nt, Mus musculus
uuggaggggagccugugggagcuuccaguuucgggcccagag

SEQ ID NO: 82592 - RNA, 45 nt, Mus musculus
gcugcacggggccggcaucuguaagugguucaacgugcgcauggg

SEQ ID NO: 82593 - RNA, 41 nt, Mus musculus
gaccagagcagugggggagggccgaagccagagccagaggg

SEQ ID NO: 82594 - RNA, 43 nt, Mus musculus
cucucucagggagcuguaccuggaagcaacuuuagguguaggc

SEQ ID NO: 82595 - RNA, 41 nt, Mus musculus
ugcagaaccauugggcagugcucuagugggaaacauggcuc

SEQ ID NO: 82596 - RNA, 43 nt, Mus musculus
aagcugggggcagcugcaucugguacuaugaagauggccugcu

SEQ ID NO: 82597 - RNA, 47 nt, Mus musculus
ugggaagucccagcccaguuagaugcaagaugcaugcaacccggaag

SEQ ID NO: 82598 - RNA, 45 nt, Mus musculus
ggcaagugccacaguaguuaaaagcacuuguugcaagccgggcag

SEQ ID NO: 82599 - RNA, 47 nt, Mus musculus
auugggucacaucugcagccaaauguuugaaggccagauccuggaug

SEQ ID NO: 82600 - RNA, 46 nt, Mus musculus
uucaaaucccagcaaccacaugguggcuuacaaccauccauacgag

SEQ ID NO: 82601 - RNA, 42 nt, Mus musculus
ccugaaggguuugggagcugauagaauggagagaggcuagag

SEQ ID NO: 82602 - RNA, 45 nt, Mus musculus
agagucagguagguagggauaaguugagaggcagacagggccaga

SEQ ID NO: 82603 - RNA, 44 nt, Mus musculus
cggaugacucuagcuugugucacauugacaaaaacuaaccauca

SEQ ID NO: 82604 - RNA, 46 nt, Mus musculus
ggcuagaacuuuccaucagaagugacaucuuaagcuucccuguccu

SEQ ID NO: 82605 - RNA, 46 nt, Mus musculus
agcccaggacaugggcugugucuuucucaccuagugugacuguuag

SEQ ID NO: 82606 - RNA, 45 nt, Mus musculus
gccucaggccaugacuucuuuacccaaucacuuggucaccucagu

SEQ ID NO: 82607 - RNA, 45 nt, Mus musculus
aguccacagaagcagggagucacauguuagaggagauagaagaag

SEQ ID NO: 82608 - RNA, 45 nt, Mus musculus
ggaggagcaggcauagccuuucagagaguagccagugccggggag

SEQ ID NO: 82609 - RNA, 46 nt, Mus musculus
ccuuuaagguaagcagcaguucucaacccacccuuucccugugcag

SEQ ID NO: 82610 - RNA, 42 nt, Mus musculus
gccagggcugagugggaugaagguuguccucguggggagcag

SEQ ID NO: 82611 - RNA, 46 nt, Mus musculus
uguaaccaacuccuugucguccuaaucugcaaacccagacccagac

SEQ ID NO: 82612 - RNA, 45 nt, Mus musculus
gucagaguuugggucugaggagcuggucugggcccacgucccucc

SEQ ID NO: 82613 - RNA, 41 nt, Mus musculus
uauauagucucuguacacggaaucuucuagaacuugccuca

SEQ ID NO: 82614 - RNA, 47 nt, Mus musculus
cugaauaaagcuaaaauguuauuuaauaaaaggaccaugaguuuggc

SEQ ID NO: 82615 - RNA, 25 nt, Mus musculus
uagaguggcuggcagucgcagauug

SEQ ID NO: 82616 - RNA, 42 nt, Mus musculus
gggcgcaccgagagaggcggcaugcagacuauggacaagcag

SEQ ID NO: 82617 - RNA, 52 nt, Mus musculus
cagcgguugauuucuggagauuaugagaucaaaggggacaccauguugauca

SEQ ID NO: 82618 - RNA, 91 nt, Mus musculus
gacacgggcacagccaugggaacagccgugacgacagcagccagcagcagaaccccagcguccgagcugccuucauucaugugauugggga

SEQ ID NO: 82619 - RNA, 46 nt, Mus musculus
aguacucugaggacaugaagaacugccaggcgugccagggccccuu

SEQ ID NO: 82620 - RNA, 67 nt, Mus musculus
gcagggucggucucauugauaaaagaaccuggagcuggacucaggaggaagaucugaggcuauuuua

SEQ ID NO: 82621 - RNA, 45 nt, Mus musculus
ccaggcaagccaugaaucucggcagcuacugaaggaaagugagcg

SEQ ID NO: 82622 - RNA, 45 nt, Mus musculus
gaacagugagaaagccacgcaugcgcacacacacaauuucaagau

SEQ ID NO: 82623 - RNA, 45 nt, Mus musculus
ugggugacugacaggcccaacugaaugaacucuaaaaaaacugca

SEQ ID NO: 82624 - RNA, 41 nt, Mus musculus
aauccuuugagcugguuugagguuacagaugcaagagguaa

SEQ ID NO: 82625 - RNA, 42 nt, Mus musculus
ccuaaaguuccugcaauggcucuguccuggcacaguaaggag

SEQ ID NO: 82626 - RNA, 45 nt, Mus musculus
cgggagccuuccaaggaauccaggauccugcgcugagccucagag

SEQ ID NO: 82627 - RNA, 45 nt, Mus musculus
agggcaaaggguggcaagguugugugaagguagagaaagcagucg

SEQ ID NO: 82628 - RNA, 45 nt, Mus musculus
cugaaguuggagccggagugcaucccaugcccgccgccuggggaa

SEQ ID NO: 82629 - RNA, 42 nt, Mus musculus
cuuggaccagguucccagggaggcacuggaagugccaugcug

SEQ ID NO: 82630 - RNA, 46 nt, Mus musculus
uccuuuucucauuuaucuguuccugccucacuggagaagcaccgag

SEQ ID NO: 82631 - RNA, 29 nt, Mus musculus
aaaagggcgggggggggggggcggcgggc

SEQ ID NO: 82632 - RNA, 45 nt, Mus musculus
uccugcccaacauaagauauuccagauucaacccaacaaugagau

SEQ ID NO: 82633 - RNA, 46 nt, Mus musculus
acuggcuguauacucuacacaauccacuggcaaggaaagcccugga

SEQ ID NO: 82634 - RNA, 42 nt, Mus musculus
uggauuuccuccagggaaagguccuucuucuuugggggggaa

SEQ ID NO: 82635 - RNA, 46 nt, Mus musculus
uaugcauaugugucaggccuuuagaaaccaguagagggcaucagau

SEQ ID NO: 82636 - RNA, 46 nt, Mus musculus
cucacggucuggaucuaccuauacgguccuacaucggcuucuagac

SEQ ID NO: 82637 - RNA, 46 nt, Mus musculus
cacgcgcugaaauuccaggcacacaccauuaagccugguccccgag

SEQ ID NO: 82638 - RNA, 24 nt, Mus musculus
cuuugaagaaauaccugaagguca

SEQ ID NO: 82639 - RNA, 46 nt, Mus musculus
ccaggacgacacagagaaacccugucuugaaaaacaacaacaaaaa

SEQ ID NO: 82640 - RNA, 44 nt, Mus musculus
gcugaauuugggggaguaagagaucagagaacccuuacguguca

SEQ ID NO: 82641 - RNA, 45 nt, Mus musculus
ccacacgguggcucacaaccacccguaaugagaucugaugcccuc

SEQ ID NO: 82642 - RNA, 46 nt, Mus musculus
augccguccaacuaagcauuuauucuugagaauucaaguggguaag

SEQ ID NO: 82643 - RNA, 36 nt, Mus musculus
cugccuuagagaguugucaugagaguauacauggag

SEQ ID NO: 82644 - RNA, 45 nt, Mus musculus
aaggaaaaaagaaagguggcacaaggaauguguuggggguccugg

SEQ ID NO: 82645 - RNA, 46 nt, Mus musculus
aaacaaacaaaaaacccugaaguaaacaaauccucaaaauacccgg

SEQ ID NO: 82646 - RNA, 46 nt, Mus musculus
ugaggauaauucccgauccucccuugucuaucuccuggguccuaag

SEQ ID NO: 82647 - RNA, 46 nt, Mus musculus
ucuuaacuuuagaagauaaugauaagacuuugugaagaccgcuuua

SEQ ID NO: 82648 - RNA, 71 nt, Mus musculus
acgaacugcacgcgggaaccgaguccacccccagugugguggugcacgucugugagagcgaaacugaagag

SEQ ID NO: 82649 - RNA, 45 nt, Mus musculus
uuuuguuuuuguuuuuguuuuuuuuaaaugccagcacuugggaga

SEQ ID NO: 82650 - RNA, 45 nt, Mus musculus
aguugugagccaccaugugguugcugggauuugaacucuucggaa

SEQ ID NO: 82651 - RNA, 86 nt, Mus musculus
aaagccagaguaagcauagaacagaagagacaagaagagaagagauaggaagagacaggagcuguuugcaaagcaagcccuccccg

SEQ ID NO: 82652 - RNA, 46 nt, Mus musculus
gccuagacugggcagaucgaccacuacacuacucuaguccccagcu

SEQ ID NO: 82653 - RNA, 46 nt, Mus musculus
ugaauaccccauuccuaagcaaugcgguauaaaaacugcccaccuu

SEQ ID NO: 82654 - RNA, 41 nt, Mus musculus
gagagagagagaaggagggagggagggaggagagauagaga

SEQ ID NO: 82655 - RNA, 42 nt, Mus musculus
uguaggguuuaaaaccaaauauauauauauucgcgucccaau

SEQ ID NO: 82656 - RNA, 45 nt, Mus musculus
aucucaaggggauuauauaacagacuggaaggauggagccuccac

SEQ ID NO: 82657 - RNA, 45 nt, Mus musculus
ugauggaagucaugacaauuacaguuugagcagcugccuggauug

SEQ ID NO: 82658 - RNA, 44 nt, Mus musculus
uguuagcacugcccacauuaugucuucuaaaagaagugagccag

SEQ ID NO: 82659 - RNA, 46 nt, Mus musculus
aauguaaagggaggacccaggccuggcuccagggagcaggggaaag

SEQ ID NO: 82660 - RNA, 33 nt, Mus musculus
acagagagaauagacauuucuggucagggacaa

SEQ ID NO: 82661 - RNA, 46 nt, Mus musculus
gagugaagccggcucuugaccuugucuggccaagggaacacauugg

SEQ ID NO: 82662 - RNA, 41 nt, Mus musculus
uggagauggagccggagggaacggagggaaguggggggggg

SEQ ID NO: 82663 - RNA, 46 nt, Mus musculus
ucaggggcaggcccucaccuccugugggucaucuuugaaggugcug

SEQ ID NO: 82664 - RNA, 42 nt, Mus musculus
gggacgguauuggucuugccggggguggguagaacccccucc

SEQ ID NO: 82665 - RNA, 45 nt, Mus musculus
guguguuugcaguaaaugccaacccacauggcaugagcaacuggg

SEQ ID NO: 82666 - RNA, 42 nt, Mus musculus
agaguuggugggauuaggacagcggauggggauagcgggaag

SEQ ID NO: 82667 - RNA, 46 nt, Mus musculus
uaaggcuaaccauuuagcuucuuggaagccuugacuguucauaaag

SEQ ID NO: 82668 - RNA, 46 nt, Mus musculus
aguuggugucccugucuaagacagaaccccugagccgucagacgug

SEQ ID NO: 82669 - RNA, 42 nt, Mus musculus
gugaagaagccagaggccccgugagcggccuuaucccuggag

SEQ ID NO: 82670 - RNA, 45 nt, Mus musculus
aauggaucaauguauccaccucagggaagagacagccuggaagca

SEQ ID NO: 82671 - RNA, 46 nt, Mus musculus
gccugcaagcguuugaguucuuaaccugcugaggaaaagcuccaaa

SEQ ID NO: 82672 - RNA, 42 nt, Mus musculus
cccggggaagcguuugcucuacguugcgcuuuggauguugag

SEQ ID NO: 82673 - RNA, 49 nt, Mus musculus
agauucguaaaaccuucaauaucaaaaaugacuuuacugaagaggagga

SEQ ID NO: 82674 - RNA, 42 nt, Mus musculus
ugccaugccuacgacaaaguugcagaguucugauggagagau

SEQ ID NO: 82675 - RNA, 46 nt, Mus musculus
cccaaggcaguccaggaaaccugcacagauaaagcuaggcccaccu

SEQ ID NO: 82676 - RNA, 34 nt, Mus musculus
uggucccagccaaccaguucaggaggaagauucc

SEQ ID NO: 82677 - RNA, 46 nt, Mus musculus
uggaacuugcuuuuguuugaaaggaaaggugcugaugugcccagag

SEQ ID NO: 82678 - RNA, 47 nt, Mus musculus
uuguaaacuauaagacauaguuuuaauaauaaauauugcccccagau

SEQ ID NO: 82679 - RNA, 46 nt, Mus musculus
cgauaaacaggacuugccuuggagguugagucuggaagcaggaaua

SEQ ID NO: 82680 - RNA, 46 nt, Mus musculus
acaagcaaagauggcuuuugucaacucuguggccaagccaccaaga

SEQ ID NO: 82681 - RNA, 46 nt, Mus musculus
gaaaguucacugucaccgagacuuuaaggaagaaaggccagaagag

SEQ ID NO: 82682 - RNA, 46 nt, Mus musculus
agcuggguucacaggacgcagaaugaauucuaagaugcagguguau

SEQ ID NO: 82683 - RNA, 45 nt, Mus musculus
cacuuagaguggauagugcgcaggauaagauuuguucugggcuag

SEQ ID NO: 82684 - RNA, 115 nt, Mus musculus
gcacuuggagaaaaaggacuuaaaaaaaaggacucuaaaagcacuaguaaaaacuugaacucagcucagaaauugcccaaagucaacgaaaacaagucagagaaguugcagccag

SEQ ID NO: 82685 - RNA, 47 nt, Mus musculus
ccacgauguccuucgaguccuaccucagcuaugaccagccccggaag

SEQ ID NO: 82686 - RNA, 47 nt, Mus musculus
accaccugaaggcucaggaggggaaaguaagaacuaacgcagaugga

SEQ ID NO: 82687 - RNA, 71 nt, Mus musculus
uguugcuucagacaaccacuuuaaaaagcccaaacacaaggacuccgagaaagccaaaucugacaaaaaca

SEQ ID NO: 82688 - RNA, 46 nt, Mus musculus
gccucuuccaaagaggaaagccgaagacuacugucaggggacagug

SEQ ID NO: 82689 - RNA, 46 nt, Mus musculus
ggaggaccaggagcccaucaucucacaccagaagccaggaaaaguc

SEQ ID NO: 82690 - RNA, 46 nt, Mus musculus
ccugaaaggccucacaaaguggcucacagucacgagaagagagaug

SEQ ID NO: 82691 - RNA, 46 nt, Mus musculus
aucacucugugucccucaaccugaaauuuaaacacacgggguacau

SEQ ID NO: 82692 - RNA, 42 nt, Mus musculus
cucuaggugauccgucuaccucaguuuccuaaaugcugagau

SEQ ID NO: 82693 - RNA, 46 nt, Mus musculus
gccccuguuuugacucuuuaaaaauugaaauagccgggcgguggug

SEQ ID NO: 82694 - RNA, 46 nt, Mus musculus
uugugagccacuaugugguugcagggauuugaacucaggacuucug

SEQ ID NO: 82695 - RNA, 46 nt, Mus musculus
aguaacuccagauuucccuuugagaaaauguuauuagccuuaaccu

SEQ ID NO: 82696 - RNA, 46 nt, Mus musculus
gccacaggcaauacucacuuugccagucuguacaaagccuugagau

SEQ ID NO: 82697 - RNA, 45 nt, Mus musculus
uacuuuuuaaauacauuguauccccucgcggucccccgggugucu

SEQ ID NO: 82698 - RNA, 42 nt, Mus musculus
gaaggggcccuggaccuucugaagaagcugaacaguugccag

SEQ ID NO: 82699 - RNA, 46 nt, Mus musculus
ucccccagaaccaccaaaggagaaagagaagaaagagaaaaagcga

SEQ ID NO: 82700 - RNA, 45 nt, Mus musculus
cuggaaaccagaagcaggccuuucuccaccaaggaagaaaggagg

SEQ ID NO: 82701 - RNA, 46 nt, Mus musculus
auggaaacuugccucaaaaaagaccaaggcucaggauguaguucag

SEQ ID NO: 82702 - RNA, 46 nt, Mus musculus
uuauuaaccauaugcauuugcaacaaaauacacuugaugggaccag

SEQ ID NO: 82703 - RNA, 46 nt, Mus musculus
acuaaaagcuugugccaccaugcuucugggaaccauuagggucuag

SEQ ID NO: 82704 - RNA, 42 nt, Mus musculus
gucucacacacacacacccucaacacacacacacgcgcacau

SEQ ID NO: 82705 - RNA, 45 nt, Mus musculus
ucugccgggaacgcgcgggugugugugugugugugugugugugug

SEQ ID NO: 82706 - RNA, 42 nt, Mus musculus
ugaaaagggaucacggucugcccaucacaguagucucuaggu

SEQ ID NO: 82707 - RNA, 42 nt, Mus musculus
agccaggacuacacagagaaacccuaucucgaaaccccgccc

SEQ ID NO: 82708 - RNA, 46 nt, Mus musculus
auuaccaaguucacuaaaagaacuugucucaaaauaugagggagau

SEQ ID NO: 82709 - RNA, 46 nt, Mus musculus
cacacauacauguuauccugccagguuuuguauagguucuggggau

SEQ ID NO: 82710 - RNA, 41 nt, Mus musculus
ugagccaccaugugguugcugggauuugaaccuaggaccuu

SEQ ID NO: 82711 - RNA, 91 nt, Mus musculus
gugugugugucugugugucugugugugugugugucucugugugugugugugugugugugugucugugugucuguguguuugucuguguguc

SEQ ID NO: 82712 - RNA, 41 nt, Mus musculus
agccacuaugugguugcugggauuugaagucaggaccuuug

SEQ ID NO: 82713 - RNA, 42 nt, Mus musculus
caacuuagcaagacaguauuucaaaauaaaaacaugccaggc

SEQ ID NO: 82714 - RNA, 46 nt, Mus musculus
ggucaacaagacuagaaagacagaacaaccccuucccaugccagac

SEQ ID NO: 82715 - RNA, 44 nt, Mus musculus
aucccagcaaccacaugguggcucacaaccaucuguacccucuu

SEQ ID NO: 82716 - RNA, 46 nt, Mus musculus
agaguuggauuuaucuaugucugugugugggguguguggguguggg

SEQ ID NO: 82717 - RNA, 42 nt, Mus musculus
acaucuguugucaguucuauuaaaucaaauucagggggagga

SEQ ID NO: 82718 - RNA, 45 nt, Mus musculus
auacacuguagcugucuucagacaccccagaagaggucaccagau

SEQ ID NO: 82719 - RNA, 29 nt, Mus musculus
gaguacaaaggacuugaaggcaccuggau

SEQ ID NO: 82720 - RNA, 45 nt, Mus musculus
ccagucuacagucuauccaccaaacugcagagccauggaggccag

SEQ ID NO: 82721 - RNA, 48 nt, Mus musculus
agacacuugcauaacaacuugucaaagaaagagagagagagagagaga

SEQ ID NO: 82722 - RNA, 46 nt, Mus musculus
aggcauuuccaugaccacugcacauuuuccaagcuuucccccaguc

SEQ ID NO: 82723 - RNA, 44 nt, Mus musculus
aggccaugaaucugaaggagaaggggguagcauauaggcuagag

SEQ ID NO: 82724 - RNA, 31 nt, Mus musculus
uugguaagaacacacuaaauaauccugaggu

SEQ ID NO: 82725 - RNA, 46 nt, Mus musculus
guucucuuugucuccugagucccacugucuguacccauucccaugu

SEQ ID NO: 82726 - RNA, 46 nt, Mus musculus
cugcguauaggcguuaguagcuuccauguuccuaccuauuccaguc

SEQ ID NO: 82727 - RNA, 46 nt, Mus musculus
caauauaaaauguaaaagguacuaguagugagucuagaggcaagac

SEQ ID NO: 82728 - RNA, 42 nt, Mus musculus
aagggacugggcuuugauauacaaacugcuuaccauggagca

SEQ ID NO: 82729 - RNA, 41 nt, Mus musculus
agaucacagagcaaggaaugacaaagccaggaggggugggg

SEQ ID NO: 82730 - RNA, 46 nt, Mus musculus
uccuaaucuccccgugugacagcaauagaaaaaugauguuagagau

SEQ ID NO: 82731 - RNA, 46 nt, Mus musculus
auauaguaucuguaaagucuucacugcuauaguggugugugugggg

SEQ ID NO: 82732 - RNA, 47 nt, Mus musculus
gaaguacagcuccauaaagacugcucgagaagcaaguggugugagau

SEQ ID NO: 82733 - RNA, 81 nt, Mus musculus
cuuugccucgucaggccacaccaggugucccugcacagcaguccccaaguaugugagacagaugguucugaacagagagau

SEQ ID NO: 82734 - RNA, 46 nt, Mus musculus
acccagcuacaguccauggugcucuguugagugggcuucgagaagc

SEQ ID NO: 82735 - RNA, 47 nt, Mus musculus
gacuaugauuuaauggcucagccgaucacuccuggccccucaauucc

SEQ ID NO: 82736 - RNA, 62 nt, Mus musculus
uagugaugaugugauugucggccggugccuggccauucucaaagggauuuuuggcagcagug

SEQ ID NO: 82737 - RNA, 49 nt, Mus musculus
uacuauuggcccugguagcaggagaagcugcuggcauuauggagaacau

SEQ ID NO: 82738 - RNA, 90 nt, Mus musculus
ucccugguuacauccaggccaucugguccugucacugccaguaucauggaauaucucccacacccccuuagcauuccuuacccaccacca

SEQ ID NO: 82739 - RNA, 47 nt, Mus musculus
guuuccuauguagcaguuguaggccacugcuuagcagcacagacaag

SEQ ID NO: 82740 - RNA, 58 nt, Mus musculus
ugcauguaaaaaugaagaaacauccugagacuuagauccuauuugcccaaacgccuca

SEQ ID NO: 82741 - RNA, 46 nt, Mus musculus
ucuuauagagacagaauuaggaauauugaaguuuucuaauauagau

SEQ ID NO: 82742 - RNA, 46 nt, Mus musculus
uguggcuuuagcugaaggcuuggacauuaaacugaacacagcagug

SEQ ID NO: 82743 - RNA, 44 nt, Mus musculus
ugauggccgacuaggccaucuuuugauauauaugcaagcuugug

SEQ ID NO: 82744 - RNA, 46 nt, Mus musculus
auacugaguaacuguuuguggucuuaaaauacuguuuggggcagga

SEQ ID NO: 82745 - RNA, 46 nt, Mus musculus
gugaaguuucucugaauauuauuuuuaucagauaaaaauguaagag

SEQ ID NO: 82746 - RNA, 46 nt, Mus musculus
aagcuagaagaaaaacuucaagaauuggaagccaaucccccaaggu

SEQ ID NO: 82747 - RNA, 41 nt, Mus musculus
gauugaacauuggaagaagauagugaaaacucaggaggagu

SEQ ID NO: 82748 - RNA, 42 nt, Mus musculus
cuucaacguccucaauaauaaaccuguaucccuuggccaggc

SEQ ID NO: 82749 - RNA, 42 nt, Mus musculus
ucauagucuaagaccuuuggcauugaacucugaagcugagac

SEQ ID NO: 82750 - RNA, 73 nt, Mus musculus
cuuggugucacucacuauugccaugacuccagcauuggggcugcagauaguuuacauugggacaaaacuaaga

SEQ ID NO: 82751 - RNA, 113 nt, Mus musculus
aggcagucacccuuuuuugauaggucaucugucuuugccauaggagugacccaucucaugggaugguauaguugagugcuugcaaguauaaaauugaaggguuuccauugaga

SEQ ID NO: 82752 - RNA, 75 nt, Mus musculus
cgagauuauuagaguuuagauuuccuuuaggcugggaguagcuaauuccuugaggcguuaaguaugacugucacu

SEQ ID NO: 82753 - RNA, 46 nt, Mus musculus
cccaccagcuccugagaccacgguaaugcauaaacagcaccaagca

SEQ ID NO: 82754 - RNA, 42 nt, Mus musculus
aaucaaguaggcugcucagaaaauagagggaagaaacaaagg

SEQ ID NO: 82755 - RNA, 46 nt, Mus musculus
uugaagccagcuuggucuacauagcaaguuccaggacagacaaggc

SEQ ID NO: 82756 - RNA, 43 nt, Mus musculus
gaacuguugaccuguaggcuaguuuuucauuuaaaggacaggu

SEQ ID NO: 82757 - RNA, 56 nt, Mus musculus
acaugaucucugugcauaaugcgugccugcugcccauggaagacagaagaggguuu

SEQ ID NO: 82758 - RNA, 45 nt, Mus musculus
agcucauaaaauaagcuuuuagcuuuguguuuguuggguggggaa

SEQ ID NO: 82759 - RNA, 46 nt, Mus musculus
cuucugacaggagggcuagcaaacagccggggacacuuauccagag

SEQ ID NO: 82760 - RNA, 45 nt, Mus musculus
gggaacuguaugacugagcaugcuaugaguauacagaccgagaag

SEQ ID NO: 82761 - RNA, 46 nt, Mus musculus
uggcuuuuuaugaaguuuuaauuuuuuaaauaauauuuaaauagag

SEQ ID NO: 82762 - RNA, 87 nt, Mus musculus
uauuaaauuauaucccuuguuugcuagauagggaaagggaauuauguucgguagagcaggucuuucaggagcagcuaaagcuaggag

SEQ ID NO: 82763 - RNA, 46 nt, Mus musculus
cucucuccagcucuaaaguuagcgcuuuaauuugggguggucauaa

SEQ ID NO: 82764 - RNA, 46 nt, Mus musculus
gaguugguugugagucacucggggcugcugggaauugagcucagau

SEQ ID NO: 82765 - RNA, 45 nt, Mus musculus
aaugacuguggaguucauaaaggauccgucaguccuuggggugga

SEQ ID NO: 82766 - RNA, 46 nt, Mus musculus
aaaggugauuauuauagguucagguguuucuggcuuggcagcagcu

SEQ ID NO: 82767 - RNA, 46 nt, Mus musculus
uacugugcuuguccaccgaguucacaguuacuuagagcgccauggu

SEQ ID NO: 82768 - RNA, 46 nt, Mus musculus
uagaugacauaaguuguauuacacauccacagaaacacgccaccug

SEQ ID NO: 82769 - RNA, 41 nt, Mus musculus
ugaauaugucucugcgcauguuuacuuucuaggccccgcuu

SEQ ID NO: 82770 - RNA, 46 nt, Mus musculus
ggcugcagcaggagaagcucauucaagguuaguguaggcuacagaa

SEQ ID NO: 82771 - RNA, 46 nt, Mus musculus
agcggauauaaauuacuuuaagcagucacugccuuucccuucaaac

SEQ ID NO: 82772 - RNA, 45 nt, Mus musculus
aaucuacacugaaaaaaaauuugucgcaacucuuuuuggggugga

SEQ ID NO: 82773 - RNA, 46 nt, Mus musculus
ucagucugugaauucggcaaagcuuuauaacucuucucaggcagaa

SEQ ID NO: 82774 - RNA, 46 nt, Mus musculus
agcaagucuuguauauagugaaguguuucugauguugcuggcagaa

SEQ ID NO: 82775 - RNA, 45 nt, Mus musculus
uuguaguucagugugauugcagacuggaaggaagaccauucuaga

SEQ ID NO: 82776 - RNA, 46 nt, Mus musculus
ugucuagcagguucaggacauauuuguguuuuaauuuggaucagau

SEQ ID NO: 82777 - RNA, 46 nt, Mus musculus
gaaauacugugugcuuuguccuacugccuuucaauaaggaucagca

SEQ ID NO: 82778 - RNA, 52 nt, Mus musculus
acaguucauuaaaggauacuagaacccaucucccauccccacccagauuuac

SEQ ID NO: 82779 - RNA, 46 nt, Mus musculus
acgaacaaugucuuuucuuuuuuuaaauuuacaacacuuucuagga

SEQ ID NO: 82780 - RNA, 45 nt, Mus musculus
gcugaaacaaguuugguuauugaaugacaugcauuguaguuggag

SEQ ID NO: 82781 - RNA, 45 nt, Mus musculus
gaucagugugagcacuagacuggugaucaucucaggcccccuccc

SEQ ID NO: 82782 - RNA, 46 nt, Mus musculus
cuuaguaaaagcacaggaguuuaaucccagcacucaggaggcagag

SEQ ID NO: 82783 - RNA, 25 nt, Mus musculus
uuauuaggaugaagcucucucuggg

SEQ ID NO: 82784 - RNA, 46 nt, Mus musculus
ggucggagaauugcugaaaagaucccaaacucacaaguaugcaaag

SEQ ID NO: 82785 - RNA, 29 nt, Mus musculus
cugucuuuugcauuacuuucccuguuacc

SEQ ID NO: 82786 - RNA, 46 nt, Mus musculus
gaauuagaagaaaauaaaugguuagagaaaacaaagaaugucagau

SEQ ID NO: 82787 - RNA, 46 nt, Mus musculus
ccaccuccucaagccccaccugaggaagaaaaugaaagugagccgg

SEQ ID NO: 82788 - RNA, 45 nt, Mus musculus
auuauaaauugauuugaucauuguuauuucuuuaaaauuugaagu

SEQ ID NO: 82789 - RNA, 42 nt, Mus musculus
aauuuugagguauauauagauacuguuuuauugccuaaagau

SEQ ID NO: 82790 - RNA, 46 nt, Mus musculus
ugauuguugcuuuuggccgcuugcuuuuuaacuuaaucucagagau

SEQ ID NO: 82791 - RNA, 48 nt, Mus musculus
aguucccucucccuaaggagauuggggcauuuuggcuaaggucacccc

SEQ ID NO: 82792 - RNA, 42 nt, Mus musculus
ccuuggugccccuccuaaccccuucuccuucagccccccaug

SEQ ID NO: 82793 - RNA, 46 nt, Mus musculus
uaauacuuggaugaaaaauaaauuaaaacaaaaaaaugcagcagua

SEQ ID NO: 82794 - RNA, 46 nt, Mus musculus
aaguacacuguagcugucuucagaugcaccagaagagggugccaga

SEQ ID NO: 82795 - RNA, 45 nt, Mus musculus
ugagaucugacacccucuucuggaggucugaagacagcuacagug

SEQ ID NO: 82796 - RNA, 84 nt, Mus musculus
aaggccuguugggggaggagggauuaucagacaugcauuagaaaggaggaguauuggggauacuggaauaguuuuagcagagau

SEQ ID NO: 82797 - RNA, 42 nt, Mus musculus
uauuagccuuaaccagagaugcuuaaucugauggggaaauug

SEQ ID NO: 82798 - RNA, 41 nt, Mus musculus
cugcggcccgcggcggccaggcggcccgagauguugucugg

SEQ ID NO: 82799 - RNA, 41 nt, Mus musculus
aacagcaaaacaaaauaaguaaauuauaacuuggagcuagc

SEQ ID NO: 82800 - RNA, 41 nt, Mus musculus
ggcgcgggcaggcucgauggcucccgcaaagaaggguggcg

SEQ ID NO: 82801 - RNA, 46 nt, Mus musculus
agggaauaaggaacguuccauaucccauccgaguacgcuuguccag

SEQ ID NO: 82802 - RNA, 47 nt, Mus musculus; identical to SEQ ID NO: 60801

SEQ ID NO: 82803 - RNA, 45 nt, Mus musculus
aaaggacagagugcagaggacuagucuauaguggaagaugguggg

SEQ ID NO: 82804 - RNA, 45 nt, Mus musculus
aggggaaagggaagcagaggaaacaggggaggggaagaucagaga

SEQ ID NO: 82805 - RNA, 46 nt, Mus musculus
agggaauaaaggcagagccaggaaucuggcccauggaggauuccag

SEQ ID NO: 82806 - RNA, 42 nt, Mus musculus
cugaacugaaguccugauguguguguggcaggcaccagggag

SEQ ID NO: 82807 - RNA, 70 nt, Mus musculus
agcaagaagaagccuuugagguuuuuggucaggauccggagggccaccuccaccaucucggagagcgaag

SEQ ID NO: 82808 - RNA, 45 nt, Mus musculus
acuuaccuaagagguaguccacccuggaggggucaagggccagca

SEQ ID NO: 82809 - RNA, 46 nt, Mus musculus
ugagauccaggccaucuagccuuguaccccuggccuucucauccag

SEQ ID NO: 82810 - RNA, 47 nt, Mus musculus
gagggacaaaggagccaucacacccaggguucuaaauuguccagaag

SEQ ID NO: 82811 - RNA, 41 nt, Mus musculus
gaguggacaccagaauuuuugauucauggacggucugggga

SEQ ID NO: 82812 - RNA, 44 nt, Mus musculus
cucagagccucugguggcaucucguuauccgaguaccagucccg

SEQ ID NO: 82813 - RNA, 46 nt, Mus musculus
uagauaaggaagucccugcacacguaccucucccucccugccauag

SEQ ID NO: 82814 - RNA, 42 nt, Mus musculus
gcugcccccaucucccuccauuccaagccacacugcccucag

SEQ ID NO: 82815 - RNA, 24 nt, Mus musculus
guccaaagaggugaaggguccagu

SEQ ID NO: 82816 - RNA, 45 nt, Mus musculus
uuuaaaagaaaguuuuaaaggcucuguugaaggaaggguggguag

SEQ ID NO: 82817 - RNA, 46 nt, Mus musculus
agggccuugucucagaaaaaccaagccccauaaaaagagccauuga

SEQ ID NO: 82818 - RNA, 46 nt, Mus musculus
cagccagggcuauauaaugagaccaugucagaaaagaaagacagau

SEQ ID NO: 82819 - RNA, 45 nt, Mus musculus
ugugcggggauguguguguguguguguguguguguguguggugug

SEQ ID NO: 82820 - RNA, 45 nt, Mus musculus
aaauaaaugcuguggaaauagucauccacgggagguuuuaagcag

SEQ ID NO: 82821 - RNA, 42 nt, Mus musculus
uuguacccugagagccucacauuucuccaccagggcccacag

SEQ ID NO: 82822 - RNA, 46 nt, Mus musculus
cucuggcauguucuuuggacauggagcaucaauaaugaugcuggag

SEQ ID NO: 82823 - RNA, 46 nt, Mus musculus
cccucuguuauauguaugugugugugugugugugugugugugugug

SEQ ID NO: 82824 - RNA, 42 nt, Mus musculus
gugccuuuaacccuuucuuacccgcgcugggcaaggcagcag

SEQ ID NO: 82825 - RNA, 45 nt, Mus musculus
ucaaagccccggucuggaggaaagaaacccggaacccggucagga

SEQ ID NO: 82826 - RNA, 45 nt, Mus musculus
cuguuuucucuucaucaaauucaaucccacacucacugcccagcu

SEQ ID NO: 82827 - RNA, 42 nt, Mus musculus
uuaggauguccaaaaccaagggauuguccgggucugccacca

SEQ ID NO: 82828 - RNA, 45 nt, Mus musculus
gcgcucauacugcgugugcuggaguggccucacugacaccuguaa

SEQ ID NO: 82829 - RNA, 46 nt, Mus musculus
cuuggaaaacuuacagaaaaaaaaaaauguucccugccccccaccc

SEQ ID NO: 82830 - RNA, 44 nt, Mus musculus
guugugagcugccaugugggugcugggacuugaaccuggguccu

SEQ ID NO: 82831 - RNA, 42 nt, Mus musculus
gaggcacuaccugugcccguccaguuagguucuugggcagaa

SEQ ID NO: 82832 - RNA, 42 nt, Mus musculus
cccaugggugcaggaguaaacaccagccaaagaggcccaguu

SEQ ID NO: 82833 - RNA, 45 nt, Mus musculus
cgcguggcuuuggcuggagaguauggagcaguuacuuacagguga

SEQ ID NO: 82834 - RNA, 99 nt, Mus musculus
uuauaggaaagggcccggaugucguccugaagggagcagacggggagcaggcuccagggacucccaccuuucccuuugccaucaagaugauguggaaua

SEQ ID NO: 82835 - RNA, 42 nt, Mus musculus
ccaggcacagcaagaacgcagaugggggccugggggagagau

SEQ ID NO: 82836 - RNA, 41 nt, Mus musculus
uugccuucuucugucuuucuguuuuucuccccgucgcccuc

SEQ ID NO: 82837 - RNA, 42 nt, Mus musculus
guggggcgcugcaggggaaggaccuuaacucccgcggggaag

SEQ ID NO: 82838 - RNA, 46 nt, Mus musculus
aaaaccaugaccgacaaggcacccccuggugucuaacugccccaaa

SEQ ID NO: 82839 - RNA, 46 nt, Mus musculus
ugaaaucgacaacuugugucucaagucaggccgggagacagaugag

SEQ ID NO: 82840 - RNA, 45 nt, Mus musculus
ucggaacuggaacuucuguaaacaucaccugccugaucugcagag

SEQ ID NO: 82841 - RNA, 42 nt, Mus musculus
ccaccuccuugccuccuaccccucccccaacccuugggaugu

SEQ ID NO: 82842 - RNA, 45 nt, Mus musculus
cuaacaugagauccuguaaaaggggagggaauggaagggaggggg

SEQ ID NO: 82843 - RNA, 41 nt, Mus musculus
gauucugugugguguguggugugugugugugugugugugug

SEQ ID NO: 82844 - RNA, 73 nt, Mus musculus
cgggauacucaguuucccagggagacaccugaagaugagauucauguguguggugugugugugugugugugug

SEQ ID NO: 82845 - RNA, 73 nt, Mus musculus; identical to SEQ ID NO: 82844

SEQ ID NO: 82846 - RNA, 46 nt, Mus musculus
uggcuugcgggauacucaguuucccagggagacaccugaagaugag

SEQ ID NO: 82847 - RNA, 41 nt, Mus musculus
uugagaccguugcacagacuccugguuucugguugcuggga

SEQ ID NO: 82848 - RNA, 45 nt, Mus musculus
gcacuaguccagguucgugggcuuaggugugaccccugcccccag

SEQ ID NO: 82849 - RNA, 45 nt, Mus musculus
agucuugcuagacuggggauccugucucugccuucuggggcugga

SEQ ID NO: 82850 - RNA, 64 nt, Mus musculus
ggggguuggggagaggccucuauuauuuccguggucuggcaggucuggaagcaaagcuucaagu

SEQ ID NO: 82851 - RNA, 45 nt, Mus musculus
cauuggaacucuucuuccugaccuggccugacucuugugucuccu

SEQ ID NO: 82852 - RNA, 24 nt, Mus musculus
augcugugcuuggugccacuggca

SEQ ID NO: 82853 - RNA, 49 nt, Mus musculus
ccaaguuaucccugguugauuaauagagaugccuacagccugggccugg

SEQ ID NO: 82854 - RNA, 164 nt, Mus musculus
uuccugggcuuggggucucaggcagagaccaugaugagaagagagaagaaggagaaugaagucgcaaugggauagguggauugggagcgugugaccaugagggcuggccagucggaguagcagugacccagguggaauauggcaagugauaucuugguguuauu

SEQ ID NO: 82855 - RNA, 46 nt, Mus musculus
gccaacccuuauuuuauuugcuuugaaguagaggcuuuacagccag

SEQ ID NO: 82856 - RNA, 41 nt, Mus musculus
aagcgaaagcuacuacaguuuggggaagggcccaguaggga

SEQ ID NO: 82857 - RNA, 46 nt, Mus musculus
uagaaagcagauggagaggcaggggugagauauauaagucugagag

SEQ ID NO: 82858 - RNA, 42 nt, Mus musculus
gccuagaaccauguggccuggguucugaugucccgccugcug

SEQ ID NO: 82859 - RNA, 41 nt, Mus musculus
ggugcucuguccggccuggggaggagaguaaacgggccuag

SEQ ID NO: 82860 - RNA, 45 nt, Mus musculus
ccugugugugugucugugcaccacaugcauucaauguuagcagaa

SEQ ID NO: 82861 - RNA, 42 nt, Mus musculus
cacccucaucccuccaucaccugcucuagucccgagccccuu

SEQ ID NO: 82862 - RNA, 44 nt, Mus musculus
uggggggcauccugcaaucccagcauuugagacauggaggcagg

SEQ ID NO: 82863 - RNA, 45 nt, Mus musculus
ugguagggaggccgcuauggaaaaaaugagcccccaagaacagga

SEQ ID NO: 82864 - RNA, 45 nt, Mus musculus
agagaccuucagugacaaugcccucuguuucucucucauuuccaa

SEQ ID NO: 82865 - RNA, 24 nt, Mus musculus
cuggucacagagcggggccauagg

SEQ ID NO: 82866 - RNA, 46 nt, Mus musculus
ugacucucgggcccugagaggugaaggauguaccuacgcugcagac

SEQ ID NO: 82867 - RNA, 42 nt, Mus musculus
ucacugcccagggucugugcaucuacaucuuagcagccaccg

SEQ ID NO: 82868 - RNA, 42 nt, Mus musculus; identical to SEQ ID NO: 82867

SEQ ID NO: 82869 - RNA, 25 nt, Mus musculus
uggaugagggcuuggaaccgcuucu

SEQ ID NO: 82870 - RNA, 42 nt, Mus musculus
gcaauguccgugcccauuuauugaugggcggcagaaggagau

SEQ ID NO: 82871 - RNA, 41 nt, Mus musculus
uggucuguaucucacauguggcuaauuuccugggccgugag

SEQ ID NO: 82872 - RNA, 23 nt, Mus musculus
gaaugaaggcacccgaggcaucg

SEQ ID NO: 82873 - RNA, 46 nt, Mus musculus
ccuacacugacuuggaguuuguggagauccugcugcucccuguuuc

SEQ ID NO: 82874 - RNA, 45 nt, Mus musculus
ugguccuguggaccugucaccugggacuugcagggaaaaccagaa

SEQ ID NO: 82875 - RNA, 42 nt, Mus musculus
aaggcuucagcugcagugugacgucacucuagcugugcaggg

SEQ ID NO: 82876 - RNA, 42 nt, Mus musculus
uuacucaggcaagaaaaccaggggauuuagcucuaugcaugg

SEQ ID NO: 82877 - RNA, 75 nt, Mus musculus
gauagcuccgagugcugcaguuuaaugggagcccaguauaaucaggguaggagcacugggaagugaggggcagag

SEQ ID NO: 82878 - RNA, 100 nt, Mus musculus
gccucucacaagaagccaugcuggagcaguucacaaaggaacaagaggaguuugccucugugggaugagugccggguggaaggccagagcaugcgugucu

SEQ ID NO: 82879 - RNA, 42 nt, Mus musculus
ggggggggaacagguugguaugaucuucauaagggaccacgg

SEQ ID NO: 82880 - RNA, 45 nt, Mus musculus
acuacggaugagagagugagggugaagaagauagaggccuugguu

SEQ ID NO: 82881 - RNA, 44 nt, Mus musculus
gacauuauuguagaaagagggugcuuaauauaaaaggagccagg

SEQ ID NO: 82882 - RNA, 44 nt, Mus musculus
agagggcgccagaucaucuggagcugggauuacugguuaggaga

SEQ ID NO: 82883 - RNA, 46 nt, Mus musculus
guuguaggcauccugaagaugagggcaaggucacagaggucaagug

SEQ ID NO: 82884 - RNA, 41 nt, Mus musculus
uugcauuuauaaauaauuuaguauacgggcuaucagguuua

SEQ ID NO: 82885 - RNA, 52 nt, Mus musculus
agcaugagugugagugugugugauguguauguauggugaguguguauguaug

SEQ ID NO: 82886 - RNA, 41 nt, Mus musculus
guaugugugugagugugugugugugagugaugaggggguac

SEQ ID NO: 82887 - RNA, 46 nt, Mus musculus
agacagcuacaguguacucauaugcauaaaauaaaucaaucaaucg

SEQ ID NO: 82888 - RNA, 41 nt, Mus musculus
ugacaagugaauaagccauaaggaucccugccugcacuuca

SEQ ID NO: 82889 - RNA, 45 nt, Mus musculus
aggcucacaccaccaucccaggcucugcaaucuaucuuggcguau

SEQ ID NO: 82890 - RNA, 45 nt, Mus musculus
guuccaaccaggcucagccacagaaauggaaaucucaugccagga

SEQ ID NO: 82891 - RNA, 46 nt, Mus musculus
cggcgcugccugcaugaguuguacguuugguuuuaugccccaggau

SEQ ID NO: 82892 - RNA, 42 nt, Mus musculus
ucgcaccgggacugggggagaaguuauucaggcacaagggaa

SEQ ID NO: 82893 - RNA, 42 nt, Mus musculus
gggucgggcucagcugcccuugggaagccugggaccugaggu

SEQ ID NO: 82894 - RNA, 46 nt, Mus musculus
aguacaucaaagccugcaagacaggcaacauggaccaggcccuauc

SEQ ID NO: 82895 - RNA, 42 nt, Mus musculus
ggcugguggugaagauggcagugguggcugcaggggccagag

SEQ ID NO: 82896 - RNA, 41 nt, Mus musculus
aagcgccgggcaugguggcacaugccuuuaaucccagcacu

SEQ ID NO: 82897 - RNA, 42 nt, Mus musculus
gagaggcaggcggaggacaccaugugcgaauacuggccaggu

SEQ ID NO: 82898 - RNA, 23 nt, Mus musculus
augcugaaacuccaacacuugcc

SEQ ID NO: 82899 - RNA, 41 nt, Mus musculus
gauaggcuuuggugggaagcaccuuccuggcuuugcuugga

SEQ ID NO: 82900 - RNA, 45 nt, Mus musculus
acaccggcuguggaucuugaacuggugaggaugaagggggcuggc

SEQ ID NO: 82901 - RNA, 46 nt, Mus musculus
aagacuguagccgcgauugcugaggagugcaggaaagaguagcuug

SEQ ID NO: 82902 - RNA, 45 nt, Mus musculus
guugcaaaguacgugugugaucagugacgcgugucccgcguugga

SEQ ID NO: 82903 - RNA, 46 nt, Mus musculus
uuugcuaaacuuuuaaauaguugugaauucagcauccagcccguag

SEQ ID NO: 82904 - RNA, 43 nt, Mus musculus
caucccaggcuguagcagcuccugggccacaaagcaguagcag

SEQ ID NO: 82905 - RNA, 42 nt, Mus musculus
uggcugugacaucugugggagugcuggucugaccgggccccu

SEQ ID NO: 82906 - RNA, 46 nt, Mus musculus
gcgcaaucacagcagccaggucccacuugagcuuccccaggaccag

SEQ ID NO: 82907 - RNA, 42 nt, Mus musculus
aaaauuguguccgcgggguguucccgggagacagcaggagac

SEQ ID NO: 82908 - RNA, 46 nt, Mus musculus
caccacucuagagggaacagcuauuuauuuugcuauggacaaagac

SEQ ID NO: 82909 - RNA, 49 nt, Mus musculus
gacgaugaccugccugagagcgcgccugagucugagggagagucugagg

SEQ ID NO: 82910 - RNA, 46 nt, Mus musculus
gggcuuucccugagcuggggaugggauuuguuggucacugggggua

SEQ ID NO: 82911 - RNA, 41 nt, Mus musculus
caccagacaugcauaugauacacauacacacaggcaaaaca

SEQ ID NO: 82912 - RNA, 43 nt, Mus musculus
gguuccccaaccuccuggaaauguaaguuugugacuuggauuc

SEQ ID NO: 82913 - RNA, 83 nt, Mus musculus
auaggcgggagaccuuugauuuugaugacgacugugacagccugacgugggaagagaaugaagacacacugcugcuaugggag

SEQ ID NO: 82914 - RNA, 46 nt, Mus musculus
ccaucacgaucgaucgguucaacagagaguugucaaaggcccgcug

SEQ ID NO: 82915 - RNA, 45 nt, Mus musculus
ggcauguaguuguucuagauaccagaacaugcuguaggcauagau

SEQ ID NO: 82916 - RNA, 46 nt, Mus musculus
gaggugacaggcucagcucaggaaggaaugaggggcaaacgcagac

SEQ ID NO: 82917 - RNA, 44 nt, Mus musculus
gagaggaauccccuagcuuagagccaggacagguguggcauagu

SEQ ID NO: 82918 - RNA, 23 nt, Mus musculus
cggguccugugaggggggcccug

SEQ ID NO: 82919 - RNA, 88 nt, Mus musculus
gcuucuagcaccuuugcaucuagucuugcuuguacugaggcgcgguaaauacguuuuuaaaaugaagaaaauucccaucacaaguacu

SEQ ID NO: 82920 - RNA, 45 nt, Mus musculus
aaguccaccuaugcuaauuacuaauuucauaguacgucccccagc

SEQ ID NO: 82921 - RNA, 46 nt, Mus musculus
ggacggaaugaauaagaaggggaaggaaggcggauccacgugguuu

SEQ ID NO: 82922 - RNA, 44 nt, Mus musculus
uucucuguuaacucuaagaaagagauggagcuugacccucggga

SEQ ID NO: 82923 - RNA, 45 nt, Mus musculus
uccuaaccaucuugcaguagaagaaagguucccgcuaggcaugca

SEQ ID NO: 82924 - RNA, 45 nt, Mus musculus
cugcaucggguuguccugaaguuuaggaaagccauguggaguugg

SEQ ID NO: 82925 - RNA, 46 nt, Mus musculus
agagacacaggcagggacaucagagaagucugacccuuggggggag

SEQ ID NO: 82926 - RNA, 50 nt, Mus musculus
gagccgcccgaguaaaagaggggaccaaaauggucggguuauauagagaa

SEQ ID NO: 82927 - RNA, 45 nt, Mus musculus
cuaggguuucacggacccugcaacauaguguugguucuuagugca

SEQ ID NO: 82928 - RNA, 46 nt, Mus musculus
guugccagccucuugcucccugguucuccuagucccugagcaucag

SEQ ID NO: 82929 - RNA, 46 nt, Mus musculus
gcugucagacagaugcagucauguccaggcugaguuagccccggag

SEQ ID NO: 82930 - RNA, 57 nt, Mus musculus
ggcuugacugaaagugaguugaaucgcacuaauuaaaacuuuguauuccauaaggag

SEQ ID NO: 82931 - RNA, 69 nt, Mus musculus
aacaguugaguuaauagcaaacgggguguaggugcucgcaguggauacggugagcugugagaauggggu

SEQ ID NO: 82932 - RNA, 83 nt, Mus musculus
gaagcuggggccaggguagcaguuaguguucuugggaagccaggcaagguuguccacaggucucuuuuuccgaagggugggac

SEQ ID NO: 82933 - RNA, 43 nt, Mus musculus
ugaggccucuccccuauguuucuggggccccuucaaagugcag

SEQ ID NO: 82934 - RNA, 46 nt, Mus musculus
guucagguaacuugagucuggccccacaccccacaggaggucugaa

SEQ ID NO: 82935 - RNA, 45 nt, Mus musculus
uggccucugccuuuuggaccugacuggaaguaggggacaccgggg

SEQ ID NO: 82936 - RNA, 42 nt, Mus musculus
uugaggucaucugccuuggagcauguggugguggcgggggga

SEQ ID NO: 82937 - RNA, 31 nt, Mus musculus
ucuuggcugaggcuagaagaugugugugcca

SEQ ID NO: 82938 - RNA, 42 nt, Mus musculus
agguggccaguggggugcugcuccgcccaccagguagguguu

SEQ ID NO: 82939 - RNA, 64 nt, Mus musculus
uaauggcuaccaguccagcucugaagccgaagccacugccagcuugugacugugaccugugaac

SEQ ID NO: 82940 - RNA, 42 nt, Mus musculus
ccagcccugccugucccguaguguaggauuguagggcugagg

SEQ ID NO: 82941 - RNA, 45 nt, Mus musculus
gauacuggaucaguguuugccuucggagagaauaaaauggggcag

SEQ ID NO: 82942 - RNA, 45 nt, Mus musculus
ggaggcuguccucaagaugagagcugcccacuguugugaccucag

SEQ ID NO: 82943 - RNA, 42 nt, Mus musculus
uguugccacagauggccauuuggccucugcauuuaaagaaag

SEQ ID NO: 82944 - RNA, 42 nt, Mus musculus
agucugccucccgagugcugguguuaaaggcugcuggcccuu

SEQ ID NO: 82945 - RNA, 45 nt, Mus musculus
cuuagcacucaagugguacauagacaugcaggcaaaauauccaaa

SEQ ID NO: 82946 - RNA, 41 nt, Mus musculus
ggcuguccaggaacucaacucuguagaccaggcuggccucg

SEQ ID NO: 82947 - RNA, 44 nt, Mus musculus
gggguauggggaccacaagcccaagucuucuacugcggcccagg

SEQ ID NO: 82948 - RNA, 91 nt, Mus musculus
gccaugggcuauucacacuccuuggugauagcgcgagacgagagcgaggcugagaaggagaagcugcagaggcuaccugaguacaccccgc

SEQ ID NO: 82949 - RNA, 45 nt, Mus musculus
cucguggcagcuguccuuuccacgugcacugggaccagaagucag

SEQ ID NO: 82950 - RNA, 42 nt, Mus musculus
gguauggggugggcaguuagagguuggucauccagcagucag

SEQ ID NO: 82951 - RNA, 45 nt, Mus musculus
ugguuugacugcuuuaacuaggauuaguucaguggugcuuggggg

SEQ ID NO: 82952 - RNA, 46 nt, Mus musculus
aggaagggaguuaacgaggauggugggauucgguugaaggugccug

SEQ ID NO: 82953 - RNA, 41 nt, Mus musculus
gggacccgggaggccaggucgcaccuccagguuaggcuggu

SEQ ID NO: 82954 - RNA, 45 nt, Mus musculus
ccgugccaaggggaaugggagaaauuucacaaggccccaccccua

SEQ ID NO: 82955 - RNA, 46 nt, Mus musculus
ucaaaucccaacaaccacaugguggcucacaaccaucuuuaaagag

SEQ ID NO: 82956 - RNA, 35 nt, Mus musculus
uuuaaaggggagaaaaaaccaaaaacaaaaaacaa

SEQ ID NO: 82957 - RNA, 49 nt, Mus musculus
guccacaucuaggucuggacgacauaucgagaccaugccuuaaaagaaa

SEQ ID NO: 82958 - RNA, 45 nt, Mus musculus
gcuuccugguucaaggugaggucuaggcaggaaagaaagcggaga

SEQ ID NO: 82959 - RNA, 64 nt, Mus musculus
auuaggaaccccuucccagauccacacagugaggcgugugcgacauaacaggugaugugcaugg

SEQ ID NO: 82960 - RNA, 46 nt, Mus musculus
auacaaauccauugagccuuaucugaagaagaaggaugagucccag

SEQ ID NO: 82961 - RNA, 45 nt, Mus musculus
cccugugucuguacaauaagacugugccaacugagcccgucccca

SEQ ID NO: 82962 - RNA, 45 nt, Mus musculus
ggagccucgccuugagguggcuuuauuaagaagugaaggccucug

SEQ ID NO: 82963 - RNA, 42 nt, Mus musculus
gccuuaaaaugacaagccaggcccugucacuuaagcacucag

SEQ ID NO: 82964 - RNA, 46 nt, Mus musculus
ucugcguuccaggccagcuaggacuguccagugagaccccgucuua

SEQ ID NO: 82965 - RNA, 34 nt, Mus musculus
agcuaggagccuucccacaaggcaagaacuccag

SEQ ID NO: 82966 - RNA, 44 nt, Mus musculus
ccaccaggucccaagaggggcaggccuuaccuguggguccauag

SEQ ID NO: 82967 - RNA, 47 nt, Mus musculus
gcaugaacagcaggaagaggcaggcggcucucauggccauggaguga

SEQ ID NO: 82968 - RNA, 46 nt, Mus musculus
acaguaggaagucagcauagguguguucagugaguggcucccaggu

SEQ ID NO: 82969 - RNA, 46 nt, Mus musculus
guccgggaauggggggagaggauccaggucauauuggcccugagcc

SEQ ID NO: 82970 - RNA, 98 nt, Mus musculus
cagaccugccuuccuccaccaagagauccuuauuaaacacagcccccaaagcacagaauggauucaauuuguggccuggguucagcucugccucugca

SEQ ID NO: 82971 - RNA, 42 nt, Mus musculus
agugucaggaugcuaaaugcaaauccaaaccuaagggcuggg

SEQ ID NO: 82972 - RNA, 45 nt, Mus musculus
uguucucauaugacuucagccuuucccuuuguaagagaugagaga

SEQ ID NO: 82973 - RNA, 39 nt, Mus musculus
uucuuucucuugcuuggaagaaacuaacauuuaaugagc

SEQ ID NO: 82974 - RNA, 46 nt, Mus musculus
uauucggcccuuugcuuuuagaccuguccugccucugcacaggagu

SEQ ID NO: 82975 - RNA, 46 nt, Mus musculus
ugugacagacuccagcagguacuucgucauccgaauugaagaugga

SEQ ID NO: 82976 - RNA, 42 nt, Mus musculus
gucucuguuaauuucccaucuacuguuagaagcgucucugag

SEQ ID NO: 82977 - RNA, 41 nt, Mus musculus
ucugacaggggccaggaggcgggggaugggggacgagccug

SEQ ID NO: 82978 - RNA, 42 nt, Mus musculus
ggguucgggacauggcaggugaggcccgggcggcgccagcgg

SEQ ID NO: 82979 - RNA, 46 nt, Mus musculus
gagaaguuucuggaaagagggcuacaaagggaaccugaggggauga

SEQ ID NO: 82980 - RNA, 41 nt, Mus musculus
ccgggagaggcagccccagggcgugcgggauccgggagccc

SEQ ID NO: 82981 - RNA, 45 nt, Mus musculus
ggacuucuuacccacccuuaaguuucccccugguugaggacagag

SEQ ID NO: 82982 - RNA, 41 nt, Mus musculus
gccuugcugcaagggguuaggggaacgacaacacggacaau

SEQ ID NO: 82983 - RNA, 45 nt, Mus musculus
gguccaaaccucggaacccuggggugugcguggagcaguuggaaa

SEQ ID NO: 82984 - RNA, 48 nt, Mus musculus
ucaacguguccagccgcuuugaggaagagaucaaagcugagcaagagg

SEQ ID NO: 82985 - RNA, 46 nt, Mus musculus
caacugaguuguggggaaaggcugugugcucugagggccuggagau

SEQ ID NO: 82986 - RNA, 45 nt, Mus musculus
cuguuagaugucuaagucaggugcggcuguagguaacuggagagg

SEQ ID NO: 82987 - RNA, 46 nt, Mus musculus
gcagaugguggcugggccuugauagcccuccccugccugccugaca

SEQ ID NO: 82988 - RNA, 46 nt, Mus musculus
ggaugugaaauguucaguguagcaucuggugcaugggggugggggu

SEQ ID NO: 82989 - RNA, 46 nt, Mus musculus
uucuuucccuggauccucugagacucccagagccucaaucccaguu

SEQ ID NO: 82990 - RNA, 69 nt, Mus musculus
gcuuugauaaauaacaaaaauagagagaugaauucauuaucacuuaauuacguggcaggcaggugguag

SEQ ID NO: 82991 - RNA, 50 nt, Mus musculus
uccccaccugaugugcugucaagugcguaaccuaguacuuggcccagaau

SEQ ID NO: 82992 - RNA, 42 nt, Mus musculus
caaccccuacaccgaguucaaggaguucuccaggaagcagau

SEQ ID NO: 82993 - RNA, 44 nt, Mus musculus
uggccagcaagcugagccggaggcugcagauggagggcgaaggc

SEQ ID NO: 82994 - RNA, 42 nt, Mus musculus
cccaccuucagggcggcgccuggcggcggggagugucaggaa

SEQ ID NO: 82995 - RNA, 26 nt, Mus musculus
cagaggucaucagagagaaguugaug

SEQ ID NO: 82996 - RNA, 45 nt, Mus musculus
uggcguuagacacccuaguuucagcaacugagaaauccagucaca

SEQ ID NO: 82997 - RNA, 45 nt, Mus musculus
auuucauuguuuuuaagugugugugugugugugugugugugugug

SEQ ID NO: 82998 - RNA, 41 nt, Mus musculus
guggugguggugguuuguguguguggugugugugugugugu

SEQ ID NO: 82999 - RNA, 45 nt, Mus musculus
ggugggaaaaugcagucagagaugugggaaagccgcugcuggaga

SEQ ID NO: 83000 - RNA, 42 nt, Mus musculus
cgguggccaauagccaugaguuggacaagaaccgugguaggg

SEQ ID NO: 83001 - RNA, 42 nt, Mus musculus
gaagggugacccagcacaguuugcacaugcaaagagagggag

SEQ ID NO: 83002 - RNA, 46 nt, Mus musculus
aggagaagaaaagacgacagcuaguugggaagagaaaggggaccag

SEQ ID NO: 83003 - RNA, 46 nt, Mus musculus
acagcucuguguccaagggagcuggguucuagggcucaggccucag

SEQ ID NO: 83004 - RNA, 45 nt, Mus musculus
acugauggacacaaauguucaacagugacuucaagagaaggccga

SEQ ID NO: 83005 - RNA, 42 nt, Mus musculus
aucucuauaaauuuguggcucaguucacugacuggcaaucag

SEQ ID NO: 83006 - RNA, 46 nt, Mus musculus
acacaaaaaccccagaaguaguggugcauaucugcaaucccagcac

SEQ ID NO: 83007 - RNA, 46 nt, Mus musculus
acccuuuugauggaggaggguuucuguuccuuuccaacaggcccac

SEQ ID NO: 83008 - RNA, 45 nt, Mus musculus
cacuugacccaguuaacaggaaggcuggcaggccagccaggccug

SEQ ID NO: 83009 - RNA, 46 nt, Mus musculus
uugccaguggggaaaucccugugcggacgccucccuuccagcaagc

SEQ ID NO: 83010 - RNA, 44 nt, Mus musculus
ccacuucacauggagacaguuccugaaugucaccuggcagguac

SEQ ID NO: 83011 - RNA, 46 nt, Mus musculus
uuuuuuuuaaaggggagagggauagggaucaacuaaaugccucucu

SEQ ID NO: 83012 - RNA, 45 nt, Mus musculus
ccagacucaagggccacacucagagcugagcugccaguccgguga

SEQ ID NO: 83013 - RNA, 45 nt, Mus musculus
aauauaauucuguuaacuaucaaaauaguuuaaaauccacuggag

SEQ ID NO: 83014 - RNA, 46 nt, Mus musculus
gcuuuuuuggacuugacugaagcugcaaacuugacauucugucugg

SEQ ID NO: 83015 - RNA, 46 nt, Mus musculus
caaagauauuuccgacuccaugaagcagaaaucggugcucugauag

SEQ ID NO: 83016 - RNA, 49 nt, Mus musculus
guggugagggggaggaggaggaacaugaagaggaagagaaggaagagga

SEQ ID NO: 83017 - RNA, 50 nt, Mus musculus
aggaccaggggaagcagcagacaugaguggcucuacaggaggaauaggag

SEQ ID NO: 83018 - RNA, 58 nt, Mus musculus
ugguggaguggcaacaguuaacacaggagggcagggcggaggggaagaaggcucugug

SEQ ID NO: 83019 - RNA, 46 nt, Mus musculus
uucaugccgccuccuguugaucugugugccaaaugguuucccacag

SEQ ID NO: 83020 - RNA, 45 nt, Mus musculus
cacaaugcugacauggaaacaugaauguuucaagccccucgccgu

SEQ ID NO: 83021 - RNA, 43 nt, Mus musculus
guggcgccuggggagccuucagaaguuucaguuggcacacucc

SEQ ID NO: 83022 - RNA, 45 nt, Mus musculus
ucugccccuggcugugacucgcaggcaggaagagggauggccacc

SEQ ID NO: 83023 - RNA, 46 nt, Mus musculus
auaaaaagaugagcugaaauuuaaaguaugguaguaugugucucag

SEQ ID NO: 83024 - RNA, 47 nt, Mus musculus
acgcgguagauuaagagauugagaaaaaggcuugaauacugagacca

SEQ ID NO: 83025 - RNA, 46 nt, Mus musculus
cauaaaagaguggcucaacugucaugauacaacaggcuguccacag

SEQ ID NO: 83026 - RNA, 45 nt, Mus musculus
ucuggcacuauucuccucacacacaagccaccuccacuccuagag

SEQ ID NO: 83027 - RNA, 45 nt, Mus musculus
agcuaguaagaaaacaggcuugguguguucuguuuccuuugggag

SEQ ID NO: 83028 - RNA, 46 nt, Mus musculus
gcccccugccugugagcacucacauccucacagcaaaggacccaag

SEQ ID NO: 83029 - RNA, 26 nt, Mus musculus
aagagcugaggagaagauuaagggug

SEQ ID NO: 83030 - RNA, 46 nt, Mus musculus
aguaccccagcagcaugguaaaguacuucagcaugucuaagccuag

SEQ ID NO: 83031 - RNA, 41 nt, Mus musculus
gagcccucagcccccuggaacuucaugucacuuaugacaca

SEQ ID NO: 83032 - RNA, 42 nt, Mus musculus
acuuaacaaacauuaaugagagaaagaaacaaacaaaaagag

SEQ ID NO: 83033 - RNA, 45 nt, Mus musculus
ucgggguugucuuccccauuguaccagaccaggagcuccucgcca

SEQ ID NO: 83034 - RNA, 46 nt, Mus musculus
gaaucaugaagaaagccuaugagaggcuauuggugaagccuagcug

SEQ ID NO: 83035 - RNA, 46 nt, Mus musculus
cagaagagacuuugaacuuugaacuuuuaacauuguugagacugcu

SEQ ID NO: 83036 - RNA, 46 nt, Mus musculus
auccaccccaaauuuggguaguacaccuagggauggagaagaacaa

SEQ ID NO: 83037 - RNA, 53 nt, Mus musculus
cuacugaggaauaauggaccuucaagauguggggccugguagaaggaaggccc

SEQ ID NO: 83038 - RNA, 46 nt, Mus musculus
ugugcuccugccaggagacaccccuguuaccuuaccagaagcccag

SEQ ID NO: 83039 - RNA, 44 nt, Mus musculus
uaggagcuggaacagugguaugugccuauauuaucagcacucag

SEQ ID NO: 83040 - RNA, 57 nt, Mus musculus
ucuggaaguccucgaagcacguguucagguaccucagccagagucucagugacugcc

SEQ ID NO: 83041 - RNA, 46 nt, Mus musculus
gcccaaauccauagucacuguggguuuccauuaagacuagcuggaa

SEQ ID NO: 83042 - RNA, 42 nt, Mus musculus
gguguguguguguguguguguguguauggguguggguguggg

SEQ ID NO: 83043 - RNA, 46 nt, Mus musculus
auaggcaugucccugcuuugggguuaaugagaccucuguguucuag

SEQ ID NO: 83044 - RNA, 46 nt, Mus musculus
uaaagauacacacaacaaagaaacuucuuugauuacaugagcccua

SEQ ID NO: 83045 - RNA, 51 nt, Mus musculus
cuacagcuuccaucagacuuuuuuccucuguugcgggggagagguugccag

SEQ ID NO: 83046 - RNA, 42 nt, Mus musculus
uucccagcaaccacaugguggcucgcaaccaucuguaauagu

SEQ ID NO: 83047 - RNA, 41 nt, Mus musculus
gaacuuggcaaaaggcaguucacgugucaaauacacccaaa

SEQ ID NO: 83048 - RNA, 44 nt, Mus musculus
acacucacaaggagugcuaaaaagcacagcgucaggcugccaag

SEQ ID NO: 83049 - RNA, 45 nt, Mus musculus
uccuucccuuggcuuucacuucucuguacuaugagaagccauagg

SEQ ID NO: 83050 - RNA, 46 nt, Mus musculus
uggcaacugcaaaaggacccaugccucugugauguaacauuuccag

SEQ ID NO: 83051 - RNA, 46 nt, Mus musculus
ggggcuguggcuuguccuguaucuuuccuuugguacugcuggccaa

SEQ ID NO: 83052 - RNA, 47 nt, Mus musculus
gguucaauucccaccucuucaaagagggaaggaaggagggagaaagg

SEQ ID NO: 83053 - RNA, 45 nt, Mus musculus
uuggggugacuuguuuucuuguccacagaguggcuagucaccacu

SEQ ID NO: 83054 - RNA, 45 nt, Mus musculus
cuccuguaccuggggucacaauaucaucuucauucacgccuauag

SEQ ID NO: 83055 - RNA, 49 nt, Mus musculus
guguguguagaguucagaagacaacuucaggugucacggugguuuggau

SEQ ID NO: 83056 - RNA, 46 nt, Mus musculus
acagcaguuuugccucuauucuuuaaaaagguaggaggcuggagag

SEQ ID NO: 83057 - RNA, 41 nt, Mus musculus
ugugucauggugccacacauuccucuguaucugugggaggu

SEQ ID NO: 83058 - RNA, 45 nt, Mus musculus
gggcuccaggaagauucugcugagaaggaauaggagaaggaagag

SEQ ID NO: 83059 - RNA, 41 nt, Mus musculus
gagagggagagggagagggagaaggagagggagaggaaguu

SEQ ID NO: 83060 - RNA, 44 nt, Mus musculus
gccagggcuauacagagaaacccugucuggaaaaaccaaaccaa

SEQ ID NO: 83061 - RNA, 45 nt, Mus musculus
ggcagcaugucagcuguuuccuaaccuggcucuauccuaccuuag

SEQ ID NO: 83062 - RNA, 42 nt, Mus musculus
gugcaucuguuaccgcaacaauggggaggccgaggcaaccgg

SEQ ID NO: 83063 - RNA, 91 nt, Mus musculus
accucccugcgcagagucccagaaccaaacgcuccccaaaacccagaacaacacuggcacgguccacaucuugaucucguuggagccucag

SEQ ID NO: 83064 - RNA, 45 nt, Mus musculus
aaacaaaacaaaacaaaacaaaaaacuucgaagccacaggcccag

SEQ ID NO: 83065 - RNA, 63 nt, Mus musculus
gcagcaagcacagcaaacuuggcagcuggcaaccucucggcacagucggcauuuaugucuccg

SEQ ID NO: 83066 - RNA, 42 nt, Mus musculus
cccggccugcgcggcgagggccgucggagggaggcggcugga

SEQ ID NO: 83067 - RNA, 47 nt, Mus musculus
aguuucucgguaaucacucugguuagugaccucacagccaaacagau

SEQ ID NO: 83068 - RNA, 45 nt, Mus musculus
ccuucuucauccucuuccucuuuguccacaccauccaccuccaca

SEQ ID NO: 83069 - RNA, 45 nt, Mus musculus
gggcgaaguccccaggcuuggugguggauuaccaaggggcuaacg

SEQ ID NO: 83070 - RNA, 42 nt, Mus musculus
uuuaaaagugggcauagugccaaaugcccuuuggggaggugg

SEQ ID NO: 83071 - RNA, 41 nt, Mus musculus
uuggccauugcugagccaucugggaaaggacuguggagugu

SEQ ID NO: 83072 - RNA, 44 nt, Mus musculus
uccagauccugcaucuggauacugucuucuuccuagagggucau

SEQ ID NO: 83073 - RNA, 46 nt, Mus musculus
uggcuuggaaaggguguaccaugcuaggaagccuucucaguaauga

SEQ ID NO: 83074 - RNA, 46 nt, Mus musculus
ccaugucuuguuuguuugauaaagggaagaacagagaaggggagaa

SEQ ID NO: 83075 - RNA, 46 nt, Mus musculus
cugugccugacgccaucagggacgagucuagcagccccugagaauc

SEQ ID NO: 83076 - RNA, 64 nt, Mus musculus
agaagcuccuccagguucaucaaaaggaagaaauucgacgaugaacugguagagagcagccugg

SEQ ID NO: 83077 - RNA, 42 nt, Mus musculus
ccccgccggcccccuucacccggguggaggauuuggccaggc

SEQ ID NO: 83078 - RNA, 101 nt, Mus musculus
ccaaauccuccacccgggugaagggggccggcgggguggagucaggccgcugcucagggagcgagcccuccucuagugagaagaagaagguauccaaggcu

SEQ ID NO: 83079 - RNA, 59 nt, Mus musculus
cccaguacuccuguaccucccagcccugccccaaccccugggcugaccaagcgugugaa

SEQ ID NO: 83080 - RNA, 50 nt, Mus musculus
aaguccuggaacaugagcugacaguggcugaccggcgccagaaacgagag

SEQ ID NO: 83081 - RNA, 46 nt, Mus musculus
ucuuggcagccucagcccggaugagggcaaugagguccugguugau

SEQ ID NO: 83082 - RNA, 46 nt, Mus musculus
ugcuggccuccuaggauauucagcagcugguccugucaccuuccag

SEQ ID NO: 83083 - RNA, 46 nt, Mus musculus
ugaauuggguucauggugauguuuuaauuaauuuuaugauugccag

SEQ ID NO: 83084 - RNA, 46 nt, Mus musculus
caagugcugggauuaaaggcgugcgccacaacacccggcaggcaag

SEQ ID NO: 83085 - RNA, 42 nt, Mus musculus
gaugugaugauauggauuucccaugguaggcagugcugucag

SEQ ID NO: 83086 - RNA, 46 nt, Mus musculus
uucuccagaaggucuacuugcuuucugaaucaccuauucuguccac

SEQ ID NO: 83087 - RNA, 46 nt, Mus musculus
cauucugucuuuaccugugccuagcauguucucucuucagccugag

SEQ ID NO: 83088 - RNA, 46 nt, Mus musculus
ucuguggcucuacucucucaacuguacuguacugcagcccaugcac

SEQ ID NO: 83089 - RNA, 46 nt, Mus musculus
ucagucgaugauauucuguucuuuaugagauuauguuccuuaggau

SEQ ID NO: 83090 - RNA, 42 nt, Mus musculus
guuuuuuucuagcucacuuaauguugucuucaaaugccuggg

SEQ ID NO: 83091 - RNA, 46 nt, Mus musculus
uauuuauuaauauguaaguacacuguagcugacuucagacacucag

SEQ ID NO: 83092 - RNA, 29 nt, Mus musculus
uugcugggauuugaacucaugaccuuaga

SEQ ID NO: 83093 - RNA, 32 nt, Mus musculus
uguguuuaugccaggugcccacugaagucaga

SEQ ID NO: 83094 - RNA, 42 nt, Mus musculus
ucagcaagugcuucuuggcaucuguaauagugucugggguug

SEQ ID NO: 83095 - RNA, 46 nt, Mus musculus
acacaccuccauucaauuuucugacucucuguacuucucgccuguc

SEQ ID NO: 83096 - RNA, 46 nt, Mus musculus
uacaccugagauucucucuuccaucucuuguauucuaugguuccag

SEQ ID NO: 83097 - RNA, 46 nt, Mus musculus
agcacucucugcaggcaagcucuacucuuacagagaaggcgcacag

SEQ ID NO: 83098 - RNA, 45 nt, Mus musculus
cccccauguacccuauuuuuaauaggguuauuugguucucuagag

SEQ ID NO: 83099 - RNA, 46 nt, Mus musculus
uauggaugauguauuuagguauuaacuuuuaugaggaggcacccua

SEQ ID NO: 83100 - RNA, 90 nt, Mus musculus
auguagaaaggacaugaucccacucuaaauaguucauggucaguaaacaagacucauucauuagaaaaagaaauuggauuacaugugcag

SEQ ID NO: 83101 - RNA, 71 nt, Mus musculus
gguaucugaccuccucuucugaucucaauugauacuaagcaugcaagugaggcacauacauacacaugcag

SEQ ID NO: 83102 - RNA, 46 nt, Mus musculus
aagaauauugcugaaaucaaaaguuucauauuuucauuugggccag

SEQ ID NO: 83103 - RNA, 46 nt, Mus musculus
aaauaucuaaauguaugcugugagaccauuaugucauguacuuuua

SEQ ID NO: 83104 - RNA, 46 nt, Mus musculus
gaaauagaaaggugaaagaucacauccucaaccccaaucauuaaag

SEQ ID NO: 83105 - RNA, 46 nt, Mus musculus
uaauguuccaacaacuaaauucaucaaaacguuuuaaccaacugag

SEQ ID NO: 83106 - RNA, 49 nt, Mus musculus
cagcucuggucuagucuggcagcaacuuuguggagaagcugugcagagu

SEQ ID NO: 83107 - RNA, 46 nt, Mus musculus; identical to SEQ ID NO: 83082

SEQ ID NO: 83108 - RNA, 45 nt, Mus musculus
gaauuggguucaaggucauguuuuaauaaauuuuaugauugccag

SEQ ID NO: 83109 - RNA, 46 nt, Mus musculus
uuacugugagggugucuuaagaugucuguugagagugaauugucug

SEQ ID NO: 83110 - RNA, 46 nt, Mus musculus
ggaaaaaagaaaaaggaugaguucuucucugguaaacacuccacag

SEQ ID NO: 83111 - RNA, 46 nt, Mus musculus
cuaaucucuucauuuucuucugggaugaggagaauuuaacgguuug

SEQ ID NO: 83112 - RNA, 49 nt, Mus musculus
accauuauauuuuccgugcaauuuccauggacugaaaaccugcaaaucu

SEQ ID NO: 83113 - RNA, 46 nt, Mus musculus
cuuucucucuuuuucucucucuuccuuucuuccuuccuuccuuccu

SEQ ID NO: 83114 - RNA, 45 nt, Mus musculus
guguccugucagcaaaaucuuguugacaguugaaauggugucugg

SEQ ID NO: 83115 - RNA, 45 nt, Mus musculus; identical to SEQ ID NO: 83098

SEQ ID NO: 83116 - RNA, 45 nt, Mus musculus
auacugucagaggaaacucuuccuauuucagucugacccguucuu

SEQ ID NO: 83117 - RNA, 46 nt, Mus musculus
agagaaugaaugugaagccugaauauguuacagguuaucugacccu

SEQ ID NO: 83118 - RNA, 46 nt, Mus musculus
auggagcccagagccggagacucuuauuuauuaauuguaaugugag

SEQ ID NO: 83119 - RNA, 46 nt, Mus musculus; identical to SEQ ID NO: 83099

SEQ ID NO: 83120 - RNA, 106 nt, Mus musculus
auguagaaaggacaugaucccacucuaaauaguucauggucaguaaacaagacucauucauuaguaaaagaaauuggauuacaugugcagagauggcugagauaau

SEQ ID NO: 83121 - RNA, 71 nt, Mus musculus; identical to SEQ ID NO: 83101

SEQ ID NO: 83122 - RNA, 46 nt, Mus musculus; identical to SEQ ID NO: 83102

SEQ ID NO: 83123 - RNA, 45 nt, Mus musculus
agucuggccucgaaaucagaaaugugccugccucugccucccaag

SEQ ID NO: 83124 - RNA, 46 nt, Mus musculus; identical to SEQ ID NO: 83103

SEQ ID NO: 83125 - RNA, 45 nt, Mus musculus
uuuguuccucucugucaccuaugacuuccucaacugagccagcuc

SEQ ID NO: 83126 - RNA, 46 nt, Mus musculus
ucuauuuugacuucugucucuugaguuuguuucauaauucauuuug

SEQ ID NO: 83127 - RNA, 42 nt, Mus musculus
aaucuugcuagugcaugcaauggugucagugcuuggaggcug

SEQ ID NO: 83128 - RNA, 42 nt, Mus musculus
aaauuguaucuuauaucuugaguaugcuaaguuucugggcua

SEQ ID NO: 83129 - RNA, 46 nt, Mus musculus
guugucaaauugcucuggcuaggacuucagguacaauguugaauag

SEQ ID NO: 83130 - RNA, 46 nt, Mus musculus
uguuaacuugauccugacuuaacuuugguaccuuguaucugucuag

SEQ ID NO: 83131 - RNA, 45 nt, Mus musculus
ccuauuauuuuuguuguuagaguuggcauucuguuauuguggcug

SEQ ID NO: 83132 - RNA, 45 nt, Mus musculus
ucaagaagaauucaaucuuuguucuucacauaaaaccugggagaa

SEQ ID NO: 83133 - RNA, 46 nt, Mus musculus
uuuauauugugaggacauauaauucccuuggacuagcuaccugcau

SEQ ID NO: 83134 - RNA, 42 nt, Mus musculus
cuguccuuuuauguuagugugaaguaaggucucuucugccau

SEQ ID NO: 83135 - RNA, 46 nt, Mus musculus
aucacacaguaaucacuguugacaccugaaaucuauuugucucaag

SEQ ID NO: 83136 - RNA, 46 nt, Mus musculus
ccuacuauguguuuauguaaaugcucugagauauccagagacccuu

SEQ ID NO: 83137 - RNA, 46 nt, Mus musculus
aaaauucacuacagauggaucauuauuugucccaacuuaugcagag

SEQ ID NO: 83138 - RNA, 46 nt, Mus musculus
uccauucccugucuggaaacucgauaucccaccccucgccccagcu

SEQ ID NO: 83139 - RNA, 42 nt, Mus musculus
caguccaaugguugguacagguucugcaucucuuugguccag

SEQ ID NO: 83140 - RNA, 93 nt, Mus musculus
auuguucuugaacacaugaauauucaagagaagucuucuaaauguaacaagccuagcaauguguuucuagaauccccccauuauacaccucac

SEQ ID NO: 83141 - RNA, 46 nt, Mus musculus
ccaaaaaucucaucuuaauauucaucagaaaauucaugcaggagag

SEQ ID NO: 83142 - RNA, 42 nt, Mus musculus
gaaaaggcacucugagaauucaucagagaauucauacaggag

SEQ ID NO: 83143 - RNA, 46 nt, Mus musculus
cucggcgccgcgccugcccauggccgcggcgggugacgcagccgga

SEQ ID NO: 83144 - RNA, 117 nt, Mus musculus
ggacucgugccccggccccgcggacaccgagauggaggaaguauuugauaauggaucaccuggaaagcaaaaagaaauccaagaaccagauccuauauaugaagaaaaaaugcaaac

SEQ ID NO: 83145 - RNA, 107 nt, Mus musculus
agacuccaaccucacccuugaagaugaaaccagggcgcccacggguaaaaaaggaugaaaaacagaauuugcuuucaguuggagauuaccgacaccauagaacagag

SEQ ID NO: 83146 - RNA, 45 nt, Mus musculus
aauuugaagauucuccaucauauguaaaaugggguaaacugagag

SEQ ID NO: 83147 - RNA, 71 nt, Mus musculus
cucauaugguuuugguucccaagucuacauugcacaacuggaugagugaauucaagagauggauaccaaca

SEQ ID NO: 83148 - RNA, 73 nt, Mus musculus
cuuaggucuguuugcuugauaggagauaaagagcaaagagcugcauuugucagggauguuuuauuaccaggag

SEQ ID NO: 83149 - RNA, 45 nt, Mus musculus
gcugaugacuuugauuccugguuugauacaaauaauugccuuggg

SEQ ID NO: 83150 - RNA, 46 nt, Mus musculus
ugguguuagacaagcuacucccuaaacugaaagaacaagguucaag

SEQ ID NO: 83151 - RNA, 47 nt, Mus musculus
auccucaaguugaucuucaggcuauggacuaugcccauagaauugga

SEQ ID NO: 83152 - RNA, 48 nt, Mus musculus
augaaacuuagacuggauucgauaguaauucaacaagggaggcuugua

SEQ ID NO: 83153 - RNA, 53 nt, Mus musculus
aagugaaaucacugaugaggauauugaugguauuuuagaaagaggugcaaaga

SEQ ID NO: 83154 - RNA, 48 nt, Mus musculus
aaaaacaaaagauugcauucacagaguggauugaaccaccaaaaagag

SEQ ID NO: 83155 - RNA, 45 nt, Mus musculus
gguuuaugugaauuacuggaaaaagaaauucuguauuacaggaaa

SEQ ID NO: 83156 - RNA, 107 nt, Mus musculus
aagcuucugacacagggguuuacaaauuggaauaagagagauuuuaaccaguuuaucaaggcuaaugagaaguggggucgugaugauauugaaaauauagccagaga

SEQ ID NO: 83157 - RNA, 122 nt, Mus musculus
ucagcuguguucugggaaagaugcaaugagcuucaggacauagagaagauaauggcucagauugaaaggggagaggcaagaauucaaagaagaauaaguaucaagagagcacuagauacaaa

SEQ ID NO: 83158 - RNA, 42 nt, Mus musculus
uuucaugagcuaagaauaucauaugguacuaacaaaggaaaa

SEQ ID NO: 83159 - RNA, 84 nt, Mus musculus
ggagcuccagaggagguguaauaccuuaauuacuuugauugaaagagaaaauauggaacuagaagaaaaggagaaggcagagaa

SEQ ID NO: 83160 - RNA, 42 nt, Mus musculus
guuuagcuacuuucugcucauacgguuguuuaucuuuggcag

SEQ ID NO: 83161 - RNA, 46 nt, Mus musculus
caggccuggguguucaauuuugaucuuugggcgauuuucagagcaa

SEQ ID NO: 83162 - RNA, 52 nt, Mus musculus
uuccuuugaagacauggucuuccaucucucggagcauuucuuggagaacuca

SEQ ID NO: 83163 - RNA, 54 nt, Mus musculus
gcgaaguucaccgacgagucgggaugcuucuucuugugcuccucgcggcagguc

SEQ ID NO: 83164 - RNA, 54 nt, Mus musculus
accugcugcgagcgcugcuucccucagaccuccgcagagagacuuccuucccca

SEQ ID NO: 83165 - RNA, 63 nt, Mus musculus
cucuccagucuauaguaacacauuuucucccacaaggucgccauucccaaaccuucccaaaca

SEQ ID NO: 83166 - RNA, 46 nt, Mus musculus
guuuggaguccauaauggugcggauggcauggcagcagcaggaaga

SEQ ID NO: 83167 - RNA, 46 nt, Mus musculus
acuuaagcuuuaccuaaauggaacacuaaaguuaaaaauaaaagau

SEQ ID NO: 83168 - RNA, 41 nt, Mus musculus
aaguuaaauguccauaugauggugacaggcagggcagcagg

SEQ ID NO: 83169 - RNA, 46 nt, Mus musculus
aagacaaaugucaaaaaguguagagggucuuuaagaucaugcagua

SEQ ID NO: 83170 - RNA, 63 nt, Mus musculus
uguguugauuugaauaugcgugguucauaggaaauggcacuauuaggaguuguggccuuguug

SEQ ID NO: 83171 - RNA, 53 nt, Mus musculus
gcuuacaagucucuuuugacagaguauagaggacuuuccuguaguauagaugc

SEQ ID NO: 83172 - RNA, 42 nt, Mus musculus
gacggcgacgacaucucggcgacccgggcgcucggcgccucc

SEQ ID NO: 83173 - RNA, 51 nt, Mus musculus
uuccuguucauuugaaguggcaucuuugagcuggggcagggggugcagguc

SEQ ID NO: 83174 - RNA, 46 nt, Mus musculus
ggcaggcagcucucuaugccuagagguaauccacagaauucuggag

SEQ ID NO: 83175 - RNA, 43 nt, Mus musculus
gugggagaaagagaagagaacagauaaaugggaacaggggcag

SEQ ID NO: 83176 - RNA, 45 nt, Mus musculus
ugaggucauaggcuugaauagucugaaauuuaaaugaucgguggu

SEQ ID NO: 83177 - RNA, 46 nt, Mus musculus
gguuauucacaauaaauucaugacaucauugaccuagcauauuuug

SEQ ID NO: 83178 - RNA, 42 nt, Mus musculus
uuuuuguagcuugcaaagcccuucccauaacgaggacugugg

SEQ ID NO: 83179 - RNA, 47 nt, Mus musculus
caguauucagcauguuacagauuuaaauuaacugaauagacacgcag

SEQ ID NO: 83180 - RNA, 45 nt, Mus musculus
uacaaaugcagugagugugacaaaugcuuuacccaaccaucccau

SEQ ID NO: 83181 - RNA, 42 nt, Mus musculus
agaaauucacucugagaaagcaucagagaauucauacaggag

SEQ ID NO: 83182 - RNA, 47 nt, Mus musculus
caaaccaucccaucuuaguauucaucguagaauucauucaggagaga

SEQ ID NO: 83183 - RNA, 70 nt, Mus musculus
aaaugcagugagugugacaaaugcuuuacccaaccaucccaucuuaguauucauuguagaauucauucag

SEQ ID NO: 83184 - RNA, 43 nt, Mus musculus
acaaaggcagucuuagaguucaucauagaauucaugcaggaga

SEQ ID NO: 83185 - RNA, 45 nt, Mus musculus
gacaaacacagucugagaaggcaucagagaauucauacaggagag

SEQ ID NO: 83186 - RNA, 45 nt, Mus musculus
gacaaaugcuuuaccugaaaaucacaucuuaguauucaucagaua

SEQ ID NO: 83187 - RNA, 45 nt, Mus musculus; identical to SEQ ID NO: 83186

SEQ ID NO: 83188 - RNA, 45 nt, Mus musculus
aauguaaugaaugugacaaaugcuuuacugacaaaggcagucuga

SEQ ID NO: 83189 - RNA, 42 nt, Mus musculus; identical to SEQ ID NO: 83160

SEQ ID NO: 83190 - RNA, 46 nt, Mus musculus; identical to SEQ ID NO: 83161

SEQ ID NO: 83191 - RNA, 52 nt, Mus musculus; identical to SEQ ID NO: 83162

SEQ ID NO: 83192 - RNA, 54 nt, Mus musculus; identical to SEQ ID NO: 83163

SEQ ID NO: 83193 - RNA, 54 nt, Mus musculus; identical to SEQ ID NO: 83164

SEQ ID NO: 83194 - RNA, 63 nt, Mus musculus; identical to SEQ ID NO: 83165

SEQ ID NO: 83195 - RNA, 46 nt, Mus musculus; identical to SEQ ID NO: 83166

SEQ ID NO: 83196 - RNA, 46 nt, Mus musculus; identical to SEQ ID NO: 83167

SEQ ID NO: 83197 - RNA, 41 nt, Mus musculus; identical to SEQ ID NO: 83168

SEQ ID NO: 83198 - RNA, 46 nt, Mus musculus; identical to SEQ ID NO: 83169

SEQ ID NO: 83199 - RNA, 63 nt, Mus musculus; identical to SEQ ID NO: 83170

SEQ ID NO: 83200 - RNA, 53 nt, Mus musculus; identical to SEQ ID NO: 83171

SEQ ID NO: 83201 - RNA, 42 nt, Mus musculus
gugcgugcgcgcuaccgcggcccgggggagguccucgcgggg

SEQ ID NO: 83202 - RNA, 42 nt, Mus musculus; identical to SEQ ID NO: 83172

SEQ ID NO: 83203 - RNA, 52 nt, Mus musculus
cuugcuguucauuugaaguggcaucuuugagcuggggcagggggugcagguc

SEQ ID NO: 83204 - RNA, 42 nt, Mus musculus; identical to SEQ ID NO: 83160

SEQ ID NO: 83205 - RNA, 46 nt, Mus musculus; identical to SEQ ID NO: 83161

SEQ ID NO: 83206 - RNA, 46 nt, Mus musculus
uuccuuugaagacauggucuuccaucucucggagcauuucuuggag

SEQ ID NO: 83207 - RNA, 45 nt, Mus musculus
gaggacauuuugccccgcggcuuguuggggucacccuugcccaug

SEQ ID NO: 83208 - RNA, 54 nt, Mus musculus; identical to SEQ ID NO: 83164

SEQ ID NO: 83209 - RNA, 46 nt, Mus musculus
cuagucaggaugggagucaaaggguguccuaccuaaaccuggugga

SEQ ID NO: 83210 - RNA, 42 nt, Mus musculus
uauccaucauggacccuccacaccaguaucgaauucacagaa

SEQ ID NO: 83211 - RNA, 42 nt, Mus musculus
uguccagggauugggggaauccgucacucauccugcucuucu

SEQ ID NO: 83212 - RNA, 46 nt, Mus musculus
aaccaagguccugguuuccaccccauccucagugcagccccucuuc

SEQ ID NO: 83213 - RNA, 41 nt, Mus musculus
gacauuacugugagaagcccgcaugcccaauauggcagaga

SEQ ID NO: 83214 - RNA, 43 nt, Mus musculus
uucugguguguccgaacaaauaaauaaaucuuugagaaagaga

SEQ ID NO: 83215 - RNA, 46 nt, Mus musculus
ugagcaccaugccuugcaggaugcccggagcgccaaccuucaccag

SEQ ID NO: 83216 - RNA, 46 nt, Mus musculus
gccuuaaggugcagcgugugccgcagguccugcagaugugugaggu

SEQ ID NO: 83217 - RNA, 97 nt, Mus musculus
ggaaugaauccaagauaaaguuguggcugucccaccaggaagacagaugaaggcuuagaaagucgaguaguuguagagaggaaaggaaugacaaugg

SEQ ID NO: 83218 - RNA, 46 nt, Mus musculus
cuaugaauacucauggaggcugucaccccagccccacuaccugcag

SEQ ID NO: 83219 - RNA, 45 nt, Mus musculus
guugccauagucucuuaaacccaucucccugacagcaucuggaaa

SEQ ID NO: 83220 - RNA, 46 nt, Mus musculus
ucagucuuauuuaaaugaucaguagguggcagcgaggcauuuugag

SEQ ID NO: 83221 - RNA, 46 nt, Mus musculus
uggacccagagcggcacgagagacuccgggagaagaugaggcgcag

SEQ ID NO: 83222 - RNA, 45 nt, Mus musculus
gccaggugccaggcuagacucacauaauaggaagucucggccuuu

SEQ ID NO: 83223 - RNA, 42 nt, Mus musculus
gaggggcuugggaggaccugauucccuccguccagugcaugc

SEQ ID NO: 83224 - RNA, 46 nt, Mus musculus
uggugucugucaagggcuuguacggagaacaguuauuaacucuuga

SEQ ID NO: 83225 - RNA, 46 nt, Mus musculus
aggccuggcuugggcugauggcaggaaugcagcaggccacucccag

SEQ ID NO: 83226 - RNA, 51 nt, Mus musculus
guaaaacuguccaagcuggaggugccacagaagaucaaggauguaauugag

SEQ ID NO: 83227 - RNA, 42 nt, Mus musculus
ggcuuggugccaggccuccacuucuauacccucaaccgcgag

SEQ ID NO: 83228 - RNA, 46 nt, Mus musculus
gcccucaggaguaacuagagucacccaguuccagccuccaccucag

SEQ ID NO: 83229 - RNA, 42 nt, Mus musculus
ccgggaggaagauguccgucccaucuucugggccuccagacc

SEQ ID NO: 83230 - RNA, 41 nt, Mus musculus
gggcagaucuagucagauguggagacagauuggagcaggcu

SEQ ID NO: 83231 - RNA, 45 nt, Mus musculus
ugugugugugugugugugugugugugugugugugagugcaaggca

SEQ ID NO: 83232 - RNA, 30 nt, Mus musculus
gaagguugguugugucuguucuguggcugg

SEQ ID NO: 83233 - RNA, 46 nt, Mus musculus
guauguaguguugguuacugggcaaguguuuggccuccuuggacug

SEQ ID NO: 83234 - RNA, 42 nt, Mus musculus
uugcaaaugguuuaauguaaucaagaaauucaagcugaagag

SEQ ID NO: 83235 - RNA, 46 nt, Mus musculus
gcccuggcugaccuggaauucacucuguagaccaggccuggccuca

SEQ ID NO: 83236 - RNA, 45 nt, Mus musculus
uuguguguaaaaccucauaccaugacaagaguauguguggagguc

SEQ ID NO: 83237 - RNA, 44 nt, Mus musculus
ugcauacaaccuaaacaaaccuaaggguuuugugagagguugcc

SEQ ID NO: 83238 - RNA, 45 nt, Mus musculus
cucagccugugguuccccauaagucuucaaguaucuguccccaga

SEQ ID NO: 83239 - RNA, 46 nt, Mus musculus
aagcugaggauggccaugccggcgccgaagcggccaguguccccag

SEQ ID NO: 83240 - RNA, 54 nt, Mus musculus
gggugugggggaaagcaucagaggaagagaaagaaagagguugagaggggcaga

SEQ ID NO: 83241 - RNA, 42 nt, Mus musculus
uugucuggguuucuuugggacccgaccauuagcagggcuggg

SEQ ID NO: 83242 - RNA, 45 nt, Mus musculus
guuaguacgcacugccgcaggggccuguccuuaucccacugugua

SEQ ID NO: 83243 - RNA, 23 nt, Mus musculus
ggagcagagccagagcgggggga

SEQ ID NO: 83244 - RNA, 42 nt, Mus musculus
aagacagccugauuucuauagugaguuccaggccagccagag

SEQ ID NO: 83245 - RNA, 45 nt, Mus musculus
cccgaacugcacugaccucucagaaggauagaugucccuguccug

SEQ ID NO: 83246 - RNA, 46 nt, Mus musculus
guccggugcccgugccagccugggucuguccgggaggggcggcccu

SEQ ID NO: 83247 - RNA, 46 nt, Mus musculus
ccuugggcaagcccaucaacucaguagugauaguuggcacccacag

SEQ ID NO: 83248 - RNA, 46 nt, Mus musculus
gcaaaggcuaaggcguuagugggcagucaggcucccagucccauga

SEQ ID NO: 83249 - RNA, 45 nt, Mus musculus
ccagagaaccugagcucauggcggauagacuccaacggaggggau

SEQ ID NO: 83250 - RNA, 46 nt, Mus musculus
ccguggaagacuggaaggucuucuauauccugugcagccugcagag

SEQ ID NO: 83251 - RNA, 46 nt, Mus musculus
uuuuugagaggcagcagucuugcucugcugcccagaguggccuaga

SEQ ID NO: 83252 - RNA, 46 nt, Mus musculus
ugcggaaucuucaaaaugccaauuacaagaaggacaagaagccuag

SEQ ID NO: 83253 - RNA, 53 nt, Mus musculus
cgaggccagccugaucuacaaaugagaauuccagggagaaaagaaacagagag

SEQ ID NO: 83254 - RNA, 41 nt, Mus musculus
cuggagaaagagacuccugaagcuacuuauugaacccaaca

SEQ ID NO: 83255 - RNA, 42 nt, Mus musculus
ggagggagaggagggggaagaggagaggaaggagggagagga

SEQ ID NO: 83256 - RNA, 46 nt, Mus musculus
agcucugaggaguugccaaaggaggaggaggaagaaggggagaggg

SEQ ID NO: 83257 - RNA, 46 nt, Mus musculus
gggggggggggacguuagcagcagaaauaaaggugauuacaaagga

SEQ ID NO: 83258 - RNA, 44 nt, Mus musculus
uauggguaggagagcuacguucugaaaaaggagaccuugcagag

SEQ ID NO: 83259 - RNA, 46 nt, Mus musculus
uucagucacauauguagcagagaauggccuugucggacaucaaugg

SEQ ID NO: 83260 - RNA, 41 nt, Mus musculus
guucuccauaaaggugggcucuccuuuccagcugccccaug

SEQ ID NO: 83261 - RNA, 42 nt, Mus musculus
gagagagagagggagagagagagagagagagagaggugggga

SEQ ID NO: 83262 - RNA, 41 nt, Mus musculus
aaagaaaagaaggaagaaagaaagaaagaaagaaagaaaga

SEQ ID NO: 83263 - RNA, 46 nt, Mus musculus
accauauuuugaaggugauauuaacaaaccggaucuugccccagau

SEQ ID NO: 83264 - RNA, 46 nt, Mus musculus
agcgcuuguccccugaaugugcugccugcuagagaagggcccucau

SEQ ID NO: 83265 - RNA, 46 nt, Mus musculus
uggaccuggauggaaggcagugagaugugguacaguacuggggcug

SEQ ID NO: 83266 - RNA, 45 nt, Mus musculus
uaaagacaacaggagaagcaagcuguaaaccuagcugcugggagg

SEQ ID NO: 83267 - RNA, 45 nt, Mus musculus
cccugccucaaaaaacgaacaaaaagaagaaggagcaggagcagg

SEQ ID NO: 83268 - RNA, 88 nt, Mus musculus
gcccuccagccuaagaggagggaagaugagaccacauaaaggagacugaaggagugggaagaaaaucaagagacuguaguuguccaac

SEQ ID NO: 83269 - RNA, 46 nt, Mus musculus
agucauuggccuauagauaaaguagggcuggugagaugguuagaga

SEQ ID NO: 83270 - RNA, 47 nt, Mus musculus
agccacuggaaggcacaguugacaucaugccacacgggaaaagggca

SEQ ID NO: 83271 - RNA, 48 nt, Mus musculus
aguucaggcaagagguuugguggcuugcuucacgguaguggccagaga

SEQ ID NO: 83272 - RNA, 45 nt, Mus musculus
ucugggaauagaugcacugggaauagauaauaagcacgguggaca

SEQ ID NO: 83273 - RNA, 46 nt, Mus musculus
ugucuggcuccuuucucuacacaggagguaagaauuggccuguuuc

SEQ ID NO: 83274 - RNA, 42 nt, Mus musculus
guacaggccccgggggagaagauuaauauccuggcaggagag

SEQ ID NO: 83275 - RNA, 51 nt, Mus musculus
gacucugggugaucacaauacugccuucaaacauccucagucaaaaaccaa

SEQ ID NO: 83276 - RNA, 45 nt, Mus musculus
acacacacaauagaaccacacgugccaacagugcacacuagcaga

SEQ ID NO: 83277 - RNA, 54 nt, Mus musculus
cagaagccuucaagcccugagagaaggcagacacugaggagggagaacagcaug

SEQ ID NO: 83278 - RNA, 79 nt, Mus musculus
cgcuacgcagaguauagcuacuuugcguugggcaaugaacugaacagcuaccgccucuuccuggggaacuacaguggca

SEQ ID NO: 83279 - RNA, 45 nt, Mus musculus
accggcucaccaggcagccaagccggcuucguguggagcuggagg

SEQ ID NO: 83280 - RNA, 41 nt, Mus musculus
cauggaaacuucaggaggaggcuggaccaucauccagagac

SEQ ID NO: 83281 - RNA, 41 nt, Mus musculus
ggccaaccucagcagucugcugggagagcugagcaggaagc

SEQ ID NO: 83282 - RNA, 45 nt, Mus musculus
ucucuagcuuuaagaaaggcuaagcaagcacacagaggaaggaga

SEQ ID NO: 83283 - RNA, 46 nt, Mus musculus
uggaggggccaacaucauggccaagcuuuccacugucccugugcag

SEQ ID NO: 83284 - RNA, 41 nt, Mus musculus
gcggggccgggcgcggcugggccgucggggccaggcuccau

SEQ ID NO: 83285 - RNA, 46 nt, Mus musculus
gccauccagaaccagcacguugccguagguuuuacugcgggcagag

SEQ ID NO: 83286 - RNA, 41 nt, Mus musculus
ugcugguucuggauggcgucauccaguguacugagagggau

SEQ ID NO: 83287 - RNA, 45 nt, Mus musculus
ccaggggcaaugcgguaccuuccgcggguugggguggcugcagag

SEQ ID NO: 83288 - RNA, 42 nt, Mus musculus
ugugcagccacgcaugcuuacagccccagcacuuggguagaa

SEQ ID NO: 83289 - RNA, 45 nt, Mus musculus
aggcaucuugguucuguuucaugaacucaaagccaucgcccacgu

SEQ ID NO: 83290 - RNA, 43 nt, Mus musculus
ggcccugcugagagccucuucaaggaguccuauuaccagcuca

SEQ ID NO: 83291 - RNA, 45 nt, Mus musculus
uccaggugcagccacuggcacucacccuggcagcacaggaugcca

SEQ ID NO: 83292 - RNA, 45 nt, Mus musculus
guggacuacgccuacuguagcauuccuaccuaucccagcggccag

SEQ ID NO: 83293 - RNA, 76 nt, Mus musculus
caacuuccgggagccagugcagcaguugacacaggcccagguggagcagaugcagcugaaauacuauaacucggac

SEQ ID NO: 83294 - RNA, 42 nt, Mus musculus
cacugugacaccacccgagaccucaaucggauuggaccaagg

SEQ ID NO: 83295 - RNA, 45 nt, Mus musculus
uggacucagucucugucugucuaucucuguggcguucagccccac

SEQ ID NO: 83296 - RNA, 42 nt, Mus musculus
uagggcagccugaagcuauagcuuuucaacugcccacgggca

SEQ ID NO: 83297 - RNA, 76 nt, Mus musculus
gguggcuccaacccacucaguggccugcgcugugggagcugcugaccaauccucaguggcuggcugugcacuccag

SEQ ID NO: 83298 - RNA, 44 nt, Mus musculus
gugcucacgggagauaguaccucgcaugcggaguacuucccugg

SEQ ID NO: 83299 - RNA, 46 nt, Mus musculus
cagguugacauaagaggccucugugaguggcugguggucagcccug

SEQ ID NO: 83300 - RNA, 65 nt, Mus musculus
aucugaaagucaagguuggugccaccuaaguggguucccgcagcaaggaauuugaggacauccuc

SEQ ID NO: 83301 - RNA, 46 nt, Mus musculus
uuuaacuccggcuuuuuuuaaagacuccaaauaaaacaggacaggu

SEQ ID NO: 83302 - RNA, 49 nt, Mus musculus
ucccagcaauaggacagccccguggcgcucagcacccccccuuugcccu

SEQ ID NO: 83303 - RNA, 85 nt, Mus musculus
cacaccuaugaacucuuaaccaaaccgggagaauuuauccacaccaacuggacgggccacgggggcagugugucauccucuucau

SEQ ID NO: 83304 - RNA, 45 nt, Mus musculus
cuucacuacugcccucuccuucuaugauggguacagacacgagau

SEQ ID NO: 83305 - RNA, 48 nt, Mus musculus
guuccugggaaaaauuaaagaugcauuugagcgaaacccagaacuuca

SEQ ID NO: 83306 - RNA, 51 nt, Mus musculus
uuuggcuggacccucaauuauggcggcauugcccugauguggagagggggc

SEQ ID NO: 83307 - RNA, 46 nt, Mus musculus
ucacccucucucacgucucugaggugcgaaugaaacugggacaugg

SEQ ID NO: 83308 - RNA, 104 nt, Mus musculus
ggagaagcugucuuugcucggugcuuguccucucugaaggaggagcggguucaggccagccaaaagcugaaggguccuaaggugguccagcuggaaggcaguaa

SEQ ID NO: 83309 - RNA, 46 nt, Mus musculus
cugaaggcacugcaggcaagugaugcauauacacaugaaggcagac

SEQ ID NO: 83310 - RNA, 45 nt, Mus musculus
uaaaaugcugucuuaguucccagagaucaacccacuuuguuuaga

SEQ ID NO: 83311 - RNA, 45 nt, Mus musculus
cugaguaccggaauguaggccugccugccuuguuggcuguugguu

SEQ ID NO: 83312 - RNA, 40 nt, Mus musculus
gagcuguugccaaagauccgggacagugcugggcagaagg

SEQ ID NO: 83313 - RNA, 72 nt, Mus musculus
ggaggaggguuugcugucccuaugugcucugcagugagggcaccagcuacagacagaagcaagaauauggca

SEQ ID NO: 83314 - RNA, 45 nt, Mus musculus
ccagggcuacacagaggaacccuguuuucaaauccaauaggaaga

SEQ ID NO: 83315 - RNA, 42 nt, Mus musculus
uuaccauuugaugaaggauguucugggcaugcggcaugagga

SEQ ID NO: 83316 - RNA, 44 nt, Mus musculus
gagggggcggggcacuuugugaagauggugcacaacgggauaga

SEQ ID NO: 83317 - RNA, 42 nt, Mus musculus
uccuguugauugaacucacuuccccuuccgcaggccccacau

SEQ ID NO: 83318 - RNA, 51 nt, Mus musculus
ggaccucaaggccaagggcaucuuguuuguggggagcggagucaguggugg

SEQ ID NO: 83319 - RNA, 42 nt, Mus musculus
ggugacaucaucaucgauggaggaaauucugaauaccgggac

SEQ ID NO: 83320 - RNA, 47 nt, Mus musculus
agagucuacauagugacugcuuucccacuguuuaucugggauuuauu

SEQ ID NO: 83321 - RNA, 47 nt, Mus musculus
cagggcggcacagugagaugcugccucaggugagagggauggaggag

SEQ ID NO: 83322 - RNA, 45 nt, Mus musculus
ugaucucaggugcagccuuggaagggggacacugagcaauaaaga

SEQ ID NO: 83323 - RNA, 23 nt, Mus musculus
gaucccgagggggggaggguuga

SEQ ID NO: 83324 - RNA, 45 nt, Mus musculus
aggggaagcaguugaucaguaucacucuauuuuaaugcucuaaga

SEQ ID NO: 83325 - RNA, 46 nt, Mus musculus
uggaacucacucuguauacagaccagggugaccucaggcccacaga

SEQ ID NO: 83326 - RNA, 46 nt, Mus musculus
uagagccucgugcauguccaugccagggaaacacaagcacccuaag

SEQ ID NO: 83327 - RNA, 84 nt, Mus musculus
gcuauuccuggguggucguaauucuaggaccguaaggacauuucagucagauuugugaagaggaauagcacuugaacaauaguc

SEQ ID NO: 83328 - RNA, 46 nt, Mus musculus
ccuccaccgugugguuuguggaaagaacucagguugucuggcuuaa

SEQ ID NO: 83329 - RNA, 23 nt, Mus musculus
gcgaagggcaccaaggugguugg

SEQ ID NO: 83330 - RNA, 42 nt, Mus musculus
ccuccucgacucugcuucgucugccuccgccauggcccagug

SEQ ID NO: 83331 - RNA, 46 nt, Mus musculus
aagcaggaauuuuaaagucucguuuucagaaguuguuaaugcagug

SEQ ID NO: 83332 - RNA, 66 nt, Mus musculus
cugaaaguugaaaacccagagaaguaugguuuugagccaaagaagcuguuggaccaacugacagau

SEQ ID NO: 83333 - RNA, 67 nt, Mus musculus
ugguccccgauuagcagccaugcugaacuuuaaccugcagcagcucugcggacccaagugccgggac

SEQ ID NO: 83334 - RNA, 42 nt, Mus musculus
acaacugggugccacccugccuggcuucagccccacccccca

SEQ ID NO: 83335 - RNA, 45 nt, Mus musculus
aaggcguuagagagauccuucaguucuugagaccagggcgggagc

SEQ ID NO: 83336 - RNA, 46 nt, Mus musculus
cgcaccgccgcagccuccuccagcagcaagcgcccagagcugccgc

SEQ ID NO: 83337 - RNA, 41 nt, Mus musculus
gagaggaccccauagcgguggccguggccagaggcggcagc

SEQ ID NO: 83338 - RNA, 46 nt, Mus musculus
cugacuccccucagcuucccagguuacccagggcgggcggcgcggu

SEQ ID NO: 83339 - RNA, 54 nt, Mus musculus
uuuugaugaauaauucuugguggggcgaggggguaagaguaggguuggaggggu

SEQ ID NO: 83340 - RNA, 46 nt, Mus musculus
uuaauuugcuuaucaaguauauguauggauauguuccuguuugugg

SEQ ID NO: 83341 - RNA, 48 nt, Mus musculus
guugcuugagguugauguacuggagggcacccugcaaugcccagaauc

SEQ ID NO: 83342 - RNA, 51 nt, Mus musculus; identical to SEQ ID NO: 64210

SEQ ID NO: 83343 - RNA, 45 nt, Mus musculus
agugaggcugcucuuucucuuuguguggcaaaugugugugugugu

SEQ ID NO: 83344 - RNA, 44 nt, Mus musculus
uacaguguacuuacauauaauaauaaauaaaucuuuaaaacaaa

SEQ ID NO: 83345 - RNA, 46 nt, Mus musculus
auacaccacaguuauucuagaaaagucaaagcuuucugggggccag

SEQ ID NO: 83346 - RNA, 46 nt, Mus musculus
caauuuaacugguucucaaaggcugugugggcuugcucuuucccag

SEQ ID NO: 83347 - RNA, 42 nt, Mus musculus
ccagcgcagggaacaccgccgccuugcucucauuggccccac

SEQ ID NO: 83348 - RNA, 48 nt, Mus musculus
accugcacaccucggcgggagcuuggaguucgucuguccgcggggagg

SEQ ID NO: 83349 - RNA, 74 nt, Mus musculus
cccugagaaggugugcuuucugcccuugccuucucgugcgucugaguuggacaguuuuccucaagccgaguccc

SEQ ID NO: 83350 - RNA, 82 nt, Mus musculus
gagugcuguggccucacccagaggagacucggcaaaagcuacgggaggcacagcccagggauucaguggccucucccgcguc

SEQ ID NO: 83351 - RNA, 47 nt, Mus musculus
cacagcaaauaaaacucuuaacaguuuuaccuuguucuagccagcuc

SEQ ID NO: 83352 - RNA, 45 nt, Mus musculus
agaggucaggaugccagagacuggagggagcgagcagggguaaug

SEQ ID NO: 83353 - RNA, 46 nt, Mus musculus
uauugggcgaggcucggaucccggugcgcagaucgucuccagcaag

SEQ ID NO: 83354 - RNA, 46 nt, Mus musculus
uuucaagucuaaagguuuaaaaugauaaaccugaaauaaggguuug

SEQ ID NO: 83355 - RNA, 42 nt, Mus musculus
caacaccuugccagagacuugucauucuaaguccaucagaga

SEQ ID NO: 83356 - RNA, 46 nt, Mus musculus
caguguacacagacuugacuaugauuuuucuuuccugguguccucu

SEQ ID NO: 83357 - RNA, 23 nt, Mus musculus
ccauggggugaguuugggugugg

SEQ ID NO: 83358 - RNA, 46 nt, Mus musculus
auuaguguguguccguguccgugugugugugugugugugugugugu

SEQ ID NO: 83359 - RNA, 45 nt, Mus musculus
ccaguauuuggagggcuaauauuguacuuacaucuagcuaguuaa

SEQ ID NO: 83360 - RNA, 46 nt, Mus musculus
uucagacacaccagaagagggcaccagaucccauuacagauggaug

SEQ ID NO: 83361 - RNA, 44 nt, Mus musculus
cuaucagccaauggauuucuacacauaaaagguauaaagcagaa

SEQ ID NO: 83362 - RNA, 45 nt, Mus musculus
caggaagguuaaauuugaagccagccuaggguauuuauguuagag

SEQ ID NO: 83363 - RNA, 46 nt, Mus musculus
agacagagacagagacacacacagagaaagagacagaaagacagag

SEQ ID NO: 83364 - RNA, 54 nt, Mus musculus
gauaacacggugcugcucgacccuccccucaucgcccuggauaaagauucaccg

SEQ ID NO: 83365 - RNA, 46 nt, Mus musculus
acaacaacaaagauuuauuucuauuaccuuuguuacacaugcacag

SEQ ID NO: 83366 - RNA, 46 nt, Mus musculus
aaaucccagcaaccacaugguggcucacaaccaucugaucacgaga

SEQ ID NO: 83367 - RNA, 46 nt, Mus musculus
ccgugguaguggauaaguccacgggugagggaauaauccggucaaa

SEQ ID NO: 83368 - RNA, 44 nt, Mus musculus
acagaaagacuacacauucaccauccaggccuacgacugcggga

SEQ ID NO: 83369 - RNA, 45 nt, Mus musculus
uaucugugggugcuggggcucaaugcuccugccuucauacuuucg

SEQ ID NO: 83370 - RNA, 46 nt, Mus musculus
gaccgugcacauccaggugaacgacgugaacgaguacgcccccgug

SEQ ID NO: 83371 - RNA, 68 nt, Mus musculus
gguggaggcuguggacgcagacugcuccccgcaguucagccagaucugcagcuacgagauucucaccc

SEQ ID NO: 83372 - RNA, 46 nt, Mus musculus
uucugaacucacucuguagacuuggcuggccucaaacucucuagag

SEQ ID NO: 83373 - RNA, 45 nt, Mus musculus
agguuauauuaagaacacagagaagcuaaacuauggcaaagagca

SEQ ID NO: 83374 - RNA, 57 nt, Mus musculus
cucacagucacagccuacgacugugggaagaaaagagccaccgaggacguccuagug

SEQ ID NO: 83375 - RNA, 44 nt, Mus musculus
gcaggcuggagcagcagaauugaguaugagcccggcacgggugc

SEQ ID NO: 83376 - RNA, 28 nt, Mus musculus
cacgguggagcuggagaccagccacaua

SEQ ID NO: 83377 - RNA, 46 nt, Mus musculus
auacagacccugcagaaucaauucagaauuacguauguguccgcac

SEQ ID NO: 83378 - RNA, 46 nt, Mus musculus
aguggcagccaucuuggugucuuucagaugccauacaaacugcuag

SEQ ID NO: 83379 - RNA, 41 nt, Mus musculus
ccacaugucgcaugagaugagcagauugcauuucgacccca

SEQ ID NO: 83380 - RNA, 46 nt, Mus musculus
gguuucgcuuucuucauucugucuucccugacuguuauccucagag

SEQ ID NO: 83381 - RNA, 45 nt, Mus musculus
cccacaguguacuuggccaauaggugccaguuguugagcagguag

SEQ ID NO: 83382 - RNA, 63 nt, Mus musculus
uacaccugcaaggaggggcuggaccugcaggucccugaagaugccaacagaggcgugcaggug

SEQ ID NO: 83383 - RNA, 67 nt, Mus musculus
ccaagcaagcuccagccaggcggucuugaccuuggagggagacaacguuggagagcuggauaaggcu

SEQ ID NO: 83384 - RNA, 77 nt, Mus musculus
augcagcacauuuccuaccuuaacucaaggcaguuccccacaccaggcauccgcaggcucaaaaucaccagcaccgu

SEQ ID NO: 83385 - RNA, 103 nt, Mus musculus
caucgaggugcccccgguggaaggcuacgugaugguuuugcagccggaggagccuaagaucagccugaguggcguccaccacuuugcccgcgcagcuucugag

SEQ ID NO: 83386 - RNA, 50 nt, Mus musculus
cccugagcugagaaucaucagcaccaucaccagagagguggagcccgagg

SEQ ID NO: 83387 - RNA, 48 nt, Mus musculus
gaccuggacaccugugaggucacaguggaaggggaugagcugaacgca

SEQ ID NO: 83388 - RNA, 48 nt, Mus musculus
ccugcuggaucgcaaguucaagcucauuugcucagaacuaaauggucg

SEQ ID NO: 83389 - RNA, 65 nt, Mus musculus
agccacaguucguccacccugaacaucgauccuuuguggaccugucuggucacaaccuggccaau

SEQ ID NO: 83390 - RNA, 44 nt, Mus musculus
ggggaaagcacgugggucaggaugcugugguauguaggguccag

SEQ ID NO: 83391 - RNA, 68 nt, Mus musculus
gauuguggugugugucagcuuccugguuuucaugaucauccuggggguguuucggauccgggcugcac

SEQ ID NO: 83392 - RNA, 91 nt, Mus musculus
aucagcgaacgaugcgggaccaggacacggggaaggagaaugagauggacugggaugacucugccuugaccaucaccgucaaccccaugga

SEQ ID NO: 83393 - RNA, 69 nt, Mus musculus
gcagugaggaggaggaagaggaggaggaggaggaggagagcgaagauggggaggaagaggaagacauca

SEQ ID NO: 83394 - RNA, 66 nt, Mus musculus
ccagugccgagucugagagcagugaggaggaggaaggaggccccggagacggccagaaugccaccc

SEQ ID NO: 83395 - RNA, 46 nt, Mus musculus
ccccacggguccacgauguacaaaaucauuuugaccagcaggucug

SEQ ID NO: 83396 - RNA, 46 nt, Mus musculus
ccuguuggugaaaugguguagcugggaacggacagcaaaggugcag

SEQ ID NO: 83397 - RNA, 46 nt, Mus musculus
ccuguccccuguagcugcuuucuuagauggaaacaggcuaacgaag

SEQ ID NO: 83398 - RNA, 44 nt, Mus musculus
agccgcaggguccccuuuaagauguguauaucgacacuagguca

SEQ ID NO: 83399 - RNA, 46 nt, Mus musculus
gaaugagcaucuccaaucugaaaguccagaacgucaccuuggccag

SEQ ID NO: 83400 - RNA, 52 nt, Mus musculus
cuggauguccacaggggagcaggauccuggccugcuguguugugaggcugua

SEQ ID NO: 83401 - RNA, 46 nt, Mus musculus
gcaagcaguuuggccaacuagaagaccccguguacucaucucguag

SEQ ID NO: 83402 - RNA, 44 nt, Mus musculus
gcuagcugcagcuaccccagcucacccugcagacagcacagcag

SEQ ID NO: 83403 - RNA, 42 nt, Mus musculus
acagacggaguccggacagcagaaagaaguggacaccccccg

SEQ ID NO: 83404 - RNA, 46 nt, Mus musculus
cuaccacccugcccagagcuucagugcuaaguacacacaucaagag

SEQ ID NO: 83405 - RNA, 45 nt, Mus musculus
ccccgcuagccgccgacuccgccgcugcccgccccuugugaccgg

SEQ ID NO: 83406 - RNA, 55 nt, Mus musculus
augugggcgugcuuguugacauaaaaggaguccagggugaguauuuaauaaugca

SEQ ID NO: 83407 - RNA, 45 nt, Mus musculus
uucaauaacaugauuguauaaugauuguauaacaucaauguugag

SEQ ID NO: 83408 - RNA, 46 nt, Mus musculus
cauaagucucauuuagagguccgaggacaauuugcagguccuaggg

SEQ ID NO: 83409 - RNA, 46 nt, Mus musculus
ccauucagugaguuuuuaacuucaugacuaaauauauucucugggu

SEQ ID NO: 83410 - RNA, 41 nt, Mus musculus
ggauauuggcaauaauucguuuauuucaugugaaugcgggg

SEQ ID NO: 83411 - RNA, 42 nt, Mus musculus
acacagaggacacagaggacucagaaccacuguccccagcag

SEQ ID NO: 83412 - RNA, 44 nt, Mus musculus
aagccuccaggccugagcacgagagaaccugaaucugcugucaa

SEQ ID NO: 83413 - RNA, 46 nt, Mus musculus
gcacaggaagcaaacccagccaccagugaugggauacauacugaga

SEQ ID NO: 83414 - RNA, 45 nt, Mus musculus
uauacaaaaccuaucuacacuaaggagugaaaauuacugggcaau

SEQ ID NO: 83415 - RNA, 45 nt, Mus musculus
ggagaaugaaaguauuaauaaggggaaagacauucaugguagcag

SEQ ID NO: 83416 - RNA, 45 nt, Mus musculus
gugugugugaguguguguguguguguguguguguguguaugagug

SEQ ID NO: 83417 - RNA, 29 nt, Mus musculus
uugcaauuagaaaccaauuuuaaaaccag

SEQ ID NO: 83418 - RNA, 42 nt, Mus musculus
gaggaagugaugucugaacgaaaagauaggggguggggcaaa

SEQ ID NO: 83419 - RNA, 28 nt, Mus musculus
aaaugagcucacccuaacccaggaaagu

SEQ ID NO: 83420 - RNA, 45 nt, Mus musculus
uuuccccuccgcgcgccacauccuccuccuccucgcgaccgggac

SEQ ID NO: 83421 - RNA, 41 nt, Mus musculus
accaugcagggauucugcaggugcacugaagggaagcggga

SEQ ID NO: 83422 - RNA, 42 nt, Mus musculus
ugggcugaggcugucagcuguggggaagcagcagugaccaaa

SEQ ID NO: 83423 - RNA, 24 nt, Mus musculus
uagcaggaagugguguucuggccu

SEQ ID NO: 83424 - RNA, 46 nt, Mus musculus
caggccagaacaccacuuccugcuaagguguugccaccacccccac

SEQ ID NO: 83425 - RNA, 41 nt, Mus musculus
gggaaauggacuggggcuaaacccggaggguaacgggcagc

SEQ ID NO: 83426 - RNA, 42 nt, Mus musculus
gacagaacaggagcagcggggagagguggccgggcuucagag

SEQ ID NO: 83427 - RNA, 45 nt, Mus musculus
aauagccucaccuuucaccagacucaagcgugugaacacugccug

SEQ ID NO: 83428 - RNA, 41 nt, Mus musculus
ucgagagaagaggaggagggaggggagagggagggcaggaa

SEQ ID NO: 83429 - RNA, 41 nt, Mus musculus
ggaagggagggggaggaggaggaagaggaggaggaggagga

SEQ ID NO: 83430 - RNA, 41 nt, Mus musculus
cucaagauggagccguucagggcuucucccuagugcugaga

SEQ ID NO: 83431 - RNA, 45 nt, Mus musculus
gauucuucuacacacaaaugaauuuaacuuaaaaacaaagaauga

SEQ ID NO: 83432 - RNA, 24 nt, Mus musculus
uccgggaggcccaggccaggguuu

SEQ ID NO: 83433 - RNA, 23 nt, Mus musculus
agaccccugcccggauggcccca

SEQ ID NO: 83434 - RNA, 46 nt, Mus musculus
gcagaagaaagacuugcagagccacaugaucaagcugcacggagcc

SEQ ID NO: 83435 - RNA, 44 nt, Mus musculus
gaguuccaggccaguuggggcuucaguguguggcacccuguuua

SEQ ID NO: 83436 - RNA, 46 nt, Mus musculus
ucugcgagcuacacuuguccaugguugccagcuuccuuggggugga

SEQ ID NO: 83437 - RNA, 46 nt, Mus musculus
ucccucagaggacaaagagucugaggacugcaaagagcccccaagg

SEQ ID NO: 83438 - RNA, 45 nt, Mus musculus
aaccaaaaaaaaaaaagaaaaagaaaaagaaaaaaaaggaaaagu

SEQ ID NO: 83439 - RNA, 42 nt, Mus musculus
aaguauacggccauaucaucaaccaagggcagccuccccaag

SEQ ID NO: 83440 - RNA, 42 nt, Mus musculus
cgagacugcauccguuccagaaucauaauggagcccagagga

SEQ ID NO: 83441 - RNA, 45 nt, Mus musculus
ugugagugagguguguguucagagaaucccauguguuagcaggag

SEQ ID NO: 83442 - RNA, 42 nt, Mus musculus
ugggacuuucucagaccaccuuagaccacaaugcccccaacc

SEQ ID NO: 83443 - RNA, 45 nt, Mus musculus
gaggguggccucacgauguggucaagagagaaacugaacggcuca

SEQ ID NO: 83444 - RNA, 46 nt, Mus musculus
uacccaggguggccuuguaugaaguuucucuucccuuuguuguuug

SEQ ID NO: 83445 - RNA, 46 nt, Mus musculus
ggguuggucaaggaugugcuucugggacuguuguuucaguguguga

SEQ ID NO: 83446 - RNA, 45 nt, Mus musculus
ucauuucuuugucugugaaugccacauauuuucagaaggccagaa

SEQ ID NO: 83447 - RNA, 79 nt, Mus musculus
ucgggucaauucugaguuuacaacuuugaagaaaauuggcaucagaagacagaagaggaagaaagccauuugcuugagu

SEQ ID NO: 83448 - RNA, 42 nt, Mus musculus
ccuguggugaguuuugccuguuguagaugccuguguccccga

SEQ ID NO: 83449 - RNA, 42 nt, Mus musculus
aaaagcaaguuucuccauuugaaucucacuucaugcccagau

SEQ ID NO: 83450 - RNA, 45 nt, Mus musculus
augauccuugugugucacgaauuuuccacaaagaaggcugccuca

SEQ ID NO: 83451 - RNA, 45 nt, Mus musculus
ccagauagucaaccccaggaaugcugaaaauugugagagagagag

SEQ ID NO: 83452 - RNA, 77 nt, Mus musculus
agcauuccugggguugacuaucuggaaugugaucuggggcagacggaguucacuccuccuggcugugucgcuuuacu

SEQ ID NO: 83453 - RNA, 45 nt, Mus musculus
cagucugaaccaggaaaaggauguuauaggauaacugguggaggc

SEQ ID NO: 83454 - RNA, 55 nt, Mus musculus
gaggaugguguacuaugggaagaugaacuguuacaaugacuacgagaauuacauu

SEQ ID NO: 83455 - RNA, 72 nt, Mus musculus
gacauaguaaaauacguguucagagauuacaagagagaguuuccacuuaucaucaacacgaugggcugggug

SEQ ID NO: 83456 - RNA, 75 nt, Mus musculus
acuggcaagaagagggaauucugggaaguaguaagaaugaaauagauuggagggagaugcugaguaagacacuaa

SEQ ID NO: 83457 - RNA, 51 nt, Mus musculus
aguuaggagccagucacugaaugagccaaagccauggccaagacguuuagu

SEQ ID NO: 83458 - RNA, 45 nt, Mus musculus
aucagaauauaacugaacgacauaauugggagacagcacccggau

SEQ ID NO: 83459 - RNA, 33 nt, Mus musculus
agagcucacagauggccuguauacaaaaagcaa

SEQ ID NO: 83460 - RNA, 46 nt, Mus musculus
uggcacgggaagcaucagcuggcuaagguagcccaacacugccaga

SEQ ID NO: 83461 - RNA, 46 nt, Mus musculus
aggcuuaugagccuguaggggccguucuccuucaaacuaucagcag

SEQ ID NO: 83462 - RNA, 41 nt, Mus musculus
ccaggcagugguggcacaagccuuuaaucccagcacucggg

SEQ ID NO: 83463 - RNA, 47 nt, Mus musculus
cccucucaaaaaaccaaaaaaaagaaagaaaaugauucagacaggag

SEQ ID NO: 83464 - RNA, 46 nt, Mus musculus
cuacagaguaagacuaucugcaaaagaacccugcaaguccagaaag

SEQ ID NO: 83465 - RNA, 45 nt, Mus musculus
uuaguucauuguuuaggagccuaaggcaguacauuguccguuuga

SEQ ID NO: 83466 - RNA, 45 nt, Mus musculus
aguauguggguaggcgcaacgucggcaugcaagacccggauagcg

SEQ ID NO: 83467 - RNA, 42 nt, Mus musculus
aaagcccaaacagucacauaugggguucugggcaagcaggau

SEQ ID NO: 83468 - RNA, 45 nt, Mus musculus
acauggacaagcggaccuaccacauccucaccccucuacccccag

SEQ ID NO: 83469 - RNA, 45 nt, Mus musculus
caaccagcagacaguucacaguuuuuaacucuucuggggguagag

SEQ ID NO: 83470 - RNA, 46 nt, Mus musculus
agauuauaauuuaaauaucccuggagcaacagagaaaauuggagag

SEQ ID NO: 83471 - RNA, 46 nt, Mus musculus
ugugaagcagugaagaaagccgugguguccucagaacaggcagagg

SEQ ID NO: 83472 - RNA, 46 nt, Mus musculus
uguugugaccaggagugacugugucaggucauuucugugguugcag

SEQ ID NO: 83473 - RNA, 46 nt, Mus musculus
uuggugccaucuuuguggcagccucagcaucugaaaaucccauuag

SEQ ID NO: 83474 - RNA, 45 nt, Mus musculus
cuucaaacucucugcgaggcaggagagccaacggugcccagagac

SEQ ID NO: 83475 - RNA, 45 nt, Mus musculus
caccuuuguccaguuccccagaucuucuggucuucacaguacuaa

SEQ ID NO: 83476 - RNA, 42 nt, Mus musculus
accugggacagcugucuguccgugcaauuauggugucugcau

SEQ ID NO: 83477 - RNA, 46 nt, Mus musculus
aaaugagaugauguggauaaggagccccaggcuaaccugcagagag

SEQ ID NO: 83478 - RNA, 46 nt, Mus musculus
cucaucucaaccaaacacugcacugagauggacaaacaagccccau

SEQ ID NO: 83479 - RNA, 42 nt, Mus musculus
agaaugugaagggaaagaauaaggcuggaggccagagcaagu

SEQ ID NO: 83480 - RNA, 46 nt, Mus musculus
aguacaguacccgcuuggcugugcuuagcagcagucugacccauug

SEQ ID NO: 83481 - RNA, 30 nt, Mus musculus
guauugccgcugcugggcgcggaggugagu

SEQ ID NO: 83482 - RNA, 46 nt, Mus musculus
agccacaaagcugcuuccaagucugcacugggaaccaggucacuaa

SEQ ID NO: 83483 - RNA, 46 nt, Mus musculus
agacccugccucaaagagggaaaaaaaaaaucuggucugccugcuu

SEQ ID NO: 83484 - RNA, 42 nt, Mus musculus
gcucagacgaaugaggaggguuauccggggaguaugagggag

SEQ ID NO: 83485 - RNA, 42 nt, Mus musculus
cuugaacuuaaggucucaagcuggagcgugcuccugggggca

SEQ ID NO: 83486 - RNA, 45 nt, Mus musculus
acaggugcagucuucuaugagggagacugagcugagcuuccggga

SEQ ID NO: 83487 - RNA, 45 nt, Mus musculus
ccaagaagaagaagaagaaacugaaggagaagaaggagaagaagg

SEQ ID NO: 83488 - RNA, 46 nt, Mus musculus
cugguagggagggggauauccucuacuaacagauauucuauguguc

SEQ ID NO: 83489 - RNA, 42 nt, Mus musculus
aguggauagaagauuagacuucucuccauggcccugccccag

SEQ ID NO: 83490 - RNA, 45 nt, Mus musculus
cauuccuccugaccaaaccuuggccauuuuccaagaccaucaaua

SEQ ID NO: 83491 - RNA, 45 nt, Mus musculus
ggcauggccagaugcccuaucuuggagggccagaagcgguaaggg

SEQ ID NO: 83492 - RNA, 42 nt, Mus musculus
aucccagaaaccacauuguggcucacaaccaucuguaauggg

SEQ ID NO: 83493 - RNA, 24 nt, Mus musculus
gggguuagacuaguggcuaggggu

SEQ ID NO: 83494 - RNA, 41 nt, Mus musculus
aaccuaaaugucaagauaagugacagguucggaugcaccac

SEQ ID NO: 83495 - RNA, 46 nt, Mus musculus
gguacaugucaaaagccaagucaucaaguggagagauguagucaga

SEQ ID NO: 83496 - RNA, 45 nt, Mus musculus
gggcacgguagcgagccaucugcuguuucuucuccuuggccagau

SEQ ID NO: 83497 - RNA, 42 nt, Mus musculus
caggcaguugucggcagcugccagcucacugagcaggggcag

SEQ ID NO: 83498 - RNA, 46 nt, Mus musculus
auuuuucaagacaggguuucuguguccugaaacuaccucuguagau

SEQ ID NO: 83499 - RNA, 44 nt, Mus musculus
gcacuacaguuccaagcacagccguggaaggcagaugcugcccu

SEQ ID NO: 83500 - RNA, 45 nt, Mus musculus
uuacagaagguagaaaugguccuuuaaggucagaggucaccaacg

SEQ ID NO: 83501 - RNA, 46 nt, Mus musculus
agcuucacuaguucugacagcuaacggcucucgcacggccuuagga

SEQ ID NO: 83502 - RNA, 45 nt, Mus musculus
gaacugcaacacuguccugggagacgcaugugcuaaggcugcuga

SEQ ID NO: 83503 - RNA, 41 nt, Mus musculus
uggcugagccagggacaugggugcaguagagaggugacagg

SEQ ID NO: 83504 - RNA, 45 nt, Mus musculus
guaaaugacaugcuaguguccacuauaagccuguuggcaguaggu

SEQ ID NO: 83505 - RNA, 45 nt, Mus musculus
augcgacaagcuauguguggauuucauucucacuaugcagaagau

SEQ ID NO: 83506 - RNA, 53 nt, Mus musculus
gcucugacacuuugcaacugauccaucaucagcaccagcccacuaacacaagg

SEQ ID NO: 83507 - RNA, 25 nt, Mus musculus
cauuucuugaugccaggaaguagcu

SEQ ID NO: 83508 - RNA, 44 nt, Mus musculus
cagacauacuggucugucugcuuucaaggcacuuacuagagaua

SEQ ID NO: 83509 - RNA, 46 nt, Mus musculus
auuaauccagguuguguuaauacagcaguuuuccuaggcccaaaag

SEQ ID NO: 83510 - RNA, 47 nt, Mus musculus
ggccguggaaggcaacgugcgcaggauggagcggcugcggguggaga

SEQ ID NO: 83511 - RNA, 45 nt, Mus musculus
gaagccccucacaucaucggaguagucggugacugcuggccccag

SEQ ID NO: 83512 - RNA, 46 nt, Mus musculus
ggaguggguggaggacuuuuuacucaccccuuagaaacagguagaa

SEQ ID NO: 83513 - RNA, 42 nt, Mus musculus
gagagcaggugagccauacaccaagugucucuucagccucca

SEQ ID NO: 83514 - RNA, 42 nt, Mus musculus
cuccucccuugaggucuccugcccuccucagaaugcccagga

SEQ ID NO: 83515 - RNA, 46 nt, Mus musculus
ggaccaggcuggugugaugacaauccccaggacccacgcgguagaa

SEQ ID NO: 83516 - RNA, 43 nt, Mus musculus
guguauguaccccaugcccuuccaggucagaagaagacaucag

SEQ ID NO: 83517 - RNA, 46 nt, Mus musculus
ugacucuagcuugugucaagcugacauaaaacuagccagcacagua

SEQ ID NO: 83518 - RNA, 46 nt, Mus musculus
uguaaugagaucugccacccucuucuggugugucugaagucagcua

SEQ ID NO: 83519 - RNA, 42 nt, Mus musculus
guauguguguauguacauguguguguguguguguguauauau

SEQ ID NO: 83520 - RNA, 45 nt, Mus musculus
uccucccuccccgugaccaccccaugggucgcuccugggccacag

SEQ ID NO: 83521 - RNA, 44 nt, Mus musculus
aacaggaucuguggcccaggagcgacccaugggguggucacggg

SEQ ID NO: 83522 - RNA, 42 nt, Mus musculus
auccaaaagacaaaauggagucaagaccuuuugggcagccag

SEQ ID NO: 83523 - RNA, 45 nt, Mus musculus
gcuacaguguacucauauacauuaaauaaacaauauuuuaaagaa

SEQ ID NO: 83524 - RNA, 42 nt, Mus musculus
ccaggcaaccacaugguggcucacaaccaucuguaaugugau

SEQ ID NO: 83525 - RNA, 45 nt, Mus musculus
guggacauagaggcucguuuggcuuccgguuuuggcagcugggac

SEQ ID NO: 83526 - RNA, 42 nt, Mus musculus
uaggaucagacaagccugaggacaggcucggauugggggcag

SEQ ID NO: 83527 - RNA, 46 nt, Mus musculus
gcauacuauuccaccguacagcacaaaguggccaaagugagaucuu

SEQ ID NO: 83528 - RNA, 47 nt, Mus musculus
cuaugagaucucaguccaggaggagaucacagcucgccugcauuuca

SEQ ID NO: 83529 - RNA, 46 nt, Mus musculus
agccugccuggacuucaucagagaccaccuagucaacacugagacc

SEQ ID NO: 83530 - RNA, 45 nt, Mus musculus
aagggaaagagggcagggacauuuccaagaggucacauggucuua

SEQ ID NO: 83531 - RNA, 45 nt, Mus musculus
agaguccauggaugcaguugagagggcagagaaauuccggcagaa

SEQ ID NO: 83532 - RNA, 42 nt, Mus musculus
ucccuucuuagcacagggaccucgacuggcauggugggagga

SEQ ID NO: 83533 - RNA, 46 nt, Mus musculus
uuuugcuuuaucuggcaguauggaaggaaguuaaggccugagacca

SEQ ID NO: 83534 - RNA, 41 nt, Mus musculus
cugucuggggacuacuucagggggagggaaggagcccaagg

SEQ ID NO: 83535 - RNA, 23 nt, Mus musculus
ccugagcccugccucagcccgau

SEQ ID NO: 83536 - RNA, 45 nt, Mus musculus
augugcaacucagggagacccccucccuaccugcuaggccaagau

SEQ ID NO: 83537 - RNA, 42 nt, Mus musculus
caagcaggagccaggccagggccagugcagggagguucaggg

SEQ ID NO: 83538 - RNA, 45 nt, Mus musculus
cacuuuaaaagcagacugcucgcgggacugguauauaucucagug

SEQ ID NO: 83539 - RNA, 42 nt, Mus musculus
uucuggagucuucaucuuuucuguuaggaaauggagggaggu

SEQ ID NO: 83540 - RNA, 42 nt, Mus musculus
cguucucagccacuggaagcuuuaugcaaaaagcccccagau

SEQ ID NO: 83541 - RNA, 46 nt, Mus musculus
augaggugugugugugugugugugugugugugugugcgugugcgcg

SEQ ID NO: 83542 - RNA, 45 nt, Mus musculus
gggcuggaagaucacaucgagaugcaaaguuuccaguggcaagau

SEQ ID NO: 83543 - RNA, 45 nt, Mus musculus
auuccaugcuuuuaguggucaaggagggcauaagguccccuggga

SEQ ID NO: 83544 - RNA, 24 nt, Mus musculus
acccuggggggaaggccgggaagc

SEQ ID NO: 83545 - RNA, 45 nt, Mus musculus
guacacuggugagacaugucuacaagcccagagcagagcagagag

SEQ ID NO: 83546 - RNA, 42 nt, Mus musculus
uguguccuagugcccuggguggaaaauccucugcccggagug

SEQ ID NO: 83547 - RNA, 46 nt, Mus musculus
ugccuggugucuacgaaggcuagaugaggacaugaggcuaggaaug

SEQ ID NO: 83548 - RNA, 52 nt, Mus musculus
agaauguauuuugacaaguauguccuuaagccggccacagaaggaaagcagu

SEQ ID NO: 83549 - RNA, 48 nt, Mus musculus
cuaucaaugaccgcauugacgagauggucugcuuugcccugccacagc

SEQ ID NO: 83550 - RNA, 47 nt, Mus musculus
cugccaaguuacauccaucuaucagguuuaccugaggaggcauaaga

SEQ ID NO: 83551 - RNA, 50 nt, Mus musculus
aacccccagacgaacaaaacaaacaaaaaacguggaagguaagggagcaa

SEQ ID NO: 83552 - RNA, 45 nt, Mus musculus
cgaacagauccgugugcaagccgaggaaagaaggaaaacccugac

SEQ ID NO: 83553 - RNA, 74 nt, Mus musculus
aaaagucauagccaggucaggcgauccuguguugugguaguuaauagcaaucucucacuuaaaaaggagagagu

SEQ ID NO: 83554 - RNA, 41 nt, Mus musculus
gcggagggcggcggugaccgcggggcgggagaccggccauc

SEQ ID NO: 83555 - RNA, 42 nt, Mus musculus
caggaacagguuuccucucaagucccuauguaggccucuccu

SEQ ID NO: 83556 - RNA, 45 nt, Mus musculus
aucccuagcugacagcuugcugcagggagaggaucuguguggaga

SEQ ID NO: 83557 - RNA, 45 nt, Mus musculus
uuccuaucauugcccgggagcugcggggcuccauaacugguaggu

SEQ ID NO: 83558 - RNA, 55 nt, Mus musculus
acagaguuuacuuuugaccaguacaguucaggccaggcuauacaggaugccaucc

SEQ ID NO: 83559 - RNA, 44 nt, Mus musculus
gggacagcccaggaugcccuggguacauggacauuguacaguug

SEQ ID NO: 83560 - RNA, 46 nt, Mus musculus
ugagucuuagugauggaaggucucaucaguaccucagccggcuggg

SEQ ID NO: 83561 - RNA, 35 nt, Mus musculus
uguuccuacuuacgcauaaauuaucauucuccuuu

SEQ ID NO: 83562 - RNA, 44 nt, Mus musculus
uuugagauaggaucugggaucagugauucaguguaagugcagga

SEQ ID NO: 83563 - RNA, 42 nt, Mus musculus
cucaagggugagcaguagccauugguuaguccccgggaagug

SEQ ID NO: 83564 - RNA, 46 nt, Mus musculus
agaugcaaggcuuuuaucagaggcccugaugagagaaacaagagac

SEQ ID NO: 83565 - RNA, 33 nt, Mus musculus
ccuugauuuccagcucaucauccaccugcagag

SEQ ID NO: 83566 - RNA, 46 nt, Mus musculus
auaccagccggaaauucuguggggcaaaggcaaacaggucacagaa

SEQ ID NO: 83567 - RNA, 45 nt, Mus musculus
gguggcuguggggcuagggauccuggcacccacacaagugaaagu

SEQ ID NO: 83568 - RNA, 42 nt, Mus musculus
gugcggaagcgacccaucaucgcgccccugugaggccgagga

SEQ ID NO: 83569 - RNA, 42 nt, Mus musculus
uuuacaaacaccucagaugucugccggaaacuggagguggag

SEQ ID NO: 83570 - RNA, 46 nt, Mus musculus
ugaggaggaacgcggggagcagacagaagaaaagugucaucugggg

SEQ ID NO: 83571 - RNA, 42 nt, Mus musculus
cuucccugggccuggcccugcuccccucaacaguggcggaag

SEQ ID NO: 83572 - RNA, 46 nt, Mus musculus
aguucuuagcaucuacucacaucugcccagguguuggugugcaagu

SEQ ID NO: 83573 - RNA, 45 nt, Mus musculus
gcagaugggagucuugcaugaagcaauugugagaauaugggugag

SEQ ID NO: 83574 - RNA, 42 nt, Mus musculus
cgagggaaggcccauggaggacaaggagcugcugggggagua

SEQ ID NO: 83575 - RNA, 59 nt, Mus musculus
cagcaacaucuaugaggucuuucugacgcagacuguagacacgcuuaagaagaaggugu

SEQ ID NO: 83576 - RNA, 33 nt, Mus musculus
cuuguacguacgugugcucuuucaugcucuggg

SEQ ID NO: 83577 - RNA, 44 nt, Mus musculus
ggacucgaagccggaagccaggaacucguccacacugagguccu

SEQ ID NO: 83578 - RNA, 41 nt, Mus musculus
ggagaccuuacccugacggucuguaagaacacccacaucag

SEQ ID NO: 83579 - RNA, 45 nt, Mus musculus
uuuuaaaacugaugauccuccugccucagccuccuaagugcuaag

SEQ ID NO: 83580 - RNA, 42 nt, Mus musculus
gccccaccguacggggagggagccagcacaucugggcugcag

SEQ ID NO: 83581 - RNA, 46 nt, Mus musculus
uugaaacagaauagaauaugcuacaaauucuuugaauauggagauu

SEQ ID NO: 83582 - RNA, 46 nt, Mus musculus
aaaauauaacaaauacugucacuguucgcaggaaacaaacuucaug

SEQ ID NO: 83583 - RNA, 46 nt, Mus musculus
auuuuaauucagguauugagcaaucuguguucagagacuggcaggg

SEQ ID NO: 83584 - RNA, 42 nt, Mus musculus
ggaacuuggcagaaccucuagucaggguggagauagguguau

SEQ ID NO: 83585 - RNA, 46 nt, Mus musculus
uuuugaugaaaguguuuaucauaguuaaagaguuuucuggucagau

SEQ ID NO: 83586 - RNA, 42 nt, Mus musculus
ugugcuccacugcaccuggccguuuuacaagaggcuggagau

SEQ ID NO: 83587 - RNA, 27 nt, Mus musculus
gggcaucccugugugaacugugaugua

SEQ ID NO: 83588 - RNA, 46 nt, Mus musculus
aaugaauaaauguaguuuucaaauuuaauucugccagggguggugg

SEQ ID NO: 83589 - RNA, 45 nt, Mus musculus
caguagaucugcaggacgacuccuugaauacaacggcaaccuuaa

SEQ ID NO: 83590 - RNA, 41 nt, Mus musculus
guaaaaauauaaguuuuauugucucucaaguggcuccagag

SEQ ID NO: 83591 - RNA, 42 nt, Mus musculus
aggccacccugaucuacagaguaaguuucagaacagccagau

SEQ ID NO: 83592 - RNA, 27 nt, Mus musculus
guauggugcgauugaacaguauaacgc

SEQ ID NO: 83593 - RNA, 42 nt, Mus musculus
ccaggccgcaacagggcagggucgaucaagucagggcgacua

SEQ ID NO: 83594 - RNA, 46 nt, Mus musculus
gaucgcagaggacgauuuuuagguuuccugauuugcucauauagau

SEQ ID NO: 83595 - RNA, 45 nt, Mus musculus
aaaguuagcucauacaacagaucuagggcaagagguuuauuggga

SEQ ID NO: 83596 - RNA, 56 nt, Mus musculus
acacgugcacgcuaauuucacaguaaaaacaaaaaugagugaaaggcagagaugga

SEQ ID NO: 83597 - RNA, 45 nt, Mus musculus
agugcccagcacgcacaaagcucugauucaucccucagcaccagg

SEQ ID NO: 83598 - RNA, 46 nt, Mus musculus
aaucuugugucauaaaaauguuuuuauugcgcaccucaguccauag

SEQ ID NO: 83599 - RNA, 42 nt, Mus musculus
aggcacauuuaaugacugcacuugcccacacaagaccgucua

SEQ ID NO: 83600 - RNA, 46 nt, Mus musculus
cauauacaagcaacauguauuuauuguacaacuaucaaaagcaaag

SEQ ID NO: 83601 - RNA, 46 nt, Mus musculus
acaaagaggaucacaggaagaaaaggagaaaauauaauugcauuuu

SEQ ID NO: 83602 - RNA, 42 nt, Mus musculus
cggcacucuucucacaguacugguccugaauaaagccccuga

SEQ ID NO: 83603 - RNA, 41 nt, Mus musculus
acuauaagagagaggggggagagggaagagagagaggggga

SEQ ID NO: 83604 - RNA, 45 nt, Mus musculus
augucccuggguagugguggcgcacgccuuuaaucccagcacuug

SEQ ID NO: 83605 - RNA, 44 nt, Mus musculus
aaaauacccauggaaggaguuacagagacaaaguucggggcuga

SEQ ID NO: 83606 - RNA, 46 nt, Mus musculus
cuuggucuugugaagauccuaugccccaguacaggggaaugccagg

SEQ ID NO: 83607 - RNA, 47 nt, Mus musculus
agacagagagagacagagagagacagagagaaagagagagacagaga

SEQ ID NO: 83608 - RNA, 60 nt, Mus musculus
cucauccauccacugguccucacaagcugagggaaugccugccucucaucauuuuccuaa

SEQ ID NO: 83609 - RNA, 133 nt, Mus musculus
ggaacagacuuaaguaugcccugacuggagaugaaguaaaagagauuugcaugcagcgauucauuaagauugaugggaaagucaggaccgauauagccuacccugcuggguuuauggaugucaucagcauuga

SEQ ID NO: 83610 - RNA, 63 nt, Mus musculus
agggucgcuuugcuguucaucguauuacaccggaggaggccaaguacaaguugugcaaaguga

SEQ ID NO: 83611 - RNA, 60 nt, Mus musculus
acacugggaaccuguguauggugacuggaggugcuaacuugggaagaauuguuguaauca

SEQ ID NO: 83612 - RNA, 47 nt, Mus musculus
ccaacagagagagacaucccggcucuuuugaugugguucaugugaaa

SEQ ID NO: 83613 - RNA, 70 nt, Mus musculus
gcugaagagagagacaagaggcuagcggccaaacagagcagugggugaaauggucucuaggagacaugcu

SEQ ID NO: 83614 - RNA, 46 nt, Mus musculus
cagguguggcacugguuccaguuuggacuuuuaaaacaggagaggu

SEQ ID NO: 83615 - RNA, 45 nt, Mus musculus
cauucaggccguuuagugcggaaugcgacaguaaggacaaggagu

SEQ ID NO: 83616 - RNA, 41 nt, Mus musculus
uugucucuuacugagugguuguuagacuuuuaggucauaga

SEQ ID NO: 83617 - RNA, 45 nt, Mus musculus
uggugcugcacaccuguaaugcuguuauucaggaccugcggcagg

SEQ ID NO: 83618 - RNA, 41 nt, Mus musculus
ugauuuugagauuagugaguucuggccuugagacuggggaa

SEQ ID NO: 83619 - RNA, 57 nt, Mus musculus
uuuggaacugguguuugaaguuucaaagccuugucaaaugcuacaaagguaaugggg

SEQ ID NO: 83620 - RNA, 41 nt, Mus musculus
ucuuggaauuaagaagauauagaaugcagcauccagguaau

SEQ ID NO: 83621 - RNA, 46 nt, Mus musculus
ugauuuuaauguuuuauuaacucggugauuuuugucagaccgaaug

SEQ ID NO: 83622 - RNA, 59 nt, Mus musculus
caaacgacgaucaaaaugagaagaggaacaagaagccaguguggagagaggaccgcaag

SEQ ID NO: 83623 - RNA, 54 nt, Mus musculus
cacugugaauuauacaacaaugauccacaccccagaaaacccaguaauccguua

SEQ ID NO: 83624 - RNA, 46 nt, Mus musculus
acuggacauaccuggacuuuuaaauaauuuagauucucaccuuaug

SEQ ID NO: 83625 - RNA, 53 nt, Mus musculus
uuuguugagaaccugguaaaccaucggauuauuugguuuuuugcuacccagau

SEQ ID NO: 83626 - RNA, 46 nt, Mus musculus
gaccuacauccuuuuauuacuucuaaacauacuaaggccuugaacu

SEQ ID NO: 83627 - RNA, 42 nt, Mus musculus
ucuccuacugucaaucaaagacugaaagacuccugggcagag

SEQ ID NO: 83628 - RNA, 46 nt, Mus musculus
uuagagguaccuauccccuucaaugccugaaauccuuccuccuauu

SEQ ID NO: 83629 - RNA, 46 nt, Mus musculus
ugcugcuggcuggacagcacacauccuccaccaccagugccuggau

SEQ ID NO: 83630 - RNA, 46 nt, Mus musculus
agcugaggacauucuucaaacuuuacuagauucuacauacaaguaa

SEQ ID NO: 83631 - RNA, 46 nt, Mus musculus
aaauucccugguuuugaauuauaggcgcagggauagagcccaucga

SEQ ID NO: 83632 - RNA, 44 nt, Mus musculus
uuauaaagccucucacaagacagcuauaucaggcuccugucagc

SEQ ID NO: 83633 - RNA, 42 nt, Mus musculus
cauuggggacuccaugaucaguucaaugauuggcugccagaa

SEQ ID NO: 83634 - RNA, 46 nt, Mus musculus
caaguguuauccccuuuccugguucccccuccaaaaacccccuauc

SEQ ID NO: 83635 - RNA, 51 nt, Mus musculus
cucauaauuuugacagcuagccauuguuuacauggaaaggaaauuagaagu

SEQ ID NO: 83636 - RNA, 46 nt, Mus musculus
aauuggcaugucuguaccagcagcaguaucugcuucuaggccagua

SEQ ID NO: 83637 - RNA, 47 nt, Mus musculus
uaucauugaaaaagaagcaaaggaauacuuucaaaguuggggagaaa

SEQ ID NO: 83638 - RNA, 46 nt, Mus musculus
uaaggauaacaugauauacuucagaaugaaauaaaaguguccuuua

SEQ ID NO: 83639 - RNA, 41 nt, Mus musculus
agauagcaggagaggaaggugggucccugagugguggagua

SEQ ID NO: 83640 - RNA, 47 nt, Mus musculus
auggugucagugaugauggcauuuagcucuagaaugagaagaaaagg

SEQ ID NO: 83641 - RNA, 46 nt, Mus musculus
acauagcccacacuguguuaagggucaauaucaguguuucuggggu

SEQ ID NO: 83642 - RNA, 45 nt, Mus musculus
uuauucauucacguguuaugaauagaauauagaugaggcagcaga

SEQ ID NO: 83643 - RNA, 45 nt, Mus musculus
aagucuacggucggcugacaacaccuguguuugggaagggaguug

SEQ ID NO: 83644 - RNA, 46 nt, Mus musculus
ugcauuauuauuguuauuauuguuauuauuauucucaccaccauga

SEQ ID NO: 83645 - RNA, 41 nt, Mus musculus
cauacacagaguauggaaaccuaaggagauuucagugaagu

SEQ ID NO: 83646 - RNA, 52 nt, Mus musculus
ugcugccugcuucuagauuuuacccuucuaugaaaugcagaccucgagguug

SEQ ID NO: 83647 - RNA, 41 nt, Mus musculus
aaaacuauaaccaucuuggcguugggccagguggauggcga

SEQ ID NO: 83648 - RNA, 41 nt, Mus musculus
gcgguggcgguggccuacaucgcuggcuuucuguuggagga

SEQ ID NO: 83649 - RNA, 45 nt, Mus musculus
ggggguccgagcgcaggcggcgggccagguauccgggccgggcca

SEQ ID NO: 83650 - RNA, 58 nt, Mus musculus
acaaauggucaggcggcggcggagaaggaggaggcggaggcgcaggggggacccaggg

SEQ ID NO: 83651 - RNA, 69 nt, Mus musculus
uggggggcgccuagaaacccguuggagggcgcgcgagggagagcagaggcugcgaguugagggauugac

SEQ ID NO: 83652 - RNA, 45 nt, Mus musculus
cagccaggguucuuaacuuccaagccuucuucuccagccccuuuc

SEQ ID NO: 83653 - RNA, 46 nt, Mus musculus
cagcagcguaacagcuucggucacggaaccuucaccagcccuagau

SEQ ID NO: 83654 - RNA, 46 nt, Mus musculus
augcucaggcauugagagcacacacugaucuaauagaggaccaggg

SEQ ID NO: 83655 - RNA, 46 nt, Mus musculus
acugguaagcaauguugugagauuacuuauuacagacuagggagaa

SEQ ID NO: 83656 - RNA, 46 nt, Mus musculus
caugcaauaacaaugaaauaagagacuaugaauuugaaagagaauu

SEQ ID NO: 83657 - RNA, 46 nt, Mus musculus
agccaaggcuacacagugagacccugucuuagggguuggggcagug

SEQ ID NO: 83658 - RNA, 46 nt, Mus musculus
uggacuuaagacaaacucagcauguugacacuugggaggcagaggu

SEQ ID NO: 83659 - RNA, 47 nt, Mus musculus
caacaaauuagaagcaauaugaaugucauuagaaagcuggcuggaua

SEQ ID NO: 83660 - RNA, 46 nt, Mus musculus
ucagaauauuuuucaggaguuggcuuucuuccuuccccauguagau

SEQ ID NO: 83661 - RNA, 47 nt, Mus musculus
ucuaccacuccaaauaucagugaaaaguaucuaucucucuaguuaug

SEQ ID NO: 83662 - RNA, 45 nt, Mus musculus
ugggaucauacauaauuuauauuuauuauuacaguuuuugcagaa

SEQ ID NO: 83663 - RNA, 46 nt, Mus musculus
auaaaucacagaaggaaccugugggggguagcauguaggacagauc

SEQ ID NO: 83664 - RNA, 44 nt, Mus musculus
acuguggcuggcuggggagaaggcaugaaugaggaagucaguga

SEQ ID NO: 83665 - RNA, 49 nt, Mus musculus
guagauaggccuagaugggagaguuggagccagcaugggaaguugucag

SEQ ID NO: 83666 - RNA, 44 nt, Mus musculus
gccucuaguauuacuuccuguauuuauucucuuuaggcucaguu

SEQ ID NO: 83667 - RNA, 45 nt, Mus musculus
uucauccgcucaccuguguguguuggugaagaacuaagggcagug

SEQ ID NO: 83668 - RNA, 46 nt, Mus musculus
gugaugcgaauuaacucucauguuucuguuuaauguuuguccagau

SEQ ID NO: 83669 - RNA, 45 nt, Mus musculus
uauaacuggauucccagaaaacuuaacuacuaauagccucuuacu

SEQ ID NO: 83670 - RNA, 46 nt, Mus musculus
cagcacaaucaagacagucccuaacagacuuccccacaggccaacg

SEQ ID NO: 83671 - RNA, 46 nt, Mus musculus
cgguggaauggguuacccucguuuagguggagaagguggaagaggu

SEQ ID NO: 83672 - RNA, 44 nt, Mus musculus
agggcagaaaccuuggggcuggguggaacaauugaucguugagg

SEQ ID NO: 83673 - RNA, 47 nt, Mus musculus
uggcagggagagugggcagcucagaaaagaacaggaaggcuccaaca

SEQ ID NO: 83674 - RNA, 64 nt, Mus musculus
gaaaauggguuuaugauagaaagaacaaaugauaaucuaaacagaggagaaagcaugaauagag

SEQ ID NO: 83675 - RNA, 59 nt, Mus musculus
ggucaaccuucaguuuguuuuuguuuuuuuuuaaacccacagauuuuuuugauacccaa

SEQ ID NO: 83676 - RNA, 90 nt, Mus musculus
gaaucucagugagcuuaacuggcaacggugugugaaagcuagaggucauguacauaagcuguuguuaggaacagccauuauaaaugagag

SEQ ID NO: 83677 - RNA, 54 nt, Mus musculus
ggaagucagaauguguguuugcugugccucauauagagauuuuacgucaauuuu

SEQ ID NO: 83678 - RNA, 46 nt, Mus musculus
uuugguuugguucucauuguuuaaaagagaguccauaaccugcuuu

SEQ ID NO: 83679 - RNA, 46 nt, Mus musculus; identical to SEQ ID NO: 28986

SEQ ID NO: 83680 - RNA, 78 nt, Mus musculus; identical to SEQ ID NO: 28987

SEQ ID NO: 83681 - RNA, 46 nt, Mus musculus; identical to SEQ ID NO: 28988

SEQ ID NO: 83682 - RNA, 44 nt, Mus musculus
cugcuugguggggauggugguauugcgcuugaugaggacaguca

SEQ ID NO: 83683 - RNA, 46 nt, Mus musculus; identical to SEQ ID NO: 28991

SEQ ID NO: 83684 - RNA, 45 nt, Mus musculus; identical to SEQ ID NO: 28992

SEQ ID NO: 83685 - RNA, 45 nt, Mus musculus
cagcuccgaccuucuuaucuaagccauaagcaauagcagcagcag

SEQ ID NO: 83686 - RNA, 47 nt, Mus musculus
uuggaccuugggccugccugcaucauucaccaccaugaagggccagu

SEQ ID NO: 83687 - RNA, 44 nt, Mus musculus
aaaacuguguuggugggguucauugcaaccugauucuuggccgc

SEQ ID NO: 83688 - RNA, 46 nt, Mus musculus
ccuuuccaugcuggaagacacccacacaggaguagguggugccgag

SEQ ID NO: 83689 - RNA, 53 nt, Mus musculus
guagacagaggggagaauaaaguaaaagagagaaaaguacagaaaaggaaaag

SEQ ID NO: 83690 - RNA, 49 nt, Mus musculus
caggauucuggaaaagauauauauguuagggguagaagauaaaauuaag

SEQ ID NO: 83691 - RNA, 46 nt, Mus musculus
acauucuggccaauuuguagccuccggcacuguuuuaaaugauuag

SEQ ID NO: 83692 - RNA, 46 nt, Mus musculus
gaauucagccucuacucacaucuuuuuaguuuuaugaccucggcuu

SEQ ID NO: 83693 - RNA, 46 nt, Mus musculus
gcacccauggguucaaaauacagcgcuuuaaaagaccaacugauag

SEQ ID NO: 83694 - RNA, 42 nt, Mus musculus
acauuauagauagcaccucuucccuuuaguacuagggcccug

SEQ ID NO: 83695 - RNA, 45 nt, Mus musculus
uuacauguuuuuggcucaugccuggaacgucacaacuucuccuaa

SEQ ID NO: 83696 - RNA, 101 nt, Mus musculus
uuggcuggacaagcugugcaugauucugggaacucucgcugcuauuauccauggaacauuacuuccccucuugaugcugguguuuggaaacaugacagaua

SEQ ID NO: 83697 - RNA, 39 nt, Mus musculus
gaagccaguauucugccaagcauuacuaaucaaaguaag

SEQ ID NO: 83698 - RNA, 56 nt, Mus musculus
uaauguuuaugggcauuagagcaucuaggagaagugcuggcagagauaagucggaa

SEQ ID NO: 83699 - RNA, 100 nt, Mus musculus
ggcaucugggcaguuuuggcugaaagcagauccuggaguggagagaagaaggcuaagacaguuguuuauagagagagggagaggggacagaauaagggag

SEQ ID NO: 83700 - RNA, 46 nt, Mus musculus
cacugccuccagauuaaaggucuacauagucaugccugauacucca

SEQ ID NO: 83701 - RNA, 42 nt, Mus musculus
accaacugggggcagggacccucgugcaauuuuuggaaccag

SEQ ID NO: 83702 - RNA, 42 nt, Mus musculus
agaauaaaauucauuuuuaaauguuuugcauaagccgggcag

SEQ ID NO: 83703 - RNA, 46 nt, Mus musculus
auguggauaguuaugguguugggguuucucauguauuugguucaga

SEQ ID NO: 83704 - RNA, 45 nt, Mus musculus
uagguggacccaacaguacucugaucaucagcaacagcagucugg

SEQ ID NO: 83705 - RNA, 45 nt, Mus musculus
uuugacaugcuuaaaggaagcauagccacuggcuuauacuugaaa

SEQ ID NO: 83706 - RNA, 42 nt, Mus musculus
aagcuuguggcauuccaucugccucagccauacaagugccag

SEQ ID NO: 83707 - RNA, 45 nt, Mus musculus
aguagaacucuuuuuucuuuuaaguggggaaaucuguauccugua

SEQ ID NO: 83708 - RNA, 46 nt, Mus musculus
cagacagugugauggaggcucauuacugaguucucaugaugcucau

SEQ ID NO: 83709 - RNA, 46 nt, Mus musculus
uugggacccaggaucuuaagcagccugccuguguuuacaagguauu

SEQ ID NO: 83710 - RNA, 46 nt, Mus musculus
acuuuggugccuggcagcuggaagacagauacacaagauuaggcag

SEQ ID NO: 83711 - RNA, 45 nt, Mus musculus
auaaugaaucaggagauaggcugguuugaugugcaugauguuggg

SEQ ID NO: 83712 - RNA, 45 nt, Mus musculus
cauagaggacagagccauaugcauacagcagaaaucucugagcag

SEQ ID NO: 83713 - RNA, 46 nt, Mus musculus
auaagugguuggaagcuaacccuugucauuuuggcugucagcccuc

SEQ ID NO: 83714 - RNA, 45 nt, Mus musculus
uguacaagcaacaauuuuauaucuuuacuuuuuacuuugcgaaag

SEQ ID NO: 83715 - RNA, 46 nt, Mus musculus
auguuauccagucucucaggaaguaaggcuuuccacacagcuuuug

SEQ ID NO: 83716 - RNA, 46 nt, Mus musculus
uuuggaauuucagcuaugucacugucagugccaggccuuuugggag

SEQ ID NO: 83717 - RNA, 45 nt, Mus musculus
ggguagguuuucuuuuuaagaaguuaaguggauacuuuuggugug

SEQ ID NO: 83718 - RNA, 45 nt, Mus musculus
aacaagaagaaagugucuuuaauaaaacaaagaacaaagucccaa

SEQ ID NO: 83719 - RNA, 45 nt, Mus musculus
guuuaaaaauguucacuucaacuacccaucgagaagcgaaguuca

SEQ ID NO: 83720 - RNA, 43 nt, Mus musculus
ccgagaacauucgcuauggccgagaagaugucaccauggauga

SEQ ID NO: 83721 - RNA, 46 nt, Mus musculus
augguggugucauuguggagcaaggaaaucaugaugagcucaugag

SEQ ID NO: 83722 - RNA, 46 nt, Mus musculus
ccuuuaauaaggagaucaauuuacagaaguguccacagaaagcaag

SEQ ID NO: 83723 - RNA, 42 nt, Mus musculus
uauccuuuccuccaguacagccuuugacgugaugaugggaag

SEQ ID NO: 83724 - RNA, 46 nt, Mus musculus
caguccaugcugggaagcagggaaugcccagcugcucaucuuugaa

SEQ ID NO: 83725 - RNA, 42 nt, Mus musculus
auagaucaucauauaucccuuuagcaguagcauuggccccuc

SEQ ID NO: 83726 - RNA, 46 nt, Mus musculus
ugcaugaugguauuaagguauucaggauugaauggccucugucuuc

SEQ ID NO: 83727 - RNA, 45 nt, Mus musculus
augaguuugaggccagccuagucuacaaagugaguuccaggauag

SEQ ID NO: 83728 - RNA, 45 nt, Mus musculus
uuagucagaagcaucugugacauaaaugcaugaaggcuggugaca

SEQ ID NO: 83729 - RNA, 46 nt, Mus musculus
cuuacauaaacaucacacuuuuuccuaucgagucauucaccgggag

SEQ ID NO: 83730 - RNA, 41 nt, Mus musculus
agaaaggagagaggagagaagacagagaggagagagagggg

SEQ ID NO: 83731 - RNA, 45 nt, Mus musculus
uguuacguuauauaaauuggauuuucucuuguauguagacguuag

SEQ ID NO: 83732 - RNA, 42 nt, Mus musculus
gugucucaugaggagauugugagggcagccaaggaggccaac

SEQ ID NO: 83733 - RNA, 45 nt, Mus musculus
cuccagccuguguccuccuccuucccacagaguuaacugcaccau

SEQ ID NO: 83734 - RNA, 45 nt, Mus musculus
agaggacauaguagauaaaucccaggucugguuauggagggggaa

SEQ ID NO: 83735 - RNA, 42 nt, Mus musculus
uucauacuuggaugcgaucuuguucuuaacuucggcggagag

SEQ ID NO: 83736 - RNA, 46 nt, Mus musculus
ggauagcuuuaaugaaguugccgauauucuccaacugcggccaauu

SEQ ID NO: 83737 - RNA, 46 nt, Mus musculus
augccuccgagucccauaggcugucaugcccgccuggcuggcacau

SEQ ID NO: 83738 - RNA, 44 nt, Mus musculus
ggcuuccgcugugaaugacagguucugugggugcggcacaguac

SEQ ID NO: 83739 - RNA, 46 nt, Mus musculus
cugagcuaggaugagguguugacuuucauuagacagauuaggucag

SEQ ID NO: 83740 - RNA, 44 nt, Mus musculus
agcaaagagcaaagccacugcucugaggauggcuggguuuuaga

SEQ ID NO: 83741 - RNA, 46 nt, Mus musculus
uuauggaaaguaaaacauugcuaauuaaguccaaucuuaucuugag

SEQ ID NO: 83742 - RNA, 45 nt, Mus musculus
gccauaugaugggucuaguaaagaauagaguuuauuugggcacau

SEQ ID NO: 83743 - RNA, 45 nt, Mus musculus
gagggucagagagagaaaaaauggcagaaagucauaguuagagag

SEQ ID NO: 83744 - RNA, 45 nt, Mus musculus
cagacuuguauagccaaauuggaaaucaauuuguuaguuguucag

SEQ ID NO: 83745 - RNA, 45 nt, Mus musculus
uaaaacagaaacggcuacaguucuuagcaggagagagagugagga

SEQ ID NO: 83746 - RNA, 45 nt, Mus musculus
gugguggaggaaacuuuggucguggaggaaacuuuggugaaagag

SEQ ID NO: 83747 - RNA, 45 nt, Mus musculus
uauggcaagauugaaaccauagagguuauggaagacaggcauaaa

SEQ ID NO: 83748 - RNA, 44 nt, Mus musculus
gugcuugcuuaaggguaaugaauaaauaucaaccugacuagaga

SEQ ID NO: 83749 - RNA, 45 nt, Mus musculus
uggaagcaguggguggcucugcuccaggagucuacugggaaagaa

SEQ ID NO: 83750 - RNA, 46 nt, Mus musculus
cuuugaucacuauacuucagaugaguuauuaaccacggaaggauaa

SEQ ID NO: 83751 - RNA, 42 nt, Mus musculus
uugcuucuggaguuacugcucuuuaucuuccagcccagagac

SEQ ID NO: 83752 - RNA, 46 nt, Mus musculus
aaggccaugauuccaaggccauguacucuguagcccacccccuuuc

SEQ ID NO: 83753 - RNA, 102 nt, Mus musculus
uaagacuuguacaaaagaaauguuugcuaaugagccuguuggaauguuuuaguuagggagagcuuguauuuuaaauagucaguauucuugauuaggugaaga

SEQ ID NO: 83754 - RNA, 46 nt, Mus musculus
aauguaaucugcuguucuuauguucuauuuucauuuggcaggaagg

SEQ ID NO: 83755 - RNA, 46 nt, Mus musculus
cuaucuugaaacaguuuugcuuaucuuauauuuuucaggagcaugg

SEQ ID NO: 83756 - RNA, 50 nt, Mus musculus
auguuaaagacuuggguggguauaaacaaaacugagugcagacagaauug

SEQ ID NO: 83757 - RNA, 69 nt, Mus musculus
aacacaguggcuaccaggaguguggagcauucuuuucuucccccaaguucagggcaaguuaagaugaag

SEQ ID NO: 83758 - RNA, 100 nt, Mus musculus
ugacaucagugggaauguuacaagucuaucuucacaaggcaguaagaaaagcauccuaaccgggaaaaguuauaaaauauaaaaagauaucucagagaga

SEQ ID NO: 83759 - RNA, 42 nt, Mus musculus
cacagagaugugugucagcucagcccuacucuaccaggaguu

SEQ ID NO: 83760 - RNA, 44 nt, Mus musculus
cacugugccccuccuuagauuugggaacaaaacacccauggaag

SEQ ID NO: 83761 - RNA, 42 nt, Mus musculus
uaguuccaauuucuugucucuauguauggggugcguguuaga

SEQ ID NO: 83762 - RNA, 45 nt, Mus musculus
aaugucauuuuucuccuuucuucuuuuuucuucaauggguaagau

SEQ ID NO: 83763 - RNA, 46 nt, Mus musculus
gcaaagaaguugacuucuuauucugucucuagauugaccgccauug

SEQ ID NO: 83764 - RNA, 46 nt, Mus musculus
uuaagguuuucuuuuugaaugaagaugaaagcaaaacacuggagau

SEQ ID NO: 83765 - RNA, 46 nt, Mus musculus
ccuucuguuuuucuauuagacuaaaaaaaccucucagcacacuacu

SEQ ID NO: 83766 - RNA, 45 nt, Mus musculus
ccacuagacugugaugcggugaggccugugcacacuuacaaauag

SEQ ID NO: 83767 - RNA, 46 nt, Mus musculus
gagacccagguuugcucugucuaccaaugagggaaaagaaccagag

SEQ ID NO: 83768 - RNA, 83 nt, Mus musculus
ggaagauaagguaguucacaggagaggugggaaccugagagcugugcagcacaggaaggggcaugugaggaagcuaggagggg

SEQ ID NO: 83769 - RNA, 68 nt, Mus musculus
agcaagcucccugcuaaguggggagagucugaaggagugguggcugagaagcgcagcgugccugcugg

SEQ ID NO: 83770 - RNA, 46 nt, Mus musculus
aaauaauuuccaacuuuacuuaaaauguuuuacuccagcaaguuga

SEQ ID NO: 83771 - RNA, 46 nt, Mus musculus
cauauauaagcauaugugauuggguguaaucacaugaagggagaau

SEQ ID NO: 83772 - RNA, 45 nt, Mus musculus
auaacaaucacaguaaacuuagccgcauggcagcacaaggcaguu

SEQ ID NO: 83773 - RNA, 46 nt, Mus musculus
augcauaucacacuguaugugauaguaaaaauuacaccggacaugg

SEQ ID NO: 83774 - RNA, 58 nt, Mus musculus
aaacagagagagggagaaagggaaaaggagagagaagaaagaaggaagaaaagaggga

SEQ ID NO: 83775 - RNA, 52 nt, Mus musculus
caaguuccagacaggauucugagagcacaaggccagaaucugaaaccgaaga

SEQ ID NO: 83776 - RNA, 42 nt, Mus musculus
uaacaaaucugaagaugacccagguuuuuggagccaccagau

SEQ ID NO: 83777 - RNA, 45 nt, Mus musculus
ugcuuguuucuggacaugguaauacuagcacuugggaggcugaga

SEQ ID NO: 83778 - RNA, 42 nt, Mus musculus
ucagagcaguugcuuacucccagaacagcuaugccaccauug

SEQ ID NO: 83779 - RNA, 46 nt, Mus musculus
uacuuagccauuuaacaauauaaacauuagcaaaacaacaguaguc

SEQ ID NO: 83780 - RNA, 46 nt, Mus musculus
aaaagaaaaaagaaaaacucuucaaaugaaaacuucucgggcguuu

SEQ ID NO: 83781 - RNA, 46 nt, Mus musculus
uucaaggccauccuggucuacaaagucagcucuaggccagccaggg

SEQ ID NO: 83782 - RNA, 46 nt, Mus musculus
uagugcacagacaugcaugcaggcaaaacacucauaugacugaaau

SEQ ID NO: 83783 - RNA, 42 nt, Mus musculus
cuccagcaugaggaacuguauggauucaaggguugcaguguu

SEQ ID NO: 83784 - RNA, 46 nt, Mus musculus
ugcauucaccacccucagcuuuaccuuagaagcagagccaacuuuc

SEQ ID NO: 83785 - RNA, 90 nt, Mus musculus
caguucagggaucugacaacuccugaacuucuugggcaguguacaguguacauccauauacgugcagggaaagcauucauacacauaaaa

SEQ ID NO: 83786 - RNA, 46 nt, Mus musculus
acccauugcguggucauguggacagaacuucugaaagcggucuucg

SEQ ID NO: 83787 - RNA, 46 nt, Mus musculus
auaauuuuuagagauugucaguuuaaagcucaaauaucagucagau

SEQ ID NO: 83788 - RNA, 46 nt, Mus musculus
cgugcugcuucuacacagacaugaggaccaaugggacaugguagaa

SEQ ID NO: 83789 - RNA, 45 nt, Mus musculus
aguguauucaacuaguguauuuuuaagguucuuuucccuggagua

SEQ ID NO: 83790 - RNA, 56 nt, Mus musculus
ccauuuggaaguccacagggaaggggacgguucuagcaccacagauaacacacagg

SEQ ID NO: 83791 - RNA, 45 nt, Mus musculus
ccagauuguuucaacaagaacacccaagccuccacuaggcacagg

SEQ ID NO: 83792 - RNA, 45 nt, Mus musculus
gcaugcauguacaucacauacaugcaugccugguucuccagaggu

SEQ ID NO: 83793 - RNA, 45 nt, Mus musculus
uccccagcguucuauuacagucuguuaacaugcguugucuacagu

SEQ ID NO: 83794 - RNA, 48 nt, Mus musculus
gaguuguucucugcucccacauguucucuguguaaggaggggaagagg

SEQ ID NO: 83795 - RNA, 42 nt, Mus musculus
agcagcaccuccagcaucaucugcgugccucugggcccagug

SEQ ID NO: 83796 - RNA, 46 nt, Mus musculus
uuaaaacaaacaaacaaacaaaaaaggucuagaucacugagcagaa

SEQ ID NO: 83797 - RNA, 45 nt, Mus musculus
auuaaaaucaauauucaaaacaaaacagagaagaggaggaggaga

SEQ ID NO: 83798 - RNA, 42 nt, Mus musculus
agaagaaagaaggaauaauacgaauuccauuagcagacaguc

SEQ ID NO: 83799 - RNA, 46 nt, Mus musculus
ccuucagaaugugauuugguaauuggcuugaggaagaagaugaagg

SEQ ID NO: 83800 - RNA, 46 nt, Mus musculus
guucagucucuaaagguaaaugcggaaggaaaauguaugaggagau

SEQ ID NO: 83801 - RNA, 46 nt, Mus musculus
uaguuuggguuauugucucaccaaaauaguugauguguuggaaugg

SEQ ID NO: 83802 - RNA, 44 nt, Mus musculus
gaauuaaagacuuguuucucaauguuucuuacaugauauucaga

SEQ ID NO: 83803 - RNA, 46 nt, Mus musculus
ugcaaacaaaggcagacguguaaucaucugauauucgucuaggggg

SEQ ID NO: 83804 - RNA, 44 nt, Mus musculus
ggcaggccacggccacauggagagaggggagagggggagcaaaa

SEQ ID NO: 83805 - RNA, 46 nt, Mus musculus
ugagaagaggcaguccaugguuuuaaggcaucuauuauagaaagau

SEQ ID NO: 83806 - RNA, 46 nt, Mus musculus
ggaagaguagggugaguuugcuuuucauuauguuuuuucuguuggu

SEQ ID NO: 83807 - RNA, 45 nt, Mus musculus
agaaagaauaggccagacaaaggucaagacagaaugagccagaga

SEQ ID NO: 83808 - RNA, 42 nt, Mus musculus
uuuuaaucccacacaaugaagggaaaguucauuuguagaaga

SEQ ID NO: 83809 - RNA, 46 nt, Mus musculus
agacagauucuuccugcauuaaaaaaugggaaacuccauuucagau

SEQ ID NO: 83810 - RNA, 46 nt, Mus musculus
aaaaccuuuccuuaaauccuuaacaacuuaagcucaauugugagau

SEQ ID NO: 83811 - RNA, 46 nt, Mus musculus
cauuuaugugugugagugugugugugugugugugugugugugugug

SEQ ID NO: 83812 - RNA, 45 nt, Mus musculus
uuccacagccuggugagaacugcagcugaaagaaugaagagcggu

SEQ ID NO: 83813 - RNA, 46 nt, Mus musculus
auugugcauucuggagugucugaagacagcuacaguguacuuagau

SEQ ID NO: 83814 - RNA, 46 nt, Mus musculus
caaagugugggauucauuuauuaacuuaaacaaacugucccgagua

SEQ ID NO: 83815 - RNA, 46 nt, Mus musculus
ucaguguacacauuuaacuacuaagccaucucucaagucccccaga

SEQ ID NO: 83816 - RNA, 46 nt, Mus musculus
aaauggcguccagagucacagaugcuauagucugguaucagaagaa

SEQ ID NO: 83817 - RNA, 87 nt, Mus musculus
gcgagagaguugaccucuggcaugcacauaaacacacauggaugcagacaucuacacugaggucuucuacacacaaaagguucagau

SEQ ID NO: 83818 - RNA, 45 nt, Mus musculus
guuuucuugagagggucuuguuauguagccaggauagccucagaa

SEQ ID NO: 83819 - RNA, 46 nt, Mus musculus
cugugggucgugacaccuauggagguuaaacaacucuugcacagga

SEQ ID NO: 83820 - RNA, 62 nt, Mus musculus
ugugccuauguguuucugugcacugugggagguuuaugaguuauuuuuuauucuugcccuua

SEQ ID NO: 83821 - RNA, 46 nt, Mus musculus
cuccagauuauucuguauuggaugauugaaugauacgucagcaaau

SEQ ID NO: 83822 - RNA, 42 nt, Mus musculus
gguugugagcuaccaugugguugcugggauuuaaacucaggg

SEQ ID NO: 83823 - RNA, 28 nt, Mus musculus
uucugggcauggggaggggauuugagag

SEQ ID NO: 83824 - RNA, 84 nt, Mus musculus
guguauguuauauguguguagaauaugcaugugaguuggcagaugaggagguaggugguugugcugaguuuacaauagaucuau

SEQ ID NO: 83825 - RNA, 43 nt, Mus musculus
aucugggccaagaugaaucugaaaggaaugugucaaauagaug

SEQ ID NO: 83826 - RNA, 46 nt, Mus musculus
aauauuuaaucuuauaaauaauuuuauuuauaguggcuggugagau

SEQ ID NO: 83827 - RNA, 46 nt, Mus musculus
ucagguuugagguuuaugggauccuguuacaggaaaaugaggaggg

SEQ ID NO: 83828 - RNA, 45 nt, Mus musculus
gcuacacagagaaacauugucucaaaaaacaaacagaaaacaaag

SEQ ID NO: 83829 - RNA, 46 nt, Mus musculus
cucuauguauauaugcauggagaauuuaauccauuuuccaacagau

SEQ ID NO: 83830 - RNA, 46 nt, Mus musculus
guguagugaauuccugacuguacauaugggaauaguaguugcagaa

SEQ ID NO: 83831 - RNA, 46 nt, Mus musculus
aaacuauacauuuugugguacacaccuuuaaucccagcacucagga

SEQ ID NO: 83832 - RNA, 46 nt, Mus musculus
uccucuaaauacuacuuugauuauuucacuuuuugauuauacagau

SEQ ID NO: 83833 - RNA, 45 nt, Mus musculus
agggagacucucacugugguuuuacuuugcauuugcaauuuugau

SEQ ID NO: 83834 - RNA, 42 nt, Mus musculus
cggguguggugguguacuucuguaaucacagcacuggggagg

SEQ ID NO: 83835 - RNA, 45 nt, Mus musculus
accaccacauucuacucccuggcuucuauauacuuguagccgcau

SEQ ID NO: 83836 - RNA, 41 nt, Mus musculus
acuguucugcugugacaaaggaccaugaccaaggcaacuua

SEQ ID NO: 83837 - RNA, 46 nt, Mus musculus
uuauuauaucugcauaugaugcaugagcgugaguguguaugcaggu

SEQ ID NO: 83838 - RNA, 70 nt, Mus musculus
uggcaucaggcagcuggaggguccugaaauaguagcugagaacuuacaaguugauccacgagcauuaaag

SEQ ID NO: 83839 - RNA, 45 nt, Mus musculus
uuguauaucaacaauaaaugcugauuugcauagauugugucucgg

SEQ ID NO: 83840 - RNA, 46 nt, Mus musculus
aacauguaucuuuuauuuuuuaagagaaugguugggagguccaggg

SEQ ID NO: 83841 - RNA, 49 nt, Mus musculus
uacaugcaggcaaaccaucaauguaaacuuaaaacagaaagaaagagag

SEQ ID NO: 83842 - RNA, 46 nt, Mus musculus
uucucuauuauuacaacuaagauuuaguuaacuaaugguucgagau

SEQ ID NO: 83843 - RNA, 42 nt, Mus musculus
gacgggcgggagcaggacgcggugaggcugagcgugcagcag

SEQ ID NO: 83844 - RNA, 41 nt, Mus musculus
ucagccuccgcuuccucgucucagccgcugccgcgcaaacu

SEQ ID NO: 83845 - RNA, 44 nt, Mus musculus
ggcgccguggcucuccucucugagaaggaagcaucuggcaaagu

SEQ ID NO: 83846 - RNA, 54 nt, Mus musculus
gcucccauugggcgcgcuaaacugagagaucccggaacaaaccaaucaaagacg

SEQ ID NO: 83847 - RNA, 46 nt, Mus musculus
ugagugcuaaagguuuucacuuuaauuauucuuuaaacgacaccag

SEQ ID NO: 83848 - RNA, 45 nt, Mus musculus
guuugaaaaugcaguuagaguucuguauuucagagucagcgcuau

SEQ ID NO: 83849 - RNA, 46 nt, Mus musculus
uaaacuugcuggauucaugcagccagcauugcagguuaucagagau

SEQ ID NO: 83850 - RNA, 46 nt, Mus musculus
ggguuucucugugaagcguggcuguccuggaauuuacucuguagau

SEQ ID NO: 83851 - RNA, 46 nt, Mus musculus
ggaauagcucuacguuagcuccaccuuagagcuguuauccucaguu

SEQ ID NO: 83852 - RNA, 46 nt, Mus musculus
ugaguaauuaaaaucaaaauguaaguuguaauugaugcugacaguu

SEQ ID NO: 83853 - RNA, 46 nt, Mus musculus
cuccuccuuuaccugaacgaacuccugagucuuuuguauuagcagg

SEQ ID NO: 83854 - RNA, 41 nt, Mus musculus
ccagagauuaaauaccuuuugcaggaaggaauguccagagg

SEQ ID NO: 83855 - RNA, 42 nt, Mus musculus
gccugaaaggccauuuauagauccaaggagaagcaugcaguu

SEQ ID NO: 83856 - RNA, 46 nt, Mus musculus
aacaccaaugugcauaaaauaaaaauaaauaaguaaacaaguagac

SEQ ID NO: 83857 - RNA, 45 nt, Mus musculus
gagagugcuugcacuaggagaguauugccgauguccauugccaga

SEQ ID NO: 83858 - RNA, 23 nt, Mus musculus
cugauggugcugugaccaggaac

SEQ ID NO: 83859 - RNA, 46 nt, Mus musculus
aggacacguaacguggucacuucauggaccugaaaaugccacaccu

SEQ ID NO: 83860 - RNA, 45 nt, Mus musculus
ucagaggagucccagagcaacucacacacaccuccacggccagac

SEQ ID NO: 83861 - RNA, 63 nt, Mus musculus
ggacccaauggggaaaagugaaucagcuauugagcacauagauaagaaguuagagcgcaauuu

SEQ ID NO: 83862 - RNA, 86 nt, Mus musculus
caaguuuaacuuuuuaaaagacaauuguaucaaauucaaauaagcuguguuaaagagguuuauuuauaaaguaguagacaguagaa

SEQ ID NO: 83863 - RNA, 45 nt, Mus musculus
auucccagcaaccacaugguggcucacaaccaccuguauugagau

SEQ ID NO: 83864 - RNA, 46 nt, Mus musculus
aaagacgaagagaauuaacaacaauacaauccuaaaggagcaaacc

SEQ ID NO: 83865 - RNA, 46 nt, Mus musculus
ugcucaaccugacuuauuauagaaccaggaccaccaacccacagau

SEQ ID NO: 83866 - RNA, 46 nt, Mus musculus
aggauuaaauaaucacugacuagacacuuuuuaaagccaguaagua

SEQ ID NO: 83867 - RNA, 46 nt, Mus musculus
uuuauuacguguaaguacaguguagcugucuucagacacaccagaa

SEQ ID NO: 83868 - RNA, 45 nt, Mus musculus
ugucugcauagaagguuguauuuucagaaguaugcauuugccaaa

SEQ ID NO: 83869 - RNA, 46 nt, Mus musculus
aguuauuauaaaagaauguaaagaaccucucuccucgccccugguc

SEQ ID NO: 83870 - RNA, 46 nt, Mus musculus
gggugagccucucaaaggacaguucugcuagguucaacagccauau

SEQ ID NO: 83871 - RNA, 46 nt, Mus musculus
ggauuaauguccaacaagaguucuuaauacauccugaauccuagaa

SEQ ID NO: 83872 - RNA, 46 nt, Mus musculus
aaguugugagcauauacucugaugauauagaaaagaacgugcagaa

SEQ ID NO: 83873 - RNA, 42 nt, Mus musculus
aaauguuaaaaagaacagauauaaggacauacugccauguaa

SEQ ID NO: 83874 - RNA, 46 nt, Mus musculus
uaggggagccacaugugaaggcacaggaaugugugcauggcgaggu

SEQ ID NO: 83875 - RNA, 46 nt, Mus musculus
gaaguacagugccuggcauuggaauccacacuaauuaagggauuaa

SEQ ID NO: 83876 - RNA, 45 nt, Mus musculus
aaacagaggcuacuaggagcugguggaaagauuaagagaugaacc

SEQ ID NO: 83877 - RNA, 42 nt, Mus musculus
auacuauugcuaccucacugaagagggagagagggagggaga

SEQ ID NO: 83878 - RNA, 46 nt, Mus musculus
aaaaaauccaggcauaguggugcacuaaguaaucucaguacuagag

SEQ ID NO: 83879 - RNA, 42 nt, Mus musculus
aucgcuaauuaaggaaauacacuacagacuucacccacagac

SEQ ID NO: 83880 - RNA, 42 nt, Mus musculus
aggagagagggaacuaacugccauauccucugauccccacuu

SEQ ID NO: 83881 - RNA, 47 nt, Mus musculus
cguucaagacagccagggcuacacagagaaacccugccugagagaga

SEQ ID NO: 83882 - RNA, 45 nt, Mus musculus
uagaaggaagccagauuacaguccuuggaagagaaaaugggugau

SEQ ID NO: 83883 - RNA, 45 nt, Mus musculus
aaaacuagccugggaaaaggagaaagaagaagaaaagggagaggu

SEQ ID NO: 83884 - RNA, 42 nt, Mus musculus
ggcaguggaaugucuuaagaaagguauuuguuuggcagaaag

SEQ ID NO: 83885 - RNA, 46 nt, Mus musculus
uauaaugcagagaaaaggugaugccugagacagguagguuuuggac

SEQ ID NO: 83886 - RNA, 47 nt, Mus musculus
cuguugaaauggugucacaugaagcugccaguccacugaugccugaa

SEQ ID NO: 83887 - RNA, 57 nt, Mus musculus
aucugaaauuugguuaugaaaagccauaugcaguugaggucuauaaaaaugaguggc

SEQ ID NO: 83888 - RNA, 82 nt, Mus musculus
auguugcgcaagacuggggcguuguaaacccuggaggucuggggaauggaaaaggaaaugggacuuugggaaguccuucgcu

SEQ ID NO: 83889 - RNA, 67 nt, Mus musculus
agucuaguaugugaaauuucucuaggugcauaauuggagagaggguaucaauuccgaaggcguggga

SEQ ID NO: 83890 - RNA, 51 nt, Mus musculus
ggguggggguggggaagcugggaacaauagucaugguaggguggaggcgac

SEQ ID NO: 83891 - RNA, 48 nt, Mus musculus
agacccagguuugagguggcugugaggccagugugacuuuagaucgaa

SEQ ID NO: 83892 - RNA, 46 nt, Mus musculus
uuguugauggcagaacggcccuucuuccucucuccacccuucuuug

SEQ ID NO: 83893 - RNA, 45 nt, Mus musculus
cugcugugccaaaaacucucaagaaaaagguucccgcugugccag

SEQ ID NO: 83894 - RNA, 27 nt, Mus musculus
gcucaucuacaagcgaggcuacggcaa

SEQ ID NO: 83895 - RNA, 61 nt, Mus musculus
gaggugggaugaagaaaaagacaacucacuuuguagaagguggagaugcuggcaacaggga

SEQ ID NO: 83896 - RNA, 42 nt, Mus musculus
cacuguagcugucuucagacacaccagaagagugagucagau

SEQ ID NO: 83897 - RNA, 46 nt, Mus musculus
gaauccauuaagaaaaaaaaaagcuauuauacagcauagagauuua

SEQ ID NO: 83898 - RNA, 46 nt, Mus musculus
ccagaagaugcuguaaggauucacauugaccuucaaacaaagagau

SEQ ID NO: 83899 - RNA, 46 nt, Mus musculus
agguguguccuuuguauacagaauaauuuauuuuuccccugaagau

SEQ ID NO: 83900 - RNA, 48 nt, Mus musculus
gcgccccuuugaucucucuagcguuuguuucgaguggcagauuaggau

SEQ ID NO: 83901 - RNA, 42 nt, Mus musculus
agguuugguccuuuugaccuugcggccauucccaucggagcu

SEQ ID NO: 83902 - RNA, 42 nt, Mus musculus
ugugugugugugugugagugugugugugugugugugccauug

SEQ ID NO: 83903 - RNA, 50 nt, Mus musculus
gauuacagacuagaggaggacguaacuaaaucaaagaaaggaaaagacgg

SEQ ID NO: 83904 - RNA, 46 nt, Mus musculus
gguugcaacagugaagggacuuuugaaaggcuuggcuggcaggucg

SEQ ID NO: 83905 - RNA, 45 nt, Mus musculus
ggucuuacuuuauugcucagaacauugguaguuaugcugauacgg

SEQ ID NO: 83906 - RNA, 46 nt, Mus musculus
ucguaacuucgggagccagugaugucuuuaucuuuauuuuauagau

SEQ ID NO: 83907 - RNA, 45 nt, Mus musculus
ccaauuagaaagcacguguuuguuugcuuaauauaaucgguagga

SEQ ID NO: 83908 - RNA, 42 nt, Mus musculus
acucugauucauguuauacagaugaagcaggcaagccaagau

SEQ ID NO: 83909 - RNA, 46 nt, Mus musculus
aaaaauacacauauacuagaauuagauauuguucuuccagccaaga

SEQ ID NO: 83910 - RNA, 42 nt, Mus musculus
cuuuuaaaacugaaagaaauagguagauaaaugggauuagaa

SEQ ID NO: 83911 - RNA, 42 nt, Mus musculus
ggagaguggagugucugcagugacagaaguggagugcacaag

SEQ ID NO: 83912 - RNA, 41 nt, Mus musculus
cuauggcccagagugagcacuacaagcguugcuggccuaau

SEQ ID NO: 83913 - RNA, 64 nt, Mus musculus
cagaugggccuggcgagcagucuggggauuucgagucacggcaaugauaggagcccgagggcgg

SEQ ID NO: 83914 - RNA, 57 nt, Mus musculus
uaccuggccacuuggugagcacuccugccagacuuggugagcacgauaauggcccca

SEQ ID NO: 83915 - RNA, 42 nt, Mus musculus
cugcucucgggcaaucaggugcugcaugcguacagccuccag

SEQ ID NO: 83916 - RNA, 46 nt, Mus musculus
aucaugcucuccagcaucuguguggcacagaugacaggcuucccag

SEQ ID NO: 83917 - RNA, 45 nt, Mus musculus
guccaggucaccacgagccaccaugaucccaucacuggccuccaa

SEQ ID NO: 83918 - RNA, 45 nt, Mus musculus
cccaaacuucagguccuggauguccuuuuccgacacagcggggag

SEQ ID NO: 83919 - RNA, 47 nt, Mus musculus
caccuccgucaccaggaagucagcgccuuucuccuucaccugcagug

SEQ ID NO: 83920 - RNA, 46 nt, Mus musculus
gccacauucauuccagacuugaucaucuccuucagcaucuccacag

SEQ ID NO: 83921 - RNA, 56 nt, Mus musculus
ggaaggugucagccauggcugcauggagcugcugggucugaaugaaggcagucccc

SEQ ID NO: 83922 - RNA, 45 nt, Mus musculus
agcaccauucagccuggcaggguugacggagcuuggggcaggccg

SEQ ID NO: 83923 - RNA, 46 nt, Mus musculus
aggaaaugguguguguguagauuccuaauggugguauacuggggag

SEQ ID NO: 83924 - RNA, 45 nt, Mus musculus
uuuuauuuuuuauuuucuuugggguggagguugcaaggguggaga

SEQ ID NO: 83925 - RNA, 51 nt, Mus musculus
gacucagggauuaaaggauaaagaauaaauggaugugaggucaggagagag

SEQ ID NO: 83926 - RNA, 41 nt, Mus musculus
uuaucuugucccuucuguuugucuaaccuccagcagggaag

SEQ ID NO: 83927 - RNA, 43 nt, Mus musculus
uuccauacccauguucccuuucaguuuaggccaagcaggagau

SEQ ID NO: 83928 - RNA, 58 nt, Mus musculus
auucugcaguccuuccaacagcaggacacacacacacacacacacacacacacacaca

SEQ ID NO: 83929 - RNA, 46 nt, Mus musculus
aauuccuagauauaacucuaauuucucuaggaccaucguuauuaag

SEQ ID NO: 83930 - RNA, 46 nt, Mus musculus
gcacuaacgauguaauaauguguuugggauaacuuaggaggcagcg

SEQ ID NO: 83931 - RNA, 46 nt, Mus musculus
gucuaaacuauauuaucaauaugggcccauaucuugcugacauaaa

SEQ ID NO: 83932 - RNA, 46 nt, Mus musculus
guaaccugagguaaccaaguacaugagagacugcaggcaggaggau

SEQ ID NO: 83933 - RNA, 42 nt, Mus musculus
aaacccugucucaaaaaaagaaagaaagaaagaaagagagag

SEQ ID NO: 83934 - RNA, 46 nt, Mus musculus
aaaacaguuauuuugaucagcuucuucuuucucucuaggccccuug

SEQ ID NO: 83935 - RNA, 45 nt, Mus musculus
acuuugaacucagagauccaacuuucucugucuccaaagugucag

SEQ ID NO: 83936 - RNA, 46 nt, Mus musculus
aguuguaguggugcacacuuuuauucccaacacuuaggaggcagaa

SEQ ID NO: 83937 - RNA, 47 nt, Mus musculus
uuauucauucuauucucuuauuaaaggguuuuaugggguggacaaaa

SEQ ID NO: 83938 - RNA, 44 nt, Mus musculus
auaagugugcauaaagggggauucaaacuaaagaugagccuaga

SEQ ID NO: 83939 - RNA, 45 nt, Mus musculus
ugacucuucacgcccuuaagagaguagaaagaagacuagagagau

SEQ ID NO: 83940 - RNA, 46 nt, Mus musculus
uguuaagcggguauguaguaaguuaacuauaugcaguuaaaaagag

SEQ ID NO: 83941 - RNA, 46 nt, Mus musculus
ucuuuaggaaaugauuuugauguuaccugccuguuccuggcuaaug

SEQ ID NO: 83942 - RNA, 46 nt, Mus musculus
ggcuguggguuuuagugaucagaagauuggcauucuaguagcagag

SEQ ID NO: 83943 - RNA, 46 nt, Mus musculus
agaauaguacacaaccuuuauuuuuauuuauuguucacuuguaauc

SEQ ID NO: 83944 - RNA, 42 nt, Mus musculus
ggaggcccugagugucacugguauggguaacaaggacagguu

SEQ ID NO: 83945 - RNA, 58 nt, Mus musculus
ggggaggggaccggguuugggcggaggagaugguggugcggucggcguuggcugcccg

SEQ ID NO: 83946 - RNA, 42 nt, Mus musculus
gcugacgaugaccucaugcugcagcagcggguggggccagag

SEQ ID NO: 83947 - RNA, 43 nt, Mus musculus
agucgcugccgccgccuccuauacuucuuagcaccggggaagg

SEQ ID NO: 83948 - RNA, 42 nt, Mus musculus
auuucccacacauuuggugacaucuaggaaaacuggcaggau

SEQ ID NO: 83949 - RNA, 61 nt, Mus musculus
uuugcuucgcuguuccuuuugcgcaagaaauuuguguggugucuuugguacuauagagaaa

SEQ ID NO: 83950 - RNA, 41 nt, Mus musculus
cccgugccccgcguccccgauccucaucccgcgccccggau

SEQ ID NO: 83951 - RNA, 46 nt, Mus musculus
agcauccugccuccgcacgaauucuggauuccaugcaccgccagcc

SEQ ID NO: 83952 - RNA, 46 nt, Mus musculus
uaaggucacuucccacuuccuucucuaugaaugcagacacauagga

SEQ ID NO: 83953 - RNA, 42 nt, Mus musculus
aggauaaagcaaacuaaggccacuggcugccaaggugcuggg

SEQ ID NO: 83954 - RNA, 47 nt, Mus musculus
aaccaaaugaaugaacagacaccuacuaaaaaaugaagggaaggauu

SEQ ID NO: 83955 - RNA, 42 nt, Mus musculus
auuaggaagugugguuuuuuuggaguaggcaugcguuuguug

SEQ ID NO: 83956 - RNA, 45 nt, Mus musculus
agaagaacauuguacaagagauaacagggacacuuacgguuuagg

SEQ ID NO: 83957 - RNA, 42 nt, Mus musculus
gccuaggcuacauaagacagucucaaaaagaaccaaacgagg

SEQ ID NO: 83958 - RNA, 46 nt, Mus musculus
ucaaucucuuccaucugggugaucauggcuccaaggucauccaucc

SEQ ID NO: 83959 - RNA, 46 nt, Mus musculus
uguguguguguguguguguguguauaugguguguguguguguaugu

SEQ ID NO: 83960 - RNA, 46 nt, Mus musculus
uguuuugguuuucugagacagggucucauauaucccaggcugacuu

SEQ ID NO: 83961 - RNA, 45 nt, Mus musculus
aaagauggccauuguuacaagaaguagaaccaggggcaggugaga

SEQ ID NO: 83962 - RNA, 42 nt, Mus musculus
ugccaggacagggaagcaggaguggguggguuagugaaaagg

SEQ ID NO: 83963 - RNA, 46 nt, Mus musculus
gagagcacgcugaggaagccugugcuaaguauuguaacugacagac

SEQ ID NO: 83964 - RNA, 46 nt, Mus musculus
ugaaaaccccuguaaaucuuguagcacagcuaccgagauaccagaa

SEQ ID NO: 83965 - RNA, 42 nt, Mus musculus
gacuaugaagggaauaaugucuaguuugcaguaagcugagau

SEQ ID NO: 83966 - RNA, 45 nt, Mus musculus
ugcucgcaagcaaacccagagagcccagagcgagaaccuugagcu

SEQ ID NO: 83967 - RNA, 70 nt, Mus musculus
gccagucgggucuaucaaacaguagucacaauuguaguaacaagacaaguguaggaaagaaccagagacg

SEQ ID NO: 83968 - RNA, 46 nt, Mus musculus
uuugucauuucuuuguuuaggagauacagaauuaacaggucaagaa

SEQ ID NO: 83969 - RNA, 43 nt, Mus musculus
acucaggaggcaaaaaucuguaagaaaaaugauggaggaugga

SEQ ID NO: 83970 - RNA, 42 nt, Mus musculus
guguccggagagaggaccgggaauggggaaaaaggcagagcu

SEQ ID NO: 83971 - RNA, 45 nt, Mus musculus
acaagguaacuguagcuuguuauaagugauuuuuaaagaaacaga

SEQ ID NO: 83972 - RNA, 45 nt, Mus musculus
uucuuuuuaccaccuaaaaauauuuauuaucuuaagcugugaguu

SEQ ID NO: 83973 - RNA, 45 nt, Mus musculus
auugcaguaacaaaauacccuaaacaccuugcacugggccccacu

SEQ ID NO: 83974 - RNA, 46 nt, Mus musculus
accuuaggaaagcaccgucggagccuaguaaacaaagccccuaggu

SEQ ID NO: 83975 - RNA, 54 nt, Mus musculus
ucuagaauaucaagaaaugcaguuaccagcaugucaauacgaggucacaggugg

SEQ ID NO: 83976 - RNA, 80 nt, Mus musculus
uugcuaaugcaauaaaggcuucauugccucauggugccaugaaaucuaguaaggaagguacaagguguauucaaguggag

SEQ ID NO: 83977 - RNA, 46 nt, Mus musculus
agcucagaaagcacuggaugacauuauauacagagcccagcuagaa

SEQ ID NO: 83978 - RNA, 41 nt, Mus musculus
agaugaaugggguuggagugcaugauaugaaauccagagag

SEQ ID NO: 83979 - RNA, 55 nt, Mus musculus
aggugugagcagcaggauaccgauuucauccggcuucauggugcagaugcuaaca

SEQ ID NO: 83980 - RNA, 45 nt, Mus musculus
ucuuaccaguauaucauauucagggaaauguuacaggcauucuga

SEQ ID NO: 83981 - RNA, 46 nt, Mus musculus
acuuuuacauaugugugugugugugugugugugugugugugugugu

SEQ ID NO: 83982 - RNA, 85 nt, Mus musculus
acauuccuucugcuguguuacaaugcugccuuaaccuacaugcccagugucucucuucagucacugugucagauuuguucaaggu

SEQ ID NO: 83983 - RNA, 46 nt, Mus musculus
gcuuaucaaaagucguguacaguggaccccauccucaacgggagau

SEQ ID NO: 83984 - RNA, 47 nt, Mus musculus
uuaagcugguuuuugccuucacacacacacacacacacacacacaca

SEQ ID NO: 83985 - RNA, 43 nt, Mus musculus
uucauuuaaaagaacaaagaaccuaaggguauuggggcacaca

SEQ ID NO: 83986 - RNA, 46 nt, Mus musculus
guaacauauguggauccaugggccuuugcaaccagacugugcacuc

SEQ ID NO: 83987 - RNA, 45 nt, Mus musculus
uagcaaguaaaacaaacacuccuagcagcagggaaguguaggaga

SEQ ID NO: 83988 - RNA, 41 nt, Mus musculus
agacacucccagaaacaucuuugccaaauuaugccacaaau

SEQ ID NO: 83989 - RNA, 43 nt, Mus musculus
gaaauggggugagggaugggaggacagggucagagagggagau

SEQ ID NO: 83990 - RNA, 46 nt, Mus musculus
gauguucaccucagagauaggaguuguggaagaauggcugucagaa

SEQ ID NO: 83991 - RNA, 46 nt, Mus musculus
ucuuuugcugaagacaccauguacuucagaaacagagcccagagac

SEQ ID NO: 83992 - RNA, 45 nt, Mus musculus
auggguuaauggugcucccuucaagagucaaagaccaccucacaa

SEQ ID NO: 83993 - RNA, 46 nt, Mus musculus
acugaaaaagcuacucagaaacauacuauuaacuauucaccuggaa

SEQ ID NO: 83994 - RNA, 28 nt, Mus musculus
agggaauggcagggauucaagucaucug

SEQ ID NO: 83995 - RNA, 45 nt, Mus musculus
gcaucgcagacaagaagcgcagagcaggcugcauuggggccucag

SEQ ID NO: 83996 - RNA, 50 nt, Mus musculus
ccaaggcagaggaaauucuggagaaaggccugaaggugcgggaguaugag

SEQ ID NO: 83997 - RNA, 53 nt, Mus musculus
caagcucugccucaauaucugcgucggggagagcggagacagacugacccggg

SEQ ID NO: 83998 - RNA, 46 nt, Mus musculus
cagcacuuaauuagcugucacaauuggcccuucuaacaggagagac

SEQ ID NO: 83999 - RNA, 41 nt, Mus musculus
gauauagcugucuccugagaggcucugccagagccgacaaa

SEQ ID NO: 84000 - RNA, 45 nt, Mus musculus
cacaugagaugcacucacugauaaguggauauuagcccaaaagcu

SEQ ID NO: 84001 - RNA, 41 nt, Mus musculus
gauucugaagcaugagguuggccuugcuaagggaauggagg

SEQ ID NO: 84002 - RNA, 46 nt, Mus musculus
uaagaauuuauccaguaauuuguauuugacuuaauaaacacaguau

SEQ ID NO: 84003 - RNA, 42 nt, Mus musculus
uaccaagauugguuuccuaaagugcccuuuaaagguccacaa

SEQ ID NO: 84004 - RNA, 42 nt, Mus musculus
ucgccguggucgccguggucgccguggucguggggggaggcc

SEQ ID NO: 84005 - RNA, 67 nt, Mus musculus
cuguccgggcuggguugucagucagagagaggagggaagauggcucgcccggacucgugcugcuaga

SEQ ID NO: 84006 - RNA, 46 nt, Mus musculus
caguaguccaccacucucugccuccaccaccaccaucacccaccag

SEQ ID NO: 84007 - RNA, 46 nt, Mus musculus
ccacugcccaguggaaccuaguucgugacguugucagugggugcuu

SEQ ID NO: 84008 - RNA, 44 nt, Mus musculus
ccuuccagcuuccccaaguccacaccaugggguggcagcagaga

SEQ ID NO: 84009 - RNA, 46 nt, Mus musculus
ucaucucaaaacccuuuugcuucaccucucucugaugagcagaaag

SEQ ID NO: 84010 - RNA, 77 nt, Mus musculus
gggaaggaauuguuaaggacguagaaguuugggagucgucgggacaguggauguuuucuguuuacucgccagugaga

SEQ ID NO: 84011 - RNA, 46 nt, Mus musculus
ggcuguuuuuuggugaggauggaacccagaccagcauacaugcuag

SEQ ID NO: 84012 - RNA, 55 nt, Mus musculus
aauuugaucuuuuuuaaaguauucaaguaucccagcuaaaugauucagagacuga

SEQ ID NO: 84013 - RNA, 46 nt, Mus musculus
guacccacgugugcugcucacgcgaagggauguuugccaccaccag

SEQ ID NO: 84014 - RNA, 42 nt, Mus musculus
augacaggguuacugccaauaguaaaacugaaauucccuggg

SEQ ID NO: 84015 - RNA, 46 nt, Mus musculus
aagcauguggucugacuagaaaaagcugacccagugaugcaggaag

SEQ ID NO: 84016 - RNA, 42 nt, Mus musculus
acaaauccaguaugauuccugagugcuuuuugcaguggagua

SEQ ID NO: 84017 - RNA, 46 nt, Mus musculus
uguguacuuuuguucugcaugcuugcuuuuuucaucagggccccag

SEQ ID NO: 84018 - RNA, 44 nt, Mus musculus
accagaggaguugaggcuugaauaccauaacuucuuaaccagca

SEQ ID NO: 84019 - RNA, 45 nt, Mus musculus
gccaugauaauggacugaaccucugaaacuuuaaacuagccccaa

SEQ ID NO: 84020 - RNA, 45 nt, Mus musculus
ggacuugguaauguguaagagucacccaggugguacugguuugga

SEQ ID NO: 84021 - RNA, 46 nt, Mus musculus
ugccugcauguauaucugugcaccaaguauguaccugauguagcag

SEQ ID NO: 84022 - RNA, 50 nt, Mus musculus
ggucauugugaacguuguaaggucccuggaacaacccguccucaguggcu

SEQ ID NO: 84023 - RNA, 44 nt, Mus musculus
uuacauuuguuuauccauuuaccuauuggugacuauuacuccag

SEQ ID NO: 84024 - RNA, 71 nt, Mus musculus
gcaccugucuguaguggugagcuaaugaucaauugugugggaccagaaguggagaaagggcugucugccca

SEQ ID NO: 84025 - RNA, 45 nt, Mus musculus
uauguuacaguuauguaacaguagcaaaauuacaguuuugaagua

SEQ ID NO: 84026 - RNA, 47 nt, Mus musculus
auugucuaagauacuucuaggaaagaaagcucagcuucaaugguuuc

SEQ ID NO: 84027 - RNA, 46 nt, Mus musculus
gguggauaucugugagcucaagauagccuagucuauagagaaaaaa

SEQ ID NO: 84028 - RNA, 45 nt, Mus musculus
ccugaagccacgucugcugcaucauuuucguucaagagcccugaa

SEQ ID NO: 84029 - RNA, 42 nt, Mus musculus
cucugcugagcagucggcagaguugaggucagcuggcauggg

SEQ ID NO: 84030 - RNA, 46 nt, Mus musculus
gccgcagacagaccugcagcccuagcccucaaaaacaucccugaag

SEQ ID NO: 84031 - RNA, 42 nt, Mus musculus
cauuccuggcccacaacagccccccgcuaacccggcccccag

SEQ ID NO: 84032 - RNA, 45 nt, Mus musculus
uccaggcuccugaugagcccccagaacucuucacucugcccccag

SEQ ID NO: 84033 - RNA, 45 nt, Mus musculus
ucucuuuccacuuuuacacagcucaggguugaaacucgagucccc

SEQ ID NO: 84034 - RNA, 88 nt, Mus musculus
agcauucauaugcacaaaauaaauacagcucaaaaaaaaaaaaagagaaggauguccacauaggucauugauaaaaagcaagcaagaa

SEQ ID NO: 84035 - RNA, 45 nt, Mus musculus
aaacaaaaaacuauaugcaccuauuuaaguaccaacagcccccaa

SEQ ID NO: 84036 - RNA, 44 nt, Mus musculus
gcuggggguuucugagccgggugagaccacagcaugaaguuuca

SEQ ID NO: 84037 - RNA, 46 nt, Mus musculus
cauagcaguggggaaucugaaggaagggagagggccaaggaaggaa

SEQ ID NO: 84038 - RNA, 45 nt, Mus musculus
gugaaaccuucugugugggagaagaugccaaagcugcugcccgag

SEQ ID NO: 84039 - RNA, 46 nt, Mus musculus
agguaccggcugaguacccaggcugagagccugcaauuacuaccag

SEQ ID NO: 84040 - RNA, 45 nt, Mus musculus
uauuucccagaacccaccaggcacccuaaaagccuucucccacag

SEQ ID NO: 84041 - RNA, 45 nt, Mus musculus
aaugccuggaauuaagauaacuuggugggguuaaggguggaggag

SEQ ID NO: 84042 - RNA, 45 nt, Mus musculus
auacaugagaaaugugugugugugugugugugugugugugugugu

SEQ ID NO: 84043 - RNA, 46 nt, Mus musculus
uuuguuugguuuggguugaggggugugugugugugugugugugugu

SEQ ID NO: 84044 - RNA, 41 nt, Mus musculus
ccgggauauguaguuccgggcucgcgcggggcuugcuggga

SEQ ID NO: 84045 - RNA, 46 nt, Mus musculus
uaaguacacuguagcuguccucagacacuccagaagagggcgccag

SEQ ID NO: 84046 - RNA, 45 nt, Mus musculus
agcagcugaauccucuugcucucuuguuucucucuuucccucuug

SEQ ID NO: 84047 - RNA, 42 nt, Mus musculus
cuauuucucuacucucucccucucucugccuuucucuaccgc

SEQ ID NO: 84048 - RNA, 45 nt, Mus musculus
uucuugacuugucucccuugguucuuccuagcaucucuggcccau

SEQ ID NO: 84049 - RNA, 42 nt, Mus musculus
uguggugaaauagacaguggaaauguuauugccugggccguu

SEQ ID NO: 84050 - RNA, 44 nt, Mus musculus
gcaguaggcaucuggugggagcucaucucaagagaugcaccuag

SEQ ID NO: 84051 - RNA, 42 nt, Mus musculus
ggaccaggggauguguauguugguaaagagacugaggcacag

SEQ ID NO: 84052 - RNA, 45 nt, Mus musculus
acuugagucccauuucaauccccaccacuauccugcuagcccuac

SEQ ID NO: 84053 - RNA, 42 nt, Mus musculus
cucuuggccaagugcuccuguuccuugcuuugcggccugcag

SEQ ID NO: 84054 - RNA, 46 nt, Mus musculus
ggucucuguccuugguacuucauuucucccaagcaacucucuagug

SEQ ID NO: 84055 - RNA, 41 nt, Mus musculus
uaaagcaagcugcuuuauccauaaaguugcuggcaagggag

SEQ ID NO: 84056 - RNA, 42 nt, Mus musculus
ggccagaucugaugauucaggauaguaguuaacuugguagag

SEQ ID NO: 84057 - RNA, 83 nt, Mus musculus
ucuugggucauccuaagcucaugacuugcaaaaacaacaacaaaaaaggcaauaaugguuacaaagagccagaaaaaggagag

SEQ ID NO: 84058 - RNA, 45 nt, Mus musculus
aauacaugaugaagugcuauccagagaucaaggagaaggaggaga

SEQ ID NO: 84059 - RNA, 78 nt, Mus musculus
cacaggguaauuaugaucaguaugugaagacacggcuggaguuggaagagaaccagaugaagagguuucacugggagc

SEQ ID NO: 84060 - RNA, 45 nt, Mus musculus
caauuccuagcaaccacaugauggcucacaaccaucuguaaaggu

SEQ ID NO: 84061 - RNA, 46 nt, Mus musculus
guaauacuugaguuucuuguugugcauauggaugauauugguacag

SEQ ID NO: 84062 - RNA, 49 nt, Mus musculus
accaaccaccuggaccucgaugcuuguguguggcuggaagaggaacuua

SEQ ID NO: 84063 - RNA, 45 nt, Mus musculus
ucgagguccaggugguugguaggcucguccagaagcagcaugaag

SEQ ID NO: 84064 - RNA, 46 nt, Mus musculus
gcaccuuucauuuagcauuuaagauguuucuguuucuuuggcaucc

SEQ ID NO: 84065 - RNA, 46 nt, Mus musculus
aaggacauuguuuggcaacuugcuggagucugucagccccgucaag

SEQ ID NO: 84066 - RNA, 46 nt, Mus musculus
cacuuccucucuguggggaguccacacugcauucaagccugcuccu

SEQ ID NO: 84067 - RNA, 45 nt, Mus musculus
aaguaaaugccuuugaauguuggugcuuagguaaggaaggccuca

SEQ ID NO: 84068 - RNA, 45 nt, Mus musculus
caugacucuagaggcacaaggucagggagcucagcugcuguagua

SEQ ID NO: 84069 - RNA, 45 nt, Mus musculus
accugcuaugcagcgcaagaagcugaaagacuucagugguggcug

SEQ ID NO: 84070 - RNA, 45 nt, Mus musculus
agcuucuugcgcugcauagcaggugugaagcccaauccauguaag

SEQ ID NO: 84071 - RNA, 68 nt, Mus musculus
auggagguggacacagagcgggccaugcuggagagagaggcugagcgguuagcacaugaggaugcgga

SEQ ID NO: 84072 - RNA, 65 nt, Mus musculus
augggaguuuuugacagaaggugcuauagagagguuggugggggagugagggugaggaguggugg

SEQ ID NO: 84073 - RNA, 41 nt, Mus musculus
agcugcucagcgacaccaaacuggaauuaaacucaggccgg

SEQ ID NO: 84074 - RNA, 50 nt, Mus musculus
gaagaaagcugcugcucgagcugucaccgguguccuggcuucucacccca

SEQ ID NO: 84075 - RNA, 50 nt, Mus musculus
gagagagaaagggagggaaagagagagagagucaccauagaugcacuaaa

SEQ ID NO: 84076 - RNA, 41 nt, Mus musculus
gaagaaaugaacuuuuuccucucaaguuaauuuuagucaga

SEQ ID NO: 84077 - RNA, 24 nt, Mus musculus
caauaaaagggaaggcaacuugua

SEQ ID NO: 84078 - RNA, 46 nt, Mus musculus
cagaagagaaaaucgaggaggccaauggcagagagaccacaggaga

SEQ ID NO: 84079 - RNA, 72 nt, Mus musculus
ggaggcugccaaagcccgacagcgacccagaaagggacaugaagaaaauggagaugcugucacagaaccuca

SEQ ID NO: 84080 - RNA, 45 nt, Mus musculus
gggcuuuggcagccuccuucuuuuuggcugccuucuucuuggcca

SEQ ID NO: 84081 - RNA, 46 nt, Mus musculus
cgguggggauuggcgcgcgaaccccaagggaggagaugaggcugga

SEQ ID NO: 84082 - RNA, 51 nt, Mus musculus
cucgugguuccgggagagaaaccgcgccgcagucggugggguggaugagag

SEQ ID NO: 84083 - RNA, 69 nt, Mus musculus
aaagggccgaaagggaaaagaacuggcccaggcagagacgccggcgagcggggugugggggagguuagg

SEQ ID NO: 84084 - RNA, 42 nt, Mus musculus
ccuccccuccggcgccccuucccccucaacucacggggccuc

SEQ ID NO: 84085 - RNA, 46 nt, Mus musculus
cuuggaccauguguaacaggacugcuaucugaauaaaauacuaggu

SEQ ID NO: 84086 - RNA, 45 nt, Mus musculus; identical to SEQ ID NO: 22841

SEQ ID NO: 84087 - RNA, 29 nt, Mus musculus
gugaacauuaacaccaauggguaagacac

SEQ ID NO: 84088 - RNA, 26 nt, Mus musculus
gagugcauugggagaggggagagacc

SEQ ID NO: 84089 - RNA, 48 nt, Mus musculus
cuaaaauuucacacuuuugauggccccagggcuguaaggugagcaagg

SEQ ID NO: 84090 - RNA, 41 nt, Mus musculus
cacggccaaccagcaggagaucagugcucuggacaguaagg

SEQ ID NO: 84091 - RNA, 42 nt, Mus musculus
ugacaaggaguacaucaauggcgacaaguauuuccagcaggu

SEQ ID NO: 84092 - RNA, 53 nt, Mus musculus
ucuuccuucuucaagaguuuggucauugaguuggacaaagaccuuuauggccc

SEQ ID NO: 84093 - RNA, 41 nt, Mus musculus
accagaaguaucugucagcguccaggaggcagggcagggcu

SEQ ID NO: 84094 - RNA, 35 nt, Mus musculus
agaguuaaccacucugggguagaaaucaguugaag

SEQ ID NO: 84095 - RNA, 46 nt, Mus musculus
cuguggcugggcaggagagggaaaaguggaacuucuguccccagag

SEQ ID NO: 84096 - RNA, 46 nt, Mus musculus
guguguuuguguuuuguguaugugcccaugcaguagcuauggagac

SEQ ID NO: 84097 - RNA, 46 nt, Mus musculus
acacacauacagagagagagagacagagacagacagacagacagac

SEQ ID NO: 84098 - RNA, 42 nt, Mus musculus
agcuuuuucucugcaucaucaaggcauuccagcuguuccagg

SEQ ID NO: 84099 - RNA, 45 nt, Mus musculus
cagagccucacagacacaaguguucaugcugcaugugagagaggg

SEQ ID NO: 84100 - RNA, 46 nt, Mus musculus
gugccacacaaaccagcaggaacaauggaagccaaggccugcagag

SEQ ID NO: 84101 - RNA, 42 nt, Mus musculus
ggaaaugugaguggcugcaugguccacguuuccaucgcaggc

SEQ ID NO: 84102 - RNA, 45 nt, Mus musculus
ccagugucccagaggaucuguucaguaucuguucucugcaccugc

SEQ ID NO: 84103 - RNA, 46 nt, Mus musculus
aacauuuucucccucuauccuaaaccguuuuguacacagcugucag

SEQ ID NO: 84104 - RNA, 45 nt, Mus musculus
aggugugccugacuguauguuaaggugauaagauuaaaagcauag

SEQ ID NO: 84105 - RNA, 42 nt, Mus musculus
uggacucgggugucgcacucccggggaaaaaaaaagggcaag

SEQ ID NO: 84106 - RNA, 42 nt, Mus musculus
cgaguucagauggagcaugucucuuuuauggaaauggcugag

SEQ ID NO: 84107 - RNA, 46 nt, Mus musculus
cugaaagguaaguucuuaacauuuaaagagacauuuuaaacuucau

SEQ ID NO: 84108 - RNA, 45 nt, Mus musculus
gcucuuuggauggaaaaccuuuucagucuucaggcaaccaagagg

SEQ ID NO: 84109 - RNA, 46 nt, Mus musculus
gggccauuucccaaaaaauucuacccacguuucacucgagguccag

SEQ ID NO: 84110 - RNA, 42 nt, Mus musculus
gugaucaggaauugagagaccugggcuaccagaagcacgccu

SEQ ID NO: 84111 - RNA, 42 nt, Mus musculus
cauccagugccugggucugcaucuccaggguuucagccaaag

SEQ ID NO: 84112 - RNA, 46 nt, Mus musculus
ggcagcccacugggauuggcacagcagcuggaauuccacccugcag

SEQ ID NO: 84113 - RNA, 75 nt, Mus musculus
gcugcacuucaagugggaucuaguucccguaucugagcugggaggcccugacggcgccacggccccaauaaggua

SEQ ID NO: 84114 - RNA, 45 nt, Mus musculus
agacaguauuucaaugaucuuggacaguaugacaguggcauggau

SEQ ID NO: 84115 - RNA, 45 nt, Mus musculus
agguugugagccacccauuugguugcuggaaauugaacuuaagac

SEQ ID NO: 84116 - RNA, 64 nt, Mus musculus
auuuuccgaaaaaggcgaccguacggaucuccggaaggccaggacaccaugacacacaacuccc

SEQ ID NO: 84117 - RNA, 27 nt, Mus musculus
ccaggauucccucagguuugguuuuca

SEQ ID NO: 84118 - RNA, 45 nt, Mus musculus
aagaaacgcuguacgcuuuaggugucaccucuguccacagcccua

SEQ ID NO: 84119 - RNA, 46 nt, Mus musculus
uaugagccaccaugugguugcugggacuugaacucgggaccuucag

SEQ ID NO: 84120 - RNA, 46 nt, Mus musculus
aggagaacugagccuaguacuuuucuccucauuuauaaagccccag

SEQ ID NO: 84121 - RNA, 44 nt, Mus musculus
ggcaaauauuuugugcccauauaguugauaaccuuuccagcaua

SEQ ID NO: 84122 - RNA, 23 nt, Mus musculus
cuucugacagcagcgcgugugcu

SEQ ID NO: 84123 - RNA, 40 nt, Mus musculus
uuaauuguuguuacuguacauacauacacaugcacaugcg

SEQ ID NO: 84124 - RNA, 46 nt, Mus musculus
gguugugagccuccaugugguugcugggauuugaacucgggaccuu

SEQ ID NO: 84125 - RNA, 44 nt, Mus musculus
gagauuggagugagaugcugggggaaacauugaggaagaagcag

SEQ ID NO: 84126 - RNA, 42 nt, Mus musculus
cacagguugugcccguucugaaccuaaaaugagcgcccaugu

SEQ ID NO: 84127 - RNA, 45 nt, Mus musculus
cuccuuaggucuuucuggguauaaagacucuagucaugguccagc

SEQ ID NO: 84128 - RNA, 45 nt, Mus musculus
uaaucccaaauccauucucuguuaaaaaguuaagccugcucauuc

SEQ ID NO: 84129 - RNA, 42 nt, Mus musculus
gcagcguuguugcugcguuuucugaccuucuucacgugagaa

SEQ ID NO: 84130 - RNA, 89 nt, Mus musculus
uucagaaucaagaagaaaugacaucaaaacugagccaggcacuuuauuuuuuacuucaccuuuugguucauccccaaauggucccagau

SEQ ID NO: 84131 - RNA, 46 nt, Mus musculus
ccuuauauaauuuaagcaguauauauaucauaauaaucaaauagac

SEQ ID NO: 84132 - RNA, 46 nt, Mus musculus
gagcuuuaggaccgaagccauuucagcugccuuucagaccucagga

SEQ ID NO: 84133 - RNA, 46 nt, Mus musculus
aauuauuuugagaaauaugugagugucuguuuuccugguggcuuuu

SEQ ID NO: 84134 - RNA, 46 nt, Mus musculus
ucuuuaacagagggaauaaaacuuauuugauguauaucccagagau

SEQ ID NO: 84135 - RNA, 90 nt, Mus musculus
agugaaaacaagaaacagcgaagcaaacggacucaaaggacgggggaaaaagcagcaccucgcucaaagaaaaggaagaaggaugaagag

SEQ ID NO: 84136 - RNA, 46 nt, Mus musculus
agacuggcgcuauuuuucauauuuuaauauaccuuaaugcagaggg

SEQ ID NO: 84137 - RNA, 45 nt, Mus musculus
ugcucguucaucuggcauggugcuucccuggucucagcuuagaua

SEQ ID NO: 84138 - RNA, 42 nt, Mus musculus
auaaaguuggaaaaggcugagacacagccaagucaggaggau

SEQ ID NO: 84139 - RNA, 46 nt, Mus musculus
accccuucagcagucuccacaacaccagcaacaaauagggccaguu

SEQ ID NO: 84140 - RNA, 46 nt, Mus musculus
guguaguguguuacaugaugauggcagagagcaagcauuaaucgga

SEQ ID NO: 84141 - RNA, 45 nt, Mus musculus
aagauaaggauuugccacagagaaaguccaguguuagcagugaga

SEQ ID NO: 84142 - RNA, 46 nt, Mus musculus
uaaucagugugcaucuguugaaccaaaaacaagggaucaaggagac

SEQ ID NO: 84143 - RNA, 45 nt, Mus musculus
aggucauccugcucaccaaucuucuauugucaugaggccccuaaa

SEQ ID NO: 84144 - RNA, 42 nt, Mus musculus
gggucugccaguucagcaacauaauauacuaggccaggcauu

SEQ ID NO: 84145 - RNA, 41 nt, Mus musculus
gauuuccaggagcuggccauggucccaugccaagccaagau

SEQ ID NO: 84146 - RNA, 45 nt, Mus musculus
cugggagcacucgaucaccuguuaucccuccacuaggaccuagau

SEQ ID NO: 84147 - RNA, 46 nt, Mus musculus
gcccauucauaugaaugaaacaucagccacaaggccauccccagcc

SEQ ID NO: 84148 - RNA, 46 nt, Mus musculus
ccccaucccguauaccuguucaggaaagucuuucucagucccagaa

SEQ ID NO: 84149 - RNA, 50 nt, Mus musculus
gauucuaugaagaggcaacaacagcaagacagcaucgaucccagcucacg

SEQ ID NO: 84150 - RNA, 72 nt, Mus musculus
gcaagugauccuaacagcuccugggcaccaacaacuccaaguauggaaggagaaaaugacacccugucaaau

SEQ ID NO: 84151 - RNA, 25 nt, Mus musculus
cagaguucacggccauuaacugaag

SEQ ID NO: 84152 - RNA, 45 nt, Mus musculus
uugugucuguaugaugcauguacauagacagcauaagggagaaga

SEQ ID NO: 84153 - RNA, 45 nt, Mus musculus
aguugaucaaacaacuuacuguaugacuugaaauggucugcuacu

SEQ ID NO: 84154 - RNA, 45 nt, Mus musculus
ugcacugugugugaggccugugggaaggcaacugacccuggaaga

SEQ ID NO: 84155 - RNA, 53 nt, Mus musculus
uaguugucugcauaagaauggauaucguacgacuguauuuuaacguuuggggu

SEQ ID NO: 84156 - RNA, 25 nt, Mus musculus
uuagaugaaauuaauauguuaauca

SEQ ID NO: 84157 - RNA, 46 nt, Mus musculus
ucaggauauguguguaguuuguggcaguuucggccaaggagcagaa

SEQ ID NO: 84158 - RNA, 46 nt, Mus musculus
uuuauuauauguguguacacuauagcugucuuuagacacuccagaa

SEQ ID NO: 84159 - RNA, 46 nt, Mus musculus
cagaguauauuuucuuaauuucuauuaaaauuggaagggcacauuu

SEQ ID NO: 84160 - RNA, 46 nt, Mus musculus
cuguccugaggaaaaugagaacagagaaugaacuuugagcaacaug

SEQ ID NO: 84161 - RNA, 45 nt, Mus musculus
auuuaggcuucgguuccuaggaaauaugagggcuuuaggagugaa

SEQ ID NO: 84162 - RNA, 46 nt, Mus musculus
cuaaguuugcuaaugauuugaguggaagggucgauagaaaacagau

SEQ ID NO: 84163 - RNA, 46 nt, Mus musculus
cccacggccuuaccugaaggguuagaagcagccauccaguuuuugg

SEQ ID NO: 84164 - RNA, 46 nt, Mus musculus
ucuaauugcucaaaucccuugccuguuuaccuuucagccuguuuua

SEQ ID NO: 84165 - RNA, 87 nt, Mus musculus
gugaacaguagugugugucuuucuaucuguucauauaggucagagagugccagugaucaaacucaggacauugugcuugcccuucgc

SEQ ID NO: 84166 - RNA, 45 nt, Mus musculus
gaaagguccuuaucuuguaaggaaccauuguugacagaaagagua

SEQ ID NO: 84167 - RNA, 82 nt, Mus musculus
uuuggcaaaugagauugcucaugagguugauacugagaaaacggaaaugcuuucuaaagggcgacauguuugugaggaagau

SEQ ID NO: 84168 - RNA, 50 nt, Mus musculus
ucugauagacauaaagaagcagauaggcaauagauaagaacaggcaagau

SEQ ID NO: 84169 - RNA, 46 nt, Mus musculus
gcaguuuuuacagcaugcacaagaccugcacaacauuaauccagac

SEQ ID NO: 84170 - RNA, 38 nt, Mus musculus
gaaguaugcucuguucuuugaaccaacagugccuuaac

SEQ ID NO: 84171 - RNA, 46 nt, Mus musculus
uguguguguucacacuccuccccucucugugugucugcccccaccc

SEQ ID NO: 84172 - RNA, 46 nt, Mus musculus
uuauuaguguaaaacuccuaacgcuguuaauugcccaccaccucua

SEQ ID NO: 84173 - RNA, 31 nt, Mus musculus
cacugggugugcgugugcgugugcgugugcg

SEQ ID NO: 84174 - RNA, 48 nt, Mus musculus
ugcaacacuuuuccuugagccuuuucuggaagcauaaugccaccuuug

SEQ ID NO: 84175 - RNA, 46 nt, Mus musculus
uuuugucccugaaguuuuuucagacaggaacaaguauaggucagag

SEQ ID NO: 84176 - RNA, 42 nt, Mus musculus
ugguugguggcucaguaucucagagaucuuggggguccaggu

SEQ ID NO: 84177 - RNA, 46 nt, Mus musculus
ggcucaucaucgauguguagaguggucacugggaauaugccaaaug

SEQ ID NO: 84178 - RNA, 94 nt, Mus musculus
cgcuuuuuguuauuguggagagaaaaguuccuuaggacaaggagacuugaaacaauucagaguaacaccuggacuuaccuuaccuuggaaagau

SEQ ID NO: 84179 - RNA, 45 nt, Mus musculus
aauacaauuuuaucaagagcagauuguuuucuuuuagugguagag

SEQ ID NO: 84180 - RNA, 46 nt, Mus musculus
ucauuucuguuguugggauaauaccccgacuaaggacaacguaggg

SEQ ID NO: 84181 - RNA, 46 nt, Mus musculus
gaaugaaagugguggauggaaagguuugauaucugugucuagagau

SEQ ID NO: 84182 - RNA, 46 nt, Mus musculus
aggcugggauggguuuguggaguucuuccacgcacaggaccuagaa

SEQ ID NO: 84183 - RNA, 31 nt, Mus musculus
uuuggugccuuuguggccaaacacuuaaaga

SEQ ID NO: 84184 - RNA, 46 nt, Mus musculus
cugccuuuguauguuacuugaccuuucccccuuacugcuuuuaaua

SEQ ID NO: 84185 - RNA, 26 nt, Mus musculus
cuggaauuaauucuguagaucagguu

SEQ ID NO: 84186 - RNA, 24 nt, Mus musculus
cuggauccucuggaaugggaguua

SEQ ID NO: 84187 - RNA, 45 nt, Mus musculus
cuaaacuguaguaauagacauguguuaaugagauagauaccauua

SEQ ID NO: 84188 - RNA, 46 nt, Mus musculus
auaaaauuuaccaggaguuuagcaagccugguaccagacaagagau

SEQ ID NO: 84189 - RNA, 46 nt, Mus musculus
aaggagaaggaugugaggccagcuaccucuaccacaucauguagua

SEQ ID NO: 84190 - RNA, 46 nt, Mus musculus
uugcugagggauuauuggaggaaauagagguacuuugcaggcagag

SEQ ID NO: 84191 - RNA, 46 nt, Mus musculus
uuuuaccuuugagcuaucucucuagcccugcuccccggccccauca

SEQ ID NO: 84192 - RNA, 46 nt, Mus musculus
ucagcccaaguauguggaagcaagaagcuucaggacaccaccagaa

SEQ ID NO: 84193 - RNA, 46 nt, Mus musculus
aaaucccaucugcauuguuaggaaaucagcaguucaauucacaggu

SEQ ID NO: 84194 - RNA, 46 nt, Mus musculus
guccauuggggaauaauaugauuuugcuuuuguuucuuggccagga

SEQ ID NO: 84195 - RNA, 45 nt, Mus musculus
aaccuuguagauuaguagggauguugaaauaguugauuugguaga

SEQ ID NO: 84196 - RNA, 46 nt, Mus musculus
aaaagcuuguugugugaugacauugaacuuguauuuccugguggau

SEQ ID NO: 84197 - RNA, 46 nt, Mus musculus
aaagguauacauuuauuuagaacauaaauaguaauguagcacaguc

SEQ ID NO: 84198 - RNA, 46 nt, Mus musculus
uuuuauuuauauauuuaaaauuuuuauuuacuuuuaugugccugca

SEQ ID NO: 84199 - RNA, 42 nt, Mus musculus
ccugccccuuguauguguauucggauucucauagcuguaggg

SEQ ID NO: 84200 - RNA, 46 nt, Mus musculus
uuucuuauuauuauuuucucccucccaaccucccucacucccuuug

SEQ ID NO: 84201 - RNA, 46 nt, Mus musculus
uaaaucuuaacuccuuggauuuuauuauucugaaguucugugagau

SEQ ID NO: 84202 - RNA, 24 nt, Mus musculus
guguuggggacuuguagaggucaa

SEQ ID NO: 84203 - RNA, 46 nt, Mus musculus
uuaccuccauuccagugagugcauccauaauguuuggguagcagua

SEQ ID NO: 84204 - RNA, 46 nt, Mus musculus
uaccaauccuaauauuuguugauucuaauccagaucagggcauuuu

SEQ ID NO: 84205 - RNA, 42 nt, Mus musculus
ggacagccaggacuacacagagaaacccugucuugacccucc

SEQ ID NO: 84206 - RNA, 49 nt, Mus musculus
auauaguaagcaauucaucuguuuauuagauacgccagaguagaauagc

SEQ ID NO: 84207 - RNA, 46 nt, Mus musculus
gguucacaaguucaaaacuagccuguacugcacaacuuagugagau

SEQ ID NO: 84208 - RNA, 46 nt, Mus musculus
gccaagccuggucuacagugaaaaacuguuucaaaaagcgagagug

SEQ ID NO: 84209 - RNA, 45 nt, Mus musculus
uuuuguuuugcuuuugagacagagucucacuauauagcccuggau

SEQ ID NO: 84210 - RNA, 61 nt, Mus musculus
ugugugaaccagugugggaggcugccuguugguauguuggccuuuuuaggagcugugaagu

SEQ ID NO: 84211 - RNA, 56 nt, Mus musculus
gaacuauaccucugaccccuacuguacaguuuuuaaucaagacaaagagaaaaauc

SEQ ID NO: 84212 - RNA, 46 nt, Mus musculus
ggauguaggaaugguauucagggauagcucagcguacguaacuaag

SEQ ID NO: 84213 - RNA, 45 nt, Mus musculus
gaaguccucaccacuaccgaggaguguaaaaguuucuggcauaga

SEQ ID NO: 84214 - RNA, 45 nt, Mus musculus
uuuuucuggagaauggaggcagaggcuuaauaauagggagugaga

SEQ ID NO: 84215 - RNA, 46 nt, Mus musculus
cuaauucuguuaacguuaaaagaaauuuuuccugaagagagagaga

SEQ ID NO: 84216 - RNA, 41 nt, Mus musculus
cucauugaacuguuggcgguggaagggugcgcugggacuug

SEQ ID NO: 84217 - RNA, 50 nt, Mus musculus
uugaaaauuaaggaaaccguuuuagugccaaugaguuaguugaucagcaa

SEQ ID NO: 84218 - RNA, 44 nt, Mus musculus
ugagcguccgugaggacugugccggguggaugaacugggcaaga

SEQ ID NO: 84219 - RNA, 46 nt, Mus musculus
guuucgggaacgcggccggguuccgcggcgcugacggcccagagca

SEQ ID NO: 84220 - RNA, 46 nt, Mus musculus
ggccggccucgcaaagauggcgcuuccccuuuccagagagccagaa

SEQ ID NO: 84221 - RNA, 46 nt, Mus musculus
ugcuaguauuacaaggcuuauguugcuuauuuaaacucuuccccgu

SEQ ID NO: 84222 - RNA, 42 nt, Mus musculus
guacacauaaauacgcaagaaacccugagguguugaauagug

SEQ ID NO: 84223 - RNA, 44 nt, Mus musculus
aacauggaaauuccaaugccuguggggagaagggggcuuaaaga

SEQ ID NO: 84224 - RNA, 45 nt, Mus musculus
cauaagcacaggguaggugguggagugaaggguuugauaggggaa

SEQ ID NO: 84225 - RNA, 45 nt, Mus musculus
uagauuuccccuaagucuuuuguguuauuauuuuaagagguagag

SEQ ID NO: 84226 - RNA, 44 nt, Mus musculus
gcagagcugaaauauuagagaguggaagugugauggagaagaga

SEQ ID NO: 84227 - RNA, 46 nt, Mus musculus
uaaaaacacucagaaaggaauauaaaauaaaucaggaaggccagag

SEQ ID NO: 84228 - RNA, 46 nt, Mus musculus
acaggugaauaacaugucacauucuugcaugcaugucuucaagaua

SEQ ID NO: 84229 - RNA, 46 nt, Mus musculus
ggcugguugcuguuuguacagcugucauggauguauugagguggau

SEQ ID NO: 84230 - RNA, 24 nt, Mus musculus
guuucgggggggggggcggcgggg

SEQ ID NO: 84231 - RNA, 46 nt, Mus musculus
gacgaaggagguggacuuggcgaauguggaguaaguccugggaagu

SEQ ID NO: 84232 - RNA, 46 nt, Mus musculus
aucggcggggagcgaguuggacgaauuguuuuagaauuguuugcag

SEQ ID NO: 84233 - RNA, 46 nt, Mus musculus
cuggguccacgaccaggaagccucuccauuuuaaaggaugcccuuu

SEQ ID NO: 84234 - RNA, 85 nt, Mus musculus
auuuauggugaaaaauuugaagaugaaaauuuucauuauaagcaugaucgggaggguuugcugagcauggcaaaugcacgcccca

SEQ ID NO: 84235 - RNA, 47 nt, Mus musculus
gugaauggugaaaaaccugccaaacucuguguuauugcagaaugugg

SEQ ID NO: 84236 - RNA, 48 nt, Mus musculus
gggcacccaccaggcggaggagaagaugguggcuaucaccucgucggg

SEQ ID NO: 84237 - RNA, 45 nt, Mus musculus
gucccuucaucccccucccccaccccaagaacaaggaaaggcacu

SEQ ID NO: 84238 - RNA, 56 nt, Mus musculus
agggacacgucagcuguuaaagucacccuuguuacaagaaaaggagaacggagagg

SEQ ID NO: 84239 - RNA, 66 nt, Mus musculus
guaggaaaccccagacguuggcgagcgacaggcggaaguuggagggacuagugauggagaugaggu

SEQ ID NO: 84240 - RNA, 42 nt, Mus musculus
cugggggucuugggauuggucauguaccaucauuagaagcag

SEQ ID NO: 84241 - RNA, 46 nt, Mus musculus
aaaugcuuccuuaacuuuuggaucacuagaaauuagauuuugccaa

SEQ ID NO: 84242 - RNA, 46 nt, Mus musculus
ugggcuugggauuaccaucgccuuccuagcuacgcugaucacucag

SEQ ID NO: 84243 - RNA, 54 nt, Mus musculus
acucaccacucagcuggguggauuaggggugauucaugccuuucaucccaguac

SEQ ID NO: 84244 - RNA, 49 nt, Mus musculus
gguuuacagaaugaguuccaggauagucaagacuacacaaggggaaaaa

SEQ ID NO: 84245 - RNA, 72 nt, Mus musculus
ggugaccauaaaacaugacacauuugauaacuuuagcccacaauugucucccucacccacauuacaggaucc

SEQ ID NO: 84246 - RNA, 97 nt, Mus musculus
cugcguaguuaagucuguuuuguuuuucucccuagguacacguccccugauuuccucuauauccguucuuggcuccccuguauauuuuucucaggag

SEQ ID NO: 84247 - RNA, 46 nt, Mus musculus
uguuccaugggcugaaguaaagagagcuuuacagaaaggugacuag

SEQ ID NO: 84248 - RNA, 46 nt, Mus musculus
cuuugaaugaugagugaacucuaauacucgggaaacugccccccuu

SEQ ID NO: 84249 - RNA, 62 nt, Mus musculus
aguuuugugucagugcccaaaggagggagguugauggugcuuaacagagaugaagugugugu

SEQ ID NO: 84250 - RNA, 62 nt, Mus musculus
aguaagaauauuuauccagaauuaaaauaaaggguuguguaaagagggguugagagcagcag

SEQ ID NO: 84251 - RNA, 26 nt, Mus musculus
acugaaacagcagacagcgacucacu

SEQ ID NO: 84252 - RNA, 46 nt, Mus musculus
cagucauaaugagccgaaauugugucucugucacuccaggguggag

SEQ ID NO: 84253 - RNA, 45 nt, Mus musculus
gugggaccuaacuugcaaggauugggucuucaacuucaagugcaa

SEQ ID NO: 84254 - RNA, 42 nt, Mus musculus
auacccuccacugcacacuaguccucugacauacuccagcuu

SEQ ID NO: 84255 - RNA, 45 nt, Mus musculus
aagcucuguaccuguggacaccuggguuuggguuaacccucgcag

SEQ ID NO: 84256 - RNA, 45 nt, Mus musculus
aacuacuuuggcuaaaagaaaauggguugugcuagacuuugggac

SEQ ID NO: 84257 - RNA, 46 nt, Mus musculus
aagacauucuucagcuaagacuggagugucuugcacaagcuacagu

SEQ ID NO: 84258 - RNA, 46 nt, Mus musculus
acuaguaccaagcacacucacuuuccugaucugaacacccagcgag

SEQ ID NO: 84259 - RNA, 42 nt, Mus musculus
agagagacagacgggcagauagacagaaacaugggggcaggc

SEQ ID NO: 84260 - RNA, 42 nt, Mus musculus
uuuccagagugauuguaccaguuugcaauccuaccagcaaua

SEQ ID NO: 84261 - RNA, 45 nt, Mus musculus
cuuuccaauaauaugacccagauggaguuggagggaacggguaag

SEQ ID NO: 84262 - RNA, 45 nt, Mus musculus
ccucgggagggaggauggagagaguaguuugggaauaguuucaga

SEQ ID NO: 84263 - RNA, 46 nt, Mus musculus
gcucuugaacucuaugcuccacugcuucuggauccugccuauagag

SEQ ID NO: 84264 - RNA, 45 nt, Mus musculus
guugaaauauaaucagguauauaaaaauaugaaccuggaaagaau

SEQ ID NO: 84265 - RNA, 46 nt, Mus musculus
uuauccuaaaagugagcuauucauuaaugauauauuccuuuaagag

SEQ ID NO: 84266 - RNA, 45 nt, Mus musculus
aaaguguucauucagccuuggggccugaaacuagaagggauuagg

SEQ ID NO: 84267 - RNA, 23 nt, Mus musculus
uggaugaggagcaggugcucuua

SEQ ID NO: 84268 - RNA, 46 nt, Mus musculus
ugaaaauuuaugaaaauuuuguguuaaaaacuuacugugcucagag

SEQ ID NO: 84269 - RNA, 46 nt, Mus musculus
caucgguggaguacaauguaauggaauuggagcaagaacuugagaa

SEQ ID NO: 84270 - RNA, 63 nt, Mus musculus
aauaugguggggaaaaaaaaggaucaagaaauugcucuaaucugauacgugaauuuggggauu

SEQ ID NO: 84271 - RNA, 61 nt, Mus musculus
guuccagaccuguacagccagccucuagcuaacaccccuuccacacaggguuaagagagag

SEQ ID NO: 84272 - RNA, 34 nt, Mus musculus
uacuuuagaaucccccaaagucacaaagggacac

SEQ ID NO: 84273 - RNA, 44 nt, Mus musculus
cagcuugcaguugugaagaguuacacauguuacuuauugacuag

SEQ ID NO: 84274 - RNA, 56 nt, Mus musculus
uucugaagagagauaaaaagaaaggaaagaaaauguagaauugggaggguaagggg

SEQ ID NO: 84275 - RNA, 48 nt, Mus musculus
cagguucaagccaggggagggggaggauauucaggagcugcgaggaga

SEQ ID NO: 84276 - RNA, 46 nt, Mus musculus
auauugcaaauuuuauaugccccaguacaggggaacaccauggcca

SEQ ID NO: 84277 - RNA, 30 nt, Mus musculus
gcaugugguucacagacauaaacauuuagg

SEQ ID NO: 84278 - RNA, 46 nt, Mus musculus
auucucagcacacacaauaguuuacaaccaucuauaaccccaguca

SEQ ID NO: 84279 - RNA, 45 nt, Mus musculus
aagaaaugcuggaguuugggaaauucuguuaucuugggagcaaaa

SEQ ID NO: 84280 - RNA, 46 nt, Mus musculus
acuauuaaagucuuugaacuauaauucaauucuguuaggcacuauu

SEQ ID NO: 84281 - RNA, 46 nt, Mus musculus
acagaauccuggugacauguuuaggaagggugacacaggcacagua

SEQ ID NO: 84282 - RNA, 47 nt, Mus musculus
uagauaaaaaucaaauaaaaacaccaaacaaacccaagguagagcau

SEQ ID NO: 84283 - RNA, 46 nt, Mus musculus
caccuaaagaaaccaucaaccaugugaagaagaagccuguagagug

SEQ ID NO: 84284 - RNA, 48 nt, Mus musculus
ugucuuacaauucauauggaaugaacaaaaaaggacaaugcugaagag

SEQ ID NO: 84285 - RNA, 46 nt, Mus musculus
agcuuaagccagaacagcugaguuguaucaggcaaggagagaucag

SEQ ID NO: 84286 - RNA, 46 nt, Mus musculus
ucgaaagaguuaggaaagguaagcuaccuaagagagcggugcagag

SEQ ID NO: 84287 - RNA, 45 nt, Mus musculus
cuuaguuguauugcaggauauuugaucacacugugaacccugaga

SEQ ID NO: 84288 - RNA, 45 nt, Mus musculus
gggaucuacagaguucuacacagagaucugaauuccaugcuaucc

SEQ ID NO: 84289 - RNA, 43 nt, Mus musculus
gagugagagcugucuacagcuaaaacaaauaaaucaaccagau

SEQ ID NO: 84290 - RNA, 44 nt, Mus musculus
acuguuuauucucaccuucccugugauaugcuugccccccacac

SEQ ID NO: 84291 - RNA, 46 nt, Mus musculus
gugacauggucugugugcuuuuucugggucuauuuaguuuguuuua

SEQ ID NO: 84292 - RNA, 45 nt, Mus musculus
cugaucauguaaaauugaguugcgggguuuaaaaaaaauaaaaau

SEQ ID NO: 84293 - RNA, 46 nt, Mus musculus
ucuaucauaucuaccuauuguauuuuucaaauaaaaaugugguaga

SEQ ID NO: 84294 - RNA, 46 nt, Mus musculus
uggagucuuuggugcuucuuugguuagaaucaugucaacugcagag

SEQ ID NO: 84295 - RNA, 46 nt, Mus musculus
auucuguaggccagcuuuucaacuaauucaguuuucuugcagaaca

SEQ ID NO: 84296 - RNA, 46 nt, Mus musculus
aaucacugagguugguacugcuuuugaagacaugaaggggucagug

SEQ ID NO: 84297 - RNA, 45 nt, Mus musculus
gugauggcugauuaggccaucuuuuguuacauaugcagcuagagu

SEQ ID NO: 84298 - RNA, 45 nt, Mus musculus
uuuguuuggaggaagguggauuuugggacuuuggauuugguaaga

SEQ ID NO: 84299 - RNA, 46 nt, Mus musculus
ucugacucagaaaagauucauguccucuauuugaaucugcucagau

SEQ ID NO: 84300 - RNA, 46 nt, Mus musculus
acauauaauacuacaguggcuuauauaauguauauuuaaggcagau

SEQ ID NO: 84301 - RNA, 46 nt, Mus musculus
uguaauguaaauaugacgacagauuaauucauaaagcccaggacuu

SEQ ID NO: 84302 - RNA, 46 nt, Mus musculus
ccuuucuuacaugggggugaguugcuuuuucuuuaggaccaucuag

SEQ ID NO: 84303 - RNA, 46 nt, Mus musculus
aggaugaaugcacagcuugaauugaaaaucuagcgaagcagaauuc

SEQ ID NO: 84304 - RNA, 44 nt, Mus musculus
gaggguucagcucuggcagguaguuuagauuugaugcuguagac

SEQ ID NO: 84305 - RNA, 46 nt, Mus musculus
aaccaacucaagcaagauauccucugaccuucacauguacccagac

SEQ ID NO: 84306 - RNA, 45 nt, Mus musculus
gaaagcaguuuguugcagucaacaaagaugaaacaggaauggaga

SEQ ID NO: 84307 - RNA, 46 nt, Mus musculus
ugaggcuuggcacugugagaggucauggaaagccauuggagaaggu

SEQ ID NO: 84308 - RNA, 46 nt, Mus musculus
gacuugguaauguguaagaauuacccaggugguacugguuuugaag

SEQ ID NO: 84309 - RNA, 45 nt, Mus musculus
agugaaggauuuggaaaacagaaagccagugacaaugcaguagua

SEQ ID NO: 84310 - RNA, 46 nt, Mus musculus
uucacacaaaauaguaauuuugagaugacauagaguaguagagaga

SEQ ID NO: 84311 - RNA, 45 nt, Mus musculus
guuguauuuugaacuauuuugugauaccagcagguggcaguagaa

SEQ ID NO: 84312 - RNA, 46 nt, Mus musculus
guuguuuguuuuuuuuuguuuguuuguuuuugugaaucuaucagau

SEQ ID NO: 84313 - RNA, 31 nt, Mus musculus
aaggagaggaggagugggggaggaggaggag

SEQ ID NO: 84314 - RNA, 46 nt, Mus musculus
agcaguuauuagaagucucccacacccaaaaaauccaggaccagau

SEQ ID NO: 84315 - RNA, 46 nt, Mus musculus
caguguguaguuaggaaggagggagugcugauuucaguguguaguu

SEQ ID NO: 84316 - RNA, 46 nt, Mus musculus
uaagacagaauuccucaucgccauauucagccugccuucuguagau

SEQ ID NO: 84317 - RNA, 42 nt, Mus musculus
aaaaauggcauauuucaucuucaggagauuuaaugaggaaca

SEQ ID NO: 84318 - RNA, 47 nt, Mus musculus
uuaugaaugaaagaagacaaaagagaugguguauaggaagccugaga

SEQ ID NO: 84319 - RNA, 67 nt, Mus musculus
aagaacggcuaagacacaccacugacauggaggcuagagagauccagagacucaaggacaugaggca

SEQ ID NO: 84320 - RNA, 46 nt, Mus musculus
uuucuccagacuuggugauggauuagguguggagguagcaggauaa

SEQ ID NO: 84321 - RNA, 46 nt, Mus musculus
gaaugagaaagacuguggaccuugcugguuggauagaaugacggau

SEQ ID NO: 84322 - RNA, 46 nt, Mus musculus
uuaaagauaccuggucacauuguuuuauagauuagacacauagaag

SEQ ID NO: 84323 - RNA, 47 nt, Mus musculus
guuuggaaguauuccuuggauccuuaauccgccaagaaugugaagau

SEQ ID NO: 84324 - RNA, 46 nt, Mus musculus
cucauauauuaacgauucuuugauauaauaucuuaucaaacgagag

SEQ ID NO: 84325 - RNA, 46 nt, Mus musculus
ucucauucguaacuaagaauaguuguuggcuauuuacuaccuagga

SEQ ID NO: 84326 - RNA, 42 nt, Mus musculus
ccaggaaacccgacuacacucagccacccauccagcccagac

SEQ ID NO: 84327 - RNA, 46 nt, Mus musculus
gaaaugugucacaaggguacaccuuugcucacuaaugcccccagug

SEQ ID NO: 84328 - RNA, 46 nt, Mus musculus
aaacauacauauaacgugugugugugugugugugugugugugugug

SEQ ID NO: 84329 - RNA, 46 nt, Mus musculus
agugucuucuucagguuuugagugcuauagaguuuucguuguagau

SEQ ID NO: 84330 - RNA, 46 nt, Mus musculus
ugugaaagauguuaguauuuugauuaggugcauuggacuuguagau

SEQ ID NO: 84331 - RNA, 46 nt, Mus musculus
aaccugaacuacagaaucuucacaaucaaacuagcaauagcccuga

SEQ ID NO: 84332 - RNA, 60 nt, Mus musculus
agguacaaccuugguuaucucuggaacauaaccucugugcucucaaacacuucccagaag

SEQ ID NO: 84333 - RNA, 45 nt, Mus musculus
cuuucacagugccgagccucaggcuucucugcgugaccccuugau

SEQ ID NO: 84334 - RNA, 46 nt, Mus musculus
auugucuauuuuuggaagauuuguuaagaaccauauagcuguagau

SEQ ID NO: 84335 - RNA, 46 nt, Mus musculus
uuggcuacgcaaaggcugggccauucuaauccucccucaacuagca

SEQ ID NO: 84336 - RNA, 42 nt, Mus musculus
acccgcaucucccuauacucacacccucucuaaaccccucua

SEQ ID NO: 84337 - RNA, 42 nt, Mus musculus
aucugcaccuuuaucaucugcuucaccaucuucaccugaguu

SEQ ID NO: 84338 - RNA, 45 nt, Mus musculus
ugugugugugugugugugugugagagagagagagagagaagcauu

SEQ ID NO: 84339 - RNA, 45 nt, Mus musculus
gggauggaggacaguaggaaaauaagacccucuaaauuaacaaga

SEQ ID NO: 84340 - RNA, 46 nt, Mus musculus
cuuaacugccuuccucucccagguuugagaaacugaggcaugaguu

SEQ ID NO: 84341 - RNA, 49 nt, Mus musculus
aggccuugguguuaguggagggggcacuggccuuggcagggguugcugu

SEQ ID NO: 84342 - RNA, 44 nt, Mus musculus
agugcccgcuuccgggcgguggcgguggcgggaccaggcuuucc

SEQ ID NO: 84343 - RNA, 94 nt, Mus musculus
cuuccuccucuuccucgcugcuuucguacaggccgccgccgcucccacauuccagggcccccaggauguaguccagaccgucgcgcgcgaagcu

SEQ ID NO: 84344 - RNA, 45 nt, Mus musculus
uacaucuuccugauccuccugcagcacuugccagucuggguccuc

SEQ ID NO: 84345 - RNA, 27 nt, Mus musculus
agcucggggcuuagcugcgguccgcuu

SEQ ID NO: 84346 - RNA, 46 nt, Mus musculus
caaggaacucugcacugcaaacuaaaaggucuuaaaaacuuuggag

SEQ ID NO: 84347 - RNA, 46 nt, Mus musculus
uuacggugucaucaguacacacacuuggguggagcuuuggaauuag

SEQ ID NO: 84348 - RNA, 56 nt, Mus musculus
gguagugaagggccuacaguuaaaggcaggauuuuguaggagggauuagaguggca

SEQ ID NO: 84349 - RNA, 46 nt, Mus musculus
guucaucuaaagaggauuuuguuccauguacuucaguuggcuauag

SEQ ID NO: 84350 - RNA, 50 nt, Mus musculus
auuaccagugacguuguugcauguuugaaauucagucuguuuaaaguggc

SEQ ID NO: 84351 - RNA, 41 nt, Mus musculus
uucaagauugacaaagaguacuugcuaaaaauggcagcaga

SEQ ID NO: 84352 - RNA, 77 nt, Mus musculus
gugacauccugagacugaucaaggaacuggcuaaauaugaauacauagaagaucaagucauuuuaacugagaaagau

SEQ ID NO: 84353 - RNA, 45 nt, Mus musculus
guucaaguacaggggccuggugcgcaaagggaagaaaagcaaaag

SEQ ID NO: 84354 - RNA, 46 nt, Mus musculus
gucuuauacugagguucgccgggucauggugccagccugacugaga

SEQ ID NO: 84355 - RNA, 46 nt, Mus musculus
ugcuuacugauuccaguaacugcaauuucuuuuucagcuagaugag

SEQ ID NO: 84356 - RNA, 45 nt, Mus musculus; identical to SEQ ID NO: 81615

SEQ ID NO: 84357 - RNA, 41 nt, Mus musculus; identical to SEQ ID NO: 81616

SEQ ID NO: 84358 - RNA, 44 nt, Mus musculus
acacagacagagucaaggagcuaagcccccacagugggcccagu

SEQ ID NO: 84359 - RNA, 52 nt, Mus musculus
uaaaccuggaaguuuaugugacauucuucgugaucuacaaugggaagguguu

SEQ ID NO: 84360 - RNA, 46 nt, Mus musculus
caauuuuugaagugggaaaagcaacaugcuuugccuauggacaaac

SEQ ID NO: 84361 - RNA, 23 nt, Mus musculus
ugggcugccuggucgggagagug

SEQ ID NO: 84362 - RNA, 44 nt, Mus musculus
ccaaacacaggauaacaauaaaauccggacuuugugccucugcc

SEQ ID NO: 84363 - RNA, 47 nt, Mus musculus
ggggagccccacugugcuucuuuugcaagcccugccugagacccaaa

SEQ ID NO: 84364 - RNA, 44 nt, Mus musculus
uuaacaugaagugcaaacaguuaauucacagucagacuucacca

SEQ ID NO: 84365 - RNA, 50 nt, Mus musculus
gguagggugggagggccugucacugguagaacuucuugcuagaguuguua

SEQ ID NO: 84366 - RNA, 45 nt, Mus musculus
ccguagccgguccacuaccuucugagcaccauacagauccacaaa

SEQ ID NO: 84367 - RNA, 50 nt, Mus musculus
acacacacacacacacacagagagagagagugagugugugugugugugug

SEQ ID NO: 84368 - RNA, 42 nt, Mus musculus
acacuggucuuuuccugguucauauacuaaaauuucagccag

SEQ ID NO: 84369 - RNA, 46 nt, Mus musculus
cucucccaaucaaucaaauugcugcugucagcaaaaggccugagaa

SEQ ID NO: 84370 - RNA, 42 nt, Mus musculus
gaaagacagggaagcaucuacaaacuguuccacgggcugcag

SEQ ID NO: 84371 - RNA, 46 nt, Mus musculus
aggcuguguuugaggaccucgguguaaagcacaaaguguuaaagga

SEQ ID NO: 84372 - RNA, 46 nt, Mus musculus
acgacaaagugaagaagaaagcucucacaucauuugaaagggauuc

SEQ ID NO: 84373 - RNA, 31 nt, Mus musculus
agacagcugcuguguggcuuuaggcacccug

SEQ ID NO: 84374 - RNA, 46 nt, Mus musculus
ugaccaaagaaucgaaggcccugauggggcuuuauaacggccaggu

SEQ ID NO: 84375 - RNA, 46 nt, Mus musculus
ccuuguaacagcacuaugaacuaggcauccauuuucccauuuaaau

SEQ ID NO: 84376 - RNA, 46 nt, Mus musculus
auaucagcuggggauguagcucugguagaaccuuugucuggcuuga

SEQ ID NO: 84377 - RNA, 57 nt, Mus musculus
cugucccauuugucagacaacagguuuacaaaacaguugaagaaaaagugaagaagc

SEQ ID NO: 84378 - RNA, 45 nt, Mus musculus
auuaauacaagaguagauuauaauaguguacuaaaaguccccaga

SEQ ID NO: 84379 - RNA, 81 nt, Mus musculus
auuuuguuguuguuguuuuauuuuguuuuuacaggaccaggaauaaaaucaccagaagaaaggacaauugaauaccuagag

SEQ ID NO: 84380 - RNA, 25 nt, Mus musculus
gagugugauguggagugaggacugg

SEQ ID NO: 84381 - RNA, 42 nt, Mus musculus
agauacccuucccuccuuggucuuuuuaccuuagggcaccag

SEQ ID NO: 84382 - RNA, 46 nt, Mus musculus
uacuuaaauaccuaacagaacuaaccacaaaguuauauaugggguu

SEQ ID NO: 84383 - RNA, 43 nt, Mus musculus
ucagccauagcaaaauccagagaaggaaacaagcggcacucag

SEQ ID NO: 84384 - RNA, 45 nt, Mus musculus
gaauuagcuuauuaaaaucacacaacaaaagguucaugcccccaa

SEQ ID NO: 84385 - RNA, 46 nt, Mus musculus
ugugugaagguaugucuguguuuuuccaauugcuaguuuguaccag

SEQ ID NO: 84386 - RNA, 46 nt, Mus musculus
aauggauaaacaaacuaugguguauauauaauaaaacagcccucaa

SEQ ID NO: 84387 - RNA, 45 nt, Mus musculus
aaccccccaagaagcaacacgaauaucacaggaaggucagagaau

SEQ ID NO: 84388 - RNA, 45 nt, Mus musculus
uccugugauauucguguugcuucuugggggguuguacaagaggau

SEQ ID NO: 84389 - RNA, 46 nt, Mus musculus
auaaggaccaguggagaagaauaaucaggccugugugcaggcagau

SEQ ID NO: 84390 - RNA, 42 nt, Mus musculus
auccaugagaaaccugggcacagugagucugauggaucacuu

SEQ ID NO: 84391 - RNA, 46 nt, Mus musculus
cgcaggaauucauucuccccccauuucaaauauaaaggugucuuuu

SEQ ID NO: 84392 - RNA, 46 nt, Mus musculus
gcuaugaauuugaggaaccagggaaauguaugggaggggcuggaag

SEQ ID NO: 84393 - RNA, 25 nt, Mus musculus
uguguguguguuuauuuccaaccua

SEQ ID NO: 84394 - RNA, 46 nt, Mus musculus
accuccaguuucaaccuucuauacauucaaacuaagauuacugaag

SEQ ID NO: 84395 - RNA, 44 nt, Mus musculus
aaagacucaggaaaguuaggggagagccugacacugccggagca

SEQ ID NO: 84396 - RNA, 46 nt, Mus musculus
agagaagcgacugagacugccaaucgcccgggacgccaccaucuug

SEQ ID NO: 84397 - RNA, 41 nt, Mus musculus
cgaaaggaugauuucucugaaggugagacuaaggaccuccg

SEQ ID NO: 84398 - RNA, 45 nt, Mus musculus
guaggacugguuggcugguuacuuacacacacacacacauacaca

SEQ ID NO: 84399 - RNA, 47 nt, Mus musculus
uguuguuuggucaggcucucacuuuguagccuccuagauugggcuug

SEQ ID NO: 84400 - RNA, 45 nt, Mus musculus
cacugagaaguccucagggcagguagugucuccaucugaagaagg

SEQ ID NO: 84401 - RNA, 46 nt, Mus musculus
gcauugggaauccgacauuuuuugcaaggaggcugaggacaagaga

SEQ ID NO: 84402 - RNA, 45 nt, Mus musculus
uggugagccagcagcaugggugcugggaacagaucucagguccuc

SEQ ID NO: 84403 - RNA, 46 nt, Mus musculus
cugcaaagguuuucuucucauuucauuguaaguugguagccaaaag

SEQ ID NO: 84404 - RNA, 34 nt, Mus musculus
auugaucuuauccucugugaccgucaccucgucg

SEQ ID NO: 84405 - RNA, 42 nt, Mus musculus
agcuacagaugggugugagccaccucugggaguugaacucag

SEQ ID NO: 84406 - RNA, 46 nt, Mus musculus
gcuucuggauaggcauuguaauuugaauuucuugcugguacuggag

SEQ ID NO: 84407 - RNA, 42 nt, Mus musculus
uuccccucgaacgcccccguacacacucacccgggccacaag

SEQ ID NO: 84408 - RNA, 63 nt, Mus musculus
caggggcccagagaacagacuccccucagaaguacagaagaggagagcggaaggaacugaggg

SEQ ID NO: 84409 - RNA, 50 nt, Mus musculus
agggacagacaggagccugaggaggaaagaggagggggagaaggggucag

SEQ ID NO: 84410 - RNA, 45 nt, Mus musculus
gugacagacauggaguggaggugcugucaggguuaugggggcgau

SEQ ID NO: 84411 - RNA, 42 nt, Mus musculus
cuggcuccagugccggcagccaucucaguggacugggaggag

SEQ ID NO: 84412 - RNA, 43 nt, Mus musculus
gguccuguugagucagagaaggugcagcagcuagagcggcagg

SEQ ID NO: 84413 - RNA, 53 nt, Mus musculus
gcugcaaggccuucgggguguccugcaggggaugaaugggcgccuagcagaag

SEQ ID NO: 84414 - RNA, 41 nt, Mus musculus
ggcagggccucaggcccugucccaguuccuucuggccccag

SEQ ID NO: 84415 - RNA, 46 nt, Mus musculus
ugccccccagagcugggucgacgagugucugagcuggagcggaggc

SEQ ID NO: 84416 - RNA, 87 nt, Mus musculus
uuggagggacugcaagggcuccugagccggcuucgggagcgcauggaugcacaggaggagacugcagcagaaaucuuacugcgccuc

SEQ ID NO: 84417 - RNA, 57 nt, Mus musculus
gggccaccaaggacagcaucaucucugaaaucaacagacuacagcaggaggccacgg

SEQ ID NO: 84418 - RNA, 42 nt, Mus musculus
cugcgaacgacuggacaccguggcagggggacuacaaggccu

SEQ ID NO: 84419 - RNA, 45 nt, Mus musculus
acaccacuauccuggcagcccugcauaguauuccacacugagcuu

SEQ ID NO: 84420 - RNA, 46 nt, Mus musculus
ccgcagagccaccuggaugguggcuacccaccaaggcaagggcaag

SEQ ID NO: 84421 - RNA, 31 nt, Mus musculus
cguccccaccagagcccucuccgggacccaa

SEQ ID NO: 84422 - RNA, 46 nt, Mus musculus
cgcccagaaccaggagcagggcggccgcccgagagccgccugacuc

SEQ ID NO: 84423 - RNA, 46 nt, Mus musculus
uguaaaaaguuuggaccaggauccuucagggaacaguucugaagau

SEQ ID NO: 84424 - RNA, 41 nt, Mus musculus
aggagaggcccuuuguccugugaagguucgaugccccagug

SEQ ID NO: 84425 - RNA, 45 nt, Mus musculus
ucacaaccauccguaaugaugagaucugacucccucuucuggggu

SEQ ID NO: 84426 - RNA, 24 nt, Mus musculus
ccaucugccggaggggggugaaau

SEQ ID NO: 84427 - RNA, 44 nt, Mus musculus
cccacgggcucuacuuucucccccaugaugauccuuguggccaa

SEQ ID NO: 84428 - RNA, 46 nt, Mus musculus
guacuggucaucuccacaccaaguaccacgucggcaccggccaagc

SEQ ID NO: 84429 - RNA, 46 nt, Mus musculus
caguguagaagucugccguacccaggcuggcauagaggcuguagcc

SEQ ID NO: 84430 - RNA, 43 nt, Mus musculus
cacguggacaucaaucaauccuaggagaaaguugggggcgaga

SEQ ID NO: 84431 - RNA, 45 nt, Mus musculus
cagcacucugggguauagcggcucaccuucugggcaagggcgaga

SEQ ID NO: 84432 - RNA, 42 nt, Mus musculus
gagaaggucucguugagguagagcuucaggccugcugcagag

SEQ ID NO: 84433 - RNA, 45 nt, Mus musculus
gcuccaagucuucccgguuuaggaacagguggugaggagcgaccu

SEQ ID NO: 84434 - RNA, 45 nt, Mus musculus
uagagaagggcauguggcuggggacuguccacucaugcuccagau

SEQ ID NO: 84435 - RNA, 48 nt, Mus musculus
uggcagguggaagcggccaucaggaaggcccgggaugacucggcgugg

SEQ ID NO: 84436 - RNA, 42 nt, Mus musculus
ugucuagguacugguggugcaggguagcagggaccaucaggg

SEQ ID NO: 84437 - RNA, 42 nt, Mus musculus
gugagagaagcaaaagcauuaccacccagcuccuggagagcc

SEQ ID NO: 84438 - RNA, 23 nt, Mus musculus
aucguuacuuccagcccccaggg

SEQ ID NO: 84439 - RNA, 41 nt, Mus musculus
cauuucuucucaagucacacugaaggagggguggccuccuu

SEQ ID NO: 84440 - RNA, 46 nt, Mus musculus
aaacaaaaaauaaagcaaugcauuccuccugcccgagucccccacc

SEQ ID NO: 84441 - RNA, 42 nt, Mus musculus
uagagacagggcuacuuucuuccuucuucaauguauccagug

SEQ ID NO: 84442 - RNA, 44 nt, Mus musculus
ggaucacucugugugaaguaacaugagggacagaggcaguaaga

SEQ ID NO: 84443 - RNA, 46 nt, Mus musculus
ugauuauagggugauguaaugaaaggggauuaauguccguggguau

SEQ ID NO: 84444 - RNA, 41 nt, Mus musculus
uuccaugcaggggcaaaggaugaaaaaggagacagcucaga

SEQ ID NO: 84445 - RNA, 46 nt, Mus musculus
auuaauccggggaaugaauucccaaguuauaguuuaggugccagaa

SEQ ID NO: 84446 - RNA, 46 nt, Mus musculus
ugggagcauaggcacagggcaaguguguauaaaucuccucucaggu

SEQ ID NO: 84447 - RNA, 46 nt, Mus musculus
agugaucuuuuguguagccagcccaggaaaagggaagguaugguua

SEQ ID NO: 84448 - RNA, 46 nt, Mus musculus
gacaauaaccgaagcuccccguuuucaucacguugacugaucuuug

SEQ ID NO: 84449 - RNA, 105 nt, Mus musculus
gucauccuccucuuccuccaccucaucugauucaucuucacuguccucaaagaacuuggacuuagcaacucgaggcagcuugucagaggcugaagagcaggaagg

SEQ ID NO: 84450 - RNA, 46 nt, Mus musculus
cuccauguccaucguagacagaaaacauggcugucucauuguccag

SEQ ID NO: 84451 - RNA, 46 nt, Mus musculus
cguccccggagcacuucaccguguugggcugagagagguaggcacc

SEQ ID NO: 84452 - RNA, 46 nt, Mus musculus
ccgcagccugcgcuucagcuccagcucggguuccggggccucggau

SEQ ID NO: 84453 - RNA, 42 nt, Mus musculus
caauucauucgucuauuuugugucgucauugggaacccagua

SEQ ID NO: 84454 - RNA, 46 nt, Mus musculus
ccuccccuguguucaaucagcgcugcaggaagaggaugaggaagau

SEQ ID NO: 84455 - RNA, 45 nt, Mus musculus
uuccucauccucuuccugcagcgcugauugaacacaggggaggac

SEQ ID NO: 84456 - RNA, 41 nt, Mus musculus
ugugaacauagucuucaaaaugcaaaagaggccuagagaga

SEQ ID NO: 84457 - RNA, 46 nt, Mus musculus
aaguggguguauaaaaccauccccacuucucuggugggccugaggu

SEQ ID NO: 84458 - RNA, 42 nt, Mus musculus
gucagugcucuuaccaguugagccaucucaccagcccuacuu

SEQ ID NO: 84459 - RNA, 41 nt, Mus musculus
aagaaaauugcagaccaaagggaaugaaauuguuguguguu

SEQ ID NO: 84460 - RNA, 45 nt, Mus musculus
ugguugugagccaccaugugauugcugggaauugaacucaugacc

SEQ ID NO: 84461 - RNA, 77 nt, Mus musculus
ccagccuuuagacuguaaaaaucccaaugcuccauuccagauccggcacagugacccagagagugacuuuuaccggu

SEQ ID NO: 84462 - RNA, 46 nt, Mus musculus
ggaucuggaauggagcauugggauuuuuacagucuaaaggcuggag

SEQ ID NO: 84463 - RNA, 45 nt, Mus musculus
guuggcugagggcuggugcaggggcgggucauggacuuccaccag

SEQ ID NO: 84464 - RNA, 46 nt, Mus musculus
uaaacgaucuccuaaaggugugugcuuccgucucuggcaacuguag

SEQ ID NO: 84465 - RNA, 46 nt, Mus musculus
ucugaucuacaguugccagagacggaagcacacaccuuuaggagau

SEQ ID NO: 84466 - RNA, 46 nt, Mus musculus
gcgugugugugcgugugugugugugugugugugugugucuuuuauc

SEQ ID NO: 84467 - RNA, 42 nt, Mus musculus
ucuuuacuaacuucauaaaaggaauaaauucgagagcugcag

SEQ ID NO: 84468 - RNA, 45 nt, Mus musculus
aagacucgcagaguuuuaaagaugugaauagcacuagggagucac

SEQ ID NO: 84469 - RNA, 46 nt, Mus musculus
gggaugcgaguuuuguugaggaacgugccguggguacuucccagau

SEQ ID NO: 84470 - RNA, 49 nt, Mus musculus
cggcacguuccucaacaaaacucgcaucccaccccgcacuuacuguaga

SEQ ID NO: 84471 - RNA, 44 nt, Mus musculus
gacuucccacaguuguaaagugugauucuuuuaaaggggugaga

SEQ ID NO: 84472 - RNA, 46 nt, Mus musculus
uuguuguugcugcuguuguuguuguuguuguuguuguuguuguuga

SEQ ID NO: 84473 - RNA, 52 nt, Mus musculus
aacagguuguccuguuguugcuuuguuuggccuggugugugugugugugugu

SEQ ID NO: 84474 - RNA, 42 nt, Mus musculus
aaccggcagcuuuucuuuuucgccuuuuuggcgcccugagag

SEQ ID NO: 84475 - RNA, 42 nt, Mus musculus
uucuugauaauugcuuccagcuuuugcuuuauugggcuugag

SEQ ID NO: 84476 - RNA, 45 nt, Mus musculus
uugguuuuguuacuuuauguugauguaauggagcgcugaagaaga

SEQ ID NO: 84477 - RNA, 42 nt, Mus musculus
ggggaaaugcaaacacagugucagcuauguauggcaaaccag

SEQ ID NO: 84478 - RNA, 45 nt, Mus musculus
gguagggauuagaaauaguucaaauuagcauaacccuaaggaaga

SEQ ID NO: 84479 - RNA, 46 nt, Mus musculus
agagugugucucucugugugugugugugugugugugugucugugug

SEQ ID NO: 84480 - RNA, 44 nt, Mus musculus
agaguuaucguggauagcccuggggcuaaugauauuugauguua

SEQ ID NO: 84481 - RNA, 45 nt, Mus musculus
agguggagagagaaggagaaaauggaagagggagaggaugcagaa

SEQ ID NO: 84482 - RNA, 45 nt, Mus musculus
gaagcacauggccuggagaauccgcaaguuauaaggggucucaua

SEQ ID NO: 84483 - RNA, 46 nt, Mus musculus
uuaugucuagagaccaugcuucuuaaaaacuguagcauaugucagu

SEQ ID NO: 84484 - RNA, 46 nt, Mus musculus
uucuuagaacaacuuuacacacaggaggagaaaaauuuuuggugga

SEQ ID NO: 84485 - RNA, 79 nt, Mus musculus
gucugggcuuccacuucccuucccccagcuucagauuccacagccauuuugguuauguaccuucuagguuuccggacua

SEQ ID NO: 84486 - RNA, 43 nt, Mus musculus
uacuugcucccuuuccccaucccuccucucucauggccccauu

SEQ ID NO: 84487 - RNA, 46 nt, Mus musculus
auauaauacuuaauaaaaaugaaaaauacuuuaaaauggaaaagag

SEQ ID NO: 84488 - RNA, 46 nt, Mus musculus
uaguuugcuuucuauuucugugagaaaacaccaugaccaauagcaa

SEQ ID NO: 84489 - RNA, 46 nt, Mus musculus
caaucauuaauuaaggaaauacaucacaggguugccuacaggccag

SEQ ID NO: 84490 - RNA, 49 nt, Mus musculus
gugggugcuauugaaugaaccaaggugcuaugggagcaaccagugcccu

SEQ ID NO: 84491 - RNA, 46 nt, Mus musculus
aaaaauggaaaaaaaaaacccacuaaagaccacauaaagggcacuc

SEQ ID NO: 84492 - RNA, 46 nt, Mus musculus
uauuuuauucaaaacaugguguuuggacuuuaacaauagcugucug

SEQ ID NO: 84493 - RNA, 46 nt, Mus musculus
ugucauuauuaucauauuaccauauuaccuugcauauuaccagcua

SEQ ID NO: 84494 - RNA, 45 nt, Mus musculus
uuugcuaguguaggcgcuaugaaagccuaagucaugacuccccaa

SEQ ID NO: 84495 - RNA, 46 nt, Mus musculus
gaguccugguguggcgcugagcaucacauaggaagagauacaagag

SEQ ID NO: 84496 - RNA, 45 nt, Mus musculus
cuuucucagucugcuuucuuacacagguaagggccacauacucag

SEQ ID NO: 84497 - RNA, 44 nt, Mus musculus
uauuaaggaaaagugauuguuucuuccuguuaauuuucuuguua

SEQ ID NO: 84498 - RNA, 45 nt, Mus musculus
uguuuugauuauuaugugucgguaggaauuucuuuucuggucgag

SEQ ID NO: 84499 - RNA, 45 nt, Mus musculus
uuuaauuuuuuuugccuauauuaguaggucuuacaacuucaagau

SEQ ID NO: 84500 - RNA, 42 nt, Mus musculus
cucaagaccuucagaagaacagucugugcucuuaaccgcuga

SEQ ID NO: 84501 - RNA, 46 nt, Mus musculus
uaaaguuuagaauauaaagagaauuuugguuucuuuaaaaaccuag

SEQ ID NO: 84502 - RNA, 46 nt, Mus musculus
uaaguucacaaaguuaaaugcugugggggaaagaaugagcugugag

SEQ ID NO: 84503 - RNA, 67 nt, Mus musculus
aagauacaucagaaagauaaaauacaagaauagacaugaaaaagccaggagagggaaguuguauaua

SEQ ID NO: 84504 - RNA, 70 nt, Mus musculus
caaggauuuuggaaugaucuagacaguacgugaucaguaguagccaagggaaguaguaauuaauuaguug

SEQ ID NO: 84505 - RNA, 48 nt, Mus musculus
uuagcugcacuagggucaaggugaggcauaacauuaugucauggagca

SEQ ID NO: 84506 - RNA, 46 nt, Mus musculus
ugcaggguacauccacacuaauacaauacaacuaaaaaagacccac

SEQ ID NO: 84507 - RNA, 47 nt, Mus musculus
gucaggggugguaguggaagaaaaugcuuccauaagauugggcugua

SEQ ID NO: 84508 - RNA, 45 nt, Mus musculus
aaauuagagcugggcgugguggcacacgccuuuaaucccagcacu

SEQ ID NO: 84509 - RNA, 69 nt, Mus musculus
gaugauuaaucugacuaaggaaaaggggacaugaagaaacguauuuauauucacuauauggaccaagag

SEQ ID NO: 84510 - RNA, 53 nt, Mus musculus
aauaguaagaguaguaggugggcagaugaagguugugcggcucuagaagcuag

SEQ ID NO: 84511 - RNA, 46 nt, Mus musculus
ccaaagugauaaucaaaaaggauaauuuaaaguuuguauuggcugg

SEQ ID NO: 84512 - RNA, 46 nt, Mus musculus
uuucuuucuguuauuuugugcuguuuucuuaaaacaucuuuugcag

SEQ ID NO: 84513 - RNA, 45 nt, Mus musculus
auacacaccggaaaaucuuacagagccuguaagcccaagugccag

SEQ ID NO: 84514 - RNA, 91 nt, Mus musculus
cucaguggugucaaguucauauccuacagguuuaacaggugagauuuaaauggauaguugcagaaaauauaaccuuggccuuuacauacuu

SEQ ID NO: 84515 - RNA, 45 nt, Mus musculus
uucccaaaaugugugugagcaaauaaguucucuaacaaagggcag

SEQ ID NO: 84516 - RNA, 56 nt, Mus musculus
guagaacuggaaaucaaaagcaaggccucuaccauaacaugcuaguuaccauaacg

SEQ ID NO: 84517 - RNA, 81 nt, Mus musculus
aagaugauuggugaaggcccuguaguuggcauagaaagccaccuuaggaagaaaucucuugaauugauauuugauugauag

SEQ ID NO: 84518 - RNA, 42 nt, Mus musculus
uagaaguauagcucacugauagacuaacuuugcauguaggag

SEQ ID NO: 84519 - RNA, 45 nt, Mus musculus
agaccuuuccuuuaagaagggugaacgauuucaaauaauuaacaa

SEQ ID NO: 84520 - RNA, 46 nt, Mus musculus
cuauuuugcaagucauacucauggaguuagucuguaaacaauugag

SEQ ID NO: 84521 - RNA, 42 nt, Mus musculus
acuaauucuuuuucuggaaugacuuuuccuuucuuuuuggug

SEQ ID NO: 84522 - RNA, 45 nt, Mus musculus
gggauacuggguaguucauauuguuguuccgccuauaggguugca

SEQ ID NO: 84523 - RNA, 45 nt, Mus musculus
ugaguuucauguguuuagcaaauuagaaauuuuggaaaagccaag

SEQ ID NO: 84524 - RNA, 46 nt, Mus musculus
uccaucuccugggugcuggaucauaggcuuaugucaccaccacuag

SEQ ID NO: 84525 - RNA, 45 nt, Mus musculus
acaccaugaccaaggcaagucaugguguccaaaggcugcuagugg

SEQ ID NO: 84526 - RNA, 42 nt, Mus musculus
cuucacagugccaagccucaaauucuuugcaagacccccuaa

SEQ ID NO: 84527 - RNA, 46 nt, Mus musculus
ucuggaacacagcuucuaugugcucgcagaaaacacuucccagaag

SEQ ID NO: 84528 - RNA, 46 nt, Mus musculus
agcaugccugucuuuugggauuaaagguguguaccaccaugccugg

SEQ ID NO: 84529 - RNA, 43 nt, Mus musculus
gggaaggagacuggugggaagcaagaucaauugcuaccggaaa

SEQ ID NO: 84530 - RNA, 32 nt, Mus musculus
uagaugguauuuuggcaaaauggggagaaaag

SEQ ID NO: 84531 - RNA, 47 nt, Mus musculus
ccgugauugggaugaggugaggggugacaaugugaagcauuacaaga

SEQ ID NO: 84532 - RNA, 89 nt, Mus musculus
cuggcaaaagaugcuugggaaaucccucgagaaucauugcgacuagaggugaaacuaggucaaggaugcuuuggggaaguguggauggg

SEQ ID NO: 84533 - RNA, 67 nt, Mus musculus
gaauggaacuacaaaaguagcaaucaaaacacuaaagccagguacaaugaugccagaagcauuccuu

SEQ ID NO: 84534 - RNA, 46 nt, Mus musculus
agcuuauugccuccugugcuuugucauuauauugcuucacgugcag

SEQ ID NO: 84535 - RNA, 81 nt, Mus musculus
aggaagcuuguuagauuuccuuaaagaaggagauggaaaguauuugaagcuuccacagcugguugauauggcugcucaggu

SEQ ID NO: 84536 - RNA, 41 nt, Mus musculus
uacagagaaacugucuugaaaaaccaaacaaaaagaagaaa

SEQ ID NO: 84537 - RNA, 45 nt, Mus musculus
aaagaaaaggaaggaaggaaggaaggaaggaaggaaggaaggcag

SEQ ID NO: 84538 - RNA, 44 nt, Mus musculus
ugcgccaccacacccaguuuuguugcucuuguucuuguugcaga

SEQ ID NO: 84539 - RNA, 57 nt, Mus musculus
cugauggcauggcguauauugaaagaaugaacuauauucaccgagaucuccgagcug

SEQ ID NO: 84540 - RNA, 86 nt, Mus musculus
cuaauauucuuguaggagaaaaucuuauaugcaaaauagcagauuuuggcuuagcaagauuaauugaagacaaugaauacacggca

SEQ ID NO: 84541 - RNA, 46 nt, Mus musculus
uaaguacacuguagcugucuucagacgcaccagaagagggaaucag

SEQ ID NO: 84542 - RNA, 48 nt, Mus musculus
aauaaagucagauguguggucauuuggaauucuacagacagagcuggu

SEQ ID NO: 84543 - RNA, 23 nt, Mus musculus
cucugaagguagccuaguaguug

SEQ ID NO: 84544 - RNA, 46 nt, Mus musculus
accuaccaucuucuuugaaguggaguggggguacugucaggagcag

SEQ ID NO: 84545 - RNA, 46 nt, Mus musculus
ggguccccagggcagggagcauacagaccuggcaaggaagcaguag

SEQ ID NO: 84546 - RNA, 48 nt, Mus musculus
aguaccaaugaugcaucuuacagcauacuucaggguccagagaaagua

SEQ ID NO: 84547 - RNA, 46 nt, Mus musculus
cacuuuguccagagaacuggaaagcaaaacaaauuuuucauaucag

SEQ ID NO: 84548 - RNA, 45 nt, Mus musculus
uuuuaaaggguuauauacaauugaaauuauucuauccaguccaag

SEQ ID NO: 84549 - RNA, 50 nt, Mus musculus
cuagaucagggacuugaaugcacuuugcuuauauugaguauagaauagga

SEQ ID NO: 84550 - RNA, 46 nt, Mus musculus
aaagcugccgccacgugccucaccuucuuucugauacaccccagau

SEQ ID NO: 84551 - RNA, 42 nt, Mus musculus
cucuaguuucugcagagacaagcugcccaacuccuggcacag

SEQ ID NO: 84552 - RNA, 45 nt, Mus musculus
gggacaaagacaguguuaaagacugaacuagauguggggcugaga

SEQ ID NO: 84553 - RNA, 44 nt, Mus musculus
uaucaagaccccaacaaagacuugaaauucacuucacauuaauu

SEQ ID NO: 84554 - RNA, 41 nt, Mus musculus
ccuuuuccucuucacagucccugaauauauuaacuaucuca

SEQ ID NO: 84555 - RNA, 46 nt, Mus musculus
cauguggguugggaucccucccagaagugaagacugguggcuggag

SEQ ID NO: 84556 - RNA, 42 nt, Mus musculus
cuccccaucuucuccuuucucuaucauacugcucugccccac

SEQ ID NO: 84557 - RNA, 46 nt, Mus musculus
ucuggguagucuauugguaccuuuacuguuucuccacaaucaggaa

SEQ ID NO: 84558 - RNA, 41 nt, Mus musculus
ggaguauucagcagaugaugucagaaagcucaaagcaggua

SEQ ID NO: 84559 - RNA, 46 nt, Mus musculus
uguggaaaucaguauaaugcacauauuauuggaauaaaggacagag

SEQ ID NO: 84560 - RNA, 46 nt, Mus musculus
uccuaucaaaucuaucuucuuucaacaagucccccuagucccccua

SEQ ID NO: 84561 - RNA, 46 nt, Mus musculus
ucaaaucccaucaaccacaugguggcucacagccauccguaaugag

SEQ ID NO: 84562 - RNA, 46 nt, Mus musculus
gcuguggacucuguggucagccuauuggauggugugguggagaagc

SEQ ID NO: 84563 - RNA, 47 nt, Mus musculus
ccaagacuuggaaagugguuccaaagagauuguguagaauacagugu

SEQ ID NO: 84564 - RNA, 45 nt, Mus musculus
auuagagaucauggacuucugaugugguugcccagagaaggguag

SEQ ID NO: 84565 - RNA, 46 nt, Mus musculus
ccucaacaauagccaaggaaagggcagaaagugaugguuugggagg

SEQ ID NO: 84566 - RNA, 42 nt, Mus musculus
gugucugcuaugacuuaggcaguagaguccauccaggccgag

SEQ ID NO: 84567 - RNA, 44 nt, Mus musculus
cagccagcagcagccagcauguggaagcggaagcgcauggaccg

SEQ ID NO: 84568 - RNA, 45 nt, Mus musculus
gaccuugugaauaucgagauguuccugacagccaaagaaguggag

SEQ ID NO: 84569 - RNA, 24 nt, Mus musculus
cagaggcagcuagaugggaaagga

SEQ ID NO: 84570 - RNA, 46 nt, Mus musculus
cuggugggaaggagagcuaagagggaaguagaggcugaccaugguc

SEQ ID NO: 84571 - RNA, 41 nt, Mus musculus
ggugcaggucuguugcuuucagccccuguugucuggcccgu

SEQ ID NO: 84572 - RNA, 45 nt, Mus musculus
auauaacuuugugaugugggacaucuuguauggaaauaucaucag

SEQ ID NO: 84573 - RNA, 46 nt, Mus musculus
gcuagcaggguaacaggcuuagcccaucaaguccugucagugacag

SEQ ID NO: 84574 - RNA, 52 nt, Mus musculus
aaagacaagaaaggcugaccucuccuuguuuauauuuggccuacuauaccau

SEQ ID NO: 84575 - RNA, 42 nt, Mus musculus
ucugcuuucuauucgucaagaugauaaaguuguuugcccaag

SEQ ID NO: 84576 - RNA, 45 nt, Mus musculus
accccagaccccagccugcaucgacauuuguuucuugcgaccaaa

SEQ ID NO: 84577 - RNA, 36 nt, Mus musculus
aagaggaagugagauuuaauaagucugugcuugaga

SEQ ID NO: 84578 - RNA, 29 nt, Mus musculus
ugguccugaucuggagaugcugugaacac

SEQ ID NO: 84579 - RNA, 46 nt, Mus musculus
ggaagagcccggccauggucacucucaucacagagaagcugcagaa

SEQ ID NO: 84580 - RNA, 42 nt, Mus musculus
auugcuagaggcuucaggaaggaacauacuugguuaucuuag

SEQ ID NO: 84581 - RNA, 23 nt, Mus musculus
ucagaacaccugccccucucucc

SEQ ID NO: 84582 - RNA, 45 nt, Mus musculus
ccacaggcuuacuggcaaaacaguuuuggugaauguauugcagag

SEQ ID NO: 84583 - RNA, 46 nt, Mus musculus
gacugugagccagaauccugaacucauucauagagucuggggaggg

SEQ ID NO: 84584 - RNA, 46 nt, Mus musculus
caguuugauaacccaacuugaagcuccagaacccccagugugggaa

SEQ ID NO: 84585 - RNA, 45 nt, Mus musculus
auguggaugggcucuaaaaagaagaacaguggcaaccggaaagau

SEQ ID NO: 84586 - RNA, 45 nt, Mus musculus
gagaugaggacgcacugggagggaggccaggcacacagggugcuu

SEQ ID NO: 84587 - RNA, 45 nt, Mus musculus
uccuuuuuuucuuuuccuccugguacuagggagugaaacccagau

SEQ ID NO: 84588 - RNA, 44 nt, Mus musculus
aggggaagaccuuguucuucugggaagguuauuucucuuguaga

SEQ ID NO: 84589 - RNA, 87 nt, Mus musculus
gucugucuggugcaagaaagggaggcauguccucacauuaggaaggaaggacagagucaugucauuuugugauugaauggaaggaga

SEQ ID NO: 84590 - RNA, 54 nt, Mus musculus
ggcaggaggaaggcugcccuuaacgugguaggagggagaaggcuuugccuugug

SEQ ID NO: 84591 - RNA, 45 nt, Mus musculus
ugauugugugucuucaucacgugcaugcuugguguccuuggagga

SEQ ID NO: 84592 - RNA, 46 nt, Mus musculus
uuuuccaaauucugaauauuacgccaagguggaaauugaaauugau

SEQ ID NO: 84593 - RNA, 46 nt, Mus musculus
cgcuguuguugagacucagugauuguuauuuuguauucaggaagca

SEQ ID NO: 84594 - RNA, 51 nt, Mus musculus
caaccuugaauggauucgacugacuacuaccaaguggaaccgaucaugcua

SEQ ID NO: 84595 - RNA, 31 nt, Mus musculus
ucagcgggaagcccgagaaacacaggagagu

SEQ ID NO: 84596 - RNA, 45 nt, Mus musculus
aagaauagcauuuaaaguggaaaaucguguuuggaaaacuguaau

SEQ ID NO: 84597 - RNA, 46 nt, Mus musculus
ucuuucugcaguggcguccucgaaggugguauuggaguccgguucc

SEQ ID NO: 84598 - RNA, 46 nt, Mus musculus
ucauagcggugcuaggugcuucugaggccauacugaacggcaauag

SEQ ID NO: 84599 - RNA, 46 nt, Mus musculus
aaaauccuguguucuaggaguuaacagagugggaccuuggggcaag

SEQ ID NO: 84600 - RNA, 46 nt, Mus musculus
uggacuugguaauguguaagaauuacccaggugguacugguuuuga

SEQ ID NO: 84601 - RNA, 44 nt, Mus musculus
aguguauggauacaucaacuugucaauaaaaacucuggcuuaua

SEQ ID NO: 84602 - RNA, 44 nt, Mus musculus
uccgcuuuagcugaaaaugcuugacugguggggugaggggccca

SEQ ID NO: 84603 - RNA, 45 nt, Mus musculus
uccuaagaugucuugaacauugggguucuguuccucaagguccag

SEQ ID NO: 84604 - RNA, 46 nt, Mus musculus
uaucaauuaucuagaauacaagaaaauuuaaccacagaaaguacag

SEQ ID NO: 84605 - RNA, 36 nt, Mus musculus
agcuggcagcuagagcugggaaugaacaaccaggca

SEQ ID NO: 84606 - RNA, 41 nt, Mus musculus
uagccagugacugaguaggagagagaaggaagggaagggag

SEQ ID NO: 84607 - RNA, 46 nt, Mus musculus
uaucuugcaggaaauuggucagaaggauuugacgagacucucgagu

SEQ ID NO: 84608 - RNA, 46 nt, Mus musculus
gcaccuuccaugggcauuaauccucacagaaugugacccccuagau

SEQ ID NO: 84609 - RNA, 41 nt, Mus musculus
auccgagaaagugagagaauggggaaaggacgcccagggag

SEQ ID NO: 84610 - RNA, 45 nt, Mus musculus
cugagaggaauguuuggccuugauuucucucaucucucuccucaa

SEQ ID NO: 84611 - RNA, 46 nt, Mus musculus
gguggcucacaaccaucuguaaugggaucugaugucaugucugaag

SEQ ID NO: 84612 - RNA, 45 nt, Mus musculus
aguucaaaucccagcaaccacaugguggcucacaaccauaaugag

SEQ ID NO: 84613 - RNA, 42 nt, Mus musculus
guggaggcuugcuugaacgggucuccucagcggcggcuggag

SEQ ID NO: 84614 - RNA, 37 nt, Mus musculus
cgguugucggaacauggagcggcgccgucgucggaag

SEQ ID NO: 84615 - RNA, 42 nt, Mus musculus
caaaaaaaaaaccacagaagccagugaagccucuggucccag

SEQ ID NO: 84616 - RNA, 45 nt, Mus musculus
cuagugccaucuccuaucuaucacuacuaugcuccccgccaugau

SEQ ID NO: 84617 - RNA, 39 nt, Mus musculus
ucuuggaggguauaguuucugcaugaagacaguuuccag

SEQ ID NO: 84618 - RNA, 46 nt, Mus musculus
ucaccagaaaacagcaaggcuuucucagcauuucuuguaggcugag

SEQ ID NO: 84619 - RNA, 46 nt, Mus musculus
uuuuuuuauaucuuauucuucugaaugaccaaauaaagcagcuauu

SEQ ID NO: 84620 - RNA, 46 nt, Mus musculus
uggcugacuggggcccaggucugcuucacugugugcucggcccucu

SEQ ID NO: 84621 - RNA, 42 nt, Mus musculus
cucacaggagcugccucugauuaccuggggaggcgcccagug

SEQ ID NO: 84622 - RNA, 42 nt, Mus musculus
gcuccuggcagcgugggguagacugguuugcuucagccaucg

SEQ ID NO: 84623 - RNA, 41 nt, Mus musculus
cugccucugcugccugggcugcuggagagacacggccgcga

SEQ ID NO: 84624 - RNA, 27 nt, Mus musculus
augcggauaacugaugaugaggguggg

SEQ ID NO: 84625 - RNA, 42 nt, Mus musculus
caaucugcaagaugcuucgacaggagggcuugauggggccug

SEQ ID NO: 84626 - RNA, 46 nt, Mus musculus
gcuggggaguugguaggcagaguuggccagaggucugagcaggcag

SEQ ID NO: 84627 - RNA, 41 nt, Mus musculus
aaugugagauuauuucaucccugcauggguagcaugaguca

SEQ ID NO: 84628 - RNA, 46 nt, Mus musculus
aaaggugccugcuucaucucugcggucauagaccuguggccaugga

SEQ ID NO: 84629 - RNA, 47 nt, Mus musculus
ccucacugucaucuucucccucuuucuggucauucucuugcccaucu

SEQ ID NO: 84630 - RNA, 44 nt, Mus musculus
uaaaggagaguugaagauugggcagagagagggaagaugagaug

SEQ ID NO: 84631 - RNA, 46 nt, Mus musculus
agaagcaccuggccuggagaaacugcaaguucuaaggggucucaua

SEQ ID NO: 84632 - RNA, 48 nt, Mus musculus
cuccuccuuugcuaguuccucuucuguuuucauccuguuagagggcug

SEQ ID NO: 84633 - RNA, 46 nt, Mus musculus
acccaccucauaugaaacgcgucgacaugaacuaaaggaccagaag

SEQ ID NO: 84634 - RNA, 30 nt, Mus musculus
accuuccugauggcacgagcgcgggacacc

SEQ ID NO: 84635 - RNA, 46 nt, Mus musculus
uaaugcuuuuaggaggucucggcgggagugcugagggcgggggagu

SEQ ID NO: 84636 - RNA, 46 nt, Mus musculus
gacccucuaggucccuggucuucgaggaacgggauuucuuaggcag

SEQ ID NO: 84637 - RNA, 46 nt, Mus musculus
gauuagugaugucauguuuuugcuggaugaaaugagugacgguaag

SEQ ID NO: 84638 - RNA, 46 nt, Mus musculus
uaucaguuacugcauuuaucuccaaauagagaacguagcaaugaaa

SEQ ID NO: 84639 - RNA, 45 nt, Mus musculus
auugaacuguauugacaucuuuguugaaaauuauuaccuguccau

SEQ ID NO: 84640 - RNA, 46 nt, Mus musculus
ccuuuccuuuauuagcccugggugugauuuucuucucugcugauag

SEQ ID NO: 84641 - RNA, 46 nt, Mus musculus
gaauuuaaccacagugccuauucaguuuugaauaucacaugacuag

SEQ ID NO: 84642 - RNA, 41 nt, Mus musculus
ucccaggaaccacgugguggcucacaaccaucuguaauggg

SEQ ID NO: 84643 - RNA, 45 nt, Mus musculus
aacucacaucugacuagcaguuugcaggcagggagagaaagagag

SEQ ID NO: 84644 - RNA, 44 nt, Mus musculus
agauugguauugucuauaagucauaguuugauaagcuugacuaa

SEQ ID NO: 84645 - RNA, 46 nt, Mus musculus
cauauucuuuguugccaccuuuauccuaugggguuaucucaugaag

SEQ ID NO: 84646 - RNA, 69 nt, Mus musculus
cuacacaaagaaaccuuuaacucauaaaaaacagaaaacaaagaagaagaagaagaagaagaagaagaa

SEQ ID NO: 84647 - RNA, 44 nt, Mus musculus
aaggaaggaagaaggaaggaagaaggaaggaagaagaaggaaga

SEQ ID NO: 84648 - RNA, 41 nt, Mus musculus
ucacaaccaucuguaaugagaucugaugcccucuucugugg

SEQ ID NO: 84649 - RNA, 46 nt, Mus musculus
guuuucucaacuaaacuuacuaaaauacuuuacaaauaguacccag

SEQ ID NO: 84650 - RNA, 41 nt, Mus musculus
cagguuagguuaauuggagguagcaugaccugaauggggag

SEQ ID NO: 84651 - RNA, 46 nt, Mus musculus
uacuuacuggaugaaugacaacugucccugaucccaucagcagcag

SEQ ID NO: 84652 - RNA, 48 nt, Mus musculus
uuaaaucaagaucauguaaacuaucuaaacaguccuauauccccuaaa

SEQ ID NO: 84653 - RNA, 46 nt, Mus musculus
gacaucccuaaaaauuccuuugguaugcagaucacuuuuuccucag

SEQ ID NO: 84654 - RNA, 46 nt, Mus musculus
ucuuacguguguguuuauuucuauuagcacuuuuauuggucugaau

SEQ ID NO: 84655 - RNA, 45 nt, Mus musculus
aaugugcuaugaagucaacaguuaguuaggcuaaguguggaaaua

SEQ ID NO: 84656 - RNA, 46 nt, Mus musculus
uuugccagucaggauuuaggggcaugcauaugcauacagguugcgu

SEQ ID NO: 84657 - RNA, 45 nt, Mus musculus
ugcuccuagguuuaugaacugacuuugcaucauacucagcaccaa

SEQ ID NO: 84658 - RNA, 46 nt, Mus musculus
ucacucugguucaagaagaggcccggggccgaggccgcagcgggag

SEQ ID NO: 84659 - RNA, 46 nt, Mus musculus
uacuauuuccugaaucuccugaugauuuuuuauuuagacuggugau

SEQ ID NO: 84660 - RNA, 46 nt, Mus musculus
acaucuuuaucuuuucuuguuuguuuguuuguuuuuguuuguccag

SEQ ID NO: 84661 - RNA, 41 nt, Mus musculus
augguguauaugugugugugugugugugugugugucagagu

SEQ ID NO: 84662 - RNA, 46 nt, Mus musculus
uggaaaauucuaaauacacauuuuuuuaaccauuaaaugcccccac

SEQ ID NO: 84663 - RNA, 42 nt, Mus musculus
ccgugugagaugugugaaauuggugagagaacuguuggggau

SEQ ID NO: 84664 - RNA, 48 nt, Mus musculus
ugugaauguguaugaagggaguaguuaugugcugaguauuuuuaggug

SEQ ID NO: 84665 - RNA, 41 nt, Mus musculus
ccuguaacuguaacugacuccaaaaaccuuccaugccccug

SEQ ID NO: 84666 - RNA, 45 nt, Mus musculus
cucuccccuucuuguaaggaagaacuccgcauuauuauuaaagag

SEQ ID NO: 84667 - RNA, 61 nt, Mus musculus
aucuccccuccuaccucaaacugcaugauguccugaaagccacucacgccaacuauaaggu

SEQ ID NO: 84668 - RNA, 45 nt, Mus musculus
uguccauguacccauguucaugcuuacauagaaagaagcccugua

SEQ ID NO: 84669 - RNA, 37 nt, Mus musculus
gcagguuucaugugccuucucccucuaucagccuuaa

SEQ ID NO: 84670 - RNA, 42 nt, Mus musculus
uggguuuacauucuuuuuuuuuccccaugauuaucccagcau

SEQ ID NO: 84671 - RNA, 46 nt, Mus musculus
acauacugaggcugauuccagugcaccccagaccuagaccuguuag

SEQ ID NO: 84672 - RNA, 46 nt, Mus musculus
gaaguaaaagauuuccaggaagguugaggaguagggagaagcagag

SEQ ID NO: 84673 - RNA, 45 nt, Mus musculus
cauuuaaaagacaggucaaaacauaaauauaaguauaauaaggag

SEQ ID NO: 84674 - RNA, 42 nt, Mus musculus
cuuuguucuguaugucuaguguuuugauuauuauguggccag

SEQ ID NO: 84675 - RNA, 56 nt, Mus musculus
aguaugccugauguuguuggaagcugggauguagugaagaguagcagaaggagguc

SEQ ID NO: 84676 - RNA, 46 nt, Mus musculus
caguaaccgugugcucucuccuuccaccuugccaaggucaccuuag

SEQ ID NO: 84677 - RNA, 46 nt, Mus musculus
aaaguuugggggguuccugcgcucugccuuggacguccuuucucag

SEQ ID NO: 84678 - RNA, 42 nt, Mus musculus
guguguugaagagguccuuggauaccugaaauccugcuuuag

SEQ ID NO: 84679 - RNA, 45 nt, Mus musculus
gacaaacuuagccucacaguuugauggcuuaucuuccaaccccag

SEQ ID NO: 84680 - RNA, 45 nt, Mus musculus
cccggcuuauaucacuacugcuucauggcaccauacacgcacuuc

SEQ ID NO: 84681 - RNA, 46 nt, Mus musculus
ucugauuuuuuugaacaugaaguugaauugauguauggcugaguag

SEQ ID NO: 84682 - RNA, 46 nt, Mus musculus
cuccccucagggagcacugcugaagagggggauggaaaaaagagag

SEQ ID NO: 84683 - RNA, 45 nt, Mus musculus
uacagauaccuuaugcaggucuacagugaaaaagagcaauuagga

SEQ ID NO: 84684 - RNA, 23 nt, Mus musculus
aaauuacaguucuuagcaaguag

SEQ ID NO: 84685 - RNA, 23 nt, Mus musculus
uacgggugggacuaaaugagguc

SEQ ID NO: 84686 - RNA, 46 nt, Mus musculus
cuguuacgacucauccaguaccaucagguaagaggaaagcacaggg

SEQ ID NO: 84687 - RNA, 45 nt, Mus musculus
ucccgagugcugagacugaaaccauacaccaacgugccuggccag

SEQ ID NO: 84688 - RNA, 45 nt, Mus musculus
cuauuaaaguauauacaauaucagaggauaguaguuuugauggca

SEQ ID NO: 84689 - RNA, 42 nt, Mus musculus
cugggauugcagcaugacauuuggauacaagcuagucccagg

SEQ ID NO: 84690 - RNA, 45 nt, Mus musculus
cuucagcuccuuggguacuuucucucgcuccuccauuggggcccu

SEQ ID NO: 84691 - RNA, 48 nt, Mus musculus
uugaaagugguaugauuaccauuucacauuuaaagaagguaauagaga

SEQ ID NO: 84692 - RNA, 46 nt, Mus musculus
aucaaccuuuggaguuggaagaacaaacuagagaaauggaguugag

SEQ ID NO: 84693 - RNA, 45 nt, Mus musculus
uuuccauucuuuauaaagcuuuguaaaauucaggcugcauauuaa

SEQ ID NO: 84694 - RNA, 25 nt, Mus musculus
guuaugaguaaauguguucugggua

SEQ ID NO: 84695 - RNA, 46 nt, Mus musculus
caugacucagaacacuuaacauggcucauugugaaucacauucaag

SEQ ID NO: 84696 - RNA, 46 nt, Mus musculus
ucuuaguuaggguuucuguugcuaugauauaacacuaugaccaaaa

SEQ ID NO: 84697 - RNA, 42 nt, Mus musculus
gagccucugugaaagggcacaggcucuggacaaaucagagua

SEQ ID NO: 84698 - RNA, 25 nt, Mus musculus
cauauagguggguuggggaugugcu

SEQ ID NO: 84699 - RNA, 57 nt, Mus musculus
cacuccguguggcugggaaauaacaucacaccccugagagaggaggaaugggaugag

SEQ ID NO: 84700 - RNA, 46 nt, Mus musculus
ccgccuacuggagagcacacugaggagcagccaccugcccagccag

SEQ ID NO: 84701 - RNA, 46 nt, Mus musculus
gagcuauacagaaaaacccugucucgaaaaaccaaaaagaaagaaa

SEQ ID NO: 84702 - RNA, 44 nt, Mus musculus
cacaguuguguggcauuaguggaauaaucauaggucagcggucu

SEQ ID NO: 84703 - RNA, 46 nt, Mus musculus
uguugacagggacacgaaacagaaggucuaaccauuugccagccag

SEQ ID NO: 84704 - RNA, 25 nt, Mus musculus
ccgggcggggcugggcccggcgcgg

SEQ ID NO: 84705 - RNA, 42 nt, Mus musculus
uaggucccaugauauuaaggugggugaauagaggccccagaa

SEQ ID NO: 84706 - RNA, 48 nt, Mus musculus
aaagaaaacucaauccaaaucuagauguaaaggcgcugugguugucaa

SEQ ID NO: 84707 - RNA, 44 nt, Mus musculus
uggcuuacuggggcaaggggggaagaagacuccccauuuguagc

SEQ ID NO: 84708 - RNA, 57 nt, Mus musculus
aggacuugggucauugugagccaaagacagauccacccucugcagacaagacccucc

SEQ ID NO: 84709 - RNA, 45 nt, Mus musculus
ugagcugggacucaggaagggaaccaguaaauucuauguauagga

SEQ ID NO: 84710 - RNA, 42 nt, Mus musculus
aguugucuuagagccuugcuccaagacugccugaaaacugag

SEQ ID NO: 84711 - RNA, 96 nt, Mus musculus
aauggcuuucuuacacauguugguacauaauuccucccgcccccuuaggaaaaauacaaacgugcuuuggcagauacugagaaucuacggcagaga

SEQ ID NO: 84712 - RNA, 44 nt, Mus musculus
cuugcuggagguugcagacauccuggagaaggcaacccagagug

SEQ ID NO: 84713 - RNA, 46 nt, Mus musculus
cuuagcucccucccucaggcucuggacuuuguaggucacuugcuag

SEQ ID NO: 84714 - RNA, 42 nt, Mus musculus
aaagaauucaauuuguuuaaaagagcaacaauguugggggag

SEQ ID NO: 84715 - RNA, 45 nt, Mus musculus
ucuaucuccacaucaucaucgucauaguucacagacagcccacug

SEQ ID NO: 84716 - RNA, 46 nt, Mus musculus
uuuggaaaugagccugucguucauguuuuuaguagugggguaagaa

SEQ ID NO: 84717 - RNA, 46 nt, Mus musculus
gauaguaaauuguuuuguauuauauucaauuuucuaugguguagac

SEQ ID NO: 84718 - RNA, 45 nt, Mus musculus
ccuuguuaagauuuauauauuuauaugaucaaaagugcccaagaa

SEQ ID NO: 84719 - RNA, 42 nt, Mus musculus
ggaccuggggaagccaacugaauuaauuuaucggugcaauac

SEQ ID NO: 84720 - RNA, 41 nt, Mus musculus
cacgaaggccuccagcuugucgauccggccguagaugcgcc

SEQ ID NO: 84721 - RNA, 42 nt, Mus musculus
cccgcgcugggcagcaggcuggaggcguagcccgaggcggcg

SEQ ID NO: 84722 - RNA, 48 nt, Mus musculus
ggaacaagcugcgcaucagacagcuguguggcagaaaguggccauggg

SEQ ID NO: 84723 - RNA, 67 nt, Mus musculus
ccuaaggaaauccggaccuucuucauuaaauuccagcagugacaucaaugcauuggccccagggaca

SEQ ID NO: 84724 - RNA, 46 nt, Mus musculus
caaggcuggagcucacagccccagcaggacuugaauagagcuagug

SEQ ID NO: 84725 - RNA, 46 nt, Mus musculus
ucauucagcugugggccauggggcuauccugaaggaaggcugagau

SEQ ID NO: 84726 - RNA, 46 nt, Mus musculus
ucaaucuccuaggggucucucucuccauccaaucaagcugucaauc

SEQ ID NO: 84727 - RNA, 45 nt, Mus musculus
cggaggcccuacaaggcuuucaagagcaaucccaucccccgggua

SEQ ID NO: 84728 - RNA, 45 nt, Mus musculus
gauggaaaugguggcaggcacacugguaacggacauaaggcagua

SEQ ID NO: 84729 - RNA, 46 nt, Mus musculus
ugcccgugaugaaugacugcuauauucugcuguucgaccaggacac

SEQ ID NO: 84730 - RNA, 45 nt, Mus musculus
uuuuuaauggcgaguauaucugugaguacaucuguguguggguga

SEQ ID NO: 84731 - RNA, 46 nt, Mus musculus
ccacaguucuccuggcacguggacccuuucggugcaucagcaacga

SEQ ID NO: 84732 - RNA, 46 nt, Mus musculus
gccaagucaugcaugaugaggcugugacccaccuggaugaccagau

SEQ ID NO: 84733 - RNA, 34 nt, Mus musculus
gggaacaggguuuaguucuggagagugaguauaa

SEQ ID NO: 84734 - RNA, 45 nt, Mus musculus
acccccaccuaugaggaaacugaguuuaggggagggguuggugaa

SEQ ID NO: 84735 - RNA, 42 nt, Mus musculus
uucauaacacucaacgacccaagugcuguguagauacugcag

SEQ ID NO: 84736 - RNA, 44 nt, Mus musculus
ugguguucuuuuucauccuuuaugcuuccgcuuuuguuccuuua

SEQ ID NO: 84737 - RNA, 46 nt, Mus musculus
agucugccugucuuuuuaaagacacacacacacacacacacacaau

SEQ ID NO: 84738 - RNA, 41 nt, Mus musculus
gagcuuuauuguagaaaggcagagagaaagagagaggguaa

SEQ ID NO: 84739 - RNA, 46 nt, Mus musculus
agaaaaugggaagcaaauguuggcaaagcuugcuucuagaggggga

SEQ ID NO: 84740 - RNA, 45 nt, Mus musculus
gcagaacagaagugaagugcccagaagaugagauuuuacuugcag

SEQ ID NO: 84741 - RNA, 36 nt, Mus musculus
agcuuuaccucccuggcucaugacuuagcacuggag

SEQ ID NO: 84742 - RNA, 46 nt, Mus musculus
agaagcaagcauuuauguuuguuuuuaacuuccucuuccaacucuu

SEQ ID NO: 84743 - RNA, 24 nt, Mus musculus
ggcaggcagcagaggggaagggaa

SEQ ID NO: 84744 - RNA, 41 nt, Mus musculus
aguuacuuauuagcccugcuuuccuccuugguguaggugaa

SEQ ID NO: 84745 - RNA, 42 nt, Mus musculus
gagccuggcaucguguguguucauuuuucaguaacugggugg

SEQ ID NO: 84746 - RNA, 46 nt, Mus musculus
ugagcugcagcugcuuaguucuaaacuaggcguugauggaguguaa

SEQ ID NO: 84747 - RNA, 24 nt, Mus musculus
uuuaguuuucuuugaaaauauuua

SEQ ID NO: 84748 - RNA, 41 nt, Mus musculus
ccucuuucacaagagcagggcauaugaugacugugcaugga

SEQ ID NO: 84749 - RNA, 46 nt, Mus musculus
uuuaaucuugaacaaugcuugcuucuuucagaggcaaauuaugcag

SEQ ID NO: 84750 - RNA, 44 nt, Mus musculus
acauugggaagcugagagauuuucuccuggagcacaggaaggag

SEQ ID NO: 84751 - RNA, 42 nt, Mus musculus
gguuguagaccauugccagccuuucagcuuuacagccccccu

SEQ ID NO: 84752 - RNA, 45 nt, Mus musculus
aacagccuuuguucuuagaagccuuuggaaggcuuggcaggaucc

SEQ ID NO: 84753 - RNA, 102 nt, Mus musculus
uucuggguaauguucugaagguaauaccuacaggauauguagacagaucugcauaaacuaagagaggcaaugggagcuagggaugaugucaggguuuggagu

SEQ ID NO: 84754 - RNA, 46 nt, Mus musculus
aagucagggcuuccguuuuagacccaagcgcaauacaaguaagaug

SEQ ID NO: 84755 - RNA, 46 nt, Mus musculus
agucaaggaacuaauacuugauguuuauauaugcagaucccaugag

SEQ ID NO: 84756 - RNA, 56 nt, Mus musculus
augucugacuaugggaggaugacagacacagagcgagaccagauagaccaggaugc

SEQ ID NO: 84757 - RNA, 61 nt, Mus musculus
acaaggagauacauucccagcaagugaaggaacacaggacugccguuuuggauuucguuga

SEQ ID NO: 84758 - RNA, 46 nt, Mus musculus
gcuucccaggacucugaaggaaagccugcugcugaggagcugccag

SEQ ID NO: 84759 - RNA, 46 nt, Mus musculus
augugggugguucuguuugcacagccucagccuauuccuggcucag

SEQ ID NO: 84760 - RNA, 46 nt, Mus musculus
uagacugccauagggcauccucuagaaacacuguagacagggagga

SEQ ID NO: 84761 - RNA, 46 nt, Mus musculus
caagcucaucagaguggaugcccugcagagcuauggagagucauga

SEQ ID NO: 84762 - RNA, 52 nt, Mus musculus
aagaaaaucagcgacucauuggugaaaugaacagcuuguuugacgaagugag

SEQ ID NO: 84763 - RNA, 25 nt, Mus musculus
ccugugggaggagccuggcugcuac

SEQ ID NO: 84764 - RNA, 46 nt, Mus musculus
cagacguggugaucacagacuguacugcagcauugucuugccauag

SEQ ID NO: 84765 - RNA, 23 nt, Mus musculus
gucuuccugucggggguggagag

SEQ ID NO: 84766 - RNA, 46 nt, Mus musculus
caggaaacugagaucgacagcauucaccaguuagucgugggggcaa

SEQ ID NO: 84767 - RNA, 36 nt, Mus musculus
cacuaaaaccgccaagguaauacaguuuuauuccga

SEQ ID NO: 84768 - RNA, 46 nt, Mus musculus
uuugcguguuauaguuugucaguugaauucacuaaacaguuaagag

SEQ ID NO: 84769 - RNA, 42 nt, Mus musculus
guuuggugcuucuaaucccagcucugaguaggugggggcggg

SEQ ID NO: 84770 - RNA, 47 nt, Mus musculus
caggggcagauccuguucucucucaucccaggaggugaccauggaac

SEQ ID NO: 84771 - RNA, 45 nt, Mus musculus
ccccuaccaagccaaggcuacugaaaucucugcuucucccagcac

SEQ ID NO: 84772 - RNA, 44 nt, Mus musculus
accacuuacuacgauguuuuggggguaaaacccaaugccaccca

SEQ ID NO: 84773 - RNA, 46 nt, Mus musculus
guucuugcugauuccaaaaaaagggaacuauaugauaaaggagggg

SEQ ID NO: 84774 - RNA, 53 nt, Mus musculus
guuuuggcucacccauggauaucuuugauauguucuuuggaggaggaggaaga

SEQ ID NO: 84775 - RNA, 49 nt, Mus musculus
ucggcaaaagaaugugauuugugacaaaugugaaggccgaggugguaag

SEQ ID NO: 84776 - RNA, 80 nt, Mus musculus
agaacgcaucaguccaaaagacagauguaaaagcugcaauggaagaaaaauaguucgagagaagaaaauuuuagaaguuc

SEQ ID NO: 84777 - RNA, 119 nt, Mus musculus
auauugauaaaggcaugaaagauggucagaagauaacauuccacggugaaggagaccaagaaccaggacuggagccaggagauauuaucauuguguuagaucagaaggaccaugcuguu

SEQ ID NO: 84778 - RNA, 46 nt, Mus musculus
gcauugugcggcuuccaaaagccaauaucuacucuugacaaccgaa

SEQ ID NO: 84779 - RNA, 44 nt, Mus musculus
auugaucagguagaacugguggacuuugauccaaaucaggaaag

SEQ ID NO: 84780 - RNA, 40 nt, Mus musculus
cagagguggcguuuagugucagaccucuuaaugggccagu

SEQ ID NO: 84781 - RNA, 26 nt, Mus musculus
gagagaagaggagcagaggcugugag

SEQ ID NO: 84782 - RNA, 46 nt, Mus musculus
ccugcugggccaaaaacucucaagaaaaagguuccagcugugccag

SEQ ID NO: 84783 - RNA, 45 nt, Mus musculus
ggcaaaacacuaucacaaggaguacaggcagauguaccgcacuga

SEQ ID NO: 84784 - RNA, 46 nt, Mus musculus
ggccuuugucaucagaauccgagguaucaauggaguaagcccaaag

SEQ ID NO: 84785 - RNA, 27 nt, Mus musculus
guucaucuacaagcgaggcuacggcaa

SEQ ID NO: 84786 - RNA, 45 nt, Mus musculus
uugauugcucggucucuugguaaguuuggcaucaucugcauggag

SEQ ID NO: 84787 - RNA, 49 nt, Mus musculus
ugaacuaaggugucacccauuguauuuuuguaaucuggucaguuaauaa

SEQ ID NO: 84788 - RNA, 46 nt, Mus musculus
aaacugucugacuuaaguuuuucauaaaauaacauuuucuuaagau

SEQ ID NO: 84789 - RNA, 42 nt, Mus musculus
aucuccauacugucuguucagugaagagaagugcuugaagau

SEQ ID NO: 84790 - RNA, 47 nt, Mus musculus
uuacaaaccauuguucauggacgguauuauguacauucacuucagau

SEQ ID NO: 84791 - RNA, 84 nt, Mus musculus
cugacuuuuaacucuccucauuaccuuggcuuuugcucaauacagaucaaaggcacagcucuccccuucugucaagcgcaagag

SEQ ID NO: 84792 - RNA, 46 nt, Mus musculus
uuugugcuaguuguuuucaguggggucuguguguguuucaguagaa

SEQ ID NO: 84793 - RNA, 45 nt, Mus musculus
gaucauauaggaugacuagaaaaaaaagaaagaaagagagaauug

SEQ ID NO: 84794 - RNA, 46 nt, Mus musculus
uaguagccccccggacuagagaaucuagugcuaccauugcccagug

SEQ ID NO: 84795 - RNA, 46 nt, Mus musculus
agaauuuaguccuggcugacaccaauuuacuagcaaugaucaagag

SEQ ID NO: 84796 - RNA, 48 nt, Mus musculus
uguaacugacuacuuggagcauuuagugcugugaaucaugcccucagu

SEQ ID NO: 84797 - RNA, 57 nt, Mus musculus
ccuuuucucccuuuucucuggaaagucagcuucucccuuaaucggauuucugucuug

SEQ ID NO: 84798 - RNA, 46 nt, Mus musculus
gcuuccuuagcaguguuugcucucuaaucuguauccucucuaagaa

SEQ ID NO: 84799 - RNA, 63 nt, Mus musculus
ugucugaaacaucagaggacaaaaaagaugaggagucugaugaggaagaagaggaggaagagg

SEQ ID NO: 84800 - RNA, 58 nt, Mus musculus
uaaagaugaguccaauaaagaaauagccaaccuagaagaaaaaaguacaagcaaugua

SEQ ID NO: 84801 - RNA, 46 nt, Mus musculus
ggggaugggauuacuuugguucauaauccaaagauuuaaaagagau

SEQ ID NO: 84802 - RNA, 88 nt, Mus musculus
uuuuccucagaugaauuuagcagcagugaggguacaggagaaaagacugagccaaaugaagaugauggcagcaucaagucacaggagg

SEQ ID NO: 84803 - RNA, 48 nt, Mus musculus
cucaguuacuucaaagacaaacagcagcacuggccuggaagacagagg

SEQ ID NO: 84804 - RNA, 46 nt, Mus musculus
auagaaacagcacagagacaguauucugagacugagccacaugaca

SEQ ID NO: 84805 - RNA, 62 nt, Mus musculus
agaggaagaaaagcaaauaucucaaagaaacagaaagccggauuacuccuccucagaagaag

SEQ ID NO: 84806 - RNA, 49 nt, Mus musculus
ggcagcacggaagcucugagcgguugcaguguugaagcggauccugaag

SEQ ID NO: 84807 - RNA, 45 nt, Mus musculus
agaaucaaugaagaaauucacuuugaaucucaaaacaaagaaggu

SEQ ID NO: 84808 - RNA, 46 nt, Mus musculus
ccaggaccagaccaugugugccaccccucacuccaaguccccagua

SEQ ID NO: 84809 - RNA, 80 nt, Mus musculus
acagcugaacuacagauggaagcuuuauugaugagggaaucacuaaauguaaguagcuauaauaguuugggccuugauga

SEQ ID NO: 84810 - RNA, 45 nt, Mus musculus
cgagugcuguuucugguauugaauaguguugcagagucuggguuc

SEQ ID NO: 84811 - RNA, 45 nt, Mus musculus
ggcagacaaugaauuugccucuuaccuuuuaaaauaguucagaga

SEQ ID NO: 84812 - RNA, 52 nt, Mus musculus
uacaagucauggaguuguagcggcacccgagaacccguguguuggaaggcgg

SEQ ID NO: 84813 - RNA, 44 nt, Mus musculus
gaagcucauuggaagagaaagaagagaaaaccuaggcaaagaga

SEQ ID NO: 84814 - RNA, 46 nt, Mus musculus
ggguauaggaggauuggaacugucgacuggcuuaacaacugaggua

SEQ ID NO: 84815 - RNA, 23 nt, Mus musculus
agccuuuuaacaaggaaaaccuu

SEQ ID NO: 84816 - RNA, 48 nt, Mus musculus
aguuccagaaggaucugacacccuugcagagauguauaugcaggcgga

SEQ ID NO: 84817 - RNA, 46 nt, Mus musculus
gguuauauguuuagaagugugugugugugugugugugugagugaga

SEQ ID NO: 84818 - RNA, 45 nt, Mus musculus
uguuaagcagcauaaacaaaugcccuaagguaucuucuccaagga

SEQ ID NO: 84819 - RNA, 44 nt, Mus musculus
uucuacaaacucaguuucugaguuaaaauugaaggagccauaga

SEQ ID NO: 84820 - RNA, 45 nt, Mus musculus
aagacagcuaugaauucuuccacagugacucaaguaugacaagug

SEQ ID NO: 84821 - RNA, 46 nt, Mus musculus
acugaguuggcaauucaaguaagaugcaauaauuucccguuuagaa

SEQ ID NO: 84822 - RNA, 110 nt, Mus musculus
uccugugucuuaaacauuaaaacuagaccauuacucaugggucaguauagaagagucaggaggcuaaggggaggcaucuaaacauguugauuuucaugacuggcaaguuu

SEQ ID NO: 84823 - RNA, 48 nt, Mus musculus
aggcagcaggggacaguagcacagccaggagaacagugagaaaggacu

SEQ ID NO: 84824 - RNA, 42 nt, Mus musculus
gggacaaggccagccaggcacugcuuugugcuuaggagagga

SEQ ID NO: 84825 - RNA, 44 nt, Mus musculus
aaguuccagaaugugaaguuggccacaugucacccaggaaaaau

SEQ ID NO: 84826 - RNA, 46 nt, Mus musculus
ugaauacaaaugacaguaauguugauaguaugaguggugcagagaa

SEQ ID NO: 84827 - RNA, 46 nt, Mus musculus
acagggauagaagaaagugaaggaaugaugguuugugagaguggag

SEQ ID NO: 84828 - RNA, 45 nt, Mus musculus
ugaugaaggcauugugaccagcacaggugcaaaagaagaggauga

SEQ ID NO: 84829 - RNA, 38 nt, Mus musculus
ggcauuacugaagaagauggggaagcaucagcaaauug

SEQ ID NO: 84830 - RNA, 46 nt, Mus musculus
gugguccaaguaaaugcugcuaaaccccaagaggcaaaugccaauc

SEQ ID NO: 84831 - RNA, 46 nt, Mus musculus
ugaaguugaaagugauggagcuguuacaagugcuggaacggaaaua

SEQ ID NO: 84832 - RNA, 46 nt, Mus musculus
caagcuccaaggaaggagaaaguggagaaugugcuguggcugaguc

SEQ ID NO: 84833 - RNA, 86 nt, Mus musculus
ggaagacugaaaacagugaaguagacaccagugcuaggcgcgauucugcuccugugccacagcaaaggcacgggaaaauggagagg

SEQ ID NO: 84834 - RNA, 61 nt, Mus musculus
uaaagcaagacagugcugcaggcgagcaugucguagaccugaguacaagaaaggaggcuga

SEQ ID NO: 84835 - RNA, 111 nt, Mus musculus
aguugacagcagucaugaaaagggcagagggaauggcccagucacagaaaaaaaacuaaguagaaggcugugugaaaaccgaagaggaagcacgucacaggaaauggccaa

SEQ ID NO: 84836 - RNA, 120 nt, Mus musculus
aaccuccucuaaacuugagaggaaggucucagacgggcacagaagcagaagcuuaaagcauaguaauaaagacaugaaaaagaaagaagaaaauaagccagaugacaagaaugguaaaga

SEQ ID NO: 84837 - RNA, 46 nt, Mus musculus
gcagaaggacucugggcacagagcuaaguuagcaucaauuaaagag

SEQ ID NO: 84838 - RNA, 46 nt, Mus musculus
acaggugacaacuccaaagccugauaaagagaaaaacacagaagac

SEQ ID NO: 84839 - RNA, 45 nt, Mus musculus
ugugagacagacuccacuaacgccgauagcagcuucaaaccagaa

SEQ ID NO: 84840 - RNA, 58 nt, Mus musculus
gaugggaagccaguuucugaauacacuauaaaaacagaugagcaugcacguaaagaua

SEQ ID NO: 84841 - RNA, 55 nt, Mus musculus
aacgaaacuuucuucagaugauagaacugaacguaaaaguaaacacaagagugaa

SEQ ID NO: 84842 - RNA, 63 nt, Mus musculus
uaccagagauggaaaaaaacaaccagaacgcucagaaacuaauguggaagaaacccagaagca

SEQ ID NO: 84843 - RNA, 70 nt, Mus musculus
aaguagaaagagaauauaagcgacggacauccacuccuguuauauuggaaggagcucaggaagaaacaga

SEQ ID NO: 84844 - RNA, 45 nt, Mus musculus
caagaaccaguuagaugaaauaacugcucuguauaacugggaaga

SEQ ID NO: 84845 - RNA, 46 nt, Mus musculus
cuagaagacucaucagccaagacuuuggaacccaaagccccaagaa

SEQ ID NO: 84846 - RNA, 43 nt, Mus musculus
aagacgaaucaauagagagaaacuugaagaaaaacgaaagcag

SEQ ID NO: 84847 - RNA, 46 nt, Mus musculus
aaauuggagaccaguccacauugugaguucuaggacagccagagaa

SEQ ID NO: 84848 - RNA, 40 nt, Mus musculus
ccuuucguccuuugaagaagacacagaggaggaaguuguc

SEQ ID NO: 84849 - RNA, 75 nt, Mus musculus
aaaaaaaauugaucacucuaaaaggaaugaagauacacagaaagugaaagaugagagacaagcaaaggacaaaga

SEQ ID NO: 84850 - RNA, 48 nt, Mus musculus
auggacaaaggagaaaagaaacccgaugguaaugagaaaggagagaga

SEQ ID NO: 84851 - RNA, 41 nt, Mus musculus
uccacucacuuauauugaagggaaaaaagauaagcaaagau

SEQ ID NO: 84852 - RNA, 46 nt, Mus musculus
uguagacauacagugcccugcgagaacugcugagugguuguaugua

SEQ ID NO: 84853 - RNA, 46 nt, Mus musculus
cauguuauaaauguuagaaagaaauuuucacguugauuuaggguaa

SEQ ID NO: 84854 - RNA, 45 nt, Mus musculus
uaagucagugaaguuggugaaaagcuaugaaagugugucuggaag

SEQ ID NO: 84855 - RNA, 41 nt, Mus musculus
ugaggggcgggugaacuugcaaagguagagaggcaaaguug

SEQ ID NO: 84856 - RNA, 90 nt, Mus musculus
uaugaaaaccgaauauacagccuuaagauagagugugggccuaaguacccagaggcacccccgucuguaagauucauaacaagagucaau

SEQ ID NO: 84857 - RNA, 62 nt, Mus musculus
agauggcagccaccacaggcucgggaguaaaagucccucgaaaguuccgacuguuggaagag

SEQ ID NO: 84858 - RNA, 45 nt, Mus musculus
ucaaaauaaggauaauugacaguccaauauucauggaauuuaugg

SEQ ID NO: 84859 - RNA, 41 nt, Mus musculus
uucccacaggcauaauggccauaauugcauucucugucuca

SEQ ID NO: 84860 - RNA, 45 nt, Mus musculus
acuugagagaagcaaugacuuuuugauggaggaacacaacccaag

SEQ ID NO: 84861 - RNA, 41 nt, Mus musculus
ucacguguuguuugcuuucauacagguccucaugcugacac

SEQ ID NO: 84862 - RNA, 46 nt, Mus musculus
gaaauauguacaaggaaaacuuggcuaaagacugacagugggagaa

SEQ ID NO: 84863 - RNA, 45 nt, Mus musculus
uaugugauggguggagccaagcuuauuagcaagggaugggugagg

SEQ ID NO: 84864 - RNA, 45 nt, Mus musculus
aauguaaauuuuuuuauuucuaauuuucaguagaaacuugggaga

SEQ ID NO: 84865 - RNA, 46 nt, Mus musculus
uacuacugugacaacauuaacgguaaugccuuuuuuacagugagau

SEQ ID NO: 84866 - RNA, 45 nt, Mus musculus
aacuggugcagggcugcaggauuuggucucagcguguccuucccu

SEQ ID NO: 84867 - RNA, 46 nt, Mus musculus
ugucuuuuuguauuuucucuuuguaacauaguacuacuggcuaaau

SEQ ID NO: 84868 - RNA, 46 nt, Mus musculus
ucaaaaggcgugugugugugugugugugugugugugugugugugug

SEQ ID NO: 84869 - RNA, 47 nt, Mus musculus
uuucauuaaaauauagugcuuauugguuguauuggcugcauuugggg

SEQ ID NO: 84870 - RNA, 44 nt, Mus musculus
uugaaggaugccaugacuccuucccucuggagcagggcagcaga

SEQ ID NO: 84871 - RNA, 65 nt, Mus musculus
gaccgcuuaggaugaccaagguacuuucucugggagaaggguacuauuuuggcucagguagggga

SEQ ID NO: 84872 - RNA, 46 nt, Mus musculus
caccaccacacacgagucaugcaccaaagccuuccagagaccacca

SEQ ID NO: 84873 - RNA, 46 nt, Mus musculus
aguguuaugauuaaaggcagcacuuacugcuuucuugaggcaaggu

SEQ ID NO: 84874 - RNA, 46 nt, Mus musculus
auuuaacugacaaaggcauuggugaagaaauagacaacgagcacuc

SEQ ID NO: 84875 - RNA, 42 nt, Mus musculus
ugagacaacuuuaguuuacuuauuaauguuuaagagggaaaa

SEQ ID NO: 84876 - RNA, 46 nt, Mus musculus
gaauguguaacuguaggguuuuuuuuguaaacgaagcauaccuaga

SEQ ID NO: 84877 - RNA, 46 nt, Mus musculus
cagaauugcuguaauagagauucacagugauguuugggagcauaga

SEQ ID NO: 84878 - RNA, 45 nt, Mus musculus
acagcuuugguccacccccauuaaguauuauaugagggguggucu

SEQ ID NO: 84879 - RNA, 90 nt, Mus musculus
aaucaucuggguugagaauugggaggcaggaugaugguauguguguaaagucaugucacuugccucaagguuguuacacaguuaagaggu

SEQ ID NO: 84880 - RNA, 46 nt, Mus musculus
ggcugcuacuaccuuuagaauaauggggaaaauacgucagagagau

SEQ ID NO: 84881 - RNA, 45 nt, Mus musculus
ccaaaacauagauuuuuuauaguugauuugguuuuaguauacagu

SEQ ID NO: 84882 - RNA, 46 nt, Mus musculus
uuccugcacauaaggaacugaggaugaauuuguugugaguuaagga

SEQ ID NO: 84883 - RNA, 45 nt, Mus musculus
uagaaaauaaaaagcuuucuaaauguccaaaugcuaggcagcagc

SEQ ID NO: 84884 - RNA, 45 nt, Mus musculus
acagaaaguucucaaguacucuguggaugagaaggcagauacagg

SEQ ID NO: 84885 - RNA, 47 nt, Mus musculus
gguuuuucagcccauguuaauggaauauuuuaccuacgaggagcuua

SEQ ID NO: 84886 - RNA, 45 nt, Mus musculus
augaguacgaacaguuaaauuaugcaaaacagcugaaagagagau

SEQ ID NO: 84887 - RNA, 58 nt, Mus musculus
auaucuuuucucuauuuuaguaaaauuuaaaaaccagaauuggaguuaguagggagcu

SEQ ID NO: 84888 - RNA, 45 nt, Mus musculus
aagugugcauuacuaauaggaggagaggcauugguggguuugaag

SEQ ID NO: 84889 - RNA, 46 nt, Mus musculus
agucagccuggucuacguacugaguuccaggccagccaggguuaua

SEQ ID NO: 84890 - RNA, 46 nt, Mus musculus
caaauugaaaaugaauacauuaucgguuuacuucagcagcgcaguc

SEQ ID NO: 84891 - RNA, 46 nt, Mus musculus
gaauauuacuuugaguuuauuuauuuauuuauuuauuuaggcagaa

SEQ ID NO: 84892 - RNA, 44 nt, Mus musculus
uuuucuuuguuuuuggccuuauucacuauuuuaucagagcaaca

SEQ ID NO: 84893 - RNA, 46 nt, Mus musculus
uggauaugcuuuuauccuuuaaauccacuaacuucuguuacuagau

SEQ ID NO: 84894 - RNA, 42 nt, Mus musculus
uuuuuauuuugugguauugaagauugaacucggguacucguu

SEQ ID NO: 84895 - RNA, 45 nt, Mus musculus
accuccccuuuuauauccugggggacaauguuucuuacagugaga

SEQ ID NO: 84896 - RNA, 45 nt, Mus musculus
uaguaggucaucaaucaacuuugugcaucagaaauggcauuagaa

SEQ ID NO: 84897 - RNA, 46 nt, Mus musculus
guuuuguaacaagagucuuguuucauaagucacugacccugcagau

SEQ ID NO: 84898 - RNA, 41 nt, Mus musculus
uuacgggaagguucuuuaucucugccgugcagaccacaggc

SEQ ID NO: 84899 - RNA, 46 nt, Mus musculus
uuaugaccuucccaaauaaucaaaauuuguaauguaguacccaguc

SEQ ID NO: 84900 - RNA, 45 nt, Mus musculus
aguucucauuuagugguuguguuguuuguaaucucccugccuuuu

SEQ ID NO: 84901 - RNA, 87 nt, Mus musculus
cugaacccuaacucaaauuggaaucucugagcauagaacccagaugucaaguacaguuuagagcucucagugagaguggggcccagc

SEQ ID NO: 84902 - RNA, 46 nt, Mus musculus
ggaaaaagucaccaauccaagaaugaggcuuuucauggcagugaua

SEQ ID NO: 84903 - RNA, 42 nt, Mus musculus
gaaucuccugucucugucucugucucucucugugugugugug

SEQ ID NO: 84904 - RNA, 45 nt, Mus musculus
guggagcaagucagguccugcuguagauaaaauuugugaccagag

SEQ ID NO: 84905 - RNA, 45 nt, Mus musculus
uaaagagggaaggucagccucugggcuuugagagaugucacagua

SEQ ID NO: 84906 - RNA, 46 nt, Mus musculus
auugaauguuaaaggaauauuacaucuauaacucaaaaguuaaggg

SEQ ID NO: 84907 - RNA, 45 nt, Mus musculus
gcaaugguaaaaaaaaaugaaugauguuagauugaggcuggagau

SEQ ID NO: 84908 - RNA, 46 nt, Mus musculus
gugcgucacucugggauuuauuaggauuuaucgccugggucgcggc

SEQ ID NO: 84909 - RNA, 45 nt, Mus musculus
uguuuucugaauagaauagaauagaagauuacaaagcuguugugu

SEQ ID NO: 84910 - RNA, 44 nt, Mus musculus
cuccuuguucagguucauuagagggcgagucucugggcccacug

SEQ ID NO: 84911 - RNA, 46 nt, Mus musculus
uucuucgaugucagcauuggcggccaggaaguuggucgcaugaaga

SEQ ID NO: 84912 - RNA, 70 nt, Mus musculus; identical to SEQ ID NO: 38325

SEQ ID NO: 84913 - RNA, 46 nt, Mus musculus; identical to SEQ ID NO: 38326

SEQ ID NO: 84914 - RNA, 47 nt, Mus musculus
aacugccaguggugaucucacaguguggggaaauguaaucuagacaa

SEQ ID NO: 84915 - RNA, 42 nt, Mus musculus
uuuuucuguuugcgcagcgugcgggcaaccuguuuccaguag

SEQ ID NO: 84916 - RNA, 46 nt, Mus musculus
agaaauuguugaauaaaacagccacuggccccuuggcuagcuccag

SEQ ID NO: 84917 - RNA, 45 nt, Mus musculus
auacugggcuggguguggcugugugaagagaaggggaaagucaug

SEQ ID NO: 84918 - RNA, 42 nt, Mus musculus
ggaggccacugaccuugauggggccaacuugaaacagggugg

SEQ ID NO: 84919 - RNA, 45 nt, Mus musculus
cccuuagggucacacagcaccgagaauuucagcuuuccuagagau

SEQ ID NO: 84920 - RNA, 71 nt, Mus musculus
uucucaugucuguaauucugguacuguggaaacagaggcaggaggaucacuguaaacuugaggccaaccag

SEQ ID NO: 84921 - RNA, 23 nt, Mus musculus
auacaaacagcaagaucgcuuga

SEQ ID NO: 84922 - RNA, 42 nt, Mus musculus
aaccugcaguggcagaaaguccuuacuagggagccggcauga

SEQ ID NO: 84923 - RNA, 46 nt, Mus musculus
gcacgcuguuaccaacgcaucucauggaagcaaccaaggcggaccg

SEQ ID NO: 84924 - RNA, 45 nt, Mus musculus
uucuaauguagaggaggcauuuauuaacacagcaaaagaaauuua

SEQ ID NO: 84925 - RNA, 49 nt, Mus musculus
ucaucacgcuuauuggaaauaaaagugacuuagaaucuaggagagaaga

SEQ ID NO: 84926 - RNA, 52 nt, Mus musculus
cagaggugcagcgggggcuuuacuaguguaugauauuacaaggagagacacu

SEQ ID NO: 84927 - RNA, 46 nt, Mus musculus
agccggugcaugaccucacaauugguguagaguuuggugcucagau

SEQ ID NO: 84928 - RNA, 45 nt, Mus musculus
gggagugagaggucucugggaucggggucuguccaccgcagacau

SEQ ID NO: 84929 - RNA, 42 nt, Mus musculus
uuucuguccuuuuaggggaaaggguuuuauugagagagguca

SEQ ID NO: 84930 - RNA, 51 nt, Mus musculus
gaccugccacaauuuacaagugcgggagagaguuuuaauaaguuggugucu

SEQ ID NO: 84931 - RNA, 42 nt, Mus musculus
uugggguuccuuuuuguuuguguguguauuuugcauugugag

SEQ ID NO: 84932 - RNA, 45 nt, Mus musculus
cagccucuaaaugcacuuuaacugaguaauuuaaaaacagccuaa

SEQ ID NO: 84933 - RNA, 46 nt, Mus musculus
ucuggagauggccugagaucugaccucucucuccuagauuagcaag

SEQ ID NO: 84934 - RNA, 45 nt, Mus musculus
ccucucaaagcaggcaaaaccagaaccuucuauggucugcaucag

SEQ ID NO: 84935 - RNA, 74 nt, Mus musculus
caggacuuccccagcguggugguggucggccuuggcaagcgaucggcuggaguugaugaccaggaaaacuggca

SEQ ID NO: 84936 - RNA, 46 nt, Mus musculus
aaggagcugugcuuggucucuaugaguacgaugaccugaagcagaa

SEQ ID NO: 84937 - RNA, 46 nt, Mus musculus
cagucagauuuaucuuacuuccucaguggggugggccuagggaugg

SEQ ID NO: 84938 - RNA, 46 nt, Mus musculus
aaccagauucgcugaaaucauugaaaaaaaccucaaaagugccagu

SEQ ID NO: 84939 - RNA, 45 nt, Mus musculus
uaguguaaugguccugacuaaaugggcaggcaaguacaggaguag

SEQ ID NO: 84940 - RNA, 42 nt, Mus musculus
gagacucaaacacagguuaucacacuuggcagcaggcaccuu

SEQ ID NO: 84941 - RNA, 29 nt, Mus musculus
cugcaaacauggaccucaugagggcugau

SEQ ID NO: 84942 - RNA, 47 nt, Mus musculus
uugaaucauggaaaucuaaaugauauaugacuuaauauaggcccuuu

SEQ ID NO: 84943 - RNA, 46 nt, Mus musculus
aacaaaaacaaaaaaaacaacgcauaccaccaccaccaaaauguag

SEQ ID NO: 84944 - RNA, 45 nt, Mus musculus
accuaaauuugguucugugucuuugugguuuuuuuuucggugcuu

SEQ ID NO: 84945 - RNA, 42 nt, Mus musculus
uaucccaaguacuuagacuauagugcugaaucacacaggcag

SEQ ID NO: 84946 - RNA, 41 nt, Mus musculus
ccguggugggguugaaagguauuccagguguggaauaagac

SEQ ID NO: 84947 - RNA, 46 nt, Mus musculus
ggcucacaaccuaccguaaugagaucugacacccucuucuggugca

SEQ ID NO: 84948 - RNA, 36 nt, Mus musculus
gagacauccuacagacgaaagugguaacggggagag

SEQ ID NO: 84949 - RNA, 46 nt, Mus musculus
gaaggacucuguuggauaaugaguuuguaucaguuucugucccuau

SEQ ID NO: 84950 - RNA, 25 nt, Mus musculus
cugccucagcuccucuaguacucua

SEQ ID NO: 84951 - RNA, 46 nt, Mus musculus
caaguuugaagcuguuguagauuacaugagagagaucugcccccgu

SEQ ID NO: 84952 - RNA, 46 nt, Mus musculus
gguuguaccaggauaaaaagccgagcagaguagcuuaauccuagag

SEQ ID NO: 84953 - RNA, 46 nt, Mus musculus
cagcuuggaaugucuguguucaacagccagcaaagugccacuuagg

SEQ ID NO: 84954 - RNA, 46 nt, Mus musculus
ucuucgaagacaugcuaagaggucugucuccuaggugggacuagau

SEQ ID NO: 84955 - RNA, 71 nt, Mus musculus
guucaagauuuuggugguucaguccaccauggcugggaaggacagagcugaaguaguuggucacagugucc

SEQ ID NO: 84956 - RNA, 44 nt, Mus musculus
agucuugugccuuaccaagaauuacaaugcugagaaaugcccag

SEQ ID NO: 84957 - RNA, 46 nt, Mus musculus
caaacgagagugggcauuuccuauccaaaacuccaaaugcucccag

SEQ ID NO: 84958 - RNA, 46 nt, Mus musculus
aaacuugcauacuugaugcauugaguaaaaauggagguguaccaag

SEQ ID NO: 84959 - RNA, 46 nt, Mus musculus
cacagugccuuagcaagugaaaacaucuaacuacacugagcaccua

SEQ ID NO: 84960 - RNA, 46 nt, Mus musculus
aggccugaccaugcuauuugaaagaauguggguuuugggacuuugg

SEQ ID NO: 84961 - RNA, 42 nt, Mus musculus
gaaccacagucucucucgggcaguucccgucccggcgccaug

SEQ ID NO: 84962 - RNA, 42 nt, Mus musculus
ccaggcgaagcuggugguggcgcugagccgcacguacggcgc

SEQ ID NO: 84963 - RNA, 46 nt, Mus musculus
uuaagaaaccuuagaguuuaaccuaaggguaacacuuucagcagua

SEQ ID NO: 84964 - RNA, 45 nt, Mus musculus
acagccaaguuuguuacuucauuucaccagucugaugaggaagaa

SEQ ID NO: 84965 - RNA, 46 nt, Mus musculus
uuggcucuuucucgacuccaagaucccaaggacgaugauugcccag

SEQ ID NO: 84966 - RNA, 45 nt, Mus musculus
uuuuuagcauauguuaaugugauugaaaaugauucaaauccagaa

SEQ ID NO: 84967 - RNA, 66 nt, Mus musculus
gcucuguacuggugcacccuuugugaauauuugagaucaaagggagaugaaggugaagaguuuuua

SEQ ID NO: 84968 - RNA, 53 nt, Mus musculus
auaaacuagaggacaaaccuuuagguaugucugugagagauuuuagauugagu

SEQ ID NO: 84969 - RNA, 46 nt, Mus musculus
accugcuaaaagagacugagcaacuugaaauuaaagaaguccacac

SEQ ID NO: 84970 - RNA, 31 nt, Mus musculus
auugaacauauuuauaauugcacuugauuua

SEQ ID NO: 84971 - RNA, 45 nt, Mus musculus
uaguuuauuuauauuacauauuuauacucuuuggcuuguccuagg

SEQ ID NO: 84972 - RNA, 46 nt, Mus musculus
ggucaaggccagcuugggccacauaggugaggcccuccuuuaaaga

SEQ ID NO: 84973 - RNA, 46 nt, Mus musculus
aagaauaggaugaguacucuguaauacaggguuaagauuuuuggag

SEQ ID NO: 84974 - RNA, 46 nt, Mus musculus
ccugagaugauagcauugugaacaaggugaugcugaauacaaauag

SEQ ID NO: 84975 - RNA, 46 nt, Mus musculus
aguggggguaagagggucaugccaugggagggaggggacaugaaag

SEQ ID NO: 84976 - RNA, 46 nt, Mus musculus
agcuuauaugagugcauacuaugugcuaucacuguucuuggcuuag

SEQ ID NO: 84977 - RNA, 58 nt, Mus musculus
caauugaugauguuuggaauugagccauuuaaaacccagaaaguuaagggcguucaau

SEQ ID NO: 84978 - RNA, 46 nt, Mus musculus
auuuuguuuuuucuucauuuucuuuuuggauuguucacugcuguag

SEQ ID NO: 84979 - RNA, 45 nt, Mus musculus
uaaagucagguucagcucuccccaccugaacuaugucucggccau

SEQ ID NO: 84980 - RNA, 46 nt, Mus musculus
aaucauuucauucagcagcuuuaaguuggaguggcaaagagguuag

SEQ ID NO: 84981 - RNA, 46 nt, Mus musculus
agugcuuugaagaagccuuuauuccaacugugcaaacacuggccaa

SEQ ID NO: 84982 - RNA, 46 nt, Mus musculus
aaguagaugucacaaauguuguugaauugcuuguugaucugacaag

SEQ ID NO: 84983 - RNA, 45 nt, Mus musculus
aaugaaauucaauuuuaaaauucuuuaaugauguuugaacacuua

SEQ ID NO: 84984 - RNA, 45 nt, Mus musculus
augaaguggugagaagauuuggggaaaguuugagaggcaaaugag

SEQ ID NO: 84985 - RNA, 45 nt, Mus musculus
agacuucuugggaaaguaagcaaaguaggcuggggcauaggcugg

SEQ ID NO: 84986 - RNA, 45 nt, Mus musculus
cuaaaacaguuccacuuucaucagcuggauuaucucaacaacugg

SEQ ID NO: 84987 - RNA, 51 nt, Mus musculus
uuuuuuaggccuuaacaguacaugacaacuuggcuauaaaaauuugcaaug

SEQ ID NO: 84988 - RNA, 46 nt, Mus musculus
gucugagagccuuggagaagauuaagagucaguuaggaaagggagg

SEQ ID NO: 84989 - RNA, 42 nt, Mus musculus
cccaucuaauuucauuuuucuuccagucaauuucccaagggg

SEQ ID NO: 84990 - RNA, 42 nt, Mus musculus
cauaaauuuuaguauuuucccccuccacuauguauugagagc

SEQ ID NO: 84991 - RNA, 46 nt, Mus musculus
uuagugaucaugaaccaccaucagaaaugaagaugagauuacccag

SEQ ID NO: 84992 - RNA, 46 nt, Mus musculus
ccacaugacuucagacuccuuauuuacauuaaacaauggcuuugag

SEQ ID NO: 84993 - RNA, 45 nt, Mus musculus
cuucauuaaauuuauuuaucagaggccauuuaacaguuguucuga

SEQ ID NO: 84994 - RNA, 41 nt, Mus musculus
cuugucuuaaauucauggggaacaggaagugagcagggcua

SEQ ID NO: 84995 - RNA, 46 nt, Mus musculus
auaaagauagugcaagggcugcagacuaauuuucuucacuuuugag

SEQ ID NO: 84996 - RNA, 46 nt, Mus musculus
gggcuacacagagaaacccugucucgaaaaaaccaaaaggaaaaaa

SEQ ID NO: 84997 - RNA, 45 nt, Mus musculus
agguccuugccauguggggauccaagucaggccuugccauaagga

SEQ ID NO: 84998 - RNA, 42 nt, Mus musculus
aacuuccaauggcaaagccaaaaaugcaaacacaaggcaaaa

SEQ ID NO: 84999 - RNA, 45 nt, Mus musculus
uguggguagaaaaaaaagaagccagugaaugagguagguagccag

SEQ ID NO: 85000 - RNA, 46 nt, Mus musculus
cucuguuaaugaagacaaauagucuugaagugagaagggccaugau

SEQ ID NO: 85001 - RNA, 46 nt, Mus musculus
gagacaguuggaccgcauuauugccaaacuucaauccaaggaauau

SEQ ID NO: 85002 - RNA, 41 nt, Mus musculus
acaaagaauuauauccggacauguacagauaucaagccaga

SEQ ID NO: 85003 - RNA, 42 nt, Mus musculus
uucuuuauaaguuauuuaauuuaaauguauguauuagagguc

SEQ ID NO: 85004 - RNA, 46 nt, Mus musculus
gggacuauuauauuaauauaagaaaagcuuugguuacuggguauuu

SEQ ID NO: 85005 - RNA, 46 nt, Mus musculus
acgcaaagguugcugcagucagaauuuagcaucuugguguagagga

SEQ ID NO: 85006 - RNA, 56 nt, Mus musculus
ucgccccacggaggccaagaaagcugcagaugaggccaagaugagauuugcccaca

SEQ ID NO: 85007 - RNA, 45 nt, Mus musculus
agaguguuuuauuuuuaagcaguguuauaauugaaauugcaguga

SEQ ID NO: 85008 - RNA, 48 nt, Mus musculus
acaguggccauuguggugagauugaacuccucaagcuagauauugguu

SEQ ID NO: 85009 - RNA, 46 nt, Mus musculus
uuaguuuuuagagaaaggggcaagaauuauuagauagugugcuugu

SEQ ID NO: 85010 - RNA, 46 nt, Mus musculus
uuaauaauugaguuuucuaaaaauaaaauuauggcauaguucagau

SEQ ID NO: 85011 - RNA, 46 nt, Mus musculus
uugagccuuuccuacaucuauguguauucagugacaaaccugaguu

SEQ ID NO: 85012 - RNA, 48 nt, Mus musculus
acucugaugagagcccuagaacuuuugaauuauuuggcugcuuuaaau

SEQ ID NO: 85013 - RNA, 46 nt, Mus musculus
auugguuuuaugggguaguguuaaaacuuaaaagaugguggcaguu

SEQ ID NO: 85014 - RNA, 45 nt, Mus musculus
augcuguguucaguaaucuaggccacacuuuccacaugguccagu

SEQ ID NO: 85015 - RNA, 46 nt, Mus musculus
uucuacuacagcaguguacuuuaagagaguuuccuaguccugagau

SEQ ID NO: 85016 - RNA, 46 nt, Mus musculus
augaaguccuugaaggcacgauucauauuaauauuguuugguagag

SEQ ID NO: 85017 - RNA, 45 nt, Mus musculus
ucagccauccaaagcagggaugagcgauuggccacaccaguaauc

SEQ ID NO: 85018 - RNA, 52 nt, Mus musculus
cuacacuuccaccccagcagcaacaacgcauuuuugagccaccaccuccaaa

SEQ ID NO: 85019 - RNA, 48 nt, Mus musculus
ggccuguaagagaauaaagcgugaaguugaugauuugggcccugaagu

SEQ ID NO: 85020 - RNA, 48 nt, Mus musculus
aacacauccuguugagauuuuuuauacuccagaaccagagagagauua

SEQ ID NO: 85021 - RNA, 46 nt, Mus musculus
agguuauaguuaugagugcuacccuagaugcugggaaauuccagau

SEQ ID NO: 85022 - RNA, 46 nt, Mus musculus
agauauucucauggguguucuaaaggaaguuguaagacagagauca

SEQ ID NO: 85023 - RNA, 45 nt, Mus musculus
ugaucuguguacagucgugauauacugacacucagauuaauagug

SEQ ID NO: 85024 - RNA, 49 nt, Mus musculus
agucaaaagaucuaccaagcaaaauagaaacacuguucaguaaggcucu

SEQ ID NO: 85025 - RNA, 46 nt, Mus musculus
uuacucuuaaguuauuaaagaacuaaauuauggacacaguauaaga

SEQ ID NO: 85026 - RNA, 78 nt, Mus musculus
uugucgacguuuucaguccaagauccaauagacguuuucaguccaagauccaguagaagcaaauagaaagauucaggu

SEQ ID NO: 85027 - RNA, 45 nt, Mus musculus
uaacaaaucuuagaacauuucucaguuuauuuucagggaacagau

SEQ ID NO: 85028 - RNA, 42 nt, Mus musculus
ugugagcucaugggggaaucuuguucuguaauaacgugguua

SEQ ID NO: 85029 - RNA, 103 nt, Mus musculus
aggagaguggcugcaaugaguguggcucagagaguugcugaugagauggacgugauguuaggccaggaaguuggauacuccauucgauuugaagacugcagua

SEQ ID NO: 85030 - RNA, 46 nt, Mus musculus
auuccagcauuuagggaucagguaggcaagucucugaauucaaggu

SEQ ID NO: 85031 - RNA, 45 nt, Mus musculus
ucacuuccacagugcauuaauccauucaccaaccugccccauacu

SEQ ID NO: 85032 - RNA, 123 nt, Mus musculus
ccaccaaugcuaugcuuaucagugcuggauugccaccuuuaaaagcuucucauucagcucacucaacccacucggcucauucaacacauucuacacauucugcccacucaacacacacuggac

SEQ ID NO: 85033 - RNA, 84 nt, Mus musculus
gaucuaaagaucgugaccgagaacgugauagaggagacagagaacgggagagggaaaaagaaaaggaaaaagaauugagagcuu

SEQ ID NO: 85034 - RNA, 46 nt, Mus musculus
uccuuauuuugaggugaucuagaacccaguuaaggagugcguagac

SEQ ID NO: 85035 - RNA, 48 nt, Mus musculus
ugcauuguauuucuuucucugcuauaguaauggagcuguaggugaagu

SEQ ID NO: 85036 - RNA, 46 nt, Mus musculus
guuuuuaguuccaucuuaaaagccacagcuugcaugugagcaagaa

SEQ ID NO: 85037 - RNA, 46 nt, Mus musculus
acguuaaugcacaugcuuagaaguucccaaagugagacugucagaa

SEQ ID NO: 85038 - RNA, 49 nt, Mus musculus
cacuacaaucccgugguagcugaaauuaaauaauaagaugauaagaugc

SEQ ID NO: 85039 - RNA, 42 nt, Mus musculus
gcuucauguuuccucugaauauuucauauuugucacuaagua

SEQ ID NO: 85040 - RNA, 46 nt, Mus musculus
gcuaagaugcaacuaauuucucuccuuauagaggucacauugggau

SEQ ID NO: 85041 - RNA, 45 nt, Mus musculus
cguucugucgcucuccuuagguugaaauauugaauacggaaagca

SEQ ID NO: 85042 - RNA, 45 nt, Mus musculus
gugacaccgacucgcugucaagucagauguguggucucuugaguu

SEQ ID NO: 85043 - RNA, 48 nt, Mus musculus
ucgguuggaccugggggaggauuaccccuccggcaagaagcgugcggg

SEQ ID NO: 85044 - RNA, 46 nt, Mus musculus
gugaugaaacaccaacaccauagccaaauuaacuugugaagugggg

SEQ ID NO: 85045 - RNA, 46 nt, Mus musculus
aucaggaaucacucaauuuuaaaugugugauaaaugggcuggagag

SEQ ID NO: 85046 - RNA, 46 nt, Mus musculus
ucagggcagacaaaucaguggaaccgaacagugaauccaaaaauag

SEQ ID NO: 85047 - RNA, 46 nt, Mus musculus
uaugccuuagagaaacauucagguaacuacauucaaauguggguga

SEQ ID NO: 85048 - RNA, 45 nt, Mus musculus
aggcuucuacuuccaagguagaauuggaacuucuugugaacuagg

SEQ ID NO: 85049 - RNA, 45 nt, Mus musculus
agacuucuaucuguguguggucacaugagcuuaaggacaauguaa

SEQ ID NO: 85050 - RNA, 52 nt, Mus musculus
cacagugaaaccaugucucaaaaauaaacaaaacaaaagaacaagaaccuau

SEQ ID NO: 85051 - RNA, 45 nt, Mus musculus
cgucuuaauguguuuaucauuugccuuucuuaucccugugaccaa

SEQ ID NO: 85052 - RNA, 46 nt, Mus musculus
gacaggaucucuugaagcugcuagcucacgucuagguguaacccaa

SEQ ID NO: 85053 - RNA, 45 nt, Mus musculus
cgugcgcacgcguguacacacacacacacacacacacacacacac

SEQ ID NO: 85054 - RNA, 47 nt, Mus musculus
uuccuccggccucuagcugggugcuggccugaacuucaccagaggga

SEQ ID NO: 85055 - RNA, 41 nt, Mus musculus
cgucuggaagcucaggucuggcauugggagaguccaggaga

SEQ ID NO: 85056 - RNA, 45 nt, Mus musculus
gaccugguugagaagauaggcgacacgcaugccaaagugcuggag

SEQ ID NO: 85057 - RNA, 46 nt, Mus musculus
gcggcugauccgguggcagcguggcugaugguuguacccugcagau

SEQ ID NO: 85058 - RNA, 41 nt, Mus musculus
acgccuccaaccgugccauccacgugcaugaguucggggac

SEQ ID NO: 85059 - RNA, 42 nt, Mus musculus
cgaaguugccaaagucgcccgggugcugagggugcggcaccu

SEQ ID NO: 85060 - RNA, 42 nt, Mus musculus
gaccgcgucgcuggccggaccgcacgccaucuugggccgcuc

SEQ ID NO: 85061 - RNA, 47 nt, Mus musculus
uugccguucugcaggcuggccugguugccaccuuuacccaggucguc

SEQ ID NO: 85062 - RNA, 49 nt, Mus musculus
gugguaggcaccagcagcuccgccgccugggagagccagacaaaggagc

SEQ ID NO: 85063 - RNA, 91 nt, Mus musculus
ggaggccucugucuaggacgccuagaggccucuggggugacuagaggcgucugggggcgccuggagacaucuaugcgugcagcggcggggc

SEQ ID NO: 85064 - RNA, 99 nt, Mus musculus
gccucccagacaccucagucgccucugcgcuuccaugcacgccagacaccucuguauggcccccagaugccuccacgaaccuccgcgcacccuagaugu

SEQ ID NO: 85065 - RNA, 120 nt, Mus musculus
gaggaacgguguccgggacaugggagaacaucuagggugcgcggagguucguggaggcaucugggggccauacagaggugucuggcgugcauggaagcgcagaggcgacugaggugucug

SEQ ID NO: 85066 - RNA, 71 nt, Mus musculus
cguuccucuguguccaggacaccuuaguuaacccagaaaucuuuucacgcccuaugcacuuccacagaccc

SEQ ID NO: 85067 - RNA, 57 nt, Mus musculus
ggauugucuugggacacaaaggggcucgggauggaucuagagcauuaaggaucuggg

SEQ ID NO: 85068 - RNA, 46 nt, Mus musculus
cuagucuuugagucugcucucagagaacccccucuuccuccccaga

SEQ ID NO: 85069 - RNA, 45 nt, Mus musculus
guccucagaggaggagaguaucugagcacaugcgaucucugggga

SEQ ID NO: 85070 - RNA, 44 nt, Mus musculus
ccuuugagaguacucccuugggguauacugaaauaucgcccacc

SEQ ID NO: 85071 - RNA, 45 nt, Mus musculus
gagcgccucggaggaacaaagggaagaaaaaagaggucucuaggg

SEQ ID NO: 85072 - RNA, 49 nt, Mus musculus
guuccuccgaggcgcucugggaccacucugacacccucacccccacccc

SEQ ID NO: 85073 - RNA, 42 nt, Mus musculus
gguggguaaagguauaagacgugcagucgcuguucuggagau

SEQ ID NO: 85074 - RNA, 46 nt, Mus musculus
acugaaccacaguuagaaacccguccucugcgcugagugugcccug

SEQ ID NO: 85075 - RNA, 46 nt, Mus musculus
cucuuccccacagugggaccgaagcuggugcacaguggauccaguc

SEQ ID NO: 85076 - RNA, 46 nt, Mus musculus
cacucugggggcuugcggugguuugaguaagaaugacccccccccc

SEQ ID NO: 85077 - RNA, 45 nt, Mus musculus
agauaaaccaguugugcaacuaggugcuguauuuaacccugacca

SEQ ID NO: 85078 - RNA, 45 nt, Mus musculus
uauuucauugucacuggaggaacagcaaauaucuaugacccagga

SEQ ID NO: 85079 - RNA, 37 nt, Mus musculus
uuggccuggacaggcaagcuaaacuaguuccugaaga

SEQ ID NO: 85080 - RNA, 46 nt, Mus musculus
uuauguggauuuugcaaucugaaaacuugugaaagaacugugagag

SEQ ID NO: 85081 - RNA, 46 nt, Mus musculus
uccacaugauuaaaaccuaauucagauuaaggauugaaggcuggag

SEQ ID NO: 85082 - RNA, 46 nt, Mus musculus
gaggcaguuagcaagcgguacaggaggcgaggaccugagggcuuag

SEQ ID NO: 85083 - RNA, 46 nt, Mus musculus
ucuguauuuuuuauguucuuuuucagcauuuuucagaacagccaag

SEQ ID NO: 85084 - RNA, 36 nt, Mus musculus
ccguuuccugaguuaaguagauguucuguucccaga

SEQ ID NO: 85085 - RNA, 46 nt, Mus musculus
uagccuugugcuuucuguucuuuuuaugcaucuaccugugcagucc

SEQ ID NO: 85086 - RNA, 68 nt, Mus musculus
cuccauaucaaggacacauagcacagccccaacacacacacacacacacacacacagcacagccccaa

SEQ ID NO: 85087 - RNA, 46 nt, Mus musculus
cacacagcacagccccaacacacacacacacacacacacacagaga

SEQ ID NO: 85088 - RNA, 42 nt, Mus musculus
ucuuucccuauuuuuuaacuuuuucagaggauaaugggaagg

SEQ ID NO: 85089 - RNA, 45 nt, Mus musculus
aggacuaauuuuuguugucuauucugcauaauuuuucaggccaug

SEQ ID NO: 85090 - RNA, 46 nt, Mus musculus
augugugucuguauuauguguuuaugugugccuggugcgcacagag

SEQ ID NO: 85091 - RNA, 46 nt, Mus musculus
ucuaucuugagggguacaugaaaguuuuggugugacuuugaggaag

SEQ ID NO: 85092 - RNA, 46 nt, Mus musculus
uauauaugugcuuuacauuaggaucaaccuuacggcccuacagaag

SEQ ID NO: 85093 - RNA, 23 nt, Mus musculus
uucccuuucuggagaggagugga

SEQ ID NO: 85094 - RNA, 46 nt, Mus musculus
ucucugugcgccuuccugcuuuaguggcuuguuuuccuaacugcag

SEQ ID NO: 85095 - RNA, 45 nt, Mus musculus
ucacuuagcuguggguagaaggauagguguuuagaguacaguugg

SEQ ID NO: 85096 - RNA, 46 nt, Mus musculus
cacaaauuuagaguacacacaacuugguggcuaucacuacuacaga

SEQ ID NO: 85097 - RNA, 46 nt, Mus musculus
auuuucuaucagaagcaaugcuguguaaaaagcaagaugguagaua

SEQ ID NO: 85098 - RNA, 49 nt, Mus musculus
caaccaaacaacagaaacaucaaaggcagagaacagaagaguauaggua

SEQ ID NO: 85099 - RNA, 85 nt, Mus musculus
ugugcuaacuuugcauuugaggaugcuaaaaauccccuaagagauuggaugaagaugacauuguaguaaacauugaaauugcagu

SEQ ID NO: 85100 - RNA, 24 nt, Mus musculus
guuguguaugaguuuaagacacaa

SEQ ID NO: 85101 - RNA, 46 nt, Mus musculus
gucccuauugugucucuuuguagcagaggucuguuuguuuggguug

SEQ ID NO: 85102 - RNA, 46 nt, Mus musculus
uguuuguaguugggugaaugggaauagguggcuauaaaauaaucag

SEQ ID NO: 85103 - RNA, 45 nt, Mus musculus
uaguugauacauuucagaagcuuuguauggucuggauuagccaaa

SEQ ID NO: 85104 - RNA, 46 nt, Mus musculus
uuucagugugaucuguuauuuuuacuuuuauuacgaugccugcagu

SEQ ID NO: 85105 - RNA, 54 nt, Mus musculus
ccacauuaugcuugugugaaaugccagugaaaacagugagcuaugucauacccu

SEQ ID NO: 85106 - RNA, 46 nt, Mus musculus
caagcaggucuuuucucugaauguuaacaacgccuauuuagucaag

SEQ ID NO: 85107 - RNA, 42 nt, Mus musculus
cuguccagaagauaaguaagguagaaauuguguauguuggag

SEQ ID NO: 85108 - RNA, 46 nt, Mus musculus
auaaaauuuauugcuuucaacuuauaauuaguacaaggaacaaaag

SEQ ID NO: 85109 - RNA, 41 nt, Mus musculus
ucaugcuggaagaaggaagggcaagagagcaugaggaggga

SEQ ID NO: 85110 - RNA, 46 nt, Mus musculus
gacuuuauagucugaguaaguaccuggccuguucgauuccguuuag

SEQ ID NO: 85111 - RNA, 46 nt, Mus musculus
cacuucagacaauacacaaacagauggacgacgacaaggacggcgg

SEQ ID NO: 85112 - RNA, 66 nt, Mus musculus
uuucgaaaccuuaauuuaauuacauaguucccaccccccuuuuuccccucccucuaaacucuccca

SEQ ID NO: 85113 - RNA, 46 nt, Mus musculus
uggcucucuccauagggccuuguaaaauaucacuggcuucccccag

SEQ ID NO: 85114 - RNA, 45 nt, Mus musculus
ggauguuuguugauggucaguguaugcauucugcgggauguuugu

SEQ ID NO: 85115 - RNA, 45 nt, Mus musculus; identical to SEQ ID NO: 85114

SEQ ID NO: 85116 - RNA, 46 nt, Mus musculus
cugggaacauuuuacaagacuucccaaaggaugucugaaacagcag

SEQ ID NO: 85117 - RNA, 46 nt, Mus musculus
uaguuaaggaaacuauagaaagcacaacuugagaaaggaggaccaa

SEQ ID NO: 85118 - RNA, 45 nt, Mus musculus
cuggcauguuuuguuuuagaauaucuuaaguggaacuccguaaua

SEQ ID NO: 85119 - RNA, 50 nt, Mus musculus
gcgacugcuccugcuaugguacuuuuaaaaccagaguauuuaccuccuug

SEQ ID NO: 85120 - RNA, 51 nt, Mus musculus
uguuuuuaaagucccaauccacauggaauaaagugcacacguuauuucacu

SEQ ID NO: 85121 - RNA, 45 nt, Mus musculus
ggugguauuuagaauaguucaugaagauugacuaguaggucuuag

SEQ ID NO: 85122 - RNA, 46 nt, Mus musculus
acuuuguaaaagcuugaaguuuuguucaccguacucuagcaaggag

SEQ ID NO: 85123 - RNA, 41 nt, Mus musculus
caaguucuguuccaaaauaguuacauugugguagggcuggc

SEQ ID NO: 85124 - RNA, 78 nt, Mus musculus
augagugcucaguaaggaacuuauacauccuuuaguggaaaagcagauguuaaaagaauuccuucucuucuagaugau

SEQ ID NO: 85125 - RNA, 47 nt, Mus musculus
auucuguggggaaaaaaguucuuaugaagaacugaauuuagcuaaga

SEQ ID NO: 85126 - RNA, 49 nt, Mus musculus
aggacggauaaaaaggagccaccguagggguugaaagaccagcagagua

SEQ ID NO: 85127 - RNA, 45 nt, Mus musculus
cccugcagugguuaauagaauuuguugaacugccacaauaugaga

SEQ ID NO: 85128 - RNA, 71 nt, Mus musculus
gaaaacagaacuguugcuguagaaaagcaaaaucuggaacggaaaaugauggaugaaaucaacuaugccaa

SEQ ID NO: 85129 - RNA, 24 nt, Mus musculus
aaaaagaagagaagcacagucuuu

SEQ ID NO: 85130 - RNA, 65 nt, Mus musculus
cauuccacccuacccuauugcuggaggaguugaugaccucgaugaagacacacccccaaucgugc

SEQ ID NO: 85131 - RNA, 77 nt, Mus musculus
cucgucgcagcaucgugccauccuccccacagucucagcgagcucagcuuccugcucaugcuccucuggcagcccac

SEQ ID NO: 85132 - RNA, 46 nt, Mus musculus
aaacucuuccagugggagaaaaccgucucccccuucaagccuugag

SEQ ID NO: 85133 - RNA, 42 nt, Mus musculus
cucugcaaguaaaacuguauagaguuuauaaacugacugugg

SEQ ID NO: 85134 - RNA, 46 nt, Mus musculus
aaggcucuugauuccuuauccaaguggaagaguaaaacuugaucga

SEQ ID NO: 85135 - RNA, 45 nt, Mus musculus
uaaaugcaaagaauuuaugguuugugaaaaauuuguacuguggaa

SEQ ID NO: 85136 - RNA, 46 nt, Mus musculus
ggagugcauacagaaggcuuggcugcgagauugcuuauagcuaggg

SEQ ID NO: 85137 - RNA, 45 nt, Mus musculus
caacuuuaugguagguuuccaggaaaccccagaucugacggaggu

SEQ ID NO: 85138 - RNA, 46 nt, Mus musculus
gggcuuuucucguucaaucuugugcagcaguggugugaagauacgc

SEQ ID NO: 85139 - RNA, 46 nt, Mus musculus
aaaguccuuccaauauggggucaauaguccuaauauaggguuagau

SEQ ID NO: 85140 - RNA, 45 nt, Mus musculus
ccucaggaguuaggagguuggggggacccuccagaaugcaccaga

SEQ ID NO: 85141 - RNA, 45 nt, Mus musculus
acuccugcucccgucagccugcccccugucauucucuggucacuu

SEQ ID NO: 85142 - RNA, 46 nt, Mus musculus
aucuguuccugaaccccagauuccauguugacuuuggcccuaagau

SEQ ID NO: 85143 - RNA, 44 nt, Mus musculus
uugaaagaagcuuugggcuuaaaaggugugaugaaaguuuuagu

SEQ ID NO: 85144 - RNA, 46 nt, Mus musculus
ugcuggcuuucuugaagaguucuaagagacuccgaacuugcgagau

SEQ ID NO: 85145 - RNA, 45 nt, Mus musculus
cuaaaauucuuaacauaguuuuuuaaaacucuuuugggugugugu

SEQ ID NO: 85146 - RNA, 45 nt, Mus musculus
cuucuuuguuuguuuguucugagacaaggucucuguggucccagu

SEQ ID NO: 85147 - RNA, 46 nt, Mus musculus
gguaucuaaaaggaucagcaauuguaacaaugguucaacccagaca

SEQ ID NO: 85148 - RNA, 41 nt, Mus musculus
gaggaggaggaggaagaagaggaggaggaggaggaggcagu

SEQ ID NO: 85149 - RNA, 46 nt, Mus musculus
cuaaagaaaaauaaaacaaaccaaaaauaucucauuguggaaagau

SEQ ID NO: 85150 - RNA, 46 nt, Mus musculus
cauucucuaucuaaagggagaaaaaauaaauaagcaaaaaccagau

SEQ ID NO: 85151 - RNA, 45 nt, Mus musculus
uucugauuugacuugugcuccacuuucgugacucugaaccugagg

SEQ ID NO: 85152 - RNA, 45 nt, Mus musculus
ggccaccccagggaagcaugucuguggucaucaucugcacacagu

SEQ ID NO: 85153 - RNA, 41 nt, Mus musculus
ucagugugauggugugagaagucagugugauggugugggag

SEQ ID NO: 85154 - RNA, 42 nt, Mus musculus
uuuguguuacugguuauagguugugguuguugggcgccagau

SEQ ID NO: 85155 - RNA, 45 nt, Mus musculus
ugugcuaacuucauucaauuauuaccaggacuauagagcgcuucc

SEQ ID NO: 85156 - RNA, 45 nt, Mus musculus
cacaacaucuuaaauacagcuuuuauggggaaaaugggauccagu

SEQ ID NO: 85157 - RNA, 43 nt, Mus musculus
gcaagagcuggagauuagaagauaaagaagacagaagcuggga

SEQ ID NO: 85158 - RNA, 46 nt, Mus musculus
auuuggggucaggcaagucuucgcugagaguaauggcuagcacaag

SEQ ID NO: 85159 - RNA, 64 nt, Mus musculus
uggcucugauugcucacuuaguucuuuuucuuucucagcgaaugcagauaucuugaaagcuaug

SEQ ID NO: 85160 - RNA, 44 nt, Mus musculus
uauucuuucuucucuggagaauuuauugugguuagucaugggau

SEQ ID NO: 85161 - RNA, 45 nt, Mus musculus
auccccaauaucagucaaacaugaaagugacauguaucacaagau

SEQ ID NO: 85162 - RNA, 42 nt, Mus musculus
aguggcaucaaaagggugccaagccaagcauagcgaugacag

SEQ ID NO: 85163 - RNA, 46 nt, Mus musculus
acacacacacacacuuacuuuugccaguuuaaccgcuuggccauuu

SEQ ID NO: 85164 - RNA, 45 nt, Mus musculus
aagaagaaaggcuaccgguguacaacagaggcggaacaggaaguc

SEQ ID NO: 85165 - RNA, 41 nt, Mus musculus
aggaaggaaggaaggaagggaggaaggaaggaaggagggaa

SEQ ID NO: 85166 - RNA, 41 nt, Mus musculus
ugagccaccauugguugcugggaauugaacucaggaccuuu

SEQ ID NO: 85167 - RNA, 45 nt, Mus musculus
uaauaugaucuucacauugaaggaagaugcacacaugcauggaua

SEQ ID NO: 85168 - RNA, 45 nt, Mus musculus
guucucuguaccucacauaguguccuuucuaauuccugggguuca

SEQ ID NO: 85169 - RNA, 45 nt, Mus musculus
ccuucaguucccgguucccagguucucagaaaccagccagaccca

SEQ ID NO: 85170 - RNA, 87 nt, Mus musculus
caucugggguuuuccugaugggccuauuucaucuuuccagaauucuuuuucccauuugaucuuugguuuuccucuuggccccccuuu

SEQ ID NO: 85171 - RNA, 46 nt, Mus musculus
uggaaaggcuggaacuucuguccuuuccuugauuucugggguucag

SEQ ID NO: 85172 - RNA, 45 nt, Mus musculus
uguacuaugucaacaguccuuacacagacacuccauguuugggau

SEQ ID NO: 85173 - RNA, 45 nt, Mus musculus
ggaggguagaggaccaagaggagucccggggaauugcccugugag

SEQ ID NO: 85174 - RNA, 46 nt, Mus musculus
agaguuugcaucucugucaacauuuccuguugauguugacuaagaa

SEQ ID NO: 85175 - RNA, 46 nt, Mus musculus
aauauagcaauagacuccucugauugauggagagaggaugccagcc

SEQ ID NO: 85176 - RNA, 46 nt, Mus musculus
aauauagcaauagacuccucugauugauggagagaggaugccucua

SEQ ID NO: 85177 - RNA, 42 nt, Mus musculus
uggagaaccgacagagagcuucucagaggguggguggcaguc

SEQ ID NO: 85178 - RNA, 46 nt, Mus musculus
gcuucuuucccgagacuuguaacuacaacauaguuucaacguagau

SEQ ID NO: 85179 - RNA, 46 nt, Mus musculus
ggagccugcuucucauuuguccuuuacuuuuucaugggcaucagaa

SEQ ID NO: 85180 - RNA, 42 nt, Mus musculus
cagugccauuauggcgugugaagucaccacccuggcccauga

SEQ ID NO: 85181 - RNA, 44 nt, Mus musculus
ccuucccaaagaccacaugcuugccauccagccauucauucuug

SEQ ID NO: 85182 - RNA, 59 nt, Mus musculus
aucuucaaaaccuucaaagucagaaagagagaaggaguccaaaaaaggaaaaggaaaga

SEQ ID NO: 85183 - RNA, 56 nt, Mus musculus
gaugacacucagucugagaaagagcaggaugcaguggagacugacgccaugaucaa

SEQ ID NO: 85184 - RNA, 42 nt, Mus musculus
accugaccccauacucacuucagguaguaaagacaucgaggc

SEQ ID NO: 85185 - RNA, 46 nt, Mus musculus
uccuccccccgaguguuugcuacuguccuggacaguggccagagaa

SEQ ID NO: 85186 - RNA, 45 nt, Mus musculus
aacuuauggacacauacuaucugaugaaagaagauuuugagaaca

SEQ ID NO: 85187 - RNA, 42 nt, Mus musculus
agagagagagagagagagagcgagagagagcgagagagagcg

SEQ ID NO: 85188 - RNA, 42 nt, Mus musculus
gaggggagggagagggagagggagagggagagagcgagggag

SEQ ID NO: 85189 - RNA, 46 nt, Mus musculus
gcagaggccagaggcagagggucucugaguuugaagccagccagau

SEQ ID NO: 85190 - RNA, 42 nt, Mus musculus
gcauaugugacggugacuuaguggacaaucagauccggagua

SEQ ID NO: 85191 - RNA, 46 nt, Mus musculus
uucccaugcaagccacuccagcguacacuucauuuagcauccugca

SEQ ID NO: 85192 - RNA, 45 nt, Mus musculus
cucgugugugugugugugugugugugugcgugugugugugucugu

SEQ ID NO: 85193 - RNA, 44 nt, Mus musculus
gcaaaguuuggcaaacuugccagcaaagaugauggcuccaguuu

SEQ ID NO: 85194 - RNA, 46 nt, Mus musculus
ggcuggaggaacaaccagugccagugucugaaggccugugagagag

SEQ ID NO: 85195 - RNA, 51 nt, Mus musculus
aaagaacaguccuaugaaggcagugaagaaggaggcaagcacgugcccaag

SEQ ID NO: 85196 - RNA, 54 nt, Mus musculus
gaagaaagaaaaguccaaauuggagcgaacaccccaaaaaaaugaucaaggaaa

SEQ ID NO: 85197 - RNA, 45 nt, Mus musculus
uauuggcuugcacugcuucagccuccuccagccuacggugguucu

SEQ ID NO: 85198 - RNA, 42 nt, Mus musculus
auuguccacccagauuauuccaguagaaaaguccuaggaaug

SEQ ID NO: 85199 - RNA, 41 nt, Mus musculus
aagaaaguguuggcuugcauagcuaggcugugggcaggaug

SEQ ID NO: 85200 - RNA, 75 nt, Mus musculus
agacggccuguuggaucugauucgaacuaugccaggcaagagauccaaguaugagauggcugcugaggcugaggu

SEQ ID NO: 85201 - RNA, 46 nt, Mus musculus
uagaucccaucuuaauuuuucauuauuggaagugugugaggaagaa

SEQ ID NO: 85202 - RNA, 63 nt, Mus musculus
caggaaacgugagcaagaaaaccaacuaccucgucaugggccgcgacagugggcaguccaaga

SEQ ID NO: 85203 - RNA, 46 nt, Mus musculus
cuagccagguuucacgcugggguuauuuaugauguugggagagaaa

SEQ ID NO: 85204 - RNA, 51 nt, Mus musculus
gcguuucagugggcaauugcaucaagguaugaaagcuaauugcugguuuaa

SEQ ID NO: 85205 - RNA, 31 nt, Mus musculus
uuagauuagcugucaucuuuccgcggguggg

SEQ ID NO: 85206 - RNA, 38 nt, Mus musculus
ugguuagcuucuuuucaagacuucccaucuuuaccaau

SEQ ID NO: 85207 - RNA, 46 nt, Mus musculus
gucuacuacagcuugauaaggcguguuggguugauaucugugagag

SEQ ID NO: 85208 - RNA, 27 nt, Mus musculus
acagggagagagggaggugggggaaga

SEQ ID NO: 85209 - RNA, 45 nt, Mus musculus
guggagggagagcugucaucuaagaaacucuggcuggcaagagga

SEQ ID NO: 85210 - RNA, 41 nt, Mus musculus
ggaagagcacuuaagcauagagccauauucuaagcccugaa

SEQ ID NO: 85211 - RNA, 46 nt, Mus musculus
gaagcgcacuaauuaucaagcuuaucgaagcuacuugaaccgagaa

SEQ ID NO: 85212 - RNA, 45 nt, Mus musculus
uguguguguguguguguguguguacacauagaacugaacugaagu

SEQ ID NO: 85213 - RNA, 46 nt, Mus musculus
cucacccaaggccagugccaaacuggcgcuuaugaaagcaaaagaa

SEQ ID NO: 85214 - RNA, 56 nt, Mus musculus
aagagggagaagaaucauuuucaucuguccaagaugauuuaagcaaagcagaaaag

SEQ ID NO: 85215 - RNA, 52 nt, Mus musculus
uacuuaacauucggacacguuuuaaacuuguuuuaggcccgaaaggauucug

SEQ ID NO: 85216 - RNA, 52 nt, Mus musculus
uaauaaaacauucccuuugcuggggguaguuuuuguggauaaauggauggca

SEQ ID NO: 85217 - RNA, 29 nt, Mus musculus
cauuucuggguuaggagacugggugggau

SEQ ID NO: 85218 - RNA, 46 nt, Mus musculus
aagaauuugcaagaacacuggccuuauuggaugaagaacccaagau

SEQ ID NO: 85219 - RNA, 45 nt, Mus musculus
uuuucuuagaacaaauaaaccauaauaaaacauauaaugaagaga

SEQ ID NO: 85220 - RNA, 48 nt, Mus musculus
cagacuggcguggagauuguuaagguguggcaaguggcaaauguuagc

SEQ ID NO: 85221 - RNA, 73 nt, Mus musculus
acugagcccaggaucgcaaggguaagcaucugagaaaguaugcgcaggagaucaguauggccacacagaugaa

SEQ ID NO: 85222 - RNA, 28 nt, Mus musculus
agcugcagcuggaugaagaugcagaggu

SEQ ID NO: 85223 - RNA, 46 nt, Mus musculus
aauggacuuauagauacaguauaguaaaggaaauggaccuauagau

SEQ ID NO: 85224 - RNA, 45 nt, Mus musculus
acgccggugugcaccgaugcuucagcgcuugggagacugaggcua

SEQ ID NO: 85225 - RNA, 46 nt, Mus musculus
ugcucgacuauuuuggaacugaaaguguccagagaucugggaagaa

SEQ ID NO: 85226 - RNA, 46 nt, Mus musculus
ggccuggcccuuguaaaugucagagugccuguuagauucagaagau

SEQ ID NO: 85227 - RNA, 57 nt, Mus musculus
ucccagcauugggaggcagaggcaggggcagaggggcagagagagagagagaggcag

SEQ ID NO: 85228 - RNA, 42 nt, Mus musculus
gagguuugaguuggaggucagcucuggauauguaggaagguc

SEQ ID NO: 85229 - RNA, 42 nt, Mus musculus
aguguggagugugugguagcugggaaacaaaaagggggagga

SEQ ID NO: 85230 - RNA, 46 nt, Mus musculus
uuugcguauuaggauucuacauaaaagaaucuuuaaguuuagagau

SEQ ID NO: 85231 - RNA, 46 nt, Mus musculus
auugcugagcuaucucucuccagccccauaaaauugaaauguagaa

SEQ ID NO: 85232 - RNA, 46 nt, Mus musculus
uaagggagaaaggguuuauuuuaguuccuaguuuggggugacacca

SEQ ID NO: 85233 - RNA, 46 nt, Mus musculus
aacuccgguaaagaggacgccuccaaaccaaagcagcacagcaaga

SEQ ID NO: 85234 - RNA, 46 nt, Mus musculus
gaggguugaagaagcugacaagguuugcaguuuguaaguuggagac

SEQ ID NO: 85235 - RNA, 46 nt, Mus musculus
ggucaaaauuugacaucuguggugacaaagcauauucuggaaagau

SEQ ID NO: 85236 - RNA, 45 nt, Mus musculus
gggguuauaucaaguggaaaaaagccuguaaacgagacaguaaag

SEQ ID NO: 85237 - RNA, 42 nt, Mus musculus
agucgggccuauauagugaguuccuguauagccgggguacau

SEQ ID NO: 85238 - RNA, 46 nt, Mus musculus
cuaaaaaaaguaauuuguguggcuaaaagccaauuuugaaggagag

SEQ ID NO: 85239 - RNA, 44 nt, Mus musculus
aauuuaaauauugguuuuuauuuacguguauuugugcgugucug

SEQ ID NO: 85240 - RNA, 46 nt, Mus musculus
cacaaggaaguuuauuuguuuauuuuguuuagaauaauuuauagga

SEQ ID NO: 85241 - RNA, 46 nt, Mus musculus
cccagaaacgagauccugaccacaugaacaauuugggcucuuuugg

SEQ ID NO: 85242 - RNA, 46 nt, Mus musculus
ugagcacagugugauuaaaaaggauuaaaagaacuuucugagcagg

SEQ ID NO: 85243 - RNA, 46 nt, Mus musculus
ugauucagcaagccacaacaguuaaaaacaaggauaucaggaaguu

SEQ ID NO: 85244 - RNA, 24 nt, Mus musculus
uagauguucaaauuggguggcaca

SEQ ID NO: 85245 - RNA, 49 nt, Mus musculus
cugauuucuguuuccaaacuucugagaaacaggaagaaauccauugugg

SEQ ID NO: 85246 - RNA, 46 nt, Mus musculus
acacaccucuuucagguguggcuuguucugucucucaagcccagaa

SEQ ID NO: 85247 - RNA, 46 nt, Mus musculus
cuugauugguugcuugggguuuuaaauggaguuguauuggugagau

SEQ ID NO: 85248 - RNA, 48 nt, Mus musculus
cuuuguccuugggucuggauggagccuugguguucggguguggugaag

SEQ ID NO: 85249 - RNA, 24 nt, Mus musculus
gguggguagagugcguguguuaaa

SEQ ID NO: 85250 - RNA, 42 nt, Mus musculus
aaaggaggcacuuucagauauuggggguggguuagcacagau

SEQ ID NO: 85251 - RNA, 43 nt, Mus musculus
ggugucuguguuucaggaugaagaccauucucagcaaucagac

SEQ ID NO: 85252 - RNA, 58 nt, Mus musculus
gucuacugagugaauguuguacugaacccuuuuuguagauauuuggaagauaugcguu

SEQ ID NO: 85253 - RNA, 79 nt, Mus musculus
cuucaagauuuuguaucuggugaucuugcagacaagaguacaugggaugaauauaaaggaaacuuaaagcgccagaaag

SEQ ID NO: 85254 - RNA, 24 nt, Mus musculus
ccacagaagagacaucccaaucug

SEQ ID NO: 85255 - RNA, 46 nt, Mus musculus
auuuugguuccuuuaagugauuuuguuuuuuaaucaucugcuccaa

SEQ ID NO: 85256 - RNA, 45 nt, Mus musculus
uggcucucaaccucccuaaugcugagacccuuuaauacagucccu

SEQ ID NO: 85257 - RNA, 46 nt, Mus musculus
aagguugaagaauauguuacuccugagaaguucaaauacugggaaa

SEQ ID NO: 85258 - RNA, 46 nt, Mus musculus
agcucauccaagcaugcuuuaggcgccagguucaguucucagcagc

SEQ ID NO: 85259 - RNA, 46 nt, Mus musculus
cuaugcuauuucuuaaauaguaauaaaagaaagcaugaaguuggag

SEQ ID NO: 85260 - RNA, 45 nt, Mus musculus
gaguacuuagacauagauagaaguacuacagccuuugaaaucuga

SEQ ID NO: 85261 - RNA, 25 nt, Mus musculus
gaaugagugacagaaggcuuggcag

SEQ ID NO: 85262 - RNA, 46 nt, Mus musculus
aaaacaacaacaaaacaaacaaacaaacacaaaaaaggcaguccag

SEQ ID NO: 85263 - RNA, 42 nt, Mus musculus
uguguuuauuuuucacauuuuaaaauucauucuaauggccag

SEQ ID NO: 85264 - RNA, 42 nt, Mus musculus
cagguuuauuuagaucaucguuuuugguugcauugcccugag

SEQ ID NO: 85265 - RNA, 40 nt, Mus musculus
agcucuugaacucacugccccuaugagcucauugcacaag

SEQ ID NO: 85266 - RNA, 48 nt, Mus musculus
gaacagaguucagaggcaucagaaacuggaguuagugaaaaugaggag

SEQ ID NO: 85267 - RNA, 46 nt, Mus musculus
gucaggcuaugugcuuguggcaggccucuugccucagccucuagaa

SEQ ID NO: 85268 - RNA, 63 nt, Mus musculus
gaagcgccggcacagagacuggaagcaauauuaacgccaauucagagcugaguccuucagccg

SEQ ID NO: 85269 - RNA, 42 nt, Mus musculus
cugugccggcgcuucuaacauaaggcuuccuucccguugcug

SEQ ID NO: 85270 - RNA, 46 nt, Mus musculus
uuuucaggcuguguaaagaacuucauugggaggacuggguccuuug

SEQ ID NO: 85271 - RNA, 46 nt, Mus musculus
ucuuucacugaguguuaggauuacagguauacuauaucuggcucaa

SEQ ID NO: 85272 - RNA, 26 nt, Mus musculus
cuuuuucuuuaaaaaaaaaggggggg

SEQ ID NO: 85273 - RNA, 45 nt, Mus musculus
cuaaaggccagcuuuucuuauacauaagguuucaaauccagcggg

SEQ ID NO: 85274 - RNA, 46 nt, Mus musculus
gagggcacauauauauauuaagggaauuugaguacauugcuuagua

SEQ ID NO: 85275 - RNA, 45 nt, Mus musculus
uuaagagacugggcauagucgugcacaucuuuaguauagcuuuca

SEQ ID NO: 85276 - RNA, 45 nt, Mus musculus
uagaacaccaaaccuacauaguacaacauugcuuuacagggggag

SEQ ID NO: 85277 - RNA, 46 nt, Mus musculus
guguucaaggccagcaugggcuacacacccaguuucaagccaaccc

SEQ ID NO: 85278 - RNA, 42 nt, Mus musculus
aaauagaaaaauagcuggauaugggcuggugugguagcuuag

SEQ ID NO: 85279 - RNA, 46 nt, Mus musculus
cauggaugcagugaacagccugcuuugcuugguguggagugccccg

SEQ ID NO: 85280 - RNA, 45 nt, Mus musculus
ccuccauucuuaggcacuguaacaaggacucauaugucucugcag

SEQ ID NO: 85281 - RNA, 42 nt, Mus musculus
guaauucugauaaaauuaaggcuaaaguggaaggacugucau

SEQ ID NO: 85282 - RNA, 23 nt, Mus musculus
aaacaaaaacaugucugccacca

SEQ ID NO: 85283 - RNA, 46 nt, Mus musculus
ggaaagugacuaguauaugacuaaaaucucaccuagcaaugcugag

SEQ ID NO: 85284 - RNA, 45 nt, Mus musculus
uuauuguuuuugaggggagguugcaaggguggagggcagguccua

SEQ ID NO: 85285 - RNA, 46 nt, Mus musculus
aaaauucacaaagauccaaaaaguuaauaaacaaacaagcccaccu

SEQ ID NO: 85286 - RNA, 41 nt, Mus musculus
gaaagaaagaaagacagacagacagacagacagacagucag

SEQ ID NO: 85287 - RNA, 45 nt, Mus musculus
uggcuucuucuggaucaugugaccuaacuuucaaauauucuguaa

SEQ ID NO: 85288 - RNA, 24 nt, Mus musculus
cugcaaacagaacagaaaggcuca

SEQ ID NO: 85289 - RNA, 46 nt, Mus musculus
uucuauaauuuuaggcuagacauugauaucuacauuucucuugggg

SEQ ID NO: 85290 - RNA, 42 nt, Mus musculus
agagaaauccuaucuagaaaggagaaggggggagggggguag

SEQ ID NO: 85291 - RNA, 41 nt, Mus musculus; identical to SEQ ID NO: 72923

SEQ ID NO: 85292 - RNA, 46 nt, Mus musculus
aagguaaaccccaaauccagugagagacccaagaaauaaaguggag

SEQ ID NO: 85293 - RNA, 46 nt, Mus musculus
aaucucucuguuuggugaacuccagguccagagagaaagcauguca

SEQ ID NO: 85294 - RNA, 46 nt, Mus musculus
aagauuuaucugcuuuagacuaagguauagcucagagauagagcag

SEQ ID NO: 85295 - RNA, 45 nt, Mus musculus
cgccacccccacccgagccagccccggugccacgggguucucggc

SEQ ID NO: 85296 - RNA, 46 nt, Mus musculus
uuuaccuccuccucaugcgggcggacggugcagcgagcgccgggcc

SEQ ID NO: 85297 - RNA, 46 nt, Mus musculus
aguacaaaucuguaauuccaggacucuggguagccaggcagaagga

SEQ ID NO: 85298 - RNA, 42 nt, Mus musculus
agaagacuuuuaauguagcuauaaaggagaaagcaggcagag

SEQ ID NO: 85299 - RNA, 97 nt, Mus musculus
aacaaaaacccuaaaguugaucucauugaaacugagaagaguagccgcuagugaggaggaaaaggaagaggaggaagaagaggaagauaaugaugaa

SEQ ID NO: 85300 - RNA, 41 nt, Mus musculus
aagccauaggguaguuugaauggguuaaauaacuaauaagc

SEQ ID NO: 85301 - RNA, 44 nt, Mus musculus
cccgggucuuggucacaucaagccagaguugaucacauaaagcc

SEQ ID NO: 85302 - RNA, 46 nt, Mus musculus
uguggagcugcugguguaugugccucuccucagcuuuccagcccag

SEQ ID NO: 85303 - RNA, 44 nt, Mus musculus
gcaaguugcugugaacaauaggcuucuauucuuucuuacgguca

SEQ ID NO: 85304 - RNA, 45 nt, Mus musculus
gaacauuucuccgugucucuguguguuuaggcagcccggguauua

SEQ ID NO: 85305 - RNA, 46 nt, Mus musculus
gggcaucaucucucagggccaagcggcugcgaagauuaggguucag

SEQ ID NO: 85306 - RNA, 43 nt, Mus musculus
aggugaagauuuuuguuuguuuuguuuugcuuuguuugggggu

SEQ ID NO: 85307 - RNA, 45 nt, Mus musculus
gugccuguuuuuguggcccaagugccuuugggugagaugaaauag

SEQ ID NO: 85308 - RNA, 46 nt, Mus musculus
ccccugauuaacucagcuuguggucguuuuugcucuauugucucug

SEQ ID NO: 85309 - RNA, 41 nt, Mus musculus
agggcuagaggguucuagaagccgcugccugccggacuggg

SEQ ID NO: 85310 - RNA, 46 nt, Mus musculus
guaagaaugcuaaucuaauucauaaagaaguugggaauuacggcag

SEQ ID NO: 85311 - RNA, 45 nt, Mus musculus
uugaucucuguguagccauguggcagaggaugaaacuuggccgag

SEQ ID NO: 85312 - RNA, 45 nt, Mus musculus
guguauuuugagugcucguuauuuuucccaccccaccgcccccau

SEQ ID NO: 85313 - RNA, 46 nt, Mus musculus
ccaaucacuaauuaagaaaaugccccacaggccugccuacagccag

SEQ ID NO: 85314 - RNA, 48 nt, Mus musculus
aauuuuuucacuagaauuucuuucuuuaauuaacuaguguaugugugu

SEQ ID NO: 85315 - RNA, 44 nt, Mus musculus
uggugauacacauguguauguuuuaugugugucuauagaugcca

SEQ ID NO: 85316 - RNA, 46 nt, Mus musculus
uauguauagguagguauauguagcaugcccauucaucugcugauag

SEQ ID NO: 85317 - RNA, 44 nt, Mus musculus
ggguaguguuagucaguguacacauguguauguaaauuccgcaa

SEQ ID NO: 85318 - RNA, 45 nt, Mus musculus
ggaaggaagcauuucaggaaucucaggucuuggcugaacggguuc

SEQ ID NO: 85319 - RNA, 45 nt, Mus musculus
uguuuacccagcaaaugugguucagaggguuuaauggaaagggcu

SEQ ID NO: 85320 - RNA, 58 nt, Mus musculus
uggggaguaguugagggcagcgauggguguuucagccugguaacgcauagaugaguug

SEQ ID NO: 85321 - RNA, 64 nt, Mus musculus
auuccuuuauaaaaggcauucugauccuuacuacucacuguugcaugauuggaaguacuuaaaa

SEQ ID NO: 85322 - RNA, 62 nt, Mus musculus
guauuuaaauuuccuugaaauaaaauuucacuaagggagaugcuuuugaaagaaaaacaaga

SEQ ID NO: 85323 - RNA, 25 nt, Mus musculus
gaagccagguaucuaagcauuucag

SEQ ID NO: 85324 - RNA, 46 nt, Mus musculus
ugacuaacucacccagggagaaauuagcuguggacaguuagguuua

SEQ ID NO: 85325 - RNA, 96 nt, Mus musculus
aucuugguucuaugaccccuuuaauucaauaguggacaguuauuugcuaaguauuuacuaugugugcugugagauggggauggggauugaagccag

SEQ ID NO: 85326 - RNA, 95 nt, Mus musculus
uucaaaagaagugcguugucaauacaagccaggaaaacagggcccagucuggaguggcguguguguuagugucucuucuuuucauuuucagccag

SEQ ID NO: 85327 - RNA, 47 nt, Mus musculus
cuuuuacaaauguucaaagaaaugauaacuuuucuaauauagagaga

SEQ ID NO: 85328 - RNA, 55 nt, Mus musculus
acuugaguguuuggaaacuacuauaucaguaaugcuaccuagguuugaagaucga

SEQ ID NO: 85329 - RNA, 45 nt, Mus musculus
cccauuuucuccugggggccaggacuuuggccucucauuuuccag

SEQ ID NO: 85330 - RNA, 49 nt, Mus musculus
uuauauuuaaguacacuguuagcugucuucagacagggcgucagaucuc

SEQ ID NO: 85331 - RNA, 44 nt, Mus musculus
gggggggaucaccacaguaaaaggaacuauauuaaaguguugca

SEQ ID NO: 85332 - RNA, 46 nt, Mus musculus
aaugaggacucagagagaaguggaaaggcaguaccugacaggccuu

SEQ ID NO: 85333 - RNA, 45 nt, Mus musculus
ggauuuugacaaaaaguugaugacuuaauuugaaucaguuuucag

SEQ ID NO: 85334 - RNA, 46 nt, Mus musculus
auuagauaagccuauuaauauuaagaugauugaacaaaggcaccgc

SEQ ID NO: 85335 - RNA, 45 nt, Mus musculus
guguuuccuacugaaauaggcuaguuggugagaacgucugucuag

SEQ ID NO: 85336 - RNA, 45 nt, Mus musculus
ggguuuggcggcugauuaugggauggugccugcaucgguacugag

SEQ ID NO: 85337 - RNA, 46 nt, Mus musculus
agcaccgcgaagagucuguuuguuucucugaaaaacuuaucuccag

SEQ ID NO: 85338 - RNA, 46 nt, Mus musculus
ugagacccagugccuggaauuccuggcacaagaacacuuuccccag

SEQ ID NO: 85339 - RNA, 45 nt, Mus musculus
uucaaauuggcuuugaugugaguuugguuggcugacuugacaaca

SEQ ID NO: 85340 - RNA, 46 nt, Mus musculus
ugugucacccaugguuucuuauauuuauuuccuacaauuguugcag

SEQ ID NO: 85341 - RNA, 46 nt, Mus musculus
aacacaccuaucauggaacacgugugugucuucagaagccagcaga

SEQ ID NO: 85342 - RNA, 42 nt, Mus musculus
cauggugaagguaaagguaggauuccuacagaugagcugaag

SEQ ID NO: 85343 - RNA, 46 nt, Mus musculus
agcuaugaaauaacaggacaaaugaaaacaggaagauggcugcaag

SEQ ID NO: 85344 - RNA, 42 nt, Mus musculus
ucacuuaggcaggaagcaggaggugggacauccuauaggcag

SEQ ID NO: 85345 - RNA, 45 nt, Mus musculus
aaauauaucuugagucugagucuuauuucuggaagcauggggcua

SEQ ID NO: 85346 - RNA, 79 nt, Mus musculus
gcagauguaucuuuuguucuguuuuuugacuguaauaaugagaucuguauugaacgauguccugaaaggggaaaaagua

SEQ ID NO: 85347 - RNA, 56 nt, Mus musculus
ugacuuauaugaagaaauggggaaagucaagaagauagauguuucuaagucuguug

SEQ ID NO: 85348 - RNA, 42 nt, Mus musculus
uacuugccacucacacagaggaccugaguucaguccccagca

SEQ ID NO: 85349 - RNA, 46 nt, Mus musculus
ugagcauugaauuuuaauaugcguauuagguacuucuaguggauga

SEQ ID NO: 85350 - RNA, 45 nt, Mus musculus
gacgguguccgcuuuccagcaacauccacgcacuauuuuuguaug

SEQ ID NO: 85351 - RNA, 47 nt, Mus musculus
cuuaaguguaauuacuuaaauuuugauauauaaaauuuaaagaagac

SEQ ID NO: 85352 - RNA, 56 nt, Mus musculus
agcuuuaugaaagguaaaguugggcuagagacuguaggucgggcuugaagccagua

SEQ ID NO: 85353 - RNA, 46 nt, Mus musculus
ugguaucuggaucuuaccacuuacccuucuuuuguuccaggguuug

SEQ ID NO: 85354 - RNA, 46 nt, Mus musculus
uguuuaugaaagaaucuccuuugccucugcauuucgggauguaggu

SEQ ID NO: 85355 - RNA, 42 nt, Mus musculus
aagcauccacaguugagguuucugaugacuguaaaacaagga

SEQ ID NO: 85356 - RNA, 46 nt, Mus musculus
ggugauauugauuucagaggucagcuuuagagagaaagguuaagag

SEQ ID NO: 85357 - RNA, 46 nt, Mus musculus
gucagugcucuccagcccccucauuguguuucuaacagucacuuaa

SEQ ID NO: 85358 - RNA, 45 nt, Mus musculus
accaagcuuagucugccuccaaaacaaacaauaacaagccaaauu

SEQ ID NO: 85359 - RNA, 46 nt, Mus musculus
cagagcacagacacgcuggacuguucuuaaaugcaaacagcaagac

SEQ ID NO: 85360 - RNA, 45 nt, Mus musculus
auggaaauccgucagaaacccuaagggacaggaaauugcaugacu

SEQ ID NO: 85361 - RNA, 46 nt, Mus musculus
cuuuuaagccgcaauaaccaucaccuucuuccuagucugccuaguu

SEQ ID NO: 85362 - RNA, 46 nt, Mus musculus
gacaaauguuaaaaauugcuuuuguaaaguucugaguuugggagau

SEQ ID NO: 85363 - RNA, 46 nt, Mus musculus
gguuucaaugugucucacucgcugacacuuaauaucaagcacagaa

SEQ ID NO: 85364 - RNA, 45 nt, Mus musculus
ggaugugaaggaagaugacaaagugaaaccguacacuguugagau

SEQ ID NO: 85365 - RNA, 46 nt, Mus musculus
ccaagaacuauuugcacauauuuaugaguugauuacuuuaguagau

SEQ ID NO: 85366 - RNA, 45 nt, Mus musculus
aaagcaauaagacaacaaacagaacgacaaagaaaaccaccaaca

SEQ ID NO: 85367 - RNA, 46 nt, Mus musculus
cuaugacauuguguggucaggugacauucuucucuuacgcuuggau

SEQ ID NO: 85368 - RNA, 43 nt, Mus musculus
agcauauuagcaaagggaagagggaguuaggggugguuguggg

SEQ ID NO: 85369 - RNA, 45 nt, Mus musculus
cugauuucagagaugaagcucuggaaggguuauguuaagcucgua

SEQ ID NO: 85370 - RNA, 44 nt, Mus musculus
cacuuuccgugaccacccagauuaacuaucucaacaaggcccug

SEQ ID NO: 85371 - RNA, 46 nt, Mus musculus
aacagauuccuuuuacagcuuuaauguucuuuuuaaauuugcccau

SEQ ID NO: 85372 - RNA, 42 nt, Mus musculus
uuccucaguuucagucacauuauuaauuuuagacaauccaag

SEQ ID NO: 85373 - RNA, 79 nt, Mus musculus
aaggggccgaauaauaaaaccaguagaaccaaaacauaaugucaucuuuaccuucaaaagcuuuggagguggcaggggu

SEQ ID NO: 85374 - RNA, 46 nt, Mus musculus
uuagagaucaccuaauuuacacauucggacaaaaggcaaggcccag

SEQ ID NO: 85375 - RNA, 45 nt, Mus musculus
cccggguguaauaagacugguucggguguaauaagacugguucga

SEQ ID NO: 85376 - RNA, 42 nt, Mus musculus
cccugcggcuuggggagucggagcgggcggcgcggccggcau

SEQ ID NO: 85377 - RNA, 46 nt, Mus musculus
acauuuaacagacaguauucgagaggugaauaucaaugcaaagaga

SEQ ID NO: 85378 - RNA, 59 nt, Mus musculus
auagacugugaacucaggcuaaggugagaguugacuggagaccagacacuaagugcaga

SEQ ID NO: 85379 - RNA, 45 nt, Mus musculus
ugggauuggggaugaagaauaaugcauagcuccaaagcagacagu

SEQ ID NO: 85380 - RNA, 64 nt, Mus musculus
uaaaaccuugaucucugcuccucaccucagucucauuuuaauuaauuacagcccucaagccagu

SEQ ID NO: 85381 - RNA, 46 nt, Mus musculus
cccauaccagcaucacccuuuagaagaauucugugugugccuagaa

SEQ ID NO: 85382 - RNA, 42 nt, Mus musculus
cucagacaacccuugugggaacacucauuagacggugcaucc

SEQ ID NO: 85383 - RNA, 41 nt, Mus musculus
gucagcccuacgcgccugcccaguuccuccagcggggacca

SEQ ID NO: 85384 - RNA, 42 nt, Mus musculus
gcgcgcgcacacacacacacacacacacacacacacggucuu

SEQ ID NO: 85385 - RNA, 42 nt, Mus musculus
gcuggccugggcucaaauccuccugccucucaagugcuggau

SEQ ID NO: 85386 - RNA, 46 nt, Mus musculus
gacuuaaacaucaaagucgaugggcgugcaauugugcgaggcaacg

SEQ ID NO: 85387 - RNA, 46 nt, Mus musculus
caaaaggaugauugaaauagacucauugugugaaaaaucuguaguu

SEQ ID NO: 85388 - RNA, 45 nt, Mus musculus
agaggacaagauguagcuccgagugucucaaaaguuucaauggug

SEQ ID NO: 85389 - RNA, 45 nt, Mus musculus
aagccuuauuaaaucuaaauccuccaguggcuacuccuggcagau

SEQ ID NO: 85390 - RNA, 59 nt, Mus musculus
uguuguguuuuccuucacgaggcggcucgucuggguucaagagagaaagguauggcagc

SEQ ID NO: 85391 - RNA, 46 nt, Mus musculus
ggauuugaagcauggguuugguaugguagcgaccugcugaguagag

SEQ ID NO: 85392 - RNA, 45 nt, Mus musculus
ugacaccaagcaaagccauggcuguucugugaaguaaggacugag

SEQ ID NO: 85393 - RNA, 45 nt, Mus musculus
uuggaagucacccacccagagcacucagauauauuuuccgagaag

SEQ ID NO: 85394 - RNA, 45 nt, Mus musculus
cuaccaugagaaccucgguaucuagcaaugccaaauacuuuauaa

SEQ ID NO: 85395 - RNA, 45 nt, Mus musculus
uauuguaaaaugacuaugaaauuaaguaauuuuagaaccacagag

SEQ ID NO: 85396 - RNA, 46 nt, Mus musculus
aucucauucaaaguuaauaaaagcaaaaaaaaaaagagucccccuu

SEQ ID NO: 85397 - RNA, 42 nt, Mus musculus
uaggcccgugggacgugcaugugcacagugacuuggcaaagg

SEQ ID NO: 85398 - RNA, 46 nt, Mus musculus
uaauggugaugaggaccuaaaaguucuaacguauuaugucuaauag

SEQ ID NO: 85399 - RNA, 46 nt, Mus musculus
gugacgaugaugaagaugauguucacgucacuauaggagacaucaa

SEQ ID NO: 85400 - RNA, 46 nt, Mus musculus
cuggcauuguucuuaguugagauagcuuugguuucugaggcccuuc

SEQ ID NO: 85401 - RNA, 46 nt, Mus musculus
ugccuucauuuuuaugaauggcgcacugccuguguacugggaugug

SEQ ID NO: 85402 - RNA, 46 nt, Mus musculus
auugaguuuaguaccugggagauuuuugagacggaaaaaugucaga

SEQ ID NO: 85403 - RNA, 46 nt, Mus musculus
uuaggaguuauggaacagcaccaguaaaucuuaauaucaaggcagg

SEQ ID NO: 85404 - RNA, 48 nt, Mus musculus
auaggaaccaaagucaaaggaguggaccucgaugcaccuggcagcauu

SEQ ID NO: 85405 - RNA, 66 nt, Mus musculus
uaggugcugaucuuucugauuauuuuaacuauggcuuuaaugaagauacuuggaaagcuuacugug

SEQ ID NO: 85406 - RNA, 62 nt, Mus musculus
aaaaacaaaagaggauacgaaugggacuggaaguuauaccuguuacuucaaccacaaacaag

SEQ ID NO: 85407 - RNA, 42 nt, Mus musculus
auuuuaaaugauuaccaaccuuucaggugucugcucgggcau

SEQ ID NO: 85408 - RNA, 46 nt, Mus musculus
aaguuguggguauauaguuuacauucaugcauaugcacacagagag

SEQ ID NO: 85409 - RNA, 45 nt, Mus musculus
ggauuuuggaaaagaaaaugacagccaaguggaguuaaaagguca

SEQ ID NO: 85410 - RNA, 45 nt, Mus musculus
uagaugccuuugucaucaguguuuaucagacucugauagccagga

SEQ ID NO: 85411 - RNA, 45 nt, Mus musculus
ucaugggaauaggcuuauugguuuucuguuucacuuuguguugag

SEQ ID NO: 85412 - RNA, 23 nt, Mus musculus
cauggacuguaugaauaugcaug

SEQ ID NO: 85413 - RNA, 46 nt, Mus musculus
guguauaugccuguguugagcagcauucacauggcacacguaggag

SEQ ID NO: 85414 - RNA, 45 nt, Mus musculus
cugugcauauagauaguuaaauucaagguaaugauucaaugugau

SEQ ID NO: 85415 - RNA, 91 nt, Mus musculus
aucaaaaaggauaguaaauucagaaauccugaugagagagacaagacaagaggaaaggcuauccuaacugagugugaugaggaugagugga

SEQ ID NO: 85416 - RNA, 45 nt, Mus musculus
uuugguugauuugggaggcaguuggagaaccuugagcagagagag

SEQ ID NO: 85417 - RNA, 45 nt, Mus musculus
ggggaugccauuuuauuaauauguggacaauguggagaggaucag

SEQ ID NO: 85418 - RNA, 46 nt, Mus musculus
guauucaugggaccagcugauaauguuaacuguauucccaauccuu

SEQ ID NO: 85419 - RNA, 82 nt, Mus musculus
auaaacgcauuuuuaaggccuaauuaauuauagguaggugccaucggauaaaaaccaauagcuaguuaauagagaucugccu

SEQ ID NO: 85420 - RNA, 45 nt, Mus musculus
cucuaaccccucccacaauccuuauucucaaauacauggccucuu

SEQ ID NO: 85421 - RNA, 46 nt, Mus musculus
uauuacuagugugcauauggccucagagcugauuauuuggcaaugg

SEQ ID NO: 85422 - RNA, 46 nt, Mus musculus
ucuacguagagaacagcuuacagugugaaccgugauaggaacaggg

SEQ ID NO: 85423 - RNA, 45 nt, Mus musculus
caaaacagauacaugagagaaauuaaaaaguaaaaauaggggcaa

SEQ ID NO: 85424 - RNA, 45 nt, Mus musculus
uugcaauauuuucuauaucugagagugaguugacuagaaauccua

SEQ ID NO: 85425 - RNA, 42 nt, Mus musculus
ucucaauuuaguuuccuugcuaagaacaccgaggaaagguag

SEQ ID NO: 85426 - RNA, 69 nt, Mus musculus
uuuccuagcaaaauaaaauacagauuacuaggagagacugaagauggcacaagaggguguuaauguuug

SEQ ID NO: 85427 - RNA, 45 nt, Mus musculus
cuuccuucaaaagugugcuuuucuauguugauggaaaugggguag

SEQ ID NO: 85428 - RNA, 46 nt, Mus musculus
uucccaaaaaaguauguguggggaucaucauuuuauguauauggag

SEQ ID NO: 85429 - RNA, 46 nt, Mus musculus
auacuggccuaagcaguagaugucuauugcuaaaguuauagaugau

SEQ ID NO: 85430 - RNA, 45 nt, Mus musculus
uuuaaagaaaauuucacuuuggcaccgugacugcaaagggauuga

SEQ ID NO: 85431 - RNA, 46 nt, Mus musculus
uuuuaguagcuuugaaagaauacugaucuuuuacaggauuggcaag

SEQ ID NO: 85432 - RNA, 46 nt, Mus musculus
gauagccuugauuggcagauuuugauuauacuuaaaugagaccaaa

SEQ ID NO: 85433 - RNA, 46 nt, Mus musculus
ccauuagagacaucagaaugcacaugauguacagacaagcaugcag

SEQ ID NO: 85434 - RNA, 56 nt, Mus musculus
uuuugaugggaauaagcauuaaaacuggggaagggaaccaagucugcaguggagaa

SEQ ID NO: 85435 - RNA, 46 nt, Mus musculus
guuuuggugccuguaaauggugaggguaguaagcauucuguuaggg

SEQ ID NO: 85436 - RNA, 45 nt, Mus musculus
acauucuguggcugugagcagccuuuaaccccagcucacugggag

SEQ ID NO: 85437 - RNA, 45 nt, Mus musculus
ucuaaguugugugcaucauucuugccgauggcuuuuugaaggaua

SEQ ID NO: 85438 - RNA, 44 nt, Mus musculus
gcuuaaacaguguuuuuuuguauuaaaaguguacaaaagcgagu

SEQ ID NO: 85439 - RNA, 46 nt, Mus musculus
cuggagcaauugaugucauuggucaaacaauaaccaucagccgagu

SEQ ID NO: 85440 - RNA, 46 nt, Mus musculus
ccuccuccauuucucccaccaccuccaacugucagcaccgccccac

SEQ ID NO: 85441 - RNA, 98 nt, Mus musculus
aaggugcaggugugaucacagaguccagggccagauugcuucuuccccaauauuuguucugacuuacaaaugccaccuacuccaucugcccugugagu

SEQ ID NO: 85442 - RNA, 46 nt, Mus musculus
ggucuguggcuuuagaaaagucuguuaucuuggaauagaaggcagu

SEQ ID NO: 85443 - RNA, 81 nt, Mus musculus
uagugaagacacaaaagugguuccuuagucucugaaaaaauaaaguaagauguaaaaauaguuaauuuguuaauaugcuca

SEQ ID NO: 85444 - RNA, 48 nt, Mus musculus
uaacauacuuuaaucguuucacauacugaacauauuuuauggugggac

SEQ ID NO: 85445 - RNA, 44 nt, Mus musculus
ugcuauugugaacugccugaugucagugcugggagcuagacuga

SEQ ID NO: 85446 - RNA, 46 nt, Mus musculus
uauaagugaauauucuuaaauaguucuuaaaauuaugagcugaaaa

SEQ ID NO: 85447 - RNA, 46 nt, Mus musculus
uaugcaugugguaugcauacauauauuuagaugaaacacccauaca

SEQ ID NO: 85448 - RNA, 46 nt, Mus musculus
cucaaaacauucaucugaacacauguaugaaccucauucauugaau

SEQ ID NO: 85449 - RNA, 46 nt, Mus musculus
ggugucauauccacuggaauugcauuaucuuaugcuuaacugacag

SEQ ID NO: 85450 - RNA, 42 nt, Mus musculus
guucaagaguaacuacauucacccccagauguuggccaucuc

SEQ ID NO: 85451 - RNA, 46 nt, Mus musculus
uuuguauaguucuuuuuguuuuuauuugguugauuucagcccugag

SEQ ID NO: 85452 - RNA, 46 nt, Mus musculus
uguuuccuguaugcagcaaaaugcuggguccuguuuacauagccag

SEQ ID NO: 85453 - RNA, 46 nt, Mus musculus
uuuggguuuauugaaagauuacuuucuugcuuuuucuaggguguaa

SEQ ID NO: 85454 - RNA, 45 nt, Mus musculus
uguguaaugaagucccucuuacuuaaaagaggauucaaaugccag

SEQ ID NO: 85455 - RNA, 45 nt, Mus musculus
agcaaaguacuugauuuguauguuuaagucuguuggaguugucca

SEQ ID NO: 85456 - RNA, 46 nt, Mus musculus
aaucuuuuguaggauauuacuauaguaggauuaaaauuaaaggcag

SEQ ID NO: 85457 - RNA, 46 nt, Mus musculus
gguuucuaaugcugugauaaaguacugugaccaaaagcaacaggag

SEQ ID NO: 85458 - RNA, 31 nt, Mus musculus
cugcacuuguucucaccacuuaacgugcuuu

SEQ ID NO: 85459 - RNA, 46 nt, Mus musculus
uagaguuugaaauucucaccuuaacaaucugugaggaaaaugguag

SEQ ID NO: 85460 - RNA, 45 nt, Mus musculus
gagcacuuguucuuagaguggugaauacugggccuugggauggug

SEQ ID NO: 85461 - RNA, 46 nt, Mus musculus
uuacuucuuacaguguaaugguggaaagauuaguuacggaguucag

SEQ ID NO: 85462 - RNA, 64 nt, Mus musculus
gugcaugacguggacucgaggacuccugcuguaacugccaagccugggcucgauugauguuagu

SEQ ID NO: 85463 - RNA, 46 nt, Mus musculus
cuccaccaggcgccccaccuccaucucuuauaccaacaauagaaag

SEQ ID NO: 85464 - RNA, 46 nt, Mus musculus
uauuugcauuagauauaaagauaguucuuuccuccacaguggccau

SEQ ID NO: 85465 - RNA, 51 nt, Mus musculus
caaggagagaaaaagaccgagaccgagaccgggagagagaccgagacagag

SEQ ID NO: 85466 - RNA, 45 nt, Mus musculus
ggagcgagagcgcgaccacagccccaccccaaguguuuucaacag

SEQ ID NO: 85467 - RNA, 47 nt, Mus musculus
cagggaguaugcagagagaggcuaugagcgccauagagcuagucggg

SEQ ID NO: 85468 - RNA, 33 nt, Mus musculus
agacacaagcacaaaaagucuaaaagaagcaaa

SEQ ID NO: 85469 - RNA, 45 nt, Mus musculus
uuguaggaaaauaacauggcauagcugcagcaaagaguacagagg

SEQ ID NO: 85470 - RNA, 46 nt, Mus musculus
auauucauaugcauauuaaguagaccaaaacaagccccuugacuag

SEQ ID NO: 85471 - RNA, 46 nt, Mus musculus
gaauucauaugcauauuaaauagaccaaaacaagccccuugacuag

SEQ ID NO: 85472 - RNA, 89 nt, Mus musculus
uggccaagggacagaaguaagggggaaucugugagugacagagcccgcucugagaagucaguggggggaaaggagaaaagaggugcaga

SEQ ID NO: 85473 - RNA, 42 nt, Mus musculus
gcuguaauuggagccugcaccugcagacccugggccugggag

SEQ ID NO: 85474 - RNA, 26 nt, Mus musculus
auaaacugauuuccaagggaauaacg

SEQ ID NO: 85475 - RNA, 42 nt, Mus musculus
gccugaagccccucccccugcaucucuccccagcccgcgccc

SEQ ID NO: 85476 - RNA, 45 nt, Mus musculus
gggggcuuccucuucucugaggagaaggggaggggucggugagga

SEQ ID NO: 85477 - RNA, 46 nt, Mus musculus
ggcucaggucuuccuccgggccggcgcggaccccggccggggccca

SEQ ID NO: 85478 - RNA, 46 nt, Mus musculus
acaaaaaaacguguuuuggcaugaaggaaguugcccuugaaugcag

SEQ ID NO: 85479 - RNA, 44 nt, Mus musculus
ugagggauuccaaaacuccauuuauagguaaacuagagccucau

SEQ ID NO: 85480 - RNA, 45 nt, Mus musculus
gcauccugggaagggcuccggaagguucugcuggcucuugaagau

SEQ ID NO: 85481 - RNA, 42 nt, Mus musculus
cagucagcaccuguuaggagauuuaguuauagugacgguaag

SEQ ID NO: 85482 - RNA, 41 nt, Mus musculus
agaaaaauuacuuagcaaaugccaaaacauacacggucuua

SEQ ID NO: 85483 - RNA, 59 nt, Mus musculus
guuuuaaauacuuuuauggaaaaaacuauaaaaugaacucaagcagggaaaaaacuuuu

SEQ ID NO: 85484 - RNA, 55 nt, Mus musculus
uuuaagaguauauauccagccgccuuuuacuugcuaaaggauuuacuagaugaag

SEQ ID NO: 85485 - RNA, 46 nt, Mus musculus
cacacacacacacacacacacacacacauggugugugugggggcag

SEQ ID NO: 85486 - RNA, 49 nt, Mus musculus
gguagugcagaccagguggcacaugugaagcaggagccauucaccauca

SEQ ID NO: 85487 - RNA, 46 nt, Mus musculus
gauucuuaucuuuacaauuaagggguuggaggacuugcuggugcag

SEQ ID NO: 85488 - RNA, 46 nt, Mus musculus
uuuuacagugaaaaaaauuuuuucuuccauguuucuuaaaccacuu

SEQ ID NO: 85489 - RNA, 93 nt, Mus musculus
uacaguugucccaguccuugggaauuugaggcaggagcaguggcauuuccuuugaacauacagucaugaguaaacuacaguuuuuaugcugca

SEQ ID NO: 85490 - RNA, 48 nt, Mus musculus
cagaauauagauccuauauauucugacguuagagcuaaucuggccgag

SEQ ID NO: 85491 - RNA, 46 nt, Mus musculus
gauaacaggacugggcaggccuaccaacacugcuccucggccagau

SEQ ID NO: 85492 - RNA, 43 nt, Mus musculus
uuaaacugcauuaaacacagaaggugucuucuucagcacccag

SEQ ID NO: 85493 - RNA, 45 nt, Mus musculus
caaucacaaaaggcugagaucugggugcugaagaagacaccuucu

SEQ ID NO: 85494 - RNA, 46 nt, Mus musculus
aaggggagaauacagugaguuuguguuccuuaaacuauacagcuag

SEQ ID NO: 85495 - RNA, 45 nt, Mus musculus
aguccacaacacugccccuccuaccaaaaacaaagaggaggagga

SEQ ID NO: 85496 - RNA, 44 nt, Mus musculus
ggggagagaaggaagaagcaaaggcagaaugcacuggaggucag

SEQ ID NO: 85497 - RNA, 46 nt, Mus musculus
uaaauaagucucaaaaaggacacaagagcaaggagggaacucagau

SEQ ID NO: 85498 - RNA, 23 nt, Mus musculus
ucucuacaggccuccagcccauc

SEQ ID NO: 85499 - RNA, 44 nt, Mus musculus
gauauaauaugauaccuuagaaagccuaguuagugguggggggu

SEQ ID NO: 85500 - RNA, 51 nt, Mus musculus
uauuucuauuagauuaugcauaguugggcaagcaugaugcccuagauguuu

SEQ ID NO: 85501 - RNA, 45 nt, Mus musculus
cagccagggcuacacagagaaacccugucaugaaaagccaaaaaa

SEQ ID NO: 85502 - RNA, 61 nt, Mus musculus
uggccacagggagugacacuauuaggagguauggccuuauuagagaaaguguggccuucuu

SEQ ID NO: 85503 - RNA, 45 nt, Mus musculus
uacccuuagaaugcuugugugugugugugugugugugugugugug

SEQ ID NO: 85504 - RNA, 46 nt, Mus musculus; identical to SEQ ID NO: 61923

SEQ ID NO: 85505 - RNA, 59 nt, Mus musculus
caugauggcagcuaugaaaaacgucuugucgccgaguucggacacuaugaugacugaua

SEQ ID NO: 85506 - RNA, 46 nt, Mus musculus
acccagauuuuacuuagguggaauuuuuaguuauucagagccagaa

SEQ ID NO: 85507 - RNA, 46 nt, Mus musculus
ggagaaaacugaaauauuaauauuaacuugaguaaacugcugugac

SEQ ID NO: 85508 - RNA, 46 nt, Mus musculus
ccccaaacuucuauggaaguaauuuuaaauacauaaagccauacag

SEQ ID NO: 85509 - RNA, 42 nt, Mus musculus
cugcacucuucgccauuuuuggcauuagaaugcuucgggaag

SEQ ID NO: 85510 - RNA, 46 nt, Mus musculus
ugggccagauguugaaacugguacaagcacagcaauaccucagaaa

SEQ ID NO: 85511 - RNA, 45 nt, Mus musculus
aauggggcgaucgcucucaacucacuaccauuguccuggcagcua

SEQ ID NO: 85512 - RNA, 45 nt, Mus musculus
cuguugggguggggauggaucgccguccucuccugagagcuguca

SEQ ID NO: 85513 - RNA, 56 nt, Mus musculus
auccuuggagaaguuccucacauaguucuacaguuuaaaauaggaagcauuucagg

SEQ ID NO: 85514 - RNA, 45 nt, Mus musculus
uagccacacugcacuccuggaucccagcaucuacccucagcccuu

SEQ ID NO: 85515 - RNA, 42 nt, Mus musculus
gugcuuggguucacagcucaagaguacaguucaucaccgagg

SEQ ID NO: 85516 - RNA, 72 nt, Mus musculus
caguggguggcacagugggacacugcuuauguacuggauuggcaguaauuggaggaaggaugauagcgcaaa

SEQ ID NO: 85517 - RNA, 46 nt, Mus musculus
caagcuuaucuaaaauauggucacacuuguuuguuuuguaagccag

SEQ ID NO: 85518 - RNA, 46 nt, Mus musculus
acccugugugaggcuugaacauuuucaacauuuaaaaugggcuggg

SEQ ID NO: 85519 - RNA, 46 nt, Mus musculus
guagcauugauuuguaaguuugacccacuuaauuauuaugcccaaa

SEQ ID NO: 85520 - RNA, 46 nt, Mus musculus
gagaugaugguucuuucucccaaggaaaaagaaauagagauaguua

SEQ ID NO: 85521 - RNA, 46 nt, Mus musculus
aaguuguuuauaagauugagcaaguaguuucuaauaguuuuuagau

SEQ ID NO: 85522 - RNA, 46 nt, Mus musculus
gucagcuuugcuacaugcauuaaaaaugacauuaauuaaaaaagau

SEQ ID NO: 85523 - RNA, 46 nt, Mus musculus
gcccaguugguaccuugccuaggaugcacaaaguacuuaagaggau

SEQ ID NO: 85524 - RNA, 45 nt, Mus musculus
cccaaagcacauagcuccccaugcuacaaugauugacagccagug

SEQ ID NO: 85525 - RNA, 50 nt, Mus musculus
uaaauagaaauagagaguaaauauaaguuaauuagaaagacccagauaga

SEQ ID NO: 85526 - RNA, 46 nt, Mus musculus
gggcccauuauaugaaaauaaaaacuacaagaaauaggcuaagaca

SEQ ID NO: 85527 - RNA, 65 nt, Mus musculus
caaauaauuucaguaauauaaaaaauuuagaaugaucauaacagaaaaaaaaucaaaguaagaua

SEQ ID NO: 85528 - RNA, 46 nt, Mus musculus
uaauucauucauuauaaggaauuuuagugucuccaguaagccagua

SEQ ID NO: 85529 - RNA, 46 nt, Mus musculus
gugugaccaacaaacacaauggcucuggggcuaaauggacucaguu

SEQ ID NO: 85530 - RNA, 46 nt, Mus musculus
uucauuccuuguguuucacuuguaugcaguaccccccaccccacuc

SEQ ID NO: 85531 - RNA, 54 nt, Mus musculus
gggaaaggaagaggaggaagagaagaaaguggaaaagaagaaaaaggaggagac

SEQ ID NO: 85532 - RNA, 44 nt, Mus musculus
ccccgugugguuguguguacguuaaauuccagcgcucuggcaga

SEQ ID NO: 85533 - RNA, 55 nt, Mus musculus
uguguguguguguaugugugugugaguauguguaugugugugugagugaguaugu

SEQ ID NO: 85534 - RNA, 45 nt, Mus musculus
cagugcuuggugacagagcagaucagcacaaggugacggauagag

SEQ ID NO: 85535 - RNA, 46 nt, Mus musculus
guugugagccaccaugugguugcugggacuugaacucagguccucu

SEQ ID NO: 85536 - RNA, 41 nt, Mus musculus
acuaacucuggcauugcuucucacccuagugaugucauuuu

SEQ ID NO: 85537 - RNA, 42 nt, Mus musculus
cguuugacuuuucuuucuguguagauuucucagccaccaaug

SEQ ID NO: 85538 - RNA, 46 nt, Mus musculus
uauaagaugcagacggauaauuuaccuauauauauaaugcccagua

SEQ ID NO: 85539 - RNA, 42 nt, Mus musculus
aauaguccaucucuugugagcugggcaaacacaugccaagua

SEQ ID NO: 85540 - RNA, 45 nt, Mus musculus
cuacauuuggucuauaguaucauguguuacauaauggcaggucaa

SEQ ID NO: 85541 - RNA, 46 nt, Mus musculus
ugugccgggaccccccauccaucugucguucauacacuuaguacau

SEQ ID NO: 85542 - RNA, 46 nt, Mus musculus
ggcucugaggaccaguguacaauucuuaaaaaaugaaaaccuacgu

SEQ ID NO: 85543 - RNA, 115 nt, Mus musculus
ugcagcaucugaggauucauuuuguacaaggacugacuuuucacucgagagaaggcaggggguuaguggcaguucccagaaccaugcuugagggguuuaaaagaggcuagaguau

SEQ ID NO: 85544 - RNA, 89 nt, Mus musculus
aguggauaccacaugcuuauguauguauacuuuaagcuuugagauuuucugagguuauuauuaaauugcuauauugaaccugaagauua

SEQ ID NO: 85545 - RNA, 48 nt, Mus musculus
augguagcugccuggacagauguguugcuuccagacuguagggucauc

SEQ ID NO: 85546 - RNA, 46 nt, Mus musculus
gccaauaagccagaauuugauugucuugcagaguaccucgguagga

SEQ ID NO: 85547 - RNA, 46 nt, Mus musculus
gauuuucauuauaaccuagcagauuuuauuuuuuacuauggcagaa

SEQ ID NO: 85548 - RNA, 46 nt, Mus musculus
gcaaagaaguuuggcguguugucugacaacuuuaaaggcaaaagaa

SEQ ID NO: 85549 - RNA, 39 nt, Mus musculus
ucuucggggggucacacagaggaagccucugguccagcg

SEQ ID NO: 85550 - RNA, 45 nt, Mus musculus
guauuuacuuuuaauuauuaccugugaguuggucaccuggcagug

SEQ ID NO: 85551 - RNA, 44 nt, Mus musculus
gagaaaaaauucccaccaauauuccuauauuccuagccugaauu

SEQ ID NO: 85552 - RNA, 45 nt, Mus musculus
ccccuccucaagaaaaagaugaugcuccagacuggguagcaaggu

SEQ ID NO: 85553 - RNA, 45 nt, Mus musculus
gguauuuguagaaugccugguuucuauuacugugugcuuuuggau

SEQ ID NO: 85554 - RNA, 47 nt, Mus musculus
ugguuuugcaagagacuggcgcuaucccacauagguaucaagggcag

SEQ ID NO: 85555 - RNA, 42 nt, Mus musculus
gacgcuucacggaaaaauagcuguggcccauaacggggaacu

SEQ ID NO: 85556 - RNA, 42 nt, Mus musculus
uguucgguaaaguuguuuucguauauuucuuucugcccagac

SEQ ID NO: 85557 - RNA, 24 nt, Mus musculus
gaagggcuuugucacacaaggucc

SEQ ID NO: 85558 - RNA, 33 nt, Mus musculus
gaguugauuucuagcacuuggaaagagaaaagg

SEQ ID NO: 85559 - RNA, 46 nt, Mus musculus
gugaacaaggaugcuccuuaguguaguuuguaugaaggcaggagau

SEQ ID NO: 85560 - RNA, 45 nt, Mus musculus
uccaacccauacucggggaugcacucaguagaauugcaugcagau

SEQ ID NO: 85561 - RNA, 46 nt, Mus musculus
aaggccucuuccugaaguguugaggaacgcagugcaauaggaaguu

SEQ ID NO: 85562 - RNA, 46 nt, Mus musculus
uauaauaagugcuuguuacccuaaaacaguagaucagggccaaaga

SEQ ID NO: 85563 - RNA, 46 nt, Mus musculus
caugcuaccuagcaacauaagaaugccauuaagauuugcuuagauc

SEQ ID NO: 85564 - RNA, 42 nt, Mus musculus
gaccaacccuauacuugcuuuuauaugagaaagcuauaagau

SEQ ID NO: 85565 - RNA, 46 nt, Mus musculus
uacugagcagauuugucagccugaaagcaguuagagguuuggagau

SEQ ID NO: 85566 - RNA, 41 nt, Mus musculus
caugugaucacucugggacucguggggcuacagcaccggug

SEQ ID NO: 85567 - RNA, 61 nt, Mus musculus
cuucucuuaaccuaacccacuaacacuuuauuacagccagcugguuuuacacagagaaauc

SEQ ID NO: 85568 - RNA, 46 nt, Mus musculus
augagugccacgcauccaacucccaagggcaggcuuccgcggcagc

SEQ ID NO: 85569 - RNA, 47 nt, Mus musculus
auucagacccggggugguccagaaaagcaugaaguaacgggcugggu

SEQ ID NO: 85570 - RNA, 46 nt, Mus musculus
ggaacaaggucaguagugcaggccucgggaaagcaucgugcaagcc

SEQ ID NO: 85571 - RNA, 46 nt, Mus musculus
gggcaucccuuuugcuguaagcuucuuuggcucucuguuccuggag

SEQ ID NO: 85572 - RNA, 46 nt, Mus musculus
gugggagaagaggcccuugguccugggaaggcuagaugccccagug

SEQ ID NO: 85573 - RNA, 45 nt, Mus musculus
ucacuguggcaguguggcucuuugcuggagcugccugcaugagug

SEQ ID NO: 85574 - RNA, 46 nt, Mus musculus
ccuguguuucugucucucugugcucugugugugugugucugugugu

SEQ ID NO: 85575 - RNA, 46 nt, Mus musculus
ugauaucaaucuuucguuagcugguuccuuguuucugggccauggu

SEQ ID NO: 85576 - RNA, 41 nt, Mus musculus
auguucuagaaaaagacuggaaugugcaaaauucaggggcu

SEQ ID NO: 85577 - RNA, 46 nt, Mus musculus
acagcuauaauuugucaaguugcaguuaaagcaugcacccacagga

SEQ ID NO: 85578 - RNA, 45 nt, Mus musculus
gguagguagguagguagguagguagguagauagauagguagauag

SEQ ID NO: 85579 - RNA, 42 nt, Mus musculus
gucagugcucuuaaccacugagccaucucucaugcccccuuc

SEQ ID NO: 85580 - RNA, 45 nt, Mus musculus
ucaagguuaauccucccucccucaugcacacuaugcaagcacuuu

SEQ ID NO: 85581 - RNA, 46 nt, Mus musculus
agauaggaugcucuugauggaugaauggucaccauagcagcaagga

SEQ ID NO: 85582 - RNA, 45 nt, Mus musculus
aagagggcaaaucucuucucuuuguauguauuuucuguugcgcuu

SEQ ID NO: 85583 - RNA, 46 nt, Mus musculus
guuucagcacuuuucuuaccaucuucucgaacuucccaguccagug

SEQ ID NO: 85584 - RNA, 45 nt, Mus musculus
aaagcuaaugcucugauugguuggagaguacagaaaggcagaaua

SEQ ID NO: 85585 - RNA, 42 nt, Mus musculus
aacacuuacugucaaguguggacuagaaaugaggcugcagag

SEQ ID NO: 85586 - RNA, 41 nt, Mus musculus
uugaaucguguucuaucccaaauucaauuaauggccaaacg

SEQ ID NO: 85587 - RNA, 46 nt, Mus musculus
gacgugaagcucuccacaacucguggcuucugguggggaugcagga

SEQ ID NO: 85588 - RNA, 45 nt, Mus musculus
gggaugacugacaauucaguuuaauaaaaagaaucaggacaaaga

SEQ ID NO: 85589 - RNA, 42 nt, Mus musculus
ggagccgacagagagccuccagaauaccuuuccaaagcagag

SEQ ID NO: 85590 - RNA, 46 nt, Mus musculus
ggagaaggccaucacccaggucagcaagggcaccugcgagcaaggu

SEQ ID NO: 85591 - RNA, 42 nt, Mus musculus
cgacgcgugcgggugcugcccggugugugcucgcggcgaggg

SEQ ID NO: 85592 - RNA, 46 nt, Mus musculus
caaacagcgucugcauguugagcaacucaagcaucuugcccuuuca

SEQ ID NO: 85593 - RNA, 46 nt, Mus musculus
aucacuauauuuugcuuuuacaguuugucuuccauggcacauuguu

SEQ ID NO: 85594 - RNA, 42 nt, Mus musculus
ugaaaauuccauagcugauaggaagagggguggcagauaggu

SEQ ID NO: 85595 - RNA, 46 nt, Mus musculus
ccuuugaacuggaauaccauuuucuaauacuuauuaagcccugugg

SEQ ID NO: 85596 - RNA, 46 nt, Mus musculus
cacugagaagaaauauguggaucuuacugugucauuugccccagac

SEQ ID NO: 85597 - RNA, 45 nt, Mus musculus
uccucucagagaggacacuacagcggcuccccuccuaccccccau

SEQ ID NO: 85598 - RNA, 44 nt, Mus musculus
agucucuaacccuaaagauaauuguaacaacagcagcaacagag

SEQ ID NO: 85599 - RNA, 46 nt, Mus musculus; identical to SEQ ID NO: 67956

SEQ ID NO: 85600 - RNA, 80 nt, Mus musculus
gaauccagaucccaacgagauuaaaagcuauugcuauguaucaaaggaagaagucagagaaauuuugaagaaggcagcca

SEQ ID NO: 85601 - RNA, 46 nt, Mus musculus; identical to SEQ ID NO: 67958

SEQ ID NO: 85602 - RNA, 46 nt, Mus musculus
accagauucccugaggcagggacgcugguuauccauggccauacgg

SEQ ID NO: 85603 - RNA, 36 nt, Mus musculus
uaagaucuuuauuugaacaagcuagcugucuaggga

SEQ ID NO: 85604 - RNA, 50 nt, Mus musculus
cucgcuuucugugcucugauuuaggcaagcaccccacgaacugagagcca

SEQ ID NO: 85605 - RNA, 58 nt, Mus musculus
guggaccuccguuccaggacgccugggucucauggauagggagggagucgccaucaga

SEQ ID NO: 85606 - RNA, 45 nt, Mus musculus
cuuuaccugguuuaccgaccauucugacgcaggugcugaugaguu

SEQ ID NO: 85607 - RNA, 45 nt, Mus musculus
agaguugaagugacagaauuugaagacauuaaaucagguuacaga

SEQ ID NO: 85608 - RNA, 52 nt, Mus musculus
gaaaguagaacaaaaauauaacaaacuccgccaaccauuuuuucagaagagg

SEQ ID NO: 85609 - RNA, 48 nt, Mus musculus
agcaagaagcaauugaacauauugaugaaguacaaaaugaaauagacu

SEQ ID NO: 85610 - RNA, 45 nt, Mus musculus
aauauguucaauugcuucuugcuguucuuuuucucccuucggcag

SEQ ID NO: 85611 - RNA, 46 nt, Mus musculus
ggccauuuuggcagucucagacuauacacuguuggaacccccagaa

SEQ ID NO: 85612 - RNA, 46 nt, Mus musculus
ugggaaguugauuuggugaacagguuaacauaacccuuggugagaa

SEQ ID NO: 85613 - RNA, 46 nt, Mus musculus
aggccacaucucagaaaaccacuaacauaacugagcuggguguagu

SEQ ID NO: 85614 - RNA, 46 nt, Mus musculus
gugagcuuugucaucuuuauuuggugcuaauacaaacuugacauug

SEQ ID NO: 85615 - RNA, 46 nt, Mus musculus
uagguggaaaacuugcaaccagaaauaaaagacaucgccaagcgcc

SEQ ID NO: 85616 - RNA, 47 nt, Mus musculus
acuagaacugugaguuugguuguccugaccaaaugcugaguggggga

SEQ ID NO: 85617 - RNA, 59 nt, Mus musculus
guugguuuaacucaguaugguugccaagaucacgcagauagauguacaggcaaggaauu

SEQ ID NO: 85618 - RNA, 53 nt, Mus musculus
gugggggugggguaagucaagauuuuaauuugagucacagaggauugccagga

SEQ ID NO: 85619 - RNA, 46 nt, Mus musculus
auugaaacuucgaguuggcuuuuuaggaacucuguucaguggaauu

SEQ ID NO: 85620 - RNA, 46 nt, Mus musculus
uguagcagaugauauguaggagaauuuaauuauauagcuggccgug

SEQ ID NO: 85621 - RNA, 46 nt, Mus musculus
uugggaguaauuugucuacaucaguaggacauaguggcaucugguc

SEQ ID NO: 85622 - RNA, 46 nt, Mus musculus
cuccugccccauccucaguaccuuuagggucugaaaagcccagcag

SEQ ID NO: 85623 - RNA, 46 nt, Mus musculus
cauauaaaaguaucccaguuuguguuaauaguguauacccccagau

SEQ ID NO: 85624 - RNA, 45 nt, Mus musculus
acaccaaauuugagauuuuaaccucaccauaacuuuaaugcagaa

SEQ ID NO: 85625 - RNA, 49 nt, Mus musculus
cagacagcauuuuuccccacuuaguuuguugacuccauguucaucagca

SEQ ID NO: 85626 - RNA, 66 nt, Mus musculus
caacauggacacaccauaugguucuguaacaccuucuucuacacauuugggaaacuuugccucaag

SEQ ID NO: 85627 - RNA, 29 nt, Mus musculus
auuacagguauuugccaccacacccagcu

SEQ ID NO: 85628 - RNA, 45 nt, Mus musculus
cccuuacaucaagucuggccuugaauuuauuauguagccaaagau

SEQ ID NO: 85629 - RNA, 31 nt, Mus musculus
ugggauccaaucucagguccucugcaagaag

SEQ ID NO: 85630 - RNA, 45 nt, Mus musculus
cuggacucaaagucacauaaauugcccugccucugccagccuaua

SEQ ID NO: 85631 - RNA, 46 nt, Mus musculus
auuuauugugagacagauucucacuguguagcuuuugccacccagg

SEQ ID NO: 85632 - RNA, 56 nt, Mus musculus
caaauucagauccuuuccaucagucagauacuuccaaagcaccagguuuuaggcca

SEQ ID NO: 85633 - RNA, 46 nt, Mus musculus
ccuggccuugacuucaagguguuugcuguggugcccagccuuagag

SEQ ID NO: 85634 - RNA, 82 nt, Mus musculus
aauucagauccuuuacaucagucagauacuuccaaagcaccagguuuuaggccaccauuacagagaccugcuccaagucccu

SEQ ID NO: 85635 - RNA, 64 nt, Mus musculus
accuguuguuucaucucagucaacaccagaaucuaugcugucaggaaaauccucguauuugcca

SEQ ID NO: 85636 - RNA, 46 nt, Mus musculus
aaaauggaagccccugcuauuagaccacccucucaugccacagcug

SEQ ID NO: 85637 - RNA, 46 nt, Mus musculus
acaacagucacaacuacagcaagcaacaacagcaccgcacccacaa

SEQ ID NO: 85638 - RNA, 86 nt, Mus musculus
aguucaucagcuucagcggugccugguacaacuucaaauggcaguccaaguucuccuucagucagaaggcagcuuuuugucacagu

SEQ ID NO: 85639 - RNA, 46 nt, Mus musculus
auagcuauaguauaaguacauuuugaaaagcggguucucaggguag

SEQ ID NO: 85640 - RNA, 46 nt, Mus musculus
aagucacauucaccaaagaaccacaaaaacagucucuaggccacau

SEQ ID NO: 85641 - RNA, 42 nt, Mus musculus
uccuuuuucaaaggaaucuaaaucucuuggccucaggcagac

SEQ ID NO: 85642 - RNA, 43 nt, Mus musculus
aacacaggauucagcuccauuuuacuucugagugccccuuuaa

SEQ ID NO: 85643 - RNA, 45 nt, Mus musculus
agcgccugggugacucuuacacauuaccaaaagacagcugcaaca

SEQ ID NO: 85644 - RNA, 46 nt, Mus musculus
gccaccacgcacagcagaacacaccaauuucaacaaggccauaccu

SEQ ID NO: 85645 - RNA, 46 nt, Mus musculus
uggugcacacauagauauugacaagcaaaaagacaagacuggagac

SEQ ID NO: 85646 - RNA, 67 nt, Mus musculus
caaaugggaaguuaacaguagcaaguccuaagcgugggccaaagagggaagaaggauggaaggaggu

SEQ ID NO: 85647 - RNA, 41 nt, Mus musculus
acauuuccaaaagaggagagaaaauccguuucgggcaaggc

SEQ ID NO: 85648 - RNA, 44 nt, Mus musculus
uuuccagcugcagugacgagagcagcaacagcaacagcagcaga

SEQ ID NO: 85649 - RNA, 60 nt, Mus musculus
guucccaugguaaaagaaauaauaccauaacuacaaccagcucaaagaggaaaaacagga

SEQ ID NO: 85650 - RNA, 94 nt, Mus musculus
aaggaagaacaaagaaggaaauuagaggaaauugaagccaaaaauaaggagaacuuugaacuucaagcugcucaagaaaaagagaaacuuaaag

SEQ ID NO: 85651 - RNA, 58 nt, Mus musculus
ucgaaggcuggcuuuggcugcuaaaagagaaaagcgaaaagagaaaagaaggaaaaaa

SEQ ID NO: 85652 - RNA, 85 nt, Mus musculus
uguguguuugaagacagcuauaguacuuauaauaaaucugugggccagagcgagcagggacugagcaaguagggcggaccggagu

SEQ ID NO: 85653 - RNA, 45 nt, Mus musculus
caaggugguuagauuauacaggaaagaacagcucagcccccuggg

SEQ ID NO: 85654 - RNA, 45 nt, Mus musculus
gagaauacauaguaaacaugaucuuuagccauguggggagguggg

SEQ ID NO: 85655 - RNA, 58 nt, Mus musculus
gccaaagacaggcaggcugcugaagcaaauaagaaugccagcauacuacuggaggagc

SEQ ID NO: 85656 - RNA, 46 nt, Mus musculus
uagcucuuucauagauguuuugagauuacucugccuacccccagcu

SEQ ID NO: 85657 - RNA, 46 nt, Mus musculus
gguggugcgcuacuuagucaaagaggucaaucaguuuccaucagau

SEQ ID NO: 85658 - RNA, 44 nt, Mus musculus
acaaccauccguaaugagaucugacucccucuucuggagagucu

SEQ ID NO: 85659 - RNA, 42 nt, Mus musculus
aucggaacacugcccuuacauuagccugcuuccaaggaagaa

SEQ ID NO: 85660 - RNA, 46 nt, Mus musculus
auuugcacacauuuguccugugauagguacuguagaacacucaaaa

SEQ ID NO: 85661 - RNA, 67 nt, Mus musculus
gcugguggccaugaggaacugguacaaacacuacuagagagaggagcuaguauugaacaucgagaca

SEQ ID NO: 85662 - RNA, 46 nt, Mus musculus
acaaaucaaugaaguaaaauuaaauuaaaauuuagaaagaaaagac

SEQ ID NO: 85663 - RNA, 93 nt, Mus musculus
acccacaguaucgcugcuucuguuucccaaccucagacuccaacuccaagucccaucaucucuccuucagccaugcuaccuaucuacccugcc

SEQ ID NO: 85664 - RNA, 103 nt, Mus musculus
agggcuggggcaaggaauucucacugaaacacaacaaggguuaaugguagccagcccugcucagacccucaaugacacgcuggaugacaucauggcagguggg

SEQ ID NO: 85665 - RNA, 69 nt, Mus musculus
uugccucuggcaacgggucccuugccuccaggguccaucgcaaaucuuacagaacuucaaggagugaua

SEQ ID NO: 85666 - RNA, 69 nt, Mus musculus
agagcagcuuuccgagggagacuaugcacgguuacagcaaguggauccuguuuugcuuaaagaugaacc

SEQ ID NO: 85667 - RNA, 46 nt, Mus musculus
cucaacgaauucagcuucagcagcagcagcaacagucuugccagca

SEQ ID NO: 85668 - RNA, 45 nt, Mus musculus
guccuuggagcuggcucaugcugaccaacucaccaaggagaagau

SEQ ID NO: 85669 - RNA, 82 nt, Mus musculus
cagcaaacagccaggauguacaggguuacaucaccaaucagucuccagagagcauuguagaagaggcucagggaaaguuaac

SEQ ID NO: 85670 - RNA, 45 nt, Mus musculus
cucaccguuuaaaaguagguaacucaaguacuuaaggcagcauca

SEQ ID NO: 85671 - RNA, 46 nt, Mus musculus
agaguuaaggcaucguagcacauuccuauguacucggaggcuaaag

SEQ ID NO: 85672 - RNA, 45 nt, Mus musculus
ggacauguggaacuugcagccuuacuuauugaaagaggagcuagc

SEQ ID NO: 85673 - RNA, 46 nt, Mus musculus
uagauagauagauagauagauagauagacagacagacagacuugua

SEQ ID NO: 85674 - RNA, 46 nt, Mus musculus
caauugguugcugggauuucaacucaggaccuugggaagaguaguc

SEQ ID NO: 85675 - RNA, 41 nt, Mus musculus
aaaccuggcuuccuuuuuauuacaaguacaagauagggaga

SEQ ID NO: 85676 - RNA, 45 nt, Mus musculus
ggagauguaaaugcugugcggaaacuacucauugaaggucggagu

SEQ ID NO: 85677 - RNA, 46 nt, Mus musculus
cacuuacccggaugagagcugagagcacagcaaaugcagggcaguc

SEQ ID NO: 85678 - RNA, 46 nt, Mus musculus
acaguaaaacacuuaaaaacauguaaaaaauaaauaagcccaaggg

SEQ ID NO: 85679 - RNA, 46 nt, Mus musculus
uaggauaaucuguuugauauaguauaacuucauguugggaguaaac

SEQ ID NO: 85680 - RNA, 46 nt, Mus musculus
uagcucuuguaggaaguguguucaguccuucauaagugcaaaaaag

SEQ ID NO: 85681 - RNA, 46 nt, Mus musculus
ucauaccuggaucuaaacuuagcuggauacaaucuugccccaaagu

SEQ ID NO: 85682 - RNA, 124 nt, Mus musculus
ucuggaacacagcuuuuuuugugucucagaaaauacuucccagaagauuucacuucaaugaugcuggucucuucuucaaucaccacuaauuuauuuccagcuaaccagugugaauuaucccagu

SEQ ID NO: 85683 - RNA, 42 nt, Mus musculus
gugcgccaccacgcccggcuuugguuuuucauuggggaagau

SEQ ID NO: 85684 - RNA, 47 nt, Mus musculus
auuuguuguuguauaggacauucguagcugguuaugguggcagcaaa

SEQ ID NO: 85685 - RNA, 46 nt, Mus musculus
acauauagauacuaaaaguagauucauaaaaaaauucaucagagac

SEQ ID NO: 85686 - RNA, 46 nt, Mus musculus
ugucauacugaauauuacuagagaaucuugaguuuaggguuuaguu

SEQ ID NO: 85687 - RNA, 46 nt, Mus musculus
cuuggaacuuacuuuguuagaucaggcugaccuugaacucacagag

SEQ ID NO: 85688 - RNA, 49 nt, Mus musculus
ucucuagcaaucagccacuuugauaacauuauagauucagauuuguccc

SEQ ID NO: 85689 - RNA, 41 nt, Mus musculus
ucuggcuuugaaagacagaaguuaggaucaaacaagauuuu

SEQ ID NO: 85690 - RNA, 46 nt, Mus musculus
ggucuucuggaauagcaauacgugcuuuuaauuguucagccauauc

SEQ ID NO: 85691 - RNA, 44 nt, Mus musculus
aaugugggagccugcagaaaccaaaggcauucuggauccucugg

SEQ ID NO: 85692 - RNA, 45 nt, Mus musculus
cuuauggauacccuuuuuauaguacugauaccauuugcuaguaua

SEQ ID NO: 85693 - RNA, 44 nt, Mus musculus
gaagugagagaauggguguuguguagagugcagaggaccagaca

SEQ ID NO: 85694 - RNA, 46 nt, Mus musculus
cuauccugccauuaacuugaggcaguuucugacauuaucuaaauag

SEQ ID NO: 85695 - RNA, 45 nt, Mus musculus
ugcaugguagcauacaccuuuaaucccagcacucagaaggcagag

SEQ ID NO: 85696 - RNA, 42 nt, Mus musculus
uucccagcaaccacaugguggcucacaacuaccuguaauaga

SEQ ID NO: 85697 - RNA, 46 nt, Mus musculus
uuauugugaggaauaucuuuaaaaaaauauuuucuaaugggcuauu

SEQ ID NO: 85698 - RNA, 46 nt, Mus musculus
uaacugcccuuaacugcuagccccuaauuuauaaguuaaggaauac

SEQ ID NO: 85699 - RNA, 46 nt, Mus musculus
guugcauguauguauuguucaggagggccagaauagcgcuuuaggu

SEQ ID NO: 85700 - RNA, 46 nt, Mus musculus
gaaauagcuagauaauuccuuuuuugggaucuuugagguuggagau

SEQ ID NO: 85701 - RNA, 46 nt, Mus musculus
aaacagaaucucuaaaggaaugauuaaaauugaaagagaggcuggg

SEQ ID NO: 85702 - RNA, 46 nt, Mus musculus
cccugccauacaguuuuaaaaauacaaaaggaaaugguguagaggu

SEQ ID NO: 85703 - RNA, 46 nt, Mus musculus
uuacugagagacauucugcaaaguugguagugaaguaggucauugu

SEQ ID NO: 85704 - RNA, 46 nt, Mus musculus
uuuucagcauauguaucuuuagauuuguaugaaauaaguuaaaggu

SEQ ID NO: 85705 - RNA, 46 nt, Mus musculus
uuggaagcaguggcaggcagaucucugaguuugaagccagcuugau

SEQ ID NO: 85706 - RNA, 46 nt, Mus musculus
cuuugauguagacauucaguggcuccaaccuaguuugccugcuaau

SEQ ID NO: 85707 - RNA, 45 nt, Mus musculus
guaccauaaaugugaggcagauuagauuaacuaaugaugcguaga

SEQ ID NO: 85708 - RNA, 42 nt, Mus musculus
uauaaugucuauauaauguuuauaugcuguuugggggaagaa

SEQ ID NO: 85709 - RNA, 46 nt, Mus musculus
uuucaucuuauaagaaauuguauguuuagucuuaaauaguugaguu

SEQ ID NO: 85710 - RNA, 46 nt, Mus musculus
cagcaaagcuucaaacucaguuuggcucaauaaacacaguauggua

SEQ ID NO: 85711 - RNA, 45 nt, Mus musculus
guguguaaaccaguuccugcaccuccauauuuauauugugguaau

SEQ ID NO: 85712 - RNA, 46 nt, Mus musculus
auaagcaaauaacaugccaggguuuauguugugcuuagagucaacu

SEQ ID NO: 85713 - RNA, 85 nt, Mus musculus
aaaucuacuacuauaguaggaaaaauacuacuaucuaguauagauuuguauguagaguggucuucauuuguagaauccagcaguu

SEQ ID NO: 85714 - RNA, 45 nt, Mus musculus
caugcaacaaccuugagaucuuucucauucugcauuguugggaaa

SEQ ID NO: 85715 - RNA, 46 nt, Mus musculus
uagaaauaaauacaauuacuuccacaggagaauaucaguuucagau

SEQ ID NO: 85716 - RNA, 46 nt, Mus musculus
acccagauuauuuuguuucacaagguuaaaauuuaagaguacagag

SEQ ID NO: 85717 - RNA, 46 nt, Mus musculus
auuugucaagagguggggcaaaugauaaaucauucuauguguaguu

SEQ ID NO: 85718 - RNA, 46 nt, Mus musculus
uggcuuaagcaguugacugcacuccuuuaaguugaagcugaaauaa

SEQ ID NO: 85719 - RNA, 42 nt, Mus musculus
ggguagaaaauaccucaauguuaugaggcagagaagccugau

SEQ ID NO: 85720 - RNA, 24 nt, Mus musculus
uacugugaaacagugguauacagg

SEQ ID NO: 85721 - RNA, 63 nt, Mus musculus
uucaaaagagagauuucauuguggggaaagggcuugggagcugcugcaaagggaaacuaggcg

SEQ ID NO: 85722 - RNA, 70 nt, Mus musculus
uaaaaagccuggcuauucagauaucgaggcuuuauggugguguaagaauaauuguuaccauuucacuguc

SEQ ID NO: 85723 - RNA, 46 nt, Mus musculus
gaaauucagauugcugguuuuacuuugugcugcguuccaacgggga

SEQ ID NO: 85724 - RNA, 46 nt, Mus musculus
guuuguauagcuuuuacccacugaacuaucuugcuagcccugagug

SEQ ID NO: 85725 - RNA, 46 nt, Mus musculus
auguaguugauaauguacaacauuaucugauaauauaggggcaaaa

SEQ ID NO: 85726 - RNA, 46 nt, Mus musculus
uauauagguguauaacuuuugugcagcuuccuauacuuguuuuaaa

SEQ ID NO: 85727 - RNA, 46 nt, Mus musculus
guuaaacauaagguguagcuucugagccuuuaguauaagccaagau

SEQ ID NO: 85728 - RNA, 46 nt, Mus musculus
gaugcaauuugcauuuuaacaguagauuacauuuuucagaccagau

SEQ ID NO: 85729 - RNA, 46 nt, Mus musculus
aaucauauuuuacuuaauaagaauauacucaaauguucaugaaggu

SEQ ID NO: 85730 - RNA, 45 nt, Mus musculus
guaugccagugcuguacaagacugucucaaaaauacuaaaacaga

SEQ ID NO: 85731 - RNA, 46 nt, Mus musculus
uuagacaauaaaauuaagucuuuuaagauauuuaauauagagagac

SEQ ID NO: 85732 - RNA, 47 nt, Mus musculus
gaaguguguguauguguaugugugucugauuuuucuucguuaguggu

SEQ ID NO: 85733 - RNA, 46 nt, Mus musculus
aucugggauuguuuuauaucucacuucuucaugccucuggcuuuua

SEQ ID NO: 85734 - RNA, 42 nt, Mus musculus
auuacagagauaaagugcaagucugauguccugcccagcaaa

SEQ ID NO: 85735 - RNA, 46 nt, Mus musculus
uugauucaaauguuuuguuuguuuauguguauauggugugugagug

SEQ ID NO: 85736 - RNA, 46 nt, Mus musculus
cauauuuguaaagaugaaggcuaauuuaaauacuaguaggguggau

SEQ ID NO: 85737 - RNA, 46 nt, Mus musculus
uauccaucugcauacauagguauauaaaauagguguacauacagau

SEQ ID NO: 85738 - RNA, 45 nt, Mus musculus
cuuauuuuagaguccuucuuugguacuuccugauuugaggcagau

SEQ ID NO: 85739 - RNA, 24 nt, Mus musculus
uuaaccacugaggcucccacagaa

SEQ ID NO: 85740 - RNA, 83 nt, Mus musculus
gugugccuuaaugaaauacuaggguccuccgguccuccuguccuccuguccucaguacuguaacaguuuaguuguuagguuug

SEQ ID NO: 85741 - RNA, 46 nt, Mus musculus
aacuuuuaaaacauuuauuuagaacucucuuuauuucucuuaagua

SEQ ID NO: 85742 - RNA, 46 nt, Mus musculus
gugaacuuaguguuucuauaaauuguuaaaguugaaagguaaagaa

SEQ ID NO: 85743 - RNA, 47 nt, Mus musculus
acguucucaaaauguaaagugggaagaauggccauucugccagguaa

SEQ ID NO: 85744 - RNA, 59 nt, Mus musculus
uuccuaaccuccaucuugagaauauucauguaacugaucuugaugcuugauguauagau

SEQ ID NO: 85745 - RNA, 93 nt, Mus musculus
aggauggcuuuagucuacuguagguguaagaacuacucccuaccagacuuugagugucuuguccauuguguucuguucuuucauccuguuggu

SEQ ID NO: 85746 - RNA, 46 nt, Mus musculus
cucucuccuugucuccccuuacuguauuaaagcuguguccccauua

SEQ ID NO: 85747 - RNA, 52 nt, Mus musculus
cugucauguugagucuaguauauuuuuuuugucuucuuagauuuuuaugcca

SEQ ID NO: 85748 - RNA, 46 nt, Mus musculus
uaaacauuuguugugaauuguuguaugguucuuauugccaucauga

SEQ ID NO: 85749 - RNA, 44 nt, Mus musculus
ccagugcugagauuaaaguccugcaccauuaugucugccaaguu

SEQ ID NO: 85750 - RNA, 79 nt, Mus musculus
caauuuuauguguauggguguuuuaccugcauuguaugucugcgaggaugucauccccuggaacuacuuacagacaguu

SEQ ID NO: 85751 - RNA, 46 nt, Mus musculus
accacgccugguguacacaacaugcuuuuaguuuucaggcucuuca

SEQ ID NO: 85752 - RNA, 46 nt, Mus musculus
cacaacaugcucuuuuuguuuuguuuuguuuuuucgagacaggguu

SEQ ID NO: 85753 - RNA, 46 nt, Mus musculus
uuaccuuagaaccugcgauuuuguuuuuguauguguguguuggggu

SEQ ID NO: 85754 - RNA, 45 nt, Mus musculus
uagcuacagaaucagaugugcacacggaggaggauguaugaaggu

SEQ ID NO: 85755 - RNA, 46 nt, Mus musculus
auauaugauugguaacuacuugguuagcuagauagcauucagagau

SEQ ID NO: 85756 - RNA, 45 nt, Mus musculus
uuuuuauuuguaugcguacaccuuagcugucuccagacacacgag

SEQ ID NO: 85757 - RNA, 45 nt, Mus musculus
ugagacaaaaaucauguaagaugagauucaaaacaagacccaaag

SEQ ID NO: 85758 - RNA, 45 nt, Mus musculus
uccaaagggccaaaauguggaaggagcuugcacaggggccagcac

SEQ ID NO: 85759 - RNA, 46 nt, Mus musculus
auaagaugguaagggcugccuaaggaagcccgucuggaaggcaguu

SEQ ID NO: 85760 - RNA, 46 nt, Mus musculus
uguggccacccaacauuugcacacacuuuucuuuguacaucuaguc

SEQ ID NO: 85761 - RNA, 46 nt, Mus musculus
uuuuuuuaauaugaauugccaagucuucagagaacuuugcccuuuc

SEQ ID NO: 85762 - RNA, 42 nt, Mus musculus
agucagccacugaguuuugagacauugauuuuacaggcagag

SEQ ID NO: 85763 - RNA, 46 nt, Mus musculus
uguaccaaugaguaaagagagguugggaaaaguguaagaaugaggu

SEQ ID NO: 85764 - RNA, 56 nt, Mus musculus
aauuucuuaauuacugugaguuaugaaacuugccuagcgagagaaaacaaguuaaa

SEQ ID NO: 85765 - RNA, 46 nt, Mus musculus
uuuggacaccgucaaccccccaccccccaccccaacaccaccaguu

SEQ ID NO: 85766 - RNA, 44 nt, Mus musculus
auacagaucuguuccgucaacuaguaucaguuuuagggagaauc

SEQ ID NO: 85767 - RNA, 46 nt, Mus musculus
uuaaugauagaacuuuuaaguucaagagcaauguuguugaagagaa

SEQ ID NO: 85768 - RNA, 46 nt, Mus musculus
cguuguacauuggauugaacuaaauauuuacaagaaaaagguagaa

SEQ ID NO: 85769 - RNA, 41 nt, Mus musculus
ccuaugucuggugaaagaggaaaaaugggagagaacaugga

SEQ ID NO: 85770 - RNA, 46 nt, Mus musculus
ucuaaagagaagacuaauugaauuauccagaaauacugcgugccac

SEQ ID NO: 85771 - RNA, 45 nt, Mus musculus
acuccuuauaguuuuuccugggucuacagacaggcggcguuguag

SEQ ID NO: 85772 - RNA, 45 nt, Mus musculus
auuuaauuaacuuuauuuauuuaucuauuguaaaguaagcaggga

SEQ ID NO: 85773 - RNA, 45 nt, Mus musculus
gggaccgacugcgagcuugguaguuuucugucaguggaagguggc

SEQ ID NO: 85774 - RNA, 42 nt, Mus musculus
aggaggaggcggcggcaccagcagcaacaacagcgaggaaga

SEQ ID NO: 85775 - RNA, 46 nt, Mus musculus
agguaaauaccagucauuuguguaaggacaguacccgcaugcagga

SEQ ID NO: 85776 - RNA, 45 nt, Mus musculus
cugucuggauccagaagcuccugugauaaagaaaaucauucagaa

SEQ ID NO: 85777 - RNA, 46 nt, Mus musculus
ucucucucugucucucucugucucucucucucucugucucucuguc

SEQ ID NO: 85778 - RNA, 42 nt, Mus musculus
cucucucucuguguguguguguguguguguguguguuaggau

SEQ ID NO: 85779 - RNA, 46 nt, Mus musculus
agcaaaaauauuuccuauucuuuccuaucugucacacuaucggaaa

SEQ ID NO: 85780 - RNA, 27 nt, Mus musculus
uuuacuguuguuucuuggguguguuaa

SEQ ID NO: 85781 - RNA, 46 nt, Mus musculus
uuauuaauuauuaacuaguuuauuaguauuacuauuugggccacua

SEQ ID NO: 85782 - RNA, 46 nt, Mus musculus
agugugcuuuguuauaaggagauuaaugaauucaucacauccauua

SEQ ID NO: 85783 - RNA, 46 nt, Mus musculus
ucagugccugaacacccuaccaaggguugauuuugagaccauccag

SEQ ID NO: 85784 - RNA, 41 nt, Mus musculus
cucaacccccaaggccccaggcuucagauaaucaucaagaa

SEQ ID NO: 85785 - RNA, 24 nt, Mus musculus
cuuguucaguuuaaagauggguag

SEQ ID NO: 85786 - RNA, 62 nt, Mus musculus
aauauuuauugggagaccacuaagugucaaccacugugcuaguagaaggguguugugcgaaa

SEQ ID NO: 85787 - RNA, 44 nt, Mus musculus
uguacggucuguuaaauagacgugucaugugugacccccaaagu

SEQ ID NO: 85788 - RNA, 48 nt, Mus musculus
ugcuugagguugauguacuggagggcacccugcaaugcccagaaucug

SEQ ID NO: 85789 - RNA, 46 nt, Mus musculus
uuaaaagaaaccucugggaacgaauaccagaagauuuggccuuaau

SEQ ID NO: 85790 - RNA, 45 nt, Mus musculus
cuggggacuuccagcuacacacaaauguaaauaaugggacagaau

SEQ ID NO: 85791 - RNA, 46 nt, Mus musculus
agaccaaguacaaauggugugaguauggucugacuuucacagagaa

SEQ ID NO: 85792 - RNA, 41 nt, Mus musculus
cuagggaaccccccagcacagcgccagccaaucaggcauca

SEQ ID NO: 85793 - RNA, 40 nt, Mus musculus
gcuccagcccgggggagcuucuaaaagcucuagccugcag

SEQ ID NO: 85794 - RNA, 45 nt, Mus musculus
aaggcaacucuuagaaaagaaaacguuuauuugaguguggcagcc

SEQ ID NO: 85795 - RNA, 42 nt, Mus musculus
cacagcccagaaaagccucuucccccacacagugcccaugcu

SEQ ID NO: 85796 - RNA, 44 nt, Mus musculus
ucuguguaaguuuuuauucucuguuuuauucucuagugcucaga

SEQ ID NO: 85797 - RNA, 46 nt, Mus musculus
ugugguguguauaugguguguauguguaaggaacauguguguggua

SEQ ID NO: 85798 - RNA, 46 nt, Mus musculus
uuaugugugugcaugguguaugucuauguauggugugugucugugg

SEQ ID NO: 85799 - RNA, 48 nt, Mus musculus
uuuaugugugugugguguagguauguuuaugugugugcauggaguaug

SEQ ID NO: 85800 - RNA, 45 nt, Mus musculus
cuggaagucauccugcguuaaaacucgacuggugcugauggcugc

SEQ ID NO: 85801 - RNA, 42 nt, Mus musculus
cauccucuuccuccuccucacugaggcuggcgcuuucccauc

SEQ ID NO: 85802 - RNA, 44 nt, Mus musculus
cuccauauucuuguauucuugcuucgauggaggcuucagugggu

SEQ ID NO: 85803 - RNA, 46 nt, Mus musculus
aaauucucaagcaaaggcagcagugagguaggagggagggagccac

SEQ ID NO: 85804 - RNA, 45 nt, Mus musculus
acucuuaucuuugugugucuuauacugagccagguccuggagaag

SEQ ID NO: 85805 - RNA, 45 nt, Mus musculus
cugguggggcugcagaaaccuuugcacaaaaggguagaaguugaa

SEQ ID NO: 85806 - RNA, 45 nt, Mus musculus
auuguuaagaauuaaagugugugugugugugugugugugugugug

SEQ ID NO: 85807 - RNA, 42 nt, Mus musculus
uucugagucacuguccugcuucucuuccucaucuuucccaag

SEQ ID NO: 85808 - RNA, 56 nt, Mus musculus
accgggagcacuguguguguguguguguguguguguauguguguguauguguuaga

SEQ ID NO: 85809 - RNA, 42 nt, Mus musculus
ccuuucuccccuaacuucaggcgcacauucacacggucaggg

SEQ ID NO: 85810 - RNA, 42 nt, Mus musculus
ggccggcgggucccgcuugaucagguucuguaacugcggcag

SEQ ID NO: 85811 - RNA, 48 nt, Mus musculus
gcagugcuuggaaaacguccgccucugucagucgcagcccgggccccg

SEQ ID NO: 85812 - RNA, 93 nt, Mus musculus
ccaaaucaccaauaugugaaacuaaacugaaaauaucugaccuuuaguaaugacaaauauuuuuagacuuugucaauauuuaacucgguaguu

SEQ ID NO: 85813 - RNA, 46 nt, Mus musculus
ugcucucugcuuccugugacaaucacuuuucugacagagcgagaaa

SEQ ID NO: 85814 - RNA, 67 nt, Mus musculus
gcucuaaucuucaggaaaauaacucaagucuuuugauugguuuauaguguguuaggaaucaaguagg

SEQ ID NO: 85815 - RNA, 45 nt, Mus musculus
ccuccuggucagagggaaaugagcagggugacauggcuggcaauu

SEQ ID NO: 85816 - RNA, 47 nt, Mus musculus
cauacgaaccuaaugggacuuaccuguugccugagcuuggugagaga

SEQ ID NO: 85817 - RNA, 42 nt, Mus musculus
gcccggcccggguuagagucuuaaagagcaaugacagccaag

SEQ ID NO: 85818 - RNA, 45 nt, Mus musculus
cauuauggcacuggguguguucuuuggcuugguuuucacguggcu

SEQ ID NO: 85819 - RNA, 44 nt, Mus musculus
uaccuaaugagauccugucuuaaggagaaagaaauaaaggaagg

SEQ ID NO: 85820 - RNA, 45 nt, Mus musculus
auuuugagaggggccaagagauuccagaucaacacuuacguuagg

SEQ ID NO: 85821 - RNA, 52 nt, Mus musculus
ccaagccgacgagaaguucguuucugccauaaaaggcaugcaucccaacaag

SEQ ID NO: 85822 - RNA, 46 nt, Mus musculus
ccgaaaacgcuggcuucuguauacccgagggaaacugcauggacuc

SEQ ID NO: 85823 - RNA, 45 nt, Mus musculus
aggaugagguccuguaccucuucccgucagacuugugcagguacc

SEQ ID NO: 85824 - RNA, 44 nt, Mus musculus
gacugguggaccacagacacaugcaauaugauuaacgggacaga

SEQ ID NO: 85825 - RNA, 46 nt, Mus musculus
cuacuuuuucuuucucuguuauaguuccuaccucuucugugccuac

SEQ ID NO: 85826 - RNA, 46 nt, Mus musculus
gcagccagugcucuuaaccacugagccaucucuccaggccccuugu

SEQ ID NO: 85827 - RNA, 45 nt, Mus musculus
gacuggagaggacaauuaccuuaacuuuucaaaaaucguggagug

SEQ ID NO: 85828 - RNA, 57 nt, Mus musculus
caaguuucaaauauuacuucugugagagaauggguccugaaaguugagucucucgcc

SEQ ID NO: 85829 - RNA, 29 nt, Mus musculus
ugaagacuguaaaguaguuuaauagagau

SEQ ID NO: 85830 - RNA, 24 nt, Mus musculus
aggucuuuaauuccugggagaagc

SEQ ID NO: 85831 - RNA, 42 nt, Mus musculus
agucacaaagcuuuuaaauaccuacuucuaacauggacagag

SEQ ID NO: 85832 - RNA, 46 nt, Mus musculus
aguacagguuucuuccaguacagguuuccucggggcguuuguggag

SEQ ID NO: 85833 - RNA, 46 nt, Mus musculus
uuuucuacugcuaaacaaaaugucaaaaaaucuuaaagcuagagaa

SEQ ID NO: 85834 - RNA, 41 nt, Mus musculus
uagcacucgugagacccuagauuuagucucuagcaccauaa

SEQ ID NO: 85835 - RNA, 29 nt, Mus musculus
uugcuuuuggucagagauuuaugacagug

SEQ ID NO: 85836 - RNA, 46 nt, Mus musculus
uuccagauuaauaaaauuaguugccuuauuccaaaugccaauagau

SEQ ID NO: 85837 - RNA, 46 nt, Mus musculus
uguaggcuugcccgcgcagccuuugaaacggagugagccuggggau

SEQ ID NO: 85838 - RNA, 45 nt, Mus musculus
ucacgcugcuaguggcucgagucuuucagaaggcgguagaccaga

SEQ ID NO: 85839 - RNA, 45 nt, Mus musculus
cgaucgcaccggcucugcugcucauuccgguaucuacuccagggc

SEQ ID NO: 85840 - RNA, 41 nt, Mus musculus
aauuccccaaacuacuugcaguaaucaaguuuggucccaga

SEQ ID NO: 85841 - RNA, 42 nt, Mus musculus
gagagaaggagagaguagaaaaguagaggccagccaugacca

SEQ ID NO: 85842 - RNA, 46 nt, Mus musculus
ccaugccugccuccaccugaaacagcucagagacacucgcucagac

SEQ ID NO: 85843 - RNA, 45 nt, Mus musculus
ggcucacaaccaucugugacaagaccugauucccuccucuggugu

SEQ ID NO: 85844 - RNA, 46 nt, Mus musculus
gggaccgagacacaggcaacagcaucacuaucgaccaccugcggcg

SEQ ID NO: 85845 - RNA, 42 nt, Mus musculus
aacacaaaauaucauacuaugaagugguuuuguuaggaagac

SEQ ID NO: 85846 - RNA, 46 nt, Mus musculus
ucaccccagccaugucuugcaaacaucuugaucacuacucacagga

SEQ ID NO: 85847 - RNA, 29 nt, Mus musculus
gugucccugcagguuuuauugcugauagg

SEQ ID NO: 85848 - RNA, 46 nt, Mus musculus
ugaaucacagaacaaaauagaacuauuacuucaacaacaucaagau

SEQ ID NO: 85849 - RNA, 29 nt, Mus musculus
gcugagggcuuccaucccgagcugccgcg

SEQ ID NO: 85850 - RNA, 45 nt, Mus musculus
aaggagaggauggaugccaaagaguugucuucccaaaugcgaggg

SEQ ID NO: 85851 - RNA, 45 nt, Mus musculus
auaguucacauggaaucaaaagcuugugaaucaaaaaacgaagau

SEQ ID NO: 85852 - RNA, 46 nt, Mus musculus
aagaacugaaugauccuaagaagcgcucacuucucaagaucucuaa

SEQ ID NO: 85853 - RNA, 47 nt, Mus musculus
aagaguccaccuuaacaagaguccuaaggaaagaaguggagauggag

SEQ ID NO: 85854 - RNA, 46 nt, Mus musculus
gucugcuuuuaggggaguguacaccaacccugugaaauccccaguc

SEQ ID NO: 85855 - RNA, 45 nt, Mus musculus
accuccauaucauaaucuuagagauguccaauguuguugucaaga

SEQ ID NO: 85856 - RNA, 45 nt, Mus musculus
acuaaccuacuagguagugcuguaugcacauauuuugaggcagau

SEQ ID NO: 85857 - RNA, 45 nt, Mus musculus
caaucauuuauuauggagcaguaaguugcuguacacagcccaaau

SEQ ID NO: 85858 - RNA, 43 nt, Mus musculus
agguguuguuagcagguaugcggacggagugcgccucggggua

SEQ ID NO: 85859 - RNA, 42 nt, Mus musculus
accccugccccccacccgcagugauagcuaugcagccuuccg

SEQ ID NO: 85860 - RNA, 46 nt, Mus musculus
cagcugcauacagucccagagaggaguccagagaacagccccccag

SEQ ID NO: 85861 - RNA, 45 nt, Mus musculus
gagggugacuuucaggaagaucacaaugccaaccucaggcagaaa

SEQ ID NO: 85862 - RNA, 46 nt, Mus musculus
gugagugaggagcuagaagcugccuagagugaauuccacccuuggc

SEQ ID NO: 85863 - RNA, 46 nt, Mus musculus
uguacuaugucaguuccaccauuguuaaauaaguuugccccauguc

SEQ ID NO: 85864 - RNA, 45 nt, Mus musculus
auccaacguaauuuaauauaaaggcuauauuuguagacucaagau

SEQ ID NO: 85865 - RNA, 46 nt, Mus musculus
agggaaggcuguggagaaggcaugugcuuuaucagacugacugaag

SEQ ID NO: 85866 - RNA, 28 nt, Mus musculus
gcaauaaaauaaggccacacauagauuu

SEQ ID NO: 85867 - RNA, 42 nt, Mus musculus
auuucagugugaucacucuccagugagagugaggaaggagag

SEQ ID NO: 85868 - RNA, 46 nt, Mus musculus
uguggauaccuguguguguggcauggcauuuguguggggaucagaa

SEQ ID NO: 85869 - RNA, 87 nt, Mus musculus
acugcuuuuuuaaaaucagaacuuuaucauuuuauuacuugcuguuuuauuuuucaaaaauacaacauaauauucuuuaacguagau

SEQ ID NO: 85870 - RNA, 55 nt, Mus musculus
uauacccuaacucuaaaacuuuaucaccacuaccagcaguuuccuuggucaugaa

SEQ ID NO: 85871 - RNA, 44 nt, Mus musculus
uaacaguacaauguuggcuuguauuucuucuuuagccgaaugga

SEQ ID NO: 85872 - RNA, 46 nt, Mus musculus
acugugacucuuaaacugguguuucagaugucauuaaugcguagua

SEQ ID NO: 85873 - RNA, 26 nt, Mus musculus
aauuaaaggaacuuguuucuucaagc

SEQ ID NO: 85874 - RNA, 48 nt, Mus musculus
uuuuccucuuuaacuuuuuuugaacuucccuguccaaaucacugccug

SEQ ID NO: 85875 - RNA, 36 nt, Mus musculus
cagagcagcagcagcagagaugacaacaugcuccag

SEQ ID NO: 85876 - RNA, 45 nt, Mus musculus
uuuguggguuugccuuuauaaccucuguaucccuaagcuuggcac

SEQ ID NO: 85877 - RNA, 45 nt, Mus musculus
caaucucugguuuuccaaagguccuggaaacuucaugguaucccu

SEQ ID NO: 85878 - RNA, 46 nt, Mus musculus
caaugcuuauuaagcaauuuauaaaacaaaguaagaauguuaugag

SEQ ID NO: 85879 - RNA, 46 nt, Mus musculus
auguuuguaaucucagaacuucugaggaccugugcuacacagccag

SEQ ID NO: 85880 - RNA, 45 nt, Mus musculus
uaccuuacaucaaacuguacuaccaacauacauccaggacccccu

SEQ ID NO: 85881 - RNA, 82 nt, Mus musculus
cuucuccuccucuuccuccuccuccuccuccccggcagagcuguaggccucacaguggugacgcggggucauccgggggccc

SEQ ID NO: 85882 - RNA, 45 nt, Mus musculus
cggccgaggggucacucagcgaacuaguuccaugaugacccuggg

SEQ ID NO: 85883 - RNA, 42 nt, Mus musculus
cgaggggaaaugguggaaggggggaaggggaaaaaagaaaag

SEQ ID NO: 85884 - RNA, 51 nt, Mus musculus
ggaugaaaagggaaagugcauuuugugugcacaaagagaaggaaaggugcg

SEQ ID NO: 85885 - RNA, 45 nt, Mus musculus
acuuguccuuagcccuccugaacgaauuuauuagacguggaugga

SEQ ID NO: 85886 - RNA, 45 nt, Mus musculus
ucuuuguugaccuuacgcaaaauuauguugucccguuccuauuag

SEQ ID NO: 85887 - RNA, 42 nt, Mus musculus
agccgcagcugagggacugacaggggcuccaggguguucuga

SEQ ID NO: 85888 - RNA, 41 nt, Mus musculus
guguggugugugugugugugugagagagagagagagugaga

SEQ ID NO: 85889 - RNA, 42 nt, Mus musculus
auggagaaaaucaucucagagaaacugcacuaugagcuggaa

SEQ ID NO: 85890 - RNA, 46 nt, Mus musculus
acaugaguuguggagaggagagucucagcagcuccccacccagcga

SEQ ID NO: 85891 - RNA, 49 nt, Mus musculus
ggagggaaggugcugauuccuucauuccuuucaggccuuugaaagauga

SEQ ID NO: 85892 - RNA, 49 nt, Mus musculus
caugguuuaucuuggauuuccuucucccuuguucucagaacagagacug

SEQ ID NO: 85893 - RNA, 24 nt, Mus musculus
ggaagauaaauguggacaauaccc

SEQ ID NO: 85894 - RNA, 45 nt, Mus musculus
caacuuggauaucagguccugaaaaaaaaaauguacacuuuagca

SEQ ID NO: 85895 - RNA, 45 nt, Mus musculus
cagcuacuguuuacuuguacugagcacaguuggauauggauuaga

SEQ ID NO: 85896 - RNA, 46 nt, Mus musculus
aaaauuuuugauccaauaauuauauaccacuuuuggugauagagag

SEQ ID NO: 85897 - RNA, 25 nt, Mus musculus
cugugauauucuaaacauuuaacuc

SEQ ID NO: 85898 - RNA, 45 nt, Mus musculus
cagagauuaaaucguaucuaguuuucaacuauauaagugccaagu

SEQ ID NO: 85899 - RNA, 45 nt, Mus musculus
cccuuaccuguguaauuccugagcggugcucugcugaccuuugag

SEQ ID NO: 85900 - RNA, 45 nt, Mus musculus
aaacgauaaaagaaaacccuuauguguucugagcaagagccacag

SEQ ID NO: 85901 - RNA, 45 nt, Mus musculus
gaaaugcugcuguccucagcauugucuuguuaaaugcaugccauu

SEQ ID NO: 85902 - RNA, 46 nt, Mus musculus
uguuguuuugguuuuuuuuguuucauuuuaagguaacaguagagau

SEQ ID NO: 85903 - RNA, 45 nt, Mus musculus
acagcugcuuauaguggcaaaugcccacaugcauugggacccaga

SEQ ID NO: 85904 - RNA, 46 nt, Mus musculus
aucuuuaaugugagauuuuguguuuacuucuguuuuagccuuuuca

SEQ ID NO: 85905 - RNA, 46 nt, Mus musculus
cagauggauccgaagcaaugcuaaacagaguaaugacgaaagauaa

SEQ ID NO: 85906 - RNA, 28 nt, Mus musculus
ggauuuuugucuagacaggguaggagag

SEQ ID NO: 85907 - RNA, 42 nt, Mus musculus
uugggggggguaaaagcuaggauauauauuaaagacauauaa

SEQ ID NO: 85908 - RNA, 46 nt, Mus musculus
ucagcuguauaaucgugaguaaguuguuugcacuuuuacaucaguu

SEQ ID NO: 85909 - RNA, 46 nt, Mus musculus
uucaggggccccacuuuuacucucuucuuucuucauggcagaggua

SEQ ID NO: 85910 - RNA, 47 nt, Mus musculus
uuguccguccugggcauuaaacugggaauacaggaaaaagggaauua

SEQ ID NO: 85911 - RNA, 42 nt, Mus musculus
uuccaacugaaacguagacuucaguauacaaaauggccauga

SEQ ID NO: 85912 - RNA, 45 nt, Mus musculus
aggugauggggggcauucaacaggggcugggguaguuaggugaug

SEQ ID NO: 85913 - RNA, 46 nt, Mus musculus
agagcagcuuccuccgaggccauggauuacauuaaaagaacgagac

SEQ ID NO: 85914 - RNA, 41 nt, Mus musculus
gaaugaaugguccugcugcagauguagcacaacaucauaga

SEQ ID NO: 85915 - RNA, 45 nt, Mus musculus
auaagccaacauauucuuaguuuuuguagguguuaagcaugcacu

SEQ ID NO: 85916 - RNA, 42 nt, Mus musculus
cagggcuacacagagaaacccugucucaaaaaacccccaaaa

SEQ ID NO: 85917 - RNA, 28 nt, Mus musculus
cuccuacucccagccaaauuuccuuuuc

SEQ ID NO: 85918 - RNA, 42 nt, Mus musculus
auacucaggagccccccacccucucagaggagagugggagga

SEQ ID NO: 85919 - RNA, 52 nt, Mus musculus
auuuuagagguuguuaaagcuaugacggcacaaagaggcuaaggaggggaga

SEQ ID NO: 85920 - RNA, 103 nt, Mus musculus
gauaauaaaauaaggacuuggaggguaaggauaaggauuaaauauuaaucuugaaaacaaaauugaaguggguaaaguaguuggggguuuuacugguuuacag

SEQ ID NO: 85921 - RNA, 81 nt, Mus musculus
uaauagcaauaaccucauuugaauuuaguaucugugggaggauaaacaaccaagggugguauagagaauucucauauuuua

SEQ ID NO: 85922 - RNA, 84 nt, Mus musculus
uggcuuuguccugcuuauuucauucagcuguuuguguccucggucaguaacuuuguucuuugauuuauuuuaacacacuuagau

SEQ ID NO: 85923 - RNA, 46 nt, Mus musculus
cuuucuuucuuucuuucuuucuuucuuucuuucaauucauguagaa

SEQ ID NO: 85924 - RNA, 58 nt, Mus musculus
cugagaccuaagagcuuuuuacuuuacuugacuuacuaugcuuuuuaauauccagcau

SEQ ID NO: 85925 - RNA, 75 nt, Mus musculus
uuugucucugucugauuguucuaguucuacuuuuuucaugcccagauauugugucucuuugaucuaugcuaaugg

SEQ ID NO: 85926 - RNA, 88 nt, Mus musculus
ucgccuuuagaacuagguucuuuuucuuuuauuccuaccaugauaaauuuguuccuuucagaauuuuauuuaugccuuauuuccacug

SEQ ID NO: 85927 - RNA, 44 nt, Mus musculus
ccuguguugaauauauagcuggaaaagauuuucucacucugagg

SEQ ID NO: 85928 - RNA, 86 nt, Mus musculus
cccauccuaguguguccucauccuacauucauguacugucccuuucuuuugggagggggauccacuggguuccaauuaguggccuc

SEQ ID NO: 85929 - RNA, 47 nt, Mus musculus
uuugacaauuucaugcauguauacaguugauuauauuugcccccagc

SEQ ID NO: 85930 - RNA, 78 nt, Mus musculus
uuuuaauuucaaauuuugauauaaauacagcuaggcacuccuggguuccauuuccauugaacaucagcucucaccucc

SEQ ID NO: 85931 - RNA, 45 nt, Mus musculus
gguaugcuaaaucauacauaguuaaaaaaguuaucuaggcagagg

SEQ ID NO: 85932 - RNA, 45 nt, Mus musculus
gguugguuccuagcacccagaucagguagcucucaagcaccucua

SEQ ID NO: 85933 - RNA, 24 nt, Mus musculus
uuggaucucugccuaggccagugu

SEQ ID NO: 85934 - RNA, 41 nt, Mus musculus
uuaagccaagaaaauugcuuacuuaagacccaugggaagga

SEQ ID NO: 85935 - RNA, 45 nt, Mus musculus
uauguaauuaaguuucaaaaauuguuaaugaguacuauucuuuga

SEQ ID NO: 85936 - RNA, 40 nt, Mus musculus
gcuucugguggguuuccaaggacagcaguaguaggcuaua

SEQ ID NO: 85937 - RNA, 51 nt, Mus musculus
acuggguagaugcuuaugagaacuaguccacagggagugggaguucagguc

SEQ ID NO: 85938 - RNA, 58 nt, Mus musculus
ugcaaggaguuuccuugaugaggagacaaagaccauacuuauuugggggguguaagga

SEQ ID NO: 85939 - RNA, 48 nt, Mus musculus
aaucuuuuugccugcuuuccugcaguguuuacugauccuuaggugugg

SEQ ID NO: 85940 - RNA, 54 nt, Mus musculus
ugggcagucauguugguaagacuuaucaaguauagcuucugauguuacuaggag

SEQ ID NO: 85941 - RNA, 46 nt, Mus musculus
gagagacauccuuccugcucuccgcuuuacucaguugccuguaguu

SEQ ID NO: 85942 - RNA, 46 nt, Mus musculus
cuugcagaaucaaauaaggauauaauuuugauaaaucuugucagau

SEQ ID NO: 85943 - RNA, 46 nt, Mus musculus
ucagaagcucucagcugugccucucuuaggaaagugaagaucagug

SEQ ID NO: 85944 - RNA, 45 nt, Mus musculus
uaaguuuugaauuugggagaaaaucaguuuaacauggaguuggac

SEQ ID NO: 85945 - RNA, 47 nt, Mus musculus
aucccacuccuauaugaggaguuuuagguaaucuguggcugcugcga

SEQ ID NO: 85946 - RNA, 25 nt, Mus musculus
gcccgcggaggagaaugagguagag

SEQ ID NO: 85947 - RNA, 46 nt, Mus musculus
ccagaucacuugguuuuguuugcuuuuaauuacucaccugcuaaga

SEQ ID NO: 85948 - RNA, 46 nt, Mus musculus
uuaauggaauuguuuaggaagaacuaggagggcuuaaaugaaagag

SEQ ID NO: 85949 - RNA, 46 nt, Mus musculus
gauacaguagguguggcugguagcuguaaaauaugucugugaagau

SEQ ID NO: 85950 - RNA, 45 nt, Mus musculus
augucaguauacuguuagugacaucaacagaagucuucauggugu

SEQ ID NO: 85951 - RNA, 45 nt, Mus musculus
uaccgcugucuuggagauggcuguggccacuccaccggccaagaa

SEQ ID NO: 85952 - RNA, 45 nt, Mus musculus
gcuuaucugccgugauuugcuugcuggcaugcugcaccugcagca

SEQ ID NO: 85953 - RNA, 42 nt, Mus musculus
ggcaccaccugaugccagguuccuugcaaaguagcgccagaa

SEQ ID NO: 85954 - RNA, 47 nt, Mus musculus
aucagauuuguagaucuuaaccaggcagucaccaaggccuuugaauu

SEQ ID NO: 85955 - RNA, 48 nt, Mus musculus
cugggagcauucccuuugcagugucauagauaccaaaguaggcagcuc

SEQ ID NO: 85956 - RNA, 23 nt, Mus musculus
gccugaagggcuguccuaaaggu

SEQ ID NO: 85957 - RNA, 80 nt, Mus musculus
auuuuaacuuguaaaauaaaggcuaaagucggugguugggcaguggaagggaagguggagcuaaaaaguuugagggagag

SEQ ID NO: 85958 - RNA, 42 nt, Mus musculus
ugaauuuugauguuuauuuugcuuccccaagagggguugucu

SEQ ID NO: 85959 - RNA, 44 nt, Mus musculus
cagcaagugugauggaggugucugaggguaauuuccuguuggga

SEQ ID NO: 85960 - RNA, 44 nt, Mus musculus
cuaaccauguggggugugugugugugugugugugugugugugug

SEQ ID NO: 85961 - RNA, 41 nt, Mus musculus
aagcuccgcauuaaaguguaaugauggcugcagaggcggag

SEQ ID NO: 85962 - RNA, 92 nt, Mus musculus
agguggcaggagccaccuucaaaugaaucuucaaauuggaaaauacugcuucaccaccuggagacaaagaaaaagggacaaagucacucggg

SEQ ID NO: 85963 - RNA, 46 nt, Mus musculus
caaauggaauaauuuaguaugguuuguagcuauuuugauguccacc

SEQ ID NO: 85964 - RNA, 24 nt, Mus musculus
cucugccugcaaacccuccucuag

SEQ ID NO: 85965 - RNA, 76 nt, Mus musculus
aucuucuucacuggcuccucuuccuuaaagguaauaaaacagaacccacgccucuuauuggucuuguuguccauag

SEQ ID NO: 85966 - RNA, 46 nt, Mus musculus
caacaaaaauuuuuuugacaggcucuuuuguuuucauggcuuuggc

SEQ ID NO: 85967 - RNA, 51 nt, Mus musculus
cacucuccgacucuuuaaauagcacaaagccaaaaccccuugaucgcccug

SEQ ID NO: 85968 - RNA, 43 nt, Mus musculus
ccagucaaucuagcacuucgauacucaaggucgucgucccccc

SEQ ID NO: 85969 - RNA, 46 nt, Mus musculus
gguuucuauuauacucuccaauauuuuaaagacaugugugaucccc

SEQ ID NO: 85970 - RNA, 46 nt, Mus musculus
caugucaaauaacaaacucaucuuuaaaaaauauuuuagcaggaaa

SEQ ID NO: 85971 - RNA, 42 nt, Mus musculus
gcauuaccacacagcauaucacgcaauggcguucuugcccag

SEQ ID NO: 85972 - RNA, 42 nt, Mus musculus
aauaacuuggcagaaugggggaagggcaaccgcaggcgggag

SEQ ID NO: 85973 - RNA, 44 nt, Mus musculus
aggguaagcuccgacaggcgggaaaaaauccuggcggccacauc

SEQ ID NO: 85974 - RNA, 42 nt, Mus musculus
guggcugcaagggcuccugcgccucuccccggccugcccccc

SEQ ID NO: 85975 - RNA, 42 nt, Mus musculus
ggcugcacugaaaaaaaaaagaaugaaguagcagcggcggcc

SEQ ID NO: 85976 - RNA, 24 nt, Mus musculus
gcaagacuuagaagaaaauggaau

SEQ ID NO: 85977 - RNA, 46 nt, Mus musculus
ugauaacgcccucugcggguucuuuuggcuucuggaagcgagguaa

SEQ ID NO: 85978 - RNA, 46 nt, Mus musculus
guaaauuuauauucuggacuuugaugcagacuuuuauuucgaagag

SEQ ID NO: 85979 - RNA, 41 nt, Mus musculus
aggaauuuugucgaaaccuuagggugcuuagagccacgaca

SEQ ID NO: 85980 - RNA, 44 nt, Mus musculus
uaccaaguggauuuccuuaagaggaaaugaaauacuuugcuuga

SEQ ID NO: 85981 - RNA, 80 nt, Mus musculus
uaaauagcauuuuguugugguuguuguugcagauauagacugcuuuuuauauaugauauauauuauauguggguuggguu

SEQ ID NO: 85982 - RNA, 46 nt, Mus musculus
cucugagggcaccagacaaacccguggugcacagacacacaugcag

SEQ ID NO: 85983 - RNA, 46 nt, Mus musculus
agacccuaucucaaaaaauccaaaacucagaacaaaaagcccccag

SEQ ID NO: 85984 - RNA, 38 nt, Mus musculus
cuccccaaaucuggguuuacgaaugugcccugccagga

SEQ ID NO: 85985 - RNA, 42 nt, Mus musculus
agugauuccuauguccaaaauagauaccauuugugugccaaa

SEQ ID NO: 85986 - RNA, 45 nt, Mus musculus
uuuguauaaaauacucuaggaguauguaaauacaagacguagcua

SEQ ID NO: 85987 - RNA, 78 nt, Mus musculus
agauaucgucagauucuggaaaaagccauucaguuaucugggacagaacaacuagaagcauugaaagcuuuuguggaa

SEQ ID NO: 85988 - RNA, 41 nt, Mus musculus
gggauuccucuggaaacaggacaaaaguauaguaaauagug

SEQ ID NO: 85989 - RNA, 45 nt, Mus musculus
uuccuaacuccugacgcaggggguacaaacauuuauagagcguua

SEQ ID NO: 85990 - RNA, 46 nt, Mus musculus
uuggaguuuucauaacaucaaaaagcaaagaaccauacagagacag

SEQ ID NO: 85991 - RNA, 46 nt, Mus musculus
uguccuggaacuccauguauggaucaggcuguccuccaguuuacag

SEQ ID NO: 85992 - RNA, 46 nt, Mus musculus
aucucagaugauaacggaaggacgcaugaauggguuuauugaccag

SEQ ID NO: 85993 - RNA, 45 nt, Mus musculus
agacagcaccgugaguucaaggucacggggucugcgucacccccu

SEQ ID NO: 85994 - RNA, 45 nt, Mus musculus
agagaaaccauuucccauuucauuuuuuaaaacugucuugaucag

SEQ ID NO: 85995 - RNA, 42 nt, Mus musculus
agccagagucacuguggucuuaaagaaaugaaaacagggcag

SEQ ID NO: 85996 - RNA, 43 nt, Mus musculus
agcagauccagucacuuuguuuccaaguaaacaaccuccugga

SEQ ID NO: 85997 - RNA, 45 nt, Mus musculus
cccaaacucggggcuugguagugcacgccuuuaaucccagcacuc

SEQ ID NO: 85998 - RNA, 46 nt, Mus musculus
aaccaucuguaacaagguaugacucccucuucuggugugucugaag

SEQ ID NO: 85999 - RNA, 46 nt, Mus musculus
ucuggugcccucuucuggugugucugaagacagcuacagccuacuc

SEQ ID NO: 86000 - RNA, 42 nt, Mus musculus
gagaugacgcugcaaggacccgucugugacgaacuagggcac

SEQ ID NO: 86001 - RNA, 46 nt, Mus musculus
ggugugaaaaccaggaaaggacauuuagucaguaaaaccacagcag

SEQ ID NO: 86002 - RNA, 45 nt, Mus musculus
gaagcacaaggccuggagaaaccacaaguccuaaggggucucaua

SEQ ID NO: 86003 - RNA, 46 nt, Mus musculus
aacaaaauggugcccaauguauugauuugaauucaacuaaccugag

SEQ ID NO: 86004 - RNA, 46 nt, Mus musculus
uugauguuaauuccguucuccugugaguggcugaacgagucagcac

SEQ ID NO: 86005 - RNA, 45 nt, Mus musculus
cagacgcacauguccuggagaaacugcaaguucuaagggucucau

SEQ ID NO: 86006 - RNA, 46 nt, Mus musculus
agcauguauucauauuaacugaguuguuuucauugccggggcauau

SEQ ID NO: 86007 - RNA, 45 nt, Mus musculus
cauccugcaguccacuccagaauaaauaguaauuaccacccccug

SEQ ID NO: 86008 - RNA, 42 nt, Mus musculus
gaagagcugcccacaguuccugcaauggugccuccgcucugu

SEQ ID NO: 86009 - RNA, 44 nt, Mus musculus
gccgaggcugaggcggcggcggggacccggcgagggagaagacg

SEQ ID NO: 86010 - RNA, 46 nt, Mus musculus
uaacugucuacugccuucacuuuaaaguuaacucuguuggcaagaa

SEQ ID NO: 86011 - RNA, 47 nt, Mus musculus
gacucugggaccagcuguguguagagaagaccaauuacuuauaaggu

SEQ ID NO: 86012 - RNA, 45 nt, Mus musculus
cauuuaauugggacuggcuuacagguucaaagguuuaguccauua

SEQ ID NO: 86013 - RNA, 67 nt, Mus musculus
uuuaaaggugacuucuuggcugugugugcauaaaggaacagggagauuggagagcuaacuaccccgg

SEQ ID NO: 86014 - RNA, 46 nt, Mus musculus
aaggucaggaugagacuuugaaggagaggcgggguuuuauuagcag

SEQ ID NO: 86015 - RNA, 85 nt, Mus musculus
gaguugagaccguaguaaagagagaaagagagagagagagagaagaugagaggaugagaggagagaccagaccagaccagaucag

SEQ ID NO: 86016 - RNA, 28 nt, Mus musculus
agcuacacagcaagagcaagaaaggaag

SEQ ID NO: 86017 - RNA, 46 nt, Mus musculus
cugcugugcccagaauaguucccuuauaguuauccacugucccugg

SEQ ID NO: 86018 - RNA, 72 nt, Mus musculus
aaaaaguuaaaagaaguucuauccuguuacuuuucugccuaagacccauuguuguguuuuauaaaaagauag

SEQ ID NO: 86019 - RNA, 46 nt, Mus musculus
ugugggggaggaugugugacucaugagucaccccaaagugcugcuu

SEQ ID NO: 86020 - RNA, 42 nt, Mus musculus
gagagaaaggauuuauuugauggaucauaauucggagguuuc

SEQ ID NO: 86021 - RNA, 45 nt, Mus musculus
ugucuugaaaaaccaagaaagaaagaaagaaagaaagaaagaaag

SEQ ID NO: 86022 - RNA, 46 nt, Mus musculus
uuuuguuuuuguuuuuuggaacagggucucacgcugcagccccaau

SEQ ID NO: 86023 - RNA, 46 nt, Mus musculus
gcaaauacuugguaauagaccucuaucugugucuauuagcuggaag

SEQ ID NO: 86024 - RNA, 46 nt, Mus musculus
uaccacaguuagagguaccuuucuugcugaaggcacaaagcugauu

SEQ ID NO: 86025 - RNA, 46 nt, Mus musculus
gacagcuacaguguacuuacauauaauaaauaaauaaauaauaaau

SEQ ID NO: 86026 - RNA, 45 nt, Mus musculus
guuaaaacaagcuggccagugggugguagguaagcuaccgggaga

SEQ ID NO: 86027 - RNA, 30 nt, Mus musculus
ucaggauagccagggcuacacugggaaauu

SEQ ID NO: 86028 - RNA, 46 nt, Mus musculus
ccauguuggcuggaaauccaacagagggggugagggagaggcagau

SEQ ID NO: 86029 - RNA, 46 nt, Mus musculus
aggucccauuucguaaaagugcuaccaccucucaguagcucugcag

SEQ ID NO: 86030 - RNA, 59 nt, Mus musculus
uguucuaaggaaugaccaccaugcuggaagcuuauugggggaguggaaggggaguugga

SEQ ID NO: 86031 - RNA, 46 nt, Mus musculus
gagagagagagagagagagagagagagagagagagacagacauaga

SEQ ID NO: 86032 - RNA, 45 nt, Mus musculus
gacacccacuucuggugcaucugaagacaacuacaguguacuuag

SEQ ID NO: 86033 - RNA, 41 nt, Mus musculus
ggaaguuuaaaaaaaugaaggaaugugggagaaaaccgaga

SEQ ID NO: 86034 - RNA, 46 nt, Mus musculus
ugagacugcccaaaaacuucuccaaaaacuugcuuaaaacucccag

SEQ ID NO: 86035 - RNA, 46 nt, Mus musculus
acuaccuugcaagggccuaaacuuuucauggccacuaugccucaag

SEQ ID NO: 86036 - RNA, 45 nt, Mus musculus
uugugagccaccaugugauugcugggaauugaacucaggaccccu

SEQ ID NO: 86037 - RNA, 42 nt, Mus musculus
ugcaccaaagagcucuagaugauagcuauuaaagaaggggaa

SEQ ID NO: 86038 - RNA, 46 nt, Mus musculus
gaacucccaguacagugcauaugugauauguguugauugucagcag

SEQ ID NO: 86039 - RNA, 46 nt, Mus musculus
ucgauuugggauggauuagaggauugcuuuucuuuauccacaggag

SEQ ID NO: 86040 - RNA, 41 nt, Mus musculus
auuuccuuaaaucccacuuugccuucacacguacugagacg

SEQ ID NO: 86041 - RNA, 46 nt, Mus musculus
uguugagagaugagugcaguuauuuauuuauuuaacgccgggcuag

SEQ ID NO: 86042 - RNA, 46 nt, Mus musculus
guuuaauccucucaacuuggcuuaguugugucuucaucuuauugag

SEQ ID NO: 86043 - RNA, 45 nt, Mus musculus
uguccuuaccuugucaaugguguauuuuaguagauacucuucuag

SEQ ID NO: 86044 - RNA, 41 nt, Mus musculus
aauuuacuugugaaaguauccuuauguaucacgcugccuca

SEQ ID NO: 86045 - RNA, 49 nt, Mus musculus
ccgggucacacagguuucgugcucaaggucacacaggugcaaccugccu

SEQ ID NO: 86046 - RNA, 46 nt, Mus musculus
cuuccugcuucuuguugccucugcugugccagcugcagaacuucag

SEQ ID NO: 86047 - RNA, 45 nt, Mus musculus
gcuggcucacaagcucuggcacuagaaacaaaaccacacggccau

SEQ ID NO: 86048 - RNA, 46 nt, Mus musculus
cauauaucagcuuugugaacugguuaacgacuggaagaagcuacgc

SEQ ID NO: 86049 - RNA, 46 nt, Mus musculus
ucccccaacagcuccccaggugcuguuguucuccuucugucuccaa

SEQ ID NO: 86050 - RNA, 44 nt, Mus musculus
uuauaauuuuauguuaccuaaucaaagcacacaaaggagcuucg

SEQ ID NO: 86051 - RNA, 48 nt, Mus musculus
acacuuugaaaggcaggacuuggaugaagucucucgauggcagauagg

SEQ ID NO: 86052 - RNA, 45 nt, Mus musculus
guuucuuugagguuucuuuagaggaacuaaaguagaaggugaaaa

SEQ ID NO: 86053 - RNA, 46 nt, Mus musculus
gacgaggguagugcugaugcugacacugagggauggaaggagguuu

SEQ ID NO: 86054 - RNA, 45 nt, Mus musculus
gcuugaauaaguuuaagugauaugaauaauauucaagaugccuuu

SEQ ID NO: 86055 - RNA, 40 nt, Mus musculus
cuuuaaggagaugccaauuacagcggguggugggagguga

SEQ ID NO: 86056 - RNA, 46 nt, Mus musculus
cagcagucuguuuaacucugaaaauucaguugacccuggucucugc

SEQ ID NO: 86057 - RNA, 46 nt, Mus musculus
uccauuuuagguaucagacagugaaucacgguuugucaucuuccag

SEQ ID NO: 86058 - RNA, 41 nt, Mus musculus
agagagagagagagagagagagagagagagagacuccgcua

SEQ ID NO: 86059 - RNA, 45 nt, Mus musculus
cuucugcaaggugaauuaacaugguguuuccuuagagccgguauc

SEQ ID NO: 86060 - RNA, 31 nt, Mus musculus
uuuuaaauuuuuacccguuuuguguggggag

SEQ ID NO: 86061 - RNA, 45 nt, Mus musculus
ucugaagacucaauuuugucuuuauuuguuucccuccacccccac

SEQ ID NO: 86062 - RNA, 45 nt, Mus musculus
aucuaacaaggaucuaaagaaggauuguaugcagcucaguguuua

SEQ ID NO: 86063 - RNA, 45 nt, Mus musculus
aaaaagcuuguacaaugaagauagaaaccugcuucgaaucagaga

SEQ ID NO: 86064 - RNA, 46 nt, Mus musculus
ugcucccggaucacguccugucgguaacauuagccacaguccaaag

SEQ ID NO: 86065 - RNA, 45 nt, Mus musculus
agccagcccccaggcuuccagugauuucccugucuuugccccugc

SEQ ID NO: 86066 - RNA, 41 nt, Mus musculus
uggcaaagggggagugacaggguguguuuucaccagccccu

SEQ ID NO: 86067 - RNA, 46 nt, Mus musculus
acagagagacagagagaaagagacagagacagagagagacagagag

SEQ ID NO: 86068 - RNA, 41 nt, Mus musculus
uaccgagcuauguccccaacccucacuuuucucccgggcua

SEQ ID NO: 86069 - RNA, 41 nt, Mus musculus
acugaaaugugagcaaagucacauuugggagucagaaguga

SEQ ID NO: 86070 - RNA, 45 nt, Mus musculus
gaugucagugaagaugauagagccauugcuuccgugaggaugggg

SEQ ID NO: 86071 - RNA, 45 nt, Mus musculus
uagacuauggaaucugaggacaguaaauuuacauaauugccccau

SEQ ID NO: 86072 - RNA, 45 nt, Mus musculus
gagugaaugaauuauacuaugggagauugacuccaggagggacag

SEQ ID NO: 86073 - RNA, 45 nt, Mus musculus
gacacagcucccuguaccuggugaucuaaaucguauuagucuaag

SEQ ID NO: 86074 - RNA, 44 nt, Mus musculus
aaggcuagccuucucugcauagugagaaucugccuaaagaccag

SEQ ID NO: 86075 - RNA, 46 nt, Mus musculus
uuuaucucuugcugugucuccuugccaacccaaccuagcagcaaac

SEQ ID NO: 86076 - RNA, 46 nt, Mus musculus
ucuucguguguguguguguguguguguguguguguguguucgugug

SEQ ID NO: 86077 - RNA, 46 nt, Mus musculus
uuguucccaguguuucugauugguggguucuuuuggagggggagag

SEQ ID NO: 86078 - RNA, 45 nt, Mus musculus
caguuccucagacucugagagugagagcagcuccagcgacagcga

SEQ ID NO: 86079 - RNA, 42 nt, Mus musculus
aaaagcaacucuguggcucucucugcugucuuguggcaccgg

SEQ ID NO: 86080 - RNA, 42 nt, Mus musculus
gccauaauuuguuguaaauccacacacauuugugacucagag

SEQ ID NO: 86081 - RNA, 42 nt, Mus musculus
ucccuacggcucaaaggagcagacuuccaaagacagacccaa

SEQ ID NO: 86082 - RNA, 60 nt, Mus musculus
aggauuccccagccucuggggaaggggagccgccccaggaaagcagaagacaagcagcug

SEQ ID NO: 86083 - RNA, 65 nt, Mus musculus
ucagcagggaagaagcaggacucggagaccaagagcugugacagcuccagcagagugaccaagaa

SEQ ID NO: 86084 - RNA, 50 nt, Mus musculus
gggugacccagaaaaagagcacaguaacaagagacacaaacuggauaagu

SEQ ID NO: 86085 - RNA, 46 nt, Mus musculus
cgauccuagcuuuaaucccuaguuauuuagauggacagacauacag

SEQ ID NO: 86086 - RNA, 74 nt, Mus musculus
acucaagaaaggaaaugcugccuccagcaucggcguccucagucuccucuuccucauccucccagaagccaagc

SEQ ID NO: 86087 - RNA, 45 nt, Mus musculus
gcagcacaaagagcagcucuacagacccucccgcucccaagcaca

SEQ ID NO: 86088 - RNA, 46 nt, Mus musculus
caccccccaccucccccuuuccuuuucaccucuucuccugccccag

SEQ ID NO: 86089 - RNA, 46 nt, Mus musculus
ugugaugucacuaaaaugcuucucagauaacacgaugccagcacaa

SEQ ID NO: 86090 - RNA, 45 nt, Mus musculus
cugcaccauuggaagccaugauccagugcagacaacgacugucag

SEQ ID NO: 86091 - RNA, 45 nt, Mus musculus
gaugagguugaagaagaucugugaccuucccaggcuacaccccac

SEQ ID NO: 86092 - RNA, 45 nt, Mus musculus
uggccuacugaaguuuugccagagcauguguacauccugccagca

SEQ ID NO: 86093 - RNA, 47 nt, Mus musculus
cacaauaauguuuucucuuuuggaaaaaauuaaaauuagauacaugu

SEQ ID NO: 86094 - RNA, 46 nt, Mus musculus
agguugcccuugguuaaggugccuagagggcagaccacauggcagu

SEQ ID NO: 86095 - RNA, 46 nt, Mus musculus
gaaauucgagaugaguugggcuuaaaaaauauuauauauaucuaag

SEQ ID NO: 86096 - RNA, 46 nt, Mus musculus
auauauuuucuuucuuaaaauguuagaagucaaaucuugguauuaa

SEQ ID NO: 86097 - RNA, 46 nt, Mus musculus
aaaagguaauugacuuguucaucuucacaaucuuuccuuuccacaa

SEQ ID NO: 86098 - RNA, 48 nt, Mus musculus
cgcagaagacugcaaacccaagcaaggaugcuucuucagugugagcug

SEQ ID NO: 86099 - RNA, 44 nt, Mus musculus
gaggaagagagaggagggagagagagaggagggagagagggaga

SEQ ID NO: 86100 - RNA, 41 nt, Mus musculus
aagauacauagaacuuuacaaugugugugugacaggagaga

SEQ ID NO: 86101 - RNA, 66 nt, Mus musculus
gagggaggaggcaaugccaaacaggcaaaagcaaaucacugccaaucucauggucguaguuagucc

SEQ ID NO: 86102 - RNA, 47 nt, Mus musculus
ugauuugcuuuugccuguuuggcauugccuccucccucccggugagu

SEQ ID NO: 86103 - RNA, 43 nt, Mus musculus
ccuucuccucugagcugccagaaucagucacuuucaccuuuaa

SEQ ID NO: 86104 - RNA, 45 nt, Mus musculus
cuucccugacugucuucgcugagcaaugaaacugcaaugacgcuc

SEQ ID NO: 86105 - RNA, 46 nt, Mus musculus
uauggaaauguuaauucucccaucuuguuauuguaguugagcaccc

SEQ ID NO: 86106 - RNA, 48 nt, Mus musculus
cugcacccagauccuauagccacauggcuggugccugacccaucucag

SEQ ID NO: 86107 - RNA, 47 nt, Mus musculus
augggucaggcaccagccauguggcuauaggaucugggugcaggcug

SEQ ID NO: 86108 - RNA, 46 nt, Mus musculus
uucagaaugcuguguccucugaagaaaaggaugacuuuaagcaaga

SEQ ID NO: 86109 - RNA, 126 nt, Mus musculus
cucauccgaauggugagauucgucagauucauccgaguccacagaauccucgcucucugcauggucuccaucgucaucaucaucgucaucaucgucguccauguggucauggcuuucauuggaauu

SEQ ID NO: 86110 - RNA, 54 nt, Mus musculus
gaccacauggacgacgaugaugacgaugaugaugacgauggagaccaugcagag

SEQ ID NO: 86111 - RNA, 99 nt, Mus musculus
ggaugaaucugacgaaucucaccauucggaugagucugaugagaccgucacugcuaguacacaagcagacacuuucacuccaaucgucccuacagucga

SEQ ID NO: 86112 - RNA, 53 nt, Mus musculus
aacuccuagacuuugaccucaguccauaagccaagcuaucaccucggccguug

SEQ ID NO: 86113 - RNA, 60 nt, Mus musculus
uguccccaacggccgaggugauagcuuggcuuauggacugaggucaaagucuaggaguuu

SEQ ID NO: 86114 - RNA, 78 nt, Mus musculus
aggagucccucgaugucaucccuguugcccagcuucugagcaugcccucugaucaggacaacaacggaaagggcagcc

SEQ ID NO: 86115 - RNA, 44 nt, Mus musculus
uccguuguuguccugaucagagggcaugcucagaagcugggcaa

SEQ ID NO: 86116 - RNA, 46 nt, Mus musculus
cuccuggcucucuuuggaaugcucaagucuguguguuuccagacuu

SEQ ID NO: 86117 - RNA, 70 nt, Mus musculus
augagucaagucagcuggaugaaccaagucuggaaacacacagacuugagcauuccaaagagagccagga

SEQ ID NO: 86118 - RNA, 88 nt, Mus musculus
gauagucaagcaaguuccaaagccagccuggaacaucagagccacaaguuucacagccacaaggacaagcuaguccuagacccuaaga

SEQ ID NO: 86119 - RNA, 59 nt, Mus musculus
agugaggguuaagcaggaauacuaacugcucauuucucaguucaguggauauauguaug

SEQ ID NO: 86120 - RNA, 47 nt, Mus musculus
augaauaaaauguauguagaaacaagcaaauuuacugaaacaagcag

SEQ ID NO: 86121 - RNA, 69 nt, Mus musculus
cagucuauaucacuauacccuuuuaguuuuauaauuagcauauauuuuguugugauuauuuuuuuuguu

SEQ ID NO: 86122 - RNA, 42 nt, Mus musculus
uagagaaccccuugaggacagaaaugacaagaagacccccgc

SEQ ID NO: 86123 - RNA, 25 nt, Mus musculus
cgacuccgggaagaaaagaacaugg

SEQ ID NO: 86124 - RNA, 42 nt, Mus musculus
ccuagcuguccccggcggccucggggagcagcggggccugga

SEQ ID NO: 86125 - RNA, 46 nt, Mus musculus
guguccccccccccccccccccgugugugugugugugugugugugu

SEQ ID NO: 86126 - RNA, 46 nt, Mus musculus
accccaggagggagcaggguuacaccugccaaauaccagcuagaag

SEQ ID NO: 86127 - RNA, 46 nt, Mus musculus
uauucuuaugugcccauauuacacucgaaaacgcguuuacugucaa

SEQ ID NO: 86128 - RNA, 46 nt, Mus musculus
ugcaggcugauauaugggauggauccccggguguggcagucucuag

SEQ ID NO: 86129 - RNA, 41 nt, Mus musculus
ggacuggcuuacagguucaaagguucaguccauugucauca

SEQ ID NO: 86130 - RNA, 49 nt, Mus musculus
uucaccgaaggcuccuuccuggaugggcuguacuggaaggcacagacca

SEQ ID NO: 86131 - RNA, 46 nt, Mus musculus
cuccgagucagaaacggauccugcuccaucccucaggaccugcgag

SEQ ID NO: 86132 - RNA, 34 nt, Mus musculus
gcuccauuuggaccgcggaauggaacugcgugcg

SEQ ID NO: 86133 - RNA, 47 nt, Mus musculus
gauguacacaagugagaaggagcugaaugggagcagucacuggggga

SEQ ID NO: 86134 - RNA, 46 nt, Mus musculus
uauagacagacaaaccaacacacauacacacaaacacacacacaca

SEQ ID NO: 86135 - RNA, 42 nt, Mus musculus
auauccauaagucacauccauugcuucuuuucagaguccuag

SEQ ID NO: 86136 - RNA, 45 nt, Mus musculus
uaauauggucaguccucuaaucaguagauuaaaaauaggcauuuu

SEQ ID NO: 86137 - RNA, 46 nt, Mus musculus
guggaccacauugugucauccacucauugacuguccuugcccccuc

SEQ ID NO: 86138 - RNA, 46 nt, Mus musculus
cgaugacuucagcacuuuccaagaauguauguaaguaucuguguag

SEQ ID NO: 86139 - RNA, 46 nt, Mus musculus
caagauaguccuguuacuguuugacgaacaaauguuaaaaaugcag

SEQ ID NO: 86140 - RNA, 42 nt, Mus musculus
auuucccugcauuucauuccuguugaauauuguugccugcau

SEQ ID NO: 86141 - RNA, 45 nt, Mus musculus
uggacagggggccccaguugcuccugcuuauugaugaaagccagg

SEQ ID NO: 86142 - RNA, 46 nt, Mus musculus
caagugugacuauuacgaagauucugaguugcuaguuuuuacccag

SEQ ID NO: 86143 - RNA, 45 nt, Mus musculus
uucacccaguuccgcaucauuuugggugauaucaacuucgcagag

SEQ ID NO: 86144 - RNA, 42 nt, Mus musculus
aaagcacuguuuaaaaagaaagaaagaaagaaagaaagaaag

SEQ ID NO: 86145 - RNA, 63 nt, Mus musculus
aaagaaacacuguagaugccaucucagagagucuccggcaaggugguggcaaacugaacuuug

SEQ ID NO: 86146 - RNA, 74 nt, Mus musculus
cacuaaauaugaccaggauggcgaccaggaacugaccgagcgugagcaucaacagaugagagaugacuuggaga

SEQ ID NO: 86147 - RNA, 53 nt, Mus musculus
guuuccccagaagccuggaugacuccgaggaggaggaugacgaagacaguggc

SEQ ID NO: 86148 - RNA, 46 nt, Mus musculus
gccgugauugucaagcuggagaucauggagcgggccaagcugaaga

SEQ ID NO: 86149 - RNA, 52 nt, Mus musculus
gaugcgcgacugggucgggacagugagauccacagggagcagauggagcgcc

SEQ ID NO: 86150 - RNA, 70 nt, Mus musculus
uccuuccucccagucugcagagggccuggaagguggagguggaaauggaagugccaacguccaugccuaa

SEQ ID NO: 86151 - RNA, 66 nt, Mus musculus
uaauccacacguguuuguguguuccugagacaccgagagguggcuguccaguacgacaaugauaag

SEQ ID NO: 86152 - RNA, 46 nt, Mus musculus
aguucguguggagccaccacagucugcugcauuaguccagugcgag

SEQ ID NO: 86153 - RNA, 46 nt, Mus musculus
uuuuguuucagauuuggcaaggaaagcucaaaagauaaauuauaag

SEQ ID NO: 86154 - RNA, 51 nt, Mus musculus
cuccuggccggccuggaacuaacuguguaaacuaggcugcccucagacucc

SEQ ID NO: 86155 - RNA, 54 nt, Mus musculus
ggccagugugaccacagcaguuguugaauaacuuggcccuuugagagcuagggg

SEQ ID NO: 86156 - RNA, 45 nt, Mus musculus
ucccucccccucucucucugucugucucucucugucucucucugu

SEQ ID NO: 86157 - RNA, 46 nt, Mus musculus
gaggaggaggaagcaaggauauggucacguguccaagagggcagaa

SEQ ID NO: 86158 - RNA, 46 nt, Mus musculus
gcuguuguucuuggauggugguuuuguuugugggagguguugagga

SEQ ID NO: 86159 - RNA, 42 nt, Mus musculus
ucucuacaaggaugugaugcuggagaccuacaggacccucag

SEQ ID NO: 86160 - RNA, 46 nt, Mus musculus
cggauuauauggucaguuuuggagaaggugcugugagcugcugaga

SEQ ID NO: 86161 - RNA, 46 nt, Mus musculus
cuacaucucuucucuuuacauaaccucucugggucuguggagauac

SEQ ID NO: 86162 - RNA, 46 nt, Mus musculus
gaaaaagaccuaagaugcuguggcuaaagaaaaucagauggcagau

SEQ ID NO: 86163 - RNA, 48 nt, Mus musculus
gggagacaguuaugcaaucuagugaaagaggcagaaaaagugugugug

SEQ ID NO: 86164 - RNA, 46 nt, Mus musculus
ccucaucauugauuaauucaugcauguuuauagaaauuguacagau

SEQ ID NO: 86165 - RNA, 60 nt, Mus musculus
ucagacuagaacaggaggaaugguuuacuguguacacaguagggugaaacaaugucgaca

SEQ ID NO: 86166 - RNA, 51 nt, Mus musculus
aaugacccugcuuuccuuuuuauuagacuuucaaaguucgaauguuaaaug

SEQ ID NO: 86167 - RNA, 77 nt, Mus musculus
cuuucaauaugucucugcuuuuaaggaaacaaaaaauagauccauuaauuuuuguacagcugcaccuuuagccuuuu

SEQ ID NO: 86168 - RNA, 47 nt, Mus musculus
ucuaucauuuuuuguugugauucauuuggaguuaauuuugucuaguu

SEQ ID NO: 86169 - RNA, 46 nt, Mus musculus
ggcugaaucugcacaaagcauuugaagcagggcccuguguauauaa

SEQ ID NO: 86170 - RNA, 47 nt, Mus musculus
auaccacccaugagaaggugaggaauagagagcauagccaccaagua

SEQ ID NO: 86171 - RNA, 108 nt, Mus musculus
ucugacugguaaguaagaugcugaccacuaauggcugggcagggcaggaagaggagagacuuuuaagauucacaggcuugagagagauaagaaggaagagauugagau

SEQ ID NO: 86172 - RNA, 84 nt, Mus musculus
uuauuaaaaugaauaauuaguaaguaaacauucuguagcuacagauccucauacaauugcuuauuugauuacaacgugcuaaga

SEQ ID NO: 86173 - RNA, 46 nt, Mus musculus
cugucccuuguauuucuagaauuuacugucacaacuucgucauuca

SEQ ID NO: 86174 - RNA, 45 nt, Mus musculus
accuggugcaggcagagcugagaguucauccaaaggcugcuagug

SEQ ID NO: 86175 - RNA, 46 nt, Mus musculus
uuucuguugauucaacaacaaaagugaccaaaaagcaaguugggua

SEQ ID NO: 86176 - RNA, 42 nt, Mus musculus
uacaucaucauccauauaugaagaaagcacucacccccuguu

SEQ ID NO: 86177 - RNA, 46 nt, Mus musculus
aaauacaugauuuugaaaauauauaauuucucaacucagccaaaaa

SEQ ID NO: 86178 - RNA, 35 nt, Mus musculus
cagcugagaagcuguguguguaucagguuauagau

SEQ ID NO: 86179 - RNA, 47 nt, Mus musculus
uaaaguuuaagggagucaucugcaggggucaucauucugaggcaaag

SEQ ID NO: 86180 - RNA, 46 nt, Mus musculus
uuccuuuuuauuagacuuucuuaguuugaauguuacauguauguac

SEQ ID NO: 86181 - RNA, 62 nt, Mus musculus
uuucaauaugucucugcuuuuaaggaaccaaaaaauagauccguuaauuuuuguacagcugc

SEQ ID NO: 86182 - RNA, 50 nt, Mus musculus
ccuuguguauagaaacauccuugacaggaugccaguggcaggcaggcuug

SEQ ID NO: 86183 - RNA, 44 nt, Mus musculus
auaagaauugacuuugagaaaucaguuuuuucuauggcuaauaa

SEQ ID NO: 86184 - RNA, 41 nt, Mus musculus
cuuagauugggcuacauccaucugucaucugaagaagaaga

SEQ ID NO: 86185 - RNA, 45 nt, Mus musculus
gcuuuggacccggcaugcugaugccuaagaacggugggcacagga

SEQ ID NO: 86186 - RNA, 45 nt, Mus musculus
ucuauagcgaguauaccguguauauacagggcuguauaucgagag

SEQ ID NO: 86187 - RNA, 42 nt, Mus musculus
cuuagucccuuugucacaugaauggaaagacccuaccgccag

SEQ ID NO: 86188 - RNA, 46 nt, Mus musculus
uauuauguauacaguauuuugccuucacauaugcaugccuguggau

SEQ ID NO: 86189 - RNA, 83 nt, Mus musculus
uuucuuucuuucuugagguguccugauuuauuuuugcuuagcuggugcaauauugcuuaaccuuggaucguugaagacacaag

SEQ ID NO: 86190 - RNA, 45 nt, Mus musculus
cugcgaaucccacagcagacuuuacagucuuggcggccuggaaug

SEQ ID NO: 86191 - RNA, 46 nt, Mus musculus
aaaauaacacauccuuuaauagucacuuuaugugcauaggcuggag

SEQ ID NO: 86192 - RNA, 44 nt, Mus musculus
uucauaaccauuuuaguggcaaguuguauuuccuguguuugucu

SEQ ID NO: 86193 - RNA, 46 nt, Mus musculus
ucccuacucucuugaauaccaucaauaaaguucgcugcaccaaaaa

SEQ ID NO: 86194 - RNA, 42 nt, Mus musculus
guaaccucaaaaacuuuguguguggaaucuucaccagcccag

SEQ ID NO: 86195 - RNA, 46 nt, Mus musculus
ggugcauugagcaugccacuaaaagugucauggguuuugcgaaggu

SEQ ID NO: 86196 - RNA, 29 nt, Mus musculus
cugccaucauaaucaacagacucuaagaa

SEQ ID NO: 86197 - RNA, 46 nt, Mus musculus
uggaaagguccgaauguucaaaggcauuaauaaagcccgagccaag

SEQ ID NO: 86198 - RNA, 46 nt, Mus musculus
aagaaauggagaugucugcauaggggacauaggaagaacagggaug

SEQ ID NO: 86199 - RNA, 45 nt, Mus musculus
agugguggaagauuuaaagaaaggaagaagagguuagccauugag

SEQ ID NO: 86200 - RNA, 44 nt, Mus musculus
cuaaaggcucccuaacauucucagcacacgaacuagggaccagg

SEQ ID NO: 86201 - RNA, 45 nt, Mus musculus
gcgcaccuacagaggaugaagcagacucugcugugguugugugug

SEQ ID NO: 86202 - RNA, 45 nt, Mus musculus
auagcaguaguuuuagaauacaggaauaccuccuaaacucagaaa

SEQ ID NO: 86203 - RNA, 54 nt, Mus musculus
aucaucaucaucaaaguuuagcuacauagcccuagcuggccucaaccucacaau

SEQ ID NO: 86204 - RNA, 45 nt, Mus musculus
aacuugaaagaccugucugccagacugaugauguuuuccuuugag

SEQ ID NO: 86205 - RNA, 46 nt, Mus musculus
ugcggaauagagacccgcaaccgcggcuccacgcagaccugcagag

SEQ ID NO: 86206 - RNA, 46 nt, Mus musculus
cgggcucaaauggcagaguacgaucuacaauuacuccucgcaaaug

SEQ ID NO: 86207 - RNA, 47 nt, Mus musculus
cuaucauccuauauuuggguguguuguacuuauucuuguccuggauc

SEQ ID NO: 86208 - RNA, 53 nt, Mus musculus
auugccaguuguaguucgggcaagaccugcauccagauagcaagugaaggcac

SEQ ID NO: 86209 - RNA, 96 nt, Mus musculus
augucuggaguuacguuguucuugauguacugagagaacuguuucuuauacgcaucuucaucuuccuccauuagguagcgcauguagucugccaca

SEQ ID NO: 86210 - RNA, 65 nt, Mus musculus
aagaugugaacuauacagggauaaagacacacuaacaagugagagcaagggcaugaggagggggu

SEQ ID NO: 86211 - RNA, 83 nt, Mus musculus
uaagccaauauuaccuccuuauauccccaagugcagcccacccuuauccuuacaucucacuguuuaggaugaacaccugcaug

SEQ ID NO: 86212 - RNA, 44 nt, Mus musculus
uucuucucauagacuggauucucucggauagcagcaugagcuuu

SEQ ID NO: 86213 - RNA, 46 nt, Mus musculus
aauuuguuuguaauaaauguccugaugaucaugcuaauuaccagau

SEQ ID NO: 86214 - RNA, 47 nt, Mus musculus
aacucgcacaggaagaucauggccugcugcaauaccacauuugcgga

SEQ ID NO: 86215 - RNA, 46 nt, Mus musculus
uaucaguuugaagaacuuaacacagaaauucugaauaacuuagcag

SEQ ID NO: 86216 - RNA, 41 nt, Mus musculus
uguggcgaaaaauacagaguuuuggcucgucgggugacgcu

SEQ ID NO: 86217 - RNA, 48 nt, Mus musculus
aguguggguuuuauuaucuuucuuagaaaaacaaacaaagagaaaaca

SEQ ID NO: 86218 - RNA, 47 nt, Mus musculus
auguuauggauauugucauaaaaaaagauaucuuuuaaaaaucagag

SEQ ID NO: 86219 - RNA, 46 nt, Mus musculus
uauacacacauguguauauauaugugugugauuaugugaccuaugc

SEQ ID NO: 86220 - RNA, 57 nt, Mus musculus
ugaaaugucuguaguaacuguuagucauguuugaguaagcguaguaugaacaaaguc

SEQ ID NO: 86221 - RNA, 46 nt, Mus musculus
uugauuuccccuagcuauuaauuuaaaguugccuuuccugcagcug

SEQ ID NO: 86222 - RNA, 47 nt, Mus musculus
ucuuuaauuuuaacugaacaccagcaguauuuuuaguaauucuuuaa

SEQ ID NO: 86223 - RNA, 79 nt, Mus musculus
agaagcugugaaucuuggcagcugcuggaauagguaagcguaggugaaaaggacaaaguccuguuguguuagguucugg

SEQ ID NO: 86224 - RNA, 46 nt, Mus musculus
gugugugugugugugugugugagagagagagagagagagagacgug

SEQ ID NO: 86225 - RNA, 46 nt, Mus musculus
uguuuaucaguguugggaugaaguucuauuuuuggcugauuuguac

SEQ ID NO: 86226 - RNA, 46 nt, Mus musculus
uguuaaccucuaaguuaucauuuuugcuaccuuuuuguucuuugag

SEQ ID NO: 86227 - RNA, 76 nt, Mus musculus
uuacgcacuagugucaucaaaauaaugagcuccugugucagugaggaaaaaauagaguggagaucaauaaaggaag

SEQ ID NO: 86228 - RNA, 46 nt, Mus musculus
ucaugauucuuuauggaauagaggggcuuagaaauuugacagcuag

SEQ ID NO: 86229 - RNA, 45 nt, Mus musculus
cugcuaguuuagguauaugugaaugagauuaaaaguguguggggu

SEQ ID NO: 86230 - RNA, 46 nt, Mus musculus
cuagcagaggaccagcuuugguuuccaacaccccacauggcgaucc

SEQ ID NO: 86231 - RNA, 45 nt, Mus musculus
aaccaucccuaacaagaucuggcguccucuucuggagugucugaa

SEQ ID NO: 86232 - RNA, 42 nt, Mus musculus
cacacuguagcugucuucagacauaccagaagagggcagcag

SEQ ID NO: 86233 - RNA, 46 nt, Mus musculus
cucuggguaucauaauuuugugugugagguagcaggguagugcaag

SEQ ID NO: 86234 - RNA, 46 nt, Mus musculus
uuuagauuacccuccuuugaucugaucuuuauuauaauuggguuag

SEQ ID NO: 86235 - RNA, 46 nt, Mus musculus
uuucaauuucucaagagagacuucaauugggauuagaggaucugag

SEQ ID NO: 86236 - RNA, 88 nt, Mus musculus
ggggcaugggcugguagaaacacuccuuccggccggccggcagcgugaagguaaaaucacuguccaaagagggugugaagccggccgc

SEQ ID NO: 86237 - RNA, 46 nt, Mus musculus
cgagggguuuguuuucucuugggacagucgaccugcgccuggccug

SEQ ID NO: 86238 - RNA, 35 nt, Mus musculus
cggaaaggaggcugccagacuuugcucuacucccu

SEQ ID NO: 86239 - RNA, 56 nt, Mus musculus
agugugcgugugugagaacucauuuuucacuagacuugaagauacgguugucaggg

SEQ ID NO: 86240 - RNA, 46 nt, Mus musculus
cuuaaaugguguccuacaguacugaucagcauuuucuagucucaag

SEQ ID NO: 86241 - RNA, 71 nt, Mus musculus
uugcuugcaaacguugcuucauuaagacaugaacucaaaauaacagaauggaguuugcacaauuuagggga

SEQ ID NO: 86242 - RNA, 51 nt, Mus musculus
aguguuaguccaagugaaaauucugaguaugucugcaguccuucaagaucu

SEQ ID NO: 86243 - RNA, 59 nt, Mus musculus
gaaaggcuuauuuuggaagaacucacccaaccuagccaccugggacguuugauuuaccc

SEQ ID NO: 86244 - RNA, 42 nt, Mus musculus
aggcuguagagauguuuggagcaauaaacuuugaaccaggag

SEQ ID NO: 86245 - RNA, 58 nt, Mus musculus
uuaaaaaccuucgagagaaacuucauaaacuuaggcaacagaaugcuuguuuggucac

SEQ ID NO: 86246 - RNA, 23 nt, Mus musculus
cuuacaugaaauuaauauuccua

SEQ ID NO: 86247 - RNA, 52 nt, Mus musculus
cuaugcuugagucugcacaagagcaggcagccaacauuccaaucuuagaaga

SEQ ID NO: 86248 - RNA, 49 nt, Mus musculus
guaagcugaggcagggcauggaguugaggaauaauuauucagcagacuu

SEQ ID NO: 86249 - RNA, 47 nt, Mus musculus
cccuguagccagugagaagcaucacacacacacacacacacacacac

SEQ ID NO: 86250 - RNA, 46 nt, Mus musculus
agucagaaaauggugauugaaaaggagcacaguuuacaagaggcca

SEQ ID NO: 86251 - RNA, 46 nt, Mus musculus
agcuucuuggcaucagcaauaguguggggggguuuggugucugcag

SEQ ID NO: 86252 - RNA, 41 nt, Mus musculus
gagcugagcgacaaaggaaugaagcccucuauaaugcagaa

SEQ ID NO: 86253 - RNA, 46 nt, Mus musculus
agguggaucucugugaguucaaagccagccugcuauacagagcuag

SEQ ID NO: 86254 - RNA, 47 nt, Mus musculus
aaucuguauaaaagugaacuugaaauuuugaaagagaaauucaggua

SEQ ID NO: 86255 - RNA, 47 nt, Mus musculus
cacaguuaacggaaucuagacaauguauucugaagcuagagagggag

SEQ ID NO: 86256 - RNA, 45 nt, Mus musculus
cugcuggcccucagggcuucagucuuuucccuuacccaauaccag

SEQ ID NO: 86257 - RNA, 46 nt, Mus musculus
uaguaaaccaaccuugcaucccugggaugaagccuacuugaucgug

SEQ ID NO: 86258 - RNA, 46 nt, Mus musculus
gaaugugguaaaguaaacacguuagaaacagaaccgguaaaauuag

SEQ ID NO: 86259 - RNA, 46 nt, Mus musculus
agcuuuaaaagcauugcagauucauguaucugaagaaacaaucaag

SEQ ID NO: 86260 - RNA, 45 nt, Mus musculus
accacauaguggcucacaaccauccguaacgagaucuggcgcccu

SEQ ID NO: 86261 - RNA, 28 nt, Mus musculus
acuccugccucagccucccaaggguugg

SEQ ID NO: 86262 - RNA, 42 nt, Mus musculus
agcagcagcagauguuacagcaagagaccaugagaaauggag

SEQ ID NO: 86263 - RNA, 63 nt, Mus musculus
ucagaaacaaagggaaaguucaacagaaaaguugagaaaaauggaagagaaauaugaaacagc

SEQ ID NO: 86264 - RNA, 46 nt, Mus musculus
gguuacaacaccacacagaaacugaauuaacagaaaccaugcagaa

SEQ ID NO: 86265 - RNA, 46 nt, Mus musculus
gauggagauugaagacaaaaaacaagaacuuauugaaauggaucag

SEQ ID NO: 86266 - RNA, 46 nt, Mus musculus
cauuuggauaugacuauucgugaacacagaggagaaauggagcaaa

SEQ ID NO: 86267 - RNA, 45 nt, Mus musculus
uuccacuauaaagagggaaguuuuuggagucugugaaccugccug

SEQ ID NO: 86268 - RNA, 41 nt, Mus musculus
uccauagaauaaaugaagccuuauuguauaacugaccccug

SEQ ID NO: 86269 - RNA, 41 nt, Mus musculus
guaggggauuuccauaucuaaacaaugucuauucucaagaa

SEQ ID NO: 86270 - RNA, 44 nt, Mus musculus
gucgaccucgaggggaaagagguuccaguuuuuauaggcccuca

SEQ ID NO: 86271 - RNA, 54 nt, Mus musculus
ggggauuuccauaucuaaacaaugucuauucucaagaaauggguaugggagggu

SEQ ID NO: 86272 - RNA, 46 nt, Mus musculus
gaguaaacuguaacuaucuucagacagcaccagaagagggcaucag

SEQ ID NO: 86273 - RNA, 45 nt, Mus musculus
caaggguggauggagggaggaaagugggucggggaguagguaggu

SEQ ID NO: 86274 - RNA, 45 nt, Mus musculus
ggcacuaauaggaaguguagccuuggagugaguguggugucauug

SEQ ID NO: 86275 - RNA, 45 nt, Mus musculus
augcuuuuggguuuuguucuuuguucuuugggguuuuuguuggug

SEQ ID NO: 86276 - RNA, 42 nt, Mus musculus
acaaccauccguaacgagaucugacucccucuucuggagggu

SEQ ID NO: 86277 - RNA, 46 nt, Mus musculus
gguuucugaaauugaaguuuaaaauuuagauauuaucagcguauag

SEQ ID NO: 86278 - RNA, 46 nt, Mus musculus
acuuuaauauccuaguguugauaauggacagaacaacuaagcagaa

SEQ ID NO: 86279 - RNA, 41 nt, Mus musculus
caggcuggauccagggggaucaggaccgcagaccaggcagg

SEQ ID NO: 86280 - RNA, 42 nt, Mus musculus
gaauggcucccaggaccuggcaggacuuagaaaauggcagaa

SEQ ID NO: 86281 - RNA, 46 nt, Mus musculus
aauauaggcccauaauccuugcuauugcucgagaggcugaaacaag

SEQ ID NO: 86282 - RNA, 41 nt, Mus musculus
cugucuuugguaauguagcacacugcucccacucuccugua

SEQ ID NO: 86283 - RNA, 46 nt, Mus musculus
guucugagacuuagcugucuugagugcuggagccuucagaaaagag

SEQ ID NO: 86284 - RNA, 46 nt, Mus musculus
gccugaagccuccaugccaccgagugaggaaggacacgcagacauc

SEQ ID NO: 86285 - RNA, 45 nt, Mus musculus
gcaaaguaggaaaggagccuaccuagagaaagagaacaaauagag

SEQ ID NO: 86286 - RNA, 46 nt, Mus musculus
acuuggguuuuauuuaauuccagaugugguuaguuuggcagcccag

SEQ ID NO: 86287 - RNA, 46 nt, Mus musculus
aauaccugccccaccugcaggaucgugauccaucagagccacccau

SEQ ID NO: 86288 - RNA, 46 nt, Mus musculus
gccacugucagccuggagugugagcauguucauuuugaagaagcag

SEQ ID NO: 86289 - RNA, 47 nt, Mus musculus
gcucacaaccauccauaacaagaucugacuccuucuucuggaguguc

SEQ ID NO: 86290 - RNA, 46 nt, Mus musculus
gaucuucagaagcauucacaauagaauuguauaagcauauagccaa

SEQ ID NO: 86291 - RNA, 42 nt, Mus musculus
gugguucucugcauuuccuuggcuuuuguuguuaugccccac

SEQ ID NO: 86292 - RNA, 45 nt, Mus musculus
cuucuaugauuuuguugaaacuauuuucugugccuuugcccuggg

SEQ ID NO: 86293 - RNA, 66 nt, Mus musculus
cauucauucauucauucauucaguuucuguuucucucuguagaucuuaagggugugugugguugug

SEQ ID NO: 86294 - RNA, 45 nt, Mus musculus
uuccagggaaaagcugccucaaguguuggccagugagacaaagag

SEQ ID NO: 86295 - RNA, 45 nt, Mus musculus
cuaggguucuaaggguuccaggucuuuaggaaaaacagauaagca

SEQ ID NO: 86296 - RNA, 74 nt, Mus musculus
aguguacuuacauguaauaaauaaaucuaaaaauaaauaaauaaaauaaaaugggacaauguauauguuaggcu

SEQ ID NO: 86297 - RNA, 45 nt, Mus musculus
aaaggugaaaccaaagcagacgacaauucaaauaaagagacagca

SEQ ID NO: 86298 - RNA, 46 nt, Mus musculus
acaaguauaacaaaauaucauuauuagugucagguucuugcccaca

SEQ ID NO: 86299 - RNA, 42 nt, Mus musculus
uuccagaccaaccagagcuauacguaaugaaacuaucucaag

SEQ ID NO: 86300 - RNA, 44 nt, Mus musculus
agcaucugucuggaaugcaacagcagcaaacuacguggccucaa

SEQ ID NO: 86301 - RNA, 46 nt, Mus musculus
gcuguguuugucacuuaccaaccagcacaugccauccaguggggag

SEQ ID NO: 86302 - RNA, 46 nt, Mus musculus
uuauucaguuuccugaguuugcuguccauucaaaucauuucuagag

SEQ ID NO: 86303 - RNA, 47 nt, Mus musculus
uuaagcaguuacaaaccuccaaauucaaguaaaguuaauuuacagau

SEQ ID NO: 86304 - RNA, 46 nt, Mus musculus
auuaguguuuaaauugugaucuagcaucuacuaaauugaaagggaa

SEQ ID NO: 86305 - RNA, 45 nt, Mus musculus
uguguguguacguacuuucuaucaauauuaaaagauaaacagcca

SEQ ID NO: 86306 - RNA, 45 nt, Mus musculus
cacaacacacgugucuguuuccucaggaaaucauuuaagccccaa

SEQ ID NO: 86307 - RNA, 47 nt, Mus musculus
uuaagaguuugacagauaauguguuacagaacaugaucagcccccuc

SEQ ID NO: 86308 - RNA, 43 nt, Mus musculus
caagguuuuguuuguuuuauuuuucuguucauagucccuaacu

SEQ ID NO: 86309 - RNA, 45 nt, Mus musculus
uggaaaaacccccuuaucaaccccauccccaccuaacacuagcau

SEQ ID NO: 86310 - RNA, 46 nt, Mus musculus
aauaccuggacuuucagacaggauagcaauaaauucacaguuacag

SEQ ID NO: 86311 - RNA, 42 nt, Mus musculus
ucagaggcacucaggaugguccagcguuugacauaccgccgu

SEQ ID NO: 86312 - RNA, 46 nt, Mus musculus
acaccaagaagguugggaaagcaccuaaauccgcauguggcgugug

SEQ ID NO: 86313 - RNA, 52 nt, Mus musculus
cuuauugaggagcagaaaaucguugugaaaguguugaaggcacaagcacaga

SEQ ID NO: 86314 - RNA, 45 nt, Mus musculus
gaaaaaaagcuuugaaaaaagcacagagaauaaaagagcuggagc

SEQ ID NO: 86315 - RNA, 46 nt, Mus musculus
acagcggcaacaaacccaugucaaaaaaagaaaugaucgcccagca

SEQ ID NO: 86316 - RNA, 45 nt, Mus musculus
uacuggaucuaaucuuucagauuuaauuuguuuucugggccuugu

SEQ ID NO: 86317 - RNA, 45 nt, Mus musculus
ucuaguuuuguuacaaguauaacuuaggagaaaaaauugguagaa

SEQ ID NO: 86318 - RNA, 72 nt, Mus musculus
cuuuauaaauucaaagccauuuaaaacacaggcaguuggccagcccaagauagagucguuuucuuacccgau

SEQ ID NO: 86319 - RNA, 46 nt, Mus musculus
acagguccugccuccagcuggaaccuucgucuauccacuggccgau

SEQ ID NO: 86320 - RNA, 46 nt, Mus musculus
cuauaccauauguccaugauggauaaacaaccaaacuucaugaaug

SEQ ID NO: 86321 - RNA, 46 nt, Mus musculus
ugggaagaccauaauauugaagaacauugucaaaguuccagaagac

SEQ ID NO: 86322 - RNA, 48 nt, Mus musculus
uacauuagaacuuuuuggucaugaaauaaguaggggaaacaccagaau

SEQ ID NO: 86323 - RNA, 84 nt, Mus musculus
uagaccagagauaugauauacuugcuucugucuccugagugcugcgauuaaagacaugaacuaauaugcucagcuugcccaauu

SEQ ID NO: 86324 - RNA, 61 nt, Mus musculus
gaugcugcaagaugaauagagaaauggagugaaugugcaauucuuucuaagaacuccaguu

SEQ ID NO: 86325 - RNA, 81 nt, Mus musculus
ugucuauuuguauguguuuaaagaugcaucccuuuuuaguaagaucuuguuacuguuacagauuaaacugggacacuuuag

SEQ ID NO: 86326 - RNA, 42 nt, Mus musculus
aaacuuaagccuagucucccaaauugucaguuugcagcuugu

SEQ ID NO: 86327 - RNA, 47 nt, Mus musculus
uuaauucugauugguugacucaauuuacagggguauggguuucuuug

SEQ ID NO: 86328 - RNA, 46 nt, Mus musculus
uugugaugacugaugugggaagggucuuccacugaggguggcagga

SEQ ID NO: 86329 - RNA, 46 nt, Mus musculus
gccucuccucauuucuuggcaacucuggcuuucagucgcugcaaug

SEQ ID NO: 86330 - RNA, 46 nt, Mus musculus
acuggagugugcauagcagcaaccugauaggaggaagucucaagau

SEQ ID NO: 86331 - RNA, 83 nt, Mus musculus
aaaaacaaaacaaaacaaaacagaaaaacccacaaccauugcauugaguguaggccugauccagcuaugcuuucccugaaguc

SEQ ID NO: 86332 - RNA, 48 nt, Mus musculus
agaguaaaacugaugauguaaaggauuuaguaaagcuuaggaaauagu

SEQ ID NO: 86333 - RNA, 49 nt, Mus musculus
uuggaguuaauuuuguggaggcuguaaaaggcaucucuugugcugggua

SEQ ID NO: 86334 - RNA, 42 nt, Mus musculus
ggcugcaucugugcagaacauuuggcuuguguguagagagau

SEQ ID NO: 86335 - RNA, 42 nt, Mus musculus
cuguccugccgcuggaugcuguggagggugcucaggcaagcu

SEQ ID NO: 86336 - RNA, 45 nt, Mus musculus
agcccacuacuugaauugcagggaaauuaucaaucugucccacaa

SEQ ID NO: 86337 - RNA, 46 nt, Mus musculus
agcaggggcacgccuccaccaaauauggacuuguuuacaccgccag

SEQ ID NO: 86338 - RNA, 42 nt, Mus musculus
uaggggcugaggacaaagcgaagugucagaacuggggggcgc

SEQ ID NO: 86339 - RNA, 44 nt, Mus musculus
gcccauuacucaacuugcaggggaguuaucaaucugucccauaa

SEQ ID NO: 86340 - RNA, 46 nt, Mus musculus
uaucggaggacaggcacaaauacuacagaaauacaaaucccuguag

SEQ ID NO: 86341 - RNA, 46 nt, Mus musculus
cuuugcauaucaaaauuauuuccaaguacauaaaagaauacauacu

SEQ ID NO: 86342 - RNA, 27 nt, Mus musculus
uggaaagaccauaauauugaagaacau

SEQ ID NO: 86343 - RNA, 45 nt, Mus musculus
uuuaguaagaucucacuacuguuauauuuuaaucugggagcacuu

SEQ ID NO: 86344 - RNA, 46 nt, Mus musculus
aaagugaguuccaggacagccagagguacgcagagaaaccaaaaaa

SEQ ID NO: 86345 - RNA, 41 nt, Mus musculus
aacuuaggccuagucucccaaauugucaguuugcagccugu

SEQ ID NO: 86346 - RNA, 46 nt, Mus musculus
ugagcuuugcaagcuccauuuaaacccgauuaggggaauuccaggg

SEQ ID NO: 86347 - RNA, 45 nt, Mus musculus
gguccaagaaucacugaaggaagaccccagacucaaauaguaugc

SEQ ID NO: 86348 - RNA, 46 nt, Mus musculus
uuaauuuuguggagguuguaaaaggcaucucaugugcuggguagca

SEQ ID NO: 86349 - RNA, 42 nt, Mus musculus
ggcagguggagugguggggccucccuggggcugcgcggggag

SEQ ID NO: 86350 - RNA, 42 nt, Mus musculus
ccaggagggagaaggcaaacagccuagugaguaagggaagcu

SEQ ID NO: 86351 - RNA, 46 nt, Mus musculus
cuuuaauuguuaaaauccugggcacccuuccucuuaugggacagau

SEQ ID NO: 86352 - RNA, 61 nt, Mus musculus
aacauaaaauacuaagagaacaaugugcagaaugcagagggaaagaggagaaaagaagaug

SEQ ID NO: 86353 - RNA, 74 nt, Mus musculus
ugaggcgaaauuuuuagacagaacacuuuuuagauuaggacaauggagaguggaguagcuuagaaauuauaggc

SEQ ID NO: 86354 - RNA, 48 nt, Mus musculus
cgugaucauguauucugaaugauguuuuaagugcugaggacaaagaga

SEQ ID NO: 86355 - RNA, 34 nt, Mus musculus
gcuuucuaugaaaauaacaucauuagccaaauau

SEQ ID NO: 86356 - RNA, 46 nt, Mus musculus
gaugguugugagccacccugugguugcugggauuugaacuucggac

SEQ ID NO: 86357 - RNA, 45 nt, Mus musculus
acguugaacaggggaacaugcuucugaagggaagcgaggaugaaa

SEQ ID NO: 86358 - RNA, 41 nt, Mus musculus
ugagccaccacgugguugcugggaauugaacucagggccuu

SEQ ID NO: 86359 - RNA, 42 nt, Mus musculus
ggcauggugagcacagggucacugccaacaaccgggaggagc

SEQ ID NO: 86360 - RNA, 46 nt, Mus musculus
cuucaugaugccugaucuugcuccuauccccaaccacgccccauac

SEQ ID NO: 86361 - RNA, 45 nt, Mus musculus
ccaccgccgugguccgaggucuucccgcucggcccuugacuggau

SEQ ID NO: 86362 - RNA, 42 nt, Mus musculus
gguggagucggagucuggcgagcuugcgugcugggggcguga

SEQ ID NO: 86363 - RNA, 45 nt, Mus musculus
gagaagccgagggaggagcacugggggcaggguacuaugauggac

SEQ ID NO: 86364 - RNA, 42 nt, Mus musculus
uucuucccgucccucccugcucucccucccccgcccccgcag

SEQ ID NO: 86365 - RNA, 50 nt, Mus musculus
guugugucugcguguuggcugggucuguugagcuauuggcagggaaugca

SEQ ID NO: 86366 - RNA, 64 nt, Mus musculus
aggcuaauaauaguagcaggggcuugaggccuucugugacccaucaaccacuacugcaagacca

SEQ ID NO: 86367 - RNA, 41 nt, Mus musculus
agcacagauggguaauacccaucuagcugcuggugaugucu

SEQ ID NO: 86368 - RNA, 46 nt, Mus musculus
cuauacgugaucuuaaaaaagacaagacaguaugagauuguggcag

SEQ ID NO: 86369 - RNA, 46 nt, Mus musculus
uuaggcugugaccucucuuuccccagcaauaaacuggucucuggag

SEQ ID NO: 86370 - RNA, 42 nt, Mus musculus
aagauacagacagagcgacauagucauucacacacucaggag

SEQ ID NO: 86371 - RNA, 46 nt, Mus musculus
gagaagcagguagucaaggcagaggcaaaacaaccuguggggucag

SEQ ID NO: 86372 - RNA, 42 nt, Mus musculus
gcuuagaggaaccacagccaucaacaucgacaucagaccucc

SEQ ID NO: 86373 - RNA, 45 nt, Mus musculus
aucuuuaauaggauaguaauuucucuaaaaagaaaguugucuuaa

SEQ ID NO: 86374 - RNA, 88 nt, Mus musculus
ucaaaucccagcaaccacaugguggcuuacaaccauccauaauaacaucugacacccucuacuggugugucugaagacagcuacagug

SEQ ID NO: 86375 - RNA, 46 nt, Mus musculus
uuugggucagcccgcaacggauuuuguuugagugucacaguggcag

SEQ ID NO: 86376 - RNA, 46 nt, Mus musculus
cacauccugaacaaccuaguggaagcauaccuuauccagcacccag

SEQ ID NO: 86377 - RNA, 46 nt, Mus musculus
uauggccagaacucaauggacccagagcagcagugaacaccguuaa

SEQ ID NO: 86378 - RNA, 37 nt, Mus musculus
uauguccacugaguagguacuaagugguccaagguag

SEQ ID NO: 86379 - RNA, 42 nt, Mus musculus
gugggguucauugccuucuucacaguugcugaaguggugcug

SEQ ID NO: 86380 - RNA, 41 nt, Mus musculus
gaaauuaggggagccagguagagauaggaggaucucuguga

SEQ ID NO: 86381 - RNA, 46 nt, Mus musculus
cuuuguggaauuuuuugagagaaucgugacucuucuucagguccag

SEQ ID NO: 86382 - RNA, 42 nt, Mus musculus
ucuaaagacagcuacaguguacucacaugaaagaaagggguu

SEQ ID NO: 86383 - RNA, 45 nt, Mus musculus
acuaaauucccagucuugccuugguuucuuauuauuacauagaga

SEQ ID NO: 86384 - RNA, 46 nt, Mus musculus
gaaauucaaucacaucugugagcaaacaagguucaagaacugaaua

SEQ ID NO: 86385 - RNA, 42 nt, Mus musculus
ucucagggaagccaaacuagaugacuugagaaaugcuaagau

SEQ ID NO: 86386 - RNA, 46 nt, Mus musculus
acuugguaagaccaauucucacuauccggagaggguggccugagga

SEQ ID NO: 86387 - RNA, 42 nt, Mus musculus
uagccaaggaucucuuuaagauaaaaaaugggaagugggcgg

SEQ ID NO: 86388 - RNA, 46 nt, Mus musculus
aaacaguuacaaaaacccccguacccaggaccucacggccaagcug

SEQ ID NO: 86389 - RNA, 45 nt, Mus musculus
aguggcugacuucuuagccacugagccauuucucuagcccccuaa

SEQ ID NO: 86390 - RNA, 46 nt, Mus musculus
ugugugccuugcggggcacaucuaggaugcagacugcuagugugau

SEQ ID NO: 86391 - RNA, 46 nt, Mus musculus
guaauuugcacagaagcucagaaaguugauucuaguagcugcaaag

SEQ ID NO: 86392 - RNA, 42 nt, Mus musculus
ccugcucuugcaggagacuggagcuguguccccugcccccag

SEQ ID NO: 86393 - RNA, 46 nt, Mus musculus
uagguaauuugugaaagaagccaaaacaaaucuccagcacugaaag

SEQ ID NO: 86394 - RNA, 42 nt, Mus musculus
acucuaguuguguuacagaacacaacuaaacuaaacugccag

SEQ ID NO: 86395 - RNA, 46 nt, Mus musculus
ccaggucauccaaacaauacccaaacuuguguaaauagagugagag

SEQ ID NO: 86396 - RNA, 45 nt, Mus musculus
gucaguguucuuaacccuggagaugucucucuagccccccccccc

SEQ ID NO: 86397 - RNA, 26 nt, Mus musculus
gauggauauaaagagaagaguugaaa

SEQ ID NO: 86398 - RNA, 42 nt, Mus musculus
ugauaagccauugaucaaagcaggaagcugcagacugagcag

SEQ ID NO: 86399 - RNA, 59 nt, Mus musculus
gugguccucagaccagaaagcugaagccucaaauacugcccacuguagaagcagcccca

SEQ ID NO: 86400 - RNA, 42 nt, Mus musculus
cacugagagcuuucgugggaccucugaguccauccaaaguga

SEQ ID NO: 86401 - RNA, 42 nt, Mus musculus
accaacucauggaagccuaaggucaucuuuaucugacaucac

SEQ ID NO: 86402 - RNA, 44 nt, Mus musculus
caaauuccagccugagcuuccuacacaugaaacucuuaccccuu

SEQ ID NO: 86403 - RNA, 46 nt, Mus musculus
uaaacuagugagguggcaguagacaaugccuguugugcuaggccag

SEQ ID NO: 86404 - RNA, 45 nt, Mus musculus
aaagaaagcaggcuucuuccacagcaucagaaagucugacccaga

SEQ ID NO: 86405 - RNA, 45 nt, Mus musculus
uuucugggauguuuuguugaucugucuucccaggaaggcuugcaa

SEQ ID NO: 86406 - RNA, 81 nt, Mus musculus
uuauccagaaggaguuaagcaaaaaggcucaacaagaaauacgagaaaaugaaggcugccuucaggacagaaccucagauu

SEQ ID NO: 86407 - RNA, 46 nt, Mus musculus
aacuccaucuccgugggagcauuucuagauggggaugaugacagua

SEQ ID NO: 86408 - RNA, 46 nt, Mus musculus
uaaaagugguucccuucccuugggacagaaggucgacccuggagaa

SEQ ID NO: 86409 - RNA, 42 nt, Mus musculus
ugaauuugcaaagccugggagacagccuucaugagacaccag

SEQ ID NO: 86410 - RNA, 80 nt, Mus musculus
uugagugugcgaauauugacccuggucuguacccagcaauccacagauggaaaagcacugucaugugcuacucgcccuca

SEQ ID NO: 86411 - RNA, 44 nt, Mus musculus
auacaagccuggccuguguguccauguagauguggccacaaagg

SEQ ID NO: 86412 - RNA, 46 nt, Mus musculus
ccacaguuggccaaguccugcacucaaagggaaguucacaacugag

SEQ ID NO: 86413 - RNA, 47 nt, Mus musculus
uggcacacguggcccgacuugcagcucuguagagccagcuuacuccu

SEQ ID NO: 86414 - RNA, 48 nt, Mus musculus
ugguauuuuagaaaauacaauguucugaguauaauuugaaugucugau

SEQ ID NO: 86415 - RNA, 109 nt, Mus musculus
augaaagcaaacucagauacuaauuguuugaaaguguagccguaauaaugauucagacuuuucagguggaaacuucuaauuuugaaauagaacaaagaugcaaaggcau

SEQ ID NO: 86416 - RNA, 46 nt, Mus musculus
auuucugaaacagaucaauuauguauugucucuugggggggugcag

SEQ ID NO: 86417 - RNA, 46 nt, Mus musculus
agaaaagcagaugugcccugacucagacuucaguaacaaugcucaa

SEQ ID NO: 86418 - RNA, 42 nt, Mus musculus
cgagaaucaugcgaguaaucaucauagaaaacucaccagcaa

SEQ ID NO: 86419 - RNA, 46 nt, Mus musculus
guggcaccaucuagagguguggccuuguuggaauaggugugaccug

SEQ ID NO: 86420 - RNA, 45 nt, Mus musculus
ucauagcuguccuccuccugccuggcaucagcucgguggauguag

SEQ ID NO: 86421 - RNA, 61 nt, Mus musculus
uagaggaauggacaauuuuauuaaacuuuaaucccaggcuugcaagucggagccccgugag

SEQ ID NO: 86422 - RNA, 46 nt, Mus musculus
cagacuacauagugagagucuggcuguaucaccaccaugcugaaag

SEQ ID NO: 86423 - RNA, 46 nt, Mus musculus
gguccuucuccagggagccauccacaugguacugggaaugccggau

SEQ ID NO: 86424 - RNA, 46 nt, Mus musculus
auccuaugagguuuguaggcucacacucaagacaacagaggccagg

SEQ ID NO: 86425 - RNA, 45 nt, Mus musculus
uccccgggcagaaucaaacccagagccagaagaagaaugcccuua

SEQ ID NO: 86426 - RNA, 46 nt, Mus musculus
gagauccucaaguaacuguaaaaagaggaaaaaggaaggggacaga

SEQ ID NO: 86427 - RNA, 46 nt, Mus musculus
auuuucuucauaugaguacacuguagcugucuaaagagggcaucag

SEQ ID NO: 86428 - RNA, 45 nt, Mus musculus
uguagagccgggugugguggugcacaccuuuaaucccagcacuca

SEQ ID NO: 86429 - RNA, 71 nt, Mus musculus
gccauaguggaaauaggaguuguccuuguguuguagcaagacucccaggcaagagaggaaacugaugaaga

SEQ ID NO: 86430 - RNA, 45 nt, Mus musculus
augcuucaugugugggacucauggaauucacauuaacagcaagcg

SEQ ID NO: 86431 - RNA, 44 nt, Mus musculus
gcgggacccgggguccuagcccgcgcggcguccggugcugagag

SEQ ID NO: 86432 - RNA, 46 nt, Mus musculus
ugguuguacaagaguuguacaagaaagcagaucucuaagaccaguc

SEQ ID NO: 86433 - RNA, 42 nt, Mus musculus
guauagaugcagaccacaucuuuguguauaaaaagcccagug

SEQ ID NO: 86434 - RNA, 45 nt, Mus musculus
ucucaugcucucuccuccacaggcaagcugugcauugagaggaga

SEQ ID NO: 86435 - RNA, 38 nt, Mus musculus
gcagacaacacagugcccacugugcaggcaggccaugu

SEQ ID NO: 86436 - RNA, 45 nt, Mus musculus
cgccgguggcccugaguaccagcuccaggaaagugugguggcuga

SEQ ID NO: 86437 - RNA, 42 nt, Mus musculus
ucugcccgccacuuagugccuggggccuguggagaggccccg

SEQ ID NO: 86438 - RNA, 41 nt, Mus musculus
cuaggccgggcccuccuuugacuuccccaaaacccccagcu

SEQ ID NO: 86439 - RNA, 46 nt, Mus musculus
accuaagcugccugacuuccuacagcggaguccccuaccccccauc

SEQ ID NO: 86440 - RNA, 46 nt, Mus musculus
guccgacuuccauguugugcgucccaagcugccuaagcccccaaca

SEQ ID NO: 86441 - RNA, 46 nt, Mus musculus
auguaaaugaagaaaauaucuaaaaaaaauugaaaaaaaaaacccc

SEQ ID NO: 86442 - RNA, 44 nt, Mus musculus
aacagcgcccaguuauguggaaggggaguccuacaaggaugugu

SEQ ID NO: 86443 - RNA, 43 nt, Mus musculus
agggacuaaaucuagugauuggauugccauagggacggggaag

SEQ ID NO: 86444 - RNA, 46 nt, Mus musculus
aguucacaaauuguuugcaauuugcuguuuuguuuuguuuguuuuc

SEQ ID NO: 86445 - RNA, 42 nt, Mus musculus
uggugagcuggugcccaauaaaagggguugggcagcccagac

SEQ ID NO: 86446 - RNA, 24 nt, Mus musculus
agaagggcaaguggaaccaaugua

SEQ ID NO: 86447 - RNA, 57 nt, Mus musculus
agccaggagaucuaucucugugggagaaucugguagguacacgcuaagagcagggaa

SEQ ID NO: 86448 - RNA, 46 nt, Mus musculus
auucauuagacaaaggugcauauugguaccuaguaagggucuaagu

SEQ ID NO: 86449 - RNA, 46 nt, Mus musculus
aaauaucucagugucuggggcggggcagccuccuacgugcccagau

SEQ ID NO: 86450 - RNA, 56 nt, Mus musculus
gaguuaagugggucagugccugacacccgccugccagauccagccugagaucacca

SEQ ID NO: 86451 - RNA, 45 nt, Mus musculus
gaaguugaugcauggcaguaggcuuggagaccuaccuggcuagau

SEQ ID NO: 86452 - RNA, 79 nt, Mus musculus
acuaagagucauuuuucuggcuguacugugugugauaggugagauguuugucugugguggucagaauugcaguagauaa

SEQ ID NO: 86453 - RNA, 43 nt, Mus musculus
caugugggauucuggggacucuaaauucagguugucagguugg

SEQ ID NO: 86454 - RNA, 46 nt, Mus musculus
gucaaucugcugguguuaaagacaugcacuaccucugccccaucuu

SEQ ID NO: 86455 - RNA, 57 nt, Mus musculus
gauacauacuuugggcagagaaaaaaagaugauuuggccgagaauucucucucucuc

SEQ ID NO: 86456 - RNA, 45 nt, Mus musculus
uggccgucaaaugcauuaacaagaagaaccuugccaagucccaaa

SEQ ID NO: 86457 - RNA, 42 nt, Mus musculus
gcguacgcggcccgccggccuccgccugagcccagcgcaccc

SEQ ID NO: 86458 - RNA, 48 nt, Mus musculus
ccaggagcaacuggaaccaccauggacggaaccccuaaaacugugagu

SEQ ID NO: 86459 - RNA, 42 nt, Mus musculus
ccugugcugaaguuucguaacguccacccugaaggagcgguu

SEQ ID NO: 86460 - RNA, 42 nt, Mus musculus
uuuuaagaccugguagcugcaaugaagggaaacagaacaggu

SEQ ID NO: 86461 - RNA, 41 nt, Mus musculus
ggugugucugaagacagcuacaguguacuuacauacaauca

SEQ ID NO: 86462 - RNA, 31 nt, Mus musculus
cucgcuggagacagugucuacccaggaacuc

SEQ ID NO: 86463 - RNA, 46 nt, Mus musculus
guucaaaucccagcaaccaugguggcuugcaaccaucuguaaugag

SEQ ID NO: 86464 - RNA, 41 nt, Mus musculus
gugagccaccaugugguugccgggauuugaacucgggacuu

SEQ ID NO: 86465 - RNA, 76 nt, Mus musculus
agagauaaaagcugugaauauugcuucgauggaccacuguugagaaggacggacaaguaccggacuuacagcaaga

SEQ ID NO: 86466 - RNA, 49 nt, Mus musculus
aucguauacauagaggaucacaguggaaauggaaccuucguaaauaccg

SEQ ID NO: 86467 - RNA, 49 nt, Mus musculus
gcaaacgcuguccucugaguaacaacucugaaaucgcacuuucacuaug

SEQ ID NO: 86468 - RNA, 46 nt, Mus musculus
guaagucaguguucaguagcauccaagaguuacaccauugccugag

SEQ ID NO: 86469 - RNA, 45 nt, Mus musculus
uuuuuauuuuuguuuuuagacgaggucuuacuauauggcuguccu

SEQ ID NO: 86470 - RNA, 48 nt, Mus musculus
aucuccaccuuaauuauuuacauuuauugugugugugugugugugaga

SEQ ID NO: 86471 - RNA, 62 nt, Mus musculus
ugacuguagaugaucagucaguuuauccuaaggaauuaagagacgaauacaucaugucaaaa

SEQ ID NO: 86472 - RNA, 46 nt, Mus musculus
uuuaaggccggugcuguguauccaaacucaggcucuuguguggcag

SEQ ID NO: 86473 - RNA, 42 nt, Mus musculus
aagcaggagcugaugcagaggccauggagggaugugugugag

SEQ ID NO: 86474 - RNA, 42 nt, Mus musculus
caaaguccuaaaaucuuccccuaaaacaacauggcugcaucc

SEQ ID NO: 86475 - RNA, 46 nt, Mus musculus
uaguuguuuaaggacagccugagcuuccuaaggcuuuugucucaaa

SEQ ID NO: 86476 - RNA, 29 nt, Mus musculus
aucgcuaggggcaaagguauagugguguu

SEQ ID NO: 86477 - RNA, 39 nt, Mus musculus
uuuugcuugguuuacgugggugcuggguguuugaaguca

SEQ ID NO: 86478 - RNA, 53 nt, Mus musculus
agguaaagauggcuuuugagaggaagacaugucagaaaguggccauaaagauc

SEQ ID NO: 86479 - RNA, 46 nt, Mus musculus
aacaggcuuuuucuuauuuuaaagucgcuaugaagggauaggggag

SEQ ID NO: 86480 - RNA, 36 nt, Mus musculus
uuuucuuaauuguucucuuccagucauuggacccug

SEQ ID NO: 86481 - RNA, 46 nt, Mus musculus
uaaggacacagcucccaguguggaaacugaaauagaaauuuugaag

SEQ ID NO: 86482 - RNA, 45 nt, Mus musculus
uauguuugugagaagacacguggaccuggcucuuauucaccucug

SEQ ID NO: 86483 - RNA, 45 nt, Mus musculus
gugguaucugacagauaagaagcccauuguugcaucugauucgua

SEQ ID NO: 86484 - RNA, 50 nt, Mus musculus
uuugauuauggaugaggcguaugagagaucauuacuuuguuacgagauuu

SEQ ID NO: 86485 - RNA, 56 nt, Mus musculus
agcagaugaaacauggccaagggacugaaccuggccaugagagaagagagcagaga

SEQ ID NO: 86486 - RNA, 26 nt, Mus musculus
gcucauagcugaaauggcagaguuag

SEQ ID NO: 86487 - RNA, 83 nt, Mus musculus
gagaacuauuugaccgggugguggggaacaagcgccugaaagaagccaccuguaagcucuacuucuaccagaugcuuguagcu

SEQ ID NO: 86488 - RNA, 37 nt, Mus musculus
ucagaguuucucugcuuugugugugacugugugugag

SEQ ID NO: 86489 - RNA, 46 nt, Mus musculus
agagagagaaugugugugugugugugugugugugugagagagagag

SEQ ID NO: 86490 - RNA, 46 nt, Mus musculus
guaccuucacgaaaaugggaucauacaucgggacuuaaagccggag

SEQ ID NO: 86491 - RNA, 46 nt, Mus musculus
aucugguaggagacauuuucauggcuucacagucugguuggaugag

SEQ ID NO: 86492 - RNA, 43 nt, Mus musculus
agcugauuuuucucacugccgagaagaagccuguguauccaau

SEQ ID NO: 86493 - RNA, 44 nt, Mus musculus
cugcuguuuuucucccaucugaucacuccgcugcuuugcaccau

SEQ ID NO: 86494 - RNA, 46 nt, Mus musculus
ugcuuugagaguuuugugccaggcucacucaaagccugcugccagu

SEQ ID NO: 86495 - RNA, 42 nt, Mus musculus
ggcaggcuuagugacacauacauauacucuuagaaggcugag

SEQ ID NO: 86496 - RNA, 46 nt, Mus musculus
guguuucugcguuuuguuuugauaugcuccugcagcccuggaagac

SEQ ID NO: 86497 - RNA, 46 nt, Mus musculus
uuuuaaguggcuguacauuuauuagugguuagaaaucgccagggag

SEQ ID NO: 86498 - RNA, 45 nt, Mus musculus
cuccuuuugcuuuauuuccagacuuccagucaaaagcggccccug

SEQ ID NO: 86499 - RNA, 26 nt, Mus musculus
uuaagaaaaauguuaggggguggugu

SEQ ID NO: 86500 - RNA, 46 nt, Mus musculus
ccaggggaaggcuugaauauguucuaggucuuggcuguggccaguc

SEQ ID NO: 86501 - RNA, 46 nt, Mus musculus
gcaggugcugugcuccuggcucaguaacagucccaauuacgaggag

SEQ ID NO: 86502 - RNA, 45 nt, Mus musculus
accagaacccaccacaagcaagacugugaagcaaaauguccuugg

SEQ ID NO: 86503 - RNA, 49 nt, Mus musculus
ucuguaauggaaucugcugcccucuucaggccugcaggugaacaugcgg

SEQ ID NO: 86504 - RNA, 46 nt, Mus musculus
gccaccaaagacuggauuucaggguuuuggaucaaugagccaccag

SEQ ID NO: 86505 - RNA, 51 nt, Mus musculus
gucuauguauaugugcgaaugugaaugugugcaugugucuauauguaggag

SEQ ID NO: 86506 - RNA, 46 nt, Mus musculus
ucaggacaagcuagcaggcacauacacgugccuguguucugcggag

SEQ ID NO: 86507 - RNA, 46 nt, Mus musculus
auggaggcucugcaacuggugugugugugugugugugugugugugu

SEQ ID NO: 86508 - RNA, 46 nt, Mus musculus
gagcgaaacaaguugucuguuaccuugcaaacauaaagcaggagac

SEQ ID NO: 86509 - RNA, 45 nt, Mus musculus
uuggucagcucuaucucgggggucugacugauucuauaaucaagc

SEQ ID NO: 86510 - RNA, 45 nt, Mus musculus
guguagccuugaggcuauccagggaugucuacuacugaggcuuug

SEQ ID NO: 86511 - RNA, 41 nt, Mus musculus
cucccucaagcugauuuuguauuuugucacaacaaugagaa

SEQ ID NO: 86512 - RNA, 49 nt, Mus musculus
cauuuaauuuugugaugugugugguguagugugguaugauguggugugu

SEQ ID NO: 86513 - RNA, 46 nt, Mus musculus
acucauucagugcgucuacaaagccgggguccaucuugagggcgug

SEQ ID NO: 86514 - RNA, 49 nt, Mus musculus
ggcuuggcuagccucaguugaugcaagugaaguauagggcaaagauaag

SEQ ID NO: 86515 - RNA, 46 nt, Mus musculus
ggggaaaggcugggucguggucacagguguuugcccguuuucaguc

SEQ ID NO: 86516 - RNA, 42 nt, Mus musculus; identical to SEQ ID NO: 44661

SEQ ID NO: 86517 - RNA, 45 nt, Mus musculus
uuuuuuuuuuuuuuaauauaaaugcuuuauuuaacaguugcagau

SEQ ID NO: 86518 - RNA, 44 nt, Mus musculus
gcccuggcagcagggaucuauguuauuuggggucccauuacaga

SEQ ID NO: 86519 - RNA, 46 nt, Mus musculus
gcugcagggccugucugccugcccugcguuugucaaguggcuggaa

SEQ ID NO: 86520 - RNA, 35 nt, Mus musculus
auuuucagugucuagcugacagaauaagaggcuua

SEQ ID NO: 86521 - RNA, 46 nt, Mus musculus
aggucuuggacgccagcugucugcuggacguccugagaauguacag

SEQ ID NO: 86522 - RNA, 41 nt, Mus musculus
cuagaccaugggaaguggcacuauuaggagguguggccuua

SEQ ID NO: 86523 - RNA, 45 nt, Mus musculus
ggaagacucaccaguaacauggugugcaaacacugugaacaccag

SEQ ID NO: 86524 - RNA, 41 nt, Mus musculus
cuggccgugugugugcaugugugugugugugugugugugug

SEQ ID NO: 86525 - RNA, 45 nt, Mus musculus
cacacagacacagacacacacacacacacacacacacacggugga

SEQ ID NO: 86526 - RNA, 45 nt, Mus musculus
acaccuuucaguccaaagggcuuugggugauuugguguggcccag

SEQ ID NO: 86527 - RNA, 42 nt, Mus musculus
ccacugccuucaccacuucaucucaucagaguccgugcgaga

SEQ ID NO: 86528 - RNA, 46 nt, Mus musculus
guguguaccaugagagugccuggugucauggaaucagaagagggaa

SEQ ID NO: 86529 - RNA, 46 nt, Mus musculus
accuucugccaagaacccucucucaaccagcaaccaauggcugugg

SEQ ID NO: 86530 - RNA, 46 nt, Mus musculus
ucagucagccuacgguaaggacggaagcagcaugauaccugagcag

SEQ ID NO: 86531 - RNA, 46 nt, Mus musculus
ggacuccacgacacagcagccccacagaccuggcuuccgggcugag

SEQ ID NO: 86532 - RNA, 41 nt, Mus musculus
cacagacagacagacagacagacagacagacagggccuggu

SEQ ID NO: 86533 - RNA, 46 nt, Mus musculus
augcauguguaugaugcauuuuggcuguuuucacacacccccgauu

SEQ ID NO: 86534 - RNA, 46 nt, Mus musculus
caaaauaaaauauuuaaauacauaaaauaaaacaaaauuuuaaaaa

SEQ ID NO: 86535 - RNA, 52 nt, Mus musculus
ugcugucccagaggacccaaguuugggucugagcacccacauggcagcccac

SEQ ID NO: 86536 - RNA, 44 nt, Mus musculus
acgaacuguccacgaggucuagaacgaaauuauuuggcaacuga

SEQ ID NO: 86537 - RNA, 46 nt, Mus musculus
ucugagcugugauuacaccguccuauucggcaaagccgaggcagac

SEQ ID NO: 86538 - RNA, 63 nt, Mus musculus
gcagaacugucaggccugaugggaacaaagaaaccuuuagugugaaagaaacaaggagccaga

SEQ ID NO: 86539 - RNA, 45 nt, Mus musculus
gagaagcccugucucgaaaagcaaagggaaaaagaaaggagcagg

SEQ ID NO: 86540 - RNA, 48 nt, Mus musculus
gguagauggauggaugaaugaacaagugguuagauagauagaugaaac

SEQ ID NO: 86541 - RNA, 88 nt, Mus musculus
ucccagugaucacggcugaaccuuuaagaauccggacgcacuucaaguuuaauugaauagaauucuuuguauaauaaauuccgcauga

SEQ ID NO: 86542 - RNA, 47 nt, Mus musculus
ugucugugugugugugugugugugagugugugugugagagagagaga

SEQ ID NO: 86543 - RNA, 75 nt, Mus musculus
guaccacugauacuuaguauguagacaccaaagacaccauugaccauccuccaugcacaggagagccccagccaa

SEQ ID NO: 86544 - RNA, 45 nt, Mus musculus
gagccaucuugcuaauccugaaagauuuuaucuuugucugguagc

SEQ ID NO: 86545 - RNA, 46 nt, Mus musculus
gcaguaugcuacagcagcugcuguacagguagagacagggacagga

SEQ ID NO: 86546 - RNA, 46 nt, Mus musculus
ugugggcuccaguuuccucaacggagaagcguauggcuaacuuugg

SEQ ID NO: 86547 - RNA, 42 nt, Mus musculus
gccauguugucagaagcccugcugguguccgccccggggaag

SEQ ID NO: 86548 - RNA, 45 nt, Mus musculus
acuugaacgaugggguaccaugucucucagacccuggauuggaag

SEQ ID NO: 86549 - RNA, 35 nt, Mus musculus
uccuccugcugcgaccgcagagcaaugggaaagug

SEQ ID NO: 86550 - RNA, 42 nt, Mus musculus
guuguaugugugguguguguaugugguauguuauauguguga

SEQ ID NO: 86551 - RNA, 58 nt, Mus musculus
ugugugugugguauauggugugugugugcugugugugucuuugugugguguguugugu

SEQ ID NO: 86552 - RNA, 45 nt, Mus musculus
ucggaacuuccccccggggcaggcuugggcuccagcgccgccuac

SEQ ID NO: 86553 - RNA, 45 nt, Mus musculus
cagcacccuguacaagcacccagcacaagcaccccacacagcacc

SEQ ID NO: 86554 - RNA, 41 nt, Mus musculus
ggcccaugaugauggcuacugucucucucucucucuaggcg

SEQ ID NO: 86555 - RNA, 46 nt, Mus musculus
ccuuaggccucauggucugccugccuuccuuucccacaguucccug

SEQ ID NO: 86556 - RNA, 42 nt, Mus musculus
agcucguggcuccuggcuccuggcucuugcccucucucggag

SEQ ID NO: 86557 - RNA, 45 nt, Mus musculus
gacuguguugcuuuagguuuuuguuuguuugguuguuuugcuguu

SEQ ID NO: 86558 - RNA, 42 nt, Mus musculus
ugggacggcugggggcugggucauagggcccucgcuggaggu

SEQ ID NO: 86559 - RNA, 45 nt, Mus musculus
agaacacaagggacaggacaggggucaggagggggaggggguggg

SEQ ID NO: 86560 - RNA, 45 nt, Mus musculus
gugccucuuucuucauuugagccgcccuuggagagcugaaugacc

SEQ ID NO: 86561 - RNA, 46 nt, Mus musculus
ucccagcuuuagaacccaagucacagggacuuuaugcuuggcagcc

SEQ ID NO: 86562 - RNA, 44 nt, Mus musculus
ucgcccuggaggagaucagccgugccugcgccuccacgggaguu

SEQ ID NO: 86563 - RNA, 45 nt, Mus musculus
ugggcugucuccauccaucuauaccccuuucaugccccaccccac

SEQ ID NO: 86564 - RNA, 57 nt, Mus musculus
ccuuucagaggacaacugucaggaaacaguugaggugccaggugggaggggagacuu

SEQ ID NO: 86565 - RNA, 46 nt, Mus musculus
uuggcaugcucgcauccaggcagucaugugugaugggagcacauag

SEQ ID NO: 86566 - RNA, 47 nt, Mus musculus
aucucuugggaugggcuucucucggaguguaaaagcaaggggccagg

SEQ ID NO: 86567 - RNA, 44 nt, Mus musculus
ugucuuucucgggcugcuuuugcgucguuguccuagguggccag

SEQ ID NO: 86568 - RNA, 46 nt, Mus musculus
gaggcuacaccgacaaaccgcagacacgcaggaucugcucagagau

SEQ ID NO: 86569 - RNA, 47 nt, Mus musculus
gccaccacaugugacucuucuccgugacucuauaaagaccuagcaga

SEQ ID NO: 86570 - RNA, 45 nt, Mus musculus
gcuggccuacucugacauaauacaagugucuucuugccuugagga

SEQ ID NO: 86571 - RNA, 53 nt, Mus musculus
uggcccugaucuagagucuuagcuaaggagcugagaaacagccacaguacucc

SEQ ID NO: 86572 - RNA, 46 nt, Mus musculus
ggagaucccagggucccacacgccucaccucggugagugggcagag

SEQ ID NO: 86573 - RNA, 45 nt, Mus musculus
caugucccgaaaccauuaaaucuauuguuuggaaagucugcaguc

SEQ ID NO: 86574 - RNA, 70 nt, Mus musculus
cagucaggggccagcuggccucugacugcauugcuuuaggucguauucaaacucucuuaaacauugugcc

SEQ ID NO: 86575 - RNA, 52 nt, Mus musculus
ccagccacuagagagaaagguacaagagcagagcagaggagcaagcaaggac

SEQ ID NO: 86576 - RNA, 50 nt, Mus musculus
uuuguuccccgcuguguuuugagcuagaacaaggaguugccugggauugg

SEQ ID NO: 86577 - RNA, 46 nt, Mus musculus
cuugaaagcuuuccccucccucuaagaugauguagguacuugaggu

SEQ ID NO: 86578 - RNA, 48 nt, Mus musculus
cggaaggaacaucuuucuguagcuaauaaaaacuaaaagggaagagga

SEQ ID NO: 86579 - RNA, 42 nt, Mus musculus
uuuaaguuugccuuaucagauaucugagcugugcgacaagua

SEQ ID NO: 86580 - RNA, 45 nt, Mus musculus
uccauccaaauacgugggacucaaagacuccuagucagcuguagu

SEQ ID NO: 86581 - RNA, 46 nt, Mus musculus
guccucuuucagcuaguuuaggcuuaugccuagagucaccccaaag

SEQ ID NO: 86582 - RNA, 46 nt, Mus musculus
gggucuugcugccagggacagggaugcuuuccagccugcagcaaca

SEQ ID NO: 86583 - RNA, 78 nt, Mus musculus
cucuuaaucugguucauuugaaauuucucacuucuuaaccauagagcuaaguuauugucaaaacugggcaggagacag

SEQ ID NO: 86584 - RNA, 63 nt, Mus musculus
gauguaucuucauugucaucucucauccugaugugugccaguuagaggacugucugguaucca

SEQ ID NO: 86585 - RNA, 55 nt, Mus musculus
gcagucaugguauuccaaguguguguguggagguagauaagugggacgguaaaga

SEQ ID NO: 86586 - RNA, 46 nt, Mus musculus
cacuuccuugguuuuuuuagguuagacauuaacaaacagcaggaaa

SEQ ID NO: 86587 - RNA, 45 nt, Mus musculus
ggagaggauccuuccucuccgaggauccucauuauauaccuagua

SEQ ID NO: 86588 - RNA, 49 nt, Mus musculus
acacacacacacaaacacagacacacaugugcucacacacacacggaaa

SEQ ID NO: 86589 - RNA, 41 nt, Mus musculus
caaauggccauccucagcaggguggagggagugugcgagaa

SEQ ID NO: 86590 - RNA, 46 nt, Mus musculus
agggugcagucaggcccccgcacgccuaaccccuaugccucggaca

SEQ ID NO: 86591 - RNA, 50 nt, Mus musculus
uaccaaagcugcagccucauccaggauuggaaaagaaagaagaggaggag

SEQ ID NO: 86592 - RNA, 51 nt, Mus musculus
gugucgggcacagcacggcccaugaugaaaucaucccgaugagcaucagga

SEQ ID NO: 86593 - RNA, 90 nt, Mus musculus
ugcgcuccaccccggaggaccagauccuauaucagacagagcgguacaaugaagagaccuuuggcuacgaaguacccgucaaggaggagg

SEQ ID NO: 86594 - RNA, 42 nt, Mus musculus
cuuuacgcucguucccacccuuucccagcaugcccaggaacu

SEQ ID NO: 86595 - RNA, 46 nt, Mus musculus
aauagcugugagccaucauacgguugcugggaauugaacucaggac

SEQ ID NO: 86596 - RNA, 42 nt, Mus musculus
cucauggccugggacuggagggugguauauguuugggaagac

SEQ ID NO: 86597 - RNA, 45 nt, Mus musculus
guugggggaaggggagauuuuauggaauguugauaagccucauug

SEQ ID NO: 86598 - RNA, 46 nt, Mus musculus
ccacuggaacuuuuagcucaucuuucaccuuuugucggguccuuuu

SEQ ID NO: 86599 - RNA, 47 nt, Mus musculus
uuuggaagccaugugucuuugauuuccugaggagauacagggaggag

SEQ ID NO: 86600 - RNA, 44 nt, Mus musculus
cauagguguguguguccugagcagccuuugaguuugggaaggau

SEQ ID NO: 86601 - RNA, 48 nt, Mus musculus
cucauucuauguuaaagaaaccugcuuagcuguugguguguaaaggcu

SEQ ID NO: 86602 - RNA, 42 nt, Mus musculus
ggguugaauuuuccagugagccuggcugcccuaggagcagau

SEQ ID NO: 86603 - RNA, 45 nt, Mus musculus
ggaccuaaaagaaacaacuaguuaguucagcaucacuuaguagau

SEQ ID NO: 86604 - RNA, 49 nt, Mus musculus
gggcugccauuuggcuaaggaagaauuuagccuugaggagcuaagagcc

SEQ ID NO: 86605 - RNA, 24 nt, Mus musculus
caugaaauuaaaaguaggucagag

SEQ ID NO: 86606 - RNA, 46 nt, Mus musculus
gggcuccaggucguggcagccaaagccagacuuuguaacagcaggu

SEQ ID NO: 86607 - RNA, 45 nt, Mus musculus
gauucuuccauaaguaggauugaaaaacagguuuagaaggaaagu

SEQ ID NO: 86608 - RNA, 45 nt, Mus musculus
ccggguugccgaggcagaacgguccgcugcgcuguucuccugagu

SEQ ID NO: 86609 - RNA, 46 nt, Mus musculus
cuguaugauuaggcagguguaucggcucacauauuuaaucccagca

SEQ ID NO: 86610 - RNA, 46 nt, Mus musculus
aaggaaggaaggaaggaaggaaggaaggaaggaaggaagagccggg

SEQ ID NO: 86611 - RNA, 46 nt, Mus musculus
gccacucaggcaaccccaagggaagaaaagggucucaggguaugca

SEQ ID NO: 86612 - RNA, 26 nt, Mus musculus
caagccugaggggaugggggugggau

SEQ ID NO: 86613 - RNA, 46 nt, Mus musculus
auccacaaggcucuugugagccaacgaagaaagcuacggccuauag

SEQ ID NO: 86614 - RNA, 46 nt, Mus musculus
ggcccagcuuucuuucucugcaaaccuagccaggggaaguguucag

SEQ ID NO: 86615 - RNA, 46 nt, Mus musculus
gagggggacccaagguggcagcugcaacugggaauuaggccagcag

SEQ ID NO: 86616 - RNA, 46 nt, Mus musculus
caauucugaccuaaaggucuuuuucacuggcuucgcuggagugcag

SEQ ID NO: 86617 - RNA, 46 nt, Mus musculus
ccucugaugaauggggaaggaucuggggucuaagguugagccccag

SEQ ID NO: 86618 - RNA, 58 nt, Mus musculus
ggaaguaucguuugcccggcauuuaugagccgggugcugugcuuggcucuggaaacaa

SEQ ID NO: 86619 - RNA, 50 nt, Mus musculus
ugaagaggaacaacaacaacgggaguuuacauccucgcaggugggcaaga

SEQ ID NO: 86620 - RNA, 46 nt, Mus musculus
aaaacaaaagcagguguguucauaucauagucuuccaaggcccaag

SEQ ID NO: 86621 - RNA, 45 nt, Mus musculus
uucagaacccgggggcuggagaaucgucuccacuuaauggcugag

SEQ ID NO: 86622 - RNA, 42 nt, Mus musculus
cucucuuccugguuucuuuuuuuccucaagcuaaccccagac

SEQ ID NO: 86623 - RNA, 42 nt, Mus musculus
gggcuggguauugaacuuuuugccuugucccacugcgcgauc

SEQ ID NO: 86624 - RNA, 46 nt, Mus musculus
cuuuuugagaucaaacgccucagccuguggaauuugucacacagau

SEQ ID NO: 86625 - RNA, 44 nt, Mus musculus
gucaaggguuuuuauacuuagagaaauagguguuacagcucagc

SEQ ID NO: 86626 - RNA, 46 nt, Mus musculus
cagcuuccccucuuuacaccagaauaaaguauugacacucaacuug

SEQ ID NO: 86627 - RNA, 43 nt, Mus musculus
uuaaguauuugaguuugaacagauugauuagcuuggggcgggg

SEQ ID NO: 86628 - RNA, 36 nt, Mus musculus
gcugcuguucagcaccucggucguccacaccaagug

SEQ ID NO: 86629 - RNA, 46 nt, Mus musculus
ggguggggugggguggagaagucauguacuuuuuaguguaguagcc

SEQ ID NO: 86630 - RNA, 30 nt, Mus musculus
cgacucucccuuccuuuccuuugcccaggu

SEQ ID NO: 86631 - RNA, 45 nt, Mus musculus
guuuggcaauuguggauuucuaaagcaagaauaguuuaguucuca

SEQ ID NO: 86632 - RNA, 67 nt, Mus musculus
uuuucuaguccauacuucuguacccccauuuuuuucucccuuaggucauuccuuuaaaaauaaaucu

SEQ ID NO: 86633 - RNA, 48 nt, Mus musculus; identical to SEQ ID NO: 65210

SEQ ID NO: 86634 - RNA, 90 nt, Mus musculus
ucuaccuccaucgaauugcuggagucagaggugaggugcagaugaugggucuuuuaaccccccagcacuaggaaggcagaggcaggcaga

SEQ ID NO: 86635 - RNA, 41 nt, Mus musculus
ccaugcaccccaaaucaggaagacaaccaccaccccccccc

SEQ ID NO: 86636 - RNA, 46 nt, Mus musculus
gguagcagaugcucucuaacuugcuaauuuuuaagacuggguagau

SEQ ID NO: 86637 - RNA, 41 nt, Mus musculus
ucugcuuaauaaaugagguuuucauaccgauugcccgauaa

SEQ ID NO: 86638 - RNA, 81 nt, Mus musculus
gcgcaagacugccaacuucucaagcuauguuugcuggaaggaaacuggaagccgaagccgugggaggguuccaguggagaa

SEQ ID NO: 86639 - RNA, 54 nt, Mus musculus
guuuccagccgggcuaggaggagaucuugccagccuucuagucgggaguuaguc

SEQ ID NO: 86640 - RNA, 42 nt, Mus musculus
ggagugcgcuacccaggcguuggagaaguacaacaucgagaa

SEQ ID NO: 86641 - RNA, 46 nt, Mus musculus
agguaaccaugugcgaccggaaggcggugaucaaaaaugcagacau

SEQ ID NO: 86642 - RNA, 45 nt, Mus musculus
ccgccuuccggucgcacaugguuaccuguguggugacgaagcgca

SEQ ID NO: 86643 - RNA, 25 nt, Mus musculus
acgcgggccgggggcggggccgcgg

SEQ ID NO: 86644 - RNA, 46 nt, Mus musculus
agauuacuccuuucacauuuauauggguucugggaauaaaguucag

SEQ ID NO: 86645 - RNA, 46 nt, Mus musculus
uugcuguggcuaacuuucaacuccacgaguucaagucagugugcag

SEQ ID NO: 86646 - RNA, 42 nt, Mus musculus
ugcuuacugauuuuuguuugcuuaccaugcccuaaggcugua

SEQ ID NO: 86647 - RNA, 50 nt, Mus musculus
cagcacugguuuuggacccuuacucuguguggaccacgaaaacccuuugg

SEQ ID NO: 86648 - RNA, 47 nt, Mus musculus
cgguaaccauacccucuuccacaacccucaugugaacccacuuccga

SEQ ID NO: 86649 - RNA, 77 nt, Mus musculus
ugugucacaguugugagucaccucaucugaaguuugggagaauuuugaaggaacagaucuuauccacugagccaccu

SEQ ID NO: 86650 - RNA, 45 nt, Mus musculus
agagcacgagagacccccguucguugccuacccucaccugcgcau

SEQ ID NO: 86651 - RNA, 45 nt, Mus musculus
guuucaaaacucuaggagucuauuuuaagaagugaaguaggugga

SEQ ID NO: 86652 - RNA, 42 nt, Mus musculus
ccucagcauuaaaaagcaaacagaaaaaccccugggucagug

SEQ ID NO: 86653 - RNA, 46 nt, Mus musculus
ugcccaggccccugugaaggccccauagaaaugacuccugccagug

SEQ ID NO: 86654 - RNA, 44 nt, Mus musculus
ccgcaaauggcacagaaauggcaucaagaaaccacggucgcaaa

SEQ ID NO: 86655 - RNA, 45 nt, Mus musculus
acacagucguccuugaagucagcagggaacuggaaggcaggaggg

SEQ ID NO: 86656 - RNA, 45 nt, Mus musculus
cucugugucuaacuuuagacgucauccauaaugcuuuccuuagac

SEQ ID NO: 86657 - RNA, 41 nt, Mus musculus
gaccuggaagcgaaugauaaagcccccgcccaggcccggcc

SEQ ID NO: 86658 - RNA, 45 nt, Mus musculus
uugggggucaccacaacauaggggaccguauuaaaggggcgcagc

SEQ ID NO: 86659 - RNA, 42 nt, Mus musculus
aaaguuggguugggaguucuaguguucuuuuuggcgguaaaa

SEQ ID NO: 86660 - RNA, 44 nt, Mus musculus
gaacaucauuaaggagaaagcagcucagggaccgcguuugagau

SEQ ID NO: 86661 - RNA, 46 nt, Mus musculus
ccacccuaaagagucauacccuugugcuucuuccccgccccuaccc

SEQ ID NO: 86662 - RNA, 45 nt, Mus musculus
aguugaggucauagacuuauuucuucuucccuuucuccguguggu

SEQ ID NO: 86663 - RNA, 45 nt, Mus musculus
uguguuugugcauguguuuaugcgugugugcgugccugugugugu

SEQ ID NO: 86664 - RNA, 42 nt, Mus musculus
gugauguauagaaggucggggagaggcaucaugacaagugaa

SEQ ID NO: 86665 - RNA, 45 nt, Mus musculus
uaucagacccaugucaaaaaaaggaaaaaugagagagagggagag

SEQ ID NO: 86666 - RNA, 45 nt, Mus musculus
caccacacacacccuacugacggagaagcuguucacggcgagagc

SEQ ID NO: 86667 - RNA, 28 nt, Mus musculus
ucaccgggauuccagacaaaggaagugu

SEQ ID NO: 86668 - RNA, 59 nt, Mus musculus
cucuucccagucaaguccacacagccuucauucuccccaguuucuuucacauggcccgu

SEQ ID NO: 86669 - RNA, 46 nt, Mus musculus
agagaucuucuugaggcccucgaagcgggccaggaagucccucagg

SEQ ID NO: 86670 - RNA, 91 nt, Mus musculus
gugauccaucaaucaaguaaggcagauugggaaaguccaggcccagcuugaacuucucauucagccacuggcuucugucaaaaucgggagc

SEQ ID NO: 86671 - RNA, 45 nt, Mus musculus
cucuucucaucauagcuugagucuguguauuccaggagcaugcag

SEQ ID NO: 86672 - RNA, 35 nt, Mus musculus
cugcaugcuccuggaauacacagacucaagcuaug

SEQ ID NO: 86673 - RNA, 45 nt, Mus musculus
guggguaaacaagacagcuuuaaggucacaaagcugggggcgggg

SEQ ID NO: 86674 - RNA, 43 nt, Mus musculus
gcgccggccgccccggaguacuacccggaggacgaggaggagu

SEQ ID NO: 86675 - RNA, 44 nt, Mus musculus
gccggcgcugcagccggagccggcgccggagccagcagccccgc

SEQ ID NO: 86676 - RNA, 42 nt, Mus musculus
ucuccgcgggaccggcuccgccgcggccccgaggcggcgaca

SEQ ID NO: 86677 - RNA, 45 nt, Mus musculus
guuuugcuuagaagaggaggaagaggaggaaagggaagaggugga

SEQ ID NO: 86678 - RNA, 42 nt, Mus musculus
cacagccucugugaucaaaugcauuuccaaaugggcccccag

SEQ ID NO: 86679 - RNA, 42 nt, Mus musculus
gaugccuguuaauuuguugcuucuuuaauaguauugggagcu

SEQ ID NO: 86680 - RNA, 45 nt, Mus musculus
acacaguuugaaaggauggauaaugcaauauuuaugaccacagau

SEQ ID NO: 86681 - RNA, 88 nt, Mus musculus
ccuugcuucucagugggguaggcaaaagucaccugagcugccgaguguguugauccuccuugucaaguacaaauaaaaaggcauugca

SEQ ID NO: 86682 - RNA, 54 nt, Mus musculus; identical to SEQ ID NO: 64893

SEQ ID NO: 86683 - RNA, 53 nt, Mus musculus; identical to SEQ ID NO: 64894

SEQ ID NO: 86684 - RNA, 42 nt, Mus musculus
aacaacagaaugacuccaucagaacauuagaccccuccccag

SEQ ID NO: 86685 - RNA, 47 nt, Mus musculus; identical to SEQ ID NO: 64895

SEQ ID NO: 86686 - RNA, 45 nt, Mus musculus
ugggguuacaggugugcaccacuacacugauuuaugcugugcugu

SEQ ID NO: 86687 - RNA, 46 nt, Mus musculus
ucuauucauaacacccacauccuggcuacagcccaaggacccagcg

SEQ ID NO: 86688 - RNA, 46 nt, Mus musculus
uucccugugacuguggacugcacgguccagccuuccucucgcuggg

SEQ ID NO: 86689 - RNA, 42 nt, Mus musculus
uuuauaacucucccuuucuccccaaaaugugucuggguacuu

SEQ ID NO: 86690 - RNA, 45 nt, Mus musculus
cuucuuguucacaggaucagaaacuuccaugaucacccauagcag

SEQ ID NO: 86691 - RNA, 61 nt, Mus musculus
ggacggccuugauccugggaaacucuacacccugguccucacagaccccgaugcucccagc

SEQ ID NO: 86692 - RNA, 42 nt, Mus musculus
aagcucgggacauuagaagguuacagaagaggcuuucggcug

SEQ ID NO: 86693 - RNA, 108 nt, Mus musculus
gacagcuccccggguccuguccucacugaagcacuuaugcaggaaagcccuccgaaguuuccugacaacguaucaaguccuagcacugccaauccccaagaagaugaa

SEQ ID NO: 86694 - RNA, 65 nt, Mus musculus
acuuucuagcagugccggcucccccaccuccugcagcagcagcaguacaagggacuggcuaggau

SEQ ID NO: 86695 - RNA, 96 nt, Mus musculus
auccguggugagcagccuucgucagucuaguuguguugaagccaagugcaguuguggauguugcugggguaauaaaggcaagcgggcuccagagcc

SEQ ID NO: 86696 - RNA, 46 nt, Mus musculus
ccuuaacugggaaguaccugccacguagggcauuucugcugccuau

SEQ ID NO: 86697 - RNA, 72 nt, Mus musculus
ucaccauacacuagugccggcuuuuguuuccuguaaacagugguugcauguguaggaaguaacaagcgagua

SEQ ID NO: 86698 - RNA, 47 nt, Mus musculus
cagauggccauuuaucagcauauuuauuuguauuuucucagcagaua

SEQ ID NO: 86699 - RNA, 44 nt, Mus musculus
ucuauuugaagaacaaugcaaaaugaggcuuucauugaagggag

SEQ ID NO: 86700 - RNA, 46 nt, Mus musculus
gaaauuuuguaauaaaauauuugauuagaaaccuacuagcacccau

SEQ ID NO: 86701 - RNA, 42 nt, Mus musculus
ggccucagagcuucuaggccucugcaacuaucaggucucugg

SEQ ID NO: 86702 - RNA, 44 nt, Mus musculus
augcagcgccaagcccuucagagucuucagcuccaugaugucug

SEQ ID NO: 86703 - RNA, 42 nt, Mus musculus
aggccaggaugguggaugucuuuccugucccuggagggccau

SEQ ID NO: 86704 - RNA, 46 nt, Mus musculus
gccuacccacuccuccguccucggaaccuuucuaaagaaacccagg

SEQ ID NO: 86705 - RNA, 42 nt, Mus musculus
gaccacuaauaacaccgccuuucuccuugauccgggccucag

SEQ ID NO: 86706 - RNA, 42 nt, Mus musculus
ccauccugcuuccuuuguggcaaaacccugggucacccagag

SEQ ID NO: 86707 - RNA, 45 nt, Mus musculus
augaauggauggguagguggguagauagguauaugaaugaaugga

SEQ ID NO: 86708 - RNA, 41 nt, Mus musculus
ggguggaugcauaggcaaguagaugaaugaauaugugggua

SEQ ID NO: 86709 - RNA, 75 nt, Mus musculus
agagguaagaaguuggagggcagaggagaacagaggauggggaggcagagaauucgagggaggaggaggagugga

SEQ ID NO: 86710 - RNA, 46 nt, Mus musculus
acuagagagcugaagggaggaccaauggaugauccagggacugaaa

SEQ ID NO: 86711 - RNA, 45 nt, Mus musculus
gauuacaaggucaaaucugggcaagagaguaagacacgccccccc

SEQ ID NO: 86712 - RNA, 46 nt, Mus musculus
auacauuuucagacaggaaguugacuggagacuguuuaggucugag

SEQ ID NO: 86713 - RNA, 45 nt, Mus musculus
accugugcaagaacgacugguccaagccagugaggacccacagug

SEQ ID NO: 86714 - RNA, 46 nt, Mus musculus
gccccagguucaaguauuugaauacauauauacuugguccccaguu

SEQ ID NO: 86715 - RNA, 45 nt, Mus musculus
ugcuagcaacuuaaguuuuuagauacuaauacacacaccauggaa

SEQ ID NO: 86716 - RNA, 43 nt, Mus musculus
gggcacaggugccaucuaugucaucagggaaaccuggcaaguu

SEQ ID NO: 86717 - RNA, 46 nt, Mus musculus
ucuccugucugggauaauggaaggccaucugcucuuagggggagac

SEQ ID NO: 86718 - RNA, 46 nt, Mus musculus
aauguaacguauuuccugauaccucgagguagguaaaugcugucua

SEQ ID NO: 86719 - RNA, 46 nt, Mus musculus
gagguggcauguaaugagagaaggagggugcaaaagacauggagaa

SEQ ID NO: 86720 - RNA, 55 nt, Mus musculus
cagcaugcucugggccccuggguuugugggaggagccuggguuuuguggaagaga

SEQ ID NO: 86721 - RNA, 44 nt, Mus musculus
guaaacucccaguugaaccuguaggagacuuccuuugccaucua

SEQ ID NO: 86722 - RNA, 41 nt, Mus musculus
caccuaaucaccuuccccucauuuuucaaucaagaguccca

SEQ ID NO: 86723 - RNA, 45 nt, Mus musculus
augagugggcggauccacugacagguucauaacacgcaggcgcug

SEQ ID NO: 86724 - RNA, 46 nt, Mus musculus
aaagcaguuucucagugguacaccaguauaauuuuucacggcuggc

SEQ ID NO: 86725 - RNA, 45 nt, Mus musculus
ccuuugggguuuggggcaggccuguaaucccaucacuuggcaggc

SEQ ID NO: 86726 - RNA, 46 nt, Mus musculus
uaguaucugaaccauucucucucagguauaucuuccccaaggagau

SEQ ID NO: 86727 - RNA, 41 nt, Mus musculus
uugggcacaacgauaguggcugggaugcccagccuccuggc

SEQ ID NO: 86728 - RNA, 41 nt, Mus musculus
uuugcauuuaccagggacuggcaugagagucuaggcugagg

SEQ ID NO: 86729 - RNA, 44 nt, Mus musculus
ccacccuggugucuggaaaaccaaccccgugcaggcaucugcag

SEQ ID NO: 86730 - RNA, 43 nt, Mus musculus
aggaugacuguggacuacaaggcauucaaguucaaggccacac

SEQ ID NO: 86731 - RNA, 43 nt, Mus musculus
gugaugcaggugaacaguagguacguggacuagagaaaggaca

SEQ ID NO: 86732 - RNA, 42 nt, Mus musculus
gcuuaugcuuggcugugggccuggugggauccggggcacaca

SEQ ID NO: 86733 - RNA, 41 nt, Mus musculus
cuaggcggaggcggacucucucucagucccauggcacccug

SEQ ID NO: 86734 - RNA, 46 nt, Mus musculus
caucagggugccaugggacugagagagaguccgccuccgccuagcu

SEQ ID NO: 86735 - RNA, 45 nt, Mus musculus
gaaggauggaugggacaggugcagggucagaggucagaccugggc

SEQ ID NO: 86736 - RNA, 94 nt, Mus musculus
auuuccuccaugacccucugucauugugugaagccugcaacccaaagccuaaugcggagaaugccaucucugcccgcucugaccucaaccccgc

SEQ ID NO: 86737 - RNA, 47 nt, Mus musculus
ccagucacugguggaggacauggacgccaugguccggcucaugaggu

SEQ ID NO: 86738 - RNA, 72 nt, Mus musculus
agugggcugcaggcccugguggcccaguauggagauugguucucuuacacuaagaacccucgagccaagauc

SEQ ID NO: 86739 - RNA, 25 nt, Mus musculus
ugucucuucccauuccacagaugug

SEQ ID NO: 86740 - RNA, 28 nt, Mus musculus
ucuugucagccaccaccaccaugccccu

SEQ ID NO: 86741 - RNA, 45 nt, Mus musculus
cggacccagcccuggaagccgggugcucacuauccuagaacagau

SEQ ID NO: 86742 - RNA, 41 nt, Mus musculus
ccuuguaguccacaaucauccacugguuauuguaccugcca

SEQ ID NO: 86743 - RNA, 46 nt, Mus musculus
auaauagggagccgugugcuguacuugaacaggcaugcagcaagag

SEQ ID NO: 86744 - RNA, 51 nt, Mus musculus
gcucagauaacggaagggaaugagccugggaaccaaguucaggggagcggg

SEQ ID NO: 86745 - RNA, 46 nt, Mus musculus
uuaucugagcccaaacguuuaucuucuuccaaggggacagccccaa

SEQ ID NO: 86746 - RNA, 24 nt, Mus musculus
ucaagcgguucaacagcggcacgu

SEQ ID NO: 86747 - RNA, 45 nt, Mus musculus
agagagacagagagagacaaagacagagacaaacagagacaggca

SEQ ID NO: 86748 - RNA, 46 nt, Mus musculus
ggggaggagguggaggaggaggaaggugaggagauagaggaaugag

SEQ ID NO: 86749 - RNA, 44 nt, Mus musculus
cugcagaucucuggagaccuggaagaccuagagccagcccugaa

SEQ ID NO: 86750 - RNA, 43 nt, Mus musculus
acaagauagaugggcagacaggaugggaauggaucaacaggag

SEQ ID NO: 86751 - RNA, 42 nt, Mus musculus
ucccagccccccuccucuuaggucucccuacucuggggccug

SEQ ID NO: 86752 - RNA, 42 nt, Mus musculus
ggugcaguguaaucuagaccuuccaaaucacaggccccagag

SEQ ID NO: 86753 - RNA, 46 nt, Mus musculus
ccugcuagaucaugaggcaaaucauagucagcugcuguggacaguc

SEQ ID NO: 86754 - RNA, 45 nt, Mus musculus
ccagggcuacaagaacuccuaucucaaaacaaacaccaaggccag

SEQ ID NO: 86755 - RNA, 45 nt, Mus musculus
aauucccagcaaccacaugguggcucacaaucauccauaacgaga

SEQ ID NO: 86756 - RNA, 46 nt, Mus musculus
caguuucaaugggacuuagaaagcuccacuguggauguaaggagag

SEQ ID NO: 86757 - RNA, 45 nt, Mus musculus
cucgcugcugcuggacgccgcgucgggccagcugcgccuggagga

SEQ ID NO: 86758 - RNA, 46 nt, Mus musculus
agaagaagcgguuuguggggcagucaggccaagaagacaagaaaaa

SEQ ID NO: 86759 - RNA, 44 nt, Mus musculus
agcgccggcaagcucagaagcagcgcuuccugcagcgagggggc

SEQ ID NO: 86760 - RNA, 45 nt, Mus musculus
cgccagggcgccuuuggccggggugcucccuccaggaagggcaag

SEQ ID NO: 86761 - RNA, 42 nt, Mus musculus
ggaggccuuguucaggcuauacacgcaucaagcugagcaggc

SEQ ID NO: 86762 - RNA, 46 nt, Mus musculus
ccggcuucucccccacuaaaccgcuccggacauuugagacccacuu

SEQ ID NO: 86763 - RNA, 46 nt, Mus musculus
uccacuucucccagcuuggggagaaagagacagaaaggcccccaug

SEQ ID NO: 86764 - RNA, 76 nt, Mus musculus
ggcuguggggggggugaugggaguccaccaggccagcuggcuccaaccuguggcuuccggcaagagcagcagagau

SEQ ID NO: 86765 - RNA, 46 nt, Mus musculus
gaacacuuggucccagcuuguggagcucauuucagaggguguggag

SEQ ID NO: 86766 - RNA, 42 nt, Mus musculus
guagggaacugaugaugucacgugugaccucaggguggugau

SEQ ID NO: 86767 - RNA, 45 nt, Mus musculus
guucagacuuacaggcaugggaccugcuggcaaaggaggcucaga

SEQ ID NO: 86768 - RNA, 24 nt, Mus musculus
cgagcuccagcaggagguggaauu

SEQ ID NO: 86769 - RNA, 45 nt, Mus musculus
cuccuuccccccguauccuagcgaguaucauuaagcccagugaga

SEQ ID NO: 86770 - RNA, 45 nt, Mus musculus
ggagacagucucauaggcuaggcuagccuucaacuugcagcaauc

SEQ ID NO: 86771 - RNA, 42 nt, Mus musculus
aaacucauaccuuuauuucuaugcguggucacagacauuagg

SEQ ID NO: 86772 - RNA, 46 nt, Mus musculus
ccagaaaacuuugcgcccucuuuuccucauggauccccugggaggu

SEQ ID NO: 86773 - RNA, 45 nt, Mus musculus
uuacauggaugaugucaagccggaaucagugaaaggccccaccua

SEQ ID NO: 86774 - RNA, 49 nt, Mus musculus
acagcaaaccaccgugcaguggagggcaucccagcccaggauucgcagc

SEQ ID NO: 86775 - RNA, 42 nt, Mus musculus
gaguugugcuccaugagaccugggcuccagcucugccuuugu

SEQ ID NO: 86776 - RNA, 70 nt, Mus musculus
gccugagcaguucagcugcuguggaagacagcaucaucauccccugugaguucuguggggugcagcugga

SEQ ID NO: 86777 - RNA, 63 nt, Mus musculus
cugguaccaucuuccagaacuuucuacaacaagcaacaaguaaccaguuugacacuuuaaugg

SEQ ID NO: 86778 - RNA, 25 nt, Mus musculus
gccucauccucuuaagugcugaggc

SEQ ID NO: 86779 - RNA, 46 nt, Mus musculus
uuuggagccuucucugccaccucucguuuuuccccucgguguuuug

SEQ ID NO: 86780 - RNA, 27 nt, Mus musculus
aggcaacggcaaagcccgccuuguggu

SEQ ID NO: 86781 - RNA, 45 nt, Mus musculus
ggacagguugcagcuccucgugaccaugaagcucaacgagcgcag

SEQ ID NO: 86782 - RNA, 45 nt, Mus musculus
ggguaguguggagcacgcugcccgagcagcccucgguagccccuc

SEQ ID NO: 86783 - RNA, 45 nt, Mus musculus
cugagguguagacucuagucugggacgggcuuacaaacucuaaag

SEQ ID NO: 86784 - RNA, 56 nt, Mus musculus
agccagagauggggugggguggggguggaggauuuggucugggagauaaagcccaa

SEQ ID NO: 86785 - RNA, 45 nt, Mus musculus
agucagugcucuuaaccacugugucaucucuccagucccuuggau

SEQ ID NO: 86786 - RNA, 41 nt, Mus musculus
caauggcguuggagacaggcuucuaacaugcaggcuagagu

SEQ ID NO: 86787 - RNA, 42 nt, Mus musculus
gucggcggccaucuuguucuucucgugguucccaguggcgag

SEQ ID NO: 86788 - RNA, 42 nt, Mus musculus
gccgccgccaccaccgcucguggggcucguggcgugaggaag

SEQ ID NO: 86789 - RNA, 45 nt, Mus musculus
gccgcugcugcugcugcugcugcgggagggucggcggcgggacgg

SEQ ID NO: 86790 - RNA, 47 nt, Mus musculus
uccacccuccccucaaagccauccauccuccagcguucuuucccccu

SEQ ID NO: 86791 - RNA, 46 nt, Mus musculus
accaagaauuaacaguuaaaagucagguuucaaaccccgggguagc

SEQ ID NO: 86792 - RNA, 42 nt, Mus musculus
ccuagggcacggauuaaaggcuugggccaccacugcccagag

SEQ ID NO: 86793 - RNA, 45 nt, Mus musculus
gggauuaaaggcgugcaccaccacgcccggcuucagcacccccuu

SEQ ID NO: 86794 - RNA, 42 nt, Mus musculus
cuauccagaguacugggauuaaaaacuuuuuaccaccccugu

SEQ ID NO: 86795 - RNA, 46 nt, Mus musculus
cuggaagcagauccuagacugagcagagggcacacaacacagcaag

SEQ ID NO: 86796 - RNA, 46 nt, Mus musculus
aucuagggcuuuguccuguccuuuuauuacuuauuuuuuaauugag

SEQ ID NO: 86797 - RNA, 65 nt, Mus musculus
cacacaagagccucauugggaacagcaggcugacccagcaauaguaagagccagagaauaagguu

SEQ ID NO: 86798 - RNA, 41 nt, Mus musculus
uuguggugacauacagcuuuaauccuauuaucgaaguggca

SEQ ID NO: 86799 - RNA, 46 nt, Mus musculus
cuugguacagggcacgaguguguccuagggacucugaaacggccag

SEQ ID NO: 86800 - RNA, 46 nt, Mus musculus
ugagaggguccaagccaggcaagaauguccagcuccaggagaacga

SEQ ID NO: 86801 - RNA, 80 nt, Mus musculus
acaaucugccucuugcuggccuacaaaaucaaguauccggagaacuucuuucuucucagagggaaccacgagugcgccag

SEQ ID NO: 86802 - RNA, 76 nt, Mus musculus
gaccuugguugccaggcuugcaccuuuccuucucagccccgcgcuggcuggcuggcuggcuuccuuccuuucccuu

SEQ ID NO: 86803 - RNA, 41 nt, Mus musculus
ucugaaugcugggugcuggugguggguggucugcccagcuu

SEQ ID NO: 86804 - RNA, 48 nt, Mus musculus
aacccuggugcuuaagagggaguauauugaguguagacuguuaggacc

SEQ ID NO: 86805 - RNA, 44 nt, Mus musculus
gcccccauguuucaguugcuugaaagguggccuuagagagcaaa

SEQ ID NO: 86806 - RNA, 27 nt, Mus musculus
cuugccgauagcagccaucguggacga

SEQ ID NO: 86807 - RNA, 46 nt, Mus musculus
ggguuauagguugggaagagaacgagacuuuaaauacaggacgagc

SEQ ID NO: 86808 - RNA, 27 nt, Mus musculus
cucuuggaucggguacuuagagaacaa

SEQ ID NO: 86809 - RNA, 45 nt, Mus musculus
ucuauggagcagauucggcgaauuaugagaccaacugauguacca

SEQ ID NO: 86810 - RNA, 45 nt, Mus musculus
ggcgccaugaugaguguggaugagacccucauguguuccuuccag

SEQ ID NO: 86811 - RNA, 50 nt, Mus musculus
ccagguauagcucuccuaagguucuucuuucuuuccucuuuacagauuuu

SEQ ID NO: 86812 - RNA, 59 nt, Mus musculus
aaagccugcagagaaaaagaagcccaacgccacgagaccugucacaccaccacggggua

SEQ ID NO: 86813 - RNA, 45 nt, Mus musculus
cacugagugaucuuuuuacaguuggaucaggccugaacccgucca

SEQ ID NO: 86814 - RNA, 46 nt, Mus musculus
cuacauucuuuauucugcggugacauugaggcuuauaaaucaaaag

SEQ ID NO: 86815 - RNA, 45 nt, Mus musculus
auacagaacucacaguaucuaugacuuuuuuaaacuacgaccugu

SEQ ID NO: 86816 - RNA, 76 nt, Mus musculus
gaaaacagugagacccugucucaaaaaggagaaagagggagagagaggaagagagaagacaggaggaaagggaagg

SEQ ID NO: 86817 - RNA, 46 nt, Mus musculus
auaauaggauaaaaucaaguauucuaaaaugauucgcuagccaggu

SEQ ID NO: 86818 - RNA, 48 nt, Mus musculus
ggaguuuuuuaaacuuggccggcaggcuguugcaccggugcggaaugu

SEQ ID NO: 86819 - RNA, 45 nt, Mus musculus
agucguagcucuccuuggugcagagguugccggugcagaggaugu

SEQ ID NO: 86820 - RNA, 46 nt, Mus musculus
uauuuucaugcucaaaugcuucaaauuuguguguguguccugagau

SEQ ID NO: 86821 - RNA, 43 nt, Mus musculus
ucuguguuaauguguaauguaugcuuguuucuagcuagaacaa

SEQ ID NO: 86822 - RNA, 62 nt, Mus musculus
gcggccuccggcucuccccacuccgacccugcucaaguggccgccggauggugcggaggaag

SEQ ID NO: 86823 - RNA, 45 nt, Mus musculus
cugacugccauggaagguuuuuauuuuacccugaguuuuggagua

SEQ ID NO: 86824 - RNA, 45 nt, Mus musculus
aaauuaauucuaaaaaaaaaagagagagagagaaagguaggcugg

SEQ ID NO: 86825 - RNA, 46 nt, Mus musculus
uaccuuuuaggaagucagucacagaguucccauccucccaccccag

SEQ ID NO: 86826 - RNA, 45 nt, Mus musculus
ccaaugaucaaaugacuaugugaaugucugcuuaccuaagagaua

SEQ ID NO: 86827 - RNA, 45 nt, Mus musculus
guucccuggcucaaaaaaauaaggagaaaaauagauugggggacc

SEQ ID NO: 86828 - RNA, 43 nt, Mus musculus
uaacaucaugacgaagauggaccugcugaguaagaaagccaag

SEQ ID NO: 86829 - RNA, 41 nt, Mus musculus
uuggggguggggaggggugugaugguuaguuugggcaguca

SEQ ID NO: 86830 - RNA, 46 nt, Mus musculus
cuuugggcuccaucgcgcacacacacacacacacacacacacacag

SEQ ID NO: 86831 - RNA, 46 nt, Mus musculus
caaccuucucuucugggcagcagcgugcaccugugcacauacgcau

SEQ ID NO: 86832 - RNA, 46 nt, Mus musculus
acaaaaccacaauacaguaagauaguguuuuagauguuuuggccau

SEQ ID NO: 86833 - RNA, 49 nt, Mus musculus
acaaggaugccauugcuguacucgaugggaucccuucaagacaaagaac

SEQ ID NO: 86834 - RNA, 46 nt, Mus musculus
gaguuaggguucagacagauggcaguuuacuucauuaagggacccu

SEQ ID NO: 86835 - RNA, 42 nt, Mus musculus
gugcacaccuuuaauccugacacuuaaaggcagggcaggugg

SEQ ID NO: 86836 - RNA, 43 nt, Mus musculus
uagauaaacaugaugcuggcaaaccuguacaagaaggcugguc

SEQ ID NO: 86837 - RNA, 46 nt, Mus musculus
guguuugcagucuuagaugaugguucucagucacaacuaugguuag

SEQ ID NO: 86838 - RNA, 47 nt, Mus musculus
uuugucuguaugucuguauguauguagugucuaaugccauaaugguu

SEQ ID NO: 86839 - RNA, 64 nt, Mus musculus
gagguggcaucaaugacgaugaaugugauccagacugugcccaacuuggacuggcuguccgugu

SEQ ID NO: 86840 - RNA, 46 nt, Mus musculus
agcaggggacagcaagaacucuguccucaaguuugagcaggcccag

SEQ ID NO: 86841 - RNA, 49 nt, Mus musculus
gagcaggaguguggcuaugaacuugcucugagaguaauggggauuugaa

SEQ ID NO: 86842 - RNA, 46 nt, Mus musculus
ucuguuacucaagggggcggcgcuuaggaacauggggaggguccag

SEQ ID NO: 86843 - RNA, 46 nt, Mus musculus
guuacuuagcuucuaacagcauccgagaagcaauggugauggccaa

SEQ ID NO: 86844 - RNA, 42 nt, Mus musculus
gccaaaacucuguuagauaaagcccuggcgcagaggccggac

SEQ ID NO: 86845 - RNA, 49 nt, Mus musculus
ggagaaggaggagagucccacggaugccacucaggaggaagauguggac

SEQ ID NO: 86846 - RNA, 44 nt, Mus musculus
cgugcuucacggacugcagagcagcacuuggccccagugggcag

SEQ ID NO: 86847 - RNA, 45 nt, Mus musculus
aggcgcagcacuggcucacaucuagcauuccagcauucuggagau

SEQ ID NO: 86848 - RNA, 45 nt, Mus musculus
gaaagaaagaagaaagaaagaaagaaagaaagaaagaaaggaagg

SEQ ID NO: 86849 - RNA, 41 nt, Mus musculus
agguaguggcuucaguccuacuaccccugagcuaacccaga

SEQ ID NO: 86850 - RNA, 41 nt, Mus musculus
cucccccccacuuucauccagguggagauucuagacccaga

SEQ ID NO: 86851 - RNA, 46 nt, Mus musculus
caaacaaacaaacaaaaaggaaaaaaaagaaaagaaacgugcaacg

SEQ ID NO: 86852 - RNA, 58 nt, Mus musculus
cuguaaucgcccuauccgguguggagaaaaagcggcaacgagaaccgaccaugcagug

SEQ ID NO: 86853 - RNA, 45 nt, Mus musculus
acaaguuggucccggucacuuccaucuuccccuuucaagcaccac

SEQ ID NO: 86854 - RNA, 43 nt, Mus musculus
aaccuuuuccagcagguauuguggucuuuuuaacccggggagg

SEQ ID NO: 86855 - RNA, 45 nt, Mus musculus
agagagaauggauuggccaaaugcaauaccaacagggucuacuag

SEQ ID NO: 86856 - RNA, 41 nt, Mus musculus
caggaucgcgggcgccgugccuggcaggcuguuagggcccg

SEQ ID NO: 86857 - RNA, 46 nt, Mus musculus
aucucaggcgacaguaacacgagaacggcagugcaguuaaggacag

SEQ ID NO: 86858 - RNA, 46 nt, Mus musculus
aaauagaauuaauaagauggucaggcuuaaguguuuaauagaggaa

SEQ ID NO: 86859 - RNA, 41 nt, Mus musculus
gaaaaugauaaaugcaaaaaaggggacucucugucgcuggu

SEQ ID NO: 86860 - RNA, 42 nt, Mus musculus
gaugugugauuaccucaccucgcucucacauacuguagacag

SEQ ID NO: 86861 - RNA, 45 nt, Mus musculus
ucauccucagaggacgaggaggagaugaccguaccugggguggag

SEQ ID NO: 86862 - RNA, 41 nt, Mus musculus
gcccgagcccccuccuaugcucuccuugcccuugcagccgc

SEQ ID NO: 86863 - RNA, 24 nt, Mus musculus
gcaucccaucuugugggaaguuac

SEQ ID NO: 86864 - RNA, 46 nt, Mus musculus
gagggaacauucaagcaaacacagggucaggagcaaaugcugugga

SEQ ID NO: 86865 - RNA, 42 nt, Mus musculus
caugccucuacucgggcaggcucagagcggcggucugagcag

SEQ ID NO: 86866 - RNA, 46 nt, Mus musculus
cuagggagacaguguuguagcacugaugccaaccaggugagugaua

SEQ ID NO: 86867 - RNA, 62 nt, Mus musculus
aucgucaucuacucuaagcagcacaucaacgucaacgaggagaucacguacgacuacaaguu

SEQ ID NO: 86868 - RNA, 42 nt, Mus musculus
auuaaaauucagaucuccaucuuggacagcuccugcccccac

SEQ ID NO: 86869 - RNA, 42 nt, Mus musculus
aaaaaaaaaagcaaaccaacaacaacaaaaagacacacacag

SEQ ID NO: 86870 - RNA, 45 nt, Mus musculus
uguugagcuaacccuuccccaagccccuggcuucuccacccccac

SEQ ID NO: 86871 - RNA, 46 nt, Mus musculus
cccucuguuaaauuuuauauccucugacuucuaggaaugaagccug

SEQ ID NO: 86872 - RNA, 42 nt, Mus musculus
agugucucucucaguaccguuguuuaugcuccuuagacccau

SEQ ID NO: 86873 - RNA, 46 nt, Mus musculus
aaagcuuauuaucugucuccacaugccuuuccagguuggacuccag

SEQ ID NO: 86874 - RNA, 45 nt, Mus musculus
uagucaggguuucuauuccuguacaaaacaucacgaccaagaagc

SEQ ID NO: 86875 - RNA, 46 nt, Mus musculus
acguacaggucccuaaacuuccaaggaggucucuugauggcucaag

SEQ ID NO: 86876 - RNA, 44 nt, Mus musculus
ucaaagcaauauccuuagcuaucgcuuuccaaacugaacgucgu

SEQ ID NO: 86877 - RNA, 46 nt, Mus musculus
gaugaacagugggcaguguguguaacaccauagaaaaagccagcau

SEQ ID NO: 86878 - RNA, 63 nt, Mus musculus
uauguguguguguguaugauggggcaugguguguguauguguguauguguguauguguauggu

SEQ ID NO: 86879 - RNA, 45 nt, Mus musculus
caggauaagaaaccuguugaagaauucaccccgaaaucagcagaa

SEQ ID NO: 86880 - RNA, 58 nt, Mus musculus
cgguguguugaacaugaacaugagcaaugggagcaaccagcagcccauucacccggac

SEQ ID NO: 86881 - RNA, 52 nt, Mus musculus
gagaucuagcggcaagcggucuuccucgcaguccagcccuaacaguccaaag

SEQ ID NO: 86882 - RNA, 72 nt, Mus musculus
ucgguuccauaccaaugcaggcgugucaacagaaggauguguuugccaguuaccuuaauucuaacauccagu

SEQ ID NO: 86883 - RNA, 76 nt, Mus musculus
ggagucaaaucucaaaaagaugauguuuuccaaacccacucauccuuguuucuuccacaccaggaauggagaaugu

SEQ ID NO: 86884 - RNA, 115 nt, Mus musculus
ucuaguuuuagaguuuccauuacuguuuucuagcuugcauacaaauaaagggucucauugugacauuucuguuuagaggggguggugguguuauugggguuuuguuuugaguugg

SEQ ID NO: 86885 - RNA, 46 nt, Mus musculus
gugagcuuuuagggacauguuucagcuuuucauuuguuagacagau

SEQ ID NO: 86886 - RNA, 47 nt, Mus musculus
cucaaaauugguaaacuauccagguuuuaauauaucuacucccagag

SEQ ID NO: 86887 - RNA, 46 nt, Mus musculus
aauauaaauaaauaaaauaauuaaaaagaaauuagauggucuaaag

SEQ ID NO: 86888 - RNA, 46 nt, Mus musculus
ucuuuagagccgggcaugguggugcaugccuuuaaacccagcacuu

SEQ ID NO: 86889 - RNA, 46 nt, Mus musculus
ccuaucuuuagaaaaaagaauagaagaaauaguaucagguagggga

SEQ ID NO: 86890 - RNA, 25 nt, Mus musculus
cacuguuucaacugugguucugaag

SEQ ID NO: 86891 - RNA, 46 nt, Mus musculus
uaggauguacugauuugcuugucuguugucauuuacaucgugaaaa

SEQ ID NO: 86892 - RNA, 42 nt, Mus musculus
augauaacuauuccuuaauaaaacucacuaaagguaccagca

SEQ ID NO: 86893 - RNA, 45 nt, Mus musculus
gccuugauaaauuggggcaaccgcuacuaaaugaaaacccucagc

SEQ ID NO: 86894 - RNA, 44 nt, Mus musculus
agggucacucugucugcaacugacuuaaaugauuaaggugugug

SEQ ID NO: 86895 - RNA, 26 nt, Mus musculus
agugauagauacuagggagucagagu

SEQ ID NO: 86896 - RNA, 46 nt, Mus musculus
gcauugcuggcaauguccuagagagacuggcagggucauuuaagag

SEQ ID NO: 86897 - RNA, 46 nt, Mus musculus
guguagagaaggcccagcuaugcuaaugucgugcuaauccguagag

SEQ ID NO: 86898 - RNA, 44 nt, Mus musculus
uuagauguagauguccuuuaaccccagaaagaauagucagaaga

SEQ ID NO: 86899 - RNA, 46 nt, Mus musculus
ggucuguagucaguuagaaagcuggucuauuaaccucagacaagag

SEQ ID NO: 86900 - RNA, 46 nt, Mus musculus
uagccuuggcuguccuggaacucgcuuuguagaccaggcuggcuuu

SEQ ID NO: 86901 - RNA, 46 nt, Mus musculus
aaacuuaguaaaacgauuugaggaacagcaaaaaaaugacguggaa

SEQ ID NO: 86902 - RNA, 32 nt, Mus musculus
uacuggugagcaauacuaagauagauggaccg

SEQ ID NO: 86903 - RNA, 42 nt, Mus musculus
augucaaaaucuguuuaucaccuguuugcucucuuucaccag

SEQ ID NO: 86904 - RNA, 87 nt, Mus musculus
cucuggugauaaucauaauaauuguccguuuguuucacugagccaaaacgugugacaaccccagauacagcauugaagacaaaguua

SEQ ID NO: 86905 - RNA, 46 nt, Mus musculus
aagauccaagcauucagcuuaagccauggguuuauaaucguugcag

SEQ ID NO: 86906 - RNA, 46 nt, Mus musculus
cagccuucuagcagcuuauagccuaauuggaaggaaaagacaacag

SEQ ID NO: 86907 - RNA, 42 nt, Mus musculus
ugugcgugcgugcgugcgugcgugugugugugugugcgugug

SEQ ID NO: 86908 - RNA, 46 nt, Mus musculus
gugcagcagggacguggcucccauauuuuuacuugaauuaauuaga

SEQ ID NO: 86909 - RNA, 45 nt, Mus musculus
gaguuucuccguccagccuggucuauauagugagacagagagaga

SEQ ID NO: 86910 - RNA, 46 nt, Mus musculus
caguggcuucuuuucuaaggcucuagucuucaguguguauaggccg

SEQ ID NO: 86911 - RNA, 46 nt, Mus musculus
uaaaaaugguuuucauaauuucuaauaaucuggcuuuacugucuag

SEQ ID NO: 86912 - RNA, 45 nt, Mus musculus
ugugugugugugugugugugugugugugagagagagagaguuugc

SEQ ID NO: 86913 - RNA, 28 nt, Mus musculus
ucuuggauugaguuccugaauaacgaag

SEQ ID NO: 86914 - RNA, 55 nt, Mus musculus
aggcaggaggauugcuuagucuaggaauuucaggccagauugggcaauguagacc

SEQ ID NO: 86915 - RNA, 46 nt, Mus musculus
acaaacugauggagaugaagaaacuuuugcgaggguaugggauaag

SEQ ID NO: 86916 - RNA, 46 nt, Mus musculus
aggaugaaucugaagaauuccugaagcgauuucaaaugguugcuag

SEQ ID NO: 86917 - RNA, 46 nt, Mus musculus
auucacaaugcuauguacccaucuccucugcucuuuucacacucag

SEQ ID NO: 86918 - RNA, 46 nt, Mus musculus
cgcuguggagcuuugcagacaaugccagauggaugacuguggaaug

SEQ ID NO: 86919 - RNA, 45 nt, Mus musculus
caacuuauggaagaaagggguugcuuuggcuuacaguuccagagg

SEQ ID NO: 86920 - RNA, 44 nt, Mus musculus
caguauguuuuguuuuguuuuguuuuguugugguugcuguugua

SEQ ID NO: 86921 - RNA, 46 nt, Mus musculus
acaaggauaaaauauugacucuguggacaucgucuaaaagccuugg

SEQ ID NO: 86922 - RNA, 46 nt, Mus musculus
agagauacuguugagucaucagaagaaagagcaaggucuuagguag

SEQ ID NO: 86923 - RNA, 44 nt, Mus musculus
uuaauugcaaagcucacagcuguauuuggguucugaugcagggg

SEQ ID NO: 86924 - RNA, 45 nt, Mus musculus
caccuccaggugcugggauaacagaugccuaucacugugcugguu

SEQ ID NO: 86925 - RNA, 64 nt, Mus musculus
cuaugacucugucccagaguucuaucccaccuccauccccaugucccgccuuuccacuccugcg

SEQ ID NO: 86926 - RNA, 44 nt, Mus musculus
cauaagcgaaaggcuuuguaccacaucuggcaaagauuaucccg

SEQ ID NO: 86927 - RNA, 45 nt, Mus musculus
guuaauuuggaaaaaaucugggacauguuguuggagaaauggcug

SEQ ID NO: 86928 - RNA, 44 nt, Mus musculus
uuuaauuuuaaaaaucagaaaaaucucagcaauugagagguaga

SEQ ID NO: 86929 - RNA, 46 nt, Mus musculus
agcaggugauguauaggugaugaguaggugauguauaggugaugag

SEQ ID NO: 86930 - RNA, 44 nt, Mus musculus
gcuuuuuguuuuuaaaucauuuuauuauauuguauaugugagua

SEQ ID NO: 86931 - RNA, 46 nt, Mus musculus
agaguuagagaagauugugagccaccaugugaguguuuggaaucag

SEQ ID NO: 86932 - RNA, 44 nt, Mus musculus
gaaacccugucuugaaacccaugccccccaaaaaaagagagaga

SEQ ID NO: 86933 - RNA, 42 nt, Mus musculus
ccugcagccuaaauggacaagaaacaacaagcuagcccccug

SEQ ID NO: 86934 - RNA, 42 nt, Mus musculus
ggcuggccuggaacucagaaaucugccugugucugccuccca

SEQ ID NO: 86935 - RNA, 47 nt, Mus musculus
ugguugugagccaccaugugguugcugggauuugaacucagcaucau

SEQ ID NO: 86936 - RNA, 46 nt, Mus musculus
uuaagaggguucaauucccagcacccacgugguaacgguagaccag

SEQ ID NO: 86937 - RNA, 46 nt, Mus musculus
agaagaacauaugaacacuggccagcuagcaggguuuucacaucag

SEQ ID NO: 86938 - RNA, 46 nt, Mus musculus
cuaacuugaaugucucauaugaugaaucaauaaacuaugugcacau

SEQ ID NO: 86939 - RNA, 45 nt, Mus musculus
gccugagcagaacaagaugauggccaggggcaagaagaauuccaa

SEQ ID NO: 86940 - RNA, 45 nt, Mus musculus
aaacacagaugugaacccagaaagucugaauccccgcccccaauc

SEQ ID NO: 86941 - RNA, 45 nt, Mus musculus
cggagcuagaagaacuggaagaggaggagguugaacuggaucgcg

SEQ ID NO: 86942 - RNA, 38 nt, Mus musculus
ugaucugugccacugauccagugaggggccgggcagag

SEQ ID NO: 86943 - RNA, 45 nt, Mus musculus
ucaucagcuuagcacgagagagucugggacucucaugccauagca

SEQ ID NO: 86944 - RNA, 46 nt, Mus musculus
cccagaggaugugaauagauacaaucucagaaagaccuggugucag

SEQ ID NO: 86945 - RNA, 41 nt, Mus musculus
gggcaugcagggaaacacccaacuccugccuaaggggccug

SEQ ID NO: 86946 - RNA, 46 nt, Mus musculus
uucagcagguaaaagugcuugccgcuaagccugaagaccuguuuaa

SEQ ID NO: 86947 - RNA, 46 nt, Mus musculus
augcuauucuuacaccugcuauuuuauacuuaaaauggccacauau

SEQ ID NO: 86948 - RNA, 43 nt, Mus musculus
auaacccacuaguacaauuguuuaaguucuuucuuucccuccc

SEQ ID NO: 86949 - RNA, 46 nt, Mus musculus
auucacaaugggaaacucaugguacuucacaaggaaagcggaggga

SEQ ID NO: 86950 - RNA, 46 nt, Mus musculus
gguuguccucuuugacuaaauguacagcuuuggaaggacugcacau

SEQ ID NO: 86951 - RNA, 46 nt, Mus musculus
uuugaagucauuaagagaacuuuuaaaaaugauuaagccaggggug

SEQ ID NO: 86952 - RNA, 48 nt, Mus musculus
gcuggaggaagcccuuguuccugggugagauaauggcagaggucagcu

SEQ ID NO: 86953 - RNA, 24 nt, Mus musculus
auacuguggaauguuucuuauccc

SEQ ID NO: 86954 - RNA, 46 nt, Mus musculus
acaugguuucuaagucacgguacaaauguaaaucaaacuuggagau

SEQ ID NO: 86955 - RNA, 46 nt, Mus musculus
gauuguggcagcacacaccuuuaauuccagaacuugggagucagag

SEQ ID NO: 86956 - RNA, 46 nt, Mus musculus
gcuguuacagagucagagcuugcugaucaaggggaggaauguccag

SEQ ID NO: 86957 - RNA, 46 nt, Mus musculus
gccuugaugucaguuauccauuggcguuauaagauaagcccguguu

SEQ ID NO: 86958 - RNA, 41 nt, Mus musculus
ucugcggcaaaguuuuauugcuuacaucuucaggagccaga

SEQ ID NO: 86959 - RNA, 45 nt, Mus musculus
aaaaagaaagccagguuugauaguuuuaauccuagcacuggagau

SEQ ID NO: 86960 - RNA, 41 nt, Mus musculus
guaggauggaggaguuuuuaguguuuuuggcagggcugagg

SEQ ID NO: 86961 - RNA, 44 nt, Mus musculus
gcuaggcugcauaccccuaaggccccauaauuuucccagcagua

SEQ ID NO: 86962 - RNA, 45 nt, Mus musculus
ggguggugagagcgcugcucauucauauuguuauaagcaggaggc

SEQ ID NO: 86963 - RNA, 45 nt, Mus musculus
auggaagaccuugucucaaacaaaaaaggauaaaucagaccagcc

SEQ ID NO: 86964 - RNA, 50 nt, Mus musculus
cagccaugacagacaugcaagccuacucucacaagaaaaagaaaucaaga

SEQ ID NO: 86965 - RNA, 41 nt, Mus musculus
auauaauggauucuuguauuuaaaagaaaaguuagggacua

SEQ ID NO: 86966 - RNA, 80 nt, Mus musculus
cagggcuacacagugagacccugccucaaaagaaaaaaaggagaaggaggaagaaagaagaagaggaggaggaagaagaa

SEQ ID NO: 86967 - RNA, 40 nt, Mus musculus
ugugaauuguuuuuaagauuuauuuauuuuuauuuugagu

SEQ ID NO: 86968 - RNA, 46 nt, Mus musculus
gaucuuauuacaggugguugugagcuacuaugugguugcugggauu

SEQ ID NO: 86969 - RNA, 45 nt, Mus musculus
uagugucgugaggcauugugcuugaaaccuggcuuuauagcagaa

SEQ ID NO: 86970 - RNA, 45 nt, Mus musculus
ccuucccaggugucuggguucuccaaguauccuucaaccacgaga

SEQ ID NO: 86971 - RNA, 45 nt, Mus musculus
cuagguccugacucuugauccaggagccauacgcaugaagccaaa

SEQ ID NO: 86972 - RNA, 46 nt, Mus musculus
cugggguuauaguuagugcucagcuaaaauuugguauuuuaaaaaa

SEQ ID NO: 86973 - RNA, 41 nt, Mus musculus
uuauuggcaguuuccuuccuuguuuucccucucuccuagau

SEQ ID NO: 86974 - RNA, 46 nt, Mus musculus
agaggauccggguuccauucucaacacccauaugauggcucacgac

SEQ ID NO: 86975 - RNA, 45 nt, Mus musculus
cuaguuggagucaucugugcuuuaaaaguguucucagagccgggc

SEQ ID NO: 86976 - RNA, 45 nt, Mus musculus
guacaugcugagugucugucuacugccacaccuuuaccccgagac

SEQ ID NO: 86977 - RNA, 45 nt, Mus musculus
acuaauuguggauuggggcagaaaauugcuauuuucuuuguaguu

SEQ ID NO: 86978 - RNA, 52 nt, Mus musculus
cuggggaauuugaccgaaauuuucuuggugaaaacaagaucucugaagugua

SEQ ID NO: 86979 - RNA, 33 nt, Mus musculus
uuuucuuuacccucuuuguucucagcgaauaca

SEQ ID NO: 86980 - RNA, 46 nt, Mus musculus
agagugugagaaaugacgcaggaggaauguuugcugcggugcuuug

SEQ ID NO: 86981 - RNA, 46 nt, Mus musculus
ggauuuugacuugguggaaaauuuacaaaaaacgucaccuucugua

SEQ ID NO: 86982 - RNA, 46 nt, Mus musculus
ccaauuucacaguuuugaaugucagccauugaggaugccgguagaa

SEQ ID NO: 86983 - RNA, 32 nt, Mus musculus
ggucgcgugaggccaaaucuccggguacccga

SEQ ID NO: 86984 - RNA, 46 nt, Mus musculus
uuucaaaaaaaaaaaaaagucauaagcaaaaugcauauaauucuag

SEQ ID NO: 86985 - RNA, 46 nt, Mus musculus
cugcagccuugcucaggaauuuccucaaacuuuagauucucagauc

SEQ ID NO: 86986 - RNA, 44 nt, Mus musculus
gcgguggaaacgguuuuucucgcggugcggaaagaaccccaaau

SEQ ID NO: 86987 - RNA, 42 nt, Mus musculus
aagagcagucgggugcucuuacccacugagccaugucaccag

SEQ ID NO: 86988 - RNA, 45 nt, Mus musculus
uguccuggaacuugcuuuguagaccaggcuggccucaaacucaga

SEQ ID NO: 86989 - RNA, 58 nt, Mus musculus
gagggccaggguguggccugagaaugauugggaaagagagagggaguucagggaggag

SEQ ID NO: 86990 - RNA, 45 nt, Mus musculus
agagugcggcaugucaggcaagcgcuccaaccacagccacauagg

SEQ ID NO: 86991 - RNA, 45 nt, Mus musculus
gccggcuccuccccgugggaacgcugcgaggcgacguggguuugg

SEQ ID NO: 86992 - RNA, 45 nt, Mus musculus
aaugccuccguucucuaccacuccuucagcaccaacuaugacaag

SEQ ID NO: 86993 - RNA, 41 nt, Mus musculus
cagcccuggcacucugaggaaggacugugaguucugggcca

SEQ ID NO: 86994 - RNA, 45 nt, Mus musculus
uuacccgacagcagcauccagcaccacagugacagggacguugag

SEQ ID NO: 86995 - RNA, 46 nt, Mus musculus
uaaguuaaugccaacgcuacuuuaaaguuauuuuuuaaaguguaag

SEQ ID NO: 86996 - RNA, 46 nt, Mus musculus
uuccuuuucaacuuaaaaaaaaagaaacaugaaguuauuccaucgc

SEQ ID NO: 86997 - RNA, 42 nt, Mus musculus
ugggacagacuccuuuucccccagauccuccccuggccucag

SEQ ID NO: 86998 - RNA, 45 nt, Mus musculus
aaaauaaaaacaaaaccagcuccaaggucacauuuuucuacggag

SEQ ID NO: 86999 - RNA, 46 nt, Mus musculus
aaugucaccaaacuaaggaagccagaaaaacagcacggaguccuag

SEQ ID NO: 87000 - RNA, 45 nt, Mus musculus
auagauguggccaccgaacaggccaugugggagccucccggcaga

SEQ ID NO: 87001 - RNA, 43 nt, Mus musculus
caucugggggcucaggccauggcacuggugggcuguccgcuga

SEQ ID NO: 87002 - RNA, 41 nt, Mus musculus
ucgggccuuagggacaguaggauguugggcaaagggugcag

SEQ ID NO: 87003 - RNA, 42 nt, Mus musculus
accccugcccugcaacccccauaccgaucccccuaguggcag

SEQ ID NO: 87004 - RNA, 46 nt, Mus musculus
cugaugaaacccgcaggacaaacaaccuugcccccagaccccagcg

SEQ ID NO: 87005 - RNA, 42 nt, Mus musculus
agcaagcaccccaggggacuugaccaaugucguaaccccaag

SEQ ID NO: 87006 - RNA, 47 nt, Mus musculus
gcaguuggcagaugaugggcaccagcaacaggaggccuccaagcccc

SEQ ID NO: 87007 - RNA, 45 nt, Mus musculus
cuuucgcugguuagaaucuagucuuaggaccugaagggcgacgag

SEQ ID NO: 87008 - RNA, 41 nt, Mus musculus
uucccagccaccacaugguggcuuacaaccaucuggaauug

SEQ ID NO: 87009 - RNA, 44 nt, Mus musculus
cguuguaaaagugggggugggagagaaacagaggcgcaccugga

SEQ ID NO: 87010 - RNA, 46 nt, Mus musculus
aacaguaaugccaggcagagagccgagagaccaaaagucaggccag

SEQ ID NO: 87011 - RNA, 48 nt, Mus musculus
gggaucuggugucuggguacaugccuucuaucccgauaccucugaagg

SEQ ID NO: 87012 - RNA, 46 nt, Mus musculus
auccugcugaaauucuggacgcccgugaagacagugaagaccccag

SEQ ID NO: 87013 - RNA, 45 nt, Mus musculus
aucucaccaacugugcgguucauaaaagcacgcuggcccauggug

SEQ ID NO: 87014 - RNA, 42 nt, Mus musculus
cuguugcuuuuucaauaucaaaaauggaauuaagggcuggag

SEQ ID NO: 87015 - RNA, 44 nt, Mus musculus
cuguagacauaggguccacgcucccggacuacuggcuucuggcc

SEQ ID NO: 87016 - RNA, 94 nt, Mus musculus
uaugggcagggauuagggggugugucguuggaggagguguggccuugucggaggaagaggcgugucuuugucggaggagguguggccuuguuga

SEQ ID NO: 87017 - RNA, 91 nt, Mus musculus
uucugaagguccugaguucaaaucccagcaaccacauggcucacacccauccguaaugagaucugacgcccucuucuggagugucugaaga

SEQ ID NO: 87018 - RNA, 46 nt, Mus musculus
aggcaauaaauuagucaggauggucccugaugcggugugaccggag

SEQ ID NO: 87019 - RNA, 45 nt, Mus musculus
agagcaaagaagagguaggugggagggagcugggagacugcccga

SEQ ID NO: 87020 - RNA, 45 nt, Mus musculus
ccucugugggugugggucucucucucucccucucucucucugugu

SEQ ID NO: 87021 - RNA, 46 nt, Mus musculus
ccugcccuaggccaguggaggccaaggucaccagugagggagagag

SEQ ID NO: 87022 - RNA, 46 nt, Mus musculus
aggguuacaaucuuuuagcagaggcuacaucuugguucugucaccu

SEQ ID NO: 87023 - RNA, 45 nt, Mus musculus
caggccauguuuaauaaccagcugccgaccuuugcuaugggccag

SEQ ID NO: 87024 - RNA, 45 nt, Mus musculus
acaauauugugcaucgauaggauugcaccuguaaccccagagaca

SEQ ID NO: 87025 - RNA, 45 nt, Mus musculus
auaucggugcccgguugaaagggcaaaacagggccuaaggcugag

SEQ ID NO: 87026 - RNA, 46 nt, Mus musculus
gacggagacagaggugacggaggccacagagaugacagaagccgag

SEQ ID NO: 87027 - RNA, 48 nt, Mus musculus
caagaccaucacccuggacgucgagcccaguguuaccaccaagaaggu

SEQ ID NO: 87028 - RNA, 46 nt, Mus musculus
cucgacguccagggugauggucuugccugucagggucuucacaaag

SEQ ID NO: 87029 - RNA, 49 nt, Mus musculus
agaguccacccugcaccugguccuucgccucagagguggcaugcagauc

SEQ ID NO: 87030 - RNA, 46 nt, Mus musculus
ugcuugccugcaaagaucagccucugcuggucaggggggaugcccu

SEQ ID NO: 87031 - RNA, 49 nt, Mus musculus; identical to SEQ ID NO: 87029

SEQ ID NO: 87032 - RNA, 102 nt, Mus musculus
cuuucuggauguuguagucugacagggugcggccaucuuccagcugcuugccugcaaagaucagccucugcuggucaggggggaugcccuccuuguccugga

SEQ ID NO: 87033 - RNA, 77 nt, Mus musculus
gaagacccugacaggcaagaccaucacccuggaggucgagcccagugacaccauagagaaugucaaggcaaagaucc

SEQ ID NO: 87034 - RNA, 46 nt, Mus musculus
cucgaccuccagggugauggucuugccugucagggucuucacaaag

SEQ ID NO: 87035 - RNA, 147 nt, Mus musculus
auccaggacaaggagggcauccccccugaccagcagaggcugaucuuugcaggcaagcagcuggaagauggccgcacccugucagacuacaacauccagaaagaguccacccugcaccugguccuucgccucagaggugggaugcag

SEQ ID NO: 87036 - RNA, 46 nt, Mus musculus; identical to SEQ ID NO: 87030

SEQ ID NO: 87037 - RNA, 127 nt, Mus musculus
agaguccacccugcaccugguccuucgccucagagguggcaugcagaucuuugugaagacccugacaggcaagaccaucacccuggaggucgagcccagugacaccauagagaaugucaaggcaaag

SEQ ID NO: 87038 - RNA, 102 nt, Mus musculus; identical to SEQ ID NO: 87032

SEQ ID NO: 87039 - RNA, 77 nt, Mus musculus; identical to SEQ ID NO: 87033

SEQ ID NO: 87040 - RNA, 46 nt, Mus musculus; identical to SEQ ID NO: 87034

SEQ ID NO: 87041 - RNA, 131 nt, Mus musculus
gcauccccccugaccagcagaggcugaucuuugcaggcaagcagcuggaagauggccgcacccugucagacuacaacauccagaaagaguccacccugcaccugguccuucgccucagaggugggaugcag

SEQ ID NO: 87042 - RNA, 46 nt, Mus musculus; identical to SEQ ID NO: 87030

SEQ ID NO: 87043 - RNA, 70 nt, Mus musculus
ccugacaggcaaaaccaucacccuggaggucgagcccagugacaccauugagaaugucaaggcaaagauc

SEQ ID NO: 87044 - RNA, 85 nt, Mus musculus
gcauccccccugaccagcagaggcugaucuuugcaggcaagcagcuggaagauggccgcacccugucagacuacaacauccagaa

SEQ ID NO: 87045 - RNA, 102 nt, Mus musculus; identical to SEQ ID NO: 87032

SEQ ID NO: 87046 - RNA, 46 nt, Mus musculus; identical to SEQ ID NO: 87034

SEQ ID NO: 87047 - RNA, 49 nt, Mus musculus; identical to SEQ ID NO: 87029

SEQ ID NO: 87048 - RNA, 46 nt, Mus musculus; identical to SEQ ID NO: 87030

SEQ ID NO: 87049 - RNA, 77 nt, Mus musculus; identical to SEQ ID NO: 87033

SEQ ID NO: 87050 - RNA, 147 nt, Mus musculus; identical to SEQ ID NO: 87035

SEQ ID NO: 87051 - RNA, 102 nt, Mus musculus; identical to SEQ ID NO: 87032

SEQ ID NO: 87052 - RNA, 46 nt, Mus musculus; identical to SEQ ID NO: 87034

SEQ ID NO: 87053 - RNA, 127 nt, Mus musculus; identical to SEQ ID NO: 87037

SEQ ID NO: 87054 - RNA, 46 nt, Mus musculus; identical to SEQ ID NO: 87030

SEQ ID NO: 87055 - RNA, 50 nt, Mus musculus
ggaggucgagcccagugacaccauugagaaugucaaggcaaagauccagg

SEQ ID NO: 87056 - RNA, 41 nt, Mus musculus
gcgcaggccuuuaaucccagcacuuuggaggcagaggcagg

SEQ ID NO: 87057 - RNA, 42 nt, Mus musculus
cagguccaugguucuuacccgcuguaucucuugcccccagaa

SEQ ID NO: 87058 - RNA, 46 nt, Mus musculus
gaggucagaggagggagucagacccucuggaacuggaauuagagau

SEQ ID NO: 87059 - RNA, 41 nt, Mus musculus
gguggcauguacccucuuuauucauuuaaggugggccaggc

SEQ ID NO: 87060 - RNA, 45 nt, Mus musculus
gugggaagugugcagggagggcagacuaaagucaccuugucaggg

SEQ ID NO: 87061 - RNA, 42 nt, Mus musculus
agguacaccucacuguggcuggucugcaccagcucuccagau

SEQ ID NO: 87062 - RNA, 77 nt, Mus musculus
cccauccaagaaagagaggaagccccugacaaagaaggagaggaaggugcuacagaaggucuuagaacagaaggaga

SEQ ID NO: 87063 - RNA, 45 nt, Mus musculus
cgccuaagcacaaaggugaugagcacgggcauuggucagguugug

SEQ ID NO: 87064 - RNA, 41 nt, Mus musculus
ggcauauugguugugccauuaagaaaagcauuacagguuga

SEQ ID NO: 87065 - RNA, 47 nt, Mus musculus
uacaaagcaggacauugccucgauccccaacuucuaaaagaggaagu

SEQ ID NO: 87066 - RNA, 58 nt, Mus musculus
cagacaaacaaacaaacaaacaaaaaaggcuguguauaugagagagacagauaacacu

SEQ ID NO: 87067 - RNA, 96 nt, Mus musculus
acauggauaguaaaaugucaaaaccuucuggagaccuggguggggaaacccaaggacuaggggacaucggaguuugcgaguuguauagaugauugg

SEQ ID NO: 87068 - RNA, 81 nt, Mus musculus
guguaguaaauggcagucacucggguaggugcuagagggauagagcagaagaugggagagagcgguguacuggggaaagua

SEQ ID NO: 87069 - RNA, 46 nt, Mus musculus
gggacacuguuuuggucucugggaauagugacagcagaaucggaga

SEQ ID NO: 87070 - RNA, 46 nt, Mus musculus
ugcaauauuuuuuuccagucugaccaaauguagacucuaaagccag

SEQ ID NO: 87071 - RNA, 41 nt, Mus musculus
guaagaggaagagauuguauuugcgauuaccauuuaaacau

SEQ ID NO: 87072 - RNA, 46 nt, Mus musculus
gagaguugugagcugccaugugggugcugggaauugaacccggguc

SEQ ID NO: 87073 - RNA, 29 nt, Mus musculus
gcuuaguugguagaaugcuuguggcucag

SEQ ID NO: 87074 - RNA, 29 nt, Mus musculus
auguaguugguagagugcuuguggcucag

SEQ ID NO: 87075 - RNA, 29 nt, Mus musculus
gcuuaguugguagagugcuuguggcucag

SEQ ID NO: 87076 - RNA, 46 nt, Mus musculus
uuaaucuccuuggggcacccacccauuugugcccauacaugcacag

SEQ ID NO: 87077 - RNA, 53 nt, Mus musculus
guguucugagagaugccuuugauuuugaaagcccaucugaaauugccaaccug

SEQ ID NO: 87078 - RNA, 46 nt, Mus musculus
augaaguuaaagaauaugccccagcuggggcccaguaaggaagcag

SEQ ID NO: 87079 - RNA, 46 nt, Mus musculus
gagcuugucucugauagaugguggugaucaugugugugugugugug

SEQ ID NO: 87080 - RNA, 48 nt, Mus musculus
ggggucaucuuugguggaacugacuuaaaugaagaugccaaucacaaa

SEQ ID NO: 87081 - RNA, 42 nt, Mus musculus
cucugaucugggagcagcacaagauaaggacaaagacaaaag

SEQ ID NO: 87082 - RNA, 55 nt, Mus musculus
gaaacuccauuaagaguucuuguaauagauguagacucuaaggcucaaccggggc

SEQ ID NO: 87083 - RNA, 45 nt, Mus musculus
acgcacggcggaagcccccuuuuaaacaaacaaaacaaaaccaac

SEQ ID NO: 87084 - RNA, 46 nt, Mus musculus
agugaaggagagccuuuaccuagagcaguagaauucaagugccgau

SEQ ID NO: 87085 - RNA, 46 nt, Mus musculus
accaaaugccaacuuuaacuggaacaccuuccugcagcaaucaggu

SEQ ID NO: 87086 - RNA, 45 nt, Mus musculus
acugagcccauaggcauccucuugucucuuccuccccagcacugg

SEQ ID NO: 87087 - RNA, 29 nt, Mus musculus
uaggugggguuuagguuuccuggacuugg

SEQ ID NO: 87088 - RNA, 46 nt, Mus musculus
cugaccuuggauuccggugccugaauuccaauucuccgaccuugag

SEQ ID NO: 87089 - RNA, 46 nt, Mus musculus
caccuggcuuagaagugugugugugugugugugugugugugugugu

SEQ ID NO: 87090 - RNA, 46 nt, Mus musculus
aauggugguaucucccuguagugcacuugggagguggagucaggag

SEQ ID NO: 87091 - RNA, 42 nt, Mus musculus
cacaugucaggacacauuaaaauucuucuuuuaauggccaaa

SEQ ID NO: 87092 - RNA, 46 nt, Mus musculus
aaaagagucccucccacuuugcuucuaagaccugcuguuguuccag

SEQ ID NO: 87093 - RNA, 42 nt, Mus musculus
gcaggaugcucugaauucagcguggguuuccaauggaugcuc

SEQ ID NO: 87094 - RNA, 47 nt, Mus musculus
augacagccuaaugacuucccccagcaacuucuuaauagcaaagauu

SEQ ID NO: 87095 - RNA, 45 nt, Mus musculus
gagaauucuucucuugcugcuuucaaagcuuuccuccccacccuc

SEQ ID NO: 87096 - RNA, 46 nt, Mus musculus
cacuaagagauuugaaagugaaccgauguggaaaguaaacccagag

SEQ ID NO: 87097 - RNA, 43 nt, Mus musculus
cggaacacaacuuguauccuugacaaauuaucuuuccccagac

SEQ ID NO: 87098 - RNA, 46 nt, Mus musculus
gaaacaaacccauguaaaaaauuuuaaggugaaaauuaacauguag

SEQ ID NO: 87099 - RNA, 81 nt, Mus musculus
ugggagccagggaaggagaccgaggugcagcggaaagagaggcagagcggaaagagauagugacccugggcguggcaggua

SEQ ID NO: 87100 - RNA, 44 nt, Mus musculus
caguagcaauuuguuguucauagcuaugagcucuucucugcaca

SEQ ID NO: 87101 - RNA, 45 nt, Mus musculus
cacccccucaagcccccgcccaguagaauuaccuuaaaggaggga

SEQ ID NO: 87102 - RNA, 42 nt, Mus musculus
cagugauugugaacugucauucagcuuggguacugucggcaa

SEQ ID NO: 87103 - RNA, 46 nt, Mus musculus
gagacugguuagcgaucccgcacuggagaaggaaaucgugaccaac

SEQ ID NO: 87104 - RNA, 44 nt, Mus musculus
agaccaugcguaccacccaggcucccaccacccacagccaggug

SEQ ID NO: 87105 - RNA, 96 nt, Mus musculus
acaacaucgagagaaauguggugaacucuguagauuacguggaacaugccaaggaagagacgaagaaagccaucaaauaccagagcaaggccaggc

SEQ ID NO: 87106 - RNA, 47 nt, Mus musculus
cagggaggaccagagagugcaugcaaguauaaagacauuaggaaaaa

SEQ ID NO: 87107 - RNA, 33 nt, Mus musculus
uuccuccuggggagucucauagggucucugaga

SEQ ID NO: 87108 - RNA, 89 nt, Mus musculus
agauucgaagcagcauagccaggauugcucagcauguagaagacgugaagaagaaccacagcaucauccugucugcuccaaacccagaa

SEQ ID NO: 87109 - RNA, 45 nt, Mus musculus
gacaguauaugguggcuauaauuacauaaucauuuuaaaggaagg

SEQ ID NO: 87110 - RNA, 46 nt, Mus musculus
ccuccuaccaggguacuguggcccacaccugccuuuccugggagaa

SEQ ID NO: 87111 - RNA, 46 nt, Mus musculus
auaaagcaaggcccuguguggagagaacuuuucugagaagauaguu

SEQ ID NO: 87112 - RNA, 46 nt, Mus musculus
cuugaacuugcucuguagaccaggcuggccuugaacucacagagau

SEQ ID NO: 87113 - RNA, 44 nt, Mus musculus
gugaccuaggaagacuuuauugcaaaagaagauuagcugugggg

SEQ ID NO: 87114 - RNA, 42 nt, Mus musculus
ugugagagcuugcugcaucugccuuucuccacaccaccaguc

SEQ ID NO: 87115 - RNA, 46 nt, Mus musculus
uccaagggucacaguuuguugggacuccaggaaugggcugugggag

SEQ ID NO: 87116 - RNA, 46 nt, Mus musculus
ugacuguccuagcucaguuaagaugcuaguauuaucgacgugaggu

SEQ ID NO: 87117 - RNA, 42 nt, Mus musculus
ugggggcugcgcagcgcccgcgccccgcgcggaggaccucag

SEQ ID NO: 87118 - RNA, 42 nt, Mus musculus
uaaggucaucuuuggcuacauagaguucaaggcuagcccgag

SEQ ID NO: 87119 - RNA, 45 nt, Mus musculus
gaguucugucuaacacacacacacacacacacacacacacacaca

SEQ ID NO: 87120 - RNA, 46 nt, Mus musculus
ugaaaagaugcacauugugucaaauggugauaaacgcaacagcaag

SEQ ID NO: 87121 - RNA, 45 nt, Mus musculus
ccuugggccccuggcuugagccugugagcuuggcagggagucuug

SEQ ID NO: 87122 - RNA, 42 nt, Mus musculus
ugauggcacacaacuuuaaaugcuagcacuggggaggcagag

SEQ ID NO: 87123 - RNA, 46 nt, Mus musculus
guggcuaagcagguuuggcuaccugccgccugcagauccggcauca

SEQ ID NO: 87124 - RNA, 42 nt, Mus musculus
aaacuugaaugcuggcuuaacuugacuggauaugcgggggag

SEQ ID NO: 87125 - RNA, 49 nt, Mus musculus
cccucgaugcucccuuccggaccugcccccuggggcccaaucgagaagg

SEQ ID NO: 87126 - RNA, 57 nt, Mus musculus
acccuugaacuuccacgagguagcgggcaacgcggcggacauccagaucgacuucuc

SEQ ID NO: 87127 - RNA, 42 nt, Mus musculus
cgguggcccacgcauucuucccuggugaccaccacacggcag

SEQ ID NO: 87128 - RNA, 41 nt, Mus musculus
ccaccaugccuguuucacaaguaagagaguugaugccccga

SEQ ID NO: 87129 - RNA, 36 nt, Mus musculus
gaagggcuucuaacaccuggaauaaaggugggcguu

SEQ ID NO: 87130 - RNA, 46 nt, Mus musculus
ggucgcagcguuaggaaggcugaggaccacugcuuuagggucugag

SEQ ID NO: 87131 - RNA, 46 nt, Mus musculus
aaccccuucuucccagguugccauaagucaucccaguaaagagaca

SEQ ID NO: 87132 - RNA, 45 nt, Mus musculus
uugucucauuguucauugccucccccaaagaaaucuuggacugag

SEQ ID NO: 87133 - RNA, 45 nt, Mus musculus
guguggaucugagcacaggugagaauauugcagcuugguugugag

SEQ ID NO: 87134 - RNA, 70 nt, Mus musculus
cugggauguccucucugaaggguugaggccugccugugauacuacaggauguuggggggaaugguuauuu

SEQ ID NO: 87135 - RNA, 66 nt, Mus musculus
uuguccaagcuucaagugauuuggaaaaaaauuuucucuuccugauuggagaaaagaaacgggaca

SEQ ID NO: 87136 - RNA, 47 nt, Mus musculus
agcagcucuuuuucaacccacugaacaagauguuuuagcuacaccga

SEQ ID NO: 87137 - RNA, 86 nt, Mus musculus
ugacacaugccuguaagccuagcccuuuggaaauaguccggaauuucuaugccaacucaggcuacaggagaccccaggucgaaaga

SEQ ID NO: 87138 - RNA, 66 nt, Mus musculus
auaauuuguuguggauguauuugaaauuauccagccaacucccuguuaaacauguaagauccuugc

SEQ ID NO: 87139 - RNA, 45 nt, Mus musculus
cacuugaaaugacugaaaaugcuucagaaaagcuaauaaagccaa

SEQ ID NO: 87140 - RNA, 42 nt, Mus musculus
auuggucugaggucaaguccagcaagugugccugccacuagg

SEQ ID NO: 87141 - RNA, 42 nt, Mus musculus
cacuuaagagacagcccagcucccagccuuggucauccaggu

SEQ ID NO: 87142 - RNA, 46 nt, Mus musculus
ggcgcucauaacugucuagcuaaaguuauggauauuugaggaagug

SEQ ID NO: 87143 - RNA, 46 nt, Mus musculus
cugcaugcauuuuauguaacccacaugcaugcaguaccuguagagg

SEQ ID NO: 87144 - RNA, 42 nt, Mus musculus
gccgaucucagaauucaaggucagccugaucuaccgagagug

SEQ ID NO: 87145 - RNA, 83 nt, Mus musculus
guuuggucuacagagugaguuccaggacagccagggcuauacagagaaacccugucucaaaaaaaccaaaauaaauaaauaaa

SEQ ID NO: 87146 - RNA, 41 nt, Mus musculus
gaaaaugccuccauaaaauccagauguagaggcuggagaga

SEQ ID NO: 87147 - RNA, 46 nt, Mus musculus
guuaagagcacugacugacugcuuuuccagagguugugaguucaau

SEQ ID NO: 87148 - RNA, 46 nt, Mus musculus
gucccagcacuugggagguagagguaggcagauauuacugugagau

SEQ ID NO: 87149 - RNA, 41 nt, Mus musculus
gaaagugcgaagcuuucuuucuuugccacaagugcagagaa

SEQ ID NO: 87150 - RNA, 55 nt, Mus musculus
acagguugggggaagggcugucgagggcauagucuaagaggaggugaggaaagaa

SEQ ID NO: 87151 - RNA, 45 nt, Mus musculus
uuguuuucauuaguggaccaucccaggccaguggaucauggagag

SEQ ID NO: 87152 - RNA, 46 nt, Mus musculus
auggcugucaagagggaaaguucuaaaacguaucuuugagcuccgu

SEQ ID NO: 87153 - RNA, 46 nt, Mus musculus
agaauuaccauucaguucuggaucagaaacguaaagaauacguggu

SEQ ID NO: 87154 - RNA, 46 nt, Mus musculus
ucuguguaaacagcuacuuuucuugguaucaugacuaugggcauuu

SEQ ID NO: 87155 - RNA, 46 nt, Mus musculus
gccagccaggcgugguggcacacgccuuuaauuccagcacccggga

SEQ ID NO: 87156 - RNA, 72 nt, Mus musculus
ccacaccaaagcccuggaccucacccgucccgugaccuuugugagcaacgccaaauaugaugcagaccuggg

SEQ ID NO: 87157 - RNA, 46 nt, Mus musculus
guggucuguggccaaugagccuuccucugcucugaaacccgccgca

SEQ ID NO: 87158 - RNA, 41 nt, Mus musculus
agucagaguuuuggcaacgagucacuucggcaccaccuaga

SEQ ID NO: 87159 - RNA, 47 nt, Mus musculus
gaagcccuucuauuuccaaggggucaauaagcacgaggauucagaug

SEQ ID NO: 87160 - RNA, 46 nt, Mus musculus
ucacuuugugggagaguccagcugugaauugugaagguccugagau

SEQ ID NO: 87161 - RNA, 42 nt, Mus musculus
ccuaggagaugcuacccacuacagagauuugggggcgggggu

SEQ ID NO: 87162 - RNA, 46 nt, Mus musculus
acagugccuuggguggcacagcgaaauccagugucgaauggcagau

SEQ ID NO: 87163 - RNA, 45 nt, Mus musculus
ccgccaggcccacgaggccucagggaaagcuguguucauggcaga

SEQ ID NO: 87164 - RNA, 77 nt, Mus musculus
gcaccggaagcagcuugaugccccagaagaaaaacccagacagccuggagcugauccggagcaaggcgggccgagug

SEQ ID NO: 87165 - RNA, 45 nt, Mus musculus
ugguaccaaggaauucagcuuugugcaacucucagaugccuacag

SEQ ID NO: 87166 - RNA, 42 nt, Mus musculus
uacacacccauagccccagcacuugggaaauagagccgggaa

SEQ ID NO: 87167 - RNA, 46 nt, Mus musculus
ugaacuuuggggccaucacucucaacagcauggaugccaccaguga

SEQ ID NO: 87168 - RNA, 46 nt, Mus musculus
ugggagaggcacagagaacucgugcccacaauauaaacagcacaau

SEQ ID NO: 87169 - RNA, 45 nt, Mus musculus
gcaggcaacccucuggguguggaccgggagcuacuccgugcaggu

SEQ ID NO: 87170 - RNA, 89 nt, Mus musculus
agugaaacucacugggucaccaacaaagacaugaaauguugagaaaaggaaggacucaucagaguaguaagaggacaagagaggguaau

SEQ ID NO: 87171 - RNA, 44 nt, Mus musculus
guggguacaaaccuuccuuauuuguaaagaggcaaaacugagac

SEQ ID NO: 87172 - RNA, 42 nt, Mus musculus
gucagaaagccaaugaaagcaggaccacggugcugccccuau

SEQ ID NO: 87173 - RNA, 41 nt, Mus musculus
ugcagaacgcgugcccuuuagguggccuauaagaaugggac

SEQ ID NO: 87174 - RNA, 44 nt, Mus musculus
guuggcaggaaaugguugccauuguauggagcuaggugcuguca

SEQ ID NO: 87175 - RNA, 45 nt, Mus musculus
aggggggaauauguacgggauucuuucuuggacgugagauggagg

SEQ ID NO: 87176 - RNA, 46 nt, Mus musculus
uuuaagggcuaucaggucgaaugaguaggacuuggugauggaugcu

SEQ ID NO: 87177 - RNA, 45 nt, Mus musculus
cgcuguggugguuccuuuccaguuuccugaagucguccccuugaa

SEQ ID NO: 87178 - RNA, 45 nt, Mus musculus
augucauuaagaggaccaaaugggugguguaugguuaguggcuag

SEQ ID NO: 87179 - RNA, 90 nt, Mus musculus
cugauccccacaggggcugcugacugucccagaagccgcugaguugagaggacagagcgcggaggcacagaugcagagagagaggcccag

SEQ ID NO: 87180 - RNA, 46 nt, Mus musculus
uguccaaguguaucuuugcuacuuggacucucuccucacuagccuu

SEQ ID NO: 87181 - RNA, 45 nt, Mus musculus
cugaucgaguucugaguugcuucauggaggacuaacagacccuca

SEQ ID NO: 87182 - RNA, 42 nt, Mus musculus
ccuagcugaccugaaacucuuuguagaccaaacuggccucag

SEQ ID NO: 87183 - RNA, 46 nt, Mus musculus
gaaguaaaaaauagacauacaguuuaaaaucguuaaaguagcuaag

SEQ ID NO: 87184 - RNA, 46 nt, Mus musculus
gaaaaugcaccacaaguuugcucacuggccaauuuaauggggacag

SEQ ID NO: 87185 - RNA, 45 nt, Mus musculus
ugcagguugccgcuggugggaagcauguucaguaucaacccccug

SEQ ID NO: 87186 - RNA, 35 nt, Mus musculus
cuugugucugauggaccuuguagaggagugugugu

SEQ ID NO: 87187 - RNA, 46 nt, Mus musculus
uagggaaugccuaguuguuuuaaguaauacuaucaauuuuaugcag

SEQ ID NO: 87188 - RNA, 48 nt, Mus musculus
ugggccauguaguaagaguauguuccaaaagagucugaagagagcaug

SEQ ID NO: 87189 - RNA, 46 nt, Mus musculus
uacagugacgaacccgcggccuuacgugcuaaccuaaaauacugag

SEQ ID NO: 87190 - RNA, 60 nt, Mus musculus
acgagacacugaagcaucucuccaacgauaccaccacaccagagagcaccaugaccgucg

SEQ ID NO: 87191 - RNA, 44 nt, Mus musculus
ucucgaaauguuacacaccuguacuccaccauccucgggcauca

SEQ ID NO: 87192 - RNA, 46 nt, Mus musculus
uuuugcauggguggaugugcacuguguguuccuggugccugccaac

SEQ ID NO: 87193 - RNA, 45 nt, Mus musculus
ccaacucaagcuggauuagaucauauuaaaggcagguuuauuggg

SEQ ID NO: 87194 - RNA, 47 nt, Mus musculus
gugagcaggcgguguucacagcaugcaugacccucacagcugccccc

SEQ ID NO: 87195 - RNA, 44 nt, Mus musculus
cuucuccuccauaaacagaugugccuguuggggguuguagcuca

SEQ ID NO: 87196 - RNA, 33 nt, Mus musculus
ucacuguauccccgacacauacagcaacgccac

SEQ ID NO: 87197 - RNA, 45 nt, Mus musculus
uaagauuuauuauuauauguaagugcacuguagcugucuucagac

SEQ ID NO: 87198 - RNA, 42 nt, Mus musculus
uaacgauguucugcuaugcagucaucaaaggcagacccagca

SEQ ID NO: 87199 - RNA, 46 nt, Mus musculus
uuuucuuauaaagagaaaaaaaaguuacaauuuacuacugcccuag

SEQ ID NO: 87200 - RNA, 44 nt, Mus musculus
agaaugcacauuauagguauguaauguggaaccgacacugggga

SEQ ID NO: 87201 - RNA, 49 nt, Mus musculus
uucaauguuuuucucucagcgccuugccuuaacaauccccagacagugu

SEQ ID NO: 87202 - RNA, 45 nt, Mus musculus
aggcugaggcaggagaaucucaaguucagggccagccugggccac

SEQ ID NO: 87203 - RNA, 28 nt, Mus musculus
cuaauaaaaaaggaaacgaaaggcaggg

SEQ ID NO: 87204 - RNA, 57 nt, Mus musculus
agagagccaugaaggacauccacuacuccgugaaacccaacaagagcacaaagcaac

SEQ ID NO: 87205 - RNA, 46 nt, Mus musculus
gagaaguucaagugucagauaaagaacggcacacacagcuggagca

SEQ ID NO: 87206 - RNA, 45 nt, Mus musculus
caucaguucuggguaucucucuacugcacagguagguagcgggga

SEQ ID NO: 87207 - RNA, 46 nt, Mus musculus
agggccagggagaaagcccauucagagcagcagugcucagccuaug

SEQ ID NO: 87208 - RNA, 42 nt, Mus musculus
aaacccacaggccgcugugguggcaugcaauucuaaucccag

SEQ ID NO: 87209 - RNA, 46 nt, Mus musculus
uaaaucaaacuuuagaaaauaaccugauugugcuucccacccucaa

SEQ ID NO: 87210 - RNA, 48 nt, Mus musculus
cccauucaguguuuguaaauguuuccaaaggucagguugccaagaagg

SEQ ID NO: 87211 - RNA, 46 nt, Mus musculus
uggcaaccugaccuuuggaaacauuuacaaacacugaaugggucug

SEQ ID NO: 87212 - RNA, 46 nt, Mus musculus
agcugggugugaugugcacaucuguaacucaccauuuaggaggcag

SEQ ID NO: 87213 - RNA, 46 nt, Mus musculus
gaagugggagaauccagauacuguccuucgcagguagccaccagag

SEQ ID NO: 87214 - RNA, 24 nt, Mus musculus
cucgaggggacgccaagugcucgg

SEQ ID NO: 87215 - RNA, 46 nt, Mus musculus
cgauugcccuacugcacaugcgucaaguggcgcacuagccaggcag

SEQ ID NO: 87216 - RNA, 46 nt, Mus musculus
aggacugugugagcuccagaggccagcagggaugguuuggggacag

SEQ ID NO: 87217 - RNA, 44 nt, Mus musculus
gugaagauaaaauaggaugucugcugaggucugucugugugugg

SEQ ID NO: 87218 - RNA, 44 nt, Mus musculus
agucuugaguucccccguagcacucuggguauugacugcaugaa

SEQ ID NO: 87219 - RNA, 49 nt, Mus musculus; identical to SEQ ID NO: 25232

SEQ ID NO: 87220 - RNA, 46 nt, Mus musculus; identical to SEQ ID NO: 25233

SEQ ID NO: 87221 - RNA, 45 nt, Mus musculus
cccucugucuccuuucaguauuuauacaaaacacuucuuggaauu

SEQ ID NO: 87222 - RNA, 46 nt, Mus musculus
gaacucggcaaacacaaacaccgcgccuaaauuguauagaucugug

SEQ ID NO: 87223 - RNA, 41 nt, Mus musculus
auaacaucuucaaucacagaucuauacaauuuaggcgcggu

SEQ ID NO: 87224 - RNA, 45 nt, Mus musculus
ucaggccagcugcuucagguggucagagcagccaauggugcccag

SEQ ID NO: 87225 - RNA, 46 nt, Mus musculus
uguuccaucaacuugcagcaccaacggagcuugcuguugggcaggc

SEQ ID NO: 87226 - RNA, 46 nt, Mus musculus
aaaauaaauggaaauuuccucucaaggauggcauuaugaaucuuaa

SEQ ID NO: 87227 - RNA, 95 nt, Mus musculus
ugacaccagccgcucuaucauccgaaaugucaaaggucccguaagagagggugacgugcucacccuauuggagucagaaagagaagcucgaaggu

SEQ ID NO: 87228 - RNA, 42 nt, Mus musculus
ccccaggagcgcagauuuccccuuuccuucuugaagcuagau

SEQ ID NO: 87229 - RNA, 45 nt, Mus musculus
ucugaucuccacgccugugccauggcacauauaaauaauaaacau

SEQ ID NO: 87230 - RNA, 45 nt, Mus musculus
gcuggcuccuuucuugguuuugaguuuguuguuggucaguugguu

SEQ ID NO: 87231 - RNA, 42 nt, Mus musculus
aauacagaccauugaagcucaacgaaauagugggcaaugaag

SEQ ID NO: 87232 - RNA, 46 nt, Mus musculus
aaguguggagcagagacugaaggaaaggccauccagagacugggga

SEQ ID NO: 87233 - RNA, 46 nt, Mus musculus
ccuggggaagccacaggucccuggcuggguugccaacagucgggag

SEQ ID NO: 87234 - RNA, 46 nt, Mus musculus
cuuuuugaauuaauucacuuuauguguaugguugguuugccugcau

SEQ ID NO: 87235 - RNA, 35 nt, Mus musculus
ccuggaacugagauuacaguugguuuugggcacug

SEQ ID NO: 87236 - RNA, 46 nt, Mus musculus
cagaaagucacccuucccaagggccggcacaagaucaucauucuag

SEQ ID NO: 87237 - RNA, 45 nt, Mus musculus
cagcaugacggacggugcccagcaggcccucaggagaaccaugga

SEQ ID NO: 87238 - RNA, 45 nt, Mus musculus
aagcguguuaccacaugcuuuuccugccagcucauggcugcccag

SEQ ID NO: 87239 - RNA, 46 nt, Mus musculus
ucaggauuuggcuauaucaacagugagaauguauucaagguaccag

SEQ ID NO: 87240 - RNA, 31 nt, Mus musculus
aagaauugucucuagacacagccccaggcua

SEQ ID NO: 87241 - RNA, 42 nt, Mus musculus
ugcugaugggauagaccugcugguccagcgagccccagggau

SEQ ID NO: 87242 - RNA, 46 nt, Mus musculus
aacuuguaacccucaguccuaguguugggauugcggcauaccaguu

SEQ ID NO: 87243 - RNA, 46 nt, Mus musculus
uggaagcccaagaccugaggcaagauguguccccagucucacaucu

SEQ ID NO: 87244 - RNA, 45 nt, Mus musculus
accauuggaaccuggcugggauugcugcucugugugcuuggggau

SEQ ID NO: 87245 - RNA, 74 nt, Mus musculus
gguuucuuguuuuguaauuuaaggucuguucacagcuguaauuauuauuauuuucuacaauaaauggcaccugc

SEQ ID NO: 87246 - RNA, 45 nt, Mus musculus
gcgucuccaucuagaagauuauaagacagcggcagcggccuggaa

SEQ ID NO: 87247 - RNA, 46 nt, Mus musculus
ccagauguuguggaacgauugguuguuguagacauaagcccgguag

SEQ ID NO: 87248 - RNA, 42 nt, Mus musculus
caagugcugagcuaacguauccaaguucagucuccaggagaa

SEQ ID NO: 87249 - RNA, 42 nt, Mus musculus
ccacaccggcuuacuguacauauguagaauuuccaccaagca

SEQ ID NO: 87250 - RNA, 41 nt, Mus musculus
uggagagggaagacaauggagagguguggggagagggagaa

SEQ ID NO: 87251 - RNA, 45 nt, Mus musculus
ccgugccuaacgcuggccacuggguccacagcgacaaaccccaag

SEQ ID NO: 87252 - RNA, 84 nt, Mus musculus
uugcuucugcacagaaaaacucaggggcacggagaggguccaggaguacagaaguggcccaacacuuuuaaugaauaaagacag

SEQ ID NO: 87253 - RNA, 45 nt, Mus musculus
cugacaagucucagucaccaggccuugacucucuaagcucauaga

SEQ ID NO: 87254 - RNA, 45 nt, Mus musculus
uucgagagguggcugagaacugcgcagacaaacugcagagacugg

SEQ ID NO: 87255 - RNA, 42 nt, Mus musculus
gccagacgaggaggggcuugugcauggaucaggggacagaug

SEQ ID NO: 87256 - RNA, 42 nt, Mus musculus
cacguucuguagggccagaaaggggaggcgccuuguuugggg

SEQ ID NO: 87257 - RNA, 61 nt, Mus musculus
cgggcagcuccgggaucugcuucaagaugagcccaagcuggaccggaucgugcggcucagc

SEQ ID NO: 87258 - RNA, 42 nt, Mus musculus
cagucauggagcugccgcagaugccggagcugaugggguugu

SEQ ID NO: 87259 - RNA, 46 nt, Mus musculus
guggucuacacuguagaucuaaauuguaagcaucugaaaaggcaag

SEQ ID NO: 87260 - RNA, 42 nt, Mus musculus
aaagaaaacgaacccaagaagucaggauccaagaagcagaag

SEQ ID NO: 87261 - RNA, 27 nt, Mus musculus
aagagagguagcuggggcuucgcagag

SEQ ID NO: 87262 - RNA, 49 nt, Mus musculus
ugaaugaugagaacauggcccugagggcuggucagcuggagacaaguua

SEQ ID NO: 87263 - RNA, 42 nt, Mus musculus
agccaucucaccagcccccgguaucaaguucuugauuggcag

SEQ ID NO: 87264 - RNA, 42 nt, Mus musculus
gggauucgaggcaggcauucugccaauaaacuacagcccuag

SEQ ID NO: 87265 - RNA, 51 nt, Mus musculus
guaucuggagcacuaaagauuuccuucagcgggagcaccgcagcaugagag

SEQ ID NO: 87266 - RNA, 46 nt, Mus musculus
gacaguauggagccuccuggggccucucggaggcuccgcucuauag

SEQ ID NO: 87267 - RNA, 48 nt, Mus musculus
uaagaugaccaagcgggaagaugggggcuuuacuuucacggccacacc

SEQ ID NO: 87268 - RNA, 85 nt, Mus musculus
aucugaaaggucaggugcuuuccacgaucaacacuaaccagaugaacaacagucacgcaguuaucuccccauguagcaggugagg

SEQ ID NO: 87269 - RNA, 63 nt, Mus musculus
aagaagaggaugaggguagguacgggguagguacagagcagggaggcagcuucuaggaggggu

SEQ ID NO: 87270 - RNA, 77 nt, Mus musculus
augaauuacaugacagguuuguggguucguguggcuucaccccagaugugaaggucugggaggucuguuucgggaag

SEQ ID NO: 87271 - RNA, 43 nt, Mus musculus
cuggcaccaauauucaucucuucaacacacgccgcggggagaa

SEQ ID NO: 87272 - RNA, 41 nt, Mus musculus
gcccccuacuuuuuccuauugaaacuauucuugcauacuca

SEQ ID NO: 87273 - RNA, 46 nt, Mus musculus
gcccuagggguagaaucugucuucaucuagcacggagaaggggagu

SEQ ID NO: 87274 - RNA, 46 nt, Mus musculus
caaccacauuacuucaagucaguuuucuacauaguuuagccugcuu

SEQ ID NO: 87275 - RNA, 42 nt, Mus musculus
ggaaggaaacgguagagacugcacugggcugguggccgugug

SEQ ID NO: 87276 - RNA, 71 nt, Mus musculus
cucugcuggugagccaugccucaaccccucacugggagaugcuagacgaagacucuccucagccacagccc

SEQ ID NO: 87277 - RNA, 47 nt, Mus musculus
aacccuuguuggucugcuuugcucugggucccgagucaacuagccag

SEQ ID NO: 87278 - RNA, 46 nt, Mus musculus
acacggauuugggcuucugacuacacagcugugccucaggcuugug

SEQ ID NO: 87279 - RNA, 43 nt, Mus musculus
cccaguugagcugggucagaugugacuccccuuggagcauugc

SEQ ID NO: 87280 - RNA, 26 nt, Mus musculus
uuaauuucuuuugugaucuugggcaa

SEQ ID NO: 87281 - RNA, 41 nt, Mus musculus
cccagcaaccacaugguggcucacaacaauccguaacaaga

SEQ ID NO: 87282 - RNA, 45 nt, Mus musculus
ggcggguacucuuacccauugagccaucucaccagccccaaacug

SEQ ID NO: 87283 - RNA, 43 nt, Mus musculus
caucuauguguagguauguucaagugagagcagacaccgagag

SEQ ID NO: 87284 - RNA, 42 nt, Mus musculus
ucccaucucccuaccuuguccugcaggaugagauggccagca

SEQ ID NO: 87285 - RNA, 42 nt, Mus musculus
ucuucgcuucacaaauaaagggcaaacucacaucuaugacag

SEQ ID NO: 87286 - RNA, 42 nt, Mus musculus
uuuuauggcagggguuaggcuggguuguguggagcuggagaa

SEQ ID NO: 87287 - RNA, 45 nt, Mus musculus
aaaugcuauugaauaguagaauuagcuguauaguuaugccugugu

SEQ ID NO: 87288 - RNA, 55 nt, Mus musculus
uuuaaaaggaaugaaucucacagaggaccggugaaggacaaagcagcaagaaaua

SEQ ID NO: 87289 - RNA, 42 nt, Mus musculus
gggucuuggaucccgcaccaauggaaaacgaaggagcugcug

SEQ ID NO: 87290 - RNA, 46 nt, Mus musculus
guugccacugccucaucaagcuucuuagcacaggagacugaaucag

SEQ ID NO: 87291 - RNA, 45 nt, Mus musculus
gcaccaaagccagaugugguagcugacccaaaggagaacacagac

SEQ ID NO: 87292 - RNA, 46 nt, Mus musculus
agguugggagcgcaggcuuggcacuggagcuaaagggaauguugaa

SEQ ID NO: 87293 - RNA, 44 nt, Mus musculus
ggggcaagaggcuugccaaacuggaagauggaggccagagcugg

SEQ ID NO: 87294 - RNA, 42 nt, Mus musculus
cggugccagaggccaccguggaaguggcagugcccaggccag

SEQ ID NO: 87295 - RNA, 44 nt, Mus musculus
gggcuuaaacaugggagaagcacaagccggagcuggaguggcaa

SEQ ID NO: 87296 - RNA, 42 nt, Mus musculus
aaaggcaaaagcaaacaccaagggcgacugaucuaccugcag

SEQ ID NO: 87297 - RNA, 46 nt, Mus musculus
gauucuggagacaggauauuuuaacucccaugcacauacagaacag

SEQ ID NO: 87298 - RNA, 44 nt, Mus musculus
auugaugagcggaauagcuugcugucuggaggggcaauccucac

SEQ ID NO: 87299 - RNA, 49 nt, Mus musculus
cacagccuucuuauggccaccauuccagcagacgguuggaagugcccca

SEQ ID NO: 87300 - RNA, 45 nt, Mus musculus
aucgucuucgggguguuauaacaaaccgacuggacaaaggcccac

SEQ ID NO: 87301 - RNA, 64 nt, Mus musculus
cgguggggcggccuccgggagggucgcaaaagcgggguggggagcgcgggguagacguggugga

SEQ ID NO: 87302 - RNA, 58 nt, Mus musculus
cucgcuggaccgccgaggccggaggcggggagcgugcgggugggcggcgccccggccu

SEQ ID NO: 87303 - RNA, 46 nt, Mus musculus
agaggcuaccguugacuggugacuuggccggaggcggugaagcggu

SEQ ID NO: 87304 - RNA, 33 nt, Mus musculus
acauuuuccccagcuaagcugaccucucagauc

SEQ ID NO: 87305 - RNA, 42 nt, Mus musculus
aguuuugugugugugugugugugugugugugugcaugcacac

SEQ ID NO: 87306 - RNA, 42 nt, Mus musculus
ccccugccuagaaucccccagggaggggcuggggacguggcu

SEQ ID NO: 87307 - RNA, 42 nt, Mus musculus
ggagucugcgggcugaggaagcgcgccauccccgccccgccu

SEQ ID NO: 87308 - RNA, 45 nt, Mus musculus
gggagaaugguggugggcacggaggucugggguuggcuggcagug

SEQ ID NO: 87309 - RNA, 42 nt, Mus musculus
caaagaaugaauggaucugggguaacauggaagggggcgauu

SEQ ID NO: 87310 - RNA, 45 nt, Mus musculus
auggcgaaagcuacuggggugaacccucuggcauccuccaccucc

SEQ ID NO: 87311 - RNA, 46 nt, Mus musculus
ugagggaugagccaggaggcacacagcagcaaccacggcacaagga

SEQ ID NO: 87312 - RNA, 44 nt, Mus musculus
gcucaccaagcacgaggagaagcugaagaccaagaagcagcagc

SEQ ID NO: 87313 - RNA, 46 nt, Mus musculus
cgaguccucacuguuauuaaacagacucaaaaagaaaaccucagga

SEQ ID NO: 87314 - RNA, 63 nt, Mus musculus
aaauggccaaguuuaaggcucgggaccugcgcggcaagaagaaggaggagcuguugaaacaac

SEQ ID NO: 87315 - RNA, 45 nt, Mus musculus
augaccaggcugaugcacuggagggucaaaguuggauccccagcc

SEQ ID NO: 87316 - RNA, 46 nt, Mus musculus
gacuuggggggcauccacugacuuccauuuacagagacagcuaagg

SEQ ID NO: 87317 - RNA, 46 nt, Mus musculus
ugagugugccacagugugugugugugugugugugugugugugugug

SEQ ID NO: 87318 - RNA, 42 nt, Mus musculus
agaucacacaaaggcccagggaauggagaucuaggggcaguc

SEQ ID NO: 87319 - RNA, 45 nt, Mus musculus
uguguguaguggguaccuguagacaggaaggaggccuggccuccc

SEQ ID NO: 87320 - RNA, 49 nt, Mus musculus
agugcugaagcugcggcggagagcggcgccggcaggacgggcgagagcg

SEQ ID NO: 87321 - RNA, 42 nt, Mus musculus
uggaagaagaaaaggggauacacaccuauagucccggcagga

SEQ ID NO: 87322 - RNA, 45 nt, Mus musculus
gcuguucuucagcaggagugaaagggguugcccaaugcccccaga

SEQ ID NO: 87323 - RNA, 42 nt, Mus musculus
ugugacucagaucugcugccacaccaggugugugagcgauau

SEQ ID NO: 87324 - RNA, 31 nt, Mus musculus
uccgacuaggcuaggcugacugcccagagau

SEQ ID NO: 87325 - RNA, 42 nt, Mus musculus
ugugagcauuuucuggugcgagccccuccacacaccccaggc

SEQ ID NO: 87326 - RNA, 44 nt, Mus musculus
gcucuacccugcugcucuaauguucugagacagucucccucccu

SEQ ID NO: 87327 - RNA, 45 nt, Mus musculus
acaaccauguaagaucuuggggggcuggaaauggcagucucugcc

SEQ ID NO: 87328 - RNA, 55 nt, Mus musculus
gcugggugaagggaaaaaggugggacuuuugggucccaggaggaggagaagggac

SEQ ID NO: 87329 - RNA, 46 nt, Mus musculus
aagugguugacguccagggacacgcgccagcgaucagccgucuguc

SEQ ID NO: 87330 - RNA, 42 nt, Mus musculus
ggggugccugacugucuggaaucuuaaaacuuuccagaaacu

SEQ ID NO: 87331 - RNA, 33 nt, Mus musculus
gaaaaacagcagguaaauguauguaucaaaaga

SEQ ID NO: 87332 - RNA, 45 nt, Mus musculus
ggcguggcgcagcugaaggacuucauuaugaagcuuguggacaua

SEQ ID NO: 87333 - RNA, 42 nt, Mus musculus
ucuugacucuggcugagaucccuucacagagcaggccacuag

SEQ ID NO: 87334 - RNA, 36 nt, Mus musculus
auuuuauguacauugguguuuugccugcaugugugu

SEQ ID NO: 87335 - RNA, 46 nt, Mus musculus
uuccccuucccaggagugacacugauacaggacuuugugaccccag

SEQ ID NO: 87336 - RNA, 45 nt, Mus musculus
gcuguggggcgagcggcuggugagccucaaccuccugucagccac

SEQ ID NO: 87337 - RNA, 45 nt, Mus musculus
gguuacaguguugcguguuaagggaugaacccccaaagugccugu

SEQ ID NO: 87338 - RNA, 46 nt, Mus musculus
ccggagucuuucauccugcaccgcagccaggacauuaggcccagag

SEQ ID NO: 87339 - RNA, 45 nt, Mus musculus
ugucaugagaacauccucgggugcagggguccauggaugcccaga

SEQ ID NO: 87340 - RNA, 46 nt, Mus musculus
guucuaucuagcaccgagaagaauucuugguguguuauagcugcuu

SEQ ID NO: 87341 - RNA, 46 nt, Mus musculus
aaaggaaaagaaaggcaugaagauauucacuuuugcaucaucugag

SEQ ID NO: 87342 - RNA, 46 nt, Mus musculus
gacacauuuccccauguauggguggcagggucccaacggcccaggu

SEQ ID NO: 87343 - RNA, 70 nt, Mus musculus
ugaaaaccagcacagagcaaacagugccccuaaugugaggaugacaucagauuuauagcucccauagggc

SEQ ID NO: 87344 - RNA, 30 nt, Mus musculus
ugccaagugaaugcucuaccgacgagcuac

SEQ ID NO: 87345 - RNA, 83 nt, Mus musculus
gaaugagcucacaccucaaaauauagaauaaaaggugugcgugucuggggagggagagggagagggagagggagagggagagg

SEQ ID NO: 87346 - RNA, 41 nt, Mus musculus
cauccuuggcuuagcaaguuggaguccagccugggguagga

SEQ ID NO: 87347 - RNA, 46 nt, Mus musculus
ugagugacccuugucugacuuguuuuucauuucauucugugugugu

SEQ ID NO: 87348 - RNA, 42 nt, Mus musculus
cccuucccaacccaccccagcucauucacaaaggacagagag

SEQ ID NO: 87349 - RNA, 42 nt, Mus musculus
gggggggggggguggggggggggguggggggggggggguggu

SEQ ID NO: 87350 - RNA, 64 nt, Mus musculus
cagcugggcaagaggcuaccucaguuugaugaugaugcagacacaggugagauggggguuaggg

SEQ ID NO: 87351 - RNA, 45 nt, Mus musculus
cagcugcaauuuauugugucuccaguuauugcugggacugggagg

SEQ ID NO: 87352 - RNA, 46 nt, Mus musculus
gcugugcacaggaggucaucccaggccagccugggcuuccugagau

SEQ ID NO: 87353 - RNA, 42 nt, Mus musculus
cgcagcgcggggacacgcaccggggaugcaaagggcacaggg

SEQ ID NO: 87354 - RNA, 42 nt, Mus musculus
gccgcagccauggcuagcagcacgcuuaggcuacacccaggc

SEQ ID NO: 87355 - RNA, 46 nt, Mus musculus
ucggagcgggcguaguacucauuggggcucagggcaccccagaagu

SEQ ID NO: 87356 - RNA, 65 nt, Mus musculus
gugucgcugcuggagaauaccuccuuuuggggcaguucaguccucagggucuccccgcggaucac

SEQ ID NO: 87357 - RNA, 103 nt, Mus musculus
ugucaaagaucugccagaggucuggguguagguggucugugucauagcgagaaguagccagcagccggccaaacucgugcugguugcugagguggaggaagau

SEQ ID NO: 87358 - RNA, 45 nt, Mus musculus
aggagaggaucuauggagggcugacccaagcucucuagguggaga

SEQ ID NO: 87359 - RNA, 42 nt, Mus musculus
accugccucugucgagagugcugggauuaaaggugugcagau

SEQ ID NO: 87360 - RNA, 42 nt, Mus musculus
ggaacagguacuccgucaugggccccacauauguccgcagca

SEQ ID NO: 87361 - RNA, 44 nt, Mus musculus
ggaggcuaugugguuguugaucuggacugccaacuugguggagu

SEQ ID NO: 87362 - RNA, 48 nt, Mus musculus
gaaaauaaaacuaagguuaguucacagggugaugagggugcagggggg

SEQ ID NO: 87363 - RNA, 45 nt, Mus musculus
ccagguuguccaacaaggcacaguggcagagaagguuuggcagac

SEQ ID NO: 87364 - RNA, 78 nt, Mus musculus
ugcuggggccucggugggaacuggguccaaagggcaugcugggcagauccagguacugugaguucuaugguccaugag

SEQ ID NO: 87365 - RNA, 45 nt, Mus musculus
ccgaggucugggaugcugguuggaaagauuaccaguguggggggu

SEQ ID NO: 87366 - RNA, 30 nt, Mus musculus
gcuuauaacaucuccaguuucgucccaaau

SEQ ID NO: 87367 - RNA, 45 nt, Mus musculus
accaucuccgugggggccaugcgggcugagaugacaaaggcugaa

SEQ ID NO: 87368 - RNA, 42 nt, Mus musculus
cuuccauugucugaugaguucagcauccaagauguuggugag

SEQ ID NO: 87369 - RNA, 46 nt, Mus musculus
uuguugcucugagccaucaugggcacagagacggugcugccaucag

SEQ ID NO: 87370 - RNA, 46 nt, Mus musculus
aaaucuggcucuuuccacuucugagaaguccaccuguuucaccaua

SEQ ID NO: 87371 - RNA, 60 nt, Mus musculus
cuaggucccgcuggacaaagauggcauccgcaguacugaucucauucuuguuccacggcc

SEQ ID NO: 87372 - RNA, 46 nt, Mus musculus
cgcuguggucaucugcagcauagccagcaccgaggacacgccauag

SEQ ID NO: 87373 - RNA, 45 nt, Mus musculus
guccuggcugggcuaggguggacuaaaggcugcagaguuccagaa

SEQ ID NO: 87374 - RNA, 46 nt, Mus musculus
aacuugggauccaccugggauugguggagcagagacgucaguggca

SEQ ID NO: 87375 - RNA, 45 nt, Mus musculus
ccuuaaucccuaugggcacaauucugaauguacauauggccagga

SEQ ID NO: 87376 - RNA, 42 nt, Mus musculus
gggagugcacgugugguguguguguguguuugugugugugug

SEQ ID NO: 87377 - RNA, 46 nt, Mus musculus
gucugcacaggcaagugcucauuaaacgucugugaagugacuuaau

SEQ ID NO: 87378 - RNA, 41 nt, Mus musculus
ccagaccaaguaguagggauaaagaaccaaaugggaucaga

SEQ ID NO: 87379 - RNA, 82 nt, Mus musculus
gugguuugauagaaugaacgucuguggaucacaacuaugaaaaguauuuggaagaaaaguaugugauguagucauaagagag

SEQ ID NO: 87380 - RNA, 45 nt, Mus musculus
aaauaaauaaauaagcuaacauaaaaauauauacacagcaaagca

SEQ ID NO: 87381 - RNA, 48 nt, Mus musculus
cagugugugugugagacacaggggccuuuggaauaaaguccagaugga

SEQ ID NO: 87382 - RNA, 45 nt, Mus musculus
cuguguuccgggagcuccggagauccccguagcaaaggcaggggc

SEQ ID NO: 87383 - RNA, 46 nt, Mus musculus
ggagguguggcagauugguaaggggaggggagaaauggagucaagc

SEQ ID NO: 87384 - RNA, 44 nt, Mus musculus
gaugauccggagaaugaagggagagguggaacaggaaggagagg

SEQ ID NO: 87385 - RNA, 41 nt, Mus musculus
gcaccgcggggaggggagcuuagcccaagacaugcagaaga

SEQ ID NO: 87386 - RNA, 42 nt, Mus musculus
ucguggguaacaaaagcagucacugaacagccagccaccccc

SEQ ID NO: 87387 - RNA, 45 nt, Mus musculus
gaucaaagugugggaauggggugaggacagacuuugggcuccugg

SEQ ID NO: 87388 - RNA, 42 nt, Mus musculus
accccuaaacucuccuccuuucuuucuccuaaccaaguccag

SEQ ID NO: 87389 - RNA, 46 nt, Mus musculus
aacccugggccucuugcaagagcagcaauugccuuaaacugcugag

SEQ ID NO: 87390 - RNA, 49 nt, Mus musculus
uuauggagccaagggugaccauaaacuccuacuccuccugcccccacau

SEQ ID NO: 87391 - RNA, 45 nt, Mus musculus
auguccccgcaccuaaaagguguauuuuuacaaaucuucacccaa

SEQ ID NO: 87392 - RNA, 46 nt, Mus musculus
agaguuucgcuguguagcccucgcuguucuggaacuugcucuguag

SEQ ID NO: 87393 - RNA, 42 nt, Mus musculus
agcaaugggagggaaguugaguacucggauaagcaugggcag

SEQ ID NO: 87394 - RNA, 51 nt, Mus musculus
gcagugagggaauuugccaaagagaucgaugucuccuaugucaagauugaa

SEQ ID NO: 87395 - RNA, 42 nt, Mus musculus
guucggcgaggugugccggggucggcugaaggcaccagggaa

SEQ ID NO: 87396 - RNA, 42 nt, Mus musculus
cagaggcgugaguuccugagcgaggccuccaucaugggccag

SEQ ID NO: 87397 - RNA, 46 nt, Mus musculus
acugagccacgcccccagccccucacugggggauucuaggcagccu

SEQ ID NO: 87398 - RNA, 45 nt, Mus musculus
cacacacacacacacacacacacacacacacacacagagagccac

SEQ ID NO: 87399 - RNA, 46 nt, Mus musculus
cuauucugcuuucgguucugugggcgaguggcuucgagccaucaag

SEQ ID NO: 87400 - RNA, 42 nt, Mus musculus
ucgucacagccuucccauuggauugcacuuugaacagagggg

SEQ ID NO: 87401 - RNA, 44 nt, Mus musculus
ggcucucuccccaagcgccuuccaccucaacgggcaugucccug

SEQ ID NO: 87402 - RNA, 45 nt, Mus musculus
augccacagccuuagacaguuccuucuuccuuuccuccccccaag

SEQ ID NO: 87403 - RNA, 42 nt, Mus musculus
gacaggagguuggugguggucaacagaggcagacaacggugc

SEQ ID NO: 87404 - RNA, 45 nt, Mus musculus
uuauuucauacaucauuuguacaucaguaucccaaguuaggggag

SEQ ID NO: 87405 - RNA, 46 nt, Mus musculus
auccuaacuuuacccuagccuuugacaucuguuguuggcauuugag

SEQ ID NO: 87406 - RNA, 45 nt, Mus musculus
uaguacaggaaguugcuaagguacauugcuuuaaguugcacaaag

SEQ ID NO: 87407 - RNA, 42 nt, Mus musculus
uacuaccacaugugguucaugcaaugugaagguaaaacccag

SEQ ID NO: 87408 - RNA, 47 nt, Mus musculus
cucuaggggggggcccccacuguggagauaaaagucggggauggaau

SEQ ID NO: 87409 - RNA, 56 nt, Mus musculus
acaggcuccugggacuccuuccucaagaucuggaacuaaccuccccaaccccagau

SEQ ID NO: 87410 - RNA, 63 nt, Mus musculus
cucgcuggccaugauaaccgugugagcugccuuggggucacagaugauggaauggccguggcu

SEQ ID NO: 87411 - RNA, 42 nt, Mus musculus
gugaccgugcaggugaggacucugggcccacagaaggcagag

SEQ ID NO: 87412 - RNA, 42 nt, Mus musculus
ucagaugacgccacuugucgccucuuugaccugcgggcugau

SEQ ID NO: 87413 - RNA, 42 nt, Mus musculus
aggcauagccauuggggaagaacugcaagauuugggccagag

SEQ ID NO: 87414 - RNA, 45 nt, Mus musculus
ccuccaucaagcugugggauguucgggauuccaugugccgacaga

SEQ ID NO: 87415 - RNA, 47 nt, Mus musculus
agacaggaccucccgcgcuccuccaagcgaccccuuggcagaguccc

SEQ ID NO: 87416 - RNA, 42 nt, Mus musculus
gauguacccugucucaaugucugugaacaauagugugcaguc

SEQ ID NO: 87417 - RNA, 45 nt, Mus musculus
uggugugugugugguguguguguguggugugugugguguguggug

SEQ ID NO: 87418 - RNA, 48 nt, Mus musculus
ugugguaugugugugugugugugguguguguguggugugugucugugu

SEQ ID NO: 87419 - RNA, 61 nt, Mus musculus
aagaggaagugucccucccaaccuaggacagcugccugauguccuagccagauacagccuc

SEQ ID NO: 87420 - RNA, 47 nt, Mus musculus
caguuaucugcugaugggucagguggaagaaaacagaggccccaucc

SEQ ID NO: 87421 - RNA, 47 nt, Mus musculus
ucucugaaguuguaugugcccugcaggcagaugccccccaugaagaa

SEQ ID NO: 87422 - RNA, 46 nt, Mus musculus
ccucacugucacugucagucuccuuggugucuacaaaaccggagga

SEQ ID NO: 87423 - RNA, 42 nt, Mus musculus
gcccccagcaucaccugcccaaagcaguacaagcggucaggc

SEQ ID NO: 87424 - RNA, 59 nt, Mus musculus
aagacaggaacugggcccaaagucaaaccacccacuaaaccuaaaucccaaccugcaga

SEQ ID NO: 87425 - RNA, 51 nt, Mus musculus
cucagugucaccgcagauggcuucucagccuccuacaggacccugccacgg

SEQ ID NO: 87426 - RNA, 28 nt, Mus musculus
cuaggaguccaaacuacuggucagaaca

SEQ ID NO: 87427 - RNA, 87 nt, Mus musculus
cacguacugccgauaugacucugucaguguguuuaacggagcugugagugacgacucaaagaggcuggggaaauuuugcggagacaa

SEQ ID NO: 87428 - RNA, 41 nt, Mus musculus
cagcuguuccuggcacaucauugcacccucaaaccagguac

SEQ ID NO: 87429 - RNA, 53 nt, Mus musculus
ggggcggauggagaaggcgcagggaaccuugaccacgcccaacuggccugagu

SEQ ID NO: 87430 - RNA, 90 nt, Mus musculus
ugcggcaccuucaggccugcaccuguagucgcaccuggcaaccaagugacuuuaaggaugacaacugacgagggcaccgggggacgaggc

SEQ ID NO: 87431 - RNA, 46 nt, Mus musculus
uuacguggcaagugaggguuuccccaaccucuaccccccaaacaag

SEQ ID NO: 87432 - RNA, 42 nt, Mus musculus
uggccugggugcugccucuugcccgaggccagacccccaacu

SEQ ID NO: 87433 - RNA, 45 nt, Mus musculus
uuucgaaaaccauccagccacuugcuugaugcugcaacagcagau

SEQ ID NO: 87434 - RNA, 45 nt, Mus musculus; identical to SEQ ID NO: 46090

SEQ ID NO: 87435 - RNA, 46 nt, Mus musculus
cuccccccccccaugugugugugugugugugugugugugugugugu

SEQ ID NO: 87436 - RNA, 46 nt, Mus musculus
gcagucagugcucuuacccacugagccauuucuccagccccccacc

SEQ ID NO: 87437 - RNA, 48 nt, Mus musculus
guuaagguggcaaacacuugacaagccagaguugggagacagcuggga

SEQ ID NO: 87438 - RNA, 42 nt, Mus musculus
uugaguuccacugcagagccuaaaaggcaagacuggguccag

SEQ ID NO: 87439 - RNA, 42 nt, Mus musculus
gguauaaccaacguuucugaagcuucugaaaauugccaccag

SEQ ID NO: 87440 - RNA, 42 nt, Mus musculus
ggauuugucccggagcgcuucgaagaaggggaauggcuuguu

SEQ ID NO: 87441 - RNA, 41 nt, Mus musculus
ccucuucgccuucaauggacucuaacgcagacgccccgaag

SEQ ID NO: 87442 - RNA, 45 nt, Mus musculus
cuucuuccugcaagccuacagguucuagaauggcugcugccucag

SEQ ID NO: 87443 - RNA, 50 nt, Mus musculus
agaaccuguaggcuugcaggaagaagcagagcugccugccaagaucaugg

SEQ ID NO: 87444 - RNA, 46 nt, Mus musculus
ggcuucugaagaugcaagucggcaaaaggcaacugaaacuaaggag

SEQ ID NO: 87445 - RNA, 46 nt, Mus musculus
cgcuucuuagccucgaguugcucaaaagccuucugaagcucuuugu

SEQ ID NO: 87446 - RNA, 46 nt, Mus musculus
cuugcccucagagaugaccagcuuauucugcagggaacacagcagc

SEQ ID NO: 87447 - RNA, 46 nt, Mus musculus
gggcgaaugggagcggaggcagcagcggcauggaaguggaugcagc

SEQ ID NO: 87448 - RNA, 76 nt, Mus musculus
ucgcucuucauccccuugucauccuuaacaucucagaccauuggauccgcaugcgcucccaggaggggcggccuau

SEQ ID NO: 87449 - RNA, 45 nt, Mus musculus
ggucaugguggugcgugccuuuaauauaccagcauccagaggcag

SEQ ID NO: 87450 - RNA, 46 nt, Mus musculus
gcaucuaauguaagucugggcucccacuccuggacgugaagggcag

SEQ ID NO: 87451 - RNA, 46 nt, Mus musculus
auuggcuugacagaagaauuuuguguuggaaagucagaacugagag

SEQ ID NO: 87452 - RNA, 46 nt, Mus musculus
gccgagggaguucaaaggagaggcuggcaggacccagccccaaggg

SEQ ID NO: 87453 - RNA, 42 nt, Mus musculus
cagcuugacgaugggcugcacgcugggaaccgugguggugac

SEQ ID NO: 87454 - RNA, 46 nt, Mus musculus
gggccugugaaagggucagugugggccgaggcuaugaagagaacag

SEQ ID NO: 87455 - RNA, 46 nt, Mus musculus
accucuacccaugguguacauucauaaacauaaaaaagucuuaaaa

SEQ ID NO: 87456 - RNA, 46 nt, Mus musculus
gcauccaugagcugucuguggagcagcagcuguauuacaaggagau

SEQ ID NO: 87457 - RNA, 46 nt, Mus musculus
uguaccuguguguacgugugugugugugugugugugugugugugug

SEQ ID NO: 87458 - RNA, 42 nt, Mus musculus
aggcaaaggucaaggggcagcugcagcugauggcaaagguca

SEQ ID NO: 87459 - RNA, 41 nt, Mus musculus
acccugacggaggaagauguauuccccuuccuaguccccuu

SEQ ID NO: 87460 - RNA, 45 nt, Mus musculus
gaagaaagaaacauccaauaugugaauggcaagaaggggacuagg

SEQ ID NO: 87461 - RNA, 44 nt, Mus musculus
ugaaguucaugcacauggggaaacgacagaagcucacuaccagu

SEQ ID NO: 87462 - RNA, 76 nt, Mus musculus
aaucuaugggcauugcucagauucaggaggagacuugccagcuacugacagaugaggucagcuaccgcaucaagga

SEQ ID NO: 87463 - RNA, 57 nt, Mus musculus
agaaacugaaacucagcaauacuguguugcccucugaguccaugaaggugguggcag

SEQ ID NO: 87464 - RNA, 45 nt, Mus musculus
gcuccugucccuggaaggaugccuccccaggauggaaagauggag

SEQ ID NO: 87465 - RNA, 30 nt, Mus musculus
aguccacugaaauuagaaguguuaaccccu

SEQ ID NO: 87466 - RNA, 45 nt, Mus musculus
caugcugggcagugguggcucacgccuuuaaucccagcacuuggg

SEQ ID NO: 87467 - RNA, 46 nt, Mus musculus
ccuucucuaagaagucuuccugucgcuuccacugaucugagaaacu

SEQ ID NO: 87468 - RNA, 45 nt, Mus musculus
gcagcggugagaggcuuuuacugcucccggugcuuggcuggcggg

SEQ ID NO: 87469 - RNA, 42 nt, Mus musculus
aauuuucugcccuugcagcguagcucaauuccugccucuaga

SEQ ID NO: 87470 - RNA, 38 nt, Mus musculus
ugcucaucguucucaagguccccagaugacugugugug

SEQ ID NO: 87471 - RNA, 45 nt, Mus musculus
uggaaaagaagaagcuaucagaaggcaugaccugaaguaccugca

SEQ ID NO: 87472 - RNA, 46 nt, Mus musculus
ugucacuugccuguaaacccauuauucuuugggaugcugaggcagg

SEQ ID NO: 87473 - RNA, 34 nt, Mus musculus
uuuuaaaucuuugggcucacugaugggguggggg

SEQ ID NO: 87474 - RNA, 42 nt, Mus musculus
aaccuccaucugacugcuaugagccagcucuggagcccagcc

SEQ ID NO: 87475 - RNA, 126 nt, Mus musculus
auacucugggguuugugugcugccagcccggcucagacuccgcccuugggaaagauaaccaccauccgcucuaaucauguagacguacugccgccugguuucucuguuacaauaaaauuacuauag

SEQ ID NO: 87476 - RNA, 45 nt, Mus musculus
uagguuuucugcuccugcauagccuccucucucaucaaagagccg

SEQ ID NO: 87477 - RNA, 46 nt, Mus musculus
aaaaaccaacaggucuguugccacuucaacagggacaguagaagau

SEQ ID NO: 87478 - RNA, 46 nt, Mus musculus
cuuuucugaaaguuuacacacgcaagaaaaaucacagcaccaaaca

SEQ ID NO: 87479 - RNA, 46 nt, Mus musculus
gcaaugugggcuaccuugcccaugccauucaccaggucaccaagua

SEQ ID NO: 87480 - RNA, 46 nt, Mus musculus
uggcugaccgcaucaucagcaugaggacccagcuggucuccaaccu

SEQ ID NO: 87481 - RNA, 45 nt, Mus musculus
ugccggcaugcagcuccaagguuaucgcuacuaugaccccaagac

SEQ ID NO: 87482 - RNA, 50 nt, Mus musculus
augggaccuccagaucccauccugggcguuaccgaagccuucaagagaga

SEQ ID NO: 87483 - RNA, 42 nt, Mus musculus
gggacgcuuccccagaucucggcucuaccaccauccacugcc

SEQ ID NO: 87484 - RNA, 46 nt, Mus musculus
cuccauggccucugcaucagcuccugcuuuuugaccugccugaguu

SEQ ID NO: 87485 - RNA, 32 nt, Mus musculus
aauaggauaaguagaauaaaacaaugauaaga

SEQ ID NO: 87486 - RNA, 47 nt, Mus musculus
uuucucagcagucagaagugagucuucaucagaaaauccgcagaggg

SEQ ID NO: 87487 - RNA, 41 nt, Mus musculus
acugaugcugaugagauagaaguuggagaagaaccugaaga

SEQ ID NO: 87488 - RNA, 42 nt, Mus musculus
uuccagaauaugaguacccugaauaagagcaguccagauacc

SEQ ID NO: 87489 - RNA, 46 nt, Mus musculus
ugcuggagaacuacagcaacuugcuguucuugggugaguggaagau

SEQ ID NO: 87490 - RNA, 46 nt, Mus musculus
agagcguuuaucugucaugcccaaagcuacaauuugaaccuuagaa

SEQ ID NO: 87491 - RNA, 46 nt, Mus musculus
gcuugagcugaggccacuggccaucuuggcuucucacugcccuguc

SEQ ID NO: 87492 - RNA, 46 nt, Mus musculus
cagaggcugagugagagugagcuuugaaugucagcaacuugccagg

SEQ ID NO: 87493 - RNA, 45 nt, Mus musculus
cucccucugugugucugauuggacacuucucaacucagugccucc

SEQ ID NO: 87494 - RNA, 41 nt, Mus musculus
cuagaccuauaagcagacucaaggcaaagcaggccccuaga

SEQ ID NO: 87495 - RNA, 43 nt, Mus musculus
gggucaccuguacgcuggccuuguaagccgcuuuuccucgucg

SEQ ID NO: 87496 - RNA, 42 nt, Mus musculus
gcacagguguuguaggugcggcgaugggcgcgggcccgguag

SEQ ID NO: 87497 - RNA, 46 nt, Mus musculus
ggaccaaauacuaauuagauuuuaccauuccguccauugcaccggu

SEQ ID NO: 87498 - RNA, 45 nt, Mus musculus
ugugugugugugugugugugugugugagagagagagagauugugg

SEQ ID NO: 87499 - RNA, 46 nt, Mus musculus
ccuuccuuccuuccuuccuuccuuucccuuuguuuuuuguuguugu

SEQ ID NO: 87500 - RNA, 25 nt, Mus musculus
gcuuaugcuccccagccagaugcuc

SEQ ID NO: 87501 - RNA, 46 nt, Mus musculus
guuuugauggaauguggugacauaggccuuuaacuuaagcacccaa

SEQ ID NO: 87502 - RNA, 46 nt, Mus musculus
uuucuugagucuaccaguauuuccuguaaaguggugguagcccuag

SEQ ID NO: 87503 - RNA, 46 nt, Mus musculus
gaacauagauaggaggagagggguguguauguguugaggccagaua

SEQ ID NO: 87504 - RNA, 24 nt, Mus musculus
cuugaagccagggccucgggggug

SEQ ID NO: 87505 - RNA, 45 nt, Mus musculus
caggacauggcuucaggacgcuaguugcuacggcaggaaggaagg

SEQ ID NO: 87506 - RNA, 46 nt, Mus musculus
cacaaugaccaaagcaacucuuaaaaacaaaaacauuuaaucagag

SEQ ID NO: 87507 - RNA, 46 nt, Mus musculus
accaggcuggcuugguauuccaucuguaaggucuuacaucacccag

SEQ ID NO: 87508 - RNA, 25 nt, Mus musculus
cucaugagguguccaaccgacagca

SEQ ID NO: 87509 - RNA, 41 nt, Mus musculus
ggggacagccaggcuauugauucgcacauuagcaccagcag

SEQ ID NO: 87510 - RNA, 46 nt, Mus musculus
gcaauggauacacuugccgugacugcaggaugcucucagcgcgcac

SEQ ID NO: 87511 - RNA, 45 nt, Mus musculus
gcuuugccagcacuuuaacauuaaugucacaaagggagaaucaua

SEQ ID NO: 87512 - RNA, 44 nt, Mus musculus
guccucacugggucggacuggaagugcucagcugcugugccuga

SEQ ID NO: 87513 - RNA, 45 nt, Mus musculus
guggucucuucccaaguguccaguuuuaaaaugcuuugcaacuug

SEQ ID NO: 87514 - RNA, 41 nt, Mus musculus
cagcugcaaugggaucuggugcccucuucuggugugucuga

SEQ ID NO: 87515 - RNA, 32 nt, Mus musculus
cuggucuaucuagugugcuccaggacagcuaa

SEQ ID NO: 87516 - RNA, 46 nt, Mus musculus
agaagguagcuucuuugagugcgcagugccacaaccaugaugagag

SEQ ID NO: 87517 - RNA, 45 nt, Mus musculus
ggguauugcuauaggucugcagugccaaccaugugacccuuggua

SEQ ID NO: 87518 - RNA, 44 nt, Mus musculus
cugucuuggggugggguguggggauagauaagaaaguggagguc

SEQ ID NO: 87519 - RNA, 45 nt, Mus musculus
cauaucauugugaacaaugcucugaagcuguacucccaagacaag

SEQ ID NO: 87520 - RNA, 45 nt, Mus musculus
accacaugcaugccugguaaauauaaaaucagaaaauagcaagag

SEQ ID NO: 87521 - RNA, 46 nt, Mus musculus
cacccaguggcugcugggaacagaaccuaugucuugacaagcacaa

SEQ ID NO: 87522 - RNA, 42 nt, Mus musculus
aggcugugcugaguccuuaaggugugccagccccacaaauag

SEQ ID NO: 87523 - RNA, 50 nt, Mus musculus
uuguccaugaagaucuacccaaccacauucaccauggaacacauuccaaa

SEQ ID NO: 87524 - RNA, 45 nt, Mus musculus
gcuuuuggaacucaccaccucucuuagucauauuucacugucaga

SEQ ID NO: 87525 - RNA, 44 nt, Mus musculus
cuucaggucuuucucagggagauaaguugucacucaggaaagca

SEQ ID NO: 87526 - RNA, 46 nt, Mus musculus
guaucaagaagaggggcagccucugggacgguucaccuaugaccag

SEQ ID NO: 87527 - RNA, 96 nt, Mus musculus
cacuccagccauguacaugucuguauauaccaagacgccauaacacuggaacucauugagaaagagagcacgugagcauaggaacuugucagccac

SEQ ID NO: 87528 - RNA, 66 nt, Mus musculus
cugaggcugugcguguguucucaaagcccaaaagccggggaggcuuuuuuaauucauuugaaugua

SEQ ID NO: 87529 - RNA, 45 nt, Mus musculus
ugacuuagggauuugcuugaaugcauaaagucaagaagcagauag

SEQ ID NO: 87530 - RNA, 46 nt, Mus musculus
agcccuuaagacaguggcccaaagcacaucccacuccauaggguua

SEQ ID NO: 87531 - RNA, 52 nt, Mus musculus
gaagucagaauuuccuauauuaaacuaaauuggggaauuggggguggagaua

SEQ ID NO: 87532 - RNA, 46 nt, Mus musculus
aaacacuugucuuugguagugcuucuacugccacuaaauuaagaug

SEQ ID NO: 87533 - RNA, 46 nt, Mus musculus
ccuugcucacaccuaucgugcaauccuggaggccgagggugcauga

SEQ ID NO: 87534 - RNA, 90 nt, Mus musculus
acaguuguaagcuuccaggacucccuuggcagacagaguggcagcaucgugguguuacagggcguagccaggacccaaguguggccgagc

SEQ ID NO: 87535 - RNA, 46 nt, Mus musculus
gaagagggcaaucacguacugcugaugcucagagagguccccagug

SEQ ID NO: 87536 - RNA, 45 nt, Mus musculus
acuucaaggccagcauggugcauaaugagcucccaggugugugug

SEQ ID NO: 87537 - RNA, 63 nt, Mus musculus
ggggcugcugggacucuugccuugccucccugccugcccuguuuucuuucugccucauccucc

SEQ ID NO: 87538 - RNA, 42 nt, Mus musculus
uccucucugcaaugcccccaucccugugaagagaggugagau

SEQ ID NO: 87539 - RNA, 45 nt, Mus musculus
cucuguucaccauaagauuguauggaagggaaggacucucggaga

SEQ ID NO: 87540 - RNA, 45 nt, Mus musculus
ggauggguagguggguauuauuggcgcucggaacauccugcagaa

SEQ ID NO: 87541 - RNA, 32 nt, Mus musculus
uuuggggacuugaccuguggaaagugcaagag

SEQ ID NO: 87542 - RNA, 45 nt, Mus musculus
aguaggaaaggaagggggaagggugggaagugaauuggcuuagag

SEQ ID NO: 87543 - RNA, 46 nt, Mus musculus
cuuccaagcugaugagagauccuaagccacuguacaugcaugagau

SEQ ID NO: 87544 - RNA, 46 nt, Mus musculus
gaccuuacuuagagauggggaaacuaaggcuggcacagaggcagau

SEQ ID NO: 87545 - RNA, 29 nt, Mus musculus
cuggaacaggaaaagcaggugcuggagau

SEQ ID NO: 87546 - RNA, 62 nt, Mus musculus
gcauaugacugcuuaacagaccauaacuaacaaccagccaacaacccacaucacaccucuca

SEQ ID NO: 87547 - RNA, 103 nt, Mus musculus
uuuuuucccuaccauuucaacacccuaacacuagauaagagacagagaaagagacaaagagagacagagacucacagagagaagagaaaggcacacagagaga

SEQ ID NO: 87548 - RNA, 46 nt, Mus musculus
ugcauucagagagguuuuuaucuguuaggucggacacgggcaagug

SEQ ID NO: 87549 - RNA, 47 nt, Mus musculus
aggaaagaagagguugcaugguuaucaucaucugugagugugugugu

SEQ ID NO: 87550 - RNA, 51 nt, Mus musculus
cugcuuuuaaagagauaagcaaauauuuucaagggccgugaaaaagugcua

SEQ ID NO: 87551 - RNA, 46 nt, Mus musculus
agguggagaguuaccgcugccgcagugccuucaaacuccuggagau

SEQ ID NO: 87552 - RNA, 42 nt, Mus musculus
gucccgggcgaaugagaucugggugcgggagagacgcuggag

SEQ ID NO: 87553 - RNA, 45 nt, Mus musculus
cuggcaccccacucccgaccuccagcgucucucccgcacccagau

SEQ ID NO: 87554 - RNA, 81 nt, Mus musculus
agcuucaaacccaccaggaaaacugggguacugggcaggccugaggucgggaagaccagggaaacuacagagaguagggag

SEQ ID NO: 87555 - RNA, 46 nt, Mus musculus
ugucagggaacuuuggacaaccuuuggucugaauugaggucaagug

SEQ ID NO: 87556 - RNA, 46 nt, Mus musculus
uguuuguuuauuauauacacuguagcugucuucagacacuccagaa

SEQ ID NO: 87557 - RNA, 42 nt, Mus musculus
cucuccuggguccuguuaagaggaugggaaaaugugguuuga

SEQ ID NO: 87558 - RNA, 44 nt, Mus musculus
cagaccaaucaaaccacauuuucccauccucuuaacaggaccca

SEQ ID NO: 87559 - RNA, 45 nt, Mus musculus
cuggaauggcuucgggggcaaggugcaggaaggagagaccauuga

SEQ ID NO: 87560 - RNA, 46 nt, Mus musculus
gacugaccgaugcuauguagaccaugcuggccuugaacucgcggag

SEQ ID NO: 87561 - RNA, 46 nt, Mus musculus
acagcaugcaugcaguuccuauagacaccagaagagggcaucagau

SEQ ID NO: 87562 - RNA, 46 nt, Mus musculus
ucggcugaaaucuauguucuuccucuucccccuccccccaacccag

SEQ ID NO: 87563 - RNA, 42 nt, Mus musculus
uuccaggaucaggacacgauccucaguuacucgcugcgagag

SEQ ID NO: 87564 - RNA, 46 nt, Mus musculus
gugagcagacaguaagcggugcucaccuauaaagcaaggcccaucc

SEQ ID NO: 87565 - RNA, 42 nt, Mus musculus
agcaccgcuuacugucugcucacacuccggcuacugugucag

SEQ ID NO: 87566 - RNA, 46 nt, Mus musculus
auugauagagauggagcccagggcagagcaagcauucuaccccccc

SEQ ID NO: 87567 - RNA, 42 nt, Mus musculus
ccuaggguuucaggcacacagcacuuaauugguucuggggau

SEQ ID NO: 87568 - RNA, 46 nt, Mus musculus
accgacucggccauucucccagcucugggaggacggauuucugcuu

SEQ ID NO: 87569 - RNA, 92 nt, Mus musculus
cuggagaccagguuccauugcuggagauugcaguugaggugugaugggaaccaggaccaggucugucagagguaaacucgugaugcuagagg

SEQ ID NO: 87570 - RNA, 46 nt, Mus musculus
agaugcagugcaugacauuguggguguggcucagugguuaggggag

SEQ ID NO: 87571 - RNA, 46 nt, Mus musculus
acaaggcacgcgugcuugggcucagagucugggaaaacccgagaga

SEQ ID NO: 87572 - RNA, 45 nt, Mus musculus
cagacccugguggcucacgcacgugaucccgacaccgggccggcu

SEQ ID NO: 87573 - RNA, 41 nt, Mus musculus
cugucuguuagcauguauuuuuauccgugugugugugugug

SEQ ID NO: 87574 - RNA, 46 nt, Mus musculus
ggcucugacacccucaaacagacauacaugacauucacgcaggcag

SEQ ID NO: 87575 - RNA, 42 nt, Mus musculus
cccagagguuauuuagaagagggccguuugauucccgaguau

SEQ ID NO: 87576 - RNA, 38 nt, Mus musculus
uuaagauuuauuuuauaugucuguguguguaugugaaa

SEQ ID NO: 87577 - RNA, 44 nt, Mus musculus
gugcacaaggcugaagugaagggccaggagugggcccagcccag

SEQ ID NO: 87578 - RNA, 53 nt, Mus musculus
aucugcacacgucucucuccaggccacacauccuagaaccccuucccacccag

SEQ ID NO: 87579 - RNA, 80 nt, Mus musculus
ugaguuuuuggauacucuccuuaguucugacgcaaagcacaacgaccuuuccaggagaaaaacugagcagcccccggugc

SEQ ID NO: 87580 - RNA, 77 nt, Mus musculus
ccgcccccagcaagccagucuugagccacauggaggagaacgugagaggcuacgacugguccacucaugaugcccau

SEQ ID NO: 87581 - RNA, 46 nt, Mus musculus
ugcacaacaccagcacgcaccucaccuucaacaaguucuggcgccg

SEQ ID NO: 87582 - RNA, 46 nt, Mus musculus
agaggauuccacgccucucgcaucuggagaccgugguacagccaag

SEQ ID NO: 87583 - RNA, 40 nt, Mus musculus
acgaaagugggaggaagcuggaguaaaguguggcacccgc

SEQ ID NO: 87584 - RNA, 45 nt, Mus musculus
ucaaaugguguggggaagaaggcaaaggacacagggguggcaggu

SEQ ID NO: 87585 - RNA, 46 nt, Mus musculus
uuuggaagccccaggacaggauaccugacugaguaacugaccagag

SEQ ID NO: 87586 - RNA, 96 nt, Mus musculus
gucagugcuccuaagcccugagccaucgcuccagccccauguguucuuucuugagaugagaucuuaccauguauucuuggcucaucuagaauucaa

SEQ ID NO: 87587 - RNA, 42 nt, Mus musculus
auguacuaccaagcaugacucucccguccugaaaacggccaa

SEQ ID NO: 87588 - RNA, 47 nt, Mus musculus
ugugcugugggaucuccaagaagcccaugaaccucucugaauccagu

SEQ ID NO: 87589 - RNA, 93 nt, Mus musculus
cucuucaggucaagcuggccuugaacuuuauaauuccaccuccaccuccuaagcagcaugggccauaccacacugagcaagagacagagcuau

SEQ ID NO: 87590 - RNA, 59 nt, Mus musculus
guuugugguaccccagagcuaaagcuaacuucugugcugucuguagcuguccucuuacc

SEQ ID NO: 87591 - RNA, 45 nt, Mus musculus
acguguaaagggacaccucaggucauugaacacaacaugagcgca

SEQ ID NO: 87592 - RNA, 46 nt, Mus musculus
gccagggauggagcugcaggaggggcaugacagacauacagcccag

SEQ ID NO: 87593 - RNA, 62 nt, Mus musculus
cucaagagacccugcaggggguggaucacauguuuuaagccggguacgauaacacaccuaug

SEQ ID NO: 87594 - RNA, 46 nt, Mus musculus
ggagugcaugacuggagggcuucugggaggcggcagcuacugggag

SEQ ID NO: 87595 - RNA, 45 nt, Mus musculus
uggcuucauccaggaaguccuggccuggggaccacuugccucagg

SEQ ID NO: 87596 - RNA, 42 nt, Mus musculus
ccagguccaggcaacagccuugucaucuucagauggggguga

SEQ ID NO: 87597 - RNA, 41 nt, Mus musculus
auuugggguucauaagggaggauggggucugcucggcgggg

SEQ ID NO: 87598 - RNA, 45 nt, Mus musculus
ccgcugcagcugcugcgcuuuuugugcagccuccagaauaaccag

SEQ ID NO: 87599 - RNA, 45 nt, Mus musculus
guccuaaagaucccccgagggugaauauggccacagaggcugcuu

SEQ ID NO: 87600 - RNA, 45 nt, Mus musculus
uacuuguuuggcuugcuugugugugugugugugugugugugugug

SEQ ID NO: 87601 - RNA, 52 nt, Mus musculus
uuccaauguuuguuaucuaugcaggcgugugugugugugugugugugugugu

SEQ ID NO: 87602 - RNA, 46 nt, Mus musculus
ggaugcucugucgcauguacaccugcacaccagaagagggcaucag

SEQ ID NO: 87603 - RNA, 45 nt, Mus musculus
gccauguguguguguguaugugcaugugugugucuuccaguguga

SEQ ID NO: 87604 - RNA, 46 nt, Mus musculus
ugagagucuaugacuguguuaauaugugugugaaugugugugugag

SEQ ID NO: 87605 - RNA, 42 nt, Mus musculus
gagguacaaggugaggcggggaagccacacagaggaagugag

SEQ ID NO: 87606 - RNA, 43 nt, Mus musculus
cuuccgauugcaccacuucacagaccacagaggaggggugucc

SEQ ID NO: 87607 - RNA, 76 nt, Mus musculus
cgcucuccuggcaaccccacacucaccuuggucacaguggcccccagcagcggcugggaacagguugugucuguuu

SEQ ID NO: 87608 - RNA, 45 nt, Mus musculus
cuggccacauccccucggcuugugaagacuuggugaggcaggcag

SEQ ID NO: 87609 - RNA, 46 nt, Mus musculus
ucaacaaggaagaguuucuguagagaggcgaaagcuguguccccag

SEQ ID NO: 87610 - RNA, 46 nt, Mus musculus
cccgauucaguagcuaucacugacacucccgcguccucuugcccgg

SEQ ID NO: 87611 - RNA, 53 nt, Mus musculus
gugaacuuggcagucuaccagggcagccuggaaccaagaaaggugaugucguc

SEQ ID NO: 87612 - RNA, 44 nt, Mus musculus
uaacugugacuuggcuuuuuguuuuuuuuguuuuuaaaggagag

SEQ ID NO: 87613 - RNA, 43 nt, Mus musculus
uuuggggggaagguguggucucacacuacaccccaggcccugg

SEQ ID NO: 87614 - RNA, 42 nt, Mus musculus
ucuggcugcuguuggcaccugugcccuggagcauccgaggag

SEQ ID NO: 87615 - RNA, 28 nt, Mus musculus
ugguacagcuggaagcugagcagaaggc

SEQ ID NO: 87616 - RNA, 29 nt, Mus musculus
cgaggaagaggaaggcauugguagcuaua

SEQ ID NO: 87617 - RNA, 45 nt, Mus musculus
acaaaaaaacacaaaaaaacaaacaaacaaaaaaaccccacagaa

SEQ ID NO: 87618 - RNA, 45 nt, Mus musculus
cgucuagguuuuuggcagcguagccugcccuauccgccuauauuu

SEQ ID NO: 87619 - RNA, 45 nt, Mus musculus
aagguuacuagugccaaacacaaaauaaccuuccauguuuuuaga

SEQ ID NO: 87620 - RNA, 45 nt, Mus musculus
gggucagugagaaggagaaaaggcgcaggccaccauagccgaguu

SEQ ID NO: 87621 - RNA, 45 nt, Mus musculus
cccgcuaaaacacacacauacacgugcacaugaacauggggagau

SEQ ID NO: 87622 - RNA, 46 nt, Mus musculus
agacauuguucuaggcuucccgggugugaguagcucauauucagag

SEQ ID NO: 87623 - RNA, 46 nt, Mus musculus
uccuccuccuccuccuccucuuccuccuccucucucccucucuccc

SEQ ID NO: 87624 - RNA, 46 nt, Mus musculus
ccaggaagauggaggggggcuuccaggccagaggccagcccaaguc

SEQ ID NO: 87625 - RNA, 39 nt, Mus musculus
cugaagucacccuucaaguuuuccgacggccccggggga

SEQ ID NO: 87626 - RNA, 63 nt, Mus musculus
aagaaaaaaaagauggcaagcgaccaggagcaguuggcaagcaagcuagacagagcccucucc

SEQ ID NO: 87627 - RNA, 46 nt, Mus musculus
guuaagcaguuuaccacgucuaaaggguaugggaugguaguuagcc

SEQ ID NO: 87628 - RNA, 41 nt, Mus musculus
gugaguggguggguguauauggguguguguguguagguagg

SEQ ID NO: 87629 - RNA, 54 nt, Mus musculus
ggcccucaugggcauggggaaagcccgcagcaggaaccagagcugggacgauca

SEQ ID NO: 87630 - RNA, 70 nt, Mus musculus
ugacaucagacgacuaugaucugggagcggggauaaggaagagacacaaggggcccgaggaggagcaaga

SEQ ID NO: 87631 - RNA, 45 nt, Mus musculus
aacggacccacacccugagcgcccugucgccccccugcaagagag

SEQ ID NO: 87632 - RNA, 45 nt, Mus musculus
uccgcgugaacugaacuccaauaagaaauauagcuggaugcagaa

SEQ ID NO: 87633 - RNA, 46 nt, Mus musculus
aauucaaugauuauauaaauaaaaauaaaaaauaaaaccccaaacc

SEQ ID NO: 87634 - RNA, 46 nt, Mus musculus
ccaaggccagccuggucuaccuaagugagucccaggucagccagag

SEQ ID NO: 87635 - RNA, 46 nt, Mus musculus
uuuuugaggaaucucucccaauucuacuagugacaaacccccaaau

SEQ ID NO: 87636 - RNA, 46 nt, Mus musculus
gugcaugccucugaaauuccuugguugcuccaacagaauuggaggc

SEQ ID NO: 87637 - RNA, 41 nt, Mus musculus
gcagcuggcugaccgggaggugaaggcugaaguugaggaua

SEQ ID NO: 87638 - RNA, 42 nt, Mus musculus
ugguugugagucaccaugugggaauugaacucaggaccuuug

SEQ ID NO: 87639 - RNA, 46 nt, Mus musculus
gcucacucugcagaccacggagugugugguucccaugguggcaggu

SEQ ID NO: 87640 - RNA, 45 nt, Mus musculus
agaucccucagugggguucaaggguccuaaagggcuguuguuggg

SEQ ID NO: 87641 - RNA, 47 nt, Mus musculus
uccuuccuggaggagacggaagcugaaguuguauugaaugguccagu

SEQ ID NO: 87642 - RNA, 42 nt, Mus musculus
ggguuuuguggucuuugcuagcagccccuucuguggccucuc

SEQ ID NO: 87643 - RNA, 42 nt, Mus musculus
ucccagcaaccacauggugguucacaaccaucugcaacgaga

SEQ ID NO: 87644 - RNA, 45 nt, Mus musculus
agaugugcuuaugauuuuuuuuuuguuuguuuguuuuuaagagug

SEQ ID NO: 87645 - RNA, 42 nt, Mus musculus
cacagagaaacccugucucgaaaaaaagauaauaaauaaauu

SEQ ID NO: 87646 - RNA, 46 nt, Mus musculus
gacaguuuguaugugugugcuguguguguauauaugugcaugugug

SEQ ID NO: 87647 - RNA, 46 nt, Mus musculus
uuuuauuuuuacuuauuuauuuuuuuggugugugugugugugugug

SEQ ID NO: 87648 - RNA, 46 nt, Mus musculus
ugcaaagugaaauaaaaugggguaugauaauaggauacucggagau

SEQ ID NO: 87649 - RNA, 42 nt, Mus musculus
agucacaaccacucugggggaucccaguccgagggcucuuga

SEQ ID NO: 87650 - RNA, 29 nt, Mus musculus
cacgguaucuuuggugagggaagaccgcg

SEQ ID NO: 87651 - RNA, 26 nt, Mus musculus
uucugguaaccagagccugauaaaga

SEQ ID NO: 87652 - RNA, 45 nt, Mus musculus
ucgagcugacaggggcuuuugacaggggcuucgagaggacaggag

SEQ ID NO: 87653 - RNA, 46 nt, Mus musculus
gagagaguguguguguguguguguguguguguguguguugguguug

SEQ ID NO: 87654 - RNA, 45 nt, Mus musculus
agaagccaagugugauugugcaucucaucccagacugcaggaggu

SEQ ID NO: 87655 - RNA, 45 nt, Mus musculus
ggguagguagcaguggacgcuggagagagaggcggcaugcuggcc

SEQ ID NO: 87656 - RNA, 45 nt, Mus musculus
ucagacaugggggaauucauccuuuguaaacagaaagccccugac

SEQ ID NO: 87657 - RNA, 47 nt, Mus musculus
ugagcgcuugggccucugugugugugugugugugugugugugugugu

SEQ ID NO: 87658 - RNA, 45 nt, Mus musculus
ugcuauuuuggcacugguguuaaucgaaauuuauagccugcagca

SEQ ID NO: 87659 - RNA, 42 nt, Mus musculus
ucgcccuggaacagagcugcgcucagguggugcugcaggcgg

SEQ ID NO: 87660 - RNA, 45 nt, Mus musculus
cuuggcuauccuggaacucgcuauguagacugggcuggccccgaa

SEQ ID NO: 87661 - RNA, 75 nt, Mus musculus
cuggggucccuucugaggacccaggagcugccccaggagagugaauagaaaugagcaugcaccaaguuuauggac

SEQ ID NO: 87662 - RNA, 46 nt, Mus musculus
cggaggcagggaguugcaaauagagaagcccugcauagcuaggagg

SEQ ID NO: 87663 - RNA, 46 nt, Mus musculus
agaccagcucucugcuuacagagcuguggccgaggcuugugcccug

SEQ ID NO: 87664 - RNA, 46 nt, Mus musculus
uucugagggugccaugauugugcaugauucacacugaugcggcagg

SEQ ID NO: 87665 - RNA, 42 nt, Mus musculus
ugcggguuagaggacccucugagucaccgcagagacgccuag

SEQ ID NO: 87666 - RNA, 46 nt, Mus musculus
gguucuaggcaggggcucuaccacugagccacgcccccaaagccag

SEQ ID NO: 87667 - RNA, 45 nt, Mus musculus
gagggagagagggagagagagagagagagagagagagauugggac

SEQ ID NO: 87668 - RNA, 84 nt, Mus musculus
uacacacaggcaagacguucacacacgauacauacaauacaagacguaucuuucuaaaaauuaaagaaaauaaaugagaagcga

SEQ ID NO: 87669 - RNA, 45 nt, Mus musculus
augcugggcaaacaauuuacacugagcuauauuuucgacccccuc

SEQ ID NO: 87670 - RNA, 47 nt, Mus musculus
cagccaaucaggaugaagagaccgaucaggagaccuuccagcuggag

SEQ ID NO: 87671 - RNA, 48 nt, Mus musculus
ccgccggaucacucugagagccuccaacggcaaguuugugaccgccaa

SEQ ID NO: 87672 - RNA, 36 nt, Mus musculus
ggaacucuuccucaugaagcugauuaaccgccccau

SEQ ID NO: 87673 - RNA, 41 nt, Mus musculus
aguuacgaugucuuccaguuggaauucaaugacggcgccua

SEQ ID NO: 87674 - RNA, 65 nt, Mus musculus
uucuacugcugaguuaaauccccaaccccaagaaucaucucaaaaagaaagaaagaaaagggaaa

SEQ ID NO: 87675 - RNA, 45 nt, Mus musculus
ugcagagaaacccugucucaaaaacaaacaaaaaaaggggguggg

SEQ ID NO: 87676 - RNA, 46 nt, Mus musculus
guacuagggccaccugcccucugcaggccgcucucgucagucccuc

SEQ ID NO: 87677 - RNA, 42 nt, Mus musculus
gcuacagggccuagggacuuacccugagcuuguaacuggaag

SEQ ID NO: 87678 - RNA, 45 nt, Mus musculus
cucgcuccuuuauuuuuuuguaacugucauuucuauaacucugaa

SEQ ID NO: 87679 - RNA, 45 nt, Mus musculus
ucuugaguguggaguccuaaaacaaaguccauuuuaacuugagcu

SEQ ID NO: 87680 - RNA, 48 nt, Mus musculus
aaaagcauuugguuauagugaacauuggaaguccaacagguagucaag

SEQ ID NO: 87681 - RNA, 42 nt, Mus musculus
ucuucucucgggugucguaccucaccauacacuaucggagcc

SEQ ID NO: 87682 - RNA, 45 nt, Mus musculus
gaaaguccuucagucaaaagggaacccucacuguacaucggagau

SEQ ID NO: 87683 - RNA, 46 nt, Mus musculus
guggggagacccuggagucuguuucagaacugauuagcagugacgg

SEQ ID NO: 87684 - RNA, 46 nt, Mus musculus
cauucaaggauguggcuguggccuucucccaggaggaguggcagca

SEQ ID NO: 87685 - RNA, 46 nt, Mus musculus
aaagugccaccuuggugucuuuccaccucccuuucugccccaccuc

SEQ ID NO: 87686 - RNA, 68 nt, Mus musculus
ugccaaacaugggugcugggaaccgaacucagguccucugcaagagcaacaagcacucuaacaugggu

SEQ ID NO: 87687 - RNA, 46 nt, Mus musculus
auaaguacccuuguuucccccaccuuuacaccaaaugcccguggau

SEQ ID NO: 87688 - RNA, 45 nt, Mus musculus
acacacaacuaucuguguguguguguguguguguguguguguggu

SEQ ID NO: 87689 - RNA, 45 nt, Mus musculus
aaaaaguguuccaggggcuggggagguggcucaguggggagagca

SEQ ID NO: 87690 - RNA, 41 nt, Mus musculus
gaccugucccaccuggcggccaucgucauccuacugcugaa

SEQ ID NO: 87691 - RNA, 45 nt, Mus musculus
gugcuugccuguaaucccagcacucgagaggugguaaccugaggu

SEQ ID NO: 87692 - RNA, 46 nt, Mus musculus
uaguugagauccaggaaguaagcacaacccaaaagaccuuugcccg

SEQ ID NO: 87693 - RNA, 87 nt, Mus musculus
gaguugccuagugugcugaaacugaacucagguccuuugcaagagcaguacccuuaguggcugaacccucucuccagccccaagaaa

SEQ ID NO: 87694 - RNA, 59 nt, Mus musculus
uucuggaacugaaguuacaggcaguuauaagccaccauguuauugcuggaaagugaacc

SEQ ID NO: 87695 - RNA, 93 nt, Mus musculus
aggaagcagguugcuacuuaauauucauuguuuccaugggagauuagagcauugaggaaaacacaguauuuagcugaugugccaagaauggaa

SEQ ID NO: 87696 - RNA, 43 nt, Mus musculus
gagucagcuccuguucgcacuggucuucacgacucgcuaccug

SEQ ID NO: 87697 - RNA, 45 nt, Mus musculus
uacucagccaucuugcugguguguguguauguguguaugugugug

SEQ ID NO: 87698 - RNA, 45 nt, Mus musculus
ccaucuguaacgaaauuugaugcccucuucuggaguaucugagga

SEQ ID NO: 87699 - RNA, 28 nt, Mus musculus
gccaccuaugauggaaaucacgauaccu

SEQ ID NO: 87700 - RNA, 45 nt, Mus musculus
aguaaguaugcgcucuagugagugugcauugauuucauauuguca

SEQ ID NO: 87701 - RNA, 45 nt, Mus musculus
uaugaucagcaagacuggcgaggcugagaccaucaccacccacua

SEQ ID NO: 87702 - RNA, 104 nt, Mus musculus
cugggccucuaccgcgcucuguaccuggucaacuggaucuggcgcuucuacuucgagggcuucuuugaucucauugcugugguggcuggugucguccagaccau

SEQ ID NO: 87703 - RNA, 49 nt, Mus musculus
gaagaagcucagccugccagccuaagugccaaagaccagcagcagccuc

SEQ ID NO: 87704 - RNA, 102 nt, Mus musculus
cuucugucuacugcauccugccuuaucuuuuuuauuacuauguacaaagauuuuuuuacacaaagaaacuuaaugcuguguuaauaaauucaguauguagau

SEQ ID NO: 87705 - RNA, 46 nt, Mus musculus
aauucuuugugucuacaaugaaauuauacuccuugacacuugguag

SEQ ID NO: 87706 - RNA, 58 nt, Mus musculus
ccugucacugucaguccgaaggaucacuacaaccauguuagacucaaauguuuuucuc

SEQ ID NO: 87707 - RNA, 46 nt, Mus musculus
caguguuggaaguggaagagaaaaggacaaaggcauggccagggag

SEQ ID NO: 87708 - RNA, 46 nt, Mus musculus
gaccaaucaguaugaggguguucauucaauaaauuauuccugucug

SEQ ID NO: 87709 - RNA, 41 nt, Mus musculus
acggcauguaagauuuauauaguauauaaauggcagcaaau

SEQ ID NO: 87710 - RNA, 46 nt, Mus musculus
cuauaaaacugugacacuuauaauucacugguccugcaucaggaga

SEQ ID NO: 87711 - RNA, 46 nt, Mus musculus
ggacaugugugucacuacagagaugugggcaucuuggugaccccga

SEQ ID NO: 87712 - RNA, 46 nt, Mus musculus
ccuugauauaaaaagcuugacaauucugccucggacacccaaagau

SEQ ID NO: 87713 - RNA, 41 nt, Mus musculus
augagcagccuccggaaaguggaccgaggacacuaucggag

SEQ ID NO: 87714 - RNA, 46 nt, Mus musculus
aagagaacagccuggcauuugacagugccagcugccagguccagcc

SEQ ID NO: 87715 - RNA, 42 nt, Mus musculus
cuaaggcagcugcuguguugcagacagcuacgcgcagcgcac

SEQ ID NO: 87716 - RNA, 54 nt, Mus musculus
gacuuacacgccaccccucgccaauuacauguuaucccaugaacacuccaagac

SEQ ID NO: 87717 - RNA, 46 nt, Mus musculus
ugagaagucccugcuucauaaugagaccucggcucaccggcagaag

SEQ ID NO: 87718 - RNA, 35 nt, Mus musculus
ggcaaguggcaccacaucugcaucaccuggaccac

SEQ ID NO: 87719 - RNA, 42 nt, Mus musculus
aucaucaacaucgccaacugcuccacgaacaugcccggcaac

SEQ ID NO: 87720 - RNA, 59 nt, Mus musculus
cuugagccacuuccugcugggguuucuaguaaagucugugagccucuccaccagucccu

SEQ ID NO: 87721 - RNA, 59 nt, Mus musculus
gauggcugugcggucauccuaucggcguggccuaggucccuuguguguguagcacaucc

SEQ ID NO: 87722 - RNA, 45 nt, Mus musculus
gcuggaaggccagcugcucagacaauccccagcauccccggaaca

SEQ ID NO: 87723 - RNA, 46 nt, Mus musculus
guuuuguaagccacauugguuccugugagcaucugaccguccccca

SEQ ID NO: 87724 - RNA, 46 nt, Mus musculus
gugacuccaggcugcaucauauaucauaauuuauuuuaaagagaaa

SEQ ID NO: 87725 - RNA, 36 nt, Mus musculus
cucuugugaugauggaauuuugauuaaagugcaccg

SEQ ID NO: 87726 - RNA, 41 nt, Mus musculus
gagaucugacucccucuucuggugugucugaagacagcgac

SEQ ID NO: 87727 - RNA, 46 nt, Mus musculus
ugaugggaaagaagcugagcccucucaaucuuaucuguggcccgag

SEQ ID NO: 87728 - RNA, 45 nt, Mus musculus
acuucauuuucacuguauguucccaccagauccugaguccuaaag

SEQ ID NO: 87729 - RNA, 45 nt, Mus musculus
gccaagagggcgaaagccagaguuccugaggccacugggugggga

SEQ ID NO: 87730 - RNA, 45 nt, Mus musculus
cagccgaguacccucccaccuuugaccggguaugugcaccaaguu

SEQ ID NO: 87731 - RNA, 46 nt, Mus musculus
aagucccaggugagcccuaacauccacaucuacagcacccuuauca

SEQ ID NO: 87732 - RNA, 46 nt, Mus musculus
ccaucuguaaugacaucugaugcccucuucuggugugucugaagac

SEQ ID NO: 87733 - RNA, 48 nt, Mus musculus
gcauaggguggaggccgacguaaccuucuucaacacgcugauaaggaa

SEQ ID NO: 87734 - RNA, 43 nt, Mus musculus
gaaaggcuuguggaaaaacuaccucauuaguggaggcaaagau

SEQ ID NO: 87735 - RNA, 41 nt, Mus musculus
aucugcccuuccagccgucacauaaucauugcagggcaugu

SEQ ID NO: 87736 - RNA, 46 nt, Mus musculus
uuaugggugagccaccaugugguugcugggauuugaacucaggacc

SEQ ID NO: 87737 - RNA, 46 nt, Mus musculus
ccgcuucgcccucuggggaccgaaccuuugcccaagagagagguag

SEQ ID NO: 87738 - RNA, 42 nt, Mus musculus
uauguguguguguguguguguguguguguguaucgcugggcg

SEQ ID NO: 87739 - RNA, 24 nt, Mus musculus
uuuuaaaccacagauuugggauug

SEQ ID NO: 87740 - RNA, 42 nt, Mus musculus
auguuaccuccuccaucccuguucaggggacaaugaccauca

SEQ ID NO: 87741 - RNA, 48 nt, Mus musculus
ugacaugagagaggccagggucuugaauaagaaggugggccuuagugg

SEQ ID NO: 87742 - RNA, 46 nt, Mus musculus
auggcagguagcaaaucacacuagaucaccaggagaggaggcagac

SEQ ID NO: 87743 - RNA, 45 nt, Mus musculus
ccauuuaauuuccuguuugaacacagugucucuuuacaugcacag

SEQ ID NO: 87744 - RNA, 42 nt, Mus musculus
uucuacaagccgcacacaauagcuugcagaaauagugcccaa

SEQ ID NO: 87745 - RNA, 45 nt, Mus musculus
uguuuggauuucuuucugaguaggugugagguuuuuuagguaguc

SEQ ID NO: 87746 - RNA, 46 nt, Mus musculus
auaacccaaaguaaccuucaauuuaccuccacccccacccccaagg

SEQ ID NO: 87747 - RNA, 45 nt, Mus musculus
aagagagaggggagagagagaggggagagagaggaaggggaagag

SEQ ID NO: 87748 - RNA, 41 nt, Mus musculus
ccagcacccacaugguggugcacaaccaucuguaaugagag

SEQ ID NO: 87749 - RNA, 45 nt, Mus musculus
augacucagggcugggcaggaauucacacaaugaauccggguggu

SEQ ID NO: 87750 - RNA, 45 nt, Mus musculus
uuggugaaucucuaacauggaagccuuccuuaugaucacgugcau

SEQ ID NO: 87751 - RNA, 46 nt, Mus musculus
auaaggaaggcuuccauguuagagauucaccaaaugucacuuaggg

SEQ ID NO: 87752 - RNA, 46 nt, Mus musculus
acugugaugccucacugugugaccucucacuugugugacccccaga

SEQ ID NO: 87753 - RNA, 45 nt, Mus musculus
cuggucuauagagugaguuccaggacagccagagcuacauagaga

SEQ ID NO: 87754 - RNA, 57 nt, Mus musculus
uuaauauucacaguguaaaaugugauaugaggucgguuugugguggugcaagccuuu

SEQ ID NO: 87755 - RNA, 49 nt, Mus musculus
aauaaucuaaaaaauauguuuuaagggcaaugggcuggaaaauauggac

SEQ ID NO: 87756 - RNA, 46 nt, Mus musculus
uugcuugaguguauuuguaccguguucaugguuggugccuguggag

SEQ ID NO: 87757 - RNA, 46 nt, Mus musculus
aguauguuguucaaaagaagugcuggcuguauuauuagugcuggcg

SEQ ID NO: 87758 - RNA, 73 nt, Mus musculus
uaauuuuuugguauaaguauauuuaggagccaguuugacaccauauccuuugagcaaaacagaaguaggaccu

SEQ ID NO: 87759 - RNA, 45 nt, Mus musculus
auagauagauagauagguagguagguagguagguagauaagacag

SEQ ID NO: 87760 - RNA, 46 nt, Mus musculus
uuccuggaacauuaugauaauuaaauaugauaugcagucgucggau

SEQ ID NO: 87761 - RNA, 45 nt, Mus musculus
gaucuggagucuaagaauagagaagucauaagaggugacuguuca

SEQ ID NO: 87762 - RNA, 113 nt, Mus musculus
auuuguauuuuuuauuuauauuguauuagauggagagaccagagaagaaaacaagcuguugauuccuaagcggaaaauuucagaagaaguacauucauacaaagugagaguag

SEQ ID NO: 87763 - RNA, 46 nt, Mus musculus
aaccagaacccagcaguuggugaacaagaaccaauaaaucuaacag

SEQ ID NO: 87764 - RNA, 46 nt, Mus musculus
gaugauguagucucugauguucaacuaaguaugagguguggcagaa

SEQ ID NO: 87765 - RNA, 45 nt, Mus musculus
gauugaauucccaucuuauucagcaucaaagaauucacacaggag

SEQ ID NO: 87766 - RNA, 46 nt, Mus musculus
acuucagucagagagcacaccucauccaacaugaaaggguccauac

SEQ ID NO: 87767 - RNA, 45 nt, Mus musculus
cuuggggagacauuuagucaaguucaggccucauucaauauguga

SEQ ID NO: 87768 - RNA, 45 nt, Mus musculus
gcuucuuuaucuguucccuccuccacucccuucaucaagccaggg

SEQ ID NO: 87769 - RNA, 45 nt, Mus musculus
ggaggcagaaaagguguaucacaagagagagacagaggaauagaa

SEQ ID NO: 87770 - RNA, 48 nt, Mus musculus
ggccgggugcagagaccugugcaggaaugggacccaguggggguagaa

SEQ ID NO: 87771 - RNA, 59 nt, Mus musculus
gauagggcagauggggaggagauucuggccacucaggaggccccucaauauuaggauag

SEQ ID NO: 87772 - RNA, 45 nt, Mus musculus
uguuucaugaagagucagggcucaggagccugaccuacgcugggg

SEQ ID NO: 87773 - RNA, 46 nt, Mus musculus
caauggcuuuaacuucaaagauaagagucaaauuaaaaguccccuc

SEQ ID NO: 87774 - RNA, 43 nt, Mus musculus
guaguaugcacguguggucccagcagugagaccagcggcagag

SEQ ID NO: 87775 - RNA, 35 nt, Mus musculus
gaagcaguuuguggcuucagcgguugcagaaagga

SEQ ID NO: 87776 - RNA, 45 nt, Mus musculus
gggucacugugguacugauguauuucucuguggucuguggguccu

SEQ ID NO: 87777 - RNA, 46 nt, Mus musculus
gccuggauugucaggcuuuaccuacagccuaaagguggggcuugag

SEQ ID NO: 87778 - RNA, 45 nt, Mus musculus
agcuuugcuuugggacagggugggaguguggcugugcuggauggg

SEQ ID NO: 87779 - RNA, 67 nt, Mus musculus
gcacgugugugccugcacguguguggacaacuguagguagagugagugagggcugacugaugauguc

SEQ ID NO: 87780 - RNA, 42 nt, Mus musculus
gggcucauggaagucaaagguguugagguuguuaaccaaagg

SEQ ID NO: 87781 - RNA, 45 nt, Mus musculus
uaggcaccagcggacccaugaagaagaaaaauccuuuggcugugu

SEQ ID NO: 87782 - RNA, 45 nt, Mus musculus
ugggcagugcccagugagggacagcagaacgugcucaaguaggag

SEQ ID NO: 87783 - RNA, 46 nt, Mus musculus
ugauugcaggaaugugccaccaugccugguuuauguuauguuggag

SEQ ID NO: 87784 - RNA, 48 nt, Mus musculus
gcucuggguuuaucaagagguccuccuugguauguaaugugaauagag

SEQ ID NO: 87785 - RNA, 36 nt, Mus musculus
cucugagaagcagacaacuagaaauacacacgugua

SEQ ID NO: 87786 - RNA, 46 nt, Mus musculus
auauacagggucucuggacuuccccuaaacucugcugcaaccagaa

SEQ ID NO: 87787 - RNA, 59 nt, Mus musculus
aacguuuaccagagguguaccuagaacugaguaauggagaugcagccgaugacaguggu

SEQ ID NO: 87788 - RNA, 47 nt, Mus musculus
ccccgcuguccaacucaagacuugugucaagaauaacaguagaagag

SEQ ID NO: 87789 - RNA, 46 nt, Mus musculus
uaggcacagagguguaacgcgggucuuuuuagaacaagguagagaa

SEQ ID NO: 87790 - RNA, 58 nt, Mus musculus
cagcgguuuggagcagcacauauuugggaaaacggggcuagaaguaauguuacaguga

SEQ ID NO: 87791 - RNA, 77 nt, Mus musculus
uuagugccccucgcacuaauguuauuaauucccacaccaaccagucagaugguaguacucucaggcaagguggacgg

SEQ ID NO: 87792 - RNA, 42 nt, Mus musculus
uggucugagugcccaagggaguucugaggggguagagcagaa

SEQ ID NO: 87793 - RNA, 46 nt, Mus musculus
uuguuuucaaauuaguuuuauuuuuugcuguuugucucuggugggg

SEQ ID NO: 87794 - RNA, 46 nt, Mus musculus
agaagucucaggauggauccgucuagaucuagaucaggugggagug

SEQ ID NO: 87795 - RNA, 42 nt, Mus musculus
ggccucgauuaacaggauaaggaaaagaaccaguagcgggau

SEQ ID NO: 87796 - RNA, 42 nt, Mus musculus
caaaaugaacaggagccagacucucugcccaagcgcccccag

SEQ ID NO: 87797 - RNA, 45 nt, Mus musculus
auucaggguugggagacucuaguuugugucuuucacuggccccag

SEQ ID NO: 87798 - RNA, 44 nt, Mus musculus
ugggaaagagggagguaagggcccaucuguggaguuuggggugg

SEQ ID NO: 87799 - RNA, 82 nt, Mus musculus
auuuccucuucuuuuccuggugucguuccucuaucugaaggagcucggcuucuaguuuccgcugaugaaccauuaaagacug

SEQ ID NO: 87800 - RNA, 45 nt, Mus musculus
agcugcaaucuucuccaugucuacuuccaccuucagaccacauaa

SEQ ID NO: 87801 - RNA, 44 nt, Mus musculus
cuccugcccacucuccuuguccucaggaguagacgugccuucuu

SEQ ID NO: 87802 - RNA, 45 nt, Mus musculus
uuuucuuuugccauggcuuguuuuauuuuaggcaccuuccacaau

SEQ ID NO: 87803 - RNA, 64 nt, Mus musculus
ggugauccagcucagauagacuggcggguugcuauuauuacuacuagacauuugugcagccaca

SEQ ID NO: 87804 - RNA, 45 nt, Mus musculus
acucaacuucauuguccccaaccaggaccaacuaugacgaaagag

SEQ ID NO: 87805 - RNA, 41 nt, Mus musculus
gggccgcaguggccucucuggcuucagaucugugggcagaa

SEQ ID NO: 87806 - RNA, 41 nt, Mus musculus
ucgcagugccugugcacaagugugaguuugaagccccagaa

SEQ ID NO: 87807 - RNA, 46 nt, Mus musculus
gugcagaggaacaccagcucagagccaccggaguaccagcuuauga

SEQ ID NO: 87808 - RNA, 44 nt, Mus musculus
acauaguaauaugugugcccaguuugcuuucuauugcuucgaga

SEQ ID NO: 87809 - RNA, 46 nt, Mus musculus
ugggaaccauaaaacguugcaguugauauucugcuggggccuugaa

SEQ ID NO: 87810 - RNA, 41 nt, Mus musculus
cgaaaggugcgggacaaggcaggaaggaagaaaccaccgac

SEQ ID NO: 87811 - RNA, 45 nt, Mus musculus
acucaaugaguauaaaaguaucuuuguaaaaagcgggccaaguau

SEQ ID NO: 87812 - RNA, 41 nt, Mus musculus
uccaggacagccagggcuauacagagaaauccagucucaaa

SEQ ID NO: 87813 - RNA, 46 nt, Mus musculus
agggacuugcagggaggagcuuggggaaacagcuugcaauuaagag

SEQ ID NO: 87814 - RNA, 42 nt, Mus musculus
uguggaaaaccuccagaacuuagucuacagagggagccacgu

SEQ ID NO: 87815 - RNA, 46 nt, Mus musculus
gcuaagaagcgacagcagaaugucgcuaaccgggucuguuggaggg

SEQ ID NO: 87816 - RNA, 46 nt, Mus musculus
gaaggaaauacugucuguauaccgucccugagacagcacagacacg

SEQ ID NO: 87817 - RNA, 45 nt, Mus musculus
aucacuaauuaagaaaaugccccacaggcuugccuacagcccgau

SEQ ID NO: 87818 - RNA, 41 nt, Mus musculus
ucacuggaagaagucaggacaggaacuccaacagggcugga

SEQ ID NO: 87819 - RNA, 45 nt, Mus musculus
cuguuucaaagggaacugcaacugagaaacaccuccacaggaccg

SEQ ID NO: 87820 - RNA, 42 nt, Mus musculus
ggaggcagaggcagagaggcagagaggcagaggcaggcaggu

SEQ ID NO: 87821 - RNA, 42 nt, Mus musculus
agucugugacuuggcaaggaggcacccgccuguggagugaug

SEQ ID NO: 87822 - RNA, 29 nt, Mus musculus
cggcggagcuggggcgggggccggcgggg

SEQ ID NO: 87823 - RNA, 45 nt, Mus musculus
cauuccugcacaccacagugagacuguccacugaucagcggccag

SEQ ID NO: 87824 - RNA, 46 nt, Mus musculus
ugugugugugugugugugugugcgcgcgcgcgcgcgugugcgugga

SEQ ID NO: 87825 - RNA, 46 nt, Mus musculus
ugugugugugucauugucagugugcucucacauagcaugaauguag

SEQ ID NO: 87826 - RNA, 45 nt, Mus musculus
uaaggucgcaguuggacacaagaacugggaaggucggauagaacu

SEQ ID NO: 87827 - RNA, 45 nt, Mus musculus
ugguugugagccaccaugugguugaugggauuugaacuccggacc

SEQ ID NO: 87828 - RNA, 46 nt, Mus musculus
uauugcuucuauuguucuaaagguaguuuuacuguauauucagaau

SEQ ID NO: 87829 - RNA, 42 nt, Mus musculus
gaucuaacccucuuucucugcucuguagguacuugcacccac

SEQ ID NO: 87830 - RNA, 46 nt, Mus musculus
ggagacaacaagcuuuaagugaauugcaaguuacuuuuaaaacuag

SEQ ID NO: 87831 - RNA, 45 nt, Mus musculus
gaaucaccauguggauucuaagaacugaaucaagguccccuccaa

SEQ ID NO: 87832 - RNA, 80 nt, Mus musculus
cucguguaagcuaagccagagagccccuguaacccaggucaguguacacuucucaagauagaagccaggcaaaaggaaag

SEQ ID NO: 87833 - RNA, 46 nt, Mus musculus
cucuuugucauagcugggugugacacugaggacauuuuauagauag

SEQ ID NO: 87834 - RNA, 46 nt, Mus musculus
guguguguguguagagagcacauauacauauaugcuaguaacauag

SEQ ID NO: 87835 - RNA, 46 nt, Mus musculus
ucugacuucaucugcuucauccuuguuuaaugacuucggugcccuc

SEQ ID NO: 87836 - RNA, 45 nt, Mus musculus
uuucuucauauauucuguuguuaacauaacgcaguguaggucacu

SEQ ID NO: 87837 - RNA, 46 nt, Mus musculus
guggucacgugagcacucggugcacaugacuucuuuccaucuugag

SEQ ID NO: 87838 - RNA, 47 nt, Mus musculus
aauauuuauaucuguuuuugaaaagauauagcaaaaaauaauggaga

SEQ ID NO: 87839 - RNA, 46 nt, Mus musculus
augagugcaaacuuaaaauauuuagugguugcacaguagcagcgaa

SEQ ID NO: 87840 - RNA, 46 nt, Mus musculus
gucauuacagauaggaucacagggaccaaagccagcuucagcggag

SEQ ID NO: 87841 - RNA, 45 nt, Mus musculus
ugaaaagguuauaauaugaaauacauguaauucuuggguaaaaga

SEQ ID NO: 87842 - RNA, 42 nt, Mus musculus
gugccaccacgccuggcuaaaaugagaguuauuauacuagag

SEQ ID NO: 87843 - RNA, 46 nt, Mus musculus
cauaucuuuugaaaacaaaauauucuuuuaucagaguuagauauag

SEQ ID NO: 87844 - RNA, 46 nt, Mus musculus
uuuaauaaauauauggugcuuuuaccuuaguccugagagcuaguag

SEQ ID NO: 87845 - RNA, 49 nt, Mus musculus
aaugauuaagcaauuuaguuaacuaagggaugacucucuggaguuggag

SEQ ID NO: 87846 - RNA, 59 nt, Mus musculus
cauacaaguccccaggagugcucaggcuguuuggaaacaagaucaacacuaguauuggc

SEQ ID NO: 87847 - RNA, 42 nt, Mus musculus
ccuccacacugauguagaacuuccuuucugagaugcacccac

SEQ ID NO: 87848 - RNA, 46 nt, Mus musculus
cugcuuguauguauguguacaaugugugugucuggugccugaugag

SEQ ID NO: 87849 - RNA, 45 nt, Mus musculus
uagcugugaacaggaaauaagauagugagaugaacugcugaagaa

SEQ ID NO: 87850 - RNA, 46 nt, Mus musculus
uacgggucccaggaaucaaaaucagauucucaggcucggcagcaag

SEQ ID NO: 87851 - RNA, 42 nt, Mus musculus
uuucaauuagaucuuauacugagaucuuuuucacccaacaaa

SEQ ID NO: 87852 - RNA, 24 nt, Mus musculus
auggaaaacugcuuuaggaaaaaa

SEQ ID NO: 87853 - RNA, 48 nt, Mus musculus
ugagucucuguacuucuguuacacugucucauuguaaguggggccuga

SEQ ID NO: 87854 - RNA, 49 nt, Mus musculus
uggucauuauuguaaacaucacuuugauuuucuuuuacugagcaguuau

SEQ ID NO: 87855 - RNA, 46 nt, Mus musculus
augcaugcauggguacauacaccuaugugugugcuuuuggagccag

SEQ ID NO: 87856 - RNA, 46 nt, Mus musculus
aaugacaggauugagugauguaaagcucuauaaaauguuuguggua

SEQ ID NO: 87857 - RNA, 47 nt, Mus musculus
uugccugaaaguacugauguauuaaaggcauucaugcugccucagaa

SEQ ID NO: 87858 - RNA, 46 nt, Mus musculus
gugguucucaggagugaggaauggagguggucaugaggcugaggag

SEQ ID NO: 87859 - RNA, 58 nt, Mus musculus
uucuuuaguuacucacuagguuagagugcuacuucagguagguuuuagucuuuagggc

SEQ ID NO: 87860 - RNA, 42 nt, Mus musculus
auucucagcaaccacaugguggcucacaaccauucguaauaa

SEQ ID NO: 87861 - RNA, 45 nt, Mus musculus
gugagagcaggagagaaggcacagcuccuugcaggcagcagcauu

SEQ ID NO: 87862 - RNA, 63 nt, Mus musculus
uuuuauuauuuguuugugaguguuuuauuuuguaauaaguuggaagggcaaaaguugauauga

SEQ ID NO: 87863 - RNA, 68 nt, Mus musculus
gagaacgcggagaugagugggaauggggagcaugaugugaaacucaacaagucaauaaaagguacaga

SEQ ID NO: 87864 - RNA, 45 nt, Mus musculus
gcagucucucuugugacccaucauuucagauuaaaaauucucaag

SEQ ID NO: 87865 - RNA, 45 nt, Mus musculus
ccugggggguaaaagaccaacaaguaaacaaaaacauugccacca

SEQ ID NO: 87866 - RNA, 42 nt, Mus musculus
auuuauaacuguuaaaaugacaauaguaaagucugaagggag

SEQ ID NO: 87867 - RNA, 46 nt, Mus musculus
aguagaggaagaguccacccugcacgcccugccccaggugcuuacg

SEQ ID NO: 87868 - RNA, 46 nt, Mus musculus
uggagcauaaaauaacaccaaauaaaaugauacacaagagguacag

SEQ ID NO: 87869 - RNA, 45 nt, Mus musculus
agggaggcugaggcuguuugcuuguuucauaagaaggcaguggag

SEQ ID NO: 87870 - RNA, 45 nt, Mus musculus
cugaagaguaauaccuaguagggucaaaugucuguugggggccga

SEQ ID NO: 87871 - RNA, 46 nt, Mus musculus
agaugaguggaacugcuuauacugcugcugucacucugguguagga

SEQ ID NO: 87872 - RNA, 46 nt, Mus musculus
aaaaaauaaaguuguauagccuauuaggucuguguuuucugucaga

SEQ ID NO: 87873 - RNA, 46 nt, Mus musculus
agcacuuaguucuagguuauuuggucaugaaucuugcacacacuga

SEQ ID NO: 87874 - RNA, 55 nt, Mus musculus
uauuaaaacaacuauguggguuaagcuguagacacacuuccccaaugcggagacu

SEQ ID NO: 87875 - RNA, 48 nt, Mus musculus
ggcagguguucaaaucucuucucaacauuucucuagucagcuagaagc

SEQ ID NO: 87876 - RNA, 71 nt, Mus musculus
aauugaaaacuuugaaguauuauuuaaguauuuugagucuguauuuuaauuuuguaacccacuucuaucuc

SEQ ID NO: 87877 - RNA, 46 nt, Mus musculus
cuguuuucuucaaacauuagaggcaaaagaaagaucuacauaaaag

SEQ ID NO: 87878 - RNA, 54 nt, Mus musculus
gcuguuuguagggcagggcuuguuagguugaagggaaggaagaucaggauaugg

SEQ ID NO: 87879 - RNA, 42 nt, Mus musculus
gugagccaccaugugguugucuggaauugaacucagggccuc

SEQ ID NO: 87880 - RNA, 45 nt, Mus musculus
aaaaaaaaaaaaaaagaaaaaaaaaagaaacaaagaaacaauggg

SEQ ID NO: 87881 - RNA, 46 nt, Mus musculus
aauuccauccacaguguacagugugagcuuuaugaagagaguggag

SEQ ID NO: 87882 - RNA, 46 nt, Mus musculus
gaugcuuagaugaggcuaagguuaauuuguuuacuaguagcuugag

SEQ ID NO: 87883 - RNA, 44 nt, Mus musculus
uuaagcauuuguggugugaaugaaaacacuacagcucaguacaa

SEQ ID NO: 87884 - RNA, 32 nt, Mus musculus
auuauaauuuaaaguuuaguaagccccuuaaa

SEQ ID NO: 87885 - RNA, 45 nt, Mus musculus
auggugguggugguagcacauuccuuuaaucccagcauucaggag

SEQ ID NO: 87886 - RNA, 46 nt, Mus musculus
cuuuucacauauacuagcuuggcucauaguuugauaucauacagaa

SEQ ID NO: 87887 - RNA, 46 nt, Mus musculus
ucaccgguucuuauugugugcucuaggcauucuuuuuauugaacag

SEQ ID NO: 87888 - RNA, 59 nt, Mus musculus
guagaauugugcuacagagcacauuugugcuugaaacugucucagacuuuaaaagaaaa

SEQ ID NO: 87889 - RNA, 99 nt, Mus musculus
aaaaccauccagccauuuuuacgguccaggacuuugaucugcuuuaguugaccugagagcuuuuucuuuaauuuaaugcuuauacaauuuuuacucuug

SEQ ID NO: 87890 - RNA, 47 nt, Mus musculus
gugucaagaacaaauaccuuguuugucacuuuuguguccuucauuuu

SEQ ID NO: 87891 - RNA, 80 nt, Mus musculus
ucugaaacagggucuugcucuauggcacaaguagacuugaacuagaauuaccacgucugccucguuugaguagugggauu

SEQ ID NO: 87892 - RNA, 37 nt, Mus musculus
auacuacugucggagaacugcucuagacuuggccacg

SEQ ID NO: 87893 - RNA, 49 nt, Mus musculus
ucccaaggauuaauugaacauccagaauuauagauaaagauuucagagg

SEQ ID NO: 87894 - RNA, 46 nt, Mus musculus
guggguuacagguugcuccugagaaacuacagagaaaucguccaag

SEQ ID NO: 87895 - RNA, 46 nt, Mus musculus
caaaauugaaaaugguuccgagaagucuugauacucaggugucugc

SEQ ID NO: 87896 - RNA, 46 nt, Mus musculus
gauuuauuauacauaaguacacuguagcugacugcacacacaccag

SEQ ID NO: 87897 - RNA, 45 nt, Mus musculus
uacugagauggcuacaaauccucuucuccuucauuugagacagag

SEQ ID NO: 87898 - RNA, 41 nt, Mus musculus
cccagcaaguuucauggugccgccuagugccuccacuccug

SEQ ID NO: 87899 - RNA, 42 nt, Mus musculus
ggcaugcaaugguaaaggcuguaguguaucuugcaggagggg

SEQ ID NO: 87900 - RNA, 46 nt, Mus musculus
uuuagaauaaauuuuugacuacauuaauagaucuuauauauuccag

SEQ ID NO: 87901 - RNA, 46 nt, Mus musculus
gucauaaauguacacacagcaguggaaaccugaagcagucugaaug

SEQ ID NO: 87902 - RNA, 42 nt, Mus musculus
uaaucuaacucaucuuugacuuuugggcuuuuaucucugcag

SEQ ID NO: 87903 - RNA, 45 nt, Mus musculus
uuuuaagauucagcaucccuuugauaaaaacuaaauuaaccagau

SEQ ID NO: 87904 - RNA, 46 nt, Mus musculus
uuaagggucuuacugcauuuuuauaaaguaucucaaagaauuggag

SEQ ID NO: 87905 - RNA, 41 nt, Mus musculus
uuuuucaguaauuuguucuuauucaacauuuauuuggucag

SEQ ID NO: 87906 - RNA, 45 nt, Mus musculus
uagaguaauggacccaacgaagauucugauaaccagcaaaacaag

SEQ ID NO: 87907 - RNA, 46 nt, Mus musculus
aaaauuauuuagcuggaaaauacaggggaaaaaagaguuccuugag

SEQ ID NO: 87908 - RNA, 66 nt, Mus musculus
caguagaugaacauggauucaguaacugacuugguaucucagauccuaaguauuuauagaaaucau

SEQ ID NO: 87909 - RNA, 81 nt, Mus musculus
augcuuaaagcaaccacauucuuuuaggcaugugaugauugucauuguagaggaguauugcuagggacuguuuuguuugcu

SEQ ID NO: 87910 - RNA, 46 nt, Mus musculus
aaaaagccucugccuccagagugcugggauuaaaggcgugcgccag

SEQ ID NO: 87911 - RNA, 45 nt, Mus musculus
agauagcucagcacauuaagacaucuaucauguuagccuggagac

SEQ ID NO: 87912 - RNA, 48 nt, Mus musculus
ugagacacuagaagccagugcuugccugggaccuagaaguagucaguu

SEQ ID NO: 87913 - RNA, 46 nt, Mus musculus
ggaauuaauuugcaugaaaaguauguuuucaaauugugagugccag

SEQ ID NO: 87914 - RNA, 42 nt, Mus musculus
aggcuucuagcaaaauugggaacaaucaacgagaggccggag

SEQ ID NO: 87915 - RNA, 46 nt, Mus musculus
ugugcgugugugugcacgugugugugugugugugugugugugugug

SEQ ID NO: 87916 - RNA, 46 nt, Mus musculus
gcggaagagcagguaaaccgugcacggcagaccugcugacucccag

SEQ ID NO: 87917 - RNA, 46 nt, Mus musculus
aauguagauacugacagugguacuuacaguaagcuacagacagucg

SEQ ID NO: 87918 - RNA, 42 nt, Mus musculus
uggaaacuauugaguaaauaauuagugucaaguuggcagaag

SEQ ID NO: 87919 - RNA, 45 nt, Mus musculus
ucagcuagaugcuggugugccagaaaaaaucagccugauuuccag

SEQ ID NO: 87920 - RNA, 46 nt, Mus musculus
ggagcgaagcuucucacacgugggucuaacaggugcacuguuacuu

SEQ ID NO: 87921 - RNA, 63 nt, Mus musculus
guguuuaaagggaacgagaacuuucgguguaccacgcagaagucuuuaucauuagcucaugua

SEQ ID NO: 87922 - RNA, 46 nt, Mus musculus
guauucuagaagaaauaugaaaugcuuaauuuauaagcgggcugga

SEQ ID NO: 87923 - RNA, 46 nt, Mus musculus
uguaaacccauauagaagguugucugaaaguuacuauuuagugcau

SEQ ID NO: 87924 - RNA, 66 nt, Mus musculus
cuuucuucuauuuuaaggugguuuuuaaaauuuuuaaauccuuggauuguggggcuguggguguag

SEQ ID NO: 87925 - RNA, 45 nt, Mus musculus
gcugagaacagaauaggggccgcagggcagcacuaggccucggag

SEQ ID NO: 87926 - RNA, 45 nt, Mus musculus
gagaccggccauggccaagaggagagaagggggaagggaaagaga

SEQ ID NO: 87927 - RNA, 45 nt, Mus musculus
uuagagagagagagagagagagagagagagguaaaagcuuagaga

SEQ ID NO: 87928 - RNA, 39 nt, Mus musculus
uuuucuuuucuuuuuuaacucgcugcucucucuggucac

SEQ ID NO: 87929 - RNA, 42 nt, Mus musculus
cugcugcagaaaagcaaauggaauauggauuuaccagaaaga

SEQ ID NO: 87930 - RNA, 46 nt, Mus musculus
aaagagccuucugucuauucuuuuccccccucaaggugcuggggau

SEQ ID NO: 87931 - RNA, 45 nt, Mus musculus
cuugugguagguauuguucccuuucagaauuuagacugccuagga

SEQ ID NO: 87932 - RNA, 46 nt, Mus musculus
accaguguuuugucugucugugcacuacaugcaugcaguaccuaca

SEQ ID NO: 87933 - RNA, 42 nt, Mus musculus
cucugucuccagcaaucaggggaugagaagcagcggggagau

SEQ ID NO: 87934 - RNA, 46 nt, Mus musculus
cuggaaaaaaugagugaaccucuaauacgaaggaguaguuucucug

SEQ ID NO: 87935 - RNA, 45 nt, Mus musculus
uuaagcaguuugcaaaacuaggaauacuggguaaguucugugugg

SEQ ID NO: 87936 - RNA, 23 nt, Mus musculus
aggcugggggaaucccccacuug

SEQ ID NO: 87937 - RNA, 41 nt, Mus musculus
ugugugucugugugugucugugugugugugucugucugugu

SEQ ID NO: 87938 - RNA, 45 nt, Mus musculus
uguuccaguuagugugugugugugugugugugugugugugugucu

SEQ ID NO: 87939 - RNA, 46 nt, Mus musculus
agaagucucuucuagcccaagauagacagguacaaaccucucagug

SEQ ID NO: 87940 - RNA, 45 nt, Mus musculus
uuugucuuugcgccuggaagauaggcgcgaacacacacaccaagc

SEQ ID NO: 87941 - RNA, 58 nt, Mus musculus
ugaauacaaaaggagaccaacuuuuugggaaauuuuuaaggcgagaugcagcacagca

SEQ ID NO: 87942 - RNA, 42 nt, Mus musculus
cuggucucugcauuuguuccucagcaucaauuuagcaggcau

SEQ ID NO: 87943 - RNA, 46 nt, Mus musculus
aggcaagcuagccuggaacuuauauaauccuucuguaugcucccag

SEQ ID NO: 87944 - RNA, 42 nt, Mus musculus
gaagagagccuaugagaggcuguuggugaagccuagugggag

SEQ ID NO: 87945 - RNA, 122 nt, Mus musculus
aagccucaauugguuugaggagcuuuccucagaagcccccccauacaauucugaaccuccggaggaaucugaguauaagccccacgguuaugaaccacagcuguuuaaaacaccacagagga

SEQ ID NO: 87946 - RNA, 49 nt, Mus musculus
caacuccaauaauguucaaagaacgaagucaaacucuaccacuggacca

SEQ ID NO: 87947 - RNA, 46 nt, Mus musculus
cuuaguuccacugugcucauagguaauagugacaaacguguacugg

SEQ ID NO: 87948 - RNA, 46 nt, Mus musculus
ucuauuacuucagaaaaaucuuuaccucauauuucuagucuuccag

SEQ ID NO: 87949 - RNA, 45 nt, Mus musculus
auaaggaacaugaaggacagcauuuugaaucacuugaagacucca

SEQ ID NO: 87950 - RNA, 45 nt, Mus musculus
uucaaagcaagauuuucauucaaauaauuuaacgaccagccaaaa

SEQ ID NO: 87951 - RNA, 45 nt, Mus musculus
aauuuagaaaacucugaugguaguaugucaaguacaaguggccca

SEQ ID NO: 87952 - RNA, 46 nt, Mus musculus
uaaauaaggacaaaaugcauacuucaugucacaagaaagcaaucag

SEQ ID NO: 87953 - RNA, 46 nt, Mus musculus
ugaaaaaccuuuuugaugagacacaauauguuaggaaaacugccag

SEQ ID NO: 87954 - RNA, 46 nt, Mus musculus
guaucaaaaauacuuccucaaccuugugcugaaaucagaaccccag

SEQ ID NO: 87955 - RNA, 42 nt, Mus musculus
cagcuuaccaaguaauuauaaagaaagugguucuucgggcaa

SEQ ID NO: 87956 - RNA, 45 nt, Mus musculus
uacuagcauguaagccccugcaggucggcaagagaaggugguuca

SEQ ID NO: 87957 - RNA, 45 nt, Mus musculus
gucccgccuuucaagaugaaaucacaguuucacggagaugaacau

SEQ ID NO: 87958 - RNA, 78 nt, Mus musculus
ggcccuucccucugcccuuguccucacuguucagugacggaggaaauguuggcuguguggauaucauuguucagagag

SEQ ID NO: 87959 - RNA, 45 nt, Mus musculus
gguggagaagacagugucuggauuguacauauuucguagugagag

SEQ ID NO: 87960 - RNA, 48 nt, Mus musculus
gaaacuagaggccuuguucaccaaaguccacacagaguuuaaagacca

SEQ ID NO: 87961 - RNA, 46 nt, Mus musculus
cacguacacauuuacucagaaauggacuuuuaaaauauagacugga

SEQ ID NO: 87962 - RNA, 30 nt, Mus musculus
augcagcagugcaguaugcaucagacccag

SEQ ID NO: 87963 - RNA, 42 nt, Mus musculus
gaaggaaagagauacagaaucuaucaucuugcagugucaaaa

SEQ ID NO: 87964 - RNA, 52 nt, Mus musculus
ugugguggaagauggagggggaggaggagguaacaaacaaaacaauggaggg

SEQ ID NO: 87965 - RNA, 42 nt, Mus musculus
ugcagaugcagacuuuaagagcauugguauacccgagagaug

SEQ ID NO: 87966 - RNA, 45 nt, Mus musculus
uugcucugugugugugugugugagagagagagacagagagacaga

SEQ ID NO: 87967 - RNA, 46 nt, Mus musculus
auggcccuugcucacauguauuuuacuauuauuuaauggucaucag

SEQ ID NO: 87968 - RNA, 47 nt, Mus musculus
ucuuggaguggagagaacgagauugaugacccaaaaaccugucgaaa

SEQ ID NO: 87969 - RNA, 45 nt, Mus musculus
caagcguuucccggugauuccacaaggaacccccagccagcacag

SEQ ID NO: 87970 - RNA, 45 nt, Mus musculus
cggagcuggaaagagacgcgaggcuggagcaguuucauacgcaag

SEQ ID NO: 87971 - RNA, 46 nt, Mus musculus
ugcauacaacuuacucgggguggaccagagauuacauaccuuuugc

SEQ ID NO: 87972 - RNA, 46 nt, Mus musculus
agcuggaauucuaaauaccuguccauugucuaaccaagcaagaaau

SEQ ID NO: 87973 - RNA, 45 nt, Mus musculus
uucuuuccugucaaugaacugcuguuuguaaccauaggccuggau

SEQ ID NO: 87974 - RNA, 46 nt, Mus musculus
ggugucaaguugcaaauguaagcccguuccacuuuuggagcuugca

SEQ ID NO: 87975 - RNA, 45 nt, Mus musculus
aggucagagaaugaugugagugucaaaaccauggccugcagccag

SEQ ID NO: 87976 - RNA, 45 nt, Mus musculus
agccuucaagguagcugagaagcagcaacccuuuccagugcucgc

SEQ ID NO: 87977 - RNA, 45 nt, Mus musculus
uggauaugccaguguuuuucuacauugacccugaauuugcagaag

SEQ ID NO: 87978 - RNA, 46 nt, Mus musculus
guguguguugaagaacugagaaaaaauaaaaucgagaaaaagacug

SEQ ID NO: 87979 - RNA, 34 nt, Mus musculus
aaucauaccugcuucucaccuuggcuccccacac

SEQ ID NO: 87980 - RNA, 45 nt, Mus musculus
cgagagagagggggguacagacagagagagucagagagaggaugg

SEQ ID NO: 87981 - RNA, 46 nt, Mus musculus
ggacagccuggucuacagagugaguuccaggacagccacggcuaua

SEQ ID NO: 87982 - RNA, 46 nt, Mus musculus
gcucgugguuuccccgggacuccuggacuuccuggcuucaaaggcg

SEQ ID NO: 87983 - RNA, 45 nt, Mus musculus
uuacuuuuauuuugacuacagagaaucaaugacauaagaggaggg

SEQ ID NO: 87984 - RNA, 28 nt, Mus musculus
uagggagcccgagggcuuccuggugaga

SEQ ID NO: 87985 - RNA, 45 nt, Mus musculus
cugcaaacguagagugaaaaaacucuucuguaggcauuuuggagg

SEQ ID NO: 87986 - RNA, 76 nt, Mus musculus
guccucuggcaccuguagcaccagcagcaccagcggggccaggaauaccacgggggccagggagaccgggagcccc

SEQ ID NO: 87987 - RNA, 66 nt, Mus musculus
ucuguuggagcccaagguccuccuggucccagcggugaagaaggaaagagagggucucccggagaa

SEQ ID NO: 87988 - RNA, 94 nt, Mus musculus
cccuggcauugauggcagaccuggcccaaucggcccagcuggaccaagaggugaagcuggcaacaucggauucccuggacccaaaggccccucu

SEQ ID NO: 87989 - RNA, 41 nt, Mus musculus
uccuauuggaagccgaggucccaguggagccccagggccug

SEQ ID NO: 87990 - RNA, 46 nt, Mus musculus
uguccucuucuuuuuagccaucgugucauuaauagcaggcccccag

SEQ ID NO: 87991 - RNA, 42 nt, Mus musculus
cuggugccucugggccuggugggcuuccaggagagaggggug

SEQ ID NO: 87992 - RNA, 45 nt, Mus musculus
agggugaaacuggucuccgaggugacacuggcaacacugguagag

SEQ ID NO: 87993 - RNA, 42 nt, Mus musculus
aaaugauagggcuuaagguauagaucagacagcuggcacauc

SEQ ID NO: 87994 - RNA, 45 nt, Mus musculus
aaagagcaguggugagucgcuuaaugggccucacauagaugaggg

SEQ ID NO: 87995 - RNA, 66 nt, Mus musculus
ccaacccggugcuaaaggagagaagggaaccaaagggccuaagggugaaaauggcauuguuggucc

SEQ ID NO: 87996 - RNA, 42 nt, Mus musculus
gcaaaccaccuuguguguguguguguguguguguguguguau

SEQ ID NO: 87997 - RNA, 45 nt, Mus musculus
ggugugguggcacaugccuuuaaucccagcacuuggaagguagag

SEQ ID NO: 87998 - RNA, 57 nt, Mus musculus
cuuucauuuaggguccuaauggcccaccugguccuguuggaagucguggugauggag

SEQ ID NO: 87999 - RNA, 47 nt, Mus musculus
ccuccaucaccacgacuuccaacaggaccaggugggccauuaggacc

SEQ ID NO: 88000 - RNA, 46 nt, Mus musculus
aaucccuuccuuuccagcagcaccaggggggccaggggggccagca

SEQ ID NO: 88001 - RNA, 77 nt, Mus musculus
cgugguccccguggcgaccaagguccaguuggccgaacuggagaaacaggugcaucuggacccccuggauuuguugg

SEQ ID NO: 88002 - RNA, 45 nt, Mus musculus
ggggguccagaugcaccuguuucuccaguucggccaacuggaccu

SEQ ID NO: 88003 - RNA, 41 nt, Mus musculus
gugcucccgguauucugggucucccuggcucuagaggugaa

SEQ ID NO: 88004 - RNA, 46 nt, Mus musculus
gcaauaccuggcagaccacguucaccucuagagccagggagaccca

SEQ ID NO: 88005 - RNA, 86 nt, Mus musculus
gguccucugggcaucucaggcccuccuggugcccguggucccccuggugcugugggcagcccuggaguuaauggugccccugguga

SEQ ID NO: 88006 - RNA, 77 nt, Mus musculus
gcuucaccaggggcaccauuaacuccagggcugcccacagcaccagggggaccacgggcaccaggagggccugagau

SEQ ID NO: 88007 - RNA, 46 nt, Mus musculus
cccuggcagcgauggucccccaggucgugauggucagccuggacac

SEQ ID NO: 88008 - RNA, 46 nt, Mus musculus
cugcaggugccccugguccucacgguucuguggguccugcugggaa

SEQ ID NO: 88009 - RNA, 45 nt, Mus musculus
uacagguucaccucgguuuccauguuucccagcaggacccacaga

SEQ ID NO: 88010 - RNA, 94 nt, Mus musculus
auaggguccucaaggcauccgaggugacaaaggagaaccuggugauaaagggcacaggggucuuccuggcuuaaaaggauacaguggauugcag

SEQ ID NO: 88011 - RNA, 45 nt, Mus musculus
cugcaauccacuguauccuuuuaagccaggaagaccccugugccc

SEQ ID NO: 88012 - RNA, 47 nt, Mus musculus
uaggguccugcugggccuucuggacccguuggcaaagaugguagauc

SEQ ID NO: 88013 - RNA, 47 nt, Mus musculus
agaaccacgaacaccagcaggcccgacugggccagguugcccagauc

SEQ ID NO: 88014 - RNA, 66 nt, Mus musculus
ucaaaaccaaagucauagccaccuccgcugacaccaggaggaccaggagguccagggggaccaggg

SEQ ID NO: 88015 - RNA, 87 nt, Mus musculus
uucuacagggcugaccagccucgcucccagccuucacucagacccaaggacuaugaaguugaugcaacucugaaaucucucaauaac

SEQ ID NO: 88016 - RNA, 68 nt, Mus musculus
caacuucauaguccuugggucugagugaaggcugggagcgaggcuggucagcccuguagaagucuccu

SEQ ID NO: 88017 - RNA, 64 nt, Mus musculus
cucacuccugaaggcucuagaaagaacccugcucgcacgugccgggacuuaagacucagccacc

SEQ ID NO: 88018 - RNA, 49 nt, Mus musculus
gcuguuccacucuggguggcugagucuuaagucccggcacgugcgagca

SEQ ID NO: 88019 - RNA, 75 nt, Mus musculus
ggguguuuacagguugggccuggaugcagguuucaccaguagagaaaucacaguacacuuugauggcauccauag

SEQ ID NO: 88020 - RNA, 87 nt, Mus musculus
acccuaaccaaggauguacuauggaugccaucaaaguguacugugauuucucuacuggugaaaccugcauccaggcccaaccuguaa

SEQ ID NO: 88021 - RNA, 63 nt, Mus musculus
acaccccagcgaagaacucauacagccgcgcccaggccaacaagcaugucugguuaggagaga

SEQ ID NO: 88022 - RNA, 81 nt, Mus musculus
ccugcuagccaaccgugcuucucagaacaucaccuaccacugcaagaacagcauugcguaccuggaugaggagacgggcag

SEQ ID NO: 88023 - RNA, 49 nt, Mus musculus
guugcugagggcaacagcagguucaccuacucuguccuagucgauggcu

SEQ ID NO: 88024 - RNA, 44 nt, Mus musculus
caagacaaucauugaauacaaaacaaauaagccaucucgccugc

SEQ ID NO: 88025 - RNA, 45 nt, Mus musculus
caccaccaauguccagaggugcaaugucaaggaacggcaggcgag

SEQ ID NO: 88026 - RNA, 47 nt, Mus musculus
caaauaagugaacucaaccuaaauuaaaaaccaaaaaccccugaaaa

SEQ ID NO: 88027 - RNA, 74 nt, Mus musculus
gugugcaauaugauccaacuaagucuccucccuuggccccuccccaaaauguuugcaguguuauuuuugugggu

SEQ ID NO: 88028 - RNA, 73 nt, Mus musculus
uuuuuuuuaacacccugacaccuguuguggacauugucaaccuuuguaagaaaacccaaauaaaaauugaaaa

SEQ ID NO: 88029 - RNA, 45 nt, Mus musculus
cuaauuaguaguauuucagauacuugaagaauaugaacggugcug

SEQ ID NO: 88030 - RNA, 46 nt, Mus musculus
cacaucaauguggaggauuguuucuucuguaauucuuccagcaccg

SEQ ID NO: 88031 - RNA, 55 nt, Mus musculus
ucucuucauuagauucagcauucauucuuuaacagccucauuuuccuucuugccc

SEQ ID NO: 88032 - RNA, 36 nt, Mus musculus
agaaaaauugaauuguaccuauuuuguauaugugag

SEQ ID NO: 88033 - RNA, 42 nt, Mus musculus
aagucucugcaugcccuugaugucucuaacauuccaugucug

SEQ ID NO: 88034 - RNA, 45 nt, Mus musculus
uccaacuugaguuggugugugucgaagaauccugaccaacuacga

SEQ ID NO: 88035 - RNA, 67 nt, Mus musculus
gaccgggccgucgcgggaccccucauccuucguggcaucgcagaggaauccucguguggugaguaug

SEQ ID NO: 88036 - RNA, 42 nt, Mus musculus
uuuuacaucgggagcugcgggagauaaaaguagcgcccccca

SEQ ID NO: 88037 - RNA, 48 nt, Mus musculus
ccugcuuauggcaguggaguggaggggugcuggauuuuggagauggcg

SEQ ID NO: 88038 - RNA, 87 nt, Mus musculus
cccaagugcugacgccuuagagccagccuaccugguccccacccccaaggcccgccuccucugagguggccugccuagcccccgccc

SEQ ID NO: 88039 - RNA, 46 nt, Mus musculus
ucuuaggaguuuucaggggcuuuagugucauggcuuggcuucugag

SEQ ID NO: 88040 - RNA, 46 nt, Mus musculus
cccacacccaguccagcccuuuaagagggguuuugaggagccccaa

SEQ ID NO: 88041 - RNA, 50 nt, Mus musculus
ucccccucccccuccucccaacaacaacaacaacaacaacaccccaaaga

SEQ ID NO: 88042 - RNA, 44 nt, Mus musculus
acagagcuacagucugcuggaucauuuagaugacuuugaugaug

SEQ ID NO: 88043 - RNA, 46 nt, Mus musculus
gcagcagccccuaucccaaacuuuuucuccgaugaugacugccuug

SEQ ID NO: 88044 - RNA, 47 nt, Mus musculus
gaagcaugucuuugaagacccucagagacgugaagcugccaaacgca

SEQ ID NO: 88045 - RNA, 49 nt, Mus musculus
ccgauccuucacccagagccuuggugaugccuccaaacagccagaccga

SEQ ID NO: 88046 - RNA, 46 nt, Mus musculus
aaacuccccggccccgcuguagggggaccuucagcgacagggccag

SEQ ID NO: 88047 - RNA, 62 nt, Mus musculus
uaggaauucguuggcugagcacgcaugacccucacauuaccuggaguacccgcuccauuguc

SEQ ID NO: 88048 - RNA, 77 nt, Mus musculus
uucaacucugauuacugccgacuucgcugccggauguuugcacagauaccuucuaacuuacuguuuacagugccaca

SEQ ID NO: 88049 - RNA, 46 nt, Mus musculus
augcaucagcaucugcaucagcaucugcaucaguuucugcauccag

SEQ ID NO: 88050 - RNA, 46 nt, Mus musculus
uuuguauuaccaucuguauccgguuaugcaccaccaucugccucca

SEQ ID NO: 88051 - RNA, 45 nt, Mus musculus
ugcauaaccauaugaauccggauccacaucaccauccucauccag

SEQ ID NO: 88052 - RNA, 92 nt, Mus musculus
ccauauggauccacaccugcaucagcaccagcauccgcagccgcagccgcauccacaacagcauccuaaccauccucagcagccaccauucu

SEQ ID NO: 88053 - RNA, 122 nt, Mus musculus
gagacccugcacaccuggcaagcuauggugaauuuguccaaguuccuggcuacccauauccagccuauguuuacuauacaagcccgcauaugaugacugcgugguacccaguaggacgagau

SEQ ID NO: 88054 - RNA, 119 nt, Mus musculus
guacauggacgaauaaucguugugccuguuguaaucaccuggucucaaaauacgaaccgccagccuccggugccccaguauccuccuccgcagccaccuccaccaccaccaccaccucc

SEQ ID NO: 88055 - RNA, 42 nt, Mus musculus
agcucaagucaguuuucgucuugacugccacuuuauaaguug

SEQ ID NO: 88056 - RNA, 57 nt, Mus musculus
caaacacaggccaugcugauuucuuacagagggagagaagaggaagagaagaagaaa

SEQ ID NO: 88057 - RNA, 46 nt, Mus musculus
aaggagcagcaacucgacugguucucugcuacaugaaacaccucag

SEQ ID NO: 88058 - RNA, 46 nt, Mus musculus
caaaucauguguacccaagaacucugacauagcaucuuaccaucau

SEQ ID NO: 88059 - RNA, 43 nt, Mus musculus
guagaaaguuguaaccaccucucagucaugcaagaggguacau

SEQ ID NO: 88060 - RNA, 45 nt, Mus musculus
ugugaguuaguucauuguaaccaacuugucaggaacuucagcaag

SEQ ID NO: 88061 - RNA, 63 nt, Mus musculus
ggaaaugauuuugcacccagauccacacuccucucaugucagauauuuggaauuagagcaccg

SEQ ID NO: 88062 - RNA, 46 nt, Mus musculus
agacuccauuuugcugcuaugcaaggagaugaaagaggcaggccua

SEQ ID NO: 88063 - RNA, 46 nt, Mus musculus
cugagucaaggagguggugcuggugugaguucacagcucacagggg

SEQ ID NO: 88064 - RNA, 46 nt, Mus musculus
gcccaaauuugaauuccuuauuaauucaaagugaaggaagugugag

SEQ ID NO: 88065 - RNA, 46 nt, Mus musculus
gaugggaauggauuguuuuugcuuguuucagaauuuugcuguugag

SEQ ID NO: 88066 - RNA, 44 nt, Mus musculus
guaaucuuagguggguggguaauuuaggaaauuaaguuaggaua

SEQ ID NO: 88067 - RNA, 45 nt, Mus musculus
aggauaaguuagauaaauuaggauaaguuagauaaguuaggauaa

SEQ ID NO: 88068 - RNA, 46 nt, Mus musculus
uaauacaggcucugggaauuaacucaagggauuuuaggaaugccag

SEQ ID NO: 88069 - RNA, 32 nt, Mus musculus
ucuuuccauaccccucccccucccuaccccac

SEQ ID NO: 88070 - RNA, 46 nt, Mus musculus
cuucccccucccuaacacaccccuucuuccuuucccccuccaaccc

SEQ ID NO: 88071 - RNA, 45 nt, Mus musculus
gacaaagagaggaagagaaagaaauggauaaacucaaccagagau

SEQ ID NO: 88072 - RNA, 46 nt, Mus musculus
cuuaaucauugaguucuaaguuacaguuaaauagagugaaggagau

SEQ ID NO: 88073 - RNA, 46 nt, Mus musculus
ccagaagccugaacagacaguugcuuuggcauugagaaaaacagaa

SEQ ID NO: 88074 - RNA, 40 nt, Mus musculus
cuacauuugccacacuagagcuucgagaguccugucaucc

SEQ ID NO: 88075 - RNA, 45 nt, Mus musculus
cuucaauacuuucauaggugaaccuugguagucagcuuugggagg

SEQ ID NO: 88076 - RNA, 46 nt, Mus musculus
gaauggcuuucccaacgggagacgucaacaacuucgugguuggcag

SEQ ID NO: 88077 - RNA, 45 nt, Mus musculus
uuguguaugguuguuuucaccauaugcagagaugagagcuguugu

SEQ ID NO: 88078 - RNA, 34 nt, Mus musculus
acagaaaaaaaaagugcaguggccuagagaacaa

SEQ ID NO: 88079 - RNA, 45 nt, Mus musculus
agauauaguagcagucagaaagcagugacaguuguaguugcaggg

SEQ ID NO: 88080 - RNA, 46 nt, Mus musculus
uauuuucuauacugcugccagugauuugcucaaaauaagccauuug

SEQ ID NO: 88081 - RNA, 55 nt, Mus musculus
gaugcuuguccauguugauguuacagaaguacggguaaaggaagaaaacaaaauc

SEQ ID NO: 88082 - RNA, 46 nt, Mus musculus
agggagcgagcaucuggaaagccaucgaggaucaaagaauggguag

SEQ ID NO: 88083 - RNA, 28 nt, Mus musculus
gugaaagacaguuacaaccgccucaaga

SEQ ID NO: 88084 - RNA, 24 nt, Mus musculus
gccucuccucaacagugccggguc

SEQ ID NO: 88085 - RNA, 47 nt, Mus musculus
uucuuccagguccaggacgacuaccuugaucucuuuggagaccccaa

SEQ ID NO: 88086 - RNA, 46 nt, Mus musculus
uugguagauacacugaaaagagguacaaaucgauugucaaguacaa

SEQ ID NO: 88087 - RNA, 44 nt, Mus musculus
cucccugcaguagaacuucagcaaacgauagauggaggcuucca

SEQ ID NO: 88088 - RNA, 28 nt, Mus musculus
ucugauaccagcagaucugucccgggcg

SEQ ID NO: 88089 - RNA, 45 nt, Mus musculus
ugcugagagucuucagcgggcccugacagugggcugguguguaga

SEQ ID NO: 88090 - RNA, 23 nt, Mus musculus
gagauucuuaguguggaguucug

SEQ ID NO: 88091 - RNA, 46 nt, Mus musculus
ucccuuugaagccuguuuucuaaugagagacagaaaggguguagau

SEQ ID NO: 88092 - RNA, 42 nt, Mus musculus
gagguaagggcugugcugcgaguggcucauguagggguaggc

SEQ ID NO: 88093 - RNA, 42 nt, Mus musculus
acggggccgcccgcaggagggggccggcggaggccccggcgu

SEQ ID NO: 88094 - RNA, 44 nt, Mus musculus
ccaagaacaaaggagcagccaaaguacuacugaaaacccagaga

SEQ ID NO: 88095 - RNA, 45 nt, Mus musculus
cagacucaaacuuccaucaacaauguauugcaaaggaaucuguag

SEQ ID NO: 88096 - RNA, 41 nt, Mus musculus
ccugaaaggaguggaagagucgguguaugaagcugcugcca

SEQ ID NO: 88097 - RNA, 42 nt, Mus musculus
cuaauccagacuagaucucaccaacucagcacgcucacccag

SEQ ID NO: 88098 - RNA, 44 nt, Mus musculus
ugauccacuuaggcauccaauaaugagucagccaaucagcccgg

SEQ ID NO: 88099 - RNA, 45 nt, Mus musculus
cuucaauacucccaaaacuaaggaaggcuacuucuaccgucagau

SEQ ID NO: 88100 - RNA, 46 nt, Mus musculus
ugggaguauugaagggaaacuucugggaggcugcagacaucaucuc

SEQ ID NO: 88101 - RNA, 46 nt, Mus musculus
gaaauguuuuauguuccuacuuuaucuuauagguugaugaugagau

SEQ ID NO: 88102 - RNA, 96 nt, Mus musculus
caucuccugagagagacuuuugaggacugcaaccugcuacccaaagagauucucuggcgacccaaagaagccuucagugaugggaucaccucaguc

SEQ ID NO: 88103 - RNA, 45 nt, Mus musculus
cuggaucaucgguuuucuuccuauuaccugucucugccgccagau

SEQ ID NO: 88104 - RNA, 46 nt, Mus musculus
ugcugaaggaacucuaccuguuugauguucuccgggccgaccgcac

SEQ ID NO: 88105 - RNA, 82 nt, Mus musculus
ggaagaacacagacagcguggugaucuucuccggagaggggucagaugaacuuacacagggcuauauauauuuccacaaggu

SEQ ID NO: 88106 - RNA, 46 nt, Mus musculus
gucuccugaagcaucauaguuaaauacucacacguauagcacaucu

SEQ ID NO: 88107 - RNA, 66 nt, Mus musculus
aagaccauuuaaaagcgcccugaauuucuuucgacuggaggaagugcuuaaugaauauaaucagau

SEQ ID NO: 88108 - RNA, 48 nt, Mus musculus
aucaugaaguccuuuuuaacucugaagaaggcauucaggcccuggaug

SEQ ID NO: 88109 - RNA, 45 nt, Mus musculus
aaaaaggacuucaugaugcucgcuuccaauauaauuugccaccug

SEQ ID NO: 88110 - RNA, 98 nt, Mus musculus
gggauaccaugcuggauauaaaauuaggcauuucaguacaguacaagggagaugauggucaaaagggagaaaugaggcagguuaaguaaaauaggaga

SEQ ID NO: 88111 - RNA, 83 nt, Mus musculus
augccguguguggaagauggcgugcugcucuguaaagaccuagaaugacugagagaagccucgaggagaauuccaauucgaca

SEQ ID NO: 88112 - RNA, 66 nt, Mus musculus
ccgcuagaaagguacagcacaaccugcccaucguauagacucagaacuuagcccaauuguuaggac

SEQ ID NO: 88113 - RNA, 46 nt, Mus musculus
ucuauacgaugggcagguugugcuguaccuuucuagcggccaggag

SEQ ID NO: 88114 - RNA, 100 nt, Mus musculus
uugguugcugccucucugcugaagcaacucaaggaggcccaaguucaguauccucuccagacauuugcuauuggcauggaggacagccccgaucuccugg

SEQ ID NO: 88115 - RNA, 46 nt, Mus musculus
uguuuauaaaacucagagaucuucauagucaaaugccaauccagau

SEQ ID NO: 88116 - RNA, 89 nt, Mus musculus
uaggguuagagcuuguugguccucauccccuagacuccuguguauugaucuuuuaagccaguuuagaugcaguugccauuguaagggga

SEQ ID NO: 88117 - RNA, 114 nt, Mus musculus
uuacugguguuuaaaugaaaugauuuguagcuggcacugagcuuugaauguuaaaggccuacuauauaguuucauguuucauuuucuauagacguguuuauaaacugcauuugu

SEQ ID NO: 88118 - RNA, 47 nt, Mus musculus
cguauccuuuuugacaacgcuaucaagaaacgcuugaugacagaccg

SEQ ID NO: 88119 - RNA, 31 nt, Mus musculus
ugccucaucucagucagcuuagccucagcuu

SEQ ID NO: 88120 - RNA, 70 nt, Mus musculus
aauaccaucacuguacggaugaaccauugcaugccaucuaugacagcguggagaaacucuucccagguga

SEQ ID NO: 88121 - RNA, 65 nt, Mus musculus
uccuggacacuaugaaguuuuggauuuaaaaccaaauggcaaaguugcgucuguggaaaugguca

SEQ ID NO: 88122 - RNA, 47 nt, Mus musculus
caacuuugccauuugguuuuaaauccaaaacuucauaguguccagga

SEQ ID NO: 88123 - RNA, 46 nt, Mus musculus
aauaauggaguuuaacuauuuuugguuuguguuucuuccuggauca

SEQ ID NO: 88124 - RNA, 49 nt, Mus musculus
cagagacaccuauggagucaggcccuuguuuaaagccaugacagaagau

SEQ ID NO: 88125 - RNA, 44 nt, Mus musculus
gcaacguuuugaauuugaauaucagaccaauguggauggugaga

SEQ ID NO: 88126 - RNA, 46 nt, Mus musculus
acauuuacaugggaagucauccuuucuuuaggaccccagccccaag

SEQ ID NO: 88127 - RNA, 46 nt, Mus musculus
acugcagaacacucacacauaaaaucaauaaaguaaacagaggggu

SEQ ID NO: 88128 - RNA, 44 nt, Mus musculus
uuauuuucaaaugcuguagggugcucccacccagagggguagau

SEQ ID NO: 88129 - RNA, 46 nt, Mus musculus
ugugcagcacagaagcguccauuccagaguuagaguuaguacucgg

SEQ ID NO: 88130 - RNA, 47 nt, Mus musculus
uuuguuuuuauuuuuuuggugugugugugugugugugugugugugug

SEQ ID NO: 88131 - RNA, 46 nt, Mus musculus
aucuaauaucaaguucauaguuaagcuucuccaaaugucccuagaa

SEQ ID NO: 88132 - RNA, 46 nt, Mus musculus
cacacuuaguaggagccaaauuguagaaagguggccggaggcacug

SEQ ID NO: 88133 - RNA, 40 nt, Mus musculus
cuuagaggggagagauaguccugcaauguugagaggaggu

SEQ ID NO: 88134 - RNA, 46 nt, Mus musculus
uuaaacugagaccugauagacagagaauacuugccaagccccggac

SEQ ID NO: 88135 - RNA, 42 nt, Mus musculus
uggcugugguugacccgcuguuuggaaugcagccgauaagag

SEQ ID NO: 88136 - RNA, 48 nt, Mus musculus
gaugaagaucgcgcacagggggccagaugcauuucgcuuugagaaugu

SEQ ID NO: 88137 - RNA, 46 nt, Mus musculus
cuucucuguuauugacacauggucucauacaguacaggauggccuu

SEQ ID NO: 88138 - RNA, 45 nt, Mus musculus
cccccccuccaguguuguuucuaacuaaccaaugcggcuuugaga

SEQ ID NO: 88139 - RNA, 46 nt, Mus musculus
cuuugaccccaggguugagaaccgcugcuauaguacacaugcagag

SEQ ID NO: 88140 - RNA, 46 nt, Mus musculus
cugugaguucucagccuucccgaugcugccgcccuuuaauacagaa

SEQ ID NO: 88141 - RNA, 46 nt, Mus musculus
uaaaauacaguaaggugagauaaaagggaaaccaucauauugaggu

SEQ ID NO: 88142 - RNA, 41 nt, Mus musculus
ucccgggacaugugcccgcgcggacagcacauccuccggcc

SEQ ID NO: 88143 - RNA, 49 nt, Mus musculus
accagugacgaaaccccccaagaucuauucagagauugaagaacccccu

SEQ ID NO: 88144 - RNA, 45 nt, Mus musculus
auguccgagaugaggcugggcgcccuguccaaacuccagcugaga

SEQ ID NO: 88145 - RNA, 42 nt, Mus musculus
agagauguaguuagagaggcagagaaaguguaucauaagaga

SEQ ID NO: 88146 - RNA, 45 nt, Mus musculus
uuugacuaggauccuggccgcaguaggagaaagagauaauagaag

SEQ ID NO: 88147 - RNA, 46 nt, Mus musculus
guccgaaaaaaaaaacaagagguaaaggugcuuucucuuggagaaa

SEQ ID NO: 88148 - RNA, 46 nt, Mus musculus
gaugagagauuauuguucacuaucagauuaaaaauagagacccccu

SEQ ID NO: 88149 - RNA, 25 nt, Mus musculus
ggcgggcgagcggccacccucgcgc

SEQ ID NO: 88150 - RNA, 43 nt, Mus musculus
aaaguucucuugacuggggauggaaugcuuugcuuuaaggugg

SEQ ID NO: 88151 - RNA, 49 nt, Mus musculus
gcagcagagaccagcaagacccuggugugugaaaggagacagcagaguc

SEQ ID NO: 88152 - RNA, 58 nt, Mus musculus
caggucauuuuaagguuugggcuuuuuaaaaugaggcuaggcagguuguagaggcguu

SEQ ID NO: 88153 - RNA, 35 nt, Mus musculus
uacuagcagaaauagccagaagaaagaagggugcg

SEQ ID NO: 88154 - RNA, 46 nt, Mus musculus
caauugcucuccauguuuugagcuggucucucacuaaaccgggaag

SEQ ID NO: 88155 - RNA, 46 nt, Mus musculus
gugugucucaggaguuuaccguugacacggaagcagcauagaguag

SEQ ID NO: 88156 - RNA, 45 nt, Mus musculus
uugagucuaugugacuuugaaucuuagagaguucugagaaggucc

SEQ ID NO: 88157 - RNA, 44 nt, Mus musculus
gggugucagaaggcuaaacaucuggccugguguuuggagaccuc

SEQ ID NO: 88158 - RNA, 44 nt, Mus musculus
acuacccuauaaacaagucccauucuaccuccccauagccccug

SEQ ID NO: 88159 - RNA, 46 nt, Mus musculus
uuugggcugcuaaacuuaauacuauuuucacuacuuaagaccucuc

SEQ ID NO: 88160 - RNA, 42 nt, Mus musculus
aguguuguaguucuuaaugucgauaauuuccaaacagaggug

SEQ ID NO: 88161 - RNA, 45 nt, Mus musculus
agaugauaucagccuuucaaaaccaacuagaagucauuuccgcca

SEQ ID NO: 88162 - RNA, 24 nt, Mus musculus
gguauguggugugugaauaugggu

SEQ ID NO: 88163 - RNA, 46 nt, Mus musculus
gccagaagauuuaagcugacauagaagcacugucuuguaagaaaga

SEQ ID NO: 88164 - RNA, 45 nt, Mus musculus
gaaaggaacucucaagaaaaaguacuucuuggcaucuucacucag

SEQ ID NO: 88165 - RNA, 45 nt, Mus musculus
ugaacacugaggauccuaguuuccguauuguuggaucccagggaa

SEQ ID NO: 88166 - RNA, 46 nt, Mus musculus
ccugcuuuuguggaaaagagggcauguaguuaugaaguugggacaa

SEQ ID NO: 88167 - RNA, 42 nt, Mus musculus
acaaugggaggugguaugugagucugaacugcuaggccugag

SEQ ID NO: 88168 - RNA, 47 nt, Mus musculus
aaagcuacgugggcccagcguuguaauaaaguguuauuuaugaguuc

SEQ ID NO: 88169 - RNA, 46 nt, Mus musculus
cuuugggcgaagauuuaagcccuaugugaagcagggauacaugagc

SEQ ID NO: 88170 - RNA, 46 nt, Mus musculus
agcucugggaaggugcauggaaauuauaaauguagaagcuggagau

SEQ ID NO: 88171 - RNA, 66 nt, Mus musculus
auccauuuguaccagaacaccacuuaaucaaagguuaucuaccaaaaacauuuugguacuggaauu

SEQ ID NO: 88172 - RNA, 46 nt, Mus musculus
auaacccaagcuuuuuuauguauguacugacaguguaacacagcag

SEQ ID NO: 88173 - RNA, 63 nt, Mus musculus
guucugauauugcaguuucuuuucacuauguugaugggacaacuauguaugaauuagaauacc

SEQ ID NO: 88174 - RNA, 51 nt, Mus musculus
aaccugccuuaccugagaauauacugaaagaaauuaaucaaguaaacagaa

SEQ ID NO: 88175 - RNA, 46 nt, Mus musculus
uuaaagcacuuuuaaaauuaauuuuuaugucugauguggcagguaa

SEQ ID NO: 88176 - RNA, 46 nt, Mus musculus
cacggcaguguuugcugacugguuguuuucugaguuguuucuugag

SEQ ID NO: 88177 - RNA, 46 nt, Mus musculus
auuaagucagaaaaaauguauuuuuaaauguuuuuuaaagugccuu

SEQ ID NO: 88178 - RNA, 41 nt, Mus musculus
aucuaaggaugaucauucuagcuguauacaccaauccagga

SEQ ID NO: 88179 - RNA, 46 nt, Mus musculus
uuagauuguaaggaagaagaaacuaugcaauucaaaaagagccaaa

SEQ ID NO: 88180 - RNA, 48 nt, Mus musculus
aucuuucagaguaaaaugguaaauggaaauaaucaacaaggacaaacg

SEQ ID NO: 88181 - RNA, 45 nt, Mus musculus
aacaguccuucacgucuuggaaucuagucaagagucagugcugaa

SEQ ID NO: 88182 - RNA, 42 nt, Mus musculus
gacccuguccugcggcccgcacgcaccggagcaucccgggac

SEQ ID NO: 88183 - RNA, 111 nt, Mus musculus
ucucuuucucacuuaccuuugcauucaaauaaagaagauggcuaugauggcguuacaucgacagacaauaugagaaauggauugguuagcagugaagugcacaacgaagac

SEQ ID NO: 88184 - RNA, 46 nt, Mus musculus
aaguugcuuccaccucaauauuucuaaaagaaaaucuauaguguau

SEQ ID NO: 88185 - RNA, 43 nt, Mus musculus
uugugaacucuggaacagggcagcguuggagggacaggagcag

SEQ ID NO: 88186 - RNA, 45 nt, Mus musculus
cuuaauaagaucugacgcccucuucugaugugucugaagacagcu

SEQ ID NO: 88187 - RNA, 45 nt, Mus musculus
cuaaaucaaacucuugaggcagagcaacugugaaauagagggcag

SEQ ID NO: 88188 - RNA, 46 nt, Mus musculus
aacugguggcauugauuccauauagugaucagcgguuacggccaag

SEQ ID NO: 88189 - RNA, 86 nt, Mus musculus
acuggagggauuagagguagguggguuuucagugaccugguuagagagagaggggaaagcaggaggaaggacaagagagagagaaa

SEQ ID NO: 88190 - RNA, 46 nt, Mus musculus
aacaaacaaacagugugcucauauaaauaaauaaauaaacaaacaa

SEQ ID NO: 88191 - RNA, 87 nt, Mus musculus
guugaaaacaucacugcucaaguccaguuuucaaaaaccgugauuggaaaggcucguuuaaacaacauaacuaacauuggcccacuu

SEQ ID NO: 88192 - RNA, 46 nt, Mus musculus
ccauaauuguguguauguaugugugugugugugugugugugugugu

SEQ ID NO: 88193 - RNA, 46 nt, Mus musculus
ucccauucuuacaugguagucuuucaacuauaugauaacuuagcua

SEQ ID NO: 88194 - RNA, 46 nt, Mus musculus
agcuaaugguugcauaauauuuaccaaccauaccauucggccacau

SEQ ID NO: 88195 - RNA, 46 nt, Mus musculus
uucuaaugucuagcuuuaauaaugccugagucauuugaaaacccag

SEQ ID NO: 88196 - RNA, 46 nt, Mus musculus
uugugcuuuucuuaggucugguuuagcuaggucugacuucgggcag

SEQ ID NO: 88197 - RNA, 46 nt, Mus musculus
ugcucuucugucugcuuuucuuauguaauuucucaacaggacacug

SEQ ID NO: 88198 - RNA, 46 nt, Mus musculus
acauuuuuggugugaauuauuuauaaguaagauuauuacauuugag

SEQ ID NO: 88199 - RNA, 45 nt, Mus musculus
agcgaccuccauuauguuacaucuguuaaauucauuauuuguaca

SEQ ID NO: 88200 - RNA, 39 nt, Mus musculus
uuaaaaaaugaaucuuguuuuacaacuagaaauacagau

SEQ ID NO: 88201 - RNA, 46 nt, Mus musculus
ccaauuauccuuacauucuagauuuucaucuuugaaagagggaggu

SEQ ID NO: 88202 - RNA, 46 nt, Mus musculus
guaugguuguaauuuguaaacuuuaauucaguguuuuguuggagua

SEQ ID NO: 88203 - RNA, 80 nt, Mus musculus
aguguguuuuaagagaacuaccaguuuacuuaguaggagauucuuucaugugugugauucauauagguuuggccccagga

SEQ ID NO: 88204 - RNA, 45 nt, Mus musculus
cacaggacaaggcuuuaaacuugucaaaucuuaauguggacauca

SEQ ID NO: 88205 - RNA, 46 nt, Mus musculus
augggugaaagaagugagaaagauuaaugaccaguauguugcaguu

SEQ ID NO: 88206 - RNA, 44 nt, Mus musculus
cuucuagggguagcuggccucggggagguggauggggcaaagga

SEQ ID NO: 88207 - RNA, 41 nt, Mus musculus
gucacugccaacugucuugauuuaguagugagcagcagacu

SEQ ID NO: 88208 - RNA, 46 nt, Mus musculus
aaacugaaagcuuuccuugaacuucggacaguggauggaccuagac

SEQ ID NO: 88209 - RNA, 46 nt, Mus musculus
uucaaagaagucugucaguacagcgcaacuucacuucuagcaagac

SEQ ID NO: 88210 - RNA, 46 nt, Mus musculus
guauucugugaaguguaacuauacuuagagcaaaaaagaagaggag

SEQ ID NO: 88211 - RNA, 46 nt, Mus musculus
aaaguguauaucaaccacagggcagauaacaauagccuugacagaa

SEQ ID NO: 88212 - RNA, 46 nt, Mus musculus
cuugacauuuauuuuaguggacuuucaguaacugagagguggaaac

SEQ ID NO: 88213 - RNA, 46 nt, Mus musculus
aggaucaacuuacuuguggccauauguuuaggccuuuauguaagau

SEQ ID NO: 88214 - RNA, 52 nt, Mus musculus
gaaguuaauuuuugugccucuugggacccuccagugccagauuacaugugca

SEQ ID NO: 88215 - RNA, 62 nt, Mus musculus
cuguguguguguguucauacacagcucagugagugcaugugcaauggcauucuuguagaggg

SEQ ID NO: 88216 - RNA, 44 nt, Mus musculus
ucaagaacgugugaggauuaacucaugggucaagaagugugggg

SEQ ID NO: 88217 - RNA, 82 nt, Mus musculus
aaaaaaggaacauguuuaagaaugaggucauugucaccaaaauuuagguggugauuuuuuggcggauaagaaguaguagaaa

SEQ ID NO: 88218 - RNA, 63 nt, Mus musculus
ugagggguggaaagccaauagagaauuuugcauaguggagcauaacacgauaaaauucggguc

SEQ ID NO: 88219 - RNA, 42 nt, Mus musculus
auuucuguaguucauaauugaaguguaguuggaauaaaagug

SEQ ID NO: 88220 - RNA, 45 nt, Mus musculus
gaguauaggguauuagcaauuucuccaagugaagugugugugugu

SEQ ID NO: 88221 - RNA, 46 nt, Mus musculus
uucucuguguaguucuggaacuuuugcacuauagaacaggcuggcc

SEQ ID NO: 88222 - RNA, 45 nt, Mus musculus
agcuuagauucuuccaggucaaauuucacugcuggagggggcugg

SEQ ID NO: 88223 - RNA, 46 nt, Mus musculus
auuucaaauguccuccucauucaacucuuacaaggacaagccaaag

SEQ ID NO: 88224 - RNA, 45 nt, Mus musculus
uuccccuauauuggggcauagaaucuucauaggacaaagggccuc

SEQ ID NO: 88225 - RNA, 46 nt, Mus musculus
ggagcucaggguucuaguagaaucguugggauuaggauugagggag

SEQ ID NO: 88226 - RNA, 45 nt, Mus musculus
aaagaauaaauaaaauaaaauggcucaagaaugugaagcaacaag

SEQ ID NO: 88227 - RNA, 78 nt, Mus musculus
aaacaaaauaaucauggaagguagagggugggagggacuugggaggaagagaggaaggggagagggaaaaaagcgggg

SEQ ID NO: 88228 - RNA, 46 nt, Mus musculus
acacuacaaaaugguagcaucaagaaauguacucaugggcaacuag

SEQ ID NO: 88229 - RNA, 45 nt, Mus musculus
uaguuuauaggugccagggcuguuucuauucccugacuacugaga

SEQ ID NO: 88230 - RNA, 46 nt, Mus musculus
caggguucucuguguagcccuggcuuuccuggaacucacucuguau

SEQ ID NO: 88231 - RNA, 46 nt, Mus musculus
cuuuuuuuugugaagagaauuagaaacacauaugagaaggaggcag

SEQ ID NO: 88232 - RNA, 41 nt, Mus musculus
cagauuuguaaaauugaacacacaaacacagggggcgggga

SEQ ID NO: 88233 - RNA, 42 nt, Mus musculus
agagcugacacccccuucuggugugucugaagacagcuacag

SEQ ID NO: 88234 - RNA, 45 nt, Mus musculus
uuuacaaaguugucuuugagagcaaugccagccccagcaucaaau

SEQ ID NO: 88235 - RNA, 45 nt, Mus musculus; identical to SEQ ID NO: 28197

SEQ ID NO: 88236 - RNA, 45 nt, Mus musculus
auuucuggaugucacugguccacgagccugccucauucagcccgg

SEQ ID NO: 88237 - RNA, 47 nt, Mus musculus
aauugcuguucuaaagucggggcaaaaccuaagacacauaguuaaau

SEQ ID NO: 88238 - RNA, 41 nt, Mus musculus
agaccauuaacuugauuuuggaugaaagccaugagcgggug

SEQ ID NO: 88239 - RNA, 46 nt, Mus musculus
gccauauguaucauagaauugugcacuuaacuuguuuuguagguag

SEQ ID NO: 88240 - RNA, 46 nt, Mus musculus
accuccuguggcuaacauuuaaguuuaaauacuaugaauagucaaa

SEQ ID NO: 88241 - RNA, 46 nt, Mus musculus
ccacuaccccauggagacuuuuguuugccucauauaaaugcugcag

SEQ ID NO: 88242 - RNA, 46 nt, Mus musculus
uuccacauguuuaagaagcaugaaacaagaugcuguaguuaaugag

SEQ ID NO: 88243 - RNA, 133 nt, Mus musculus
aagagacggauucugcacucgacuuggggaacauccgagcagagccucugaacuccguagcacacugagaccucaguguguagugagauguguguaaauccuguacagaagcgucuguccugagagugauguu

SEQ ID NO: 88244 - RNA, 47 nt, Mus musculus
uaccauuacuuuugguaauuuaauauuuaugggaaauuggcuguaaa

SEQ ID NO: 88245 - RNA, 46 nt, Mus musculus
acauuagcuaaguaaccaucugcuaccaaccaguggcauuugggag

SEQ ID NO: 88246 - RNA, 45 nt, Mus musculus
ugugguaggggagugguucuuuaaucccuagagagauccacagag

SEQ ID NO: 88247 - RNA, 45 nt, Mus musculus
cauacuuauugcuagcaaggaauccauccuguaacagggucauag

SEQ ID NO: 88248 - RNA, 46 nt, Mus musculus
ucagugaguucuuuaugaaugcaaagaagaauaaacccgaguggcg

SEQ ID NO: 88249 - RNA, 45 nt, Mus musculus
aaacuauuuuuccuuaggacuacuauaaagcuuuggaagaugcag

SEQ ID NO: 88250 - RNA, 46 nt, Mus musculus
uaggugugcuucucagauuguugucaugaugacaucaguaccauau

SEQ ID NO: 88251 - RNA, 46 nt, Mus musculus
aucucucuuacuggugcacaguacucuaaccaaaagcaacuuagag

SEQ ID NO: 88252 - RNA, 46 nt, Mus musculus
ucucagagacuccagcacugaagaaaguggcacccacaccccccag

SEQ ID NO: 88253 - RNA, 23 nt, Mus musculus
acacuuagacaggcacccaaaca

SEQ ID NO: 88254 - RNA, 42 nt, Mus musculus
cuuccaccucaucgccguggacugaucuuucacucacaagua

SEQ ID NO: 88255 - RNA, 46 nt, Mus musculus
gaugucccgguccucuggcacuuaaaaucuuuucacucacccccuc

SEQ ID NO: 88256 - RNA, 45 nt, Mus musculus
ccaaaucugaaaccauuugaaaucugaaacaccucugcagcccug

SEQ ID NO: 88257 - RNA, 49 nt, Mus musculus
gcauagcuguaucuugaggguuuuagcuaaaguuuaaucaucuggucaa

SEQ ID NO: 88258 - RNA, 45 nt, Mus musculus
aauaauauauuuaguaaaacaauuucaaguagagagaugggauga

SEQ ID NO: 88259 - RNA, 46 nt, Mus musculus
gagugguacgacugacccaacuauacacuucuucauguaggcccau

SEQ ID NO: 88260 - RNA, 46 nt, Mus musculus
ugcuuagcugauauuuaucaugugauaaaaucuuguuauuagugag

SEQ ID NO: 88261 - RNA, 43 nt, Mus musculus
ccaucaccauggcggcagcacaggccgugcaagcgacagcaca

SEQ ID NO: 88262 - RNA, 46 nt, Mus musculus
uuuacauauauugauguugucaauacaugucuacuuaagaugaaag

SEQ ID NO: 88263 - RNA, 54 nt, Mus musculus
ccuccucaucggcacucaugacaaccuuaacccagaaugccaguuccuccgcca

SEQ ID NO: 88264 - RNA, 46 nt, Mus musculus
ugugaguuuaaaggcagugcuuuucuacugaguauuuaugaaucag

SEQ ID NO: 88265 - RNA, 46 nt, Mus musculus
uguuucugcauccagauagagugcagcucacgcucaaggggguggg

SEQ ID NO: 88266 - RNA, 41 nt, Mus musculus
agugaaauguucaugcugcccuuugugggaugaggccacac

SEQ ID NO: 88267 - RNA, 89 nt, Mus musculus
acaggaauacuugacucucauagccuugauuuguaaaccaagaaauucuguuauuuauuucuaacuuugugauagcagcuguugccuaa

SEQ ID NO: 88268 - RNA, 46 nt, Mus musculus
ugcugggaaacccuaucauggaauaauguggcuuuuagggaggaga

SEQ ID NO: 88269 - RNA, 48 nt, Mus musculus
acaauaaggaaacgaacaaguacgagggauggccugaggugguggaga

SEQ ID NO: 88270 - RNA, 42 nt, Mus musculus
cagggucacacuaggcaugcucaaaugauccagccguaaaug

SEQ ID NO: 88271 - RNA, 42 nt, Mus musculus
ugcccuuucaggagggaggcaugcugguauuacagggccaug

SEQ ID NO: 88272 - RNA, 46 nt, Mus musculus
gccuugagacaggguuuccuacugcgcugaaaguuaacuaguugag

SEQ ID NO: 88273 - RNA, 46 nt, Mus musculus
uuuuagauuuaauuuuuaaaaucucuaugugcgugcaugccuggau

SEQ ID NO: 88274 - RNA, 47 nt, Mus musculus
gguuuugaggcucauggccauuuguuucaggaaaagcgagaccacag

SEQ ID NO: 88275 - RNA, 66 nt, Mus musculus
uuugcuuaaaauagaauagaacacaaaaggaacauggaaacagcucacagacuuuacauaggaaga

SEQ ID NO: 88276 - RNA, 52 nt, Mus musculus
cucgggcuguuuugcauugauuuaaacuuccuccugaaauaggaaauuaccc

SEQ ID NO: 88277 - RNA, 50 nt, Mus musculus
ugagaaauccugcugacccccaaaauaaaauuuuaaaagugugugugugu

SEQ ID NO: 88278 - RNA, 136 nt, Mus musculus
auuggaaaguuuucuauuuaucuuaaaagaagucuucucuaaaauaauugauucaggauaaaccuuugaaaauggauuauacuuuaguuaugguggaugugugaauaagcacacacauucuauggugugcauaugg

SEQ ID NO: 88279 - RNA, 41 nt, Mus musculus
aaggagacccuaugcaacauuaggaugucuuuaggcccccu

SEQ ID NO: 88280 - RNA, 46 nt, Mus musculus
ccuguucuccaccaccauguguacccagggaucaaagccaagucac

SEQ ID NO: 88281 - RNA, 45 nt, Mus musculus
gcguagaaaagcacaaagaggaaacaaguucccacaucccaucgc

SEQ ID NO: 88282 - RNA, 42 nt, Mus musculus
gaugugaggagugugugugugugugugugugugugugugugu

SEQ ID NO: 88283 - RNA, 45 nt, Mus musculus
ucagauguggcaccauucauugaguuuuugaagaccauacaagac

SEQ ID NO: 88284 - RNA, 46 nt, Mus musculus
aaauguuuggaauccuugcuguuggaaaagagagagagagagagaa

SEQ ID NO: 88285 - RNA, 45 nt, Mus musculus
acaggggaaguaauagacaccaaauuuuuugacauguggggagga

SEQ ID NO: 88286 - RNA, 45 nt, Mus musculus
guuuucauccuguccguguucuccucagagguucauugguguaga

SEQ ID NO: 88287 - RNA, 46 nt, Mus musculus
uugucuucucucccuuuaguuugaugaguggugugaagaauaaugu

SEQ ID NO: 88288 - RNA, 46 nt, Mus musculus
gugucagcagaggccagaggccuacaaucccccuggagguggaguu

SEQ ID NO: 88289 - RNA, 30 nt, Mus musculus
gaaagggucuguccuuuggcguuuugagaa

SEQ ID NO: 88290 - RNA, 45 nt, Mus musculus
uuuggagagacuuauagugauacugucugucccuuagcaggaagg

SEQ ID NO: 88291 - RNA, 48 nt, Mus musculus
uuucaugaucauuuuuuuuaaaguucuauuugaggggauuaguuggga

SEQ ID NO: 88292 - RNA, 46 nt, Mus musculus
gauuugaaaguguauaguguuuaugccuuucccuuaagggucauuc

SEQ ID NO: 88293 - RNA, 46 nt, Mus musculus
gcugucuggacagagguaaucacuauguuuguuauuuaucauagcu

SEQ ID NO: 88294 - RNA, 46 nt, Mus musculus
aaaaaaaugaauuuuauagcuauauaagaugagucagcugguggaa

SEQ ID NO: 88295 - RNA, 44 nt, Mus musculus
ucugaacaccccagacgggaggcacauguucacaggccauaagg

SEQ ID NO: 88296 - RNA, 45 nt, Mus musculus
aaucagcugcauuucaagaaucauucugccauucccacgagagau

SEQ ID NO: 88297 - RNA, 45 nt, Mus musculus
uaaacccuuucccaaagccaguuuuccaaccgcaguuacauaggu

SEQ ID NO: 88298 - RNA, 45 nt, Mus musculus
uaaauaagaggaggaaaguucucuuggaauaccucgcccacaguc

SEQ ID NO: 88299 - RNA, 25 nt, Mus musculus
acagugcggcauuuuucucccagcu

SEQ ID NO: 88300 - RNA, 42 nt, Mus musculus
cuguugaccacacaucucauacagaaaacauuugugccagag

SEQ ID NO: 88301 - RNA, 46 nt, Mus musculus
uccucuggaaaagcagccaguacuccuaaucgcugaacccccaccu

SEQ ID NO: 88302 - RNA, 45 nt, Mus musculus
uuaacuuccagaaugauuaaguaaaaucugccuugcugagcaaga

SEQ ID NO: 88303 - RNA, 78 nt, Mus musculus
gacuuaguucuggggguuaguuuucucauucgaaagagcgaaagcaucggaucugaucucuguaauuauaccaggaaa

SEQ ID NO: 88304 - RNA, 46 nt, Mus musculus
ccauugcaccuucacaucguuuuucuucuuaaagacagacugaggu

SEQ ID NO: 88305 - RNA, 45 nt, Mus musculus
cugauuuuaacaguacuccuuucuagaaauuuaaacaccugaguc

SEQ ID NO: 88306 - RNA, 67 nt, Mus musculus
uaucugaaacgcgaugaccaugucaguaaucaccaagaaguacuugacagagcuaacacauaggaaa

SEQ ID NO: 88307 - RNA, 47 nt, Mus musculus
gagaaauuaaacauacacuaaaaaauagaagcuagcuccaccaauca

SEQ ID NO: 88308 - RNA, 47 nt, Mus musculus
gucaagccugacuucuugaguucaauuccuaggacccacaugguaga

SEQ ID NO: 88309 - RNA, 51 nt, Mus musculus
ugucugcucauagucacccuuuagaagugaguggugcagccagccugagug

SEQ ID NO: 88310 - RNA, 47 nt, Mus musculus
uaagugaggacuaccuugcuuagcauaucuagauuuaguccccagca

SEQ ID NO: 88311 - RNA, 46 nt, Mus musculus
cuuuauaucauaguguuucagaaaaauaaaacagacauuuccagac

SEQ ID NO: 88312 - RNA, 44 nt, Mus musculus
cacucuguagaccaggcuggcccugaacucagaucugccucccu

SEQ ID NO: 88313 - RNA, 60 nt, Mus musculus
aaagguagcaaccaaaccugacaaaauaaaauauaguaagauaaaacaaaagucaucaua

SEQ ID NO: 88314 - RNA, 45 nt, Mus musculus
cacuugaguuuuugaucuauuaaccauucugaccaggcugugaug

SEQ ID NO: 88315 - RNA, 44 nt, Mus musculus
cuccauccuccuuuacccaacuugaucccuccuguucccauccc

SEQ ID NO: 88316 - RNA, 80 nt, Mus musculus
gaggcagcccaauacggggaaagggucccaaaggcaggguacagccccugcuucagcugucaggggucccagaugaagac

SEQ ID NO: 88317 - RNA, 91 nt, Mus musculus
aaagaaggggagaccuuccacagacaucaaacagccuuugcagaucaagucucagugagaccaggagcaacuucuucuauugaggcuagau

SEQ ID NO: 88318 - RNA, 45 nt, Mus musculus
gcaguuaguucuuuuaagugcugaccuaccuuccagccccagaau

SEQ ID NO: 88319 - RNA, 88 nt, Mus musculus
caugcuaugucucggacacagcacuuuucagcuucccaccccuuuaaauucucucugccuucucuucuccaagguugccugagcuuuc

SEQ ID NO: 88320 - RNA, 42 nt, Mus musculus
ucauacauguguaaaauguuuggauugugaaugcccgcauug

SEQ ID NO: 88321 - RNA, 46 nt, Mus musculus
ccuucuauguuauuucucaaguauuugaaauuaaaauggaugcaag

SEQ ID NO: 88322 - RNA, 103 nt, Mus musculus
cccuugacuugguggguaucaguagagucguuguaaccccaguaucauuaagaucuaggggaugacaauauagaaguguauucgccuucaugcuuuugccaga

SEQ ID NO: 88323 - RNA, 45 nt, Mus musculus
gcagcuaguaggugcucuaaaaggcaggaagcagacuuuggaggg

SEQ ID NO: 88324 - RNA, 46 nt, Mus musculus
ugauugccugaaggcuucuugagcuguuucacccaccaccucagau

SEQ ID NO: 88325 - RNA, 45 nt, Mus musculus
cacuuuuggagccaugaauuccuuaaguauccugucuugaauauu

SEQ ID NO: 88326 - RNA, 87 nt, Mus musculus
ccagaaaauugggccugguucccaggagucuuaccuugagaaucucuucuuuacucucagacccugauugugcacacacuuuggggc

SEQ ID NO: 88327 - RNA, 73 nt, Mus musculus
uagacaggucuuucuuauauaacagcccaauuuugaguuagaaaauuguauuaaauuggaccaaucuagggag

SEQ ID NO: 88328 - RNA, 64 nt, Mus musculus
guaauuguuuuuauggcuuguuucuuugauacagaaccaugcuguauugaaggagugggaagug

SEQ ID NO: 88329 - RNA, 77 nt, Mus musculus
guaaggccuagggcagcuagacuagccaacugguggugguggggggacugccuggccagacgguaauuguuuuuaug

SEQ ID NO: 88330 - RNA, 42 nt, Mus musculus
auaaagcauuuaguugggggcuugcuuacaguuucagagguc

SEQ ID NO: 88331 - RNA, 44 nt, Mus musculus
uccuaucauaggaauuggacucggggauuugauucgguguuaga

SEQ ID NO: 88332 - RNA, 41 nt, Mus musculus
cugggcgcggcugggcgcguggaggcaggagcggacggagc

SEQ ID NO: 88333 - RNA, 41 nt, Mus musculus
aagauggacccacuacggaacgaggaggagguccgggugaa

SEQ ID NO: 88334 - RNA, 45 nt, Mus musculus
ccuuggccuccccuucagcaguuuugaccacucuaaagcccacua

SEQ ID NO: 88335 - RNA, 84 nt, Mus musculus
uggaucaguuuggcucaguuugaguucucuucugggaaagaaggaaguguggcgaaaugcagacagauuuaucaagaagccaac

SEQ ID NO: 88336 - RNA, 46 nt, Mus musculus
uaugccagagcuacuuuggaaauccuauauugauuuugagauggag

SEQ ID NO: 88337 - RNA, 46 nt, Mus musculus
uacgcccaguuugaaauacgacagaagaaucugccauuggccagaa

SEQ ID NO: 88338 - RNA, 45 nt, Mus musculus
acuacaccaucuuugagaagaaguuuggugagcggagggauguag

SEQ ID NO: 88339 - RNA, 46 nt, Mus musculus
gacagaagaggacugugauuagcaacuggaucaaauacgcacaaug

SEQ ID NO: 88340 - RNA, 45 nt, Mus musculus
uaaccaguggaaguggccaauaugaccucagugucagauggugga

SEQ ID NO: 88341 - RNA, 45 nt, Mus musculus
aacaggcugaaaaagaacuaagucuggcaaggaaaauguugaagu

SEQ ID NO: 88342 - RNA, 60 nt, Mus musculus
agccagauguuaaaaaauuagaagccuugcuucaggguggugaaguggaagaggugauuc

SEQ ID NO: 88343 - RNA, 64 nt, Mus musculus
agacucuugauauucugaagcacuuuccuaaacaugcagccuauagaaaauacacagaacagau

SEQ ID NO: 88344 - RNA, 46 nt, Mus musculus
uuucuuaaaaagaaaauuucaacuugccaaguuuacauccccagaa

SEQ ID NO: 88345 - RNA, 41 nt, Mus musculus
uaagaggagggguugggggaguguuccgcuguccuggcagg

SEQ ID NO: 88346 - RNA, 44 nt, Mus musculus
ugugcgcuggaggcgcuggacgcugucauggcgggcuugcugaa

SEQ ID NO: 88347 - RNA, 42 nt, Mus musculus
ggggagacugaguucuuugaguugcauauaaauggggguaua

SEQ ID NO: 88348 - RNA, 46 nt, Mus musculus
agacugacacaaaccuuaauguaauuuaguuagaaugccagaagga

SEQ ID NO: 88349 - RNA, 45 nt, Mus musculus
uaugcgugcuuaacuccugcuuuuggguuuauuuuuagaugaaga

SEQ ID NO: 88350 - RNA, 45 nt, Mus musculus
uuugacucauugaaaacacacugguugaaaucuuuuucccguagg

SEQ ID NO: 88351 - RNA, 41 nt, Mus musculus
aaggauggugaugucacuaaaaugggguaacuagagucaag

SEQ ID NO: 88352 - RNA, 45 nt, Mus musculus
gaaaaaacaauccaaccugauaguggguguggacugugguaaaaa

SEQ ID NO: 88353 - RNA, 46 nt, Mus musculus
ugccucuuuugaggggugguucugagugggaucuaaaugauaagac

SEQ ID NO: 88354 - RNA, 45 nt, Mus musculus
gacagucuaagaaaccgagguagcagaauuaugaggaagaggaaa

SEQ ID NO: 88355 - RNA, 41 nt, Mus musculus
ugugggugcgcugauggaagugaugcagaaaaggagcaaag

SEQ ID NO: 88356 - RNA, 42 nt, Mus musculus
ggccugccuucugauggugaccaucaaguuccagcuccuuca

SEQ ID NO: 88357 - RNA, 46 nt, Mus musculus
gagaggaggaccucccccuccuccucccccuccucauagcucaggu

SEQ ID NO: 88358 - RNA, 46 nt, Mus musculus
uguggggguagggagugguuuugccuauacgugcaauacuugcaga

SEQ ID NO: 88359 - RNA, 46 nt, Mus musculus
ugcaaacuuuauaugccccaguacaggggaauaacagggccaagaa

SEQ ID NO: 88360 - RNA, 46 nt, Mus musculus
cgaaggucccaaguucaaaucccagcaaccacccauaaugagaucu

SEQ ID NO: 88361 - RNA, 46 nt, Mus musculus
ccauccauucauaaauauuuauucuauuuuccuuuucuaauaagau

SEQ ID NO: 88362 - RNA, 46 nt, Mus musculus
guggcugucuauacuuuuagguaaaguguuucaguugcacagagaa

SEQ ID NO: 88363 - RNA, 46 nt, Mus musculus
auuuuugugagauccauuagaauaagugacauuuuugaagugaaaa

SEQ ID NO: 88364 - RNA, 46 nt, Mus musculus
ccaaggagauuuuuaguacauuuuaacuuuucuucuuuucuaggau

SEQ ID NO: 88365 - RNA, 46 nt, Mus musculus
aaaaaauaaugguuuucauagcuaguuccuuguauuuugguuuagg

SEQ ID NO: 88366 - RNA, 45 nt, Mus musculus
gaguaagaccuagcgguuacacaggaaaguugcagagaaacagaa

SEQ ID NO: 88367 - RNA, 85 nt, Mus musculus
cuuggcccuaguggcagccagucuuuggggggcaguauuuagcauugcaacacagcaaaagaccaaaccuuaacagugccccucc

SEQ ID NO: 88368 - RNA, 41 nt, Mus musculus
cuggucuuugccucagaaagccugggaaccagagccccacc

SEQ ID NO: 88369 - RNA, 47 nt, Mus musculus
gauguaucaaccucuuagauauucaguacauuuacgugaaugaggaa

SEQ ID NO: 88370 - RNA, 41 nt, Mus musculus
uugcugcucgaaucaagaaguuacugggagcugaucugagu

SEQ ID NO: 88371 - RNA, 45 nt, Mus musculus
cguguuuuguguggagguagggguggggcugauagaagugggaga

SEQ ID NO: 88372 - RNA, 61 nt, Mus musculus
aaauaauuuacaaguauaacauguagugguauuaauguagauacucaaacaagcucuugcc

SEQ ID NO: 88373 - RNA, 45 nt, Mus musculus
uuuuuuuuaaaaagcuauaaucauuguuuaaaagcugucaccauu

SEQ ID NO: 88374 - RNA, 44 nt, Mus musculus
auaugccccaguacaggugaaugccagggccuagaagcgggagg

SEQ ID NO: 88375 - RNA, 46 nt, Mus musculus
ggggacugguucuggggcuggcaagaaggugcugcuggagagagug

SEQ ID NO: 88376 - RNA, 46 nt, Mus musculus
ucacuuucuccuuuugugauguuuauucaguucaugacccccucgc

SEQ ID NO: 88377 - RNA, 45 nt, Mus musculus
ugaaaagugcccuccucuguggugggaagaagauaaggaccaaau

SEQ ID NO: 88378 - RNA, 42 nt, Mus musculus
aaaauaauaaugagccugaacuaaagcaguuuauagguagag

SEQ ID NO: 88379 - RNA, 46 nt, Mus musculus
cacauacaggucagggcucacuuugacaggauacuuggguaaggug

SEQ ID NO: 88380 - RNA, 46 nt, Mus musculus
aaaucucugaaaacuucuuagaaacagauggagaacuauuggguga

SEQ ID NO: 88381 - RNA, 38 nt, Mus musculus
agcaaauuuacaggucagaacaaauauaauaagcagau

SEQ ID NO: 88382 - RNA, 46 nt, Mus musculus
agagcuuacuguaguguuuacccaggguuucaaggaaaugacagau

SEQ ID NO: 88383 - RNA, 46 nt, Mus musculus
ugacuaaaguagaaaacagugguucaaaaaaagaagaaaaagaguu

SEQ ID NO: 88384 - RNA, 67 nt, Mus musculus
uucauaucgacuuugggaaaccaaaucauuccaucggacuuaagauguauuucuuguucuaaaauuu

SEQ ID NO: 88385 - RNA, 46 nt, Mus musculus
cauuucauauccucccuuggcaauguuggagaugucagaaucagac

SEQ ID NO: 88386 - RNA, 88 nt, Mus musculus
uggugcugugaggaggcccauuccaaccccagauggcggauugggagcaagcaguucugugggaaggggaauggguguuauugacgga

SEQ ID NO: 88387 - RNA, 52 nt, Mus musculus
guuucugcucuccgccccacuguggguuuuucuuuuccucccuggcguugug

SEQ ID NO: 88388 - RNA, 62 nt, Mus musculus
agauggggaaagaagcgaauuggauuuucgguccgccuuaaggauuccgggagagaauaaag

SEQ ID NO: 88389 - RNA, 45 nt, Mus musculus
cauuucucuacaacauuagaaguugcuucauugcccaccagcgaa

SEQ ID NO: 88390 - RNA, 42 nt, Mus musculus
gaggguuaggugcaucuucucugacugaauccagacccggca

SEQ ID NO: 88391 - RNA, 46 nt, Mus musculus
gacuaggaauaauuauacucaagcaucuguaccaagguguugaacu

SEQ ID NO: 88392 - RNA, 45 nt, Mus musculus
cuacucaauuugggauuccuguuaacaagcuguucugguccuagg

SEQ ID NO: 88393 - RNA, 46 nt, Mus musculus
ccaugaacucaggauuuagcuccauuuuucuuccuugugccccuuu

SEQ ID NO: 88394 - RNA, 45 nt, Mus musculus
gugguagacauucuagucuacgauaaccacguucaaguggcgaga

SEQ ID NO: 88395 - RNA, 45 nt, Mus musculus
cacuugggagacagaggcagagaggcagagaggcagagaggcaga

SEQ ID NO: 88396 - RNA, 46 nt, Mus musculus
gggaauaaaagaacaauagaaaccacauguuuaaaacacaagagug

SEQ ID NO: 88397 - RNA, 46 nt, Mus musculus
gcucugaccagucaagcuugugcaguacagaguacguagagggagg

SEQ ID NO: 88398 - RNA, 24 nt, Mus musculus
aggaaacagagaugcagcaguaga

SEQ ID NO: 88399 - RNA, 35 nt, Mus musculus
gcggcaaaacuuuuauugcuuacuuaucaggaggg

SEQ ID NO: 88400 - RNA, 46 nt, Mus musculus
caucuuaauagcugacaaaauagacuucaaaauuaaucagaagaga

SEQ ID NO: 88401 - RNA, 45 nt, Mus musculus
aaucaaaacuaaacauaaagaaaaauaaaaauuuaaaagcuagag

SEQ ID NO: 88402 - RNA, 46 nt, Mus musculus
gggugcugcuuacuggcuuacuccacaugccuugauuagcuuguau

SEQ ID NO: 88403 - RNA, 46 nt, Mus musculus
guguauauuguuccuguguguuucuuucaucucugagggcauagac

SEQ ID NO: 88404 - RNA, 48 nt, Mus musculus
aguguacuaucauuucugaucacaaucuucaugagguagcagaugcuc

SEQ ID NO: 88405 - RNA, 46 nt, Mus musculus
guuaaauuuaucuuauaaacuuuaaauuuacuauagagauggcaga

SEQ ID NO: 88406 - RNA, 59 nt, Mus musculus
gucucuuacauauagcagugugaugucacagaacagauccauagugucaguagcgucua

SEQ ID NO: 88407 - RNA, 42 nt, Mus musculus
agaagucaggcaaaucacacugauguuuguguucagccaagg

SEQ ID NO: 88408 - RNA, 46 nt, Mus musculus
uuacuuauuaucagucuuagugucugagccuggccugucgaguuua

SEQ ID NO: 88409 - RNA, 46 nt, Mus musculus
gugauugaaguuaaauaucuguaagcuuagaaaauauuccuucugc

SEQ ID NO: 88410 - RNA, 45 nt, Mus musculus
guauagcaugugccgagugugagcugagagaguacugggaggaga

SEQ ID NO: 88411 - RNA, 45 nt, Mus musculus
ugacucaguacaggggaacuccagggccaagaagugggagugggu

SEQ ID NO: 88412 - RNA, 43 nt, Mus musculus
uguuguauaccaaagacagaaagaagcagggugggccagaaga

SEQ ID NO: 88413 - RNA, 46 nt, Mus musculus
uacagcaguuuggcauagaugccuaggacugugaggaaccucuuuu

SEQ ID NO: 88414 - RNA, 45 nt, Mus musculus
ugugugugugugugugugugugugugugugugguaagcagagaca

SEQ ID NO: 88415 - RNA, 46 nt, Mus musculus
aaacuuaacuguuuuaaauucucaacuaugcugggcaagaggagag

SEQ ID NO: 88416 - RNA, 67 nt, Mus musculus
auugcaaguuucucuuaggauauuuacgaguuugagggaggaggcaaccaaugccaguuuugaaauc

SEQ ID NO: 88417 - RNA, 46 nt, Mus musculus
aacaaagcccugggcacuugucuauguuauuaucccaugugcagau

SEQ ID NO: 88418 - RNA, 46 nt, Mus musculus
cagauagauacuuuuacagcugagccaucucuccagccccaaugga

SEQ ID NO: 88419 - RNA, 45 nt, Mus musculus
ccccagcugcauguauagcagaggauggcuugucagucaucaaug

SEQ ID NO: 88420 - RNA, 46 nt, Mus musculus
aaaauaacuuuucaccauauaagagaggauucaagcaaggccugag

SEQ ID NO: 88421 - RNA, 45 nt, Mus musculus
caagcauaacauuagaucauguaucccaaaaaauuacuauucuag

SEQ ID NO: 88422 - RNA, 45 nt, Mus musculus
aaaccuuuuguuuuccaaugaaagacagaaaggagguggauagau

SEQ ID NO: 88423 - RNA, 26 nt, Mus musculus
gaagugcauauguggaggguggaggc

SEQ ID NO: 88424 - RNA, 45 nt, Mus musculus
aguaacagagaagcggccggaguaggaaaacacacagacagcgcc

SEQ ID NO: 88425 - RNA, 46 nt, Mus musculus
gugauagcacacccauucucugucccucuaacagugagcaccauca

SEQ ID NO: 88426 - RNA, 45 nt, Mus musculus
acugcuagguucuuccuucaaacagguaagacaaugaaaggacag

SEQ ID NO: 88427 - RNA, 45 nt, Mus musculus
aguaggguauaauccaugugauuaauucaguauccauagcuagau

SEQ ID NO: 88428 - RNA, 44 nt, Mus musculus
gcagacaaagcuaggagcugcuggauguaccucuaaccccauua

SEQ ID NO: 88429 - RNA, 46 nt, Mus musculus
caagaaauucccagauagagacuagaaacauuagauuaagaaaagg

SEQ ID NO: 88430 - RNA, 45 nt, Mus musculus
uuacaguaauaaguaaauuaaacauuuuuuguguugauauuuaga

SEQ ID NO: 88431 - RNA, 67 nt, Mus musculus
aggaaugaugcacuagagaaaaagaaaugaagcaguaggcacaggaaauugaauuacagggugaggu

SEQ ID NO: 88432 - RNA, 45 nt, Mus musculus
augugcuaauuuugacugguagcuuucauuuugaaugggacuaga

SEQ ID NO: 88433 - RNA, 46 nt, Mus musculus
uuagccccuucuauuuugauagggucucacuguguaccuuagaggg

SEQ ID NO: 88434 - RNA, 65 nt, Mus musculus
ggggggcacggggauugaaaucuuaaagaaauguggcugcuuuuguuacuuuuuuguaguggugc

SEQ ID NO: 88435 - RNA, 23 nt, Mus musculus
uuucacacuggauuugggaggag

SEQ ID NO: 88436 - RNA, 42 nt, Mus musculus
gaagaucuagaaagucauaauaaaaugcuucuauagguagaa

SEQ ID NO: 88437 - RNA, 46 nt, Mus musculus
ccuugcacuuagacauuuaacaucccuaguaguaaaugagucugag

SEQ ID NO: 88438 - RNA, 46 nt, Mus musculus
gagagauugauugauugugaccaaaaggaaagcaaaacccccuuug

SEQ ID NO: 88439 - RNA, 46 nt, Mus musculus
gacgagguguucgucgucacauucgaaaaguacacaaaaaaaagau

SEQ ID NO: 88440 - RNA, 46 nt, Mus musculus
gacaagagagaauauauuauuaagcuagaacccauagaaaccaacc

SEQ ID NO: 88441 - RNA, 46 nt, Mus musculus
uagaccacaguaauuauauugauaaguaauuggaauuggggcaaga

SEQ ID NO: 88442 - RNA, 46 nt, Mus musculus
cacagaacacugacuaaaugcaggagagugagacagcuggggagau

SEQ ID NO: 88443 - RNA, 45 nt, Mus musculus
cacagucacacauauaaaauacaugaauaaauuguuuuuuaaaga

SEQ ID NO: 88444 - RNA, 46 nt, Mus musculus
uauaggaauuggcucuauauuauauuugugcaguuacaguucaguc

SEQ ID NO: 88445 - RNA, 46 nt, Mus musculus
gagcauuuaauugucucacuuauaccuuagugaacagccacacagu

SEQ ID NO: 88446 - RNA, 46 nt, Mus musculus
gcuuuuguguuuguuuuuuggaaacuuuguuagcuccaugauaaga

SEQ ID NO: 88447 - RNA, 46 nt, Mus musculus
cauuguugauuuucuucuuuuuauucucuauuucuugcccccugua

SEQ ID NO: 88448 - RNA, 46 nt, Mus musculus
ugcccauguaaagcugacucgguaaguauguuuucuagugggaggu

SEQ ID NO: 88449 - RNA, 46 nt, Mus musculus
gagguauccaucauuuggauuauagacagagggugaggccugagau

SEQ ID NO: 88450 - RNA, 49 nt, Mus musculus
cccccagagaaagugccacaagugucaccgucaaucauuuccacaaggu

SEQ ID NO: 88451 - RNA, 46 nt, Mus musculus
augcacucuuuuguccaucucacuaccggcagauggcccaucccca

SEQ ID NO: 88452 - RNA, 46 nt, Mus musculus
gucucgauggucuccaagagauccuucuuacuugggccgcccccga

SEQ ID NO: 88453 - RNA, 41 nt, Mus musculus
gaguagacugccaagcucaaugcagaugugggaaaccagca

SEQ ID NO: 88454 - RNA, 45 nt, Mus musculus
acccagggccucaucuuugugguagacagcaacgaccgggagcgg

SEQ ID NO: 88455 - RNA, 46 nt, Mus musculus
cucuuccuccccacagacaggccucugcuccugcgccugccugcau

SEQ ID NO: 88456 - RNA, 47 nt, Mus musculus
uuuuuguuuuggggguacccuuggggccagguuuuggggggaggaaa

SEQ ID NO: 88457 - RNA, 25 nt, Mus musculus
uacuaaucauugacuucagguucua

SEQ ID NO: 88458 - RNA, 45 nt, Mus musculus
ucucaaaaaacaaaaacaaaaacucuugggagagcuggcccuggg

SEQ ID NO: 88459 - RNA, 42 nt, Mus musculus
ccuagccagagcagugcuagagagcuugcccuggugacucag

SEQ ID NO: 88460 - RNA, 45 nt, Mus musculus
agaagagggcauuggaucccauuacagaugguugugagccacccu

SEQ ID NO: 88461 - RNA, 45 nt, Mus musculus
uauuuuccuggagaguagucauuuccagugguauuuaggagcugc

SEQ ID NO: 88462 - RNA, 48 nt, Mus musculus
auaaguuagaaagcgggugcugcuuucuuuugccauuuggaaggguga

SEQ ID NO: 88463 - RNA, 45 nt, Mus musculus
ucuuacuguggacuggguugaucugagggucagaaaugguugaag

SEQ ID NO: 88464 - RNA, 46 nt, Mus musculus
acaagccugugcuacacagccagcuuuugauuuucuucuuucugug

SEQ ID NO: 88465 - RNA, 45 nt, Mus musculus
uuccauggagagaaguugugcaugguagcuuucaaucaagacgag

SEQ ID NO: 88466 - RNA, 46 nt, Mus musculus
uuugagugaaaacaaagcauccaucugguuccaguuuugcugacag

SEQ ID NO: 88467 - RNA, 32 nt, Mus musculus
uuuugagacagaucucauugugaagcacuaua

SEQ ID NO: 88468 - RNA, 107 nt, Mus musculus
cuggucacugggugccuaucccgugcgugucucauggaggagucaguaaagaagggaauaaguaagcaugggaagagaggagagugaauucacauagugggccagaa

SEQ ID NO: 88469 - RNA, 47 nt, Mus musculus
gguguggauuuaacaugaguuacugcauaacgcguguuuaaggauga

SEQ ID NO: 88470 - RNA, 44 nt, Mus musculus
ugucuguaacugucgguguauguauucuaagcagguucagcaag

SEQ ID NO: 88471 - RNA, 52 nt, Mus musculus
uuuuuguuuuuacagcagaaacugaugcugaaucacagucugugagcguugg

SEQ ID NO: 88472 - RNA, 45 nt, Mus musculus
aaugaacaguagcuucaguuggcuuuuauguuuuaaauuaggcag

SEQ ID NO: 88473 - RNA, 51 nt, Mus musculus
uuucauuuucaggugccauuuaaaaagugugugugugugugugugugugug

SEQ ID NO: 88474 - RNA, 45 nt, Mus musculus
gagaggcaguuguauuuucuucagucacacugaaacagagcugag

SEQ ID NO: 88475 - RNA, 50 nt, Mus musculus
caacaacuuucuuuggagguggauuaguugaaauacagcauuuuaguaug

SEQ ID NO: 88476 - RNA, 46 nt, Mus musculus
uuagagaaaguaaauccugguuuucuaaccaggucauuguggggag

SEQ ID NO: 88477 - RNA, 46 nt, Mus musculus
aggaacuuguucuguagacaaggcuaaccuugaacucaagagaccc

SEQ ID NO: 88478 - RNA, 46 nt, Mus musculus
augugaugugugugggucugugcaugugugugcuggggcccuggag

SEQ ID NO: 88479 - RNA, 45 nt, Mus musculus
gguuuugcugccugucucaugcaguuacugcuaacuggcaagaag

SEQ ID NO: 88480 - RNA, 46 nt, Mus musculus
caaagcucaagccuaaauggaucaaagaccuccacauaagaccaga

SEQ ID NO: 88481 - RNA, 45 nt, Mus musculus
agcuagagaaagcacccaaggaucugaaggggucugcagcccuag

SEQ ID NO: 88482 - RNA, 45 nt, Mus musculus
auaagguugauacgguccuuugcacucacagaacuggcagcccag

SEQ ID NO: 88483 - RNA, 46 nt, Mus musculus
acuaucuucuaucagacagaguuagugaaauguguaaagauaccau

SEQ ID NO: 88484 - RNA, 46 nt, Mus musculus
guaugugggcacuuuucacugguccagcaaaauauaauacauccuu

SEQ ID NO: 88485 - RNA, 46 nt, Mus musculus
caguuguuaacucuaaaaaucaggauacuuuuucccaugacuguag

SEQ ID NO: 88486 - RNA, 46 nt, Mus musculus
gguaaagggugggaaaaagaaacccacaguagcaaagaccagccac

SEQ ID NO: 88487 - RNA, 44 nt, Mus musculus
gcugguguuggcucaugguucucacauaugcaguauuugggguu

SEQ ID NO: 88488 - RNA, 25 nt, Mus musculus
gucuguggauuguuguuauugccag

SEQ ID NO: 88489 - RNA, 46 nt, Mus musculus
uccuuuucgggcuucucuucagugauccugagauuuacaagcugag

SEQ ID NO: 88490 - RNA, 42 nt, Mus musculus
guucagccccuguggcuggcugacuugugccuugaagccaga

SEQ ID NO: 88491 - RNA, 42 nt, Mus musculus
ggagugauuuaggccauggucuaugugcuuaagguauaggag

SEQ ID NO: 88492 - RNA, 42 nt, Mus musculus
cacaguuguaacuagguucuguucugacugcuuugccaggac

SEQ ID NO: 88493 - RNA, 51 nt, Mus musculus
cgagcuggaaaucuugcccgucgggcagcugccacacaaccagaugggaag

SEQ ID NO: 88494 - RNA, 42 nt, Mus musculus
ccagggcuuucuauggcuguggaccuaguugacagccugcuc

SEQ ID NO: 88495 - RNA, 45 nt, Mus musculus
caggucacuuccugcuccuacauacuguaggcuauuggcccaggg

SEQ ID NO: 88496 - RNA, 45 nt, Mus musculus
gucucacacaugccaggcaagcaagcacucuacuaccgagcacua

SEQ ID NO: 88497 - RNA, 41 nt, Mus musculus
cuguugucacugugucuauccagugacucgugaggcgggaa

SEQ ID NO: 88498 - RNA, 46 nt, Mus musculus
cauauacaaauacucuuaacaucucauuuuuaccccacacccccaa

SEQ ID NO: 88499 - RNA, 45 nt, Mus musculus
cauuucaagaucuccaguguaauuuucuuuugccugaccagcuag

SEQ ID NO: 88500 - RNA, 37 nt, Mus musculus
auccugaauugugacucaaagggaugacagcaggcag

SEQ ID NO: 88501 - RNA, 56 nt, Mus musculus
cagcccugggcauuuccugcccgagaguuccuucgcaagaagcugauugggaaaga

SEQ ID NO: 88502 - RNA, 52 nt, Mus musculus
agucuguuucacgauagaaaacaagacuccccagggacgagaguaugggaug

SEQ ID NO: 88503 - RNA, 29 nt, Mus musculus
aguuguggucuucuuuggauuggauucag

SEQ ID NO: 88504 - RNA, 45 nt, Mus musculus
aucccauuaaggcugagcuauacaaguucuagaaaagugaauuga

SEQ ID NO: 88505 - RNA, 42 nt, Mus musculus
cuuaagucuugguguccuuuggagucuagaaugugccaugga

SEQ ID NO: 88506 - RNA, 46 nt, Mus musculus
auuccauucagagaauuuagcaguaaguagacuuaggcugggcuag

SEQ ID NO: 88507 - RNA, 46 nt, Mus musculus
agaggcuucuguagcugucgcugucuucagacacaucauaagacga

SEQ ID NO: 88508 - RNA, 46 nt, Mus musculus
cagagcagaaccggcuuucagaaugcgaggaacaagcaaaggcauc

SEQ ID NO: 88509 - RNA, 46 nt, Mus musculus
cgucgggaaacagaugggagugaaacgccggagcccuucgcugcag

SEQ ID NO: 88510 - RNA, 46 nt, Mus musculus
uuugcccgcuguguggacuggucaauugcaguuuacacccggggug

SEQ ID NO: 88511 - RNA, 46 nt, Mus musculus
agcuuguucagguauagcuagauguugagcucauuugugguggugu

SEQ ID NO: 88512 - RNA, 42 nt, Mus musculus
auauaucugacaagucuauauuguuugauaaaaagccagagg

SEQ ID NO: 88513 - RNA, 46 nt, Mus musculus
uagucagacuauggucuucucugggucuuuccacaggguaggguag

SEQ ID NO: 88514 - RNA, 46 nt, Mus musculus
aaagugaaaauuuuuuuaacauguuuuucuauuucugcaaggccag

SEQ ID NO: 88515 - RNA, 46 nt, Mus musculus
augauggaagacagagacuaagcauaguacaugauccuagguacag

SEQ ID NO: 88516 - RNA, 46 nt, Mus musculus
caaggguggucuauucagggguggugaugagcaggcucuggguggg

SEQ ID NO: 88517 - RNA, 47 nt, Mus musculus
aagaguuaauuugaguuugagaguaaguacagaucuguccaagagua

SEQ ID NO: 88518 - RNA, 45 nt, Mus musculus
ggucaugcagguuuugaaugcugaugccauuguugugaagcugaa

SEQ ID NO: 88519 - RNA, 46 nt, Mus musculus
uuccucccuagggagcuggagagcaguuaggggugggauaugggag

SEQ ID NO: 88520 - RNA, 46 nt, Mus musculus
aggaagaguuggucuucagugugcuucagguaguucauggcuagag

SEQ ID NO: 88521 - RNA, 46 nt, Mus musculus
uaagccauuuuuaggggcuggggcguguugagcuuagguagaguaa

SEQ ID NO: 88522 - RNA, 41 nt, Mus musculus
gagaguuucuuugaggaaaugacauuuaaaacauugaugac

SEQ ID NO: 88523 - RNA, 41 nt, Mus musculus
uuuccggacaugaaaugagggccuugaugaugaauaguaga

SEQ ID NO: 88524 - RNA, 74 nt, Mus musculus
ugguugguaagcaagggucagaggucaagaguuuaugcuauguuuuaaguuuugucuugacgaauuuuaagccg

SEQ ID NO: 88525 - RNA, 45 nt, Mus musculus
uaacuaagaagcccaaauugaguauucaagguagaagcaggcaua

SEQ ID NO: 88526 - RNA, 46 nt, Mus musculus
ucuauauacagaguuccuggacaguuagcaugucagggcuacauag

SEQ ID NO: 88527 - RNA, 72 nt, Mus musculus
gcagcuugcacaagaauauauuccugcccuaguuagaccaagaucugguaggcucuccaaggaaaagauggu

SEQ ID NO: 88528 - RNA, 46 nt, Mus musculus
uccuguacugcuauugcugucuguucauuuccauucccuguccuug

SEQ ID NO: 88529 - RNA, 45 nt, Mus musculus
accuugguggagggcugcuuugcaaccagaccucuguucagcuua

SEQ ID NO: 88530 - RNA, 41 nt, Mus musculus
ugaaguuugcuuagcaucugcuucuccagcuggauggcuag

SEQ ID NO: 88531 - RNA, 45 nt, Mus musculus
uauugaguacccucauuggagcuucuuuaccuuuuacugcagcgg

SEQ ID NO: 88532 - RNA, 42 nt, Mus musculus
ugugugugugugugugagagagagagagagagagaccggggg

SEQ ID NO: 88533 - RNA, 46 nt, Mus musculus
cccugcgcaucucacuuuugaauagucucaguuuuauuagucauuu

SEQ ID NO: 88534 - RNA, 46 nt, Mus musculus
cagguugagauaggccuacaccucugcuuucaucuucacaccauuc

SEQ ID NO: 88535 - RNA, 45 nt, Mus musculus
aaauuuaaagaagcaaauauaaauuacuuaaaucuuauagcccag

SEQ ID NO: 88536 - RNA, 42 nt, Mus musculus
caccuaauuccuuaucgguuuguauuauuuagaagcaggcug

SEQ ID NO: 88537 - RNA, 71 nt, Mus musculus
guuauaucuauucaguaguuuguuuuuccauuuugggucugguuuuugauuuuuguuuuaucuuuuuuccc

SEQ ID NO: 88538 - RNA, 42 nt, Mus musculus
gcugcaggaggcaggaguggagguacuuuacuuugugcauag

SEQ ID NO: 88539 - RNA, 51 nt, Mus musculus
uguuagcaauuucaggaagagaagcuuagggcuggagauccauucaguggu

SEQ ID NO: 88540 - RNA, 46 nt, Mus musculus
ccuccaacaugcugagauucaaggcuuaugcaaccauacuugccag

SEQ ID NO: 88541 - RNA, 45 nt, Mus musculus
uagucacuggcuauguggcugugcuuuaaaccuaagaguaugcag

SEQ ID NO: 88542 - RNA, 46 nt, Mus musculus
uuuugcugaaugucaccaagcauuuacugucacuucucugaugcca

SEQ ID NO: 88543 - RNA, 46 nt, Mus musculus
guccauugucagaugguaaucuuucaucuuguucucuugcccuaaa

SEQ ID NO: 88544 - RNA, 46 nt, Mus musculus
cuugguauugaggacccauacagauaauuugauugcaugcauggag

SEQ ID NO: 88545 - RNA, 35 nt, Mus musculus
gaaggaauauguaaagguagguuggaauaugguag

SEQ ID NO: 88546 - RNA, 46 nt, Mus musculus
gguuucaugaccccuggcuccuaauccaugaguggccauucaaguu

SEQ ID NO: 88547 - RNA, 45 nt, Mus musculus
uuuagcuuuguuuuguuggcuuagaaaucauugaaggucuuugag

SEQ ID NO: 88548 - RNA, 44 nt, Mus musculus
uauacagauuuaauauuuugaucuggaggauagaagucagguga

SEQ ID NO: 88549 - RNA, 46 nt, Mus musculus
acacacuccuggauuuuuagggacaaauagcagcccccuucagagu

SEQ ID NO: 88550 - RNA, 41 nt, Mus musculus
uucugaauaaugacuuccugucaaguggcucgaaggguuug

SEQ ID NO: 88551 - RNA, 46 nt, Mus musculus
cuucauugucuucaugaaggcagaggcuguaucuugcuuuccaaag

SEQ ID NO: 88552 - RNA, 46 nt, Mus musculus
aaaaaaagaguagcauguuuucuuucuucaagugggcggccaccau

SEQ ID NO: 88553 - RNA, 46 nt, Mus musculus
uuuugcugccuuuuuacuguaacaucaguggcauugcucggaccaa

SEQ ID NO: 88554 - RNA, 38 nt, Mus musculus
cgagccuguugaucccgauuuugcuagauacucacaua

SEQ ID NO: 88555 - RNA, 45 nt, Mus musculus
ugagaccucuggggagauagauuuuauuuccaguauuuggccuuu

SEQ ID NO: 88556 - RNA, 46 nt, Mus musculus
acuaugcuugugaaaccaauuuaucauccaugagaaaugaggcuag

SEQ ID NO: 88557 - RNA, 45 nt, Mus musculus
acauguauugcuuugggauguaaacugugccaaauuaaaguggca

SEQ ID NO: 88558 - RNA, 44 nt, Mus musculus
guauaugagcacugucuucagauauaccagaagagggcaucaga

SEQ ID NO: 88559 - RNA, 42 nt, Mus musculus
cuccagucugucuguccuuuucuuaaaguaaaucuuuggcag

SEQ ID NO: 88560 - RNA, 45 nt, Mus musculus
cauugcugccuguuaaccagccuuccuaucucccugacuguccuu

SEQ ID NO: 88561 - RNA, 42 nt, Mus musculus
gggggcacagaaggaggggaaugugccgaguaauuggggcua

SEQ ID NO: 88562 - RNA, 45 nt, Mus musculus
auguagaagcuaaacacagcacccugacccccacaccccuugccu

SEQ ID NO: 88563 - RNA, 24 nt, Mus musculus
ugcuggacuccgugacaccauuga

SEQ ID NO: 88564 - RNA, 46 nt, Mus musculus
cuccuacaauaucauuuuguuuucaguuugcaucccuuaaugccag

SEQ ID NO: 88565 - RNA, 46 nt, Mus musculus
cucuuuuuagguagucuucuuguagcuccaccuaaaaacagaauuu

SEQ ID NO: 88566 - RNA, 42 nt, Mus musculus
uguguagaacuguuaggcuugugcuggaauaggacuggacag

SEQ ID NO: 88567 - RNA, 46 nt, Mus musculus
uuuugggggugcggguggggggagagauagaaauaacuaccacgag

SEQ ID NO: 88568 - RNA, 46 nt, Mus musculus
cagaaaccaggcuguggaagcuaaaauuccugggaaaucgggcuga

SEQ ID NO: 88569 - RNA, 45 nt, Mus musculus
gcugauauuguggcuuuuaaaauagauuuuguguguuugugugug

SEQ ID NO: 88570 - RNA, 45 nt, Mus musculus
auaguaaauaguguuuacucaucccccaaauguauuuagugccag

SEQ ID NO: 88571 - RNA, 45 nt, Mus musculus
guugggagcagucuucauaaaugucaucaacacagaggggcauug

SEQ ID NO: 88572 - RNA, 44 nt, Mus musculus
ggcugguauccucuuaagacuagaugaggacacagaagcacagg

SEQ ID NO: 88573 - RNA, 36 nt, Mus musculus
uugcagcacauaaagaaaucuugcucucucugacaa

SEQ ID NO: 88574 - RNA, 46 nt, Mus musculus
auauggguuguuaguuugcugaaaauagaauuuaauuggccacugu

SEQ ID NO: 88575 - RNA, 46 nt, Mus musculus
cgugcgccaccacgcccggcuaauguugacauuuuaauuguauuga

SEQ ID NO: 88576 - RNA, 117 nt, Mus musculus
aauuggaauauugaggguucuuaaauauuuauagaaaaccagaaccacaucuaaucgauacgcuagcagacuugcccaaucuuuuggcaucagaacauggcauuauuaucugcaaag

SEQ ID NO: 88577 - RNA, 45 nt, Mus musculus
uggacuauuuucauuucaguguccaaugcugcuauagguugccua

SEQ ID NO: 88578 - RNA, 45 nt, Mus musculus
uaaugaacagagaaccuacccacuuuuguggacuucuaucccuag

SEQ ID NO: 88579 - RNA, 45 nt, Mus musculus
ucuugugacuacuggggaggaccucaccucaucagucccuggcuu

SEQ ID NO: 88580 - RNA, 46 nt, Mus musculus
ggaauguuaaaaaaagagggaaagcaauaccuaagguuugauucau

SEQ ID NO: 88581 - RNA, 46 nt, Mus musculus
gaguaccuugacagcagugaggccuaagaaacuugacagucuggga

SEQ ID NO: 88582 - RNA, 48 nt, Mus musculus
guuuaaugacugcuuccgucaugugcugcguccgauuauaccaagaca

SEQ ID NO: 88583 - RNA, 45 nt, Mus musculus
cacugucugcaaauuuuguguccccuugaucugcagcacccccag

SEQ ID NO: 88584 - RNA, 42 nt, Mus musculus
uucugcucuuuggaacaaugucuuacuccucuaaggccucaa

SEQ ID NO: 88585 - RNA, 46 nt, Mus musculus
gaggucaguuuauuauauauuuaaauuuuguggguugaacuggaaa

SEQ ID NO: 88586 - RNA, 45 nt, Mus musculus
gaauugacccauuuaauauaacauuccuaggcugaugggcauuua

SEQ ID NO: 88587 - RNA, 46 nt, Mus musculus
ccaaacaguucauuuugcuuuacaguaauuuuuaaaaauuuagagu

SEQ ID NO: 88588 - RNA, 46 nt, Mus musculus
ugugugugugugugugugugagagagagagagagagagaaugagag

SEQ ID NO: 88589 - RNA, 42 nt, Mus musculus
uuacucuucuagaacaaaggaaggacucuacaacccggcccu

SEQ ID NO: 88590 - RNA, 45 nt, Mus musculus
gcuguucuuuucuucuacucuuccaauuccugcaggagcuuuuuc

SEQ ID NO: 88591 - RNA, 46 nt, Mus musculus
acauuuucaguuguggcuugugaaccuuuuuucuguuucuccccgg

SEQ ID NO: 88592 - RNA, 46 nt, Mus musculus
aauuuacuaauuuaugucguuucacuuguuacaguggaaauccucc

SEQ ID NO: 88593 - RNA, 46 nt, Mus musculus
uuuaucuugucuugaaccaugaggcacacucauggcucacacuuag

SEQ ID NO: 88594 - RNA, 49 nt, Mus musculus
uuaagcuuccucugacuaacucuccacccucauuuucuuauugcccagu

SEQ ID NO: 88595 - RNA, 46 nt, Mus musculus
ugauagagaacuuuaaaggucuuacuagaacauacuuagccaccuu

SEQ ID NO: 88596 - RNA, 84 nt, Mus musculus
guccuuugucagugagacagaauuucuaauauaaguagcuuaaagagaggagcaguauauuuugacucauuacuucagagguuu

SEQ ID NO: 88597 - RNA, 57 nt, Mus musculus
cauccaugaucacguuuggagacgauucaaacuauuuugcaaggauauacccagguu

SEQ ID NO: 88598 - RNA, 46 nt, Mus musculus
cguguggaucugaauuccccuuugcucuuguugcacuuacccacuu

SEQ ID NO: 88599 - RNA, 46 nt, Mus musculus
uuacacauaugaaccauuuggaauucugguaccuacagaggccaag

SEQ ID NO: 88600 - RNA, 46 nt, Mus musculus
gggguccucaucuauggcuucacaccaugcucugcuuuugccugau

SEQ ID NO: 88601 - RNA, 46 nt, Mus musculus
aagacacuucaaaggcacugaguuuaauuuguaaguguguacccaa

SEQ ID NO: 88602 - RNA, 46 nt, Mus musculus
gacucuuaaugcauucugccuuuuaaaagcauuuuauauggcucag

SEQ ID NO: 88603 - RNA, 42 nt, Mus musculus
agagaaggagaaaguagagaaguagagguuggccaugagcac

SEQ ID NO: 88604 - RNA, 46 nt, Mus musculus
uguccuuggagcuggaacuuuccauacuuauuuucugcaaacugag

SEQ ID NO: 88605 - RNA, 45 nt, Mus musculus
uuuguaagucuugacaucuguggucauguauacucaguuaaccag

SEQ ID NO: 88606 - RNA, 74 nt, Mus musculus
gggacaugaaauaaaaauaaauacgguaucuauuaaaacuuugcuaugaucucacugggcuaagacgaccucaa

SEQ ID NO: 88607 - RNA, 99 nt, Mus musculus
caugugcaaaauugaaugagggccaauuugaauaacuguuaagauaacagaaaaguggcccauggcaguacuugauacauauuaaugugaauugugcag

SEQ ID NO: 88608 - RNA, 78 nt, Mus musculus
agcccguuuccagcugcuggcuagugguuaccuaagcaccaauuccugcagccaacaggcaccuaucauguccaaaau

SEQ ID NO: 88609 - RNA, 47 nt, Mus musculus
uugguuguuggucuuucauaauguuacuacccuccaguguuccccca

SEQ ID NO: 88610 - RNA, 47 nt, Mus musculus
uuaauuauugcaacucugccuuaacucauuuuccugcaacagcccgu

SEQ ID NO: 88611 - RNA, 59 nt, Mus musculus
auccugaugugccacccacucugguguuaccugauugccugccgaauagaaucuaacuc

SEQ ID NO: 88612 - RNA, 66 nt, Mus musculus
ucuuaagugaacauaaaagccugaguaggagcuguauauaaauuaccauaauuuuaaaugagccug

SEQ ID NO: 88613 - RNA, 46 nt, Mus musculus
ugguacucccuguccucaugguaguccauguucacuuugccguugu

SEQ ID NO: 88614 - RNA, 46 nt, Mus musculus
gucuccagggaggagauagcuccuggccugugaaggucuuuggaag

SEQ ID NO: 88615 - RNA, 44 nt, Mus musculus
uuaauaagagcacaacagaaagggaaagggagaaacaagagaaa

SEQ ID NO: 88616 - RNA, 45 nt, Mus musculus
cacccccaguccagcuguaacuucuguuauaucucaaucccccca

SEQ ID NO: 88617 - RNA, 45 nt, Mus musculus
uguuuuuguuuuuuacauugauaggauuuuuuuuguagccaccaa

SEQ ID NO: 88618 - RNA, 46 nt, Mus musculus
aaauuaaggauuccauauccauugaccuuaaccgucuagucaucag

SEQ ID NO: 88619 - RNA, 46 nt, Mus musculus
uuuccccagaauuaaauucugauuuacagagaauuucacugcucua

SEQ ID NO: 88620 - RNA, 44 nt, Mus musculus
aacuuacuaagaacagcuguggauuguuucuguuuauccuuaca

SEQ ID NO: 88621 - RNA, 46 nt, Mus musculus
guucaaugguagaauaguacuuaccuagcauucuuauugcccugag

SEQ ID NO: 88622 - RNA, 84 nt, Mus musculus
uagaagagaaaaaagacccaccccaaguucugucccuggggaaaggaaugagaagcuauaguugugauaaggaauaagccugaa

SEQ ID NO: 88623 - RNA, 23 nt, Mus musculus
acuugguccagaagaaguuaggg

SEQ ID NO: 88624 - RNA, 46 nt, Mus musculus
gucaaugugacuguggacuacauuagaccagccagcccagccacag

SEQ ID NO: 88625 - RNA, 45 nt, Mus musculus
ucuaauagauuaaauuuugauuaacuucacuaugggguuggcaag

SEQ ID NO: 88626 - RNA, 46 nt, Mus musculus
uagacccaucuuuccaguuuauaaacacaguuuuauuaucugugag

SEQ ID NO: 88627 - RNA, 44 nt, Mus musculus
auuuguuuuauggaucacacauucaacuauggaauagcggacau

SEQ ID NO: 88628 - RNA, 49 nt, Mus musculus
aaagguauuuguugaguuuuugccaaguagaccaaaccuuccuguucuu

SEQ ID NO: 88629 - RNA, 46 nt, Mus musculus
uuugugccauuucuccuccaguccuucccccucugcuucccaucuu

SEQ ID NO: 88630 - RNA, 46 nt, Mus musculus
cuuucuaccuguccauuuucuuuagagcuuuauuuuuucuggguug

SEQ ID NO: 88631 - RNA, 46 nt, Mus musculus
ccauacuuuucuuguuucucacauuuacuuaugagcccagccacgg

SEQ ID NO: 88632 - RNA, 46 nt, Mus musculus
aacuaugcucagucauucuuggccuuucaucuuuuuagaacuugag

SEQ ID NO: 88633 - RNA, 46 nt, Mus musculus
cauuuguguuucuagaaucuagucuuuuccagggcuuggcaccauu

SEQ ID NO: 88634 - RNA, 47 nt, Mus musculus
auuuauuuauagaccuuucucauuccucuucuuacuccagccccauc

SEQ ID NO: 88635 - RNA, 46 nt, Mus musculus
uggcuggggucagcgagcaaaguuaggguggugaaagaucguauug

SEQ ID NO: 88636 - RNA, 45 nt, Mus musculus
gaccaggagggaauacagucuagguguucaacaagauacacucag

SEQ ID NO: 88637 - RNA, 25 nt, Mus musculus
gaagacacaguggacgucucagcaa

SEQ ID NO: 88638 - RNA, 46 nt, Mus musculus
ugugaaugcauggcauauuuagcuaugaguagaccaauuuggcugg

SEQ ID NO: 88639 - RNA, 45 nt, Mus musculus
ucucauuacagcugcauuccaauuuuauuguucuuccuugcccag

SEQ ID NO: 88640 - RNA, 45 nt, Mus musculus
uuuuuguuguuuguuuguuuaacaauaaaccauuuauggccccac

SEQ ID NO: 88641 - RNA, 46 nt, Mus musculus
auuaacuuacucauuaauauauuuuucuguuacuuucaauauuaag

SEQ ID NO: 88642 - RNA, 46 nt, Mus musculus
ccaucuuuugccacaacaucuuccuagcccuuucuuagcagccagg

SEQ ID NO: 88643 - RNA, 44 nt, Mus musculus
aacugucccuucaggggacgucuguaacuaggaaaagaagcuaa

SEQ ID NO: 88644 - RNA, 45 nt, Mus musculus
aaagucuguggcaggcuuaaaucagucuguaaauguuugcugaug

SEQ ID NO: 88645 - RNA, 47 nt, Mus musculus
ggcacggucaaagagggugugucucauucuauagugggcauagugug

SEQ ID NO: 88646 - RNA, 46 nt, Mus musculus
caaacaguugucauuucuguugacugagugccaucugaagccccag

SEQ ID NO: 88647 - RNA, 46 nt, Mus musculus
ccggcaggaugacgaccagaggucuucacacuacgaugagcugcua

SEQ ID NO: 88648 - RNA, 42 nt, Mus musculus
agcagagcaguggaauguauaaccccugucuccaggucuggg

SEQ ID NO: 88649 - RNA, 46 nt, Mus musculus
ugaguguuguuuaaugaguaugcauauauaaagaaaucuggagaag

SEQ ID NO: 88650 - RNA, 45 nt, Mus musculus
ccgaaggcaauacaggcccgguaaaggauuaugaggaacagccaa

SEQ ID NO: 88651 - RNA, 46 nt, Mus musculus
uuuauugggcuuacacuuacaaaucauaguccaucuuuggaggaag

SEQ ID NO: 88652 - RNA, 46 nt, Mus musculus
uuucucugaaauagccucuuggcuuccuuucauuuuaacucuggag

SEQ ID NO: 88653 - RNA, 45 nt, Mus musculus
acuuuaucuacagugguaccauuuuuuaaauguauaagugggaag

SEQ ID NO: 88654 - RNA, 46 nt, Mus musculus
auguuguguuuguguguguguguguguguguguguguguguggaga

SEQ ID NO: 88655 - RNA, 50 nt, Mus musculus
gguuuaguauagaguuuauuuggggcauggaaagggggaauugaaaaggg

SEQ ID NO: 88656 - RNA, 48 nt, Mus musculus
agagggagaaacagguuagggagucagggaaaguaagagggcaaggag

SEQ ID NO: 88657 - RNA, 46 nt, Mus musculus
gcaugcagucgugccguugaccugccuaccaguauccuggcgauaa

SEQ ID NO: 88658 - RNA, 24 nt, Mus musculus
aaguaagcaaagaggucagcccag

SEQ ID NO: 88659 - RNA, 23 nt, Mus musculus
gcuccuuuccccacaccccagcc

SEQ ID NO: 88660 - RNA, 46 nt, Mus musculus
agcaccuagggugcacaguccuuuucaacuccuaccgugugugccg

SEQ ID NO: 88661 - RNA, 46 nt, Mus musculus
uuacgaauggcagguauguuuagcauuaaguugagucuuuuguaag

SEQ ID NO: 88662 - RNA, 45 nt, Mus musculus
ggcugcagaggucugagguauucaguuuuguuuugucuuguuuug

SEQ ID NO: 88663 - RNA, 46 nt, Mus musculus
guaguuguuaaaauuaauacauacauauauucugaacaguuggcag

SEQ ID NO: 88664 - RNA, 46 nt, Mus musculus
gcacaugugauaaugggaccugcauagugccugaaaacuccgagag

SEQ ID NO: 88665 - RNA, 45 nt, Mus musculus
auaguugugucuacaaagccacagaggauuuaguuccuccuuauu

SEQ ID NO: 88666 - RNA, 46 nt, Mus musculus
uuguuccagugguuagcacucaauucagacuguccuuagcuugcag

SEQ ID NO: 88667 - RNA, 46 nt, Mus musculus
caugaguucaaaucccagcaaccacaugacggcuuauaaccaccaa

SEQ ID NO: 88668 - RNA, 51 nt, Mus musculus
uagguacaucaccugaggaaaguuauucuuuucaucugagccacagaaaua

SEQ ID NO: 88669 - RNA, 41 nt, Mus musculus
cauaacaaggaaagacagacaccguccuguagcugugacug

SEQ ID NO: 88670 - RNA, 41 nt, Mus musculus
cuccuacugcucauacacauucauccacucacaaaggacac

SEQ ID NO: 88671 - RNA, 46 nt, Mus musculus
gagcuuugcuuucuauucguccacagccagaaucccuuggccccuu

SEQ ID NO: 88672 - RNA, 46 nt, Mus musculus
aacucggaggagccagcacagucagaguuaaaacaucaagugugca

SEQ ID NO: 88673 - RNA, 46 nt, Mus musculus
acuagccaaggcuggugguagaagccuauaaucacaguacugagga

SEQ ID NO: 88674 - RNA, 46 nt, Mus musculus
ucugcuugcuucugugggaaccccugcugcuucaacucaagguaga

SEQ ID NO: 88675 - RNA, 46 nt, Mus musculus
aucugggaguggaccauagggcucaaaggauaaaauaguguuucag

SEQ ID NO: 88676 - RNA, 46 nt, Mus musculus
cacuucaaauauuuuucugaacaaggcaaaguaauaaagucaucag

SEQ ID NO: 88677 - RNA, 46 nt, Mus musculus
uguggagugugucagacuucuguggccuccaagucaaacuguucaa

SEQ ID NO: 88678 - RNA, 46 nt, Mus musculus
agugcuuuuuguggucuuauuaguucagagucuugguuuaggugag

SEQ ID NO: 88679 - RNA, 42 nt, Mus musculus
uguuguaugugcagggaaugcagaaauaacucuaaggcccug

SEQ ID NO: 88680 - RNA, 46 nt, Mus musculus
aucuuucucacucaugugguauuccuuguaagcagccugcuuugau

SEQ ID NO: 88681 - RNA, 58 nt, Mus musculus
cucaaaugcauauugcaaaucaaggugcauucuggguagacaaccaaaauucugcagu

SEQ ID NO: 88682 - RNA, 45 nt, Mus musculus
ucucucucucucucucucucucuccucugcuaacuaauuccugag

SEQ ID NO: 88683 - RNA, 46 nt, Mus musculus
caauagugccuuucuugugguauaaccaaaaacaaagcucaaaaag

SEQ ID NO: 88684 - RNA, 40 nt, Mus musculus
uacguaccuaagagagcauggcuaggacaugugauugugg

SEQ ID NO: 88685 - RNA, 44 nt, Mus musculus
uaaaaauguuaacaguguugauuaacaauacugcuaagcagucc

SEQ ID NO: 88686 - RNA, 46 nt, Mus musculus
uuguauuguuaauauacugguccguuugccaucuguguuuguaaag

SEQ ID NO: 88687 - RNA, 45 nt, Mus musculus
gcacaggcuucucuuagcccuggguguuuguucacaagggugcaa

SEQ ID NO: 88688 - RNA, 42 nt, Mus musculus
uauuucucacucucccucccuccuuccaucucucuccccauu

SEQ ID NO: 88689 - RNA, 46 nt, Mus musculus
auggagugcugaguggggacuucuugguuuauauugugaggugaaa

SEQ ID NO: 88690 - RNA, 41 nt, Mus musculus
uagccauuuucuuucaacaggaaauagaaaaacagggucua

SEQ ID NO: 88691 - RNA, 46 nt, Mus musculus
uagcucucuuguaguuuucuugccccauggccuuaacugccuccag

SEQ ID NO: 88692 - RNA, 46 nt, Mus musculus
ggaagugacuuugaggagguucuaggaaucagaaucauggcccugu

SEQ ID NO: 88693 - RNA, 46 nt, Mus musculus
ucuuguggauuaauugucuguaauuauauuguaaaauaauaugcau

SEQ ID NO: 88694 - RNA, 46 nt, Mus musculus
uucaauuaaguccaaaguaauuuuucuucaaagguaucuugccaag

SEQ ID NO: 88695 - RNA, 68 nt, Mus musculus
aguaaaccuccagacaacauguuagaggcauuagguaugaggauagaguagagcuagugacaucugug

SEQ ID NO: 88696 - RNA, 46 nt, Mus musculus
cuagagcagugcucaauuagccaauuaauaaaaaugaauaugccau

SEQ ID NO: 88697 - RNA, 45 nt, Mus musculus
caccaaccuaggaugguagugauguuaauagcagcagcccacgag

SEQ ID NO: 88698 - RNA, 46 nt, Mus musculus
gauaccuggugguuguagcccucaggacucugcaguauggcccgac

SEQ ID NO: 88699 - RNA, 46 nt, Mus musculus
ggacaaaaggaggagaccaguuuguccuuuuugggugucaaaacag

SEQ ID NO: 88700 - RNA, 63 nt, Mus musculus
cugucaaucaaauaucuccaucucucuuuaacccuuaacuuuuagaaguuaucacaacaaaaa

SEQ ID NO: 88701 - RNA, 46 nt, Mus musculus
uauguauuauaguaaaagccauuuucauaagauuuugaaauuaaag

SEQ ID NO: 88702 - RNA, 42 nt, Mus musculus
ugcgcuaccuuuugggcuaggcuagguucccguaagcccccu

SEQ ID NO: 88703 - RNA, 46 nt, Mus musculus
ccaaagaugagcugccaugaagcucccccucuugagaaacagucag

SEQ ID NO: 88704 - RNA, 42 nt, Mus musculus
uagaauucaggggucugaaugaggaauguucuguugaguaga

SEQ ID NO: 88705 - RNA, 45 nt, Mus musculus
uaaaaagaauuguuaggacagagcaugcacuggcucaugugggua

SEQ ID NO: 88706 - RNA, 46 nt, Mus musculus
auuugagguauuauuaauuggacacccaaggagaaaucucugucag

SEQ ID NO: 88707 - RNA, 46 nt, Mus musculus
uaucagagcguguguguguguguguguguguguguguguguccgag

SEQ ID NO: 88708 - RNA, 46 nt, Mus musculus
cucaggaucagaucaacaagaacuguguagacauuucaggggccag

SEQ ID NO: 88709 - RNA, 45 nt, Mus musculus
gccaccgcaggucugguccccugcauauagcagcccccaccccac

SEQ ID NO: 88710 - RNA, 41 nt, Mus musculus
gaaagcaggagagcccgcucuaguuuaugaccugaggcacc

SEQ ID NO: 88711 - RNA, 42 nt, Mus musculus
caaaguuguuccuugaugaugccuggauaaugacacccccau

SEQ ID NO: 88712 - RNA, 45 nt, Mus musculus
agacuauaaaguauuauaagcaacuguuacaacuguggggugggg

SEQ ID NO: 88713 - RNA, 45 nt, Mus musculus
ccaucuucuucacuuagguuucauguuauagucccucuuguguga

SEQ ID NO: 88714 - RNA, 45 nt, Mus musculus
aggagcugggcuccacuguugcaaauucuucuuugagaggcauuu

SEQ ID NO: 88715 - RNA, 46 nt, Mus musculus
cuugguuggaccugaaauuguacuuuccucccccaaguagaagcag

SEQ ID NO: 88716 - RNA, 46 nt, Mus musculus
auccuggcacggaucucuccuccuuucaucuuuaguccugacccag

SEQ ID NO: 88717 - RNA, 46 nt, Mus musculus
uuguguuuuuguaauuuguacaguaucguucaaggguguuaaagag

SEQ ID NO: 88718 - RNA, 46 nt, Mus musculus
cagaaagcauuucugguuuuuuagaaacuccauuuuuaggcaaaga

SEQ ID NO: 88719 - RNA, 46 nt, Mus musculus
agugacagcggugucuccagaggaguggguggugugacggaagcag

SEQ ID NO: 88720 - RNA, 45 nt, Mus musculus
gguuuaucugcuaccuaguaaacacagggaggugucagggcugga

SEQ ID NO: 88721 - RNA, 62 nt, Mus musculus
caucaauuaaaauaguguaaaauagcaacugggcaaaauccauaaaggucagaguagcugua

SEQ ID NO: 88722 - RNA, 41 nt, Mus musculus
cacaguaauuuaauuauauuugccucccucuguggcccaca

SEQ ID NO: 88723 - RNA, 45 nt, Mus musculus
gaugugaagaugacaucacccagaguugauauaugcuuuuacacg

SEQ ID NO: 88724 - RNA, 44 nt, Mus musculus
aagaaguugcugcagagaggcaauaagauguaaauaucagagga

SEQ ID NO: 88725 - RNA, 42 nt, Mus musculus
gcugcagucuuuccucuaauguguugcuauaacuaccccuga

SEQ ID NO: 88726 - RNA, 42 nt, Mus musculus
ugaugccaacuaguuguggugauagagugagugggggcagaa

SEQ ID NO: 88727 - RNA, 46 nt, Mus musculus
uacaaauuugugaugcuuuuuaaaauuauuuuguuuaauaagauag

SEQ ID NO: 88728 - RNA, 46 nt, Mus musculus
uuuuuuguuuuuaaauuuuaauauaaucuuuuuuaaccagcccaua

SEQ ID NO: 88729 - RNA, 49 nt, Mus musculus
uagaaaaacccugcgaaacuacugagcggccccucaucuaccagcccac

SEQ ID NO: 88730 - RNA, 45 nt, Mus musculus
cacguugcgaccauccccacccaauucccugucaccuaccucgga

SEQ ID NO: 88731 - RNA, 42 nt, Mus musculus
gacuuuaguuuuaauuaacaaagggggaaguagugggggcag

SEQ ID NO: 88732 - RNA, 41 nt, Mus musculus
cgucuccuccucgcgccgggcucgcgguguugcagguggca

SEQ ID NO: 88733 - RNA, 23 nt, Mus musculus
uugaagauauuaucaaaugcuug

SEQ ID NO: 88734 - RNA, 42 nt, Mus musculus
uccaccaugcauucauugacccauccuugggucuucagggag

SEQ ID NO: 88735 - RNA, 46 nt, Mus musculus
gagccaagcacagccaggcacaggcacuagugacuaccagccccau

SEQ ID NO: 88736 - RNA, 46 nt, Mus musculus
ccaacuggugacagaaauacagguuaaaaaugaguaagcuggagag

SEQ ID NO: 88737 - RNA, 46 nt, Mus musculus
aaauuggugagcuucagggcaacgauagaccuugucucaauguaga

SEQ ID NO: 88738 - RNA, 42 nt, Mus musculus
acagaccuuccacucuacacugcggagcuggagacaggaaag

SEQ ID NO: 88739 - RNA, 42 nt, Mus musculus
agguuuaugauaggcuccuugucuuaagcauuagugacccca

SEQ ID NO: 88740 - RNA, 45 nt, Mus musculus
auguuacuagcugagccuuugugguacagucccagaacacugaaa

SEQ ID NO: 88741 - RNA, 45 nt, Mus musculus
acagucuuuuccucauucauuuucuguacuccuuucugaccucag

SEQ ID NO: 88742 - RNA, 43 nt, Mus musculus
gcugacacugacugcacuuuuacaaaacuucuggagcuguuag

SEQ ID NO: 88743 - RNA, 46 nt, Mus musculus
aacgacaaacguuacugucuuuaagcuaagugguucaauuagccgu

SEQ ID NO: 88744 - RNA, 46 nt, Mus musculus
aaugaggugaguuguacauguauccucccugcugcuagaccgucag

SEQ ID NO: 88745 - RNA, 48 nt, Mus musculus
cugcucagggagggauggagugguaagguccauccaugggggguuuag

SEQ ID NO: 88746 - RNA, 44 nt, Mus musculus
uuccaacacagcccugaggauugcacccaguuagucucccugua

SEQ ID NO: 88747 - RNA, 46 nt, Mus musculus
agcugaccauguggaugccggagauaacaaaaauagaaaagggaag

SEQ ID NO: 88748 - RNA, 42 nt, Mus musculus
ugcacauagcgugcacagugcguggauuggcaaagaggcagg

SEQ ID NO: 88749 - RNA, 42 nt, Mus musculus
ugagacgcugaggugagaugagaugagaugagcugcagucgu

SEQ ID NO: 88750 - RNA, 46 nt, Mus musculus
ugaggaagaauucucagcuaagaucaagaaaaagccaagauugaag

SEQ ID NO: 88751 - RNA, 41 nt, Mus musculus
uacccaggcuuucccuguguuuccaguagcuucuuggccuu

SEQ ID NO: 88752 - RNA, 45 nt, Mus musculus
uaguuugagguuuguuuguuuaucaguuuaggguguuuuguugug

SEQ ID NO: 88753 - RNA, 45 nt, Mus musculus
gcucccacccccuuuagcuugauggugaggagaacacacacacua

SEQ ID NO: 88754 - RNA, 73 nt, Mus musculus
ggggacagugacccauaccugagcacuuccugucaacuccauuuggcuaaccuucacuuguuuauaaggaccc

SEQ ID NO: 88755 - RNA, 46 nt, Mus musculus
cucuggguaaggagacuaauccagaagagguuuguccugcccccaa

SEQ ID NO: 88756 - RNA, 41 nt, Mus musculus
acuauaaaucaacacagccguccuuggcucucuuggggaaa

SEQ ID NO: 88757 - RNA, 46 nt, Mus musculus
cuccacccugugagcucccuguuuaaccugugcucaugaggcccau

SEQ ID NO: 88758 - RNA, 45 nt, Mus musculus
acaaguuuuuacacuuagcagcaaaggcuuuuaaaggccccuaua

SEQ ID NO: 88759 - RNA, 46 nt, Mus musculus
cagugccuacuacaagccucuccugucugcugaggaagcugccaag

SEQ ID NO: 88760 - RNA, 77 nt, Mus musculus
acccggugcugucgccuagggcucuuucacuugaggacucauuagcaguuucugcucucacccugucagucagcucc

SEQ ID NO: 88761 - RNA, 46 nt, Mus musculus
caccagggugcugagagaucgagggugagaagcaugggugcuggca

SEQ ID NO: 88762 - RNA, 42 nt, Mus musculus
ugggaagagaaaaggaggagggggaagguugauaaggggacu

SEQ ID NO: 88763 - RNA, 42 nt, Mus musculus
acaguggccauuggaaagccugagagaggauugcccagggac

SEQ ID NO: 88764 - RNA, 46 nt, Mus musculus
ugguuguaagugauccaucuuuuugcccccaagagacauugggcag

SEQ ID NO: 88765 - RNA, 33 nt, Mus musculus
ccuucgccuucauccaggugccccaagauguga

SEQ ID NO: 88766 - RNA, 44 nt, Mus musculus
agauaagggcagccaauccaggcccauuuggaggguuagggagg

SEQ ID NO: 88767 - RNA, 46 nt, Mus musculus
uuccucagaaacaggccaggugaguggguacccaaaacuuggauau

SEQ ID NO: 88768 - RNA, 46 nt, Mus musculus
uuccgcgcugaugacgcugaugaguuuggcuacagucgcuaaggag

SEQ ID NO: 88769 - RNA, 46 nt, Mus musculus
ccgugacacagaggcagcugucagcuggcacccaccucguccccca

SEQ ID NO: 88770 - RNA, 42 nt, Mus musculus
ugucucaaaccccagcacugcaaaagggaguugggggaggga

SEQ ID NO: 88771 - RNA, 45 nt, Mus musculus
cugaagaaagcagaggagaaagaaagauggcugggaagacuggaa

SEQ ID NO: 88772 - RNA, 46 nt, Mus musculus
caacagacauggggaggucaguaccugggugaggguauauacgggg

SEQ ID NO: 88773 - RNA, 46 nt, Mus musculus
gggcagaagguucaggauucugucaaaaauaucguuuccugggcag

SEQ ID NO: 88774 - RNA, 41 nt, Mus musculus
uuccaguagccuacagugacaagagagaggcacugcugcca

SEQ ID NO: 88775 - RNA, 29 nt, Mus musculus
gauggaauggaaggagcagguagaguagg

SEQ ID NO: 88776 - RNA, 42 nt, Mus musculus
cucgugccuguaaucucaguacugaggaggcugaggcaggag

SEQ ID NO: 88777 - RNA, 28 nt, Mus musculus
gucuaacaacaacaaaaguccacaaagg

SEQ ID NO: 88778 - RNA, 42 nt, Mus musculus
aaaaaugagcaauggagugaugcuacgucucaaagaaagggg

SEQ ID NO: 88779 - RNA, 46 nt, Mus musculus
auuuuugcugugcacugcucaguagauccacagagaagggcuugag

SEQ ID NO: 88780 - RNA, 46 nt, Mus musculus
cuguugucagcccucaugggcuggcucagggggauucaagugggag

SEQ ID NO: 88781 - RNA, 41 nt, Mus musculus
gggccacuccaugucacauguuaccuagaaaaucggcagcc

SEQ ID NO: 88782 - RNA, 42 nt, Mus musculus
gagaaagucccuggaauccagccccguuaacucaggcugggg

SEQ ID NO: 88783 - RNA, 46 nt, Mus musculus
ggagucuagagguuagcacuuugagccgcaaauuuaaagaggguag

SEQ ID NO: 88784 - RNA, 46 nt, Mus musculus
aaggcggggcaacauggcaguggccaggcaggcuuggugcaggcag

SEQ ID NO: 88785 - RNA, 41 nt, Mus musculus
gauagggagguguuauuagacgcguucucacgaccggccag

SEQ ID NO: 88786 - RNA, 46 nt, Mus musculus
acugcagguucugccucucaucaggggcaggcuuccugcugaguag

SEQ ID NO: 88787 - RNA, 46 nt, Mus musculus
aucaucaucucagauuaucuccccauuaaaacaucugccuugagac

SEQ ID NO: 88788 - RNA, 42 nt, Mus musculus
ugugaaagaugaagcucacuggaggcaaaccaacccccgugc

SEQ ID NO: 88789 - RNA, 46 nt, Mus musculus
uuuuggaugugucucauuuuuaauauacacaaauauaguaugaguu

SEQ ID NO: 88790 - RNA, 39 nt, Mus musculus
agcccgcuucaaccagcugguugaacaauauaagcagaa

SEQ ID NO: 88791 - RNA, 41 nt, Mus musculus
uguaugucuauaaacuacaggcaugccuaguaccccuagag

SEQ ID NO: 88792 - RNA, 45 nt, Mus musculus
agccaaagccccagaugggccagcggaagcaaaagaagcagcagu

SEQ ID NO: 88793 - RNA, 42 nt, Mus musculus
ucuccuaugcucuuuuagauggcaaggacacuaaccagagaa

SEQ ID NO: 88794 - RNA, 46 nt, Mus musculus
caaggcugaaguggagcagguggagcugccugacgggaagaagaga

SEQ ID NO: 88795 - RNA, 64 nt, Mus musculus
ccugugaccaguaagccccaaaaggagcaaaaagaaguuggaaaagacaagcaacagaaaguag

SEQ ID NO: 88796 - RNA, 46 nt, Mus musculus
gggagaagaaggagguuucagagagagaggacgcagaggcagaggg

SEQ ID NO: 88797 - RNA, 30 nt, Mus musculus
agcuaggacuagguuauuaaagcccacgcc

SEQ ID NO: 88798 - RNA, 46 nt, Mus musculus
uagcugugacccgggaugaggcagcaaagcuucagacaaagaaggu

SEQ ID NO: 88799 - RNA, 45 nt, Mus musculus
agauuaauauaguaggcuaacucaggagucaccaucuagagagau

SEQ ID NO: 88800 - RNA, 46 nt, Mus musculus
aacuagaaucucuuagaacacccagagugcgggcgcggcacuauuu

SEQ ID NO: 88801 - RNA, 46 nt, Mus musculus
ugcccagccaagucacagggagguaaaccaucauaagccuugaggu

SEQ ID NO: 88802 - RNA, 60 nt, Mus musculus
ccaagaagucgagaaaggguggcuggugcuaacggucugcucucaccgcauccuugauuu

SEQ ID NO: 88803 - RNA, 46 nt, Mus musculus
acaguuuggggaucuuaaguauguccgaguugucuugcauccagac

SEQ ID NO: 88804 - RNA, 42 nt, Mus musculus
gcuguuagguugcagcuggaacaaguucugggggccacagug

SEQ ID NO: 88805 - RNA, 45 nt, Mus musculus
aggaaguggaggcaguuguaacaguagcguagcagcagagggaga

SEQ ID NO: 88806 - RNA, 77 nt, Mus musculus
ggauugacuagaggaggcagaggauaagagguuuaggauuucagagagugagagcauguacaaauaggggcugagga

SEQ ID NO: 88807 - RNA, 42 nt, Mus musculus
auagagacuguuuagauaaaggacacugaaugagggcuuuga

SEQ ID NO: 88808 - RNA, 46 nt, Mus musculus
ugucuuugcccccugggauuaaaggcaaguacuaccaugccuggac

SEQ ID NO: 88809 - RNA, 46 nt, Mus musculus
uacagugagguguccaugguugccaugacaagagagaacccaagau

SEQ ID NO: 88810 - RNA, 46 nt, Mus musculus
agccugcagggaaauggaacgagucauaaaaguggggcagcggcuu

SEQ ID NO: 88811 - RNA, 46 nt, Mus musculus
uuuaggggagucagcuggcagugauauugggcaaucauuuaggcag

SEQ ID NO: 88812 - RNA, 41 nt, Mus musculus
accuugacccaagugagggcuuggccacugagcgugugugu

SEQ ID NO: 88813 - RNA, 46 nt, Mus musculus
uggagagaggagcagagaaaguagugggcagcacugaaggaggauc

SEQ ID NO: 88814 - RNA, 45 nt, Mus musculus
ggucuguuacaagguuugagguugguguggaaagguugagggaau

SEQ ID NO: 88815 - RNA, 45 nt, Mus musculus
ucucagagaaaaagaagaggaaguuacccucggaugugacggaag

SEQ ID NO: 88816 - RNA, 46 nt, Mus musculus
aaaggagcuuaauguagaaaccacaaguucuucaccagcccacagu

SEQ ID NO: 88817 - RNA, 42 nt, Mus musculus
cauaacaaaacaaaaacaaaccuuuugaguugauacguagau

SEQ ID NO: 88818 - RNA, 42 nt, Mus musculus
acugcugacuggcugugucuccgcuucccucugcccccuuuu

SEQ ID NO: 88819 - RNA, 64 nt, Mus musculus
cuuccuaaacaccguccagcuuugaauaaauuaacgagaaguggacaccagcucugcccaggcu

SEQ ID NO: 88820 - RNA, 84 nt, Mus musculus
aggaaggaggcagcuccuaugaugaggggacaguggacagugagagcagcgcugaagaucaagaggaugaagguuugcugguau

SEQ ID NO: 88821 - RNA, 71 nt, Mus musculus
aagaaagcucagccgcuuacauaucagccccgaugaugagauccgaacugugcuguugcagagcagucaag

SEQ ID NO: 88822 - RNA, 51 nt, Mus musculus
aucagguaagaagaacugcaggguggaagaacaaguagaagauagugauga

SEQ ID NO: 88823 - RNA, 46 nt, Mus musculus
aaccuccuugaagcaggaaaagcucucaaaggcgcgaauaugaagg

SEQ ID NO: 88824 - RNA, 41 nt, Mus musculus
gggcagggaucuccuggcugauuggcagacuggggccuagc

SEQ ID NO: 88825 - RNA, 46 nt, Mus musculus
ucacuauggaacuguucuugaagugaauaucccaaagaagccaggu

SEQ ID NO: 88826 - RNA, 46 nt, Mus musculus
gagccaaagcacaaaaaagccaaaguggcagauaagaaagccagau

SEQ ID NO: 88827 - RNA, 45 nt, Mus musculus
uuuuaccuagcuuggaguguucugaagcuaaaaugaggccaggga

SEQ ID NO: 88828 - RNA, 46 nt, Mus musculus
acuaaccucacagaugagcagcuauauuuuuauuguacuuauggag

SEQ ID NO: 88829 - RNA, 33 nt, Mus musculus
ucaaguuugagaagcggaccaugucggcccaga

SEQ ID NO: 88830 - RNA, 42 nt, Mus musculus
uuuccucuucucuuucucuuuucuuuauuuuuugggggguga

SEQ ID NO: 88831 - RNA, 42 nt, Mus musculus
acggaggcgccuggugaauacuucuucucagauggggugagg

SEQ ID NO: 88832 - RNA, 42 nt, Mus musculus
cgaguacgcccgacguuuuggggugccgguaauagcggaugg

SEQ ID NO: 88833 - RNA, 46 nt, Mus musculus
gucccugcuaacaggauucaucccaggggaacucaguguaucagau

SEQ ID NO: 88834 - RNA, 42 nt, Mus musculus
aacgaucaagaugagcugguagccaucauugcgcgcacagac

SEQ ID NO: 88835 - RNA, 46 nt, Mus musculus
cugacaggagaggagacagugugauugucugcgugugggcccagag

SEQ ID NO: 88836 - RNA, 46 nt, Mus musculus
caccauggcacauaccuguaaucucagcagucugagccaagaagau

SEQ ID NO: 88837 - RNA, 41 nt, Mus musculus
ccuggccuggucgccagagucgaggugccauugcgggugau

SEQ ID NO: 88838 - RNA, 42 nt, Mus musculus
gcuggugcucagcagcuuggggaggugaucuggcagcugggu

SEQ ID NO: 88839 - RNA, 44 nt, Mus musculus
aucugcucaucugcuuacuuuucagccugaguggcgucucaugg

SEQ ID NO: 88840 - RNA, 46 nt, Mus musculus
gggucaaccagagccuagagugcuacagagggcagagcugaagaug

SEQ ID NO: 88841 - RNA, 45 nt, Mus musculus
ucagugucccugggacuagagggucacuuuuguuuguuuccugaa

SEQ ID NO: 88842 - RNA, 46 nt, Mus musculus
uaaguugggaaugauagcgcuccaguuuaauuuaacaugaagguag

SEQ ID NO: 88843 - RNA, 46 nt, Mus musculus
ugggcgugguggugcacgccuuuaauccccagcacuugggaggcag

SEQ ID NO: 88844 - RNA, 32 nt, Mus musculus
ccguuaggcuguaacacauuagaauuaaacag

SEQ ID NO: 88845 - RNA, 42 nt, Mus musculus
agcuuuuuuaucccugauguuuugauagauuaaguuggccag

SEQ ID NO: 88846 - RNA, 46 nt, Mus musculus
acuagacaagugugaaaugauuugucauuaacaugccuuuuaagag

SEQ ID NO: 88847 - RNA, 42 nt, Mus musculus
uuuagugauaagauagaaaaccaaauuucaaagcggcugcag

SEQ ID NO: 88848 - RNA, 45 nt, Mus musculus
ucuuccuuuguucuacuucccaaaacuuugaagcagauccagaga

SEQ ID NO: 88849 - RNA, 46 nt, Mus musculus
aacuugauuacaucuacaaggacuauauuuccaaauaaaggcacau

SEQ ID NO: 88850 - RNA, 46 nt, Mus musculus
uguuguuguuacuugugaauggacauccagauggguuggugacaag

SEQ ID NO: 88851 - RNA, 61 nt, Mus musculus
caugagccucagcucagcgauaaaguucacaaugaugcucagaauuuugacuaugaccaug

SEQ ID NO: 88852 - RNA, 53 nt, Mus musculus
augccuucuugggugcagaagaggcaaagaguuuugaucagcugacaccagaa

SEQ ID NO: 88853 - RNA, 46 nt, Mus musculus
gcguauugaggacuuagugagccuccucuggcuuugcgggugguag

SEQ ID NO: 88854 - RNA, 44 nt, Mus musculus
gccaucuugcuacauucccuuuccugucaguguuguagggcuga

SEQ ID NO: 88855 - RNA, 72 nt, Mus musculus
aaggauggguuugucacuguggaugaacucaaaggcuggauuaaguuugcacaaaagcgcuggauucacgag

SEQ ID NO: 88856 - RNA, 45 nt, Mus musculus
gaaggggcacgaccucaaugaggauggccucguuuccugggagga

SEQ ID NO: 88857 - RNA, 49 nt, Mus musculus
cuuguagaaugauuguagauaaaauagacgcggauaaagauggguuugu

SEQ ID NO: 88858 - RNA, 49 nt, Mus musculus
cuccugggaugaguacagaaacgugacuuauggcacuuacuuggguaag

SEQ ID NO: 88859 - RNA, 45 nt, Mus musculus
auauauauauauauaccuaccuaccucuuuagaguaaguuucaug

SEQ ID NO: 88860 - RNA, 46 nt, Mus musculus
auacccacccaauuaagaacauguguauuaagaacccagcacagau

SEQ ID NO: 88861 - RNA, 46 nt, Mus musculus
uacuguauguacugucugucuaauaaguaaaauaaaagauaccaag

SEQ ID NO: 88862 - RNA, 42 nt, Mus musculus
acagaugaggagacugaaauacaguuaaguuucuugcccaag

SEQ ID NO: 88863 - RNA, 46 nt, Mus musculus
cagauagacacaagacauucaagucuucuacuaaccuuaacaccag

SEQ ID NO: 88864 - RNA, 45 nt, Mus musculus
aaucaaaagccauuucuucaugcuugguuuaacuucaccuggaua

SEQ ID NO: 88865 - RNA, 81 nt, Mus musculus
uccagauccugaugauggauuuaauuauaaacagaugauggucagagaugagcggagguuuaaaauggcagacaaggaugg

SEQ ID NO: 88866 - RNA, 76 nt, Mus musculus
agaccuaauugccacaaaggaagaguucacagcuuuccugcacccugaggaauaugacuacaugaaagacauaguc

SEQ ID NO: 88867 - RNA, 50 nt, Mus musculus
gaaaccauggaggauauagacaagaaugcugauggguucauugaucuaga

SEQ ID NO: 88868 - RNA, 46 nt, Mus musculus
gagaaauucaggcuugucacaguuacuugccaagcacuggggcccg

SEQ ID NO: 88869 - RNA, 41 nt, Mus musculus
aucuguccagcccccuuuacucccuuucuuauuuggcccag

SEQ ID NO: 88870 - RNA, 46 nt, Mus musculus
aagauggucugaaccaaaaaauuaauuccuuagucuuaucugguag

SEQ ID NO: 88871 - RNA, 27 nt, Mus musculus
cuuguuaucacaacacuuaggcugagg

SEQ ID NO: 88872 - RNA, 41 nt, Mus musculus
uuuauuuauuuuuguugauguguauguguuagguacuggag

SEQ ID NO: 88873 - RNA, 46 nt, Mus musculus
caaaaccaauggaagaaaauagcacuuacuguacacaugucaccau

SEQ ID NO: 88874 - RNA, 69 nt, Mus musculus
cauguacagucaugaugggaaugcugaugagccagagugggugaagacagagcgagaacaguucgugga

SEQ ID NO: 88875 - RNA, 82 nt, Mus musculus
guuucgagauaagaaccgggaugggaagauggacaaggaagagaccaaagacuggauccuccccucagacuaugaccaugca

SEQ ID NO: 88876 - RNA, 94 nt, Mus musculus
aaggaggagauugucgacaaguaugauuuauuugugggcagccaggccacagauuucggggaggccuuaguacgacaugaugaguucugagcug

SEQ ID NO: 88877 - RNA, 53 nt, Mus musculus
ugcgcuacugagacuguuauuacaaacuuuuuaagacgugaaaaggcauauug

SEQ ID NO: 88878 - RNA, 96 nt, Mus musculus
uuuauuuuuguauuguucucuaguuggggcuauacuaugaaggaucgagauccuccacccacacuuguaggcagauauuagcauuuacacguccuc

SEQ ID NO: 88879 - RNA, 78 nt, Mus musculus
auaguuuuuauaauucucacuuaacuaauuuuuuuaaagccugagaucaauaagaaauguucaggagagaaaaagcaa

SEQ ID NO: 88880 - RNA, 60 nt, Mus musculus
aaggaaaaccaugugugucaggaucgaugcuuagaggagaaugcuuucucuugccuguug

SEQ ID NO: 88881 - RNA, 43 nt, Mus musculus
uaauuuugucagacacagcugugcuaggaagaauuagggccag

SEQ ID NO: 88882 - RNA, 42 nt, Mus musculus
acucuuacuugaaaucacuguaaggccccauccagccccuuu

SEQ ID NO: 88883 - RNA, 46 nt, Mus musculus
gugccuuuaacaggaaaaaugaucacugaaugggaauuggacuaag

SEQ ID NO: 88884 - RNA, 46 nt, Mus musculus
ccuaaaccucacccugcugauuggaccagggauccucauaccucag

SEQ ID NO: 88885 - RNA, 56 nt, Mus musculus
ucucugacacaaaaaggugggguuguaggaggguuguagaucaucauguugccauc

SEQ ID NO: 88886 - RNA, 54 nt, Mus musculus
uucaccuguuuuggucucgaguugaugggccucuuaagaauuauuguaccccaa

SEQ ID NO: 88887 - RNA, 46 nt, Mus musculus
acaucuguauaaucuuuauuacuuccuauaucucugaacaacacau

SEQ ID NO: 88888 - RNA, 24 nt, Mus musculus
caucaagcucuugauagcagauac

SEQ ID NO: 88889 - RNA, 50 nt, Mus musculus
ucacugccuuccaggcccucaacuguauuguuaaggagaccagagauaau

SEQ ID NO: 88890 - RNA, 45 nt, Mus musculus
cucuaaugucuaugagccccucauaguguugggguuugggugugg

SEQ ID NO: 88891 - RNA, 46 nt, Mus musculus
cugcuacgugcccuaugcugcccuggccauguacauggucaacaau

SEQ ID NO: 88892 - RNA, 48 nt, Mus musculus
ggcuggagcaggugagaggauagggcagugcucugaugugggacgaga

SEQ ID NO: 88893 - RNA, 33 nt, Mus musculus
gaaucgucuauaagagggaccggaggugguagu

SEQ ID NO: 88894 - RNA, 64 nt, Mus musculus
gagagagagaguugugugcacaagagagagagagagagaguugugugcacaagagagagagaga

SEQ ID NO: 88895 - RNA, 42 nt, Mus musculus
ugggcuguccggcuagggcucucucucucucccggggcggag

SEQ ID NO: 88896 - RNA, 45 nt, Mus musculus
gcaaggguggcccgguggaaggaaaagaggggacuuugggcaggu

SEQ ID NO: 88897 - RNA, 77 nt, Mus musculus
acaucugcugugucacggagacagggcuauuuccaggccagagcaggaggguggggugugugugugugugugugugu

SEQ ID NO: 88898 - RNA, 46 nt, Mus musculus
uucucugccuaccaaagccuuucacuuacccccauggccggaugug

SEQ ID NO: 88899 - RNA, 42 nt, Mus musculus
caugggcauggaaauggaguagugaaggaucagcguccagau

SEQ ID NO: 88900 - RNA, 41 nt, Mus musculus
cggucuuugucauuguugggaaccacuuuggccuugugggg

SEQ ID NO: 88901 - RNA, 42 nt, Mus musculus
cuaguucugagggggagaagaggcaaagugagggugccaggc

SEQ ID NO: 88902 - RNA, 27 nt, Mus musculus
gagaucaagauggacaugaacccgggu

SEQ ID NO: 88903 - RNA, 42 nt, Mus musculus
aacuagguguugagauggcugaucauggggugugugggacau

SEQ ID NO: 88904 - RNA, 46 nt, Mus musculus
ggcaggccugugauuggacaggaaaagggaggcggagcuaggaguu

SEQ ID NO: 88905 - RNA, 42 nt, Mus musculus
aacagcuuaugucuuuugacauuguaguugaaacgugaagag

SEQ ID NO: 88906 - RNA, 45 nt, Mus musculus
caucgccauugucacgcaccuccacaggcucagccacaccuggac

SEQ ID NO: 88907 - RNA, 42 nt, Mus musculus
gucgggcagguaggacacaguauaugugccauccccauuguc

SEQ ID NO: 88908 - RNA, 41 nt, Mus musculus
acaaggcacuugcuggcauccccuguaggcagggcauggau

SEQ ID NO: 88909 - RNA, 44 nt, Mus musculus
uguucgcccccaaagcggauggugaugacauauuugcccggcuc

SEQ ID NO: 88910 - RNA, 42 nt, Mus musculus
auggcucaggccuggcccguaggcacugacauggcggcuguu

SEQ ID NO: 88911 - RNA, 45 nt, Mus musculus
cacgcucaccacgugcucaccgaccuccuuggggguaaaggagau

SEQ ID NO: 88912 - RNA, 46 nt, Mus musculus
ggacuccuccacucggacuucacgcuuggucuccccaccccgaguc

SEQ ID NO: 88913 - RNA, 42 nt, Mus musculus
cagugaacugaaaagggcuuccgggcacguguuggccgcggu

SEQ ID NO: 88914 - RNA, 42 nt, Mus musculus
uuuaguuuggggggcuuagacgggauuaggguggagcaaagg

SEQ ID NO: 88915 - RNA, 45 nt, Mus musculus
ugacaaccccuccccucccagugugugugugugugugugugugug

SEQ ID NO: 88916 - RNA, 42 nt, Mus musculus
gcaucugguguagauguggucggugggcuccaggagagagau

SEQ ID NO: 88917 - RNA, 42 nt, Mus musculus
guuucuugacggccugccccuaaacuuaagaaguaacaacuu

SEQ ID NO: 88918 - RNA, 23 nt, Mus musculus
cucuaaguuacagguucugucag

SEQ ID NO: 88919 - RNA, 61 nt, Mus musculus
gacucaaguccacugauggcuucaggguggcaccaucuaagccagguacccggugucacug

SEQ ID NO: 88920 - RNA, 42 nt, Mus musculus
gugugcaggccccagaguaugugcacggaggucagaggucag

SEQ ID NO: 88921 - RNA, 45 nt, Mus musculus
gggcuucaggggcugugcuaggucaugaucgcagggcuccuguga

SEQ ID NO: 88922 - RNA, 42 nt, Mus musculus
ccaugcaagccccacccugaguuugaccucuggaaaccgcag

SEQ ID NO: 88923 - RNA, 46 nt, Mus musculus
cacugcaugcuggugugugucuaucaugugugugcaucaucugcua

SEQ ID NO: 88924 - RNA, 44 nt, Mus musculus
ggggagggagaguuugcaaucaacaaagcugaaaggaacuggag

SEQ ID NO: 88925 - RNA, 46 nt, Mus musculus
ugcgcugcucaacauggggcccggguuccaaaguuugcaaaguugg

SEQ ID NO: 88926 - RNA, 51 nt, Mus musculus
uguagagaagaaagagaggaugaagguggaagacauuuaaggauuuggagg

SEQ ID NO: 88927 - RNA, 110 nt, Mus musculus
cuaagguucuuggcuugaugcagauguuggagcaggaacuuggaggacggcggguaccgagaagauagaacuguauucuauggagauaagguucuaaaguaaccuauagg

SEQ ID NO: 88928 - RNA, 46 nt, Mus musculus
uaacaguagcaaccuuacagucaucaaaauaauuucaugguuuggg

SEQ ID NO: 88929 - RNA, 46 nt, Mus musculus
acaugcacacuuaugauaauauguuugcauaaaugcaguauagaag

SEQ ID NO: 88930 - RNA, 46 nt, Mus musculus
gcuaugcacaccccaugaucugagcagcaugcccagaacccaagag

SEQ ID NO: 88931 - RNA, 46 nt, Mus musculus
ggugguaguagagguagggugaggauggaaguguggcuuugccuuu

SEQ ID NO: 88932 - RNA, 45 nt, Mus musculus
auuacagcuggaaaugucuccuaccaugcaugccaagcuagccag

SEQ ID NO: 88933 - RNA, 54 nt, Mus musculus
auauguggcucuguugccuagccaggguccagccagcaggaaaaagaccggaaa

SEQ ID NO: 88934 - RNA, 61 nt, Mus musculus
acugggaggaauuucuuacuggucuuucagaccucaaguugggauguuguuggugaugggu

SEQ ID NO: 88935 - RNA, 46 nt, Mus musculus
guguguguguguguguguguguguguguguguguaaaauuaguuug

SEQ ID NO: 88936 - RNA, 46 nt, Mus musculus
aaaagacaacugacuuccccaacuuguccucuaaaacauccacaag

SEQ ID NO: 88937 - RNA, 45 nt, Mus musculus
cucugaccacacuugagcucacacacacacacacacacacacaca

SEQ ID NO: 88938 - RNA, 65 nt, Mus musculus
acaggcuggagcaauagcugagaacuuagauguugagacaaccaccauaagggggagagagcgag

SEQ ID NO: 88939 - RNA, 46 nt, Mus musculus
ucuucugccauugccuguuauuccacaggguugugcauugcuuauu

SEQ ID NO: 88940 - RNA, 46 nt, Mus musculus
uauuuguuugggguguguguguguguguguguguguguguggugug

SEQ ID NO: 88941 - RNA, 64 nt, Mus musculus
uguguguguguggugucuguguguguguguguguguguguguggugugagugugugugugugug

SEQ ID NO: 88942 - RNA, 48 nt, Mus musculus
ggaaauucuacaagggcaagaaauacaagccccuggaccugcgaccca

SEQ ID NO: 88943 - RNA, 26 nt, Mus musculus
agucaaggccugagaugacaacgaca

SEQ ID NO: 88944 - RNA, 46 nt, Mus musculus
gguagauggagacuccgugaguggcaucuguuuuguaggcuacaag

SEQ ID NO: 88945 - RNA, 45 nt, Mus musculus
cucagcuccucaggacuuaaaccuagaaucccaggucuuucgaua

SEQ ID NO: 88946 - RNA, 66 nt, Mus musculus
gaacaagccaacauguggcugguugaggcagagaucuccccagaguuagagaagcguuugggccgg

SEQ ID NO: 88947 - RNA, 45 nt, Mus musculus
cuguguaugucuggcuagaagcagccaggccauggaaacaaguug

SEQ ID NO: 88948 - RNA, 46 nt, Mus musculus
aauucugguuuuaucccaggugacuuguagauaugauauaccacug

SEQ ID NO: 88949 - RNA, 42 nt, Mus musculus
cagcggguggcggggacccagaggcuccagcuccggcucccg

SEQ ID NO: 88950 - RNA, 46 nt, Mus musculus
aggaaaguaaucguuuggggcugucggcuuccuucauaaauagaaa

SEQ ID NO: 88951 - RNA, 45 nt, Mus musculus
auuacacuuaaaagaugcagccugggcuagugcuggaaguacuua

SEQ ID NO: 88952 - RNA, 45 nt, Mus musculus
gagaaaacuguacaaaugaaaaccucaaagaauuguaaaguuaga

SEQ ID NO: 88953 - RNA, 84 nt, Mus musculus
cugggaugagauuugcaguuuuuaugcagagucuuuuugaguugaguuucugaguaagacuaaguagaagccugaggccaccuu

SEQ ID NO: 88954 - RNA, 46 nt, Mus musculus
ccuguaugcuuaccaugugcaugcuugguacccacagaagccagga

SEQ ID NO: 88955 - RNA, 46 nt, Mus musculus
ugcucuuaacuaucgagccaguuccaacccauugggugcccccuaa

SEQ ID NO: 88956 - RNA, 45 nt, Mus musculus
ucuuagccuucacaagugcagggauuauaggcaucaugcaugcuu

SEQ ID NO: 88957 - RNA, 45 nt, Mus musculus
ggaccuaaaguucauuucacccagugggugguuucagucagccug

SEQ ID NO: 88958 - RNA, 51 nt, Mus musculus
cugaugaccuaugccuggaacccauguggugaaagagagaaccaagucccc

SEQ ID NO: 88959 - RNA, 44 nt, Mus musculus
aggguccuuucagcaaaaucuugcuaguguaaucaaugguguca

SEQ ID NO: 88960 - RNA, 42 nt, Mus musculus
caguuagugcucuuacccacugagccaucucuccagcccauc

SEQ ID NO: 88961 - RNA, 46 nt, Mus musculus
uaguggucaccucagagagacucaucuguuaauguuccuuuaccaa

SEQ ID NO: 88962 - RNA, 46 nt, Mus musculus
cuuaguccuaaggugauaguaucaguaaguuaccauucuugcccua

SEQ ID NO: 88963 - RNA, 46 nt, Mus musculus
gaacuugaacuuaguucucuaugaaaguguggaacugaggaacgua

SEQ ID NO: 88964 - RNA, 46 nt, Mus musculus
gguuguucaugguaugcauggugcauacacaguagauuugcaugaa

SEQ ID NO: 88965 - RNA, 42 nt, Mus musculus
agccugguggugaagauaaguaaugccagccaucagguaguu

SEQ ID NO: 88966 - RNA, 42 nt, Mus musculus
gguaggugcauagcuggcuuuuguugugaguaucucgggcag

SEQ ID NO: 88967 - RNA, 46 nt, Mus musculus
ccagaaaacgguuggaacuugaucagugaguugagugaggcuucag

SEQ ID NO: 88968 - RNA, 45 nt, Mus musculus
uuaugaaaagauuuguuuuuauuaaauuauuugugugugugucug

SEQ ID NO: 88969 - RNA, 45 nt, Mus musculus; identical to SEQ ID NO: 33337

SEQ ID NO: 88970 - RNA, 42 nt, Mus musculus
aagcacuucuaaccccucagccaucucuccagaucccuggag

SEQ ID NO: 88971 - RNA, 45 nt, Mus musculus
ugguugugagccaccaugugguugcugggaauugaacccaugacu

SEQ ID NO: 88972 - RNA, 46 nt, Mus musculus
uuugaucucacagagaucuguuugucccugccucuccagggcuaag

SEQ ID NO: 88973 - RNA, 45 nt, Mus musculus
auaagugguauaauuuucauauuaauuuauuuauugcauugguag

SEQ ID NO: 88974 - RNA, 45 nt, Mus musculus
cuugaaaggcagaggcaggugaauacaguuaagucuuagggugga

SEQ ID NO: 88975 - RNA, 46 nt, Mus musculus
cugcuuugaagcacaagaucauaguugaguaaagaaaacaugggag

SEQ ID NO: 88976 - RNA, 45 nt, Mus musculus
ugagaauuuugaaggucuuaggagagggugaguguaauuugcaug

SEQ ID NO: 88977 - RNA, 48 nt, Mus musculus
auaguuugugagagucauaucuauguauaagggagacauaaggaauca

SEQ ID NO: 88978 - RNA, 46 nt, Mus musculus
auuugaaggcaaagucauuauuagaguuaaaaauugggcuggagag

SEQ ID NO: 88979 - RNA, 46 nt, Mus musculus
guaguuccacacagugagaauucugacuguuuugaguaaccuaaag

SEQ ID NO: 88980 - RNA, 46 nt, Mus musculus
agucuucucaguugggucaucucaccacaguugaggaagugaucug

SEQ ID NO: 88981 - RNA, 106 nt, Mus musculus
acaucacauugaaggauuccaucuugugacuuucaugcuuguuuccuuugccucucuguauguucaguguauggcuguugauaauugaaagggagagugaggacug

SEQ ID NO: 88982 - RNA, 46 nt, Mus musculus
ugcuguucuuuuagaagaccuuaaaugucuguaauuccagagccag

SEQ ID NO: 88983 - RNA, 46 nt, Mus musculus
uagaauuauguaccaggaaggucugaauuuuuaaaauuuuuaccag

SEQ ID NO: 88984 - RNA, 45 nt, Mus musculus
uuugaagaguaugauuggguagaaucugucuguuugauaguuguu

SEQ ID NO: 88985 - RNA, 42 nt, Mus musculus
aagccccucccaugucccccacucucaaauugauagccccgu

SEQ ID NO: 88986 - RNA, 46 nt, Mus musculus
gauauuuguugggguugggcuccaugaucuguugaauaagaaggag

SEQ ID NO: 88987 - RNA, 46 nt, Mus musculus
gccugcuuucaugucugcauaucaugugugugcagugccuguggag

SEQ ID NO: 88988 - RNA, 46 nt, Mus musculus
uuuuguuuuugaaacagauuauuuuuauuuguuuguuugcuugcuu

SEQ ID NO: 88989 - RNA, 46 nt, Mus musculus
aaaggcaugugccauaaucaccuggcuugacucagauuauugugag

SEQ ID NO: 88990 - RNA, 42 nt, Mus musculus
aguccacacugggcuccagcucaugguucucuaagccccccg

SEQ ID NO: 88991 - RNA, 46 nt, Mus musculus
aauucauuguuuuuaauuuggcaguuccucagaaaauuggacauag

SEQ ID NO: 88992 - RNA, 41 nt, Mus musculus
ucuuuuuaaaugguuauugauuagccuggcaucauggcgca

SEQ ID NO: 88993 - RNA, 41 nt, Mus musculus
cagcaaccacaugguggcucacaaccauccauaacgagaac

SEQ ID NO: 88994 - RNA, 46 nt, Mus musculus
ucuaguuauaauuuguauguguauguguacccuuggucaugauggu

SEQ ID NO: 88995 - RNA, 41 nt, Mus musculus
aacccaccugaguugugugugcuacuaaaauuagagggaca

SEQ ID NO: 88996 - RNA, 46 nt, Mus musculus
agcugaacucuguuaagugccucguuuguguuuaguauuugccaag

SEQ ID NO: 88997 - RNA, 46 nt, Mus musculus
caauacccauccauaaaaacuaaugaagcgguaaagagucacuggg

SEQ ID NO: 88998 - RNA, 46 nt, Mus musculus
aucuugaauguuaacaucagugcaggagaaacaguauuuagccaag

SEQ ID NO: 88999 - RNA, 46 nt, Mus musculus
aaacaaaacaaaacagaacaaaaaagaacaauaagggugaaagaag

SEQ ID NO: 89000 - RNA, 45 nt, Mus musculus
guguuucuuuuuucuucauauugaauaacguauuuuaaaaguaag

SEQ ID NO: 89001 - RNA, 42 nt, Mus musculus
uacccauguucuuuucuuacacacuucuugcuauucggccua

SEQ ID NO: 89002 - RNA, 46 nt, Mus musculus
uaagaaauuagugagcuuccaguucagugacccugucucaggucag

SEQ ID NO: 89003 - RNA, 46 nt, Mus musculus
cuacaguguacuuacauauaauaaauaaauaaaucuuuaaaaugcc

SEQ ID NO: 89004 - RNA, 45 nt, Mus musculus
gcuuauaaccuguaagucaguaaguuugucauugaaaucaucuag

SEQ ID NO: 89005 - RNA, 42 nt, Mus musculus
uguccuggaacucuguaggccaggcugaccucgaaaucaaag

SEQ ID NO: 89006 - RNA, 46 nt, Mus musculus
accauuuuuauuuguuuuaauacaagguuucauauagccuagccau

SEQ ID NO: 89007 - RNA, 48 nt, Mus musculus
uuuuuguuuuguuuucauuuaucauuuuguuuguuuguuuggggugug

SEQ ID NO: 89008 - RNA, 45 nt, Mus musculus
aagccucuaucaaacugggagauggcaguuuuauuucauuuuuag

SEQ ID NO: 89009 - RNA, 46 nt, Mus musculus
ucucgaacuaagcagauagaucugcuuuguguauauagauagauag

SEQ ID NO: 89010 - RNA, 40 nt, Mus musculus
auacacuaauagaaauaaccugugggcuugcaauacgcau

SEQ ID NO: 89011 - RNA, 46 nt, Mus musculus
uuuuagcuaaagcuagcuugaauguuuaauccuucugucuccugag

SEQ ID NO: 89012 - RNA, 29 nt, Mus musculus
uucauugauuuuaugaaaggaaaagcaac

SEQ ID NO: 89013 - RNA, 47 nt, Mus musculus
ucacccaugugaacuuucauuaggacaaaugaaguuuauuccagauc

SEQ ID NO: 89014 - RNA, 42 nt, Mus musculus
uucugugcgcucucucucucugugugugugugugugugugug

SEQ ID NO: 89015 - RNA, 46 nt, Mus musculus
ucuucugcugucuuuaaggugacuaacuguccuugaaagugcccag

SEQ ID NO: 89016 - RNA, 46 nt, Mus musculus
auaaagagcggggaagaaaugauuccuugcuguuguuggccauaag

SEQ ID NO: 89017 - RNA, 46 nt, Mus musculus
auuugggugacaaaaagggagucugacugacagauaauaaggauga

SEQ ID NO: 89018 - RNA, 45 nt, Mus musculus
auuuauaaaaaguaucccaacauguuuaaaaaaaucaaaggcaua

SEQ ID NO: 89019 - RNA, 46 nt, Mus musculus
ccuuuucuuugguccagggcucccauccaucaagugguacugccua

SEQ ID NO: 89020 - RNA, 42 nt, Mus musculus
uucuugaccaagauucccagaaaaaguagucuuuacccaagg

SEQ ID NO: 89021 - RNA, 45 nt, Mus musculus
cugcgcugcucugaaagccaugggcuccauuguguacgugacuga

SEQ ID NO: 89022 - RNA, 42 nt, Mus musculus
acaugugcuuagcuuggacaugaguucagucuucagcaggaa

SEQ ID NO: 89023 - RNA, 45 nt, Mus musculus
guaugcuguacguacaagcugugugcugaggguaaaugcgaaagu

SEQ ID NO: 89024 - RNA, 42 nt, Mus musculus
gcagacuaagcauggguacugaaagaacagagagggguccag

SEQ ID NO: 89025 - RNA, 36 nt, Mus musculus
cuaauugaaauggccaagaaaggcauuuuguggaua

SEQ ID NO: 89026 - RNA, 44 nt, Mus musculus
uuugugaucaaaauuuagaauaaaucauaguacuuggggguuga

SEQ ID NO: 89027 - RNA, 41 nt, Mus musculus
agauucacagcaaagccaauucugugcuccuccacccccac

SEQ ID NO: 89028 - RNA, 45 nt, Mus musculus
cuauuacuguggaaggaguuagcagauagagucagugcagcucac

SEQ ID NO: 89029 - RNA, 46 nt, Mus musculus
acauuucagcagcugccuuucucaaagcuuugguccuuucccaggu

SEQ ID NO: 89030 - RNA, 46 nt, Mus musculus
ccauuuaacuggacuguuuccuaggaagcccccuagaugggcacug

SEQ ID NO: 89031 - RNA, 45 nt, Mus musculus
uccucuagaucuucuccccuggcuccaccaucucugcugucccuu

SEQ ID NO: 89032 - RNA, 46 nt, Mus musculus
gacuacgcaaaggcgcgccgaguaaaaugugggggagccgcuuugg

SEQ ID NO: 89033 - RNA, 42 nt, Mus musculus
gcaaguugugaggaggcgccuaggcggcaguucgaggaggag

SEQ ID NO: 89034 - RNA, 86 nt, Mus musculus
guaccuaacccacaucgaaacaaaacaauagucuuuuagcccacuuuauuuaaaaucuugauuucauuauaaucucaaacucagca

SEQ ID NO: 89035 - RNA, 45 nt, Mus musculus
uauacauguacguauauguaugugugcaugacuauaauuugaaag

SEQ ID NO: 89036 - RNA, 46 nt, Mus musculus
ugugcuuaacuugaggaaggcacuugauucaaucacuaucaaggag

SEQ ID NO: 89037 - RNA, 46 nt, Mus musculus
gcugcguguaugucuauggaaggguguuaguuucuagaguuaacag

SEQ ID NO: 89038 - RNA, 45 nt, Mus musculus
aggguuggggcaccaaaucccauuacagaugguugugagccacca

SEQ ID NO: 89039 - RNA, 44 nt, Mus musculus
gcauguuaauguggucaggcuggcagcuaaccuacaaagaacaa

SEQ ID NO: 89040 - RNA, 45 nt, Mus musculus
ccuuacaagauaccugagucacaaaauuugggccuuauauuggag

SEQ ID NO: 89041 - RNA, 46 nt, Mus musculus
aaaauaagaaaggguaaaaaaaagggaggaauuaguuuuuggggag

SEQ ID NO: 89042 - RNA, 83 nt, Mus musculus
ucaugcaccuugagaaacagcaaguggauuuaacuuguacuuggaguguggaagacaaaguuuucuugggaaaguuugggaag

SEQ ID NO: 89043 - RNA, 46 nt, Mus musculus
aaaaaccaaacaaacaaacaaaaaaaacaaaacacuuuuaagaaag

SEQ ID NO: 89044 - RNA, 44 nt, Mus musculus
auaugugaguuuaugugccccacauuuacgugaaugcucccaga

SEQ ID NO: 89045 - RNA, 46 nt, Mus musculus
guugaguuguuaagauggcucagcaaguaaaggcccuggcagccug

SEQ ID NO: 89046 - RNA, 47 nt, Mus musculus
ucgaguggaugucuaacugagcuuugcugaggcacuucuuagauaga

SEQ ID NO: 89047 - RNA, 45 nt, Mus musculus
cccaauugccugucuauccaucuauucaugcauccauccgucugc

SEQ ID NO: 89048 - RNA, 42 nt, Mus musculus
cuaccuaaugggacacuccaagcccaaagaagcgaccccuuc

SEQ ID NO: 89049 - RNA, 46 nt, Mus musculus
ccugccagagcuacaucgugagaucugucucaaacaacaaaaccag

SEQ ID NO: 89050 - RNA, 41 nt, Mus musculus
aacuuagaacacaucacacauacacauauacacaacgggga

SEQ ID NO: 89051 - RNA, 42 nt, Mus musculus
aucccagcaaccauaugguagcucacaaccauccauaacgaa

SEQ ID NO: 89052 - RNA, 46 nt, Mus musculus
aaugagaucugacgaccucuucuggugcgucugaagacagcuacag

SEQ ID NO: 89053 - RNA, 45 nt, Mus musculus
gaguacacuauagcugucuuaagacacaccagaagagggcaucag

SEQ ID NO: 89054 - RNA, 46 nt, Mus musculus
cgggauaguggaaggaauugggacguuugugcaagcaaagccaugg

SEQ ID NO: 89055 - RNA, 46 nt, Mus musculus
ugaucaacuggagcugauaaauuagcagugauuaagaggaggccag

SEQ ID NO: 89056 - RNA, 41 nt, Mus musculus
agcuuagaagacaagcugugugugcuggaaggaaggaccca

SEQ ID NO: 89057 - RNA, 46 nt, Mus musculus
guggccauuuauguuauuucuccuuaauggaaauugaggcagccuu

SEQ ID NO: 89058 - RNA, 47 nt, Mus musculus
ucauucauauuuuugagguaaugucucauuuuauauacaccagugau

SEQ ID NO: 89059 - RNA, 41 nt, Mus musculus
gggauccaacacccucuucuggcuuccauggacaucaggca

SEQ ID NO: 89060 - RNA, 46 nt, Mus musculus
ccagagugcugaaauuaaggauguguucuaccacacuuggcccaaa

SEQ ID NO: 89061 - RNA, 44 nt, Mus musculus
aggagcuaggauauaucccuuguauauugaaaaacucacacaaa

SEQ ID NO: 89062 - RNA, 46 nt, Mus musculus
augcaaugcccagaacccaggcuggaagggaagaccugaccucuac

SEQ ID NO: 89063 - RNA, 46 nt, Mus musculus
cauggcuaccauagaagcccaugcaguggcccagcaaguccagcag

SEQ ID NO: 89064 - RNA, 45 nt, Mus musculus
uucagugcuggggaucaaacccagggccucgcauauacuaggcaa

SEQ ID NO: 89065 - RNA, 45 nt, Mus musculus
ggguggguauagugcugggcaggacagcagucaggaauggccgaa

SEQ ID NO: 89066 - RNA, 46 nt, Mus musculus
uuuauacuucccagaagagggcauccuaacauaaugaacccaggac

SEQ ID NO: 89067 - RNA, 48 nt, Mus musculus
uuugaaggagcugucaggccaccagccguaguaucagugcaggcaaau

SEQ ID NO: 89068 - RNA, 45 nt, Mus musculus
ggggacugaaacaugugguaugguuuccagggcugugggaaggag

SEQ ID NO: 89069 - RNA, 55 nt, Mus musculus
cuagagccacaauucuugccuaggaugcaccggagcaggaggaggaaagaaaaga

SEQ ID NO: 89070 - RNA, 80 nt, Mus musculus
ugcaguucaccuauuuagaauaugcacgugaauauaauguuagcaguuuaauuuguaucuaagccuuuuaugggcuggca

SEQ ID NO: 89071 - RNA, 84 nt, Mus musculus
augcugucuuugaugcuaacccauugcuaucaaaagugaguaguaaggaauuacuuagacuuacccauucaaacaaccccaaga

SEQ ID NO: 89072 - RNA, 46 nt, Mus musculus
uuuucuuuugguugaacuaaggaaauguucaucuccuuggccagga

SEQ ID NO: 89073 - RNA, 41 nt, Mus musculus
ccugugggaauggccgcugcugcugcuguggcaacagggaa

SEQ ID NO: 89074 - RNA, 46 nt, Mus musculus
acugagcaacaaaggaccuuaaaaaguuuauguucugaaagagaga

SEQ ID NO: 89075 - RNA, 42 nt, Mus musculus
cuuaacaggguauagcuggcuacguaaacuuauagcccccua

SEQ ID NO: 89076 - RNA, 64 nt, Mus musculus
uuuuuacuuacuaaaacaauguauuguaccccaccagaugcaguuuaaaaaaaaaaaagagaga

SEQ ID NO: 89077 - RNA, 46 nt, Mus musculus
aagcaaaacacuagaugacuccaggauguuaauuuuauaagccaaa

SEQ ID NO: 89078 - RNA, 46 nt, Mus musculus
aaacuguucaggggaaauagcauaaagaacccugagcucaggcaga

SEQ ID NO: 89079 - RNA, 45 nt, Mus musculus
acuuguauaaaauguaggccaaugcuuuccauguaguagcuguga

SEQ ID NO: 89080 - RNA, 47 nt, Mus musculus
caugguuggaacuucuugccaaaaauuuuuccccauccccaagagaa

SEQ ID NO: 89081 - RNA, 46 nt, Mus musculus
ucccaucuaguuauauuuccauaauuccuagcuuuauuaucccuag

SEQ ID NO: 89082 - RNA, 46 nt, Mus musculus
guauuuguucuuggaguucugcaguggcuaagggaaccagccccac

SEQ ID NO: 89083 - RNA, 46 nt, Mus musculus
uacuucugcccuuaauucccugcaggugcgaaaguacaagagcaug

SEQ ID NO: 89084 - RNA, 46 nt, Mus musculus
guacaaggcgggaaaggaggaggagaugcaaagauaagagaugcag

SEQ ID NO: 89085 - RNA, 33 nt, Mus musculus
cuugggguuagucugaccuggagacuguucaaa

SEQ ID NO: 89086 - RNA, 42 nt, Mus musculus
accccagguuuuugagauaggguuucucuauguagccuugag

SEQ ID NO: 89087 - RNA, 46 nt, Mus musculus
aaguauuuucaguuuuuacauuuaacuugaauuuuuuaggguacag

SEQ ID NO: 89088 - RNA, 46 nt, Mus musculus
uaauggguaaaaccauacugauaaaaaguagcggaaagguuaccag

SEQ ID NO: 89089 - RNA, 42 nt, Mus musculus
ucauacacacacacacacacaccuuuuuuaaaaaucaggcag

SEQ ID NO: 89090 - RNA, 42 nt, Mus musculus
aaaacggaaucaugugauauauucuuaaauaggacauaguau

SEQ ID NO: 89091 - RNA, 41 nt, Mus musculus
aaaaacaaaaaaaaaaaaacaaaacaaaacaaaaaaaaagc

SEQ ID NO: 89092 - RNA, 46 nt, Mus musculus
cagauaagcucgaaccagaaagcucaguaaguaacaagggggggug

SEQ ID NO: 89093 - RNA, 41 nt, Mus musculus
accuauaacauaaguaugaaccaguucguacugucagcugg

SEQ ID NO: 89094 - RNA, 45 nt, Mus musculus
ucauuucaaauuaaaauagcaaggccuggcugggaaggugucuca

SEQ ID NO: 89095 - RNA, 45 nt, Mus musculus
acaugaaguguauuauaucauggccugagggugggagauguguga

SEQ ID NO: 89096 - RNA, 45 nt, Mus musculus
augaucuaagguuuaaacuugauaaacugcuuuucuugccccaaa

SEQ ID NO: 89097 - RNA, 46 nt, Mus musculus
cagcuucgggcauuuaucccagagaugcucaaguauuccacagguc

SEQ ID NO: 89098 - RNA, 77 nt, Mus musculus
caggcauuacggaccauaguuaaaaauugcuauaagcaacaugggcgggaggaucuuuuauaugcuuuugaagauca

SEQ ID NO: 89099 - RNA, 46 nt, Mus musculus
uguuuauugacagaugaggaaucucuaaaguucagguugggguuag

SEQ ID NO: 89100 - RNA, 41 nt, Mus musculus
caaaacugggccacguuacagggcggugaaaugaccaucca

SEQ ID NO: 89101 - RNA, 46 nt, Mus musculus
uuagguuguguuuuaagauuugucuaucagaauugauuauaguggg

SEQ ID NO: 89102 - RNA, 45 nt, Mus musculus
uuggcuagaaucugcagaucauccaggcucaaacaaacacaaaaa

SEQ ID NO: 89103 - RNA, 50 nt, Mus musculus
uauaggccccagauaugacucuaacuacuccaacuaacccagaacaagac

SEQ ID NO: 89104 - RNA, 46 nt, Mus musculus
caguguucuuaccaacucuuuaguuuaucuaguuuauccggagauu

SEQ ID NO: 89105 - RNA, 45 nt, Mus musculus
uuugauaugugauagguaguauuucugagaauuuaaauucugcaa

SEQ ID NO: 89106 - RNA, 45 nt, Mus musculus
aaaagcauguauauaaacuguguuguuauuauuuaauauggguca

SEQ ID NO: 89107 - RNA, 46 nt, Mus musculus
uuaaagaaaacuucacauuagcuuuagaaaauauguaugacuugag

SEQ ID NO: 89108 - RNA, 46 nt, Mus musculus
gcacagcaaaacaaaaaggguaaaguucauacaagugcgguggcaa

SEQ ID NO: 89109 - RNA, 41 nt, Mus musculus
uggcaagaggguaaauagauaacaucuuuuuaucuaggcag

SEQ ID NO: 89110 - RNA, 72 nt, Mus musculus
ucaggaaugucuuugggggaagacacaauguguccuuuacaguaggaaaagguuuuucuguaguacuaggag

SEQ ID NO: 89111 - RNA, 46 nt, Mus musculus
ggcauccuucugaacuacaguucucacucucaguggaacugcuaag

SEQ ID NO: 89112 - RNA, 46 nt, Mus musculus
aauuauugugugccaaguucgggauuuuugacuuggacucgaccuu

SEQ ID NO: 89113 - RNA, 46 nt, Mus musculus
cucugcuaggccucggauccccugugcuuccagaaaucauggccuc

SEQ ID NO: 89114 - RNA, 46 nt, Mus musculus
caggaggcaauauuuuuggguuugccuugauugaauguugauguuu

SEQ ID NO: 89115 - RNA, 46 nt, Mus musculus
gccucgaacucggaagucugccugccucugcuucccaaguggugug

SEQ ID NO: 89116 - RNA, 45 nt, Mus musculus
aggagacucuuuaaacugaggagguuugccagguaagccuaguca

SEQ ID NO: 89117 - RNA, 46 nt, Mus musculus
gucucuucaaaacagaacaaaagauaauuaaaaauguacuguccag

SEQ ID NO: 89118 - RNA, 46 nt, Mus musculus
ucaauucccagcaaccacaugguggcucacaaccauccguaaggag

SEQ ID NO: 89119 - RNA, 46 nt, Mus musculus
uaguuccuuacuuagguagugugugagacaccuucagaaguagcag

SEQ ID NO: 89120 - RNA, 46 nt, Mus musculus
accccagugcccuucaggccaacaugugcuucuguauauuauuguc

SEQ ID NO: 89121 - RNA, 42 nt, Mus musculus
guucccagcaaccacaugguggcucacaaccaucugauggaa

SEQ ID NO: 89122 - RNA, 42 nt, Mus musculus
cucauguagauuacuugugacacauuuuaaauccuugggcag

SEQ ID NO: 89123 - RNA, 46 nt, Mus musculus
gucccguccagcccagcgccuuuuaacaguucuauguucuugucag

SEQ ID NO: 89124 - RNA, 49 nt, Mus musculus
uuacaaguggauccuggcaagaaggcuacagguggguucgucuuugggg

SEQ ID NO: 89125 - RNA, 46 nt, Mus musculus
gucccuggcggacaagauggcuaugcgaggauaguucagaugcgag

SEQ ID NO: 89126 - RNA, 43 nt, Mus musculus
gugaagaagaagaaaccuuuagcugucacaguaggggagcggc

SEQ ID NO: 89127 - RNA, 46 nt, Mus musculus
guugucuuccuaacuccuguguggggaacuccuuucauacccugag

SEQ ID NO: 89128 - RNA, 42 nt, Mus musculus
ccuaccacuccucauucugcacuaaaacucagcuugguccua

SEQ ID NO: 89129 - RNA, 88 nt, Mus musculus
gauuccuuguuccuucccuuucccuccuccuccuuucucuucucagacuuacuuaauuuuguauauguaaauguuuugcccacaucag

SEQ ID NO: 89130 - RNA, 45 nt, Mus musculus
ccaccaaguugcugagaaccaaacccagguccuccacaagggcaa

SEQ ID NO: 89131 - RNA, 44 nt, Mus musculus
cucuacuuaggucaguguucucccacuaccucuuuuagcccuca

SEQ ID NO: 89132 - RNA, 54 nt, Mus musculus
gggagggacgcacauggagcggugagggaggaagggaacaccggccuagccagc

SEQ ID NO: 89133 - RNA, 60 nt, Mus musculus
caggcugcaggaaagauucauacagauuuuggaaagggauucauuauggcggaaguaaug

SEQ ID NO: 89134 - RNA, 46 nt, Mus musculus
cgcaugcauaugaauaaaguuaauaaaaccaaguuuuuacaagaag

SEQ ID NO: 89135 - RNA, 46 nt, Mus musculus
uaaucaggggcaggcugagcagauggaggggcagccacggccugau

SEQ ID NO: 89136 - RNA, 45 nt, Mus musculus
ugcuaggauuagagacauacccuauggcaaguuugggaguuugaa

SEQ ID NO: 89137 - RNA, 41 nt, Mus musculus
cgggccggugcagguggccauggccccagugaccaccagga

SEQ ID NO: 89138 - RNA, 33 nt, Mus musculus
cucuaucauggcagcguuuucuagucuacugca

SEQ ID NO: 89139 - RNA, 42 nt, Mus musculus
aaguuuugguaaccuuuuuuuaagaaggaagaaaggcagcag

SEQ ID NO: 89140 - RNA, 46 nt, Mus musculus
uucacugucccaaaaagccaaauuguggccagacuucuuugugcag

SEQ ID NO: 89141 - RNA, 41 nt, Mus musculus
ugcauggaauuaccuguaugaaaucaaggugaacuguggga

SEQ ID NO: 89142 - RNA, 45 nt, Mus musculus
cugccucccaguggccgccuagaccucugcuagauucaccgaagg

SEQ ID NO: 89143 - RNA, 71 nt, Mus musculus
ggugacagaaguguuaagggucugaggaguguucauggagcaggcggguguaagugcagggugugugugug

SEQ ID NO: 89144 - RNA, 46 nt, Mus musculus
gccagucucuaguuucucugggucagguuucugaguacuggcauug

SEQ ID NO: 89145 - RNA, 45 nt, Mus musculus
auaguauucugauuaccucccccucaauaaaaaaaaaguccagau

SEQ ID NO: 89146 - RNA, 45 nt, Mus musculus
uuuaguuuagaagugcuauauuccacaaggguuaagucaaugagg

SEQ ID NO: 89147 - RNA, 45 nt, Mus musculus
cuuggaugaagauagaacagugcuuuuccagagugggaaggaagg

SEQ ID NO: 89148 - RNA, 46 nt, Mus musculus
uccauuuggccaagucagccugugugcuacugaacugucaagagau

SEQ ID NO: 89149 - RNA, 45 nt, Mus musculus
agaggcccugaaggaacaggaagagggcacuggcgacagcucauc

SEQ ID NO: 89150 - RNA, 61 nt, Mus musculus
aaccuaaaaaguacauuuuuaaccagacauggugguauaugccuauaaucucagcauuuga

SEQ ID NO: 89151 - RNA, 46 nt, Mus musculus
aguacacuguaacuaucuucagacacaccagaagagggcaucagau

SEQ ID NO: 89152 - RNA, 45 nt, Mus musculus
gaguuacagcaaggcaugguggcacacgccuuuaaucccagcacu

SEQ ID NO: 89153 - RNA, 31 nt, Mus musculus
aaauacccaauuaaaaaaaaaaaagauguaa

SEQ ID NO: 89154 - RNA, 42 nt, Mus musculus
cgaagguccugaguucaaauuccagcaaccacaugggugcuc

SEQ ID NO: 89155 - RNA, 46 nt, Mus musculus
ugagaauccauuugccaacgagagcaguaaaggaauguuagcagag

SEQ ID NO: 89156 - RNA, 46 nt, Mus musculus
aguacacuaccacucucuuaagacauaccagaagagggcaucagau

SEQ ID NO: 89157 - RNA, 123 nt, Mus musculus
ucaguguggaccuuuuaguguuuaaugcccacucugcuagaaagggaagcugcagagagacagccugucccugggcacagcaugguaaauaagcucagcaauagguaaccucuguaggccucu

SEQ ID NO: 89158 - RNA, 23 nt, Mus musculus
cagagagggaggcaagcccuccu

SEQ ID NO: 89159 - RNA, 45 nt, Mus musculus
uacuuacauauaauaaauaaauaaauauuaaaaaaaaaaagaaac

SEQ ID NO: 89160 - RNA, 46 nt, Mus musculus
caacccggagucaucugagaaccuuaagaaaauguuuccaugagau

SEQ ID NO: 89161 - RNA, 45 nt, Mus musculus
agcagccaccccucuuaaccacuaucuaucucucuagcccguaga

SEQ ID NO: 89162 - RNA, 46 nt, Mus musculus
cggucagagagacccugucucaaaauuaaagacuuggaggagaguu

SEQ ID NO: 89163 - RNA, 46 nt, Mus musculus
aagcgugaggacuagagucugcucccagaacucgugaaaaucaugu

SEQ ID NO: 89164 - RNA, 82 nt, Mus musculus
acauugccucagaagaauauugcuugguguuucuucaguugugugguguugggaaugggaaagaauuuugaggggcugagug

SEQ ID NO: 89165 - RNA, 46 nt, Mus musculus
acaaaguaguuuugauaaaauuggcugccagaaacaugcaacuaga

SEQ ID NO: 89166 - RNA, 45 nt, Mus musculus
caguccuacagugguauccaguacugacaaguuaagacucgcugu

SEQ ID NO: 89167 - RNA, 74 nt, Mus musculus
uaucugauacaaauagcugcauggucccaaagcuuccuugguuguuguuauagggcucuguauuuuaguuagau

SEQ ID NO: 89168 - RNA, 85 nt, Mus musculus
agccugaucuacccaacgaguuccaaggcaaccagggcuaccuagagaaaacccugucacaaaaaagcagaaaagaaaaaaagau

SEQ ID NO: 89169 - RNA, 46 nt, Mus musculus
aaagagcaaccaauauucuuaaccacugagccaucacucuagcccc

SEQ ID NO: 89170 - RNA, 42 nt, Mus musculus
accacagcaugugcauugaaucacuuauaguagucagaggua

SEQ ID NO: 89171 - RNA, 46 nt, Mus musculus
ucacauccaucuguaauggaaucugaugcucucuucuggugugucu

SEQ ID NO: 89172 - RNA, 45 nt, Mus musculus
aaucccagcaaccacaugguggcucacaacuauccauaacgaaau

SEQ ID NO: 89173 - RNA, 109 nt, Mus musculus
gggauuuguuuaggaaagaaaaacuuaguauaguagggucaaguaggagcuaugccuuuaagaaaugaaggggauaaaagaaaggagaagaguaugcacuauagauguu

SEQ ID NO: 89174 - RNA, 46 nt, Mus musculus
uuaaagguuggauuuggaguguccaggaugacccuucuguugagaa

SEQ ID NO: 89175 - RNA, 46 nt, Mus musculus
ucucuaaccaaguaugucagucagggaaaaguguauggggcacaua

SEQ ID NO: 89176 - RNA, 45 nt, Mus musculus
cacucccccgggacuagugcccaucacugaggugaacacugaagu

SEQ ID NO: 89177 - RNA, 46 nt, Mus musculus
ggcuuaacaguuaagagcacuggcugcuuuuccagaggacccagau

SEQ ID NO: 89178 - RNA, 46 nt, Mus musculus
ggccaggagcuauggugcucaucuguuuaguugcagcuacucagua

SEQ ID NO: 89179 - RNA, 46 nt, Mus musculus
guggaauugggagaucguagcuugguggcagagggcucgccuagaa

SEQ ID NO: 89180 - RNA, 46 nt, Mus musculus
ugaucucuggacauccacaccaaucaaucagcuugcuagucuagga

SEQ ID NO: 89181 - RNA, 42 nt, Mus musculus
agggucuuugaggaaguggcauuuaaaaccuagcaccaagaa

SEQ ID NO: 89182 - RNA, 46 nt, Mus musculus
ccuguggaugcuaggaauugaagcaggguccucuggaagaacaguu

SEQ ID NO: 89183 - RNA, 45 nt, Mus musculus
cacuaccaagucaugcaagugccacaguuauuuuuguacgcagau

SEQ ID NO: 89184 - RNA, 45 nt, Mus musculus
agaugagacaaacaggccacagguguuuagaaugguagcugaauu

SEQ ID NO: 89185 - RNA, 44 nt, Mus musculus
gugguugggcaugcucauaggcucagcaccaagaaggcugaagu

SEQ ID NO: 89186 - RNA, 45 nt, Mus musculus
agcaggauggaugauucaguagaugagacaaagaccuggccaaga

SEQ ID NO: 89187 - RNA, 45 nt, Mus musculus
cugggcuguacagugagucuguuucuuaaggggacgggugguagu

SEQ ID NO: 89188 - RNA, 42 nt, Mus musculus
uuuacuuauggguugagggggacuguggccuauggggcaggg

SEQ ID NO: 89189 - RNA, 24 nt, Mus musculus
ucagggugaagauagcccaaugcu

SEQ ID NO: 89190 - RNA, 42 nt, Mus musculus
aaccgauggcaggggaaucuguauaccuuagugugcccagau

SEQ ID NO: 89191 - RNA, 33 nt, Mus musculus
uucuuuuuuuuucuuuccuuucuguagccuagg

SEQ ID NO: 89192 - RNA, 45 nt, Mus musculus
aaugagaaucuaagccuugauuuguauguaccauagcaucuagau

SEQ ID NO: 89193 - RNA, 45 nt, Mus musculus
uuaugaaauagcuagguagacccucaccuuuuuuguuguucagau

SEQ ID NO: 89194 - RNA, 42 nt, Mus musculus
ccagcucucccuugcccacacuaccagggucauucuggagau

SEQ ID NO: 89195 - RNA, 48 nt, Mus musculus
gagucgggucagucccccagcucuccugugccauugccaccaaggcca

SEQ ID NO: 89196 - RNA, 46 nt, Mus musculus
aaguagccuuagguucuuacaacuguaaauugauaacuagucagau

SEQ ID NO: 89197 - RNA, 45 nt, Mus musculus
accccgccucaauaguaaauaaguuuugucuaaauggugccagua

SEQ ID NO: 89198 - RNA, 45 nt, Mus musculus
gcugguucuuaugcuuaucuuuaagcccagcagagcccagaaucu

SEQ ID NO: 89199 - RNA, 45 nt, Mus musculus
caccagugcccagcuuuccuuuuagauucuuauggugcuuguaga

SEQ ID NO: 89200 - RNA, 46 nt, Mus musculus
cucgggaggcagaggcagaggcaggcagauuucugaggccagccug

SEQ ID NO: 89201 - RNA, 45 nt, Mus musculus
cuuccuguuucaggaggucuagaguggggucugggagugagagac

SEQ ID NO: 89202 - RNA, 82 nt, Mus musculus
ugaaacacuuuaaugaaagacauaguaggguuuugaaaguauuauaauaaaguaauuggggaaaauauagguuacaaaaagg

SEQ ID NO: 89203 - RNA, 63 nt, Mus musculus
gauccuauaaugcuuacaguguaguagcuuuuuaccuggagaccuagagaaucuguguuuuaa

SEQ ID NO: 89204 - RNA, 97 nt, Mus musculus
guuaguuuggguaguguugugacuuucccagcacucugacugguauuuacacacacaugcaguugggaucucauuuuaugcuuccaagaaccauuga

SEQ ID NO: 89205 - RNA, 46 nt, Mus musculus
ggagggguggagcuaccaaacagcugaugggagugugugacaagag

SEQ ID NO: 89206 - RNA, 45 nt, Mus musculus
gugauuugcccuaaaggaauauugguugaaguugucccuggugga

SEQ ID NO: 89207 - RNA, 45 nt, Mus musculus
gauagugcagccauuugcuugccagagccagguagauugcuagcc

SEQ ID NO: 89208 - RNA, 42 nt, Mus musculus
agcaaccuauaugguaggaaaguagcgguguggggguaggga

SEQ ID NO: 89209 - RNA, 46 nt, Mus musculus
uacaaucaccugucagugcugaggauuaaaaaugaaagaugguggu

SEQ ID NO: 89210 - RNA, 46 nt, Mus musculus
uagaggcuaucucuacuucaaguuuauuuucugguuuaauguaguu

SEQ ID NO: 89211 - RNA, 50 nt, Mus musculus
uggcuucuguucuuuccccaccucccuugcugacaaagaaagcagggcuc

SEQ ID NO: 89212 - RNA, 45 nt, Mus musculus
auguauaauugggauggagugggggagagaauuccagcuguuuuu

SEQ ID NO: 89213 - RNA, 47 nt, Mus musculus
caaguuuuaggguuugaaaucuagaauuugggggaagggcaguagua

SEQ ID NO: 89214 - RNA, 81 nt, Mus musculus
acaucuuuucaagaauaagaagguauuuuuucucuuugcccaggggagagcuggcuagaaauuaagaauagugguuagacu

SEQ ID NO: 89215 - RNA, 42 nt, Mus musculus
ucgagcauuuaaaaaaauguuuuuauuuuuugaggguggggg

SEQ ID NO: 89216 - RNA, 46 nt, Mus musculus
uuaucccuaauuccuuucuauauuaggaagagaguagccugcccag

SEQ ID NO: 89217 - RNA, 42 nt, Mus musculus
gcgacaccaugucaucccccagucccggcaagaggcggaugg

SEQ ID NO: 89218 - RNA, 42 nt, Mus musculus
gcgagcugggcccggagcccgugacagacgggccaaggaggg

SEQ ID NO: 89219 - RNA, 45 nt, Mus musculus
cuaggguagagaggccgaccgagcuggagucgucggcuuguggag

SEQ ID NO: 89220 - RNA, 46 nt, Mus musculus
cugccccggggcagagauaaacaggcccagaauccauuucucagau

SEQ ID NO: 89221 - RNA, 45 nt, Mus musculus
aguuguccucugacacugaugcucaaguuguggcaacacagagag

SEQ ID NO: 89222 - RNA, 46 nt, Mus musculus
gguguuuugcuugcauguauggcacgucuaugugagcaugucagau

SEQ ID NO: 89223 - RNA, 26 nt, Mus musculus
caaaacagcaagcucuaggcucagug

SEQ ID NO: 89224 - RNA, 46 nt, Mus musculus
uugugagccaccaugugguugcuggcauuugaacuccggaccuuug

SEQ ID NO: 89225 - RNA, 46 nt, Mus musculus
uaaugcuagaaggaaggaaauuccuucaauagaugagucuggagac

SEQ ID NO: 89226 - RNA, 42 nt, Mus musculus
ugucaugugugugugugugugugugugugugugugguguguu

SEQ ID NO: 89227 - RNA, 46 nt, Mus musculus
ucagagccuuugaaacgggagucacgggugguugucaaccaccaga

SEQ ID NO: 89228 - RNA, 58 nt, Mus musculus
auacauagaauaaauaaaucuuuuuuuaaagacacauuuaaguuaaaggaaggaagga

SEQ ID NO: 89229 - RNA, 45 nt, Mus musculus
uuucgcaggcugagacaggaggcucauugccagcgcuggcuuaca

SEQ ID NO: 89230 - RNA, 46 nt, Mus musculus
ugccgagaaccaaaacaggcggaugugacaacaugaggggugguga

SEQ ID NO: 89231 - RNA, 41 nt, Mus musculus
gacagcaagggcuacacagagaaacccugucucaggaagga

SEQ ID NO: 89232 - RNA, 42 nt, Mus musculus
ucuugggcuuggggagagaggaccacaaggaggggaggagga

SEQ ID NO: 89233 - RNA, 46 nt, Mus musculus
guggguggagagagagagagagagagagagagagagagagaacucc

SEQ ID NO: 89234 - RNA, 52 nt, Mus musculus
uccauuuauuugaaggaaggaggaaggaagggagagggagagagagacagag

SEQ ID NO: 89235 - RNA, 66 nt, Mus musculus
uuacaucuccaucucugagggaggucaggcaggaaaaugagacagaaacgaagcagaggugaagca

SEQ ID NO: 89236 - RNA, 42 nt, Mus musculus
gugggugcuguuuuguuuugcuucuguuuuugagagggagaa

SEQ ID NO: 89237 - RNA, 46 nt, Mus musculus
ucaucugugcacuagaaggccaacauggaaagcugugaacccagac

SEQ ID NO: 89238 - RNA, 41 nt, Mus musculus
uccccucagaaagccaguugaggcaggugagcaccccagau

SEQ ID NO: 89239 - RNA, 46 nt, Mus musculus
uguuuaacuguggaaaauuauuucaaaaggagugccaaauuaagga

SEQ ID NO: 89240 - RNA, 45 nt, Mus musculus
agccaaccaacugugucagaguuggauauuuugaaauggaaugag

SEQ ID NO: 89241 - RNA, 73 nt, Mus musculus
uguguguuggcuagggaguauaugggaaagaaaauaaaaaagauuaagggaaaugguugaaucaguaauauuu

SEQ ID NO: 89242 - RNA, 46 nt, Mus musculus
acaguuguaaaaagcguacguuuacaaauuuucagucuguuaaaag

SEQ ID NO: 89243 - RNA, 46 nt, Mus musculus
uugauuaauuuaaagauaacaaaggggauuuuacuuauucagagag

SEQ ID NO: 89244 - RNA, 46 nt, Mus musculus
cuaugggauccaaugcccucuucugauaauacagacagacuugcag

SEQ ID NO: 89245 - RNA, 45 nt, Mus musculus
ugguuggagccaccaugugguugcugggaauugaauucaggaccu

SEQ ID NO: 89246 - RNA, 37 nt, Mus musculus
ucuugaaggcuggcuuacaguuuugcggggccggggg

SEQ ID NO: 89247 - RNA, 41 nt, Mus musculus
gaaaacagaauaggggccccagggcagcacucagccuuggg

SEQ ID NO: 89248 - RNA, 45 nt, Mus musculus
cagcguagaaggccuuuuggcgggugugugugugugugugugugu

SEQ ID NO: 89249 - RNA, 46 nt, Mus musculus
guucaagcacagcgggccuugauggucagagacucaaugguuuuag

SEQ ID NO: 89250 - RNA, 46 nt, Mus musculus
uuuccuuuccuuuccuuuccuuuccuuuccuuucccuucccucccc

SEQ ID NO: 89251 - RNA, 41 nt, Mus musculus
guuauuucccaguuagcugaugccuacuaagcuuugaggcu

SEQ ID NO: 89252 - RNA, 45 nt, Mus musculus
gauugaauaacuuccaugaaguuagcauuagcuucaucugugaca

SEQ ID NO: 89253 - RNA, 46 nt, Mus musculus
ggaaccuuuugcuugacuugcuuaucaucuaguuuuaauuuuuaag

SEQ ID NO: 89254 - RNA, 46 nt, Mus musculus
gaauuaugcauggugcugaguuagagccuagaucacuaauugaaga

SEQ ID NO: 89255 - RNA, 45 nt, Mus musculus
acucuccagauguggcuggccuugaccucucaaaauaaaugagag

SEQ ID NO: 89256 - RNA, 46 nt, Mus musculus
uuagccgugaagcuaaauacaacuauagauauuucuaacaguguag

SEQ ID NO: 89257 - RNA, 45 nt, Mus musculus
cagguacugaucacaugcucuuacccagccauuuaauuagacuag

SEQ ID NO: 89258 - RNA, 97 nt, Mus musculus
aaaaacaagacauuauguuaauauuuuuauuuaacccauaucauuuuaucauaucauuaacguagaacugguaauuuuacuuuuucuguuugguugg

SEQ ID NO: 89259 - RNA, 70 nt, Mus musculus
accaccacuccccaacaauuuuacauucuuuuagggaugcuaaauuuuugaacacaaauucccguugggc

SEQ ID NO: 89260 - RNA, 45 nt, Mus musculus
guuuuacguuugucuugcuaauuccuagaugcauguaccuugcaa

SEQ ID NO: 89261 - RNA, 44 nt, Mus musculus
agguacagugguaccuccccagcacagaugaggagacagauuca

SEQ ID NO: 89262 - RNA, 56 nt, Mus musculus
gucucccauagcuuacucuccuguuuucagugagccagacagaaacuuaauucuuc

SEQ ID NO: 89263 - RNA, 149 nt, Mus musculus
aaaauacaguauucccaucucgauaacuuuaggucugcccuaacauugaacggaggcugcugauccagaagaaccuaaagggacauaugguagacuugagagcauuucuacacuggagaauuagagagcaggucgccuaggccaagguc

SEQ ID NO: 89264 - RNA, 46 nt, Mus musculus
ucgucagucauuuucuugaguuuaucaugcugugucaccucuccug

SEQ ID NO: 89265 - RNA, 46 nt, Mus musculus
uaccaaucucuauguguuuggaggguauaacccagacuaugaugaa

SEQ ID NO: 89266 - RNA, 46 nt, Mus musculus
aacagguauuucacuguggugauaauacaguguaaugacucugaau

SEQ ID NO: 89267 - RNA, 57 nt, Mus musculus
ggaugcagacagaaagggagacaggagagagaggaaaguaguaaugaaagagaaaag

SEQ ID NO: 89268 - RNA, 46 nt, Mus musculus
caaucgcagggcagugguggcgcacgccuuuaaucccagcacuugg

SEQ ID NO: 89269 - RNA, 46 nt, Mus musculus
ucccuuuaugucuuugggggaacaaccggcuacaucuauagcacag

SEQ ID NO: 89270 - RNA, 46 nt, Mus musculus
caugguguggacacaacucaaaccaaacaaccuguccugugaccug

SEQ ID NO: 89271 - RNA, 46 nt, Mus musculus
uuccaagauccaugcauacaaccuugaaacaaaugcaugggaggag

SEQ ID NO: 89272 - RNA, 46 nt, Mus musculus
aagcuuaaaaagccagcaacaacaacucuuggucugggagauagag

SEQ ID NO: 89273 - RNA, 64 nt, Mus musculus
uucuuaagucuggauguugaguuaguguuucugagaugugcggaguggcuggacucaacggugc

SEQ ID NO: 89274 - RNA, 81 nt, Mus musculus
cuccggugguuagcguuggccugccaauguuuagugugucugucaucaucacccucuguuguugucucucaaauuaaaugu

SEQ ID NO: 89275 - RNA, 124 nt, Mus musculus
auauggcaucaaguucuuuccaggcaguucugaacuucccuugugcuuauuaauggcuuuaaauaugucuuugacuucuuggugggggauuguagacucuuaagugugugauguaaaugucuac

SEQ ID NO: 89276 - RNA, 51 nt, Mus musculus
uuugcuguccgcuucuguguucacgaugcugugguugccuagugacuggag

SEQ ID NO: 89277 - RNA, 60 nt, Mus musculus
aagaagcaggggucauuggagagccagcaggaggaaggggugagacagggugauucgcuu

SEQ ID NO: 89278 - RNA, 65 nt, Mus musculus
uuucaaacacauuuuuccuuuaagugccucuuuuccaccuagcuuuaauauuauucauuuucuuu

SEQ ID NO: 89279 - RNA, 47 nt, Mus musculus
augucuugcccaggaauaaggaaguccacuugaaaguguugcccagg

SEQ ID NO: 89280 - RNA, 45 nt, Mus musculus
cuuuacgauaagguauuuuccacuuuacagaaaacugcaaaccag

SEQ ID NO: 89281 - RNA, 49 nt, Mus musculus
gauuugauauaaaagcuugcuuuauagcauucauguccaguacagagcu

SEQ ID NO: 89282 - RNA, 41 nt, Mus musculus
agggagcucacaggcuucucccugcagaggcaguagggaca

SEQ ID NO: 89283 - RNA, 45 nt, Mus musculus
aggucagguagcuuuggaauccccacgccauggaaagagcugaga

SEQ ID NO: 89284 - RNA, 56 nt, Mus musculus
cucuuccucacugagaugauauuugaauagagaaccggagauggaggacagaccca

SEQ ID NO: 89285 - RNA, 46 nt, Mus musculus
agugagucucacggagggaggaccauguaacuggagcauucccaga

SEQ ID NO: 89286 - RNA, 46 nt, Mus musculus
aacgggcacagaaggggauguuaaacgaccucgaagguuucaggag

SEQ ID NO: 89287 - RNA, 42 nt, Mus musculus
aguccaaauguuuggaauuaaaugaggaacuacucuccaaag

SEQ ID NO: 89288 - RNA, 45 nt, Mus musculus
augcccggggcugcaguuguagugacuguacugccuaccaugggu

SEQ ID NO: 89289 - RNA, 34 nt, Mus musculus
uccaugugaucgagaagcugucuauucauaguca

SEQ ID NO: 89290 - RNA, 52 nt, Mus musculus
acaggcaagcugauacugaaacuucuuuaagguuugugcauaaucacccaca

SEQ ID NO: 89291 - RNA, 45 nt, Mus musculus
uguaguccucuuugucagugggugaguuguagaccguggguggag

SEQ ID NO: 89292 - RNA, 42 nt, Mus musculus
uacauuguugcugucuuuagacacacuagaagaggacaucag

SEQ ID NO: 89293 - RNA, 42 nt, Mus musculus
uuaauuuuuaaaaguaacuaucucugaaauccuggcacccag

SEQ ID NO: 89294 - RNA, 41 nt, Mus musculus
cagccuguuucaacccuaacagugcuugcuguccggggcua

SEQ ID NO: 89295 - RNA, 75 nt, Mus musculus
uccaaaaacucuggauacggauuuauaggauccaauggcccauagauaaaaugaacuaggaaaaagaagaggaag

SEQ ID NO: 89296 - RNA, 45 nt, Mus musculus
uuucuguugauaacugcucagcugagaugagugaacuggcucaga

SEQ ID NO: 89297 - RNA, 42 nt, Mus musculus
acgcaagcuggcuuuugccagguuguauccacuagggcauag

SEQ ID NO: 89298 - RNA, 75 nt, Mus musculus
cuuacagugguuucaguuguucagaacccaacagacaacaucuggcaaacacaacacuucuaucgcaggccucac

SEQ ID NO: 89299 - RNA, 46 nt, Mus musculus
uguaaggcaugggaagccccgcagaugcccuacagacacaccacac

SEQ ID NO: 89300 - RNA, 46 nt, Mus musculus
uuggcaaugcuggaaaauuuuaucccagaaggguggagggggaggg

SEQ ID NO: 89301 - RNA, 46 nt, Mus musculus
uucuugguaugcagccaugugagaggucagauaaaguccccgagaa

SEQ ID NO: 89302 - RNA, 45 nt, Mus musculus
cccuguccagaucgcugaccagcccagagacaccuuuccuccauc

SEQ ID NO: 89303 - RNA, 46 nt, Mus musculus
uugacacauugcuccaaggcuuuccugcaugcucacaaccccacaa

SEQ ID NO: 89304 - RNA, 46 nt, Mus musculus
uuacaaucagccaggaauaugcuacacacuuguucgauugccagau

SEQ ID NO: 89305 - RNA, 45 nt, Mus musculus
ugguggucgugcaggccaucagugcucucugucacaaguacccuc

SEQ ID NO: 89306 - RNA, 77 nt, Mus musculus
ugacugccacuuaauauugccuuuccuuuaucuuuuaaaggcccauccuuuacauauauuuugcuccuagccccauu

SEQ ID NO: 89307 - RNA, 47 nt, Mus musculus
cuucuggggugucugaagacagcuacaguguacuuacauauauuaau

SEQ ID NO: 89308 - RNA, 46 nt, Mus musculus
uuuacuguaaaugugaaaauauaggaaagcccucaaaacagaagau

SEQ ID NO: 89309 - RNA, 45 nt, Mus musculus
acaaaaauauaaagacaugaaauauuauaaagaguaaaauuaagg

SEQ ID NO: 89310 - RNA, 45 nt, Mus musculus
auaggaaaaacuaucuaaagguaagaggaauagaaacaaagagau

SEQ ID NO: 89311 - RNA, 47 nt, Mus musculus
gaccauuuuguaaaucaguaucuuucaguuauuaaagcggugcaaac

SEQ ID NO: 89312 - RNA, 45 nt, Mus musculus
ugaguguguguguuugugugucucuuucuuguaaacacuugaaga

SEQ ID NO: 89313 - RNA, 46 nt, Mus musculus
aacaaagagaguuuauucugcagaaacaaccagcaugagcccagac

SEQ ID NO: 89314 - RNA, 46 nt, Mus musculus
uuauuuauuucuauuaugaauaaaugauacuauugauaggcaagua

SEQ ID NO: 89315 - RNA, 45 nt, Mus musculus
auguagguauaugcuagaggcaaaucuucuguuguucugcaugag

SEQ ID NO: 89316 - RNA, 46 nt, Mus musculus
uuggcaagaauuuuauuauuuuugcaucaauguucauaagggagau

SEQ ID NO: 89317 - RNA, 46 nt, Mus musculus
guuuauguggagguccuugauccacuugagcuuuguacgaggagau

SEQ ID NO: 89318 - RNA, 46 nt, Mus musculus
acaggacuuccaggucuguguucauucagagaugaugccccuaacc

SEQ ID NO: 89319 - RNA, 45 nt, Mus musculus
aagaaaggaaccacagaaugcacagcauacuagagucaaggagau

SEQ ID NO: 89320 - RNA, 72 nt, Mus musculus
uuacuauuaauuacuaggaaaagagauuagagaacuugaugauagcucagugaaaauuaccuaaacugaaau

SEQ ID NO: 89321 - RNA, 41 nt, Mus musculus
auguaucagaugugaacucccucuucugaagugggccuuaa

SEQ ID NO: 89322 - RNA, 46 nt, Mus musculus
aaacauaugaguguguggggccacuccuauucagaccaucacaggg

SEQ ID NO: 89323 - RNA, 46 nt, Mus musculus
gaacuuagcagcaauaccuuggcaguccuagaggcugggaggagac

SEQ ID NO: 89324 - RNA, 42 nt, Mus musculus
gcucaccagcuagucagccuagacaguugcaggccccagauc

SEQ ID NO: 89325 - RNA, 41 nt, Mus musculus
uuuuaagccucucagcuuguccaguugacucgaccagagag

SEQ ID NO: 89326 - RNA, 45 nt, Mus musculus
cuuagggcuuucuauaauauugccaucaucaucaucaccaccacu

SEQ ID NO: 89327 - RNA, 46 nt, Mus musculus
ugguugucagguuuuggaaccugugacugagagggaaguaagaggg

SEQ ID NO: 89328 - RNA, 45 nt, Mus musculus
ccauccguaacgagaucugacucccucuucuggagugugugaaga

SEQ ID NO: 89329 - RNA, 45 nt, Mus musculus
cguucgaaauguaaaugcaguaaauaccuaauaaaaaauuggagg

SEQ ID NO: 89330 - RNA, 46 nt, Mus musculus
ugguggcuuaaaaacagcauagauugcucauuuuacaaaucaaggu

SEQ ID NO: 89331 - RNA, 45 nt, Mus musculus
aggacuggaugagauaacaagacuggaugaaguauauacaaagau

SEQ ID NO: 89332 - RNA, 46 nt, Mus musculus
cuucacagcgaggaaaccauggaaugaagacacagucuacagagug

SEQ ID NO: 89333 - RNA, 46 nt, Mus musculus
augcuuagccaccagagaguggcacuauuugaaaggguuaauagga

SEQ ID NO: 89334 - RNA, 45 nt, Mus musculus
uacuaugguguguaauugguauuauagacaccuaaaaccccgaga

SEQ ID NO: 89335 - RNA, 57 nt, Mus musculus
accucuggcuugagcacagguugaagaagaagggccauggaggaccuguaaacugca

SEQ ID NO: 89336 - RNA, 41 nt, Mus musculus
uaaauuggggagagaaagcauuacuuaauaaaugacuacua

SEQ ID NO: 89337 - RNA, 46 nt, Mus musculus
cacccagaauguggguagugccauccuacaggcuggaggcccagac

SEQ ID NO: 89338 - RNA, 44 nt, Mus musculus
ugaaagccuaugucugaagaauguggaggauuuggggguugagu

SEQ ID NO: 89339 - RNA, 46 nt, Mus musculus
gaaacauaggucuuaaagaugcugauagugaggaaucauuggaaga

SEQ ID NO: 89340 - RNA, 46 nt, Mus musculus
auuguaccguuagcugcccagaggcagucuacagacauagggaagg

SEQ ID NO: 89341 - RNA, 46 nt, Mus musculus
agagcagcucucagacaguguacccaguaugcaaggggugggaucu

SEQ ID NO: 89342 - RNA, 48 nt, Mus musculus
agucauagaauguggcacugcgugugugugugugugugugugugugug

SEQ ID NO: 89343 - RNA, 51 nt, Mus musculus
uugcagggcaauccuuggggaaaauuucaauuagauggaaggauaggaaca

SEQ ID NO: 89344 - RNA, 46 nt, Mus musculus
ccacaucagcagcuuuagcguguuuggagcuuuuacugcgggaaag

SEQ ID NO: 89345 - RNA, 46 nt, Mus musculus
auguauguaugugcacaccaugugugugcucuugguucacagaggu

SEQ ID NO: 89346 - RNA, 45 nt, Mus musculus
uagcaagcacaaauagaagcucagggagacuugggauaagguuag

SEQ ID NO: 89347 - RNA, 59 nt, Mus musculus
ggucaaauaauauaagucacuuuacaacgagagagagaaagagagagagagagagagag

SEQ ID NO: 89348 - RNA, 45 nt, Mus musculus
uuguuuguugcaaaagggcaaaggggcuacagaaguuucagaguu

SEQ ID NO: 89349 - RNA, 45 nt, Mus musculus
agagacggaaccacuuuggggauacagugcugggacuugguugug

SEQ ID NO: 89350 - RNA, 46 nt, Mus musculus
ggucugugugugugugugucugaagugugagggucucuguguaugu

SEQ ID NO: 89351 - RNA, 47 nt, Mus musculus
gucuuuaucuguguaucagggucuguguuugugucugugucuaugug

SEQ ID NO: 89352 - RNA, 44 nt, Mus musculus
gaaggagcacugaugucgcuuggaugcgggcguaaucugccucc

SEQ ID NO: 89353 - RNA, 23 nt, Mus musculus
ccucggagacagccgcugcgcuc

SEQ ID NO: 89354 - RNA, 45 nt, Mus musculus
agagacuuggggaaagugaaacgugugugugaguuggaggcggga

SEQ ID NO: 89355 - RNA, 64 nt, Mus musculus
gcugguuuacauuucuguaacaguugcauauggcuagcaccauggacuauauauacccacugac

SEQ ID NO: 89356 - RNA, 51 nt, Mus musculus
ggugaauuaacuaaaggaagacaugaaauuguucccaaagacauaagagag

SEQ ID NO: 89357 - RNA, 46 nt, Mus musculus
ggggcugugcgauuggcaaagccaggcaggcugcaaagacagagau

SEQ ID NO: 89358 - RNA, 58 nt, Mus musculus
uccaacuuuagguccaacuucggcuauaacauuccucuaaaacaucuugcagacagag

SEQ ID NO: 89359 - RNA, 79 nt, Mus musculus
ugaucgacauguuggaauggcaguugcagguuugcuggcagaugcucguucauuagcagacauagcgagagaagaagca

SEQ ID NO: 89360 - RNA, 82 nt, Mus musculus
gcuauugggaucagauguaaagaugguguuguguuugggguagaaaaacuaguccuuucuaaacuuuaugaagaaggcucca

SEQ ID NO: 89361 - RNA, 45 nt, Mus musculus
caguuuggauguuuuaguuaugacaguugacucacugcauuaggu

SEQ ID NO: 89362 - RNA, 44 nt, Mus musculus
aguucaaaucccagcaaccacaugguggcucucaacuaucugua

SEQ ID NO: 89363 - RNA, 46 nt, Mus musculus
aaaauaaaguuucccuugugaugcugggcuaaaggcuucucuagau

SEQ ID NO: 89364 - RNA, 44 nt, Mus musculus
auacauucugaaacucuuugguuagagcagauuaguccccagau

SEQ ID NO: 89365 - RNA, 45 nt, Mus musculus
uagaaguuuggaggccaauguaggagcuagagaaaguacccaaga

SEQ ID NO: 89366 - RNA, 46 nt, Mus musculus
auccaaaguaucaguugugucuguugggagggaaggagaggcugag

SEQ ID NO: 89367 - RNA, 34 nt, Mus musculus
acaggugagcaaaugcaguguuggaagagaacac

SEQ ID NO: 89368 - RNA, 45 nt, Mus musculus
guccucaguuuauuguugaucugcuagaaaagcuuguucucagau

SEQ ID NO: 89369 - RNA, 41 nt, Mus musculus
ucuuccucacaggugugucgugcgcggccgugaaagccaga

SEQ ID NO: 89370 - RNA, 45 nt, Mus musculus
agacacaaggaucugagcucaauacccagaccccauguaacaagu

SEQ ID NO: 89371 - RNA, 45 nt, Mus musculus
agaaaggaaggaaggaaggaaggaaggaaggaaggaacagaaaag

SEQ ID NO: 89372 - RNA, 44 nt, Mus musculus
gaaguggacugauuacuucgcuguaaccaaggcauggcggggau

SEQ ID NO: 89373 - RNA, 44 nt, Mus musculus
uuccuuaaagaaauaaaagaauggaaagagagcaucucgggaga

SEQ ID NO: 89374 - RNA, 52 nt, Mus musculus
aggccagggccugugccugugcugugguuuggagcaggacuagaggagggag

SEQ ID NO: 89375 - RNA, 45 nt, Mus musculus
aagcauucagugggcaaagcccuaaggaguccaaaaugcacagcc

SEQ ID NO: 89376 - RNA, 46 nt, Mus musculus
agagcaagugaugaaggagagagagaaacgaggcaugucagaacug

SEQ ID NO: 89377 - RNA, 26 nt, Mus musculus
caguuuuaacaaagagagaagauggu

SEQ ID NO: 89378 - RNA, 46 nt, Mus musculus
acauggcgacaaccuggaggaguaacaguuuuuacuuuugggggaa

SEQ ID NO: 89379 - RNA, 47 nt, Mus musculus
cauuuucuucaccuccuucuucuccaguaauugugacgcaguaagaa

SEQ ID NO: 89380 - RNA, 49 nt, Mus musculus
cuaauguugcgcagauaaaauucaaacuugagguaaacagacgaagagg

SEQ ID NO: 89381 - RNA, 45 nt, Mus musculus
cccacaaggggccugaggcagcgggccaggaugcucggcggguga

SEQ ID NO: 89382 - RNA, 44 nt, Mus musculus
agaauggcccccauaggcucauauauuugaauguuugguuccca

SEQ ID NO: 89383 - RNA, 45 nt, Mus musculus
cccaguuucugucuaugucuaucucucccucuccuccuuuccccc

SEQ ID NO: 89384 - RNA, 46 nt, Mus musculus
acagguuagucuuuuaucauccuuuauuuuuguugagugugugaau

SEQ ID NO: 89385 - RNA, 45 nt, Mus musculus
aacaggacaugaaaagggagagguaaaaguauacauuuauuagaa

SEQ ID NO: 89386 - RNA, 46 nt, Mus musculus
ccuuaggagcuggaguugcagggagucuuaugucaccagacaugag

SEQ ID NO: 89387 - RNA, 46 nt, Mus musculus
cuuuuaaaggguuguugcaauaaacuaauugaaaaagaggcccacu

SEQ ID NO: 89388 - RNA, 45 nt, Mus musculus
accccagcauaauauauguacuccuuuuguauagaggagaaggaa

SEQ ID NO: 89389 - RNA, 46 nt, Mus musculus
cuccacugagggaggacaucagcucuagaaugaaggagagguacag

SEQ ID NO: 89390 - RNA, 45 nt, Mus musculus
uaauacaaaugaauguguaucuaaaagcuguaaaccuuuccuaag

SEQ ID NO: 89391 - RNA, 41 nt, Mus musculus
uccauuuucucuugugugugugugugugugugugugugugu

SEQ ID NO: 89392 - RNA, 49 nt, Mus musculus
aaagacauuaaucacauaauaguagauguacaauagcacuuaguagaag

SEQ ID NO: 89393 - RNA, 41 nt, Mus musculus
ggacacccccacucucucuuuuccccucuuuucagccuggg

SEQ ID NO: 89394 - RNA, 46 nt, Mus musculus
gaaaaagaaaaggagagagagauauugaucuccaucaagaagacag

SEQ ID NO: 89395 - RNA, 46 nt, Mus musculus
cuuucagguuuuauuccuaguuccuuuguuaauacuguggcuuaag

SEQ ID NO: 89396 - RNA, 46 nt, Mus musculus
gccccaaaggcagagaugaauaguugaaagagaucacauagcccag

SEQ ID NO: 89397 - RNA, 42 nt, Mus musculus
uacuuuuaacugcugagccaucucuguagcccccacccccac

SEQ ID NO: 89398 - RNA, 45 nt, Mus musculus
gggguguaggagaugauacccagggcggggccuaaccgcuaagaa

SEQ ID NO: 89399 - RNA, 46 nt, Mus musculus
guuuguuuuuaauuguuaacuguuuccuacaguggcagcuaagcag

SEQ ID NO: 89400 - RNA, 46 nt, Mus musculus
cacugaaagcauggaagaggccaagaaguuuuugcccacggaguag

SEQ ID NO: 89401 - RNA, 46 nt, Mus musculus
aguugugugacagugauuaagauaaagucaugaaacugagaaggag

SEQ ID NO: 89402 - RNA, 46 nt, Mus musculus
gagcucuugguuuucuugcaagaguuuuaagguuaagauuugauuc

SEQ ID NO: 89403 - RNA, 46 nt, Mus musculus
ucuugcuaaauucacuucuuuugguauccugagauauucgguagag

SEQ ID NO: 89404 - RNA, 42 nt, Mus musculus
uagauggcaggcaaacaaaacaccuuucucucuugaacccag

SEQ ID NO: 89405 - RNA, 46 nt, Mus musculus
uuauuagugagaagguugaauaguguuuccuuuauauuucucucag

SEQ ID NO: 89406 - RNA, 46 nt, Mus musculus
ugucuucuuucuguguuaagauaugaauucuuucuugcuuacuuac

SEQ ID NO: 89407 - RNA, 42 nt, Mus musculus
uuacuuuccauuauuuacuuccaacucauucuucaaggcaag

SEQ ID NO: 89408 - RNA, 46 nt, Mus musculus
ugcuagcuacuuacaugcuucuuugaauguaaucuguuuggaugag

SEQ ID NO: 89409 - RNA, 46 nt, Mus musculus
ggauuuuauuaaguauguuuauuuaguauagucauaaucacagaag

SEQ ID NO: 89410 - RNA, 46 nt, Mus musculus
guucccagauguuuugaugaagaagguuuuggucaggaaggcugag

SEQ ID NO: 89411 - RNA, 45 nt, Mus musculus
uuccuaucgccaugaaguacaagugccagcuucucagagugacag

SEQ ID NO: 89412 - RNA, 64 nt, Mus musculus
gcuucaugauuagcccagaaaagaaagcuguuagggggugguuuauguuccaaguaugcaaguu

SEQ ID NO: 89413 - RNA, 45 nt, Mus musculus
uuauaaacuuuugacagaaaugaguggagggggugauaaucauuu

SEQ ID NO: 89414 - RNA, 46 nt, Mus musculus
uaguaacuccuccaggacgaagaugaaaaguauacugaggaaggau

SEQ ID NO: 89415 - RNA, 46 nt, Mus musculus
uguuguuaugucaacuaauaauuuacuauuuauauuuggguagcau

SEQ ID NO: 89416 - RNA, 41 nt, Mus musculus
augccugagugauugcuuucaugcuuucuucugggaggcgg

SEQ ID NO: 89417 - RNA, 46 nt, Mus musculus
uggugggauucuugucacuguauuguauauuguguugacuugucag

SEQ ID NO: 89418 - RNA, 46 nt, Mus musculus
acagggaagucuauuugccaaacuacuuuauuucaacuaaugggag

SEQ ID NO: 89419 - RNA, 46 nt, Mus musculus
uagucucaagaguuuauaugaguuaauugaggugugagcagggcug

SEQ ID NO: 89420 - RNA, 46 nt, Mus musculus
guuuuuuuccagucaguaguuugaauagaagcuugcuuaaugccag

SEQ ID NO: 89421 - RNA, 46 nt, Mus musculus
acauuugugaaauaguaauuuguggauugauuggugauugccugaa

SEQ ID NO: 89422 - RNA, 47 nt, Mus musculus
uuaguccaucaugguggccaugaagcagagggagggagggaaggaag

SEQ ID NO: 89423 - RNA, 41 nt, Mus musculus
gaaggaaggaaggaaggaagggaggaaggaaggaaggaggc

SEQ ID NO: 89424 - RNA, 45 nt, Mus musculus
auauauuuaaaugguuagccaucaggguacagcacuauuugagaa

SEQ ID NO: 89425 - RNA, 35 nt, Mus musculus
uaaagaagccuccaauuaaaugcucuuuuucauaa

SEQ ID NO: 89426 - RNA, 52 nt, Mus musculus
ugaguuuuauagugagagauguccucuuagaaaaggcuggguuaguuuuuca

SEQ ID NO: 89427 - RNA, 46 nt, Mus musculus
aauaucuuuagccgggugugguggcgcacgccuuuaauaccagcac

SEQ ID NO: 89428 - RNA, 46 nt, Mus musculus
ucuccuuuucuuuccuccccuuucuccagaaugguccgagugccag

SEQ ID NO: 89429 - RNA, 72 nt, Mus musculus
ucuucugggacaaaagacuaaaagauguuaggcugauucugguugguuaagaacagaacaucagcaggugau

SEQ ID NO: 89430 - RNA, 55 nt, Mus musculus
uuguauagguugaaaauagaauagcuuagcgauagucuggcugaggcgcaaaguu

SEQ ID NO: 89431 - RNA, 49 nt, Mus musculus
uauuacauaaauaauacuaggcuuuuaacugauuacauggugugaaaga

SEQ ID NO: 89432 - RNA, 46 nt, Mus musculus
uugugguaucaugaugcuuuagggcucaauacuucacauucaaaau

SEQ ID NO: 89433 - RNA, 46 nt, Mus musculus
uuaaaccauauguaagucacguauccagaaaaauggggagccagag

SEQ ID NO: 89434 - RNA, 46 nt, Mus musculus
guauacauugaaaaaugcacaugugauaaccaaaugguaagggcag

SEQ ID NO: 89435 - RNA, 46 nt, Mus musculus
auaaaaguuauuucuguuucauguccugugugcuggaaaugugggg

SEQ ID NO: 89436 - RNA, 46 nt, Mus musculus
gaggacauccagucucggauuggacacugcaugcuguuccacucag

SEQ ID NO: 89437 - RNA, 42 nt, Mus musculus
cuugucauuuuuagggcuuaucgcauuuuguuguguggggag

SEQ ID NO: 89438 - RNA, 46 nt, Mus musculus
uuuuauucuagaaaaaccguugcuuauauguguuugguggccagag

SEQ ID NO: 89439 - RNA, 46 nt, Mus musculus
uagacccccucucuucaaauaguucauugacuuccauuuuccaaag

SEQ ID NO: 89440 - RNA, 46 nt, Mus musculus
cugaaugaaauacaugucuuauccggacuuagcaaagacaaagaaa

SEQ ID NO: 89441 - RNA, 45 nt, Mus musculus
uugggucuggcuuacaaguucagagguucaguccauuaucaucaa

SEQ ID NO: 89442 - RNA, 46 nt, Mus musculus
acuguggaucauucggacccagaagagacaaaagagguaaagaaag

SEQ ID NO: 89443 - RNA, 46 nt, Mus musculus
auugggaagguuggugcaggaggaucgaucacuaauuaaaggcuag

SEQ ID NO: 89444 - RNA, 42 nt, Mus musculus
acaccaucuaucugaggggaaagaaagaaauugaacaggcac

SEQ ID NO: 89445 - RNA, 46 nt, Mus musculus
uaauagcuuguguugauuccuuacacaaugccaggcauucucggug

SEQ ID NO: 89446 - RNA, 47 nt, Mus musculus
guaauccagggcauccagcaugcucaucucgccaccgugacaccaga

SEQ ID NO: 89447 - RNA, 46 nt, Mus musculus
gcuuuuguuuguucuuaguuuuuguuuuccaauauuuggugguuag

SEQ ID NO: 89448 - RNA, 46 nt, Mus musculus
caauggcuguugucaaggaaacaugacaccaaaaucuggcaaagga

SEQ ID NO: 89449 - RNA, 46 nt, Mus musculus
cagagaacagggcaagaagaugccccgaggacugaucaggcagcag

SEQ ID NO: 89450 - RNA, 42 nt, Mus musculus
auucugucaaaucuuuuucugauucgucacuuugccccucaa

SEQ ID NO: 89451 - RNA, 75 nt, Mus musculus
aaugaucaaaaauuggugggucuauuucuuacuggucaaguaggagaugaugugaauaucaaaaugagcaagaga

SEQ ID NO: 89452 - RNA, 47 nt, Mus musculus
cugagggguacacacugaccaaacaaguaaguuaaacagagugccag

SEQ ID NO: 89453 - RNA, 46 nt, Mus musculus
cugguccagacugaaaacuaugugcuuucugagauaaugcccggag

SEQ ID NO: 89454 - RNA, 46 nt, Mus musculus
uauugguugcugugaacucaaaaguaaauguuugcuguguguaaag

SEQ ID NO: 89455 - RNA, 45 nt, Mus musculus
cacacuguagacuggggagugggauugaagaauuacugggcucag

SEQ ID NO: 89456 - RNA, 45 nt, Mus musculus
acuuuuugccauacuaccaaaagcaaaacucaagauuggcccaga

SEQ ID NO: 89457 - RNA, 46 nt, Mus musculus
aaguaugcaguauaaauuaggagguaccaaauuguauaagagacag

SEQ ID NO: 89458 - RNA, 91 nt, Mus musculus
agguacuaaggagguggaugacauaacugacucaggcaggucagagccugugccuugggcauuaguggggcacuccagggguaccuuuagg

SEQ ID NO: 89459 - RNA, 46 nt, Mus musculus
ugggucaguguuuguuguaguaaagugugucagauuuagcauccag

SEQ ID NO: 89460 - RNA, 46 nt, Mus musculus
guuuugaaguucuguggagcugacuaguaccgcgcagugacaggaa

SEQ ID NO: 89461 - RNA, 46 nt, Mus musculus
ucaccuauuacugugaauuguguuucuauuuauuuuccuuggcuaa

SEQ ID NO: 89462 - RNA, 46 nt, Mus musculus
agucaugcuacuagguggguguucauuuacuaaacccuagacuaag

SEQ ID NO: 89463 - RNA, 41 nt, Mus musculus
gaagaauuuuuguuuguuuguuuuuaaauugggaugaggag

SEQ ID NO: 89464 - RNA, 44 nt, Mus musculus
gcccccacaaaacagugauccuggccagugguggguuugcggca

SEQ ID NO: 89465 - RNA, 42 nt, Mus musculus
ucuacuaaauagacauuuacauucuuguucagaaguggggag

SEQ ID NO: 89466 - RNA, 42 nt, Mus musculus
gcagaaaaagcauuugcggucugucaaauggccuugccccau

SEQ ID NO: 89467 - RNA, 45 nt, Mus musculus
ggccacauguagagugcacaaauccucagcuggcuugaaggacgc

SEQ ID NO: 89468 - RNA, 45 nt, Mus musculus
agcuggaacuagaggccugagccacaggcccgugugcacugccug

SEQ ID NO: 89469 - RNA, 46 nt, Mus musculus
caucccacccucugcuagaauuaccugguaauuuccaaaggcccag

SEQ ID NO: 89470 - RNA, 77 nt, Mus musculus
aggccagccagucucagaaaaggaaggaagggaaggacagaggaagggagagagggacagaaggaagaagggaggga

SEQ ID NO: 89471 - RNA, 90 nt, Mus musculus
gcagggguaugcugccccacaggauggcucgcugugcucggugaagaauccacaggcugcugagggcuuguuguguugucuguugugggg

SEQ ID NO: 89472 - RNA, 46 nt, Mus musculus
cuccagaggaggcuguuuguccacugcuacuggugaaggccgugcu

SEQ ID NO: 89473 - RNA, 49 nt, Mus musculus
agauugccaccgcuuugauugcucgugggguuugggguggaggucggca

SEQ ID NO: 89474 - RNA, 46 nt, Mus musculus
agagcagucagugcucuuaacugcugaaccaucucuccagcccaac

SEQ ID NO: 89475 - RNA, 46 nt, Mus musculus
auacugaucccaaccaguuuggacccaaacuugccugaauguagag

SEQ ID NO: 89476 - RNA, 46 nt, Mus musculus
aauguaaucugauggccucuucuggaguaucugaggacagcuacag

SEQ ID NO: 89477 - RNA, 46 nt, Mus musculus
gcagggaaagagaaaaaaaaacuagacacagauuaagacagaccua

SEQ ID NO: 89478 - RNA, 46 nt, Mus musculus
ugugugcgcacacgcaugggugacuggagaacagcagaguggcuag

SEQ ID NO: 89479 - RNA, 46 nt, Mus musculus
ugcgacaacuucccccaaaggcuugugcuggauauuugguccccag

SEQ ID NO: 89480 - RNA, 42 nt, Mus musculus
ugagauucgaaguguggaaaggaaauggccaaauggggcgca

SEQ ID NO: 89481 - RNA, 42 nt, Mus musculus
ccuggagguaccuccaacuuccagaccucaguuuugccccua

SEQ ID NO: 89482 - RNA, 50 nt, Mus musculus
ccauuccuuuccagaaucccacgcucgcgggugugugugugugugugugu

SEQ ID NO: 89483 - RNA, 46 nt, Mus musculus
guguguguauguauguguguguguguguauguguguguguguaugu

SEQ ID NO: 89484 - RNA, 42 nt, Mus musculus
cuaggcuugaaaaguccacagacaugcaaguguggggcccag

SEQ ID NO: 89485 - RNA, 46 nt, Mus musculus
ucaccauuaugggagugagaugcaggcgacaguagcagcagcagca

SEQ ID NO: 89486 - RNA, 45 nt, Mus musculus
ucuucucaggguggaugaacccgagauuaaauaccauuugcaggg

SEQ ID NO: 89487 - RNA, 46 nt, Mus musculus
gucuguucgauugguuuagucuugccacagucuagggagggacucu

SEQ ID NO: 89488 - RNA, 46 nt, Mus musculus
gagaagggaggucccucccagcguagcugcaaaucaggcccaaggu

SEQ ID NO: 89489 - RNA, 46 nt, Mus musculus
ccucuuuggcuuaaagaagcuuuuaaggagccuuaaagggugugug

SEQ ID NO: 89490 - RNA, 56 nt, Mus musculus
cagacugcagggaguggagagagcgaccggugggccagaccagggagagggaggag

SEQ ID NO: 89491 - RNA, 45 nt, Mus musculus
ccaugauguagcugucuacugcuguccuaccuucucagccgugag

SEQ ID NO: 89492 - RNA, 44 nt, Mus musculus
cuucaaggccacuuggcggucuaagggcuaugugucagggcaga

SEQ ID NO: 89493 - RNA, 35 nt, Mus musculus
agcuucacuguagcucuaauguccauggccaagca

SEQ ID NO: 89494 - RNA, 46 nt, Mus musculus
guaaaagccacuguagagacaaguguagcaccuuaucagggccaag

SEQ ID NO: 89495 - RNA, 43 nt, Mus musculus
auuugccgagagagagagagagagagagagagagagagagaga

SEQ ID NO: 89496 - RNA, 42 nt, Mus musculus
ugaaucauagcccacuucaggguuaagaaccugugucagagg

SEQ ID NO: 89497 - RNA, 45 nt, Mus musculus
cacaaccauccguaacgagaucugacucccucuucugaagugucu

SEQ ID NO: 89498 - RNA, 46 nt, Mus musculus
gguaagguguuaugcugggaacuugauuaugacauauuggacagga

SEQ ID NO: 89499 - RNA, 42 nt, Mus musculus
agcccguggcuccauagaaaccuacaggagccagcugcagaa

SEQ ID NO: 89500 - RNA, 46 nt, Mus musculus
ggaaugcugcuaaaucacuaaaucuaacuucuaauggggaucagau

SEQ ID NO: 89501 - RNA, 46 nt, Mus musculus
uccaggguaguaagaguccugccgugcaggaggcaugcccagagua

SEQ ID NO: 89502 - RNA, 46 nt, Mus musculus
uugccugccugccaccuucuccccaacagauguagcuccuauagcc

SEQ ID NO: 89503 - RNA, 46 nt, Mus musculus
agaccugaaacugaagaaugugaguaucaucccaagcaugggcaag

SEQ ID NO: 89504 - RNA, 46 nt, Mus musculus
aagucaagguguccucaagauggcaaugacagcggagcaggccuag

SEQ ID NO: 89505 - RNA, 46 nt, Mus musculus
uguuaauuaggcauuuauuuuacaacuggcauauaaaauuugucag

SEQ ID NO: 89506 - RNA, 46 nt, Mus musculus
uuuuuccuauaguccuugaaugagcaaguagcugacagaacuccag

SEQ ID NO: 89507 - RNA, 40 nt, Mus musculus
gcaggcagggugaggucagggcagcggcuggacuuccgcg

SEQ ID NO: 89508 - RNA, 46 nt, Mus musculus
agauagugcuugugauuggucuuuuggagacugcuacuaacuauag

SEQ ID NO: 89509 - RNA, 45 nt, Mus musculus
gggucaggacuguugauagacccaguugauagauuacuugcccag

SEQ ID NO: 89510 - RNA, 45 nt, Mus musculus
ucuagugucuguagugucuuugguuagaaauuugaguuuuacuag

SEQ ID NO: 89511 - RNA, 54 nt, Mus musculus
uguggucacaguagguuuacuuugggcauaguaagcaguagccagucguuuaug

SEQ ID NO: 89512 - RNA, 72 nt, Mus musculus
uuuaugagaauuuuuuucugaguuguaucuuuuacuagaagcccuuucaaaaaguaaauucaaaaaucauuu

SEQ ID NO: 89513 - RNA, 46 nt, Mus musculus
acacaccccucaucuuaaagggaauaagagauaguuuauucuggag

SEQ ID NO: 89514 - RNA, 46 nt, Mus musculus
guuuaaaguacauugguggguacaucagagaggcagguaaagcaag

SEQ ID NO: 89515 - RNA, 46 nt, Mus musculus
uuugaguaucgcuuaaacgugcuuuauuggggaaaugagauauaag

SEQ ID NO: 89516 - RNA, 45 nt, Mus musculus
gguagagcugaugauuuaacagcagugagggaaggaagcacgauu

SEQ ID NO: 89517 - RNA, 41 nt, Mus musculus
cuguguggugggguugagguucuugaugguaagaagcucag

SEQ ID NO: 89518 - RNA, 42 nt, Mus musculus
aggauguguguuguuuaggcugaucgaugacauugccuugag

SEQ ID NO: 89519 - RNA, 41 nt, Mus musculus
ucacuguacuuagcuaaauauguucaaauuuugcacaggua

SEQ ID NO: 89520 - RNA, 45 nt, Mus musculus
aauuagucaugguuagagauauaauucaucauguaaaauaccaga

SEQ ID NO: 89521 - RNA, 84 nt, Mus musculus
cagucuaguuuagcguuuccuguuccaguguucacucagcagcacuuuguaaauuguaaucacaguuuacaugaaauagggcag

SEQ ID NO: 89522 - RNA, 46 nt, Mus musculus
uuccuugcuucugucuuuuuguuguucuucuuaaccauuuugucag

SEQ ID NO: 89523 - RNA, 48 nt, Mus musculus
uggcauguuuccuuccacaaauggcagugcgugugugaugggagagag

SEQ ID NO: 89524 - RNA, 49 nt, Mus musculus
uugaaggcauuucuugguuguucuuuagaguagcauacuggaagacuuc

SEQ ID NO: 89525 - RNA, 49 nt, Mus musculus
guuucauuucaugcaacacuugaucucuuggcaucccuaacacauuuac

SEQ ID NO: 89526 - RNA, 45 nt, Mus musculus
ccuugcucugagugacaguuuggagaagacuguuguacggcguuu

SEQ ID NO: 89527 - RNA, 42 nt, Mus musculus
cugagggaauuuaaugaaacucuaaauuaccacaguaagcag

SEQ ID NO: 89528 - RNA, 46 nt, Mus musculus
cauguaucaaacugaguuauugaaagauuuuuaauaaguguaccua

SEQ ID NO: 89529 - RNA, 46 nt, Mus musculus
ggaccugaacuccauugaugaugcuuuugcggcaagugcugcccac

SEQ ID NO: 89530 - RNA, 35 nt, Mus musculus
cuuggucuugguacugcagaugagggcuugaucgu

SEQ ID NO: 89531 - RNA, 46 nt, Mus musculus
auuucucuaauguaccauucuuacuuucaguauacuaaagucugag

SEQ ID NO: 89532 - RNA, 46 nt, Mus musculus
ccaagaaagcaaaugccaccugacucaguguuagaaauuagugcag

SEQ ID NO: 89533 - RNA, 42 nt, Mus musculus
guaaguuagcuaucgucaggcuguguuauucuagggccacau

SEQ ID NO: 89534 - RNA, 46 nt, Mus musculus
cccuaggauaaagaauagccuuaauuaauacaaagaaugucauagg

SEQ ID NO: 89535 - RNA, 46 nt, Mus musculus
gcugaguuuucccuccugaacauuuccaugucugauacugugcuug

SEQ ID NO: 89536 - RNA, 46 nt, Mus musculus
ucucccucacuuccugcauccuuucuaauugucccgcuuuggcuag

SEQ ID NO: 89537 - RNA, 46 nt, Mus musculus
uugucuauuuaauauuaaauuuacuaacugaugcuuaaaaggggag

SEQ ID NO: 89538 - RNA, 46 nt, Mus musculus
aggucaaagagaaucugcuuuccugcaagaugcugcugcauugcaa

SEQ ID NO: 89539 - RNA, 45 nt, Mus musculus
gaagaucacggaucucauuuuagaggaugaagucuaugugacaca

SEQ ID NO: 89540 - RNA, 82 nt, Mus musculus
uauuuuuccuugguguaacaaacaccugagauaaaucagcucacgagaaggaccauguuuauuuauaguuuuaagaguucag

SEQ ID NO: 89541 - RNA, 42 nt, Mus musculus
gaguuauuuguaagagagaaccucaauugaagaauagccuag

SEQ ID NO: 89542 - RNA, 56 nt, Mus musculus
gaguuaauauuuuuaugaacuuuuuuccccccagggagaauuuguguguagaaguc

SEQ ID NO: 89543 - RNA, 42 nt, Mus musculus
acagauauuugauuaguugcuuuucagccaaaugugagccag

SEQ ID NO: 89544 - RNA, 46 nt, Mus musculus
aauaaacaagacucuuaauuggguuuuauguuucagaacucuggga

SEQ ID NO: 89545 - RNA, 74 nt, Mus musculus
ggaugcaguuaaauacagagaguuguggguagcaguguguguguguguguguguguguguguguauguauuuag

SEQ ID NO: 89546 - RNA, 41 nt, Mus musculus
caacauaccauagcacauaauacacauugcuauucugaaaa

SEQ ID NO: 89547 - RNA, 24 nt, Mus musculus
ucuuauccagcuguauacuaggcg

SEQ ID NO: 89548 - RNA, 45 nt, Mus musculus
uacuucuguuuagcagauggguaguagacaaacugcuaggcccau

SEQ ID NO: 89549 - RNA, 45 nt, Mus musculus
aaaguguucuagccagauauaaaaauuaucugauaaaacguggua

SEQ ID NO: 89550 - RNA, 76 nt, Mus musculus
uaaacacacaccaccuccaggggcuaaaagguccagucucaguguagagcagucucagggaagacaucaccaaaug

SEQ ID NO: 89551 - RNA, 45 nt, Mus musculus
aaacuggacuuuucacuuuugucccuuuugguguagcauaggcca

SEQ ID NO: 89552 - RNA, 46 nt, Mus musculus
gggagagagguaggggggagaaugagggagagagagagagagagag

SEQ ID NO: 89553 - RNA, 48 nt, Mus musculus
aagaagaggaccaagaagggagccaagagaagaaccaggaaaccaccu

SEQ ID NO: 89554 - RNA, 45 nt, Mus musculus
agguaaagaauauguuuuucacuguuaaucuuauaauagagacug

SEQ ID NO: 89555 - RNA, 46 nt, Mus musculus
ucuguuuucuuuucagagggcauugccagagcagaugacagacagg

SEQ ID NO: 89556 - RNA, 46 nt, Mus musculus
auaaaaccuguaagacaaccaccaauaacaagaaaaaugcccccaa

SEQ ID NO: 89557 - RNA, 45 nt, Mus musculus
uuuucuauuggugugaucaacacuaaagacaaagggaacuuggag

SEQ ID NO: 89558 - RNA, 45 nt, Mus musculus
cccauguggacuguccucauucaaacucucacauuuguuugcaag

SEQ ID NO: 89559 - RNA, 45 nt, Mus musculus
uucugaguaccugguuccacagaccaugcugauauaaucugcuag

SEQ ID NO: 89560 - RNA, 46 nt, Mus musculus
aucuuuccaacaguaauucuuaugaaaggacuggguacacucaaug

SEQ ID NO: 89561 - RNA, 42 nt, Mus musculus
ugucuaagauauauacuugaccaagaaguuccacagagauaa

SEQ ID NO: 89562 - RNA, 46 nt, Mus musculus
uucacuuuguuuacuuguucgcuuucguucaguuucuaugugguag

SEQ ID NO: 89563 - RNA, 52 nt, Mus musculus
auucagggccuggccagacugaagaagaucccugagacaguuaaagccauua

SEQ ID NO: 89564 - RNA, 46 nt, Mus musculus
ugugagcuacuucugagugucaacaucuuauaguuagaggagccga

SEQ ID NO: 89565 - RNA, 46 nt, Mus musculus
uuugccuuuguccccgacacacaccaggcacauaagacuggaacgg

SEQ ID NO: 89566 - RNA, 46 nt, Mus musculus
augaacuuaauuuaaaaguacuauaacugguaaaggaaaagcaaag

SEQ ID NO: 89567 - RNA, 42 nt, Mus musculus
guugauaagcuucuucacacaguuuaggaaaaugcucaguag

SEQ ID NO: 89568 - RNA, 46 nt, Mus musculus
cuucaaaauaagcuaaauuaagaaagugaagaaaacacagucagag

SEQ ID NO: 89569 - RNA, 46 nt, Mus musculus
uuuugcacaguggcacuugaagaugggaaccacagggaugcuucag

SEQ ID NO: 89570 - RNA, 46 nt, Mus musculus
auaugguugcuaguuaccuguuuuuuuugaggaaccuccguacuag

SEQ ID NO: 89571 - RNA, 46 nt, Mus musculus
aguccaaaagagucaaaagaaaaaguuaauuuuucuccacagucag

SEQ ID NO: 89572 - RNA, 45 nt, Mus musculus
uaccuccaggacucuguugggacccagcuaacacagcaggaggag

SEQ ID NO: 89573 - RNA, 46 nt, Mus musculus
guuucauugaaauuagucauauguuuagcuaauaagaaacuugcgu

SEQ ID NO: 89574 - RNA, 46 nt, Mus musculus
uugcugacugugccuaugaaaugagaccuuguuuuaaaagaaagag

SEQ ID NO: 89575 - RNA, 46 nt, Mus musculus
guauuaaaaagaguaaguacauguggagaauugaaaaauguagcug

SEQ ID NO: 89576 - RNA, 46 nt, Mus musculus
agaggcuuaugaaaugugugaagaauagaguuuggagagcaggaaa

SEQ ID NO: 89577 - RNA, 42 nt, Mus musculus
uuucaucuaacaauuaugugauugcagugguagagggagaag

SEQ ID NO: 89578 - RNA, 46 nt, Mus musculus
gucagcauaagccagaaaccagugaaugcuaucuugaaggugccag

SEQ ID NO: 89579 - RNA, 46 nt, Mus musculus
auuuagacuugcacuuaagaaauauagaaagauuucuaagcugaag

SEQ ID NO: 89580 - RNA, 48 nt, Mus musculus
aauugaucacugaaaaacuaagaaaggaagaaaauugaugucaagaaa

SEQ ID NO: 89581 - RNA, 46 nt, Mus musculus
auuauauuaaauauaaauaacuaaacaccucacuuauauggcagag

SEQ ID NO: 89582 - RNA, 48 nt, Mus musculus
uaaaaauuucaagauuuuuuuuaaacacuaaaaccuggagaaggagga

SEQ ID NO: 89583 - RNA, 45 nt, Mus musculus
cugcuucauuaauguuuaaauagugauaaaauuaaccucauggag

SEQ ID NO: 89584 - RNA, 46 nt, Mus musculus
ccugauauaugcuccucaagcuuuguugcccaagcaugacugacug

SEQ ID NO: 89585 - RNA, 46 nt, Mus musculus
acuucaguauaugacuggcaccuuugugcuuccacacagccccuuc

SEQ ID NO: 89586 - RNA, 46 nt, Mus musculus
uguagcucuggcuguccucaacucacuuuguagaccacgcuggccu

SEQ ID NO: 89587 - RNA, 46 nt, Mus musculus
ucuuaucauacagaucuuuuacuuccuuaauuagagucacacccag

SEQ ID NO: 89588 - RNA, 46 nt, Mus musculus
auagaacucugcacuaaacccauuugguccuuuuuuugguugggag

SEQ ID NO: 89589 - RNA, 45 nt, Mus musculus
aguguguacauucuccuucuguucuguuuuauuauucaugcccug

SEQ ID NO: 89590 - RNA, 46 nt, Mus musculus
uacuaauauggccaaaauaauauuuucuggaugauuaaucuggcag

SEQ ID NO: 89591 - RNA, 42 nt, Mus musculus
ccuuccgaccgacccccaccccccaaucucauucugccuccc

SEQ ID NO: 89592 - RNA, 45 nt, Mus musculus
ugccugccaggggauaauagcagaaacuauaccgaugggaauguu

SEQ ID NO: 89593 - RNA, 46 nt, Mus musculus
uuauauuaacuacuugaaauuuuuguaugguuuugaaaauauaaag

SEQ ID NO: 89594 - RNA, 47 nt, Mus musculus
gggagugagugugcuauuaaaauccauuaaccuuuucagugauaggg

SEQ ID NO: 89595 - RNA, 46 nt, Mus musculus
ugcauguucagagcuuggugaaguauucucaaagagacuggaagau

SEQ ID NO: 89596 - RNA, 45 nt, Mus musculus
gauagaggccugccuggcuugugaaguuucagagagaagcaagag

SEQ ID NO: 89597 - RNA, 24 nt, Mus musculus
gccggugaggagcagaggcccagc

SEQ ID NO: 89598 - RNA, 41 nt, Mus musculus
ugugaccaaaaccuaagagaaguaacuugagggaaggggga

SEQ ID NO: 89599 - RNA, 46 nt, Mus musculus
agccaugacaccugacccccaucccccaguucacaacuuacccaga

SEQ ID NO: 89600 - RNA, 46 nt, Mus musculus
uuaagcacuucaaugaauuuucuaccaaccauauacaagcaucuua

SEQ ID NO: 89601 - RNA, 46 nt, Mus musculus
ugugaggaacagggaucuuuggaaguaaacacuuauggacagcuag

SEQ ID NO: 89602 - RNA, 45 nt, Mus musculus
cugccugguugguggcucagugucugagaggucuugaggguccag

SEQ ID NO: 89603 - RNA, 45 nt, Mus musculus
aggacugaacagagacaauaaaggcacggagugggcugacuggag

SEQ ID NO: 89604 - RNA, 42 nt, Mus musculus
aacucccugaucaucugguucuuauaaucuuucuguccccuu

SEQ ID NO: 89605 - RNA, 46 nt, Mus musculus
gaguagagguuugauguaaggccaguauuacuauucagauguguga

SEQ ID NO: 89606 - RNA, 46 nt, Mus musculus
agagaucaauggcccugaagacacucagcauaggugggaacuggag

SEQ ID NO: 89607 - RNA, 45 nt, Mus musculus
uucuaauauaaguauucaauuggcauguuuuuauuaagaaccuag

SEQ ID NO: 89608 - RNA, 41 nt, Mus musculus
uuuguauaggagcagcuauuuuagguauccuauugacugaa

SEQ ID NO: 89609 - RNA, 49 nt, Mus musculus
ugguccuuuguaaaaccaguaaacacuauuaacugcuucgccaucugcc

SEQ ID NO: 89610 - RNA, 56 nt, Mus musculus
uguuucagucucccacccuccucuuuuaucauuuuaagccaaaaucaaaagucaga

SEQ ID NO: 89611 - RNA, 64 nt, Mus musculus
ugcuaccuacugguuuaauagaaagaaugaggagauaggcuguaguggauagaggggacgguca

SEQ ID NO: 89612 - RNA, 70 nt, Mus musculus
guucuggaaagggaauuguguaaaaggaaguagaggacuaaaggacagaagcagaguaaugaaacuugga

SEQ ID NO: 89613 - RNA, 57 nt, Mus musculus
gugcuggagguacaccugugaguucuaacuuuuccaguagauuguuaucuuuaguca

SEQ ID NO: 89614 - RNA, 51 nt, Mus musculus
uacgugaugaggacaggcaugauuucaccuuugguuuucauaccaauggaa

SEQ ID NO: 89615 - RNA, 46 nt, Mus musculus
cuugcaaagccucugaaucuuggggauuuuaguugaaccauaccag

SEQ ID NO: 89616 - RNA, 46 nt, Mus musculus
cugacaucuagaaaguccuuuuccacaauaaccauagugccacaga

SEQ ID NO: 89617 - RNA, 45 nt, Mus musculus
cacaacaugcaaauuuugaguugucaaugcugagugucagugcug

SEQ ID NO: 89618 - RNA, 46 nt, Mus musculus
caaguuacaguccuuggcaggcaaaaagacguuucucacaucucac

SEQ ID NO: 89619 - RNA, 45 nt, Mus musculus
aggcuauauaaaccuugaggaguggguagggguuuugggggugag

SEQ ID NO: 89620 - RNA, 44 nt, Mus musculus
gaagaggaaaucgagguagcuagcuggacauguccuuauaggga

SEQ ID NO: 89621 - RNA, 26 nt, Mus musculus
aggacauacauguaacuguucacggu

SEQ ID NO: 89622 - RNA, 45 nt, Mus musculus
agcauggcauguagauagauugacuguacaagagauugaaugugg

SEQ ID NO: 89623 - RNA, 45 nt, Mus musculus
gcaagugucaauaaaauaaaauuuguaauuuuguuuuaguaugca

SEQ ID NO: 89624 - RNA, 46 nt, Mus musculus
cacaagugggaggagagauccacaucuguccuacacaguagcugag

SEQ ID NO: 89625 - RNA, 46 nt, Mus musculus
uauguguuuuucugucuugaugaauuuagccaaaaguucuaaacag

SEQ ID NO: 89626 - RNA, 46 nt, Mus musculus
acacagcaugauuaggccuucauauaucugugucacuuuucuuaaa

SEQ ID NO: 89627 - RNA, 46 nt, Mus musculus
cggccaguacaagaagguuaaugugugugcucuuaugagaagggug

SEQ ID NO: 89628 - RNA, 45 nt, Mus musculus
augguuggcaagggucauagaaucuuugaagaguuuuaaguggga

SEQ ID NO: 89629 - RNA, 59 nt, Mus musculus
gcagguuaucucagacaaaugcuguugugugaacuuuuccugaagagacgaauaaauau

SEQ ID NO: 89630 - RNA, 67 nt, Mus musculus
cuauucaugccagauuuggcaccaaugacagaccaaagaaacaaguuuauucaaaucuagcuugcag

SEQ ID NO: 89631 - RNA, 46 nt, Mus musculus
caaaggacaguguuuuuuaauacuguccaacuaugaaaggccauag

SEQ ID NO: 89632 - RNA, 47 nt, Mus musculus
agacaaaggacucuuuauaaaacagguaaaggguaugacuaggcagu

SEQ ID NO: 89633 - RNA, 46 nt, Mus musculus
uugauuggcauagcccaauaagcuugauaacaccaaguguuggcaa

SEQ ID NO: 89634 - RNA, 45 nt, Mus musculus
auuacuaaaaccuuuguagcaagcauucuagaacuuucuggugaa

SEQ ID NO: 89635 - RNA, 46 nt, Mus musculus
gcuauuuucuuuuauguguuaaccuagaaaauugucacauuggugg

SEQ ID NO: 89636 - RNA, 46 nt, Mus musculus
uuuugaguuguuuucucaaaauuuaguugaagaaucauuaaugcag

SEQ ID NO: 89637 - RNA, 45 nt, Mus musculus
auuuuccuauuauaucuaagaauuaaacuguauugauaagaaaga

SEQ ID NO: 89638 - RNA, 46 nt, Mus musculus
gauucuugcugaacuguaauuuuuuuguaacuuucauccagucaac

SEQ ID NO: 89639 - RNA, 89 nt, Mus musculus
uuuauccuccuggaaaauuuccaagcuuuccucauccuuugcagaguaugucaccagacacaucaggauauuuuagauaaagggcagca

SEQ ID NO: 89640 - RNA, 45 nt, Mus musculus
uucauagacuguaaucuuacaugguuuuguacauaaaugccugag

SEQ ID NO: 89641 - RNA, 46 nt, Mus musculus
ugguucauaauauuauucagugucuuauuuuucaguuucugugaag

SEQ ID NO: 89642 - RNA, 68 nt, Mus musculus
agagugaaagucugugacccucauggcagggaguaugacagcaggcaggcaaguuugauacuggagua

SEQ ID NO: 89643 - RNA, 46 nt, Mus musculus
uaucauacacuucuacagcaguguucauugaaggaagucaggacau

SEQ ID NO: 89644 - RNA, 46 nt, Mus musculus
cucugaugacucuagcuugugucaagcugacacaaaccagccauug

SEQ ID NO: 89645 - RNA, 45 nt, Mus musculus
ugaagccugaaagacuccagugucauccuccucuaacaccuccua

SEQ ID NO: 89646 - RNA, 76 nt, Mus musculus
guauuguuguagauggcaggucccaaaggaguuauggagggagaggauuggaauggcuguauaguuuguuuuaugg

SEQ ID NO: 89647 - RNA, 42 nt, Mus musculus
uugucuggugcccucuucugguaugucugaagacagcaacag

SEQ ID NO: 89648 - RNA, 46 nt, Mus musculus
aauguaacagagaaagcuuauuguagacugagucuuacaucugcag

SEQ ID NO: 89649 - RNA, 42 nt, Mus musculus
agggugagagauagagagagugacaaagaccgagagggacag

SEQ ID NO: 89650 - RNA, 46 nt, Mus musculus
ugaacagucagugaguauuuuuucaggaugcuuuugagaugcugag

SEQ ID NO: 89651 - RNA, 46 nt, Mus musculus
uugcaaauaggccaggcaguuggacccgaggugguugccgagaauu

SEQ ID NO: 89652 - RNA, 43 nt, Mus musculus
gaggcagggagaaaagagaaucagagacagagaaggggcagag

SEQ ID NO: 89653 - RNA, 45 nt, Mus musculus
acauuuagauuagacauaaauuucugcaguauaagauauggccag

SEQ ID NO: 89654 - RNA, 46 nt, Mus musculus
agcuucaggggccuugggaagauggcagagaguuacagaagaaaag

SEQ ID NO: 89655 - RNA, 81 nt, Mus musculus
aagcugacaucacucccuaguuggggguuaugucacucagcccucaguuagagcgcuaguuaugccugcacauggcucuga

SEQ ID NO: 89656 - RNA, 107 nt, Mus musculus
uguugcuaggucucaggcacuuagcucaccucuaugcguuucaucaguaacccugacauuuacacaauaauuugcugaacauuauggaaugccagacaguaugauua

SEQ ID NO: 89657 - RNA, 55 nt, Mus musculus
guagaauggaaaugacuuuugcuuugauuuuugauguagccagaauuuuaaccug

SEQ ID NO: 89658 - RNA, 107 nt, Mus musculus
guugagcugucuaaccauagauagaccuucauaccuugucuccugagaucuuuuugccaguccucuucacugauugccauguggaacuuaguauucaggaugcuggc

SEQ ID NO: 89659 - RNA, 84 nt, Mus musculus
agucaaauauuucuuuaauguauuuucaaagggcaaguguaacuucuguuccauuguucuuccucuuauauaaguucccaggua

SEQ ID NO: 89660 - RNA, 110 nt, Mus musculus
uaauucugguuaagaggaguagaaaagucaguugguagauuuuucaggcgagaaucuauuuucuuauuauagaaaaaagaugggagacauaacuaccuaguguuuucauu

SEQ ID NO: 89661 - RNA, 85 nt, Mus musculus
auuugcuuucagucugugaugcuuucaagagucugagaaauaggguauuuaacuucucaacuuaugacugauaggaucaucguaa

SEQ ID NO: 89662 - RNA, 46 nt, Mus musculus
uugacagugauuuguaugacuauggauuauuaaaccucagccuaga

SEQ ID NO: 89663 - RNA, 45 nt, Mus musculus
caugagucuccaguugacaugugucccucugaaugugucccucag

SEQ ID NO: 89664 - RNA, 45 nt, Mus musculus
acacagacacacagacacacacacacacacagagaaacagagcga

SEQ ID NO: 89665 - RNA, 45 nt, Mus musculus
uaugggacacauaguggauauuuaguaguugguagugaacuguga

SEQ ID NO: 89666 - RNA, 45 nt, Mus musculus
aagggucugcuguugcccaaguucucuuccacuggguauucauag

SEQ ID NO: 89667 - RNA, 63 nt, Mus musculus
ugucuguuguuuuuaaaaauucuuuaaaaaugauaggagauuacaguuuaggggggauguacu

SEQ ID NO: 89668 - RNA, 52 nt, Mus musculus
acugaaagccaauuuagaagcuuuucuuggaaagaauaguaugaaaugaagg

SEQ ID NO: 89669 - RNA, 46 nt, Mus musculus
auguauuaagguugcaacacuuugguguugugcuuuaaagagccag

SEQ ID NO: 89670 - RNA, 46 nt, Mus musculus
accuccgagaggcuucaaccagcaguugaugagaaccgaugcagag

SEQ ID NO: 89671 - RNA, 62 nt, Mus musculus
gccugggccaguugguacaagauaugagggaaagggguucucuuggaagaaggggaggagga

SEQ ID NO: 89672 - RNA, 46 nt, Mus musculus
aaaugaaucaaugaaugaaugaaugaaugaaugaauuuuuaaaaag

SEQ ID NO: 89673 - RNA, 42 nt, Mus musculus
auacuguagaguaguucagacuuaauaaaugaaaggugcauu

SEQ ID NO: 89674 - RNA, 24 nt, Mus musculus
caugcaugaugccugucuuucucu

SEQ ID NO: 89675 - RNA, 46 nt, Mus musculus
augcacccccccauuucccuucucucuucucucucucagcccccuu

SEQ ID NO: 89676 - RNA, 45 nt, Mus musculus
uauugagaacuucuugcuucuaguuuguugcaguuacacacccca

SEQ ID NO: 89677 - RNA, 23 nt, Mus musculus
uggcauuuccuuggagcagcauc

SEQ ID NO: 89678 - RNA, 45 nt, Mus musculus
aaaguauaggaggcaggacaagaaagaaugaaaucauuggaaaag

SEQ ID NO: 89679 - RNA, 45 nt, Mus musculus
uagauaguuuagguugugagagaauuuguacuuuaggcuauagaa

SEQ ID NO: 89680 - RNA, 46 nt, Mus musculus
accauacuggagcagugguauagcccaggcuucuaggaaaugcgag

SEQ ID NO: 89681 - RNA, 45 nt, Mus musculus
cugugcaaacaaacguauguuuccacuuccuguaguaaggcucag

SEQ ID NO: 89682 - RNA, 45 nt, Mus musculus
uaaaucauagaugugccuuucauguucauauaucuuagaucccaa

SEQ ID NO: 89683 - RNA, 45 nt, Mus musculus
gaauggacagaaauaccagugauguauugauauuugugguuggcc

SEQ ID NO: 89684 - RNA, 46 nt, Mus musculus
uaaggaagugucuuauguuucuccaaaucacauaaauaugaagcug

SEQ ID NO: 89685 - RNA, 46 nt, Mus musculus
gugcuucagcuguugcccuugaguuacagguacaggagggaggaaa

SEQ ID NO: 89686 - RNA, 46 nt, Mus musculus
caguauugugaaauuuuuaugauuagacauuguuuuugaguaagag

SEQ ID NO: 89687 - RNA, 53 nt, Mus musculus
ugaacugagagagaagguuguaaaagccuggggacaggaaacagacaaaacaa

SEQ ID NO: 89688 - RNA, 47 nt, Mus musculus
gccacagccauuucuccuauggucuagauuuugccuuucccuuuugg

SEQ ID NO: 89689 - RNA, 41 nt, Mus musculus
uaucacauguuuuaugucuuaauauauagguaauuguguuu

SEQ ID NO: 89690 - RNA, 46 nt, Mus musculus
gauuuguugaggaaaacuauauggaugagcuaauuuguuagggggg

SEQ ID NO: 89691 - RNA, 58 nt, Mus musculus
agaaauuucugugaugagagguuauaguuagacuaauugugggaaaaggauaaauauu

SEQ ID NO: 89692 - RNA, 45 nt, Mus musculus
uucacuagccuuggguaguugguuagguuccauuacuugccccaa

SEQ ID NO: 89693 - RNA, 46 nt, Mus musculus
uauuauuauaccauauucaaauucauauagagaacaaggggucacu

SEQ ID NO: 89694 - RNA, 46 nt, Mus musculus
uggucacgcucgcucuaagaugaugaugacaacaacgcugaugaug

SEQ ID NO: 89695 - RNA, 46 nt, Mus musculus
gaggucagaggaacacuagcagggauauuauuuauaaagcaaggau

SEQ ID NO: 89696 - RNA, 45 nt, Mus musculus
gaaaggggaagcucagccucugucaugaaaagaguccacggaugu

SEQ ID NO: 89697 - RNA, 46 nt, Mus musculus
uugaaaauaaauuauaauauaaauaaaauaagauuugagccaacaa

SEQ ID NO: 89698 - RNA, 37 nt, Mus musculus
guauaacuguaucaacaggcagagagagagagagaga

SEQ ID NO: 89699 - RNA, 46 nt, Mus musculus
uggaagucaaauauaaagaaauuuaagauagaaauuuaagcuccag

SEQ ID NO: 89700 - RNA, 46 nt, Mus musculus
auuuguauuauauuagucauaacauagagaugauuucagguagcaa

SEQ ID NO: 89701 - RNA, 42 nt, Mus musculus
ucucuguccucagcagugucuuccaacaucaucgugcaccau

SEQ ID NO: 89702 - RNA, 46 nt, Mus musculus
gagaaaaagagagagaguuugauucuguucuuucuccugcccccuu

SEQ ID NO: 89703 - RNA, 45 nt, Mus musculus
acaggcucacuguuagugaaugugugcggauaguugaggucugag

SEQ ID NO: 89704 - RNA, 46 nt, Mus musculus
ccauuauuaaguagaaacauuguucuugaguuaccaaccaccggag

SEQ ID NO: 89705 - RNA, 46 nt, Mus musculus
caagugcauuauguugauaguagccaugugcuuggggaggcagugg

SEQ ID NO: 89706 - RNA, 46 nt, Mus musculus
gggugucuacucugcucacucuguaacucuccucaguuaccaucag

SEQ ID NO: 89707 - RNA, 45 nt, Mus musculus
agugccuaggaacaguagaucauugugucugugucuccugcccag

SEQ ID NO: 89708 - RNA, 46 nt, Mus musculus
uguauaugcucuuacuauucugccuacagauauauacacuuuacag

SEQ ID NO: 89709 - RNA, 45 nt, Mus musculus
uccgaggauauauaaaugguagggcccuuagagguuggugggcug

SEQ ID NO: 89710 - RNA, 46 nt, Mus musculus
cuugagcuucaaguguauccucucuuaucaucccaugcaucagcag

SEQ ID NO: 89711 - RNA, 46 nt, Mus musculus
auucuuagcuauagaacacuuguccuguuuaagucugauuucacag

SEQ ID NO: 89712 - RNA, 45 nt, Mus musculus
uguguaggcucuuaccgcuccuguccuuugcccuuuuuuguugua

SEQ ID NO: 89713 - RNA, 45 nt, Mus musculus
acaacaacauaagaaaacucauccccuccccccucccuugccccc

SEQ ID NO: 89714 - RNA, 52 nt, Mus musculus
uguguaaaagaaaagaaacagacuguucauaacccagacugacauuuacagc

SEQ ID NO: 89715 - RNA, 135 nt, Mus musculus
uucaaacauugucuacaucuagccacagguauaugauuuauuucuugccauaaguuaugagaaaagaauuguguguuacuucaggucacccauauaagagaagaaacagcaucuccuccuccagcccagcaugua

SEQ ID NO: 89716 - RNA, 45 nt, Mus musculus
cgcuuguauuggaauguggugaggagcuucuuagauaaugcagau

SEQ ID NO: 89717 - RNA, 46 nt, Mus musculus
agcaccucugauguacucagcuggaggguuccaugcuaccccagag

SEQ ID NO: 89718 - RNA, 42 nt, Mus musculus
cucccauccaucuggaaggcuuuucauauaaaaagggacagg

SEQ ID NO: 89719 - RNA, 46 nt, Mus musculus
acugcuuauccuaacauccaugagauuaacacacaguucugcagaa

SEQ ID NO: 89720 - RNA, 45 nt, Mus musculus
cccugcaguuauaaacauuuuauuuuggucaaagugaguguauga

SEQ ID NO: 89721 - RNA, 45 nt, Mus musculus
uguauguauauuuaucagaauuucucauaaaagaccauagaugga

SEQ ID NO: 89722 - RNA, 47 nt, Mus musculus
gaaagaaagaccauggugaaauuucauuuuaaacugaaagcuggaga

SEQ ID NO: 89723 - RNA, 46 nt, Mus musculus
uaaaguuaucacugagacagucaguuguauuuauagcuaacgugag

SEQ ID NO: 89724 - RNA, 46 nt, Mus musculus
guagacuuugauuacucgcacuuggaguuucagguuauucugcuaa

SEQ ID NO: 89725 - RNA, 46 nt, Mus musculus
uauaucuuuccauaguaacuagauguguguccugauugugucgaag

SEQ ID NO: 89726 - RNA, 48 nt, Mus musculus
uucuuaggaagcccuguuuguuguugcuugcuugucuguuugcauguu

SEQ ID NO: 89727 - RNA, 49 nt, Mus musculus
caauggcauuuauuuucaucucucuuggccauuacuuguucagugaugu

SEQ ID NO: 89728 - RNA, 75 nt, Mus musculus
ccuuucccaguguuggcaagaaucuguagcugugauaaauggucaguccuaugauuuucagacauuauauaaaag

SEQ ID NO: 89729 - RNA, 45 nt, Mus musculus
aaaacaauauacagaagcuguaauuugcagcauccucuaggagga

SEQ ID NO: 89730 - RNA, 45 nt, Mus musculus
cagagauggagcuagcacuuaagaaaggaaugaauuccacucaag

SEQ ID NO: 89731 - RNA, 46 nt, Mus musculus
guagaucucuguaguagacucucugagcugcaagaaaaagcugcug

SEQ ID NO: 89732 - RNA, 41 nt, Mus musculus
aaaauauaggauaguuauauguauuuauauuauaagccccu

SEQ ID NO: 89733 - RNA, 46 nt, Mus musculus
ucagcaccucuuagagauauguaugauaauauauugucagucagaa

SEQ ID NO: 89734 - RNA, 72 nt, Mus musculus
augagauuaucaaaccagggucagacacuugacagcaaagcgagagugggggagugugaaauuauaucuuaa

SEQ ID NO: 89735 - RNA, 42 nt, Mus musculus
aaauuagcuguuguuuaaucuuguggaagaagaacugccagu

SEQ ID NO: 89736 - RNA, 46 nt, Mus musculus
aaugcuuucauuauuuuugcauguaugauuacacacaagcgaccau

SEQ ID NO: 89737 - RNA, 46 nt, Mus musculus
guucuguagcuggauucccuuaaauaauauaaaagaaagggcaggg

SEQ ID NO: 89738 - RNA, 46 nt, Mus musculus
auaauuuugugauucauucaguuuaauuguguuaaguauuucugag

SEQ ID NO: 89739 - RNA, 46 nt, Mus musculus
auaucuuucuauuaacugguucauucucaggauuugaaccacucag

SEQ ID NO: 89740 - RNA, 46 nt, Mus musculus
aaauuguaugaaauauauaaaauaaaaaauaaaaaaacacugcaaa

SEQ ID NO: 89741 - RNA, 45 nt, Mus musculus
aacagaggauauuucaggauauuccugagaaucauaguuuagaga

SEQ ID NO: 89742 - RNA, 46 nt, Mus musculus
uaugcaacaaaauuaauuauggauggauaaaauauuaagcgcaaau

SEQ ID NO: 89743 - RNA, 42 nt, Mus musculus
ucuaagucccuggccuaucuagucucacauucuuggccacaa

SEQ ID NO: 89744 - RNA, 41 nt, Mus musculus
ugcaaacuuuauaugccuauguacagggguacgccagggua

SEQ ID NO: 89745 - RNA, 45 nt, Mus musculus
uucuaaauauugacucucuccuuccaaguugauaucagcuaugag

SEQ ID NO: 89746 - RNA, 85 nt, Mus musculus
ccuccccugcauccugaagaguauugagcaugucuugcuuccccagaucugaaguauccauuuucuuaccaccuaguguucgccu

SEQ ID NO: 89747 - RNA, 46 nt, Mus musculus
uauggcuuaucugugccuuuuauuuaaaaaauaaauaaaaccccag

SEQ ID NO: 89748 - RNA, 62 nt, Mus musculus
ugaaaucauuucaauagcuggggauauuuccuuuacugucaccaaacuuuuaaaaaaaaugu

SEQ ID NO: 89749 - RNA, 45 nt, Mus musculus
auucaagaaaguucugugauuucugaaucauucauuaggcacaaa

SEQ ID NO: 89750 - RNA, 46 nt, Mus musculus
ucugguuaccuuuucuggauaaggaguguuaucugcaugacccuga

SEQ ID NO: 89751 - RNA, 49 nt, Mus musculus
aaguguguauguguguguuucuuuagcaaagacaaacuauagguuucaa

SEQ ID NO: 89752 - RNA, 46 nt, Mus musculus
ucaaaucccugcaaccacauggugacucacuacuguccgaaacgag

SEQ ID NO: 89753 - RNA, 45 nt, Mus musculus
gcaguauuauaaugaaauuaaaaaagaucuaauuguaggcaggag

SEQ ID NO: 89754 - RNA, 46 nt, Mus musculus
gacuuagaaauauggugucuucuauaaagaagcaaguugcuauuga

SEQ ID NO: 89755 - RNA, 47 nt, Mus musculus
uguccuuuuuaucucuuuuguuaccucuucuuagaacugcauguaca

SEQ ID NO: 89756 - RNA, 48 nt, Mus musculus
agauuccuagauccauagaaguuuuaucuguuucucuugagugugugc

SEQ ID NO: 89757 - RNA, 42 nt, Mus musculus
aaaaaaaaaaaaaaaaaaaaaguauuucaguacugucaacag

SEQ ID NO: 89758 - RNA, 40 nt, Mus musculus
ugugcauauguguguaagugcauauauuccacaguauacc

SEQ ID NO: 89759 - RNA, 46 nt, Mus musculus
gauggggucugaugguuuaaugcagaccuuaaucaagggcugagag

SEQ ID NO: 89760 - RNA, 46 nt, Mus musculus
ugugugugugugcgugcgccuaaauacguaaauccaaccugcccag

SEQ ID NO: 89761 - RNA, 45 nt, Mus musculus
aacaguguuuucucuagcuuuaaaauccuuuagauuuagcccauu

SEQ ID NO: 89762 - RNA, 42 nt, Mus musculus
gugugugugugugugucugugugugucugugugugucuuugu

SEQ ID NO: 89763 - RNA, 42 nt, Mus musculus
cagcagcagcagcagcaggagcaggagcagcaggagcaggag

SEQ ID NO: 89764 - RNA, 42 nt, Mus musculus
gagcagcagcagcagcagcagcaggagcagcagcagcaggag

SEQ ID NO: 89765 - RNA, 41 nt, Mus musculus
agcugacugugaacauccacuuuuguguuugacaggcccug

SEQ ID NO: 89766 - RNA, 46 nt, Mus musculus
cugcucauucccugacuguucucaucgcucauuuucaucugcucag

SEQ ID NO: 89767 - RNA, 46 nt, Mus musculus
caggaucaauauggaaguuacauuugcauuuuuuagaagccucuag

SEQ ID NO: 89768 - RNA, 45 nt, Mus musculus
aaaacaaacauagaaauaacaaccaaauaaaaccaaaacaagaaa

SEQ ID NO: 89769 - RNA, 46 nt, Mus musculus
cuagcgauuacacuagaagaaaaguaauaaccaucacagguaguga

SEQ ID NO: 89770 - RNA, 45 nt, Mus musculus
uggaguugaacucaugguuggcuuugcaguuuauuuucugaauag

SEQ ID NO: 89771 - RNA, 47 nt, Mus musculus
uccucaucauuugugccugcuccuuacuuuaaaaauuguacccaggu

SEQ ID NO: 89772 - RNA, 46 nt, Mus musculus
ucauuuaguucccagugggaaacugauuuaccuuccugucccugag

SEQ ID NO: 89773 - RNA, 42 nt, Mus musculus
aagcacuaacuuuuaagguuguguuucuaaaggaacagggua

SEQ ID NO: 89774 - RNA, 46 nt, Mus musculus
gcuuguuguauuugaaaguuugucaaugaugacaaaaagguugggg

SEQ ID NO: 89775 - RNA, 46 nt, Mus musculus
guaucagucucaguccuucuuucuguguucaguguagauugccuag

SEQ ID NO: 89776 - RNA, 46 nt, Mus musculus
uggaacacauagauuggacaugaauuuuuauuacagaacagcagag

SEQ ID NO: 89777 - RNA, 46 nt, Mus musculus
uuaauucaguuuucauuugaauuaaaguuaauuuguuauaggccag

SEQ ID NO: 89778 - RNA, 51 nt, Mus musculus
cucuuuuuuacugggguucuuuggggauuagaauaaagguagaagaggaau

SEQ ID NO: 89779 - RNA, 50 nt, Mus musculus
agcauauuuaauauuguacuauaaagaaaugguaguauugaagaaguaga

SEQ ID NO: 89780 - RNA, 46 nt, Mus musculus
acacacacacacacacacacacacauacauauacauauaaucucag

SEQ ID NO: 89781 - RNA, 48 nt, Mus musculus
agucagccuguguggauauaucuucagcuauguuccuagcaccuggca

SEQ ID NO: 89782 - RNA, 46 nt, Mus musculus
gaggaguuauccaguuuuauuccuguugugucuuuuuuugcugcug

SEQ ID NO: 89783 - RNA, 45 nt, Mus musculus
auaugaaccacucugggaaggugaaugguccugggcaugagggag

SEQ ID NO: 89784 - RNA, 42 nt, Mus musculus
gcguuaguagaaauguuggacuauuggacuugggaugggcag

SEQ ID NO: 89785 - RNA, 47 nt, Mus musculus
uuuuuaauggccacaguuaauggcauauuaaguuaaaagagacugaa

SEQ ID NO: 89786 - RNA, 42 nt, Mus musculus
uacugauguuaucuggguuuugcuccuguucaacugcuucau

SEQ ID NO: 89787 - RNA, 46 nt, Mus musculus
uguguguguaucacucuagagagaaguguuuuauucuugcugauau

SEQ ID NO: 89788 - RNA, 46 nt, Mus musculus
uguggauaucucacugauuugaggaaucuuugcggauauguguugg

SEQ ID NO: 89789 - RNA, 53 nt, Mus musculus
ccucauaagaauuaaaauugacuuuuauuuucaauggcgaugucuguuaucca

SEQ ID NO: 89790 - RNA, 46 nt, Mus musculus
uauuuauaauagucuguauguuaucuauauugaagaaagucuccac

SEQ ID NO: 89791 - RNA, 66 nt, Mus musculus
cuauuaacaagggaagaaauauccuuacuuccuaguuaagaauauuuuaaagugauuucucuucac

SEQ ID NO: 89792 - RNA, 46 nt, Mus musculus
ucacugucaacucaguguguuacagacuugcugguucuguuggcua

SEQ ID NO: 89793 - RNA, 45 nt, Mus musculus
aggcuagucuguuuuugcauuccucaguucugauuucuuuuggca

SEQ ID NO: 89794 - RNA, 41 nt, Mus musculus
uauggcuucuuuguccuuguucaaauccagcaauggugcua

SEQ ID NO: 89795 - RNA, 65 nt, Mus musculus
ucugaauuguucuucucuugaagaucacaaucccagucuuuuauuuacauauccauucagucauu

SEQ ID NO: 89796 - RNA, 45 nt, Mus musculus
uaugaccccaacccuuugauucuuagaaagagacaccaagcacag

SEQ ID NO: 89797 - RNA, 45 nt, Mus musculus
cauugcuaaauuuauucauuuucuauaauguuauugucaccuaag

SEQ ID NO: 89798 - RNA, 41 nt, Mus musculus
aucauuuuuauggagaagaaaagauucuuuuuguguacaga

SEQ ID NO: 89799 - RNA, 88 nt, Mus musculus
auagcauaaccacuucaaaucuggugcuuauaauauccaggagaaaugacagaggaaaccuuauugaaacagccagcuagaguuucug

SEQ ID NO: 89800 - RNA, 46 nt, Mus musculus
cccucgaggaggcuuccauguaaaaacaagcaaacacaagucucaa

SEQ ID NO: 89801 - RNA, 42 nt, Mus musculus
caaaguucucccuuuuucucuucagcuuuauuuagcauacag

SEQ ID NO: 89802 - RNA, 45 nt, Mus musculus
aaauuuuauuauugggauuccuuagaauuuuccauagaccagcac

SEQ ID NO: 89803 - RNA, 45 nt, Mus musculus
uaaaacaaaauugaaaauccuucauuaauccucauagacccccuc

SEQ ID NO: 89804 - RNA, 44 nt, Mus musculus
gcuuaugaagacuauuucacguuuuaauguugcuuuugauguua

SEQ ID NO: 89805 - RNA, 46 nt, Mus musculus
ugccagcgcaggcuacuauacccggccaaacucucaaucaccauag

SEQ ID NO: 89806 - RNA, 42 nt, Mus musculus
accuggacagauuuuuaucuuaauguuucuaaaacaggcgac

SEQ ID NO: 89807 - RNA, 80 nt, Mus musculus
cauaaugacaagaauugauacuguaucaaaauauacagauaguagugauggaaaggucaaggucuucacauuuaauagga

SEQ ID NO: 89808 - RNA, 45 nt, Mus musculus
cuggaggaaguugccaggaucagauguuauuauugucacauggag

SEQ ID NO: 89809 - RNA, 46 nt, Mus musculus
aagccagcccuggacuugugucaccuuuguaggacagugccaucag

SEQ ID NO: 89810 - RNA, 46 nt, Mus musculus
aucagguggguugagcacauaauuagcaguuaaauuuguggccaag

SEQ ID NO: 89811 - RNA, 46 nt, Mus musculus
gacauuuuugccaucauuagcccuacaucucuguaugcuugcccua

SEQ ID NO: 89812 - RNA, 45 nt, Mus musculus
uucuccuccuuuccucuguggccuuugcugccauauccuauacag

SEQ ID NO: 89813 - RNA, 46 nt, Mus musculus
ugugucacucaugugcacgccauuuugaaagggaauggguuuguuu

SEQ ID NO: 89814 - RNA, 46 nt, Mus musculus
guauuucuguaauggaccuaacuaugcuuuuguuuggaggaaugug

SEQ ID NO: 89815 - RNA, 45 nt, Mus musculus
uggacgauuguugcugaugagcuggagcuaagaaacuagcugugg

SEQ ID NO: 89816 - RNA, 44 nt, Mus musculus
uaugaaucacccagguggaaccuguuuugaaggcauagagggga

SEQ ID NO: 89817 - RNA, 42 nt, Mus musculus
cauugaugaaggugcagccuccauuguauuugaugagccaag

SEQ ID NO: 89818 - RNA, 46 nt, Mus musculus
ucauuauuucuccauuuaguuucugacucgaucuuuugucccugag

SEQ ID NO: 89819 - RNA, 46 nt, Mus musculus
ugugguaauaauaguguguguaccugugugugugugugugugugug

SEQ ID NO: 89820 - RNA, 46 nt, Mus musculus
cugacacacugacucuuaugaaauugguuuucauuaaagucugcag

SEQ ID NO: 89821 - RNA, 50 nt, Mus musculus
ucccuuugccugcauuuucuguaacgugaaauagguguguauauuugugu

SEQ ID NO: 89822 - RNA, 41 nt, Mus musculus
uggagcacuuaaaugauaaagggucagaaaaaugaggggaa

SEQ ID NO: 89823 - RNA, 41 nt, Mus musculus
cagugaacuuugucagucagugcuacuccuuuagugaggga

SEQ ID NO: 89824 - RNA, 42 nt, Mus musculus
uggucaguuucgucucaucugccuuuucuuuauucaugccag

SEQ ID NO: 89825 - RNA, 49 nt, Mus musculus
gcugcugcguggggucuaguuuuaucuguacagguuuaucugagaucag

SEQ ID NO: 89826 - RNA, 46 nt, Mus musculus
gccuagcuaaggcaggcaauguucccccccuccccccuguggccag

SEQ ID NO: 89827 - RNA, 42 nt, Mus musculus
ugucuuguuuacugauguccguuuucuuuaagaugcccauuu

SEQ ID NO: 89828 - RNA, 46 nt, Mus musculus
cuaccuucuccuugggagugaggaaauaucuagauugagacuccag

SEQ ID NO: 89829 - RNA, 46 nt, Mus musculus
cuuauuagggguucuaagacagauggguccaugcuauguguaaaac

SEQ ID NO: 89830 - RNA, 44 nt, Mus musculus
acaggagaagacugggaaaugaauuuagaaaauuuuaaggccag

SEQ ID NO: 89831 - RNA, 46 nt, Mus musculus
uuaaauuuauuuuaugagcuaacaggaaaggauuaguggaaacaaa

SEQ ID NO: 89832 - RNA, 45 nt, Mus musculus
ucagcucuaggaacuaucccugggaggaaaagagagaaacugcca

SEQ ID NO: 89833 - RNA, 46 nt, Mus musculus
gauauaaccaagggagauauaaucaagggagauauaaacaagggag

SEQ ID NO: 89834 - RNA, 45 nt, Mus musculus
cauugucuggcccuugguccugugaaggcucaauucucuagugua

SEQ ID NO: 89835 - RNA, 46 nt, Mus musculus
auaucacagacugaauuaucuguaaugaagacucaaugguguuuag

SEQ ID NO: 89836 - RNA, 46 nt, Mus musculus
uuguguggguuguuuuuauauaaaauuacuuuuaauagaguuguag

SEQ ID NO: 89837 - RNA, 46 nt, Mus musculus
uuucauuuaaaacaaccaaacaaacaaacaaccaaacaaccaacaa

SEQ ID NO: 89838 - RNA, 46 nt, Mus musculus
uaauugaagguggaggaacaaaauuugucugcaaaccuggagccag

SEQ ID NO: 89839 - RNA, 42 nt, Mus musculus
ugauuugauuuucuuuacuuccuucuguaguccugcccaucc

SEQ ID NO: 89840 - RNA, 46 nt, Mus musculus
gaaagaaaaauucaugauucuuucacaaaaaucauucuaggcccua

SEQ ID NO: 89841 - RNA, 41 nt, Mus musculus
gcaguuacaaucacuuuuugcguagugucauuuauuguuaa

SEQ ID NO: 89842 - RNA, 42 nt, Mus musculus
cacugugagugguuccaccccacugacagcuuacacugacag

SEQ ID NO: 89843 - RNA, 42 nt, Mus musculus
uagaauagaaauggcuuccuuuugcuugauuaaugagggcau

SEQ ID NO: 89844 - RNA, 45 nt, Mus musculus
uagaaguauuauuuccacgaugucaguuugauguuugcagugaua

SEQ ID NO: 89845 - RNA, 46 nt, Mus musculus
ccuaaagcuuauguggauauguuggaaauguaaaagaaauacccaa

SEQ ID NO: 89846 - RNA, 46 nt, Mus musculus
ugauuaaauguuagaaaugugccuauaugcaaugacacuuguaaag

SEQ ID NO: 89847 - RNA, 46 nt, Mus musculus
aagcagagcgagcuagaugcuaaagugguggaugcauagccuuugg

SEQ ID NO: 89848 - RNA, 45 nt, Mus musculus
cacauugaaguaagagggacacucaggucauauugaaaucugcgg

SEQ ID NO: 89849 - RNA, 42 nt, Mus musculus
guaaauaaucuaguuuggggcaaacaagaaauucagugcagu

SEQ ID NO: 89850 - RNA, 45 nt, Mus musculus
cagaacaaaaauguuaauuacauacagguaauuagaacagcugga

SEQ ID NO: 89851 - RNA, 48 nt, Mus musculus
auuguuguugucauugcuguuguuguucaauauauaagcccucaguaa

SEQ ID NO: 89852 - RNA, 46 nt, Mus musculus
caaggcugucaaaaauuucauuucucuauauguuccccuccugaag

SEQ ID NO: 89853 - RNA, 27 nt, Mus musculus
cugcagggcguuuuuaguuugcgcugc

SEQ ID NO: 89854 - RNA, 46 nt, Mus musculus
ucagaacaccccucuauaauuuauguauauuaacauauccuaagag

SEQ ID NO: 89855 - RNA, 41 nt, Mus musculus
gauacuguauuuguacauucucugaaagccuaguagcauca

SEQ ID NO: 89856 - RNA, 45 nt, Mus musculus
agcaacgaugacaacaaaaggcuggggaaauagaaauaacauggg

SEQ ID NO: 89857 - RNA, 42 nt, Mus musculus
uuuggugggugugagugugugugugugugugugugugagaga

SEQ ID NO: 89858 - RNA, 46 nt, Mus musculus
acagaaaauaauacuuucuucucuuuuaugggaauaaauuaggaaa

SEQ ID NO: 89859 - RNA, 46 nt, Mus musculus
ucuuaacacagaacacuguuuuagacaagggcguuaaaauggccag

SEQ ID NO: 89860 - RNA, 45 nt, Mus musculus
ucuguggaggaauggcuauuugaguucauuuuagccuuaccuugg

SEQ ID NO: 89861 - RNA, 46 nt, Mus musculus
ccuguuagugacuuuaaaaauaaagaacauucaccuugacucacag

SEQ ID NO: 89862 - RNA, 45 nt, Mus musculus
ccugucaaagacauuugacauucggaauguagcacccucccaaca

SEQ ID NO: 89863 - RNA, 46 nt, Mus musculus
uggagaagggcauaauaacaacuaggcaaugcccaagaacaaggag

SEQ ID NO: 89864 - RNA, 44 nt, Mus musculus
auagccgaauagugacagagguagauaggcaaugacagggggug

SEQ ID NO: 89865 - RNA, 45 nt, Mus musculus
ugagucuguuaagaucuuuauauacacacacacauacacccuuga

SEQ ID NO: 89866 - RNA, 46 nt, Mus musculus
acguuuacuuugcuuugcauguuacuaaaccuacauuuagcacuug

SEQ ID NO: 89867 - RNA, 46 nt, Mus musculus
ucaauccuuggcuaccuucucauuuucuccccauauuugugcccuu

SEQ ID NO: 89868 - RNA, 30 nt, Mus musculus
gcuuuauucucuacuuccuuuucagccaga

SEQ ID NO: 89869 - RNA, 45 nt, Mus musculus
uggauuuucucugauauugccuugcuaguuauccuggccguccca

SEQ ID NO: 89870 - RNA, 45 nt, Mus musculus
caguacaaggaagauucuuugcugaaggugcugcauagaugccag

SEQ ID NO: 89871 - RNA, 42 nt, Mus musculus
gcaggucccacguuacccaucuccccucuccccagccccauu

SEQ ID NO: 89872 - RNA, 45 nt, Mus musculus
acucugccagcuagacccaguuaggagagccugacaaagcccaag

SEQ ID NO: 89873 - RNA, 45 nt, Mus musculus
agagugaacuuggcaagaagagaucauaacaggucugagggcagg

SEQ ID NO: 89874 - RNA, 46 nt, Mus musculus
acugugcugaaaagucugugagaagcuguguuuagcaaacaagaag

SEQ ID NO: 89875 - RNA, 42 nt, Mus musculus
gugugugauaggugacaucaaagagaugucaggagcuggcua

SEQ ID NO: 89876 - RNA, 46 nt, Mus musculus
aagaggagaaagacacugugguaaugcuaugugacuguggccucag

SEQ ID NO: 89877 - RNA, 31 nt, Mus musculus
agccuagacgcaaucuaaggggguaaugaag

SEQ ID NO: 89878 - RNA, 45 nt, Mus musculus
ugaggcuucuguagucauugaacuuguugaguaguuagacaagcu

SEQ ID NO: 89879 - RNA, 46 nt, Mus musculus
caguguaguagaaguuaggaagaugaggggcuacaagguggggaag

SEQ ID NO: 89880 - RNA, 59 nt, Mus musculus
cugugggaggaagugauggaggugguggugguagcugcugugggaguaagugauggagg

SEQ ID NO: 89881 - RNA, 69 nt, Mus musculus
agguggugguagcggcugugggaggaagugauggaggaggugaugguagcggcugugggaggaagugau

SEQ ID NO: 89882 - RNA, 46 nt, Mus musculus
uaaugacucugaucaagaucugaacugaaauaaauuuugccucaaa

SEQ ID NO: 89883 - RNA, 45 nt, Mus musculus
uucagacacuccacagguaguuauuuaaauacaguuaagccccug

SEQ ID NO: 89884 - RNA, 46 nt, Mus musculus
uuuguuuuaauuuaaaaauaaauguucucucuguagcuguggugag

SEQ ID NO: 89885 - RNA, 45 nt, Mus musculus
uguguuacuaauuuaugcacaauaagaauuuaucauuggcccuau

SEQ ID NO: 89886 - RNA, 46 nt, Mus musculus
ugauguauaagcauagcaaugcacauacgcaacauacaugcacaga

SEQ ID NO: 89887 - RNA, 44 nt, Mus musculus
accuuuuuacaaccacauaagguuucagguucucagcugggucc

SEQ ID NO: 89888 - RNA, 46 nt, Mus musculus
ucucuccuugcuuauuauugcuccugcuguucuuuguugggccugg

SEQ ID NO: 89889 - RNA, 45 nt, Mus musculus
cccccaucaccuccccucuccuccggcucaucaacccacccacac

SEQ ID NO: 89890 - RNA, 46 nt, Mus musculus
cuauccccucugccccuagacuacuggcagaaucuacuccagugag

SEQ ID NO: 89891 - RNA, 46 nt, Mus musculus
uuauuuuggugguaguggugugugugugucugccugucugucugug

SEQ ID NO: 89892 - RNA, 46 nt, Mus musculus
uccucuauuccuaauauucuuagcuuugauuauaucauagucccag

SEQ ID NO: 89893 - RNA, 46 nt, Mus musculus
uauuuuaugaauuccuaauccuucuauuaccauuuucaggccuugg

SEQ ID NO: 89894 - RNA, 46 nt, Mus musculus
uuauguuuuaaauaugcacacaucuaacaucauaagcauaguagga

SEQ ID NO: 89895 - RNA, 46 nt, Mus musculus
uaaucacacagcaagguaggagcugugacauugaguuaugucccag

SEQ ID NO: 89896 - RNA, 46 nt, Mus musculus
aagcuauuuucucaaucauuccugaaaguaaauaacuucuagagau

SEQ ID NO: 89897 - RNA, 42 nt, Mus musculus
uuguuguauucaguucacaccacaguccuguaaugccagccu

SEQ ID NO: 89898 - RNA, 46 nt, Mus musculus
ggcagaaaagaagccacuuauuguaggucauuuacuguaggucaag

SEQ ID NO: 89899 - RNA, 46 nt, Mus musculus
accucugacccaaccauauuugcaaagggaacacuuacaggaccag

SEQ ID NO: 89900 - RNA, 46 nt, Mus musculus
ugaacuguuugccaacaaguuggugaaacuaagccauuaauaucuu

SEQ ID NO: 89901 - RNA, 46 nt, Mus musculus
uaugucaucuauguguaugugugugugugugugugugugugugugc

SEQ ID NO: 89902 - RNA, 45 nt, Mus musculus
cuucccgauuaguuaauuugcccaauuaauaugaaggugacuaag

SEQ ID NO: 89903 - RNA, 34 nt, Mus musculus
guauuaguucauggugcaagaagaggaagaggag

SEQ ID NO: 89904 - RNA, 45 nt, Mus musculus
guacuggcauuuuuacacaguggcauagcauauaagcacuuagga

SEQ ID NO: 89905 - RNA, 41 nt, Mus musculus
cauuauuuaucaacuguggugaaccauucuguaagccgaca

SEQ ID NO: 89906 - RNA, 46 nt, Mus musculus
agagagagagaaugugaguauguagaaagugugugugugugugugu

SEQ ID NO: 89907 - RNA, 44 nt, Mus musculus
acugaauccaggggcuggggggaccacaugccacaucgucugca

SEQ ID NO: 89908 - RNA, 46 nt, Mus musculus
uggguauaucuuccuauaguuagugccaugauaauagccucgcaua

SEQ ID NO: 89909 - RNA, 46 nt, Mus musculus
acuccuagguaguaguccuucauggcuggucucuuuuauggugcua

SEQ ID NO: 89910 - RNA, 45 nt, Mus musculus
cuaucucuacccuacucuguuaguuuuuguguguuugcuugguug

SEQ ID NO: 89911 - RNA, 45 nt, Mus musculus
cuauuccuagauguauugaccaaaaagaaucagaaugcgggauuc

SEQ ID NO: 89912 - RNA, 45 nt, Mus musculus
caaucucauguucugaaaggggacauaaaauugaaaauauccaaa

SEQ ID NO: 89913 - RNA, 176 nt, Mus musculus
gggcuguuuucaugugguuauaaauaauuccagggacagaaaagaaaaacuuaugugaaucagaaaugguccuacauuucuuauuacaaguguuccuagucuucucucaguuaguaggcaucucacagauuugcuuuuauucagaugcuucagaaaauuauaacuccucuaucuaa

SEQ ID NO: 89914 - RNA, 55 nt, Mus musculus
uucuauuuauguuacuaaucauaaauuauauaccugcuuuugaagucauauguca

SEQ ID NO: 89915 - RNA, 47 nt, Mus musculus
agcuguuuugagguucuuggcaaaauuauguuuuguagaugguaaaa

SEQ ID NO: 89916 - RNA, 66 nt, Mus musculus
aauagguuagagaagccaaguaacaucauuccaaacagcagugguaauauguccuccucuagaaga

SEQ ID NO: 89917 - RNA, 47 nt, Mus musculus
uccacaggaguaucaccuucauuuucuaaaaaguuuuuccccgugau

SEQ ID NO: 89918 - RNA, 46 nt, Mus musculus
gagaaccugugaguggcuggugaaaacggaccaguaaaugaagaga

SEQ ID NO: 89919 - RNA, 50 nt, Mus musculus
uauucuaaaaucaaaaugcccaguaagucagucaggauacuguuaugggg

SEQ ID NO: 89920 - RNA, 42 nt, Mus musculus
gcuggagggugucauggaaucagaucuuaggucccggggaag

SEQ ID NO: 89921 - RNA, 41 nt, Mus musculus
caaaccauuuaccaagcacuagacaauagugccuucggcag

SEQ ID NO: 89922 - RNA, 45 nt, Mus musculus
gucauacuuaucuucuacguuaucuuccuuuuucucaccaccagu

SEQ ID NO: 89923 - RNA, 48 nt, Mus musculus
uagaaauuacuucuuaauuugcuauuccucuccuauuuccacagucau

SEQ ID NO: 89924 - RNA, 46 nt, Mus musculus
ccuuacuagauccuacacaguguaguauugguuuucagcacagcuc

SEQ ID NO: 89925 - RNA, 46 nt, Mus musculus
aguuguuccacagcccuuugucuuaugaccgaauuuuuuucucaag

SEQ ID NO: 89926 - RNA, 60 nt, Mus musculus
ggcuguggcugacuuauucugacacugugucacagcuuugcuugaggucuggguaguauu

SEQ ID NO: 89927 - RNA, 60 nt, Mus musculus
agagaaggaaacuaacugguccaagggagauugaaggagaacugagauccaaaaguguaa

SEQ ID NO: 89928 - RNA, 29 nt, Mus musculus
uccuuccuggaaagucagcacagguacaa

SEQ ID NO: 89929 - RNA, 46 nt, Mus musculus
uccugacccaacugcacaucacaagcuccuauaacaacaaagcuau

SEQ ID NO: 89930 - RNA, 46 nt, Mus musculus
uccaugucaagauccagauuagaagccuguaucuucuagucucaag

SEQ ID NO: 89931 - RNA, 27 nt, Mus musculus
uucacugcaggugguuaaguaggcaua

SEQ ID NO: 89932 - RNA, 46 nt, Mus musculus
ccuuaucugcagagauuuuaccuaugucauauaauaaugccccugu

SEQ ID NO: 89933 - RNA, 46 nt, Mus musculus
uacaacuagaaagucaauaaguuuguuauauuuuuauuuuuggaag

SEQ ID NO: 89934 - RNA, 45 nt, Mus musculus
uaaauuauucugguauuuccccacacacauacccaucagccccuu

SEQ ID NO: 89935 - RNA, 45 nt, Mus musculus
agugcuacuccuaacuggaguaggagaggggagcaauagagagug

SEQ ID NO: 89936 - RNA, 46 nt, Mus musculus
uauucauuaagacacauccaacaugacuuucuuucuuuagcugucu

SEQ ID NO: 89937 - RNA, 42 nt, Mus musculus
aaugagaucugacgcccucucuggagugucugaagacagcaa

SEQ ID NO: 89938 - RNA, 45 nt, Mus musculus
accuuccccacgugccccuuccuuccucccucccuccauguuugu

SEQ ID NO: 89939 - RNA, 46 nt, Mus musculus
augugaccuaacacauaaugugguuuuguguuguaugguuugugug

SEQ ID NO: 89940 - RNA, 46 nt, Mus musculus
acacaagggagaugagaaaaagaagguaaauugagaaaagauaagg

SEQ ID NO: 89941 - RNA, 46 nt, Mus musculus
uucaaacaacaccagagauauacucaggaauugguauucugugaag

SEQ ID NO: 89942 - RNA, 45 nt, Mus musculus
ugcagaucugggaggcgcuggcauguguugcuggaagcacugcag

SEQ ID NO: 89943 - RNA, 44 nt, Mus musculus
uuuucuccuggcuuugaaguuccacuaaaauaguaaacacugua

SEQ ID NO: 89944 - RNA, 49 nt, Mus musculus
auuaugacagguuuuuguuaauacuugucaguagucuaggaagauauga

SEQ ID NO: 89945 - RNA, 44 nt, Mus musculus
uuguuagagucccuguccucacuuuuggauuuuuuuuuuccccc

SEQ ID NO: 89946 - RNA, 83 nt, Mus musculus
auaaucaggccaacccugaaauuaugauauaauugucugguuccauguuguaaguaagucuacccuggucaaacacugagcau

SEQ ID NO: 89947 - RNA, 47 nt, Mus musculus
auaagcaccugaaaguaaaaugaaguucuuagaaauauguacaaagu

SEQ ID NO: 89948 - RNA, 46 nt, Mus musculus
acauauauuagagauggaacacaaaucuaaguacagaaucaaugag

SEQ ID NO: 89949 - RNA, 46 nt, Mus musculus
guaguagaggcagaggaaggcagagugagggagagaguugagaagu

SEQ ID NO: 89950 - RNA, 42 nt, Mus musculus
aggggaagggaauagggagagagagggagcaagaggcaagag

SEQ ID NO: 89951 - RNA, 42 nt, Mus musculus
cuaaucagaaagauuugaucugauuugaacuugaaaugggaa

SEQ ID NO: 89952 - RNA, 45 nt, Mus musculus
uugccagcagaauucacaggucuuauacaagcuuuucgaaaguua

SEQ ID NO: 89953 - RNA, 45 nt, Mus musculus
agcuuagguuugaacuucuggaccuugaaaugcugaagagaguug

SEQ ID NO: 89954 - RNA, 45 nt, Mus musculus
gauuaggaacagcucuggagcuuagcccaguggcagugggaguua

SEQ ID NO: 89955 - RNA, 25 nt, Mus musculus
agaacuacagaagccagagaguaag

SEQ ID NO: 89956 - RNA, 46 nt, Mus musculus
aucucagaauacccaaaauacaauuugcaaaacacaugaaacucaa

SEQ ID NO: 89957 - RNA, 41 nt, Mus musculus
ugcccauggaaggagcuacagagacaaaguguggaguagag

SEQ ID NO: 89958 - RNA, 46 nt, Mus musculus
aagaaaacacauggugggccucuggcucuagcuguauauguagcag

SEQ ID NO: 89959 - RNA, 46 nt, Mus musculus
ucacgugagauuucacugaugaaguagugugccaaaaaggaaugag

SEQ ID NO: 89960 - RNA, 46 nt, Mus musculus
uccucccacaguuccucaucccauuccuccucccccugucuccaag

SEQ ID NO: 89961 - RNA, 46 nt, Mus musculus
cuuugugcugccaccauagacucuagcccucuaaacauaagcccag

SEQ ID NO: 89962 - RNA, 44 nt, Mus musculus
ucuccuucuuuuacauuagaauauuuuccauaaggaagcucuca

SEQ ID NO: 89963 - RNA, 46 nt, Mus musculus
cuaauugaacccuuggugagcucaucaaggauuaacaaagaagaca

SEQ ID NO: 89964 - RNA, 95 nt, Mus musculus
acuggguaggauauagcaagcauuccucaaugcuuuuaaguggcacagacagaacuagggaguugaaaaugaaaugggcugaaaugagucaguua

SEQ ID NO: 89965 - RNA, 46 nt, Mus musculus
aagagauaauuugacaguacuguaguaaguguuacagaggaaauag

SEQ ID NO: 89966 - RNA, 45 nt, Mus musculus
acagagaaaucaaaaucaaaauaaauuagaaagaaagaaagaaga

SEQ ID NO: 89967 - RNA, 55 nt, Mus musculus
gaaagaacgaaagaacgaaagaacgaaagaacgaaagaacgaaagaacgaaagaa

SEQ ID NO: 89968 - RNA, 46 nt, Mus musculus
uguacauuccaaauguuguccucccucccuguccucccucccagag

SEQ ID NO: 89969 - RNA, 45 nt, Mus musculus
aguuaccaucaguucuuuguuauguccauacuauuuuggcuucua

SEQ ID NO: 89970 - RNA, 46 nt, Mus musculus
ccauaggcagguaaaauguuuguuuuaguauuauacccaguccaag

SEQ ID NO: 89971 - RNA, 48 nt, Mus musculus
uguagagcaacaguuaaagaaauagaggccaugaauugauagagaauu

SEQ ID NO: 89972 - RNA, 74 nt, Mus musculus
gggaagaagguagaugaugucauuauauuuuaauuacagcaagaaaaaaaggaaaacuaucugccuauaugugc

SEQ ID NO: 89973 - RNA, 46 nt, Mus musculus
guuagacuucaagauuguaaauaaacucaaggugaucauacuauag

SEQ ID NO: 89974 - RNA, 45 nt, Mus musculus
guggcagauuguucuuuagcuccacggaaagacaucaugcguggu

SEQ ID NO: 89975 - RNA, 42 nt, Mus musculus
agcuugucaaauaaacagaaagcauucauucucaggcaugag

SEQ ID NO: 89976 - RNA, 45 nt, Mus musculus
guaguagacauaauuugguuuuagugaaagaagacauguauguag

SEQ ID NO: 89977 - RNA, 46 nt, Mus musculus
aaaauaaaugcucuugacauacuguuguaaaauaccaagaccugag

SEQ ID NO: 89978 - RNA, 44 nt, Mus musculus
uuuuucugaugacaguuuccccuccaucagacccccacccccaa

SEQ ID NO: 89979 - RNA, 41 nt, Mus musculus
cuuugaauucuccaugaguauucuaacauuuuugaccccua

SEQ ID NO: 89980 - RNA, 46 nt, Mus musculus
agggguacugguuaguucauauugcuuauguuuuaauuuacaguag

SEQ ID NO: 89981 - RNA, 42 nt, Mus musculus
auuaaagcccgagcuagagagugggcaggggcagggugggag

SEQ ID NO: 89982 - RNA, 46 nt, Mus musculus
acagaauuuuaaaauauuauuuagcuuuacugaggaaaacuugaaa

SEQ ID NO: 89983 - RNA, 45 nt, Mus musculus
cccagggaagagaggauacuaggggaaggggggaaaugaugugca

SEQ ID NO: 89984 - RNA, 46 nt, Mus musculus
gacauuauuuugcagguacuuuuuucuuagauugcugugcauucag

SEQ ID NO: 89985 - RNA, 42 nt, Mus musculus
gcuccaugugcucuggguugcuuucccuugcaucggugcugg

SEQ ID NO: 89986 - RNA, 46 nt, Mus musculus
cuccuuugucuucuaguuccuauucuuucccauucucagccugcaa

SEQ ID NO: 89987 - RNA, 46 nt, Mus musculus
uguucuuuaaucaccauuuaugacuugggaagagucauaacuuuag

SEQ ID NO: 89988 - RNA, 59 nt, Mus musculus
ugcugagaugcacuggcacuggugacuuuacuuuucacggucgauuacaugaagggaag

SEQ ID NO: 89989 - RNA, 42 nt, Mus musculus
ccggguaugguggcagugcacaccuuuaaucccggcacucag

SEQ ID NO: 89990 - RNA, 45 nt, Mus musculus
aacauuggguaagaaggauucugcauuguuguuggauguguguau

SEQ ID NO: 89991 - RNA, 76 nt, Mus musculus
uaagggcugaacugugcuaauuucuuuccauuucccaaccaaaguugcucuuuucuuucauccuuuccaauuuugc

SEQ ID NO: 89992 - RNA, 46 nt, Mus musculus
cucaggagaucaugaagcgguggccaucauucuucuuugucagauu

SEQ ID NO: 89993 - RNA, 46 nt, Mus musculus
ggacauaaagaaggacuuuaauaacucacuuagagaaauacaggaa

SEQ ID NO: 89994 - RNA, 47 nt, Mus musculus
cgccuauuuucuguaacaaaauaguuuauaguauuucacucauaguc

SEQ ID NO: 89995 - RNA, 42 nt, Mus musculus
uccugacccccacuuuguaacuucauuuaaauccagccccac

SEQ ID NO: 89996 - RNA, 45 nt, Mus musculus
gucgugaacauaagacagucaccugacucugcugcaguaguacca

SEQ ID NO: 89997 - RNA, 46 nt, Mus musculus
acacagauauuuuuaaguauuuauugcuugaauaaaucagcccaau

SEQ ID NO: 89998 - RNA, 46 nt, Mus musculus
gauuuucagauaguucaggcuucuucugucauuaaggcauugccag

SEQ ID NO: 89999 - RNA, 45 nt, Mus musculus
cccaguuaccauuucucuucaagaugucaagauucucuacccaag

SEQ ID NO: 90000 - RNA, 46 nt, Mus musculus
gcauucuacuucucauuuaaaaaaauaauucaagugauaacaggag

SEQ ID NO: 90001 - RNA, 45 nt, Mus musculus
uuugaaauguauauaaagaaaauaucuaauaaaaaaaaggaauag

SEQ ID NO: 90002 - RNA, 46 nt, Mus musculus
aaacugaggucaucagacugagccaucucagucucauucuccaagg

SEQ ID NO: 90003 - RNA, 41 nt, Mus musculus
gugauuagugacaucaaaauggauucauuugcugcaucuug

SEQ ID NO: 90004 - RNA, 46 nt, Mus musculus
uuagccaugcaguagcuacccaguccaaaccuauccagcgccuaaa

SEQ ID NO: 90005 - RNA, 46 nt, Mus musculus
ccaaaagcacugcaguagauauagaacaaaccucccucacccagag

SEQ ID NO: 90006 - RNA, 75 nt, Mus musculus
agaccucaugaaccuuaugcaugacuugagugcguauucagaucaguuccucaacauggugugugugaagcucca

SEQ ID NO: 90007 - RNA, 46 nt, Mus musculus
aacaaacaaacaaacaaaagguggggugugauccggaaaugccaag

SEQ ID NO: 90008 - RNA, 46 nt, Mus musculus
ggaaaauauagauagagaaauuauaaauauaagcauuaauuugaag

SEQ ID NO: 90009 - RNA, 41 nt, Mus musculus
aucuguaugugagaaccauaugguagagagagaugcugaca

SEQ ID NO: 90010 - RNA, 44 nt, Mus musculus
gguaaggaugggaucuuacgcacagguagaaugguugguuuuag

SEQ ID NO: 90011 - RNA, 46 nt, Mus musculus
ugaaaguuauaaaauuuguaguaucugcuucauagaaaggaugagu

SEQ ID NO: 90012 - RNA, 46 nt, Mus musculus
uucaaagacuacaaagaacacuuaggaauaaauguaaccaaggaga

SEQ ID NO: 90013 - RNA, 45 nt, Mus musculus
uagggaaggaaggacagcacagaaugcugggcuagagaagguuag

SEQ ID NO: 90014 - RNA, 45 nt, Mus musculus
ugugaaaugcacaggccaaugggccucagcuuguaaggugugggc

SEQ ID NO: 90015 - RNA, 42 nt, Mus musculus
aagaacacaguagagcuuuagaagauaguaauucugggucag

SEQ ID NO: 90016 - RNA, 45 nt, Mus musculus
uuccaugcuugucuaaccggaugacccagagucaaaaaggaaaaa

SEQ ID NO: 90017 - RNA, 42 nt, Mus musculus
ugugugugugugugugugugugugugugugugucucagggug

SEQ ID NO: 90018 - RNA, 27 nt, Mus musculus
uaaaaccuucauuuccaaaaguucgac

SEQ ID NO: 90019 - RNA, 71 nt, Mus musculus
gggggcugcuaccuccaagcugggcucagcacuaggaaaugguggggaaagaugcagggaacaagcacaag

SEQ ID NO: 90020 - RNA, 42 nt, Mus musculus
uucaguagauaacagaauuauuuaaguucuaaauggagacaa

SEQ ID NO: 90021 - RNA, 45 nt, Mus musculus
agacacuacacccuggaauauggaaacaccgggucucaagagcag

SEQ ID NO: 90022 - RNA, 46 nt, Mus musculus
ucuaacaagaggaaagcugauaaaaacguaucuaaaaagagaauag

SEQ ID NO: 90023 - RNA, 46 nt, Mus musculus
gcagcaggaggaacggccauguuuaucaugacugagcugugaguag

SEQ ID NO: 90024 - RNA, 46 nt, Mus musculus
gugcccucuagugcugggcacuuuccccucuccacagcugaugcag

SEQ ID NO: 90025 - RNA, 45 nt, Mus musculus
caguagaguuucucagacauauuucucuugggaauccauccacuc

SEQ ID NO: 90026 - RNA, 46 nt, Mus musculus
acaaguuucaaauauuugugcacuguuaucagacaucccgccucag

SEQ ID NO: 90027 - RNA, 46 nt, Mus musculus
cacaaguagagagagaugagaguagggucgugggcuacacugugag

SEQ ID NO: 90028 - RNA, 53 nt, Mus musculus
uuuugaacucuuaggaacugaacuucucuauaaacuggcgagaguccaagggc

SEQ ID NO: 90029 - RNA, 58 nt, Mus musculus
acuuaaauguaugaugucaugaugucaggggaaaaaagacagaucugagaguucccgu

SEQ ID NO: 90030 - RNA, 45 nt, Mus musculus
caagaguuguagauaauguagaaaugauaugaacuguauggaagg

SEQ ID NO: 90031 - RNA, 45 nt, Mus musculus
gagaggggaggcggagcuaagaguuucagagacagagacagggag

SEQ ID NO: 90032 - RNA, 41 nt, Mus musculus
uaagggaauuugugaccacuagcugcaggggguagauggcu

SEQ ID NO: 90033 - RNA, 90 nt, Mus musculus
accaccagggcagagaguagcugaguauagcaugggauggccauacuuuuuuuaaaaauauuuccagcaacagaaaggguucuaauauau

SEQ ID NO: 90034 - RNA, 73 nt, Mus musculus
aacucauugcccagauucugaauuaucauuguuuuuaaguacagaggacuguggcgcugaggagugagaucau

SEQ ID NO: 90035 - RNA, 46 nt, Mus musculus
aaaagcucucaugggaacaaauagaaaaguuugauuaaagccugag

SEQ ID NO: 90036 - RNA, 44 nt, Mus musculus
acagugugaaccagaggugcagugccagggaagcaaaagcucag

SEQ ID NO: 90037 - RNA, 45 nt, Mus musculus
gagagagagagcagugucacagcugcccacaacaccgaagaccca

SEQ ID NO: 90038 - RNA, 45 nt, Mus musculus
ccagaaguugcagcaucccuuguguccucaaggacaagcaauuug

SEQ ID NO: 90039 - RNA, 46 nt, Mus musculus
auaggacaucuugucuuauaacugaauaaacccugaguggguagag

SEQ ID NO: 90040 - RNA, 46 nt, Mus musculus
cugucugaagaaagagaggggggaggagaggcagaaagggaggaag

SEQ ID NO: 90041 - RNA, 44 nt, Mus musculus
uaaugagagacagaaaguagguaggucugguuaagaggggcggg

SEQ ID NO: 90042 - RNA, 45 nt, Mus musculus
agagcugucuauggcugcccaucccauucucuuucauaucuggaa

SEQ ID NO: 90043 - RNA, 77 nt, Mus musculus
uagaaccucaugauagaauuaagagauuugcuuuaaaguguggaggucaaaaaguacgauuucgggaagggaugaac

SEQ ID NO: 90044 - RNA, 45 nt, Mus musculus
uaguauacgcaaaaauuagccuuaaugaaaaagaaaaagucaaag

SEQ ID NO: 90045 - RNA, 45 nt, Mus musculus
uaaagccacgaauuuaugaauucauaaacaauacaagagguguca

SEQ ID NO: 90046 - RNA, 46 nt, Mus musculus
auaagaaggcuggaggaagaggaugaagagaugggaauuucagagg

SEQ ID NO: 90047 - RNA, 40 nt, Mus musculus
cgguggugcucuaugucacagaaaccuuauauggcauuag

SEQ ID NO: 90048 - RNA, 45 nt, Mus musculus
aguguggagguuacuaagagaggguagcuggcuggcaaagaacag

SEQ ID NO: 90049 - RNA, 46 nt, Mus musculus
agugucagguguauggcaaaccagcaagcauaggagauggccaaag

SEQ ID NO: 90050 - RNA, 51 nt, Mus musculus
aggccagcacccaccugaauuuuuuucuugaguagaacauuuauuauaggu

SEQ ID NO: 90051 - RNA, 55 nt, Mus musculus
aguccugaauggacaugacccugagccacauuaagagagggagcagguagagcua

SEQ ID NO: 90052 - RNA, 45 nt, Mus musculus
gguaugagaugggugagugaguaaauaugguguguauagguaugg

SEQ ID NO: 90053 - RNA, 46 nt, Mus musculus
agaggaaaugcaguguuuuauguccacucuccagcagagcgaguua

SEQ ID NO: 90054 - RNA, 46 nt, Mus musculus
uaaugaucaagcucuagaggguaaccaaugacaauagccuuggcaa

SEQ ID NO: 90055 - RNA, 46 nt, Mus musculus
caugaaccucugugacguaauucacauguugucuugggggcuggag

SEQ ID NO: 90056 - RNA, 85 nt, Mus musculus
ucugaguaagaucuuugaaauccuuaaccucuguccugucccuuuuauuguuugugcuucuuaccaguacuguucuuacaaugcc

SEQ ID NO: 90057 - RNA, 94 nt, Mus musculus
caaucgcacaauuguaauauucaauuccaugccucccucaguguuaauuuaaaaaugggaaaggaucauuucagccucaaguuuaaugcucuag

SEQ ID NO: 90058 - RNA, 46 nt, Mus musculus
acaucuuugaaggucagagcugaccucugugucuagaagccuggga

SEQ ID NO: 90059 - RNA, 46 nt, Mus musculus
augcuaugauuuuuuuaaaaaacuaagcuuaaaaaggaaaauugag

SEQ ID NO: 90060 - RNA, 55 nt, Mus musculus
cauaccagaaagaccaaagggacgcacaggaugaagacccagagagaggagugug

SEQ ID NO: 90061 - RNA, 46 nt, Mus musculus
aagguguggucaugauucugcucagagcuagcaggaauaaaaacag

SEQ ID NO: 90062 - RNA, 45 nt, Mus musculus
uccauaggccaagggcaguaagauggugaugcauaaagccagcag

SEQ ID NO: 90063 - RNA, 46 nt, Mus musculus
cucgccuacccagauucuuccucgagguaccaggagcccagcccag

SEQ ID NO: 90064 - RNA, 42 nt, Mus musculus
agggguggguggguggaggagcacccucauagaggcagggga

SEQ ID NO: 90065 - RNA, 46 nt, Mus musculus
uaucuauuccauagagaagcugauuaaauauuuuggaaguauuggg

SEQ ID NO: 90066 - RNA, 45 nt, Mus musculus
gacuaccuaguuucuaaaucuauuuagagaguuccuuagugccug

SEQ ID NO: 90067 - RNA, 46 nt, Mus musculus
aaucuacacauuuauuccugcugucuauaucuguauaagaaaccac

SEQ ID NO: 90068 - RNA, 45 nt, Mus musculus
caguuucaguuauaauucuucucuacaacugggaccgugacuguu

SEQ ID NO: 90069 - RNA, 42 nt, Mus musculus
ggauggauccccaggugacccagugugggggaaugccagggc

SEQ ID NO: 90070 - RNA, 73 nt, Mus musculus
aaaggggaguguauauucacugaugcuagauagaugugggaaaggggaguguauauucacugaugcuagauag

SEQ ID NO: 90071 - RNA, 93 nt, Mus musculus
augugggaaaggggaguguauauucacugaugcuggauagaugugggaaaggggaguguauauucacugaugcuagauagaugugggaaaggg

SEQ ID NO: 90072 - RNA, 83 nt, Mus musculus
aaaggggaguguauauucacugaugcuagauagaugugggaaaggggaguguauauucacugaugcuggauagaugugggaaa

SEQ ID NO: 90073 - RNA, 46 nt, Mus musculus
aucuugguacguagguugguacugccaauauucaggauggugccuu

SEQ ID NO: 90074 - RNA, 40 nt, Mus musculus
ggcuauauaaaauaacccugucucaaagaagaagaggagg

SEQ ID NO: 90075 - RNA, 42 nt, Mus musculus
cuauauacuauuucuaaggcagaaauaagacaaacccugcag

SEQ ID NO: 90076 - RNA, 47 nt, Mus musculus
aaggggaacacuugguuucucaagagcaucuuagacagagcacauaa

SEQ ID NO: 90077 - RNA, 45 nt, Mus musculus
gguccgcauuaaugucagguacccugugguagacugcacagccag

SEQ ID NO: 90078 - RNA, 46 nt, Mus musculus
aagcaagaucugauaaauauaaguaauauaagaaaaagaacgcagg

SEQ ID NO: 90079 - RNA, 42 nt, Mus musculus
aaugguggcacgcuuacauauaggugcugggacccaaucuag

SEQ ID NO: 90080 - RNA, 46 nt, Mus musculus
ucucaugcaagaggaaugguuccuuuucuguuuuauuuuggccaag

SEQ ID NO: 90081 - RNA, 77 nt, Mus musculus
aaauuguaucacaugcacacccuaauccaucugcucacacaaauggaagaugccuucucaaaggcaguccgaagcag

SEQ ID NO: 90082 - RNA, 46 nt, Mus musculus
ugucuauuaaucucaugcucauggcugauuaguguucgagccagca

SEQ ID NO: 90083 - RNA, 46 nt, Mus musculus
uucucccuuggaauacaaguuaaugcgucaacucagcauccucaga

SEQ ID NO: 90084 - RNA, 38 nt, Mus musculus
agacucauaaaauacaaucuuuucuuuuuuaaaagaag

SEQ ID NO: 90085 - RNA, 49 nt, Mus musculus
agauccaugcaaguauacuauaaacccaguaugucauguucgccccuua

SEQ ID NO: 90086 - RNA, 48 nt, Mus musculus
aauagaaguuagacuauacaaccuaaggccuaaauaacggacaagaag

SEQ ID NO: 90087 - RNA, 53 nt, Mus musculus
aucccugcacacauaccugcacucaggaauguacacacaaccagagacacaga

SEQ ID NO: 90088 - RNA, 46 nt, Mus musculus
aaaucucucuauauacaugugaguuuuuuuuuucuucucugacaag

SEQ ID NO: 90089 - RNA, 45 nt, Mus musculus
caggccccugguacuguguuuuuaugguaauauaacacacaugag

SEQ ID NO: 90090 - RNA, 47 nt, Mus musculus
ccucuaguccucuugcagaaaccuuaauuuuaaaaauuaucugauag

SEQ ID NO: 90091 - RNA, 39 nt, Mus musculus
cuugucugcccuccucccccaacuuuggagugccuuggg

SEQ ID NO: 90092 - RNA, 46 nt, Mus musculus
uggaaaguaucugggcuaagauuauacuuguucauagugucugcag

SEQ ID NO: 90093 - RNA, 46 nt, Mus musculus
gcugagcugcuucuguguacagugugaauuuugauacccaucucag

SEQ ID NO: 90094 - RNA, 42 nt, Mus musculus
acacacccuuagucccagcacuuaggaggcagaaacaggcag

SEQ ID NO: 90095 - RNA, 42 nt, Mus musculus
uuuaaauauuuauguuucuuuaugaucuaauguaucaucaug

SEQ ID NO: 90096 - RNA, 46 nt, Mus musculus
guaagggaggaacuucgauacagauuaaagugaaugaauaaaugag

SEQ ID NO: 90097 - RNA, 42 nt, Mus musculus
accucacugggugugggugggguucccaguaugcacggccac

SEQ ID NO: 90098 - RNA, 46 nt, Mus musculus
uuaguuuugcuuuuucauaugaacgcuaagaaaguuugcaguacag

SEQ ID NO: 90099 - RNA, 42 nt, Mus musculus
uuuuacaagcuucuuguuuuauuccuucuguauuaaaaccag

SEQ ID NO: 90100 - RNA, 41 nt, Mus musculus
ucguaguacuacaugcacguggugcacagacauacaugcag

SEQ ID NO: 90101 - RNA, 46 nt, Mus musculus
auaaaacacugaccaaaaucaacacacgcacacaccaucuacacag

SEQ ID NO: 90102 - RNA, 46 nt, Mus musculus
ucaauuauuauaauaaacauugaaacuacuaaaaaguugagagagg

SEQ ID NO: 90103 - RNA, 46 nt, Mus musculus
ccuugaacucagagauccccuugggauuaaagguuugcaccaccac

SEQ ID NO: 90104 - RNA, 42 nt, Mus musculus
gaucuaguuacagaugguugugagccaccaugugguugccgg

SEQ ID NO: 90105 - RNA, 46 nt, Mus musculus
ucaaaucccagcaaccacaugguggcucacaaccaccugugaagcu

SEQ ID NO: 90106 - RNA, 47 nt, Mus musculus
auauauacuccuaagagaucaaggaaggauauauggcagauuuugga

SEQ ID NO: 90107 - RNA, 46 nt, Mus musculus
gacauauucuuuugugcccauauuuaaacugaaccaaacuaaccag

SEQ ID NO: 90108 - RNA, 46 nt, Mus musculus
acugaacucauagucugagcagcagacugaggugcccugagagaag

SEQ ID NO: 90109 - RNA, 46 nt, Mus musculus
cagcauuucucagcuguuuacauuugauagcuuguuuugcacccgg

SEQ ID NO: 90110 - RNA, 42 nt, Mus musculus
ucauuguggcugaagcugaggcuuucagacacaugcggggag

SEQ ID NO: 90111 - RNA, 46 nt, Mus musculus
cugaccccagagcaaugggucucugggagaugauggcacugugaac

SEQ ID NO: 90112 - RNA, 42 nt, Mus musculus
gguucuguaucccuagaugcccaucccgccucccacccccag

SEQ ID NO: 90113 - RNA, 45 nt, Mus musculus
acaacucugcacaugucugaaaagcuauugaaauguacaccuuaa

SEQ ID NO: 90114 - RNA, 62 nt, Mus musculus
uaacauucagugaaauucaaaauaaaaagggcauguuguuauaacgaagaauggcuuagggc

SEQ ID NO: 90115 - RNA, 57 nt, Mus musculus
cugcuuccagcacucuggaaugccuuccuagaugucggccacauaggauucagugag

SEQ ID NO: 90116 - RNA, 93 nt, Mus musculus
gaaugagaagaaaagacuuccuuaggaagucuuggggucaggagcaaggcaaaggguagaagaugucugcagggaaagagaggcagguaugaa

SEQ ID NO: 90117 - RNA, 46 nt, Mus musculus
gcugauuuugcucucacuucucaccugcugaucuguugucgguccu

SEQ ID NO: 90118 - RNA, 42 nt, Mus musculus
ccaucccuccagcaccgaggucacggacacauccugccaucu

SEQ ID NO: 90119 - RNA, 45 nt, Mus musculus
ucccuccccacacacaccuuccucuggcgauguuaagggcaguag

SEQ ID NO: 90120 - RNA, 45 nt, Mus musculus
ucccccuccuccgacgggcccccucucccuaagucuaggcugugu

SEQ ID NO: 90121 - RNA, 45 nt, Mus musculus
guagccagcggggggauuugaccagggugguuuuguguuuuggag

SEQ ID NO: 90122 - RNA, 44 nt, Mus musculus
uaauacuucucgagaagacuacuagguagcacuugggcaguuua

SEQ ID NO: 90123 - RNA, 46 nt, Mus musculus
ggauuggcccuuccacugcauuugcuguucauugauaagcagggag

SEQ ID NO: 90124 - RNA, 46 nt, Mus musculus
gggauagacugccgcaggccuuccauacaguaggucuuaugaguga

SEQ ID NO: 90125 - RNA, 46 nt, Mus musculus
uuuuuauuaguucuaguuaguuaauguacaguuuuuugaguuguag

SEQ ID NO: 90126 - RNA, 45 nt, Mus musculus
ucggacuugucagccgcuuugagguuuugccaggagcugugccag

SEQ ID NO: 90127 - RNA, 42 nt, Mus musculus
acacacauuguaagaauuaggaauucugugucugagccggaa

SEQ ID NO: 90128 - RNA, 41 nt, Mus musculus
acuguguuaaagucauuaaagucaguaucuucaagccaguu

SEQ ID NO: 90129 - RNA, 46 nt, Mus musculus
gccguaaaagagccauucuuuaugcuggcacuugauaggaugggug

SEQ ID NO: 90130 - RNA, 49 nt, Mus musculus
aagaagcuggcagauagaaagugacagacagacaggcagcagugugagg

SEQ ID NO: 90131 - RNA, 46 nt, Mus musculus
gaagagcuuugauugccugguugucaguggcuucaagggcggucag

SEQ ID NO: 90132 - RNA, 46 nt, Mus musculus
aucccccugccucugccucccaagugcugggauuaaaggcgugggc

SEQ ID NO: 90133 - RNA, 74 nt, Mus musculus
uaagggaacacuauugauuuaaaagaaaggggagggggagagagagagagagagagagagagagggggggggug

SEQ ID NO: 90134 - RNA, 45 nt, Mus musculus
acagaagcaauuucacgcaggaaacaugacccucauagacagcag

SEQ ID NO: 90135 - RNA, 46 nt, Mus musculus
augccauugugauucagagaagaagaagaggggucaaaaugccaau

SEQ ID NO: 90136 - RNA, 45 nt, Mus musculus
ccuaagagauagggauaccgaccuacucagacucggacuguucua

SEQ ID NO: 90137 - RNA, 46 nt, Mus musculus
gaaaugaaaaaugucauugauaagaaaacacgaugaucgggagcca

SEQ ID NO: 90138 - RNA, 46 nt, Mus musculus
ucuugguuucuaaaaggaagggaaucuucccgauuuuucuaagaug

SEQ ID NO: 90139 - RNA, 41 nt, Mus musculus
aaaaucuugacagcugaacucaguugcucuuuccuggcagg

SEQ ID NO: 90140 - RNA, 46 nt, Mus musculus
cagaauagaaucuguaacaagagacaugggacauaagccagagaac

SEQ ID NO: 90141 - RNA, 42 nt, Mus musculus
aauaguauuuauuagcuugcucaagcucccagcuggccauag

SEQ ID NO: 90142 - RNA, 42 nt, Mus musculus
ucuccugcccacuguguuguuuguaggacacccccacaccca

SEQ ID NO: 90143 - RNA, 45 nt, Mus musculus
cuccucugaagaagacaugacucauguucaguugagaccccagac

SEQ ID NO: 90144 - RNA, 42 nt, Mus musculus
ccuuucucuuacugccauuggaaauuauuuuagggcugagau

SEQ ID NO: 90145 - RNA, 92 nt, Mus musculus
cauggcaagcacauauuuaacacugguacuagucaugccuguauguacuaucaaaacaaaucuuguaaguaucccaccaugaguagccuuaa

SEQ ID NO: 90146 - RNA, 41 nt, Mus musculus
gacagaggcuccucucugcucagggcaucgucggggcuuga

SEQ ID NO: 90147 - RNA, 41 nt, Mus musculus
uuucuguuguccuggggaaucuguuuucucagaccgugggu

SEQ ID NO: 90148 - RNA, 24 nt, Mus musculus
cauaaaaaguaaauggguuccaua

SEQ ID NO: 90149 - RNA, 45 nt, Mus musculus
ugaggcccggauucauugguauagugugugugugugugugugugu

SEQ ID NO: 90150 - RNA, 42 nt, Mus musculus
gugguagcacaagucuuuaaccccaguacucaggaggcagag

SEQ ID NO: 90151 - RNA, 46 nt, Mus musculus
gugcaucuuagagaucuuguuguucuccugcuaaucaauaugagau

SEQ ID NO: 90152 - RNA, 41 nt, Mus musculus
cagaagucaaaacagaugacaaauguggauagggaccagga

SEQ ID NO: 90153 - RNA, 49 nt, Mus musculus
caagcugccucugacaaaaucugaggagaaggcccugaagaaaauccgg

SEQ ID NO: 90154 - RNA, 59 nt, Mus musculus
gguggggugugaacucuauacuguuacuugugugugcgagauagugggguguuccuggg

SEQ ID NO: 90155 - RNA, 41 nt, Mus musculus
agccccuugguuguaaguagagggaaagagaaacuggugug

SEQ ID NO: 90156 - RNA, 46 nt, Mus musculus
aucugcccguccuuguggaucaucaagucuccagaaagcagcaguc

SEQ ID NO: 90157 - RNA, 46 nt, Mus musculus
agcaggaaaacagaagaagcagggagugggaaggacacaugcaaag

SEQ ID NO: 90158 - RNA, 35 nt, Mus musculus
aucaaaccuggguaaacucucugagaaaaacaaga

SEQ ID NO: 90159 - RNA, 45 nt, Mus musculus
acuggcagcauuccuccagaaacaaaaggggcuuuucuccaagaa

SEQ ID NO: 90160 - RNA, 45 nt, Mus musculus
gugcguguguacauguaccucauguguacaugaaaucucugagau

SEQ ID NO: 90161 - RNA, 46 nt, Mus musculus
gagggaugcacacccucucugucccaucuccaucccgucccaagcg

SEQ ID NO: 90162 - RNA, 24 nt, Mus musculus
ucuuggaaguuguggugguuuucu

SEQ ID NO: 90163 - RNA, 46 nt, Mus musculus
gagaagcugaaauuugaaugggaauagauaggugacgugaacagag

SEQ ID NO: 90164 - RNA, 46 nt, Mus musculus
gccccucccgcaacuuguucaguucauuucagagaugcccugagau

SEQ ID NO: 90165 - RNA, 41 nt, Mus musculus
gaagcccaaaguaccagaggaggcaaguuuagaacagagau

SEQ ID NO: 90166 - RNA, 29 nt, Mus musculus
aauuugauugauggagaagcaaucauagg

SEQ ID NO: 90167 - RNA, 45 nt, Mus musculus
ggagggagacugaugcaaggucagcuugcacagacaggcagagag

SEQ ID NO: 90168 - RNA, 46 nt, Mus musculus
accuucaaaucucuccaucacacuagacuggagcagagugggggau

SEQ ID NO: 90169 - RNA, 45 nt, Mus musculus
agaaaggugacuugggaacacauugggugcacagcauugugaaug

SEQ ID NO: 90170 - RNA, 45 nt, Mus musculus
aagaggggaagaugcgcagaaaugcacaaauaacugaaggaggag

SEQ ID NO: 90171 - RNA, 46 nt, Mus musculus
caaaaugucauuuauauaugcuucuuguuugauucaaugcacagaa

SEQ ID NO: 90172 - RNA, 45 nt, Mus musculus
ggguuguccacaggcuucucaacuaaaucucuccugccuaaauuu

SEQ ID NO: 90173 - RNA, 46 nt, Mus musculus
cugguguuuuaaaaaugcuuuucuguuuauaaaacacacccauuaa

SEQ ID NO: 90174 - RNA, 45 nt, Mus musculus
gcaacugagaggaccuggcagggaagcuuucucuguguuucccag

SEQ ID NO: 90175 - RNA, 41 nt, Mus musculus
ucagggaagcugcaaggagaugguugggguugggggcaggg

SEQ ID NO: 90176 - RNA, 42 nt, Mus musculus
ucgucuacaaggcauguauuccuaccugugugggguggauuu

SEQ ID NO: 90177 - RNA, 65 nt, Mus musculus
gcagaaagugagcacaccuuugcaggaucccaaagagggaggagaugcuggggaguggucaaggu

SEQ ID NO: 90178 - RNA, 50 nt, Mus musculus
aggguccguauauaauaauccaaacagccccuggugagaggaagcagagg

SEQ ID NO: 90179 - RNA, 46 nt, Mus musculus
uugcacauucuuucuguggacaggaaggcugauaauaagagaagga

SEQ ID NO: 90180 - RNA, 42 nt, Mus musculus
gaguggaaugacaaacgaaagggaggaagaucugaggaauac

SEQ ID NO: 90181 - RNA, 42 nt, Mus musculus
ugcucugaugaaacacuaugaccaaaguaacuugggggaaga

SEQ ID NO: 90182 - RNA, 46 nt, Mus musculus
cacagggguuuugggugcuauagccacaauaugacaguaugcagau

SEQ ID NO: 90183 - RNA, 42 nt, Mus musculus
caguccuuggacuugcuaggcaagcacauuccggccucugau

SEQ ID NO: 90184 - RNA, 55 nt, Mus musculus
gaauggcccagguacauuuucuaaguugaguguguugagaggagaaugugggggu

SEQ ID NO: 90185 - RNA, 76 nt, Mus musculus
aggaaaaaaauaaacaagaaauggcaacuguaaaagagagacacaguauagaacggucaacauuuuaaaugcagag

SEQ ID NO: 90186 - RNA, 27 nt, Mus musculus
ucgaguaauuuccaugugccaagcacu

SEQ ID NO: 90187 - RNA, 46 nt, Mus musculus
guagaacugcucaugcaguuuguccaugauggcacaaggcugaauc

SEQ ID NO: 90188 - RNA, 45 nt, Mus musculus
gcgggcuaggacaacgggacagcgagcgaggaggcaagcgaagau

SEQ ID NO: 90189 - RNA, 42 nt, Mus musculus
ucccugcuugcagacauggcugacaucaagaacaaccccgaa

SEQ ID NO: 90190 - RNA, 46 nt, Mus musculus
ggaucaucgccaucuacggccuggugguggcaguacuuaucgcuaa

SEQ ID NO: 90191 - RNA, 42 nt, Mus musculus
acaccagcaucuccgacgaugccaauggcaaagccagcagcc

SEQ ID NO: 90192 - RNA, 89 nt, Mus musculus
uccugauccucaucuuugcggaggugcuuggccucuacggucucaucguggcccuaauccucuccacaaaguaguccuuuuccaccauc

SEQ ID NO: 90193 - RNA, 42 nt, Mus musculus
ggggugaucuuuacauccuauccugugacugaugguggaaaa

SEQ ID NO: 90194 - RNA, 45 nt, Mus musculus
ugcaguguccuagugcccauugucugucgcccccgccuugccccu

SEQ ID NO: 90195 - RNA, 58 nt, Mus musculus
uguggagcagcuccugucucccaacuauauaguaaucauuaguagacuguugccuugu

SEQ ID NO: 90196 - RNA, 44 nt, Mus musculus
cucccugugcucccuccgcgaguccguucggccucggagaagcg

SEQ ID NO: 90197 - RNA, 46 nt, Mus musculus
acaaaggaaccgggauaaguuguuuuguugucugcugcuuucggag

SEQ ID NO: 90198 - RNA, 45 nt, Mus musculus
auucucuguuugauauauuggacaugcagaugaaaaugcaggguu

SEQ ID NO: 90199 - RNA, 48 nt, Mus musculus
gggaagggaaugauuggauauuuuugcuuggugaauagcuuggaguuu

SEQ ID NO: 90200 - RNA, 44 nt, Mus musculus
uuggguccugagcaggagaggaaguuggccuaauucuugccagu

SEQ ID NO: 90201 - RNA, 67 nt, Mus musculus
uuuugccugaccugggcucuggucuauacauucaaugccauuuccaauuaauaccuuugucagaauu

SEQ ID NO: 90202 - RNA, 80 nt, Mus musculus
ucaaucauauccaaggauaagauccagcuggaauauagacaacuaaacaccuuugaucccucuggcuggaauacaggcag

SEQ ID NO: 90203 - RNA, 46 nt, Mus musculus
agugaccucuaauuaagaggcagacaaagugauaaaucagagaaag

SEQ ID NO: 90204 - RNA, 51 nt, Mus musculus
acacccaacucucacaagaaacaggaaagaaaggcuacuuaaagagcagcg

SEQ ID NO: 90205 - RNA, 46 nt, Mus musculus
agaaaaagcuagaaaggaugaauuuauucaucagcaagucucagag

SEQ ID NO: 90206 - RNA, 45 nt, Mus musculus
ggaacauaauacuugggucugaagaguucguuuucuuggcuccua

SEQ ID NO: 90207 - RNA, 46 nt, Mus musculus
ucugcguuuggugacugauuaugggauggaucuccggguggggcag

SEQ ID NO: 90208 - RNA, 45 nt, Mus musculus
aaggaggcaugaaguauccacauguuagucuuccuucuucuugau

SEQ ID NO: 90209 - RNA, 44 nt, Mus musculus
aauucuccaagcugacugauucaaucuggcuuuucucaccuuuu

SEQ ID NO: 90210 - RNA, 46 nt, Mus musculus
gcgcacccagcgagacacugagaccgaacuugcuguaaucacacga

SEQ ID NO: 90211 - RNA, 57 nt, Mus musculus
uaaaggcaaaaaccacaaaccagggggaggauuggggaggaaauagaggaagucuag

SEQ ID NO: 90212 - RNA, 49 nt, Mus musculus
cggguguuuaggccaccuggcaguaagccgggguccagggugaaaaguu

SEQ ID NO: 90213 - RNA, 55 nt, Mus musculus
uucuaucucuugggauuaaaggugugucuguauuccagccagagcagccuuguug

SEQ ID NO: 90214 - RNA, 73 nt, Mus musculus
auuccuguacaaaagauugugcauagauaaucuuauauugggccacugcugcuacuccugcauaucugauucc

SEQ ID NO: 90215 - RNA, 41 nt, Mus musculus
acauaaagagguggaauguccuucucuucuggugagcaggg

SEQ ID NO: 90216 - RNA, 46 nt, Mus musculus
gaaguuauagaugugagcccagguucucugcaagagcaccgagcac

SEQ ID NO: 90217 - RNA, 45 nt, Mus musculus
gccuuagcaauagagacuuaccaucuacauuugguguacaaccua

SEQ ID NO: 90218 - RNA, 42 nt, Mus musculus
guauacugucacugucagaucuuauuacagaucucuuuacag

SEQ ID NO: 90219 - RNA, 46 nt, Mus musculus
caagcucuugucgguguucauuuucuccccccaucccccacccccc

SEQ ID NO: 90220 - RNA, 46 nt, Mus musculus
ggucuuuuaauuuuuaacucugugagcuaaaaauauccguucuaag

SEQ ID NO: 90221 - RNA, 45 nt, Mus musculus
acucccccauguccugcucagguuuuuguuauuacuguuuuugag

SEQ ID NO: 90222 - RNA, 45 nt, Mus musculus
guuuaccugaacuugacuuaauuuugguauguggugucugucuag

SEQ ID NO: 90223 - RNA, 45 nt, Mus musculus
cuguugauuauguucuuucgacaucucuguugcugguuggccuga

SEQ ID NO: 90224 - RNA, 42 nt, Mus musculus
cagaccuccugggagucagacaguugugggguaaagggggag

SEQ ID NO: 90225 - RNA, 42 nt, Mus musculus
ggauccuaucacccagugugugugugugugugugugugugug

SEQ ID NO: 90226 - RNA, 46 nt, Mus musculus
cuuguugugagcugccuguugugcgugugggaaacuggagucagag

SEQ ID NO: 90227 - RNA, 46 nt, Mus musculus
gaguuguuguacauguacaucacucaucuguuucaucagcaaguag

SEQ ID NO: 90228 - RNA, 46 nt, Mus musculus
uaacuaacacagggaguguuuagaggagacuguucucuucaugcag

SEQ ID NO: 90229 - RNA, 45 nt, Mus musculus
gggcaucacagccgcuggaacuggagguaaaggcaauagugaauu

SEQ ID NO: 90230 - RNA, 45 nt, Mus musculus
uugguucauugucucauagacaguuccuuuucuuuauaacagaag

SEQ ID NO: 90231 - RNA, 45 nt, Mus musculus
gugcuuucuucccacuucuuucauuuucauuuuuguuuguaccag

SEQ ID NO: 90232 - RNA, 46 nt, Mus musculus
cucaccagagggugaaguucacaaaagaccacacagucaggcagaa

SEQ ID NO: 90233 - RNA, 46 nt, Mus musculus
acuucuuuuuuauuuacauaugugaguacacugcagauauccucag

SEQ ID NO: 90234 - RNA, 45 nt, Mus musculus
uagaagcagugggagggaggauagguuaggggauuuccagggguu

SEQ ID NO: 90235 - RNA, 45 nt, Mus musculus
uauuauuauuauuguuaaauugugacuauguaagugccuacagag

SEQ ID NO: 90236 - RNA, 46 nt, Mus musculus
agccucagcuuuagagagggacccaaggagggggcgaugggagcag

SEQ ID NO: 90237 - RNA, 45 nt, Mus musculus
cuagugucaaaaaaugaggauguuguggcccaggauacgccccgc

SEQ ID NO: 90238 - RNA, 42 nt, Mus musculus
cugauggaaaaaacaaaauauauaaaguauacaggaaaucag

SEQ ID NO: 90239 - RNA, 46 nt, Mus musculus
uguuuuuguuuguuuguuuguuuguuuguuuguuugugguggcuuu

SEQ ID NO: 90240 - RNA, 46 nt, Mus musculus
auugucacauuguguucauauaucuuuucauuuuuauuuucaccag

SEQ ID NO: 90241 - RNA, 46 nt, Mus musculus
auuuguauguuuguguguauguauauauacaugcuguacgggcuag

SEQ ID NO: 90242 - RNA, 46 nt, Mus musculus
gccucaugcgcuaaccuagacuacugacagccauugcagccgccuu

SEQ ID NO: 90243 - RNA, 41 nt, Mus musculus
caguguaggggaaugccagggccaggaagggggagugggug

SEQ ID NO: 90244 - RNA, 75 nt, Mus musculus
auuaauuuuuagauauuuuucucccuuucauuucguuuucaggauaauugaaauaaaucaaaaccaaaagcaggu

SEQ ID NO: 90245 - RNA, 45 nt, Mus musculus
agcuugaggugagucgggcagugguaagggucugggacucagcau

SEQ ID NO: 90246 - RNA, 61 nt, Mus musculus
ugaaguaacagcuauuguaucaucaaggggaugcagaauugucuagaaaaauaugaugucu

SEQ ID NO: 90247 - RNA, 46 nt, Mus musculus
guucuacacuuugauccacagguagaaugugugccacaccguugag

SEQ ID NO: 90248 - RNA, 42 nt, Mus musculus
uuacuguauacuauuuaguuaguuauuccuucaguauguugg

SEQ ID NO: 90249 - RNA, 45 nt, Mus musculus
cauuucggaugagguuugugugugugugugugugugugugugugu

SEQ ID NO: 90250 - RNA, 42 nt, Mus musculus
caaggccaagacaauuuuuuucucugaucaaagcccgcgagu

SEQ ID NO: 90251 - RNA, 43 nt, Mus musculus
acuuugugccuguaucuugcucucagaguaacguguauggaag

SEQ ID NO: 90252 - RNA, 84 nt, Mus musculus
aacaggagaggccaaaugcuucacacuagaauguugcagaagaaagaugcuuagagccaugcauggugaugaggugacaggcag

SEQ ID NO: 90253 - RNA, 46 nt, Mus musculus
acuaggaaaggaagaaagaggcuuacuaugacaguuagcacagaaa

SEQ ID NO: 90254 - RNA, 40 nt, Mus musculus
uuuucuucuuuuguaauaaaauccuuuuguucaugaacuu

SEQ ID NO: 90255 - RNA, 46 nt, Mus musculus
augcaagugccuguagaaaccagaagggagguauccgagcuucuag

SEQ ID NO: 90256 - RNA, 98 nt, Mus musculus
gauauuugaggugcgggcaguugcuuuauuuguuccauuacguuuagacagaaagguucaggugaguugcuuugcuuuguguagaggaacggcuacug

SEQ ID NO: 90257 - RNA, 58 nt, Mus musculus
gcucaaagccccaguauccaguuggguauugaaauugucaaggauugggacagcaaug

SEQ ID NO: 90258 - RNA, 47 nt, Mus musculus
agagcaucauccagagcaucagacagucuguacacuacaggacaaga

SEQ ID NO: 90259 - RNA, 94 nt, Mus musculus
aaucacacagagcaucagacagucuguacacuacaggacaggacaggaaucacacagagcaucagacagucuguacacuacaggacaggacagg

SEQ ID NO: 90260 - RNA, 42 nt, Mus musculus
cacaaaauuguuacauuugaacagaaaauuuuagguggcccu

SEQ ID NO: 90261 - RNA, 45 nt, Mus musculus
gucuuuucuuauccuggucagguuauaaauugugugaauguacag

SEQ ID NO: 90262 - RNA, 42 nt, Mus musculus
cauauucagcaacagguaauggcucagaggcaacaggugcaa

SEQ ID NO: 90263 - RNA, 42 nt, Mus musculus
agcugagauauucaccaagccagaauguaccucggcagacaa

SEQ ID NO: 90264 - RNA, 46 nt, Mus musculus
uggcucaugccuuuaaucccagcacaugggaggcagaggcaggcag

SEQ ID NO: 90265 - RNA, 46 nt, Mus musculus
agcccugccucaacaaaaaagcagaggaaggaaagauaacacuuag

SEQ ID NO: 90266 - RNA, 45 nt, Mus musculus
aguuuuuauacaaaaagaccaaaggggaaacaacccuuaugcaga

SEQ ID NO: 90267 - RNA, 42 nt, Mus musculus
aagccacccucuauccccagaacuccuuuauauuagccccuu

SEQ ID NO: 90268 - RNA, 46 nt, Mus musculus
cugaaaauuaugauuuuccuguuguuauaguaaaacaagaaucaga

SEQ ID NO: 90269 - RNA, 45 nt, Mus musculus
auugacuuccacacugcucacuuuacugcuuagucuuuaguugua

SEQ ID NO: 90270 - RNA, 42 nt, Mus musculus
ugugcuguuugucaaaaugguggggaacuccuaugcugugag

SEQ ID NO: 90271 - RNA, 42 nt, Mus musculus
auaggcagaggauaaaacccuguccaaagaaaccugccauag

SEQ ID NO: 90272 - RNA, 45 nt, Mus musculus
gccagagguugacuaugauugugauguucccagucaccacucaga

SEQ ID NO: 90273 - RNA, 45 nt, Mus musculus
cagguuuacauggagggauaauuuuuaaauuuuaugagaacccaa

SEQ ID NO: 90274 - RNA, 42 nt, Mus musculus
ucugcggguauuugauugauauaugccuugggaauuggggag

SEQ ID NO: 90275 - RNA, 45 nt, Mus musculus
uguaaguucagugacgacucagacgaugacuuuguacagccccgg

SEQ ID NO: 90276 - RNA, 47 nt, Mus musculus
aaaauaaaaagaagaggaaggaaggaaauguguacaagaauaaaaga

SEQ ID NO: 90277 - RNA, 46 nt, Mus musculus
uuggauuucauacaggagccuggagugagugcuacacuaagaaaga

SEQ ID NO: 90278 - RNA, 46 nt, Mus musculus
cauuuuuagaauauuaauuucauuacccauuaauuauggccaacug

SEQ ID NO: 90279 - RNA, 46 nt, Mus musculus
acaccaaauaguguccauguaagauggcaacugcauuaaaaaaaaa

SEQ ID NO: 90280 - RNA, 46 nt, Mus musculus
uuuugcuuguuuggugguuuuuuugggggguguggggggagcucag

SEQ ID NO: 90281 - RNA, 46 nt, Mus musculus
ugagauaugacuuuggugauuagguauuaccuuuuuugguugaguu

SEQ ID NO: 90282 - RNA, 42 nt, Mus musculus
aacaguggugguuccucacuuuggguuucuauccggggauau

SEQ ID NO: 90283 - RNA, 45 nt, Mus musculus
uauacguguuguguuuaggcuuacggauguagugauguguguggu

SEQ ID NO: 90284 - RNA, 46 nt, Mus musculus
ccaugguagccgcauuuaaauauugauauaguuggccuuugaagau

SEQ ID NO: 90285 - RNA, 45 nt, Mus musculus
ucaccccaugcugggcagauaaaguuaagagaugugguacugagg

SEQ ID NO: 90286 - RNA, 46 nt, Mus musculus
aaguugugacauuuuuuuccuagugguauuugugugugugugugug

SEQ ID NO: 90287 - RNA, 42 nt, Mus musculus
cuguguaaaaagauuuguguuucuuuccauaacgugacauuu

SEQ ID NO: 90288 - RNA, 41 nt, Mus musculus
auugugacaggcgcagcaggcaugagacagagacagagaga

SEQ ID NO: 90289 - RNA, 42 nt, Mus musculus
cgacggcccgugggacgcagaggccgagguggcggcgggcga

SEQ ID NO: 90290 - RNA, 42 nt, Mus musculus
ccugagccccugcaacauuccuggcuccuggguuccuggcag

SEQ ID NO: 90291 - RNA, 46 nt, Mus musculus
ugcaaaggacgcuggccuugaucucggccuuuucuugcccccaccu

SEQ ID NO: 90292 - RNA, 46 nt, Mus musculus
aggaaguuuuuacccacugugcugguuccuuacuagguuuuuugag

SEQ ID NO: 90293 - RNA, 46 nt, Mus musculus
aggaccauaaaagacauuggugcugaggaugaucugaacugugcag

SEQ ID NO: 90294 - RNA, 41 nt, Mus musculus
cauacugaaauucuucuccacugaaaccucuugggccaggu

SEQ ID NO: 90295 - RNA, 48 nt, Mus musculus
cacucacgguggcguccgcggggacagcugagggugcuggagggaaga

SEQ ID NO: 90296 - RNA, 49 nt, Mus musculus
gggaaccggugaacaaugggauuaggacagcgguuugucggugauugua

SEQ ID NO: 90297 - RNA, 46 nt, Mus musculus
aguuacaaguaugguguggccaucauuacuaaauguuuucagagaa

SEQ ID NO: 90298 - RNA, 42 nt, Mus musculus
accugggugggggagauucuugaguuuuuauugggaaaagag

SEQ ID NO: 90299 - RNA, 46 nt, Mus musculus
gcucuuuguaucaggguacuaaggcaggauugugacuuugaggcua

SEQ ID NO: 90300 - RNA, 50 nt, Mus musculus
uucuuaguuaaagaaaaauauaaaucuuugugcauacuaugaguuaggcu

SEQ ID NO: 90301 - RNA, 45 nt, Mus musculus
agacuagcaugugaaaggcucuggguucaguaaaaguccccauca

SEQ ID NO: 90302 - RNA, 44 nt, Mus musculus
cauacagaagauccauuuacugaugagcauaaggagaggcaaga

SEQ ID NO: 90303 - RNA, 46 nt, Mus musculus
acuauaauauuuauacaggauauuugaacagccauugagcauucag

SEQ ID NO: 90304 - RNA, 45 nt, Mus musculus
aauguauauuaaaaucauaaaugcuuuuuaaaaaaacucuaaggg

SEQ ID NO: 90305 - RNA, 48 nt, Mus musculus
uggccucugaccuagauaaauuuucaauuucuuuaaauuccugcagau

SEQ ID NO: 90306 - RNA, 46 nt, Mus musculus
uggccucugaccuagauaaauuuucaauuucuuuaaauuccugcag

SEQ ID NO: 90307 - RNA, 46 nt, Mus musculus
augcauacaauaaauaaaauauguuuaaaaaaauucucuagaaaga

SEQ ID NO: 90308 - RNA, 46 nt, Mus musculus
aaauggugguacacacuuguaaucucaguacuuggaugcugagaua

SEQ ID NO: 90309 - RNA, 45 nt, Mus musculus
gcaguggcugugguuguguguaguugugacuuuaauuagcauucu

SEQ ID NO: 90310 - RNA, 45 nt, Mus musculus
gcguuauaauggaaaggaagugaggugugacuaaaucugugagca

SEQ ID NO: 90311 - RNA, 45 nt, Mus musculus
guuuaaccccaggucuggcaaaaauuuaaaaguuaaaaggaagag

SEQ ID NO: 90312 - RNA, 41 nt, Mus musculus
guauguguggaugguuuugguuuguuuguuucugaggcacu

SEQ ID NO: 90313 - RNA, 69 nt, Mus musculus
cauccuuguuaauacuugcuauuagcacuuuuaauauuaucagguaucgaagugugugugauccagagu

SEQ ID NO: 90314 - RNA, 47 nt, Mus musculus
gagaugaggaggacaacuccugggagucauguuucucuugcccugag

SEQ ID NO: 90315 - RNA, 46 nt, Mus musculus
cugucuuuguuuggguuuuauuucugugaauaaacacugugaccac

SEQ ID NO: 90316 - RNA, 43 nt, Mus musculus
guuuuguccauuaucauugucauggugggaaacgugggcaugc

SEQ ID NO: 90317 - RNA, 46 nt, Mus musculus
uuccuaagcguugguguguucucauuuguggaaugugaaauagaag

SEQ ID NO: 90318 - RNA, 45 nt, Mus musculus
gucuaucaacauguuucuuccaagucacugugagcuuugcagaaa

SEQ ID NO: 90319 - RNA, 45 nt, Mus musculus
cguaucucuucuuugcagggugggaaagcccguaaacaccggaag

SEQ ID NO: 90320 - RNA, 46 nt, Mus musculus
guauuauauacugucaaccccagcauugguagagaugggggaucag

SEQ ID NO: 90321 - RNA, 46 nt, Mus musculus
gcuggguuuugauauaucauauuuuuuuuuacuuaguuugaagaaa

SEQ ID NO: 90322 - RNA, 45 nt, Mus musculus
aauaauguuugccuucccugccugcaaaggagucaugaggaccag

SEQ ID NO: 90323 - RNA, 46 nt, Mus musculus
cuuucauuccuucacuugccaguaguacugaucuuuuuuccaugag

SEQ ID NO: 90324 - RNA, 46 nt, Mus musculus
cuuuuaaauacuugaaaauauauuucuacuuacacacagaggcaag

SEQ ID NO: 90325 - RNA, 47 nt, Mus musculus
aguaagugcuguucuuugacauaaacaugacauagaauuauagacag

SEQ ID NO: 90326 - RNA, 63 nt, Mus musculus
cugaagaagaugauuucacagauaaccaaaagcacaagccacccaaggugaguuugacaucuc

SEQ ID NO: 90327 - RNA, 42 nt, Mus musculus
aaauauauguucuuauuacugauuuguacacccaggccagaa

SEQ ID NO: 90328 - RNA, 45 nt, Mus musculus
aaaaaaagaaaaagcgguauaaagauucccuuucucuggcugcca

SEQ ID NO: 90329 - RNA, 41 nt, Mus musculus
guguguguguaucugugucucugugugugugugugugugug

SEQ ID NO: 90330 - RNA, 46 nt, Mus musculus
auauuuuaguuuuccuuaaagauaagauauaaguugaaguuuguag

SEQ ID NO: 90331 - RNA, 46 nt, Mus musculus
caaaagaacuacaaauuugaggcuagcuugggaucuaaguugagag

SEQ ID NO: 90332 - RNA, 42 nt, Mus musculus
aagcagguguaguauggaauagaguuuauuuggggcauagga

SEQ ID NO: 90333 - RNA, 42 nt, Mus musculus
aaacaaaaaaaaaaaucuuugggccggagcaaacgggggcug

SEQ ID NO: 90334 - RNA, 45 nt, Mus musculus
guuucccagacuccaggaauuccaauccugcuguauagugccaag

SEQ ID NO: 90335 - RNA, 87 nt, Mus musculus
cagguagaagauauucuucugacaucagguacccuuacugucccagaaaggaucccagcagaccgguaccagaugucauagcaggag

SEQ ID NO: 90336 - RNA, 46 nt, Mus musculus
ugucucccuaaagugggguuugagaaaaugguauugaacauaggag

SEQ ID NO: 90337 - RNA, 45 nt, Mus musculus
aggguuguguuaccuaggaacucggcagagcagcucaucagggua

SEQ ID NO: 90338 - RNA, 24 nt, Mus musculus
gcacagggcuuuaucugguuaaua

SEQ ID NO: 90339 - RNA, 45 nt, Mus musculus
uaaucugacuaagcuggggcuagacagagauagcuuuugaccuaa

SEQ ID NO: 90340 - RNA, 72 nt, Mus musculus
gaucaaauugggaugcuaugaauuagagccaaauaaaagccagucugcugaggauuaucuuaaauccuucau

SEQ ID NO: 90341 - RNA, 46 nt, Mus musculus
acauaaacuauugauuugcuaaaauucuaaauacaaagaaaccaua

SEQ ID NO: 90342 - RNA, 45 nt, Mus musculus
acagaaauggguauuuccuuaguaaaaauaaaaaacaaaugucua

SEQ ID NO: 90343 - RNA, 46 nt, Mus musculus
agcuagggcuacauagagaaacucuguuccaaaaaacauagcuaag

SEQ ID NO: 90344 - RNA, 41 nt, Mus musculus
ucagugguucuucuaaagguccugaguucaauucccagcaa

SEQ ID NO: 90345 - RNA, 75 nt, Mus musculus
cagcuguccagcagaacuaugugucuccauugcaagccaccauuaguaaaucacagaccaacccaguggugaaau

SEQ ID NO: 90346 - RNA, 62 nt, Mus musculus
uaaguaauaacccccaacuuuccuguucgucccaacuacucaagacuucagauaagccacug

SEQ ID NO: 90347 - RNA, 45 nt, Mus musculus
uauuuagccaaggcuauggugucacaaaucuccacgcaggguuuc

SEQ ID NO: 90348 - RNA, 61 nt, Mus musculus
acaucucccaagccuuugcccucaccuaagccuucuguuucacccaagcccucucugucag

SEQ ID NO: 90349 - RNA, 70 nt, Mus musculus
caacccuguccauaaacagcccaguggaaugaacaucagcagacagucucccacucugaauuuguugccc

SEQ ID NO: 90350 - RNA, 45 nt, Mus musculus
guuaauucccagcaaccauaugguggcucacaaccaucuguagug

SEQ ID NO: 90351 - RNA, 46 nt, Mus musculus
acaugcagauacucauacauuaaauagacuugaaagagagagagag

SEQ ID NO: 90352 - RNA, 46 nt, Mus musculus
uucuagaagucaucauucaguaagcaaacugaguacuaugugccaa

SEQ ID NO: 90353 - RNA, 46 nt, Mus musculus
aaaagcaugugcuaugaaaagauuguuuaaaauugguuguugcuaa

SEQ ID NO: 90354 - RNA, 74 nt, Mus musculus
guugguaugggcuagaggaaacaacaguauaaacaugccaagugaaagagcccuccuguguugugugagcaaag

SEQ ID NO: 90355 - RNA, 44 nt, Mus musculus
cuuauaaaucuccuugguaacaaaggagaggaggaaagaggaag

SEQ ID NO: 90356 - RNA, 139 nt, Mus musculus
acuggaaaauggaggaggcuaugcuugacuaagauuuuaaaaaggaauacaaguaguaucagauuauuacugggagauggguagaaucuagacauaacagugaagauguacaaagagagucuggggugggguguggaga

SEQ ID NO: 90357 - RNA, 47 nt, Mus musculus
guggugugguugggcaguuaucagcucuaaagaagcacagggaagau

SEQ ID NO: 90358 - RNA, 45 nt, Mus musculus
uggcuggaaugacuuccuagugacucgcggagaagcagagaaggg

SEQ ID NO: 90359 - RNA, 46 nt, Mus musculus
uuugagacuuaccagcaagaaugggcauugaacaucuaagccgcag

SEQ ID NO: 90360 - RNA, 45 nt, Mus musculus
caccucgggaucuaccucagcggcucuccaucacagccuaaccca

SEQ ID NO: 90361 - RNA, 46 nt, Mus musculus
ccuacugucuauaagaguuuagagaugcugcguaaauguuccucaa

SEQ ID NO: 90362 - RNA, 46 nt, Mus musculus
acguugaagaaaaaggaaaggaugaaugagaucuguuagacagaag

SEQ ID NO: 90363 - RNA, 42 nt, Mus musculus
cuccaggcacacacauggugcacacacauacaugcaggcaaa

SEQ ID NO: 90364 - RNA, 47 nt, Mus musculus
cuguuucuguccauguuuacaugcuugucccaagcacuguggugagg

SEQ ID NO: 90365 - RNA, 47 nt, Mus musculus
aaaaaaaaaaaggaaagaaaagaaaagaaaaggaaaaaaacugggga

SEQ ID NO: 90366 - RNA, 46 nt, Mus musculus
guccugagcaaacuugaaucuucuccaguauauagcagguccccgu

SEQ ID NO: 90367 - RNA, 46 nt, Mus musculus
ugcugcucaucucucuugcagccugccaagaacugcaaacucccag

SEQ ID NO: 90368 - RNA, 41 nt, Mus musculus
auuauaagauucguuaauucuaguuuucauaugcgaauaga

SEQ ID NO: 90369 - RNA, 46 nt, Mus musculus
cuauaaucucauuacauauuacucuguaucauuuaaguuuauucag

SEQ ID NO: 90370 - RNA, 47 nt, Mus musculus
aguccucccacuuccuaguucaaguuucauuugugccccgacugccc

SEQ ID NO: 90371 - RNA, 55 nt, Mus musculus
aaaugaggaggcuauguaagccccaguagauauuuuggaaagauauugggauguu

SEQ ID NO: 90372 - RNA, 50 nt, Mus musculus
caauaaucucuacuaaaaucaaauuauaguucuucuccugcuucugagaa

SEQ ID NO: 90373 - RNA, 46 nt, Mus musculus
aaguuaauguauaauaacaaaguccugauauuuugaagaaaucaag

SEQ ID NO: 90374 - RNA, 46 nt, Mus musculus
uguucuuugggaaugucucuagaacucauuguccuacuugcugcua

SEQ ID NO: 90375 - RNA, 41 nt, Mus musculus
gccuuguuuauuccauugcuuugaguugauucagaugggca

SEQ ID NO: 90376 - RNA, 46 nt, Mus musculus
ucccuuucugaauaucuguagaaguuaauauauaugugugugugug

SEQ ID NO: 90377 - RNA, 45 nt, Mus musculus
uagugcuagaaccaugggguggugucugaauacacuuuggaggag

SEQ ID NO: 90378 - RNA, 51 nt, Mus musculus
guauaucuacaaaggacccccuuuuaaguaaaauuuuaguugaaaaaggag

SEQ ID NO: 90379 - RNA, 45 nt, Mus musculus
aucaguagugaguguuaauuccuaaacuacuuuaucuagggggaa

SEQ ID NO: 90380 - RNA, 63 nt, Mus musculus
auuuaaacauaccauauuuguugugugguauaauuauuaguuucagauuaaaucaaaggggaa

SEQ ID NO: 90381 - RNA, 46 nt, Mus musculus
uuuuaaagcuuuuaugauguuauuacuugugugauauuugcaaagg

SEQ ID NO: 90382 - RNA, 74 nt, Mus musculus
ggcugugcguucuuuuaacuuuguauuucaugcuucuucagccagagccaucaacuguucggguuguaguaaaa

SEQ ID NO: 90383 - RNA, 82 nt, Mus musculus
ugggaggaagaucgacaggauucacucccuagcuagggcagagguaaagauggucaggauagaaggaaauaugauuucccaa

SEQ ID NO: 90384 - RNA, 70 nt, Mus musculus
gguacuacaguuuuuguuagggcugaguagugcaugugagagugggggcgggagggggguagucuaaaug

SEQ ID NO: 90385 - RNA, 78 nt, Mus musculus
acagcgaauauucagggucagagagaguggagugcaggguguugaggagcaauuacucagcucaggugaguuaggagg

SEQ ID NO: 90386 - RNA, 45 nt, Mus musculus
accuagucauucucuaguccuucuaaaaucauuuuugggauuuuu

SEQ ID NO: 90387 - RNA, 84 nt, Mus musculus
uuccacauuauauuccuauucauuguucaauaacauguuaagauuaacccaaaugaauguguguguuuccucuagagaagagua

SEQ ID NO: 90388 - RNA, 45 nt, Mus musculus
gccugggauaccaguguauuuuaagauucuucagaagaaaugcag

SEQ ID NO: 90389 - RNA, 44 nt, Mus musculus
uccuaauuuuagguuccucaaaagaaaaacauuacuugccccga

SEQ ID NO: 90390 - RNA, 45 nt, Mus musculus
cccuccucauggugucucuuguccuguuaaacuuaucagacuuca

SEQ ID NO: 90391 - RNA, 46 nt, Mus musculus
acccuuugguaaaguuagauaaggggagacuuuuguuuaguagcag

SEQ ID NO: 90392 - RNA, 45 nt, Mus musculus
cauaggaccgcuggugaauuuuagauauuuccaaacaugcaucug

SEQ ID NO: 90393 - RNA, 42 nt, Mus musculus
agugcggggaugucuguguucauuuugcuuugcgacagccuu

SEQ ID NO: 90394 - RNA, 44 nt, Mus musculus
uccuggcuauccuccaagacaggaccuuuuuacaugagugaguu

SEQ ID NO: 90395 - RNA, 46 nt, Mus musculus
cuugaugguguacaaaaagaauucuucaaacuugcuuugccaccag

SEQ ID NO: 90396 - RNA, 46 nt, Mus musculus
gugcagagguuugggucaaaguguguugcuagcauuacaguaacag

SEQ ID NO: 90397 - RNA, 50 nt, Mus musculus
aaguagcauuagauuugaggaugacaggauagaauucuuuuaaugggaag

SEQ ID NO: 90398 - RNA, 45 nt, Mus musculus
acugaugucacucucaugcuuugcugguuuugaugcucucagauu

SEQ ID NO: 90399 - RNA, 46 nt, Mus musculus
uuuaggauuuauuaucuuaaugacaucuguuuucuuuuuugcugag

SEQ ID NO: 90400 - RNA, 42 nt, Mus musculus
gaccgcuagcaucuaccucugggcuguaccauggaccaggag

SEQ ID NO: 90401 - RNA, 46 nt, Mus musculus
agauaucugagcuagccucuuuccucagucccaacagccugcauau

SEQ ID NO: 90402 - RNA, 46 nt, Mus musculus
ggccuaauggauaaggcauuggccuccuaagccagggauugugggu

SEQ ID NO: 90403 - RNA, 46 nt, Mus musculus
gcuggguuagaacaaacugcagaccauaauggucuaugagcuguga

SEQ ID NO: 90404 - RNA, 46 nt, Mus musculus
gaaggcgugugccacaacgcccggccaucuuguuuuaaaacuagag

SEQ ID NO: 90405 - RNA, 31 nt, Mus musculus
agacauccacauacucuccugccagacaccu

SEQ ID NO: 90406 - RNA, 45 nt, Mus musculus
cgauuucauugguuugucuggugcaugggguguggaauggaguaa

SEQ ID NO: 90407 - RNA, 61 nt, Mus musculus
auccuuucuacauuaaaguuuuaauaggaagcaguguuuuugugauuugacgggugugugu

SEQ ID NO: 90408 - RNA, 46 nt, Mus musculus
ccaggcaaaugcaauuuuuaaggcaauuuaguggggaauauucaag

SEQ ID NO: 90409 - RNA, 42 nt, Mus musculus
aaauucacuuaucuuuuaaaaaguuauguuagguacugugua

SEQ ID NO: 90410 - RNA, 45 nt, Mus musculus
aguaggcuauaauuaggcaucuggaauuggcaagugaauagaggu

SEQ ID NO: 90411 - RNA, 45 nt, Mus musculus
gugugaacaggcugucugacuuugcuaauuacuuuuuuagguuac

SEQ ID NO: 90412 - RNA, 42 nt, Mus musculus
ugccaagcccugauuggacuggaagagagacgggggggaccu

SEQ ID NO: 90413 - RNA, 42 nt, Mus musculus
gaaagcccagaggaaaggagcuggagcuggggguggagaccu

SEQ ID NO: 90414 - RNA, 39 nt, Mus musculus
cguuaagaccagggagggaggggauguuucucuccacac

SEQ ID NO: 90415 - RNA, 42 nt, Mus musculus
gguuugugcucccauaaaaacaauuuuaagggcuggcaagau

SEQ ID NO: 90416 - RNA, 45 nt, Mus musculus
gguugugagccaccaugugguugcugggaauugaacucucaggac

SEQ ID NO: 90417 - RNA, 45 nt, Mus musculus
aagauccaagcaaggugccgaaugccuuuaaucucagcacuaagg

SEQ ID NO: 90418 - RNA, 46 nt, Mus musculus
acacauauaauaaauaaauuaauuaaaaaaaaaaaaccggaauguu

SEQ ID NO: 90419 - RNA, 43 nt, Mus musculus
ccaggacuacauggagagccuauuugaggggggugggagggug

SEQ ID NO: 90420 - RNA, 46 nt, Mus musculus
caaugguuauuauagggaaaaaaacuuccaagguaaauauggggac

SEQ ID NO: 90421 - RNA, 23 nt, Mus musculus
cuuggugagcuuuaaaauaauga

SEQ ID NO: 90422 - RNA, 42 nt, Mus musculus
auagauacauugaaccuuuacaaauaaaacaaggggccagau

SEQ ID NO: 90423 - RNA, 41 nt, Mus musculus
acuuuguuccagcugaagugucucccuuuugcugcugggag

SEQ ID NO: 90424 - RNA, 46 nt, Mus musculus
gaaggauuuuaagaauaaauucaaggggagcaugggccagagagau

SEQ ID NO: 90425 - RNA, 45 nt, Mus musculus
aguauuauaaacugucaugugggugcuggggauugaacccagauc

SEQ ID NO: 90426 - RNA, 46 nt, Mus musculus
acuuuauuuuuauuuacuuaauuuagauuuguuauuacuuuguguc

SEQ ID NO: 90427 - RNA, 46 nt, Mus musculus
aaguacuugugaaaagaaagagaaaugaguuuuucagaaucaggag

SEQ ID NO: 90428 - RNA, 46 nt, Mus musculus
cauggcucugccuucauaguggugggauuaaagaugugggccaccg

SEQ ID NO: 90429 - RNA, 35 nt, Mus musculus
ucuuuuaaccccugaaccuuaccuuucuagcccaa

SEQ ID NO: 90430 - RNA, 45 nt, Mus musculus
uuuuuuucacuuucacaggcauccugugacacucacuucccccca

SEQ ID NO: 90431 - RNA, 46 nt, Mus musculus
uuagcugccugacaugagugcugggaacuuaaguggaguacucugg

SEQ ID NO: 90432 - RNA, 46 nt, Mus musculus
aaauuaagcuaaggggcuagaaaaauggcucaacacucgcuccucc

SEQ ID NO: 90433 - RNA, 45 nt, Mus musculus
cucauggcagacagacaaacgacaaaucggggaaggaaaggaggg

SEQ ID NO: 90434 - RNA, 46 nt, Mus musculus
gaggaaaucucagaggaaaaacacaaaccaaaaaaggggggcagaa

SEQ ID NO: 90435 - RNA, 46 nt, Mus musculus
uaaugaacugucaaaauauaaaauuuuagacaauuagagcugagga

SEQ ID NO: 90436 - RNA, 46 nt, Mus musculus
ucugcucuuaaagccaggucauggacuuucaagcauucuccaagau

SEQ ID NO: 90437 - RNA, 26 nt, Mus musculus
aaagggggaaaacaaaaggcuuaaaa

SEQ ID NO: 90438 - RNA, 77 nt, Mus musculus
ugucauugucaugaagaccuaaauacgcagagcagaccucgcagacacgaaguuucugcugcuggaagcuggaagcu

SEQ ID NO: 90439 - RNA, 32 nt, Mus musculus
ucucucccucucuucucuucguuucagacguu

SEQ ID NO: 90440 - RNA, 45 nt, Mus musculus
cugucagggcuuaccuccguggcacuggggggaaacucaggccca

SEQ ID NO: 90441 - RNA, 46 nt, Mus musculus
cagggggaaguuauauauccuaccuuaaucuaucauuuguuaagag

SEQ ID NO: 90442 - RNA, 45 nt, Mus musculus
gguucacaaccauccguaacgagaucugacucccucuucuggagu

SEQ ID NO: 90443 - RNA, 42 nt, Mus musculus
agugugagagagagagagagagagagagagagaaggauguag

SEQ ID NO: 90444 - RNA, 45 nt, Mus musculus
gcugcugagcaaggcauggugagugcucuggucccacaauugagg

SEQ ID NO: 90445 - RNA, 45 nt, Mus musculus
caauggacacauacacaaaaaguaccugagaccaucagcauugag

SEQ ID NO: 90446 - RNA, 46 nt, Mus musculus
ucagaugcauagaggagacccacauggggcuggagagauggcccag

SEQ ID NO: 90447 - RNA, 45 nt, Mus musculus
agucggggcacaaaugaaacuugaacuaggaagugggaggacuua

SEQ ID NO: 90448 - RNA, 47 nt, Mus musculus; identical to SEQ ID NO: 90370

SEQ ID NO: 90449 - RNA, 42 nt, Mus musculus
cccaccuggcugcggcugcccaccuccccacccagccucacc

SEQ ID NO: 90450 - RNA, 42 nt, Mus musculus
cugcggaccgcaccgggagucaccgucgacagcaggccuaca

SEQ ID NO: 90451 - RNA, 45 nt, Mus musculus
agaaaguacucccugcuaccuucugauagucugcuuaccccucug

SEQ ID NO: 90452 - RNA, 46 nt, Mus musculus
ugcagucugcauacauagcaagauucugucucaaacaaggaggggc

SEQ ID NO: 90453 - RNA, 44 nt, Mus musculus
uaagugcaucugaaaccccucaaguuggaggagccaagcuaaga

SEQ ID NO: 90454 - RNA, 45 nt, Mus musculus
cauagugucugagaugacaguggaaaugugguaagggagcugcca

SEQ ID NO: 90455 - RNA, 54 nt, Mus musculus
uggaaggcagaggcauggggaacagugacugaucagaggaugggaaagcccagu

SEQ ID NO: 90456 - RNA, 46 nt, Mus musculus
gcuugaaccguuacucccaucuuccagucuuauaaguccccaaaga

SEQ ID NO: 90457 - RNA, 49 nt, Mus musculus
cacauccaccaacuugaccaugaccuuuaacaaccagcugaccacuguc

SEQ ID NO: 90458 - RNA, 23 nt, Mus musculus
gagcaaaaguggccauagaaaca

SEQ ID NO: 90459 - RNA, 45 nt, Mus musculus
cauaaaguguaucuuuuaagucaguucuuuuccauagcaguuagu

SEQ ID NO: 90460 - RNA, 45 nt, Mus musculus
agaguuaugauaauaguuauagucaaaugcaccagaaggguaggg

SEQ ID NO: 90461 - RNA, 29 nt, Mus musculus
aaacuuguugggcagguugaaagauaaag

SEQ ID NO: 90462 - RNA, 45 nt, Mus musculus
ugcagcaguuaaaggacugagaagcaggugaauggcugguuggac

SEQ ID NO: 90463 - RNA, 38 nt, Mus musculus
acccaagaauauaaccugugaagggugagggaaaagau

SEQ ID NO: 90464 - RNA, 42 nt, Mus musculus
gccuacuaugcuuguaccaagggcaacacuuaaaggcccaga

SEQ ID NO: 90465 - RNA, 45 nt, Mus musculus
cagcacacaggaccauggcgggcagucuacccucuggcaccugag

SEQ ID NO: 90466 - RNA, 46 nt, Mus musculus
gggagccuggggcggaaggaaggugagcuaguguggauggacagag

SEQ ID NO: 90467 - RNA, 38 nt, Mus musculus
ucugaguacagcgagagccacugagggcuuugaaacac

SEQ ID NO: 90468 - RNA, 45 nt, Mus musculus
aaaugagacccagaccauauucuuagagauuuaaaaagagacaga

SEQ ID NO: 90469 - RNA, 46 nt, Mus musculus
ggacagaaacaaccuccauggaaugugcccucaagccuccuaaauc

SEQ ID NO: 90470 - RNA, 46 nt, Mus musculus
cuacaagccuggaggauagugaccagugugaggacugugcccaaag

SEQ ID NO: 90471 - RNA, 23 nt, Mus musculus
uaauaucucuguuggcuccuucc

SEQ ID NO: 90472 - RNA, 46 nt, Mus musculus
uugugggguuccuucaaagaugaaggaaggcuaaagcaguguguca

SEQ ID NO: 90473 - RNA, 46 nt, Mus musculus
ugagggauguuucaaaagcaaagggguacagaugaaguucaguugg

SEQ ID NO: 90474 - RNA, 64 nt, Mus musculus
uaaauagaacuuggauuuccugugauaagcaaguugaugcuugaggaaggaaguagggcaguga

SEQ ID NO: 90475 - RNA, 56 nt, Mus musculus
aggccaugcagugacugcuagaaggaaauguaaaauucugucauuagaggaaggga

SEQ ID NO: 90476 - RNA, 36 nt, Mus musculus
gcacuugggaauccuguggaguaucggcauuaaggc

SEQ ID NO: 90477 - RNA, 45 nt, Mus musculus
aagccaccuucaccuguaggugcagucuggacuugaggaaccagu

SEQ ID NO: 90478 - RNA, 42 nt, Mus musculus
agccauggugaacuuccuaucaugcgcccaaagaccacaggu

SEQ ID NO: 90479 - RNA, 41 nt, Mus musculus
aauuaugaagcacauuauaagauucgggaagaggagcugag

SEQ ID NO: 90480 - RNA, 62 nt, Mus musculus
cuagagccugacccugugagggggaggugaagggagaggggggagccagaccaaaggccucg

SEQ ID NO: 90481 - RNA, 46 nt, Mus musculus
cugaauucugagaagguaguugugggcuaaagagauuaacucagag

SEQ ID NO: 90482 - RNA, 46 nt, Mus musculus
uauuuuaugccuuguggaacauuauugacaauggagaaaauuguag

SEQ ID NO: 90483 - RNA, 27 nt, Mus musculus
acaaaggacccaggagugguguuacac

SEQ ID NO: 90484 - RNA, 42 nt, Mus musculus
accaggaacucuccuuuccuguucaucucaaucccggcugug

SEQ ID NO: 90485 - RNA, 49 nt, Mus musculus
ugggggaaaaucguaggaggcuuucacacacugaaauaaagaaugacug

SEQ ID NO: 90486 - RNA, 44 nt, Mus musculus
cacaccuaugcacacgugcuaacauauaucaaaaauagcagaaa

SEQ ID NO: 90487 - RNA, 46 nt, Mus musculus
cccccucucucccucugaggcagacugcucaguggugccugcagau

SEQ ID NO: 90488 - RNA, 80 nt, Mus musculus
cuguguggugcugggguggacucuggguccugcacaugcccagugugucucccaaugcccugcacucccagcccagcccc

SEQ ID NO: 90489 - RNA, 108 nt, Mus musculus
gaauacuacagauuucugaccauuuuccuguucagucacugacauaaagggaaaacacaaaacauaggaagguaggggaaacaaacccccgcuuuuguaauaaacguc

SEQ ID NO: 90490 - RNA, 75 nt, Mus musculus
agacuaugaauucuauaagaaucaauacuuuaaggucauucuguacauacauuuuaaauuauguaaacuaggagg

SEQ ID NO: 90491 - RNA, 50 nt, Mus musculus
gaaucauguuaguggauuguuagggccugaggccugcccuuuagaagauu

SEQ ID NO: 90492 - RNA, 46 nt, Mus musculus
cugucacagccgcagccagguuccugaaguucccucagcagaagau

SEQ ID NO: 90493 - RNA, 52 nt, Mus musculus
ugucaggcauccuacaacacugccagcuaccccagacacaggcaaggaaggg

SEQ ID NO: 90494 - RNA, 41 nt, Mus musculus
ucaguaaaaguccgagcugcacacaccugauaacccgagcu

SEQ ID NO: 90495 - RNA, 45 nt, Mus musculus
gguccauuugugggcuagggaugcagcauauuugaggccccagag

SEQ ID NO: 90496 - RNA, 45 nt, Mus musculus
gguaggcuuguggguacugugauuuacagggcuuguguuaugggu

SEQ ID NO: 90497 - RNA, 45 nt, Mus musculus
uccaggaugcccuugaguuccugauccaccuugcacgugcuggga

SEQ ID NO: 90498 - RNA, 46 nt, Mus musculus
cuguacaauaaaugguugacaugcuuaggauauuugacuguauaau

SEQ ID NO: 90499 - RNA, 42 nt, Mus musculus
guggcccgguugucugugccaccccccacacugccccccacc

SEQ ID NO: 90500 - RNA, 45 nt, Mus musculus
cugucacggggaucgucgauggaacagggaguauuggugcugcug

SEQ ID NO: 90501 - RNA, 46 nt, Mus musculus
gcagaauagcuagauuuuuuuucucucaugccaaaacugggaaaua

SEQ ID NO: 90502 - RNA, 46 nt, Mus musculus
uucaguucuucaugcuuuaaguucaaaugaggaaauccaggggaau

SEQ ID NO: 90503 - RNA, 45 nt, Mus musculus
aucauacuucuguaucuuccacaguuaaaggcaucuuggugcaga

SEQ ID NO: 90504 - RNA, 46 nt, Mus musculus
aauaauaaacccuuaggcaagaccaacagauuauacacuguggccu

SEQ ID NO: 90505 - RNA, 46 nt, Mus musculus
gcuagggauugaacccuggguuaggaaauguacuauaacccuaguu

SEQ ID NO: 90506 - RNA, 49 nt, Mus musculus
ucuccagccaaggaagcaaacauagcaccuuaguguguagauugucagg

SEQ ID NO: 90507 - RNA, 41 nt, Mus musculus
uuucagggauggcuuggcuuugaagcugauuuugugagaga

SEQ ID NO: 90508 - RNA, 46 nt, Mus musculus
gauguacugucgcugucuucagacacaccagaagagggcaucagau

SEQ ID NO: 90509 - RNA, 42 nt, Mus musculus
uuaucuacaguuaccucagcauaguuuguaauagccaaagau

SEQ ID NO: 90510 - RNA, 45 nt, Mus musculus
caguccuuguucugccuuccaguguuucugugugugaaugaagua

SEQ ID NO: 90511 - RNA, 45 nt, Mus musculus
ccaaccccuaguaagggguucuuauugguugaaucaacuucuaga

SEQ ID NO: 90512 - RNA, 46 nt, Mus musculus
uuaccuccuauggcccucaugccauggccaguugacaccccuagcu

SEQ ID NO: 90513 - RNA, 46 nt, Mus musculus
aucuggagcagcaaccaucuauuucccagcacagaggaagccacuc

SEQ ID NO: 90514 - RNA, 46 nt, Mus musculus
uuuauggaaaccaggggcuuguaacaaaagaugugugcacucagga

SEQ ID NO: 90515 - RNA, 45 nt, Mus musculus
cccuaaauauuuaaugacacccuuguaagucaacuuuuuuugaga

SEQ ID NO: 90516 - RNA, 32 nt, Mus musculus
cuccucaccagcuucagccaucaccaccuugc

SEQ ID NO: 90517 - RNA, 46 nt, Mus musculus
aaaucccagcaaccacaugguggcucacaaccauccaugaggagau

SEQ ID NO: 90518 - RNA, 46 nt, Mus musculus
uagccuaagagaugaggagucaauuauuuguugccuggucauaaac

SEQ ID NO: 90519 - RNA, 40 nt, Mus musculus
uccugagugcagguucccacggacgccagaugcagcagau

SEQ ID NO: 90520 - RNA, 28 nt, Mus musculus
uauauggugcuggggaucaaacucagga

SEQ ID NO: 90521 - RNA, 46 nt, Mus musculus
cccuguuugugugugugugugugugugugugugugugugucccagu

SEQ ID NO: 90522 - RNA, 46 nt, Mus musculus
ugguggcuucuugagaggcagggagacagccaagugucuguaagga

SEQ ID NO: 90523 - RNA, 46 nt, Mus musculus
uuggggauacagggaaaaggcaagugaagaagacaggacugaagaa

SEQ ID NO: 90524 - RNA, 45 nt, Mus musculus
ccugggagaagaaaagacucuggggagauggcauguaaucuggua

SEQ ID NO: 90525 - RNA, 45 nt, Mus musculus
uuuguccacagaagaauggaggugcuguuucugagguggggaguc

SEQ ID NO: 90526 - RNA, 41 nt, Mus musculus
auuaaguucagagguaaaaagguauuuaguaaugggcuggg

SEQ ID NO: 90527 - RNA, 81 nt, Mus musculus
gaggagaaggcuuggcaggcucagggauuagagaugggugcagguagagggacggaguggagggaaggggacaaagaguag

SEQ ID NO: 90528 - RNA, 84 nt, Mus musculus
guugucugggcagcuacuuagggaggugacaucugagaaaugagccaagaaagggaggagcaagcuauugcaaagaaccaagag

SEQ ID NO: 90529 - RNA, 24 nt, Mus musculus
ucuggggacacuguggacuuagaa

SEQ ID NO: 90530 - RNA, 46 nt, Mus musculus
gacaugcuguuguugcagugauaacuggcacgauuagggcuuuguc

SEQ ID NO: 90531 - RNA, 45 nt, Mus musculus
cgugauauuuuacugaaauguuuagaggauaccuaguugccaggg

SEQ ID NO: 90532 - RNA, 44 nt, Mus musculus
aggaaaggguucaugguuuagcaagaggagggccacguuucagg

SEQ ID NO: 90533 - RNA, 45 nt, Mus musculus
cagagauccugacugccgaggaauuagcaucuccuaaaccaggca

SEQ ID NO: 90534 - RNA, 45 nt, Mus musculus
ucuaaaacagaugucagaucaucuuguuuaaacucuguugcccag

SEQ ID NO: 90535 - RNA, 45 nt, Mus musculus
gaauccuugcuggcuaaaaggcuaucugggggguaguuugguuga

SEQ ID NO: 90536 - RNA, 45 nt, Mus musculus
uaugcuuccaucaaacuaauacuucaaaaauagaaaugccgggag

SEQ ID NO: 90537 - RNA, 41 nt, Mus musculus
caucccacacaaaacugagugcgagggcgggcucacuagga

SEQ ID NO: 90538 - RNA, 42 nt, Mus musculus
auuacagcaaugagaaaauugauuaauauagcaugcaaguac

SEQ ID NO: 90539 - RNA, 46 nt, Mus musculus
acuuaugggauauuggcauaacuuuauuugaaaucaauuuggccac

SEQ ID NO: 90540 - RNA, 45 nt, Mus musculus
aggcaaaggcgugcguguguguguguguaugugugugugugugug

SEQ ID NO: 90541 - RNA, 44 nt, Mus musculus
guggcugcuggggauagggagguccuguuaacuggaaccauggg

SEQ ID NO: 90542 - RNA, 44 nt, Mus musculus
acgacguuucaugcuccugugcucuguauuuuaguguugacgaa

SEQ ID NO: 90543 - RNA, 46 nt, Mus musculus
ugcucauccuugacuuacgguuuaaaacaaaacaguggugggucua

SEQ ID NO: 90544 - RNA, 86 nt, Mus musculus
ugagucuguggcucagcucaaguguuggacugccuggaagagguggaugggugaauuguggggcgccuggagggagagagugagug

SEQ ID NO: 90545 - RNA, 45 nt, Mus musculus
ccagagagacaucuggggcauaaaaaaaucugguuuaggagagga

SEQ ID NO: 90546 - RNA, 45 nt, Mus musculus
auccuauucuacugagugguguguccaaaaaagcuuucccaugca

SEQ ID NO: 90547 - RNA, 42 nt, Mus musculus
gcgucggaacccgagagcagagggagcgguuucccugaaaag

SEQ ID NO: 90548 - RNA, 42 nt, Mus musculus
agcguccggggaacccgccuggcguccggggaucggccacgc

SEQ ID NO: 90549 - RNA, 46 nt, Mus musculus
cuaaagggugggucgguucauucguucuauuuauuagguucugcag

SEQ ID NO: 90550 - RNA, 46 nt, Mus musculus
aagguagaaguacaugaaaaagaaggaagcagagauuggugagugg

SEQ ID NO: 90551 - RNA, 45 nt, Mus musculus
ucuuuaaaacgcuucgaaaucauuggaagaaaacuacagcugggc

SEQ ID NO: 90552 - RNA, 46 nt, Mus musculus
guugaucgcagagcuauuaaaggccugaaauaauggcagcauaagg

SEQ ID NO: 90553 - RNA, 46 nt, Mus musculus
aagacugguauaauuggugaugcagaaagaagaaagucaccaagga

SEQ ID NO: 90554 - RNA, 46 nt, Mus musculus
cauuucaaaguucauuuugcaucaccccaucccccaccccaugcac

SEQ ID NO: 90555 - RNA, 41 nt, Mus musculus
uuacuagaagggcgcuguuacgccauuugacugaugggguu

SEQ ID NO: 90556 - RNA, 46 nt, Mus musculus
gugucucccugcaugggaaggcauggaggaaggaacauguggaugg

SEQ ID NO: 90557 - RNA, 45 nt, Mus musculus
auucuacuaccuuuuaggagaagcaaaacaugaaguauaaaagua

SEQ ID NO: 90558 - RNA, 45 nt, Mus musculus
auauggucuauuuucuauuugcauuuuucuacaugugguuuuuca

SEQ ID NO: 90559 - RNA, 46 nt, Mus musculus
acuggagccauuauacuuuucagggaacauuguuucuagcuuucag

SEQ ID NO: 90560 - RNA, 46 nt, Mus musculus
ugacuuuacaagucuggcuaggaauucuugggacuaggaaaugagg

SEQ ID NO: 90561 - RNA, 46 nt, Mus musculus
cuuugcaucuccaugacugcugucaaaucacacuucagcucucaaa

SEQ ID NO: 90562 - RNA, 60 nt, Mus musculus
gauacaagaguaaaaagagaacaagauacaagaguaaaaagagaacaagauacaagagua

SEQ ID NO: 90563 - RNA, 42 nt, Mus musculus
ugcauaaccguguuaggcugccaucacaaaggaguuugagag

SEQ ID NO: 90564 - RNA, 23 nt, Mus musculus
cauuaagaaagggccuggagaga

SEQ ID NO: 90565 - RNA, 47 nt, Mus musculus
gauguuuuaauacuguuuuuggugugugugugugugugugagagaga

SEQ ID NO: 90566 - RNA, 46 nt, Mus musculus
agugucacagccauguuguuugccuugccucagaauuuaccuuuau

SEQ ID NO: 90567 - RNA, 46 nt, Mus musculus
uaaauaauuuuuuaaaguaaaaucauuagaauuuuuugauguuuua

SEQ ID NO: 90568 - RNA, 48 nt, Mus musculus
auauauaauugugagccgccaugugugugcuaggauucaaaacaagau

SEQ ID NO: 90569 - RNA, 46 nt, Mus musculus
auuuugauacuuuccauuccccacuacucccacuaacucaucccag

SEQ ID NO: 90570 - RNA, 46 nt, Mus musculus
ccauuuuacccuucaccucagcugggccugcucuccccuccugccg

SEQ ID NO: 90571 - RNA, 45 nt, Mus musculus
aaaacaaaaacaaaaacaaaaacaaaacaaaacaaaaaacagccc

SEQ ID NO: 90572 - RNA, 46 nt, Mus musculus
aaauagaaacagaagggauacuaccuaacucauucuaugaagccac

SEQ ID NO: 90573 - RNA, 46 nt, Mus musculus
guggucuuacagugacaaguuuaccaaugacgcuuugauauugcag

SEQ ID NO: 90574 - RNA, 41 nt, Mus musculus
ugagaaaauuaaauaaaacaagcaaggcuauaaucaagcac

SEQ ID NO: 90575 - RNA, 43 nt, Mus musculus
uuuccugccacaguuuauaauacuuuaguaaaaacaauaagag

SEQ ID NO: 90576 - RNA, 45 nt, Mus musculus
guugggguauuugcuuacugaccuagagauggggaauggagauga

SEQ ID NO: 90577 - RNA, 69 nt, Mus musculus
cucccaaaaaauaugugguaggcaguguuaguggacauuaggggaaguuugaagauuugguauacauag

SEQ ID NO: 90578 - RNA, 47 nt, Mus musculus
aaccagccugguuacacaggcagacacugccuccaaagucaagagga

SEQ ID NO: 90579 - RNA, 24 nt, Mus musculus
ugagggaggagggauguaguucag

SEQ ID NO: 90580 - RNA, 46 nt, Mus musculus
uagauuuaaaacauauaaaccaaucacaauuuaugugucuuguuug

SEQ ID NO: 90581 - RNA, 42 nt, Mus musculus
cuguagccaugggaggacagcaacaguguagugaugagggag

SEQ ID NO: 90582 - RNA, 45 nt, Mus musculus
cacaagauacagugugcugucucuaagaccucuccucuaccccca

SEQ ID NO: 90583 - RNA, 41 nt, Mus musculus
ggagaugguugucaggcuuugcugacaggaagaacgggcuc

SEQ ID NO: 90584 - RNA, 46 nt, Mus musculus
cauaggcuuaguuuuagaaacuuucguagguugaaacuucuggcuc

SEQ ID NO: 90585 - RNA, 41 nt, Mus musculus
ugguuuaugcaugugugugcauuuugugugagaggggccac

SEQ ID NO: 90586 - RNA, 46 nt, Mus musculus
aaaaguauagaauaagugggauaauuugucuaaucuagguggucag

SEQ ID NO: 90587 - RNA, 45 nt, Mus musculus
aaaaacaaaacagaacagaacaaaacaaaacaaaaagaaaaacaa

SEQ ID NO: 90588 - RNA, 45 nt, Mus musculus
ugagcagauagauggcuguguuuucauauacccagagcaggggag

SEQ ID NO: 90589 - RNA, 94 nt, Mus musculus
ucuaccccccccccccccccccgugugugugugugugugugugugugugugugugugugugugugagagagagagagagggagcgggcagggac

SEQ ID NO: 90590 - RNA, 42 nt, Mus musculus
gcuuuucuugcacugauucaguauuuuucuguuuacucugug

SEQ ID NO: 90591 - RNA, 46 nt, Mus musculus
cgguggaggucaaacuacugcccagaaagcugcgguucuucuguga

SEQ ID NO: 90592 - RNA, 46 nt, Mus musculus
agugggcagaugcaagucugcauaauauucugugaguuuccuauga

SEQ ID NO: 90593 - RNA, 45 nt, Mus musculus
cugaaaauccaacguuugaaugcaguguaaucucucuuccccaga

SEQ ID NO: 90594 - RNA, 46 nt, Mus musculus
aaugacacuggcuuuuggcuuuggucagcuuuugaggccucauggu

SEQ ID NO: 90595 - RNA, 45 nt, Mus musculus
ggaggaccagaggaugggagguucuaucgagccagagccuugagg

SEQ ID NO: 90596 - RNA, 46 nt, Mus musculus
caccgauauaguauagaauagaauuuauuuagggcaugggaagggg

SEQ ID NO: 90597 - RNA, 42 nt, Mus musculus
uuaccuuaguaucugcgaagagauaagugucuggguugaagc

SEQ ID NO: 90598 - RNA, 46 nt, Mus musculus
gcuggugaauugagugucagguggaggguggagguugcuuugaaag

SEQ ID NO: 90599 - RNA, 45 nt, Mus musculus
cuaggccauccucugcuacauagugcauucacuuuuuauggaaga

SEQ ID NO: 90600 - RNA, 42 nt, Mus musculus
gauaugguguugaguguagucaaaaaguaaaggcccacaacu

SEQ ID NO: 90601 - RNA, 46 nt, Mus musculus
cuguagacaccaguacacacuggguaaaguuauuucacauuuaagc

SEQ ID NO: 90602 - RNA, 45 nt, Mus musculus
aguggaaagccaauggaaacucuggaaauagacagucgcccugag

SEQ ID NO: 90603 - RNA, 48 nt, Mus musculus
ugugucuguguaugugugugugucugugugucugugugugugugucug

SEQ ID NO: 90604 - RNA, 46 nt, Mus musculus
gcuguggcuugucugucugucugucugacaagagcaacucacagaa

SEQ ID NO: 90605 - RNA, 46 nt, Mus musculus
uuggccccucacauugccuggucacuucccuuggggaucugcagag

SEQ ID NO: 90606 - RNA, 54 nt, Mus musculus
gagacauuaauggcuuucugacugcauaaugguagcugucuggugauagagucu

SEQ ID NO: 90607 - RNA, 47 nt, Mus musculus
aggaaugcucggaugcuucuuccucgauuucuccuuugagcugcuag

SEQ ID NO: 90608 - RNA, 41 nt, Mus musculus
ucgauccucgcuccggugagagccacuuagggauggaagga

SEQ ID NO: 90609 - RNA, 41 nt, Mus musculus
gcugcaagcuggaggauggguccggggcggcaguggggagg

SEQ ID NO: 90610 - RNA, 41 nt, Mus musculus
gagagagagagagagagagagagagaaagagaaaagaaaaa

SEQ ID NO: 90611 - RNA, 42 nt, Mus musculus
cuaaaaccgacacaagucuccuaaugcaguaagacugaagaa

SEQ ID NO: 90612 - RNA, 43 nt, Mus musculus
gcaggccugaaauaccaucggugacaaaguagaagcaggagga

SEQ ID NO: 90613 - RNA, 46 nt, Mus musculus
acucaguuccuuugucacgaucacagaaaauacuaaugugacagau

SEQ ID NO: 90614 - RNA, 46 nt, Mus musculus
aagcuaccauaauaacuuagcacaucagacaucaaauaggccagau

SEQ ID NO: 90615 - RNA, 46 nt, Mus musculus
cuuuagucuguagauucuaauccuggcuuucgaggugucaggacau

SEQ ID NO: 90616 - RNA, 45 nt, Mus musculus
gcagucagugcucuuacuugcugagccaucucuccagccccguca

SEQ ID NO: 90617 - RNA, 45 nt, Mus musculus
ggcaagagaggcagauggaucucuaaguuuaaggccagccugauc

SEQ ID NO: 90618 - RNA, 46 nt, Mus musculus
augucacaaauauuauauuuauuguguuuuucaaagcaggucuaug

SEQ ID NO: 90619 - RNA, 45 nt, Mus musculus
auaagacuaucaauaaagauaauccacaacagaaagauccugaag

SEQ ID NO: 90620 - RNA, 45 nt, Mus musculus
agcuuguuuuuacaaaugacaguagcuacagcaaccuccugccag

SEQ ID NO: 90621 - RNA, 46 nt, Mus musculus
auagguaagggcucuaggcaaaaucagcagguggagaaaacuccag

SEQ ID NO: 90622 - RNA, 45 nt, Mus musculus
gcucugaaccucccaauggucacuucaugcaccccuuagccccuc

SEQ ID NO: 90623 - RNA, 42 nt, Mus musculus
ggaagaugaggaggaggaggaagaggaugaagaggaagauga

SEQ ID NO: 90624 - RNA, 28 nt, Mus musculus
agcgcuaugagaagaaggcugcugagcu

SEQ ID NO: 90625 - RNA, 45 nt, Mus musculus
gggagcaggugggagaaagaagagagaaaagagagaagaggggag

SEQ ID NO: 90626 - RNA, 46 nt, Mus musculus
cgggaggucgcaguccucccugcacaggaaggggcugauggcggcu

SEQ ID NO: 90627 - RNA, 45 nt, Mus musculus
auaaacccagcuaacagcugcuguauucauuuuaauuuaaccaag

SEQ ID NO: 90628 - RNA, 46 nt, Mus musculus
gucacuccauugucaucagacuuaagcauuuuuucauacuaaauaa

SEQ ID NO: 90629 - RNA, 44 nt, Mus musculus
agcuguuagaacaccuccuagagaaggacauuaucacuuuggaa

SEQ ID NO: 90630 - RNA, 46 nt, Mus musculus
aaaaccuugucugugcauucucacucuguaaagaggaauugcaaag

SEQ ID NO: 90631 - RNA, 32 nt, Mus musculus
ccuuaggccaaagggggcaguuucagccagaa

SEQ ID NO: 90632 - RNA, 47 nt, Mus musculus
aagacuuacugcucacaacccucucagauauucagcacguacuccca

SEQ ID NO: 90633 - RNA, 32 nt, Mus musculus
agcugagaguauaaauaacuugaguagaugag

SEQ ID NO: 90634 - RNA, 45 nt, Mus musculus
ucuguauaguuaaucaaugaagauaaaauucuuaagucgcacccc

SEQ ID NO: 90635 - RNA, 46 nt, Mus musculus
uuuguuuucuuaacauguauuuauguguguugacauguguuuaggg

SEQ ID NO: 90636 - RNA, 46 nt, Mus musculus
uuucagauucauuaugcauuugauuuuaaauaagacaccugaacag

SEQ ID NO: 90637 - RNA, 48 nt, Mus musculus
auguaucugguuucuccauauaugaugucuuuguuuacaucuuagcag

SEQ ID NO: 90638 - RNA, 45 nt, Mus musculus
gccuugguguaagucucugauucuaccuccuucucugcugccagc

SEQ ID NO: 90639 - RNA, 55 nt, Mus musculus
gacaccuaaagauuauuuuuucaggcacucuguuauuauuuuuuaggacacaccu

SEQ ID NO: 90640 - RNA, 45 nt, Mus musculus
cucuugauugggaucuuuuccccuaguuucccucuuucccauugu

SEQ ID NO: 90641 - RNA, 46 nt, Mus musculus
uuagugagcaauaggucacuauggugacccaugucacacagccuga

SEQ ID NO: 90642 - RNA, 46 nt, Mus musculus
aaauuaguccauuauuuaaauucaaccucaaguuuucagaauauag

SEQ ID NO: 90643 - RNA, 29 nt, Mus musculus
gaaaugucuagcuaguauauggauuacua

SEQ ID NO: 90644 - RNA, 46 nt, Mus musculus
guuggucuuuuugcagaugagacagauagaggugucgaccagcaag

SEQ ID NO: 90645 - RNA, 46 nt, Mus musculus
uuuuagcuacagccuagaaaaugacauugugaacacaguauuauug

SEQ ID NO: 90646 - RNA, 46 nt, Mus musculus
ccuccuuaugagggcaucauguuggucucuguugugcuuacugcag

SEQ ID NO: 90647 - RNA, 41 nt, Mus musculus
gccucuaagccuaacaacuuaaguuugaucucugggcccca

SEQ ID NO: 90648 - RNA, 45 nt, Mus musculus
agaagcaggcauggaaaaucaauggaaaacagaaaugugugaaug

SEQ ID NO: 90649 - RNA, 46 nt, Mus musculus
ggggaaugcccaagaagaugggcuccaguucuaccauggacagcuu

SEQ ID NO: 90650 - RNA, 51 nt, Mus musculus
gcaguaccuggccugggucaccuucccacuuauccugauccucuucagcgc

SEQ ID NO: 90651 - RNA, 46 nt, Mus musculus
ccuuccucgaaugagacuccuuuaaggaagaacuuuugucuggcuu

SEQ ID NO: 90652 - RNA, 46 nt, Mus musculus
acaucgccagcaucugugcugcuguccucagcaaguuuauguccau

SEQ ID NO: 90653 - RNA, 46 nt, Mus musculus
uauucucuaggguaggauuugcccaaauauguuucucagagcgcag

SEQ ID NO: 90654 - RNA, 49 nt, Mus musculus
ugcugaugccacaggcauuaauugagaaagaaaugguguuagugacuag

SEQ ID NO: 90655 - RNA, 46 nt, Mus musculus
uaauuggacagaggcauggcaugggggccagagagaaaacagagca

SEQ ID NO: 90656 - RNA, 46 nt, Mus musculus
auaagcauggcgagaugcuaguaggaaaaaggaaaauucaauggaa

SEQ ID NO: 90657 - RNA, 45 nt, Mus musculus
uaccacgugccaaauacauaacucuuggccauuggcuuuuggcua

SEQ ID NO: 90658 - RNA, 46 nt, Mus musculus
auuuugaaaaguuuucuaaaaauaaaauaucuuuuaacacucacuc

SEQ ID NO: 90659 - RNA, 45 nt, Mus musculus
agaaacacauucugggcuauauuucaagcucaacaguuuauagaa

SEQ ID NO: 90660 - RNA, 45 nt, Mus musculus
uuaucuuaguauuuuucuucuuuaucuuccuucuaggagcugcau

SEQ ID NO: 90661 - RNA, 45 nt, Mus musculus
uauuugaugauaucaucuauaagaucuuaccugggggcuaugcag

SEQ ID NO: 90662 - RNA, 45 nt, Mus musculus
gcucaggucagggccauuggcuggaauuaguuuagguaugguggg

SEQ ID NO: 90663 - RNA, 46 nt, Mus musculus
uggcauccugguggucgaccugaguccuuugccuucguagaugaag

SEQ ID NO: 90664 - RNA, 41 nt, Mus musculus
gggccacugcccagccauaaacagccaccugaagccucaga

SEQ ID NO: 90665 - RNA, 46 nt, Mus musculus
auugggagugucaauaagacacagaaugaagguuggaaagaugaaa

SEQ ID NO: 90666 - RNA, 46 nt, Mus musculus
uuggcacuagaagagguaaggaugaauaggccccccuugagcagag

SEQ ID NO: 90667 - RNA, 46 nt, Mus musculus
gauuccuuucuuaacacaaggaaaagaagggagguaugugggcugg

SEQ ID NO: 90668 - RNA, 46 nt, Mus musculus
uuuucuacauuuuuauaacuucuuggggacucaggguugagcagag

SEQ ID NO: 90669 - RNA, 45 nt, Mus musculus
gugggagaugagccauggcuauggcucuuggguccaugcccaggu

SEQ ID NO: 90670 - RNA, 48 nt, Mus musculus
cugggcucgcacuccagaaacccgucauuccaggaacugagacccaga

SEQ ID NO: 90671 - RNA, 46 nt, Mus musculus
gaggacaugagugucaauucuacccaggagccacuggacugcaacu

SEQ ID NO: 90672 - RNA, 42 nt, Mus musculus
aaagacuccccaagggagcaucagguaaaugcggguccccag

SEQ ID NO: 90673 - RNA, 45 nt, Mus musculus
auccugucagcagguaucaagaagauacccaagaagagggguagg

SEQ ID NO: 90674 - RNA, 45 nt, Mus musculus
aggagggucuccauggaaauaaaccgggucucagaaaucaggcuu

SEQ ID NO: 90675 - RNA, 44 nt, Mus musculus
ccccgccccagagggaaaaugcacgugaacaaagcaaaucgggg

SEQ ID NO: 90676 - RNA, 45 nt, Mus musculus
ugguugggggcaaaacacacaugccauauggagaagagggugaag

SEQ ID NO: 90677 - RNA, 41 nt, Mus musculus
agggaaaguaaaggcgcgaggcagggccgggcgggcgcgga

SEQ ID NO: 90678 - RNA, 45 nt, Mus musculus
ugcuauaaauuagacccucaaaagaauaucuaccaagcauuugga

SEQ ID NO: 90679 - RNA, 45 nt, Mus musculus
uugaucaguugaugcacaaaacuauagcugaauuaguugagagaa

SEQ ID NO: 90680 - RNA, 57 nt, Mus musculus
ggauuucaaagucucguggaguaugagaagagacugauugggcacuggcaguaggua

SEQ ID NO: 90681 - RNA, 55 nt, Mus musculus
cacuacccugggcucugugaagaauaugccagaguagcacugaggagaugggaca

SEQ ID NO: 90682 - RNA, 47 nt, Mus musculus
cuuuccauauauauguggaagaaaguccaaaaaagaaaaggaaagaa

SEQ ID NO: 90683 - RNA, 47 nt, Mus musculus
aaacuuuuguucccagaauuccauauaguacagacugucaagaguaa

SEQ ID NO: 90684 - RNA, 47 nt, Mus musculus
aaaguggaaacaggagggcuagaaggaacauguugaaagugcccagg

SEQ ID NO: 90685 - RNA, 46 nt, Mus musculus
cagaaggcagcacagaaagccuggacagugagagaauaagaaagac

SEQ ID NO: 90686 - RNA, 53 nt, Mus musculus
aggagacuaaaagcauuugguuggagaagaucucaacaaauuucaggaagaga

SEQ ID NO: 90687 - RNA, 46 nt, Mus musculus
guugggagccauuuauucgucucuucaccgaguacagaaaccagac

SEQ ID NO: 90688 - RNA, 56 nt, Mus musculus
gguccugggcauaccccgaagccgugccaauauugcgcuauggccuccaguucggg

SEQ ID NO: 90689 - RNA, 42 nt, Mus musculus
aucacaggagaguaugaaagggaagucaaaucagagccagaa

SEQ ID NO: 90690 - RNA, 46 nt, Mus musculus
uagggaaagaaaaacagaaaagcccucugggccaaagucaggagaa

SEQ ID NO: 90691 - RNA, 42 nt, Mus musculus
agaggcuucauuuccuauaauggugaaugacgugggccaggu

SEQ ID NO: 90692 - RNA, 46 nt, Mus musculus
uaaugcuccaaaccgagguuaauaugacuagagaugaggccaaggu

SEQ ID NO: 90693 - RNA, 45 nt, Mus musculus
ccaaacuggguuccucccucgcagugugcugguagauugucagug

SEQ ID NO: 90694 - RNA, 45 nt, Mus musculus
gugcaacaagaugucauuugguguacaauggagugucuagggaga

SEQ ID NO: 90695 - RNA, 46 nt, Mus musculus
uaaaaacaucuucccauaaaaaaaaagaacaagaaucagcccaucu

SEQ ID NO: 90696 - RNA, 45 nt, Mus musculus
ucuugggcugucugaauguuuauuuugucagauauucacacaguu

SEQ ID NO: 90697 - RNA, 46 nt, Mus musculus
ggcauucauaguauuuauuuuggaagaaaaucuauuaaaaggagau

SEQ ID NO: 90698 - RNA, 23 nt, Mus musculus
aaccagcccuuccaccuccaacc

SEQ ID NO: 90699 - RNA, 61 nt, Mus musculus
ucauuuuuguguguguguguguacaguuugagauuacuuauguuggggaagucacagcagc

SEQ ID NO: 90700 - RNA, 46 nt, Mus musculus
cuccugcucuggggaucccucuucugacuugcacgagcacucaaau

SEQ ID NO: 90701 - RNA, 46 nt, Mus musculus
cuugggaucucccugauuugggccaggcaugucuuucucugcagug

SEQ ID NO: 90702 - RNA, 42 nt, Mus musculus
gggccacagucccugcuuagccuccuuuacccgcccccaggu

SEQ ID NO: 90703 - RNA, 41 nt, Mus musculus
acugccagaaggguggggugcuucgcggggaagggggcagg

SEQ ID NO: 90704 - RNA, 46 nt, Mus musculus
aaugucaacgauggccaggugagacagaaagaaguacaugggagug

SEQ ID NO: 90705 - RNA, 42 nt, Mus musculus
ccauaaaagaguccaacaacacagagaugagaggagcaagug

SEQ ID NO: 90706 - RNA, 46 nt, Mus musculus
gcagaucauugcaaggauagucccauuccccaguauggugagagua

SEQ ID NO: 90707 - RNA, 41 nt, Mus musculus
ugcaggcauaggccauaucgacaauggccaggugggacagg

SEQ ID NO: 90708 - RNA, 42 nt, Mus musculus
cugcgucucuccccugacugaauccucaggauugccaccagg

SEQ ID NO: 90709 - RNA, 46 nt, Mus musculus
aaaguuccugucauuagguaaaggugugugugugugugugugugug

SEQ ID NO: 90710 - RNA, 45 nt, Mus musculus
gucuuuucuguagauagccucuguuugccaccauguuccagaguu

SEQ ID NO: 90711 - RNA, 55 nt, Mus musculus
gagaggaguaaggaaguguaugaagcauaauguggccuugaagugaccuuuagua

SEQ ID NO: 90712 - RNA, 53 nt, Mus musculus
auacagaucccucugaagaaguccugccuaaaccucauugugcuauacuggga

SEQ ID NO: 90713 - RNA, 41 nt, Mus musculus
caauagccuguugccaugguuaaaggcugugguguuggugu

SEQ ID NO: 90714 - RNA, 41 nt, Mus musculus
cucagugaaaggcacuucaguggggucuuaagugggggaga

SEQ ID NO: 90715 - RNA, 55 nt, Mus musculus; identical to SEQ ID NO: 90711

SEQ ID NO: 90716 - RNA, 53 nt, Mus musculus; identical to SEQ ID NO: 90712

SEQ ID NO: 90717 - RNA, 41 nt, Mus musculus; identical to SEQ ID NO: 90713

SEQ ID NO: 90718 - RNA, 41 nt, Mus musculus; identical to SEQ ID NO: 90714

SEQ ID NO: 90719 - RNA, 42 nt, Mus musculus
cucuggaggguaccagagcuagguggauacauggacccaggg

SEQ ID NO: 90720 - RNA, 45 nt, Mus musculus
acuucuaucuccaaacacauuuacauuacgauucauagcagcaaa

SEQ ID NO: 90721 - RNA, 48 nt, Mus musculus
aacuagaacaccacagagauucuuucuaaugcaccauuucggggcaga

SEQ ID NO: 90722 - RNA, 46 nt, Mus musculus
aacuagcaagggaagauuuucaguuagcucaucaucugggccaaag

SEQ ID NO: 90723 - RNA, 45 nt, Mus musculus
gccacuucggacuucucguggagaccgagccgaggcugggggcuc

SEQ ID NO: 90724 - RNA, 46 nt, Mus musculus
auuccgcucguccggcaggacccggcucggcguuugggaagcagag

SEQ ID NO: 90725 - RNA, 41 nt, Mus musculus
cgugccccucccgcgccgccgcaggcccggcgauggcggcg

SEQ ID NO: 90726 - RNA, 41 nt, Mus musculus
uggugcaggcggcggcggcggcggcgggaggaggagggccg

SEQ ID NO: 90727 - RNA, 41 nt, Mus musculus
agcuccaggcggggcagcccgggcgcugagggacgcggcca

SEQ ID NO: 90728 - RNA, 42 nt, Mus musculus
uaaucaugccccgcaccgucgcaacaaugagugcccccggau

SEQ ID NO: 90729 - RNA, 46 nt, Mus musculus
aucaguuuucugugaaagauccuuuaaauuagaaauacuaugggag

SEQ ID NO: 90730 - RNA, 48 nt, Mus musculus
ucuggucauacuagaaggggagguuugggauccugcaugagcaugagg

SEQ ID NO: 90731 - RNA, 51 nt, Mus musculus
aucagaucccaggcuuaccuuuaggaaguaugagacugguuugggagagag

SEQ ID NO: 90732 - RNA, 48 nt, Mus musculus
uggcugcugcuccucagcuuucuccuucuuguaauuaaaugccuuaua

SEQ ID NO: 90733 - RNA, 70 nt, Mus musculus
cagaaagaaguaggucacuauuaucaggggccccaaaacauacagaaagaagaaaacucauaaccggugg

SEQ ID NO: 90734 - RNA, 46 nt, Mus musculus
gcuuuguacauguuuuguacauaauugacuuugccuuguacagaga

SEQ ID NO: 90735 - RNA, 63 nt, Mus musculus
augcuuagucacuggguuguggcacuauuugaaaaggauuagaaggauugugagguauggcuu

SEQ ID NO: 90736 - RNA, 42 nt, Mus musculus
cuggaagagcaacaaguguucuuaaccagugagcuagcccau

SEQ ID NO: 90737 - RNA, 46 nt, Mus musculus
accuaucuccagacacuuacuuuagucaaugacuuuuuccaaacag

SEQ ID NO: 90738 - RNA, 46 nt, Mus musculus
aagacccuuuaucuccauucuugcaucaugccucuucacguaacuu

SEQ ID NO: 90739 - RNA, 46 nt, Mus musculus
uuuaaaaaagauuuacuuuuauuuauuucaaauuauguguguguag

SEQ ID NO: 90740 - RNA, 48 nt, Mus musculus
uucuuggaaauuguauuuuugcuuguuuguuacagggcaagguuuuaa

SEQ ID NO: 90741 - RNA, 46 nt, Mus musculus
uuguuucuguaaaugaacaaaacaacucauaaaaauuuaaagcuag

SEQ ID NO: 90742 - RNA, 45 nt, Mus musculus
augagauuuugcaaugaacuucccuucauuuuuguuuguguccug

SEQ ID NO: 90743 - RNA, 46 nt, Mus musculus
gagguauugcuggcuucuuugagccaaguauacagagaacugucag

SEQ ID NO: 90744 - RNA, 47 nt, Mus musculus
uaguuuauaguuuaaauguuuuauaaauuuuauagaaaagaaaugaa

SEQ ID NO: 90745 - RNA, 42 nt, Mus musculus
uaguacucaaagccaaugugauuuuuauccuaaaggccccag

SEQ ID NO: 90746 - RNA, 46 nt, Mus musculus
gggugcgagcacuuugagugccaaggaagauauguuugggugucag

SEQ ID NO: 90747 - RNA, 42 nt, Mus musculus
agcauccacuuauguguuugccaagcauuggcauagccucac

SEQ ID NO: 90748 - RNA, 46 nt, Mus musculus
uaccucacucaggaugauaucuaccagguccauccauuuggcuaag

SEQ ID NO: 90749 - RNA, 45 nt, Mus musculus
ucuggaaaaaacaaaaacaaaacaaacaaacaaaaauccugccaa

SEQ ID NO: 90750 - RNA, 46 nt, Mus musculus
uguuacauucauuuguuucauaacuucuguuaguuucacuguguua

SEQ ID NO: 90751 - RNA, 46 nt, Mus musculus
uauucuuagguuuggccuucucauuguguccuggauuuccuggcug

SEQ ID NO: 90752 - RNA, 46 nt, Mus musculus
ggucuuggucucagcuccgccuccuagcugaggaugaaggccagaa

SEQ ID NO: 90753 - RNA, 46 nt, Mus musculus
acuuuugaccaagagauagaaaauaauuuaucgaguaaugcccagg

SEQ ID NO: 90754 - RNA, 46 nt, Mus musculus
agugagugagaaacugugccuguuugagguauaugguagagagcag

SEQ ID NO: 90755 - RNA, 45 nt, Mus musculus
gcuuuggcuucagcaacagcaucugguaaauguuuuuagucucag

SEQ ID NO: 90756 - RNA, 46 nt, Mus musculus
ucugugacuuguggcaguacuugguuggugauguuuugugccuuag

SEQ ID NO: 90757 - RNA, 45 nt, Mus musculus
gacuuuacucucuacacuuaaagaacauucuuucugagcugcugu

SEQ ID NO: 90758 - RNA, 45 nt, Mus musculus
agggucaucaggaggucaagaacauccucaacauagcgaggucca

SEQ ID NO: 90759 - RNA, 45 nt, Mus musculus
gaggaggaggaagaagaggaggaggaagaggaagaagaugaagaa

SEQ ID NO: 90760 - RNA, 46 nt, Mus musculus
caauuaggaauugaaucuccacacccccaugccccuucucuggcag

SEQ ID NO: 90761 - RNA, 45 nt, Mus musculus
auuauuuuaguugguuguuuaauuuguguaaguaugugcgugcau

SEQ ID NO: 90762 - RNA, 46 nt, Mus musculus
uuauccuuaaugucauuuauuaaguaaucuuuuacgcacugauuuu

SEQ ID NO: 90763 - RNA, 46 nt, Mus musculus
uaguauacuguaaaaacaucaaacaauccuacuaauagagaggcug

SEQ ID NO: 90764 - RNA, 45 nt, Mus musculus
uuuagagugaagauucccaacuuuaggugguuuuguucguguccu

SEQ ID NO: 90765 - RNA, 78 nt, Mus musculus
uaacuacuguacuagugugcaucaguccaaccaagcccggggugcuggagucccuccuuccaagucaaaaaaggggca

SEQ ID NO: 90766 - RNA, 61 nt, Mus musculus
cugaauggaaucugugccuaccucaauagacauuggguucgccgugaaugugaugaaggac

SEQ ID NO: 90767 - RNA, 45 nt, Mus musculus
aauaguguagccacuguuuggaaaugcagccauaaauucuagcag

SEQ ID NO: 90768 - RNA, 45 nt, Mus musculus
gcuggucucucagugagagaguuugucucaagggaauagggugga

SEQ ID NO: 90769 - RNA, 67 nt, Mus musculus
guucuuaauuuauguacaagaaacugcauuuaaaaugcacaaucaagauuggaagauuuuuauaauu

SEQ ID NO: 90770 - RNA, 62 nt, Mus musculus
ucuaaaauguaucuugauauguuaggaaacugagaguaacuagaauuaguuuuagcaggugu

SEQ ID NO: 90771 - RNA, 46 nt, Mus musculus
auauucaauacaucuuuuccccuuuuucauccagcuugcauuggug

SEQ ID NO: 90772 - RNA, 68 nt, Mus musculus
aaugcuguuuuaaaguugauugaaaaggaaagaaauggagaaaccaucaauacaagacugauuagugg

SEQ ID NO: 90773 - RNA, 46 nt, Mus musculus
ugaaucucaauuuuuggcugacacagagagauuuuauaccagagaa

SEQ ID NO: 90774 - RNA, 46 nt, Mus musculus
uggaaauuuuucacacagaguuucagaauuuauuggaugcugacaa

SEQ ID NO: 90775 - RNA, 46 nt, Mus musculus
gagaggcuguaagcacuuuguuaaaacaagaugaaaugauagugag

SEQ ID NO: 90776 - RNA, 42 nt, Mus musculus
auuuucuuuugucugaagggucccugucgcccacaccccgag

SEQ ID NO: 90777 - RNA, 51 nt, Mus musculus
uaaauccccugagcugcuugcucgguacugugacuccuugcugaagaaaag

SEQ ID NO: 90778 - RNA, 41 nt, Mus musculus
uaaacaccuugcccuuuuaaauuucaguuccaagaacccag

SEQ ID NO: 90779 - RNA, 46 nt, Mus musculus
cuguguacauguauguauauguacuacaugugugcuugugccugag

SEQ ID NO: 90780 - RNA, 46 nt, Mus musculus
acccuguuuaggguucuucuguuccauguagcccuuccuuggccag

SEQ ID NO: 90781 - RNA, 93 nt, Mus musculus
uggggacucagaagucuuaaaaaucuagaucuuguuuuugaagcaggcucuccuggcucucagucaaccacuguuuggcccauuacucacagg

SEQ ID NO: 90782 - RNA, 68 nt, Mus musculus
auaccuccacaccagagguuuaaacuucagcaggcacauucuaaaaaaagacaguuuagugguagaau

SEQ ID NO: 90783 - RNA, 46 nt, Mus musculus
gucauugacagcccaggcuagccucuuccugcugaguacggugcuu

SEQ ID NO: 90784 - RNA, 44 nt, Mus musculus
cuuuuagaacauaaaacuuuaaucuguauauauuuaugccauaa

SEQ ID NO: 90785 - RNA, 46 nt, Mus musculus
acuuccaaacuucagcgaauguuucaagacauugguguaagcaaag

SEQ ID NO: 90786 - RNA, 45 nt, Mus musculus
gaguacugagugcucauagcagggcucuuugggcucuugguagca

SEQ ID NO: 90787 - RNA, 45 nt, Mus musculus
ggaucguggcccuuucagcagucuugcacguuugccuugccguca

SEQ ID NO: 90788 - RNA, 46 nt, Mus musculus
aaaacuuacuucauuccuugaaaaggucucaguagugagcugguaa

SEQ ID NO: 90789 - RNA, 46 nt, Mus musculus
auguuguggaaagggggagaggacauggguuucuuuggcuuacuag

SEQ ID NO: 90790 - RNA, 60 nt, Mus musculus
uuuuaaacccagucagucacugucugucucugucucuaucucugugugugugugugugug

SEQ ID NO: 90791 - RNA, 46 nt, Mus musculus
acugaacagaagcaggaacaagaaacuacacacaaaaauauagagg

SEQ ID NO: 90792 - RNA, 48 nt, Mus musculus
ucaacuuuuuauugccuucucaccagcugcaaaguguuuuguaccagu

SEQ ID NO: 90793 - RNA, 50 nt, Mus musculus
ucuacuaccucuuccccuucucucugaaacagcugccuuagcuucaggaa

SEQ ID NO: 90794 - RNA, 46 nt, Mus musculus
ggucaccauuaaccaucauaacugcaaagagaaacauuggcagcag

SEQ ID NO: 90795 - RNA, 45 nt, Mus musculus
aaaauucguuuugcuaaucauucaguaaauccaaacugcuaugca

SEQ ID NO: 90796 - RNA, 45 nt, Mus musculus
aagcagacagaagaggaaaaguguaugacaaauacaugugcagcu

SEQ ID NO: 90797 - RNA, 69 nt, Mus musculus
caggcuggggcaucuuuaucaaagauccuguacagaaaaaugaauucaucucagaauacuguggggagg

SEQ ID NO: 90798 - RNA, 46 nt, Mus musculus
agcauguggugggcaauaguagcucaauccacagcacacaggaggc

SEQ ID NO: 90799 - RNA, 46 nt, Mus musculus
uggagcuguuucguuucaguuagacuggcuggcagugaagucccag

SEQ ID NO: 90800 - RNA, 46 nt, Mus musculus
gugcuaagggcucuaacaaauaaaagaauguacuuugggaaacaga

SEQ ID NO: 90801 - RNA, 46 nt, Mus musculus
ucuaucacgaaagacacacagacaaaacaaaacaaaaaucuaagua

SEQ ID NO: 90802 - RNA, 46 nt, Mus musculus
ucuagaguucugguaacacaggcauguaccacacaccuggccuguu

SEQ ID NO: 90803 - RNA, 45 nt, Mus musculus
cccauacccacccccaacucuccuacccacccauucccacuuuuu

SEQ ID NO: 90804 - RNA, 46 nt, Mus musculus
acuuauuuuuggcuggccucagacuucuaaguaaaagcucgcagug

SEQ ID NO: 90805 - RNA, 46 nt, Mus musculus
uacauuuccaaugcuauccaaaaaguccccaauacacacccccccc

SEQ ID NO: 90806 - RNA, 42 nt, Mus musculus
ugaaugcuacaguucuuacaggauacauuuuuacugucccaa

SEQ ID NO: 90807 - RNA, 46 nt, Mus musculus
cccugaccucugucucacguguggagcugcugaccauugggacagu

SEQ ID NO: 90808 - RNA, 45 nt, Mus musculus
accgcuuuccuggaugucggugcaaagcacaaugcaacaccaaac

SEQ ID NO: 90809 - RNA, 45 nt, Mus musculus
uagugagaguuaaguggguuuugguuuucagaaugaagggaagua

SEQ ID NO: 90810 - RNA, 47 nt, Mus musculus
cauguuuacaacuaucaacccugugaccauccacggcagccuuguga

SEQ ID NO: 90811 - RNA, 46 nt, Mus musculus
gugggcugcacacugcagaaagauacaacugaaaaagggucagcau

SEQ ID NO: 90812 - RNA, 46 nt, Mus musculus
auuggguuaccuaacuaaggaugauauacuccaguuaccuccauuu

SEQ ID NO: 90813 - RNA, 46 nt, Mus musculus
ccuguucccacugaggauguagacacuccuccaagaaagaagaaaa

SEQ ID NO: 90814 - RNA, 42 nt, Mus musculus
caaacuggagaaauguuuuugucucucccaucacacugccag

SEQ ID NO: 90815 - RNA, 69 nt, Mus musculus
aagccuccauguuuagaguccucauugguacuuacuacgauaacuuuugugccauugcuaggcuaauug

SEQ ID NO: 90816 - RNA, 75 nt, Mus musculus
auucucggugucaaacaccaauaaagaugaagccaaauauugaaccuccugagaauguggaguggaguggugcug

SEQ ID NO: 90817 - RNA, 46 nt, Mus musculus
uguucucuccaggacccuugccuuucuccccuuuuguggcuaagau

SEQ ID NO: 90818 - RNA, 53 nt, Mus musculus
ugacagagaagcagggacugaaacugggggagagaacaaugauaaagaagaag

SEQ ID NO: 90819 - RNA, 43 nt, Mus musculus
acugucuguauccuuugacuccagcacacugauggugggggug

SEQ ID NO: 90820 - RNA, 46 nt, Mus musculus
gcugagcguauaaagacaccaccuaaacgcccagggggccgcagaa

SEQ ID NO: 90821 - RNA, 50 nt, Mus musculus
gguggugucuuuauacgcucagcaguaagagcagcagcaaacuccuuagc

SEQ ID NO: 90822 - RNA, 46 nt, Mus musculus
auuggccauaugacaggcaguguucuuauccuuguuucuuucagag

SEQ ID NO: 90823 - RNA, 41 nt, Mus musculus
caacaagccuuguggaccacaguguuaccagcaucugguga

SEQ ID NO: 90824 - RNA, 45 nt, Mus musculus
caaagcuguuucuguguucuuccucuuauauguguuggguguugc

SEQ ID NO: 90825 - RNA, 45 nt, Mus musculus
agcaacuugcugucaguuaccacaaccaaaauguaccggccaauc

SEQ ID NO: 90826 - RNA, 46 nt, Mus musculus
acugcacuuacgauguaggaagcagucauacuuaaaacaucgucga

SEQ ID NO: 90827 - RNA, 60 nt, Mus musculus
uccugaauguacuccaaacaucgauggaccaaaugccaaaucuguucagagggagcaaag

SEQ ID NO: 90828 - RNA, 54 nt, Mus musculus
uuuggcauuugguccaucgauguuuggaguacauucaggaggcagagcaccugg

SEQ ID NO: 90829 - RNA, 49 nt, Mus musculus
uauuugaagccauuuccucaauguuuccagauaagggcaccgcagaaga

SEQ ID NO: 90830 - RNA, 44 nt, Mus musculus
uucuucugcggugcccuuaucuggaaacauugaggaaauggcuu

SEQ ID NO: 90831 - RNA, 42 nt, Mus musculus
acagcaucucaacaaagcugauuuucuaagaacuuguccccu

SEQ ID NO: 90832 - RNA, 46 nt, Mus musculus
uagaaucugagccccaaguugaugaccuaggucugaccugagagcu

SEQ ID NO: 90833 - RNA, 46 nt, Mus musculus
ccccuuuuuguuaaguguaugaucaaauauauuuucugcagcauuu

SEQ ID NO: 90834 - RNA, 70 nt, Mus musculus
uggucaauauaaugaugaugaugaugacgaugauggagaugauccagaugaaagagaagaaaaacagaaa

SEQ ID NO: 90835 - RNA, 46 nt, Mus musculus
gaucaucuccaucaucgucaucaucaucaucauuauauugaccaag

SEQ ID NO: 90836 - RNA, 45 nt, Mus musculus
uucaaaccuguuuugcauuaugauaugaccacaucuccguuugcu

SEQ ID NO: 90837 - RNA, 46 nt, Mus musculus
guuuuuccauuugaggaucuuauuugccacuugguaaucaucagua

SEQ ID NO: 90838 - RNA, 45 nt, Mus musculus
augauuaggaagugugguagcguugggguagguguagccuugcua

SEQ ID NO: 90839 - RNA, 46 nt, Mus musculus
aacaguucauauuuauuuacaggcuguaauccuauauuuggcagau

SEQ ID NO: 90840 - RNA, 42 nt, Mus musculus
uggcaguaagcgugguggcccgcaggcaaguauggugcugga

SEQ ID NO: 90841 - RNA, 60 nt, Mus musculus
ggauggcacuuucauugaagaacuaauaaaaaauuaugauggaaaagugcauggugacag

SEQ ID NO: 90842 - RNA, 48 nt, Mus musculus
uccaucauaauuuuuuauuaguucuucaaugaaagugccauccugauc

SEQ ID NO: 90843 - RNA, 46 nt, Mus musculus
aacuguucaaauacauaagccuauagaggguguuucucauucagau

SEQ ID NO: 90844 - RNA, 46 nt, Mus musculus
uguagaguauuuugauuuuacaaguauaaauccuuuuggcauagaa

SEQ ID NO: 90845 - RNA, 46 nt, Mus musculus
ucggugccuauaauguacucuuggucgcccuuacaacagaauuuua

SEQ ID NO: 90846 - RNA, 54 nt, Mus musculus
uucagggucuuuaacgggaugacuugugcuggaaaauccaagucacuggugacu

SEQ ID NO: 90847 - RNA, 42 nt, Mus musculus
agacugaauaaauuacaaauaaaauucaggucccagccucag

SEQ ID NO: 90848 - RNA, 46 nt, Mus musculus
aucacacauucuccuauucaaaacgccauguguacugccugaaguu

SEQ ID NO: 90849 - RNA, 42 nt, Mus musculus
cacccauuuggagaaaucucucuacauacuuaguccccagau

SEQ ID NO: 90850 - RNA, 52 nt, Mus musculus
augaaauaccaagaugguggcuauggcauucuguaaguccacagaugauagu

SEQ ID NO: 90851 - RNA, 56 nt, Mus musculus
cucacuguuauacuucgcagguaugacaugagucccuuggccagauucaauacugu

SEQ ID NO: 90852 - RNA, 42 nt, Mus musculus
uuucuaaaacauguguccucucaagugcccacuccagcaaaa

SEQ ID NO: 90853 - RNA, 46 nt, Mus musculus
aggcaauagcaucaucagcaaagaccagugucugggaagcccagug

SEQ ID NO: 90854 - RNA, 24 nt, Mus musculus
aaaccaccaggcucugccaauugg

SEQ ID NO: 90855 - RNA, 46 nt, Mus musculus
ugugcauuugauguuucucuagugaacuugucuguagacaacgaag

SEQ ID NO: 90856 - RNA, 46 nt, Mus musculus
uuuaaaaagaaggaaauauauucugaauuaaaauucuguggccaag

SEQ ID NO: 90857 - RNA, 46 nt, Mus musculus
uuguuauugagguucagaaauaaucuuagcaaucuuggccacagaa

SEQ ID NO: 90858 - RNA, 41 nt, Mus musculus
gaugggggaauaauuaaagaacuccugaauuuaagagggaa

SEQ ID NO: 90859 - RNA, 46 nt, Mus musculus
acauguaugugaauggacuaugugcaugccuuguaucuaaagagau

SEQ ID NO: 90860 - RNA, 46 nt, Mus musculus
ccaagauugguguuuucuacaguuacauuuucugugugagggagau

SEQ ID NO: 90861 - RNA, 23 nt, Mus musculus
gagacauccugaagucugugaau

SEQ ID NO: 90862 - RNA, 46 nt, Mus musculus
guuucaguucuuuccaaaauuuucugacgauuggaacuaaacauag

SEQ ID NO: 90863 - RNA, 44 nt, Mus musculus
aucgucagaaaauuuuggaaagaacugaaaccuuaaaccaagag

SEQ ID NO: 90864 - RNA, 52 nt, Mus musculus
acacgcuuccgccaacaaaccggucccuucucagauuucuucccagucuggc

SEQ ID NO: 90865 - RNA, 49 nt, Mus musculus
auaaucaugggccagacugggaagaaaucugagaagggaccgguuuguu

SEQ ID NO: 90866 - RNA, 46 nt, Mus musculus
cacuugggaggcagaggcagguggaucuuugaguuugaggccagcc

SEQ ID NO: 90867 - RNA, 42 nt, Mus musculus
guguguguguguguguguguguguguguguauagagugguuu

SEQ ID NO: 90868 - RNA, 46 nt, Mus musculus
uuucaauucuccuaucuccucuccuguuucuaucuggcugccagcu

SEQ ID NO: 90869 - RNA, 46 nt, Mus musculus
aaguuuuacuaugacaguagugggauuugggaauugugaaggaguc

SEQ ID NO: 90870 - RNA, 44 nt, Mus musculus
gcagaauccagaaagaaaaggaaaagugaaaaagggaaaggggg

SEQ ID NO: 90871 - RNA, 45 nt, Mus musculus
aguuacugaaacugauuuuauuugcuugaugguagggcccaagug

SEQ ID NO: 90872 - RNA, 44 nt, Mus musculus
cuaugauucuuagaaaagcuaaucuaaacuaguauggugugugu

SEQ ID NO: 90873 - RNA, 42 nt, Mus musculus
uaguaagaaagcaagaugagcaagccaggaaagaagccagug

SEQ ID NO: 90874 - RNA, 46 nt, Mus musculus
caaggcuguggcaaguuugagguuuaccugggcuacauagugagau

SEQ ID NO: 90875 - RNA, 46 nt, Mus musculus
aucugauggaggcaauaguuuaauuaagguucauucauugucaggu

SEQ ID NO: 90876 - RNA, 46 nt, Mus musculus
caguuuggguacauaauaggucuuaaauggucuccccccaccaccc

SEQ ID NO: 90877 - RNA, 46 nt, Mus musculus
uuucacagucagguggagaaauggaacaguguuguauagacuaaga

SEQ ID NO: 90878 - RNA, 46 nt, Mus musculus
cucugcucuguauuuauugaaauguaccggaagcaucacaugaggg

SEQ ID NO: 90879 - RNA, 45 nt, Mus musculus
gugugguuuucuuuccucuguguguuuuuuucuucuucugugugg

SEQ ID NO: 90880 - RNA, 46 nt, Mus musculus
uaaaauaaguuagcacaacucacuuugugauagaaaauagcuucag

SEQ ID NO: 90881 - RNA, 45 nt, Mus musculus
gcacaggagcuauagucuucccaaucuacacugacguugguauug

SEQ ID NO: 90882 - RNA, 46 nt, Mus musculus
gcuugagaaguuuggcaaauguauacaccugcaguaaccaccucau

SEQ ID NO: 90883 - RNA, 71 nt, Mus musculus
caaaucccagcaaccacaugguggcucacaaccaucuuuaucaagaucugacucccucuucuggagugucu

SEQ ID NO: 90884 - RNA, 45 nt, Mus musculus
uucuuugaccuccacauacacaccaugaaacacacacacagggag

SEQ ID NO: 90885 - RNA, 40 nt, Mus musculus
uuauuuuuuaauguggaaaaaaaaaugacaagggcuggag

SEQ ID NO: 90886 - RNA, 73 nt, Mus musculus
ugggcauggaugugggauuuacugagcauggaaaacuuaaccaguaucuacgcaacugaagaaaacugacuuc

SEQ ID NO: 90887 - RNA, 46 nt, Mus musculus
uguuuagucuuuugagugcuaguuuuauaaauguguaccaccaggu

SEQ ID NO: 90888 - RNA, 46 nt, Mus musculus
aagaauugguugaaaauauugccuuauguuucgguagaaaugagaa

SEQ ID NO: 90889 - RNA, 46 nt, Mus musculus
gugauuauuccccaaaucuccagggguagguuguuaaagacuagau

SEQ ID NO: 90890 - RNA, 45 nt, Mus musculus
aaucuguuuuggccaacuugugugcuuuugagaauggugacaggu

SEQ ID NO: 90891 - RNA, 31 nt, Mus musculus
gcuucagggcuacuuuuugaaaaugggagaa

SEQ ID NO: 90892 - RNA, 42 nt, Mus musculus
ucccggcggcggcgguggcgguggcggcggguugggggcgac

SEQ ID NO: 90893 - RNA, 28 nt, Mus musculus
gccaccgccaccgccgccgccgggacuc

SEQ ID NO: 90894 - RNA, 46 nt, Mus musculus
aaaucccacagaccugugaaaacagguucaauagugaagaguucag

SEQ ID NO: 90895 - RNA, 42 nt, Mus musculus
gagaggauuugauauuuugcaacaguguuuaugaaggccagg

SEQ ID NO: 90896 - RNA, 42 nt, Mus musculus
ccagguggcuuccuaaaccucuacuguaaugaacggggagag

SEQ ID NO: 90897 - RNA, 46 nt, Mus musculus
cauuuuaaaacaauuaaauauguauuaugagaauaaggacaaagag

SEQ ID NO: 90898 - RNA, 46 nt, Mus musculus
auuauauggggagauguaaguuucaaaaaagacuagucaagugcag

SEQ ID NO: 90899 - RNA, 46 nt, Mus musculus
ugacugugaacaaucaauugagauaacucacuaccuucggaccagc

SEQ ID NO: 90900 - RNA, 42 nt, Mus musculus
ggggagcaaagaagggagagagagagagagagagagagagag

SEQ ID NO: 90901 - RNA, 65 nt, Mus musculus
aggccaagacaguuccacaugggagagauuuuauugggagagagagagacaagguaguggcagaa

SEQ ID NO: 90902 - RNA, 46 nt, Mus musculus
auuauauauuauuauacuagauuauuauacuuaagauccauguagu

SEQ ID NO: 90903 - RNA, 73 nt, Mus musculus
uggcaggaucuugacuuuuuuuuauauuuuguuaaugccaccucaugcucugaauacugaauagccacgagug

SEQ ID NO: 90904 - RNA, 47 nt, Mus musculus
auuugagcaaguuuauagaugaacaugccacaaagaggagcaggacc

SEQ ID NO: 90905 - RNA, 45 nt, Mus musculus
ccucuuuguggcauguucaucuauaaacuugcucaaaugcuccag

SEQ ID NO: 90906 - RNA, 46 nt, Mus musculus
cguuggugaugucguuggcaguagcauccaucuuggcgaugaccag

SEQ ID NO: 90907 - RNA, 47 nt, Mus musculus
ggcaagaaauacaagggccagaaggaccuggucaucgccaagaugga

SEQ ID NO: 90908 - RNA, 53 nt, Mus musculus
aaagccagucaucaaaucacagccaguacccaagaacaacaagggaccaguca

SEQ ID NO: 90909 - RNA, 46 nt, Mus musculus
aacaaucuuuugaauaugaggaacacuugcuaugagacuccaaguc

SEQ ID NO: 90910 - RNA, 42 nt, Mus musculus
uuuucagguaacuaagucagaaaauggguuggagagggcuua

SEQ ID NO: 90911 - RNA, 45 nt, Mus musculus
gagaaacaggggaccuaccaggucuuuucuggggacuauggagag

SEQ ID NO: 90912 - RNA, 45 nt, Mus musculus
uuuuuaaaucauuuauucauucuugauaaaagaguccuuugcugg

SEQ ID NO: 90913 - RNA, 77 nt, Mus musculus
aaggaccuggggcucagugagaguggagaggaugucaaugcagccauccuagacgagagcgggaagaaguuugccau

SEQ ID NO: 90914 - RNA, 43 nt, Mus musculus
ggauggcugcauugacauccucuccacucucacugagccccag

SEQ ID NO: 90915 - RNA, 44 nt, Mus musculus
cuuccucgucagcaauggcgaagguauacucagggaaguccuug

SEQ ID NO: 90916 - RNA, 70 nt, Mus musculus
agagguggccaaggacuucccugaguauaccuucgccauugcugacgaggaagacuaugccacggaggug

SEQ ID NO: 90917 - RNA, 42 nt, Mus musculus
acgcucuccgacaaggcccagacccagaaguaccucgaccag

SEQ ID NO: 90918 - RNA, 44 nt, Mus musculus
uccuuuccuaucuggucgagguacuucugggucugggccuuguc

SEQ ID NO: 90919 - RNA, 46 nt, Mus musculus
gaaguccacacuguaguauacaaccaccagggggcguuugcuguac

SEQ ID NO: 90920 - RNA, 46 nt, Mus musculus
ugccuugccccuggugggccaucguaagacuucuaaugaugcuaag

SEQ ID NO: 90921 - RNA, 24 nt, Mus musculus
uaagagggccuugacagucaguca

SEQ ID NO: 90922 - RNA, 46 nt, Mus musculus
ccuggggaaguuggugcugacacacccugagaaguuccaguccaag

SEQ ID NO: 90923 - RNA, 45 nt, Mus musculus
aagcagccccucuuauggugggcuguuaucuuuacuguugcuaca

SEQ ID NO: 90924 - RNA, 56 nt, Mus musculus
gaaaagagagaagguagaaagagagagagagaccggccaugcccaagaggagagaa

SEQ ID NO: 90925 - RNA, 90 nt, Mus musculus
ugggccuuuacuggaacacaggaaggccuuccauccggagaucagaaauggcuuguuaagagaaagccuaucccaucguccaagcgcagc

SEQ ID NO: 90926 - RNA, 51 nt, Mus musculus
cccaacugggggcgccccggggcuaugggaaagagggcugaaggagagagg

SEQ ID NO: 90927 - RNA, 46 nt, Mus musculus
cugggccucccucaaaggagauccugacccugaagcagguccagga

SEQ ID NO: 90928 - RNA, 46 nt, Mus musculus
ucaaaaggccuuccuuugcggaaaauuuucaaagucggguagccag

SEQ ID NO: 90929 - RNA, 42 nt, Mus musculus
ugaugucucuggcuacccgacuuugaaaauuuuccgcaaagg

SEQ ID NO: 90930 - RNA, 42 nt, Mus musculus
agcaagcgcucucccccaauucccuuagccaaaguggacgcc

SEQ ID NO: 90931 - RNA, 42 nt, Mus musculus
caauaagccacuccugauuuauauuguugacagccccuagau

SEQ ID NO: 90932 - RNA, 46 nt, Mus musculus
ucaaguauagacaaugguaacagacuagcuggauucaggggcugag

SEQ ID NO: 90933 - RNA, 65 nt, Mus musculus
ggcagagugcaggccuggcagcagggguaggaagcugaggacccaccagagugaagcagacagaa

SEQ ID NO: 90934 - RNA, 61 nt, Mus musculus
gcuuauaaaagaaggacuuuguguggccuuaugguuccagagagauaauagaccauaugau

SEQ ID NO: 90935 - RNA, 42 nt, Mus musculus
ccuuacauugcuauagaagaggccugacaugaucggugagac

SEQ ID NO: 90936 - RNA, 46 nt, Mus musculus
aacuucucaaguccuggaauucaggcauguguuaccaccccuggau

SEQ ID NO: 90937 - RNA, 46 nt, Mus musculus
ucauugacuaaagauaacuuugacgauguuguaaauaaugcagaca

SEQ ID NO: 90938 - RNA, 90 nt, Mus musculus
gccagcaaauuugaugugaguggcuaccccaccaucaagauccugaagaagggacaggccguugacuaugauggcuccaggacccaggaa

SEQ ID NO: 90939 - RNA, 72 nt, Mus musculus
agcaguuugcuccagaauaugagaaaauugccaguacuuugaaggauaaugauccucccauugcuguagcga

SEQ ID NO: 90940 - RNA, 60 nt, Mus musculus
gaugacgaugacuuggaaguuaaggaagaaaaugguguuugggucuuaaaugaugggaac

SEQ ID NO: 90941 - RNA, 45 nt, Mus musculus
ucgucauccucuuccucuuccuccucuuccuccucaguggcauuu

SEQ ID NO: 90942 - RNA, 55 nt, Mus musculus
agauacuucagauacagaaaaugccacugaggaggaagaggaggaagaggaagag

SEQ ID NO: 90943 - RNA, 51 nt, Mus musculus
guuccuacuuggaauguaaaguagccauauaguuuacagagguggaacggg

SEQ ID NO: 90944 - RNA, 52 nt, Mus musculus
uuauguauguaccagaggguaaaucuugauaucugcacauuuggagggaaca

SEQ ID NO: 90945 - RNA, 45 nt, Mus musculus
uguaaaguugucauuguuucauagucuuuuccucucagaguauua

SEQ ID NO: 90946 - RNA, 41 nt, Mus musculus
cugggagcagguuucaggccuugagugcacucagucccaga

SEQ ID NO: 90947 - RNA, 41 nt, Mus musculus
uaacucaauacuggcucuauaacuguggguacauagagacc

SEQ ID NO: 90948 - RNA, 46 nt, Mus musculus
ucauuauguagcuuggagcucaucauguagaccaggcuggccuuga

SEQ ID NO: 90949 - RNA, 41 nt, Mus musculus
acacagcugcuggcugcugcgagcgccggagaugcacacga

SEQ ID NO: 90950 - RNA, 91 nt, Mus musculus
gcaggaccaacagccaagcuuuccggagcuucaugauugggugcagagcugggccugcagacaccggccaccgcagagcacucgccgaccu

SEQ ID NO: 90951 - RNA, 46 nt, Mus musculus
aaagaaaaaaaaaagaaaaaagaaaaaaaaaaaaaaagaaaaucaa

SEQ ID NO: 90952 - RNA, 54 nt, Mus musculus
uuggacacagaauccgugugaugcuguacccaucccagauuuaaacuaauggag

SEQ ID NO: 90953 - RNA, 46 nt, Mus musculus
gacuuuuuaaauaagucagaagucaggcaggucugcagaggaguag

SEQ ID NO: 90954 - RNA, 45 nt, Mus musculus
gcuuguuaaauuaugguacaguuguaguguguaagcugaaugaua

SEQ ID NO: 90955 - RNA, 46 nt, Mus musculus
agucagucaauuugaauucuguugacaauuuuggugaaaaguugga

SEQ ID NO: 90956 - RNA, 44 nt, Mus musculus
ggcucuagugagcauggauaacaagcgaucaagcuucagaggua

SEQ ID NO: 90957 - RNA, 42 nt, Mus musculus
ggaguuacaaauaacugcaagcugcuauauaguugcugggaa

SEQ ID NO: 90958 - RNA, 44 nt, Mus musculus
uagagauguucuuuuucuacuagauacuuucacuguauucucaa

SEQ ID NO: 90959 - RNA, 46 nt, Mus musculus
auuuguuuccuggaguacauccccaaauuauuaagaaaaggcgcau

SEQ ID NO: 90960 - RNA, 45 nt, Mus musculus
acaguauuauauaccuguaaucccagugcuuaggagaucgaggca

SEQ ID NO: 90961 - RNA, 45 nt, Mus musculus
gaucauaugccuuuuuaaaaacagaaaucauacuuuaguuuuggu

SEQ ID NO: 90962 - RNA, 46 nt, Mus musculus
agaguggaauaacuuguuaagucuucuagaaaguagaauguccaga

SEQ ID NO: 90963 - RNA, 46 nt, Mus musculus
uuccaucuguaaaaaacaauccaaacaguccuucaaagaccgugag

SEQ ID NO: 90964 - RNA, 46 nt, Mus musculus
gauacaaaaaaauggagguagcaagaucucaacaugaacuggagag

SEQ ID NO: 90965 - RNA, 47 nt, Mus musculus
uuaggugacaucuuuuuuuuuuuaguuagagaaugaauugcugaauu

SEQ ID NO: 90966 - RNA, 45 nt, Mus musculus
cuucaggaagguuucugguucauauuauuuuguguuugcaucaag

SEQ ID NO: 90967 - RNA, 48 nt, Mus musculus
cgcuguucucauacacuguagaaucugguuucaagcugaagaaggaca

SEQ ID NO: 90968 - RNA, 46 nt, Mus musculus
guuguaaauaguuggaaguggauagaugguaagaagugaugcagga

SEQ ID NO: 90969 - RNA, 54 nt, Mus musculus
gaacacaguacagaugaccagccaaggccagaagcaagugagauuccugcagac

SEQ ID NO: 90970 - RNA, 54 nt, Mus musculus
aacaagauugccagggaaagaauaauaaguguauauaaacgaauaaagaauaug

SEQ ID NO: 90971 - RNA, 24 nt, Mus musculus
cugcaccugaaaaagagucaaagc

SEQ ID NO: 90972 - RNA, 47 nt, Mus musculus
cucagucccaaaaagucucccugaaaaaaaauaaguaccuaaguuuc

SEQ ID NO: 90973 - RNA, 48 nt, Mus musculus
uguagcaaagagucagucucuuaucauaugggauauauucaacaggcu

SEQ ID NO: 90974 - RNA, 46 nt, Mus musculus
cucccaaaguccucuggucuccacaugaaagugaacacacacacag

SEQ ID NO: 90975 - RNA, 46 nt, Mus musculus
agcugaaaaauaaaaaagaauugauacuugguuuaaaaaaaaaaaa

SEQ ID NO: 90976 - RNA, 51 nt, Mus musculus
ucaagagauaagaaggcaauagauaaugcaauagauaaguggguuugauua

SEQ ID NO: 90977 - RNA, 46 nt, Mus musculus
cuaaaauaaaagaaagaaaaaaaagaaaaauaaagaaaaagaaaag

SEQ ID NO: 90978 - RNA, 45 nt, Mus musculus
guaugggaccagcaggauuuggcagagagagauauucccacagau

SEQ ID NO: 90979 - RNA, 45 nt, Mus musculus
aacagagucucucaucucagcacaugacauuuuguccuggaucaa

SEQ ID NO: 90980 - RNA, 42 nt, Mus musculus
auugaaagaaaugauaauagcagccacuucuauagcccccag

SEQ ID NO: 90981 - RNA, 46 nt, Mus musculus
agagaaagagagagagagagagaaggagagagagagagagagagag

SEQ ID NO: 90982 - RNA, 41 nt, Mus musculus
gggucccuugagaaugauggagucuguuucucggagcagga

SEQ ID NO: 90983 - RNA, 45 nt, Mus musculus
auuaauuaguuuccuaucacuguguaagaaacuaugaccgaggca

SEQ ID NO: 90984 - RNA, 46 nt, Mus musculus
ucaauucccagcaaccacaugguggcuaacaaucaucaguaaugag

SEQ ID NO: 90985 - RNA, 87 nt, Mus musculus
gauuuauacuguauuuuuucuaacccagagguccuuggccagccagaggaagaaguggaguugggugcagagauggugggugacuug

SEQ ID NO: 90986 - RNA, 46 nt, Mus musculus
uucagaauagacagaguuuuuucuuuccaaauuuuuuuagggggac

SEQ ID NO: 90987 - RNA, 45 nt, Mus musculus
gcacugacuguuguagcagggaucauguucaguucccagcacaca

SEQ ID NO: 90988 - RNA, 42 nt, Mus musculus
ggccuugaacucauggagaucugccuguuucuuucucccaag

SEQ ID NO: 90989 - RNA, 45 nt, Mus musculus
gcucacaaccaucuguaacgagaucugacgcccuccucuggaaug

SEQ ID NO: 90990 - RNA, 42 nt, Mus musculus
uuuucagugcucagaugucugaauagcacugugggggccugg

SEQ ID NO: 90991 - RNA, 46 nt, Mus musculus
gcaagcaccagcccuuuaucacuuaaacaggaggaagaaucugcag

SEQ ID NO: 90992 - RNA, 41 nt, Mus musculus
acauuucuugguguuagauuuguggcaaaggaucccagaga

SEQ ID NO: 90993 - RNA, 46 nt, Mus musculus
gacugccuccucccaaccacauuuuguuguaugggucaguggucac

SEQ ID NO: 90994 - RNA, 42 nt, Mus musculus
gguccugaggcucccccccagcagcagggaugaagcccccaa

SEQ ID NO: 90995 - RNA, 46 nt, Mus musculus
auucccagcaucuaauggcagcucacaacugucuguaacucccaag

SEQ ID NO: 90996 - RNA, 46 nt, Mus musculus
uuuaaguagaggaagucaacagaaagcaucuccauucaggucccaa

SEQ ID NO: 90997 - RNA, 34 nt, Mus musculus
uggcagaaggaacucugcaagcgcguagcaaagg

SEQ ID NO: 90998 - RNA, 65 nt, Mus musculus
auguauuuccucagugacucuuggaucuaagaaccagagcaaauugauccucugccuucaagcug

SEQ ID NO: 90999 - RNA, 46 nt, Mus musculus
aucauaugcuugucugguuccugcagaggccagaagagaacaucag

SEQ ID NO: 91000 - RNA, 41 nt, Mus musculus
gguucuucugagagugcgugggggucacugguccuggccag

SEQ ID NO: 91001 - RNA, 46 nt, Mus musculus
aggccagcuggaaucugccccgaguguucuucccuggaucaagcaa

SEQ ID NO: 91002 - RNA, 92 nt, Mus musculus
acccucucacgaucuuguaaugaaaagccaaaggaaugaguuccccagguagaaaaaaagcuccagguccguguguccugggagaaggggag

SEQ ID NO: 91003 - RNA, 42 nt, Mus musculus
aacagaaaacccaaauaagcagacucuaggauggggccagug

SEQ ID NO: 91004 - RNA, 46 nt, Mus musculus
caucuucucuaugcaguauaugaauacucuuccuugaacaucaggu

SEQ ID NO: 91005 - RNA, 42 nt, Mus musculus
cgcucugaguggagagaugcucccuucagagcuuucccaaau

SEQ ID NO: 91006 - RNA, 47 nt, Mus musculus
gcagcuaaccacacauuaaggcaacccuugccaggcaccagguccuu

SEQ ID NO: 91007 - RNA, 46 nt, Mus musculus
cacaacugaacccccugaaaacaugagucauaguaaaccuggccuc

SEQ ID NO: 91008 - RNA, 38 nt, Mus musculus
cuuccacggugggacaacagugcuacuggaugugaaga

SEQ ID NO: 91009 - RNA, 42 nt, Mus musculus
gcagaguuucugagauugugugacaucuggaguucuggggau

SEQ ID NO: 91010 - RNA, 42 nt, Mus musculus
ccaaggucuaguauucuuuaucccaaauuccuggggacagau

SEQ ID NO: 91011 - RNA, 26 nt, Mus musculus
ucaagagcagagcuggaaggcaucua

SEQ ID NO: 91012 - RNA, 42 nt, Mus musculus
acacgggcauggauuaagaacauggacuacaguguaacagcu

SEQ ID NO: 91013 - RNA, 46 nt, Mus musculus
ccaagccguugccccuggcugcuccuggggcuccugaaauccagau

SEQ ID NO: 91014 - RNA, 45 nt, Mus musculus
uucugguuugucugaagacugcaacaguguacucacauauauaga

SEQ ID NO: 91015 - RNA, 46 nt, Mus musculus
uugacauugauccugcuguugacuuagagccacauaaaucaggagc

SEQ ID NO: 91016 - RNA, 46 nt, Mus musculus
cagggccagucacgcaggugaaacgcaagggccucacaggcaagau

SEQ ID NO: 91017 - RNA, 45 nt, Mus musculus
uccgcagaacagcuauugcuguugacucuuggagaugcgccagag

SEQ ID NO: 91018 - RNA, 42 nt, Mus musculus
caaauugacagugggacucggagauuguugaagucuggaccu

SEQ ID NO: 91019 - RNA, 45 nt, Mus musculus
ucaaaaguucuauucucacuguguaugugauguuggcgaucagac

SEQ ID NO: 91020 - RNA, 42 nt, Mus musculus
uacgugauacagacauguauagcucaugcugccugccuguga

SEQ ID NO: 91021 - RNA, 41 nt, Mus musculus
agcuggcugacagcagccuuccccugagaagcguccacagg

SEQ ID NO: 91022 - RNA, 42 nt, Mus musculus
gcugccugacagugaaggagcagucagggcauggggugugag

SEQ ID NO: 91023 - RNA, 37 nt, Mus musculus
cgcaucugauccgccaccagcguauccacaccggcga

SEQ ID NO: 91024 - RNA, 42 nt, Mus musculus
ggugaagguagaggaugaggaucaggaggcagaggaggaggu

SEQ ID NO: 91025 - RNA, 42 nt, Mus musculus
acgggugcgcgcaagggaggagccaaaggggcggggcaagag

SEQ ID NO: 91026 - RNA, 42 nt, Mus musculus
gaggaagggggaggggagcgcugcccaagacugcugguagag

SEQ ID NO: 91027 - RNA, 45 nt, Mus musculus
ccgggaggggagagaagcggagccggagcuugcaggguaggcaga

SEQ ID NO: 91028 - RNA, 71 nt, Mus musculus
ggagucuagucagaaggaaaacuccggagagggcgugaagucaguggggagcagaaaugggcaagggggcu

SEQ ID NO: 91029 - RNA, 42 nt, Mus musculus
ggggaggauccccaggagcgggaguaggguuccucgggauag

SEQ ID NO: 91030 - RNA, 42 nt, Mus musculus
gaggggagggcaaggacucggggaggcccggugggagcaggu

SEQ ID NO: 91031 - RNA, 45 nt, Mus musculus
cuccuuccucuccccucugcccuuccucgguccuaagcucccacu

SEQ ID NO: 91032 - RNA, 41 nt, Mus musculus
uugcaccugcuuagagucugccguucgaucugauaccccac

SEQ ID NO: 91033 - RNA, 46 nt, Mus musculus
gcuggguguuugugauagagccaguguaaccacuagggggcagcag

SEQ ID NO: 91034 - RNA, 45 nt, Mus musculus
ucuucauuggguugugguggggcagaucccaguaccauugaagag

SEQ ID NO: 91035 - RNA, 41 nt, Mus musculus
cuuuuucacuagggagagaacauuucagagagaauaaggga

SEQ ID NO: 91036 - RNA, 45 nt, Mus musculus
uucaccuuacucccuguacagcuguggcagcacccagcaggagca

SEQ ID NO: 91037 - RNA, 87 nt, Mus musculus
gucccccauaggcugacauauuugaagauuuggucuccaguugguagugcuguuuggggagguuuugaagguuugaccuugauggag

SEQ ID NO: 91038 - RNA, 46 nt, Mus musculus
ggcugccagccugacuguagguacagugagagauugucugccaaug

SEQ ID NO: 91039 - RNA, 42 nt, Mus musculus
aagggucagugggaaaaggcggggcuuuggggaccaagagag

SEQ ID NO: 91040 - RNA, 24 nt, Mus musculus
ucgaggccuucccuuucccgugca

SEQ ID NO: 91041 - RNA, 46 nt, Mus musculus
uaggggcugauuuagaauguuuggguuugugugugugugugugugu

SEQ ID NO: 91042 - RNA, 42 nt, Mus musculus
gcccugccaugaaugcaaccagcgcuuucgccacgcccccuu

SEQ ID NO: 91043 - RNA, 46 nt, Mus musculus
ccaggccugguggagacgcuguggaccgccccuuccagugugccug

SEQ ID NO: 91044 - RNA, 42 nt, Mus musculus
uggccgccgcuuccgccacaaacccaaccuguugucgcacag

SEQ ID NO: 91045 - RNA, 46 nt, Mus musculus
uacacugaugcugcuagaggaacagguaaagaucccagagggauag

SEQ ID NO: 91046 - RNA, 42 nt, Mus musculus
gaaccguuccauccucugguguuaacgccuuaauguccccag

SEQ ID NO: 91047 - RNA, 26 nt, Mus musculus
cugcaaugccuccugcauagguccca

SEQ ID NO: 91048 - RNA, 45 nt, Mus musculus
ugucagguaccaacaggcccucucgccugucauuucugcaccagu

SEQ ID NO: 91049 - RNA, 45 nt, Mus musculus
gcagcucuugcucucccuucaaauucauguaaacaccugcacacg

SEQ ID NO: 91050 - RNA, 43 nt, Mus musculus
caaucccaguguuggcuacaagcgauucugcgaggcgggauga

SEQ ID NO: 91051 - RNA, 41 nt, Mus musculus
augcaggugugugaggacauaacaaaucuagauauugggga

SEQ ID NO: 91052 - RNA, 83 nt, Mus musculus
ggcuacagagaaacccugucuuagggagaaagggcaagagagaaagaaagagagagagagagagagagagagagagagagauc

SEQ ID NO: 91053 - RNA, 44 nt, Mus musculus
gaaagcuuguguuacaugaauguaugaacuccauucagcuuuga

SEQ ID NO: 91054 - RNA, 46 nt, Mus musculus
aguugugcuaugugccucacauuggcaugcuuguauacugucggaa

SEQ ID NO: 91055 - RNA, 46 nt, Mus musculus
ggcccaagagauuucaaaggagaagaauuucaauauguggcaaaaa

SEQ ID NO: 91056 - RNA, 46 nt, Mus musculus
gcucuugucuaaaaagucugucugaggcuaaggugaagagacucag

SEQ ID NO: 91057 - RNA, 45 nt, Mus musculus
uguaauaguacaagcgggucauguucuaguuccuguaagcagcag

SEQ ID NO: 91058 - RNA, 45 nt, Mus musculus
cagaagagaccuugaacuuuggacuuuuaauauuguuaugagggc

SEQ ID NO: 91059 - RNA, 29 nt, Mus musculus
gaaggcugucacugguggggugcucugag

SEQ ID NO: 91060 - RNA, 23 nt, Mus musculus
gguggggaaggcccccgaggcag

SEQ ID NO: 91061 - RNA, 40 nt, Mus musculus
gcucaacaggacgaagacucugugggauuucugggcugag

SEQ ID NO: 91062 - RNA, 45 nt, Mus musculus
ggggcuuuaucgugugugugugugugugugugugugugugugugu

SEQ ID NO: 91063 - RNA, 43 nt, Mus musculus
augugauagaccaaccugugcuguuucccugucucgugugugu

SEQ ID NO: 91064 - RNA, 46 nt, Mus musculus
ccuguuacuccccugucucugcccaccaguggguuucagugucuag

SEQ ID NO: 91065 - RNA, 46 nt, Mus musculus
auggcaagaggcuuauuuaguuuugaaaauaucuacagcuguuuag

SEQ ID NO: 91066 - RNA, 46 nt, Mus musculus
cagggaccugggauguccacauuccucucuacucuucagugggcag

SEQ ID NO: 91067 - RNA, 46 nt, Mus musculus
uggauacuugguaccaaauguuuccuauguccagauuucagugcag

SEQ ID NO: 91068 - RNA, 46 nt, Mus musculus
acacacacacacacacacacacaccuagagagagacagagacagag

SEQ ID NO: 91069 - RNA, 46 nt, Mus musculus
ucgcucaaacaucuccucaccuagauggacuuuaguuucagagcag

SEQ ID NO: 91070 - RNA, 44 nt, Mus musculus
aggcaccaacauaaagaaggaaccagucauucauguuggaggga

SEQ ID NO: 91071 - RNA, 46 nt, Mus musculus
augagccauggucuuggcuucugauucacagauuaguuuuuaccag

SEQ ID NO: 91072 - RNA, 27 nt, Mus musculus
cagaagacaucacucuagaaugagaag

SEQ ID NO: 91073 - RNA, 42 nt, Mus musculus
aucaagcaggagaagccagaguggcuguugcagacuguggca

SEQ ID NO: 91074 - RNA, 42 nt, Mus musculus
cggcugugggcuguuguccggacaccaugcuggccccaccaa

SEQ ID NO: 91075 - RNA, 81 nt, Mus musculus
ggcugcucagacucuugaggaaaaagcugcugcaggcugcagaaggggagcagguugggaugugaguggggcaccugaugg

SEQ ID NO: 91076 - RNA, 41 nt, Mus musculus
ggagggacagaaaaccaaggcuuuagacccuccaggcccug

SEQ ID NO: 91077 - RNA, 41 nt, Mus musculus
gccgugacccuuugagaaugaauggguuugugguggcuggg

SEQ ID NO: 91078 - RNA, 46 nt, Mus musculus
cccggggaggggucaccuucaacuuuccccgggugggggugugugg

SEQ ID NO: 91079 - RNA, 29 nt, Mus musculus
uggugggaguggggaguguggagugggcg

SEQ ID NO: 91080 - RNA, 46 nt, Mus musculus
uuuuaguccauccaaucccuuucucuucaaucugacagcaccccaa

SEQ ID NO: 91081 - RNA, 46 nt, Mus musculus
gccacugcuggucaaggacucauauccuuacauauuagcccgucag

SEQ ID NO: 91082 - RNA, 46 nt, Mus musculus
guucucuacaacagauuuuauguggagcgguccuugggggacaugg

SEQ ID NO: 91083 - RNA, 45 nt, Mus musculus
ucaaauugguuccuuggagagauccugaacucucauuaacuguug

SEQ ID NO: 91084 - RNA, 45 nt, Mus musculus
gggguggaggcuaagagauauaaggagaugaacugaugcguugca

SEQ ID NO: 91085 - RNA, 45 nt, Mus musculus
ucagaucuuuagagucagcuugccuugacauggcuggccagggag

SEQ ID NO: 91086 - RNA, 42 nt, Mus musculus
ugaggaucagagccuugauaauuuuguaagugaugcggguga

SEQ ID NO: 91087 - RNA, 45 nt, Mus musculus
aaaggcggcacaaauuguuuuugcacagagaaaucaugaugaaaa

SEQ ID NO: 91088 - RNA, 45 nt, Mus musculus
aaaagcacauggccuggagaaaccacaaguucuaaggggucucau

SEQ ID NO: 91089 - RNA, 46 nt, Mus musculus
agggaagauggaguggaaggugaggagagagaagaaggaaaaaaau

SEQ ID NO: 91090 - RNA, 45 nt, Mus musculus
gagacagacaaugagccaggaaaggccauuucuugaguugucaug

SEQ ID NO: 91091 - RNA, 46 nt, Mus musculus
ucuccccacuguccucacgccaauguccuuucuuccacgaacagau

SEQ ID NO: 91092 - RNA, 76 nt, Mus musculus
cuucuugaugggcauccagcaccugcguccccggccaaagagaagaucccugcuauccugugauccgcccacaccc

SEQ ID NO: 91093 - RNA, 45 nt, Mus musculus
acuaagucuccgaaguauguauggccggagcucccaggcccuggu

SEQ ID NO: 91094 - RNA, 45 nt, Mus musculus
uccuagcguucugcaucaugcucacaguggucuguauccuggaga

SEQ ID NO: 91095 - RNA, 48 nt, Mus musculus
cauggacccuggguaugggacagugcgauacagugaugauucagacug

SEQ ID NO: 91096 - RNA, 31 nt, Mus musculus
gaacagcuuaaucaggcaaaccaguguuccc

SEQ ID NO: 91097 - RNA, 42 nt, Mus musculus
ggccuccacacauccccaguccgcucacaucagcauccacau

SEQ ID NO: 91098 - RNA, 38 nt, Mus musculus
cuugccucaaggugguaaggaaagaaagacagagggaa

SEQ ID NO: 91099 - RNA, 46 nt, Mus musculus
guaguccaggcuauccuccaacucacagaaaucuaccugccucugc

SEQ ID NO: 91100 - RNA, 42 nt, Mus musculus
ugucagacuccugugcuuucggcucugaggugcacgggugag

SEQ ID NO: 91101 - RNA, 44 nt, Mus musculus
cucccagaccucucaguuccagccccacccaucgcagaggacag

SEQ ID NO: 91102 - RNA, 44 nt, Mus musculus
ucaucaacaacagcaacaaacaccauuugcuaguacacuggaag

SEQ ID NO: 91103 - RNA, 46 nt, Mus musculus
uauguaagcuauguucuucuaguugggcugccuugucuggccucag

SEQ ID NO: 91104 - RNA, 44 nt, Mus musculus
cucuggucuuguuacuagucaaugaugagauuuuacuggcccca

SEQ ID NO: 91105 - RNA, 42 nt, Mus musculus
aauucugccauauuucaugucuagccuuuagaguggccaauc

SEQ ID NO: 91106 - RNA, 46 nt, Mus musculus
auuugauuuuuccaguguuuguuuuuuaaaaaacugacaggugcua

SEQ ID NO: 91107 - RNA, 79 nt, Mus musculus
aagucuuccaugaaauguagcagaguuucugucugcccugcauuaccugccagcgagucaagguaggggauccagcaaa

SEQ ID NO: 91108 - RNA, 105 nt, Mus musculus
gcuugaguuuguuuuaccagaugcucagcuugcuaacacacuugagaucagaccauacucugagcagacauggaaaggauugcuuugugaagaccagggggaguc

SEQ ID NO: 91109 - RNA, 60 nt, Mus musculus
ugggaauuugcaaaugcuuugugcuuugacugucaccacgaaaaggaagaaauucauguc

SEQ ID NO: 91110 - RNA, 51 nt, Mus musculus
uaaaggacagcuaguguacagggcuccaggagacuuggggauuuguguuua

SEQ ID NO: 91111 - RNA, 45 nt, Mus musculus
gaucaaaguagaauugucagaggaacacaacauuaagccauuaga

SEQ ID NO: 91112 - RNA, 46 nt, Mus musculus
gugagaauguauacuuuaugcucucugaaauauaugacacccagcu

SEQ ID NO: 91113 - RNA, 42 nt, Mus musculus
auuuauggaaaaauuaaagaagaaaacuuuguuaguccuaaa

SEQ ID NO: 91114 - RNA, 42 nt, Mus musculus
agugcggauggugauuaucacuggaccaccagaggcucaguu

SEQ ID NO: 91115 - RNA, 45 nt, Mus musculus
cuuucuucugaaaaccaucaguggaaacuuuuaaaagccccuuaa

SEQ ID NO: 91116 - RNA, 38 nt, Mus musculus
uugguauauuccauucuccgaacuuggccagucaaagc

SEQ ID NO: 91117 - RNA, 46 nt, Mus musculus
cuucauggcccaacaugacaccugugcccccccccccacccccgac

SEQ ID NO: 91118 - RNA, 45 nt, Mus musculus
aaauuugugcuuuaaagaagauguuauagguucacaucucuagag

SEQ ID NO: 91119 - RNA, 46 nt, Mus musculus
uucccagagcuaauucaagagacaguucugaaauucucaccaaguc

SEQ ID NO: 91120 - RNA, 88 nt, Mus musculus
gagaacuuguacccaaggagugagugugucagcaaguguguguaggaacgggucucauguguguucagggcggagaacuuguacccaa

SEQ ID NO: 91121 - RNA, 45 nt, Mus musculus
uccuguguguccagggcagugaacccaaggagugagugugucaga

SEQ ID NO: 91122 - RNA, 42 nt, Mus musculus
ccauuguuuuccuuuggccucuaagauagguacuugggggag

SEQ ID NO: 91123 - RNA, 45 nt, Mus musculus
ucucagggcuagggagauguguuagucaauaaaugaaagccugag

SEQ ID NO: 91124 - RNA, 45 nt, Mus musculus
gagugaaucucugcuuuuauuauaaaugcauauugcuuguuaaga

SEQ ID NO: 91125 - RNA, 46 nt, Mus musculus
auugugauaagaagcuugcuuucuuccuguucuuuccuguucuggg

SEQ ID NO: 91126 - RNA, 45 nt, Mus musculus
aucacaaguaugcacuacacuguuuaguuuucuguugggugggga

SEQ ID NO: 91127 - RNA, 46 nt, Mus musculus
uugguggguccaggcaagccuaggcuacagagcaagaccucaaguu

SEQ ID NO: 91128 - RNA, 46 nt, Mus musculus
uguauucuguagagauuauauaacacauguguuuauuuauggagac

SEQ ID NO: 91129 - RNA, 46 nt, Mus musculus
gagcauuagagguaggagaauuaggcuuuauuucccgccaacaguu

SEQ ID NO: 91130 - RNA, 42 nt, Mus musculus
gcaccauuacagugaaaggcaguguugagacgugugccaagg

SEQ ID NO: 91131 - RNA, 46 nt, Mus musculus
ucuacaacacagacguaugaaaccaugugcccaguugcugcuauug

SEQ ID NO: 91132 - RNA, 42 nt, Mus musculus
gggcacaggcugcucuugagcagcagagggagcgagccaagg

SEQ ID NO: 91133 - RNA, 45 nt, Mus musculus
cauaaggaagcucaagauauaaaauugugaguaacgaggucuagc

SEQ ID NO: 91134 - RNA, 46 nt, Mus musculus
aguggguggguuggcgagcagggggauggggaggagaauuucggag

SEQ ID NO: 91135 - RNA, 44 nt, Mus musculus
ggccuuuuuggacaucagugggcccagugcuccaguguagggga

SEQ ID NO: 91136 - RNA, 48 nt, Mus musculus
gaggaguuagaaaaaguacugaaggagcuaaaggggguugcagcucca

SEQ ID NO: 91137 - RNA, 45 nt, Mus musculus
auuccaguuagagaacuucaccuugaagguugccuacaucccaga

SEQ ID NO: 91138 - RNA, 46 nt, Mus musculus
ggagagccccacccccuccauuaccguuugcugugcucugggaguu

SEQ ID NO: 91139 - RNA, 46 nt, Mus musculus
uugccuuggauaccccacaauaguagagauaucagagccaugggau

SEQ ID NO: 91140 - RNA, 46 nt, Mus musculus
agaugucuguaccaugagaugaucaccaagaacagcagcagcagug

SEQ ID NO: 91141 - RNA, 46 nt, Mus musculus
cagaaacaguauccaaauuaauaaaaucagaaaagaaaagggagac

SEQ ID NO: 91142 - RNA, 48 nt, Mus musculus
gugaaggcagguagcacuagagacaaucagaugguaaucagauagagg

SEQ ID NO: 91143 - RNA, 46 nt, Mus musculus
uguggugguacaugcuuuuaauuucaggagacagaggcaagcagau

SEQ ID NO: 91144 - RNA, 42 nt, Mus musculus
ucccgcaaccacaugguggcucacaaccauccauaacgagau

SEQ ID NO: 91145 - RNA, 41 nt, Mus musculus
ugggaccaaagggggccaacaaccacauguguagcccauau

SEQ ID NO: 91146 - RNA, 46 nt, Mus musculus
aggauuggagcaggcagagguauccaaaaacaggaaugcacaagga

SEQ ID NO: 91147 - RNA, 41 nt, Mus musculus
uuuaauguaggccucaucuuaugaucuugaauucacgcagg

SEQ ID NO: 91148 - RNA, 46 nt, Mus musculus
ucaaaggaaaaaaagaaguaggcauucuguuaacaaguuagaaguc

SEQ ID NO: 91149 - RNA, 43 nt, Mus musculus
uuaauuuguucacaacuaaauaccaagauuaaugccggaccuu

SEQ ID NO: 91150 - RNA, 46 nt, Mus musculus
gucuaaggcaccaaggacccacugaaccccucuguagccuggaugc

SEQ ID NO: 91151 - RNA, 90 nt, Mus musculus
ugugagugaaguaaauucacuuaaguguggauucugguuugugagauauuuguggagauauuauagaacuaggugagggaugugggggga

SEQ ID NO: 91152 - RNA, 46 nt, Mus musculus
ugccucacagagucugcgcaagucuggaccugaugggaucccagug

SEQ ID NO: 91153 - RNA, 42 nt, Mus musculus
uugcucuguccuguguaaacugcccacaugguggcguaugug

SEQ ID NO: 91154 - RNA, 41 nt, Mus musculus
gacugucacugcaagucuggagagguagcuuagcaguuaag

SEQ ID NO: 91155 - RNA, 46 nt, Mus musculus
agugugugugugugugugugugugugugagagagagagauugaaag

SEQ ID NO: 91156 - RNA, 45 nt, Mus musculus
augaugacgaugacaacaauuacaaccaccaccaucaccucacac

SEQ ID NO: 91157 - RNA, 45 nt, Mus musculus
ugacaucucaaaauaggaagaguauuuaggaagguagccugggau

SEQ ID NO: 91158 - RNA, 46 nt, Mus musculus
uuuucccccuuaucaguguagguguaguguuugaggguuugucgau

SEQ ID NO: 91159 - RNA, 46 nt, Mus musculus
ccgccccuucacuacuggagacagagcuuugcagcgcaugacagaa

SEQ ID NO: 91160 - RNA, 42 nt, Mus musculus
ccucuuuuuuuuuuuuuucuuuuucuuuuucuuuuucuuuuu

SEQ ID NO: 91161 - RNA, 42 nt, Mus musculus
agaggaaagagcaucggcaggcgugauaucacagccaagacu

SEQ ID NO: 91162 - RNA, 45 nt, Mus musculus
aaagauuaauuuauuuauauguaaguacacuguagcugucuucag

SEQ ID NO: 91163 - RNA, 113 nt, Mus musculus
uuaucucuuccuacagauaacuguggguuacauuaaggcccaguaggucuuuagcugucuuugaagaugugaguugggucguccacauguuggugcagcacaagagcccugca

SEQ ID NO: 91164 - RNA, 46 nt, Mus musculus
uccuugaccguguguaguuuuuauuccuucuagauuucaaagggga

SEQ ID NO: 91165 - RNA, 77 nt, Mus musculus
aggcuuucccacuccuucucccucaggucugaauuguggcaccaugucagagggaaagggcaaauaacacaccucag

SEQ ID NO: 91166 - RNA, 67 nt, Mus musculus
uuugggacuguagcucugccuucccugggagguuuguguaguauccuguucccaggagaagauggca

SEQ ID NO: 91167 - RNA, 46 nt, Mus musculus
auuuucgcacugcucauuccagugucuuaaaucugucuugcuagag

SEQ ID NO: 91168 - RNA, 42 nt, Mus musculus
auggccagucucuucacauuacaagaagugauuuggccuuug

SEQ ID NO: 91169 - RNA, 45 nt, Mus musculus
aagacccgccuggacauaagccacauggaaaugcugguccuggau

SEQ ID NO: 91170 - RNA, 46 nt, Mus musculus
ccuccuaaaguuaagaggaaacuuaacccucuggaaggccuggugc

SEQ ID NO: 91171 - RNA, 45 nt, Mus musculus
uggaaacaaaguaacaguguccguucuaccacuuaccuugugagg

SEQ ID NO: 91172 - RNA, 46 nt, Mus musculus
agaaccacaugagaucucaagagguuaaagagcaaaaggaauagaa

SEQ ID NO: 91173 - RNA, 46 nt, Mus musculus
cuuuaacggggcgguaagguuacuuacaugagaaguggaagaagau

SEQ ID NO: 91174 - RNA, 46 nt, Mus musculus
gccuuagccuccugagugcugggaucccaggcaugcgccgucauca

SEQ ID NO: 91175 - RNA, 42 nt, Mus musculus
acuucagauacgaaauaucccgccccacuuacaaugggaggu

SEQ ID NO: 91176 - RNA, 45 nt, Mus musculus
uccucucccuccuccuccuccccccuccucccccuugccccacuc

SEQ ID NO: 91177 - RNA, 46 nt, Mus musculus
aagggucagccugggcugcugagcaagaacccguuucagagguaga

SEQ ID NO: 91178 - RNA, 48 nt, Mus musculus
ggacagccaggaccugagaccuuguucaaaaaacuaaaaagaaaaaga

SEQ ID NO: 91179 - RNA, 42 nt, Mus musculus
gucugaggugauuucaagaaggcaggauugagugagccaaga

SEQ ID NO: 91180 - RNA, 42 nt, Mus musculus
cucuuacacucaggcaucugcauuuuguccauugagccaucu

SEQ ID NO: 91181 - RNA, 45 nt, Mus musculus
uugguguucggcuaaucaucucugguuacuugaaauacuggcagu

SEQ ID NO: 91182 - RNA, 67 nt, Mus musculus
aacacaugaacuacauauguagucuucuuaguacccacauaaagaaauaaaaaagaaauaaaugaaa

SEQ ID NO: 91183 - RNA, 37 nt, Mus musculus
ucagagcagggcuuccaaucuuccugagcugggauua

SEQ ID NO: 91184 - RNA, 42 nt, Mus musculus
guaccccacaagaaagugcgggauugagucuaggacccaggc

SEQ ID NO: 91185 - RNA, 45 nt, Mus musculus
uuucuucguuuuuauuuuaugugcauugguguuuugccuguauau

SEQ ID NO: 91186 - RNA, 45 nt, Mus musculus
augauuuaaaagaaaguuucuuuauauuuaaaaaugacccaagau

SEQ ID NO: 91187 - RNA, 46 nt, Mus musculus
caaccaucuguaacaagaucugacucccucuucuggaguguuugaa

SEQ ID NO: 91188 - RNA, 46 nt, Mus musculus
accagggagagaggaaaacuugaccuuaaaacuuugaaagagagac

SEQ ID NO: 91189 - RNA, 42 nt, Mus musculus
gugagcacuggaucccguggaacuggagucacagaugggguu

SEQ ID NO: 91190 - RNA, 23 nt, Mus musculus
aagaacugagacagagagaugaa

SEQ ID NO: 91191 - RNA, 45 nt, Mus musculus
uauauccagauacauagauuuuugaauccucaaaaugcaccuagu

SEQ ID NO: 91192 - RNA, 46 nt, Mus musculus
uuuccuagacugcacucugcuuucccugagcgacauucuggcagua

SEQ ID NO: 91193 - RNA, 85 nt, Mus musculus
uucuagguccacuguacuuugacacucacuuggagcuaaaccagauuuugccucaugccagguuaaggucaucacagccacagau

SEQ ID NO: 91194 - RNA, 46 nt, Mus musculus
uuuggacaagcaaugacugucuucuucaucaaggauugcugaaggu

SEQ ID NO: 91195 - RNA, 46 nt, Mus musculus
uuuauauuacuaacagugaaguuagggaccacagcucaguguaggg

SEQ ID NO: 91196 - RNA, 46 nt, Mus musculus
uguguguguguguguguguguguguguguguguguuagagguaaac

SEQ ID NO: 91197 - RNA, 45 nt, Mus musculus
cccccucacucccacccccaugcugugagugcuacacacccagcu

SEQ ID NO: 91198 - RNA, 45 nt, Mus musculus
guaaaaagacucauacacagaaaacaaaaguaaacaagucucuaa

SEQ ID NO: 91199 - RNA, 46 nt, Mus musculus
auuuguaucuuucagucuggagcucaaagaaaugaagaagguggau

SEQ ID NO: 91200 - RNA, 46 nt, Mus musculus
uguauguuucuaagaagcagucucaguaacugcugaagaaugagau

SEQ ID NO: 91201 - RNA, 46 nt, Mus musculus
agccaucuuuacauuuuuacacaggugcuggggauuacagucagag

SEQ ID NO: 91202 - RNA, 45 nt, Mus musculus
aacuugauuaggaaauaguuugaacuuacuaagaaaaccguagua

SEQ ID NO: 91203 - RNA, 45 nt, Mus musculus
ugaccugauguucugucugguaagugcuuagcauuagugaauaaa

SEQ ID NO: 91204 - RNA, 46 nt, Mus musculus
ucuuggauaggcuucagauuaaaaauaucuuuuggaaguacagaga

SEQ ID NO: 91205 - RNA, 25 nt, Mus musculus
uuaacucucggauuugaggugagug

SEQ ID NO: 91206 - RNA, 57 nt, Mus musculus
gggcaucugaggcaggcacgccuacuugcagggcagugaccuuuauaccuguuugca

SEQ ID NO: 91207 - RNA, 46 nt, Mus musculus
aaucaaaaagaagaaaaagcaaaguccucgggcacaaucacuccag

SEQ ID NO: 91208 - RNA, 45 nt, Mus musculus
agguaaaaaucuuucaucucagcaucaagagguagagguaggcag

SEQ ID NO: 91209 - RNA, 42 nt, Mus musculus
ccaguccacuacaggauucauccaagugcucuuucagcccca

SEQ ID NO: 91210 - RNA, 24 nt, Mus musculus
uugggaucuggguuugccuguuga

SEQ ID NO: 91211 - RNA, 46 nt, Mus musculus
caccucuuuuuccacgcaucuguccgugugcaugcagagaugccag

SEQ ID NO: 91212 - RNA, 36 nt, Mus musculus
uguauaggaccuacuccgagaucgucuccuaugaga

SEQ ID NO: 91213 - RNA, 46 nt, Mus musculus
uuccauuuaguuacccaguguuaagucuuuuauaucuuagacucag

SEQ ID NO: 91214 - RNA, 42 nt, Mus musculus
gauuaauaaacccuuuaucgugacaaaaauuuaauggcccag

SEQ ID NO: 91215 - RNA, 45 nt, Mus musculus
gugaaggaaauaccucccaucucuccuuuuuuuaaagacaagguc

SEQ ID NO: 91216 - RNA, 63 nt, Mus musculus
uaguccuugaacuagaucuguaggccucgaauucaagagaucugccugggauuaaaagugugc

SEQ ID NO: 91217 - RNA, 46 nt, Mus musculus
ugguugugagccuccauauggcugcugggaauugaacucaggaccu

SEQ ID NO: 91218 - RNA, 47 nt, Mus musculus
guuuuguaguuuguguguguggguguuuugccugcauguuucugagu

SEQ ID NO: 91219 - RNA, 44 nt, Mus musculus
cuggugguuauccucugguuaucacacuuccugagugguggacc

SEQ ID NO: 91220 - RNA, 45 nt, Mus musculus
uuuguguauauuugcacgcucauauacccguugacagaagguuag

SEQ ID NO: 91221 - RNA, 46 nt, Mus musculus
acauuaaggacauuucucuuaccuuuggauagguuugauaaagcag

SEQ ID NO: 91222 - RNA, 45 nt, Mus musculus
uauaaauuccaguaccgaggagaagcugaaaggaaagguuccuga

SEQ ID NO: 91223 - RNA, 45 nt, Mus musculus
auuacagacagcugugagcugccaugugggugcuggaaauccaac

SEQ ID NO: 91224 - RNA, 92 nt, Mus musculus
uguagcccuggcuguccuggaacuugcucagcagaccaggcuagccucaaacuccaacugccucugacccccaagugcauagguguggacca

SEQ ID NO: 91225 - RNA, 46 nt, Mus musculus
auacucacaagaccucagauaaccaaagucuugagucccuuuuccg

SEQ ID NO: 91226 - RNA, 46 nt, Mus musculus
uuagccauaaagaucuguaaaggaguuuucagaggaauggucacag

SEQ ID NO: 91227 - RNA, 42 nt, Mus musculus
ccgcucacugcaacagagagccaaggagacaacaggccccag

SEQ ID NO: 91228 - RNA, 42 nt, Mus musculus
cgagaccccgcugcgauggccggaggagggguggugguggcc

SEQ ID NO: 91229 - RNA, 44 nt, Mus musculus
ccucgaaguuguucuccucuacaucacucaugucggccaggcgc

SEQ ID NO: 91230 - RNA, 46 nt, Mus musculus
cggcggcggcccgcgugauugaaaggaaaccagcaggccaggucag

SEQ ID NO: 91231 - RNA, 42 nt, Mus musculus
aggcuaagcaauggcuccaagccgauguguuucauccagcag

SEQ ID NO: 91232 - RNA, 42 nt, Mus musculus
cuuccuguuuucaaucccagccuuacuuuacccccaccccua

SEQ ID NO: 91233 - RNA, 46 nt, Mus musculus
gucugggcaggauucuucucucacuuugcuguacauugaggacuaa

SEQ ID NO: 91234 - RNA, 46 nt, Mus musculus
augcuauaauccacagacccaaagaagcuaacaaggagggcccaag

SEQ ID NO: 91235 - RNA, 27 nt, Mus musculus
gguauggggguggacaggaguuugggu

SEQ ID NO: 91236 - RNA, 46 nt, Mus musculus
ccuauggauccaguuccccuaacugggcugccuugucuggccucag

SEQ ID NO: 91237 - RNA, 42 nt, Mus musculus
agaagggaggagguguggagggaggggcugugugagggggau

SEQ ID NO: 91238 - RNA, 42 nt, Mus musculus
agacauaacuccugaugaagaaacuagaaucuguggccuggg

SEQ ID NO: 91239 - RNA, 42 nt, Mus musculus
auggccaaggagccuaggaagccacguuuacuguaaggcaug

SEQ ID NO: 91240 - RNA, 42 nt, Mus musculus
cugagcuuccuguuguugguguucggacucaucugggggcug

SEQ ID NO: 91241 - RNA, 42 nt, Mus musculus
guguguaguuucagaacagcuacaaaagguugaugacagggu

SEQ ID NO: 91242 - RNA, 46 nt, Mus musculus
cuauugcuauuuaauaugauugauuccaauuuuuccccauagcuga

SEQ ID NO: 91243 - RNA, 46 nt, Mus musculus
cuaccaauggcaccaaugggaauuuggugccgguaacgaccaacaa

SEQ ID NO: 91244 - RNA, 46 nt, Mus musculus
uuaacaagguugauaugguaagcagggaggucaucucuguacagag

SEQ ID NO: 91245 - RNA, 45 nt, Mus musculus
aguauuuauucuauauaauaacugcuuaugugcagcuagccucua

SEQ ID NO: 91246 - RNA, 46 nt, Mus musculus
gcuucuccacagcugaauuuuaaaacuacuuuuuaaaggaucccag

SEQ ID NO: 91247 - RNA, 42 nt, Mus musculus
guuggaagucauguagaagaugcaguaacauuuugggcccag

SEQ ID NO: 91248 - RNA, 45 nt, Mus musculus
gaaacuucuugaaaguuucuagcauaucaggugguaguagauugu

SEQ ID NO: 91249 - RNA, 46 nt, Mus musculus
agacuaaaguuaguguauuuugagagcagugcaaacucaugagugg

SEQ ID NO: 91250 - RNA, 46 nt, Mus musculus
aaguuuguccucuugcuaauucaguuuuuggcaaucuugauccuaa

SEQ ID NO: 91251 - RNA, 46 nt, Mus musculus
cuuugggggaaggguagcaaaggccugggcuagagaauugggguag

SEQ ID NO: 91252 - RNA, 45 nt, Mus musculus
accucagcuacuuguccuggguuugaaacuuaacaaagaggagag

SEQ ID NO: 91253 - RNA, 45 nt, Mus musculus
cccagccaggcaugcuggcaaucacaccuuuaauuccagcacuag

SEQ ID NO: 91254 - RNA, 45 nt, Mus musculus
cucaggcugaguauggcacugucgauauaggggaagaaguggcaa

SEQ ID NO: 91255 - RNA, 94 nt, Mus musculus
uuucuauacaaaguuaaaaaaguagauuucuuucuguuagauaugguagcguguguccguacguacaggguuauuggaggcggaggcaggaaga

SEQ ID NO: 91256 - RNA, 41 nt, Mus musculus
cauucuuaucaauugaaccuggacaacauuuaucagacaca

SEQ ID NO: 91257 - RNA, 84 nt, Mus musculus
caucauccucaucaucuucaucaaguuuuacuuuuuucuguggaaccuuguuaccaccuccaggagcagaucacuuuccagaca

SEQ ID NO: 91258 - RNA, 46 nt, Mus musculus
uuuuaucauuauccacuuuaaagugauagucuuuaucagccuuuag

SEQ ID NO: 91259 - RNA, 46 nt, Mus musculus
agaggagagcuugccugcagagagugcucugacuacugggacucag

SEQ ID NO: 91260 - RNA, 46 nt, Mus musculus
gacauugaaaggcuuaaaagcacaacugagauggaaauugguugag

SEQ ID NO: 91261 - RNA, 41 nt, Mus musculus
aaauauuaaagauuagauauuuuauuagagguaaaaaggca

SEQ ID NO: 91262 - RNA, 46 nt, Mus musculus
uuacauauaauaaauaaauaaauaaaucuuuuaaaaaaaaaggcag

SEQ ID NO: 91263 - RNA, 45 nt, Mus musculus
ugaauuugagaguaggaagacauaggguuuggaggaaggggcaua

SEQ ID NO: 91264 - RNA, 46 nt, Mus musculus
uauaaggcaaaagacacugucaauagacaaaaaggccacgaacaga

SEQ ID NO: 91265 - RNA, 44 nt, Mus musculus
gaaauuaggaggaguguaagaccagugguuaauuauuggguugg

SEQ ID NO: 91266 - RNA, 25 nt, Mus musculus
aguaugugucuguuccuuugccagu

SEQ ID NO: 91267 - RNA, 44 nt, Mus musculus
gagugcaagauccaggguaugucgggauguguaaggggggagca

SEQ ID NO: 91268 - RNA, 46 nt, Mus musculus
uaaaaaccuugauuuuacuuucuucauguuucagauauggcaagag

SEQ ID NO: 91269 - RNA, 45 nt, Mus musculus
aauaguuuguaucagcagaaagaagauaauuaaaacaaccacaga

SEQ ID NO: 91270 - RNA, 27 nt, Mus musculus
aacuggaauucgauuaggaauggcacu

SEQ ID NO: 91271 - RNA, 46 nt, Mus musculus; identical to SEQ ID NO: 83741

SEQ ID NO: 91272 - RNA, 46 nt, Mus musculus
guuuuuguuggacaguccugauuuaaguaaaacugacuugucauaa

SEQ ID NO: 91273 - RNA, 52 nt, Mus musculus
guacaucccuggaacaaaaaugaucuucgcuggaauuaagaagaagggagaa

SEQ ID NO: 91274 - RNA, 85 nt, Mus musculus
guucagaagugugcccagugccacacuguggaaaagggaggcaagcauaagacuggaccaaaucuccacggucuguucgggcgga

SEQ ID NO: 91275 - RNA, 42 nt, Mus musculus
cauggaccugucuugagcacagacuugcuuuaaaggagaguc

SEQ ID NO: 91276 - RNA, 46 nt, Mus musculus
uuccccaguccucccucgccuucccgugccggacuaaagcaagaga

SEQ ID NO: 91277 - RNA, 41 nt, Mus musculus
gggaggguggguuuguaaagucguagucaccccugggaucu

SEQ ID NO: 91278 - RNA, 46 nt, Mus musculus
aaaaaugauauguuaagcaccugaaucuucauggaaagggaggggg

SEQ ID NO: 91279 - RNA, 28 nt, Mus musculus
cauguuccugcuacccccaaaguuucca

SEQ ID NO: 91280 - RNA, 46 nt, Mus musculus
ccauuauagccauccccaaauccacguccacuuccguauccaucug

SEQ ID NO: 91281 - RNA, 46 nt, Mus musculus
aucaaaaguaacaaagccaaagccucuuuucuuuccagacugccua

SEQ ID NO: 91282 - RNA, 46 nt, Mus musculus
auuuuauuuauaagugugcuuagagucaaagaaaauaaccaaggag

SEQ ID NO: 91283 - RNA, 45 nt, Mus musculus
cuacagcacccguaaucuuacguauuaugaaaaauaaaacggucu

SEQ ID NO: 91284 - RNA, 46 nt, Mus musculus
gcccgauuucccgcagccgagcgagaugagaaagaccuccgcggac

SEQ ID NO: 91285 - RNA, 41 nt, Mus musculus
acugagugggggaugggaggaagccauuuggagugggcggg

SEQ ID NO: 91286 - RNA, 46 nt, Mus musculus
uacuccuauacauaaaauaaauaagcaaaucuuuaaaaagagagag

SEQ ID NO: 91287 - RNA, 46 nt, Mus musculus
caaaaccugcuuacuaacuuaauaagccaguccuccuccccgcccc

SEQ ID NO: 91288 - RNA, 59 nt, Mus musculus
cguguaaucauuacucaagggguagggcaagacccugaagagaguaaagauagcggcaa

SEQ ID NO: 91289 - RNA, 46 nt, Mus musculus
ucaccagccuaaaggcgauagccaagauggcuuguggguuuuagaa

SEQ ID NO: 91290 - RNA, 42 nt, Mus musculus
aagaaaguuguauguacugucagaauuuagccacggggagga

SEQ ID NO: 91291 - RNA, 45 nt, Mus musculus
cugucauuuuggugugaaaccuugguuuucccacugaagauagau

SEQ ID NO: 91292 - RNA, 42 nt, Mus musculus
auuauccacagguaaaauucuuucaacaagcgcuaccgaguc

SEQ ID NO: 91293 - RNA, 45 nt, Mus musculus
cuauguaauuugauguaugggggucauuuggcuccagaggaggca

SEQ ID NO: 91294 - RNA, 45 nt, Mus musculus
agacacccagcaccugccccacccccaucacacacccggccaaua

SEQ ID NO: 91295 - RNA, 45 nt, Mus musculus
gacaaggcggacgaggaggaagaggaggaagaggaggaagaagag

SEQ ID NO: 91296 - RNA, 45 nt, Mus musculus
uggaagaaagagcauaaagaugagagccaggcucccacugcagcc

SEQ ID NO: 91297 - RNA, 28 nt, Mus musculus
cuugcuccuuugcacccaacucgcagag

SEQ ID NO: 91298 - RNA, 46 nt, Mus musculus
ccucguaaaaccgacacugaaagcugccggacaacaaaucacaggu

SEQ ID NO: 91299 - RNA, 44 nt, Mus musculus
gggguucaggaauagguaugagguugucgggggagggggcgaga

SEQ ID NO: 91300 - RNA, 46 nt, Mus musculus
cugagcaguaaaaggucgccagucuuccagcauggccugagcaguu

SEQ ID NO: 91301 - RNA, 46 nt, Mus musculus
uucauucucaggcuacuuuuaaugcuagauguccccagcuucagag

SEQ ID NO: 91302 - RNA, 44 nt, Mus musculus
ggccuagcuagccaccaccaguauggggagagagagagagagag

SEQ ID NO: 91303 - RNA, 46 nt, Mus musculus
uaaacuagcuguaaggauuucccagugaaaucagauuuggaaagaa

SEQ ID NO: 91304 - RNA, 42 nt, Mus musculus
gcuagaauucaauuugaacucagguuguuuauggggggagag

SEQ ID NO: 91305 - RNA, 50 nt, Mus musculus
gauuucauccuuucacaauaugcagacugugggaggaagaagaagagggg

SEQ ID NO: 91306 - RNA, 42 nt, Mus musculus
aguugcaaggaagcugggaaaggaagacaguuggagagagag

SEQ ID NO: 91307 - RNA, 45 nt, Mus musculus
auuugaucuuuuaaucuucguuggccacaauuaaaacaaaccaga

SEQ ID NO: 91308 - RNA, 42 nt, Mus musculus
ggaguagaagaaucuccugcggagccuggcaggugggccaga

SEQ ID NO: 91309 - RNA, 46 nt, Mus musculus
ggugcuggccuucucugaugguuuuagggcagcuguggguagauug

SEQ ID NO: 91310 - RNA, 41 nt, Mus musculus
ggcucccugggaucuuggcugagaagaggagcuaaggcgac

SEQ ID NO: 91311 - RNA, 24 nt, Mus musculus
auagagagacucccuucugagcua

SEQ ID NO: 91312 - RNA, 46 nt, Mus musculus
caccucgaggauccuagcccagccuaccuugaugguaguuucagga

SEQ ID NO: 91313 - RNA, 46 nt, Mus musculus
uauuuuugcuuccuguauauucuuauacauguuuuugacuccagaa

SEQ ID NO: 91314 - RNA, 46 nt, Mus musculus
ggcucccgggacuucuccaguugucauauuucuuucugaaauagau

SEQ ID NO: 91315 - RNA, 45 nt, Mus musculus
gcagacuugcuucauaagcaagauuaucuaaugaaggcuuaauaa

SEQ ID NO: 91316 - RNA, 42 nt, Mus musculus
ucucauuuauaaagugauaauaguaucaaccaacccccacua

SEQ ID NO: 91317 - RNA, 23 nt, Mus musculus
aaucugagugugucugcugcugu

SEQ ID NO: 91318 - RNA, 42 nt, Mus musculus
aaguauaaauaaaacgugcauuauaaaguuugaaggcgaagc

SEQ ID NO: 91319 - RNA, 42 nt, Mus musculus
aggagcugcucggucuggaaaccuuacauuuauggugggagg

SEQ ID NO: 91320 - RNA, 46 nt, Mus musculus
auucaauauauuaucgucauggcagggagcauggcagcaugcagau

SEQ ID NO: 91321 - RNA, 45 nt, Mus musculus
ugugucaacuguaagucuguuuuuaaaauaggaagacuggcuaac

SEQ ID NO: 91322 - RNA, 57 nt, Mus musculus
aauugaaccuucuuaccuagcaauugaagcacugacuagauaacuugcugaugauac

SEQ ID NO: 91323 - RNA, 48 nt, Mus musculus
aauccuucuguucccuuuucacaguggucccugggcuuuaggguuagg

SEQ ID NO: 91324 - RNA, 33 nt, Mus musculus
uccauguuagcauggcuugugaucaggcagucg

SEQ ID NO: 91325 - RNA, 45 nt, Mus musculus
ucccauuacccagccuagcuuguuuucgaauucauggccccuuuc

SEQ ID NO: 91326 - RNA, 45 nt, Mus musculus
uucuccuuuugugguguguguguguguguguguguguguguguac

SEQ ID NO: 91327 - RNA, 45 nt, Mus musculus
guugauuuuuacuguuuacagaugguagaccaagucaggcagaag

SEQ ID NO: 91328 - RNA, 46 nt, Mus musculus
ccagcuugugcugguuccuaaaccaaacugccucaaaccgggagac

SEQ ID NO: 91329 - RNA, 42 nt, Mus musculus
acacagcgagcagggguagggauacuuauucacuggcaagaa

SEQ ID NO: 91330 - RNA, 46 nt, Mus musculus
agcuuugagaucuugcugggaggaaaugaucccaacaugccccugg

SEQ ID NO: 91331 - RNA, 46 nt, Mus musculus
acaaaaugaagguaaaccacuguauguaugcuuugauugcccagca

SEQ ID NO: 91332 - RNA, 44 nt, Mus musculus
ggaguuagcaagaauaacuggaaaggauccucagcaucucauga

SEQ ID NO: 91333 - RNA, 45 nt, Mus musculus
uauguagcucauggcugugcaugcugucaagaaguaggguguauu

SEQ ID NO: 91334 - RNA, 46 nt, Mus musculus
uuuuuuguuuuuuguuuuuuuguuuuuuuuuaauuuguuaucagaa

SEQ ID NO: 91335 - RNA, 42 nt, Mus musculus
agaagaaguugccuggcccgggcaaggcugugggugcaaggc

SEQ ID NO: 91336 - RNA, 42 nt, Mus musculus
uuugaaacaucuguuacaaccaugcuucagaaagggagaaga

SEQ ID NO: 91337 - RNA, 46 nt, Mus musculus
gcagaucauggagauccaagaggggaauucucuuuuggcuucagag

SEQ ID NO: 91338 - RNA, 46 nt, Mus musculus
uguucucccagcaaguuugccuucuuucuuuccauagccacuuauc

SEQ ID NO: 91339 - RNA, 46 nt, Mus musculus
uuuuaucacaguaauagaaaaguaaccaauacauuucaacacggua

SEQ ID NO: 91340 - RNA, 46 nt, Mus musculus
uuugggaauuaguacuucuggacaaagaucacaugguaauggagau

SEQ ID NO: 91341 - RNA, 44 nt, Mus musculus
gaugcauuucacauuucucagaagauaagggaaauauucagaga

SEQ ID NO: 91342 - RNA, 45 nt, Mus musculus
cuucacaaagcucagugcugcuguuagcagugugguaggccaagu

SEQ ID NO: 91343 - RNA, 42 nt, Mus musculus
aauuaacuuuguuaauacuuccacaccuuacaugggccaaac

SEQ ID NO: 91344 - RNA, 45 nt, Mus musculus
aaggugguuguucacuuugagagggacaggaagaaggggagagac

SEQ ID NO: 91345 - RNA, 46 nt, Mus musculus
uuacuuguaaaaaugacaaaugagaucugauauaaagaccuaguag

SEQ ID NO: 91346 - RNA, 46 nt, Mus musculus
ccccuucucucucucucucucucucucucucucucucugugugugu

SEQ ID NO: 91347 - RNA, 47 nt, Mus musculus
uuggaaauuaggagacuucugguuuugcuauuuuaaaguagaaagag

SEQ ID NO: 91348 - RNA, 44 nt, Mus musculus
gauaauuugaauuguguuguaauuuauuuuguauggcaccguua

SEQ ID NO: 91349 - RNA, 45 nt, Mus musculus
caugauuuuccguguguuugucuuccugaaguagguuuuauaaga

SEQ ID NO: 91350 - RNA, 45 nt, Mus musculus
gagguuaccggguguuucagcaguuuacacacuauuggaguaaua

SEQ ID NO: 91351 - RNA, 46 nt, Mus musculus
ccacugaguuuaauuaaugcuuaccuuuuaaauuuuccucuuugcu

SEQ ID NO: 91352 - RNA, 46 nt, Mus musculus
guuccuugacugcgguuauagcacaagagauauagcaugcagaggc

SEQ ID NO: 91353 - RNA, 47 nt, Mus musculus
uaguuucagucagucugaagcauagagaagagagagggaugggggag

SEQ ID NO: 91354 - RNA, 45 nt, Mus musculus
uugagggaaaaugauaaucugugcucaaaguaacaggugagggau

SEQ ID NO: 91355 - RNA, 44 nt, Mus musculus
ccaguuuugucugaaacaguagcaguggcagagagaccgccaga

SEQ ID NO: 91356 - RNA, 46 nt, Mus musculus
uuuguugguauuuguggguuccuaaucuccuaagcguccugggaug

SEQ ID NO: 91357 - RNA, 46 nt, Mus musculus
uaugaugucauuauaauauauauuauuauaugaagaaccaccagac

SEQ ID NO: 91358 - RNA, 46 nt, Mus musculus
cagcgaggaaugcaggagaauucuauuuuuauugaauaaaggagaa

SEQ ID NO: 91359 - RNA, 48 nt, Mus musculus
ggaggccugcuguuuucugcagucaggagccugggcaccuaggggagg

SEQ ID NO: 91360 - RNA, 45 nt, Mus musculus
acuucauucagcaacugaugggagucgagcaagcaaacauuaggc

SEQ ID NO: 91361 - RNA, 47 nt, Mus musculus
cuucuaggggugauaguccaaggaaauaaugguuauuacuggguaga

SEQ ID NO: 91362 - RNA, 45 nt, Mus musculus
caaguuauuuccagaaaugcugugacaugaaagaaaaggaugaga

SEQ ID NO: 91363 - RNA, 45 nt, Mus musculus
ugaaaagcaaggaagcugugcccagguggggaauuaggggaagga

SEQ ID NO: 91364 - RNA, 44 nt, Mus musculus
gcaaaaauaagaaaugacaacaguaagaccaaguacuagauaga

SEQ ID NO: 91365 - RNA, 46 nt, Mus musculus
guaaaaauccucgaaaauauuucaaaccccccuagugcugcaaauu

SEQ ID NO: 91366 - RNA, 42 nt, Mus musculus
uucuuagagauuuuaaaaauaaaacaauauaaagccuggcac

SEQ ID NO: 91367 - RNA, 50 nt, Mus musculus
gagaugucugauuuucacaaaguaauuugauaauguuggcagauaaaaag

SEQ ID NO: 91368 - RNA, 49 nt, Mus musculus
uuugcuuuacauagccuuauuuuguuagaucuggguguagcacuuuggg

SEQ ID NO: 91369 - RNA, 46 nt, Mus musculus
aaaaaaaaaaaaaaaacacaacaacaacaacaaaaaacccccaaua

SEQ ID NO: 91370 - RNA, 45 nt, Mus musculus
gagugaguguagagacccaggagaguauuguguuugaggggaggg

SEQ ID NO: 91371 - RNA, 46 nt, Mus musculus
ucaagaugguggugggccucuugccuaacguucacaaggccuggga

SEQ ID NO: 91372 - RNA, 45 nt, Mus musculus
cuaggacuacuguauuacauuuaugugcuuguuucuucucuuaga

SEQ ID NO: 91373 - RNA, 46 nt, Mus musculus
uuugagauuacuagcuagcuccuggugcuuacucaagccugcagag

SEQ ID NO: 91374 - RNA, 46 nt, Mus musculus
aggagcauuuuccugaaauggacacagguggaggacuaaggcagac

SEQ ID NO: 91375 - RNA, 46 nt, Mus musculus
acuaauuaguuggagagugaccuguguucucagagagcaugaagug

SEQ ID NO: 91376 - RNA, 45 nt, Mus musculus
auucccgucucuaggucagguuggcuuuucuuuuaucugccagag

SEQ ID NO: 91377 - RNA, 46 nt, Mus musculus
ggcaugcuuuguacagugauucauuaaauguuuuagacaaggagau

SEQ ID NO: 91378 - RNA, 46 nt, Mus musculus
aauaugguuuguugaaaaugacucuaaacuaagcacacucgugauc

SEQ ID NO: 91379 - RNA, 69 nt, Mus musculus
uggccuugauuccccugucucuaccucccaaacuagaauugcagacauccauuaucauguucagcuuca

SEQ ID NO: 91380 - RNA, 46 nt, Mus musculus
cuauugauccuucaguuucaaaagaauuggcaaaagaaguugagaa

SEQ ID NO: 91381 - RNA, 42 nt, Mus musculus
acguuauggacuguccucugggcugguccaucugcagggagg

SEQ ID NO: 91382 - RNA, 41 nt, Mus musculus
aaucagacauuguuaauacauaccaaauguaugcggucauu

SEQ ID NO: 91383 - RNA, 41 nt, Mus musculus
uggagguagaagcuaaguuagguauuuuguuguugucuugu

SEQ ID NO: 91384 - RNA, 67 nt, Mus musculus
gcaggugagaaccaggacuaagggucacggcaaggaagaagacacagccagaggagaaugcugggaa

SEQ ID NO: 91385 - RNA, 44 nt, Mus musculus
uggaugaauggguagaugaagugucauauauguacuggaauguu

SEQ ID NO: 91386 - RNA, 46 nt, Mus musculus
agcauaacuuucuggaacgaucugaugacuuacuuuacuaagagac

SEQ ID NO: 91387 - RNA, 23 nt, Mus musculus
gaguuguaaaaccuaauuguugc

SEQ ID NO: 91388 - RNA, 44 nt, Mus musculus
uguugcacaggaaggacacgcuugauggaagugguagggucagu

SEQ ID NO: 91389 - RNA, 46 nt, Mus musculus
gauguaauagugcuccauuuucucuuuuuguuaauuugcuuauggg

SEQ ID NO: 91390 - RNA, 47 nt, Mus musculus
guauaccuguaaugccaacaccgggcagcugagauuggaggaucaga

SEQ ID NO: 91391 - RNA, 48 nt, Mus musculus
accaugaauucuguaccaccauuuuuuuuaacaauauucucgccuguc

SEQ ID NO: 91392 - RNA, 46 nt, Mus musculus
gcuaugacuaggcuagccuaaucaaaaggcucacaguucaggagau

SEQ ID NO: 91393 - RNA, 45 nt, Mus musculus
gaaaggaacacaggcugcagcaggugcaaguguggagccccacaa

SEQ ID NO: 91394 - RNA, 49 nt, Mus musculus
gagugaauguaaggggcacaugagcuggagauggggaaaaggaagggca

SEQ ID NO: 91395 - RNA, 42 nt, Mus musculus
uuuuuauagucuauauucauguguuccuuugauuagguagau

SEQ ID NO: 91396 - RNA, 45 nt, Mus musculus
gcaauagguagcagaugacagauaaggaauugugauuagccagau

SEQ ID NO: 91397 - RNA, 58 nt, Mus musculus
auuucugagcagcucccagucuuugcccucaggaaaaacuuaugaaauuucuuucugc

SEQ ID NO: 91398 - RNA, 46 nt, Mus musculus
ucucuugggcaccagagggggagggcugcuuuccaaacagcaagac

SEQ ID NO: 91399 - RNA, 45 nt, Mus musculus
uuaauagaaauuacaaaguucuaucuucuaauacuugugggccaa

SEQ ID NO: 91400 - RNA, 46 nt, Mus musculus
uuggaucugauauuuuaucagcugggauuauagcgcuugggagcug

SEQ ID NO: 91401 - RNA, 46 nt, Mus musculus
acacacauaaagagguucugcugguguuagaaccuugaggcuacaa

SEQ ID NO: 91402 - RNA, 46 nt, Mus musculus
cuauauuuucauaaaaguaaaaaaacaaaagcaaaaaaaccccaaa

SEQ ID NO: 91403 - RNA, 45 nt, Mus musculus
cuacucagcugcauacaagauuaagggaauuuuuagagacugggu

SEQ ID NO: 91404 - RNA, 45 nt, Mus musculus
auacagaaagaaagcauuaauucagcaguaauugauaacauacag

SEQ ID NO: 91405 - RNA, 53 nt, Mus musculus
ccuuucuuuuuuuagugucuauugcuaaagagaagucaucagguuuauauugg

SEQ ID NO: 91406 - RNA, 45 nt, Mus musculus
uuucuuauguagucuaggcugcccuuaaacucucuaaagccucgg

SEQ ID NO: 91407 - RNA, 60 nt, Mus musculus
cuuucucagccucaugaguaauggauuaaagaugugcaccacuacucuguuuauauuguu

SEQ ID NO: 91408 - RNA, 62 nt, Mus musculus
uuuauugauagguucuuuuauguucaacccccuuuuucauacccuuuuguauucccugacuc

SEQ ID NO: 91409 - RNA, 45 nt, Mus musculus
uagugccugucucucuguguguguguauguacaugugugugucca

SEQ ID NO: 91410 - RNA, 59 nt, Mus musculus
uggguugucaggcgugguggaaaagccuuuuauccauugaguuuacacacaugcucacc

SEQ ID NO: 91411 - RNA, 46 nt, Mus musculus
aguacauugaauuuaauuaaaaguauuauuuuggauuguuggucag

SEQ ID NO: 91412 - RNA, 45 nt, Mus musculus
auuuguuuguacuggaaagaaguucaccauauacccugcccaaag

SEQ ID NO: 91413 - RNA, 46 nt, Mus musculus
cuaauguauuaggguuuuacugcugugaacagauaccaugaccaag

SEQ ID NO: 91414 - RNA, 44 nt, Mus musculus
gcugggagaugcaguguagcggugcauccagcugugguucaggg

SEQ ID NO: 91415 - RNA, 46 nt, Mus musculus
gcuauauuuguucuuaaaagauuucaaaauagaaauuugaagcaga

SEQ ID NO: 91416 - RNA, 46 nt, Mus musculus
aaaaacauaaaagacuaaacaaaccaaaaaaaucguuacauucagg

SEQ ID NO: 91417 - RNA, 46 nt, Mus musculus
uuugagaacauuuauucuaugcauuugaauaaaaagauuauuccag

SEQ ID NO: 91418 - RNA, 66 nt, Mus musculus
uguucuugaaaaagaaacagcacagcugagagaacaaguuggaagaauggagagagaacugagcca

SEQ ID NO: 91419 - RNA, 84 nt, Mus musculus
uuacacaguuugaaggauaagcucaggaaggcacagcaugagagagagcagcuugaaugucagcugcagacagaaaaggaugag

SEQ ID NO: 91420 - RNA, 42 nt, Mus musculus
uagugucggccucugcuuagccccagugggcuuuugggguug

SEQ ID NO: 91421 - RNA, 47 nt, Mus musculus
caguggcauuggucuguuaucccaguuccuggaacgaggggggaggu

SEQ ID NO: 91422 - RNA, 45 nt, Mus musculus
agcuugggucgccugacacccagcuccuccucuggaauuugugga

SEQ ID NO: 91423 - RNA, 60 nt, Mus musculus
uacagacuuuaaagaauuuagauggaaacaaagaaagcaugauuacccauuucaaagaag

SEQ ID NO: 91424 - RNA, 44 nt, Mus musculus
uauacauguauauuuacauuuuaacucaaaugagagagagagag

SEQ ID NO: 91425 - RNA, 46 nt, Mus musculus
aaagagcucagugaugcagugaaugugcgagauaaaacuauggcag

SEQ ID NO: 91426 - RNA, 42 nt, Mus musculus
agaggcuccaaaagcaaauaaacaaacuuucagaccaggcag

SEQ ID NO: 91427 - RNA, 50 nt, Mus musculus
gguugcguggucccacaguuuuagguucucaggaacaaauaggagcaagg

SEQ ID NO: 91428 - RNA, 38 nt, Mus musculus
uuuuagcacauuuuaaaaaaauguaagauuuugccugc

SEQ ID NO: 91429 - RNA, 46 nt, Mus musculus
auaggcgaguacuaacagugucuucacaaagaaaauggggagucag

SEQ ID NO: 91430 - RNA, 46 nt, Mus musculus
uugacgauucugacccugaaacaucuggggaaagaagugcuuucag

SEQ ID NO: 91431 - RNA, 46 nt, Mus musculus
ccucagacagacuaaauuuuucuuugaacaaauuuauuuuuggcua

SEQ ID NO: 91432 - RNA, 42 nt, Mus musculus
aauugugauuaaaaacugcaugguacaucgacagacagguag

SEQ ID NO: 91433 - RNA, 46 nt, Mus musculus
augagaaaacuaagugcaauaaauacgcugaagaacuugccaaaau

SEQ ID NO: 91434 - RNA, 58 nt, Mus musculus
aaguggaaagaacaagugaaaauugcugaaaauguaaaacuugaacuagcugaaguag

SEQ ID NO: 91435 - RNA, 41 nt, Mus musculus
gcaagguaugguggccccaccauugaugucuggagucugag

SEQ ID NO: 91436 - RNA, 45 nt, Mus musculus
aaagggggaagaaguaaaaaggaagcacaguguagacuaggggaa

SEQ ID NO: 91437 - RNA, 46 nt, Mus musculus
agauuggcuaaugagagagaaggguucuuacuaugugugccuggag

SEQ ID NO: 91438 - RNA, 45 nt, Mus musculus
gaaaugagucuuuaauaaugacccccccacccccaccucacugaa

SEQ ID NO: 91439 - RNA, 46 nt, Mus musculus
gaauacaggucccccuggaaaggaugaagggcgugcucagcaguca

SEQ ID NO: 91440 - RNA, 51 nt, Mus musculus
gcccauugauagcauucucagucagacgaccacagcauccuaacaaacagc

SEQ ID NO: 91441 - RNA, 31 nt, Mus musculus
gacgaaaaugugcccauuccuccugauccag

SEQ ID NO: 91442 - RNA, 46 nt, Mus musculus
aggcaguugagagccaagagagggggaacaagcugacccugugcag

SEQ ID NO: 91443 - RNA, 46 nt, Mus musculus
guguauucauccuuggaaguaaaaaaaaaacaaaaacauucugguu

SEQ ID NO: 91444 - RNA, 45 nt, Mus musculus
uccaauuuuaaaacuauauuuaguagugguuuucuaaaaaggcag

SEQ ID NO: 91445 - RNA, 46 nt, Mus musculus
uccccucugugaauuaauguucccuccuaacuacgaucagaccaaa

SEQ ID NO: 91446 - RNA, 46 nt, Mus musculus
agcaauuacaaaacaaaccacaucucagaggcuaaggagaugccag

SEQ ID NO: 91447 - RNA, 41 nt, Mus musculus
agaacuucuuuagcgugugcugucacuagggccaggguaca

SEQ ID NO: 91448 - RNA, 46 nt, Mus musculus
augaaaugauaaauuuuaaaaucguacuuagauguggagcugcaag

SEQ ID NO: 91449 - RNA, 46 nt, Mus musculus
uguuuuuaugccuguguagcugcugaacuacugauccagcccgcag

SEQ ID NO: 91450 - RNA, 45 nt, Mus musculus
cagagagggggcagccauggaguugggcgaacugcuguacaacaa

SEQ ID NO: 91451 - RNA, 32 nt, Mus musculus
cucgauguacuccgacuuguuguacagcaguu

SEQ ID NO: 91452 - RNA, 46 nt, Mus musculus
cggcuuuucacaacacagugacauccaacucuuacacuugcgaguu

SEQ ID NO: 91453 - RNA, 43 nt, Mus musculus
ugucacuguguugugaaaagccguagugucauaaggccaccau

SEQ ID NO: 91454 - RNA, 46 nt, Mus musculus
cacacagucuuccucaauaaagacaugauccccaauaugcagagga

SEQ ID NO: 91455 - RNA, 72 nt, Mus musculus
uggggaucaugucuuuauugaggaagacuguguggucaacgcugcccagauugguucuuauguucacguugg

SEQ ID NO: 91456 - RNA, 24 nt, Mus musculus
uucauggacagcaccggcgguggu

SEQ ID NO: 91457 - RNA, 42 nt, Mus musculus
ggaggcccuacgugagcugcgccuggaagguaaccggcugaa

SEQ ID NO: 91458 - RNA, 35 nt, Mus musculus
gacgcgggggccgaggugcuguaggcuguuggcug

SEQ ID NO: 91459 - RNA, 42 nt, Mus musculus
aaacaguuuucugcagaaaugcaacaaguagcaccccagauu

SEQ ID NO: 91460 - RNA, 44 nt, Mus musculus
gaaucuggggugcuacuuguugcauuucugcagaaaacuguuuc

SEQ ID NO: 91461 - RNA, 24 nt, Mus musculus
ccggcggaaauucguucuucccac

SEQ ID NO: 91462 - RNA, 42 nt, Mus musculus
gagggagugauggucacaggguggaggggauggaccugggag

SEQ ID NO: 91463 - RNA, 48 nt, Mus musculus
cagcuaaacuuucaaacagaaguaugaaagaaagacauaccuggagaa

SEQ ID NO: 91464 - RNA, 43 nt, Mus musculus
gggguaacuguaacuguugccaccugcauuuuucuggggaggu

SEQ ID NO: 91465 - RNA, 42 nt, Mus musculus
auugcaacacgaauucugcauugacauuguuacuggcgagaa

SEQ ID NO: 91466 - RNA, 46 nt, Mus musculus
uuauuucccuuagcaucuucaccucuggggauaauuccugccaguu

SEQ ID NO: 91467 - RNA, 46 nt, Mus musculus
uuccuuguaaucaacacaccaaaauaugguaggcauggcagagagu

SEQ ID NO: 91468 - RNA, 46 nt, Mus musculus
uucuuucuaaugguaacauggcaacuggaaacacaccccagcauac

SEQ ID NO: 91469 - RNA, 42 nt, Mus musculus
auggacaagcacccgcauauacuccuaagaacacccgcaaau

SEQ ID NO: 91470 - RNA, 46 nt, Mus musculus
uccauccaucauucacagaacugugucugcauuaauccagacaaua

SEQ ID NO: 91471 - RNA, 46 nt, Mus musculus
uacccagauuuuguuaaccauuguacucauauacuuagcccaagga

SEQ ID NO: 91472 - RNA, 46 nt, Mus musculus
guuguuguuuuaaucucuuuuggugauuucuaguuucuucucagau

SEQ ID NO: 91473 - RNA, 45 nt, Mus musculus
ugucaggauuuuuauccaagaaaagugucuaucacagguuagaug

SEQ ID NO: 91474 - RNA, 42 nt, Mus musculus
cucggucggcagggggaugacccugaaggugccuagggagau

SEQ ID NO: 91475 - RNA, 46 nt, Mus musculus
ggggaaacagcuuugcuuucuacagaagccaaaauucgguccuccc

SEQ ID NO: 91476 - RNA, 45 nt, Mus musculus
ucuguguucugucugcuacguggauuuuagauuaagagacaccaa

SEQ ID NO: 91477 - RNA, 27 nt, Mus musculus
augccuuaacuggguuagaauacugag

SEQ ID NO: 91478 - RNA, 47 nt, Mus musculus
uuggucucaccagcuuauagcuguaggucuagcagcaugcccccagg

SEQ ID NO: 91479 - RNA, 44 nt, Mus musculus
cuccaacagauagcaauaaauagcuccagaaguggagucaggag

SEQ ID NO: 91480 - RNA, 42 nt, Mus musculus
uucagucuggagaaauuuaccaacauccccacucaagggcug

SEQ ID NO: 91481 - RNA, 87 nt, Mus musculus
gccgacccagcucgccucgcuguuggguugcaguggagucuaagaaaacgaggaagagaugaaacccgaguuucuuggcagugcgcu

SEQ ID NO: 91482 - RNA, 41 nt, Mus musculus
aguuccuguggcucccauggcuccuuccucuguguggccca

SEQ ID NO: 91483 - RNA, 46 nt, Mus musculus
uccugaggcuggcaccguagagcuagaacuauguguagaaagucau

SEQ ID NO: 91484 - RNA, 42 nt, Mus musculus
gagcagagacugaaggaauggucauccagagacugccccacc

SEQ ID NO: 91485 - RNA, 45 nt, Mus musculus
uaaaccacaaaucaaagaaaaugcauggugggacucauggcucua

SEQ ID NO: 91486 - RNA, 42 nt, Mus musculus
gugccuccccaaggucgccaguggaaucaacagaccaugaag

SEQ ID NO: 91487 - RNA, 31 nt, Mus musculus
ggcagcuuacuuaaucgugagaacagcccgg

SEQ ID NO: 91488 - RNA, 46 nt, Mus musculus
aauauaagaugaauuuuuaucaaaaauguauuuaaacuuugaccag

SEQ ID NO: 91489 - RNA, 45 nt, Mus musculus
gggcgauuuacucuucuagcuuugaacacuauccuaaugcagcug

SEQ ID NO: 91490 - RNA, 44 nt, Mus musculus
aucacucaggaaagugacagugaaggcuugguagguagcagaca

SEQ ID NO: 91491 - RNA, 49 nt, Mus musculus
cagaaagaugacaggagagggaucaugaauucgcaucaguauuggaggg

SEQ ID NO: 91492 - RNA, 42 nt, Mus musculus
cacugaguggcucggucaguccaucuacaauuuccagcuuga

SEQ ID NO: 91493 - RNA, 46 nt, Mus musculus
uacagaggaauacuauguacugcaguuccaggcuaacguggcagag

SEQ ID NO: 91494 - RNA, 42 nt, Mus musculus
ccaagaaagauccaaggcuccgcacgcugucuccccacaacu

SEQ ID NO: 91495 - RNA, 46 nt, Mus musculus
auguauuuuauuaugucuaggacugggggacagugagaguuugggu

SEQ ID NO: 91496 - RNA, 24 nt, Mus musculus
aauauagacaauaacgccugacac

SEQ ID NO: 91497 - RNA, 45 nt, Mus musculus
uagauauccguuaguuuuccagggagagacagaaaggagguggau

SEQ ID NO: 91498 - RNA, 47 nt, Mus musculus
cacguccuucaccaugaagucagcaaauuugucuacguggccagagg

SEQ ID NO: 91499 - RNA, 46 nt, Mus musculus
cauuauaguucacaaaaagauccgcaaguucuuguuguccauaguu

SEQ ID NO: 91500 - RNA, 56 nt, Mus musculus
gaaggucuggaacauuaaguuaaaagguaccggaggggacaggucauugccagugg

SEQ ID NO: 91501 - RNA, 42 nt, Mus musculus
ugaaauucaggaaaauucccugugcaguuucuggucucagau

SEQ ID NO: 91502 - RNA, 46 nt, Mus musculus
uggcuuuccaaagagauuucucucaacugcaauuuaguagcuauua

SEQ ID NO: 91503 - RNA, 45 nt, Mus musculus
guccagugaccugggcuuuugcugaguacaaauaaaggcagaggu

SEQ ID NO: 91504 - RNA, 41 nt, Mus musculus
aaccgcugucugguuaguucuuugguccacucuggcaugaa

SEQ ID NO: 91505 - RNA, 46 nt, Mus musculus
acauagguagcacuuaccugucaaaggccuucuaaaacaacccauc

SEQ ID NO: 91506 - RNA, 45 nt, Mus musculus
cagggauggaaacucauccucacgcuugcacaguaagcaccugau

SEQ ID NO: 91507 - RNA, 45 nt, Mus musculus
agcagacugugucugcuguccagaaagggcauucuuguuauggau

SEQ ID NO: 91508 - RNA, 42 nt, Mus musculus
gucuccacguccccacgaccccacgaccccacguccccagca

SEQ ID NO: 91509 - RNA, 42 nt, Mus musculus
ugcucuuagggccgagggcagggagaaaugggauugugagug

SEQ ID NO: 91510 - RNA, 46 nt, Mus musculus
aaaagaauugauggauagauaauaagugauggauagauggauaggg

SEQ ID NO: 91511 - RNA, 82 nt, Mus musculus
agauaaaggugaguagaaugaugcaugaaugaguggagaagauggaaggaaggagaaaggaagaagaugaauaugugcaagg

SEQ ID NO: 91512 - RNA, 54 nt, Mus musculus
aagaauguauggaugggaaguagaauaaaaagaaugggugaacagauggaugga

SEQ ID NO: 91513 - RNA, 45 nt, Mus musculus
uguugaauaaaggugagcuuuugggugcacacauaccucuugauu

SEQ ID NO: 91514 - RNA, 46 nt, Mus musculus
cuccauuuaaucuaucuuuuuagugaaauuacaccagaaggaagaa

SEQ ID NO: 91515 - RNA, 28 nt, Mus musculus
cuuauauguuagauaauaaccaagagag

SEQ ID NO: 91516 - RNA, 42 nt, Mus musculus
ugacaaagguaucuuauggaagaaugcguuuaacugggggcu

SEQ ID NO: 91517 - RNA, 46 nt, Mus musculus
caacacuaugauagugcaaauucaaaagguuuguuguuggcaagag

SEQ ID NO: 91518 - RNA, 45 nt, Mus musculus
cuucaucacaaugugaauucuugacccuauacauuuguccacaag

SEQ ID NO: 91519 - RNA, 41 nt, Mus musculus
ggugggugggugggggagcacccucauagaagcaauugggg

SEQ ID NO: 91520 - RNA, 46 nt, Mus musculus
aagugaaagcuaaggcaaacauuugugcuaacgauuaaacagagau

SEQ ID NO: 91521 - RNA, 42 nt, Mus musculus
cccuccccucuccgccuccuuuuccuuuagacccgcccccug

SEQ ID NO: 91522 - RNA, 45 nt, Mus musculus
aaggcugccgcucugggucgugcggccgggccucggcguuuggag

SEQ ID NO: 91523 - RNA, 41 nt, Mus musculus
gucagucuccaccaaccugcugggugucuacccauaaagga

SEQ ID NO: 91524 - RNA, 48 nt, Mus musculus
agguuuggggcccuugugagauuuccccuaucugcuuugccauagcua

SEQ ID NO: 91525 - RNA, 50 nt, Mus musculus
ucacagauaauaucuuguccucugacuccuagaaucuuuccacccccacu

SEQ ID NO: 91526 - RNA, 76 nt, Mus musculus
uuguguuauagauguaucaucuacuuggguuggguaccucauggucaguuguccucugcauuuugaacaguuguag

SEQ ID NO: 91527 - RNA, 42 nt, Mus musculus
aauaaagacaaaauccugagagggaaggacauggaguuggag

SEQ ID NO: 91528 - RNA, 46 nt, Mus musculus
guaaguacacuguugcuguuucaaacaugacagaagaaggcaucgg

SEQ ID NO: 91529 - RNA, 46 nt, Mus musculus
ugucucuaauuaacuuuauagauaaaaugauaaaauguauaggcag

SEQ ID NO: 91530 - RNA, 46 nt, Mus musculus
uaugugaauauuauuuuaaugagucagagauuaaaugggcaggcag

SEQ ID NO: 91531 - RNA, 45 nt, Mus musculus
caacuauaauuaccagcagcuaaagaacaaaacaaaaccuugcca

SEQ ID NO: 91532 - RNA, 46 nt, Mus musculus
aagaauacucacaacuacaggguauggaacagcaauaagcauccgg

SEQ ID NO: 91533 - RNA, 45 nt, Mus musculus
ucaugaauuugagagagcaaagugaguuacguuguaagguuugga

SEQ ID NO: 91534 - RNA, 46 nt, Mus musculus
aaaaaagacacuuugcuuuuacauuuuuaaaacaaaaaggggagaa

SEQ ID NO: 91535 - RNA, 46 nt, Mus musculus
uguauuuuuaaguugggcuaaugcuuggucccuaccccagaugaag

SEQ ID NO: 91536 - RNA, 46 nt, Mus musculus
aguucacauuuagaaaagcaagaaguuggccaaggagaugauuuag

SEQ ID NO: 91537 - RNA, 46 nt, Mus musculus
cuuauauucacacacacaaagacaccucaaaugaaagaacaguaag

SEQ ID NO: 91538 - RNA, 46 nt, Mus musculus
auguaguuaaaaacuuaacucuuaaaaugguuacuuaacuggucag

SEQ ID NO: 91539 - RNA, 62 nt, Mus musculus
gcuuuucaagggccauaggccauuuuguugcugggggcaucaccuaaugcagcagccugugu

SEQ ID NO: 91540 - RNA, 49 nt, Mus musculus
ugcuguugagguaguuuugaucguaguguaacgacaaaggcacagauaa

SEQ ID NO: 91541 - RNA, 45 nt, Mus musculus
auauguauaucugauuuauaaccaacaugaauuguccacccccaa

SEQ ID NO: 91542 - RNA, 46 nt, Mus musculus
aaugagaagcuauuacauggcugagaaacagggcacuuaagucuga

SEQ ID NO: 91543 - RNA, 46 nt, Mus musculus
aaaaaugacuuccuaccuacauuaugaagaagaaacuggcugccuc

SEQ ID NO: 91544 - RNA, 45 nt, Mus musculus
uuacaacuuguuuauggaauaagaagauaaaugucccuuuccugg

SEQ ID NO: 91545 - RNA, 45 nt, Mus musculus
guuggcucuaauugguaaauaaaguugccuguggccaauggcuga

SEQ ID NO: 91546 - RNA, 42 nt, Mus musculus
cccagagcuaugugaacaacaugaagaaagacuagggagcag

SEQ ID NO: 91547 - RNA, 42 nt, Mus musculus
guaagaaacagaauuucacuuuuguuuucuauuucaggggag

SEQ ID NO: 91548 - RNA, 42 nt, Mus musculus
cacauauguaaguguaucaggccugugacuggugcccagcag

SEQ ID NO: 91549 - RNA, 41 nt, Mus musculus
aauucuucacaacugaagaggucagcaaaacucagcagccg

SEQ ID NO: 91550 - RNA, 44 nt, Mus musculus
aaaagguuacuuuuauuuacugugcaugucuacacuguguguga

SEQ ID NO: 91551 - RNA, 46 nt, Mus musculus
aaaauaccugggaaaaauguuaaccauuaacaaguuguaaggccag

SEQ ID NO: 91552 - RNA, 46 nt, Mus musculus
gccaugacucagcuacaaaguggccaguuauauaaagacccccccc

SEQ ID NO: 91553 - RNA, 44 nt, Mus musculus
ugagguuugucccugaucuauacacauaaaguggcaugugcacu

SEQ ID NO: 91554 - RNA, 46 nt, Mus musculus
aaaucauguuuucccauaaaaccauggaagcgaaaggaaacuccag

SEQ ID NO: 91555 - RNA, 46 nt, Mus musculus
acacacacacacacacacacacacacacacacagagagagcugggg

SEQ ID NO: 91556 - RNA, 45 nt, Mus musculus
uaacucacaggaagaaaauauaauuucagucagagcacaccgcug

SEQ ID NO: 91557 - RNA, 46 nt, Mus musculus
caaagucuuucaaguuuacuaucuuaauuccuugcuuaacuuaaag

SEQ ID NO: 91558 - RNA, 44 nt, Mus musculus
cuacuaggccaggcgcuuggcggggcgggaagugggggagagca

SEQ ID NO: 91559 - RNA, 42 nt, Mus musculus
ccgccuucaucuggcucaccgcgcccuuuuccucugccccac

SEQ ID NO: 91560 - RNA, 45 nt, Mus musculus
ggccggcgcgaccccgcucugcuacgcgcacgcgccuuagcagcc

SEQ ID NO: 91561 - RNA, 45 nt, Mus musculus
guuauugggucgugaccuaggaauuccauauucacgcagucaaga

SEQ ID NO: 91562 - RNA, 46 nt, Mus musculus
cgagaccaugucaaagagacucaaguuccaccuaggagaggcggag

SEQ ID NO: 91563 - RNA, 46 nt, Mus musculus
gagcacugugaugguuccuggcaguaaaaugugaauuugauguuag

SEQ ID NO: 91564 - RNA, 46 nt, Mus musculus
gucuuuaauggccucagauucauuccuggguauuuugugugugcau

SEQ ID NO: 91565 - RNA, 46 nt, Mus musculus
aguuuucuaauauuuuauugagaauuuucacaucuauguucaugag

SEQ ID NO: 91566 - RNA, 45 nt, Mus musculus
auggaauuuggauucacaucuuguucagaaaaauaaaauaaccua

SEQ ID NO: 91567 - RNA, 45 nt, Mus musculus
cacugagguuguacagugagugauacaugggcuaacaggcucuug

SEQ ID NO: 91568 - RNA, 48 nt, Mus musculus
uacuaauaucuaacuagcuacuuaacaguaccagggagucagaacuuu

SEQ ID NO: 91569 - RNA, 46 nt, Mus musculus
guuauugcuuuccaagcuccuacuaggauagcccauuaagcccuac

SEQ ID NO: 91570 - RNA, 46 nt, Mus musculus
augaaucacaaugugauauguaggauauuugauauaugacccccgu

SEQ ID NO: 91571 - RNA, 87 nt, Mus musculus
ccaugacugauccaacuuauagugaaauucauuuaauuaggggcuugcuuauaguuucauagggcuaguuaaugaucauuaaggcag

SEQ ID NO: 91572 - RNA, 46 nt, Mus musculus
gauguccuuuuccuuacagaaguuuuucaguuuuaugaggucacau

SEQ ID NO: 91573 - RNA, 46 nt, Mus musculus
ugugguuuauauuacuguugcugugcaguaccacuugaaaucggag

SEQ ID NO: 91574 - RNA, 46 nt, Mus musculus
gcagcuuuuaauauuuuucuuuguucuauacauuuagugcuuugau

SEQ ID NO: 91575 - RNA, 47 nt, Mus musculus
uauggagcccaggugaugagguguaguauaaggcuuuuggguaugcu

SEQ ID NO: 91576 - RNA, 28 nt, Mus musculus
gcaguucacugcuguuaucugugcucua

SEQ ID NO: 91577 - RNA, 45 nt, Mus musculus
cuaaauuacagguguuccagguuugugcuccucucuuauccugag

SEQ ID NO: 91578 - RNA, 46 nt, Mus musculus
ugugaaaagauauaaugagaagccaagucaggaguauggugcacag

SEQ ID NO: 91579 - RNA, 23 nt, Mus musculus
acaugaaaaaugacaauacaagu

SEQ ID NO: 91580 - RNA, 55 nt, Mus musculus
uacuugaaagaggccauggaguguagcgaugugauuuggcagcgaggucugcucc

SEQ ID NO: 91581 - RNA, 46 nt, Mus musculus
uggcaauggcuauuccuuuuugucccuuuaucgccugacgcaggau

SEQ ID NO: 91582 - RNA, 45 nt, Mus musculus
uuuuaaauugaugaugguacuuuccuuauguccuuacagccccug

SEQ ID NO: 91583 - RNA, 42 nt, Mus musculus
uuucugacaucuugguaccagagacagcacgguuuccagcau

SEQ ID NO: 91584 - RNA, 86 nt, Mus musculus
aggugcaaaaagacaacuaacauacccguuggaccaaaagccaccugauugauuagugccugacacagaacccacuguaaacccua

SEQ ID NO: 91585 - RNA, 46 nt, Mus musculus
caggacagaaaccuucacaagcccccuuuguugcaaagacccccaa

SEQ ID NO: 91586 - RNA, 46 nt, Mus musculus
auguucagugacucaaauaagucugaaagccaaauauccccugcag

SEQ ID NO: 91587 - RNA, 45 nt, Mus musculus
ugcccacugggaaugcagaccgaauaauuaauagccaccccucag

SEQ ID NO: 91588 - RNA, 45 nt, Mus musculus
gcagcuggaagauggccgcacucucucugauuacaacaucccugc

SEQ ID NO: 91589 - RNA, 45 nt, Mus musculus
ugguuugugcuuucaucacauuuguuaacaggucaaaaugcagau

SEQ ID NO: 91590 - RNA, 44 nt, Mus musculus
uugaccuguuaacaaaugugaugaaagcacaaaccacccagcgc

SEQ ID NO: 91591 - RNA, 44 nt, Mus musculus
gaggccuggccuggugggggaggaguggagacauccucuuggag

SEQ ID NO: 91592 - RNA, 41 nt, Mus musculus
gcgucuacuuccgggcggcgcgccgcucccgcuucggcccu

SEQ ID NO: 91593 - RNA, 86 nt, Mus musculus
agcagggcaaacaccccagacucagauguaacugagaaaacaggugaguuacaauguugcacacugauaacaaccggaggugacag

SEQ ID NO: 91594 - RNA, 46 nt, Mus musculus
aguuuugugcauugaaauccagcauugggacugccauagccaccaa

SEQ ID NO: 91595 - RNA, 46 nt, Mus musculus
ccagcacugaucuuuucugcaagcuagaugugacagaugcuugaag

SEQ ID NO: 91596 - RNA, 45 nt, Mus musculus
auucaaaccaauuguagcagagcauuauggauaagcagaacugag

SEQ ID NO: 91597 - RNA, 45 nt, Mus musculus
aucuucacacacgccaaaagaaggcaucagaucucauuacaggua

SEQ ID NO: 91598 - RNA, 46 nt, Mus musculus
uggcuuuugagcacaaguggguuuugagggauuaaaauaauggcag

SEQ ID NO: 91599 - RNA, 41 nt, Mus musculus
cugggaauaaaggcgugauaggguuucucuguguagcccug

SEQ ID NO: 91600 - RNA, 41 nt, Mus musculus; identical to SEQ ID NO: 91599

SEQ ID NO: 91601 - RNA, 46 nt, Mus musculus
gcaggaaauucauguugaauuuuguuccuuuuagaaaaguauuuag

SEQ ID NO: 91602 - RNA, 42 nt, Mus musculus
aacuguagguuguguucugugaaccauuuaguuuagccaaga

SEQ ID NO: 91603 - RNA, 47 nt, Mus musculus
gccggguauauugguuuauuuauaccuuguaaucccagcacuugagu

SEQ ID NO: 91604 - RNA, 44 nt, Mus musculus
uugauucucugcuggggagaagcuucagcaagacuuugggguga

SEQ ID NO: 91605 - RNA, 41 nt, Mus musculus
aaagaaauuuugguuuuaagacagaaacagggagcuggaaa

SEQ ID NO: 91606 - RNA, 46 nt, Mus musculus
agaaccgccagacaaugaaagaaaagcaaguuuaucauguuuccaa

SEQ ID NO: 91607 - RNA, 46 nt, Mus musculus
ugcccagcugucuguaauugcuuugugauuaacuauugagucccag

SEQ ID NO: 91608 - RNA, 45 nt, Mus musculus
guuuaauggcucugaggugguaauugccuaguguuuguaaguaaa

SEQ ID NO: 91609 - RNA, 45 nt, Mus musculus
uauugagcagagguaaaaugauagauguuuaaaaggccuugauag

SEQ ID NO: 91610 - RNA, 46 nt, Mus musculus
uggacaucugaauagagaugugaaguaauuaacuugugauauucaa

SEQ ID NO: 91611 - RNA, 46 nt, Mus musculus
guucagguugccuugaauucaugaccuccagucucagccuguugag

SEQ ID NO: 91612 - RNA, 46 nt, Mus musculus
cgacagaacuuuaggaaggagcugagaaguugguaacuguguguag

SEQ ID NO: 91613 - RNA, 25 nt, Mus musculus
gaaucccaugaccuuccuucuguua

SEQ ID NO: 91614 - RNA, 45 nt, Mus musculus
agaacagccaaggcuauucaacagagaaaccaugucuugguagag

SEQ ID NO: 91615 - RNA, 46 nt, Mus musculus
auggauggagccauugcugcugccuugcugauguuuggugaugcag

SEQ ID NO: 91616 - RNA, 46 nt, Mus musculus
auucuugggugccucccuuaucccagaccucugucucaucuugcag

SEQ ID NO: 91617 - RNA, 44 nt, Mus musculus
acuccugggaggcaaacugaggcugaaaagacagaaacuaggcg

SEQ ID NO: 91618 - RNA, 46 nt, Mus musculus
uuuuagccugugcuucuauuguggaauugaaucuauugaugcugag

SEQ ID NO: 91619 - RNA, 46 nt, Mus musculus
uucagggcagcugagcaugccucugggacuuauugggcagcaggau

SEQ ID NO: 91620 - RNA, 23 nt, Mus musculus
uaacuuucaacagguugucuaca

SEQ ID NO: 91621 - RNA, 42 nt, Mus musculus
uacugaggauaucuuuguguuuauuucuuaaguggcuuggaa

SEQ ID NO: 91622 - RNA, 46 nt, Mus musculus
auuucuuaaauacuguucuuuaaucuuuccauuuaaaacagguugu

SEQ ID NO: 91623 - RNA, 45 nt, Mus musculus
acguuaaugaugaucagucuguaaaacagccgcgaggggaccgug

SEQ ID NO: 91624 - RNA, 46 nt, Mus musculus
uuccauccugaucacuguccccuugcugguccuuccccucucugag

SEQ ID NO: 91625 - RNA, 46 nt, Mus musculus
auugauuaauauguagucuagcuagugcuagaaaaacaacccuaag

SEQ ID NO: 91626 - RNA, 45 nt, Mus musculus
cuuucauuugugcucucauacauuucauuucaaaaacugguccag

SEQ ID NO: 91627 - RNA, 46 nt, Mus musculus
gacauucccaguguugugcuuucugaccuugccugucuagcuccag

SEQ ID NO: 91628 - RNA, 45 nt, Mus musculus
uggaauugaauuuucuauuuaauggcuaugccacauugcccccuc

SEQ ID NO: 91629 - RNA, 53 nt, Mus musculus
agaaaguauuguguugaaauugcaaaaggaauuuccaaauuuugauaaacagg

SEQ ID NO: 91630 - RNA, 86 nt, Mus musculus
cuuacauguuuguauuauaaaauguuguuugaguuagacugugcaaauuuaaggugagcuuuauauuuuugaauuauauacuccgg

SEQ ID NO: 91631 - RNA, 46 nt, Mus musculus
guaaaauugugaauccuuaagugcaaaaagcuguccucacccccuc

SEQ ID NO: 91632 - RNA, 47 nt, Mus musculus
gggucacuaaugacucauguaccuuucucucucucucucucucucuc

SEQ ID NO: 91633 - RNA, 46 nt, Mus musculus
ucuaugaguucaaggccauccuggucuauauagaguucgaggucag

SEQ ID NO: 91634 - RNA, 46 nt, Mus musculus
guggauguacacagaagccuuggagucucugaaaguguuugcggaa

SEQ ID NO: 91635 - RNA, 71 nt, Mus musculus
aucaaaauuauucuaaaaaugcaacuaaaauaaaaaugaaacagaaaauuuccgugaaaccacaaaauggc

SEQ ID NO: 91636 - RNA, 81 nt, Mus musculus
uuuaacaagaaacguaagaaaaauguauuuaauccuaagaaagccguagaggacucugaguacgauucagguucugaugcu

SEQ ID NO: 91637 - RNA, 61 nt, Mus musculus
uugauuccuaaguguucucagaaaaaggcucagaaaauaacagaacuccggcccuuuaaua

SEQ ID NO: 91638 - RNA, 46 nt, Mus musculus
cuuuguggagguuuuggaguuuuaguucuugugcuguggaguguag

SEQ ID NO: 91639 - RNA, 46 nt, Mus musculus
uaauauuguaccuauaacaaaccuaaaugagcaugaaugaccucga

SEQ ID NO: 91640 - RNA, 46 nt, Mus musculus
uauuacagauuuaggacagcauucuuaaacguuucaauuccuaaag

SEQ ID NO: 91641 - RNA, 45 nt, Mus musculus
aaaaaucuuagucacaccuuuaaaccagacuuugaaacaguugua

SEQ ID NO: 91642 - RNA, 46 nt, Mus musculus
uguuaguuuuuuuuauccauaguuuuuuaaaaauaguaauacuuua

SEQ ID NO: 91643 - RNA, 45 nt, Mus musculus
gauuaaaggugcaugucaguacaccugacugcuuauuucuuggag

SEQ ID NO: 91644 - RNA, 45 nt, Mus musculus
uaauucuccccuaaacuuaaccaggagggcaagggguuaccuaau

SEQ ID NO: 91645 - RNA, 39 nt, Mus musculus
ucuuuauucuagcagauggcugucuguuagcuuccucgc

SEQ ID NO: 91646 - RNA, 46 nt, Mus musculus
ucuuauuuagcaucucuuuuuugaaaacauucuuuuaaaguuucac

SEQ ID NO: 91647 - RNA, 41 nt, Mus musculus
uucugguuauucuuaauauucaguagucauagaaagugaca

SEQ ID NO: 91648 - RNA, 46 nt, Mus musculus
ugaguuuacguauuucugugugaaaagacguuguuugaaguggcag

SEQ ID NO: 91649 - RNA, 46 nt, Mus musculus
accuuuaauuaauuaacuagaaagaaacuuacauucugacugcuag

SEQ ID NO: 91650 - RNA, 46 nt, Mus musculus
agauuugauauggaauugcaaaacgguaauucaagaaagggacgua

SEQ ID NO: 91651 - RNA, 45 nt, Mus musculus
ucaaggacuaguuggaauagauugugaaaaaaguacagcacgcag

SEQ ID NO: 91652 - RNA, 42 nt, Mus musculus
gccagcuugggcuacauugugaauugcgagcuugggccacag

SEQ ID NO: 91653 - RNA, 41 nt, Mus musculus
agaaaaagauaugauaauuggccuuuaauaguaagcucgaa

SEQ ID NO: 91654 - RNA, 46 nt, Mus musculus
gacaacuguuucuguguuuuggaauguuuuauauugaugugcaugu

SEQ ID NO: 91655 - RNA, 42 nt, Mus musculus
ccucauguaauuacaucaagaugauuuuuugggugcacgccg

SEQ ID NO: 91656 - RNA, 64 nt, Mus musculus
auagauaacugguuaagagaaguuaacuuauggugccccaguuuaaaugugcucuguuacuaug

SEQ ID NO: 91657 - RNA, 45 nt, Mus musculus
aaauauaaucaaaguaagcuucacuuuuaaauucuagguucucaa

SEQ ID NO: 91658 - RNA, 46 nt, Mus musculus
ggagaauuuauauaguccucuucccccugaauccuuccgccacccc

SEQ ID NO: 91659 - RNA, 46 nt, Mus musculus
cauuguugaauuuuguuaugccacacauguuuagcaguagcaccag

SEQ ID NO: 91660 - RNA, 46 nt, Mus musculus
aguauggagaaaaauaaugauuauuucuaugaccaguagucaggag

SEQ ID NO: 91661 - RNA, 63 nt, Mus musculus
gcaauugagaaaaauggccaaucacccuuuacuacaccgccaguauuacacaccugagaaacu

SEQ ID NO: 91662 - RNA, 46 nt, Mus musculus
aaaaagaaaagguuuauuuauuauuauacauaaguauacaccagaa

SEQ ID NO: 91663 - RNA, 39 nt, Mus musculus
ucguauaaauaaaaauaaauuaaaaaaaaaagggaggaa

SEQ ID NO: 91664 - RNA, 46 nt, Mus musculus
aaggaaccuacgcacugugaggccaacccugaccugaucuuugaag

SEQ ID NO: 91665 - RNA, 46 nt, Mus musculus
accacgcccggcuugaauuguuauucuuuuaauuuuuucccccaau

SEQ ID NO: 91666 - RNA, 58 nt, Mus musculus
uguuauuuuuauuuuugcacuuuagggaucauacccauaguuuuuuacaugcuaggca

SEQ ID NO: 91667 - RNA, 46 nt, Mus musculus
cuucaucuagcagcugauugaaacagaugcagagacccaaagccag

SEQ ID NO: 91668 - RNA, 25 nt, Mus musculus
agacaggugccauagaguuggucag

SEQ ID NO: 91669 - RNA, 46 nt, Mus musculus
cucacacugaguucuguugcccugugaaugacguguguauuugcag

SEQ ID NO: 91670 - RNA, 49 nt, Mus musculus
uaaagacuauagagucuguuucucuagagcuggccuuggucucaggauc

SEQ ID NO: 91671 - RNA, 46 nt, Mus musculus
gguacuuaguauaauuuaacaagcuuucuuguugacuuugcuguau

SEQ ID NO: 91672 - RNA, 47 nt, Mus musculus
ucuuauuacaaaacuuuuuauauaaaaaaaucuuagaaccacgguau

SEQ ID NO: 91673 - RNA, 46 nt, Mus musculus
uguuacaaacaagaacauuuuagauagaaucgaauuuccuacucag

SEQ ID NO: 91674 - RNA, 41 nt, Mus musculus
cagucacguagaagccaaaauaggcacuagauucccccgag

SEQ ID NO: 91675 - RNA, 46 nt, Mus musculus
aucuuaaugccaugggcugucuuuagucuguuaaauacgcuugaag

SEQ ID NO: 91676 - RNA, 45 nt, Mus musculus
gaauuaguuauagguaggaauucaccaaagagaagaaagguuggg

SEQ ID NO: 91677 - RNA, 46 nt, Mus musculus
gccagcagauauagccacauuacuaaaaacaucaaugggccuguga

SEQ ID NO: 91678 - RNA, 46 nt, Mus musculus
aaugcuuuagaaaugucaguauuuuuguaauuauuucuaccuccag

SEQ ID NO: 91679 - RNA, 45 nt, Mus musculus
ucagccugaaucacaagguggcauuccauccacuaauguccccag

SEQ ID NO: 91680 - RNA, 74 nt, Mus musculus
gccuucgcuuguguguguugcuaucagcuuccucucccgcuuuugcuucucuuaaccauugcccagucacuucu

SEQ ID NO: 91681 - RNA, 92 nt, Mus musculus
ucaccaagaucagcagauguugguggcauauuucuaguccagcagaacagauuaacuuaaagauacuuucacuucaaaggaaacuggaugug

SEQ ID NO: 91682 - RNA, 88 nt, Mus musculus
acuucauaccaagguaaugcuagauacugcaugaaaauaggucauuaacuuuaaauucuuaacaaaauauaauuuaccaguucccagg

SEQ ID NO: 91683 - RNA, 48 nt, Mus musculus
uauuucagucuuuauuaacuuuucauuuaaauuuugccugucagucua

SEQ ID NO: 91684 - RNA, 46 nt, Mus musculus
uuauaauguaaauaucauuauaaauaaacuuauuuauaaaugagag

SEQ ID NO: 91685 - RNA, 46 nt, Mus musculus
ugcucgguccuuccucugcgggugguggaggccccaagcggugcgg

SEQ ID NO: 91686 - RNA, 29 nt, Mus musculus
aagauucagucucagcagaaaaaugccaa

SEQ ID NO: 91687 - RNA, 45 nt, Mus musculus
cugccuuaauauauaccugcaccgucuguaggacacaaaugccag

SEQ ID NO: 91688 - RNA, 46 nt, Mus musculus
guuaaaggaaaggagggaaggagaagaagagagaaaaaagagaggg

SEQ ID NO: 91689 - RNA, 42 nt, Mus musculus
caugcagcugaagacuggcauugauuuaaauguauuggagac

SEQ ID NO: 91690 - RNA, 46 nt, Mus musculus
augagauucagacuaagugacagcucugacuguauuuugaaggcag

SEQ ID NO: 91691 - RNA, 46 nt, Mus musculus
aagcuacaccuccuagagguuccacagccuccucuaacauugccac

SEQ ID NO: 91692 - RNA, 45 nt, Mus musculus
ugccugccauagcaacuguggcuaguagacacgccuacauuccag

SEQ ID NO: 91693 - RNA, 46 nt, Mus musculus
uuuguaaugaguugugugcaaauugauuauuuuguagguugaaaau

SEQ ID NO: 91694 - RNA, 45 nt, Mus musculus
uccuucuggggccauaaccacaagacauauuggccauaugaccag

SEQ ID NO: 91695 - RNA, 46 nt, Mus musculus
acucccacacaaagggaagauucuccuggaaaauguuuacagauag

SEQ ID NO: 91696 - RNA, 43 nt, Mus musculus
cucacaguugauagccacagagucuacaccucacaguggacag

SEQ ID NO: 91697 - RNA, 48 nt, Mus musculus
agacaagcaagucagcuuaaaggccugguuuaaaacguacuaggagaa

SEQ ID NO: 91698 - RNA, 82 nt, Mus musculus
guaggugaccuucaucuuacuccaucucuuuauuggggcaugaagguuggaaacugaggucuggaaacuguugcugaggaag

SEQ ID NO: 91699 - RNA, 46 nt, Mus musculus
gaagggagaaggaagaacuagagagggagaaagcugcaaucagggg

SEQ ID NO: 91700 - RNA, 46 nt, Mus musculus
agccaguggcuauauaaccuacacaaugacuucucucaccugacag

SEQ ID NO: 91701 - RNA, 46 nt, Mus musculus
aacugcuguucacugcaaauacaaguguauuugauugagccuggga

SEQ ID NO: 91702 - RNA, 42 nt, Mus musculus
ucguccaguuguacgguuggcagagggaaucaaguuugucag

SEQ ID NO: 91703 - RNA, 46 nt, Mus musculus
ggggucaaauccaccaguuauugagaauaugucuaauaugcccucu

SEQ ID NO: 91704 - RNA, 47 nt, Mus musculus
gugacagugauucuccuggacaagccaggagcuccugauggccaguu

SEQ ID NO: 91705 - RNA, 45 nt, Mus musculus
cugauacaugucagcuucuggcagcauggucaggucacaaaggga

SEQ ID NO: 91706 - RNA, 46 nt, Mus musculus
gggauuugaacuucugucugucuguaaugcuuuuugauaacuucag

SEQ ID NO: 91707 - RNA, 44 nt, Mus musculus
uuguguucuuuauucaagcugaaaagggacuauauaaaccuugg

SEQ ID NO: 91708 - RNA, 91 nt, Mus musculus
gcauucagaaguugaaccuguaauuuccuaagaauuuugugcugaggaggugaguccucccuuuugcucucagcucagggagcugugggga

SEQ ID NO: 91709 - RNA, 46 nt, Mus musculus
accucuaaauaacagcaucucccacauuauuuuaaaaucuauccag

SEQ ID NO: 91710 - RNA, 46 nt, Mus musculus
uacuuucuuaaacauuucaccucacaguucaguucucucucucuag

SEQ ID NO: 91711 - RNA, 45 nt, Mus musculus
aguauugauuuccucaugcuuaggacuuggguuuuggggauggag

SEQ ID NO: 91712 - RNA, 46 nt, Mus musculus
cuuaguggagacauuaguggaaaaauaccaccuaugaagccuugag

SEQ ID NO: 91713 - RNA, 45 nt, Mus musculus
auaaagucaaaggaaggguguauuugaguuuaugaaacuagauga

SEQ ID NO: 91714 - RNA, 25 nt, Mus musculus
ccauaggaggcagcuuucccaggcu

SEQ ID NO: 91715 - RNA, 45 nt, Mus musculus
aguccauuagugaagaaagucaggacaugaacucaaauaggguag

SEQ ID NO: 91716 - RNA, 46 nt, Mus musculus
aguuuccgggcuacccaaggagcuaaaggggucugcaacccuauag

SEQ ID NO: 91717 - RNA, 26 nt, Mus musculus
ucgugucucuaacugcaucuguaaca

SEQ ID NO: 91718 - RNA, 46 nt, Mus musculus
ugaagaauauaccuaauaaaaaauaauucacaugaaagaaagaaag

SEQ ID NO: 91719 - RNA, 47 nt, Mus musculus
caguuaccaaaccuagacauuauuguggagaccaacaagacugugcu

SEQ ID NO: 91720 - RNA, 47 nt, Mus musculus
acaaauauagaggcacaugcucccagccaaccauuggacugagcaag

SEQ ID NO: 91721 - RNA, 45 nt, Mus musculus
uggcuccaguugcauauguagcagagaauggcauugugggacauu

SEQ ID NO: 91722 - RNA, 45 nt, Mus musculus
aauggaauggggcguuuuugaaggggaaaacaaggaaaggggaua

SEQ ID NO: 91723 - RNA, 68 nt, Mus musculus
uuggguguccugagcugauauagaucccuucaauaaccacccguaacuccaguuucaggggauccaau

SEQ ID NO: 91724 - RNA, 76 nt, Mus musculus
gcccucuugugaccuucucugucccuaagcaugcacacaguguacaagcauacacguaagccaaacacucacagaa

SEQ ID NO: 91725 - RNA, 47 nt, Mus musculus
gagcauccuuggcugcauuaucucugacugagaaugaggguuggaga

SEQ ID NO: 91726 - RNA, 118 nt, Mus musculus
uagaccagaccaauugucuucaaacucacagagauuugccugccucugacaguugagugcugggauuaaaggcguacuacacaaagacuauccuaaacuuacuauaguaauuguacca

SEQ ID NO: 91727 - RNA, 46 nt, Mus musculus
uguagugguaaaguuauauacauugcuguggaauauaucuccuuag

SEQ ID NO: 91728 - RNA, 46 nt, Mus musculus
acucguacggauauuuucuuuccuuccaccgugugaaucccaggag

SEQ ID NO: 91729 - RNA, 46 nt, Mus musculus
uagaauguggauuaauuauuuucaaaauaggaagaauugauuauag

SEQ ID NO: 91730 - RNA, 46 nt, Mus musculus
cuaggaguaaagauucaguuacacccguccacgucucuguauccag

SEQ ID NO: 91731 - RNA, 45 nt, Mus musculus
uuuucauaaugcaguucauauguauauugacuauauuugccccga

SEQ ID NO: 91732 - RNA, 54 nt, Mus musculus
uauaagaauuaguaauuggguaauauuugauugacagggauguguuucuauucu

SEQ ID NO: 91733 - RNA, 64 nt, Mus musculus
cccugaaccaguacugccccccaugggguucuaccacacccaucuggaccuauuuuuuaaaaga

SEQ ID NO: 91734 - RNA, 45 nt, Mus musculus
caggggccucucagcagguagcagugucuucagagagcaguggca

SEQ ID NO: 91735 - RNA, 45 nt, Mus musculus
gucagaaggcuccacacuagguaaucuccuucuuaguggcagcaa

SEQ ID NO: 91736 - RNA, 46 nt, Mus musculus
gaacacagaaaacaugaaguaucuguuauuugaggacaguugugag

SEQ ID NO: 91737 - RNA, 46 nt, Mus musculus
ccaaauuaaauaguaggcuucuguagacauaaguuuaagccaugag

SEQ ID NO: 91738 - RNA, 46 nt, Mus musculus
aacuggagucuuuuuguuuuguuuuagguacgugggagcaagggag

SEQ ID NO: 91739 - RNA, 47 nt, Mus musculus
uccaacuggcuucgcuuuguucacgaggcaccaucucaggagcggaa

SEQ ID NO: 91740 - RNA, 46 nt, Mus musculus
uaacuggugacuucagaagggaaucaauguaagggcaagauuagaa

SEQ ID NO: 91741 - RNA, 42 nt, Mus musculus
gaaggaucuagcaagcuaauagcccuucccauauguacccuu

SEQ ID NO: 91742 - RNA, 67 nt, Mus musculus
uaguaauuaaccacaagcaaaucacuugucuuaaaaauaguaguuaauauacaaaucucucccccca

SEQ ID NO: 91743 - RNA, 46 nt, Mus musculus
cuauuaaccuaaacauuucagguauuuggcauaaccuuaacucaaa

SEQ ID NO: 91744 - RNA, 64 nt, Mus musculus
uaugcaucauuuacagaccuuaaauuuuucauccucacagaacaaaagguauuaauagacauua

SEQ ID NO: 91745 - RNA, 46 nt, Mus musculus
ucuugugcagauugaauacauacaguagcaucuugaagagaguaga

SEQ ID NO: 91746 - RNA, 43 nt, Mus musculus
acagugaagaaacagauauuccaaaaagggaagaaggcagaag

SEQ ID NO: 91747 - RNA, 46 nt, Mus musculus
guaggagccuaggaaagaaugacaagggaguugaaauuggaacuag

SEQ ID NO: 91748 - RNA, 46 nt, Mus musculus
agaacucacaugauauguaaucacugauaaguggauguuagcccag

SEQ ID NO: 91749 - RNA, 45 nt, Mus musculus
cuuggagaaguccaugugacugaagggaaaggaccauggccauga

SEQ ID NO: 91750 - RNA, 46 nt, Mus musculus
caaauauggaucuauuuucauucuucuacauacaaacagccaguua

SEQ ID NO: 91751 - RNA, 42 nt, Mus musculus
ccuuugguaagauggccauuuuuaauguguuaauuaugccag

SEQ ID NO: 91752 - RNA, 46 nt, Mus musculus
auugucauacagguccuuucccuuguuugguuauaguuaccccaag

SEQ ID NO: 91753 - RNA, 45 nt, Mus musculus
ugucaucuacaaauaaugauaccuuuauuucuucuuugccacuuu

SEQ ID NO: 91754 - RNA, 46 nt, Mus musculus
gaaccuuccaaccaaaaaaguucagggccagauggauuuagugcag

SEQ ID NO: 91755 - RNA, 46 nt, Mus musculus
gguagguauagccaccauguguaugagcagcucaauucagguccuc

SEQ ID NO: 91756 - RNA, 46 nt, Mus musculus
cccauggggaaaaucccauggggaaaauuauaggaauuaugaugag

SEQ ID NO: 91757 - RNA, 46 nt, Mus musculus
uacgacuagcuagcuuuuaucuccuaaaggauccacccucucucag

SEQ ID NO: 91758 - RNA, 46 nt, Mus musculus
ucucucucucucucucucugucucucugucucucucucucugucug

SEQ ID NO: 91759 - RNA, 45 nt, Mus musculus
agugauaucagaagcuaacaugccuuagcauuuuuuuaacuuuau

SEQ ID NO: 91760 - RNA, 41 nt, Mus musculus
agcuuuugauuggcuaccuggacagugauguggaggcagag

SEQ ID NO: 91761 - RNA, 46 nt, Mus musculus
aguuggcagcuggaaguaaagguacugcaucuucguuuggugaucu

SEQ ID NO: 91762 - RNA, 46 nt, Mus musculus
cuggucacaggagcugguaggauuguuaauuuguccuugucugggg

SEQ ID NO: 91763 - RNA, 45 nt, Mus musculus
uuaaauaugugaaugacugaguuagaaauggggaaaagagccgua

SEQ ID NO: 91764 - RNA, 45 nt, Mus musculus
gguggggaauagggugccucaccuaccgcaucugcguagacagca

SEQ ID NO: 91765 - RNA, 42 nt, Mus musculus
gucaagcucagagugagcugacgacgauccauuuucuaggaa

SEQ ID NO: 91766 - RNA, 46 nt, Mus musculus
uuguuacuucugaucugaagcauuaccauucaaaggaaaacugcag

SEQ ID NO: 91767 - RNA, 46 nt, Mus musculus
uaugccauuucauuccuuucuaucuaucuaucuaucuaucuaucua

SEQ ID NO: 91768 - RNA, 46 nt, Mus musculus
uaauuaucuuuugccuuggaguugaaaauauuugaaauuugagcag

SEQ ID NO: 91769 - RNA, 46 nt, Mus musculus
ucauucucacaauuaggugaagagagugacugauaccuggcaucag

SEQ ID NO: 91770 - RNA, 48 nt, Mus musculus
auaacugacuucaguaacacagugagagguuacuuaccaugaguguga

SEQ ID NO: 91771 - RNA, 47 nt, Mus musculus
ccccugcugaauuuaaaauauacuggugccuuucauaugauggcaga

SEQ ID NO: 91772 - RNA, 46 nt, Mus musculus
uaugucaguuuuaaagucaacuuugcugaacuaaguaaaaagccag

SEQ ID NO: 91773 - RNA, 72 nt, Mus musculus
uuuuucuccuuaaaguagggaugauggggagaauacuuccuguuagagccaggagagcaccacuaagguaug

SEQ ID NO: 91774 - RNA, 72 nt, Mus musculus
gcugaggacucucuguauagaacacaagguguuuaaggagcuaggaaaccaaguuccuuuuguauugauuga

SEQ ID NO: 91775 - RNA, 54 nt, Mus musculus
ggaagcugaauauuuaaacucaggucagacauuuuuauguagauacaauagggg

SEQ ID NO: 91776 - RNA, 45 nt, Mus musculus
uauugcucugcguaaaucuaguuuuccaauuguaagaugaaagag

SEQ ID NO: 91777 - RNA, 42 nt, Mus musculus
uaauuggaguuagaaaaauggaauguuguuuuucucgguggu

SEQ ID NO: 91778 - RNA, 46 nt, Mus musculus
uugaaucccuagugucaccaccaaacauauuuucauggcuguguag

SEQ ID NO: 91779 - RNA, 42 nt, Mus musculus
uguacaugcguauucaugugagugccgagcacagauguggag

SEQ ID NO: 91780 - RNA, 46 nt, Mus musculus
aauagacuugcauucuagagcaacccuucaaagucguucucaauac

SEQ ID NO: 91781 - RNA, 45 nt, Mus musculus
gaagaugucaccucaaugaugcuggucucuucuuagucaccgcua

SEQ ID NO: 91782 - RNA, 46 nt, Mus musculus
cuaucuuauucuuuauguaaaauccuugacauacccuuggccccag

SEQ ID NO: 91783 - RNA, 46 nt, Mus musculus
cuccucucuccaugcugugauuuuugucuggcuugaacuugugcag

SEQ ID NO: 91784 - RNA, 41 nt, Mus musculus
cucuuguaguauaauaaaagucuauucacugaguaaaguuc

SEQ ID NO: 91785 - RNA, 45 nt, Mus musculus
cuagcuuuaugucugcauagauguaucccuguguuauuuguagau

SEQ ID NO: 91786 - RNA, 35 nt, Mus musculus
ucuauugccauacuggcaccaaaauuaagauuccu

SEQ ID NO: 91787 - RNA, 41 nt, Mus musculus
aucuagcucaaggagagagagagagaaagagagagagggag

SEQ ID NO: 91788 - RNA, 84 nt, Mus musculus
cuaaaagugucucacauuuuuuuagaguuuaaaacaggcauuaugauugaugucaggaggcagcaccaugcaugccaagaguuc

SEQ ID NO: 91789 - RNA, 45 nt, Mus musculus
aggcuucuuguaucuuuaugggcaucucuuuuuuuuuagguugcg

SEQ ID NO: 91790 - RNA, 45 nt, Mus musculus
aauaaguguuaccaaaaguguuuauacauuauauuauaugggugg

SEQ ID NO: 91791 - RNA, 47 nt, Mus musculus
cugcauagacagaguugguuuagcuaguagacuuaaaggaaaaggag

SEQ ID NO: 91792 - RNA, 46 nt, Mus musculus
uugccucccacaugcugagauuaaaaccaugcacuaagccuggcaa

SEQ ID NO: 91793 - RNA, 45 nt, Mus musculus
uguggaggggcaggacauuacaguggggaacaugaccagugggga

SEQ ID NO: 91794 - RNA, 61 nt, Mus musculus
uaaucauggcuugcuguaaugauuucuuucugcugcaaaaggaagcuauuuaaauaaggau

SEQ ID NO: 91795 - RNA, 49 nt, Mus musculus
auucugccucucccaagaggaaccuaacaaaaacccaguacuaggcaug

SEQ ID NO: 91796 - RNA, 46 nt, Mus musculus
uuucacucaguugccuuucagaaguugaaggucucuauugcugaag

SEQ ID NO: 91797 - RNA, 45 nt, Mus musculus
cugguaggauaaacccaggcaaguuccaaugcuagccagaucaca

SEQ ID NO: 91798 - RNA, 42 nt, Mus musculus
cuaggggaaguggaauuagcaucauaauaaaaacagcaccag

SEQ ID NO: 91799 - RNA, 44 nt, Mus musculus
ugcauacauucauguacacagagagacaggggaggagaggggaa

SEQ ID NO: 91800 - RNA, 41 nt, Mus musculus
uuuuuuaauggaauuaugauuuacagugauuaugauggaac

SEQ ID NO: 91801 - RNA, 42 nt, Mus musculus
ggagacagagacaaccuaaagcagguuggaagaaagugcuag

SEQ ID NO: 91802 - RNA, 24 nt, Mus musculus
ugaugagaagugaaauacccaccc

SEQ ID NO: 91803 - RNA, 46 nt, Mus musculus
aacucauuaauucucugaauuuaaauuguuguaauguugccuucag

SEQ ID NO: 91804 - RNA, 59 nt, Mus musculus
cccugccaaggacagaaggaaggggaagugcuuuguaggcagcccccugucauggucau

SEQ ID NO: 91805 - RNA, 45 nt, Mus musculus
cuguaaaguaaggguaacacagaaaauuacuagcaucgcguaaca

SEQ ID NO: 91806 - RNA, 58 nt, Mus musculus
agcuagcacaaagcaggcagcccaaaaagauggcagcagugcagugggagggaaguau

SEQ ID NO: 91807 - RNA, 45 nt, Mus musculus
gucuuugguuaauaaauggccaguccguugaaaaaaaauggggaa

SEQ ID NO: 91808 - RNA, 64 nt, Mus musculus
aguuuccuguuuaagaaaucugcauugaguucaugguacaggaauuuucaggugacauuugugu

SEQ ID NO: 91809 - RNA, 75 nt, Mus musculus
ugugagugugugcuugugugugagagagagagagaaagagagagaggaucgagagagagagagacagagagagag

SEQ ID NO: 91810 - RNA, 46 nt, Mus musculus
ccauuuaugauaaagauugaaaagggaagauacaaauaccaggcag

SEQ ID NO: 91811 - RNA, 42 nt, Mus musculus
auggacaacauccaugggguagcugacagcuaagaggagcgg

SEQ ID NO: 91812 - RNA, 46 nt, Mus musculus
gcucaggauagguguccucuacacuaauuggucuuccuggguguag

SEQ ID NO: 91813 - RNA, 45 nt, Mus musculus
ggcgcuuugugcaguagcaaaaacauccuaggcaauggcugccau

SEQ ID NO: 91814 - RNA, 43 nt, Mus musculus
cuucucaggaaucacuagagacauggcggcggcacagacggca

SEQ ID NO: 91815 - RNA, 47 nt, Mus musculus
cucgcuccaccucauccuccgugaguucuccagcccucuuggugagg

SEQ ID NO: 91816 - RNA, 41 nt, Mus musculus
ucugcacacuccuuugccacuggaccugugauagcagagcc

SEQ ID NO: 91817 - RNA, 47 nt, Mus musculus
uuugccuuucuuaacuguggccaucaccauguccccaacaccagcag

SEQ ID NO: 91818 - RNA, 44 nt, Mus musculus
aguuuuuagcuccuguguugucugcacaguugaucacagcuccg

SEQ ID NO: 91819 - RNA, 42 nt, Mus musculus
uaguacagaaaagaaauaaaaaaugaauaaugugugagggga

SEQ ID NO: 91820 - RNA, 42 nt, Mus musculus
ccggacucccaggcggcggcagcagcggcggcggcggcgacg

SEQ ID NO: 91821 - RNA, 42 nt, Mus musculus
cauugcuuggcacuucaaaccauggauguaaauuaccuccgg

SEQ ID NO: 91822 - RNA, 46 nt, Mus musculus
ugccucucgaagcucauucagcuacaauacccuucuaaaugcccug

SEQ ID NO: 91823 - RNA, 46 nt, Mus musculus
ccgcgugucuagaaaagcaaaugccucccgcuuuucauuugguuag

SEQ ID NO: 91824 - RNA, 36 nt, Mus musculus
agaaaucucuaacaacaaacucacaguucacuagcc

SEQ ID NO: 91825 - RNA, 42 nt, Mus musculus
agagcuauacagagaaacccugucucgaaaaaccaaaguaau

SEQ ID NO: 91826 - RNA, 46 nt, Mus musculus
uguuuguguuuuuuguuguuaauuuaucaaaaaacacugccaaggg

SEQ ID NO: 91827 - RNA, 46 nt, Mus musculus
guuugguguucuccagaacucaaaagaaaagauucaagaauggcag

SEQ ID NO: 91828 - RNA, 46 nt, Mus musculus
ugucaccaaaauguuuuguaaugauuuuuaaaauaucuauugacag

SEQ ID NO: 91829 - RNA, 44 nt, Mus musculus
guugggagcuuucuacauuuuagaggguugauccaugaucauca

SEQ ID NO: 91830 - RNA, 46 nt, Mus musculus
ugggaaggacuuuggggugagcaucuucucuauuuccagcuggcuu

SEQ ID NO: 91831 - RNA, 46 nt, Mus musculus
auuugugagcagaguucuaggauguuacugcagaaagacuuuuuua

SEQ ID NO: 91832 - RNA, 45 nt, Mus musculus
auggggcuucuagugcugugaucaaacaccaugaccaaaagcaga

SEQ ID NO: 91833 - RNA, 45 nt, Mus musculus
gugugcgcgcacacacacacacacacacacacauacacccaucau

SEQ ID NO: 91834 - RNA, 46 nt, Mus musculus
ucuguuaacugcaguuuuugcaguauccuugcuuuuguuuuuggag

SEQ ID NO: 91835 - RNA, 45 nt, Mus musculus
aaaaaaagaaugcacagauugggggucacagauugggggucacag

SEQ ID NO: 91836 - RNA, 46 nt, Mus musculus
uuaaucacgggcacccacugauccauguagcgacuuucccggcaaa

SEQ ID NO: 91837 - RNA, 42 nt, Mus musculus
ucagcucggacaagguccaccccagcagauucugggcugcag

SEQ ID NO: 91838 - RNA, 42 nt, Mus musculus
gcgagucccucccucggcgcgcgggcugcuccuggcccccac

SEQ ID NO: 91839 - RNA, 46 nt, Mus musculus
caaggaaugucuuaagguaguaguuacaaaauuaaaagcaauuaaa

SEQ ID NO: 91840 - RNA, 33 nt, Mus musculus
cuguucaguguggagagcuuuuuggggugcagc

SEQ ID NO: 91841 - RNA, 45 nt, Mus musculus
cuggugcugucagugguugggaguggucggauaaagucagcagau

SEQ ID NO: 91842 - RNA, 46 nt, Mus musculus
ugauauccccucaaagacuucuuagcagauggcuggccugucagag

SEQ ID NO: 91843 - RNA, 41 nt, Mus musculus
ugacauuaucauugcauggaaaggccucaggggcacagaga

SEQ ID NO: 91844 - RNA, 46 nt, Mus musculus
ugauguguuggggaagcacaugugcugugucugugugcucucagga

SEQ ID NO: 91845 - RNA, 49 nt, Mus musculus
uaauuuucuauugcauuuguuuaucuauuuguuuaguguggugugugug

SEQ ID NO: 91846 - RNA, 46 nt, Mus musculus
cacacacacacacccacacacccuagguugauccuccacccccaau

SEQ ID NO: 91847 - RNA, 46 nt, Mus musculus
agaaacaaggaauguagagggacacaucucacuguggucauggaga

SEQ ID NO: 91848 - RNA, 45 nt, Mus musculus
auauacucuaauuugaacccuuaagaauguuuagguuagagagau

SEQ ID NO: 91849 - RNA, 46 nt, Mus musculus
aaacuauacuuuaaagggaaaaauagaggcagagcuucaggaaacu

SEQ ID NO: 91850 - RNA, 58 nt, Mus musculus
cucaaaaaacaaaaacaaaaacaaaacaaaaaaggaagaagaggaagaaaaagaagaa

SEQ ID NO: 91851 - RNA, 69 nt, Mus musculus
gaucugcaguggggacugggugggacuuacagggacgauggcugacaaaauacaaccuaucugugagag

SEQ ID NO: 91852 - RNA, 46 nt, Mus musculus
agaaaaucuauguaaaaauguuuuguacucuuuagauaugcccaga

SEQ ID NO: 91853 - RNA, 50 nt, Mus musculus
auguuuccaggaaaacuagacuaauaccaaaauguuccaagaaaacaaac

SEQ ID NO: 91854 - RNA, 64 nt, Mus musculus
gacggcuuacuuggcauuuuuuuccuucccagcacugaagaucugaagccuggagagggacugg

SEQ ID NO: 91855 - RNA, 46 nt, Mus musculus
uauauauauauggauacacuguagcuaucuuuagacacaccagaga

SEQ ID NO: 91856 - RNA, 66 nt, Mus musculus
acacauuuguguagguaaucaugccuacauauacauaaaguaaaauuuaaaaaucuaaaaaauaug

SEQ ID NO: 91857 - RNA, 46 nt, Mus musculus
uaacaacauaagaagauuguauguuuguuuaaaagaaggggccaga

SEQ ID NO: 91858 - RNA, 46 nt, Mus musculus
gugguuuaauccauccaaccccucaguaaacagaccuugcccagag

SEQ ID NO: 91859 - RNA, 46 nt, Mus musculus
gauauagucaaguugacaacugagcauagccaucacaacccauccc

SEQ ID NO: 91860 - RNA, 46 nt, Mus musculus
cagaacacagcuucuuuguccucucagaaaacacuuuccagaagau

SEQ ID NO: 91861 - RNA, 46 nt, Mus musculus
auacaaauguaaacuuuagccacagaugcuuaucgcaggcccuauu

SEQ ID NO: 91862 - RNA, 46 nt, Mus musculus
cuuguuucuggauaagcuauaaguggcauuaauuagaccuccuuua

SEQ ID NO: 91863 - RNA, 41 nt, Mus musculus
gagggucagaucucauuacagauguuugugagccaccaugu

SEQ ID NO: 91864 - RNA, 46 nt, Mus musculus
ucuggcggaguuugacuaaagcuguaguuccucuaguagcugagac

SEQ ID NO: 91865 - RNA, 46 nt, Mus musculus
ucuucugagaauauauggcagaacaaggguugaguugaugacagau

SEQ ID NO: 91866 - RNA, 46 nt, Mus musculus
cacuuuaacuccuggugacaucaugacaucaacugggggccuagac

SEQ ID NO: 91867 - RNA, 46 nt, Mus musculus
ucaaaguugaauguguuuccaagggucuacucccaaagggccagaa

SEQ ID NO: 91868 - RNA, 45 nt, Mus musculus
ucuacaauuuauuauuugacuuuuaguaggaagacaacaggaagc

SEQ ID NO: 91869 - RNA, 69 nt, Mus musculus
uucagugguaaagaugacagaucagacccaggagagugauaagcugcagucagaaugcaaaggcccaag

SEQ ID NO: 91870 - RNA, 75 nt, Mus musculus
uggcuaugcugugucugcauggcauggaaggaauuaauuaccaucaaagugaaugauagucaucaaagaaggcag

SEQ ID NO: 91871 - RNA, 67 nt, Mus musculus
cuuggcuugugcccacacugccucucuuccuucagggcaccagaauuggagaauaaaaucuagaauc

SEQ ID NO: 91872 - RNA, 46 nt, Mus musculus
aaguaaaaauuuccccacaguuggguuuugagaugugucugaagag

SEQ ID NO: 91873 - RNA, 46 nt, Mus musculus
cguccucaaggcuaggcuguguugaagaugaauaaagcugucugcc

SEQ ID NO: 91874 - RNA, 46 nt, Mus musculus
ccauucucggaugauuuagacuugcauccuuuaaaauagcucagac

SEQ ID NO: 91875 - RNA, 45 nt, Mus musculus
uaauguagauucauccagauugaaagccagagauaaagucccagu

SEQ ID NO: 91876 - RNA, 44 nt, Mus musculus
guuuucauuaaugaguaccugcuucaucaaaagcacgcggauua

SEQ ID NO: 91877 - RNA, 42 nt, Mus musculus
gcuccacggggcgcuuuuugaugugcucuauuaaggcuagac

SEQ ID NO: 91878 - RNA, 50 nt, Mus musculus
uuguacaauaucaucugacagacuggacggauaaaacgagccgggagaga

SEQ ID NO: 91879 - RNA, 50 nt, Mus musculus
gagagagagagagagaacuugggaucccugggguuacccugugugugugu

SEQ ID NO: 91880 - RNA, 46 nt, Mus musculus
guccauuugugccugaucuuuucuugguguauuuauaacucaggau

SEQ ID NO: 91881 - RNA, 42 nt, Mus musculus
aaugaggaaaaggcugucuaggguguaugugaggugugugug

SEQ ID NO: 91882 - RNA, 46 nt, Mus musculus
gguggugaugcauaccuuuauucucaggacuuaggaaaaagcagag

SEQ ID NO: 91883 - RNA, 43 nt, Mus musculus
augugcacaugaacacagacacacacacacacacacacacaca

SEQ ID NO: 91884 - RNA, 42 nt, Mus musculus
ugucuaccccuugcccauugcauagccagugaucaggaaugg

SEQ ID NO: 91885 - RNA, 46 nt, Mus musculus
gggagguuaggaacaauuuagcaggauauccuuacuugguccagau

SEQ ID NO: 91886 - RNA, 46 nt, Mus musculus
cucacugguccacuuuguauaucccaacuucacucugcccccuccc

SEQ ID NO: 91887 - RNA, 46 nt, Mus musculus
gggaggugaccugagcucagcaucuagagaacuuguuuguggagag

SEQ ID NO: 91888 - RNA, 46 nt, Mus musculus
cgcagcucggagucuaggucagagugguugaaggcucggucggucg

SEQ ID NO: 91889 - RNA, 45 nt, Mus musculus
gauauuccagauggaacaguagcuguacuaagaucaauauucuga

SEQ ID NO: 91890 - RNA, 45 nt, Mus musculus
uuccacauggaacaguaucuguacuaagaucaguauucugacaua

SEQ ID NO: 91891 - RNA, 45 nt, Mus musculus
uggacaggacucaucauuuugaggagaugaacuuaggagagugau

SEQ ID NO: 91892 - RNA, 45 nt, Mus musculus
gacagguucaguggcagugggucaggaacagauuucacacucaag

SEQ ID NO: 91893 - RNA, 45 nt, Mus musculus
cacugaaucuugaaggaaccccaguuuccaaacugguugcaccag

SEQ ID NO: 91894 - RNA, 47 nt, Mus musculus
aggaugugcagugcucaaucauaagugugacaaagacugacaagcag

SEQ ID NO: 91895 - RNA, 45 nt, Mus musculus
ucuuacugaaagcacugguuccccuguugaagcuugcuagggauu

SEQ ID NO: 91896 - RNA, 42 nt, Mus musculus
augcuuuggauuucccagagagccgaguaaucaaucagccag

SEQ ID NO: 91897 - RNA, 46 nt, Mus musculus
aaaucggauggaacauauuggacuauucauaucacuccagaaccag

SEQ ID NO: 91898 - RNA, 48 nt, Mus musculus
ugcuaugacgaccugaucaggaaaguuguggaagucuucaagccagga

SEQ ID NO: 91899 - RNA, 44 nt, Mus musculus
uuuuguuuuuaccaguuuuucuaagaaacagcaacaacagcaga

SEQ ID NO: 91900 - RNA, 42 nt, Mus musculus
gcaucauccaaaauuccccacaaacaaggcuuucguccccau

SEQ ID NO: 91901 - RNA, 42 nt, Mus musculus
gaagaguggaaaggagucccggguggccgggagguggcugau

SEQ ID NO: 91902 - RNA, 42 nt, Mus musculus
gacagcaagaagaauggggguuggaaauuauauugagaccau

SEQ ID NO: 91903 - RNA, 46 nt, Mus musculus
ugaugccucagagauuuaggucauccagauugaugcuugccaggaa

SEQ ID NO: 91904 - RNA, 29 nt, Mus musculus
cugagucuggaaaauuuuggugaugagca

SEQ ID NO: 91905 - RNA, 74 nt, Mus musculus
uaguuuaccaggagggagccuguauggacagguuggaaaugaaaggaaggaaggauaagauacagagaagccau

SEQ ID NO: 91906 - RNA, 46 nt, Mus musculus
aacgagucuguucuagggccagggcagaaacaaauguaaaggcagc

SEQ ID NO: 91907 - RNA, 70 nt, Mus musculus
aucuuaaugucucaagagggugagaaagcagguggugaugucugauggcaaaguguuucagugugaggag

SEQ ID NO: 91908 - RNA, 57 nt, Mus musculus
gcaaaccauagguaccaugaagguuuguuuggagagaaaacuguaggcuuugguuuu

SEQ ID NO: 91909 - RNA, 46 nt, Mus musculus
cagaaaguacuugcuaggaagagaugaaggcuguggggauggcaga

SEQ ID NO: 91910 - RNA, 53 nt, Mus musculus
cccuugauaagggggauggaauacugugaaacccuuucuggagauagcuggag

SEQ ID NO: 91911 - RNA, 42 nt, Mus musculus
aguuguggauaagaaagagagaggugagggcaagaugguacu

SEQ ID NO: 91912 - RNA, 42 nt, Mus musculus
caucuucaugguagugaggauguggaaggaagggaggccuag

SEQ ID NO: 91913 - RNA, 46 nt, Mus musculus
aaggaguaacaauuauugaaaauuucuaguuagaaauccguguugc

SEQ ID NO: 91914 - RNA, 45 nt, Mus musculus
ggauuacaugaaacccugcuuuuaaaaaguaagcaaaacaaacag

SEQ ID NO: 91915 - RNA, 46 nt, Mus musculus
uggugcugccucuaagcagugguccaggcauauauaauaaaagcag

SEQ ID NO: 91916 - RNA, 42 nt, Mus musculus
aaucuuuaaagauugucuaauuuauacuaaaagaugcccaag

SEQ ID NO: 91917 - RNA, 46 nt, Mus musculus
caaccuacauuuuuuuuuuuucuaucaagagacucaaagcugacua

SEQ ID NO: 91918 - RNA, 45 nt, Mus musculus
uuuuuucuaauuggcgauaaauuuucuguuacuuuggagugcaua

SEQ ID NO: 91919 - RNA, 46 nt, Mus musculus
uucugcagauaggaccugcauucccuuggaaccagcugcuacucua

SEQ ID NO: 91920 - RNA, 81 nt, Mus musculus
ugauaccagguugagggccaauaggauuuuagugggaaguuguaucagaaggugugccagggagaagaaacacauugccag

SEQ ID NO: 91921 - RNA, 54 nt, Mus musculus
uuauguaaccauaccagauugcugccacacggggaaaagggaaggacaugugac

SEQ ID NO: 91922 - RNA, 45 nt, Mus musculus
aaucuaagagauacaucagcuuaaacugggggaauugcaguggag

SEQ ID NO: 91923 - RNA, 49 nt, Mus musculus
ugagguauaucuguucugccuugggaugucgccgaugggauagugauga

SEQ ID NO: 91924 - RNA, 44 nt, Mus musculus
auuaagguuacagguagggcauagcccaauucuugcaaagcaga

SEQ ID NO: 91925 - RNA, 46 nt, Mus musculus
accuuuaaaccggguggaaacaaagaagacucuaaaauuauuucag

SEQ ID NO: 91926 - RNA, 47 nt, Mus musculus
gaagccaccaugcuggacacagugauaaaaguuuccguugcugauug

SEQ ID NO: 91927 - RNA, 77 nt, Mus musculus
caucagccuguuugaugauacaaguuacacagccagcgaagaagccuugggagacgaagaagacauuguagaggcug

SEQ ID NO: 91928 - RNA, 46 nt, Mus musculus
uaagcggagcacgcagaucacagucagguuccuggacagcccccac

SEQ ID NO: 91929 - RNA, 49 nt, Mus musculus
aacgccuggcuggaaaccccaccagagaaguggcaagaagagauggaug

SEQ ID NO: 91930 - RNA, 116 nt, Mus musculus
cacagacuggccgcucagcuccccuagcccgauggaugccccaucuguuaagauccgaaggauggauccuuucucuacaaaagagcagaucgaagucauagcuccuucuccugaaa

SEQ ID NO: 91931 - RNA, 44 nt, Mus musculus
cucaucggagagccaguucucuccccuggaguucucagggacag

SEQ ID NO: 91932 - RNA, 69 nt, Mus musculus
cccaagguguaucuguacauucagaugcagcugugcaggaaggagaaccucaaagacuggaugaaccgg

SEQ ID NO: 91933 - RNA, 42 nt, Mus musculus
uugugagcuaaauggcuuuucuuucagugaugagggaaagug

SEQ ID NO: 91934 - RNA, 46 nt, Mus musculus
aagugggaauuuagaacucgggccagaggcuagguguaacucuuag

SEQ ID NO: 91935 - RNA, 45 nt, Mus musculus
uggucaagguuggggacuuuggacuggugacugcuauggaccaag

SEQ ID NO: 91936 - RNA, 42 nt, Mus musculus
acgggacaaguagggaccaagcuauacaugagcccagagcag

SEQ ID NO: 91937 - RNA, 45 nt, Mus musculus
uuaggcuugauucuguuugaacuccucuacccauucagcacccag

SEQ ID NO: 91938 - RNA, 45 nt, Mus musculus
cuuuuagguauuggucaaaagaucugauuugagaguuuuggguuu

SEQ ID NO: 91939 - RNA, 44 nt, Mus musculus
gucaaacgcuggaccauccugagugccucugagcaccguccccg

SEQ ID NO: 91940 - RNA, 42 nt, Mus musculus; identical to SEQ ID NO: 86311

SEQ ID NO: 91941 - RNA, 77 nt, Mus musculus; identical to SEQ ID NO: 45879

SEQ ID NO: 91942 - RNA, 42 nt, Mus musculus
gggcacacgccacaugcggauuuaggugcuuucccaaccuuc

SEQ ID NO: 91943 - RNA, 67 nt, Mus musculus
uguguccgugacaggaucaagcgggcuuuccuuauugaggagcagaaaaucguugugaaaguguuga

SEQ ID NO: 91944 - RNA, 69 nt, Mus musculus
aggcacaagcacagagucagaaagcaaaauagauaugcacauuuuuuaaguaauaaaaaucaagacuug

SEQ ID NO: 91945 - RNA, 46 nt, Mus musculus
gccacagagggaagggucuuuacaacaaaugaaucgcugggcugag

SEQ ID NO: 91946 - RNA, 45 nt, Mus musculus
cagaucuauugaacaacacuuuucuaaucggagaaaguaaggcag

SEQ ID NO: 91947 - RNA, 42 nt, Mus musculus
cgccggaacucaccggaacucgccgcccugugugaggcccug

SEQ ID NO: 91948 - RNA, 45 nt, Mus musculus
auuugguagcauuuuggagcacuaguaaggaccauggcucaggua

SEQ ID NO: 91949 - RNA, 46 nt, Mus musculus
cauacuugauuuagagucugcacuuuaaacaccugaaagcaugcau

SEQ ID NO: 91950 - RNA, 46 nt, Mus musculus
gcuccaaguccaauuuuaaaaggugugugccagugccauggcccag

SEQ ID NO: 91951 - RNA, 42 nt, Mus musculus
aaaguguuccaggccagcuugagcuacuucugauugggggag

SEQ ID NO: 91952 - RNA, 45 nt, Mus musculus
aauagaaaguggaucuuagcauagcuguacauugcuauacaucag

SEQ ID NO: 91953 - RNA, 41 nt, Mus musculus
acuuauaacuguuuauaacagagacacaacuagcccaggag

SEQ ID NO: 91954 - RNA, 46 nt, Mus musculus
cuuccuauaaaaggcugacaguggaaaaccagguaccuuacugcag

SEQ ID NO: 91955 - RNA, 42 nt, Mus musculus
ggacaaggcuccagggggaaggagaagccaccacuugggagc

SEQ ID NO: 91956 - RNA, 42 nt, Mus musculus
ucggucuucuggcugccacucaacccucuaauaaugauaaag

SEQ ID NO: 91957 - RNA, 30 nt, Mus musculus
gcucucucacuuagcuacaucucaccccca

SEQ ID NO: 91958 - RNA, 46 nt, Mus musculus
uuaugcagaauuuuguuucauaugcgacuuuucccguugcuauuug

SEQ ID NO: 91959 - RNA, 46 nt, Mus musculus
uuguuguccguaaauuugcaacugcugagcuggagucagaguggag

SEQ ID NO: 91960 - RNA, 46 nt, Mus musculus
aucuuugguuaauuguuuuauaaccucuuggaaugugcucugagua

SEQ ID NO: 91961 - RNA, 44 nt, Mus musculus
cuggagagaugucucugagguuuagaaugcaaacuucccuuaga

SEQ ID NO: 91962 - RNA, 46 nt, Mus musculus
ugacuugucugaaagucuucuuuguugcuuuuacugcuuucucuag

SEQ ID NO: 91963 - RNA, 46 nt, Mus musculus
uugauugcuggacuucaauacguugauaucuaguagucaguuucag

SEQ ID NO: 91964 - RNA, 45 nt, Mus musculus
gaccuugguggcuagccuuacaaaugucuaacgguuuuuaugcag

SEQ ID NO: 91965 - RNA, 45 nt, Mus musculus
gaaggaaaccaugagagagagagagagagagagagagagagagag

SEQ ID NO: 91966 - RNA, 45 nt, Mus musculus
uuggucauuuucaggacauuccugaaagcaagaguucaagggcag

SEQ ID NO: 91967 - RNA, 42 nt, Mus musculus
aggaauagcaacccugacuaagacaggguggaaaugaaagag

SEQ ID NO: 91968 - RNA, 41 nt, Mus musculus
ggaguuugaaacauuuguauaaaaagucuuguaaggugggg

SEQ ID NO: 91969 - RNA, 45 nt, Mus musculus
ugcacugcucucuggcucuccuccguuuucuguaaacgccaucgg

SEQ ID NO: 91970 - RNA, 46 nt, Mus musculus
gaaacaugaggggugcuaccuuggugcuucauggauuggcucugca

SEQ ID NO: 91971 - RNA, 45 nt, Mus musculus
ucauuccuuucuuacuuguuagcugacagucuucaguacagaccu

SEQ ID NO: 91972 - RNA, 84 nt, Mus musculus
ggacauacacuuugugcugaaaaggcaggagcaguaagugcccaguugcucucucuuuaaucaguaauguuagaauaagggguu

SEQ ID NO: 91973 - RNA, 46 nt, Mus musculus
cuuuucaccauuauuuugugugauguugaaauacaaguuuggucag

SEQ ID NO: 91974 - RNA, 46 nt, Mus musculus
ugacuggaaacagacuggcauucacaaauacugaugcugguugcag

SEQ ID NO: 91975 - RNA, 46 nt, Mus musculus
auuucauaauuguguuuugaauccaccaggaauuagcuucagggau

SEQ ID NO: 91976 - RNA, 46 nt, Mus musculus
uuacugcauuccuacuuauuuaaauaccuuuuuuguguuaguaaag

SEQ ID NO: 91977 - RNA, 65 nt, Mus musculus
cccagguuaaugaauggucacugaagaucagaaaggaaaugagaguuguugacaggcaaauaaga

SEQ ID NO: 91978 - RNA, 44 nt, Mus musculus
gguuguaagccaccaugugguugcugggauuugaacuccgucag

SEQ ID NO: 91979 - RNA, 42 nt, Mus musculus
gaagcauugcaaaacuagcugugcaagcaagccaagccccag

SEQ ID NO: 91980 - RNA, 45 nt, Mus musculus
gauguuaaguggucugauguauauaauuuaucagaagagucaaga

SEQ ID NO: 91981 - RNA, 46 nt, Mus musculus
uggagaaacccugucuuggaaaaaaagggggaaaauuaaaucugga

SEQ ID NO: 91982 - RNA, 95 nt, Mus musculus
agauauccaaagagaagaagagaaaguaaaacggucugugaaagaugcagccaagaagggccaaaaggaagucugugugguucuggccaaggaga

SEQ ID NO: 91983 - RNA, 47 nt, Mus musculus
ggauaguuguuuccauuugggucuugcgcgcccugacucaccagcaa

SEQ ID NO: 91984 - RNA, 45 nt, Mus musculus
aggaugaguguaguguggugugugugugugugugugugugugugu

SEQ ID NO: 91985 - RNA, 53 nt, Mus musculus
ugaagcauguuguagugacaguacagauaaagggcagugggaguugaguugag

SEQ ID NO: 91986 - RNA, 42 nt, Mus musculus
agaagaagacagaugaugagcauguuuugacugggggcaaga

SEQ ID NO: 91987 - RNA, 63 nt, Mus musculus
uauuccuaugugauucguaguagccaaggggggaaacaauguaaaugcccauuggugggugga

SEQ ID NO: 91988 - RNA, 45 nt, Mus musculus
agcuggccaugaccacucaugccuauaauccuaguaucgggugag

SEQ ID NO: 91989 - RNA, 46 nt, Mus musculus
uugucggguaauacauacauaguauagguuuuugguguccuuggcu

SEQ ID NO: 91990 - RNA, 45 nt, Mus musculus
uacaucugugcaggugcacacaccuguggguauacagaggccaga

SEQ ID NO: 91991 - RNA, 26 nt, Mus musculus
ccugcgaguagcugguucucugcaga

SEQ ID NO: 91992 - RNA, 45 nt, Mus musculus
ggcuggugggauuguuaguguuaagaagaggaauaagaaugccua

SEQ ID NO: 91993 - RNA, 46 nt, Mus musculus
augguuuuucaaacuacaaaaaggagagacugagaaccggauggaa

SEQ ID NO: 91994 - RNA, 42 nt, Mus musculus
gagccaccaugugguugcugggauuugaacucaggacucgga

SEQ ID NO: 91995 - RNA, 52 nt, Mus musculus
agaggagauguuagaggauacauuugaaagcauggaugaucaagaagaaaug

SEQ ID NO: 91996 - RNA, 46 nt, Mus musculus
gccugaacccgcaggagcgauggcugccuccgaagagggagaagag

SEQ ID NO: 91997 - RNA, 46 nt, Mus musculus
cauuguaaaugucacaugcaaugaacucaagauauuaaucucccag

SEQ ID NO: 91998 - RNA, 45 nt, Mus musculus
uguugacugaaugaccauaucauacacugguguguacaagggagu

SEQ ID NO: 91999 - RNA, 47 nt, Mus musculus
ggagcuaagugucuuguacccagggacguagccuuaaccaugagcag

SEQ ID NO: 92000 - RNA, 45 nt, Mus musculus
guaagguaaaccagccgugcagagcacguacuguccccgucucag

SEQ ID NO: 92001 - RNA, 45 nt, Mus musculus
gcucaugcaugcacacacacaugcaugcucacauccuaauccaag

SEQ ID NO: 92002 - RNA, 46 nt, Mus musculus
uucguuggauuuuauuuuauguccuucagagcacccucccccaccc

SEQ ID NO: 92003 - RNA, 46 nt, Mus musculus
uguguguggcagcucacauugcaaucccagcuucacuaauccagag

SEQ ID NO: 92004 - RNA, 46 nt, Mus musculus
guuacuugucacagacucauaccaaccaugaagauaaauugcaggu

SEQ ID NO: 92005 - RNA, 52 nt, Mus musculus
aaagagaagccaggagcccuuuggcacauauaugcugcuaaagacacagaga

SEQ ID NO: 92006 - RNA, 64 nt, Mus musculus
aguccuuagaaccauccaagauggagauucugaugaacucacaaucaagagauuuauugaagga

SEQ ID NO: 92007 - RNA, 41 nt, Mus musculus
agggcuauacagagaaacccugucucaaaaaaaccgaaaaa

SEQ ID NO: 92008 - RNA, 46 nt, Mus musculus
cuucucaaggggguuaaagcuguguaaaguggacacaagaauagca

SEQ ID NO: 92009 - RNA, 42 nt, Mus musculus
cgugcaucauaaauuaaacacugaacucuggaaacccgaguc

SEQ ID NO: 92010 - RNA, 45 nt, Mus musculus
cuaagcgggcaucagaagaauggucucuucucuagcaacuuaaua

SEQ ID NO: 92011 - RNA, 46 nt, Mus musculus
acuggcugugugacaaccgccugcugugcuugcaagaccccaacaa

SEQ ID NO: 92012 - RNA, 43 nt, Mus musculus
acuggcuagcugaccuuaccagugggaaugucaacaaggagaa

SEQ ID NO: 92013 - RNA, 24 nt, Mus musculus
ugcuccaacaggcaguucaagcuc

SEQ ID NO: 92014 - RNA, 44 nt, Mus musculus
cucgguguggguuuggaguauguguagauugcuaccggaugaag

SEQ ID NO: 92015 - RNA, 46 nt, Mus musculus
uaccauggaugauaaugaaagagaucauccuaccaagaaggcagua

SEQ ID NO: 92016 - RNA, 46 nt, Mus musculus
uuuucccuuuuuuuguuauuguugcuuuuuguuuucccauacagaa

SEQ ID NO: 92017 - RNA, 42 nt, Mus musculus
acacaaguuucccauuacgcugauggguuucuucugacauag

SEQ ID NO: 92018 - RNA, 40 nt, Mus musculus
gggacucuuaugucugucauuuuggauuuugaauagccaa

SEQ ID NO: 92019 - RNA, 46 nt, Mus musculus
ggaagccuaguaagcuaccagggucaguuugugacauaucagagau

SEQ ID NO: 92020 - RNA, 46 nt, Mus musculus
uggccaauauuggagaccacuucugucaaauggugauuucugagaa

SEQ ID NO: 92021 - RNA, 45 nt, Mus musculus
ugagccaccaugugguugcugggauuugaacuccugaccugugga

SEQ ID NO: 92022 - RNA, 42 nt, Mus musculus
gaaggacucuccuguguuuugucgcuuuuuccacuucaggag

SEQ ID NO: 92023 - RNA, 44 nt, Mus musculus
ucaguuuugacagacccagauaaagucaggaagcugcagcagag

SEQ ID NO: 92024 - RNA, 46 nt, Mus musculus
guuguuuuaugaaaaauauuuuaacuaguuuuuugagcaugcagau

SEQ ID NO: 92025 - RNA, 46 nt, Mus musculus
uuuguuuugaguuuauuuuugucuaagaacucauauaccccaacuc

SEQ ID NO: 92026 - RNA, 54 nt, Mus musculus
ugaaggaacuuaagagaaagacugacuccauagaaugacacagauaggaagauu

SEQ ID NO: 92027 - RNA, 45 nt, Mus musculus
augauuagaagaucaaaaggaccgcagcacgucagaagguccaga

SEQ ID NO: 92028 - RNA, 66 nt, Mus musculus
cagaagugaaagcaggugucacuagccuuaauaguugugcagaaaagaaggucgaaccuucacauu

SEQ ID NO: 92029 - RNA, 47 nt, Mus musculus
ugagcccaaagguagcuguauccagccuaaaacaaacacugaucagg

SEQ ID NO: 92030 - RNA, 48 nt, Mus musculus
acuuucuuccugucuaaacacaaaaccugaaguaccgagaacaaaacc

SEQ ID NO: 92031 - RNA, 46 nt, Mus musculus
auauauacuuaaagcuuuauguugauauaugugccugccaugagau

SEQ ID NO: 92032 - RNA, 45 nt, Mus musculus
uaguaccuuaacucuagaaguauucaaaggaagggagauggcaga

SEQ ID NO: 92033 - RNA, 50 nt, Mus musculus
uugaaaauggagacaugauuaaucgacuuuuugauuggaugucggguuga

SEQ ID NO: 92034 - RNA, 69 nt, Mus musculus
gucugugaaggguaggagcaucagaauugggauuagcaagaaugaagagaagucagacuagucugcggg

SEQ ID NO: 92035 - RNA, 46 nt, Mus musculus
uugagaaaguuuuagaaacgcuggucugaccuagauuuuaugagaa

SEQ ID NO: 92036 - RNA, 46 nt, Mus musculus
uguccacauuaaguuugccaucaauauaggugagcuucuuggagug

SEQ ID NO: 92037 - RNA, 42 nt, Mus musculus
caggcacuuuuguugucccaguuacuuagaagucugaagcag

SEQ ID NO: 92038 - RNA, 45 nt, Mus musculus
uguugacagucuguuauagaagugaguaaaggccaguuggcugca

SEQ ID NO: 92039 - RNA, 45 nt, Mus musculus
aauacaguaacugaacugaaaaauguggauguuugcgccuuggag

SEQ ID NO: 92040 - RNA, 50 nt, Mus musculus
gaagugaggcaguaaccuaaaagcauagcauuaauuuggcuugguggaag

SEQ ID NO: 92041 - RNA, 39 nt, Mus musculus
uuacuaugugcuggguaccuggaggaccagaggccuggg

SEQ ID NO: 92042 - RNA, 45 nt, Mus musculus
gucauugaguugugcaguuaaauugaaaauuugucuggugugaga

SEQ ID NO: 92043 - RNA, 46 nt, Mus musculus
acuauuuugggugucuaaaaguuucauuuuuuuaguuauuugguua

SEQ ID NO: 92044 - RNA, 46 nt, Mus musculus
cuguucuucuguguugucuugucugcugcuguuacaaguuccagau

SEQ ID NO: 92045 - RNA, 45 nt, Mus musculus
gccucauuggagagcccugggcagcuaucuuugggaguaggaauu

SEQ ID NO: 92046 - RNA, 46 nt, Mus musculus
aggugauugguaauaagaguaguuuuuauuucugggcguugcuuuu

SEQ ID NO: 92047 - RNA, 72 nt, Mus musculus
gagcauaaccugguuuuggcagaacgaaaaucaccugaaguuccugagcaaguuauucaguggccugcaaua

SEQ ID NO: 92048 - RNA, 86 nt, Mus musculus
agguguguguggaguuugauggggagucuuggagaaagagaagauggauagaugucuacagccuucagagaaaagcauuuuuagua

SEQ ID NO: 92049 - RNA, 46 nt, Mus musculus
gaaagcuggguaaggcugaugugaacagauuaaauucuggcuagga

SEQ ID NO: 92050 - RNA, 53 nt, Mus musculus
gauguauguaacuuacuuuuugaagcuaguaaaauaagauugagagaauuaaa

SEQ ID NO: 92051 - RNA, 42 nt, Mus musculus
ccagaccucagacagugccuuuaauaucagaaugggguuagg

SEQ ID NO: 92052 - RNA, 46 nt, Mus musculus
guauuugcugagguaugguuagugaggcaggaguagguccccgguu

SEQ ID NO: 92053 - RNA, 32 nt, Mus musculus
cuguuucccacaccgacguuacuaagaaagac

SEQ ID NO: 92054 - RNA, 42 nt, Mus musculus
gcgcuccgcgggccucggcugcgggagacagagggagaaggg

SEQ ID NO: 92055 - RNA, 46 nt, Mus musculus
ggucuucgcucgacagccuacgcgcuucaagugcaauccaauaggc

SEQ ID NO: 92056 - RNA, 42 nt, Mus musculus
aagaguccgccccuucuggcgcgugcgcaggagcccccagag

SEQ ID NO: 92057 - RNA, 47 nt, Mus musculus
uuugacuugcgggcauuuuacccaucaaaccauuccuucuguagcuc

SEQ ID NO: 92058 - RNA, 46 nt, Mus musculus
guccauggcaaaugcuggaccaaacacaaacgguucccaguuuuuu

SEQ ID NO: 92059 - RNA, 50 nt, Mus musculus
gguggugacuuuacaugccauaauggcacuggcagcagguccaucuacgg

SEQ ID NO: 92060 - RNA, 46 nt, Mus musculus
uuggcagacgccacugucgcuuuucgccgcuugcugcagccauggu

SEQ ID NO: 92061 - RNA, 46 nt, Mus musculus
uuuauuuccaauauugccucucaccuuucuuaccuggaucuggaag

SEQ ID NO: 92062 - RNA, 42 nt, Mus musculus
caaaguacaaagagaagcugaagucuggcuggcucccaggag

SEQ ID NO: 92063 - RNA, 47 nt, Mus musculus
ugggacauuguagaaacuggaugaaugcuuuagucacauugggagag

SEQ ID NO: 92064 - RNA, 70 nt, Mus musculus
uacagaaauaaaucuuaaaaaaaaaaaacagaaacaaaagaggaagaagaagaagaagagagagagagac

SEQ ID NO: 92065 - RNA, 46 nt, Mus musculus
gucaugugaucuagaauuuuugcgugguguucagaauccuccagaa

SEQ ID NO: 92066 - RNA, 46 nt, Mus musculus
uggugacuauguuuuguugugguuagcagcuaugggaucuguuagg

SEQ ID NO: 92067 - RNA, 45 nt, Mus musculus
ucucgauggccauauauagugagaauggcuuuuccuaaauuaugg

SEQ ID NO: 92068 - RNA, 45 nt, Mus musculus
uugcucuggcaggagcuggaaguuagcccacuucaucaucugcuc

SEQ ID NO: 92069 - RNA, 41 nt, Mus musculus
gcuuaagaaauucaacuguuucauuagagagagaggagaca

SEQ ID NO: 92070 - RNA, 41 nt, Mus musculus
cgcagggcgcaagggcugcuguuuuccuguuucuuccccca

SEQ ID NO: 92071 - RNA, 44 nt, Mus musculus
aaguguaacuuauauaauuaggguccuuuuuaaaaggguuuaaa

SEQ ID NO: 92072 - RNA, 56 nt, Mus musculus
aggagagagggaggagggagggaggagagagggaggagggagggaggagagaggga

SEQ ID NO: 92073 - RNA, 46 nt, Mus musculus
guccuaguuggcuuugucaacaugacacaguuuaagagucauucga

SEQ ID NO: 92074 - RNA, 41 nt, Mus musculus
uaaagccagucuaaucuacguaaugaggccugugucaaggg

SEQ ID NO: 92075 - RNA, 45 nt, Mus musculus
ucugguaugagaugguccccaauguauacuguugauucugggcag

SEQ ID NO: 92076 - RNA, 45 nt, Mus musculus
cuuuggugaggugggccgcugucugaggagagggagcuguaugag

SEQ ID NO: 92077 - RNA, 44 nt, Mus musculus
aguaauaggaagugcagcaccacacaaggccacuaggggaggua

SEQ ID NO: 92078 - RNA, 44 nt, Mus musculus
gagcauagaccuuuuccuuacucaccagcccuuucucauuucca

SEQ ID NO: 92079 - RNA, 44 nt, Mus musculus
guuuccauucuauuaugaacuaaaaauagcguuuguagccuggc

SEQ ID NO: 92080 - RNA, 45 nt, Mus musculus
ucucugccuccagucucuuggguuugaagaguuuguagugcugug

SEQ ID NO: 92081 - RNA, 46 nt, Mus musculus
ggggucuuagagugaguggaauggugaugaugaugguggugaugac

SEQ ID NO: 92082 - RNA, 41 nt, Mus musculus
aaaggagaagugauaaguccugaaggguuaucuugggguca

SEQ ID NO: 92083 - RNA, 45 nt, Mus musculus
cguucuauagguguaaugcaagaaggcauggaaagauaaagauga

SEQ ID NO: 92084 - RNA, 41 nt, Mus musculus
gcaaaggaauguguguagauguuggaguucaugcuccuuga

SEQ ID NO: 92085 - RNA, 70 nt, Mus musculus
aaaaaaaaacaaaaaaaaaagaaagaaagaaagaaagaaagaaagaaagaaagaaagaaagaagaagaag

SEQ ID NO: 92086 - RNA, 46 nt, Mus musculus
agagacugaacuuucuaaaggauuugcaaauccaggucuuaauuca

SEQ ID NO: 92087 - RNA, 35 nt, Mus musculus
gcucaggagucuguauguagacgucagaguggugg

SEQ ID NO: 92088 - RNA, 45 nt, Mus musculus
gcuggugcucaaggggacuagaaauauacaagaauagggcuucca

SEQ ID NO: 92089 - RNA, 46 nt, Mus musculus
ggaaggcgguggugugcuucuggcggcugagugguugguaggucag

SEQ ID NO: 92090 - RNA, 46 nt, Mus musculus
acccuuccugcccuuuggggucaagaacagaagcuuccgagcccuu

SEQ ID NO: 92091 - RNA, 44 nt, Mus musculus
cagcugcuggcagaauugugaguaucucagaagggcuuggcaag

SEQ ID NO: 92092 - RNA, 45 nt, Mus musculus
agcaccuuguuuuagaguacacaaggcaaaaagaaaagucuagaa

SEQ ID NO: 92093 - RNA, 49 nt, Mus musculus
caggcagcuguggcucuugcuccuuucuggcuuguguggaaggugaaug

SEQ ID NO: 92094 - RNA, 46 nt, Mus musculus
cuccuauuuggauuauauuuguucacagcuaugcccugaaggcuag

SEQ ID NO: 92095 - RNA, 46 nt, Mus musculus
cugaacccauuaagcaaagcaucugcccucuucaagcucaccccac

SEQ ID NO: 92096 - RNA, 52 nt, Mus musculus
uguuuuuacaguacacagacuagaaacuaaagcagcagauucagagggcaga

SEQ ID NO: 92097 - RNA, 45 nt, Mus musculus
uugcucucuaccugucaacucuguuggugcauaacccuggcuuag

SEQ ID NO: 92098 - RNA, 45 nt, Mus musculus
auuuacuaagccaggguuaugcaccaacagaguugacagguagag

SEQ ID NO: 92099 - RNA, 46 nt, Mus musculus
cuguauguaugaagaaguucccuuuccauccgaggugugccugcag

SEQ ID NO: 92100 - RNA, 46 nt, Mus musculus
ucuucauuaaauggagagggauguagaaugucguaaaaccccauau

SEQ ID NO: 92101 - RNA, 42 nt, Mus musculus
gcaaagugaguaugcguuaaacuguaaacuguaccagcugau

SEQ ID NO: 92102 - RNA, 42 nt, Mus musculus
auacucacuuugcaagggcauuauguacacaaagacccacau

SEQ ID NO: 92103 - RNA, 46 nt, Mus musculus
guuuguucgaucgugguacaucugguaaggaucgccagcguaccag

SEQ ID NO: 92104 - RNA, 45 nt, Mus musculus
gcagcaagacccagaguaaacuccuggauaaaaugacgacaucuu

SEQ ID NO: 92105 - RNA, 46 nt, Mus musculus
agauaauguuccaaagacauuuuaaaacuugcaaaggcagcagcag

SEQ ID NO: 92106 - RNA, 46 nt, Mus musculus
uuucuagucagccugaccaguaagcucugggauccauuugccuuuc

SEQ ID NO: 92107 - RNA, 45 nt, Mus musculus
uagaggugcaggcaguugugagcuguccaacaugggugcuggucc

SEQ ID NO: 92108 - RNA, 44 nt, Mus musculus
agaaugaagucggaggaagcgaugcacgaccgacuuuaccgucu

SEQ ID NO: 92109 - RNA, 26 nt, Mus musculus
ucuaacauacugcagcacacggaaag

SEQ ID NO: 92110 - RNA, 25 nt, Mus musculus
ugcccauaugccagguguccaacag

SEQ ID NO: 92111 - RNA, 41 nt, Mus musculus
uuagacauauucagacaucaguuguuuccucugcuccaaga

SEQ ID NO: 92112 - RNA, 66 nt, Mus musculus
aggaaacaacugaugucugaauaugucuaaaaugaauggugcacagugaagaauuaagacaggcau

SEQ ID NO: 92113 - RNA, 46 nt, Mus musculus
ccaucauauaauccagauugaugugugugcacucuaugcccagaag

SEQ ID NO: 92114 - RNA, 46 nt, Mus musculus
uauucaguggagcagucauccaaggcuaguggcauauuucugagag

SEQ ID NO: 92115 - RNA, 46 nt, Mus musculus
uuaguuuggauguuaacgaggaaagaaaaacaagaugacuugaggu

SEQ ID NO: 92116 - RNA, 23 nt, Mus musculus
gcgcccgugaagauggaagccgc

SEQ ID NO: 92117 - RNA, 43 nt, Mus musculus
augcugcgggccugucaguuauccggcgugaccgucgcggccc

SEQ ID NO: 92118 - RNA, 45 nt, Mus musculus
auaacugucaguauaacuuucuacaguugaaaauaaaaaccccau

SEQ ID NO: 92119 - RNA, 46 nt, Mus musculus
ucagugguuguagacucccugacacugauacugaacucagguccuc

SEQ ID NO: 92120 - RNA, 46 nt, Mus musculus
gcaaugacuugcaugcuucugucccacaaaaguccauaaacuccac

SEQ ID NO: 92121 - RNA, 46 nt, Mus musculus
cacccgaacuggguuccugagugggaggcuggagcuauaugggagg

SEQ ID NO: 92122 - RNA, 43 nt, Mus musculus
gaagacuccacccuagguggucuuguucacaguaacagaacag

SEQ ID NO: 92123 - RNA, 46 nt, Mus musculus
gguuauauaauauuagagacacugcuuaagagagaguaaacuggag

SEQ ID NO: 92124 - RNA, 46 nt, Mus musculus
cacagacaacaacaaugugcaggcugacauaaaccuagacauuucu

SEQ ID NO: 92125 - RNA, 45 nt, Mus musculus
gauagguagcaguguauuucuggaagaacauuuggcaugccugca

SEQ ID NO: 92126 - RNA, 41 nt, Mus musculus
gugugggaaguucguccuccguccacuacgaccaugccgua

SEQ ID NO: 92127 - RNA, 35 nt, Mus musculus
ucuuuacuauguacuaauaauagaaguaugcgugg

SEQ ID NO: 92128 - RNA, 46 nt, Mus musculus
agcuguaguguuacucuugacugcuguggucugagucgaugguaga

SEQ ID NO: 92129 - RNA, 42 nt, Mus musculus
uauuucuuucuucuagguugacugcugguaagauugcuggag

SEQ ID NO: 92130 - RNA, 41 nt, Mus musculus
uugcaccuacuggaauuagaauuacagguggaugggcugga

SEQ ID NO: 92131 - RNA, 42 nt, Mus musculus
aucccagcagccacauggugacucacaaccaucuguaauggg

SEQ ID NO: 92132 - RNA, 46 nt, Mus musculus
caguugcuuugcugacuguuccacuugaguagcauacugugccugu

SEQ ID NO: 92133 - RNA, 49 nt, Mus musculus
auuguuuuuccugugcaccgggccuuucccgccuucaguuuucaccccc

SEQ ID NO: 92134 - RNA, 46 nt, Mus musculus
uacagagaaacccugucucaaaaaaccaaaaaagaaaagagaagaa

SEQ ID NO: 92135 - RNA, 41 nt, Mus musculus
agagccagaaaacgaagggagacacuccagcuucagcaggu

SEQ ID NO: 92136 - RNA, 46 nt, Mus musculus
auuaaacacagggcaguagaaguauuuauauguuuaaguaguacag

SEQ ID NO: 92137 - RNA, 46 nt, Mus musculus
aauaucaugcauaacauguauuuauagcaucuacaggggcagcuca

SEQ ID NO: 92138 - RNA, 46 nt, Mus musculus
auagauguuuugcucaccagaacuguauugccuaggcagcccauag

SEQ ID NO: 92139 - RNA, 26 nt, Mus musculus
ucgucuagcgcaacaggaaaagcaag

SEQ ID NO: 92140 - RNA, 82 nt, Mus musculus
cuugccugcauguguguauguuuugugccugauaccuguagaggccagaagaggauguuaaacugggaguagaguuagaugg

SEQ ID NO: 92141 - RNA, 46 nt, Mus musculus
ucugaaccggacuucgucugucacucugcagacuauuacagcccag

SEQ ID NO: 92142 - RNA, 45 nt, Mus musculus
aaggcacacuccaacauacugaaaacagccauggacaauucugag

SEQ ID NO: 92143 - RNA, 90 nt, Mus musculus
cuauuaguuaugaagaauuuuguaauauaaggcauugcaguacuuggauaucauuugaaauguuuaugcucaucaauauuaaacuggggg

SEQ ID NO: 92144 - RNA, 44 nt, Mus musculus
aauuucuucauaguguuuuggaguuaaggauuuaaaaauuacuu

SEQ ID NO: 92145 - RNA, 45 nt, Mus musculus
uauuagaugucaguggggauguugccuggaaaauuggugcugaaa

SEQ ID NO: 92146 - RNA, 62 nt, Mus musculus
agacuuauguauaauauucccccugaauuuaauggcacagaauucugcauuaaucuugaccu

SEQ ID NO: 92147 - RNA, 62 nt, Mus musculus
uuuacauaacuuaaaauuuuguuuagauugcaggugagaagaagucggcccaguggcgaaca

SEQ ID NO: 92148 - RNA, 45 nt, Mus musculus
cagagaagaguuagagaagaugaaaacuauaauugaagaugcaaa

SEQ ID NO: 92149 - RNA, 45 nt, Mus musculus
cucauauaacugcugcagaggggagacuucacaacaugauaguug

SEQ ID NO: 92150 - RNA, 45 nt, Mus musculus
gucagaggcaaaggugguaucucaguaucaugaacuuguggucca

SEQ ID NO: 92151 - RNA, 42 nt, Mus musculus
agcuggacaguaucacuccagacaucacuccuggauggaaag

SEQ ID NO: 92152 - RNA, 41 nt, Mus musculus
uacacuguagaugucuucagacacuccagaagagggcgcca

SEQ ID NO: 92153 - RNA, 46 nt, Mus musculus
aaucaaagaauugugucuccuaguaaaguuuuuaguugaugugcag

SEQ ID NO: 92154 - RNA, 45 nt, Mus musculus
gugguugcugggauuugaacucaggaccuucagaagaaaagucag

SEQ ID NO: 92155 - RNA, 48 nt, Mus musculus
aucgcaaugagugaguguaugugugcauaacugaguguuugggcauga

SEQ ID NO: 92156 - RNA, 92 nt, Mus musculus
guauuaaaaaggagcaugagugaucccauuggguaucauugaucacagauuacuauucuagguagugugcauucaaggaaaggaacaaacag

SEQ ID NO: 92157 - RNA, 45 nt, Mus musculus
uucaguauaagagcauuaguccagauucuuaaacaacgcccaaag

SEQ ID NO: 92158 - RNA, 46 nt, Mus musculus
cucuaggaaaugcucuuaccuacugagccaccuuuagccaccccaa

SEQ ID NO: 92159 - RNA, 42 nt, Mus musculus
gacuggcuuggaacucucuugccucugccuccugagugcuag

SEQ ID NO: 92160 - RNA, 46 nt, Mus musculus
uuuacucuggacauaaauacugccuaugccagguugagagggauug

SEQ ID NO: 92161 - RNA, 46 nt, Mus musculus
cccugacccgggggguauacagugaagagacccuaagagcccguuu

SEQ ID NO: 92162 - RNA, 42 nt, Mus musculus
agucccuacuccuguucccgccuaagcaacugaagcccccgg

SEQ ID NO: 92163 - RNA, 48 nt, Mus musculus
uggugaccuggagcuggcagcaaaguuugucaaucagcucaaagggga

SEQ ID NO: 92164 - RNA, 46 nt, Mus musculus
ccagcgccguaggaauaggaaccacucaagugcagcaagaguaagg

SEQ ID NO: 92165 - RNA, 46 nt, Mus musculus
aacuaauuaaaucagaagcaagcuacugguuuaggcugcccagaug

SEQ ID NO: 92166 - RNA, 42 nt, Mus musculus
aguagcuugcuucugauuuaauuaguucuaagagcauccauc

SEQ ID NO: 92167 - RNA, 45 nt, Mus musculus
cagguaggcagcaagggccuguggguucuaacaugaugggcguag

SEQ ID NO: 92168 - RNA, 42 nt, Mus musculus
auuccuacuacgcccaucauguuagaacccacaggcccuugc

SEQ ID NO: 92169 - RNA, 45 nt, Mus musculus
ucuuggcaaaaaacuggccagaugugcaucuuagcgguacugcag

SEQ ID NO: 92170 - RNA, 46 nt, Mus musculus
uggagaaagcagcagugacagugacagugacgacaaaugagagaga

SEQ ID NO: 92171 - RNA, 46 nt, Mus musculus
uauccaagagucuucauguacguagguguaccauauguccacagag

SEQ ID NO: 92172 - RNA, 45 nt, Mus musculus
ugacuaaaaguuauuaaguuugguacacuggagaaauggcucacc

SEQ ID NO: 92173 - RNA, 44 nt, Mus musculus
ugaauaguugacuuguaggucacguagcuucugaacccgagaaa

SEQ ID NO: 92174 - RNA, 33 nt, Mus musculus
ugcuaguuauaucccccacggagggaaucuacc

SEQ ID NO: 92175 - RNA, 42 nt, Mus musculus
gcauucacauacaugagacuguugccuuaaucugagccuguu

SEQ ID NO: 92176 - RNA, 42 nt, Mus musculus
ccuuaggcuuauucguuuuuccaaaauuagagacaccaagau

SEQ ID NO: 92177 - RNA, 44 nt, Mus musculus
gggcucuggcauacuugugugcacauguauauacgcagccgauc

SEQ ID NO: 92178 - RNA, 45 nt, Mus musculus
augcauuuacuuuaccacacacacauaauuaaaaauaagagagau

SEQ ID NO: 92179 - RNA, 46 nt, Mus musculus
uaagauaguaaagaauacagucauacuuuccgagaugcccuaagag

SEQ ID NO: 92180 - RNA, 46 nt, Mus musculus
uucaagcauuggauguggccaauagacuagaauugguuccucagau

SEQ ID NO: 92181 - RNA, 46 nt, Mus musculus
acacuucaugccuuuaugugugaggguuguuuuuguguguccaggu

SEQ ID NO: 92182 - RNA, 46 nt, Mus musculus
caagugcugggauaaaaggcgugcgccaccacugcccggcuuuaau

SEQ ID NO: 92183 - RNA, 48 nt, Mus musculus
uuuaguaacaaaagaauuauugcuuugggguuuauggugaacuugugg

SEQ ID NO: 92184 - RNA, 46 nt, Mus musculus
caaaagauagguuaucucucuugcuaaguauaaauuguuaucagca

SEQ ID NO: 92185 - RNA, 45 nt, Mus musculus
aacauauaauuguacuuggaaaagaaaaauaggcuugggacaagg

SEQ ID NO: 92186 - RNA, 45 nt, Mus musculus
uagucuuaggaaguuuaggguaauugauagaaaguuuaaggagau

SEQ ID NO: 92187 - RNA, 46 nt, Mus musculus
gccucuugagagacagcccacucugucaggcaacuuuccugcagau

SEQ ID NO: 92188 - RNA, 46 nt, Mus musculus
agcaugcacaugcucacacauuuagugguuaaagcaagcuccauca

SEQ ID NO: 92189 - RNA, 41 nt, Mus musculus
ggccccacuggugguauguguucuguaaacccacgaugaag

SEQ ID NO: 92190 - RNA, 46 nt, Mus musculus
augggcccaucaccuaaaacuagagcuaagauauacagucuuuaag

SEQ ID NO: 92191 - RNA, 42 nt, Mus musculus
cugagucacaagccccagcuccaggaauagauccugccuuag

SEQ ID NO: 92192 - RNA, 45 nt, Mus musculus
accuuacguagaggaucauguccgaccaguuuccgguuguccccc

SEQ ID NO: 92193 - RNA, 46 nt, Mus musculus
augauaucaugaaugaauuagagggaagaacauuuucuccacagga

SEQ ID NO: 92194 - RNA, 46 nt, Mus musculus
cauccauccauccauccauccauccauccauccauccauccuuggg

SEQ ID NO: 92195 - RNA, 46 nt, Mus musculus
aacuaaauuauuuaggaguaccuguguucuuuuaaagucaagucag

SEQ ID NO: 92196 - RNA, 44 nt, Mus musculus
acauuuuuuucuauauauaaaaauagaauuuugagggccaaaga

SEQ ID NO: 92197 - RNA, 46 nt, Mus musculus
agaaaccaucaaagggacaacacuucaagacagugccacaggcaag

SEQ ID NO: 92198 - RNA, 29 nt, Mus musculus
gaggaaucacugaggaagauaacuggcaa

SEQ ID NO: 92199 - RNA, 46 nt, Mus musculus
ugauuuuaagccaucacaugggugcugggaauugaaccugggucuu

SEQ ID NO: 92200 - RNA, 46 nt, Mus musculus
cuggaacucccucuguagguagaccaggcugcccuugaacucagag

SEQ ID NO: 92201 - RNA, 54 nt, Mus musculus
acuuggaaggauaccagccuuacagauacuacgugaaaugaaacauauuggaau

SEQ ID NO: 92202 - RNA, 46 nt, Mus musculus
cuggaacuugcuauaugagccacacuugcuuugaacucacagagau

SEQ ID NO: 92203 - RNA, 46 nt, Mus musculus
uguuguagguuacaaagguaucauaugcauuaaaauucuggccaga

SEQ ID NO: 92204 - RNA, 46 nt, Mus musculus
agaacuaguucuaaggccuuacugagguuagcuaagacaccaagac

SEQ ID NO: 92205 - RNA, 46 nt, Mus musculus
uauuaaaggguugcagccaucaggaagguggagaaccacugcguua

SEQ ID NO: 92206 - RNA, 43 nt, Mus musculus
cgugcaguaggagcgugcauucuucucuggcauuaaagcgaag

SEQ ID NO: 92207 - RNA, 46 nt, Mus musculus
aaguacaaccaggccaaacccuaaauggauuucuguaugcuggcag

SEQ ID NO: 92208 - RNA, 46 nt, Mus musculus
uaggaauuuuacaguacaugaaaaauaugcuacauuguccucuaga

SEQ ID NO: 92209 - RNA, 41 nt, Mus musculus
agccuggucuacagaguaaaugccaggacagccagggcaca

SEQ ID NO: 92210 - RNA, 44 nt, Mus musculus
guacaaagggauaaauugggaauaugaaaaagaccacuggggca

SEQ ID NO: 92211 - RNA, 46 nt, Mus musculus
gcccccagcugacuauccuuuucaacaaacugaacauuuggaaaac

SEQ ID NO: 92212 - RNA, 46 nt, Mus musculus
gacucaagugaggguuguaagccaccauguggcuguucuggaaguu

SEQ ID NO: 92213 - RNA, 45 nt, Mus musculus
auuuuugcauguaugaauguuuugccugcaugugcuugccccaca

SEQ ID NO: 92214 - RNA, 42 nt, Mus musculus
aucuaacuaauguccuguuguguuuucaauuagaucugggug

SEQ ID NO: 92215 - RNA, 46 nt, Mus musculus
uuaguuagaugcucagaaaagacaagaucuuugcuagacuaccaag

SEQ ID NO: 92216 - RNA, 45 nt, Mus musculus
gagcagccagugcucuuaacuccugagcauuuuuugagccgcaga

SEQ ID NO: 92217 - RNA, 45 nt, Mus musculus
uccucuuguucuagugcuuaaugccugaguacuuugagccucaga

SEQ ID NO: 92218 - RNA, 46 nt, Mus musculus
cuuucucuuuaucuacaguccagaaccugugugaaacgaucccagu

SEQ ID NO: 92219 - RNA, 42 nt, Mus musculus
ggaaagaauuuuagcaagagcaguaggcagcuagucacagua

SEQ ID NO: 92220 - RNA, 86 nt, Mus musculus
gacuuacaacuuuccuucauugcuugucagguauuuugucacagcaggaaaagcaauccacucagggcacagcuaauggcagagag

SEQ ID NO: 92221 - RNA, 45 nt, Mus musculus
cugcagccucucccuucuccuuccuuucccaaacucacccccaga

SEQ ID NO: 92222 - RNA, 44 nt, Mus musculus
gacacucugcagauacuguacaauuccuguuccaagggguguca

SEQ ID NO: 92223 - RNA, 89 nt, Mus musculus
acauuguaguaugaauacaaauuaaaucauacuuccacagcagauuuagccauuuuagugcccaggauauuagaaugagaaccuuugcu

SEQ ID NO: 92224 - RNA, 46 nt, Mus musculus
ucaaaaaauauuuaaguuguuucugaaaaagguuuuggguuuaguu

SEQ ID NO: 92225 - RNA, 45 nt, Mus musculus
cuggguucuauccuagcaacaagagaaggaaaaaccuuuuaagau

SEQ ID NO: 92226 - RNA, 42 nt, Mus musculus
uccuguuguaguggauuugagaaauaaguccuggcccuaggu

SEQ ID NO: 92227 - RNA, 42 nt, Mus musculus
gaaugguaauagagaccaguuaaguacauaggaagcaaaggg

SEQ ID NO: 92228 - RNA, 45 nt, Mus musculus
caggguagagguaagagccguuaguuuggauaguuagcaggaggc

SEQ ID NO: 92229 - RNA, 39 nt, Mus musculus
uuguggauuuccuuacaugaggaugacaugauaaagaca

SEQ ID NO: 92230 - RNA, 44 nt, Mus musculus
aauucaguuuauaagcuacgagugcuuuuauuuuucuguguagc

SEQ ID NO: 92231 - RNA, 48 nt, Mus musculus
cguacgccccuuugcacaccucuauauccagaaaaacgacaagaaaug

SEQ ID NO: 92232 - RNA, 46 nt, Mus musculus
cauuacuguaugaacucaguagguacacuaguccuacuaugcagag

SEQ ID NO: 92233 - RNA, 45 nt, Mus musculus
ugcagauuuuaugcuggaacugaaucccucccaaagguugaagga

SEQ ID NO: 92234 - RNA, 42 nt, Mus musculus
uaaauguggcucagaaugugugcaugcggguggagcugaguc

SEQ ID NO: 92235 - RNA, 88 nt, Mus musculus
ggcucugcgcuacaagacucaaguggcguucucugcggcugacuggaacuucucucguagugacggaccucaaaacugacucggaaga

SEQ ID NO: 92236 - RNA, 45 nt, Mus musculus
auggaggcggcuucagggcauuuccuucggaauguauucggccga

SEQ ID NO: 92237 - RNA, 41 nt, Mus musculus
uacgauucccagaaggcuuugagccgagccaguccgggggc

SEQ ID NO: 92238 - RNA, 77 nt, Mus musculus
gggucaccacaacauaagcaacuguauuaugcagguugcagcauuaggaagacagagaacuacuguuguggguuaua

SEQ ID NO: 92239 - RNA, 74 nt, Mus musculus
auuuucacuucagaauagaucugacagcuguuggaggguggacaggaagaggaaggaaggacaaaacaugaugg

SEQ ID NO: 92240 - RNA, 79 nt, Mus musculus
cucaggaaguuaaguguuaaauccauuacaaauccucgauacguggacuaccugggaaacccuucagcaaauggccugu

SEQ ID NO: 92241 - RNA, 46 nt, Mus musculus
ccuagaaacuguacacccugaguguccauuguccaaaaugcuugag

SEQ ID NO: 92242 - RNA, 62 nt, Mus musculus
gccugugaguggacaggaaaagggaggcggagcuaggaauuggggagagcgauagagaggua

SEQ ID NO: 92243 - RNA, 41 nt, Mus musculus
uuuuaaaccaccacaaguagcuacgauuuucacaagguuag

SEQ ID NO: 92244 - RNA, 158 nt, Mus musculus
guaucuuguaaauugugaucuuauuguuauauaaaucugauuggauaauuaaguuuuaagagucauguuucuaccggguaacuagguguugagauagcugauugugggguguguggggcgcuguguggaagcaagaugaacucgcuagcugggagagu

SEQ ID NO: 92245 - RNA, 45 nt, Mus musculus
gguacuagagcgggaacaccggcaggcaggagagauggcugggca

SEQ ID NO: 92246 - RNA, 41 nt, Mus musculus
aaagauaagaacuuucaagacuugaauggugucugggaguu

SEQ ID NO: 92247 - RNA, 61 nt, Mus musculus
ggagcacaauaguaaacuaaucaucacauacccagccacggugcacaagaaaucagaccag

SEQ ID NO: 92248 - RNA, 46 nt, Mus musculus
acuauuugcugaaguguacuccuaagacauuuguucucgcccaaaa

SEQ ID NO: 92249 - RNA, 99 nt, Mus musculus
ucuuucugaauuaucuuuuuucgggauuggaugauauuggcccagaguccaguuucaaccccaguauguucuuucuagacuucauagucguaccgccau

SEQ ID NO: 92250 - RNA, 46 nt, Mus musculus
ccgucccgucaaucgccugggugaccagauguucacuaauggccag

SEQ ID NO: 92251 - RNA, 46 nt, Mus musculus
aaggaugcaguuuugauccggaaacuucuggcguugauggcccaag

SEQ ID NO: 92252 - RNA, 46 nt, Mus musculus
gccuucagagccacgucaauauuguguuugacagugagauggacaa

SEQ ID NO: 92253 - RNA, 41 nt, Mus musculus
guguagauccuagagaagaaggaaggccuguuccggaagca

SEQ ID NO: 92254 - RNA, 44 nt, Mus musculus
agcccgcucggucaucugcccagacauguacaucaacaccaaug

SEQ ID NO: 92255 - RNA, 45 nt, Mus musculus
uugagguacaaaaugguuuugccauccuagaagacuuuugcccca

SEQ ID NO: 92256 - RNA, 45 nt, Mus musculus
ggcuguagagaagggucagaagagacgaauaugaugucauggaga

SEQ ID NO: 92257 - RNA, 42 nt, Mus musculus
gaggugaacgggaaggaaacuaaagaugaacuuacagguuag

SEQ ID NO: 92258 - RNA, 46 nt, Mus musculus
accuguuuccuccugcuucuuaacucugugacacagaugggacuag

SEQ ID NO: 92259 - RNA, 60 nt, Mus musculus
aauguuuuaaaugucauggggggcgggggacguauuuucagauuguauccgccaagauua

SEQ ID NO: 92260 - RNA, 45 nt, Mus musculus
aacaugcagucuuggaauuguaucuguuucuuuguuaacucugag

SEQ ID NO: 92261 - RNA, 46 nt, Mus musculus
agccuaccuugcacagacccuccauccaggcccaccgugcccgcau

SEQ ID NO: 92262 - RNA, 43 nt, Mus musculus
uuuauuuaguuauuauuauuguuacacacacucgcgugcgcac

SEQ ID NO: 92263 - RNA, 46 nt, Mus musculus
uuuagaauaccauuaagaauuagcuaauuuaaugacucaucagcag

SEQ ID NO: 92264 - RNA, 46 nt, Mus musculus
gagggauggucucuuggccucccaugacaaacaacucagaagggag

SEQ ID NO: 92265 - RNA, 41 nt, Mus musculus
ucacacucgaggaaugaaacuugccuaaggucacugaagua

SEQ ID NO: 92266 - RNA, 42 nt, Mus musculus
ugccccacagugugguugauuuacucaguguuacuugggaag

SEQ ID NO: 92267 - RNA, 46 nt, Mus musculus
acagugcuaauggcaaugguguuacaccucuaauaauaaguuucag

SEQ ID NO: 92268 - RNA, 46 nt, Mus musculus
uuuggccacuugacuguugcuucuggaccuuuguguggugagucag

SEQ ID NO: 92269 - RNA, 46 nt, Mus musculus
uggcuuuaaacuugucaguccugccucagccuuccaagugccugga

SEQ ID NO: 92270 - RNA, 46 nt, Mus musculus
agcauaaagcuacuuuacccucaugauaccuucuguggcugggcug

SEQ ID NO: 92271 - RNA, 86 nt, Mus musculus
gucgacccuccucauaaacauaauuccagaggacuacgccccccugaacuuaucuggaaaggcaaaaauuggcagcaaagccuggg

SEQ ID NO: 92272 - RNA, 46 nt, Mus musculus
uagaggaggccaauguggucacccuccauuacuucaccccugugag

SEQ ID NO: 92273 - RNA, 33 nt, Mus musculus
ucugccuacggccugguccacugcugcuaugag

SEQ ID NO: 92274 - RNA, 46 nt, Mus musculus
gaagacauuuugguuaagccaaaugcagauguggugagacagcgua

SEQ ID NO: 92275 - RNA, 41 nt, Mus musculus
cagagggauuuuaacaugauugauaugaaguucaaggagga

SEQ ID NO: 92276 - RNA, 30 nt, Mus musculus
agagucugggaaggccuugguuucaugcaa

SEQ ID NO: 92277 - RNA, 47 nt, Mus musculus
agggaaugccuggccuccuguuguacuugguccuugcugugugaccu

SEQ ID NO: 92278 - RNA, 45 nt, Mus musculus
uggagauguagcugagaguucuacauccugauccauaggcagagg

SEQ ID NO: 92279 - RNA, 73 nt, Mus musculus
ggaauugauuuccucuuacaacuccaugacuaagggaacucagaacagaaacucaaggcaggaccuggagcag

SEQ ID NO: 92280 - RNA, 51 nt, Mus musculus
cugccagggguggcacugcccccaauaagcuggcccacccacauuaaccau

SEQ ID NO: 92281 - RNA, 44 nt, Mus musculus
agcagccugauagaaacauucucucaacugaaguuccucuuccc

SEQ ID NO: 92282 - RNA, 27 nt, Mus musculus
gcaggacaaacuucaaggcacucccag

SEQ ID NO: 92283 - RNA, 46 nt, Mus musculus
ggaauguucuucuuuggcuuguauaagcaucuagguuggccuucag

SEQ ID NO: 92284 - RNA, 46 nt, Mus musculus
uuuguguuuuguuuucccagaucucuugccugcugggccaaauuga

SEQ ID NO: 92285 - RNA, 42 nt, Mus musculus
ugccagaccacauggagaugcccacugugauacuagggccag

SEQ ID NO: 92286 - RNA, 49 nt, Mus musculus
aaagcugcguagcaaguccucaugccucaaaaaaaaaaaaaagaaagaa

SEQ ID NO: 92287 - RNA, 26 nt, Mus musculus
cucgccauuccacacacuugcccaua

SEQ ID NO: 92288 - RNA, 46 nt, Mus musculus
uuacagguguaucaucaagcaccuggaggggcuggucauccaguac

SEQ ID NO: 92289 - RNA, 45 nt, Mus musculus
aaugaaauccaagcaucuucaugaaguuuuauccagagcagaucc

SEQ ID NO: 92290 - RNA, 46 nt, Mus musculus
cagaagauccaggcagcugugaaagcuuugaaccuaaagggcagua

SEQ ID NO: 92291 - RNA, 24 nt, Mus musculus
cagagaggaguuacaagaaaucag

SEQ ID NO: 92292 - RNA, 44 nt, Mus musculus
gcccuccacacagaugacacugaacaccuuccacuuugcaggca

SEQ ID NO: 92293 - RNA, 46 nt, Mus musculus
gcccaugaugagugugccuguguucgacaccaagaaagcauugaag

SEQ ID NO: 92294 - RNA, 45 nt, Mus musculus
gaaaguugacauccaggaguccuucuguaugggagaaaaacggaa

SEQ ID NO: 92295 - RNA, 42 nt, Mus musculus
ucucuucugagaagugggacucagagcccacagggccugauu

SEQ ID NO: 92296 - RNA, 45 nt, Mus musculus
guccacagcaggccuccaaggucucaggcaaagacaaaaguagga

SEQ ID NO: 92297 - RNA, 51 nt, Mus musculus
aagcuaucaaaaagaagaaaaacaaagcaucagccuucagaaaugugaauu

SEQ ID NO: 92298 - RNA, 79 nt, Mus musculus
ggaugaggaagaggaggggaacauuguggaugcugaagcugaggagggcgaugcagacgcuucugacaccaaacgcaag

SEQ ID NO: 92299 - RNA, 41 nt, Mus musculus
agguugacuaugagagugaggaagaaggagaggaggaagag

SEQ ID NO: 92300 - RNA, 46 nt, Mus musculus
uguccagauacuggaccugcgccgccucuacuccaaugacauccac

SEQ ID NO: 92301 - RNA, 44 nt, Mus musculus
caugguugcugagucuacagucauuugagagucaccaugaggga

SEQ ID NO: 92302 - RNA, 46 nt, Mus musculus
cuucaagggucuagaucccagguagaaacaggacacuuaggcagag

SEQ ID NO: 92303 - RNA, 47 nt, Mus musculus
cagagccuaggugggugugugacuuccugcagucaaucuuaccugga

SEQ ID NO: 92304 - RNA, 46 nt, Mus musculus
auggggaggaaagagaauagcugagugcaugcucagaggccagaag

SEQ ID NO: 92305 - RNA, 46 nt, Mus musculus
aaaaaaaucauuaagaaaaauacagggaaauucuaggaguugguag

SEQ ID NO: 92306 - RNA, 46 nt, Mus musculus
ugguauuugaaaaagucaaaggaaaggauauuggcuuuaugauuag

SEQ ID NO: 92307 - RNA, 42 nt, Mus musculus
gcguucuuugugcgcuguuuuauuuguuuguuuugcggagag

SEQ ID NO: 92308 - RNA, 46 nt, Mus musculus
aaagaaauugagaugauuggagguuuggguggcuguuuuguugguu

SEQ ID NO: 92309 - RNA, 75 nt, Mus musculus
agguuuguuccucuuuaaauguuguguagguacuuggagcacguuuguucauuucagcacuugggagauagaggc

SEQ ID NO: 92310 - RNA, 45 nt, Mus musculus
uagagcaaguuaaaagucagcugggguauaggagaugcugucaug

SEQ ID NO: 92311 - RNA, 46 nt, Mus musculus
uguagggaaaagcagagccaccuaaaguaacaugugccacccucag

SEQ ID NO: 92312 - RNA, 40 nt, Mus musculus
cucuaaaaccucuuggaacacuucgcccuagugcccagua

SEQ ID NO: 92313 - RNA, 44 nt, Mus musculus
cucccagcuaaaagugagcauggguugagguuucaagaagcaaa

SEQ ID NO: 92314 - RNA, 41 nt, Mus musculus
uacuuggccuguacuuuucaaaaaaugucaaggucacgaga

SEQ ID NO: 92315 - RNA, 45 nt, Mus musculus
cacacacguuaaccauggugggggcaguuauugugugaaggguag

SEQ ID NO: 92316 - RNA, 93 nt, Mus musculus
uuuugggggggucuuuagacuacugccauuuacucuugccuccuuucucucccucccuggccccaacauuuuagugcccauucaacuagccaa

SEQ ID NO: 92317 - RNA, 46 nt, Mus musculus
ucuuugugugugugugcgagugugugugugugugugugugugugug

SEQ ID NO: 92318 - RNA, 37 nt, Mus musculus
uagauuguguggggauggaaaucacuugggcaaggaa

SEQ ID NO: 92319 - RNA, 46 nt, Mus musculus
uccauuuuugcaauauuuauuuccuuaauuauuuuaggacagccag

SEQ ID NO: 92320 - RNA, 46 nt, Mus musculus
ucuauguaaguucugagggucuaagauaguguucuaaggugcagag

SEQ ID NO: 92321 - RNA, 23 nt, Mus musculus
cuaggcuaacuguagcucuguca

SEQ ID NO: 92322 - RNA, 42 nt, Mus musculus
ucagauuaucacaauagcuaaagccuaacgaaguuagccaag

SEQ ID NO: 92323 - RNA, 42 nt, Mus musculus
uggcccuaauuuuuuagccucuuaucuauuuuuuaaggccag

SEQ ID NO: 92324 - RNA, 46 nt, Mus musculus
ccauccagagacagacagacaggcaaugucucacuaucugcccuag

SEQ ID NO: 92325 - RNA, 45 nt, Mus musculus
guguguguguguguguguguguguuuucacaugcagcuguauguu

SEQ ID NO: 92326 - RNA, 46 nt, Mus musculus
agccauuuccacaggccccggguugaaaauuugcaaaagucuucag

SEQ ID NO: 92327 - RNA, 45 nt, Mus musculus
accuuagcacuuaggagguggacucaggagaaucaagggcuccag

SEQ ID NO: 92328 - RNA, 46 nt, Mus musculus
aguucuaggccaauaagagauccuguuucagaaauaggcacaggag

SEQ ID NO: 92329 - RNA, 46 nt, Mus musculus
uuaacuucucguucaucaguauuacuggggauuuaucaaaacugag

SEQ ID NO: 92330 - RNA, 41 nt, Mus musculus
uugaaugauuguacauguguagucucagaagugaaccccgc

SEQ ID NO: 92331 - RNA, 52 nt, Mus musculus
uguuccuaguugcacccaguccagcugucauucauuccacaggggagggaga

SEQ ID NO: 92332 - RNA, 42 nt, Mus musculus
ccgagccucgccugcuuaguguuugugaggacuccgggccau

SEQ ID NO: 92333 - RNA, 46 nt, Mus musculus
cugugaguucccagagauuaauuaaacucaggucagcagcaagcau

SEQ ID NO: 92334 - RNA, 30 nt, Mus musculus
gcucagagcuaugcucaggaagucuugcag

SEQ ID NO: 92335 - RNA, 44 nt, Mus musculus
aagguccccacggccagugaagcugagcucaaguaugacccgcc

SEQ ID NO: 92336 - RNA, 53 nt, Mus musculus
ugaacacuugagagccaaggccugcaagcgcugugugguuguugggaacgggg

SEQ ID NO: 92337 - RNA, 46 nt, Mus musculus
cugcgcuccaaaccagccuugcuucucuagaaucuuccagggacag

SEQ ID NO: 92338 - RNA, 48 nt, Mus musculus
aauacaagggcugagggcuuccagaaccuuguaccggggccugauuga

SEQ ID NO: 92339 - RNA, 46 nt, Mus musculus
ugugugugagugugugugugugugagagagagagagagagugugag

SEQ ID NO: 92340 - RNA, 41 nt, Mus musculus
augcccuucaguuucgaucaggagaaaacagucuggcccag

SEQ ID NO: 92341 - RNA, 42 nt, Mus musculus
agagugugagagugugugugugugugugugugugagagugug

SEQ ID NO: 92342 - RNA, 47 nt, Mus musculus
agggauuagcuugguuuaguaaccaagggauucgguguuuaaggucu

SEQ ID NO: 92343 - RNA, 44 nt, Mus musculus
acccagagggugcgccacugucggacguugaauacuacgccaau

SEQ ID NO: 92344 - RNA, 46 nt, Mus musculus
gaagcgaaugucccuuucacaggguugcauaucagacauccuccag

SEQ ID NO: 92345 - RNA, 46 nt, Mus musculus
gcauggggauuuucaaaauuacccagaugauuuucuuugcagccua

SEQ ID NO: 92346 - RNA, 42 nt, Mus musculus
ugggcgccaugcacuggcaggucaugcacaaugugaccacag

SEQ ID NO: 92347 - RNA, 44 nt, Mus musculus
aguguuggauuuugcacaguuuuguaaguuaaucuuaagaaugg

SEQ ID NO: 92348 - RNA, 46 nt, Mus musculus
gaugguucauagaaauuaugacaaagccuuuguuauccaggccaug

SEQ ID NO: 92349 - RNA, 46 nt, Mus musculus
guguuccucuuguuucuacauaaaaaagcaacgucuguuuccauag

SEQ ID NO: 92350 - RNA, 46 nt, Mus musculus
acuuucuuuuccuagcccuuuaguauaauaaacuucacuaugagau

SEQ ID NO: 92351 - RNA, 44 nt, Mus musculus
gcucauguccagacgcccgccgggcuugcagcacaaccccggcc

SEQ ID NO: 92352 - RNA, 45 nt, Mus musculus
acccaccccgugaacccagacugugaggaagccagugaaagcagc

SEQ ID NO: 92353 - RNA, 46 nt, Mus musculus
gaauccaggaggaacuugcaaaacgccagagccggcacugacgggg

SEQ ID NO: 92354 - RNA, 33 nt, Mus musculus
gcuuucuuccacucaucuuugccuaggccuguu

SEQ ID NO: 92355 - RNA, 46 nt, Mus musculus
caaagaggccucaaaaccaaagcucuccuguuuauuggcaucagaa

SEQ ID NO: 92356 - RNA, 46 nt, Mus musculus
acuagauguguugauaugaccaggcuggcuuugaacucacagagau

SEQ ID NO: 92357 - RNA, 46 nt, Mus musculus
ggguucaucuucuucuucuucuucuuuuuuuguuuuguuuugagau

SEQ ID NO: 92358 - RNA, 46 nt, Mus musculus
uucacaacucucucuuuuuugcaacuagagcccuccugccccagaa

SEQ ID NO: 92359 - RNA, 46 nt, Mus musculus
ugagccugaugagacacacuuuaaccccagcaugaaagaggccaaa

SEQ ID NO: 92360 - RNA, 46 nt, Mus musculus
aaaacuaaauaaauguaacuuagguccuuuggguaaagauccccag

SEQ ID NO: 92361 - RNA, 45 nt, Mus musculus
ucugcagaggccuuuuauguguuuaugugguccucaaagaccuca

SEQ ID NO: 92362 - RNA, 42 nt, Mus musculus
augacgguacaugccaguaaucccagcauuugaaaggcugag

SEQ ID NO: 92363 - RNA, 61 nt, Mus musculus
gaggggagagagagaagaggagaaggaagagaagagagagagaggagagagaggagaggag

SEQ ID NO: 92364 - RNA, 47 nt, Mus musculus
ugauaaaaacugggguuguaccccacugacaagcaugaaugacuuug

SEQ ID NO: 92365 - RNA, 42 nt, Mus musculus
gagaccuuuguauaaugagcauucgacuuuccuaccucugag

SEQ ID NO: 92366 - RNA, 46 nt, Mus musculus
cuagaagugaaagccuuccuaguuagggguuccuccuuucccagag

SEQ ID NO: 92367 - RNA, 42 nt, Mus musculus
aaauaaauauuguuuuuaaaaguucaaggucgccgggcaugg

SEQ ID NO: 92368 - RNA, 44 nt, Mus musculus
accaccuccgaaacaagacagaggacuuggaagccacggugaga

SEQ ID NO: 92369 - RNA, 55 nt, Mus musculus
gccggaaaugaccgaguuaggaaccugcagagugagguggagggagucaagaaua

SEQ ID NO: 92370 - RNA, 46 nt, Mus musculus
acauuuacguagaacauucuccugguaaacaguugaagcaucagaa

SEQ ID NO: 92371 - RNA, 45 nt, Mus musculus
cugcugaggaaacgucagcuggguuuucuccuugacccucuuugu

SEQ ID NO: 92372 - RNA, 46 nt, Mus musculus
uucagcuuacaguuguaguccaucucggagagaagucagggcagga

SEQ ID NO: 92373 - RNA, 46 nt, Mus musculus
cuuuuaaaugugcuacuuccuggguggagcacauagaaaccaucac

SEQ ID NO: 92374 - RNA, 45 nt, Mus musculus
gaauuaggugacuuaauguccaacuuugcuuucaauuguugcgau

SEQ ID NO: 92375 - RNA, 42 nt, Mus musculus
aggaaggaggaagaaggaaggaagaaggaaggaaggaggaag

SEQ ID NO: 92376 - RNA, 97 nt, Mus musculus
accagcacguaaagaucaccuaccgcgacggccucacgggcgagcugggcuaccuuaacccuggggugagacuucugaugcugccaguucuucagag

SEQ ID NO: 92377 - RNA, 45 nt, Mus musculus
ugccugagccuccugcuucccaaguacaaugucacugagccccag

SEQ ID NO: 92378 - RNA, 46 nt, Mus musculus
gucuaugucaacacuacagaggucgcacuggagcaagaccuggcau

SEQ ID NO: 92379 - RNA, 42 nt, Mus musculus
ucaagugcuucaaacacagauucuucaaaucacccgucagag

SEQ ID NO: 92380 - RNA, 46 nt, Mus musculus
ucuugaauaauuggauggauacaugagccauucuggagacuaccag

SEQ ID NO: 92381 - RNA, 46 nt, Mus musculus
ggccauaggcugcaguccucugauaaauuggcuucuucagauccag

SEQ ID NO: 92382 - RNA, 45 nt, Mus musculus
cuagaauguuauuuuaagucacagaacacuaacuuaaucagcuag

SEQ ID NO: 92383 - RNA, 46 nt, Mus musculus
guaauaccuggucuccugcaccaauaucuuccucauuccggucaag

SEQ ID NO: 92384 - RNA, 45 nt, Mus musculus
ggagugauucaauagauauggagauacuccuuuccuugaggggag

SEQ ID NO: 92385 - RNA, 27 nt, Mus musculus
accugggugaccuuccccuacagacuc

SEQ ID NO: 92386 - RNA, 42 nt, Mus musculus
gagcugcccguucauggcggcggcggugagagagggcgacuc

SEQ ID NO: 92387 - RNA, 42 nt, Mus musculus
ucgccgagccucguggacccccguagucugagacgguacuag

SEQ ID NO: 92388 - RNA, 46 nt, Mus musculus
agaaacaaaacaaaacaaaacaaaaacaaagaaaaagaagaagaag

SEQ ID NO: 92389 - RNA, 42 nt, Mus musculus
uggugcaugcuuguaaucuaucucaucaugcuggggacagaa

SEQ ID NO: 92390 - RNA, 23 nt, Mus musculus
guagaggcacaaggaucaggagu

SEQ ID NO: 92391 - RNA, 46 nt, Mus musculus
gcccagagagaaguugagaccuccaaacauuaaaaugcccccaugu

SEQ ID NO: 92392 - RNA, 42 nt, Mus musculus
uauagagauaaaagggauugggcccuggaaauaugccaagua

SEQ ID NO: 92393 - RNA, 46 nt, Mus musculus
ugaucccaacaguugagaugcuacagcaggaggauugccaugaguu

SEQ ID NO: 92394 - RNA, 41 nt, Mus musculus
gggaccacaagaguccauccuaggaugagaaugcucccaaa

SEQ ID NO: 92395 - RNA, 46 nt, Mus musculus
cgcuugucuaacauguaugaagcccuagguuccgugcaccccauac

SEQ ID NO: 92396 - RNA, 76 nt, Mus musculus
ggagaggggagcccacccagcugggcauguaagcuucacagaugaaauauuaguucaaaagaucagucuuuuaccu

SEQ ID NO: 92397 - RNA, 60 nt, Mus musculus
acugccucugugaagggcuccucuuccccuguaguccuagauuccccaaauauaaaugcu

SEQ ID NO: 92398 - RNA, 46 nt, Mus musculus
aaagcaaauauacaggguuguguuuuucagcccggaaguacaagau

SEQ ID NO: 92399 - RNA, 64 nt, Mus musculus
uuguugaggcagggucuuguguagccaacggugaccuugaauuucuuaucuucccgccaacacc

SEQ ID NO: 92400 - RNA, 45 nt, Mus musculus
aucuucuucuuuugugccuugaccuuugagccaagagccugcaga

SEQ ID NO: 92401 - RNA, 46 nt, Mus musculus
uggcucaaaggucaaggcacaaaagaagaagauguaguccguucag

SEQ ID NO: 92402 - RNA, 46 nt, Mus musculus
ccaagcccacacuuuuccauguauagagcaucacaacacgagagug

SEQ ID NO: 92403 - RNA, 46 nt, Mus musculus
agaaacccugucuugaaaaacaaaacaaaacaaaacaaaaccugag

SEQ ID NO: 92404 - RNA, 46 nt, Mus musculus
cugccuaaacuugguauucuagacuaggcuggccucauacucagag

SEQ ID NO: 92405 - RNA, 46 nt, Mus musculus
ucugugaugauaaaaauguuuuuaguuuauaguguggaguuuucag

SEQ ID NO: 92406 - RNA, 46 nt, Mus musculus
aaccuugagaaacaggaggaaaucagaccaaggcaacccugcaaau

SEQ ID NO: 92407 - RNA, 45 nt, Mus musculus
gcuauaaggaagguguucauucagagauguacaaacaggucuaua

SEQ ID NO: 92408 - RNA, 45 nt, Mus musculus
accauccguaaugagaucugacagccucuucuggugugucugaag

SEQ ID NO: 92409 - RNA, 45 nt, Mus musculus
cucauucuucauagagucuguaaguguccccucuugguucucacu

SEQ ID NO: 92410 - RNA, 45 nt, Mus musculus
aucagacuuuuccaguuugggguugacuggugagaggggccgcgc

SEQ ID NO: 92411 - RNA, 43 nt, Mus musculus
aucgucucccccauugugaagcaggagccagcagcccccagcc

SEQ ID NO: 92412 - RNA, 46 nt, Mus musculus
gaccacuucuccccugcguccccucccacgcaucuguccccagaga

SEQ ID NO: 92413 - RNA, 42 nt, Mus musculus
ggagggaccccuggcuuagcugcuccggggcagguggcagag

SEQ ID NO: 92414 - RNA, 45 nt, Mus musculus
cacacuccugugacaaguguuuuaaccacugagccauguccccag

SEQ ID NO: 92415 - RNA, 68 nt, Mus musculus
gagaaaagggagagaggugagagguguuugucugggagagaguggaggaggacaaaggauugcaucug

SEQ ID NO: 92416 - RNA, 46 nt, Mus musculus
cuggcccaagccauuccagggacuaucuuucguuucuauugcugug

SEQ ID NO: 92417 - RNA, 45 nt, Mus musculus
guugguguugguugcuauuuguguguuccacaucuccccggcucu

SEQ ID NO: 92418 - RNA, 41 nt, Mus musculus
gcagccacccucacagcuaacuucuuugucugcuuucccac

SEQ ID NO: 92419 - RNA, 42 nt, Mus musculus
ggaccccuaccccuuccucuuccucuuuugcuuccuggccac

SEQ ID NO: 92420 - RNA, 45 nt, Mus musculus
auaagguucagagacaaaaaacuaggcugaucuccguggcugcag

SEQ ID NO: 92421 - RNA, 42 nt, Mus musculus
guguucuucuccugcgucucgguuuucuucagcuuggccuua

SEQ ID NO: 92422 - RNA, 67 nt, Mus musculus
guguaucuguguggaguaugugucuguguguaugugucucugugugagugugugucugugugugucu

SEQ ID NO: 92423 - RNA, 44 nt, Mus musculus
guguaucuguguggaguaugugucuguguguaugugucucugug

SEQ ID NO: 92424 - RNA, 46 nt, Mus musculus
gagaaaguacauucuuagcguggcuagguugugggucagcagugga

SEQ ID NO: 92425 - RNA, 45 nt, Mus musculus
agcauguuaagcaucucacuagaugcuggggauggguugguuuug

SEQ ID NO: 92426 - RNA, 42 nt, Mus musculus
ucggccgaugcacuucgcagggcgcccugcagacacggcaac

SEQ ID NO: 92427 - RNA, 45 nt, Mus musculus
gccaggucauuugaggacagagguccgacuugguaacuuugccaa

SEQ ID NO: 92428 - RNA, 46 nt, Mus musculus
gcugauggcacauaauguguugaggucccaaguuuugcaguguuga

SEQ ID NO: 92429 - RNA, 45 nt, Mus musculus
ucagugcaacagaaugggauacgacacgggucuuacacagccucu

SEQ ID NO: 92430 - RNA, 46 nt, Mus musculus
aacagguaugugcaucuacauuuuuauuuaaagugaagacuauaga

SEQ ID NO: 92431 - RNA, 46 nt, Mus musculus
aacacaaaaauaguaauacaugauagcacagaacuauaccguacag

SEQ ID NO: 92432 - RNA, 47 nt, Mus musculus
gacuggcuggauagaguggcucaacagugagaagaaucuagugugac

SEQ ID NO: 92433 - RNA, 51 nt, Mus musculus
agggagaguuagguaggcacaugaguguaugauugaaggcagaggucuugg

SEQ ID NO: 92434 - RNA, 51 nt, Mus musculus
ccuugguaaggguggcaucccagaaggcauuggcugagauggagaagaaaa

SEQ ID NO: 92435 - RNA, 45 nt, Mus musculus
cuguuugguggguuuaggggagggugcuguaaugcaugucaaggg

SEQ ID NO: 92436 - RNA, 45 nt, Mus musculus
gugaguuagaguaaaccaaguuauaauuuauaugugugugugugu

SEQ ID NO: 92437 - RNA, 50 nt, Mus musculus
gaaauugggauugugguaaaauccaguagugaguuuugcaagagauguuc

SEQ ID NO: 92438 - RNA, 46 nt, Mus musculus
ugucccagcugagacgugacaggcucggacuguucugugccaucag

SEQ ID NO: 92439 - RNA, 42 nt, Mus musculus
uuguucaaucaguucauauguuauucauugugacccaggcag

SEQ ID NO: 92440 - RNA, 25 nt, Mus musculus
guggucuuuccucugcgugugccca

SEQ ID NO: 92441 - RNA, 45 nt, Mus musculus
caaaucccagcaaccacaugauggcucauagccauccauaaugag

SEQ ID NO: 92442 - RNA, 41 nt, Mus musculus
ggcaacauuugcuagaacacacauuuaguaugcuugccuuu

SEQ ID NO: 92443 - RNA, 42 nt, Mus musculus
gucuacucaguuggcuccucugaaaagaauuggcugggggag

SEQ ID NO: 92444 - RNA, 45 nt, Mus musculus
ugaauuuuaauuccuugcccuaaaacacaaauuucauaagauuag

SEQ ID NO: 92445 - RNA, 41 nt, Mus musculus
uuuuuguuuuucccaagacagaguaccuccuuguagcccug

SEQ ID NO: 92446 - RNA, 45 nt, Mus musculus
gauagaggugggcccuccauuuuaagcagaguacaugugaaaagg

SEQ ID NO: 92447 - RNA, 41 nt, Mus musculus
ugccucguggcuguccaaguucucauuguuaaaugucacgu

SEQ ID NO: 92448 - RNA, 23 nt, Mus musculus
ccacaggggaggagcaugcuagu

SEQ ID NO: 92449 - RNA, 41 nt, Mus musculus
agcugccauaugugugcuggaaauugagcccuagguccucu

SEQ ID NO: 92450 - RNA, 45 nt, Mus musculus
ucagcaugucccccgcacagcugggaacuaccauuuauaagguga

SEQ ID NO: 92451 - RNA, 46 nt, Mus musculus
uuuccagagaggggcugcaauucagcaaagaagcaacaguaaagag

SEQ ID NO: 92452 - RNA, 46 nt, Mus musculus
aauguccuaaauugagcuauuuucacuuacuguguaacagagacag

SEQ ID NO: 92453 - RNA, 46 nt, Mus musculus
uacugaucuucagcagauauuagaaagugaaaaagacuuggaagaa

SEQ ID NO: 92454 - RNA, 45 nt, Mus musculus
cuacgccauuaagaagcaggcagagauccugcaagagucccggau

SEQ ID NO: 92455 - RNA, 46 nt, Mus musculus; identical to SEQ ID NO: 28986

SEQ ID NO: 92456 - RNA, 71 nt, Mus musculus
ugcuucucauccucagccuuguacuucucagcuucuuggaccaugugcucaauaucuuccuuacucaagcg

SEQ ID NO: 92457 - RNA, 46 nt, Mus musculus; identical to SEQ ID NO: 28988

SEQ ID NO: 92458 - RNA, 40 nt, Mus musculus
gcuugguggggauggugguauugcguuugaugaggacagu

SEQ ID NO: 92459 - RNA, 45 nt, Mus musculus
uugcagaaguuucugaaucuuggggauucugguagaaccagccac

SEQ ID NO: 92460 - RNA, 45 nt, Mus musculus; identical to SEQ ID NO: 28992

SEQ ID NO: 92461 - RNA, 45 nt, Mus musculus; identical to SEQ ID NO: 83685

SEQ ID NO: 92462 - RNA, 50 nt, Mus musculus
uguauuccacuuggaccuugggccugccugcaucauucaccaccaugaaa

SEQ ID NO: 92463 - RNA, 44 nt, Mus musculus; identical to SEQ ID NO: 83687

SEQ ID NO: 92464 - RNA, 46 nt, Mus musculus
ccuuuccaugcuggaagacacccacacaggaguagguggugccaag

SEQ ID NO: 92465 - RNA, 46 nt, Mus musculus
agccacagggaagaugguggaaaauucaccgucgccauugccagaa

SEQ ID NO: 92466 - RNA, 24 nt, Mus musculus
aauauuuuaagcaguauguacuug

SEQ ID NO: 92467 - RNA, 43 nt, Mus musculus
uuuuagaucuggguggcuugguagauuugauugguuucagcaa

SEQ ID NO: 92468 - RNA, 33 nt, Mus musculus
aacaggucuauccaggaaaauggagaacuaaag

SEQ ID NO: 92469 - RNA, 46 nt, Mus musculus
uuuucucucuuaaugguucaacaaucucuucaaucuugcuuucgau

SEQ ID NO: 92470 - RNA, 46 nt, Mus musculus
ccagaaauacccgccuguaaaguuuuuaucagaaaaggaccggaaa

SEQ ID NO: 92471 - RNA, 43 nt, Mus musculus
uggccaugaggugaccgugguggacaacuucuucacaggcagg

SEQ ID NO: 92472 - RNA, 69 nt, Mus musculus
ugacucuagagaacccugacuaauacaaagaaggaaaagaaucgaggaggaggggaguggauggagaag

SEQ ID NO: 92473 - RNA, 45 nt, Mus musculus
gcagcagguccucucgcaggcccauggugucgaacgugggggucc

SEQ ID NO: 92474 - RNA, 46 nt, Mus musculus
accagcaucuugauagcccguguccguaaacuucuccggcggauca

SEQ ID NO: 92475 - RNA, 41 nt, Mus musculus
gaagaugacggccugggugauggucagcgugucguagagau

SEQ ID NO: 92476 - RNA, 49 nt, Mus musculus
aauguacaguucucuguuguugggcaggucauaguuaaugaugagggac

SEQ ID NO: 92477 - RNA, 46 nt, Mus musculus
auauccacacaggaaagucaccuacacuucauccauccucuugccu

SEQ ID NO: 92478 - RNA, 44 nt, Mus musculus
uagguaacaggagaguagggcucauguuuccaugguuccauggg

SEQ ID NO: 92479 - RNA, 46 nt, Mus musculus
aggccaacaggcucaaagaagaagaaggaaccagaagaugaagaag

SEQ ID NO: 92480 - RNA, 116 nt, Mus musculus
aacugggugugauguggucugaacaaucugccaaagauaaacaaccauaugagcagaaagcagcuaaaccaaaggagaaguaugaaaaggauauugcugcauuccgugccaagggc

SEQ ID NO: 92481 - RNA, 44 nt, Mus musculus
accaucugccuucuuccuguuuugcucugaaaaucgcccagaga

SEQ ID NO: 92482 - RNA, 45 nt, Mus musculus
uaugucugcaaaggaaaagucgaaguuugaagauuuggccaagag

SEQ ID NO: 92483 - RNA, 46 nt, Mus musculus
cagagugcggaggagccggcgucugccggcggccgaacagagggag

SEQ ID NO: 92484 - RNA, 46 nt, Mus musculus
cuaugccauuucucuggccccaugauugauuuucuugucggugaau

SEQ ID NO: 92485 - RNA, 42 nt, Mus musculus
guuucaugggugaccacacguuuuauuuccuuuagggcugag

SEQ ID NO: 92486 - RNA, 46 nt, Mus musculus
acauuagagccuuugcacaucucauguuuucuauuuaccuagucau

SEQ ID NO: 92487 - RNA, 53 nt, Mus musculus
gccugugagcccagcauuuggaaauggcaagaaaggaggcggaucagaaguuc

SEQ ID NO: 92488 - RNA, 46 nt, Mus musculus
cugcugccuggaauacauggcaccuggcaucucuaauguuucagau

SEQ ID NO: 92489 - RNA, 92 nt, Mus musculus
cugcuccacuucugacuguaagagaagcaaugaagaggacccagagagcgauccugaugaccacgaaaagagaauacuguuuaccccaaagc

SEQ ID NO: 92490 - RNA, 46 nt, Mus musculus
uauuaugaagaggaaacagcaaugugaagugcuacuaagccugcau

SEQ ID NO: 92491 - RNA, 86 nt, Mus musculus
cuucugguuuuaauagcaaucaggagugaggaaucaagugaagagagucaggaagaugaaaaccaagacaucugggagcagcagca

SEQ ID NO: 92492 - RNA, 46 nt, Mus musculus
acuuuguagaguugcuucugucuucucagugacauaaauucugcag

SEQ ID NO: 92493 - RNA, 45 nt, Mus musculus
cuaagacagggaaauacaagaaagauguaaacauuuucugcauaa

SEQ ID NO: 92494 - RNA, 46 nt, Mus musculus
ggcuucaggccuccaugcugacuggagaguucacugagaugcacag

SEQ ID NO: 92495 - RNA, 46 nt, Mus musculus
ccugguucacagcuauaacagaguuuauggagagcagcauggacga

SEQ ID NO: 92496 - RNA, 45 nt, Mus musculus
ugguuugguauagcuuucuuuacagcuacauuuuaacugcauauu

SEQ ID NO: 92497 - RNA, 25 nt, Mus musculus
gcucuccauguuuauacuguuugag

SEQ ID NO: 92498 - RNA, 46 nt, Mus musculus
ucccuaaaaugagguuuauuuacucuuagacuucugaguguaguag

SEQ ID NO: 92499 - RNA, 65 nt, Mus musculus
acaaaagucagacuugcacauacugauuuuaagcacauagaauacuguaccauuaucugauagac

SEQ ID NO: 92500 - RNA, 48 nt, Mus musculus
ugggauuguaguuucaaaagagagucuauaauggaggggaaggccuga

SEQ ID NO: 92501 - RNA, 46 nt, Mus musculus
cacagguucuuaacgucccaaagcagcaccaccuacccagggccaa

SEQ ID NO: 92502 - RNA, 42 nt, Mus musculus
ggcucucagaugcuggacuuaaacaccuaucaccauccccag

SEQ ID NO: 92503 - RNA, 46 nt, Mus musculus
uuucaccuccaaagcauugugcaaagauuuuuaauguuagcgguuu

SEQ ID NO: 92504 - RNA, 46 nt, Mus musculus
cuuauccuggugaagguaaaagcucugacucaagccgaaucccuca

SEQ ID NO: 92505 - RNA, 45 nt, Mus musculus
uuuccugaaccuguuucaguguugacaauaaauucaugagucagu

SEQ ID NO: 92506 - RNA, 26 nt, Mus musculus
cacacuguuguguguuuaugguuuuu

SEQ ID NO: 92507 - RNA, 44 nt, Mus musculus
aguuagcaucaccagaauaagaugaacugggaucugagcaagag

SEQ ID NO: 92508 - RNA, 46 nt, Mus musculus
agcucuuugguuugaaagccauuaaguuugcuuuguaaggacauag

SEQ ID NO: 92509 - RNA, 46 nt, Mus musculus
gagccaacaggcauguuuaccuguugagccauucacuagucccagg

SEQ ID NO: 92510 - RNA, 46 nt, Mus musculus
ugacacuucaaaaauugaagcugcauugugggaagaaauagaagca

SEQ ID NO: 92511 - RNA, 46 nt, Mus musculus
gaauugugggcuggugaggugcacacaaaagucuuccccccacccc

SEQ ID NO: 92512 - RNA, 45 nt, Mus musculus
ccucuucaacauacauuacccugggaagagaaagccucggcugga

SEQ ID NO: 92513 - RNA, 42 nt, Mus musculus
gaccuugccuaaacaaacaugguuauuuucaaguauggagac

SEQ ID NO: 92514 - RNA, 45 nt, Mus musculus
uaggaagcauacuucgagucaccacagccgaccccuaugccagug

SEQ ID NO: 92515 - RNA, 46 nt, Mus musculus
aacaaacccucugaaauuuaagauagaaagaaaagauaugcuagac

SEQ ID NO: 92516 - RNA, 45 nt, Mus musculus
uaaauguuaggaucaaaggugggaaucccuaugcucgguggaaga

SEQ ID NO: 92517 - RNA, 26 nt, Mus musculus
gaagguagguaggguugggaagacug

SEQ ID NO: 92518 - RNA, 45 nt, Mus musculus
cagcugcuguggacagacugaaccagccccauaccacaccuggga

SEQ ID NO: 92519 - RNA, 41 nt, Mus musculus
gaguuuguuuuguguuggucaucuacugcugggcacggagu

SEQ ID NO: 92520 - RNA, 41 nt, Mus musculus
ggacaaaacaaacagaagaaaaauagccagagaaaaagcgu

SEQ ID NO: 92521 - RNA, 46 nt, Mus musculus
acuacaggucacuuuuuuuuaaagucaaaaaucauggcugagaguu

SEQ ID NO: 92522 - RNA, 41 nt, Mus musculus
gccucaguacaggggaaugccagggccaagaagucagagug

SEQ ID NO: 92523 - RNA, 46 nt, Mus musculus
gggccccugggagggugggacagagagagagagagaaagagagaga

SEQ ID NO: 92524 - RNA, 30 nt, Mus musculus
uacaaaauuaucuuuuuccuuauagucacu

SEQ ID NO: 92525 - RNA, 46 nt, Mus musculus
agaugcaggaagaggaaaggagauugggugaccagccaugugagau

SEQ ID NO: 92526 - RNA, 45 nt, Mus musculus
ucucugcugaucucaguuucacgagguccccuccccugccccaca

SEQ ID NO: 92527 - RNA, 46 nt, Mus musculus
caaagcauggaagaaaggccuuucccccuuaaccuccaccccaguu

SEQ ID NO: 92528 - RNA, 46 nt, Mus musculus
ugugaugucacauuauagguaaaaaaaaaaaaaagaagauguagau

SEQ ID NO: 92529 - RNA, 45 nt, Mus musculus
uagcugaguauuucugauccacgaauagaaaacacacacacacac

SEQ ID NO: 92530 - RNA, 62 nt, Mus musculus
ccuguuuacaggcucuaacuuuuaucguacauucccagaaaucccgugucaaccacguucaa

SEQ ID NO: 92531 - RNA, 79 nt, Mus musculus
uucaaagcaauuaaagcaaucuaaacaaauauuaucuguugagaccgugcuucuacuguccccugccccuucaugagau

SEQ ID NO: 92532 - RNA, 46 nt, Mus musculus
guauaguuuuaccucucccagaggaacuuuaacacaaccaccaaac

SEQ ID NO: 92533 - RNA, 46 nt, Mus musculus
uaaucuuccaguggucuuccccugucaugucugauccaugucacuc

SEQ ID NO: 92534 - RNA, 47 nt, Mus musculus
aauuuuuaugccuaagccaguuacugggcuguucccauguugaagau

SEQ ID NO: 92535 - RNA, 46 nt, Mus musculus
uuuaucaauaaccaaauauaauaaaucuucauucaugccaugugag

SEQ ID NO: 92536 - RNA, 46 nt, Mus musculus
aguaucauuaagauuuuuguauggaugguacaggaugcacacagau

SEQ ID NO: 92537 - RNA, 47 nt, Mus musculus
ggaagcaggggccuggagcaccaggucaguucagcaucuuugaggau

SEQ ID NO: 92538 - RNA, 46 nt, Mus musculus
cugaaguucuaacuggaucugucugaaagguugggugaagcgaaau

SEQ ID NO: 92539 - RNA, 45 nt, Mus musculus
uucggugguuuuuaaaaaaauauucauagauauauguagugagau

SEQ ID NO: 92540 - RNA, 45 nt, Mus musculus
ugcuuuuucuguuuuuaggcacuuuggauuaauuguggagcugga

SEQ ID NO: 92541 - RNA, 46 nt, Mus musculus
uccuugugugcuuuaacuuugcccuguuugugacacuaccccagau

SEQ ID NO: 92542 - RNA, 41 nt, Mus musculus
aauucacucuguagaccaagcuggccuugaauucgcagaga

SEQ ID NO: 92543 - RNA, 47 nt, Mus musculus
uguguuucuauaugccaaauguauguagguacccccauaagagccag

SEQ ID NO: 92544 - RNA, 46 nt, Mus musculus
ggggaauuagaaauucuacagggaaauugcaagcuuaaaagaagaa

SEQ ID NO: 92545 - RNA, 45 nt, Mus musculus
uugaugaugugagcuucaaaccuuauaaaaccuuauaaaacagau

SEQ ID NO: 92546 - RNA, 45 nt, Mus musculus
guaaaggccuuggugaaggcagacccugacguaacgcuggcggga

SEQ ID NO: 92547 - RNA, 42 nt, Mus musculus
gcuucgcaggcccaagccccgacgagugcacccgggggaguu

SEQ ID NO: 92548 - RNA, 45 nt, Mus musculus
ucaaacgucccauuccaccuaaaacaugauccccggcgcuggccc

SEQ ID NO: 92549 - RNA, 39 nt, Mus musculus
uucuuuuuuucuuaaguacacaguagagagcacucaaga

SEQ ID NO: 92550 - RNA, 46 nt, Mus musculus
gggugaaaagauuggaaaucuauguaaucaauuucuacgaacaauc

SEQ ID NO: 92551 - RNA, 55 nt, Mus musculus
aguuuccauaaugaagagaaccugggaucugaaguagauaaaagcuuugggggaa

SEQ ID NO: 92552 - RNA, 45 nt, Mus musculus
agugcuaucuuaacagcagugaucuuuccuugcuucaccaaagau

SEQ ID NO: 92553 - RNA, 102 nt, Mus musculus
caggaaucaagacauggaaaaggaaaugccauuuauuaccaccccacuagugacccacuagucuguuccugugaccuuaaaagaauugauaaaaugccagau

SEQ ID NO: 92554 - RNA, 44 nt, Mus musculus
aaucagcauccgauauauaguauaauuucucuucuagccaggau

SEQ ID NO: 92555 - RNA, 50 nt, Mus musculus
ggagaguggguccaugaucaugaaauccacuggccuuaccauguaccccg

SEQ ID NO: 92556 - RNA, 45 nt, Mus musculus
auggacuuaauuaaugccuuaucuacuaucauuagaguccacaua

SEQ ID NO: 92557 - RNA, 45 nt, Mus musculus
ugaugacaauggauuaaaccucugaacuguaagccagccccaguu

SEQ ID NO: 92558 - RNA, 42 nt, Mus musculus
acagugagugguugggccuucuuggaauagguguggccuugu

SEQ ID NO: 92559 - RNA, 56 nt, Mus musculus
cugccugaaaagaucuuguggcucugauguugcucuguacucuaaugaucuggaga

SEQ ID NO: 92560 - RNA, 46 nt, Mus musculus
acaagcccagagcagugcaaguggccaaggucauaaacaaugagau

SEQ ID NO: 92561 - RNA, 46 nt, Mus musculus
cuaaacacaaagaaauucaugcuucuauugcuaugguaauggagaa

SEQ ID NO: 92562 - RNA, 42 nt, Mus musculus
aaaagagguuguuugugcugaagcagacacaugggaggaugu

SEQ ID NO: 92563 - RNA, 45 nt, Mus musculus
cacacacuuuaucaacugauguucccccaccccucgggccaauuu

SEQ ID NO: 92564 - RNA, 47 nt, Mus musculus
caauggguauucagggcauccugagaugcaagcuggcaaggaaauca

SEQ ID NO: 92565 - RNA, 71 nt, Mus musculus
aagguaguauagaaagaaaagacaguauuccuccucagagaaagugaguuccaagauucaucaccccagaa

SEQ ID NO: 92566 - RNA, 46 nt, Mus musculus
auugcccuucaaugauuagaacagccuugccuucccugagggaaga

SEQ ID NO: 92567 - RNA, 41 nt, Mus musculus
accaaaacaguauguuaauuugaauaggaauggcccccaua

SEQ ID NO: 92568 - RNA, 45 nt, Mus musculus
ucaaauauacacauagacauauaauuuuaaaaauaagcagucagu

SEQ ID NO: 92569 - RNA, 42 nt, Mus musculus
ucuauugccaucaugguuuauugcugccccucagcccgcagg

SEQ ID NO: 92570 - RNA, 46 nt, Mus musculus
uaaguuccucucccuauuucugccucccccgcuuaagaccccagug

SEQ ID NO: 92571 - RNA, 46 nt, Mus musculus
gaauggccacucaagacuguaggaagaagaaccccucacucaccag

SEQ ID NO: 92572 - RNA, 46 nt, Mus musculus
acacacacacacacacauauauauggaccuggacuugagcccccag

SEQ ID NO: 92573 - RNA, 46 nt, Mus musculus
aauuaugccacauaucuugcuacaaauauguauaaacaguugcugu

SEQ ID NO: 92574 - RNA, 67 nt, Mus musculus
ccucauauagccuguugccaugguuaaaggcugugguguuggugugagggagcucagggaugggcug

SEQ ID NO: 92575 - RNA, 41 nt, Mus musculus
gcccaacaaaccugcaguuccuuccagaucccagcccaucc

SEQ ID NO: 92576 - RNA, 46 nt, Mus musculus
cuccaugaugaaguccugccuaaaccucagugugcuauacugggag

SEQ ID NO: 92577 - RNA, 41 nt, Mus musculus
uuagcagggccugugcuaaagcaguagaaacuguugcagua

SEQ ID NO: 92578 - RNA, 29 nt, Mus musculus
gacaaccccuggacauacaagacaagauu

SEQ ID NO: 92579 - RNA, 42 nt, Mus musculus
agcagguacucaacaggugugggaacuaaaagggaggcuggg

SEQ ID NO: 92580 - RNA, 41 nt, Mus musculus
guguauauaugggaguacaugugccuucagguauaaaggca

SEQ ID NO: 92581 - RNA, 46 nt, Mus musculus
auaaagauuucuaggaagguucauguuuaaaagaaaacacagagaa

SEQ ID NO: 92582 - RNA, 41 nt, Mus musculus
gugacauucucagaagucaucgacuaucaugaugaggccag

SEQ ID NO: 92583 - RNA, 46 nt, Mus musculus
guuaguccuccaaaugucuugcuaaggcacugaaggcugugcagau

SEQ ID NO: 92584 - RNA, 46 nt, Mus musculus
aagaauccaguacuucaaacauaaaaagaaucauauacccugauag

SEQ ID NO: 92585 - RNA, 42 nt, Mus musculus
agagggccgggcugaaaaacaaaaaauaaugugggccuggac

SEQ ID NO: 92586 - RNA, 44 nt, Mus musculus
agaggccugggcacaauacaaguuaugaagagggucugggccua

SEQ ID NO: 92587 - RNA, 31 nt, Mus musculus
gugggccuggggcuaucccuguaauaugccu

SEQ ID NO: 92588 - RNA, 45 nt, Mus musculus
aggccugggccucuucaaacuucagggauaggaucaggcacuuuu

SEQ ID NO: 92589 - RNA, 42 nt, Mus musculus
aagugaugugccuuuccuucucuucccacuuucccccuuucc

SEQ ID NO: 92590 - RNA, 45 nt, Mus musculus
gccuggggucucuucaagggucagggaugggcccaugcccacuuc

SEQ ID NO: 92591 - RNA, 46 nt, Mus musculus
aaauggagugguuuuuaggaccuugaccuuuggguucaucugacug

SEQ ID NO: 92592 - RNA, 41 nt, Mus musculus
uggaguuacagucgugggccaccaggugggugcugggaauu

SEQ ID NO: 92593 - RNA, 42 nt, Mus musculus
ggcccacgacuguaacuccagggcuagggaucugaaacccuc

SEQ ID NO: 92594 - RNA, 45 nt, Mus musculus
ggucacauguggcaguuuugagaguuuaugucuguagccccaacu

SEQ ID NO: 92595 - RNA, 45 nt, Mus musculus
augcaucagcucccauagcguaauuaauuagagaaaaagcugcag

SEQ ID NO: 92596 - RNA, 46 nt, Mus musculus
gaaggaaaagccauaaaucagggaagcagcuucccuuucuggccag

SEQ ID NO: 92597 - RNA, 46 nt, Mus musculus
ugcagguuuggcugggaauuaaguuuaugggaaagaauagaaaguu

SEQ ID NO: 92598 - RNA, 45 nt, Mus musculus
uggucuaaguggauuuauuccgagguuccucaaaccgggaagaca

SEQ ID NO: 92599 - RNA, 45 nt, Mus musculus
cagcaggcauggcggguggagcagcagcugacaaagcagagagag

SEQ ID NO: 92600 - RNA, 65 nt, Mus musculus
uggaguggaggcagggccagcgggguagggggcaggagguggagguggaagcaggagcagagagg

SEQ ID NO: 92601 - RNA, 42 nt, Mus musculus
agguguugggagggcuggcugugucugaggacugagggaaug

SEQ ID NO: 92602 - RNA, 86 nt, Mus musculus
auuucaggaauccuggcauaucagacauccuagguacacagggacaacuggcagauuguacacuacugguaaaguugggcuuggaa

SEQ ID NO: 92603 - RNA, 83 nt, Mus musculus
aguucugggaagagagggaagcuuccaaagaggcugaggaagaccgggcgagaaggagggagaccagagcugggaauauuaug

SEQ ID NO: 92604 - RNA, 45 nt, Mus musculus
uaauuucggagccaauugauaaugauacaagcugcccaccuagau

SEQ ID NO: 92605 - RNA, 46 nt, Mus musculus
guuccuggaaggugggaccaccaaccacagggggauuauggcugag

SEQ ID NO: 92606 - RNA, 46 nt, Mus musculus
ggaugugaggacauauuuuaaagccuuuugucuaugaucuaaagga

SEQ ID NO: 92607 - RNA, 46 nt, Mus musculus
cagguaaucaugguuauuauucucuccaagaauuuucagcuuaggu

SEQ ID NO: 92608 - RNA, 46 nt, Mus musculus
ucucaaaagugugaguggcuagggggagguggguaggugugugugg

SEQ ID NO: 92609 - RNA, 24 nt, Mus musculus
ggggaggaguugguuuacauaggc

SEQ ID NO: 92610 - RNA, 46 nt, Mus musculus
cucugacugcugaguauaggugcucacaacaaauaaauguaaagac

SEQ ID NO: 92611 - RNA, 46 nt, Mus musculus
agccuuuuccuuccagaggggcaaguguuucaugacguucccaaag

SEQ ID NO: 92612 - RNA, 48 nt, Mus musculus
guuuuuauaugguuuccagggccaaaauagagcaucagcaacuaggca

SEQ ID NO: 92613 - RNA, 41 nt, Mus musculus
cuggaacaauaaguuccucuugcuuuuugcaucaaccccag

SEQ ID NO: 92614 - RNA, 44 nt, Mus musculus
cagacagggucuuguguagcuuaagcugcccucaagcucgcugu

SEQ ID NO: 92615 - RNA, 46 nt, Mus musculus
acagguauguggguguguguggcuguguguaugucugcccugggaa

SEQ ID NO: 92616 - RNA, 42 nt, Mus musculus
gugccucacuuucaccaucucugcuccaccacuggcucccuc

SEQ ID NO: 92617 - RNA, 45 nt, Mus musculus
aacaaggucaaacuauuauaaaaaacccaaugauuuaccugugga

SEQ ID NO: 92618 - RNA, 42 nt, Mus musculus
gacggaugcugguccucaguucgcuucuuccuuuucauucag

SEQ ID NO: 92619 - RNA, 43 nt, Mus musculus
cgagacguccugaggguucaucucgauugucagccugaguaga

SEQ ID NO: 92620 - RNA, 46 nt, Mus musculus
cccaggcacaaggccccugucacuagacacagcucccacaccccag

SEQ ID NO: 92621 - RNA, 45 nt, Mus musculus
aaagaggcaguccaugguuuuaaggcguuuauuguuauggcagaa

SEQ ID NO: 92622 - RNA, 46 nt, Mus musculus
ugcauguguauguagguaccuguacauaugaaugaauguggaagcc

SEQ ID NO: 92623 - RNA, 100 nt, Mus musculus
auaaagaacccuucugaggagagcuguggagcugacagggagagggaagaacacaucaaggagguauuuacuggugugugugugugugugugugugugug

SEQ ID NO: 92624 - RNA, 84 nt, Mus musculus
uaaguguagugaugcaaagagaagguggagagcaauuguggcagaauggagagcauaaaaucaaagugugcuugagacgguucg

SEQ ID NO: 92625 - RNA, 59 nt, Mus musculus
ccaugaagugagaggaagagaggggacagugucuccaggaagugagaggaagagagggg

SEQ ID NO: 92626 - RNA, 83 nt, Mus musculus
ucuccaggaagugagaggaagagaggggacagugucucuaggaagugagaggaagagaggggacagugucucuaggaaguaag

SEQ ID NO: 92627 - RNA, 42 nt, Mus musculus
gaagugagaggaagagaggggacagugucuccaggaagugag

SEQ ID NO: 92628 - RNA, 51 nt, Mus musculus
gagaggggacagugucuccaggaagugagaggaagagaggggacagugucu

SEQ ID NO: 92629 - RNA, 75 nt, Mus musculus
ccaggaagugagaggaagagaggggacagugucucuaggaagugagaggaagagaggggacagugucuccaggaa

SEQ ID NO: 92630 - RNA, 58 nt, Mus musculus
caggaagugagaggaagagaggggacagugucuccaggaagugagaggaagagagggg

SEQ ID NO: 92631 - RNA, 31 nt, Mus musculus
agggaggaagaagaggcagaaaggggagagu

SEQ ID NO: 92632 - RNA, 46 nt, Mus musculus
aaugucugaggacuugcuccccuacggacagcauuguuuggaugag

SEQ ID NO: 92633 - RNA, 42 nt, Mus musculus
uagccucuguugcagaauuacagggguagggcucauuauuca

SEQ ID NO: 92634 - RNA, 42 nt, Mus musculus
uaauucuccuggcucagccuccuuggugcugguauucuagau

SEQ ID NO: 92635 - RNA, 44 nt, Mus musculus
ccgcuggaggaaaauguucuagauguuaauggaaauagccaagg

SEQ ID NO: 92636 - RNA, 79 nt, Mus musculus
aacugaaguaugauacacauaugaaacuaaauauggucuggauaacaccuccaucuguucaucaucaccagaaucaccc

SEQ ID NO: 92637 - RNA, 46 nt, Mus musculus
acaagcaugguguauuuuaaauuauuuuuguacuguacuggggauc

SEQ ID NO: 92638 - RNA, 46 nt, Mus musculus
uuguguguguguguaugcaugcuguggugcauacuugggagucagg

SEQ ID NO: 92639 - RNA, 45 nt, Mus musculus
auggcagggcugccccagcaaagaaccuccucuuccccguuugag

SEQ ID NO: 92640 - RNA, 46 nt, Mus musculus
gugguggcacugaaaaagaaaccguagggugggaggggccagggac

SEQ ID NO: 92641 - RNA, 26 nt, Mus musculus
uugggacuguggacucucuaaaguag

SEQ ID NO: 92642 - RNA, 28 nt, Mus musculus
cuagacugcaagaugauacgccuggcug

SEQ ID NO: 92643 - RNA, 42 nt, Mus musculus
cuuugggaaaguagcucagccugggaagccccagacucagau

SEQ ID NO: 92644 - RNA, 35 nt, Mus musculus
ccucuggacuagaagugggugaaagaauccagaaa

SEQ ID NO: 92645 - RNA, 41 nt, Mus musculus
gggaggggguggcguggcugcagccagcuccacaggggagg

SEQ ID NO: 92646 - RNA, 46 nt, Mus musculus
ucuccaggaccaggacucugcuuccagccucuggaguugugccuag

SEQ ID NO: 92647 - RNA, 46 nt, Mus musculus
cagcacuaugaaugagaagacucuucaguuuccuaugggggcagau

SEQ ID NO: 92648 - RNA, 23 nt, Mus musculus
cuguuuuuuccccuucguuccca

SEQ ID NO: 92649 - RNA, 46 nt, Mus musculus
aguuuuauuauuugcaaagggaaaggagagucucccucgcccccaa

SEQ ID NO: 92650 - RNA, 45 nt, Mus musculus
uccuucucugucccuuagugccccccuccuugggccccacccgcc

SEQ ID NO: 92651 - RNA, 47 nt, Mus musculus
ucugugcagcuucaguguggggucuccgucuccuucuaucagcccag

SEQ ID NO: 92652 - RNA, 46 nt, Mus musculus
ggggcuggggaaacagugacuguacccaugaugaggaugccggggu

SEQ ID NO: 92653 - RNA, 42 nt, Mus musculus
ucagucacaggcaggggucuccuuccccacuccaccgcaggu

SEQ ID NO: 92654 - RNA, 46 nt, Mus musculus
gcccacaacagccacguagucugcgguaugcugggcuuccccggag

SEQ ID NO: 92655 - RNA, 45 nt, Mus musculus
guguguguguguguucgugugcuguguguguacaugacugugcau

SEQ ID NO: 92656 - RNA, 41 nt, Mus musculus
uccuuauaaccaacaaaaaaggagcagugcaugcugggguc

SEQ ID NO: 92657 - RNA, 41 nt, Mus musculus
gcagaggcagaggcagaggcagaggcagaggcaaacgcgcg

SEQ ID NO: 92658 - RNA, 46 nt, Mus musculus
accaggucucugcuuugccugucucccugaguccacccaaccuuuc

SEQ ID NO: 92659 - RNA, 23 nt, Mus musculus
augcuggcccagaagaagcaaca

SEQ ID NO: 92660 - RNA, 45 nt, Mus musculus
agagggcccagcacacagcucaccacugcaggguuucccccagag

SEQ ID NO: 92661 - RNA, 46 nt, Mus musculus
uggugagcugugugcugggcccucuuuaugccaccuuuacugguca

SEQ ID NO: 92662 - RNA, 44 nt, Mus musculus
ucuugggugggaguguguaacugaaagguaaguuugccgugugu

SEQ ID NO: 92663 - RNA, 44 nt, Mus musculus
gcucgugugcgucuaaaggguggugcccaccagggagaaggcag

SEQ ID NO: 92664 - RNA, 46 nt, Mus musculus
agaacaucacagcugaggacuguucccacagccaggaugcgggugu

SEQ ID NO: 92665 - RNA, 77 nt, Mus musculus
cagauccgacucagugggggccgcagccgguaugaagggcgagucgaggugcaaauagggauaccugggcaucuacg

SEQ ID NO: 92666 - RNA, 46 nt, Mus musculus
uacaggccaccauggccuccaggguuccccagucauccccacagau

SEQ ID NO: 92667 - RNA, 46 nt, Mus musculus
caggagaccugguacugggacucagggaauguaacugaggugguga

SEQ ID NO: 92668 - RNA, 45 nt, Mus musculus
ucccugaaccagugugcccaucacagcagccacaucaccugcaag

SEQ ID NO: 92669 - RNA, 46 nt, Mus musculus
ccuccaucucccuccguaugggagacuggcuucucucgaggcagau

SEQ ID NO: 92670 - RNA, 45 nt, Mus musculus
caauauaagcaguuuccuguaccagugccgagugcagcagcagau

SEQ ID NO: 92671 - RNA, 44 nt, Mus musculus
ucggcacugguacaggaaacugcuuauauugaagaccggcccuu

SEQ ID NO: 92672 - RNA, 45 nt, Mus musculus
cuuauggccaccggcgucugcuccgauucucuucccagauccaca

SEQ ID NO: 92673 - RNA, 42 nt, Mus musculus
cacccaugacacucaugccacacccaggaauggcgcccagcc

SEQ ID NO: 92674 - RNA, 46 nt, Mus musculus
accacaguauggacaucuucacucauuaugauauccugacccccaa

SEQ ID NO: 92675 - RNA, 42 nt, Mus musculus
aacacuuccuucagaugucuccaagagguaugagugcgccaa

SEQ ID NO: 92676 - RNA, 46 nt, Mus musculus
cugugaugucgauccacugacagucaaugucaugccuguagagauc

SEQ ID NO: 92677 - RNA, 46 nt, Mus musculus
uaacugcaaauacgacgggcaucgcaucugggugcacaacugccac

SEQ ID NO: 92678 - RNA, 46 nt, Mus musculus
guagcgcucaaaccuccuguuggcuucuucgcugaaggcaucaccu

SEQ ID NO: 92679 - RNA, 51 nt, Mus musculus
aagaagccaacaggagguuugagcgcuacccuggccagacuaguaaccaga

SEQ ID NO: 92680 - RNA, 51 nt, Mus musculus
gaggcugccauuaccucaggagcuuaccacaagaaccccugaugucagcag

SEQ ID NO: 92681 - RNA, 81 nt, Mus musculus
uggccaaagguaaugacagcugaccccguaaaggaggcaccaacuucuguuugacaguuuguugccuguagugcacaggug

SEQ ID NO: 92682 - RNA, 71 nt, Mus musculus
cuuuacggggucagcugucauuaccuuuggccaacaagcauggagaaucagccaacagccccagcaacaga

SEQ ID NO: 92683 - RNA, 64 nt, Mus musculus
cagaacacaccacaaagaacugccccacacaggauggcagcagcucauucucuugaauagggga

SEQ ID NO: 92684 - RNA, 46 nt, Mus musculus
cuucucccccaccaaauggcuagagguaacgcgguccuuaggagaa

SEQ ID NO: 92685 - RNA, 46 nt, Mus musculus
ucugagugcauguggguagaggaggagucagugaaccugcggaggg

SEQ ID NO: 92686 - RNA, 49 nt, Mus musculus
agguauugagacauagaaguggaaaaugaaaguaguuccgaagaaacgg

SEQ ID NO: 92687 - RNA, 41 nt, Mus musculus
aaaacagacaugagagaaaacccaagaaaaggauagggugu

SEQ ID NO: 92688 - RNA, 41 nt, Mus musculus
cuggucauuuuaagaagggagcaagagaacagcugccauca

SEQ ID NO: 92689 - RNA, 46 nt, Mus musculus
cuucuccuagaccgcuugccggguucuagaggaccgccucugagua

SEQ ID NO: 92690 - RNA, 44 nt, Mus musculus
ucagaacugcuguggucccuuuuuguuccuuucacgguguauca

SEQ ID NO: 92691 - RNA, 42 nt, Mus musculus
cuaggggaagagagugaggaguuugcgcuccguguacaacag

SEQ ID NO: 92692 - RNA, 45 nt, Mus musculus
gcagaacacaugaagcgacaaagacaccccagauuacgcccccag

SEQ ID NO: 92693 - RNA, 45 nt, Mus musculus
ugucacugagggaucucaguccccgccugcacccucugccccaaa

SEQ ID NO: 92694 - RNA, 59 nt, Mus musculus
caguuccccagcucgggccuggcgaccccucagcccacagcccuaacguuugccaaguc

SEQ ID NO: 92695 - RNA, 46 nt, Mus musculus
aggcccaggaggcugaaugagcccaaaggaacaggaugguacccag

SEQ ID NO: 92696 - RNA, 44 nt, Mus musculus
cgggugagauugcccuaccccucgguguccuucccccgcgaccc

SEQ ID NO: 92697 - RNA, 53 nt, Mus musculus
caagaccaguggggagugacugaggguguguccacaggaggagguccggguga

SEQ ID NO: 92698 - RNA, 45 nt, Mus musculus; identical to SEQ ID NO: 88334

SEQ ID NO: 92699 - RNA, 42 nt, Mus musculus
ccagccagggccagacaaaacuuugugaccaaggacgagaga

SEQ ID NO: 92700 - RNA, 41 nt, Mus musculus
aaugcugacgacagagagaugagauuacuccagcggguaga

SEQ ID NO: 92701 - RNA, 45 nt, Mus musculus
gauucguuaguuauaggugcuuaaugccaagucugacaaccccag

SEQ ID NO: 92702 - RNA, 45 nt, Mus musculus
ugccagcacacacacacacacacacacacacacgagagagagaga

SEQ ID NO: 92703 - RNA, 49 nt, Mus musculus
gcagguugguggggaaugcugacgccaaagcaauggugagauugggugu

SEQ ID NO: 92704 - RNA, 48 nt, Mus musculus
gugcuugauaaaacauguucauaaacuagaguccagaauugaaccccc

SEQ ID NO: 92705 - RNA, 42 nt, Mus musculus
acagagacggggaagggguaagacugcccuccacguguagaa

SEQ ID NO: 92706 - RNA, 42 nt, Mus musculus
caaggucgccccggguacgaguacccgccgcugauauggcag

SEQ ID NO: 92707 - RNA, 41 nt, Mus musculus
gauacggagcaagaacacuaacaacagggcuucuggggcaa

SEQ ID NO: 92708 - RNA, 41 nt, Mus musculus
gcgcggggugcagugugagcgcgcggcgcacacggagccac

SEQ ID NO: 92709 - RNA, 46 nt, Mus musculus
cgccgucucccuguucacacgugugccugagcuuaggagggguccc

SEQ ID NO: 92710 - RNA, 42 nt, Mus musculus
ccacugaguucgucaagaggccugggggucagcacggagggg

SEQ ID NO: 92711 - RNA, 45 nt, Mus musculus
uucuucuacguggugacagaugggcaagagguccuacuaccagag

SEQ ID NO: 92712 - RNA, 42 nt, Mus musculus
acuucaacuguccuuuggcuccgaucucugguaguaggaccu

SEQ ID NO: 92713 - RNA, 46 nt, Mus musculus
ggcccugccugacuuugauggagccaagagaaccaggcaugcaggc

SEQ ID NO: 92714 - RNA, 45 nt, Mus musculus
uggcggggcagggaccuagcuuugccuacccuacuuaaccccaag

SEQ ID NO: 92715 - RNA, 42 nt, Mus musculus
aagucuugaugagcugcacugggcuccugagcugggggucuu

SEQ ID NO: 92716 - RNA, 45 nt, Mus musculus
cuuauugucaucccauauagcucuggggugaaugugaacucaaag

SEQ ID NO: 92717 - RNA, 42 nt, Mus musculus
acugugcuaucuuuacucacucccaagacauacacaggagcc

SEQ ID NO: 92718 - RNA, 75 nt, Mus musculus
gagccacucaaggaagcgagggcuagugccucccagccagaucuggaagaccauuccccuugugcacugccccca

SEQ ID NO: 92719 - RNA, 81 nt, Mus musculus
gcgccuucaaacccccagccuacgaggaugugguucaccacccaggcacaccgccaccuccuuacacugugggcccaggcu

SEQ ID NO: 92720 - RNA, 41 nt, Mus musculus
caguagccccuuccaagccaggacccucaaccaccccacac

SEQ ID NO: 92721 - RNA, 42 nt, Mus musculus
gugagacuggucauugcuguggggagacuggcugcugcaccu

SEQ ID NO: 92722 - RNA, 45 nt, Mus musculus
aaaaccaucuugggggugugggaggcagaccuuuggggugggaga

SEQ ID NO: 92723 - RNA, 42 nt, Mus musculus
ucacagcagaguccggcagcaucuucucuugagggagcaauu

SEQ ID NO: 92724 - RNA, 45 nt, Mus musculus
uguuuuuguuucgaggcggucucacuauauaacuuuggcugcccu

SEQ ID NO: 92725 - RNA, 46 nt, Mus musculus
aacacccagcaaccacaugguggcucacaaccaucuguaaugggau

SEQ ID NO: 92726 - RNA, 45 nt, Mus musculus
acauauggagagcuuguuguuucuuaggcagugagaggaacagga

SEQ ID NO: 92727 - RNA, 42 nt, Mus musculus
cgucuaaccaucucuguuccuccucuuccuccuggcccucca

SEQ ID NO: 92728 - RNA, 63 nt, Mus musculus
gguuagaaaugagcaacccagcuuugccaccucuacggucuucucacccagccaggcgcggua

SEQ ID NO: 92729 - RNA, 46 nt, Mus musculus
acgccuuccauagguuccucuucauuauccaccaccaucaggggag

SEQ ID NO: 92730 - RNA, 48 nt, Mus musculus
caagaaaaaacacaagaaacauaaaaagaaacacaagaaaaagcauca

SEQ ID NO: 92731 - RNA, 42 nt, Mus musculus
guguguggucacacccaacuuuccaccucccuucucgggccu

SEQ ID NO: 92732 - RNA, 42 nt, Mus musculus
aggaggucccaguuuaaagucuguaucccucacuggcccggg

SEQ ID NO: 92733 - RNA, 41 nt, Mus musculus
guuccugagccuugcaaggauaugccaggccuugggagcca

SEQ ID NO: 92734 - RNA, 42 nt, Mus musculus
agaagccaaaggggucuaacaggacugcagagggacagggac

SEQ ID NO: 92735 - RNA, 41 nt, Mus musculus
uucuuguugcuuuuauuacgugugugugugugugugugugu

SEQ ID NO: 92736 - RNA, 41 nt, Mus musculus
ggaaaauauuauaaaaacggggugcaauagcaauccagcag

SEQ ID NO: 92737 - RNA, 42 nt, Mus musculus
gaugauguauggccccaagcaaguguggaggucggaggacag

SEQ ID NO: 92738 - RNA, 45 nt, Mus musculus
gacaggucauuggugcguacaaagcauggcugggaguagaaagua

SEQ ID NO: 92739 - RNA, 46 nt, Mus musculus
guguguguguguguguguguguguguguguguuucuguauguggag

SEQ ID NO: 92740 - RNA, 46 nt, Mus musculus
ggaggcuuuauuugugguuaaaagugauaaaaagcaugugugucug

SEQ ID NO: 92741 - RNA, 37 nt, Mus musculus
uuagaccuccggaucccacucauguggaaggauacag

SEQ ID NO: 92742 - RNA, 45 nt, Mus musculus
ugguacauggaguccugaaaggcacaaaccucuuuuguuacugga

SEQ ID NO: 92743 - RNA, 42 nt, Mus musculus
ucugcccuaucugccugcacuaaccagccuccagggcggcaa

SEQ ID NO: 92744 - RNA, 45 nt, Mus musculus
gaguuguuggaaauggagggaaaggaccucacuucgugguccuga

SEQ ID NO: 92745 - RNA, 46 nt, Mus musculus
gcuuuggccgcucucccaagacuucaggcuccuggaacgcggaggg

SEQ ID NO: 92746 - RNA, 54 nt, Mus musculus
ggccccuuguuacccugguguacuuaaaagguacugagaauggaagaacugugu

SEQ ID NO: 92747 - RNA, 42 nt, Mus musculus
auguauguguguauguauguguguguguguguguguguauau

SEQ ID NO: 92748 - RNA, 42 nt, Mus musculus
uuaagccaugcuugugauaccuguuuauaagccuagccccug

SEQ ID NO: 92749 - RNA, 120 nt, Mus musculus
ggggacuguuagacgaucgcggugaaggugguggauggacagugaagagagcagcgcuugagaaguauucaccuuacugugcugucaaaaguggucagaagugagggaggagaggccagg

SEQ ID NO: 92750 - RNA, 45 nt, Mus musculus
cgacgauuagaacaguaacgccuggcuuuauguuuaacuguguag

SEQ ID NO: 92751 - RNA, 49 nt, Mus musculus
ugaguugcucuaaucuucaaagcuauggaauggcagauaggaagaaugg

SEQ ID NO: 92752 - RNA, 46 nt, Mus musculus
agccccagcagugguuguggcugccuggagguggagguuagcaaag

SEQ ID NO: 92753 - RNA, 45 nt, Mus musculus
uuaguucugggagccaguggucuaucaauccagugaucuuuguua

SEQ ID NO: 92754 - RNA, 62 nt, Mus musculus
aaaggaaauaacaggcucuccagggagaagcuggggaauuucaggaaggagaugacuauuga

SEQ ID NO: 92755 - RNA, 44 nt, Mus musculus
uuuuauuugcagggcaaagggcuugaaguagauccaagcagcca

SEQ ID NO: 92756 - RNA, 46 nt, Mus musculus
auugagccaccucccuggcccgcacaagaagucuuuaagcagggau

SEQ ID NO: 92757 - RNA, 45 nt, Mus musculus
cuugauggcacuaagggcuacaaacucacaguuuggcagacaaug

SEQ ID NO: 92758 - RNA, 45 nt, Mus musculus
uucaguuuuaagugcugucagacucugucugugugugugugugag

SEQ ID NO: 92759 - RNA, 45 nt, Mus musculus
uggaucuuagagguggauguggaaaucccuggauacuuguuagag

SEQ ID NO: 92760 - RNA, 46 nt, Mus musculus
gaggaaaauggguuagaaauccagggacuguuuuucuguuaagggg

SEQ ID NO: 92761 - RNA, 46 nt, Mus musculus
ucauagugccucugugugugugugugugugugugugugugugucug

SEQ ID NO: 92762 - RNA, 42 nt, Mus musculus
gugucaguacaggcacacaccugccacaguacacuuauggag

SEQ ID NO: 92763 - RNA, 42 nt, Mus musculus
cugcuggcugcuuuuccuuauucuuuguaacauucaugagag

SEQ ID NO: 92764 - RNA, 42 nt, Mus musculus
caaccaguguucuuaauugcugagccaucucucuagcccccg

SEQ ID NO: 92765 - RNA, 63 nt, Mus musculus
gaacugcuuuguggcauuauccuguguuaggcaagugugcagaguggcagaaauugcagucuu

SEQ ID NO: 92766 - RNA, 42 nt, Mus musculus
gagcaggcuucuagcucugccccuccuguuuaucuggcccag

SEQ ID NO: 92767 - RNA, 46 nt, Mus musculus
ggccugcaggguuugggggagagcagacaauaggacaugggcccug

SEQ ID NO: 92768 - RNA, 56 nt, Mus musculus
gaugaagcaaaaggcaaaaaugauggcacuguccagggaaggaaguauuucacaug

SEQ ID NO: 92769 - RNA, 45 nt, Mus musculus
aggcauucuugaucugacugcauuggguauguucuuuggccucag

SEQ ID NO: 92770 - RNA, 48 nt, Mus musculus
uagggccagaauaaaggugguaggagaaguguuggagucuagauguuu

SEQ ID NO: 92771 - RNA, 45 nt, Mus musculus
ucccuugaguacugcauugugguuggugcuccaguuucaccucag

SEQ ID NO: 92772 - RNA, 73 nt, Mus musculus
ggccauuucugcaguggucccuggcccagcuuuuuggagcagcgucuuggagguagaggagaagaggagcgcg

SEQ ID NO: 92773 - RNA, 45 nt, Mus musculus
augugggcaugcaugcuagcaaaugaauguugguugcaguauacc

SEQ ID NO: 92774 - RNA, 46 nt, Mus musculus
uaugaguguugccugcauggauguuugucauaugugugcccucaga

SEQ ID NO: 92775 - RNA, 42 nt, Mus musculus
ucuaaugcuuaagaggccaucuuagccaguagauugggugug

SEQ ID NO: 92776 - RNA, 30 nt, Mus musculus
cauacacccagcgugaugggaaugggagca

SEQ ID NO: 92777 - RNA, 45 nt, Mus musculus
aucauccccacaccggcccucaccucuccuggagcagcaccccca

SEQ ID NO: 92778 - RNA, 44 nt, Mus musculus
gaagggcugagggcucagguacgggaccuggaggagaagcugga

SEQ ID NO: 92779 - RNA, 39 nt, Mus musculus
agcuggagaagcacaagauccagcuggagcaggugcagg

SEQ ID NO: 92780 - RNA, 44 nt, Mus musculus
aaggaggcgcuagaggcaaaggaacgcuacauggaggagauggc

SEQ ID NO: 92781 - RNA, 48 nt, Mus musculus
cgcgcugagucucugcagcaagagguggaggcacugaaggaacgggua

SEQ ID NO: 92782 - RNA, 45 nt, Mus musculus
aggcugaaaucgaagagaaagguaaggggccagcuggcagguaag

SEQ ID NO: 92783 - RNA, 65 nt, Mus musculus
uccucagagaagcaggagcacgugaagcugcagaaacucauggaaaagaaaaaccaggagcugga

SEQ ID NO: 92784 - RNA, 49 nt, Mus musculus
guggagaugcugaccgaccggaaccugaaucuagaggagaaagugcggg

SEQ ID NO: 92785 - RNA, 45 nt, Mus musculus
gccaugaacgagaugaacgaugagcugcaggagaacgcacgggag

SEQ ID NO: 92786 - RNA, 47 nt, Mus musculus
cagcagaccaucaagaaguaccgccaguugacugcccaccuacaggu

SEQ ID NO: 92787 - RNA, 46 nt, Mus musculus
gcagccgccgccagagacuuuugauuucaaaaucaaguuugcugag

SEQ ID NO: 92788 - RNA, 41 nt, Mus musculus
aggagaaacauugaagcuagaguaggaucgccuugggugcu

SEQ ID NO: 92789 - RNA, 42 nt, Mus musculus
aguguggacguguauaagaaggucggcagccuguaccccgag

SEQ ID NO: 92790 - RNA, 42 nt, Mus musculus
cccaagugucgagauaauaggucuaagccaucaugccuggau

SEQ ID NO: 92791 - RNA, 46 nt, Mus musculus
gcugccuguggcugcacuggaggagcuggccuucaaagcaagcgag

SEQ ID NO: 92792 - RNA, 45 nt, Mus musculus
cgugcggcucagccuccuggagaagaaguuggacagcgcugccaa

SEQ ID NO: 92793 - RNA, 45 nt, Mus musculus
ucgagaaaguucagacacggcuggacgagacucagacccugcugc

SEQ ID NO: 92794 - RNA, 41 nt, Mus musculus
ucguguguagugaaagaaagccauguuccucuggagcuagu

SEQ ID NO: 92795 - RNA, 42 nt, Mus musculus
uggucccacugcgcagggcacagccaccucagccacucccag

SEQ ID NO: 92796 - RNA, 46 nt, Mus musculus
ccucagggcauuggagggggccgacaccccuccacuaaagauugag

SEQ ID NO: 92797 - RNA, 30 nt, Mus musculus
uuuugaugaaguucagcauccacucucggu

SEQ ID NO: 92798 - RNA, 43 nt, Mus musculus
aaucccagcaaccacaugguggcucacaaccaucuguacaaca

SEQ ID NO: 92799 - RNA, 46 nt, Mus musculus
agagagacagagagagagagagacagagagagagagacagagacag

SEQ ID NO: 92800 - RNA, 45 nt, Mus musculus
uguucgcuuaauuaucucccacacgccccaugggguugcuggcag

SEQ ID NO: 92801 - RNA, 46 nt, Mus musculus
gcccugguuuuguugagaacauaggagugacuggcgggauugucac

SEQ ID NO: 92802 - RNA, 42 nt, Mus musculus
cucuuccaccuccugcuguacuucuugcuugaucugcugggc

SEQ ID NO: 92803 - RNA, 46 nt, Mus musculus
uuuccuuggcuauauggcuaguccaaagccaaccugaguacgugag

SEQ ID NO: 92804 - RNA, 45 nt, Mus musculus
ggcuuaccauaaaaacccugcugaaugcagcaaagauggaugaua

SEQ ID NO: 92805 - RNA, 42 nt, Mus musculus
acgaagcccacacuucucagaaaagcaugcaagaguaaaccc

SEQ ID NO: 92806 - RNA, 74 nt, Mus musculus
gguggcagccgugcguggggcgcaacaaccgcacagccaacgcagacaacaaggaaacugaagccauggcucgc

SEQ ID NO: 92807 - RNA, 41 nt, Mus musculus
cuggugaaauuccaagaaaaccacagguuuauugcugggaa

SEQ ID NO: 92808 - RNA, 42 nt, Mus musculus
cgccgagucugacggggcgggggccacggccccucgggcuag

SEQ ID NO: 92809 - RNA, 46 nt, Mus musculus
caucucuucagcccuugaagcacaaaccucaauuuaucauaugaag

SEQ ID NO: 92810 - RNA, 46 nt, Mus musculus
ugaguacucaguauuuaauauuuauauuauaauuauauucuaggag

SEQ ID NO: 92811 - RNA, 46 nt, Mus musculus
auaucaagcuucuaagggcugacugaagaaaaaaguaagaugcaag

SEQ ID NO: 92812 - RNA, 46 nt, Mus musculus; identical to SEQ ID NO: 92811

SEQ ID NO: 92813 - RNA, 53 nt, Mus musculus
auuuuuagguggucuuaaaauauuugcucauuuuuuuuccuggugccuguaua

SEQ ID NO: 92814 - RNA, 47 nt, Mus musculus
gcagucagugcucuuacugcugagccaucucuccagcccccuuccua

SEQ ID NO: 92815 - RNA, 47 nt, Mus musculus
guuaagguuuuaacagcuaucauuaacauuuuguuguucucggcagg

SEQ ID NO: 92816 - RNA, 42 nt, Mus musculus
uggcacuaauauuaaaaagccaauuaaguguucugcaccaaa

SEQ ID NO: 92817 - RNA, 46 nt, Mus musculus
gucuuugucauacaagcuguauguuuucuuccccugggguaccuug

SEQ ID NO: 92818 - RNA, 46 nt, Mus musculus
acuucuuuugugguugggcuuagacccagggucccucacaugguug

SEQ ID NO: 92819 - RNA, 42 nt, Mus musculus
ccccaacuucuccauuucuuuuuaaaaauguugugcuaggag

SEQ ID NO: 92820 - RNA, 47 nt, Mus musculus
uauucauucauuuauauauuuauuuaguuauuuauuugagacacacc

SEQ ID NO: 92821 - RNA, 54 nt, Mus musculus
gucagugcucuuaaccacuaauccaucucuccagcccccuuagcauaucuuaag

SEQ ID NO: 92822 - RNA, 46 nt, Mus musculus
agucauaaacuucaguguaauguuugaaaaguaauuuuaaccaaga

SEQ ID NO: 92823 - RNA, 46 nt, Mus musculus; identical to SEQ ID NO: 92811

SEQ ID NO: 92824 - RNA, 46 nt, Mus musculus
uauucugaagcgucucuucaggguuuaugcccauaucuaccaccag

SEQ ID NO: 92825 - RNA, 41 nt, Mus musculus
agccagaccuuguuucaaaaaaccagaaaagaaagcuggag

SEQ ID NO: 92826 - RNA, 46 nt, Mus musculus
ugacaagcauuuuccuuacuaaggagccuucuccuuagccugcacu

SEQ ID NO: 92827 - RNA, 64 nt, Mus musculus
ugacuaaaaacaguuauuuuauauaucauaaaggucauuucuuucagauuucagaaagcuaggu

SEQ ID NO: 92828 - RNA, 63 nt, Mus musculus
cuuuuuaggaguuuaaucugauugauaggcgugaguuggcaccacuucaggaauuaauugaga

SEQ ID NO: 92829 - RNA, 46 nt, Mus musculus
ugacuacaagaaaccaggaucaaaagauccauuguguuugcagaga

SEQ ID NO: 92830 - RNA, 45 nt, Mus musculus
ugcugagcuuuguuuaagaaaaugauuuuucccaugugacagcau

SEQ ID NO: 92831 - RNA, 41 nt, Mus musculus
cuccucacucagauuaauuucauauguagcuuggggcagag

SEQ ID NO: 92832 - RNA, 41 nt, Mus musculus
cacugugugcauugcuguuuccuugcaggucuugcggggca

SEQ ID NO: 92833 - RNA, 46 nt, Mus musculus
aaguuagaguugaugagguuuuuguuauuuauuuugauuccacuag

SEQ ID NO: 92834 - RNA, 46 nt, Mus musculus
aggcaaaaacccgagaggaggcugucuuucugucuuuggcuagagg

SEQ ID NO: 92835 - RNA, 41 nt, Mus musculus
ggugaugagguuuguacucuuggcuucucucugagccccaa

SEQ ID NO: 92836 - RNA, 42 nt, Mus musculus
auaaaaaauuuauguuguauuuuuaaaacuuuuagggcuuua

SEQ ID NO: 92837 - RNA, 46 nt, Mus musculus
cuuuguacugccauuguuuuuguuuuuuuaaucucaagcaccuuga

SEQ ID NO: 92838 - RNA, 46 nt, Mus musculus
uccaaaaugggggacaaggaacauguggguucuguucccagcugcc

SEQ ID NO: 92839 - RNA, 41 nt, Mus musculus
gucuuuuagguuuguauggagagacucuaccagagggauag

SEQ ID NO: 92840 - RNA, 42 nt, Mus musculus
cuacccccaaaauaaagucaaagacaauaaaacucggcaggc

SEQ ID NO: 92841 - RNA, 42 nt, Mus musculus
ugcacuuagaggagcagggguugaaggcuguggcugggagaa

SEQ ID NO: 92842 - RNA, 42 nt, Mus musculus
ugcuucucuucuagaggagccaaaguucauuccccacaccca

SEQ ID NO: 92843 - RNA, 45 nt, Mus musculus
gaaggaaggaaggaaggaagguaggaagguagguagguagguaca

SEQ ID NO: 92844 - RNA, 46 nt, Mus musculus
uaacaagaucugaugcccucuucuggggugucugaagacagcuaca

SEQ ID NO: 92845 - RNA, 46 nt, Mus musculus
guucaaauacaugggggacgggagagaauggagcuggggagguaga

SEQ ID NO: 92846 - RNA, 93 nt, Mus musculus
uguguguguguggugugugucuguguguguggugugucuguguguguacguguguguguguguguggugugugcguguguagugugugugugu

SEQ ID NO: 92847 - RNA, 46 nt, Mus musculus
ccuugugggcuagguugguuccaccuccuugcuaucaccccgauua

SEQ ID NO: 92848 - RNA, 24 nt, Mus musculus
cauauauuuuaagcugggguauac

SEQ ID NO: 92849 - RNA, 45 nt, Mus musculus
uuuccauauaaucaaacuagaguacaccaacagccaaggcucuaa

SEQ ID NO: 92850 - RNA, 42 nt, Mus musculus
uuuuuuuuuuucuuucuuacaaauaguuucccaugaaaagaa

SEQ ID NO: 92851 - RNA, 42 nt, Mus musculus
ugcuuccugaagcccauuacuuugugacuacaaaccccaguu

SEQ ID NO: 92852 - RNA, 46 nt, Mus musculus
cugaugcugggaguuuccaccaagauggacucaaacugagccagaa

SEQ ID NO: 92853 - RNA, 43 nt, Mus musculus
ucagcuauggcuacacagagaaacccugucuuugaaaaaagag

SEQ ID NO: 92854 - RNA, 58 nt, Mus musculus
aacacauuaguagauuuuuuuaaaaaaaaugaucuagucaagagggcaaauuagcugg

SEQ ID NO: 92855 - RNA, 47 nt, Mus musculus
acauacauauauaugugguauauauauaugugguauuuaaagccaga

SEQ ID NO: 92856 - RNA, 45 nt, Mus musculus
ucaauguggcuaugagauagccaaguagaauagaaguauugaaua

SEQ ID NO: 92857 - RNA, 46 nt, Mus musculus
aaauagcaucaccagauuuagcaaaaauaaaaauaaauguccaguu

SEQ ID NO: 92858 - RNA, 46 nt, Mus musculus
ggcucaggagccaggcagaauauugcuuucucuuucugccuaaguc

SEQ ID NO: 92859 - RNA, 45 nt, Mus musculus
agggaugcuguggaggaagucagagccaaucuucagucccagcua

SEQ ID NO: 92860 - RNA, 42 nt, Mus musculus
aagauucuagguggcacuguuugccuuaauaccccaggaguu

SEQ ID NO: 92861 - RNA, 85 nt, Mus musculus
ccagcccaggucucccuccccucuguucugaagccucguuccccacccuccucaggaggcuugaaugcugccaggggcaccagag

SEQ ID NO: 92862 - RNA, 46 nt, Mus musculus
ggggcaagaccaagagagccaggccccugggacucugggcuaaucg

SEQ ID NO: 92863 - RNA, 42 nt, Mus musculus
cacccuggggcucucucuucucagucucuccugucaccaggu

SEQ ID NO: 92864 - RNA, 27 nt, Mus musculus
uuaccuggcauuucaguuuuuugcgga

SEQ ID NO: 92865 - RNA, 44 nt, Mus musculus
uccagccaugaggaccuugccaaagagucaaguuagaaggaggg

SEQ ID NO: 92866 - RNA, 46 nt, Mus musculus
uuggccuucuccagaccuuccccuucaucaugcugacgucaccuaa

SEQ ID NO: 92867 - RNA, 41 nt, Mus musculus
uucuuuuccugaagacuuggucccugucccuguuagagagg

SEQ ID NO: 92868 - RNA, 41 nt, Mus musculus
accugcucaacucuaaacugugcaguggaacuggaggaaga

SEQ ID NO: 92869 - RNA, 46 nt, Mus musculus
ucagugaggccccaggcugcugucagcugagguuugugcggcggug

SEQ ID NO: 92870 - RNA, 46 nt, Mus musculus; identical to SEQ ID NO: 37545

SEQ ID NO: 92871 - RNA, 46 nt, Mus musculus
ggcacuaggugguuuuuauuguuguuuuuuuguuugguuugguuag

SEQ ID NO: 92872 - RNA, 46 nt, Mus musculus
uaucuuuaaagaggcaggaaaauagauuugcacacuagagcaucag

SEQ ID NO: 92873 - RNA, 41 nt, Mus musculus
ugugugugugugugugugugugugugugugugugggggcau

SEQ ID NO: 92874 - RNA, 41 nt, Mus musculus
gccguagcugcauuugagucagggaaaggguagcacugcca

SEQ ID NO: 92875 - RNA, 46 nt, Mus musculus
cacuauuugggcucagugggucacaaagggaaaaaagagaagaagg

SEQ ID NO: 92876 - RNA, 45 nt, Mus musculus
ccuccagaaccaugccugccugauugcugccacguuccugccuug

SEQ ID NO: 92877 - RNA, 36 nt, Mus musculus
ucuuuguaaugugugucauggauauguuguuccuag

SEQ ID NO: 92878 - RNA, 46 nt, Mus musculus
acaaacugucaccucuagcuuacuuucuucugagcccuggacugug

SEQ ID NO: 92879 - RNA, 46 nt, Mus musculus
aacucugugggcacuaaagacauucucuguagccuuucacauucag

SEQ ID NO: 92880 - RNA, 45 nt, Mus musculus
cagccacaugaugguauaguauagaagagaguuuauucaggguau

SEQ ID NO: 92881 - RNA, 45 nt, Mus musculus
gaggaggaagaggaggaggaagaagaggaggaggaggacgaguaa

SEQ ID NO: 92882 - RNA, 46 nt, Mus musculus
auggggagagagaagggaaggggcaagaggacagggcuagagcaag

SEQ ID NO: 92883 - RNA, 46 nt, Mus musculus
uuugcagagguccagcaagcugaggucucccaugaccaagacagag

SEQ ID NO: 92884 - RNA, 47 nt, Mus musculus
gaggcaaagagauuuguaaugucuggguuccagaggguacaaggaga

SEQ ID NO: 92885 - RNA, 53 nt, Mus musculus
ccuggagcauaugggcagcuccuagcaggaggugaggaaauuccaggaaggag

SEQ ID NO: 92886 - RNA, 54 nt, Mus musculus
aagcaggggguucuacagugauguccaguaagagagagacaagugguuagagag

SEQ ID NO: 92887 - RNA, 41 nt, Mus musculus
ggaaguggaugcucauguggugggugacccaaaaggccauc

SEQ ID NO: 92888 - RNA, 45 nt, Mus musculus
cacucccagauuuuagcaucagaugaaugaaaaaagaaauaaaaa

SEQ ID NO: 92889 - RNA, 65 nt, Mus musculus
aagaccagcugaaacaacuagcuucaugggacugagcaaguacuagauucuuagacauccacagu

SEQ ID NO: 92890 - RNA, 46 nt, Mus musculus
gaacugcagacuguaaaucauuacaauaaauuuccucaauacagag

SEQ ID NO: 92891 - RNA, 45 nt, Mus musculus
ucaggaggccaaaguaaaaaaggggcagauaaucaaaaugucugg

SEQ ID NO: 92892 - RNA, 46 nt, Mus musculus
auagacuguuuuuguaagucaagaauuuaggauuagggggcuggag

SEQ ID NO: 92893 - RNA, 48 nt, Mus musculus
guggcucacaaccaucccuaaugagaccugacucccucuucugguaug

SEQ ID NO: 92894 - RNA, 42 nt, Mus musculus
gucccugaagaaagaaauugaagaagccgggcgugguggcac

SEQ ID NO: 92895 - RNA, 63 nt, Mus musculus
aagggaauggggggcgguucaggauuagguauggggaaggacaggagaggagagauggcuaga

SEQ ID NO: 92896 - RNA, 63 nt, Mus musculus
ugcccauggaaaucuacaauggacaggggugaggaggugggggccaucuccuggaagagacag

SEQ ID NO: 92897 - RNA, 46 nt, Mus musculus
aaacuuucaacccaaaauuuauuuugucuaagaaaugcaagcagug

SEQ ID NO: 92898 - RNA, 49 nt, Mus musculus
guagguuacuuucuuaaacuuuauuuuuauuuuauauauacuugagauu

SEQ ID NO: 92899 - RNA, 46 nt, Mus musculus
gugaugagcuacuguguuacuaagaaggguccuguucuauuugcag

SEQ ID NO: 92900 - RNA, 45 nt, Mus musculus
ucagaggggcagggagccagcagcagagagcaaaggaauaaagca

SEQ ID NO: 92901 - RNA, 46 nt, Mus musculus
cucccucaauggagccaauccagugguuaaaaucagcagccucaug

SEQ ID NO: 92902 - RNA, 45 nt, Mus musculus
cagaggcuuaguccauuauuaucauggcagggaccauggccacag

SEQ ID NO: 92903 - RNA, 46 nt, Mus musculus
acaacaacaacaacaacaacaacauuuaauuggggcuggcuuacag

SEQ ID NO: 92904 - RNA, 45 nt, Mus musculus
cacucccagcacacagugggucuacauuaccauuccaaaagggaa

SEQ ID NO: 92905 - RNA, 45 nt, Mus musculus
uucucaauaucuagaucagguaacgcccuguaacuccagcuccag

SEQ ID NO: 92906 - RNA, 46 nt, Mus musculus
gagggcauccucugggggcccuaagaaaauugagauaugggccaag

SEQ ID NO: 92907 - RNA, 46 nt, Mus musculus
cuagcuuauauuggcauaacugagucaauuuaaaaagauagaacau

SEQ ID NO: 92908 - RNA, 46 nt, Mus musculus
aacuacauggugacucacaaccauuccuaaucuggggugccugaag

SEQ ID NO: 92909 - RNA, 70 nt, Mus musculus
gaccuuuucuuuaaaaagggggcgaugggagugagcaguaaaagcgagaauauguuaauaagugaauguu

SEQ ID NO: 92910 - RNA, 67 nt, Mus musculus
acguugugauacugagggaauaguaaucagagaaggcuucauggaagagaagagggaugguuugcag

SEQ ID NO: 92911 - RNA, 67 nt, Mus musculus
gaacgcggagccugaggcacgcaggcgcagugagcggacgagggcuuuaggcgaagaugcgcaugcg

SEQ ID NO: 92912 - RNA, 48 nt, Mus musculus
gaucccauccgugccccacacaguuuagcacucggccuccagucaccg

SEQ ID NO: 92913 - RNA, 45 nt, Mus musculus
gaggccgagugcuaaacuguguggggcacggaugggauccagcug

SEQ ID NO: 92914 - RNA, 45 nt, Mus musculus
gggugugcgggcuguugugggccaagcgccccagugagcaccgaa

SEQ ID NO: 92915 - RNA, 44 nt, Mus musculus
gauguggggauacaugcuuguguuggugugguuccuagcuuggg

SEQ ID NO: 92916 - RNA, 48 nt, Mus musculus
cauaaauucuaguucuaaaaaagguugucucagucaucauuuucuggg

SEQ ID NO: 92917 - RNA, 46 nt, Mus musculus
cuuugguuuuuauguaauaaauaaaaaugaggagucuaaugggcag

SEQ ID NO: 92918 - RNA, 45 nt, Mus musculus
uguaaacuugcacuacuuguuugcccuuucuuuuaguacacugag

SEQ ID NO: 92919 - RNA, 46 nt, Mus musculus
ugugguugaaaauaaaaaugggaggaaaauauauaggaagucagaa

SEQ ID NO: 92920 - RNA, 46 nt, Mus musculus
uuucauuuacuuaccuaaguguugagugccuguugcaugccaggag

SEQ ID NO: 92921 - RNA, 57 nt, Mus musculus
uuauuaugaauuuuguaauugaccgacuaacagucaguuguuagggagaguacauga

SEQ ID NO: 92922 - RNA, 50 nt, Mus musculus
uuguuuuauuuguuuguaaucuuuugacccaaaauacaauuaaaagccgg

SEQ ID NO: 92923 - RNA, 46 nt, Mus musculus
uaaaacugaugacuuuucuauucuaccuuuccucuccaguucucag

SEQ ID NO: 92924 - RNA, 45 nt, Mus musculus
accucuuuucucauuuguaauuaugacuaaguaaucccgggccug

SEQ ID NO: 92925 - RNA, 46 nt, Mus musculus
gucaguaaagaguuggcugaauguauuugucugcacgauaggagag

SEQ ID NO: 92926 - RNA, 76 nt, Mus musculus
aaauuuauuguauguaucugggaugcaacaugaaaagaacagugaggguaaggaugugugggaacuaagugggugu

SEQ ID NO: 92927 - RNA, 46 nt, Mus musculus
cagagcuccugugcucugggcagguggacaugggagggcugcuaga

SEQ ID NO: 92928 - RNA, 121 nt, Mus musculus
cgagaguccuuaguccgggccuugacuggagcacaggaaggccuuucuuccaucaggagauuagaaacggcucauuacgagacagccuaucccaccauccaagcuuugauaaacagagaca

SEQ ID NO: 92929 - RNA, 153 nt, Mus musculus
gucugugguuuuagagcuuuauuguagaaaggcaggggaaagagaaaagguagaaagagagacuggccauggccaagaggagggaagggggagaggaagagaaagaggaaagucuagagaguaagagggagugagaggagaggagagaaaggg

SEQ ID NO: 92930 - RNA, 49 nt, Mus musculus
caaacagcccuucuuauggugugcuguuaacuuuauugcugcuagguaa

SEQ ID NO: 92931 - RNA, 46 nt, Mus musculus
acaccucagcuuggcuggagacuagacuguguguauauagcccaau

SEQ ID NO: 92932 - RNA, 51 nt, Mus musculus
auguaugcauauauguauguauguggguacacaugugcaaagucauguagg

SEQ ID NO: 92933 - RNA, 46 nt, Mus musculus
gauagagauuggcuagauugguuggacauuacacauaaagagccaa

SEQ ID NO: 92934 - RNA, 46 nt, Mus musculus
gaaaauguucuuuuacaaaaauuaaagaaauggaguguauggcgag

SEQ ID NO: 92935 - RNA, 46 nt, Mus musculus
uaacagaaauauaaguauagcuuaauugccauguggaaccuaguag

SEQ ID NO: 92936 - RNA, 42 nt, Mus musculus
aggacuugugaauuacaucucagcaccuaggacagcacccag

SEQ ID NO: 92937 - RNA, 33 nt, Mus musculus
cguugccucccaugguucaacaccaccuuauac

SEQ ID NO: 92938 - RNA, 112 nt, Mus musculus
uugugaggccuggcucuaugggucuuccaagauuuuacccagcagggagagcccguggaauuccacacagauuuccuggccacggaucuuaucagaacaugggaccacaaag

SEQ ID NO: 92939 - RNA, 139 nt, Mus musculus
aaugaauguucagguaacucaacaccgaaccgauccaagauuaaccaaagaaaaauuggauuuuccugaagcacaacaaaagaaggggaagccucaugguagucggugggaugaugagucucauauaacuccaccggua

SEQ ID NO: 92940 - RNA, 49 nt, Mus musculus
gagagugcuucaaguauuuuagcaaguuuuggauuaucaaaugaagauc

SEQ ID NO: 92941 - RNA, 81 nt, Mus musculus
acuccugaaaauaugccauuaauauugagggauauaagaaugcgaaaaaugagccgccgauuaccuaauuuaccuucucac

SEQ ID NO: 92942 - RNA, 55 nt, Mus musculus
uucaaguaaugugauugauuaugggcaugcaagcaaauaugguuauacagaagau

SEQ ID NO: 92943 - RNA, 57 nt, Mus musculus
aacuccaaaugugauauguaauucuguguuuccugguggagauauguuucgucagau

SEQ ID NO: 92944 - RNA, 71 nt, Mus musculus
uuucaggacagucaguccuugaaccuguaaaauccaucagccagucuauuagccaaacaguuagccagaca

SEQ ID NO: 92945 - RNA, 74 nt, Mus musculus
acgagccagucucugaauccuccaucuaugaaccagguacccuuuacauuugaauuagaugcaguuuuacgcca

SEQ ID NO: 92946 - RNA, 56 nt, Mus musculus
ugaaagcuucguggcuaccaaaguuuacacaagcuggugcccagaaaaugaagaga

SEQ ID NO: 92947 - RNA, 43 nt, Mus musculus
aguguuuuuaaaagauugcuguacaaugaugcucagugcccag

SEQ ID NO: 92948 - RNA, 45 nt, Mus musculus
uauauuuacugauuuagauuugugugugauugugaugcuggugca

SEQ ID NO: 92949 - RNA, 42 nt, Mus musculus
aacaaauaguuuggugauauuuaaccauuugugcaugcacag

SEQ ID NO: 92950 - RNA, 49 nt, Mus musculus
uuuggaacagaaugaucugguagggagguauguauagaauaguuugaag

SEQ ID NO: 92951 - RNA, 46 nt, Mus musculus
agaaaggccuugaaaagcuguugucaauuuagauuucacauggaag

SEQ ID NO: 92952 - RNA, 49 nt, Mus musculus
agugacacauugaaaauguuucagggagauuucaguguagaugaauagg

SEQ ID NO: 92953 - RNA, 46 nt, Mus musculus
caauauugugagagucuggcugucuccuuucgucauauggguccag

SEQ ID NO: 92954 - RNA, 46 nt, Mus musculus
uauuugagguguuauuuuuuuaauuuaugcuuuucuucaggucuag

SEQ ID NO: 92955 - RNA, 45 nt, Mus musculus
uuaugcuaaauauuuuuuaaguggaauuaauaugguaugggguua

SEQ ID NO: 92956 - RNA, 46 nt, Mus musculus
guaguuguuaggaguuuaauuuaggaccucugcucacucuggucaa

SEQ ID NO: 92957 - RNA, 49 nt, Mus musculus
augguggcucacaaccacccauaaugagaucugacucccugaagacagc

SEQ ID NO: 92958 - RNA, 44 nt, Mus musculus
gugagauggcucaguggguaagagcaccugacugcuccuccgaa

SEQ ID NO: 92959 - RNA, 50 nt, Mus musculus
uaaugagaucugaugcccucuucugguaugucugaagcuacaguguacuu

SEQ ID NO: 92960 - RNA, 46 nt, Mus musculus
aaaaaaaaaaaagaaaacuuaucugcauaguagauaguuccuguag

SEQ ID NO: 92961 - RNA, 46 nt, Mus musculus
ucuaauacacaagccugauucagagccuuccaguuguuuguagaag

SEQ ID NO: 92962 - RNA, 42 nt, Mus musculus
uagucaucaacuaguuuguuuuuuuguuuguuuggcggggau

SEQ ID NO: 92963 - RNA, 45 nt, Mus musculus
ggcagugguucucaaccuguaggcugaaaacuuugaaaaacacag

SEQ ID NO: 92964 - RNA, 42 nt, Mus musculus
uguguuucaacagaaaguaugaaaauuguauguccccuggag

SEQ ID NO: 92965 - RNA, 40 nt, Mus musculus
aauagauacccugauuggaauccugagauccucccaucca

SEQ ID NO: 92966 - RNA, 71 nt, Mus musculus
agacguucucauucccccagccccagacauucuaggagaucaagcucaggucacagaauccgucgcucucg

SEQ ID NO: 92967 - RNA, 80 nt, Mus musculus
aaguccaguccguuauaucuauagaccaaggagucgaaguccaagaauuugccaccguuucauuucuaaauauagaucca

SEQ ID NO: 92968 - RNA, 51 nt, Mus musculus
cgaaguccuaucggucagcuagcccagagaggacaucaagaaaaucaguga

SEQ ID NO: 92969 - RNA, 46 nt, Mus musculus
uuuccuuauauuuugacccaaaaguguacauauagcacacauagug

SEQ ID NO: 92970 - RNA, 44 nt, Mus musculus
uaccagaagguaaacaggagucugguaaaagugcuuuggcccag

SEQ ID NO: 92971 - RNA, 44 nt, Mus musculus
auuacuggaauggagaacgaacaaagauguacuauuuauaagag

SEQ ID NO: 92972 - RNA, 45 nt, Mus musculus
ugugcuaucuaugucaugguuaacuauuccauaguauuuguaugg

SEQ ID NO: 92973 - RNA, 46 nt, Mus musculus
aaaggaaaaagugugaaaguauguguuccaggaaagaaaaagccac

SEQ ID NO: 92974 - RNA, 46 nt, Mus musculus
auccuauagaauagcugcagucauuuacaccccugugauucaugag

SEQ ID NO: 92975 - RNA, 45 nt, Mus musculus
uauugguauuuuuguugauugaggggaaucacuauauagcccaga

SEQ ID NO: 92976 - RNA, 46 nt, Mus musculus
guugaaccuuguucacucaggucgccccagucccucuggcccaaag

SEQ ID NO: 92977 - RNA, 46 nt, Mus musculus
uuuugauuggauuuguugugguuuucuguaauggucuugcugcaaa

SEQ ID NO: 92978 - RNA, 52 nt, Mus musculus
guauaugcuaaagaaaccaugagauacuucuuuaagugaauaggaugaugug

SEQ ID NO: 92979 - RNA, 46 nt, Mus musculus
gguuucauacuuuguacaguuuaucuacuagagaucuuugagacau

SEQ ID NO: 92980 - RNA, 74 nt, Mus musculus
ucauagugacuaaaacaugaucacaaauuaaaggaaauguaaagagaaaaggguaagcauuuauacuucagagu

SEQ ID NO: 92981 - RNA, 49 nt, Mus musculus
aggauuuuaguuacuaaauugcuaaagaguugcauaggcauagauucau

SEQ ID NO: 92982 - RNA, 45 nt, Mus musculus
uuguguucuuuguguuaaaaagguaaaugccauuguaacuggcag

SEQ ID NO: 92983 - RNA, 63 nt, Mus musculus
aucagcggguucuguaaaaucugugguuacgguagcugcgaaagguaaagcuucuaucaaaac

SEQ ID NO: 92984 - RNA, 46 nt, Mus musculus
ugguuauacacuauauuugcaaguauauaacuauauggccugacag

SEQ ID NO: 92985 - RNA, 46 nt, Mus musculus
aaaucuggaaagaagucucuagaagcuaaaaagucugggaauauca

SEQ ID NO: 92986 - RNA, 46 nt, Mus musculus
aucagaggggguggggggaggaaggaggaggagaggagagauagag

SEQ ID NO: 92987 - RNA, 46 nt, Mus musculus
uguuguuuucuaaugagagacggaaaaggagugaaucuggaugugg

SEQ ID NO: 92988 - RNA, 45 nt, Mus musculus
uuaagguacuuuggaggccacagaaaaggaaccagugaacaaggu

SEQ ID NO: 92989 - RNA, 46 nt, Mus musculus
guaguauuuauuucuaauuugccuaacaaaggauauucuacagaag

SEQ ID NO: 92990 - RNA, 46 nt, Mus musculus
ugaagcuuauuuuuaaauacagguuauuuguaauguuuaaaggaag

SEQ ID NO: 92991 - RNA, 50 nt, Mus musculus
aaucugcagauucuaugguaaaauuuuacaccugcuucccaauauccaug

SEQ ID NO: 92992 - RNA, 46 nt, Mus musculus
auaggaagcucucuuuacaacuuugauucaagaaaaugacccagag

SEQ ID NO: 92993 - RNA, 46 nt, Mus musculus
accagugucccaccuccuauuugcuaccucaguucauuggccguug

SEQ ID NO: 92994 - RNA, 46 nt, Mus musculus
uuuaccugaagauggacuucagugugugcuuuguguugggcaucag

SEQ ID NO: 92995 - RNA, 78 nt, Mus musculus
uuuaaggagaaguaagauucacagaauaacggagcaugucuuacuaggggaguuacacauuacuuacauuaguuauau

SEQ ID NO: 92996 - RNA, 51 nt, Mus musculus
gagacuucuuguacuuaaacaauaacuguuuaacaugccucccauccaccc

SEQ ID NO: 92997 - RNA, 46 nt, Mus musculus
gugcuuagucuauguuuuaaaaauccauucaucaguugguagauag

SEQ ID NO: 92998 - RNA, 46 nt, Mus musculus
aaucugcucugucaauguacaauuuuuugaaacaaaauccacaaaa

SEQ ID NO: 92999 - RNA, 45 nt, Mus musculus
uacagagagaaaccuugucucagaaaaaaaaaaagaaaaccagag

SEQ ID NO: 93000 - RNA, 46 nt, Mus musculus
cagccaggcaauggcaaaggccuuaguauguuucuggugauggaag

SEQ ID NO: 93001 - RNA, 46 nt, Mus musculus
auuugcuuuaaauguugagucuuuuaaaaguaaaugugguugccag

SEQ ID NO: 93002 - RNA, 46 nt, Mus musculus
agcaccuguucuuuuggagaacccaaguucaacuucucacacccac

SEQ ID NO: 93003 - RNA, 45 nt, Mus musculus
uugauuuuauggaaguucuguagccauuuuaaguucacaugcaua

SEQ ID NO: 93004 - RNA, 41 nt, Mus musculus
gguacaaacuuggaaugaaaaauuguuaacuuacacaagaa

SEQ ID NO: 93005 - RNA, 49 nt, Mus musculus
agaagaaacuacuuccaauauuggaacagaaacuucagugcaucaggaa

SEQ ID NO: 93006 - RNA, 68 nt, Mus musculus
aaaauauagaugagucugcuuuaaaccagcagauguacaccagugacuuugaaaaggaagaggcagaa

SEQ ID NO: 93007 - RNA, 92 nt, Mus musculus
gugagcaaaaaggauauugcugaaaaaguuaucuuggaugaaaaggaggaagaugaauuuaauguuaaggagaccagaauggauuuacaagu

SEQ ID NO: 93008 - RNA, 46 nt, Mus musculus
cuaguugugguucauugacagcaagcaaaaugccagaaccugcuag

SEQ ID NO: 93009 - RNA, 49 nt, Mus musculus
auauaaauuaauugguauaguuaacuauuuacucuuuauuuucgaggua

SEQ ID NO: 93010 - RNA, 50 nt, Mus musculus
ucccucacaguguugagggagaauuguccuuuguaacauuagaugaaaua

SEQ ID NO: 93011 - RNA, 48 nt, Mus musculus
gaacgcuugguaacuguggaugaaauuggagaaguagaagagucagca

SEQ ID NO: 93012 - RNA, 46 nt, Mus musculus
acccuuccacuuuaguuacuguagaugaaauacaggaugacagcag

SEQ ID NO: 93013 - RNA, 46 nt, Mus musculus
cugaauuuuguuacuguggaugaaguuggagaugaggaagauggag

SEQ ID NO: 93014 - RNA, 46 nt, Mus musculus
gcuguggacccaaagaagucaaagcuugauucuuucucccaaguag

SEQ ID NO: 93015 - RNA, 42 nt, Mus musculus
gaacuuuguuuuccacagaaacaagguguugguugcacacau

SEQ ID NO: 93016 - RNA, 45 nt, Mus musculus
uuaauaaaugucuacuuuguaaaaguuaaaaaaagcaagccaggu

SEQ ID NO: 93017 - RNA, 50 nt, Mus musculus
ccagggcuguuuguuauacagagaaacccugauuuaagaaaaaagaaagg

SEQ ID NO: 93018 - RNA, 45 nt, Mus musculus
auuggcaacaauucaggggaaaguauaaagccauacugugaaaag

SEQ ID NO: 93019 - RNA, 45 nt, Mus musculus
uaaugaagcaauaaauuaggcuuucuuuuuaaagcuaaaacgcca

SEQ ID NO: 93020 - RNA, 46 nt, Mus musculus
ggagguaaaggggcuauucggguggggaaaaaacacacaacaugag

SEQ ID NO: 93021 - RNA, 46 nt, Mus musculus
ggaaauuacucacaagauguuauugugaccauguucuagcaucagg

SEQ ID NO: 93022 - RNA, 45 nt, Mus musculus
uuggaaaaaugcauuauuuuucuaucuacuacuaaaucccccaag

SEQ ID NO: 93023 - RNA, 46 nt, Mus musculus
ucauauugaaaauugcuuuuaacagaaguucauggccaagcaaaga

SEQ ID NO: 93024 - RNA, 46 nt, Mus musculus
ggaggaaaggagaaaagaauucauuagaaauucauuuaggguccag

SEQ ID NO: 93025 - RNA, 78 nt, Mus musculus
gaaagagggaaggagggagggagggagagagagagagggagagagaaugagagagagagagaaugagagagagagaau

SEQ ID NO: 93026 - RNA, 42 nt, Mus musculus
caacucugccaaagcuugcuguggaaagucacaggaccagag

SEQ ID NO: 93027 - RNA, 44 nt, Mus musculus
aaucuccugggucagguaugaagggaaaagaggacuagccggga

SEQ ID NO: 93028 - RNA, 42 nt, Mus musculus
aaauuuagacauggguuaagaguuuggcuaaacgcaggaggu

SEQ ID NO: 93029 - RNA, 46 nt, Mus musculus
aggcucuuaccacccucuguccggucuuccuccaggguuuccagau

SEQ ID NO: 93030 - RNA, 42 nt, Mus musculus
aucuauagauauggagacuugaucuagcauucugggggagug

SEQ ID NO: 93031 - RNA, 41 nt, Mus musculus
aguuccuugcucacuccccccaacccccacuccugccccau

SEQ ID NO: 93032 - RNA, 46 nt, Mus musculus
uucuccaccuuuuggaagugggaaagaggaaaaccuccaaugagaa

SEQ ID NO: 93033 - RNA, 46 nt, Mus musculus
gcugagagagaaggcaucuguaagaacaauuauaggggauuuagac

SEQ ID NO: 93034 - RNA, 25 nt, Mus musculus
uggguaacaggcagggugagugugg

SEQ ID NO: 93035 - RNA, 41 nt, Mus musculus
agaagaaaagggggccucuggccucggggaggagcggugga

SEQ ID NO: 93036 - RNA, 45 nt, Mus musculus
agucuaggugugcugagguucaaagcgcacccacucuccagaaag

SEQ ID NO: 93037 - RNA, 41 nt, Mus musculus
uguguguguguguguguguguguguguuggguguugcgggg

SEQ ID NO: 93038 - RNA, 45 nt, Mus musculus
cgauccgauuaccugcgcggguuaccgcgccccaucccgccgccc

SEQ ID NO: 93039 - RNA, 41 nt, Mus musculus
ggggggggggcaacccaggaaagggggccuccugucuccgg

SEQ ID NO: 93040 - RNA, 62 nt, Mus musculus
ggcagagaguugagggcucucagcuuucggggggagaaagggucuguuugcuuauugggugg

SEQ ID NO: 93041 - RNA, 45 nt, Mus musculus
ccuaaagggacaaacaaacaaacaaacaaaguuacaccucgaguc

SEQ ID NO: 93042 - RNA, 45 nt, Mus musculus
ggauaaaguuuuccaaaguuuuucgugugugaugguugcugggag

SEQ ID NO: 93043 - RNA, 44 nt, Mus musculus
cgcagaacagccaaaagcugggaaccagggaggggauccaggag

SEQ ID NO: 93044 - RNA, 44 nt, Mus musculus
uuuaaggagggggaagcugagacaauaugcccugcggcuguagu

SEQ ID NO: 93045 - RNA, 42 nt, Mus musculus
gcgguguccucuaaccuguccuugaguuucugggcaccagag

SEQ ID NO: 93046 - RNA, 45 nt, Mus musculus
uggaugaugcuggugggaggaagggggccugaaugggaagaccaa

SEQ ID NO: 93047 - RNA, 45 nt, Mus musculus
uaccauugcucuagcacaucuuucaggcaagccaccauuguagau

SEQ ID NO: 93048 - RNA, 42 nt, Mus musculus
gaagagucacagaagaauacacaaaacuuacuagccagcaga

SEQ ID NO: 93049 - RNA, 46 nt, Mus musculus
ucuugaacacgccucacccuugccauagcaaucucaaacaccagca

SEQ ID NO: 93050 - RNA, 78 nt, Mus musculus
ccugggcuggcccugcauuugugcauucuuccucaaagagagcauauguauuuuuuuauuaaccccuguacaguuuuc

SEQ ID NO: 93051 - RNA, 55 nt, Mus musculus
ggaugaaagauacuagccgcaagaauaacauguuugcacaguuccggaaaaauga

SEQ ID NO: 93052 - RNA, 45 nt, Mus musculus
aguaucuccgggugaacccugugacagcucugacccugcuugaga

SEQ ID NO: 93053 - RNA, 35 nt, Mus musculus
aggacauuagcaagucuacaaaaugagaauauagg

SEQ ID NO: 93054 - RNA, 46 nt, Mus musculus
uccuaccauucuuuguucucuguggaaucuauauagcaugcuagaa

SEQ ID NO: 93055 - RNA, 46 nt, Mus musculus
auuuaaaauaauaauuaguaacuaaaauauaauuagcaacuauaau

SEQ ID NO: 93056 - RNA, 42 nt, Mus musculus
ggauaaaaagguaaccuguggaaaguuauaguggugugugug

SEQ ID NO: 93057 - RNA, 45 nt, Mus musculus
aacacacacacacacacacuuuccuaaauucccaugggucuagau

SEQ ID NO: 93058 - RNA, 46 nt, Mus musculus
auuauuguuggcauuuaugauuuaggaagagaaggaagcacaagau

SEQ ID NO: 93059 - RNA, 45 nt, Mus musculus
gccaaauucguuuggagguguagagcuaaaucuaagggacuagga

SEQ ID NO: 93060 - RNA, 47 nt, Mus musculus
ugcaaggccagaguaaagaaaaugugcuucuuaaugucugauaguga

SEQ ID NO: 93061 - RNA, 46 nt, Mus musculus
guccuggaaaacaccuggucccuuaacuuugaaauagacagcagau

SEQ ID NO: 93062 - RNA, 42 nt, Mus musculus
cuggacaguuggugcagaugggguucauuugaggucaggagg

SEQ ID NO: 93063 - RNA, 46 nt, Mus musculus
aaaguuugugcuacucagcuaccuaccagauugacacugggaagag

SEQ ID NO: 93064 - RNA, 45 nt, Mus musculus
ccucugugaaugucgaacacauucagucuagagauaucuggugag

SEQ ID NO: 93065 - RNA, 46 nt, Mus musculus
cauugacaaugaccucaccugucuguuuuaaaaguucaccccucaa

SEQ ID NO: 93066 - RNA, 41 nt, Mus musculus
ugugugugucugugugugugucugugugugugugucuuugg

SEQ ID NO: 93067 - RNA, 45 nt, Mus musculus
ggacacauaauaacagauccugaagaaauccaaaacaccaucaga

SEQ ID NO: 93068 - RNA, 45 nt, Mus musculus
uugcuuucuguuugacugcuuuuuaaaaaaucccuuuccccacag

SEQ ID NO: 93069 - RNA, 45 nt, Mus musculus
uguuuuagaaaaauacuagucacugggcuuagggugcauccaucu

SEQ ID NO: 93070 - RNA, 23 nt, Mus musculus
aacaguuucuaguaguagucuag

SEQ ID NO: 93071 - RNA, 46 nt, Mus musculus
guuguaguggcucuaaguuuaaugucucaccuaaauagcaccaguu

SEQ ID NO: 93072 - RNA, 42 nt, Mus musculus
gcucggcacacaguccgcuuuauauuacuaaaagacccagug

SEQ ID NO: 93073 - RNA, 45 nt, Mus musculus
ccaucugggugcagcuuuauguucugaccacugaaugcuaaagau

SEQ ID NO: 93074 - RNA, 45 nt, Mus musculus
acaacccugggugauaaugcugcugaagcauacaguaaagcagau

SEQ ID NO: 93075 - RNA, 69 nt, Mus musculus
gcguuuaccagguggauucacuuucuucccucccugauaaggcagggagggaccuugacacacccagac

SEQ ID NO: 93076 - RNA, 71 nt, Mus musculus
gggcacuuauccaaggugaccucuucaucacccucuggcacccuggcucaccccgcuucacuacccagcca

SEQ ID NO: 93077 - RNA, 47 nt, Mus musculus
uaauuggauuucauucauaagagagaaguuucccagugcgccaaaua

SEQ ID NO: 93078 - RNA, 46 nt, Mus musculus
uuagggacuggguaucuuccccaguaggcccugccuccuuguagau

SEQ ID NO: 93079 - RNA, 46 nt, Mus musculus
cuccccagacacacacaaagauauauaucucauuaauucccaagau

SEQ ID NO: 93080 - RNA, 46 nt, Mus musculus
caaaucuaauuccacaauuauuugaucccaguugugugucucagug

SEQ ID NO: 93081 - RNA, 82 nt, Mus musculus
aaacacaagaaaaggaaaggaaaggaaaggaaaggaaaggaaaggaaaaaggaaaggaaaaauaaaaggaaaggaaaggcaa

SEQ ID NO: 93082 - RNA, 46 nt, Mus musculus
cccugggcuguugguucugggugcuaagagagcaggcugagcaagc

SEQ ID NO: 93083 - RNA, 48 nt, Mus musculus
auucaaaccacugcagggcaguuugcauguuuacauugaguagagggu

SEQ ID NO: 93084 - RNA, 41 nt, Mus musculus
ugcuggcaagguagcccggggcucgagucucgagucucgag

SEQ ID NO: 93085 - RNA, 46 nt, Mus musculus
ucaagcuauauauagcuagaggucucagauuucaaaaugcccagug

SEQ ID NO: 93086 - RNA, 45 nt, Mus musculus
gaaggaagggaggaagggagagagggagaaaggagccaugccaga

SEQ ID NO: 93087 - RNA, 46 nt, Mus musculus
gugaggagcaccuaaaaagagaaagccaaaaggcuuaguuccagug

SEQ ID NO: 93088 - RNA, 46 nt, Mus musculus
aagaacaacaaguguaucugcugagccaacucuccuguccccaguc

SEQ ID NO: 93089 - RNA, 46 nt, Mus musculus
uaccaguaaugucaucaaacagaucugaagaaauauauuaaaagug

SEQ ID NO: 93090 - RNA, 45 nt, Mus musculus
aaaauauguaaacagaacgugucuaaguauagcaugggcucauga

SEQ ID NO: 93091 - RNA, 46 nt, Mus musculus
ugucaaaaaguuugcuuucucugucccucucaaaacaugcccagaa

SEQ ID NO: 93092 - RNA, 46 nt, Mus musculus
acagguccugggacggggucaucagacuugagagcaggcaccauca

SEQ ID NO: 93093 - RNA, 46 nt, Mus musculus
aaguucagaaaccaugaauggauaaaggaauaaagacuggugagaa

SEQ ID NO: 93094 - RNA, 42 nt, Mus musculus
agacaggaguuagcuugacuguccacauauuuuacugcagcu

SEQ ID NO: 93095 - RNA, 42 nt, Mus musculus
ucuguucucgcugucaucagaaguccuuccugcuggccauaa

SEQ ID NO: 93096 - RNA, 42 nt, Mus musculus
gcacaaagauuccuggagaauaguacuaggggcuguauagga

SEQ ID NO: 93097 - RNA, 45 nt, Mus musculus
ucuaucucuuucucuuuguguguguguauauaucaguguguguau

SEQ ID NO: 93098 - RNA, 46 nt, Mus musculus
gaaccaugugugguguucaaaauucuauuaaucagcaaugcuagau

SEQ ID NO: 93099 - RNA, 44 nt, Mus musculus
caaagaaaaugucauucucaguaguuuguaacucugguaccuau

SEQ ID NO: 93100 - RNA, 41 nt, Mus musculus
gggguauaggaagaaaagguaggugggggccaagcgggaga

SEQ ID NO: 93101 - RNA, 45 nt, Mus musculus
uagacuaugaaacauuauuuaacuuccccccaguuggccuuagug

SEQ ID NO: 93102 - RNA, 45 nt, Mus musculus
aauaacagcuucaauucauucgaugucucgagcgcgcccccaacu

SEQ ID NO: 93103 - RNA, 46 nt, Mus musculus
gaggcugaggucgccucccaagccagguggacaccuguccucuggu

SEQ ID NO: 93104 - RNA, 46 nt, Mus musculus
auuucaguuuucaaauaccacugugaaaauuaagaaaaaugcagaa

SEQ ID NO: 93105 - RNA, 45 nt, Mus musculus
acuagcucauguaugcugccugguugguagcucagugucugagag

SEQ ID NO: 93106 - RNA, 45 nt, Mus musculus
cauacagaacagauugucuuugauucuuaggugugcaguucagua

SEQ ID NO: 93107 - RNA, 45 nt, Mus musculus
caccacugcucagcuaguguagacauuucuagaaagagccaagau

SEQ ID NO: 93108 - RNA, 29 nt, Mus musculus
guuaaaaagaaauucuauucugugccuuu

SEQ ID NO: 93109 - RNA, 45 nt, Mus musculus
caguuucacagggagggaaggcaugaugagugauaggcagugauu

SEQ ID NO: 93110 - RNA, 45 nt, Mus musculus
ccaaaggagccccucuuuauagcucccuccucaagcuauucagag

SEQ ID NO: 93111 - RNA, 45 nt, Mus musculus
uguuuucaaacaugauuuaguggauuguuuuguuucauuugauga

SEQ ID NO: 93112 - RNA, 46 nt, Mus musculus
gugcccacuauagugguaguguuuguuaaguuaaguagguccagaa

SEQ ID NO: 93113 - RNA, 45 nt, Mus musculus
uagacaaaaagugugaugugaccucaaagugagugggccucagag

SEQ ID NO: 93114 - RNA, 46 nt, Mus musculus
agacaucaaauacagaacaacugguagcacugaaauccccuuaagc

SEQ ID NO: 93115 - RNA, 42 nt, Mus musculus
cgggaagcucacugacacggccuucuguguuccuacccccaa

SEQ ID NO: 93116 - RNA, 46 nt, Mus musculus; identical to SEQ ID NO: 72162

SEQ ID NO: 93117 - RNA, 47 nt, Mus musculus
gcaaggcaaaagacaccaucaauaagacaaaaaggccaccaccagau

SEQ ID NO: 93118 - RNA, 46 nt, Mus musculus
ucuaguuuuauugcagcuugacacaagcuagagucauuguaaagga

SEQ ID NO: 93119 - RNA, 65 nt, Mus musculus
agaggggccuagaucuugaagguaucccagacauuggauacugaguuauuuacacaguuggaguu

SEQ ID NO: 93120 - RNA, 65 nt, Mus musculus
agcuuaggagaaaaucugugaggguguuguauaggguggagucugaaaagugacccaggcagauu

SEQ ID NO: 93121 - RNA, 82 nt, Mus musculus
cccagauggcacugguuuugaaggcaugaaaugguccauggagaguaucugagucuuggcacuauguggcagggcugcaguc

SEQ ID NO: 93122 - RNA, 46 nt, Mus musculus
cuucuugaguucuucauauguuucagauauuagcccucugucagau

SEQ ID NO: 93123 - RNA, 46 nt, Mus musculus
uucuuuugugauugggugacuucacucagaauaauauccuccagau

SEQ ID NO: 93124 - RNA, 41 nt, Mus musculus
cuguauacaccuuugggggcuagaauugagugucaggugcc

SEQ ID NO: 93125 - RNA, 46 nt, Mus musculus
uuucuuacaguuuuauuuuaauuauuuuuauuuauaagugugugug

SEQ ID NO: 93126 - RNA, 46 nt, Mus musculus
aaacagagauggggacacuuccucaaccuuauuaaaaauaucuaua

SEQ ID NO: 93127 - RNA, 47 nt, Mus musculus
ggaucagcacuuagacagcauguggugagagucaucauauaaaacag

SEQ ID NO: 93128 - RNA, 42 nt, Mus musculus
auacccauuuuuucuaauguuuuucuagaaaguuauagcaga

SEQ ID NO: 93129 - RNA, 45 nt, Mus musculus
acuuuccuuccuccuguuucucccaugugcaucccacccccaaau

SEQ ID NO: 93130 - RNA, 46 nt, Mus musculus
uuacucccaauaguuagauauuuuuuuuaauuuuaagcccacagca

SEQ ID NO: 93131 - RNA, 46 nt, Mus musculus
uaaauggggacaauggcaucgcauguuucauuggguuguuucagga

SEQ ID NO: 93132 - RNA, 45 nt, Mus musculus
aaaguuuccuuucucugaauuugugccaaaaguuuacaaccagau

SEQ ID NO: 93133 - RNA, 46 nt, Mus musculus
cugcaccugucuagacuuguguuauugucuuuuguuguucacagag

SEQ ID NO: 93134 - RNA, 46 nt, Mus musculus
augaucauauccaacaaaacaugugaaagaggacauuugggaaaau

SEQ ID NO: 93135 - RNA, 46 nt, Mus musculus
agcaauaaacuagcuuccccccuugcccucccucaaaccugcagau

SEQ ID NO: 93136 - RNA, 46 nt, Mus musculus
caagauuguacauauuaauaaaagcaaaaauaaacaaaaggaaggu

SEQ ID NO: 93137 - RNA, 45 nt, Mus musculus
auauuuaaguggaguuugacuuuaguaaguagaauaacaagagag

SEQ ID NO: 93138 - RNA, 46 nt, Mus musculus
ggagugcugagcagacagaauauguugaguuauuuucuccacaggu

SEQ ID NO: 93139 - RNA, 46 nt, Mus musculus
uguuauuuuuuuuauuacuuaguucucaaauugcuuggcaguagau

SEQ ID NO: 93140 - RNA, 46 nt, Mus musculus
gucaguaacuaaaaagaggcuaugaauuugcaaggaaaugggaggg

SEQ ID NO: 93141 - RNA, 55 nt, Mus musculus
cuuccccuaugcugggauugaccauaugccccuguggcagaugugugcgugugug

SEQ ID NO: 93142 - RNA, 49 nt, Mus musculus
augguuguuguuguuguuuuuaaucuauugauuuguguguguguaugug

SEQ ID NO: 93143 - RNA, 46 nt, Mus musculus
guccugggagcaggaauagaaggggaagugggugcucucugcagau

SEQ ID NO: 93144 - RNA, 46 nt, Mus musculus
gguuuaaaucuucaauuuacagcuuaaaaacauauaguuuaaagau

SEQ ID NO: 93145 - RNA, 46 nt, Mus musculus
cugaaaucagcagaucuguucuccacauuuauguagggccuggugu

SEQ ID NO: 93146 - RNA, 46 nt, Mus musculus
aauuucacauuucuuacuuauuucauaccuaucuuccagcaaauuu

SEQ ID NO: 93147 - RNA, 46 nt, Mus musculus
acacuguuauuggguuuuccugaguaucauaucuugaccuguagau

SEQ ID NO: 93148 - RNA, 42 nt, Mus musculus
acuuagcaucaaugugucucuuacacuucacuggcccugcag

SEQ ID NO: 93149 - RNA, 46 nt, Mus musculus
uacaguuuuuaauacuucucuaauuucucuaguguaugaaauggau

SEQ ID NO: 93150 - RNA, 46 nt, Mus musculus
caggaaauguuuaacuauuuuaaucauguuuuuguagccccaaaga

SEQ ID NO: 93151 - RNA, 45 nt, Mus musculus
uaugggguagcgugugguagaacacuacugcuccucaucagagag

SEQ ID NO: 93152 - RNA, 46 nt, Mus musculus
caaaacagauaguuaauagaucauuaaaguuaauuuugggcuaggg

SEQ ID NO: 93153 - RNA, 42 nt, Mus musculus
ccauuguauuuuuguagacagucuuucugugaaccuggagau

SEQ ID NO: 93154 - RNA, 46 nt, Mus musculus
ccuacugugacguucugaccuucauucuugucguucuucagcagac

SEQ ID NO: 93155 - RNA, 45 nt, Mus musculus
agucugugggccauguuccuuugcuuuauccagugagguucagag

SEQ ID NO: 93156 - RNA, 78 nt, Mus musculus
aaguuugcacugugguuuauggaaacagaagcuagucacagucuaaacccuuagagaauauauacccaaaauacugac

SEQ ID NO: 93157 - RNA, 46 nt, Mus musculus
uguuacagcugacucuaacuucagcaugcacacacauggggauaaa

SEQ ID NO: 93158 - RNA, 42 nt, Mus musculus
uucagugauguaaagugcuugcuguuuuugcagaggccaaga

SEQ ID NO: 93159 - RNA, 46 nt, Mus musculus
gacuucuuuuucuguucuggauauuaaucguuuguuaguuggagag

SEQ ID NO: 93160 - RNA, 45 nt, Mus musculus
aaaggaaaucuaagaaagauguuuauacaaucuuugaugcagagg

SEQ ID NO: 93161 - RNA, 46 nt, Mus musculus
uuggguuuucuuugauuauuuuucauugcauuuauuggucagaguu

SEQ ID NO: 93162 - RNA, 45 nt, Mus musculus
gaaagaaugcuguacuuaaccugagaucaugaaugcucgccuuuu

SEQ ID NO: 93163 - RNA, 46 nt, Mus musculus
ucucucucucucucucucucuguguguguguguguguuaggugucu

SEQ ID NO: 93164 - RNA, 42 nt, Mus musculus
gccucuuucugguagguuauccuguaauuuuaggggccagau

SEQ ID NO: 93165 - RNA, 86 nt, Mus musculus
agucccugagguuguguucauuuucuucuggauuuguagcccagauuucugauaaagccagaaugagggaugaggcuuaggggguc

SEQ ID NO: 93166 - RNA, 45 nt, Mus musculus
gguauguagauauguuauaucauuuuuaaugugaauauaugagga

SEQ ID NO: 93167 - RNA, 46 nt, Mus musculus
uaugguacucuuuaaaagacguagauacugcauauaggucccaugu

SEQ ID NO: 93168 - RNA, 46 nt, Mus musculus
uuuuccuuuuuuuucuuuuuuccuuucuugguaacagacaggcaau

SEQ ID NO: 93169 - RNA, 45 nt, Mus musculus
uucaaguggauauugcaaucaaugucuuaaaguuuugccugaguu

SEQ ID NO: 93170 - RNA, 46 nt, Mus musculus
auauuuuauuaguuuaguccuuuucuuuguauggaaagccugcauu

SEQ ID NO: 93171 - RNA, 46 nt, Mus musculus
acuucccccaucuccugugugugugugugugugugugugugugugu

SEQ ID NO: 93172 - RNA, 46 nt, Mus musculus
gauacuaaaugagagagagugaguguugaaaauguggcaugugggg

SEQ ID NO: 93173 - RNA, 45 nt, Mus musculus
uuuuagugguguugagacuaugaauaacaccagcuuucgggagaa

SEQ ID NO: 93174 - RNA, 45 nt, Mus musculus
acaggcacacaggcacacaggcacacacacacacacacacacaca

SEQ ID NO: 93175 - RNA, 46 nt, Mus musculus
gugccuaugaugacuuugagcagagaugagguuaaauguagcagga

SEQ ID NO: 93176 - RNA, 45 nt, Mus musculus
ggcaguggagucuauauaguacugaaaaauauucagaacccaaga

SEQ ID NO: 93177 - RNA, 48 nt, Mus musculus
ugaugguuauguugcagcacagaucgaaauuaugggcacugauggcag

SEQ ID NO: 93178 - RNA, 37 nt, Mus musculus
ucuggagaauguguggcauuugggaucuugaacagag

SEQ ID NO: 93179 - RNA, 45 nt, Mus musculus
auuuuguauguguguguugaaagagaagcagagagauagacagac

SEQ ID NO: 93180 - RNA, 46 nt, Mus musculus
gggagcaaaggggccucacacaggggcuagugaagauggucaaggc

SEQ ID NO: 93181 - RNA, 42 nt, Mus musculus
ugaaaguaauauagauaaccauaguucccccucuccuauuga

SEQ ID NO: 93182 - RNA, 39 nt, Mus musculus
uuauuugugugugcuuuuauaaaguuguuaguaugauau

SEQ ID NO: 93183 - RNA, 46 nt, Mus musculus
cuucucucacaaguguuuucauauuauauuuuccauguaagcagau

SEQ ID NO: 93184 - RNA, 45 nt, Mus musculus
cuagcagaugcagcagugggcccuaauaaucaaaaaagcucagua

SEQ ID NO: 93185 - RNA, 46 nt, Mus musculus
uagaauauucuuguuuguaucuacagcuucucauugggcgguauag

SEQ ID NO: 93186 - RNA, 46 nt, Mus musculus
auggguguugguucuuuucuaccauguuuguccugggauggaagau

SEQ ID NO: 93187 - RNA, 42 nt, Mus musculus
uucaaacacauggaaagguucuuaauguaacucucggcagua

SEQ ID NO: 93188 - RNA, 46 nt, Mus musculus
aagauggggaagagaagauagaguuuaauuguuauuggcugugggu

SEQ ID NO: 93189 - RNA, 59 nt, Mus musculus
ugacuugggcuauacuggaagauguuaucuaagacgagaaagaaagcaaacaaaauaaa

SEQ ID NO: 93190 - RNA, 46 nt, Mus musculus
guugucucccaucaucccaaggaaaagaaaugugggcgugguagga

SEQ ID NO: 93191 - RNA, 46 nt, Mus musculus
augucaguguuucuguccugcauuccuuuccucucucgguuuaacc

SEQ ID NO: 93192 - RNA, 46 nt, Mus musculus
acagagaaagaaaauagcagagauauagagacagacaagcagagag

SEQ ID NO: 93193 - RNA, 45 nt, Mus musculus
cugugucucuaucuugaaguguuuuuccucuagcguuccagaguu

SEQ ID NO: 93194 - RNA, 46 nt, Mus musculus
cagccccaguaucuguuucuuaagucugucauuuugacugggguga

SEQ ID NO: 93195 - RNA, 46 nt, Mus musculus
ucacgcugcugaaaugccuucaggcguuguuuaugagucugcaguc

SEQ ID NO: 93196 - RNA, 46 nt, Mus musculus
aguuucauguguuuuccacauuuuuucuccauauuugcugccauga

SEQ ID NO: 93197 - RNA, 41 nt, Mus musculus
uuucagcaaaaucuuguuaguguaugcaaugguguuagugu

SEQ ID NO: 93198 - RNA, 58 nt, Mus musculus
ugaaacacacgcuggacggagaugcuaagcaacacugcacugaacgcuucagggaugc

SEQ ID NO: 93199 - RNA, 46 nt, Mus musculus
guagaagguaacuauguugagaauaagcaacuuauuugggcaggcc

SEQ ID NO: 93200 - RNA, 46 nt, Mus musculus
uuaaaauuuucuuuucuuuuuuuuuuuuuuaugugcgugaaguaga

SEQ ID NO: 93201 - RNA, 45 nt, Mus musculus
ugggaugccuuguuuugugccacuaugaucccagugaugggaaga

SEQ ID NO: 93202 - RNA, 44 nt, Mus musculus
ugcaaucccaccaacaauggaggaguguuccccuuuccccacau

SEQ ID NO: 93203 - RNA, 46 nt, Mus musculus
gucugucuauguagauaggguuagacaauuauguggauuucaagga

SEQ ID NO: 93204 - RNA, 46 nt, Mus musculus
ugcuuguagaauacuagcugacaaagggagucugaggcagguaucg

SEQ ID NO: 93205 - RNA, 42 nt, Mus musculus
uggggccggagagacuucucuaguaguaaaguaccugcaaac

SEQ ID NO: 93206 - RNA, 85 nt, Mus musculus
uuuuuccaguuuguuuuccauuuuuguguuuuuguggcaguuugggguguguguguuuaaaaauagaaagagaaagggccuggag

SEQ ID NO: 93207 - RNA, 46 nt, Mus musculus
cccacaaacuggugguaaggcccuauuacugaagacagcacuuacg

SEQ ID NO: 93208 - RNA, 41 nt, Mus musculus
uuugaaaccuauuucuggaacucuuguuauggaaucuguuu

SEQ ID NO: 93209 - RNA, 41 nt, Mus musculus
uguuuggguuggugggugaguacccuuauagaagcaggggg

SEQ ID NO: 93210 - RNA, 44 nt, Mus musculus
auaguucugcauacauggcagaggauuuccuuguuggacaugag

SEQ ID NO: 93211 - RNA, 45 nt, Mus musculus
agggacugaaggaacugaggggguuugcagccgcauggcggaagc

SEQ ID NO: 93212 - RNA, 45 nt, Mus musculus
uggcugucucccaagaggcucugccagagccugacaaauauagag

SEQ ID NO: 93213 - RNA, 46 nt, Mus musculus
ucucccuaucuauucaauauaguacucaaaguucuagcuagaacaa

SEQ ID NO: 93214 - RNA, 45 nt, Mus musculus
aaacaacacaaaacugggccuucuagguuaagcaggcuguugcaa

SEQ ID NO: 93215 - RNA, 58 nt, Mus musculus
gugauugcugaaagggaaggagaaaggaaggaggaaggaagaaggaaggugcugggga

SEQ ID NO: 93216 - RNA, 68 nt, Mus musculus
uauaauaagcauauauaugacaugguaacaggagauaaccaaaggaggaggaagguauaaaaacagug

SEQ ID NO: 93217 - RNA, 46 nt, Mus musculus
ucuaugaacccuuuuuuguauucuauauuaaaaugcaggaauaaau

SEQ ID NO: 93218 - RNA, 72 nt, Mus musculus
ugguuaauauacacaauucacccauaaaggaaaaugaaauuagggcauuugcuggaaaauguagcauggaga

SEQ ID NO: 93219 - RNA, 64 nt, Mus musculus
caugauagccaagguauaaaaccaaccuuagcacccauuaccagaugaauggauaaagaaaaug

SEQ ID NO: 93220 - RNA, 46 nt, Mus musculus
acaucuuuagcuaccaggaaaacguaaacuaaaccuauacagagau

SEQ ID NO: 93221 - RNA, 46 nt, Mus musculus
ccuaugcagguuuccccuuuuuggucuacuauuugaugccuuaggu

SEQ ID NO: 93222 - RNA, 46 nt, Mus musculus
accaggugacggacacuaauaggaaacugcagcacgagggcaagga

SEQ ID NO: 93223 - RNA, 46 nt, Mus musculus
uggggcagauacuuuaguucccacuuuucaaauagagaguccaggu

SEQ ID NO: 93224 - RNA, 42 nt, Mus musculus
auggacgauucauggagaagcuagaaacucguauccgcaauc

SEQ ID NO: 93225 - RNA, 46 nt, Mus musculus
uaucaaccauauugaacuuguugguaacacaaaugugcaucaaguc

SEQ ID NO: 93226 - RNA, 45 nt, Mus musculus
uuuuucuuuccaaggaaggggaaugaaucuugauggcuguguuuu

SEQ ID NO: 93227 - RNA, 23 nt, Mus musculus
ucagaccccugccucagccuccu

SEQ ID NO: 93228 - RNA, 42 nt, Mus musculus
acaauuuauaguuugaggguauucuugaggguuaagcaaggu

SEQ ID NO: 93229 - RNA, 41 nt, Mus musculus
gaggauacaguucaucauggugggaaaggcaggguggcaag

SEQ ID NO: 93230 - RNA, 45 nt, Mus musculus
aauaacuauucuaggaggauuauuauuuuagucacuguucuauug

SEQ ID NO: 93231 - RNA, 46 nt, Mus musculus
uuuuauauuucucuuuucuuuuuucuuuuauuuugagacgggguau

SEQ ID NO: 93232 - RNA, 45 nt, Mus musculus
ucauuaaaaauuacacuuuaaggaaaauauuagaaacagaaaggu

SEQ ID NO: 93233 - RNA, 45 nt, Mus musculus
uuuugauaaaauuuuaagaauuuggucucauguuaaccccaaagu

SEQ ID NO: 93234 - RNA, 45 nt, Mus musculus
uaaacacuuuuaacaauugagucauaucaucucccacccccgaga

SEQ ID NO: 93235 - RNA, 42 nt, Mus musculus
ggguggaccaacucaaaagcccuggaucuggcugggccuggg

SEQ ID NO: 93236 - RNA, 46 nt, Mus musculus
ccuacaaaauauaauaaaauaggauauaauaacaacaacaauaaua

SEQ ID NO: 93237 - RNA, 45 nt, Mus musculus
uuccaggacagccagggcuacauagaagcuauccccaccccaacc

SEQ ID NO: 93238 - RNA, 45 nt, Mus musculus
auagguuuagauccuccaucuuucuguuuguuuuguuuguccauc

SEQ ID NO: 93239 - RNA, 47 nt, Mus musculus
agcuagaggcagagcuagaggcaggagaggcaggagaggcaggagag

SEQ ID NO: 93240 - RNA, 46 nt, Mus musculus
aacaucacaaacagauucaggaggucuuuagugaauuagucuagau

SEQ ID NO: 93241 - RNA, 46 nt, Mus musculus
cuuguugugauuuuuuucagaaaccuguuuguauucugagagagag

SEQ ID NO: 93242 - RNA, 45 nt, Mus musculus
ucuuuugucaaauauguuagagaacugaagguuuagauaggagau

SEQ ID NO: 93243 - RNA, 46 nt, Mus musculus
cucucucucucucucucucugccucucucucugcuucucucugugu

SEQ ID NO: 93244 - RNA, 47 nt, Mus musculus
uggucaucccuuauggccauguuuucaugauucacuuaccccaugac

SEQ ID NO: 93245 - RNA, 54 nt, Mus musculus
aucucaaucagggauuucuacccugccuuugaucauuuaguucccagaugaaag

SEQ ID NO: 93246 - RNA, 46 nt, Mus musculus
gcuccuguccguaauaguguccgugcagcuuccccuugugcuagau

SEQ ID NO: 93247 - RNA, 26 nt, Mus musculus
gaacuacuaguuuauaccuaguaaga

SEQ ID NO: 93248 - RNA, 42 nt, Mus musculus
ggagggagggagguagggaggaagggagagagagagugagag

SEQ ID NO: 93249 - RNA, 45 nt, Mus musculus
auggaauauggccaccuccuugaauuucauuuucauaaccuuuga

SEQ ID NO: 93250 - RNA, 46 nt, Mus musculus
uuuucauaacuaaagaggaagguuccacaaguccuuuacugcugua

SEQ ID NO: 93251 - RNA, 45 nt, Mus musculus
agagagacugagaauacauguauguuauggcauauauguggaggu

SEQ ID NO: 93252 - RNA, 49 nt, Mus musculus
uuuacauuuacuucauuuauuuaguaugugagagagagagagugcguga

SEQ ID NO: 93253 - RNA, 46 nt, Mus musculus
cagugagcuccaguuucagcgagagagucuuacuuaagauauaggu

SEQ ID NO: 93254 - RNA, 46 nt, Mus musculus
gauuaaaaacagaaaaaaaaaagacaauguaaguguugguaaagau

SEQ ID NO: 93255 - RNA, 42 nt, Mus musculus
uccagaaaagaccauuuuuaugcagcaaggaguugccaagug

SEQ ID NO: 93256 - RNA, 46 nt, Mus musculus
gcaaauaguauaaauaagagaaagagagagagagacagagagagag

SEQ ID NO: 93257 - RNA, 46 nt, Mus musculus
cugcccagguaaaguacaggaauaccugagugcuacagccacugag

SEQ ID NO: 93258 - RNA, 46 nt, Mus musculus
uuguucagugccuguggaggccaggagaggauguugaaucagagag

SEQ ID NO: 93259 - RNA, 46 nt, Mus musculus
ugauguguaugggggugcauccacgcuauggcgcuuggguggagau

SEQ ID NO: 93260 - RNA, 46 nt, Mus musculus
cuauguuuuguuuucuguguggacauauguuuucauuucuggagau

SEQ ID NO: 93261 - RNA, 42 nt, Mus musculus
uacaaccaucuguaaugagaucugacguccucugcuggugca

SEQ ID NO: 93262 - RNA, 46 nt, Mus musculus
cccugccccaggugauuuuuaacucccguuucuuauugugccaguu

SEQ ID NO: 93263 - RNA, 45 nt, Mus musculus
uguccuuaauaguuugucuuuccuccccucugcccacccccacaa

SEQ ID NO: 93264 - RNA, 45 nt, Mus musculus
aaucaucuuuaccccuccuuguacaauauauaucaaugcgccucc

SEQ ID NO: 93265 - RNA, 40 nt, Mus musculus
ugccaggcaagcccucuucagcugaacugugcacagccca

SEQ ID NO: 93266 - RNA, 46 nt, Mus musculus
ccuaccgcugggguacaguuaccguucccucuguaucagacgagau

SEQ ID NO: 93267 - RNA, 32 nt, Mus musculus
gcggcggagcacgagcggauccugagggagau

SEQ ID NO: 93268 - RNA, 46 nt, Mus musculus
cgggggccugagggucccggccccggucacaauggacaguuucuuc

SEQ ID NO: 93269 - RNA, 45 nt, Mus musculus
cacaaccgaagaagaaacuguccauugugaccggggccgggaccc

SEQ ID NO: 93270 - RNA, 47 nt, Mus musculus
gagcacgugcuggcguugaacaugcugugccuuaccgagggggccaa

SEQ ID NO: 93271 - RNA, 46 nt, Mus musculus
ucgcaguuccuguggccaaccucagguugucuugccagcccaugcu

SEQ ID NO: 93272 - RNA, 45 nt, Mus musculus
cugaugccggccagugauccgaacugggccagaaccggacuucag

SEQ ID NO: 93273 - RNA, 47 nt, Mus musculus
ucguuuguauaaacaacgaccuuucugaagaagaaagugaugaugag

SEQ ID NO: 93274 - RNA, 51 nt, Mus musculus
ugcuacaggugccaugcuccguauguuccuggacaaguucaagaaugguuu

SEQ ID NO: 93275 - RNA, 46 nt, Mus musculus
uuugaacaccucuucugacccaccuaacccagauucaguccccagc

SEQ ID NO: 93276 - RNA, 41 nt, Mus musculus
agucuuagcuugcauuaggggugucugcagagcuggggcag

SEQ ID NO: 93277 - RNA, 83 nt, Mus musculus
ucuuggggauguuuccaaaggcuuccucaacgugaaugaccuagcugaggugaacaacuacugggcucugaaccugaccucca

SEQ ID NO: 93278 - RNA, 53 nt, Mus musculus
cccugcagcccuacaagggcuggggucuguacugugcggggaaggcugcccga

SEQ ID NO: 93279 - RNA, 45 nt, Mus musculus
guaggugggugcuccugacagugcugucccuagacuuagcuggua

SEQ ID NO: 93280 - RNA, 30 nt, Mus musculus
uuuuuccauaacagcccuagagcaagagcu

SEQ ID NO: 93281 - RNA, 45 nt, Mus musculus
aacucaccaaagcuccccauagcugcugagcugaggcaggaaugg

SEQ ID NO: 93282 - RNA, 46 nt, Mus musculus
accguggcuaccauccgggccaucagcauuauacucgcagucucag

SEQ ID NO: 93283 - RNA, 52 nt, Mus musculus
ggcuguggccccugguuuugccugucuucauuuuucugagagaucuguagca

SEQ ID NO: 93284 - RNA, 46 nt, Mus musculus
ggauagugaucccuauugaccaaauuugggaacugcugcuacagau

SEQ ID NO: 93285 - RNA, 44 nt, Mus musculus
ugccaacucaaaacaccuugaaaacagaaggccauagaggaaga

SEQ ID NO: 93286 - RNA, 90 nt, Mus musculus
uggccuucuguuuucaagguguuuugaguuggcaagcccugccccagcugggaaguggcugagugugggcaaagugggaagggagaccug

SEQ ID NO: 93287 - RNA, 46 nt, Mus musculus
cucuuccacacggacgugugcauuugcuguguaggccaaggacaag

SEQ ID NO: 93288 - RNA, 82 nt, Mus musculus
ccaggagcaggcaauuguccacaaacuccuaaagggcaaguucaaggucggcuuucucccacagcccuuaccccagccccuc

SEQ ID NO: 93289 - RNA, 45 nt, Mus musculus
aagacucugaggaaggcagcagcagacacaucagguuuucuggag

SEQ ID NO: 93290 - RNA, 45 nt, Mus musculus
ucaccucaccaauuucacaacucucugacccguggagccccagcc

SEQ ID NO: 93291 - RNA, 45 nt, Mus musculus
auacauaaaauuuaaauuaaaaauacaaaaaaaaugaaggcagau

SEQ ID NO: 93292 - RNA, 45 nt, Mus musculus
auuaugaauccaccauaauuacagaggaaguauuagcugggagaa

SEQ ID NO: 93293 - RNA, 44 nt, Mus musculus
uuucagcuuuccucccacugaaggcgacccuggugacagcuaga

SEQ ID NO: 93294 - RNA, 42 nt, Mus musculus
caggcccaagaugccagacaugagguugaagagggccuccgg

SEQ ID NO: 93295 - RNA, 45 nt, Mus musculus
ugugcgcgcccuggggcguccgugggggucccucugcugcaggau

SEQ ID NO: 93296 - RNA, 46 nt, Mus musculus
cgcacaggcgccuguggccuuggugggggugggaaugguacugcgc

SEQ ID NO: 93297 - RNA, 41 nt, Mus musculus
ggcgaccgaggaggcccugaccucugaggagagugggagac

SEQ ID NO: 93298 - RNA, 42 nt, Mus musculus
guuuuguuuuguuuguuuguuuuuguuuuuaaaguagggcag

SEQ ID NO: 93299 - RNA, 45 nt, Mus musculus
gagagacguuuagcauuuaacaccuuaguuuuauugaagugcaag

SEQ ID NO: 93300 - RNA, 46 nt, Mus musculus
aggcuuuauguguuaugccaggcauuuugaggcuuuaucucuggag

SEQ ID NO: 93301 - RNA, 45 nt, Mus musculus
gaggacccgggcaaugcugucaggcaaaaaggguuuuagaacaag

SEQ ID NO: 93302 - RNA, 42 nt, Mus musculus
uaugagucacagggggucaaauuucugauggucuagugcgcu

SEQ ID NO: 93303 - RNA, 46 nt, Mus musculus
accgcaucugugguggcuuugagcaggugaugaauugucugggugg

SEQ ID NO: 93304 - RNA, 42 nt, Mus musculus
uaucuaauguaauaaguaggccaaauccugcuuagcuuccaa

SEQ ID NO: 93305 - RNA, 45 nt, Mus musculus
ccuggaacucacuguguagaccagacugaucuugaacucacagag

SEQ ID NO: 93306 - RNA, 46 nt, Mus musculus
uguaugugagagagagagagagagagagagagagagagagcgugug

SEQ ID NO: 93307 - RNA, 41 nt, Mus musculus
cagaagucuuaggcuacagaaaggauuuuaggauggaucag

SEQ ID NO: 93308 - RNA, 46 nt, Mus musculus
ccuguccagauccuuugggauuauaccugaauagaaaacaguccag

SEQ ID NO: 93309 - RNA, 46 nt, Mus musculus
ucaagaaagggauucuucccaaaccuuggcuaugucccagacugag

SEQ ID NO: 93310 - RNA, 46 nt, Mus musculus
ucaacuaaggauaugucuguguagauuuacuuuauuugauccuuag

SEQ ID NO: 93311 - RNA, 88 nt, Mus musculus
ccugcuugucuuuuaauguagaauggcuuucuuagcgcuucaccaaagauaaacuucaaguaacuuucaaaucaagguauucaaccau

SEQ ID NO: 93312 - RNA, 44 nt, Mus musculus
uauuguagguuucccuuuggagaaaggugguugaccuugcuggg

SEQ ID NO: 93313 - RNA, 45 nt, Mus musculus
uugugagcuaccaugugguugcugggauuugagcucagggccuuu

SEQ ID NO: 93314 - RNA, 46 nt, Mus musculus
uaaguuuuucucucucuguguguguguguguguguguguguguguu

SEQ ID NO: 93315 - RNA, 46 nt, Mus musculus
agaaauacuugggcaucuucucaggugcauaccagauauccagaga

SEQ ID NO: 93316 - RNA, 52 nt, Mus musculus
uaacacugaacuguuagcagaugacagcgaagagaaagaaccccuaaaacca

SEQ ID NO: 93317 - RNA, 45 nt, Mus musculus
aaguaccugaaauaccagucuacuccugggguguuugaaccagca

SEQ ID NO: 93318 - RNA, 47 nt, Mus musculus
aauagcaacuucagaaucuuggguuuuagaagauuuaaagcagcaga

SEQ ID NO: 93319 - RNA, 64 nt, Mus musculus
gaugcuaaguacuccagccuuuaugaaaaccuuggugcacagagugaaagaauugcuguauugc

SEQ ID NO: 93320 - RNA, 46 nt, Mus musculus
uccaucuucauugccuucauuuguuccucaagaaccaaccagugag

SEQ ID NO: 93321 - RNA, 45 nt, Mus musculus
accagauaauugguaaagcagcaucuacacauaccugaaaggcua

SEQ ID NO: 93322 - RNA, 44 nt, Mus musculus
caaugaugguuauagacuugcccucuugaaacuguaagccccgg

SEQ ID NO: 93323 - RNA, 45 nt, Mus musculus
uuuucaccaagaagaguugccagauaggcaucuuaaugaagagau

SEQ ID NO: 93324 - RNA, 57 nt, Mus musculus
ucuagaaccuaccagcacaaaaugaaaccugcuaauauuuaccaccaagaguugcca

SEQ ID NO: 93325 - RNA, 42 nt, Mus musculus
cuucuccugcaccagcugaccuaaacacuggggagccaccaa

SEQ ID NO: 93326 - RNA, 46 nt, Mus musculus
uggggaugcaguagaugcuuuucaucccgaaccaguuguccaggag

SEQ ID NO: 93327 - RNA, 46 nt, Mus musculus
uuauucacacagugaaaagcaccagcuuaucucagaacauguccaa

SEQ ID NO: 93328 - RNA, 45 nt, Mus musculus
ucuuuagguuuugccaaugcuggcugugaggaaaugcagaauaua

SEQ ID NO: 93329 - RNA, 46 nt, Mus musculus
agaaguuccacacauugaauauguacagaaggacauuggcacacag

SEQ ID NO: 93330 - RNA, 46 nt, Mus musculus
ugugaaacuucacugaaucaagccaaacagauacuuaaaaaugcag

SEQ ID NO: 93331 - RNA, 87 nt, Mus musculus
aauuuaggacgugaccguggauacuccauuucagaauuaaaugaagaugacagaaggaaaguagaagagauaaaagcaaaguuguuu

SEQ ID NO: 93332 - RNA, 42 nt, Mus musculus
acuaugaaaacuugaaagaugccacaggaggaaguaggccac

SEQ ID NO: 93333 - RNA, 46 nt, Mus musculus
aaauggauuuuccuuccucaucucaaauacugcccccugagcccaa

SEQ ID NO: 93334 - RNA, 71 nt, Mus musculus
uaacuccugaucuuccuucuugcauuuuucuugaacaaccagagcucuuugaggaaagccacaccccacau

SEQ ID NO: 93335 - RNA, 46 nt, Mus musculus
uuucuugagcagccaaaacucucugaacaaagcaaagccccacaug

SEQ ID NO: 93336 - RNA, 63 nt, Mus musculus
gauuucuuuauaggagauugaaucuaacuggucugguagaggucuuaagagguauguaaguaa

SEQ ID NO: 93337 - RNA, 46 nt, Mus musculus
uuuacuauuuauuuuuauauuggagauucucugaagauccugggag

SEQ ID NO: 93338 - RNA, 45 nt, Mus musculus
aagaaagaaggaagaaguguuuauucaaaaucuaugggaggggaa

SEQ ID NO: 93339 - RNA, 46 nt, Mus musculus
cauaagcaggucuggcuggcaugcacaaagcaaaugaaguggauug

SEQ ID NO: 93340 - RNA, 46 nt, Mus musculus
ccaguauugaacuggaauucuuuaugaaaguauugguagucugaag

SEQ ID NO: 93341 - RNA, 46 nt, Mus musculus
gcccugcuggcuuuguguuuuuuaauuacauuguaaucacggcagu

SEQ ID NO: 93342 - RNA, 42 nt, Mus musculus
agaagaaagcaaucacaaguguguguguguguauggggguag

SEQ ID NO: 93343 - RNA, 64 nt, Mus musculus
uguaggaacguauagaggaaguacuucaagacaugggcacacauaggguuugacuuccuguggc

SEQ ID NO: 93344 - RNA, 46 nt, Mus musculus
ucuacaaaagucaggucacaggaucagacuagauguucaacaggag

SEQ ID NO: 93345 - RNA, 46 nt, Mus musculus
acaugccagaugcaggcacacauauuacaucgaacuuucucucaua

SEQ ID NO: 93346 - RNA, 45 nt, Mus musculus
uguggauacuuugccacuucuuagaauugggaacaaaacacccau

SEQ ID NO: 93347 - RNA, 46 nt, Mus musculus
auaccuaauuaaaaaaaaagaaaauuagaugaaauaaucguuuugg

SEQ ID NO: 93348 - RNA, 46 nt, Mus musculus
agugccucaugaaugagcucaaugccuuuauccaaagacgucccuc

SEQ ID NO: 93349 - RNA, 46 nt, Mus musculus
cacuauacuuacaauugcaugguuacuuaaauauuccuugccaaag

SEQ ID NO: 93350 - RNA, 42 nt, Mus musculus
gaaugagauccuuaaaguguugacagaaaugggaagcagaga

SEQ ID NO: 93351 - RNA, 46 nt, Mus musculus
agauugaaacaucauuuauaauuccaacagaaaucaauagcaagag

SEQ ID NO: 93352 - RNA, 42 nt, Mus musculus
ucaccagcuucuaagcuuaaauuguauaguuacugggacaag

SEQ ID NO: 93353 - RNA, 49 nt, Mus musculus
cccgacaaagagguacuuuuuaucagucaucacaggcaaguaugaccca

SEQ ID NO: 93354 - RNA, 27 nt, Mus musculus
gcuucaaagaaagaaaaacaggaucuc

SEQ ID NO: 93355 - RNA, 41 nt, Mus musculus
uauucacuuauuuguuguauaugaguacacuguagcuguac

SEQ ID NO: 93356 - RNA, 47 nt, Mus musculus
gauugugagccaccauaugguugcuggaauuugaauuuaggaccuuu

SEQ ID NO: 93357 - RNA, 41 nt, Mus musculus
uucauuauuuguuuuuugacuuggugaaucuuaaagcgguu

SEQ ID NO: 93358 - RNA, 38 nt, Mus musculus
gcuuuugguuuucguuuuaacuuuuuauuuucagacag

SEQ ID NO: 93359 - RNA, 46 nt, Mus musculus
accuugcguguuuucaaauuuguuucuugaaccuuugcauuugaag

SEQ ID NO: 93360 - RNA, 63 nt, Mus musculus
aaaugccuauaacuugggaugagaaugucuuggacgaaaaccaagaagaggucaucaguagag

SEQ ID NO: 93361 - RNA, 42 nt, Mus musculus
caaacuuuauaugccccagcacaggggaacgccagggcccaa

SEQ ID NO: 93362 - RNA, 42 nt, Mus musculus
caaguauauggucgauuuuggagaagguuccaugcggugcug

SEQ ID NO: 93363 - RNA, 46 nt, Mus musculus
guucauguucucuuuccuagguuucccaucuuuaggauugccucag

SEQ ID NO: 93364 - RNA, 52 nt, Mus musculus
agugauaucacuguacaagacagaaaaacugaaaaucugccagacacuaaau

SEQ ID NO: 93365 - RNA, 46 nt, Mus musculus
gggaaagagaacagggaaauacauguuuucuacguuagcagcucag

SEQ ID NO: 93366 - RNA, 46 nt, Mus musculus
gccaucucaccagcccugcuauuuuuuaaagaaagaacauauacag

SEQ ID NO: 93367 - RNA, 46 nt, Mus musculus
uucaccaucauucaggacacagcugccuuccucccccuggcccaag

SEQ ID NO: 93368 - RNA, 46 nt, Mus musculus
aauuugggagagcaugagaaaauacauacuaucaagaaucaggcca

SEQ ID NO: 93369 - RNA, 58 nt, Mus musculus
gaaagugcacaggaugauagcagagggggacauagagccagggaguggacugggagga

SEQ ID NO: 93370 - RNA, 60 nt, Mus musculus
ggcaacaaaaacagaaaggcaagcaacacaggaaguggaguaagagccuagagaggggcc

SEQ ID NO: 93371 - RNA, 127 nt, Mus musculus
ucuccucaucaaggugggaaauccagucaguucaagauugagcagauuaaacuagauaaguacauccugaggaaagagccagguuuuaauaaugucagcaauaccuccuuggauucuagacccucag

SEQ ID NO: 93372 - RNA, 46 nt, Mus musculus
uuuucuagcacggauucuccuguggacucagauguauugaccccaa

SEQ ID NO: 93373 - RNA, 46 nt, Mus musculus
ugaaguuucucaugaucaauauuucccacaauugagauuuugguag

SEQ ID NO: 93374 - RNA, 46 nt, Mus musculus
uuaauagugguuuuuaaguaauaaaaaacuggaaacaaugcuggaa

SEQ ID NO: 93375 - RNA, 46 nt, Mus musculus
acauaggacaacuccuuuugaggcaguucuaccauuaagcugcagu

SEQ ID NO: 93376 - RNA, 46 nt, Mus musculus
aauaacaaaucaugugguaauugugucuuacugagaaacugaccaa

SEQ ID NO: 93377 - RNA, 46 nt, Mus musculus
uuccugagggccccugcgggccucacugcucuuuuguggcugcuua

SEQ ID NO: 93378 - RNA, 45 nt, Mus musculus
uggggccagacaaggcagcacgguuaggggaacauauuucacuga

SEQ ID NO: 93379 - RNA, 45 nt, Mus musculus
aaaaaaaaagagagagagagagagagagagagagagagguagaga

SEQ ID NO: 93380 - RNA, 46 nt, Mus musculus
cagauccuuuaaaagaauaguuccuuucugacugauguugccacag

SEQ ID NO: 93381 - RNA, 46 nt, Mus musculus
uaauccaaaacaauugaaauauggaggaccugaucaaauugaaaag

SEQ ID NO: 93382 - RNA, 57 nt, Mus musculus
agcucgaaugucgauguaacccaaaucuguuuugucuucaguccucacucacauggg

SEQ ID NO: 93383 - RNA, 53 nt, Mus musculus
caccagagcaaacaaaaccaaaacccaaggaccucuucagauacgaugcccuu

SEQ ID NO: 93384 - RNA, 46 nt, Mus musculus
cuggaacuuacuauguguaaaccagccuggccucaaauuuucaaag

SEQ ID NO: 93385 - RNA, 46 nt, Mus musculus
uuacaugucaagaguuuuuuuguuuuuuguuuuuguuuuuguacag

SEQ ID NO: 93386 - RNA, 46 nt, Mus musculus
cuuugacugacuuacuaguguauuucuggcauuuuaagcuuggaua

SEQ ID NO: 93387 - RNA, 46 nt, Mus musculus
ugccgauacagguagaucagaaauucaguacacagccaguuaagag

SEQ ID NO: 93388 - RNA, 46 nt, Mus musculus
agcuuguugagcuuggacucugcucuuuccaaugaggaaacuguac

SEQ ID NO: 93389 - RNA, 45 nt, Mus musculus
acucaaacauaaagaaaucuuauuuuaccaauacuggaagguccc

SEQ ID NO: 93390 - RNA, 46 nt, Mus musculus
ggccugcgugacggugucugggguccuuuguugugaacaacuggag

SEQ ID NO: 93391 - RNA, 41 nt, Mus musculus
uguuggggugacuuucccaacucccaguucuagugaggcca

SEQ ID NO: 93392 - RNA, 45 nt, Mus musculus
cugcagaccaaaaacuuaaggaagaacaagccaaaucccugugca

SEQ ID NO: 93393 - RNA, 44 nt, Mus musculus
gaaguuacuuguccaggagaggaagcuccagagccuguuccaga

SEQ ID NO: 93394 - RNA, 44 nt, Mus musculus
gaagaacaagccuauuggaaagaaggaaaugauucagaggacca

SEQ ID NO: 93395 - RNA, 57 nt, Mus musculus
ccgugcagcugcccgcagcucugcuucccagcacaugcccagauggaagccgguggg

SEQ ID NO: 93396 - RNA, 42 nt, Mus musculus
agaacugguaacagcgcuuaccucugggaagcaagggcugag

SEQ ID NO: 93397 - RNA, 46 nt, Mus musculus
cguauauguuaguguaccacaggcaugcaguucccugagagggcag

SEQ ID NO: 93398 - RNA, 45 nt, Mus musculus
uaaagacuuugaauuuuauacaauugaagcauugucuacucauug

SEQ ID NO: 93399 - RNA, 43 nt, Mus musculus
aagaauuuaugagcagcuuccagaagugaagaagaagagagaa

SEQ ID NO: 93400 - RNA, 46 nt, Mus musculus
aaugaaguaaauaaacucacaggaucacgugagagucaucagggag

SEQ ID NO: 93401 - RNA, 46 nt, Mus musculus
cuggcugugcugggaugcagucagaacucuagaucaucugcuaugg

SEQ ID NO: 93402 - RNA, 41 nt, Mus musculus
gugguuaucucaaaccccaguuugcaaggcaacuuaggcaa

SEQ ID NO: 93403 - RNA, 45 nt, Mus musculus
aauguaaaauguuaucaaccauaaagggagagaaaagacccccau

SEQ ID NO: 93404 - RNA, 45 nt, Mus musculus
cagucccucuaaagcagagguaggugagauuccaaccaagucuua

SEQ ID NO: 93405 - RNA, 46 nt, Mus musculus
ccaaugggccuccgaguaggccauguuuugauacauauccagcuag

SEQ ID NO: 93406 - RNA, 45 nt, Mus musculus
ugcuuguuacuauuacagaagcaaucagauccugauugacgccca

SEQ ID NO: 93407 - RNA, 46 nt, Mus musculus
gggugaagccaguauuuguaggauucaucugugugugugcuggggg

SEQ ID NO: 93408 - RNA, 42 nt, Mus musculus
ugcugaacucacaguuuauaguuucagguugucuugcccccu

SEQ ID NO: 93409 - RNA, 45 nt, Mus musculus; identical to SEQ ID NO: 93378

SEQ ID NO: 93410 - RNA, 45 nt, Mus musculus
auugcauccagugauauuuccaaagguaauggcuaauacuccuau

SEQ ID NO: 93411 - RNA, 46 nt, Mus musculus; identical to SEQ ID NO: 93380

SEQ ID NO: 93412 - RNA, 46 nt, Mus musculus
uaauccaaaacaauugcaauauggaggaccugaucaaauugaaaag

SEQ ID NO: 93413 - RNA, 57 nt, Mus musculus; identical to SEQ ID NO: 93382

SEQ ID NO: 93414 - RNA, 53 nt, Mus musculus
uaccagagcaaacaaaaccaaaacccaaggaccucuucagauacgaugcccuu

SEQ ID NO: 93415 - RNA, 46 nt, Mus musculus
cuggaacuuacuauguguaaaccagccuggccccaaauuuucaaag

SEQ ID NO: 93416 - RNA, 46 nt, Mus musculus; identical to SEQ ID NO: 93385

SEQ ID NO: 93417 - RNA, 46 nt, Mus musculus; identical to SEQ ID NO: 93386

SEQ ID NO: 93418 - RNA, 46 nt, Mus musculus; identical to SEQ ID NO: 93387

SEQ ID NO: 93419 - RNA, 42 nt, Mus musculus
guaucuccauggaaaaggacagcugcugugccaucaugccag

SEQ ID NO: 93420 - RNA, 46 nt, Mus musculus; identical to SEQ ID NO: 93388

SEQ ID NO: 93421 - RNA, 45 nt, Mus musculus; identical to SEQ ID NO: 93389

SEQ ID NO: 93422 - RNA, 46 nt, Mus musculus; identical to SEQ ID NO: 93390

SEQ ID NO: 93423 - RNA, 41 nt, Mus musculus; identical to SEQ ID NO: 93391

SEQ ID NO: 93424 - RNA, 45 nt, Mus musculus; identical to SEQ ID NO: 93392

SEQ ID NO: 93425 - RNA, 44 nt, Mus musculus; identical to SEQ ID NO: 93393

SEQ ID NO: 93426 - RNA, 44 nt, Mus musculus; identical to SEQ ID NO: 93394

SEQ ID NO: 93427 - RNA, 47 nt, Mus musculus
gcagcucugcuucccagcacaugcccagauggaagcaggugggguga

SEQ ID NO: 93428 - RNA, 42 nt, Mus musculus; identical to SEQ ID NO: 93396

SEQ ID NO: 93429 - RNA, 45 nt, Mus musculus; identical to SEQ ID NO: 93398

SEQ ID NO: 93430 - RNA, 43 nt, Mus musculus; identical to SEQ ID NO: 93399

SEQ ID NO: 93431 - RNA, 46 nt, Mus musculus; identical to SEQ ID NO: 93400

SEQ ID NO: 93432 - RNA, 46 nt, Mus musculus; identical to SEQ ID NO: 93401

SEQ ID NO: 93433 - RNA, 41 nt, Mus musculus; identical to SEQ ID NO: 93402

SEQ ID NO: 93434 - RNA, 45 nt, Mus musculus; identical to SEQ ID NO: 93404

SEQ ID NO: 93435 - RNA, 46 nt, Mus musculus; identical to SEQ ID NO: 93405

SEQ ID NO: 93436 - RNA, 45 nt, Mus musculus; identical to SEQ ID NO: 93406

SEQ ID NO: 93437 - RNA, 46 nt, Mus musculus; identical to SEQ ID NO: 93407

SEQ ID NO: 93438 - RNA, 42 nt, Mus musculus; identical to SEQ ID NO: 93408

SEQ ID NO: 93439 - RNA, 28 nt, Mus musculus
agcaggcugcauggugaacggggcagag

SEQ ID NO: 93440 - RNA, 44 nt, Mus musculus
aagcuuugcccuuuccuuuguuaaccuaggccaugacuggccgg

SEQ ID NO: 93441 - RNA, 46 nt, Mus musculus; identical to SEQ ID NO: 32913

SEQ ID NO: 93442 - RNA, 42 nt, Mus musculus
ccaguuccaggggaucugguucucuccuacaugcaggcuaaa

SEQ ID NO: 93443 - RNA, 42 nt, Mus musculus
caccccaggcuuuaccggggccagcgagcggccuuggcagga

SEQ ID NO: 93444 - RNA, 42 nt, Mus musculus
cuggaagcucauuaaugaaacuguacaagugaucuacagcag

SEQ ID NO: 93445 - RNA, 23 nt, Mus musculus
ggcaagcagcucaaggagccuga

SEQ ID NO: 93446 - RNA, 24 nt, Mus musculus
cauggacagaagccagacgagugu

SEQ ID NO: 93447 - RNA, 46 nt, Mus musculus
cuuccugagugaguucuaaggacaaguaauuagcaccuccauguag

SEQ ID NO: 93448 - RNA, 45 nt, Mus musculus
uaaaggcccaucucaucuaccugcccacccucucuccuccucuag

SEQ ID NO: 93449 - RNA, 42 nt, Mus musculus
ggaagaggaggaagaaggagagggagagggaggggggaaggg

SEQ ID NO: 93450 - RNA, 46 nt, Mus musculus
acuaggacucuguuucaaaagcuaaaccccaacaaaacaauaagga

SEQ ID NO: 93451 - RNA, 44 nt, Mus musculus
ggaaaggaaagggaaaccagggguuaggggaucaaaaggaggga

SEQ ID NO: 93452 - RNA, 42 nt, Mus musculus
aagcauucuucuggcauaagcuuugcuucaaauuucugucag

SEQ ID NO: 93453 - RNA, 45 nt, Mus musculus
ucuucuuggguggggcacaggcagcaaagucccggccccguccac

SEQ ID NO: 93454 - RNA, 44 nt, Mus musculus
gaugaugacccuuuuggcuccacccuucaagugggcccccggcc

SEQ ID NO: 93455 - RNA, 43 nt, Mus musculus
uugucauugagaacaaugccagccccagcaucaaagauggaag

SEQ ID NO: 93456 - RNA, 46 nt, Mus musculus
uuauuuuucaguauguuuggcacacaaaaaaaguaaaugcccccaa

SEQ ID NO: 93457 - RNA, 42 nt, Mus musculus; identical to SEQ ID NO: 44661

SEQ ID NO: 93458 - RNA, 46 nt, Mus musculus
cugaacuucucuucucugaguugaugccuuuuucucaucccuacau

SEQ ID NO: 93459 - RNA, 45 nt, Mus musculus
uagcaguguccuacguuauaauauuuaaaacuuuaucagccccuu

SEQ ID NO: 93460 - RNA, 46 nt, Mus musculus
agguaaugucuccagggucuuaaaggcuaagauauaggcaaagaag

SEQ ID NO: 93461 - RNA, 52 nt, Mus musculus
uuugaucccuuuaugaaccuugugauugacgaguguguggagauggcaacca

SEQ ID NO: 93462 - RNA, 46 nt, Mus musculus
uuuauuuuugagcuuugcccuguaagagaugggcacgcauaugcag

SEQ ID NO: 93463 - RNA, 46 nt, Mus musculus
uccacaucccuccccaaaggccuguuugauugugauguagaauuag

SEQ ID NO: 93464 - RNA, 45 nt, Mus musculus
agcaucuugcccggugugaaggaagacaagaauucuauaacauug

SEQ ID NO: 93465 - RNA, 46 nt, Mus musculus
cacauaggaggcugagacaggaggauugcugugauuucaagaccag

SEQ ID NO: 93466 - RNA, 47 nt, Mus musculus
aaagagagacaagaaaagauuacaaucuaaacaaacccaggcccaca

SEQ ID NO: 93467 - RNA, 46 nt, Mus musculus
uggcgcucauuuccaugcagcuggccgcaaacucgaugccauugag

SEQ ID NO: 93468 - RNA, 46 nt, Mus musculus
auagugaggauaggacagccauggcuuccgcacagcauaaucauag

SEQ ID NO: 93469 - RNA, 45 nt, Mus musculus
agugacaagaauugccgagaggccaaacugauccuugggucugga

SEQ ID NO: 93470 - RNA, 42 nt, Mus musculus
cauuguucgcgguaggccgggccuuuuuuuguguaaucgcug

SEQ ID NO: 93471 - RNA, 41 nt, Mus musculus
gggagcuggacccugaggugccgccgcgaccgcagcagcca

SEQ ID NO: 93472 - RNA, 45 nt, Mus musculus
ccuagccuccaaaacguugggaguaacauuuuauuugggguggga

SEQ ID NO: 93473 - RNA, 42 nt, Mus musculus
uguguguguguguguguguaacuccagcauuuuagaggugga

SEQ ID NO: 93474 - RNA, 46 nt, Mus musculus
uucucgagaugugacagaagcucucauccuccagcucuuuagccag

SEQ ID NO: 93475 - RNA, 55 nt, Mus musculus
uuaguguuaauuggcugaaugaucuauaaguucaguuauuagauugggaauuggg

SEQ ID NO: 93476 - RNA, 46 nt, Mus musculus
cauuuuuaaagguuuucuugaaugccuuucagacuuuaauguguag

SEQ ID NO: 93477 - RNA, 46 nt, Mus musculus
ggggagaaaguccagguuuuguuuauuguaucccagucaccagcag

SEQ ID NO: 93478 - RNA, 46 nt, Mus musculus
cuguuaguguccagagucuaguuuagucuggaaaagauuaguuaag

SEQ ID NO: 93479 - RNA, 50 nt, Mus musculus
gcaguaagaugucuuaaguuuguaauaauuaaaaaguaauauagagggug

SEQ ID NO: 93480 - RNA, 48 nt, Mus musculus
gacuggccuuaaacucaaagaucugccugccuccguagugcugggauu

SEQ ID NO: 93481 - RNA, 45 nt, Mus musculus
ggguaagguaagcugucagaguuagagcaggugacuugcgcugga

SEQ ID NO: 93482 - RNA, 45 nt, Mus musculus
uucaaggccagccaacacuacagagucuagaaugaaugagagaag

SEQ ID NO: 93483 - RNA, 47 nt, Mus musculus
uuuaggaagugaaagugaauugggcaacaaccccuagcagucaaaag

SEQ ID NO: 93484 - RNA, 45 nt, Mus musculus
guucacaagguaauuguaucuucuuaaacauaaaaaugaacucuu

SEQ ID NO: 93485 - RNA, 45 nt, Mus musculus
aaaucacaaccgaagacaucaaagcagcguuugcaccauuuggaa

SEQ ID NO: 93486 - RNA, 46 nt, Mus musculus
accuuaauuuuaacacuuuaaauauagcauauuccauuguuuagag

SEQ ID NO: 93487 - RNA, 46 nt, Mus musculus
uguuuuguacuauauuauaaaauacugucgccauuaaauuugcuag

SEQ ID NO: 93488 - RNA, 46 nt, Mus musculus
uuuaucacaguaagaguaauaagccauuucaguacugacucaggau

SEQ ID NO: 93489 - RNA, 46 nt, Mus musculus
gaggguuccgcuuugcagaaucuuguguguuuucaguuugguguag

SEQ ID NO: 93490 - RNA, 46 nt, Mus musculus
gauaaggugcugcuaccaaaccagaugaccugaguucaguccccaa

SEQ ID NO: 93491 - RNA, 46 nt, Mus musculus
auguucauaaaacauuuugaaauggaaaacucucuuuauacuauag

SEQ ID NO: 93492 - RNA, 46 nt, Mus musculus
aguugacucauguucacaaaguggauuuuuaaaaugcucggccaaa

SEQ ID NO: 93493 - RNA, 46 nt, Mus musculus
augguugugagccaccaugugguugcugggauuugaacucagugcu

SEQ ID NO: 93494 - RNA, 46 nt, Mus musculus
cucagucagcaccagguaugcagugcacauacuuacauacaugcag

SEQ ID NO: 93495 - RNA, 44 nt, Mus musculus
guaucgaguggccggguaugaaacccagugaaaacagacuacag

SEQ ID NO: 93496 - RNA, 46 nt, Mus musculus
uguuguuuacguaaagauuuaucaaaucagucaguacaaaugccag

SEQ ID NO: 93497 - RNA, 44 nt, Mus musculus
gggauucacuaagaacuccaaaacuagccugaaggaccagccgg

SEQ ID NO: 93498 - RNA, 42 nt, Mus musculus
gcauggcuuuggucuuggucccuggucucuuggagcccccau

SEQ ID NO: 93499 - RNA, 46 nt, Mus musculus
uguguauuuuuaaguacuaaaacauugaaauuugcuuuauggaaga

SEQ ID NO: 93500 - RNA, 57 nt, Mus musculus
aaauuuuuuaaauacuuggaauuuuauuucuuuguaaacuucuacagaucaggacag

SEQ ID NO: 93501 - RNA, 45 nt, Mus musculus
uuauggguuacaggggugacaaggagacagguuuagcucauacug

SEQ ID NO: 93502 - RNA, 45 nt, Mus musculus
gccucagguccccaagaaagcuuugucauccuugaaccucaugug

SEQ ID NO: 93503 - RNA, 45 nt, Mus musculus
uguuugccucaaacucaaggaucugccucucucugcuuccccaag

SEQ ID NO: 93504 - RNA, 46 nt, Mus musculus
acaauuauuaggguggagacagaucaaagguugauauuggggcugg

SEQ ID NO: 93505 - RNA, 45 nt, Mus musculus
ugggagaggccaagcaccggcggagcacggcuuagggugggaaca

SEQ ID NO: 93506 - RNA, 46 nt, Mus musculus
uacaaucaguaaaggucugcgagcugugacgucucgauccaaccag

SEQ ID NO: 93507 - RNA, 46 nt, Mus musculus
ugccuggguuugugcugucugaucaucacaagcuaaugaaccgcgu

SEQ ID NO: 93508 - RNA, 46 nt, Mus musculus
uucaggugcuagauagcacagaugcaaaggacugccuucuuuuuaa

SEQ ID NO: 93509 - RNA, 45 nt, Mus musculus
ucucugugugugucucugugugugugugugugugugugugucuau

SEQ ID NO: 93510 - RNA, 50 nt, Mus musculus
ugugucucugugugucucugugugugugugugugugugugugugugucuc

SEQ ID NO: 93511 - RNA, 56 nt, Mus musculus
ucugugugugugugucucugugugugugugugugugucugugugugugugucucuc

SEQ ID NO: 93512 - RNA, 41 nt, Mus musculus
guucuaagccagcgagaacaacauaaugaaacccuguaucu

SEQ ID NO: 93513 - RNA, 46 nt, Mus musculus
uuaucccuaggaccccaugguagaaagaaagaacuaacucgcacag

SEQ ID NO: 93514 - RNA, 41 nt, Mus musculus
aaagaagcggcuccccaacuccacuacaggugcgggggucu

SEQ ID NO: 93515 - RNA, 42 nt, Mus musculus
auaccauccaauuuccucuucuggugugucugaagacagcaa

SEQ ID NO: 93516 - RNA, 46 nt, Mus musculus
ucuagugaaguuuuacuuucacaacuuggaggcuuggauguguggg

SEQ ID NO: 93517 - RNA, 42 nt, Mus musculus
gcaugauagcaaauauguuuaaucaaagcacucgggcggcag

SEQ ID NO: 93518 - RNA, 45 nt, Mus musculus
auaaagaugggggaagagagaaccaucagguggucaacaaccaaa

SEQ ID NO: 93519 - RNA, 46 nt, Mus musculus
guagggguccaaggagaaugacugcacugcagugagcugccugcac

SEQ ID NO: 93520 - RNA, 46 nt, Mus musculus
ucaaacucaaagagaucacuuguucugccuccuaaguacugggauu

SEQ ID NO: 93521 - RNA, 46 nt, Mus musculus
cuggugauuucuagacagcagaggaauguguguguguuuugaagag

SEQ ID NO: 93522 - RNA, 46 nt, Mus musculus
cacacaguggcucacaaccacuuguaaugaaauuuggugcccucuu

SEQ ID NO: 93523 - RNA, 46 nt, Mus musculus
gacgguccuuacugcuccuaaguaacgugaaggagguuuauuguag

SEQ ID NO: 93524 - RNA, 45 nt, Mus musculus
ggcacuuguuucuaauuuacuuuccuugcauuuaauauauguggg

SEQ ID NO: 93525 - RNA, 42 nt, Mus musculus
caauacuccuaacugcuguaccaucuaucucuccagccccuu

SEQ ID NO: 93526 - RNA, 41 nt, Mus musculus
ggaagauguaaaagaggugggggguagaggaaaguggcuga

SEQ ID NO: 93527 - RNA, 42 nt, Mus musculus
ggggagagccgggaaggaaggaaguguggagacgaggggaag

SEQ ID NO: 93528 - RNA, 45 nt, Mus musculus
cuuggguuccauccccaacaucauagaaacuguguggugccuccu

SEQ ID NO: 93529 - RNA, 46 nt, Mus musculus
guuuauaccauucuagguacuugcagagaauagggucaguucuuag

SEQ ID NO: 93530 - RNA, 42 nt, Mus musculus
aaacuucauacaacacuuuacaaauauuaaaaaaagaaccau

SEQ ID NO: 93531 - RNA, 54 nt, Mus musculus
uugaugaucuccuuggcuugguggcuccuguggcaggagagaggagcuccgguc

SEQ ID NO: 93532 - RNA, 50 nt, Mus musculus
cuuucucaccuuggaccagcaugaaaguauuucagccauauugggcccuu

SEQ ID NO: 93533 - RNA, 53 nt, Mus musculus
agcaucuacugccggccucuguagcuacguucaggaacaugauaucagcacaa

SEQ ID NO: 93534 - RNA, 46 nt, Mus musculus
gcacaguaccuugagguggagaggaaccuuuaccaccacacuggga

SEQ ID NO: 93535 - RNA, 45 nt, Mus musculus
gugaaagcaacuugcuuucagagcacauggagcgcaccuggcaga

SEQ ID NO: 93536 - RNA, 41 nt, Mus musculus
uaaagaaagcuaaaagcuggaugcuauggcugucaggguca

SEQ ID NO: 93537 - RNA, 46 nt, Mus musculus
uuagacugucgaccucagaaaggcagcccagcucuggaguuuccaa

SEQ ID NO: 93538 - RNA, 41 nt, Mus musculus
guggguaugggggagcuccuuacagagguggugggcaugag

SEQ ID NO: 93539 - RNA, 32 nt, Mus musculus
uccuuacagagguaguggacaugugggggcug

SEQ ID NO: 93540 - RNA, 41 nt, Mus musculus
cuagaguucaggcuguucaauuggguuucaucgcagucagc

SEQ ID NO: 93541 - RNA, 45 nt, Mus musculus
uuggcgcccgauuaugcagccgauuaaguuauuuggaauggugag

SEQ ID NO: 93542 - RNA, 99 nt, Mus musculus
gagacuguugucuugccaccugguucagcuuggccagauccagcggagaaaugguguguuguccuugaaucgaguaggcgucuagagguggucccucca

SEQ ID NO: 93543 - RNA, 46 nt, Mus musculus
ggccggcaugggcugguacgggauggucaugacucuccccugugga

SEQ ID NO: 93544 - RNA, 45 nt, Mus musculus
gcggaucuccuugaucuugcagccgcccuugccgaucagggagcc

SEQ ID NO: 93545 - RNA, 77 nt, Mus musculus
gcuugucgaugaucauggcgaaggccuuaaagauggcauugguaggcccagucagcgugaugauccucuccgggcag

SEQ ID NO: 93546 - RNA, 48 nt, Mus musculus
ucagucacaccggcguccauggcgagcggcgggcggcguucgggaguu

SEQ ID NO: 93547 - RNA, 41 nt, Mus musculus
gugcuuucuuugccggcuccucgugccgccgccauagucag

SEQ ID NO: 93548 - RNA, 46 nt, Mus musculus
ucccaacaaaauggcgacacgugucgccaucgaaaaauugggccgg

SEQ ID NO: 93549 - RNA, 47 nt, Mus musculus
aucagaucucauuacgggugguugcugggauuugaacuuuggaccuu

SEQ ID NO: 93550 - RNA, 41 nt, Mus musculus
ccauuacagaugggugugagucacaaugugguugcugggaa

SEQ ID NO: 93551 - RNA, 46 nt, Mus musculus
gagaauugcuacuugaaauauacucuagaaauuucugcggcccccc

SEQ ID NO: 93552 - RNA, 46 nt, Mus musculus
ccauuauaacucaucugggauucuucucaacuucaagugaccacag

SEQ ID NO: 93553 - RNA, 45 nt, Mus musculus
uacauucuugcuccaaguucucccaguugguuaugaugcccacag

SEQ ID NO: 93554 - RNA, 42 nt, Mus musculus
gcaacuuaaagggaaagaugagaauacaauaaaguagaaaag

SEQ ID NO: 93555 - RNA, 44 nt, Mus musculus
aaagacagagaaagagagagagugcaagagagcgagcaagugag

SEQ ID NO: 93556 - RNA, 42 nt, Mus musculus
cagcauguuaagucuuaggguauaaaauaacagagggugcag

SEQ ID NO: 93557 - RNA, 45 nt, Mus musculus
gacaucggguaaccaaacaaagucagagagcgcacagucauccca

SEQ ID NO: 93558 - RNA, 46 nt, Mus musculus
uguuuguuuuggagaaguacuuaauaacaaguuaaaaauaucugag

SEQ ID NO: 93559 - RNA, 46 nt, Mus musculus
acgcugagcuugcuuuaugaauuggagacauagucucaguguguag

SEQ ID NO: 93560 - RNA, 46 nt, Mus musculus
uugccugcauguucauaugcgcaccacaugugucugguuuccaagg

SEQ ID NO: 93561 - RNA, 47 nt, Mus musculus
guaagagcaagugcuguuacacugacggacugucaggguuugguuuu

SEQ ID NO: 93562 - RNA, 45 nt, Mus musculus
uccagaggaagggguugugguagccauucuauaauccaagggcaa

SEQ ID NO: 93563 - RNA, 46 nt, Mus musculus
gagaacacuguagcugucuucagauacaccaaaagacggcaucuga

SEQ ID NO: 93564 - RNA, 45 nt, Mus musculus
uugaugucuuuuucuuugugugugucuaucuuuuggucugcacag

SEQ ID NO: 93565 - RNA, 45 nt, Mus musculus
cacucaggaagguagagacagggagaucuguaaguucaaggccug

SEQ ID NO: 93566 - RNA, 78 nt, Mus musculus
agaacaaguucuaggauagguagggcuacacagagaaacugucucaagaaaaggaaaaaaaagaauauuguauuugaa

SEQ ID NO: 93567 - RNA, 45 nt, Mus musculus
ggacucccacaccagcuugugcacacacuuacuuacauagacaca

SEQ ID NO: 93568 - RNA, 50 nt, Mus musculus
gaugacuauuggaacuuugcaguagagguggcgccauauuuccacaguug

SEQ ID NO: 93569 - RNA, 41 nt, Mus musculus
uguugauacagaacacuccgaaggcuggagaauguggcaca

SEQ ID NO: 93570 - RNA, 46 nt, Mus musculus
caguuagaauaggcauucacuaauaaauacauuuucaugugcuuag

SEQ ID NO: 93571 - RNA, 46 nt, Mus musculus
acauauuauaggacauggagggccuuaaugucaggucccacugcag

SEQ ID NO: 93572 - RNA, 46 nt, Mus musculus
gaucugacucccucuucuggugugucugaagagagcuacaguguac

SEQ ID NO: 93573 - RNA, 46 nt, Mus musculus
uuuacaaggggagggggaggaaggacagggcuuuuggagaggaaau

SEQ ID NO: 93574 - RNA, 97 nt, Mus musculus
cuucugaagguccugaguucaagucccagcaaccacauuguggcucacaaccauccaagaucuggcgcccucuucuggagugucugaagacagcuau

SEQ ID NO: 93575 - RNA, 46 nt, Mus musculus
gugcccuucucaguagauauuuucuucugaguauguuggaggccug

SEQ ID NO: 93576 - RNA, 42 nt, Mus musculus
auaauaauaaaugaaucuuugguucagagcaaggagggacug

SEQ ID NO: 93577 - RNA, 46 nt, Mus musculus
cugcacacauauggcuuauagacacacagggaaagaaguaaaggaa

SEQ ID NO: 93578 - RNA, 46 nt, Mus musculus
gugagugcuguagugaaugugguugugagugcuguagugaaugugg

SEQ ID NO: 93579 - RNA, 46 nt, Mus musculus; identical to SEQ ID NO: 93578

SEQ ID NO: 93580 - RNA, 46 nt, Mus musculus
ucugcugccagguaaccuugcccagaccuggucuugugccgccuag

SEQ ID NO: 93581 - RNA, 41 nt, Mus musculus
uguguguguguguguguguguguguguaccugccugugugg

SEQ ID NO: 93582 - RNA, 42 nt, Mus musculus
gggaacaagagagggagaguggaagggcaggcaggcagggag

SEQ ID NO: 93583 - RNA, 46 nt, Mus musculus
ggcugguaguccugggcucuauaagagagcaagcugagggcuggag

SEQ ID NO: 93584 - RNA, 45 nt, Mus musculus
uaguguacucauauacauaaaauaaauaauaugaaagaaagaaaa

SEQ ID NO: 93585 - RNA, 42 nt, Mus musculus
cccuaguaaagaguaggauuuugucugggucuaguggugcgu

SEQ ID NO: 93586 - RNA, 41 nt, Mus musculus
uuuuuuuauuuaaagggagagagaaaaagagaaagggcaga

SEQ ID NO: 93587 - RNA, 44 nt, Mus musculus
ccuggaggaaagagaucaaaagcgaggaggagcuugggggccca

SEQ ID NO: 93588 - RNA, 45 nt, Mus musculus
gugagccaccaugugguugcugggauuugaacucaggcccucugg

SEQ ID NO: 93589 - RNA, 45 nt, Mus musculus
aggcuauuuucaauagcaauaaacacaagggaccaacacauacag

SEQ ID NO: 93590 - RNA, 42 nt, Mus musculus
ggugauauauacaagaaguuacagcagauguacagagggaag

SEQ ID NO: 93591 - RNA, 46 nt, Mus musculus
ugcgcuuguuacuucuaucuuccucaauguuuagcuccugggucac

SEQ ID NO: 93592 - RNA, 45 nt, Mus musculus
agaggcagucaggcaccuaaacuaagugcaccuagucagucccug

SEQ ID NO: 93593 - RNA, 46 nt, Mus musculus
uucuaagggcccacagcuacaggcugagugagugccgcagaugcag

SEQ ID NO: 93594 - RNA, 46 nt, Mus musculus
cacaguauaaacugcauguagugcuagggccuaggacauccugcag

SEQ ID NO: 93595 - RNA, 46 nt, Mus musculus
cuguuucuuuauuugucuguaaaauugaggggcugucuuuagccag

SEQ ID NO: 93596 - RNA, 46 nt, Mus musculus
ccaaaccaaaccaaacaagccaagguuagaaaagcauggugcuaag

SEQ ID NO: 93597 - RNA, 42 nt, Mus musculus
ucaggacuugguucucucccuuucccacaggucuagggcuug

SEQ ID NO: 93598 - RNA, 42 nt, Mus musculus
guguaucaucaacacuccaggacauccauaaggaagggcgga

SEQ ID NO: 93599 - RNA, 45 nt, Mus musculus
aacugugagugugacuucaaucaggguaagaggagugggggugga

SEQ ID NO: 93600 - RNA, 44 nt, Mus musculus
cuccaugacacaaggcaacaagaggcuauccaagaggaguccca

SEQ ID NO: 93601 - RNA, 42 nt, Mus musculus
uuccuuuggaggggagguuccaaggauggaagguggguacaa

SEQ ID NO: 93602 - RNA, 42 nt, Mus musculus
cuguuugcaccuuugcguuuacuuaucucaguucacugugag

SEQ ID NO: 93603 - RNA, 42 nt, Mus musculus
auugucuggaaauuagugguucaguucacaggucagcagcag

SEQ ID NO: 93604 - RNA, 46 nt, Mus musculus
aggggaaaaacauuacucucaaaauuaaagaaauaguggccauaaa

SEQ ID NO: 93605 - RNA, 45 nt, Mus musculus
ccaggcaugguggcacuggcuucaaccccaguacuagggagggag

SEQ ID NO: 93606 - RNA, 46 nt, Mus musculus
aagagugguuauacguguaaagacaugcauagaaauggcacagaga

SEQ ID NO: 93607 - RNA, 42 nt, Mus musculus
agcuucugauuuccacaugggugcacacagccacacacacac

SEQ ID NO: 93608 - RNA, 54 nt, Mus musculus
gguaggcccugucucgaugaugaugguggugaggaggaggauguggugguggua

SEQ ID NO: 93609 - RNA, 45 nt, Mus musculus
gaucuggggagcuggcucugugaguaauguauuuacugcagaagg

SEQ ID NO: 93610 - RNA, 41 nt, Mus musculus
ucuucgacccucaggcuucucaguucucaucguggucgggg

SEQ ID NO: 93611 - RNA, 33 nt, Mus musculus
cugcaccacuccacuaucaucuccagucccugg

SEQ ID NO: 93612 - RNA, 45 nt, Mus musculus
auuacuaaaucaauaacuugaugaaaugggcucagagcugaucuu

SEQ ID NO: 93613 - RNA, 42 nt, Mus musculus
ugugguggcagaguccugccaucccagcccuugggggcagaa

SEQ ID NO: 93614 - RNA, 46 nt, Mus musculus
cauaaucagugaaacucaguguaauagcugccuugcacuagcagcc

SEQ ID NO: 93615 - RNA, 46 nt, Mus musculus
augaagaagcugugagcugugagggaacuuguuugauacacauuuu

SEQ ID NO: 93616 - RNA, 46 nt, Mus musculus
accuauuaagcucucccuuccccagaaaauguguaucaaacaaguu

SEQ ID NO: 93617 - RNA, 39 nt, Mus musculus
uuuugagauaaugcuuaaaugguuaccugguaccacaga

SEQ ID NO: 93618 - RNA, 42 nt, Mus musculus
acuacaaaaguuuaaagucgcccuuuuguaauugcugcagua

SEQ ID NO: 93619 - RNA, 34 nt, Mus musculus
caggcaaggugguucacaccuuuaaucccaggag

SEQ ID NO: 93620 - RNA, 45 nt, Mus musculus
ccaccuugccugggccuaagauuuucauggccacuaugucucaag

SEQ ID NO: 93621 - RNA, 86 nt, Mus musculus
uucucuacuggagaccugggguccccagcaagaaggaucagagcagcuacauuauggaaacaacuaaacaugacuccagaggggag

SEQ ID NO: 93622 - RNA, 50 nt, Mus musculus
ugagcgggacaguggcccaugcuugucuuggggaaaugguauggugaggg

SEQ ID NO: 93623 - RNA, 46 nt, Mus musculus
uaaagaauuucaggacauugugcugagugaaaucaaccagacccag

SEQ ID NO: 93624 - RNA, 46 nt, Mus musculus
aaaauguauauguguaauguaauaguauauaggauauagcccacaa

SEQ ID NO: 93625 - RNA, 46 nt, Mus musculus
aacuauggggcauuuuugugggacaacuuguagaacauuguaaaag

SEQ ID NO: 93626 - RNA, 44 nt, Mus musculus
uaacguggcaaggacagcuagcaaaugcucugaaauggcagaga

SEQ ID NO: 93627 - RNA, 45 nt, Mus musculus
ccugcaaaauccagcucauuaagaagaaaggaaaaguuaaggcac

SEQ ID NO: 93628 - RNA, 46 nt, Mus musculus
gagaagaaaaaacagauuggugcuaguucugcuaucgugccuccag

SEQ ID NO: 93629 - RNA, 46 nt, Mus musculus
gguuuacauagugaguuccaggccagccagggcuacacagugagac

SEQ ID NO: 93630 - RNA, 45 nt, Mus musculus
ccgcauaacgcugcacaccccaacaaacuaccucccacucucaga

SEQ ID NO: 93631 - RNA, 46 nt, Mus musculus
gagaaacaugcuaggcacacaggugacucuccgcuuuuucauugag

SEQ ID NO: 93632 - RNA, 46 nt, Mus musculus
guuuagaaaugaucaugaaauucuuaggacaguaagaacauuuaag

SEQ ID NO: 93633 - RNA, 47 nt, Mus musculus
ucaaaucccagcaaccacacauaggcucaaaaccaucuauaaugaga

SEQ ID NO: 93634 - RNA, 46 nt, Mus musculus
caguuuaaaauacaguguuagaagauaugaguuaguggagucgguc

SEQ ID NO: 93635 - RNA, 45 nt, Mus musculus
aacucaguuuucuaauauaguuauuuuguaguucaauucagaggg

SEQ ID NO: 93636 - RNA, 46 nt, Mus musculus
aguggggauaaaauagaaccacccauugucugcagagacuggacau

SEQ ID NO: 93637 - RNA, 46 nt, Mus musculus
ucaagucccagcaaccacaugguggcucacaaccaucuguaauaag

SEQ ID NO: 93638 - RNA, 45 nt, Mus musculus
acaccaaucgugucaucuuucuggaagaugaugauguugcagcag

SEQ ID NO: 93639 - RNA, 44 nt, Mus musculus
gcagaaggaaauuuuugagcagccagaaucuguugugaacacaa

SEQ ID NO: 93640 - RNA, 46 nt, Mus musculus
gaaugguggagagucauggucuccuagguaguuuucacuggguaug

SEQ ID NO: 93641 - RNA, 42 nt, Mus musculus
cagcaagugcucuuaaccauugagccaucuuuccagccccua

SEQ ID NO: 93642 - RNA, 46 nt, Mus musculus
aaacaaccaauggaagaagauaaaugauaaaguaaggcugggaaga

SEQ ID NO: 93643 - RNA, 46 nt, Mus musculus
gguacauaugugauaguacacauuacauauauaugugugauaguau

SEQ ID NO: 93644 - RNA, 42 nt, Mus musculus
acacacaacagauccucauucgggaaacuuccuuaugcccuc

SEQ ID NO: 93645 - RNA, 46 nt, Mus musculus
uucuauuucagugaauuugggagguuugaaagaucacauuaaggag

SEQ ID NO: 93646 - RNA, 46 nt, Mus musculus
cacaggcgagacagcugacacccugaugggacuucguuacuguaag

SEQ ID NO: 93647 - RNA, 42 nt, Mus musculus
cucuccucccuaagagaagagaguacaguaacugccccacag

SEQ ID NO: 93648 - RNA, 46 nt, Mus musculus
ccaacucuuugcaagcuguauugauauaaaagauuacucuccacaa

SEQ ID NO: 93649 - RNA, 46 nt, Mus musculus
uuaagcuuaacauuuuuuguugauucucuaauaagauauuugucag

SEQ ID NO: 93650 - RNA, 46 nt, Mus musculus
gugauguuugcucucaugaugugugaugacaggaucuccaugcaag

SEQ ID NO: 93651 - RNA, 45 nt, Mus musculus
caggcaaaaaaguaaccaaacagaacacagcuccagccccaugac

SEQ ID NO: 93652 - RNA, 46 nt, Mus musculus
acaacaaaaccaaacacaaaacaaaaacaaagagagaaagagagag

SEQ ID NO: 93653 - RNA, 46 nt, Mus musculus
cagagaaacccugucucagaaaaaaaaaaaaagaaaaaagaaaaaa

SEQ ID NO: 93654 - RNA, 46 nt, Mus musculus
cuguaacaagaccugacucccuuuucugaagugucugaagacagcu

SEQ ID NO: 93655 - RNA, 28 nt, Mus musculus
ugaacugugacacacacacacacacaca

SEQ ID NO: 93656 - RNA, 46 nt, Mus musculus
agcuguauuuuguucagagaacuggauaauggauuucugggcccuc

SEQ ID NO: 93657 - RNA, 44 nt, Mus musculus
gucaaggcgcuugguguuugcuucagcauaacgugauucgguca

SEQ ID NO: 93658 - RNA, 46 nt, Mus musculus
cccaaaaaugugcagaguaauuucuucacagagcuauuugggucag

SEQ ID NO: 93659 - RNA, 46 nt, Mus musculus
ccagagccacacaccaaacaaaagccacacccaaacacgagcagcu

SEQ ID NO: 93660 - RNA, 45 nt, Mus musculus
ggagcacagggugauguugguguguugagacacugaaacugggag

SEQ ID NO: 93661 - RNA, 57 nt, Mus musculus
ugagcuguauaauccaaaacugcuccaacaggaccccgggguagugacugagcugac

SEQ ID NO: 93662 - RNA, 81 nt, Mus musculus
uacuaaaccagucagaaacccagaugaggaccaggguaguacugucuaaacaaauauuauuguuuuccauaucccauuuug

SEQ ID NO: 93663 - RNA, 65 nt, Mus musculus
cuuucuaccuaaauucuuuuauuaguucuuaauacccagauauuuuagcaaggcaaggcacuagg

SEQ ID NO: 93664 - RNA, 46 nt, Mus musculus
uacccuguaaaagggaggcuuucuauuaaaauucuccccccccccu

SEQ ID NO: 93665 - RNA, 45 nt, Mus musculus
uguagauuaggcuggccucgaacucacagagaucucccuaccucu

SEQ ID NO: 93666 - RNA, 53 nt, Mus musculus
acacauggcccacuugaugguuacuacuuucuaaaaaagagaaucuaugccgu

SEQ ID NO: 93667 - RNA, 94 nt, Mus musculus
uguguugugaaaguguuaguuucccucuacaugggaccaaguccagccuccuuuccucccaccuucagaaccacugaggcaagaggccuggacu

SEQ ID NO: 93668 - RNA, 44 nt, Mus musculus
uaugaauucuuuuuuuaaacaaacauuuuccaaugacauugugc

SEQ ID NO: 93669 - RNA, 58 nt, Mus musculus
ggaaaauguuuguuuaaaaaaagaauucauaauuuacaacuugggaaggccaaagaca

SEQ ID NO: 93670 - RNA, 44 nt, Mus musculus
ugacaacccauaguggguuguguguacaguaauacuacgcaggg

SEQ ID NO: 93671 - RNA, 46 nt, Mus musculus
uucaaagccaaugcugucaguuuuauuaucuguuaucaucccagau

SEQ ID NO: 93672 - RNA, 71 nt, Mus musculus
cuuugaauaguaauguccauaguuuuaagcaagacugcuaaguuguguuguguugacuguaaguccguacg

SEQ ID NO: 93673 - RNA, 45 nt, Mus musculus
guguagaaauggucuugcuaauuuuugaauguucuuugguugaau

SEQ ID NO: 93674 - RNA, 45 nt, Mus musculus
auccuuguguccuguucaauccagugacuacaccggaacugugaa

SEQ ID NO: 93675 - RNA, 45 nt, Mus musculus
uuacaaagacuguuguguucuucugaggacaaagaggccagaaag

SEQ ID NO: 93676 - RNA, 45 nt, Mus musculus
gaucagcaguguugguagaaacccacauuuuccaucuggggaggu

SEQ ID NO: 93677 - RNA, 45 nt, Mus musculus
ggaagccuuuucacugucuuccucagggacuggggugugcuauag

SEQ ID NO: 93678 - RNA, 24 nt, Mus musculus
ggaggugaaagcuguggaccccag

SEQ ID NO: 93679 - RNA, 46 nt, Mus musculus
cugauccuacccugucagguuggcuaaaucuaucccagugauugac

SEQ ID NO: 93680 - RNA, 45 nt, Mus musculus
agcugugagagucccugugggaggggcaugagugggaccggagag

SEQ ID NO: 93681 - RNA, 46 nt, Mus musculus
ugguuaacuuaccugauaagacaacuggugccucacagcugcaagg

SEQ ID NO: 93682 - RNA, 41 nt, Mus musculus
gacagagagagagacagagagagagagacagagagagcaug

SEQ ID NO: 93683 - RNA, 42 nt, Mus musculus
ggugagacagacagacagagagagagagagagagagagagag

SEQ ID NO: 93684 - RNA, 46 nt, Mus musculus
uugccauguguucugguuuuuaauggacgauuauagcagcuaagau

SEQ ID NO: 93685 - RNA, 46 nt, Mus musculus
uaguagaauaacugugcuaaaucacaaacuaguuucugagccagau

SEQ ID NO: 93686 - RNA, 46 nt, Mus musculus
auuuuuagcuuucuuaauuuuuaagauauuaauucugacuccuaua

SEQ ID NO: 93687 - RNA, 46 nt, Mus musculus
acaaguacgcuuuccguguuuucucugcagaaucugaaguggagau

SEQ ID NO: 93688 - RNA, 47 nt, Mus musculus
ucuuuauugauuagauccauaggaauccauguuucuaccaguccucg

SEQ ID NO: 93689 - RNA, 24 nt, Mus musculus
ggaagagaaggggaagaagcagau

SEQ ID NO: 93690 - RNA, 45 nt, Mus musculus
cuucugccccccaaguuaauuuugguuuucugguucuguauagau

SEQ ID NO: 93691 - RNA, 46 nt, Mus musculus
uccuaguuagacuuuuugucaguguaacacaagccagggucaucga

SEQ ID NO: 93692 - RNA, 44 nt, Mus musculus
ucacagaauuaccucucagcuaugguggauuuucaggacccaaa

SEQ ID NO: 93693 - RNA, 42 nt, Mus musculus
cgcuccaauauggcuggguaagguucccauggcaagcgccag

SEQ ID NO: 93694 - RNA, 44 nt, Mus musculus
guauugacuccgucuggcgcuugccaugggaaccuuacccagcc

SEQ ID NO: 93695 - RNA, 41 nt, Mus musculus
gaacugagucaggaacugguuacagugauggggauggggau

SEQ ID NO: 93696 - RNA, 41 nt, Mus musculus
ucagaaugcuugaggugggaggcaaggguaggaugucagca

SEQ ID NO: 93697 - RNA, 39 nt, Mus musculus
uucugccuccugaaugcuaggauuaaaggcgagcaccag

SEQ ID NO: 93698 - RNA, 46 nt, Mus musculus
gugcuccucuugcugaugucguacgcaaggauagccccauuggcac

SEQ ID NO: 93699 - RNA, 51 nt, Mus musculus
aaagggaauagauaggaagcaauaggagaguaccugagagagagagaaaga

SEQ ID NO: 93700 - RNA, 46 nt, Mus musculus
gauuuuauuucuauuuuuuuaauuuuuaaauaacauuuauuuggga

SEQ ID NO: 93701 - RNA, 45 nt, Mus musculus
ucaucauaugcccaagauaauaugugcuugcuucuacagccugcc

SEQ ID NO: 93702 - RNA, 42 nt, Mus musculus
gaugcagcucugcugcucccaggcccucgaggcugccuccug

SEQ ID NO: 93703 - RNA, 41 nt, Mus musculus
uuucuguuuucauacugcgcuuugaaugcugacuacuggca

SEQ ID NO: 93704 - RNA, 41 nt, Mus musculus
aauaauggcuguugcaagccaaacauuguucuagggccuug

SEQ ID NO: 93705 - RNA, 42 nt, Mus musculus
cagacaggccuagcucacaccaagggaaaggggagugcaaag

SEQ ID NO: 93706 - RNA, 45 nt, Mus musculus
gguuucuguugcugcaauaaaacaccaugaccaaaaacaaguuga

SEQ ID NO: 93707 - RNA, 29 nt, Mus musculus
ccuuuccuuuccauucucuuccuuucuuu

SEQ ID NO: 93708 - RNA, 41 nt, Mus musculus
cuauuaguagauguggccuuucugaaguagguguggccuug

SEQ ID NO: 93709 - RNA, 45 nt, Mus musculus
caaaacgcuuaaaacagguagaauuggggcuagagagauggcuca

SEQ ID NO: 93710 - RNA, 50 nt, Mus musculus
guucaaaucccagcaaccacaugguggcucacaaccucuguaacaagauu

SEQ ID NO: 93711 - RNA, 45 nt, Mus musculus
caaaaucgauggccuucaugagcucagcacgugucuuucugggag

SEQ ID NO: 93712 - RNA, 46 nt, Mus musculus
accacauggaaaauaaagcauaagaaggguagaugagagcgcucug

SEQ ID NO: 93713 - RNA, 24 nt, Mus musculus
ccguguaaaggagccagaugcagu

SEQ ID NO: 93714 - RNA, 41 nt, Mus musculus
cagaugcccucuucugguaugucugaagacagcuacauagu

SEQ ID NO: 93715 - RNA, 46 nt, Mus musculus
ccuuucucccucagcagcuuguuaauuucgucauucaggucccgaa

SEQ ID NO: 93716 - RNA, 50 nt, Mus musculus
cugagacaggaggauagcugugaguuccagaacagcugauggaggaaggg

SEQ ID NO: 93717 - RNA, 45 nt, Mus musculus
uucaaaucccaacaaccacaugguagcucacaaccauccauaaug

SEQ ID NO: 93718 - RNA, 41 nt, Mus musculus
ccuuguucagccaucaccagagaagcuuccuccugcagccg

SEQ ID NO: 93719 - RNA, 42 nt, Mus musculus
gcuuagugguuuguucuuuguucuguuuuguuugggggggag

SEQ ID NO: 93720 - RNA, 47 nt, Mus musculus
cuaccauuugcuuuuagagaaagaacuuaaaauuggguagaaggcug

SEQ ID NO: 93721 - RNA, 42 nt, Mus musculus
guggcagcgcacaccuuuaauucuaccacuggggaggcggag

SEQ ID NO: 93722 - RNA, 42 nt, Mus musculus
gaaaauugauacucacauggcuuuuucugcauuucgggccua

SEQ ID NO: 93723 - RNA, 45 nt, Mus musculus
uuucucugcaauuccugaauagcuccaaauuaugcuaacucugag

SEQ ID NO: 93724 - RNA, 42 nt, Mus musculus
aaauguguucuacaccuuugccaucaccaucuguacguccag

SEQ ID NO: 93725 - RNA, 50 nt, Mus musculus
aauccaaggccgucauuaugcuaagaauuaaaguuauuuauggaagcuua

SEQ ID NO: 93726 - RNA, 45 nt, Mus musculus
uccaccccuuuccuccuuuuacacugcaaguaaagcucacuggcc

SEQ ID NO: 93727 - RNA, 46 nt, Mus musculus
uggccagugaagaggauucagagaaaauaauacaaccaucaaucag

SEQ ID NO: 93728 - RNA, 45 nt, Mus musculus
ucgcucucucuugggcuccuugcaguccuuggcaauguggccacc

SEQ ID NO: 93729 - RNA, 45 nt, Mus musculus
uuuggacauaggaggcaguccucaaauuuaagagaugggccucag

SEQ ID NO: 93730 - RNA, 45 nt, Mus musculus
gugccuugcuugguguuaguacucugguucucaacuuacugucag

SEQ ID NO: 93731 - RNA, 45 nt, Mus musculus
uaaauuggggauauaacuuaauucccuuuuacuuuaaugcaguca

SEQ ID NO: 93732 - RNA, 49 nt, Mus musculus
cagccgauugcugugcaaugucuccuuuuccaagacccccacccccacc

SEQ ID NO: 93733 - RNA, 45 nt, Mus musculus
aacgcaucucauggaccguaacgguagccacagccgcuucuauga

SEQ ID NO: 93734 - RNA, 42 nt, Mus musculus
accaugaaaugcaaacgacggucacuccugaauggggcagcc

SEQ ID NO: 93735 - RNA, 46 nt, Mus musculus
caggcgcagacaacagagugcgcaggcgcaguccauagugcagugc

SEQ ID NO: 93736 - RNA, 29 nt, Mus musculus
ggcuccaacccccuccagcaccuggagaa

SEQ ID NO: 93737 - RNA, 44 nt, Mus musculus
gaaacucccaucaauccccggaaaugugcucacauccucaccaa

SEQ ID NO: 93738 - RNA, 46 nt, Mus musculus
aucuccagcaugagcuagauugggaaggagaaagguccaggcugag

SEQ ID NO: 93739 - RNA, 46 nt, Mus musculus
aaagaggauaauuaccgcgguccugcuguccgugcccucugccaga

SEQ ID NO: 93740 - RNA, 34 nt, Mus musculus
aaugucugaggccguugucagaggggaaucagac

SEQ ID NO: 93741 - RNA, 42 nt, Mus musculus
gccuacugcaugaugauccgaguggccagcaagcaacuagag

SEQ ID NO: 93742 - RNA, 41 nt, Mus musculus
gacccucugucccuuugaaccuuaaauacagugugcuagag

SEQ ID NO: 93743 - RNA, 50 nt, Mus musculus
aggagcuggcccugaaguagcagcugcuggggaggaaggcagugugagcc

SEQ ID NO: 93744 - RNA, 89 nt, Mus musculus
acuuggaucucagaagaugaacuggcuuaggagccugcaagagcggugaugugagagccauagaaggacuugaaucaguuaaagacaag

SEQ ID NO: 93745 - RNA, 46 nt, Mus musculus
caaaaugauaagugugugugcaugugugugcguguuagugauuugg

SEQ ID NO: 93746 - RNA, 46 nt, Mus musculus
auauuuuaucuuuagggguguaugugugugugugugugugugugug

SEQ ID NO: 93747 - RNA, 44 nt, Mus musculus
uauacacagcaucccacaggaguaagugggaaagccugggggaa

SEQ ID NO: 93748 - RNA, 47 nt, Mus musculus
aguuuggagcucagaacgaagagauguugccuaguaucuugguguug

SEQ ID NO: 93749 - RNA, 46 nt, Mus musculus
caccgcagcagucaaacagccggagaagguagcagccacacggcag

SEQ ID NO: 93750 - RNA, 45 nt, Mus musculus
ugguugugagccaccaugugguugcugggaucugaacucaggauc

SEQ ID NO: 93751 - RNA, 46 nt, Mus musculus
cugggucagucauggugacccugggcuaggaccugccaugaugcau

SEQ ID NO: 93752 - RNA, 61 nt, Mus musculus
uccagggacuagggccucucuucaaguccucuccugagccaguggcccucacagaguccga

SEQ ID NO: 93753 - RNA, 52 nt, Mus musculus
ugaaguucacuguuaaggacugugaucccaacacaggagaaaucgaugaaga

SEQ ID NO: 93754 - RNA, 45 nt, Mus musculus
gugaacuuugaggcagccugggaugagguuggggaugaauuugag

SEQ ID NO: 93755 - RNA, 45 nt, Mus musculus
ucacaaggaugcauucccaggaacuucacaauauugcccacagcc

SEQ ID NO: 93756 - RNA, 54 nt, Mus musculus
ugggaaugcauccuugugagaggucagacaaagugccagaaaacaagaacaccc

SEQ ID NO: 93757 - RNA, 42 nt, Mus musculus
gcuucugcuuuuggacacagugacgaugcaggugacagccag

SEQ ID NO: 93758 - RNA, 45 nt, Mus musculus
guaguguuggacaagauaggaguggggcuuaggccaccucuagcc

SEQ ID NO: 93759 - RNA, 46 nt, Mus musculus
cuaucauucaggaaugcuaggguagauuuugucaccaugccugcaa

SEQ ID NO: 93760 - RNA, 46 nt, Mus musculus
uuagcccuuccugacuguauucuuccugccuaauacccuccccuuc

SEQ ID NO: 93761 - RNA, 42 nt, Mus musculus
aggagcgggacgggcgucucuuaggcggacgcuagcugcgag

SEQ ID NO: 93762 - RNA, 45 nt, Mus musculus
acgcagcccaagagaaggaagaaccgcaagaagaaccagccaggc

SEQ ID NO: 93763 - RNA, 46 nt, Mus musculus
gggccagcugggcuugucuaugcacagccauaacuccagcagugcc

SEQ ID NO: 93764 - RNA, 42 nt, Mus musculus
ugccucccgagugcugggauuaaaggcaugcgcaaccacgcc

SEQ ID NO: 93765 - RNA, 42 nt, Mus musculus
agagccuggcaccacaucccucuagcagaccuggggugaagu

SEQ ID NO: 93766 - RNA, 46 nt, Mus musculus
gguuuggggucaccacgacaugaggaacuguauuaaagucgcagca

SEQ ID NO: 93767 - RNA, 41 nt, Mus musculus
agaugaauagcuaacacuacucugaaaccacaagccacagg

SEQ ID NO: 93768 - RNA, 43 nt, Mus musculus
agauacccucuaaccuucugggaacaggaagucugccacagcu

SEQ ID NO: 93769 - RNA, 46 nt, Mus musculus
acagcugaucuuaaccuuucuuggaauagauugcucugggucagau

SEQ ID NO: 93770 - RNA, 46 nt, Mus musculus
ucuggcugcacccuaaguaccuggcccccucauuuugcccagauga

SEQ ID NO: 93771 - RNA, 45 nt, Mus musculus
cagaccugucccagugacucuaccuuuguucuagaaggcgcuccu

SEQ ID NO: 93772 - RNA, 42 nt, Mus musculus
ggucuuguggucuuuuaccccucccuccuugaagguccugug

SEQ ID NO: 93773 - RNA, 46 nt, Mus musculus
uuacccaacacacacacauacacaaaacacacucgugcacacaaaa

SEQ ID NO: 93774 - RNA, 102 nt, Mus musculus
gcaguuguugaaggggcagugagcacagaguccuucacagaccaagaacacacacguaggccuucaauaugcgucccuccuccuccaaacagaccagaacgu

SEQ ID NO: 93775 - RNA, 64 nt, Mus musculus
acuguacaaugaauucccugaacccaucaaacuggacaagaaugaccgggccaaggccuccgca

SEQ ID NO: 93776 - RNA, 44 nt, Mus musculus
caggccuuccagacaauugcucggaaugcccuuaaacagguggg

SEQ ID NO: 93777 - RNA, 49 nt, Mus musculus
aggcuuggugcuacagcaaaaacaacauuccuuacuucgagaccagugc

SEQ ID NO: 93778 - RNA, 61 nt, Mus musculus
uuucaaaacccucgacagcuggagagacgaguuucucauccaggccagcccccgggauccc

SEQ ID NO: 93779 - RNA, 82 nt, Mus musculus
aacgguuccagucucuugguguggccuucuacagaggugcagauugcuguguucugguguuugaugugacugcccccaacac

SEQ ID NO: 93780 - RNA, 45 nt, Mus musculus
aauucccagcaaccacaugguggcucacagccaucuguauugggg

SEQ ID NO: 93781 - RNA, 42 nt, Mus musculus
auuaaguuucuagaacuugggaaauuucacuuauuaguagau

SEQ ID NO: 93782 - RNA, 46 nt, Mus musculus
cgcccagcccaggauugagagccacacucacugcugcaguguaucc

SEQ ID NO: 93783 - RNA, 42 nt, Mus musculus
cuuuccagcaguaggaaaacaggugcugauaaaacacaggag

SEQ ID NO: 93784 - RNA, 41 nt, Mus musculus
augccaauaaccccagcauuugggaggcagaggcagguaga

SEQ ID NO: 93785 - RNA, 42 nt, Mus musculus
ucuagaaguguggguaagcugcaggguuugggcagggguucg

SEQ ID NO: 93786 - RNA, 46 nt, Mus musculus
gucauaccuccgugcuuuucaaacuuaccauuauauuuguggagaa

SEQ ID NO: 93787 - RNA, 45 nt, Mus musculus
aaguauuuucuuguuuuugaaagugccuuccagugggguagagua

SEQ ID NO: 93788 - RNA, 45 nt, Mus musculus
ucuaggaagaaaguguugcugaaggucaucauccugggggacucu

SEQ ID NO: 93789 - RNA, 46 nt, Mus musculus
uuaaagucuuucaucuuaaacuccucagaaugaaaaguccaaaguu

SEQ ID NO: 93790 - RNA, 65 nt, Mus musculus
guuuuucguuuuuuguuuuuuguuuauuuuaaauacugagauggaaucucaacuauguagcccug

SEQ ID NO: 93791 - RNA, 46 nt, Mus musculus
uugaucaguacauucaagaagaacagaauugaauguggucucgcug

SEQ ID NO: 93792 - RNA, 41 nt, Mus musculus
uucugcccucaaaaaggacuucauuauuuuuacugcaguga

SEQ ID NO: 93793 - RNA, 46 nt, Mus musculus
gaguucuuagcuaaauugccaaaggcacuuugccacacagucagag

SEQ ID NO: 93794 - RNA, 41 nt, Mus musculus
caguagcaccucaguugcccagguacaggaaaggccccgga

SEQ ID NO: 93795 - RNA, 42 nt, Mus musculus
auuucugaggucugugcacaugcuauucccucugccugaauc

SEQ ID NO: 93796 - RNA, 64 nt, Mus musculus
aaaauugguccccccuuguaagggagagcauagggaacauuuauuaucuugcugcuucagagac

SEQ ID NO: 93797 - RNA, 77 nt, Mus musculus
uuuccaacugggggaacaccuguuuagcauuugugagauccugccagcauguuugauugauaacaucuuaaaaaaau

SEQ ID NO: 93798 - RNA, 46 nt, Mus musculus
uagguaacauucuuauauuaucaauuuuguuguuugguuuugaggu

SEQ ID NO: 93799 - RNA, 46 nt, Mus musculus
ggguuggauacuggguaauggaacaagaacgguuauaggcuuagau

SEQ ID NO: 93800 - RNA, 46 nt, Mus musculus
acuucccauucauagcugaccauugucgaggaguuggacuacagau

SEQ ID NO: 93801 - RNA, 46 nt, Mus musculus
cuuaucaaacuaauaaccccacuaaauuccauuaauacaacuaaua

SEQ ID NO: 93802 - RNA, 42 nt, Mus musculus
uuuucaaaguagaauaaugaucacuggagacugggaaagaug

SEQ ID NO: 93803 - RNA, 48 nt, Mus musculus
agaaaaaaggaggggaaauuacacacacacacacacacauacacacac

SEQ ID NO: 93804 - RNA, 46 nt, Mus musculus
cuggaucugggacuagucuuguccuagguugaccuugaacucagau

SEQ ID NO: 93805 - RNA, 45 nt, Mus musculus
aauuaacaauugagaauacagggacauaccuucauagccaguuga

SEQ ID NO: 93806 - RNA, 45 nt, Mus musculus
cugccuaccugaccuuugcaucauucuuucugcucaagugaaaga

SEQ ID NO: 93807 - RNA, 46 nt, Mus musculus
aucagagcuuuuaaccacugagcuaucuaucuagcccugagauaag

SEQ ID NO: 93808 - RNA, 45 nt, Mus musculus
uugaaggcacauuuuugguuuguguauauguguauggggugugug

SEQ ID NO: 93809 - RNA, 45 nt, Mus musculus
ugugugugugugugugugugagugugugugugugugugaugggua

SEQ ID NO: 93810 - RNA, 67 nt, Mus musculus
gugagugugugugugugugugagugugugagugugagugugugugagugugugugugugugugagug

SEQ ID NO: 93811 - RNA, 51 nt, Mus musculus
gugugugugagugugugugugugugugugagugugugagugugagugugug

SEQ ID NO: 93812 - RNA, 46 nt, Mus musculus
gugugagugugugagugugugugugugugagugugugugugagugu

SEQ ID NO: 93813 - RNA, 47 nt, Mus musculus
agaaugagugugugugugugagugugugugugugugagugugagugu

SEQ ID NO: 93814 - RNA, 45 nt, Mus musculus
agaaaaugauugccuucuagacagaaguucacgggucagccaggu

SEQ ID NO: 93815 - RNA, 47 nt, Mus musculus
aguagucauuacccuuaauugcugagccaccucuuauuuuggcagau

SEQ ID NO: 93816 - RNA, 45 nt, Mus musculus
gaguucaugucucucugucccccucucccucacacacccccuuuc

SEQ ID NO: 93817 - RNA, 44 nt, Mus musculus
uuuuuaaaaauauuuauuuauuguauaaguacacugccuucaga

SEQ ID NO: 93818 - RNA, 41 nt, Mus musculus
guuuacugcugggcuuucuguuuuauuugguuuggagaaga

SEQ ID NO: 93819 - RNA, 44 nt, Mus musculus
gcaggcauagcagaugaggcuguucuuuauaacucccucugaau

SEQ ID NO: 93820 - RNA, 46 nt, Mus musculus
cuuuucauccagcuccuccccucccugcccaacaccaccaccacca

SEQ ID NO: 93821 - RNA, 45 nt, Mus musculus
aaauagcuuaaagaaaauguuaaaaguucuaugacuaaaguggga

SEQ ID NO: 93822 - RNA, 23 nt, Mus musculus
ugaauaaaaaguggaaaggcagg

SEQ ID NO: 93823 - RNA, 48 nt, Mus musculus
gggucuuuuguagucuaggcugccaaaaauucuccauguacuuucaga

SEQ ID NO: 93824 - RNA, 46 nt, Mus musculus
aguagccucuucagggaguuaacucacuuuacuucaggaaccagga

SEQ ID NO: 93825 - RNA, 49 nt, Mus musculus
uccuaggauugccuguguuggcacagagcagauuugaggcagccugagg

SEQ ID NO: 93826 - RNA, 47 nt, Mus musculus
uaccaaauuuagaacagcuacuugcaaaauguccccuuaaggagaga

SEQ ID NO: 93827 - RNA, 50 nt, Mus musculus
caugauaguuuacaucagagccgccuugaggacucucccugaccaguuuc

SEQ ID NO: 93828 - RNA, 46 nt, Mus musculus
uauccuuacauuguucaccuuuuagagaacauuaaagacuagagau

SEQ ID NO: 93829 - RNA, 66 nt, Mus musculus
cuuucugcaccucuugguguugcucuucucguugugaccaagacccuuaccugugcuggucugugc

SEQ ID NO: 93830 - RNA, 50 nt, Mus musculus
uuucaaugauaaaucaucuaaguucuauccaaguuggcaaauguggcuga

SEQ ID NO: 93831 - RNA, 45 nt, Mus musculus
uuagaugccacuucguccagugcacugucaugugggagcagagga

SEQ ID NO: 93832 - RNA, 48 nt, Mus musculus
ugugggccugagguggguauugggugucuuacuuuacugcucgccuuu

SEQ ID NO: 93833 - RNA, 69 nt, Mus musculus
cauggcuggguuguguccucagagaauuguaaaaugaugagucucagagccaggagcuguuuaggaagg

SEQ ID NO: 93834 - RNA, 73 nt, Mus musculus
ugccacuucguccagugcacugucaugugugagcagaggcuggagaagacaaguggcuggcaccuucauuugg

SEQ ID NO: 93835 - RNA, 106 nt, Mus musculus
gaaagugaauuauaacuacuucugaagcuggccagacuaaaguuugguguccuugguugucaauaguuuaguuugcuacccggccugguauacuuacgggcuguaa

SEQ ID NO: 93836 - RNA, 41 nt, Mus musculus
ggauccucgggcugggcgcguccccaccggcaaccugcugg

SEQ ID NO: 93837 - RNA, 41 nt, Mus musculus
ggccugcguugugucuccuccuccguugacccugcggugag

SEQ ID NO: 93838 - RNA, 42 nt, Mus musculus
cggcuuuccagagcuuugcgacgcgccccccucccaccccag

SEQ ID NO: 93839 - RNA, 78 nt, Mus musculus
cugugguucaaaucgagauucguugauaagcaggcaggauccaggaaccagguagagccaaagugucugccaggcguc

SEQ ID NO: 93840 - RNA, 45 nt, Mus musculus
agccaagcucccucuggucuccguggaaggaaaaggacaauuuag

SEQ ID NO: 93841 - RNA, 41 nt, Mus musculus
uaguagaccaccaggcugaacugccuggggcgaggccgugg

SEQ ID NO: 93842 - RNA, 42 nt, Mus musculus
guccagcggccaaagcggcgggagcagccaaugggggggcgg

SEQ ID NO: 93843 - RNA, 42 nt, Mus musculus
cccccgcuucacgucugugcaggagucggcagcuggcgccag

SEQ ID NO: 93844 - RNA, 46 nt, Mus musculus
gccaaccucuccccaaagcauaagaacguaaucgcccacaggagau

SEQ ID NO: 93845 - RNA, 44 nt, Mus musculus
gggguuaguuuguguauauauugucaaaguguuacgggggcgug

SEQ ID NO: 93846 - RNA, 44 nt, Mus musculus
acuacugugucuugggaaccaggcgaagguggggcggcccugga

SEQ ID NO: 93847 - RNA, 44 nt, Mus musculus
gcuguguguuauuuaaauaagcggaggagaccgggagcugggag

SEQ ID NO: 93848 - RNA, 46 nt, Mus musculus
gccagccagaggugaggcguggaagaggggaggccuggucucuaga

SEQ ID NO: 93849 - RNA, 46 nt, Mus musculus
uucuccuaucacagguacccggucccugccugcccugcccccaucg

SEQ ID NO: 93850 - RNA, 45 nt, Mus musculus
gguuaacaggccacugaccaugaagaaggaagggauccagacccg

SEQ ID NO: 93851 - RNA, 45 nt, Mus musculus
uaggcaagaagaaaaauaauuuauuuugcucuuauuucuuacaag

SEQ ID NO: 93852 - RNA, 46 nt, Mus musculus
aguuugguuuucgcuuugaguauuuucuuauuuaucuuagaggggg

SEQ ID NO: 93853 - RNA, 42 nt, Mus musculus
ggagggccugccacuccaucccugaacccacucaggauagca

SEQ ID NO: 93854 - RNA, 70 nt, Mus musculus
ccagaagcgcaugguacagacucccugaaugaaccauccugcccagcugcaagccagaccacagugccag

SEQ ID NO: 93855 - RNA, 42 nt, Mus musculus
ccucagcccugaguccaagaagauccugacaccuacacucaa

SEQ ID NO: 93856 - RNA, 45 nt, Mus musculus
ggauuacaucaucugagcugagaggcugacaaagccagauacagg

SEQ ID NO: 93857 - RNA, 46 nt, Mus musculus
uuuaaagcaaauugcaucuuuguuuacauacaugaccguugcagag

SEQ ID NO: 93858 - RNA, 42 nt, Mus musculus
cagugucccaaugagacauaccacuucaagccacagccaggu

SEQ ID NO: 93859 - RNA, 46 nt, Mus musculus
aggcagacucaugaaggaacauuucacugaagcagacacaggcagg

SEQ ID NO: 93860 - RNA, 45 nt, Mus musculus
auugaggcauuucaaagcaauuguaaaaauuauaugaaccccauc

SEQ ID NO: 93861 - RNA, 46 nt, Mus musculus
gcucuuucacaagugcugggacugcaagcacagaaagccaccauag

SEQ ID NO: 93862 - RNA, 46 nt, Mus musculus
cuuggcacggcugccugcagcacaggcugcugcuccaaccccagau

SEQ ID NO: 93863 - RNA, 46 nt, Mus musculus
cucugccuccagaggaaugggaagaaaaguuccccagacaacagaa

SEQ ID NO: 93864 - RNA, 46 nt, Mus musculus
acagauaauauugcccucucacaaaggaaggcaguagucaccagag

SEQ ID NO: 93865 - RNA, 46 nt, Mus musculus
ugggaguauucuuggggaaugggcagguaaugcacagguugcaggu

SEQ ID NO: 93866 - RNA, 46 nt, Mus musculus
ggugugcagauucucaugggaaaggacagauagugagcuguggaua

SEQ ID NO: 93867 - RNA, 46 nt, Mus musculus
gggaacaggguaucaucgacagugccuucggccaaaguggcaaguu

SEQ ID NO: 93868 - RNA, 45 nt, Mus musculus
uugagggugguaaacaugaaaguuaccccaggugaguagcauagg

SEQ ID NO: 93869 - RNA, 45 nt, Mus musculus
guuuaggagugcccagucauuggguuagaauagugugugugugug

SEQ ID NO: 93870 - RNA, 45 nt, Mus musculus
gugggagggugggugagguccuucaucgacacuguggggggagga

SEQ ID NO: 93871 - RNA, 42 nt, Mus musculus
ugugggcucacucacacaaguaucauuucccuugcccuuagg

SEQ ID NO: 93872 - RNA, 46 nt, Mus musculus
aacugcugagggagcuugauccuuccagcaaccacaggcggauaga

SEQ ID NO: 93873 - RNA, 45 nt, Mus musculus
aggaguggacagucaccuuuaucagauguggggcaguggcagaga

SEQ ID NO: 93874 - RNA, 46 nt, Mus musculus
aauauaaaacaugaguuagauuuugaucagaaagaaagaaugagug

SEQ ID NO: 93875 - RNA, 46 nt, Mus musculus
gucccugaaugucuuggucaguaucuuaaaugcuuucuugccagua

SEQ ID NO: 93876 - RNA, 46 nt, Mus musculus
ucuguguguauucuagcccuagauauacagaagguagcccaagauc

SEQ ID NO: 93877 - RNA, 42 nt, Mus musculus
caccuuggccuucuguuucugcuaccuauaaaggcaucaucu

SEQ ID NO: 93878 - RNA, 46 nt, Mus musculus
ucccauagugcccugggugcucaggucaagauagcaagacuuuguc

SEQ ID NO: 93879 - RNA, 46 nt, Mus musculus
ugcaucugugaggaauguucagugguccuugagugaguggcuagag

SEQ ID NO: 93880 - RNA, 26 nt, Mus musculus
gagggggaauaggauugggauuuuag

SEQ ID NO: 93881 - RNA, 41 nt, Mus musculus
cagccucucagcuacagggaggcugugggaugaugguguag

SEQ ID NO: 93882 - RNA, 42 nt, Mus musculus
gccugggcuuguuguguauggucaagauggaugcuagcagug

SEQ ID NO: 93883 - RNA, 46 nt, Mus musculus
auuuuaaaaaaggagugccaagccccaguaugaauuugacccaagu

SEQ ID NO: 93884 - RNA, 41 nt, Mus musculus
gcuugacuucucagaaggagccaaaucugccacagccuccc

SEQ ID NO: 93885 - RNA, 46 nt, Mus musculus
gcagcagcauuaaagggcaagggucaacauacaggaugcggaaagg

SEQ ID NO: 93886 - RNA, 47 nt, Mus musculus
cccuauuucauguuuucucaccugcuuuggauaacaccggccuuuua

SEQ ID NO: 93887 - RNA, 46 nt, Mus musculus
aggcucuuucucucgggucuuuaaggaauucuuugucuauacaguu

SEQ ID NO: 93888 - RNA, 45 nt, Mus musculus
ucccuuucuuacccugggagggucucacaaccucuccucagagau

SEQ ID NO: 93889 - RNA, 45 nt, Mus musculus
uacaggagaggucaccaagaguuuuauuucuggauuggcaggcag

SEQ ID NO: 93890 - RNA, 45 nt, Mus musculus
caugccauugccaugguccaaguauuacuccaucaauccagagga

SEQ ID NO: 93891 - RNA, 40 nt, Mus musculus
ccugcuuccugugggagucacuuguuaacugccuaguucc

SEQ ID NO: 93892 - RNA, 45 nt, Mus musculus
cacuguggguagugcccuuccugggcagauggaccugggcugugu

SEQ ID NO: 93893 - RNA, 46 nt, Mus musculus
cuucugucuccaagaaaggcuaugcagagccaugacuaccauggaa

SEQ ID NO: 93894 - RNA, 41 nt, Mus musculus
acagaugaagcuauguccacccacaugaccuauauugcagc

SEQ ID NO: 93895 - RNA, 45 nt, Mus musculus
ccuccaugauccccccccuccuuaugggcagaguuuggucuggua

SEQ ID NO: 93896 - RNA, 42 nt, Mus musculus
acugccuuucuuuucuugaagugugauuuuuggccccaaucu

SEQ ID NO: 93897 - RNA, 46 nt, Mus musculus
cccauuuaguacagucaugacgaucaaauauucaagcccaggagag

SEQ ID NO: 93898 - RNA, 46 nt, Mus musculus
auaauaaacacgauaauaaaugaaugaauuagaaugggcagugaaa

SEQ ID NO: 93899 - RNA, 46 nt, Mus musculus
ucuuagucaucagucuucucuugagggcucaauccuaacaccaggg

SEQ ID NO: 93900 - RNA, 46 nt, Mus musculus
gccuaagaagcauaaacaaggggaagcagugagggacugucauagg

SEQ ID NO: 93901 - RNA, 42 nt, Mus musculus
uuucuaucaggagacaccaggccauugaacaugcccugagaa

SEQ ID NO: 93902 - RNA, 45 nt, Mus musculus
cacaaacaacccaguacacacugguucgugagacuugccccguga

SEQ ID NO: 93903 - RNA, 44 nt, Mus musculus
acucucugugucauauacaucuaucuuccuacuuucccccuuca

SEQ ID NO: 93904 - RNA, 40 nt, Mus musculus
gcuuggauaaugaugagguguauuaauggcauauuuagau

SEQ ID NO: 93905 - RNA, 41 nt, Mus musculus
gauuuuaucuggagauuuaggugagucauauuccugguagu

SEQ ID NO: 93906 - RNA, 59 nt, Mus musculus
cccagcugggguugauuagcuaagugaggaaaugcuggggaacaaggaguaaaugacag

SEQ ID NO: 93907 - RNA, 53 nt, Mus musculus
aaagaaagagagaaacagagagagagaagagagagagacacacacacagagac

SEQ ID NO: 93908 - RNA, 65 nt, Mus musculus
gugacauaccccuacauuucagacuguuguacuagcaaaacccccagacaggaagagggagaggg

SEQ ID NO: 93909 - RNA, 54 nt, Mus musculus
uuugugaccaccaaggcugcugaaauugggagaugacugccgagaaagcacgac

SEQ ID NO: 93910 - RNA, 53 nt, Mus musculus
gugugguacaccugcacccccugaugaugugucagugaucuuacuggucagga

SEQ ID NO: 93911 - RNA, 50 nt, Mus musculus
ccucagccacccuuuuuacccauccacauccuaaccugcagccucgggca

SEQ ID NO: 93912 - RNA, 80 nt, Mus musculus
aacagggucaggagcugaagugcugagaccaaggacuuggaguaaaggugagaccaaugucuuccucuuggguaggcaga

SEQ ID NO: 93913 - RNA, 47 nt, Mus musculus
cuugaccaucuccgacccugugaagacauguugaccgcuugagagag

SEQ ID NO: 93914 - RNA, 46 nt, Mus musculus
gggucaaggcaccgugaugacugggacuauccucucaggcacuauc

SEQ ID NO: 93915 - RNA, 46 nt, Mus musculus
gaagucccagauuuccaucccaacgagagaccccucuggaccauuc

SEQ ID NO: 93916 - RNA, 42 nt, Mus musculus
ugaaacugaagcuccacagggcaucucagaacucauugaggu

SEQ ID NO: 93917 - RNA, 45 nt, Mus musculus
ucugcucuuucuacuccuacagcaaaggcuccaaauaggccagau

SEQ ID NO: 93918 - RNA, 45 nt, Mus musculus
gaucugccugccucugccuccugaguguugggauuaaaggcuugu

SEQ ID NO: 93919 - RNA, 46 nt, Mus musculus
gcgcacgcacgcguacacacacacacacacacacacacacacacac

SEQ ID NO: 93920 - RNA, 45 nt, Mus musculus
ugucacaguauaucugugugugugugugugugugugugugugugu

SEQ ID NO: 93921 - RNA, 44 nt, Mus musculus
uguggguggaggagcauucucauagaggcagugcagaugggaga

SEQ ID NO: 93922 - RNA, 46 nt, Mus musculus
ucccaccuagggauccaucccaucuucagacaccaaacccagacac

SEQ ID NO: 93923 - RNA, 50 nt, Mus musculus
cacagagagagagaagagagagagagagaagagagaagaggagagagaga

SEQ ID NO: 93924 - RNA, 46 nt, Mus musculus
uaauccgaugaguugaugcauucagcaugcguacauccacccagac

SEQ ID NO: 93925 - RNA, 47 nt, Mus musculus
ucucucucucccucccucccucccucucucuggccacuccuuucggu

SEQ ID NO: 93926 - RNA, 61 nt, Mus musculus
aauagaccuguuagcagaagggaagagacaggcagcgauugacaaaaugaccaagaaaaug

SEQ ID NO: 93927 - RNA, 74 nt, Mus musculus
augcagacacaguccgcagagugccuugugauuggccagaucgccugccagaagcugguuguggugcugaacaa

SEQ ID NO: 93928 - RNA, 46 nt, Mus musculus
uacaccuguacuuccagcuguauuguauucuuaccugaccaugcaa

SEQ ID NO: 93929 - RNA, 41 nt, Mus musculus
gggggcaaugggaucuuuaauagaaaagcaacucugccagg

SEQ ID NO: 93930 - RNA, 46 nt, Mus musculus
uuguuuguuuguuuggguguuuuguuuugugugugugugugugugu

SEQ ID NO: 93931 - RNA, 33 nt, Mus musculus
gcaccuccucugaauggccacaggcucacucuu

SEQ ID NO: 93932 - RNA, 45 nt, Mus musculus
ucauguaaguaaagugccuggagaaugagaaugggcagcagagag

SEQ ID NO: 93933 - RNA, 33 nt, Mus musculus
cuuccuugggucgcuuugucuacucugcagauc

SEQ ID NO: 93934 - RNA, 41 nt, Mus musculus
guguaguguuggggucaguagcauagagauacagucuaagg

SEQ ID NO: 93935 - RNA, 46 nt, Mus musculus
cgaccaugacaguguuaguuuauuccacaccacaucuagcccagaa

SEQ ID NO: 93936 - RNA, 66 nt, Mus musculus
cagacuuuucuguggacuuggauacugagccccagccaccacagagaaaacaggaguggcaugugc

SEQ ID NO: 93937 - RNA, 93 nt, Mus musculus
guguaacuggccuuuugucucaugcuauuagggauggcuugcaguaagacuaaugguaagauuagagauguggcuuuuguucuaagaugaugg

SEQ ID NO: 93938 - RNA, 46 nt, Mus musculus
aaagagaccaaaaaguuaauaauuuucuuacacuauaaugccagau

SEQ ID NO: 93939 - RNA, 46 nt, Mus musculus
uggcuuagggccaaccugucacccaggauuauaugagcacagaaca

SEQ ID NO: 93940 - RNA, 45 nt, Mus musculus
auugauaggccucucuucuaggccagacagauucucugcugagcu

SEQ ID NO: 93941 - RNA, 45 nt, Mus musculus
uuauguauguucuuuauuguauugaacauucacaccauguguagu

SEQ ID NO: 93942 - RNA, 45 nt, Mus musculus
gaagcuuuuacuauuucugcuaacuauguuauuugcugugggguu

SEQ ID NO: 93943 - RNA, 23 nt, Mus musculus
gguugucuuguucccgugugcac

SEQ ID NO: 93944 - RNA, 44 nt, Mus musculus
agaagcacaucugcuguugugugagucaguaucuaaagaggaaa

SEQ ID NO: 93945 - RNA, 45 nt, Mus musculus
acccucuugcaugacacagcucccauuaauucuagccccuggcug

SEQ ID NO: 93946 - RNA, 46 nt, Mus musculus
ucucuggugcaacuuuuuaaaaaugugugcgguauuauugcaguaa

SEQ ID NO: 93947 - RNA, 46 nt, Mus musculus
guuucuuuggcaugggguaagacccagugguccacagugcucagug

SEQ ID NO: 93948 - RNA, 46 nt, Mus musculus
gagccuagcacuugugccuuguggguugagaugaggggugggaagg

SEQ ID NO: 93949 - RNA, 45 nt, Mus musculus
gggcauuuccuggaggagugguugucuuugaagguuuguggcagg

SEQ ID NO: 93950 - RNA, 46 nt, Mus musculus
gagccaucucuccagccccucugggccucucuuaguguucccagaa

SEQ ID NO: 93951 - RNA, 45 nt, Mus musculus
gauucccuggaacuggaguuaaggguggguaucagucaucaugug

SEQ ID NO: 93952 - RNA, 45 nt, Mus musculus
ggacucuuauucuagggguuucaaauucagagaugcauaaggaau

SEQ ID NO: 93953 - RNA, 42 nt, Mus musculus
gcauauuuuuuugucaauuugucuuacaagacagauauauau

SEQ ID NO: 93954 - RNA, 42 nt, Mus musculus
cuucugcagagggaagcuugccaggucuuucaggagggaggg

SEQ ID NO: 93955 - RNA, 47 nt, Mus musculus
gaagagugaguguuuucuaggaaccaugagaaucuauugcauuaggu

SEQ ID NO: 93956 - RNA, 42 nt, Mus musculus
uugguguucuccucuaugugugguuuggugcugggggcuguu

SEQ ID NO: 93957 - RNA, 46 nt, Mus musculus
uuuccaacagaacuucccguugaauauuguugaaaacuuaccagug

SEQ ID NO: 93958 - RNA, 42 nt, Mus musculus
aggacacauacuaccuuuuagacaccauucaagaccccagau

SEQ ID NO: 93959 - RNA, 46 nt, Mus musculus
aacccagcuugcagacaaacaaggcaggacuagaacauggagucau

SEQ ID NO: 93960 - RNA, 42 nt, Mus musculus
ggugcaucuggugaggaagugugaugaggugcuaggccaguc

SEQ ID NO: 93961 - RNA, 46 nt, Mus musculus
accuauaucaugugaugugaugugugaguguguuguggcacaagca

SEQ ID NO: 93962 - RNA, 42 nt, Mus musculus
agcgggugacuuugcuuugguuggggugacagugugggagcg

SEQ ID NO: 93963 - RNA, 46 nt, Mus musculus
auucugcugucuggaacagccucugugaugucuucuacuaccaggu

SEQ ID NO: 93964 - RNA, 44 nt, Mus musculus
aaaaaacacuccucaaccuuuguugaggcccaggaugugggcac

SEQ ID NO: 93965 - RNA, 46 nt, Mus musculus
caggaaacauacacagaaacgcagacaaggugcagaaaugaaagau

SEQ ID NO: 93966 - RNA, 41 nt, Mus musculus
gacgcggacacaguucucaccuucacugccgugcaccgaga

SEQ ID NO: 93967 - RNA, 43 nt, Mus musculus
uggucgacugccccgggcacgccucccucauccggaccaucau

SEQ ID NO: 93968 - RNA, 45 nt, Mus musculus
uuuagcacacacaagccuggugcccggucucugcggccccuguga

SEQ ID NO: 93969 - RNA, 46 nt, Mus musculus
ggaaguucuccaucagcaccucugucuuuuugaucucaguugagua

SEQ ID NO: 93970 - RNA, 46 nt, Mus musculus
agucuugagcccuaugaucacauggcugauaguuuugccguaccca

SEQ ID NO: 93971 - RNA, 45 nt, Mus musculus
ccaguggggagcaugucagauaggauaagggugaauaguccagga

SEQ ID NO: 93972 - RNA, 56 nt, Mus musculus
ucgauauccagcauguggaccucaucgacaaaaagcacuccagggaccagcucggc

SEQ ID NO: 93973 - RNA, 57 nt, Mus musculus
aagaugacaaugggggcgauggaggacuccagggcucggugcagguagguaaagcac

SEQ ID NO: 93974 - RNA, 46 nt, Mus musculus
ggguugagggcaucaugugggcuuuccagcaagcuaaguggcagcc

SEQ ID NO: 93975 - RNA, 42 nt, Mus musculus
cugcacuucaaaguagccuggaauuuguuccugggggcaggg

SEQ ID NO: 93976 - RNA, 45 nt, Mus musculus
ggcucuaugacagcuggacaucuauaucuaugucuagauguagaa

SEQ ID NO: 93977 - RNA, 45 nt, Mus musculus
aaaaugcuuacaucuuggacaacagacacaugaguggaggcacuc

SEQ ID NO: 93978 - RNA, 46 nt, Mus musculus
cguguauagcaugguccugaugaucaucacccugucuagcagaucc

SEQ ID NO: 93979 - RNA, 45 nt, Mus musculus
cuuuccucccuuuccucaagcucaccagaaauagcugggcaagac

SEQ ID NO: 93980 - RNA, 45 nt, Mus musculus
caggaucucacuaugccuaaaaccugugauccuccugccucagcc

SEQ ID NO: 93981 - RNA, 46 nt, Mus musculus
gcugaggaggacccuccaccucaauuucucaagugcuggccaagua

SEQ ID NO: 93982 - RNA, 46 nt, Mus musculus
agugcuauuaaugagaaauacuggcaaggccacacugcacgggcca

SEQ ID NO: 93983 - RNA, 46 nt, Mus musculus
agaggcaugggggcuggaagacacugaguccuagcaccaggcucca

SEQ ID NO: 93984 - RNA, 46 nt, Mus musculus
uacccccacauccagagcagcucacagcugccuuucgcccccucuu

SEQ ID NO: 93985 - RNA, 46 nt, Mus musculus
ccuuuguacccuugcuguuaaaccguuucugucuuaagaggggccu

SEQ ID NO: 93986 - RNA, 44 nt, Mus musculus
uugaugggauagguguuguacuggccucgguaacgcgccgacuu

SEQ ID NO: 93987 - RNA, 47 nt, Mus musculus
gaugguggcaaucagguucaugagguuggggagguucuggcgguaga

SEQ ID NO: 93988 - RNA, 46 nt, Mus musculus
caguuguggccuaucuucuauucagggauaagggaguggcagccag

SEQ ID NO: 93989 - RNA, 46 nt, Mus musculus
guuuucagagagcauggccucaaauucaaaacccuccugccucagg

SEQ ID NO: 93990 - RNA, 41 nt, Mus musculus
aacacuagagaucaagagagcuguguucucaaagcaggaca

SEQ ID NO: 93991 - RNA, 34 nt, Mus musculus
auacuaagaagaugaagagggugauggcugucca

SEQ ID NO: 93992 - RNA, 46 nt, Mus musculus
gcccggccccgacugcgcuccacuucgagugaggaggcgcugcuag

SEQ ID NO: 93993 - RNA, 46 nt, Mus musculus
ugguggagauguccagauagcugccggaaccccauuuuguguugag

SEQ ID NO: 93994 - RNA, 46 nt, Mus musculus
gacagagagucaaggauagagacagagaaauggagaggggagaggg

SEQ ID NO: 93995 - RNA, 45 nt, Mus musculus
aaaagagacagagauagagagagacagaagagacagaguuggaga

SEQ ID NO: 93996 - RNA, 46 nt, Mus musculus
gaguggaggugaagguuuaggaguugccauuugugagcagugaugu

SEQ ID NO: 93997 - RNA, 46 nt, Mus musculus
ggacguaggggguguguggcaauaaagcuugaauucacucugggga

SEQ ID NO: 93998 - RNA, 53 nt, Mus musculus
aggauuucagacucaaccucagaaugaguggcaggccaugagaaaggaaguga

SEQ ID NO: 93999 - RNA, 42 nt, Mus musculus
cuauauacguaguacaacacgugaaugaagauguccggggag

SEQ ID NO: 94000 - RNA, 46 nt, Mus musculus
uggcacgugugugaaggugcugacuauugaaccuccuccagcagau

SEQ ID NO: 94001 - RNA, 41 nt, Mus musculus
gcagcacacccaggguggcccagagcugaugucaccuuugg

SEQ ID NO: 94002 - RNA, 47 nt, Mus musculus
cggugcucgcaguaccuacuucgccaacaugcuggacaccaagugga

SEQ ID NO: 94003 - RNA, 41 nt, Mus musculus
cccuauucgccgugcacugagagacuacaaacaggucacug

SEQ ID NO: 94004 - RNA, 45 nt, Mus musculus
gugagguggcuaagcacagggacuugaaagaagcgggagaugcau

SEQ ID NO: 94005 - RNA, 45 nt, Mus musculus
gaggccaagccccagguucagaaggcugagaauuuggucuuuuaa

SEQ ID NO: 94006 - RNA, 46 nt, Mus musculus
aagcugaugcaggcacugggggcggggaaggaggggaacagaacag

SEQ ID NO: 94007 - RNA, 45 nt, Mus musculus
ugcauucaaauugagggacggaucauuaacucugagguggcaucu

SEQ ID NO: 94008 - RNA, 41 nt, Mus musculus
cgcccacucgcccgaagaauagcucacuaccaagaccccgc

SEQ ID NO: 94009 - RNA, 46 nt, Mus musculus
ucagauccuucucagguauuucaaugguguccugcugggccccaaa

SEQ ID NO: 94010 - RNA, 42 nt, Mus musculus
cuggccacuuuauccugguccaucugguugagcuucgggcgg

SEQ ID NO: 94011 - RNA, 41 nt, Mus musculus
auccuaggacaagaaaucaggagagcacaauaagggugugg

SEQ ID NO: 94012 - RNA, 53 nt, Mus musculus
agggccagagccaggccucucuugaugucuucaugcccauagauggagggugc

SEQ ID NO: 94013 - RNA, 46 nt, Mus musculus
auuugcugauccuuggagagaccggugaucaucuucacguccucau

SEQ ID NO: 94014 - RNA, 81 nt, Mus musculus
caccagaucagcgaggagaauggcauccuuggaacggggcagucggccagccgccaccuugccgggacucuccuggaugcg

SEQ ID NO: 94015 - RNA, 58 nt, Mus musculus
agaauaugauuuaggaacuccgucaaggaggccgaagcccccaggauggaaaagggag

SEQ ID NO: 94016 - RNA, 46 nt, Mus musculus
aaauggcaccaucuucaucagacacuagaaaacaugaaacugucag

SEQ ID NO: 94017 - RNA, 45 nt, Mus musculus
aacucccaguaagaaaaggaguuaagggcuggagacaaggcucag

SEQ ID NO: 94018 - RNA, 44 nt, Mus musculus
aaagguacaaaagcaaggugccaaaagccuccuaaguggccaca

SEQ ID NO: 94019 - RNA, 44 nt, Mus musculus
ucugugcccagcagccccucagacucaucuucaaauggggggag

SEQ ID NO: 94020 - RNA, 42 nt, Mus musculus
aacacuagccaaggcgccugagagucgccgcugccaggggag

SEQ ID NO: 94021 - RNA, 45 nt, Mus musculus
ugagacccuaucuuuaaaaacaaucauugaaagaacaacagccag

SEQ ID NO: 94022 - RNA, 46 nt, Mus musculus
auuuagaggcuuagcagccuaggagggaagggagagaacuuugggg

SEQ ID NO: 94023 - RNA, 46 nt, Mus musculus
acuugcucagguagaaaggaguaccuugagcuauugcuagguguag

SEQ ID NO: 94024 - RNA, 42 nt, Mus musculus
uucaucuuccugcucuggaagcuucccuuagcucgggccaag

SEQ ID NO: 94025 - RNA, 44 nt, Mus musculus
cugagccaauaacaggcuagcaaggaaaggaaagguuggggcag

SEQ ID NO: 94026 - RNA, 44 nt, Mus musculus
guaggacugagcugaccuccucgccuacuacaggggaccuugga

SEQ ID NO: 94027 - RNA, 42 nt, Mus musculus
aacauggcuucucuaugcacucuccccagcucugaacccaag

SEQ ID NO: 94028 - RNA, 46 nt, Mus musculus
agcaaugaaauaauuuuaugguaggagugucaccacagugcagcau

SEQ ID NO: 94029 - RNA, 45 nt, Mus musculus
ugaguaaccacauacucaggauaugccuggaaggugacaguccag

SEQ ID NO: 94030 - RNA, 58 nt, Mus musculus
gucuucacucugccaggagauuuuuucaacuuuauggaggaagaggaagaggaagagg

SEQ ID NO: 94031 - RNA, 46 nt, Mus musculus
gguccagucagacauuuggacaucagcgucauacacuaaguggcug

SEQ ID NO: 94032 - RNA, 46 nt, Mus musculus
ucuuccucugagaacuuccuugcccgaaaccagggaucuugcugca

SEQ ID NO: 94033 - RNA, 46 nt, Mus musculus
cucuucuucaaggucuuacaaucaucugugucucuuccccacagau

SEQ ID NO: 94034 - RNA, 46 nt, Mus musculus
aagaagaggacaagaccaagaaacuguacugagaugaacaccugga

SEQ ID NO: 94035 - RNA, 46 nt, Mus musculus
gucucucagaagcaggcaggcuggccugagaucuaggccuggaacu

SEQ ID NO: 94036 - RNA, 45 nt, Mus musculus
ucuuggcuagugugcugguugaaugggagucaggagcgguuugga

SEQ ID NO: 94037 - RNA, 46 nt, Mus musculus
ggagggaaguaagcucccucuuggcagggaguggugguguugaguu

SEQ ID NO: 94038 - RNA, 46 nt, Mus musculus
ggacaguuuggcagauuugaagaagaaaccucaccaacauaauguu

SEQ ID NO: 94039 - RNA, 41 nt, Mus musculus
guaguguggucaaugcggaccugcagauuuucucgacaugg

SEQ ID NO: 94040 - RNA, 46 nt, Mus musculus
gucucucagaagcaggcaggcuggccugagaucuaggccuggagcu

SEQ ID NO: 94041 - RNA, 45 nt, Mus musculus
gaauaucacguggaggauuuauuuuuucccccugugguucucagg

SEQ ID NO: 94042 - RNA, 44 nt, Mus musculus
gugcugguugaaugggagucaggagcgguuuggaguccggcaga

SEQ ID NO: 94043 - RNA, 74 nt, Mus musculus
uaagcacagauuuaaaauauauauauauauuuacacugagaucaagucaagauuccaaacaaccacccagagug

SEQ ID NO: 94044 - RNA, 46 nt, Mus musculus
accaugaauugaaggcagagccaguauccaaggcaggaacccaggg

SEQ ID NO: 94045 - RNA, 76 nt, Mus musculus
cugcuccccugccugcccagugugugcugagccuccgggggccacaccagcucauuguuuaccucagucgugagug

SEQ ID NO: 94046 - RNA, 45 nt, Mus musculus
agacccagcucagcuccacuugcaauggagacccugccaccacuc

SEQ ID NO: 94047 - RNA, 45 nt, Mus musculus
cagaaagauccugccuuuccuggugggacugaagagagggaagga

SEQ ID NO: 94048 - RNA, 46 nt, Mus musculus
ccacugcccugcaauucgacagccaucagggaacuaauuugaggag

SEQ ID NO: 94049 - RNA, 42 nt, Mus musculus
aagccucaaggacguggggaagccuagcagaggcucagaggg

SEQ ID NO: 94050 - RNA, 47 nt, Mus musculus
cgguucuucagauuuaguacuuguaaauaaacacacauuaaggagag

SEQ ID NO: 94051 - RNA, 46 nt, Mus musculus
augccgcagaacacucccucuuacccccuuccucccacccccaccc

SEQ ID NO: 94052 - RNA, 70 nt, Mus musculus
ucggugcuacacaagcuagaguagauauauuuagagagagaaagauauuuuuaaggugaagcccaugauu

SEQ ID NO: 94053 - RNA, 41 nt, Mus musculus
gccaccagauccaacuggggaaacuggaguagaggguggca

SEQ ID NO: 94054 - RNA, 58 nt, Mus musculus
caaccagggaagacuuuaggggaaacugaggcucccacccaggcacagccuggaggca

SEQ ID NO: 94055 - RNA, 45 nt, Mus musculus
uagcuaauaaaggugcagcucuaaucugaccuccacccuguccca

SEQ ID NO: 94056 - RNA, 44 nt, Mus musculus
uuuaaauguuuuuuuuuuaauuagucauuggaaaagcaagcaag

SEQ ID NO: 94057 - RNA, 85 nt, Mus musculus
gcaauucaggaggaacccagguggaagagagcaaaaccaagggcccuggagcugccaucugauguggccucuacuucccccagau

SEQ ID NO: 94058 - RNA, 45 nt, Mus musculus
uucccucaaauaauuguacagcaccccauuggggccagggccaca

SEQ ID NO: 94059 - RNA, 42 nt, Mus musculus
auguguauauauauauauguguguguggcccuggccccaaug

SEQ ID NO: 94060 - RNA, 45 nt, Mus musculus
guccauuaaaaacguacuguugcuccuugagggcagagguggaca

SEQ ID NO: 94061 - RNA, 88 nt, Mus musculus
aaauaccacaggauuucuuguucccuuaaaagcaguacccagaugucccacugcagaggggccaggacaccguugagaggccagacug

SEQ ID NO: 94062 - RNA, 44 nt, Mus musculus
cugagcagcugagcccuggaagugcccacccagcaggaggcaga

SEQ ID NO: 94063 - RNA, 49 nt, Mus musculus
cugcaucucagccaguucaacagcaugagugcccugcacgagaucuacu

SEQ ID NO: 94064 - RNA, 58 nt, Mus musculus
cuucuuagaugagcaggccgacaagcaucagauccacgacucagaugugcgccauacc

SEQ ID NO: 94065 - RNA, 64 nt, Mus musculus
gcaccuggugaagaaccacgaccaccuggaccaacgugaaggcgaccguggcagcaagaugguc

SEQ ID NO: 94066 - RNA, 73 nt, Mus musculus
ccaguagccccgacagccuacgcucacgaacacccaugaucacgccagaccuggaaaguggaacaaaacugug

SEQ ID NO: 94067 - RNA, 48 nt, Mus musculus
gccuacaacaucuccaacuccucuaccuucacuaagucccucagcaga

SEQ ID NO: 94068 - RNA, 41 nt, Mus musculus
ugcuuggguacuagugccaccgaugacccauccgucaccug

SEQ ID NO: 94069 - RNA, 46 nt, Mus musculus
ucauccuucaggacgaggacgucaccacuaaaauugacaaugacug

SEQ ID NO: 94070 - RNA, 44 nt, Mus musculus
ggcccgcuacucucugagcgaagacaagcucauucggcagcaga

SEQ ID NO: 94071 - RNA, 45 nt, Mus musculus
cucccccucccucccacuuccuagcugacuuaaugaagccaaguu

SEQ ID NO: 94072 - RNA, 53 nt, Mus musculus
guuuauucuacaaguuaaacaacuugcuugacuagccaccuucaucuuugaag

SEQ ID NO: 94073 - RNA, 46 nt, Mus musculus
cacaucagucaaauucauaggcagaaaggagaaaggugguacggug

SEQ ID NO: 94074 - RNA, 42 nt, Mus musculus
gggcuucagcuccaagagcccaguagggcuaaguggcuccag

SEQ ID NO: 94075 - RNA, 41 nt, Mus musculus
acuuuguccucaaggccucagcacagacagguaagcagggg

SEQ ID NO: 94076 - RNA, 45 nt, Mus musculus
gccuccauacuuggcgcggauucgagguucacggacaguggccag

SEQ ID NO: 94077 - RNA, 42 nt, Mus musculus
gacaaaguugccauuccacacaaccgacagguucacaggcag

SEQ ID NO: 94078 - RNA, 45 nt, Mus musculus
uucuaauuauagauucuagaacucauaggccaggcugagugggac

SEQ ID NO: 94079 - RNA, 46 nt, Mus musculus
gcuagcccugugcagacaaaccaggcucuaugcugcccaucccacc

SEQ ID NO: 94080 - RNA, 24 nt, Mus musculus
cuacucagagcaggauuagaggga

SEQ ID NO: 94081 - RNA, 44 nt, Mus musculus
cuacuguggccuccucugccauggauggaaccuaacugcuccca

SEQ ID NO: 94082 - RNA, 43 nt, Mus musculus
guagggggagcuacucacagggcugggucucuggaggcccagg

SEQ ID NO: 94083 - RNA, 42 nt, Mus musculus
gugggaaucuuguugccuggugguagauuaagccccaggccc

SEQ ID NO: 94084 - RNA, 41 nt, Mus musculus
cggagauggcuuugaguggaggcaccaggagggggcggggg

SEQ ID NO: 94085 - RNA, 25 nt, Mus musculus
gccuggcagaggggcagaggcucag

SEQ ID NO: 94086 - RNA, 46 nt, Mus musculus
uauguaaauuccuuguguaccuguacagaguuuugaggggucucuc

SEQ ID NO: 94087 - RNA, 44 nt, Mus musculus
gagucugggccugugcccacgaaugaacuugaggaugugguaga

SEQ ID NO: 94088 - RNA, 42 nt, Mus musculus
gugugaggugcagcugaggucuuuauuggauuauggugaggg

SEQ ID NO: 94089 - RNA, 44 nt, Mus musculus
aagaaagcaauguagagaucaaugggcuuaggccugcuuucacc

SEQ ID NO: 94090 - RNA, 45 nt, Mus musculus
gaaacauaaagaaaguuauucauggucaaauugaggguggcagug

SEQ ID NO: 94091 - RNA, 41 nt, Mus musculus
uaagugugauaguccaaaggacauucagcagacagguagca

SEQ ID NO: 94092 - RNA, 46 nt, Mus musculus
uacaaagaugacaucccuggaggucaacaguauaaaaacugugaga

SEQ ID NO: 94093 - RNA, 42 nt, Mus musculus
uucaaaaaccaaaacaaaucaaaagccccuacccaggcaucu

SEQ ID NO: 94094 - RNA, 45 nt, Mus musculus
agaacacaggugacauacuagcagccaaaauuaugggaguggaga

SEQ ID NO: 94095 - RNA, 46 nt, Mus musculus
gagggucaacccacuaaugaauucaugauuuuauggugcugugaag

SEQ ID NO: 94096 - RNA, 42 nt, Mus musculus
ccuuggaguggcugggguugacaaaagacuggacucgaaguu

SEQ ID NO: 94097 - RNA, 45 nt, Mus musculus
uggugaggggcugguugucaggggucugcagaggaggcagccugg

SEQ ID NO: 94098 - RNA, 46 nt, Mus musculus
gggucuugugcuggcagaucacuuaggcuuccauagaagcugggag

SEQ ID NO: 94099 - RNA, 44 nt, Mus musculus
aagcuggcaaccugaauaaauggguaaaagauaaagaggaacca

SEQ ID NO: 94100 - RNA, 46 nt, Mus musculus
uucacuugcccuguugaagguuguggcaagucauucacuagagcag

SEQ ID NO: 94101 - RNA, 45 nt, Mus musculus
aaucacccugauaagacaguugcuccugagcuaggggcugacaac

SEQ ID NO: 94102 - RNA, 48 nt, Mus musculus
cacagcuggcugugguuuggaccugggucagggaggagagguaguagu

SEQ ID NO: 94103 - RNA, 23 nt, Mus musculus
acaguucuucugggauugauugg

SEQ ID NO: 94104 - RNA, 42 nt, Mus musculus
ccaaggaccugagagugggcuauuuaagagaauguggggcca

SEQ ID NO: 94105 - RNA, 42 nt, Mus musculus
aggcaauuguaaacaugugcugccuccagcacuugaauccag

SEQ ID NO: 94106 - RNA, 45 nt, Mus musculus
ggagcucaaaucaagagggaaccuggaaaaaggagcugauaaaga

SEQ ID NO: 94107 - RNA, 45 nt, Mus musculus
auagcaugaaggcacacguggugcggcagcacagccggcgccaag

SEQ ID NO: 94108 - RNA, 81 nt, Mus musculus
ucugggagggaaucucccuacuaacaauaacuccuuaggaccaauggauccacucguucuaguggcccacggugauaugcc

SEQ ID NO: 94109 - RNA, 46 nt, Mus musculus
gccugugaggaacuugaaucaagacucuccagcuuugacccccagc

SEQ ID NO: 94110 - RNA, 48 nt, Mus musculus
gcugguuccaauaaagguggaacaagacuugucuccugucccagaugu

SEQ ID NO: 94111 - RNA, 25 nt, Mus musculus
ggggagaggagaguuaguaaacucu

SEQ ID NO: 94112 - RNA, 45 nt, Mus musculus
ugccuaucacguugcuuucgaagaauacaguuacucucucugcag

SEQ ID NO: 94113 - RNA, 99 nt, Mus musculus
uggccagcuuucugccuucuauaagcauccuauuuuucuuuguaguuguaaauauuuaacuugauguagauauuuuacaauugugugcccucaaguaua

SEQ ID NO: 94114 - RNA, 26 nt, Mus musculus
gcucaucugaaacauacuaucugcag

SEQ ID NO: 94115 - RNA, 45 nt, Mus musculus
ugcagucagcuacuucuacagagaacccuggcuccuuuacuggag

SEQ ID NO: 94116 - RNA, 46 nt, Mus musculus
ugaacuuagguccuuacacauacugaguagguucuugaccaguuag

SEQ ID NO: 94117 - RNA, 28 nt, Mus musculus
gaauagaucuaagcaaagcauacccuua

SEQ ID NO: 94118 - RNA, 46 nt, Mus musculus
cucagcaucccaaccagcacaaagugaaacauagaaaccuagggga

SEQ ID NO: 94119 - RNA, 64 nt, Mus musculus
ugaaguuaauuuacuaaauucuaguccauauccaguguuuguaggaauuauauaagaaaugagg

SEQ ID NO: 94120 - RNA, 46 nt, Mus musculus
aaccaaaauaaagcccauugaauaauugguugccuaauuacaacag

SEQ ID NO: 94121 - RNA, 68 nt, Mus musculus
ggcugaaagauggguacagcuaugugcacaagcugccuccucuuaagaaaaggaagaacaagguggaa

SEQ ID NO: 94122 - RNA, 46 nt, Mus musculus
aacagcaugucauucugaaagacaaaugugaacauugucaccccag

SEQ ID NO: 94123 - RNA, 46 nt, Mus musculus
ggcucacuggguggugauuccaagaagaaaagaaaacaaagcuggg

SEQ ID NO: 94124 - RNA, 45 nt, Mus musculus
ugguuugugaggccuuaggcucucuggucucacuaguacauggag

SEQ ID NO: 94125 - RNA, 47 nt, Mus musculus
cagggugggcaugugcuuuccauuccauagcuuuagcccugagauga

SEQ ID NO: 94126 - RNA, 42 nt, Mus musculus
ucuucauaaguuucucacuuucaaacaaauaucuccaagcau

SEQ ID NO: 94127 - RNA, 66 nt, Mus musculus
cugaaaauuuaaguccaaagcacugggugcauuuggauugcgugggaugucguuugaccacgggag

SEQ ID NO: 94128 - RNA, 44 nt, Mus musculus
cucaggaagcugaggcaggagaaucacaaguucaagaccaauaa

SEQ ID NO: 94129 - RNA, 76 nt, Mus musculus
ucugggagagaaccaugaaggaaagaggugggacugggaguagaaggcugugaagggcuugcaggguucaaauaau

SEQ ID NO: 94130 - RNA, 85 nt, Mus musculus
gggggacagauggcaaaggguaaccuguggagcaggguguaaaaggguucuagagaaaaaaaagaugcagaugagaguuuugagg

SEQ ID NO: 94131 - RNA, 63 nt, Mus musculus
ccuccuaguuugacccagugggggaacaacauguuacuguggaagagagaaaggauucuguag

SEQ ID NO: 94132 - RNA, 56 nt, Mus musculus
acagugugcaagucagcauacagagaucaccccaagacuaagggacuauaguguga

SEQ ID NO: 94133 - RNA, 46 nt, Mus musculus
guugucaugagguggaacaguaguacucagaaggcccuuaaggcag

SEQ ID NO: 94134 - RNA, 46 nt, Mus musculus
gagcuugaagcacucaggcaucuguguggaauuuaggacauuguag

SEQ ID NO: 94135 - RNA, 45 nt, Mus musculus
cugucucuaaaaacugaaaggaaaagggagaaaaaaauauagggu

SEQ ID NO: 94136 - RNA, 44 nt, Mus musculus
agcugaccugaagcucauucgugagcaagacccaagcugcucca

SEQ ID NO: 94137 - RNA, 45 nt, Mus musculus
gggagcuagcuucagagcacacuccucagcccagcagucauugag

SEQ ID NO: 94138 - RNA, 46 nt, Mus musculus
agucagcaugcugauuguagucauacagugaccauugguuggaaaa

SEQ ID NO: 94139 - RNA, 46 nt, Mus musculus
ugcauccacgucccugugggggaaauccaagaacucccugagagau

SEQ ID NO: 94140 - RNA, 42 nt, Mus musculus
uggggugguguaagauaaaaagaaaugcagaugguagaagau

SEQ ID NO: 94141 - RNA, 28 nt, Mus musculus
auagugaugugacccucuacauugauga

SEQ ID NO: 94142 - RNA, 45 nt, Mus musculus
gcagggauuccaggccaaggccuucuugggcagggauugagagaa

SEQ ID NO: 94143 - RNA, 42 nt, Mus musculus
uauacuucuuugagacaauccucagcaaguaagcccauagag

SEQ ID NO: 94144 - RNA, 42 nt, Mus musculus
ugucuuugugugugagauacaaaaaaagauggcagggaagag

SEQ ID NO: 94145 - RNA, 43 nt, Mus musculus
gccacccuauuggcccuccucucccccuccucugccaccagca

SEQ ID NO: 94146 - RNA, 46 nt, Mus musculus
uccacaggauuagcccagucuagcucauaagguauucauuggagac

SEQ ID NO: 94147 - RNA, 31 nt, Mus musculus
ugugaugucuucaccguggaaccaggauuug

SEQ ID NO: 94148 - RNA, 53 nt, Mus musculus
ccagcgagaggccauugaagccuugcaccccgagucccucaucagcugccaac

SEQ ID NO: 94149 - RNA, 69 nt, Mus musculus
ggcaccccucagaagauuguggcccgucgccuccacucugcccagaccaguauccaggaagccacagcc

SEQ ID NO: 94150 - RNA, 36 nt, Mus musculus
aaaaaaaaaaaaaaaaagaaagagaaaagggaaguc

SEQ ID NO: 94151 - RNA, 24 nt, Mus musculus
gucagacuacauaaacuuugguuu

SEQ ID NO: 94152 - RNA, 33 nt, Mus musculus
ccccuagauaccagaaccugagcaugaccagau

SEQ ID NO: 94153 - RNA, 91 nt, Mus musculus
uacguugacccuaagacaggcguggcuauagcccgagaugcagggucugugacuguuuacuacgagaucgcugggcagcugaagaccuuca

SEQ ID NO: 94154 - RNA, 45 nt, Mus musculus
cuccagccuaugauuucuuauuuuuauuaucaacacaucgccagu

SEQ ID NO: 94155 - RNA, 46 nt, Mus musculus
cagcaaaagucuguccuccccugcuuuggaauaauacugcccagua

SEQ ID NO: 94156 - RNA, 46 nt, Mus musculus
uccgacuucguaccacuaccuguccuacaggccaucaccccagagu

SEQ ID NO: 94157 - RNA, 42 nt, Mus musculus
ggcaagggugccaccaacaacaccugcaucauccgcacaguc

SEQ ID NO: 94158 - RNA, 51 nt, Mus musculus
ugccacaccacacaggccaggccuggaagcagcaaguccagucaagaggca

SEQ ID NO: 94159 - RNA, 51 nt, Mus musculus
cuggagacaucuuccaugcucauaauucaguccucaauuuugccacuaaca

SEQ ID NO: 94160 - RNA, 45 nt, Mus musculus
agaacaaauacuaaugucacccaacucauuuauaaagcugcagac

SEQ ID NO: 94161 - RNA, 42 nt, Mus musculus
uuuucuccuuccucucuuccccucccccucacgcaugcuaag

SEQ ID NO: 94162 - RNA, 46 nt, Mus musculus
cccaccgagaacaacucagucuggcuccgagauuccccuguuagag

SEQ ID NO: 94163 - RNA, 54 nt, Mus musculus
acaggagcccaucaugucugaaguuuaauccugcgcauuuauuuaacaaucacu

SEQ ID NO: 94164 - RNA, 46 nt, Mus musculus
cauccucagucuccauuauucaucagggcaggaggcagguggagag

SEQ ID NO: 94165 - RNA, 46 nt, Mus musculus
cacaucacagcaaggcagucauggcacauggcaguugguaugagau

SEQ ID NO: 94166 - RNA, 42 nt, Mus musculus
gaaccuuacauacacagccuuuucccacaguagcauggagug

SEQ ID NO: 94167 - RNA, 45 nt, Mus musculus
uuacaacaccuaauaugcuguaagugcuucuguguggcugucaga

SEQ ID NO: 94168 - RNA, 46 nt, Mus musculus
ugcuacagcuccaggcagugaggauccgugccccaaucacacggau

SEQ ID NO: 94169 - RNA, 42 nt, Mus musculus
gcugggagucgugcaggcgguggaugcagagacuggcaaggu

SEQ ID NO: 94170 - RNA, 46 nt, Mus musculus
cauucugggugccuuguacccaguuccuaaguucugauuuagaggu

SEQ ID NO: 94171 - RNA, 46 nt, Mus musculus
gcuugacacuaggaggaaaagcuuuaguugaaauucauccgcacau

SEQ ID NO: 94172 - RNA, 46 nt, Mus musculus
ccagcccaugcagcugguaucccaggaugaugggaauggccaaaag

SEQ ID NO: 94173 - RNA, 46 nt, Mus musculus
ccacaugauggcucauaaccauccugcccucuucuguccucuacag

SEQ ID NO: 94174 - RNA, 46 nt, Mus musculus
ucuaaaaccacaguacaggauucauauuuaaaauaaaguccugggu

SEQ ID NO: 94175 - RNA, 46 nt, Mus musculus
ugucuggaaccaggagagauacaagaaauuggagagggauccugga

SEQ ID NO: 94176 - RNA, 42 nt, Mus musculus
uggccccaugccuuccucacuguaccugcccuugccccuuau

SEQ ID NO: 94177 - RNA, 42 nt, Mus musculus
aagaaagugccuggggccuucaaccagcggugguggggguaa

SEQ ID NO: 94178 - RNA, 46 nt, Mus musculus
ccccucaaggugaguugucccuguccuuugucaucugccccgucug

SEQ ID NO: 94179 - RNA, 46 nt, Mus musculus
uacauagauucugucuccaaacaaacaaacaaacaaagauacagaa

SEQ ID NO: 94180 - RNA, 46 nt, Mus musculus
ccagcauccugacauuuccauggcaaccaaagacaggcgccuauca

SEQ ID NO: 94181 - RNA, 42 nt, Mus musculus
uuugguuuugucuuguacugaaaagccucaucagcccuagua

SEQ ID NO: 94182 - RNA, 42 nt, Mus musculus
gagaaggaacugugaguucuacaucuguauccucaggcagca

SEQ ID NO: 94183 - RNA, 37 nt, Mus musculus
ucccagaaugggucuuaucaucacaucagggcuaucc

SEQ ID NO: 94184 - RNA, 43 nt, Mus musculus
gcaccuggcagaguuaacagcuuaguuggagcuauggagauga

SEQ ID NO: 94185 - RNA, 46 nt, Mus musculus
gucaucuuuagguugaugugagaguuggcaguaccuuggcagggaa

SEQ ID NO: 94186 - RNA, 46 nt, Mus musculus
ggguuuccuacacauugauugccugugauuccaucauuugagagau

SEQ ID NO: 94187 - RNA, 45 nt, Mus musculus
gcuucuaggcuccccaacagcaccaucuaugugguugaagccgga

SEQ ID NO: 94188 - RNA, 46 nt, Mus musculus
uggccauccugacacaggacacaucaagagucacugccaugcagau

SEQ ID NO: 94189 - RNA, 50 nt, Mus musculus
acucucaaugccuucugaucaauaugagcugcagcuccagaacagcaucc

SEQ ID NO: 94190 - RNA, 48 nt, Mus musculus
gguccaacuuuuuugguaauacagugagaaccccacugggcccagaug

SEQ ID NO: 94191 - RNA, 51 nt, Mus musculus
gaccugggcucuuguugggaaagucauuuuuacacaaauuuagaccgaggg

SEQ ID NO: 94192 - RNA, 44 nt, Mus musculus
agcaggugucuucaaacaaaaguacuguguucucugcccagaga

SEQ ID NO: 94193 - RNA, 46 nt, Mus musculus
ucaauugaccuuuucuaucccaaaacgcaagaaugggcacacagaa

SEQ ID NO: 94194 - RNA, 46 nt, Mus musculus
ucauggacaccaggcacugcacuagugcacugauacacaugcagac

SEQ ID NO: 94195 - RNA, 48 nt, Mus musculus
caugcuuucuguucaguuccagccuccauguuccugccuugaguuccu

SEQ ID NO: 94196 - RNA, 45 nt, Mus musculus
cagcugggcuugcaguucacagcuguacauagagagaggaggaga

SEQ ID NO: 94197 - RNA, 52 nt, Mus musculus
cuggugggaaccuccauucacuacaagguucagaagaucaggcagggcaaga

SEQ ID NO: 94198 - RNA, 45 nt, Mus musculus
auggagauugaaaauggccauaaauccaccaagaacagucuaggu

SEQ ID NO: 94199 - RNA, 46 nt, Mus musculus
cuuuuccugucagcuuugcuuggcagcaccagcccagaguccagau

SEQ ID NO: 94200 - RNA, 42 nt, Mus musculus
aucuuucuguuugucugauuuguugaaccaugguguaggggc

SEQ ID NO: 94201 - RNA, 46 nt, Mus musculus
auaucccaccuuccuacaucucagagauggagaaggcagccaagca

SEQ ID NO: 94202 - RNA, 42 nt, Mus musculus
aaugucaucauauauggguauugaugugcccaggcccaagau

SEQ ID NO: 94203 - RNA, 46 nt, Mus musculus
guacagugucuuucuuaagauuuauuuuguauuauguucauguguu

SEQ ID NO: 94204 - RNA, 42 nt, Mus musculus
uuaaugaagcuacauccaggagaggacugacuuccaggaagu

SEQ ID NO: 94205 - RNA, 46 nt, Mus musculus
caugcaaaguuagaugucuccaggagcugacaucuggucaguggaa

SEQ ID NO: 94206 - RNA, 45 nt, Mus musculus
cuacagggcaggugcugcgcugugacgccaucguugaucucaucc

SEQ ID NO: 94207 - RNA, 46 nt, Mus musculus
gcaggugaguggcaguucccuguagcaccuuuaccuuucugcagau

SEQ ID NO: 94208 - RNA, 43 nt, Mus musculus
ggaccuggagcugagaauucuacauccaagucuacaggcagaa

SEQ ID NO: 94209 - RNA, 42 nt, Mus musculus
gaugugcaaaggcauuugcaaagggauaaagaugggagaguu

SEQ ID NO: 94210 - RNA, 45 nt, Mus musculus
agcauuaaagauuccaggaggaccagugucacagggggaacugag

SEQ ID NO: 94211 - RNA, 45 nt, Mus musculus
ccuaggcaggcccacccaggggaguuaggugcuguuacagaaaga

SEQ ID NO: 94212 - RNA, 41 nt, Mus musculus
uagagggaugguuauagccacuuaaguugaggugccugaga

SEQ ID NO: 94213 - RNA, 46 nt, Mus musculus
gccguuaaacacuaacuccccacuuccuccuacacugccccugaca

SEQ ID NO: 94214 - RNA, 45 nt, Mus musculus
ugucuguagaggucagaaaagggugucgaguccccuggagcuaga

SEQ ID NO: 94215 - RNA, 46 nt, Mus musculus
gggccuugaguucaaacggagagaacagcaagggcugggcugagca

SEQ ID NO: 94216 - RNA, 46 nt, Mus musculus
auaagcugaaagaaaccuuuuccuccccaaguuagcaauagaaauc

SEQ ID NO: 94217 - RNA, 87 nt, Mus musculus
ccugagcuggcuaguguuuaugggaacuugacacaaacuagagucauuuuggaagagggaaccucagguaagaaaauacccccacca

SEQ ID NO: 94218 - RNA, 45 nt, Mus musculus
uguguuuguuuguguguacauuuuguuuuuucucuuuaggcauuu

SEQ ID NO: 94219 - RNA, 46 nt, Mus musculus
ccugaaucuucuuagcuaagagauaagugaguuaggacagaaagau

SEQ ID NO: 94220 - RNA, 42 nt, Mus musculus
cuuuccuaguuccugaauuguagcauccaguaacugggaggu

SEQ ID NO: 94221 - RNA, 51 nt, Mus musculus
ugcuuuacccaaggggaaguguuuauucuucucuggggcuuuguuuugagu

SEQ ID NO: 94222 - RNA, 42 nt, Mus musculus
gguugagaaccacugaucuaggcuaaggcuuaacuagcuagg

SEQ ID NO: 94223 - RNA, 41 nt, Mus musculus
gacaucugagucucaauauagccaaagcauggugagaggga

SEQ ID NO: 94224 - RNA, 42 nt, Mus musculus
auucaccgacggcgggugcgcggacagacugacggcggcgca

SEQ ID NO: 94225 - RNA, 34 nt, Mus musculus
cuugaugggugguucagggucugguggccacugu

SEQ ID NO: 94226 - RNA, 46 nt, Mus musculus
aggaaaggaggagcugucacuugguguagccgugcugccuuuuguc

SEQ ID NO: 94227 - RNA, 42 nt, Mus musculus
aacccgcagggauuaaacgggagugcacaccccaggaaagga

SEQ ID NO: 94228 - RNA, 46 nt, Mus musculus
gugugugguucuguguguuuucuuaugugcauauguguguguggau

SEQ ID NO: 94229 - RNA, 44 nt, Mus musculus
acugggugaguggguaaauggauaaguggaugagugggcaggua

SEQ ID NO: 94230 - RNA, 46 nt, Mus musculus
cugaggauauuggagccaguucagcuggaagaaaggagggagaggg

SEQ ID NO: 94231 - RNA, 42 nt, Mus musculus
aaugugcaugagauagauagauagauagauagauagauagau

SEQ ID NO: 94232 - RNA, 46 nt, Mus musculus
gcauuuauuugugugugugucugaauguaugugugccugugugugu

SEQ ID NO: 94233 - RNA, 44 nt, Mus musculus
agcuugccuuuaaguggucccaugccacuuaaucauaaccccaa

SEQ ID NO: 94234 - RNA, 42 nt, Mus musculus
gacuguggucuguagagggucagggaacagugaggacauaag

SEQ ID NO: 94235 - RNA, 46 nt, Mus musculus
ugggucuggaggacgaggggcagccagguggaaccaaccauagcua

SEQ ID NO: 94236 - RNA, 41 nt, Mus musculus
gcacgauggggagauggauggcugggccucagguugggcag

SEQ ID NO: 94237 - RNA, 42 nt, Mus musculus
cuagggacuccugagacaugcugcuccaggaaucugcaggag

SEQ ID NO: 94238 - RNA, 42 nt, Mus musculus
ggacggccaugcuugggcucggagucagagcugugaccagag

SEQ ID NO: 94239 - RNA, 46 nt, Mus musculus
gcaggauugcacaggugcugaguguccccugcuggagaacugcauc

SEQ ID NO: 94240 - RNA, 55 nt, Mus musculus
ugcagcagggcugugccugcgaaggcuaccaguacuacgacugcguacaaggagg

SEQ ID NO: 94241 - RNA, 46 nt, Mus musculus
ggacuuuggcagcaccgagugcuccugcccacccggugguggcaag

SEQ ID NO: 94242 - RNA, 45 nt, Mus musculus
cucaccaccagcgucaggacaguggcaagcccggcaggaugagag

SEQ ID NO: 94243 - RNA, 64 nt, Mus musculus
cugguggugagcucauuugcuaccagcuuccugguugccaugggaacuucucggaugcugagga

SEQ ID NO: 94244 - RNA, 93 nt, Mus musculus
gggugacucugagaggcaguaugaagaccccuacagcuaugaccaggagguggcagaggcagaagcuacuacggccauugugaacgaggucca

SEQ ID NO: 94245 - RNA, 68 nt, Mus musculus
ccaggguguuacucugauggaggacgguggcagauucccuccucccagagcagcuggggggcccucug

SEQ ID NO: 94246 - RNA, 79 nt, Mus musculus
ucacucuccuggcuuuggccugcacaggugcugggggacccagggcagcagcugcugugggucugggaagggcaacugg

SEQ ID NO: 94247 - RNA, 54 nt, Mus musculus
ccugugcaggccaaagccaggagagugacauuggacacugaagaggaugaggaa

SEQ ID NO: 94248 - RNA, 122 nt, Mus musculus
uucgaggagugaccugggcaucaggaauaagguuuuccucaggcccugccuuagcuucagccuccuucuccuggacagggaaaccaggucuggcuggggaucuugugggcaggcuguccagc

SEQ ID NO: 94249 - RNA, 88 nt, Mus musculus
gguuucccuguccaggagaaggaggcugaagcuaaggcagggccugaggaaaaccuuauuccugaugcccaggucacuccucgaagug

SEQ ID NO: 94250 - RNA, 74 nt, Mus musculus
ggagggggagaccugggcucggucagguggcaguguagauagaguggggugaucgcugggcuuuacuggguccu

SEQ ID NO: 94251 - RNA, 72 nt, Mus musculus
gaggacccaguaaagcccagcgaucaccccacucuaucuacacugccaccugaccgagcccaggucuccccc

SEQ ID NO: 94252 - RNA, 62 nt, Mus musculus
uccccagagacaccugaagaaauaccccagcauccacaguugcuaccucgauuccgggcaga

SEQ ID NO: 94253 - RNA, 55 nt, Mus musculus
cccggaaucgagguagcaacuguggaugcugggguauuucuucaggugucucugg

SEQ ID NO: 94254 - RNA, 46 nt, Mus musculus
gcacacagaugccaaagugaugucaggggaguacagugugagagau

SEQ ID NO: 94255 - RNA, 46 nt, Mus musculus
cucagcccaagaaacaacagacccggaaguuuccauacaaugagau

SEQ ID NO: 94256 - RNA, 42 nt, Mus musculus
caggaaaagggagggggggaagggaggaggggagcagggaag

SEQ ID NO: 94257 - RNA, 46 nt, Mus musculus
gaggaagaggagaaggaggaggaguauaauguggauguggccaaga

SEQ ID NO: 94258 - RNA, 47 nt, Mus musculus
cagcgggccagcagugggccaucgacaaugaugagugccaggagauc

SEQ ID NO: 94259 - RNA, 46 nt, Mus musculus
ugggaccaggcaugguggugaaugccuuuaaccucagcauguggga

SEQ ID NO: 94260 - RNA, 45 nt, Mus musculus
uuuaggauagcccagaggcaaugcugcaucuccuacuugaaagag

SEQ ID NO: 94261 - RNA, 46 nt, Mus musculus
acaaugggcuagcugagccugguucagauagggccccaagaaagag

SEQ ID NO: 94262 - RNA, 95 nt, Mus musculus
ggaaucacaucaaguuaugaagugaccugaagcuaacacuacacacugaccauucaacaaaacgacaaagagagguugggucccuaaggauaugc

SEQ ID NO: 94263 - RNA, 46 nt, Mus musculus
gauguaggggugggccaccuuccacccugggagagcacacaggcag

SEQ ID NO: 94264 - RNA, 50 nt, Mus musculus
ucagcaaugcugugacugcuguggccugggacuccgagugcgggcugagg

SEQ ID NO: 94265 - RNA, 45 nt, Mus musculus
aaccugggcuaucccugcaaccaugucaugcucuccugcugugaa

SEQ ID NO: 94266 - RNA, 42 nt, Mus musculus
ccucugcgaggagcagccucgggcucugguggccggcggacc

SEQ ID NO: 94267 - RNA, 46 nt, Mus musculus
aaagcaacagaggcucaaaagaugauaaggaugaagaaguaaagga

SEQ ID NO: 94268 - RNA, 74 nt, Mus musculus
acugggcacagaggcugaacugcccaauagccugccgggagaugaccaggaugagugccugaugcucccugggg

SEQ ID NO: 94269 - RNA, 61 nt, Mus musculus
agcuuugccagcaucuuugcaucaacaccgucggcuccuaccgcugugccugcuucccugg

SEQ ID NO: 94270 - RNA, 45 nt, Mus musculus
uagaggugccccacaguuggacacugcacgagagucugcaccgag

SEQ ID NO: 94271 - RNA, 41 nt, Mus musculus
cucugcuuugugaaaggcccugucuguugaugacggaggag

SEQ ID NO: 94272 - RNA, 41 nt, Mus musculus
ggggaggaggaagaagaggaggaggggaggaggaagaagaa

SEQ ID NO: 94273 - RNA, 42 nt, Mus musculus
aggucugagguauggguugggguuuccacugcaggcccaggg

SEQ ID NO: 94274 - RNA, 46 nt, Mus musculus
cccgaggcccagucuacugccucugccagacacuggcgcacugcag

SEQ ID NO: 94275 - RNA, 42 nt, Mus musculus
ugauuguaccucuauggcaaacuugacucaaaacugucccuu

SEQ ID NO: 94276 - RNA, 46 nt, Mus musculus
aacaguuagaugauagcccaggcagguucaggacuaaccaagaggc

SEQ ID NO: 94277 - RNA, 46 nt, Mus musculus
cacagacaucaaugagugugugacagaccugcacacgugcacccgg

SEQ ID NO: 94278 - RNA, 46 nt, Mus musculus
caucugugaggacauagccuggcucacaggugagcgccuuguagca

SEQ ID NO: 94279 - RNA, 46 nt, Mus musculus
cucaccugugagccaggcuauguccucacagauggugaaugcacag

SEQ ID NO: 94280 - RNA, 46 nt, Mus musculus
gugaccuuucugugaccucaugguagaggauguggggaauacagag

SEQ ID NO: 94281 - RNA, 42 nt, Mus musculus
ggauaaauuuaaucaugucacaugcuuuggauaguggcaggg

SEQ ID NO: 94282 - RNA, 46 nt, Mus musculus
agacguggacgaaugugugacgggcacacacaacugccaggcaggc

SEQ ID NO: 94283 - RNA, 46 nt, Mus musculus
cugcggucgcgguuaccaugcuaacgaggagggcucugaaugugug

SEQ ID NO: 94284 - RNA, 46 nt, Mus musculus
gugugcaucgcuguggcgagggccaacugugcuauaaccucccugg

SEQ ID NO: 94285 - RNA, 43 nt, Mus musculus
cgggccgccugugccagcacacaugugagaacacaccgggcuc

SEQ ID NO: 94286 - RNA, 45 nt, Mus musculus
uuuauaaagcauguuugcugacauuaaaauugaaccuugagcaga

SEQ ID NO: 94287 - RNA, 42 nt, Mus musculus
cagaugugaacgagugcgagacucggcgcugcagccaggaau

SEQ ID NO: 94288 - RNA, 44 nt, Mus musculus
ccagugugcaugcccagagcaaggguauacaaugauggccaacg

SEQ ID NO: 94289 - RNA, 46 nt, Mus musculus
gcgcaggcagcggaaacuccccuggauauuguggcaggucucagcc

SEQ ID NO: 94290 - RNA, 48 nt, Mus musculus
uuccgcugccugcgcuuugauuguccacccaacuauguccgugucuca

SEQ ID NO: 94291 - RNA, 45 nt, Mus musculus
gacuuaacucagaaaugagagcacccugcgcugcaacaggauaca

SEQ ID NO: 94292 - RNA, 57 nt, Mus musculus
ggaaugucaaaccucaccagcucgcaucacgcacuaccagcucaauuuccagacagg

SEQ ID NO: 94293 - RNA, 42 nt, Mus musculus
cagggagaugguguccccagcaaaggcgggagcagggccgau

SEQ ID NO: 94294 - RNA, 45 nt, Mus musculus
caaugaggagggcuacuucgucacacgcagacucaaugccuacac

SEQ ID NO: 94295 - RNA, 69 nt, Mus musculus
agcuuuggcgccagggcucugucacuaccuuccuggccaagauguacaucuucuucaccacuuuugccc

SEQ ID NO: 94296 - RNA, 46 nt, Mus musculus
ggcuuuuugcugugacucuguaacuuaacuuaaucaugcugagcug

SEQ ID NO: 94297 - RNA, 42 nt, Mus musculus
agggagggagaugcaccccagcaggcacugaguacaggccag

SEQ ID NO: 94298 - RNA, 53 nt, Mus musculus
ucagcugugcaugguagcacagaccuuuaauccuagcacuggggaggcagagg

SEQ ID NO: 94299 - RNA, 44 nt, Mus musculus
uuccaggccagccuggucuacgcugggaguucuaaccagccaga

SEQ ID NO: 94300 - RNA, 46 nt, Mus musculus
auaagaguagcacauauacauuauuaaaaaugaucaaauagcacag

SEQ ID NO: 94301 - RNA, 42 nt, Mus musculus
gauguggccaaagucaauacccugauaaggcccgauggagag

SEQ ID NO: 94302 - RNA, 41 nt, Mus musculus
uuaguggggucucgcuccuggaagauggugaugggcucccc

SEQ ID NO: 94303 - RNA, 46 nt, Mus musculus
aaugagcuugacaaaguugucauugagaacaaugccagccccggca

SEQ ID NO: 94304 - RNA, 32 nt, Mus musculus
cccuaggccccuucuguuauuaugggggucug

SEQ ID NO: 94305 - RNA, 45 nt, Mus musculus
cagcguaaagagccgcgggagcagucagcaccgaaggaggaaggg

SEQ ID NO: 94306 - RNA, 45 nt, Mus musculus
uuuuucacacauguucaucuauugggcaguguuccuuuuccagau

SEQ ID NO: 94307 - RNA, 45 nt, Mus musculus
ccagccaggcuuccuggagcggcugagugagacuucgggcgggau

SEQ ID NO: 94308 - RNA, 24 nt, Mus musculus
gcauccauaguguagcuccggaga

SEQ ID NO: 94309 - RNA, 41 nt, Mus musculus
auuaugggguccaucuaccagcugugaaacugcgacggcau

SEQ ID NO: 94310 - RNA, 46 nt, Mus musculus
ccuacagugccauggcaguggagucuuucacagcgaccgcccccuu

SEQ ID NO: 94311 - RNA, 46 nt, Mus musculus
cuggccaagcuggaggacccccauguggacaucauucgccgcggag

SEQ ID NO: 94312 - RNA, 46 nt, Mus musculus
uggugaugugcgagucuccuuuucuuaugcgggacugagcagcgau

SEQ ID NO: 94313 - RNA, 41 nt, Mus musculus
aaauggacagguccacccuagaauaaucaagucaggcagga

SEQ ID NO: 94314 - RNA, 50 nt, Mus musculus
ugccaagacuaccacaaccaucagcuacaacugcaaccugagaaaacaga

SEQ ID NO: 94315 - RNA, 42 nt, Mus musculus
cuucuguguuuuuuaccagccagcucaaaaguuaagagcaaa

SEQ ID NO: 94316 - RNA, 46 nt, Mus musculus
guaccaggauaccuggagguaguuacagauccacgugagucccuag

SEQ ID NO: 94317 - RNA, 42 nt, Mus musculus
cucgccagccccgggccauccgcugugggcuuagccacccag

SEQ ID NO: 94318 - RNA, 42 nt, Mus musculus
gaacaggagacccucagucccucccucaggggugaaggggau

SEQ ID NO: 94319 - RNA, 42 nt, Mus musculus
gucuuaggccuugguucagccacucaguuaaccuugggcagu

SEQ ID NO: 94320 - RNA, 70 nt, Mus musculus
gcuucacggcacuugggccacugauuuguuggggacauuaagauggggacauuaagguggagaagguucu

SEQ ID NO: 94321 - RNA, 46 nt, Mus musculus
ugucaaguuagccuagccaaagaaguuugaaucuauguguugugug

SEQ ID NO: 94322 - RNA, 46 nt, Mus musculus
ggagagaccccuaaugguaagcaaggaacuggauugggcuccaaag

SEQ ID NO: 94323 - RNA, 52 nt, Mus musculus
cuuuggguuaaaggauucuuuuggaaacacgcgcugaggcugggcuuagggg

SEQ ID NO: 94324 - RNA, 46 nt, Mus musculus
gucuguuuaccuugucccauccccauuccccacccucugcccccag

SEQ ID NO: 94325 - RNA, 95 nt, Mus musculus
aguugccaucuggugauagaaugaugguccuugaaaucaugaccagccuuccauuggggcugauuagcccuggagcaggggcagaguccucagaa

SEQ ID NO: 94326 - RNA, 45 nt, Mus musculus
acuauuagugggagaauauagauuagaacaaaccuuuaaaaagag

SEQ ID NO: 94327 - RNA, 46 nt, Mus musculus
uucccuuggugcuguggagucuauuucugucuuucguuucucgcag

SEQ ID NO: 94328 - RNA, 25 nt, Mus musculus
uccaugugugugggucugcuuugua

SEQ ID NO: 94329 - RNA, 45 nt, Mus musculus
guguguguguguguguguguaugagaaagagagagagagagaaac

SEQ ID NO: 94330 - RNA, 46 nt, Mus musculus
cucuuucucauacacacacacacacacacacacacacacacugcug

SEQ ID NO: 94331 - RNA, 46 nt, Mus musculus
ccucagugcuuacuccauucucccugaaggaccuuagcugccccag

SEQ ID NO: 94332 - RNA, 83 nt, Mus musculus
gcucugaggagggaggcuggcagugaacugauagagcagccagaacucugcucagguuguggaagaagcuagaguugcugcca

SEQ ID NO: 94333 - RNA, 45 nt, Mus musculus
aaggacacuuaaacuggaauuaauggugauguacagggauaagga

SEQ ID NO: 94334 - RNA, 70 nt, Mus musculus
ucaagagcagugaauccagagagaggauucagagucaguuagagggagaacaggagaggaggagagggga

SEQ ID NO: 94335 - RNA, 43 nt, Mus musculus
ggagagggaggagagagggagagggagagagggaaagggggag

SEQ ID NO: 94336 - RNA, 44 nt, Mus musculus
aagcauuagaugcuggggccaucucaggaaacuucucuccuaga

SEQ ID NO: 94337 - RNA, 24 nt, Mus musculus
guccuggcucuaaagagaggaucu

SEQ ID NO: 94338 - RNA, 42 nt, Mus musculus
ccaguagcaggaagaccuuggaaaagggaagucgcuggggau

SEQ ID NO: 94339 - RNA, 50 nt, Mus musculus
ugguuagcuaguuaaugguggucccagcaccucaggaggcugaggcagag

SEQ ID NO: 94340 - RNA, 42 nt, Mus musculus
cuccaccuccccacccuaccccucuggcuuccagacccccag

SEQ ID NO: 94341 - RNA, 41 nt, Mus musculus
acaaagugaucccggaguggugacacaugucuaugauccca

SEQ ID NO: 94342 - RNA, 45 nt, Mus musculus
cugccuuuggggccucagagaaagaaauuaaaauaucacaccuag

SEQ ID NO: 94343 - RNA, 46 nt, Mus musculus
gggucacaaugaccagacaaaagccgcaccuuuacuuaggggcuuc

SEQ ID NO: 94344 - RNA, 46 nt, Mus musculus
aggaaacacugauccugcccaggucccagucccugcucaaccccag

SEQ ID NO: 94345 - RNA, 63 nt, Mus musculus
gguuaucccucaacucucaaccaucccugcacccuugcccuucaucccucuucuuguucuugc

SEQ ID NO: 94346 - RNA, 68 nt, Mus musculus
gcuuucucuugucuugugggaagaaugccacaaucgauuaguaaugucugucaggggagcaggcuagc

SEQ ID NO: 94347 - RNA, 46 nt, Mus musculus
augcaucugucaaaucauggucacaggacauagcuggggguagcgg

SEQ ID NO: 94348 - RNA, 66 nt, Mus musculus
acucucuaagaguugcgugugguggcucauaacuauaauaccagcagucaggaagaugaggcagga

SEQ ID NO: 94349 - RNA, 45 nt, Mus musculus
agccuggagauucccagggccaugggagucugaagcuaucuuguu

SEQ ID NO: 94350 - RNA, 45 nt, Mus musculus
gaugagucucagugcuggaguguuugccuggcugugggcaagccc

SEQ ID NO: 94351 - RNA, 46 nt, Mus musculus
aguggagaagagacugucaccuggugaccucagagccacuugucau

SEQ ID NO: 94352 - RNA, 46 nt, Mus musculus
uccugugcugcagcccuuccuccagccuuaccuuguguaauuugag

SEQ ID NO: 94353 - RNA, 46 nt, Mus musculus
ccuuuggacuaauuaggagauaagugagcggcggcaaucacuggag

SEQ ID NO: 94354 - RNA, 42 nt, Mus musculus
gaaccagagccucaucgcugggagauggguguaggcugggua

SEQ ID NO: 94355 - RNA, 94 nt, Mus musculus
agagagacagagacagacagggagacagagagugagcgaaggagagauggaaagagaggcgagggaaagggagagacaaagagagggaguagag

SEQ ID NO: 94356 - RNA, 50 nt, Mus musculus
gccucgcuguuccucacacacacaggcacaacacauggagagagagagag

SEQ ID NO: 94357 - RNA, 45 nt, Mus musculus
uuucuuuuucuuucuuuuuguuuuuguuuuguuguugguggcggu

SEQ ID NO: 94358 - RNA, 24 nt, Mus musculus
agcuuaccugggcuuacgguggag

SEQ ID NO: 94359 - RNA, 42 nt, Mus musculus
acagugucuccuuuguucagaacagaggauggaucuggguag

SEQ ID NO: 94360 - RNA, 45 nt, Mus musculus
aucaaucaaucaaucaaucagacuguggaccuaaaagcauggcau

SEQ ID NO: 94361 - RNA, 43 nt, Mus musculus
gaggaaggacguccuuccugugggggaaaaagaagcauuaaaa

SEQ ID NO: 94362 - RNA, 42 nt, Mus musculus
uagaggguaaggcugaggcccaggggcagugacucgccugag

SEQ ID NO: 94363 - RNA, 45 nt, Mus musculus
uagccaagccaccuugugaccccuccacacugccgggccccuaau

SEQ ID NO: 94364 - RNA, 42 nt, Mus musculus
aaggagggaagaaaagaggggggaacugaucggggagggaga

SEQ ID NO: 94365 - RNA, 46 nt, Mus musculus
cccuccuuuccuucuucucuccccucccccucucccuccugccuag

SEQ ID NO: 94366 - RNA, 42 nt, Mus musculus
uucgggcagaccuccggcuuguaguaacaaagcuaggcagga

SEQ ID NO: 94367 - RNA, 42 nt, Mus musculus
cauagugaaacccugucucaaaaauacaaacaagggccaggc

SEQ ID NO: 94368 - RNA, 70 nt, Mus musculus
aucuaucuaccucugguauucuucacugccgaaccaccccuucagauccuaguaugacugucuuugugua

SEQ ID NO: 94369 - RNA, 95 nt, Mus musculus
acccagacugggucacacacacacacacacacacacacacacacacacccuuuuucuuuguguuuagaagacaaugugcuagagaaauugagaaa

SEQ ID NO: 94370 - RNA, 42 nt, Mus musculus
gcugggacuaaagacgugcgccaccaccaccuggcaguccag

SEQ ID NO: 94371 - RNA, 45 nt, Mus musculus
ugucacacuugacuuagccucguugcacaaauagauaaccaaaag

SEQ ID NO: 94372 - RNA, 46 nt, Mus musculus
aggguucguuguuacagucucuacagacuaauaaauacauccaggu

SEQ ID NO: 94373 - RNA, 42 nt, Mus musculus
cucuuugaauaaagaagaaggagaggaggaagaggaagaaga

SEQ ID NO: 94374 - RNA, 46 nt, Mus musculus
cugaggcgagaggagagcauuagauuccuuggaacugaaguuacag

SEQ ID NO: 94375 - RNA, 46 nt, Mus musculus
ugguagcucacaacuaucuguaacuucaguuccaaggaaucuaaug

SEQ ID NO: 94376 - RNA, 41 nt, Mus musculus
ggugccucuuugucuuagaguauagaggcaaauacugggga

SEQ ID NO: 94377 - RNA, 46 nt, Mus musculus
guggacccuagggaggaugucucaagaauucagucugagccagcag

SEQ ID NO: 94378 - RNA, 24 nt, Mus musculus
uccagagccuggguggugcccugc

SEQ ID NO: 94379 - RNA, 53 nt, Mus musculus
aagcugcaaugucugaaagacuuccacaaagacauccugaagccuucuccagg

SEQ ID NO: 94380 - RNA, 46 nt, Mus musculus
aaaggggaagggggacaaaggacauccauguucuagcugugguggg

SEQ ID NO: 94381 - RNA, 44 nt, Mus musculus
ccugauggcuugaagaaacugguagauuuacagauuagugggug

SEQ ID NO: 94382 - RNA, 46 nt, Mus musculus
guauguggcuggagucaccagggucuguaugcauugggacugccag

SEQ ID NO: 94383 - RNA, 46 nt, Mus musculus
ccaugcacugugguguguuccagcuaugguugcagugggcccaggg

SEQ ID NO: 94384 - RNA, 48 nt, Mus musculus
uagcuggaacacaccacagugcauggaggacacccugcguaggaacga

SEQ ID NO: 94385 - RNA, 42 nt, Mus musculus
gcauacccuguuucuggagggaaggaggacacacagcuguag

SEQ ID NO: 94386 - RNA, 46 nt, Mus musculus
aggacauacugugaccaucccaaguaaaggacacugaggcccagag

SEQ ID NO: 94387 - RNA, 45 nt, Mus musculus
cacauucuuuucaccuuugccugguaccugcuauuaugacaugaa

SEQ ID NO: 94388 - RNA, 45 nt, Mus musculus
gggaggaguaggugagggcagugcugcucacugagccuggcccag

SEQ ID NO: 94389 - RNA, 46 nt, Mus musculus
augucaggugagcuccuucaugugccaggugcugugguugggacag

SEQ ID NO: 94390 - RNA, 45 nt, Mus musculus
uucuguggggucccucugacaagcguggaggacgauauagcaggg

SEQ ID NO: 94391 - RNA, 46 nt, Mus musculus
gucaucaugaguccuauagggacuguccccagcagcagaggaacag

SEQ ID NO: 94392 - RNA, 78 nt, Mus musculus
aucuauagacauaaaaacaguuuuaaauaguacaggggccuccagucuccacuacaagcuaggaucaucuggugccuc

SEQ ID NO: 94393 - RNA, 46 nt, Mus musculus
uuaugucuauagauguuuugugugugugugugugugugugugugug

SEQ ID NO: 94394 - RNA, 48 nt, Mus musculus
ccugucucucucucccccacccccuucacacacacacacacacacaca

SEQ ID NO: 94395 - RNA, 47 nt, Mus musculus
gugggggagagagagacagggagagggaguguguguguguguguuac

SEQ ID NO: 94396 - RNA, 45 nt, Mus musculus
uagcuccuggaggcccuuuaaaaguaggugcuauuuuuuuuuaag

SEQ ID NO: 94397 - RNA, 46 nt, Mus musculus
guuguucucugaccgcacgcacacguguacacacacacacacacac

SEQ ID NO: 94398 - RNA, 46 nt, Mus musculus
ugacuguggugacugagccaacaggaguaggggauagagaguugag

SEQ ID NO: 94399 - RNA, 46 nt, Mus musculus
aacaggccauaccagccgucaugucaccugucuggaguccccaguu

SEQ ID NO: 94400 - RNA, 42 nt, Mus musculus
caggagacccauggggucacgcuguguggcuaggguugggau

SEQ ID NO: 94401 - RNA, 28 nt, Mus musculus
ugcucuuccccucuucagguguggaucg

SEQ ID NO: 94402 - RNA, 78 nt, Mus musculus
aguauaacucguacaggcaagugucgcgcuggcgggcccgguggacguuagaaaugaugauuaaagaaaaaaaaagag

SEQ ID NO: 94403 - RNA, 45 nt, Mus musculus
acuuagggacuguaugcugcugggaugccugaacagugguaccag

SEQ ID NO: 94404 - RNA, 45 nt, Mus musculus
ugauacuuugugucuagaucaucuagauauucaugucucagcgga

SEQ ID NO: 94405 - RNA, 46 nt, Mus musculus
uauucuguuuuucauuaugcuccucuugcuuggacuggacagccag

SEQ ID NO: 94406 - RNA, 23 nt, Mus musculus
uacucggagccaugccccagccc

SEQ ID NO: 94407 - RNA, 46 nt, Mus musculus
cuaccuugggaaaaguucuucaaauugaaguaggcugugagaucag

SEQ ID NO: 94408 - RNA, 46 nt, Mus musculus
gaaccaauggaggugaaugaguccagagaggggcggcagcuagcaa

SEQ ID NO: 94409 - RNA, 46 nt, Mus musculus
agccacagcucaguucuuuucagguucaaauuccccuugggcacaa

SEQ ID NO: 94410 - RNA, 45 nt, Mus musculus
gauguauccagagggugcaguuuuaugcugcuguuaaaaggcaag

SEQ ID NO: 94411 - RNA, 41 nt, Mus musculus
cuagagcaugggguguguguguguguguguguguguguucc

SEQ ID NO: 94412 - RNA, 45 nt, Mus musculus
ccuccugagcuccagacccguuucucucucucccucuugcccuca

SEQ ID NO: 94413 - RNA, 41 nt, Mus musculus
ccucucacccccucaggccccucucccaaucguggccuccc

SEQ ID NO: 94414 - RNA, 44 nt, Mus musculus
gcucuucccagagagcaggagccauacuugaggaggaaaagaag

SEQ ID NO: 94415 - RNA, 46 nt, Mus musculus
uauaugacgguauugaggacaugauuggcuaucggccugggcccug

SEQ ID NO: 94416 - RNA, 46 nt, Mus musculus
uuuguguuguaagucucaccugagcgugacauuuucaccuugugau

SEQ ID NO: 94417 - RNA, 91 nt, Mus musculus
gcucugguaaagccagcuucagcuauaccugggacagugggggcaguuugcuuuauguugccuugguugcauaggguuuuguaggaccaau

SEQ ID NO: 94418 - RNA, 47 nt, Mus musculus
aaggaugggcaggaggaaguggccuuuguuaaggcccugggcacauu

SEQ ID NO: 94419 - RNA, 42 nt, Mus musculus
ugggguggcauggugccuuauggaucuuuccaaggcaaaucu

SEQ ID NO: 94420 - RNA, 75 nt, Mus musculus
aagauccauaaggcaccaugccaccccaucuccauaguaaggauagaggagaggcccugccccagauaaagucca

SEQ ID NO: 94421 - RNA, 60 nt, Mus musculus
cacugcucucaaaugccuacgggcccucugacugcuugccccgucucuccacagggaugu

SEQ ID NO: 94422 - RNA, 65 nt, Mus musculus
ccccuuggucauugucauccuccucugccggacggagggaccgcuccgcguggugagcacggggc

SEQ ID NO: 94423 - RNA, 57 nt, Mus musculus
gaggacagacagugucgguuucugugugaaguuaggcaggauucucgcccucucuga

SEQ ID NO: 94424 - RNA, 41 nt, Mus musculus
gaagggagaccaaggaguacaaauuucuucuugggggcggg

SEQ ID NO: 94425 - RNA, 42 nt, Mus musculus
acugaccuaauccuuccucuuuuccagaccccgcccccaaga

SEQ ID NO: 94426 - RNA, 46 nt, Mus musculus
ggccacacccuuucacucccgaguaacccucaugaacggcgcacuc

SEQ ID NO: 94427 - RNA, 46 nt, Mus musculus
cuuuccugcuguuuacuaacguuagauucucauaggaccagguuua

SEQ ID NO: 94428 - RNA, 68 nt, Mus musculus
augucuguauauguguguuuuguuuuguuugggggauauuuuguacaaaaagaaaacccauaggccua

SEQ ID NO: 94429 - RNA, 45 nt, Mus musculus
ugauuuccauguauuuugugggaacuugguaaauuuuucuuugua

SEQ ID NO: 94430 - RNA, 76 nt, Mus musculus
ugaaugcuggguggaauuuuccuaugauaguggauacaucuucaagaacgguguagucccuucugagcugguucag

SEQ ID NO: 94431 - RNA, 42 nt, Mus musculus
agagcagggcuauggacccucagccaacaagaaagaugccaa

SEQ ID NO: 94432 - RNA, 46 nt, Mus musculus
gccugcagaggcaggcucccagaccugagccacauccucaccagac

SEQ ID NO: 94433 - RNA, 42 nt, Mus musculus
ucugaagccccagcagcuccuguggccuggcuucgggcagcc

SEQ ID NO: 94434 - RNA, 42 nt, Mus musculus
ugcuaauaucauuugguccacuggccucccucaccccgggcc

SEQ ID NO: 94435 - RNA, 99 nt, Mus musculus
caggcuggcaaguguaccccaggagggcacuauucuuccuugccucuugacaaacucuugugaaaguuaccaccccagaaccauccagcagcucccagc

SEQ ID NO: 94436 - RNA, 45 nt, Mus musculus
ucaucugaggucacuaccaagcuggcucuguacuggaacucagau

SEQ ID NO: 94437 - RNA, 73 nt, Mus musculus
aagccacugcauuggcuguuggacaggcguuugcccccaggggacggcagagggaaggcgaagggaaguuucg

SEQ ID NO: 94438 - RNA, 42 nt, Mus musculus
uacacauuuuuuccugucuccaaagcaauguacucugccaag

SEQ ID NO: 94439 - RNA, 48 nt, Mus musculus
aagguuccguugaacgaaagaaaaccaggguacauuacaagucgguaa

SEQ ID NO: 94440 - RNA, 42 nt, Mus musculus
ggugaaguguaagggagaggggggcucguccagcuguggcag

SEQ ID NO: 94441 - RNA, 82 nt, Mus musculus
ucgccagaggggcgugcccgguggggguuagggguaggguagacgggcaugaccacagacacugccacagcuggacgagccc

SEQ ID NO: 94442 - RNA, 77 nt, Mus musculus
gggccuggggacuuggcccgcugugucuuuggucuagaauucgaucugggaaugauuaaaaaaagccuuucucaggc

SEQ ID NO: 94443 - RNA, 102 nt, Mus musculus
gagccuucaguauuuuggguuggcagacaaauggcaccauucuggaaauggccugagaaaggcuuuuuuuaaucauucccagaucgaauucuagaccaaaga

SEQ ID NO: 94444 - RNA, 48 nt, Mus musculus
gcaguguccccucaccugucuucaguggcccccacucucaccccgccc

SEQ ID NO: 94445 - RNA, 45 nt, Mus musculus
ugccugucagauggagacaggaagcaagggacauugccugguuua

SEQ ID NO: 94446 - RNA, 45 nt, Mus musculus
cucaaauguccaguuccacuuagcucacaguguaaguccccacac

SEQ ID NO: 94447 - RNA, 42 nt, Mus musculus
auuugagucauuuguagcuucagguucuccaagacuuaguag

SEQ ID NO: 94448 - RNA, 46 nt, Mus musculus
ccuugcuccauauucauggaacacagagcaauacccacgugugcca

SEQ ID NO: 94449 - RNA, 46 nt, Mus musculus
ggaggguguaucaauuccuaguucccaaaggcuuuggaggagaaag

SEQ ID NO: 94450 - RNA, 46 nt, Mus musculus
ugauacacccuccccucaaguuguaccacaggaaacugagggccaa

SEQ ID NO: 94451 - RNA, 46 nt, Mus musculus
uacccuaccauggaaagccacgcagaccauggcagcgcaugaggag

SEQ ID NO: 94452 - RNA, 46 nt, Mus musculus
ucggccaugguggugacacacugugauagagaaagccccuuccugu

SEQ ID NO: 94453 - RNA, 83 nt, Mus musculus
gccagcccaguuccucucuccaagaugcagacacaagccaggaaggcaccuuagagaaggccccucacagucccacucaaacc

SEQ ID NO: 94454 - RNA, 48 nt, Mus musculus
ccuucucuaaggugccuuccuggcuugugucugcaucuuggagagagg

SEQ ID NO: 94455 - RNA, 71 nt, Mus musculus
ugagaccccugucccuauggacacuguaaauaccucugugugcacaccccuuccuucaucaagccccaaac

SEQ ID NO: 94456 - RNA, 44 nt, Mus musculus
uggaguaucuggguuuuguugugugugugguuuggggcuugaug

SEQ ID NO: 94457 - RNA, 43 nt, Mus musculus
cucucugggagggaggaguggugucauugucauuacaggcaug

SEQ ID NO: 94458 - RNA, 46 nt, Mus musculus
uuaaacuuuuguaaaaaacaaaaaacaaaaaaacaaaugcacgcac

SEQ ID NO: 94459 - RNA, 46 nt, Mus musculus
acacacacacauacacacaaagaaaaaaaaccugaaaccaaucaag

SEQ ID NO: 94460 - RNA, 42 nt, Mus musculus
gcccuccuccucccagcgcgcgggcggcggcggcagcggcac

SEQ ID NO: 94461 - RNA, 42 nt, Mus musculus
aggccgggcgggccagccucugaggaacuuggugggucucgg

SEQ ID NO: 94462 - RNA, 42 nt, Mus musculus
aaaggcucagagaauggucagagaauggaagaaacuggauga

SEQ ID NO: 94463 - RNA, 27 nt, Mus musculus
agcuggguucuggauagcaagcuugaa

SEQ ID NO: 94464 - RNA, 46 nt, Mus musculus
caauacaguugauauuguaaugauaucagaucuuuuaaggaugcag

SEQ ID NO: 94465 - RNA, 50 nt, Mus musculus
gcaagaauagccuaaucacagguucaaggcuguucaaccacaaaagggcg

SEQ ID NO: 94466 - RNA, 46 nt, Mus musculus
gguuggcacaagacuuuaucacacacaagaguucuaggccagccag

SEQ ID NO: 94467 - RNA, 45 nt, Mus musculus
cuuuuugaggguuuuuuuguuuaguucuguuguuuuguuugagaa

SEQ ID NO: 94468 - RNA, 49 nt, Mus musculus
uuugagguuauacauuuguaagcuggggaagagggagccaacacaagga

SEQ ID NO: 94469 - RNA, 71 nt, Mus musculus
cacgccagggcaagaucucaguuaccguaaggcaugaguaagacuauuuacagaaacacuaguauaagagc

SEQ ID NO: 94470 - RNA, 41 nt, Mus musculus
uccaggccucuacuuauuuucuaucuuaacaauuuugguca

SEQ ID NO: 94471 - RNA, 42 nt, Mus musculus
auuucuccuuuuuucuuacuggaagaagaaacuaaucuccuu

SEQ ID NO: 94472 - RNA, 52 nt, Mus musculus
cuacccuuuucagaagggaaguggaggaggaaugagguuagaggugugaggg

SEQ ID NO: 94473 - RNA, 41 nt, Mus musculus
uaucacaaaaaauaacaaagacuaauguuggugucugggag

SEQ ID NO: 94474 - RNA, 43 nt, Mus musculus
cauguauuugaacucuugguuccugggugaugauggugcuggu

SEQ ID NO: 94475 - RNA, 46 nt, Mus musculus
ucuuccauuuccuguucaaucucuguguuuuuaguugaagucguga

SEQ ID NO: 94476 - RNA, 45 nt, Mus musculus
ggucuagaauguuauggcauggaagacauaagacagcaagagcuu

SEQ ID NO: 94477 - RNA, 46 nt, Mus musculus
ugagauuaccauaguggauuagaguacuuuuuacacaagcaauaag

SEQ ID NO: 94478 - RNA, 46 nt, Mus musculus
ucucugaugacucuagauugugucaaguugacacaaaaccaguaag

SEQ ID NO: 94479 - RNA, 46 nt, Mus musculus
auaaaaugguaucaguuaaacuaauaaacuauguaaauuaccucag

SEQ ID NO: 94480 - RNA, 46 nt, Mus musculus
agaacaauaggagauacauuuugcuguuuucccaaugaaggaguag

SEQ ID NO: 94481 - RNA, 44 nt, Mus musculus
uuuuauuuuuuuuuuuuuuaaagaaaagaaaaaaccuuuauugg

SEQ ID NO: 94482 - RNA, 24 nt, Mus musculus
gaguuuuaucaagcauuugucaga

SEQ ID NO: 94483 - RNA, 45 nt, Mus musculus
ugguuuuugagacaggguucaauguguagcccuagcuagcuuuaa

SEQ ID NO: 94484 - RNA, 42 nt, Mus musculus
uuagcaaguaccuguaccugcugaucaucuuaccagccccug

SEQ ID NO: 94485 - RNA, 46 nt, Mus musculus
aaugaagcaaggaggcauugagcucaguuuuuacaaguaagccaag

SEQ ID NO: 94486 - RNA, 46 nt, Mus musculus
gaguauuagguuauguggagguggacagauagacaggaagauugag

SEQ ID NO: 94487 - RNA, 46 nt, Mus musculus
agaacuuauggaaugaaugaaugagugugugugugugugugugugu

SEQ ID NO: 94488 - RNA, 46 nt, Mus musculus
aaggcuauccaccaaccccuggcuaauuugguuacuauuuggcuua

SEQ ID NO: 94489 - RNA, 46 nt, Mus musculus
ggaaacaauuggcuggugaguguaaaugugugugugugugugagug

SEQ ID NO: 94490 - RNA, 42 nt, Mus musculus
guggacuggggaagaguagaagaaagcagaccaguggggcag

SEQ ID NO: 94491 - RNA, 45 nt, Mus musculus
cucucucucuuaguugggauuucuauuccugcacaaacaugacca

SEQ ID NO: 94492 - RNA, 46 nt, Mus musculus
ggaggcauuuccucaggggaggcuccuuucacugugauagcuccag

SEQ ID NO: 94493 - RNA, 45 nt, Mus musculus
gaaaccauggugacuugagcucagucccugaacuaacacaggaag

SEQ ID NO: 94494 - RNA, 47 nt, Mus musculus
cucaguggaggagaggcugaggcugagaguugcugcuuuggggauag

SEQ ID NO: 94495 - RNA, 46 nt, Mus musculus
caggauaagcuuccucaaguguugccacuuaauaguuuccggccag

SEQ ID NO: 94496 - RNA, 40 nt, Mus musculus
uggccugaccacacaacaguaaaguuagauguagccucaa

SEQ ID NO: 94497 - RNA, 45 nt, Mus musculus
ugggaaggugauccuggcuucuccggaaacauccagugccaagca

SEQ ID NO: 94498 - RNA, 45 nt, Mus musculus
ccauaauguaaaauuuaccaucuuaaucauuauuguagccccauc

SEQ ID NO: 94499 - RNA, 46 nt, Mus musculus
acugaaacacuguaccuauuugggcucucacacauaagccacggug

SEQ ID NO: 94500 - RNA, 46 nt, Mus musculus
gcuuacacagcaaggucuuuacugacugacccauccgccagcccuu

SEQ ID NO: 94501 - RNA, 31 nt, Mus musculus
gcuucuguggagcguuugcuggggaaggcag

SEQ ID NO: 94502 - RNA, 108 nt, Mus musculus
ggcagugggaaugaagaagcucagcucagggaucuggggcauagaccugaguucugaagcagcuuuuuuccacucacaggaagucuggaggguuuguuguccuggauu

SEQ ID NO: 94503 - RNA, 45 nt, Mus musculus
cuugucuugguaaagccaguccauccuaccacuuaaaggcccauc

SEQ ID NO: 94504 - RNA, 89 nt, Mus musculus
uuguacauuuuccuauaaucgaaauggacuuucucauuggaguguuugagcaaaaucuaugucugcuaaacaaggagacacacugcaga

SEQ ID NO: 94505 - RNA, 34 nt, Mus musculus
ucuuagaagucacccagauagcaaauuuaaggag

SEQ ID NO: 94506 - RNA, 46 nt, Mus musculus
aauuaaucucuagucagugugaacagugaugcugugaaguuuccua

SEQ ID NO: 94507 - RNA, 46 nt, Mus musculus
gaugagcugaggucauuagcuaaauaaagaccgaguaagugagcag

SEQ ID NO: 94508 - RNA, 70 nt, Mus musculus
guaagaguagacaccaagcugcuucuauagccaaguaugcagacuggaggagaguugccugaacugcucu

SEQ ID NO: 94509 - RNA, 38 nt, Mus musculus
aaaagcuccaguucuuucccauuagauaauuuguaaua

SEQ ID NO: 94510 - RNA, 96 nt, Mus musculus
aagcacuuaauaccacagauagugcuucaccuccaagccuggcagaugggauagaugcuaguggaggagggaguauccaugucaucagcagagauc

SEQ ID NO: 94511 - RNA, 84 nt, Mus musculus
ccaagacacuaguccuuuugaggacaucauagcauauggaaccuuggcaggcuguucuuccauuaagauguuacguugcccagc

SEQ ID NO: 94512 - RNA, 46 nt, Mus musculus
auggucacauauuccacuagugacaggcuuuuggaaguucuuugag

SEQ ID NO: 94513 - RNA, 43 nt, Mus musculus
cuuguugccaaggauuuguugcuaggagaugugucuggccuuu

SEQ ID NO: 94514 - RNA, 46 nt, Mus musculus
ccuuagauaaaacugaugggggaaaaaguccuuuuauauaggugag

SEQ ID NO: 94515 - RNA, 46 nt, Mus musculus
aauagauagcauauuguguuguauuuuucuuuuuauauacuuucua

SEQ ID NO: 94516 - RNA, 46 nt, Mus musculus
caagguagguauugcagaaaacuuggaacauucuaggaagccaaag

SEQ ID NO: 94517 - RNA, 46 nt, Mus musculus
ucucuuccagauuggccaggauucuuguccgccuaccagcacucag

SEQ ID NO: 94518 - RNA, 54 nt, Mus musculus
gucucauuggcaauguuucaauagacagcauaauuccuuacauccucaagaugg

SEQ ID NO: 94519 - RNA, 41 nt, Mus musculus
aauccucagucagggcacauagugcaggccuguaaccccag

SEQ ID NO: 94520 - RNA, 46 nt, Mus musculus
aaaaaaaaaguggaaauauacuugguauuugcauuuagauuagcag

SEQ ID NO: 94521 - RNA, 45 nt, Mus musculus
gggauuuaaguacagaaguaucucuaacuucuaaauucccagcua

SEQ ID NO: 94522 - RNA, 41 nt, Mus musculus
agcagcauccacacuauauaaaauuguuuugaaggguagua

SEQ ID NO: 94523 - RNA, 46 nt, Mus musculus
uugggcugagauguggacuugggagacagggcccagcuuggcagag

SEQ ID NO: 94524 - RNA, 47 nt, Mus musculus
uggaaggggugagagacuguggggcugucagagaagaggggccccca

SEQ ID NO: 94525 - RNA, 70 nt, Mus musculus
ucccccucaucugaccaugaauccuugucuugguuggcacgucggccagggugcugucguuugugggguc

SEQ ID NO: 94526 - RNA, 46 nt, Mus musculus
ugcuuccagcaaggcgcaggauuuggggauaccaguuagcacgaag

SEQ ID NO: 94527 - RNA, 45 nt, Mus musculus
uuuuacauuuugaaauguuuauauuguaacguugaucucugcuag

SEQ ID NO: 94528 - RNA, 47 nt, Mus musculus
acacaaagcagccagagagagugagugcagcuccuacagcagaccag

SEQ ID NO: 94529 - RNA, 46 nt, Mus musculus
cucacuaauuagcuggugguaaauaagaauauuccuaaggccauga

SEQ ID NO: 94530 - RNA, 46 nt, Mus musculus
cugugggucagggguuuuggggcacagcuguucaaaucuugcaggu

SEQ ID NO: 94531 - RNA, 46 nt, Mus musculus
uaagccacaugggcacagaaggugccgaggaggacggugccccaga

SEQ ID NO: 94532 - RNA, 45 nt, Mus musculus
gguaauuuaagccaaaaaauaacaaaagcuauuggacggggugga

SEQ ID NO: 94533 - RNA, 45 nt, Mus musculus
uacuuuggugaaaagaguccguauuaaauaggggauagcauagag

SEQ ID NO: 94534 - RNA, 45 nt, Mus musculus
gaaagcccagggacgaacagauguugacagauguugauagaggug

SEQ ID NO: 94535 - RNA, 25 nt, Mus musculus
gccauuguccuguaccugcuuuacu

SEQ ID NO: 94536 - RNA, 46 nt, Mus musculus
guuccugagaaauucuugaggaggagcuaaaggaugagcugagaga

SEQ ID NO: 94537 - RNA, 45 nt, Mus musculus
gagggaaugagagacauggagacaaguuguaguguuggcagagag

SEQ ID NO: 94538 - RNA, 46 nt, Mus musculus
gaaggugauaaaacuguauagguaaaacuagauucacggggagaaa

SEQ ID NO: 94539 - RNA, 46 nt, Mus musculus
gcaguaaguucacuuaaggagagagauguuuacauaugcugugggu

SEQ ID NO: 94540 - RNA, 46 nt, Mus musculus
uaguaaguucccagccagccagaacuacaaaguaacaccccugucu

SEQ ID NO: 94541 - RNA, 46 nt, Mus musculus
cuaggaaaagauucucaacccgaugauuaggaugcuggaccccuuu

SEQ ID NO: 94542 - RNA, 45 nt, Mus musculus
ugacaccugaaauacacaguuuacauugcacucacauugggggga

SEQ ID NO: 94543 - RNA, 44 nt, Mus musculus
auccugcuguauuuggcacaguggaugucuaaaguacgguagcc

SEQ ID NO: 94544 - RNA, 41 nt, Mus musculus
cuugcuuuuuaguauagaauagaguuuauucagggcauggg

SEQ ID NO: 94545 - RNA, 45 nt, Mus musculus
acuuauuguuuuaaucacagugugugugugugugugugugugugu

SEQ ID NO: 94546 - RNA, 45 nt, Mus musculus
acagucugugccgcacgcuucagugacagguccuggcuggggcag

SEQ ID NO: 94547 - RNA, 50 nt, Mus musculus
gauagauagauagauagauagauagauagauaagaacagccugauuggca

SEQ ID NO: 94548 - RNA, 46 nt, Mus musculus
cacaauaacaauauuaauuaaauuuccaauacuugagucuuuauag

SEQ ID NO: 94549 - RNA, 42 nt, Mus musculus
caggaggagggaagauggcccacagcaaagagcaggaagcag

SEQ ID NO: 94550 - RNA, 46 nt, Mus musculus
cagguaaagaagggcuaauccaucaaaggaaaaugagugacaucag

SEQ ID NO: 94551 - RNA, 46 nt, Mus musculus
agccagggaagcaaggagacggaccugugcagaggacuuggcagug

SEQ ID NO: 94552 - RNA, 46 nt, Mus musculus
ugcuaggaaugugggugacaucagcugcacacccgaggaugcuguu

SEQ ID NO: 94553 - RNA, 46 nt, Mus musculus
ggcaaauuuucccuugucucuuuuuaugauguuugagccagauguc

SEQ ID NO: 94554 - RNA, 45 nt, Mus musculus
uguuuuagaguggugugugugugugugugugugugugugugugug

SEQ ID NO: 94555 - RNA, 46 nt, Mus musculus
gaauguaggaauaaaugauugaugaaugaggacuuaggauguagga

SEQ ID NO: 94556 - RNA, 49 nt, Mus musculus
uagauuuaaccuccugggaaguacaugggcaaagaaacagaugaugacc

SEQ ID NO: 94557 - RNA, 105 nt, Mus musculus
ugcuucauggcucaucagugccacaccuaaagaagcaguuggacaauagggugacagcauuucugaacuguuucaaugcugcuuauuguaggaaagaacuagaaa

SEQ ID NO: 94558 - RNA, 45 nt, Mus musculus
aggauuagcucucaucaaugagcuaaucaaucagacuugccaggu

SEQ ID NO: 94559 - RNA, 45 nt, Mus musculus
ggguucaggaacagaacucagcuaacauuuugccaauuccccauu

SEQ ID NO: 94560 - RNA, 71 nt, Mus musculus
uauccacaggaagaaagaugagaaagaaaaaagaggaaaagaaaaaagaagaaaggucgugaaaauaggga

SEQ ID NO: 94561 - RNA, 46 nt, Mus musculus
ccaggcaacugggauauucaaguaaaucugaguguuacugcuagag

SEQ ID NO: 94562 - RNA, 34 nt, Mus musculus
uucuucugggcuaaaggacacauuuucaggucgu

SEQ ID NO: 94563 - RNA, 43 nt, Mus musculus
caaggauuugccuccucucacacccauuuuaacucugcagaag

SEQ ID NO: 94564 - RNA, 47 nt, Mus musculus
uuaagacaugccuuauuuuuauuuuuugacuaugguaagccagccuu

SEQ ID NO: 94565 - RNA, 45 nt, Mus musculus
ccuggucuauauacugagauguugucuaaaaacaaaagaggcaaa

SEQ ID NO: 94566 - RNA, 45 nt, Mus musculus
ucuuggaucccggcaggagcuccgcaaucccgaagacugggagga

SEQ ID NO: 94567 - RNA, 46 nt, Mus musculus
auccagugguggagcgugaaggaauugacucgaaguggcugcgaaa

SEQ ID NO: 94568 - RNA, 56 nt, Mus musculus
acccuccuuaucccuugacccaaaccaguccuaauuaauagcuuggaucaccagau

SEQ ID NO: 94569 - RNA, 62 nt, Mus musculus
ggaagcacugcaagaauuuuagggccacccccacccccaguccuuuuuaccugacuuuuuuu

SEQ ID NO: 94570 - RNA, 51 nt, Mus musculus
cuuacaagauggacaggcaugauaauugggccuccacgaacaauauaugaa

SEQ ID NO: 94571 - RNA, 47 nt, Mus musculus
uucauuuuccacaguagugaauuuucuagauacaucuguagaccuca

SEQ ID NO: 94572 - RNA, 44 nt, Mus musculus
ccgcccugcccuccgccacagcugugugguggcccuuagaauag

SEQ ID NO: 94573 - RNA, 46 nt, Mus musculus
gauagcucuaugaggaauagcauuugguugcugucaaaccagcaga

SEQ ID NO: 94574 - RNA, 46 nt, Mus musculus
guaagaaggccauuccagauuucgagaaaaaccuaagcuaaagcag

SEQ ID NO: 94575 - RNA, 45 nt, Mus musculus
gaaauuucccucuguguuaucaugucuguugauguuauuguucag

SEQ ID NO: 94576 - RNA, 41 nt, Mus musculus
cucaccuaugaauaugugaaaucuuugcugcacacggacuc

SEQ ID NO: 94577 - RNA, 42 nt, Mus musculus
gacgcuagauccucaugcuggagcugucucccuagccucuac

SEQ ID NO: 94578 - RNA, 45 nt, Mus musculus
ccuucagugucucuagauucugagucaaguauguguagcucugug

SEQ ID NO: 94579 - RNA, 47 nt, Mus musculus
ugaauuucagaaucaacuuauacauuucugcaagauaucagagaggu

SEQ ID NO: 94580 - RNA, 46 nt, Mus musculus
cuuuuguucuaggcuuaaaccaauuuugauuauguuuugacaguag

SEQ ID NO: 94581 - RNA, 49 nt, Mus musculus
uacuauuuuuacuuauuccuguguuuauguguaggugcauggauguuuu

SEQ ID NO: 94582 - RNA, 46 nt, Mus musculus
uggcugcugggaccaaauucagguuccugugcucauggggcaagua

SEQ ID NO: 94583 - RNA, 46 nt, Mus musculus
aacuccccaccccagcaugaauccauagucuugcauguagcacccu

SEQ ID NO: 94584 - RNA, 46 nt, Mus musculus
gccugugcucaaggcaccuucauccugcuuuccugugugccuggga

SEQ ID NO: 94585 - RNA, 49 nt, Mus musculus
cccacuugcuccuuccccagucccauacccagcccaagaccugcagcag

SEQ ID NO: 94586 - RNA, 28 nt, Mus musculus
cacaucaagcagacaacuccagacaaca

SEQ ID NO: 94587 - RNA, 26 nt, Mus musculus
cccacuccugauaugugaaaccugag

SEQ ID NO: 94588 - RNA, 42 nt, Mus musculus
gaagaaagaucaaaaaaccaaaugggaggcauggaggggcag

SEQ ID NO: 94589 - RNA, 46 nt, Mus musculus
gcuucuucaaagaccuugcagaucuuuuugacuaucuuaagugaag

SEQ ID NO: 94590 - RNA, 46 nt, Mus musculus
caccuggggugccucucagcaucugucacauggaagcaagccuuag

SEQ ID NO: 94591 - RNA, 49 nt, Mus musculus
aguuccagguuuggugagagauuguguuaaaaaaaugagguaaaaagug

SEQ ID NO: 94592 - RNA, 38 nt, Mus musculus
augcaugugcaagugagguacacuuguacaaaagcuug

SEQ ID NO: 94593 - RNA, 46 nt, Mus musculus
gagaaacccugucuugaaaaacaaaacaaaacaacaaaaaacccaa

SEQ ID NO: 94594 - RNA, 45 nt, Mus musculus
agagcccaaauugagauugaaaagccauugacuagcucaccccag

SEQ ID NO: 94595 - RNA, 99 nt, Mus musculus
aucugggagagaggaguuuuaucaucguaaauagaauguggguauaguuacccuaaugauuggacuuucaaaaucauuauguagguugggaaaaauugu

SEQ ID NO: 94596 - RNA, 46 nt, Mus musculus
uguuguucugauaaaaacagucugacaaagagcaacuuggggagga

SEQ ID NO: 94597 - RNA, 81 nt, Mus musculus
aggugaugcucaagccuugagauggcuuuggcacauagccaagugcauuauguaauggcagaaaagaagaaaccaguagga

SEQ ID NO: 94598 - RNA, 49 nt, Mus musculus
aggccuguguuuuaaaugugaagugagaacucuccacaggcaggaagcu

SEQ ID NO: 94599 - RNA, 48 nt, Mus musculus
ucacguuggaaaaugcauuuuuuuuuaacuuugcuacauacaugcuca

SEQ ID NO: 94600 - RNA, 55 nt, Mus musculus
aaacaaacaaaaccaaccaaccaaccaaccaaaacccaaaaaacaaaaaugaaau

SEQ ID NO: 94601 - RNA, 46 nt, Mus musculus
uuugaggcugugugacucuccucuuccccaauaaucuuuccccuaa

SEQ ID NO: 94602 - RNA, 46 nt, Mus musculus
uuaauuggcauucaucugugaagaaguucuccucuuuuacccccag

SEQ ID NO: 94603 - RNA, 46 nt, Mus musculus
uugaugaguggaaaaaaauaguuaaauggguuauuuauuccuugag

SEQ ID NO: 94604 - RNA, 46 nt, Mus musculus
ggcauugcucaauauauaugacuuugucaaguugaaguggccccug

SEQ ID NO: 94605 - RNA, 25 nt, Mus musculus
ucuuaaaauaaaaaauuggagccau

SEQ ID NO: 94606 - RNA, 42 nt, Mus musculus
ugaaauaaagaaauguuggauaacauugcuggaacucgggag

SEQ ID NO: 94607 - RNA, 45 nt, Mus musculus
gguuuaguauuggaucaaucuuaaggugcaagaaucaaauggcag

SEQ ID NO: 94608 - RNA, 41 nt, Mus musculus
ugguugcugaucccuuugcuugguggccuguggugggguag

SEQ ID NO: 94609 - RNA, 42 nt, Mus musculus
ugagagauggagagguugcaagugcugaugugugggggugau

SEQ ID NO: 94610 - RNA, 46 nt, Mus musculus
gauuggggaacugagagcauugaaguugagcaauacccaugagcag

SEQ ID NO: 94611 - RNA, 46 nt, Mus musculus
uccuucaccucugcuguggaguccuaguggaacuaggagccuugag

SEQ ID NO: 94612 - RNA, 46 nt, Mus musculus
ucgcaggaugccuauggugagcugagauggcaacaguagguugggg

SEQ ID NO: 94613 - RNA, 45 nt, Mus musculus
gcagucucauuggcacccucaaguaaggugucacacggugaccag

SEQ ID NO: 94614 - RNA, 46 nt, Mus musculus
aaguuucccucaggguauuuagagacuuauauuuuuuggugcauag

SEQ ID NO: 94615 - RNA, 46 nt, Mus musculus
uaugagcuaaauuacaacuucaaauauuuuucuaauguauauguag

SEQ ID NO: 94616 - RNA, 46 nt, Mus musculus
agaugauuacuguggugguuugaaugagaauggccccuguuggaag

SEQ ID NO: 94617 - RNA, 46 nt, Mus musculus
cccacagaggucagaagaaggcauccaugaugccugcagcuggaga

SEQ ID NO: 94618 - RNA, 41 nt, Mus musculus
ccgagauucacagcccaugugacauguuugacagugcggga

SEQ ID NO: 94619 - RNA, 46 nt, Mus musculus
gguuuagaggcaaugcuggugaacagauggacagguagguuggaag

SEQ ID NO: 94620 - RNA, 45 nt, Mus musculus
uuaaguuguggaaguaaucaccaaaacuaagcacuuucccuggag

SEQ ID NO: 94621 - RNA, 42 nt, Mus musculus
auggacucccuucuccucaggaucaaacucgcccgccaucag

SEQ ID NO: 94622 - RNA, 45 nt, Mus musculus
ucagcuuguaucuuuuucugaagucaggaauggaacucaaagcag

SEQ ID NO: 94623 - RNA, 42 nt, Mus musculus
acaccucuggacguggcuaagacaaggaucaugcuggcaaag

SEQ ID NO: 94624 - RNA, 62 nt, Mus musculus
auguuacuuccacaaaauaugugaauuugcugcuucugagaggcaaugugaaagaggaagua

SEQ ID NO: 94625 - RNA, 45 nt, Mus musculus
gccagaccuaugcaggcgugguguuggcagccucacuguagagca

SEQ ID NO: 94626 - RNA, 47 nt, Mus musculus
caugggucccgcuuuuggugauauuuucacauuagguugcugucuaa

SEQ ID NO: 94627 - RNA, 69 nt, Mus musculus
ucagucggcuagaggaguggcaucuggagcucagaaacgugagagacuauuuguguacaaaaggcagga

SEQ ID NO: 94628 - RNA, 47 nt, Mus musculus
cucuuuuaaagcagucgcuacaggaaagagguaggagaggccgugga

SEQ ID NO: 94629 - RNA, 50 nt, Mus musculus
ccaaggccugugacuccagcccugaaucugugccacugaaagggcagauc

SEQ ID NO: 94630 - RNA, 45 nt, Mus musculus
agaccuaaagccuucuccuacguuagcuucaggcagcccagagcu

SEQ ID NO: 94631 - RNA, 66 nt, Mus musculus
ucccucuauccaagcaaccaugacagaauacugccauccuugaagaacaaggcggcgucugcagau

SEQ ID NO: 94632 - RNA, 46 nt, Mus musculus
aggguggucaucaggccaaugggcacauugaaagcaaugguaaguu

SEQ ID NO: 94633 - RNA, 45 nt, Mus musculus
guccugaccucgcuggugugggugugcaucaucuaccagaccagg

SEQ ID NO: 94634 - RNA, 46 nt, Mus musculus
acugagcgagcacauagccagcugagcauuuuaccuaccccuggcu

SEQ ID NO: 94635 - RNA, 45 nt, Mus musculus
gcuuaagggaggucgcccauugagccucacagagcgccaccauuu

SEQ ID NO: 94636 - RNA, 77 nt, Mus musculus
cgagugugcugccacgggccacccuaacccucagauugccuggcagaaggauggaggcaccgauuucccggcagcuc

SEQ ID NO: 94637 - RNA, 45 nt, Mus musculus
cuggaagaaggacaaugagguccuggccaaugcagacauggagaa

SEQ ID NO: 94638 - RNA, 46 nt, Mus musculus
gucugucucacagcaugggugaauuuugacaaugaucugccaagug

SEQ ID NO: 94639 - RNA, 69 nt, Mus musculus
uuugugacagccaccugugcccauccagagucgcugaagggccagagcauuuucucagugcugccagac

SEQ ID NO: 94640 - RNA, 46 nt, Mus musculus
cuguucuguaccauucucuuccaaacaauggaucggcaccuuuuua

SEQ ID NO: 94641 - RNA, 46 nt, Mus musculus
gagagaaugcaaucaggucuguccaguuugaugccuuugcaaagau

SEQ ID NO: 94642 - RNA, 45 nt, Mus musculus
aagcaaaggaaggagcuuugccuuccagcuaccugggccacagug

SEQ ID NO: 94643 - RNA, 47 nt, Mus musculus
augagauuguuuucuuguccacccagauugccugugagagagagggg

SEQ ID NO: 94644 - RNA, 42 nt, Mus musculus
cucugcaguucugcugcugggggccuguccaugccagcuugu

SEQ ID NO: 94645 - RNA, 42 nt, Mus musculus
uagguacaugucugugugcaggcuccauuaugcagccuuuag

SEQ ID NO: 94646 - RNA, 42 nt, Mus musculus
cagucucugcuguacucagucuaaagaugacagggugggacu

SEQ ID NO: 94647 - RNA, 42 nt, Mus musculus
gucuagcggaguugagcagccucaguauccugcgccucaguc

SEQ ID NO: 94648 - RNA, 42 nt, Mus musculus
uuccugccaccuagaggugcuccugcugaccacugcccaugg

SEQ ID NO: 94649 - RNA, 42 nt, Mus musculus
ggcuggcuccuuugcagagggcagcuuuguaguuguuuagau

SEQ ID NO: 94650 - RNA, 41 nt, Mus musculus
agcuuggcugaguguucgggaagaguuacuuggggcccggg

SEQ ID NO: 94651 - RNA, 41 nt, Mus musculus
ccuggcaaccacaugguggcucacaaccaucugcaaugggg

SEQ ID NO: 94652 - RNA, 41 nt, Mus musculus
ggcagauguggcuuuuagaacacacuggucagugacaucug

SEQ ID NO: 94653 - RNA, 46 nt, Mus musculus
cauaucaaguuguauuaggugugagaccccucgggguguggggcaa

SEQ ID NO: 94654 - RNA, 46 nt, Mus musculus
accaggcaggccuuucuuucauaaggccugucauuguugggcagua

SEQ ID NO: 94655 - RNA, 45 nt, Mus musculus
gucugcucacaccugggagccauuuucagcuguccuagugcaagu

SEQ ID NO: 94656 - RNA, 91 nt, Mus musculus
uuggguuggcgugagggagcucaugucauaaagauagacuuuagggaaagaaacagacuuuuguuaggaagggacagaaucugccagcaga

SEQ ID NO: 94657 - RNA, 46 nt, Mus musculus
uauugugacuaucacugccauccugguuuccaguaaaccuuaagaa

SEQ ID NO: 94658 - RNA, 23 nt, Mus musculus
gcaggaaaucuggcacucuugcu

SEQ ID NO: 94659 - RNA, 46 nt, Mus musculus
cagacauuucaggaagauuugccgugcuuugcauggaaguaaaguu

SEQ ID NO: 94660 - RNA, 46 nt, Mus musculus
guuaaagccaaauuugacuaaguuaauuaaugaugaugcuguacug

SEQ ID NO: 94661 - RNA, 45 nt, Mus musculus
ugggauggcugugacgugaaggaagacugaacuacugaggagugu

SEQ ID NO: 94662 - RNA, 50 nt, Mus musculus
gugguuccuuuaagugagaaaaugaaaauacaguaagguuuuguguaaga

SEQ ID NO: 94663 - RNA, 45 nt, Mus musculus
cuauuauacuguucucacucucccggguggcuggucucaacuuau

SEQ ID NO: 94664 - RNA, 46 nt, Mus musculus
aucuucagacaacagauaacauuuuauccuaauuuauaucagaauu

SEQ ID NO: 94665 - RNA, 69 nt, Mus musculus
aaacacauuucucugcaguucaguuuuggcucaggucuacuagugugcaacuuuuaguguaccucugug

SEQ ID NO: 94666 - RNA, 45 nt, Mus musculus
gauuggcauuuagggagagucuuggcugugagauuagguuaggau

SEQ ID NO: 94667 - RNA, 42 nt, Mus musculus
acuguguccugugcuuauuaaagcgguuuauauggcagagag

SEQ ID NO: 94668 - RNA, 45 nt, Mus musculus
uagacacgcgucaccugauucucugcacuuguaaugucguugaaa

SEQ ID NO: 94669 - RNA, 41 nt, Mus musculus
gagucagaguggaugaggucauggggaaggaggaagggaga

SEQ ID NO: 94670 - RNA, 42 nt, Mus musculus
cuuuaggauucauguccuggcuguaacauuucuuugggaaau

SEQ ID NO: 94671 - RNA, 42 nt, Mus musculus
uaggcuggauaauugcucuggacagguuuacaauagggaggu

SEQ ID NO: 94672 - RNA, 46 nt, Mus musculus
aaaaagaaaaguaguaugauuucagguaaggaaaguuugggcuguu

SEQ ID NO: 94673 - RNA, 41 nt, Mus musculus
aagaauagcacaguuaugaacuucccccaaccaggccaggu

SEQ ID NO: 94674 - RNA, 30 nt, Mus musculus
auuugugugcgcauaugugugcacucucgu

SEQ ID NO: 94675 - RNA, 42 nt, Mus musculus
gagcucccauuuagguuuuguauggugaggauuggcugagcu

SEQ ID NO: 94676 - RNA, 42 nt, Mus musculus
auuaaggggaaagaaacaccagggcgauuucuguggugagau

SEQ ID NO: 94677 - RNA, 46 nt, Mus musculus
aaaugccugcuucaaacugcagguguuuguuuugaggugacaauau

SEQ ID NO: 94678 - RNA, 86 nt, Mus musculus
gcagggaggccuuuguaccugauaaccugagcuagcuggggggaggugugcuuucugacguugguugguugagcaaagcugccuua

SEQ ID NO: 94679 - RNA, 46 nt, Mus musculus
ugcuggugccgcaagcugcacaguuauuguuaaagaauuuggagau

SEQ ID NO: 94680 - RNA, 44 nt, Mus musculus
gcccucauagcccauugagguaaaggggugacaguggccucugu

SEQ ID NO: 94681 - RNA, 46 nt, Mus musculus
uccggucuguggagaggacugaaggcacauggaguggggguuagcu

SEQ ID NO: 94682 - RNA, 47 nt, Mus musculus
gcagcccuuuucuguccuguuguuuaagaucaaaauagcccaaaugc

SEQ ID NO: 94683 - RNA, 51 nt, Mus musculus
gccuuagauguguauaaccuuacaccuguagucucagcacuggggaggagg

SEQ ID NO: 94684 - RNA, 45 nt, Mus musculus
gggcaaccauuuucgucuacuuaaugauugacagaccagcaagag

SEQ ID NO: 94685 - RNA, 41 nt, Mus musculus
guguuuguaugugugcauguguucuuguuucugugggugug

SEQ ID NO: 94686 - RNA, 45 nt, Mus musculus
auuuuagauauuauuauuauuuaguguagagaugauuagccgguu

SEQ ID NO: 94687 - RNA, 45 nt, Mus musculus
aaugaaaauuucaguuuuucaccaguuaaauugcaaacugccagu

SEQ ID NO: 94688 - RNA, 57 nt, Mus musculus
uguucuuucaaagguuaaagcuuugucugagacaggagagagaaagggguggagggg

SEQ ID NO: 94689 - RNA, 45 nt, Mus musculus
cuuuggacuucugaguggauuauaggcaguaguucuuggcaagau

SEQ ID NO: 94690 - RNA, 42 nt, Mus musculus
ugagcccuauccucaccacauugucccccuccagggcacuau

SEQ ID NO: 94691 - RNA, 70 nt, Mus musculus
uuuauuuuguggugcuagggaucugaacucacugccugggacgugcuaaacaacugugcuuuccugcgga

SEQ ID NO: 94692 - RNA, 42 nt, Mus musculus
cagcagugcuucaagggcuuggugugcaaaguguugugaguu

SEQ ID NO: 94693 - RNA, 46 nt, Mus musculus
augauuucagaagcuccuuaaagagcauuacagauuuacuuuagac

SEQ ID NO: 94694 - RNA, 42 nt, Mus musculus
agauuuuuaucuauuaauaacugaggcaguuuggggacauuu

SEQ ID NO: 94695 - RNA, 80 nt, Mus musculus
gagugagagugcuguggagcgcgaaauauguguguguguagaguggaggugagcgaauuugugugcaugugagacggacg

SEQ ID NO: 94696 - RNA, 44 nt, Mus musculus
augagugauccuguaagggugaucgagugugccucgugaagucu

SEQ ID NO: 94697 - RNA, 62 nt, Mus musculus
gagagaggacucugcuucugggguuugaaggugagcgugauucuggaggagccugccuugcg

SEQ ID NO: 94698 - RNA, 45 nt, Mus musculus
ucaccuuucugugugugugugugugugugugugugugugugugug

SEQ ID NO: 94699 - RNA, 41 nt, Mus musculus
caaucuacuuuuauaccauuuugauuauauacaggggcugg

SEQ ID NO: 94700 - RNA, 46 nt, Mus musculus
gcugugccacuaggcaaauuaauaagauguggugcuuccuggggau

SEQ ID NO: 94701 - RNA, 45 nt, Mus musculus
uguacauguuggggggcggugcaggugcacguggaggccggagau

SEQ ID NO: 94702 - RNA, 42 nt, Mus musculus
caauuguuuucucacugggaagggacacacacaaggaucauc

SEQ ID NO: 94703 - RNA, 46 nt, Mus musculus
uaugugcuuaauaauuaagacuguaauuaaaguauaacagcaagua

SEQ ID NO: 94704 - RNA, 46 nt, Mus musculus
ugaaaccauacaggggacuuucuccccuagaaauauagcauucuau

SEQ ID NO: 94705 - RNA, 41 nt, Mus musculus
gucccuuguuuuacagaugaugagucuacccugccaauaag

SEQ ID NO: 94706 - RNA, 46 nt, Mus musculus
cagacuaauccucucuggccguuguuaugcaaaggaacaguuuuaa

SEQ ID NO: 94707 - RNA, 45 nt, Mus musculus
agaaauggacacauaaugacugacaguuguguggggugucacagu

SEQ ID NO: 94708 - RNA, 41 nt, Mus musculus
gcgggcuguggucuaggaagcugggaagaaugaagugagag

SEQ ID NO: 94709 - RNA, 46 nt, Mus musculus
ccacguugaauguggaaggauaagaucugaaugacugacaggaagg

SEQ ID NO: 94710 - RNA, 46 nt, Mus musculus
ggagguaaguauguauguaaagauaugcaaauuaacacacccaaga

SEQ ID NO: 94711 - RNA, 47 nt, Mus musculus
acauugugcauguguaccuacacacacuugcaucugcacacacaaga

SEQ ID NO: 94712 - RNA, 46 nt, Mus musculus
uuucucuggcccccaccugcaagcauacacacacuggccgccaccu

SEQ ID NO: 94713 - RNA, 84 nt, Mus musculus
aauagccaagaauuguagugcacauuuaucaucccagcacugaggaggggagggcaggagaagcccugagccaccaaugcagcc

SEQ ID NO: 94714 - RNA, 46 nt, Mus musculus
aaagaaaacguuauaccaguuccaaauauuuaagaaacccagaggg

SEQ ID NO: 94715 - RNA, 46 nt, Mus musculus
aaccccaccacaaauugcuaaugcauauuuuaagugaagcguagua

SEQ ID NO: 94716 - RNA, 46 nt, Mus musculus
uuuugauuauuaugugacaagagcauuuucuuuucuggucccauuu

SEQ ID NO: 94717 - RNA, 41 nt, Mus musculus
ccauuugcuuggaagaccuuuuccauccuuuuacuccgaga

SEQ ID NO: 94718 - RNA, 46 nt, Mus musculus
uugguuagaguuacgccaagauauuuuauauuauuuguggcuauug

SEQ ID NO: 94719 - RNA, 46 nt, Mus musculus
uuuucagagagugauuaaauuaguuaguuagguuagaacacagaga

SEQ ID NO: 94720 - RNA, 46 nt, Mus musculus
guaacccgacugggcuggugagggaaugaagaaaggacaagcagac

SEQ ID NO: 94721 - RNA, 45 nt, Mus musculus
ugacaguaacacuaaguguacugcgcagguuguauuuguauaguu

SEQ ID NO: 94722 - RNA, 46 nt, Mus musculus
ucucuucaccucugcaaucaagcucucccaauaaacgugcgcagaa

SEQ ID NO: 94723 - RNA, 46 nt, Mus musculus
gaugucuuaauuuauucuucuaaacaauuaguagaacaucggaucc

SEQ ID NO: 94724 - RNA, 23 nt, Mus musculus
gugguggacaggaguuugggcua

SEQ ID NO: 94725 - RNA, 46 nt, Mus musculus
cagugaaugagcagagaccuaaaggcaagagauguguuggguggaa

SEQ ID NO: 94726 - RNA, 41 nt, Mus musculus
ugugguguggugugguguggugugguguggugugagggcug

SEQ ID NO: 94727 - RNA, 42 nt, Mus musculus
uaaccuugaaguuaucuuaaaaucccaucuuacagcaauaga

SEQ ID NO: 94728 - RNA, 46 nt, Mus musculus
gggguggaaucucaccuguuaagaugggccuaagauaccaggaacc

SEQ ID NO: 94729 - RNA, 46 nt, Mus musculus
cccagugcuggaagauaguucuagcucauuuuuauugggcccccau

SEQ ID NO: 94730 - RNA, 48 nt, Mus musculus
agaggaaaacuuguagucuuuccuacaaaagugagaaguacagauaaa

SEQ ID NO: 94731 - RNA, 45 nt, Mus musculus
cacuuucucugacuuaucugacguauauaaauaaaggccacaacu

SEQ ID NO: 94732 - RNA, 25 nt, Mus musculus
caugaucaugaaaauugauuaugua

SEQ ID NO: 94733 - RNA, 46 nt, Mus musculus
ucaggacacccugagaguaauugcccaaacuuuuauagucacagac

SEQ ID NO: 94734 - RNA, 25 nt, Mus musculus
gagcccuucugauucuucugugcuc

SEQ ID NO: 94735 - RNA, 46 nt, Mus musculus
gaacccaauuauauuuuauguuuuauacuugccagaacuccagagu

SEQ ID NO: 94736 - RNA, 46 nt, Mus musculus
gucuguaaaguagugacacaugagugaacaaagggaccgagcaagc

SEQ ID NO: 94737 - RNA, 42 nt, Mus musculus
aguggcaagggacuaggagaggcuggcucugacccggcagac

SEQ ID NO: 94738 - RNA, 45 nt, Mus musculus
uuuauuuuuuccuuccuuaaaagcugcaaaaaagcccuuuagaua

SEQ ID NO: 94739 - RNA, 46 nt, Mus musculus
caucuuuucugaccagcacaggacaugaggcuuagauuccagagau

SEQ ID NO: 94740 - RNA, 46 nt, Mus musculus
ugaauuagagugaacauuggugacauuuuauuaauuagacacagau

SEQ ID NO: 94741 - RNA, 46 nt, Mus musculus
ucaagugacuuucuauaaacuuuaugaaauuaccucgucucaagug

SEQ ID NO: 94742 - RNA, 45 nt, Mus musculus
agguuucucugaguaccagcugaccaagccacauucaccucagca

SEQ ID NO: 94743 - RNA, 47 nt, Mus musculus
acugucucccugauccagaagcagagcuagcauuuauucuaacaaac

SEQ ID NO: 94744 - RNA, 44 nt, Mus musculus
ggcugccugccuuaggaucgugagcuuguauaaugggccaggag

SEQ ID NO: 94745 - RNA, 46 nt, Mus musculus
uguaaaccaguucuaugaauuguuuuaguguaccauaagcacagau

SEQ ID NO: 94746 - RNA, 45 nt, Mus musculus
aaauguagacucuuguuuucucaggguccagaccacgcccggaua

SEQ ID NO: 94747 - RNA, 44 nt, Mus musculus
auggcugccuauaaucuuaugcuugcguucccacagagccuuac

SEQ ID NO: 94748 - RNA, 47 nt, Mus musculus
cuagcuguauaagguuucaggaaagaaaguaauggccgccaccaucc

SEQ ID NO: 94749 - RNA, 45 nt, Mus musculus
uuguaguucuggcaguaauuauuucugauagagcccuguccaccu

SEQ ID NO: 94750 - RNA, 45 nt, Mus musculus
gcacucugaggugccacaagcaugugccugucucucugacccagg

SEQ ID NO: 94751 - RNA, 46 nt, Mus musculus
ggggaagaucuguuccacagccgguguuguuuaggguguuguuguu

SEQ ID NO: 94752 - RNA, 24 nt, Mus musculus
caguucuccaguguuguccaggaa

SEQ ID NO: 94753 - RNA, 46 nt, Mus musculus
uuagaaauguauauaauuauagaaucacaggucacaguguauaaua

SEQ ID NO: 94754 - RNA, 46 nt, Mus musculus
uaaaauuguuuuuagauauguguguauauauauguggcaaguggug

SEQ ID NO: 94755 - RNA, 46 nt, Mus musculus
guuucucacaaacucugauuaagaacacugcacacuacuuggagau

SEQ ID NO: 94756 - RNA, 45 nt, Mus musculus
gcugaguuccgacaaaaggacauauuugcuauggacgacaaaucc

SEQ ID NO: 94757 - RNA, 46 nt, Mus musculus
uauucuggcacagcauucacugucauuaaguuuagaaguuuuagag

SEQ ID NO: 94758 - RNA, 45 nt, Mus musculus
ccauucauuuugaaggugucacuuacaaguaaucuugccagugag

SEQ ID NO: 94759 - RNA, 49 nt, Mus musculus
cauauagcaauaacugaacagagcaaaguauaugagagaggggguagau

SEQ ID NO: 94760 - RNA, 42 nt, Mus musculus
cuguugauggcaguggccaucauuaauaucaaagcugcugag

SEQ ID NO: 94761 - RNA, 74 nt, Mus musculus
ucaugugcaugcaggugaacacacuuacaagaccgggagaaaagacagcuuccucugaagugggagacauuuug

SEQ ID NO: 94762 - RNA, 24 nt, Mus musculus
cccugggagaagcagugauugugu

SEQ ID NO: 94763 - RNA, 46 nt, Mus musculus
agguuucuauuaauaaggauagaggcuuuuguuguucugugaagau

SEQ ID NO: 94764 - RNA, 42 nt, Mus musculus
acgguucagcaauuuaggucacugauccuaucaugaagagau

SEQ ID NO: 94765 - RNA, 41 nt, Mus musculus
gacuauguccuaggaagagacaacuaaguguccccucugag

SEQ ID NO: 94766 - RNA, 46 nt, Mus musculus
ggccugcccaauggguaaauaauaaguugcuccacagugcccaggg

SEQ ID NO: 94767 - RNA, 46 nt, Mus musculus
ugcaagaggugauguauguauauguaucugaucgaaaugguuugug

SEQ ID NO: 94768 - RNA, 46 nt, Mus musculus
uuguggcccauaguuugaggguacaguccaucauggcaggaaaggc

SEQ ID NO: 94769 - RNA, 45 nt, Mus musculus
auucuaauggaccggucccauaauggcccugugauagugggcagu

SEQ ID NO: 94770 - RNA, 46 nt, Mus musculus
gaugauugguuauaaucuagcaacgaaacaaacuccaaaagaaggu

SEQ ID NO: 94771 - RNA, 46 nt, Mus musculus
auuuguauuuggcuuucagugacaugcaggcuguaaauggaaagau

SEQ ID NO: 94772 - RNA, 45 nt, Mus musculus
ucucuuaugcauccaguauuguuucuuuauauauuaguuugguga

SEQ ID NO: 94773 - RNA, 47 nt, Mus musculus
gaucuuagcuggaggaagaggaaaaggugucuucaauagcgguuuga

SEQ ID NO: 94774 - RNA, 46 nt, Mus musculus
uugauaaauuccaucaagguuacagccauuucugggucuuggaggu

SEQ ID NO: 94775 - RNA, 46 nt, Mus musculus
ucucaugaacauuauuuuauauaaauuuguuuucagaaugccaccu

SEQ ID NO: 94776 - RNA, 46 nt, Mus musculus
aauaacuaugagauuacucauauuaauuuauauagaggaacaagac

SEQ ID NO: 94777 - RNA, 46 nt, Mus musculus
guucaucaccauuaccaucaucugccauuuacaugauacaggagau

SEQ ID NO: 94778 - RNA, 44 nt, Mus musculus
ugcuaggugauugccauggguaucaaaauuuaccauuucugaag

SEQ ID NO: 94779 - RNA, 46 nt, Mus musculus
cacucuucagccugcccaugagacccauaguggagcugcuccagau

SEQ ID NO: 94780 - RNA, 25 nt, Mus musculus
ccaaaccugggcccuuuucaagaag

SEQ ID NO: 94781 - RNA, 23 nt, Mus musculus
uuuggagcaaagcuaccccaaga

SEQ ID NO: 94782 - RNA, 42 nt, Mus musculus
aaagcuugcugggguagcagacauuacccagacaggccagga

SEQ ID NO: 94783 - RNA, 45 nt, Mus musculus
caaaaaguuuguuguuuuuauugauauguaugugugugugugugu

SEQ ID NO: 94784 - RNA, 46 nt, Mus musculus
aaucuuucagaaguagaagguaccaccucaacucagagccagacau

SEQ ID NO: 94785 - RNA, 59 nt, Mus musculus
uugaaggcaguauaaguuauaugcauuaucacuuaaguaauaguaagcaggcagccauu

SEQ ID NO: 94786 - RNA, 75 nt, Mus musculus
aagguuuugaaaacaaauuuaaugcaauucaugauauaaaccauaacuauaaguaauagaguauaauaaauccau

SEQ ID NO: 94787 - RNA, 46 nt, Mus musculus
caaacacuucucagagacagugccugcucacucuagauggguagaa

SEQ ID NO: 94788 - RNA, 46 nt, Mus musculus
cugagaguucacaugcuucagggaaagcuagagcuucagggaggcc

SEQ ID NO: 94789 - RNA, 42 nt, Mus musculus
aaggcacagagcagccuucauucccaaagggagaagccaaga

SEQ ID NO: 94790 - RNA, 46 nt, Mus musculus
aauuuaaaauguuaguugaccaaaucagagcuaaaagcuaagagac

SEQ ID NO: 94791 - RNA, 45 nt, Mus musculus
aagaccauccuccaaguacagucaggugcacaagcuauagguaga

SEQ ID NO: 94792 - RNA, 46 nt, Mus musculus
uuacauugugggaaucuuucugaagaucacucugacuccaaugaga

SEQ ID NO: 94793 - RNA, 62 nt, Mus musculus
guagugggaaaguuuguagaaauaacaggcucggagugaguggggaaagaugguggagugag

SEQ ID NO: 94794 - RNA, 42 nt, Mus musculus
ucagccugcucuuuuauagaaccggagacugccagcccagag

SEQ ID NO: 94795 - RNA, 46 nt, Mus musculus
uuguauuugacauuuauugggucauacuugacauuucugaguagag

SEQ ID NO: 94796 - RNA, 46 nt, Mus musculus
uaggcacacauuuagaggaugaaauuuucuugagaaguugccaggc

SEQ ID NO: 94797 - RNA, 46 nt, Mus musculus
caugaugggcauguguaaaugcacaacccaaacugagagguuucag

SEQ ID NO: 94798 - RNA, 46 nt, Mus musculus
aacuucuuauaacagcaaaaguaaaaaaauauagacagacccacaa

SEQ ID NO: 94799 - RNA, 91 nt, Mus musculus
agaaaucaggaauucaaagaaguauaggaauucaaaacaaguagagcaagcaaggacucaguguacuggacugacuucaggagacacagac

SEQ ID NO: 94800 - RNA, 46 nt, Mus musculus
uccagugcuugugguuaaugcugcuaucaauguuuauguuugagau

SEQ ID NO: 94801 - RNA, 45 nt, Mus musculus
cucucaucccucucacuuucuccccucccccccuuagccccuuuc

SEQ ID NO: 94802 - RNA, 45 nt, Mus musculus
uauuaaaggcauuuacucaauaauaaccagauguguaacagaagc

SEQ ID NO: 94803 - RNA, 45 nt, Mus musculus
aguauauucugcauguuuacuggaauauaggucuguagucaaugu

SEQ ID NO: 94804 - RNA, 45 nt, Mus musculus
aaaacuaauacaauagaagcuucguaaguaugugugugugugugu

SEQ ID NO: 94805 - RNA, 41 nt, Mus musculus
gacagaugaggggaaauugaaagggaggaucgaguggagag

SEQ ID NO: 94806 - RNA, 46 nt, Mus musculus
gaaguggguggcauuauuaggagauguggccuuguugcuuuguuga

SEQ ID NO: 94807 - RNA, 45 nt, Mus musculus
ccuccuccuaguauugcauuuguuuauuuauuugugugugugugu

SEQ ID NO: 94808 - RNA, 46 nt, Mus musculus
uuaaccuuuuucuuuuucuacuccuuuucucuccuuuccccucccc

SEQ ID NO: 94809 - RNA, 46 nt, Mus musculus
guguauauguguguguguguguguguguguguguguguacguguac

SEQ ID NO: 94810 - RNA, 46 nt, Mus musculus
ugugucauugucacugggauugucuacagacagccaaggaaaagaa

SEQ ID NO: 94811 - RNA, 46 nt, Mus musculus
ggauucuguugauccgagaggaaauugaugacauuuaaaaggagau

SEQ ID NO: 94812 - RNA, 59 nt, Mus musculus
agagugcagagguucuuuguugccaacacugcuaaagaggcucuggaggcagccaagag

SEQ ID NO: 94813 - RNA, 47 nt, Mus musculus
accugcaggaguaccagagcaagaagcucaugucagagcacggagug

SEQ ID NO: 94814 - RNA, 25 nt, Mus musculus
aaaggggccuucuuaugcuaggugu

SEQ ID NO: 94815 - RNA, 43 nt, Mus musculus
guguguguggaccuuuaucauuucuccaaaguaaccccugauc

SEQ ID NO: 94816 - RNA, 46 nt, Mus musculus
uuauuuuaauaugguaaauuaaauuuuaccauagguaaguauagau

SEQ ID NO: 94817 - RNA, 46 nt, Mus musculus
cuagagcccaacuaggcuauaggauguuaugagcagugauguagau

SEQ ID NO: 94818 - RNA, 46 nt, Mus musculus
uauuucagcuugcuuguuuggguguugguauguaaugcagggcuaa

SEQ ID NO: 94819 - RNA, 45 nt, Mus musculus
uacaguuaaggaaauaaagagguggcuguguauuuacuuagagau

SEQ ID NO: 94820 - RNA, 45 nt, Mus musculus
aggcauguucugaacuucuggcuuuuacuuugggauuugauuuua

SEQ ID NO: 94821 - RNA, 45 nt, Mus musculus
cuguucuggacaaaacacccaaaacaguaacucaaaggcccuaga

SEQ ID NO: 94822 - RNA, 46 nt, Mus musculus
uaucaaaaaaccuacuuuuuuuuaaagcuuacuuuccccugaagaa

SEQ ID NO: 94823 - RNA, 46 nt, Mus musculus
gguguaucucagggcauuucucuauuauaaauaauuggguuuaggg

SEQ ID NO: 94824 - RNA, 69 nt, Mus musculus
gagauugauuguguuguuagguuuugucacaugaucccagguuagaaauuguuucuuuggcugugaaag

SEQ ID NO: 94825 - RNA, 52 nt, Mus musculus
gagagagagacagacagacagagggagagacagagacagagagagagagagg

SEQ ID NO: 94826 - RNA, 47 nt, Mus musculus
acuguacccuuaaaguuucugugugugugugugugugugugugagag

SEQ ID NO: 94827 - RNA, 50 nt, Mus musculus
gcuaaguuuucuguaccaggcaugauuuccauuuuaagucuaauuagaga

SEQ ID NO: 94828 - RNA, 74 nt, Mus musculus
gcuuucugaaguggucuccuguugcgaagagaaguuuccuugaggaggagugaggacuaaacuuacuuguggau

SEQ ID NO: 94829 - RNA, 63 nt, Mus musculus
ugacucccugcuuugcaaugaucccugagcuggaguugcuggaguuguguuauguguggaguc

SEQ ID NO: 94830 - RNA, 48 nt, Mus musculus
uguucauugcugauguccuuguucaucuccuauuuaggcagucauguu

SEQ ID NO: 94831 - RNA, 56 nt, Mus musculus
acugugggccccucucucgguaucucuugguucccuguaguucuuugucuaagcug

SEQ ID NO: 94832 - RNA, 42 nt, Mus musculus
gcuugaauagaaacccugacuaagacaccuaugcuaacaguu

SEQ ID NO: 94833 - RNA, 42 nt, Mus musculus
ucagauauugcuucuagccuuaucaccccccaacccccaugu

SEQ ID NO: 94834 - RNA, 46 nt, Mus musculus
uaugcuacuaggaaaagccaggaaggacauggugccuacaguagag

SEQ ID NO: 94835 - RNA, 50 nt, Mus musculus
cgaaagugagaccucuggaauggaagaaaaagguguaggagcaguugaag

SEQ ID NO: 94836 - RNA, 46 nt, Mus musculus
ugggaaaaauagagaugacacacaggcacucaagucaaaaugaggu

SEQ ID NO: 94837 - RNA, 45 nt, Mus musculus
uaaaauauuuauauucacguuugcuuccagcauauuggcucagug

SEQ ID NO: 94838 - RNA, 46 nt, Mus musculus
aguuguucucugccuccacaaacaaacaaacaaguuaaaaaaagau

SEQ ID NO: 94839 - RNA, 41 nt, Mus musculus
acuuuuguaccaguauggugcugugagucauuacucccaga

SEQ ID NO: 94840 - RNA, 29 nt, Mus musculus
uuuagaguauguucuagucaguguggaga

SEQ ID NO: 94841 - RNA, 42 nt, Mus musculus
gguggggccgugagagaugaggacagagaaauggggccaaau

SEQ ID NO: 94842 - RNA, 45 nt, Mus musculus
gguauuggagauacugcagaggacaaggaauagauucguguaggu

SEQ ID NO: 94843 - RNA, 42 nt, Mus musculus
aauguaccuaauaauucugauggaguggagagguggggggaa

SEQ ID NO: 94844 - RNA, 42 nt, Mus musculus
agcugccuuuggggcauuucucucucaugccugggugaaguu

SEQ ID NO: 94845 - RNA, 46 nt, Mus musculus
ggaugggaagggggugguaagacaacaagugcagaggcccugaggu

SEQ ID NO: 94846 - RNA, 41 nt, Mus musculus
ccagccuaggggaauagcuuagguuucacuucagugagaga

SEQ ID NO: 94847 - RNA, 42 nt, Mus musculus
cauuucucuguuauuguuaaugggaauuuaagaggcgcuaau

SEQ ID NO: 94848 - RNA, 41 nt, Mus musculus
gcagauuguuguaaaaucuaaaauguagauauggcccuuuu

SEQ ID NO: 94849 - RNA, 46 nt, Mus musculus
cacgguagaccugugaauuauccaaucaaaacaaaagccccaagaa

SEQ ID NO: 94850 - RNA, 45 nt, Mus musculus
cacugccaaguagccacaugaagagaagacacuuucccuguuuau

SEQ ID NO: 94851 - RNA, 46 nt, Mus musculus
agaacauucuguaguaccaucuccacugacgcuucagccgugaaga

SEQ ID NO: 94852 - RNA, 53 nt, Mus musculus
guuauagaccaguaauuagucaacuccagauuccgugcaucaagagccugaca

SEQ ID NO: 94853 - RNA, 48 nt, Mus musculus
ucuggguuuaaucccuagcaacaccacacacacacacacacacacaca

SEQ ID NO: 94854 - RNA, 49 nt, Mus musculus
ugacacccucucacagccauagacucacaaucagaggagcagaacagcc

SEQ ID NO: 94855 - RNA, 46 nt, Mus musculus
ccuucaggcugcagagcauguacugcagcacccacaguggccauuu

SEQ ID NO: 94856 - RNA, 46 nt, Mus musculus
gaaagccuaauauauacuacugucaagcgacaccauggugguaucu

SEQ ID NO: 94857 - RNA, 42 nt, Mus musculus
uuacaagguacacugcuguggaggcuucuuccacuggcacag

SEQ ID NO: 94858 - RNA, 42 nt, Mus musculus
cuucucucucuuucuuugcuagggauugaaccaagucgagau

SEQ ID NO: 94859 - RNA, 45 nt, Mus musculus
aaaaaauggaaaaggaaaaaaaaaaagaaaaaaaaagucccacuu

SEQ ID NO: 94860 - RNA, 46 nt, Mus musculus
uuuccagcgaguacgcacaccagcuaauucauaaaguuugacagac

SEQ ID NO: 94861 - RNA, 32 nt, Mus musculus
guccucuucuggucuccaggggcaccaggcag

SEQ ID NO: 94862 - RNA, 46 nt, Mus musculus
uggcucacaaccaucugugaugggauccgaugcccucuucuagugu

SEQ ID NO: 94863 - RNA, 45 nt, Mus musculus
aauugaaaggggugugugugugugugugugugugugugugugugu

SEQ ID NO: 94864 - RNA, 46 nt, Mus musculus
cccaggacauguucuggaggcaagcugacuuuggauaugcgcgaga

SEQ ID NO: 94865 - RNA, 45 nt, Mus musculus
gguuacuuuuuuccaugaauggucaaguuuuguuaaccggcagaa

SEQ ID NO: 94866 - RNA, 45 nt, Mus musculus
aaagacgcgguagccuaaccuacuaaagcuuucaucccugccaag

SEQ ID NO: 94867 - RNA, 47 nt, Mus musculus
ucaucugugaaguguguguaaguguauauguagaugugguguguugu

SEQ ID NO: 94868 - RNA, 46 nt, Mus musculus
uccucagacaccaggcacacaguggugcacaggccuagaagcagac

SEQ ID NO: 94869 - RNA, 45 nt, Mus musculus
agagcacuugcugaucuuccagagggccugaguucaauucccagc

SEQ ID NO: 94870 - RNA, 45 nt, Mus musculus
aaaccugaauuucaaaauuguuggcaagcauuuagaacugguagu

SEQ ID NO: 94871 - RNA, 46 nt, Mus musculus
ucauaaaauuaaguuuuuguauuuuagugguaaaaagcagccucau

SEQ ID NO: 94872 - RNA, 43 nt, Mus musculus
uugugagccaccaugugguugcugggauuugaacucgggacau

SEQ ID NO: 94873 - RNA, 46 nt, Mus musculus
cagcccugcagcaucgacuccacuuauagagcuggaacgugacaug

SEQ ID NO: 94874 - RNA, 42 nt, Mus musculus
agagagagagagagagagaggcagagagagagaggcagaggc

SEQ ID NO: 94875 - RNA, 45 nt, Mus musculus
acuuaaaaaacaaggaaacauguuuuguaaaaauuaccucuggga

SEQ ID NO: 94876 - RNA, 45 nt, Mus musculus
aaaaauaggguauucaugugugugugugugugugugugugugugu

SEQ ID NO: 94877 - RNA, 39 nt, Mus musculus
ugguugugagacaccauauaguuccugggacuugaacuc

SEQ ID NO: 94878 - RNA, 41 nt, Mus musculus
agaggagaagagaagagaagagaggagaagaaaggagggga

SEQ ID NO: 94879 - RNA, 45 nt, Mus musculus
uguuguuguguuacucagguuuaucuucacccccuugucucggca

SEQ ID NO: 94880 - RNA, 47 nt, Mus musculus
cagcuucacacugcucaguggccgguccagaggcagagugcccgcca

SEQ ID NO: 94881 - RNA, 46 nt, Mus musculus
aaggacucacuauuauggguacuaaagcauagccuuugccuggcag

SEQ ID NO: 94882 - RNA, 45 nt, Mus musculus
gcugugcuccugacucuguagucaggggccuggggccaggaccag

SEQ ID NO: 94883 - RNA, 46 nt, Mus musculus
cuggagcaccuguccagggucaggacguagggaccacgaggacaag

SEQ ID NO: 94884 - RNA, 42 nt, Mus musculus
uguagcuccagaagcaguaggaaacacuagacagagauggag

SEQ ID NO: 94885 - RNA, 45 nt, Mus musculus
cugguauugagaaugcuuacagugugcuuuuaaaugcuacaagga

SEQ ID NO: 94886 - RNA, 45 nt, Mus musculus
cuacugauugcuuaucagagauaaacuuaccagugcugggugugg

SEQ ID NO: 94887 - RNA, 45 nt, Mus musculus
uagccuaaguuugauaucugugugggacgagaaaacuuacuccug

SEQ ID NO: 94888 - RNA, 69 nt, Mus musculus
ggaggaggaagaggaggaggaggagguggagaaggagaaagagaagaagaaggaagaaggaagaaagaa

SEQ ID NO: 94889 - RNA, 46 nt, Mus musculus
agaaagaagaaagaagaaagaagaaauaaagaaauaguccuuguca

SEQ ID NO: 94890 - RNA, 42 nt, Mus musculus
gcaggaacggcugcugcgugucaaguaccaaaagggccccuu

SEQ ID NO: 94891 - RNA, 68 nt, Mus musculus
guaaagauggaaaagccucaagguggcguaugaacucaaaccccaguaaugcaaucugagagauacga

SEQ ID NO: 94892 - RNA, 49 nt, Mus musculus
ucuuauuguuauuagaaaauaacaugccaauuauaagccagaucaggug

SEQ ID NO: 94893 - RNA, 42 nt, Mus musculus
aagguggugcacauauguaacuauaguaccugggaggcugag

SEQ ID NO: 94894 - RNA, 46 nt, Mus musculus
caaccucaagaacaagcuggaaaauaaaauggagggaaucggccug

SEQ ID NO: 94895 - RNA, 46 nt, Mus musculus
agggaguaagcacagcccgcccagugacggggccccgcagcaggaa

SEQ ID NO: 94896 - RNA, 46 nt, Mus musculus
cacccaccucuccaaggcaucaugcaugcacaggcccacugcuaag

SEQ ID NO: 94897 - RNA, 51 nt, Mus musculus
gcaaaaauacagacccacucucccguugugucugaaguguccggugugcuu

SEQ ID NO: 94898 - RNA, 49 nt, Mus musculus
gaagucccuguagagccuggaggcaauguggaggacaugaagaucaguu

SEQ ID NO: 94899 - RNA, 46 nt, Mus musculus
uaaaguguuuaaaugucaaaugugaauuggugaugggugauggaga

SEQ ID NO: 94900 - RNA, 41 nt, Mus musculus
auuuauugugguaaguuuacuaacaaggugagggaggcuga

SEQ ID NO: 94901 - RNA, 45 nt, Mus musculus
ccuaaaaggccuuacuucaccaucuauauaacauuuuugcccaua

SEQ ID NO: 94902 - RNA, 43 nt, Mus musculus
uaugugcucgaaggcaaggagcuggaguucuaucugcggaaga

SEQ ID NO: 94903 - RNA, 46 nt, Mus musculus
gcacugccccugggccgcaagaagggggccaagcugacuucugagg

SEQ ID NO: 94904 - RNA, 41 nt, Mus musculus
agcugggacggcccgcugccaacacgaagauuggcccucgc

SEQ ID NO: 94905 - RNA, 45 nt, Mus musculus
uccuuaaagaaaaucaugaauggagucacaccaucuucacgguag

SEQ ID NO: 94906 - RNA, 42 nt, Mus musculus
cucuguucuacugaccaucuugcccuccaccuccaggcacag

SEQ ID NO: 94907 - RNA, 46 nt, Mus musculus
cuaacucuugaccuauacucaagccacaaagcagcgcuugccagag

SEQ ID NO: 94908 - RNA, 46 nt, Mus musculus
acacauauucaguaugacacuggcuguccuuauaaaaaggguacag

SEQ ID NO: 94909 - RNA, 99 nt, Mus musculus
acgggacagaagcaggugugacugacagaccacugcucagaagagaagagguccaugguacaagauggagguuugggaaccagaaaaggaagguggagg

SEQ ID NO: 94910 - RNA, 66 nt, Mus musculus
gugugugcauuuguguguuucagggagugggucucucucucucucucuguguguguuugugugugu

SEQ ID NO: 94911 - RNA, 48 nt, Mus musculus
cacacugauaagaggaggaagauaggaaggaaccccaaugauaggaag

SEQ ID NO: 94912 - RNA, 41 nt, Mus musculus
acagaagugaggcuccaguuucacaucccaccacagagggg

SEQ ID NO: 94913 - RNA, 45 nt, Mus musculus
aauauugagugugaagucagagcagagccuccccagacagccaug

SEQ ID NO: 94914 - RNA, 44 nt, Mus musculus
cccagagcuguggagagagagaggaggugcugacuccgagaaga

SEQ ID NO: 94915 - RNA, 45 nt, Mus musculus
cagggucuggagaacuagaacuagaacucaggaguaccggccuua

SEQ ID NO: 94916 - RNA, 45 nt, Mus musculus
gaggcugcuaguaugugccgagucuuuuguguugucuucucagag

SEQ ID NO: 94917 - RNA, 46 nt, Mus musculus
auggguuguggggcuucucuuagcuauaguuugacuacaucaagcu

SEQ ID NO: 94918 - RNA, 46 nt, Mus musculus
aggcaacaucaagucuccaucuguuguaggacauauuuaaaaagga

SEQ ID NO: 94919 - RNA, 46 nt, Mus musculus
aaagauugugugugugagugugugugugugugugugagugugugug

SEQ ID NO: 94920 - RNA, 46 nt, Mus musculus
acagguaaacccuguuuugaaaagccaaaaccaaauaacgaaagga

SEQ ID NO: 94921 - RNA, 42 nt, Mus musculus
aggacuugcugugaggacugaauagauaaugaggcauaucac

SEQ ID NO: 94922 - RNA, 95 nt, Mus musculus
aagauagguggguuuuauuuuuguuuuuaacuugacgagauauuugguuuuacucauaaauuauuaacuuguuuucuacuuguaccagaaguugu

SEQ ID NO: 94923 - RNA, 42 nt, Mus musculus
ugugcuguucuccuuggagccugggguagcugccgagaggac

SEQ ID NO: 94924 - RNA, 42 nt, Mus musculus
ggcauacuccaguggugagcuccugagggauuguagacggua

SEQ ID NO: 94925 - RNA, 45 nt, Mus musculus
ccuauccucucuuucauguaaaucccuccuuuaaggccccacacc

SEQ ID NO: 94926 - RNA, 34 nt, Mus musculus
ugaagacgaaugauuuagaaaggaagaaacaaga

SEQ ID NO: 94927 - RNA, 46 nt, Mus musculus
gcugaaagauguucaugguggcaaaaacaaaacaaaagaaccagga

SEQ ID NO: 94928 - RNA, 46 nt, Mus musculus
uacuauaguaaaucuaauuauguaguauacuuuaccugacacagag

SEQ ID NO: 94929 - RNA, 42 nt, Mus musculus
augcaccaguguugugauuuuaaacaaaauuaaauagcagaa

SEQ ID NO: 94930 - RNA, 46 nt, Mus musculus
ccuauaagucucugguauuugaauacuugguccccaguugguagcu

SEQ ID NO: 94931 - RNA, 28 nt, Mus musculus
gugaaaguuuguucaguaggugguguac

SEQ ID NO: 94932 - RNA, 71 nt, Mus musculus
cuaccuuuuuuuguuguuuagccugaaauagagcccgagucaguuccuuaggcauuugauuauccaggagc

SEQ ID NO: 94933 - RNA, 42 nt, Mus musculus
ugcucacugcugaacuacugcugauacaguaaaggcccuuga

SEQ ID NO: 94934 - RNA, 46 nt, Mus musculus
cccuuaacauucugauauguaauuuuucugaauacacagucuggaa

SEQ ID NO: 94935 - RNA, 46 nt, Mus musculus
aguagggggaggggaaacugcagcugggauguauuguaugagagaa

SEQ ID NO: 94936 - RNA, 45 nt, Mus musculus
aagagugcguggucuaccuaagaucucacaaaguaguggacagaa

SEQ ID NO: 94937 - RNA, 46 nt, Mus musculus
ggcuaaguggugagacccuaugucagaaaaccagauggugugagga

SEQ ID NO: 94938 - RNA, 46 nt, Mus musculus
ucuucaaguucuuccaacaagcgaaaauuacgaggaacuuuaacuc

SEQ ID NO: 94939 - RNA, 48 nt, Mus musculus
aggaguuaaaguuccucguaauuuucgcuuguuggaagaacuugaaga

SEQ ID NO: 94940 - RNA, 47 nt, Mus musculus
ugaagacaugacacuuacaagguggacaggcaugauuauugggccac

SEQ ID NO: 94941 - RNA, 44 nt, Mus musculus
ucuuaugauguccaaagaaaauaugaagcuuccacagccuccag

SEQ ID NO: 94942 - RNA, 46 nt, Mus musculus
acauuaacaugaguagaagguugcugauuuaagacaaguuugagau

SEQ ID NO: 94943 - RNA, 46 nt, Mus musculus
cauagguucaggauuguuuugauaccuguauuuauaauaaaaggug

SEQ ID NO: 94944 - RNA, 45 nt, Mus musculus
guuuaguaaaacaugcuuagauguuuuaagugaagucaacaaaaa

SEQ ID NO: 94945 - RNA, 46 nt, Mus musculus
ucaacuaguauagcauuuugcuuucaagguaauuaguugugcagaa

SEQ ID NO: 94946 - RNA, 41 nt, Mus musculus
accuaugaaccaucucacuucugaauuaacccccgggcagc

SEQ ID NO: 94947 - RNA, 46 nt, Mus musculus
cucuguggaugaccugugaucuggaauuauuucuucuuucuguuca

SEQ ID NO: 94948 - RNA, 42 nt, Mus musculus
uugcuagagcagacagaaugugugacagagacaacuagaggg

SEQ ID NO: 94949 - RNA, 45 nt, Mus musculus
uaacuuuguaggacuguuucagaaauaaagaguaaggggcuagau

SEQ ID NO: 94950 - RNA, 46 nt, Mus musculus
uguucugauguauuuuauaaauaauaaugggaccuuucugucagua

SEQ ID NO: 94951 - RNA, 46 nt, Mus musculus
gagcauugugugcucuuauccacugagccaucucuccagccuuuca

SEQ ID NO: 94952 - RNA, 46 nt, Mus musculus
gccugcauagacuccuuugucuacuuugacuuuuccgccccucuua

SEQ ID NO: 94953 - RNA, 46 nt, Mus musculus
aaugaaggaacaaaagauaagaccugaaauauaagcauuuguaaga

SEQ ID NO: 94954 - RNA, 46 nt, Mus musculus
uuguaagaagauaaaggcagaaaauuguauuuauuuaaaaugaagu

SEQ ID NO: 94955 - RNA, 45 nt, Mus musculus
uccugggacucucuaagcaugguuagcuguuaaaaauguauagau

SEQ ID NO: 94956 - RNA, 25 nt, Mus musculus
caagccaagaauguuggaaaaugua

SEQ ID NO: 94957 - RNA, 46 nt, Mus musculus
acuuugaaggauuguuguuuaagauaaaugaauaccauugacagau

SEQ ID NO: 94958 - RNA, 43 nt, Mus musculus
aguggggccuggagggagaggggggccagaguuaucgggagaa

SEQ ID NO: 94959 - RNA, 42 nt, Mus musculus
uuauguuuuuuuggaacccuauaacuuucuaggcacugaggu

SEQ ID NO: 94960 - RNA, 45 nt, Mus musculus
aggauauaaagggcacgcugaccuuuucuaagaaagggaggauaa

SEQ ID NO: 94961 - RNA, 46 nt, Mus musculus
uuaauuuuauauccagccacuuugcugaaguuguucaucagcuuua

SEQ ID NO: 94962 - RNA, 45 nt, Mus musculus
ucugcacuccacucacccacccacuccuaccuccgcgcccucaau

SEQ ID NO: 94963 - RNA, 46 nt, Mus musculus
ccacguguugugugugugugugugugugugugugugugugugugug

SEQ ID NO: 94964 - RNA, 61 nt, Mus musculus
cucaaagcauucauucaccacaugcagagaaagccuuugcagaaagaaucuaagcauacag

SEQ ID NO: 94965 - RNA, 45 nt, Mus musculus
auugaaauguccuaaguguaucaguguuaugauaggagggaaagg

SEQ ID NO: 94966 - RNA, 41 nt, Mus musculus
uguuuuacucuacuuuuccuuucuuuuuuuugggggggggg

SEQ ID NO: 94967 - RNA, 34 nt, Mus musculus
cuaggcucaccaagaaauauauaagcauggagga

SEQ ID NO: 94968 - RNA, 46 nt, Mus musculus
uauauguuuauagucucuucugaauuuugucaaauuuugguaaaua

SEQ ID NO: 94969 - RNA, 46 nt, Mus musculus
ccagacaauuaugggucuaguuacuuaagaacugagaugugaacau

SEQ ID NO: 94970 - RNA, 42 nt, Mus musculus
gugugggaaagcucacugcacugugagguuagagacgauugu

SEQ ID NO: 94971 - RNA, 46 nt, Mus musculus
cuugaaugugacagaugucuacacucaugucacuuucauuccaguc

SEQ ID NO: 94972 - RNA, 41 nt, Mus musculus
uuguuuuguuuuuuggauguauugcguagauugcagcuagc

SEQ ID NO: 94973 - RNA, 46 nt, Mus musculus
ugaauagaauguuuuuaccauuucuuaaggagugguucucagagga

SEQ ID NO: 94974 - RNA, 41 nt, Mus musculus
caccacaacaugaggaacuguauuaaggggucgcagcauga

SEQ ID NO: 94975 - RNA, 42 nt, Mus musculus
cagcuguacugggcuccccagguaaggugcaggggccacuug

SEQ ID NO: 94976 - RNA, 46 nt, Mus musculus
aacuuuuuauggauucuuugugaauuuuacaucauguaucccaguc

SEQ ID NO: 94977 - RNA, 46 nt, Mus musculus
guuaaauaaguuaguuacuuuacacuucuuuaauuuuuuucagaau

SEQ ID NO: 94978 - RNA, 42 nt, Mus musculus
guguuccauaaaugggaagaaauguaguagguggccuuagac

SEQ ID NO: 94979 - RNA, 41 nt, Mus musculus
accaggcaggaagcuguguaagacagggaguagggagcggu

SEQ ID NO: 94980 - RNA, 45 nt, Mus musculus
acacacauacacacacacacacacacacacacacacaucucagaa

SEQ ID NO: 94981 - RNA, 46 nt, Mus musculus
uuuguguuuauuugccauuugguugaguugguuguuuugucuagug

SEQ ID NO: 94982 - RNA, 41 nt, Mus musculus
ucgggacgggucguauuugauauauuguauugcgugucagu

SEQ ID NO: 94983 - RNA, 46 nt, Mus musculus
uucagugaacccacgagugcuguuuagacuccuccguggcuaccag

SEQ ID NO: 94984 - RNA, 46 nt, Mus musculus
cggcuuucuuggaacacaugacaggccuugggaacccuuguguagg

SEQ ID NO: 94985 - RNA, 42 nt, Mus musculus
aguggcuuggggcuggauucauucaggugcacgcugcggcgg

SEQ ID NO: 94986 - RNA, 45 nt, Mus musculus
cacaggccuaccugucauucagaguugcucaggaaugugggggag

SEQ ID NO: 94987 - RNA, 46 nt, Mus musculus
uuaagaauuuaucagaguuuuuuagauuucuauacuuuggcacaaa

SEQ ID NO: 94988 - RNA, 44 nt, Mus musculus
cuugaggacuuaaggugauuaucugacacguuccagauggugag

SEQ ID NO: 94989 - RNA, 41 nt, Mus musculus
cucuguagugcuggaacuacaugcaugccccaacaugcuca

SEQ ID NO: 94990 - RNA, 46 nt, Mus musculus
uuaagggaacccucucccagaguggagagguggcucagugguuaag

SEQ ID NO: 94991 - RNA, 46 nt, Mus musculus
cuuuccuuucccuuuccuuucccuuuccuuucccuuuccuuucucc

SEQ ID NO: 94992 - RNA, 46 nt, Mus musculus
uuuaaaccauuguuaaugguucuggagagaugggucagugguuaag

SEQ ID NO: 94993 - RNA, 74 nt, Mus musculus
agaaaugaggugggaacuaggaaaggacaguaaaggaaaaaaaugaagaugggagaaauagguaggugggugau

SEQ ID NO: 94994 - RNA, 53 nt, Mus musculus
ugauaagaggugcauaggugagcauagagauugcucaucaggagguaugcaag

SEQ ID NO: 94995 - RNA, 63 nt, Mus musculus
aguuuuaaaaaagaagcaggaaguggggccaucaaauuggacaguaagggaguuaguuguugg

SEQ ID NO: 94996 - RNA, 45 nt, Mus musculus
ucauccuuugccuucaagguuuuuuuguuuguuuguuuggguuuu

SEQ ID NO: 94997 - RNA, 99 nt, Mus musculus
aaaugagugugauacuuuaaaaacuaaaaacauugcuauacuuuauuggucgucguguuuauauuuucugaggggaagaugaugcguuugugaaguuga

SEQ ID NO: 94998 - RNA, 47 nt, Mus musculus
augaagaaguuuuaauucuauguuuuuaugccagaaauagccugauu

SEQ ID NO: 94999 - RNA, 45 nt, Mus musculus
uuauuguuggugagauuuaaggugugccaccauucucagcugcuu

SEQ ID NO: 95000 - RNA, 46 nt, Mus musculus
ggugugcaccaccuugccccacuucugucuacauuugaggugccag

SEQ ID NO: 95001 - RNA, 46 nt, Mus musculus
gugaggcucuccuggagaaaacuaauuuucacuuguaagugccuau

SEQ ID NO: 95002 - RNA, 42 nt, Mus musculus
aauguuuguaugugcaacuuucguucauucuguguuuaggag

SEQ ID NO: 95003 - RNA, 45 nt, Mus musculus
uguaugagagaauacaauuaggaaucuauucagcuuuuaagacag

SEQ ID NO: 95004 - RNA, 51 nt, Mus musculus
auucccucacugcucccaguuagggcugugggacuuugcaaagauuuggca

SEQ ID NO: 95005 - RNA, 46 nt, Mus musculus
uucaguaaaaaaacuaguaugauuuauaucagauguguguggugca

SEQ ID NO: 95006 - RNA, 46 nt, Mus musculus
aaauucugcagggcagcuucaggguuuaugagcacuucagcuuaag

SEQ ID NO: 95007 - RNA, 46 nt, Mus musculus
uuguauaucuuggacacaaggcuacuuuacauaggguaaggcacag

SEQ ID NO: 95008 - RNA, 79 nt, Mus musculus
uuucuuugucagcccccuugacaacaaaugguuugccugagagcacagauagcaaagauucugagcugcagcuaaguga

SEQ ID NO: 95009 - RNA, 27 nt, Mus musculus
uuuaaugggcuccauuuguggguuuga

SEQ ID NO: 95010 - RNA, 46 nt, Mus musculus
gaaguuuccuuacugagcccuguuaaaaauaaacauccagaugaag

SEQ ID NO: 95011 - RNA, 53 nt, Mus musculus
aaacggugucuggugaagucucuucaguuagagcagaggaaacggaaacagca

SEQ ID NO: 95012 - RNA, 46 nt, Mus musculus
accaggcagcacuguacagaagaggaggaggaggaggaggaagaag

SEQ ID NO: 95013 - RNA, 47 nt, Mus musculus
gaaucguuuaugacaccaagagaaauggucccagaaagaaaaaauca

SEQ ID NO: 95014 - RNA, 49 nt, Mus musculus
ccauggagagugaggaagccgcagaagucacagaugacccaauggagca

SEQ ID NO: 95015 - RNA, 46 nt, Mus musculus
gagaaacaggcuguaaaauaaagaaccuuaagaauaaacccugaag

SEQ ID NO: 95016 - RNA, 35 nt, Mus musculus
uuuuaauuuagaauuaaaguuuuuaaacuggaaga

SEQ ID NO: 95017 - RNA, 89 nt, Mus musculus
aaucuuucagucuguugaaauaccagguuaaacacauuccaagagaucugugcaaacuaaauucuuuuguauacuucuaaggugccuga

SEQ ID NO: 95018 - RNA, 45 nt, Mus musculus
gugacauucauuuguaauggccuguuagaguugagggauugacag

SEQ ID NO: 95019 - RNA, 66 nt, Mus musculus
aagcuauuccagaaacccugccccagaaagucuuaaagcauugagauccuuguguuuuauuuuggc

SEQ ID NO: 95020 - RNA, 45 nt, Mus musculus
aauaauccggacaccagaauucucuucuuucaauuuggagccuag

SEQ ID NO: 95021 - RNA, 45 nt, Mus musculus
caaagagguggcaugggacugcagcuuagagaauucugucaguag

SEQ ID NO: 95022 - RNA, 45 nt, Mus musculus
ccacuccauauuacaaaggaaaggaaaggugggcucauguuacag

SEQ ID NO: 95023 - RNA, 46 nt, Mus musculus
ugguuugguggccacugagguguggaugugguuuuauaucagagag

SEQ ID NO: 95024 - RNA, 42 nt, Mus musculus
uccaacuacaccucaggaccugccugugccaaggauacagga

SEQ ID NO: 95025 - RNA, 33 nt, Mus musculus
guuccaaugcccucuugugggucuguguagaca

SEQ ID NO: 95026 - RNA, 46 nt, Mus musculus
guauauuuuagacaguaacuuugacuguuuuacaagaacauacaau

SEQ ID NO: 95027 - RNA, 42 nt, Mus musculus
cuugauuaaagcaacagauaguucagaaccauugaaaccaua

SEQ ID NO: 95028 - RNA, 42 nt, Mus musculus
uuccugaugucauguccacucacagggaacggcgggacagac

SEQ ID NO: 95029 - RNA, 46 nt, Mus musculus
uugguaaggcugguguucuccccuccuguguuacugagaccccaaa

SEQ ID NO: 95030 - RNA, 47 nt, Mus musculus
agggcuugugcugagacucuugccuuuauaucaggugccacagauag

SEQ ID NO: 95031 - RNA, 46 nt, Mus musculus
ugguguaguugcacuuuugauuugaugagccugugaugugcuagau

SEQ ID NO: 95032 - RNA, 46 nt, Mus musculus
gcaccuguaggagugacuuccugacagauauuuccucaagucagau

SEQ ID NO: 95033 - RNA, 46 nt, Mus musculus
ugagguuaaagcuggagccaacagcaacauauagacacgugcagua

SEQ ID NO: 95034 - RNA, 46 nt, Mus musculus
auuuaguuuuagaugaacuuucuaggaagauacaaaacaaacagga

SEQ ID NO: 95035 - RNA, 60 nt, Mus musculus
augaagagucaacaagaaaaguaaacagcuguauuacccgggaaaccagcugugcacugu

SEQ ID NO: 95036 - RNA, 54 nt, Mus musculus
ugaggauucacauaugcugccauuggaccacauaaggauaaacuacagacaaag

SEQ ID NO: 95037 - RNA, 46 nt, Mus musculus
auauuauauaguacuuuguguaaaauguaagacaaguauacaggag

SEQ ID NO: 95038 - RNA, 35 nt, Mus musculus
gcacauguucagagacccacccaauuuuggucccg

SEQ ID NO: 95039 - RNA, 53 nt, Mus musculus
uccuuuacugagauaaacgcauauuuuuuaggcacuggagaaaauauggaaag

SEQ ID NO: 95040 - RNA, 46 nt, Mus musculus
ggaugaaaaucucaaagaugauucucuuccugaaaauccaauaggu

SEQ ID NO: 95041 - RNA, 46 nt, Mus musculus
aauggcaguccuuauccccuugaauaccucaacuuucuggcuagua

SEQ ID NO: 95042 - RNA, 47 nt, Mus musculus
guaacaacacagcaaggccuccuugagccugcaggaaauguccagau

SEQ ID NO: 95043 - RNA, 46 nt, Mus musculus
cuguuuuacuguuaaauuaugguaccuuucuaaacucacuaucaug

SEQ ID NO: 95044 - RNA, 45 nt, Mus musculus
gccaaguuaauugagaaacacuucagacccauucuacaaagagaa

SEQ ID NO: 95045 - RNA, 46 nt, Mus musculus
caaauagggucgaagcucccuuaaguguuuugugcugugucccaau

SEQ ID NO: 95046 - RNA, 46 nt, Mus musculus
ccugcucagcagcgggaaaggacgcauccuuugcacuuugcuccau

SEQ ID NO: 95047 - RNA, 32 nt, Mus musculus
ggguauucaauuacuuugaaaaauggggcauu

SEQ ID NO: 95048 - RNA, 46 nt, Mus musculus
uuguaaacuuuguuguaccucuuagacccgaccuauccugugugua

SEQ ID NO: 95049 - RNA, 84 nt, Mus musculus
ucaguagcccuuugcucauugucacaaggccucaacaggaggaaauaaggcaugggugaggaaggaacaagagaauaaaagaaa

SEQ ID NO: 95050 - RNA, 45 nt, Mus musculus
caagucuaggaugaccacucaguaaugucagauaccuguccccag

SEQ ID NO: 95051 - RNA, 46 nt, Mus musculus
uacacuuguguccuuguugcaagcauuauaaaaauagucccuaguc

SEQ ID NO: 95052 - RNA, 45 nt, Mus musculus
aauuaaaauaguguaacauuugguuuugaagagacgggguugcag

SEQ ID NO: 95053 - RNA, 42 nt, Mus musculus
cugucagacuucuuuauuucaugugguaucugagcgccagaa

SEQ ID NO: 95054 - RNA, 24 nt, Mus musculus
ugagaggagaaggcaaagcuguga

SEQ ID NO: 95055 - RNA, 61 nt, Mus musculus
uaugccuaucgagaagagcaggaguuuggaauugaaguagugaaagugaaagcaauuggaa

SEQ ID NO: 95056 - RNA, 47 nt, Mus musculus
guaaugugcaagaaagggaagcacaguuugggacaacagcagagauc

SEQ ID NO: 95057 - RNA, 45 nt, Mus musculus
uucagcucuggcucauaauuauguaaagguggcaaaagcgacaca

SEQ ID NO: 95058 - RNA, 46 nt, Mus musculus
ucucucacccacaggaagucagcauggugcggaacuuaauccagaa

SEQ ID NO: 95059 - RNA, 46 nt, Mus musculus
cugacuuccugugggugagagagcugcagugggagugucugcccag

SEQ ID NO: 95060 - RNA, 46 nt, Mus musculus
gaaauugaaauggaaguugaagaccaagauaguaaagaagccagaa

SEQ ID NO: 95061 - RNA, 45 nt, Mus musculus
gaucaucuuucaacagaagagauuucagggacagcagcuccacug

SEQ ID NO: 95062 - RNA, 42 nt, Mus musculus
gaacucgcccugaucuccccaggucucaucaucccagguccc

SEQ ID NO: 95063 - RNA, 46 nt, Mus musculus
auccucucuccugcuccagcugcuagcuuugugaagaauaggcaga

SEQ ID NO: 95064 - RNA, 87 nt, Mus musculus
uuuuauuguuuucuuacuguuuuuuuaauaaaucgucugcaaauuugaagaaccuuucauuuaggggugcuguggauuuaggguugc

SEQ ID NO: 95065 - RNA, 44 nt, Mus musculus
ugacgggaaacauggauggagucugagaaauuaugaggcugagc

SEQ ID NO: 95066 - RNA, 46 nt, Mus musculus
aaauaaaauauccauagucugagucucauuuauuuguaagccaguu

SEQ ID NO: 95067 - RNA, 87 nt, Mus musculus
cuggagggauuagagguagguggguuuugagugugguuggguauggagagagagaggagagaucaaggagagaagcaggaagaagag

SEQ ID NO: 95068 - RNA, 53 nt, Mus musculus
aucugguaccugaaggucuaggccugugagugaauucucacauuuacaagauu

SEQ ID NO: 95069 - RNA, 46 nt, Mus musculus
gaaaccauuuaauucuaggucuuuggguguugagguuuugucagau

SEQ ID NO: 95070 - RNA, 95 nt, Mus musculus
uuuuuagcuauuuuuuugccaugugugaaucuugaguaauacuaaucauauaaggcgagaguuaucuuacauauuauuuucagaaaagggugggg

SEQ ID NO: 95071 - RNA, 104 nt, Mus musculus
aacgugaucuuugaggcucucuccaacucuauuugaacuagcagauucuauucgaacuagcagaguguauugugauugcauagugagaauuuaugacagauuau

SEQ ID NO: 95072 - RNA, 57 nt, Mus musculus
guaucuuuggggaucaucgccauguuuuacuuugaaagccuuuugaagaggagagag

SEQ ID NO: 95073 - RNA, 131 nt, Mus musculus
ugugcagccgaccaccugcccaccgcagacugacagccaagaggagcuuuuccagauucaagaaggcguuucuuacucgcagcuggccuccccuggaaaucugaacugaucucauguaaaguauucccauc

SEQ ID NO: 95074 - RNA, 42 nt, Mus musculus
guguguguguguguguguguguguguguguguacgggcaaga

SEQ ID NO: 95075 - RNA, 45 nt, Mus musculus
uaaaagagagugauuuuguuaauuaagaaaaucuuguggguaugu

SEQ ID NO: 95076 - RNA, 46 nt, Mus musculus
guguguguguguguguguguguguguaguguuuugugugugcacau

SEQ ID NO: 95077 - RNA, 45 nt, Mus musculus
uuucuuaguucagaauccuuggccaugugauucaggagggaggac

SEQ ID NO: 95078 - RNA, 45 nt, Mus musculus
ugauuucagaguccaaccuggcaauucuugguuaggcugagugau

SEQ ID NO: 95079 - RNA, 45 nt, Mus musculus
ugggaaagaccgagugaagaaggguggauccuacaugugccauaa

SEQ ID NO: 95080 - RNA, 46 nt, Mus musculus
ugaguuucauuaggguugcuuauugaguuaugggugagggguuuuu

SEQ ID NO: 95081 - RNA, 46 nt, Mus musculus
cuuuguaguaauguugagucacaagcuacauauguuaguccaggaa

SEQ ID NO: 95082 - RNA, 45 nt, Mus musculus
cagacugaauugcaggguuauaaggagaaugaggagcucugggga

SEQ ID NO: 95083 - RNA, 28 nt, Mus musculus
uaguguccuccccgccuucuucguuagg

SEQ ID NO: 95084 - RNA, 88 nt, Mus musculus
cacucaaguucaucaagaagagggugggcacgcacauccgcgccaagagaaagcgggaggagcugagcaacgugcuggcagccaugag

SEQ ID NO: 95085 - RNA, 42 nt, Mus musculus
aaacgucaguaagccgagacacagccggcgacgcgggcgccu

SEQ ID NO: 95086 - RNA, 46 nt, Mus musculus
uccuuuuaaaaccuuuaacuaugaaauguuacaugagcccagagaa

SEQ ID NO: 95087 - RNA, 46 nt, Mus musculus
auuaaagcaucugcaugcuuggaaggggcugugcaaggcuccagaa

SEQ ID NO: 95088 - RNA, 46 nt, Mus musculus
auggcuauggcuuauacaacauaguggggaaugugugggaguggac

SEQ ID NO: 95089 - RNA, 46 nt, Mus musculus
guuugucuguauacccccacauacucauacauacaugcacacacac

SEQ ID NO: 95090 - RNA, 46 nt, Mus musculus
ucuacuucagauauucucuuauuuaaagggggagggcgaaccuuug

SEQ ID NO: 95091 - RNA, 46 nt, Mus musculus
ugguaccauggagugaagaauucuacaucuugauccaaaggcagcu

SEQ ID NO: 95092 - RNA, 45 nt, Mus musculus
ggaaagaaguuuuaugauguagaaauagcccuacugccuggguuu

SEQ ID NO: 95093 - RNA, 38 nt, Mus musculus
cuccagaguuauuuggaaagggaagucuagggcuagau

SEQ ID NO: 95094 - RNA, 71 nt, Mus musculus
acggucacucaguaggugguuauuauguaucuggcagaaugaaagcuuaucauucagguguuggauuagaa

SEQ ID NO: 95095 - RNA, 28 nt, Mus musculus
ugucuuuguugucaugcgggcuccugua

SEQ ID NO: 95096 - RNA, 42 nt, Mus musculus
ggucagugucaagaguuugugggacaagaguccuggaaaguc

SEQ ID NO: 95097 - RNA, 42 nt, Mus musculus
agaaauucuaucugaagaaagacauuaagcgaauggggaaga

SEQ ID NO: 95098 - RNA, 46 nt, Mus musculus
cuugaauuucacucagaaugggaaauaaauugucauuggauggagg

SEQ ID NO: 95099 - RNA, 40 nt, Mus musculus
cuggcuuaucacacuguauccgcacacagggagcagagag

SEQ ID NO: 95100 - RNA, 44 nt, Mus musculus
agagagcagagguagagaguuagauggagagauagacagacaga

SEQ ID NO: 95101 - RNA, 46 nt, Mus musculus
auguguguguguguguguguguguguguaugugugugcgugaguga

SEQ ID NO: 95102 - RNA, 46 nt, Mus musculus
gcuccuuugaguucugccaugucccuaacauuucacacuaguuugu

SEQ ID NO: 95103 - RNA, 38 nt, Mus musculus
cugaggagcccaggaaggcagcccucauguuacaugga

SEQ ID NO: 95104 - RNA, 47 nt, Mus musculus
gagaggaguaaggggagagguagggagagagagacagagaguggcag

SEQ ID NO: 95105 - RNA, 46 nt, Mus musculus
gcaaugcggauuuugagaaguuugugaacucgacuggcuauuugac

SEQ ID NO: 95106 - RNA, 42 nt, Mus musculus
augguccccauuccugcuggaguauucacaaugggcacugau

SEQ ID NO: 95107 - RNA, 46 nt, Mus musculus
ucacuauugcaguuuuuccagaccuguguccuuuauauguccagau

SEQ ID NO: 95108 - RNA, 43 nt, Mus musculus
gaaacuggagccagggagaccaugaguaaggauaccugagagu

SEQ ID NO: 95109 - RNA, 46 nt, Mus musculus
cacuacugaugcuuuaguuuguuuccuaucuuucuccgagacagau

SEQ ID NO: 95110 - RNA, 42 nt, Mus musculus
agauacuuugugaguuuguggggggcgggcagagaggcagag

SEQ ID NO: 95111 - RNA, 46 nt, Mus musculus
ggauccagaagaaugcaacaccuggauguaugcaaugccaccagaa

SEQ ID NO: 95112 - RNA, 46 nt, Mus musculus
gucuuuguguagugcauagguguguuagauguuaguauguacggau

SEQ ID NO: 95113 - RNA, 45 nt, Mus musculus
uguaucuucccuuccuaaagucaggugucacuaggguccggagag

SEQ ID NO: 95114 - RNA, 50 nt, Mus musculus
aaaauggguuuuuguccuaagcauuuucuaaguccucuuguagcugccau

SEQ ID NO: 95115 - RNA, 45 nt, Mus musculus
caagaaaugaaagugacaaauugaaagaaugagaacuuaaaaacg

SEQ ID NO: 95116 - RNA, 46 nt, Mus musculus
gguccucaggaauacuggcagagcgggaaacauuuggaagggaagg

SEQ ID NO: 95117 - RNA, 46 nt, Mus musculus
gcgccauuggcagggauaaaagacuguagguauuuguaggaggauu

SEQ ID NO: 95118 - RNA, 46 nt, Mus musculus
ugaucagcgaaaacaaacagguaucguaguauggcaggugcagaga

SEQ ID NO: 95119 - RNA, 42 nt, Mus musculus
uaaauacucucuucuguuuuuuuguuuguuuguguguuuguu

SEQ ID NO: 95120 - RNA, 45 nt, Mus musculus
uguuguuaauuacuaucugucauuguuauagaguuuuugauguca

SEQ ID NO: 95121 - RNA, 45 nt, Mus musculus
gauccuaaaaauaauuugaacuuaaaaaaaaauucuuucagcaca

SEQ ID NO: 95122 - RNA, 45 nt, Mus musculus
gcauagccugaagauacuuagacaguccuucagugguuuugugca

SEQ ID NO: 95123 - RNA, 46 nt, Mus musculus
gacaggcuaacucaccaggcagaauucugacaaaaacaacgccaag

SEQ ID NO: 95124 - RNA, 46 nt, Mus musculus
guuuuuuguuguuguuguuugcuuaucccucaagaguacugaacau

SEQ ID NO: 95125 - RNA, 74 nt, Mus musculus
ucccaccuggagacugcuuaaccuaaaagugacauggugccuuuuaguacuggucccugaccucaguucugaga

SEQ ID NO: 95126 - RNA, 50 nt, Mus musculus
uugauguuguuauuuuuuuuaaaugagacaacaggaaaucagugcuagag

SEQ ID NO: 95127 - RNA, 46 nt, Mus musculus
agaaggaucaagguggacgcuguugauaauacaguggccugcugag

SEQ ID NO: 95128 - RNA, 46 nt, Mus musculus
gcugaggaagcuucuaaaagccccauuuuuaaggucagguugucag

SEQ ID NO: 95129 - RNA, 41 nt, Mus musculus
gucuuggugggcuuagcauacaaaaauaccuuacacauaga

SEQ ID NO: 95130 - RNA, 61 nt, Mus musculus
uauguucucgguugcugacucuucuauaaauaagccugagucuuugucucuccugaagugu

SEQ ID NO: 95131 - RNA, 47 nt, Mus musculus
gagagugcuuccagaaguuugccugccgaggaaaacuuggcacccag

SEQ ID NO: 95132 - RNA, 44 nt, Mus musculus
cucccgccuuucucuuuuuauucccugugguuaauucaccccau

SEQ ID NO: 95133 - RNA, 47 nt, Mus musculus
gaaaauguuugacuccucuggaugaaagcuaaagaaauuaggaugca

SEQ ID NO: 95134 - RNA, 41 nt, Mus musculus
ucuuaccucgugugucaccugaggucacauggcuagaggca

SEQ ID NO: 95135 - RNA, 45 nt, Mus musculus
cuggauccagggggaccucuuauuccauccuagccucggggguca

SEQ ID NO: 95136 - RNA, 69 nt, Mus musculus
uaugacccugacuaaagucaccucuguguaccuggcuacaacaauuuuaauaaaagauagaugcgugug

SEQ ID NO: 95137 - RNA, 85 nt, Mus musculus
aagaaugcaguacuagucagaauguuaccaguugugacaagguagguggaccuggaagacacuggggcaaugaagcaagccaggg

SEQ ID NO: 95138 - RNA, 86 nt, Mus musculus
uuaaaaaaagauuaaagauaauuuuuaaaacauugagaguaaaacagugguuaccagaggccgcagagggguuaaaggaggaaaga

SEQ ID NO: 95139 - RNA, 46 nt, Mus musculus
gguagcuauggcuaauuaucacauagaaagcauuuagaaccaccua

SEQ ID NO: 95140 - RNA, 45 nt, Mus musculus
ugauuaugaauugugucauucucugugaugacaagaaauagcuga

SEQ ID NO: 95141 - RNA, 42 nt, Mus musculus
acaccaucuauuguguaaucucuuuucuacacuggggcaaug

SEQ ID NO: 95142 - RNA, 45 nt, Mus musculus
ccuuuaagagguguggccuagugagaagacuuuaggucuuugggg

SEQ ID NO: 95143 - RNA, 46 nt, Mus musculus
ugagccaaacaguucuuucucuuuauaaauugauuaucucaagcau

SEQ ID NO: 95144 - RNA, 45 nt, Mus musculus
auacacguggccaaacuuacgcuccucucaauagcguugguuugg

SEQ ID NO: 95145 - RNA, 46 nt, Mus musculus
gguaaguccaaagacgccugccucagcuguucaguuugaccccaug

SEQ ID NO: 95146 - RNA, 42 nt, Mus musculus
cugugguaaaagaaacgucacagauaugauaaggacccugag

SEQ ID NO: 95147 - RNA, 45 nt, Mus musculus
ucagauguuaaguauuccuugguagcuuccuaccuuaugguguga

SEQ ID NO: 95148 - RNA, 42 nt, Mus musculus
aacucugcacuaauaccaggucaaacuaaacuaaacaagcag

SEQ ID NO: 95149 - RNA, 57 nt, Mus musculus
ucacuucguggcuuacagaauggcuguggcagguccagguuguguuuauuuuccugg

SEQ ID NO: 95150 - RNA, 46 nt, Mus musculus
uagcauagacaacaggguacaucuuguuacauuauugauugcacac

SEQ ID NO: 95151 - RNA, 45 nt, Mus musculus
ugcugugugcuauauucugaucuaagucuugcaugaccaccccga

SEQ ID NO: 95152 - RNA, 45 nt, Mus musculus
auuuauuuuuuauuauuuuuccauacuauauauucauaugggcua

SEQ ID NO: 95153 - RNA, 45 nt, Mus musculus
gcccuguuuggcucaagaguaaaaugacuccacaaagacccgaag

SEQ ID NO: 95154 - RNA, 41 nt, Mus musculus
uuuuaaaccagaaugcuuagcuuugccaagaacugcccaug

SEQ ID NO: 95155 - RNA, 46 nt, Mus musculus
uugcaauaucuauagacugugcucuuuguggugcgguaggcagaaa

SEQ ID NO: 95156 - RNA, 27 nt, Mus musculus
ugggagauugggggaggggcaggggaa

SEQ ID NO: 95157 - RNA, 42 nt, Mus musculus
guagcagcgcauggcagucuugugggcguugggaaggaggga

SEQ ID NO: 95158 - RNA, 45 nt, Mus musculus
caggugguuugaugagaccugcaaauagugaaguguuuauuucca

SEQ ID NO: 95159 - RNA, 85 nt, Mus musculus
gauaguguaacugaaguaaaguaauucuaauaggguaggcgaucggaugaugaguuucaacaaugcugaggacgcacuacggcag

SEQ ID NO: 95160 - RNA, 46 nt, Mus musculus
caaaucuuuuacagagaauggaucguaaauacacaucacaggaucc

SEQ ID NO: 95161 - RNA, 42 nt, Mus musculus
aaucuuacagugacagccgguccucuaauagacaguaggacu

SEQ ID NO: 95162 - RNA, 45 nt, Mus musculus
ccacaaacauaaaagccaggucaugaacacauuagcacuggagaa

SEQ ID NO: 95163 - RNA, 46 nt, Mus musculus
aaaaaaaaaggguauuguuuagguguugguucacuugcuuaugcug

SEQ ID NO: 95164 - RNA, 45 nt, Mus musculus
cuaaauuaaagucuuuguaggcaagcuuguacuuuagggcagaga

SEQ ID NO: 95165 - RNA, 49 nt, Mus musculus
agcugaaagguaggauacagaugggccauuugaggcaagaaugagccua

SEQ ID NO: 95166 - RNA, 44 nt, Mus musculus
cuuucuguauuuaaaugauaugggccucuauguuauucugggga

SEQ ID NO: 95167 - RNA, 45 nt, Mus musculus
cacacacuugaaaaaaauggaacucuuuacguuuugugccuguaa

SEQ ID NO: 95168 - RNA, 41 nt, Mus musculus
aauauucuagccacuuggauagcaagucuuaaauaggagag

SEQ ID NO: 95169 - RNA, 45 nt, Mus musculus
auuacuauauacaugauagauaagguaacaacuguauggcaccag

SEQ ID NO: 95170 - RNA, 45 nt, Mus musculus
uauugauaucuuuaagauugaauggugggcugcagagauggcuca

SEQ ID NO: 95171 - RNA, 46 nt, Mus musculus
uugaaaaaaacaaaacaaaacaaaacaagccaaaacaaacaaacag

SEQ ID NO: 95172 - RNA, 47 nt, Mus musculus
cugaggaacauuuuuauuguuucuauuucuuaucuacuguggauugu

SEQ ID NO: 95173 - RNA, 57 nt, Mus musculus
uauuuuuagaugauuuaucauugcucaagcugauugaauucagaaaagggagcaagg

SEQ ID NO: 95174 - RNA, 44 nt, Mus musculus
agaugugaguggaucauagauaggucaugcagaaaggauuucug

SEQ ID NO: 95175 - RNA, 30 nt, Mus musculus
gcuucaguuccuauuccagguuccugccuu

SEQ ID NO: 95176 - RNA, 45 nt, Mus musculus
uaaacacuuagaugaaaucagccuuguaaauguuuuuauuugaaa

SEQ ID NO: 95177 - RNA, 46 nt, Mus musculus
ugugguuuaucuuucaggccaugguuaguuugugcuuuagccuaaa

SEQ ID NO: 95178 - RNA, 44 nt, Mus musculus
guugaauuugguaaugguuugaggcggcugccuagcuacccuga

SEQ ID NO: 95179 - RNA, 45 nt, Mus musculus
uagaacuuguuggugaagccuaccccccacacccccuacccccgg

SEQ ID NO: 95180 - RNA, 37 nt, Mus musculus
cuagugugaaagagaacacaaggcauguaauaaagac

SEQ ID NO: 95181 - RNA, 36 nt, Mus musculus
ucucuggggcuuguucacuaguuuuggaagauuuga

SEQ ID NO: 95182 - RNA, 46 nt, Mus musculus
cuauuagcucaugcguacagaacaguguggaagguauuuuguggag

SEQ ID NO: 95183 - RNA, 46 nt, Mus musculus
cacaugagaugauggccugugggcuguugaggaauuguggugugga

SEQ ID NO: 95184 - RNA, 46 nt, Mus musculus
uggguguagaguggguuggguugauucgaaucauguguucuaggag

SEQ ID NO: 95185 - RNA, 45 nt, Mus musculus
cagagacacauuacauaaaauaauaaaauaucuacuuuugucuaa

SEQ ID NO: 95186 - RNA, 46 nt, Mus musculus
aggugaguucagacuguuauugaugagugaagauaguccuuggcau

SEQ ID NO: 95187 - RNA, 46 nt, Mus musculus
aauguuggugaggaugugggggaaaggagcccuuauuuacaacugg

SEQ ID NO: 95188 - RNA, 95 nt, Mus musculus
agggaucuaagccagcacgccaccaagaugcuuggggacauggauugugaugugcugguuacaguggaucagauacggaaccagcauagaggcuc

SEQ ID NO: 95189 - RNA, 88 nt, Mus musculus
aacccuagaugaacagauagagaaagagcggugcacauacuagugagagugcaguacgucgcaggaaaaggggugggucuaucugcag

SEQ ID NO: 95190 - RNA, 49 nt, Mus musculus
gugacacgaaauuaggaagggguugcuugggagaagaaaacagugagau

SEQ ID NO: 95191 - RNA, 43 nt, Mus musculus
uugucuuuaaauaucucagugaggcugaugaguuugagugcug

SEQ ID NO: 95192 - RNA, 46 nt, Mus musculus
ucacaucguggggcagaaacagccuacuuuccuuuuguguagugaa

SEQ ID NO: 95193 - RNA, 42 nt, Mus musculus
ggguguacauguguguguguguguguguguguguaugugugu

SEQ ID NO: 95194 - RNA, 46 nt, Mus musculus
uauuuucaauugcaugcucuacugcuuagcucuaccccacccccag

SEQ ID NO: 95195 - RNA, 46 nt, Mus musculus
aguacagagcaacauauccuuuauuguguaagagagugcggugcaa

SEQ ID NO: 95196 - RNA, 45 nt, Mus musculus
agguaacauguaagccucggucugagauauuucccagaauuacag

SEQ ID NO: 95197 - RNA, 45 nt, Mus musculus
gauggcuuccuagauaucgguuuuuuaaaacagaugacaaaggag

SEQ ID NO: 95198 - RNA, 46 nt, Mus musculus
ggguucugaaaggugcaggugcauuuuaauucaggugaaugucugg

SEQ ID NO: 95199 - RNA, 45 nt, Mus musculus
agagagugagagagagagagagagagagagagagagagacagaga

SEQ ID NO: 95200 - RNA, 41 nt, Mus musculus
uucauaauaaaccaaaguucccaaaaccacgugcugcccaa

SEQ ID NO: 95201 - RNA, 46 nt, Mus musculus
gaaacuugaugacugaagaggauagauacuacuuguuacgguuuug

SEQ ID NO: 95202 - RNA, 42 nt, Mus musculus
uaaaaauaacuuucugugaauuuuuuuuuuaaguaggggaug

SEQ ID NO: 95203 - RNA, 41 nt, Mus musculus
uuuuagcuccugcauuugaaaagcaauaaauaccugacugu

SEQ ID NO: 95204 - RNA, 41 nt, Mus musculus
accuggggaaaauaaagcaauuuaagguuuauuguggcuaa

SEQ ID NO: 95205 - RNA, 42 nt, Mus musculus
agauguuuguacugaagcccagcuggccuuccugggaggaac

SEQ ID NO: 95206 - RNA, 45 nt, Mus musculus
aaguggaggugagcagugggcuguggagguaaagcgugaggcagg

SEQ ID NO: 95207 - RNA, 45 nt, Mus musculus
gcucagaauuaaaccucucagcagcuguguuucuaaaucauacca

SEQ ID NO: 95208 - RNA, 46 nt, Mus musculus
aguagaagaggccauggauuugagaagagucgggggcaagggagga

SEQ ID NO: 95209 - RNA, 46 nt, Mus musculus
cgugcucaggagguuuuaguaaggaaggaagaacugauggggugag

SEQ ID NO: 95210 - RNA, 54 nt, Mus musculus
cccaguacacuggucccaaaccaaaagcaaaagucaauguguggggaaagggaa

SEQ ID NO: 95211 - RNA, 30 nt, Mus musculus
cgagugcuaaacugucacaagaccuucaaa

SEQ ID NO: 95212 - RNA, 32 nt, Mus musculus
guauaguaucugcucaaauacuuugcccauuu

SEQ ID NO: 95213 - RNA, 45 nt, Mus musculus
uguucacaguuuguguuuguucuuuucuuugcacucaaaauagug

SEQ ID NO: 95214 - RNA, 45 nt, Mus musculus
gaggauacaggaggaggaagucagggagugggagagggaagcaga

SEQ ID NO: 95215 - RNA, 90 nt, Mus musculus
gaggauacaggaggaggaagucagggagugggagagggaagcagagaggauacaggaggaggaagucagggagugggagagggaagcaga

SEQ ID NO: 95216 - RNA, 55 nt, Mus musculus
gcagucucccaagguaacuagaaguggaaauacaaaguaaggaaaaaccaaacau

SEQ ID NO: 95217 - RNA, 46 nt, Mus musculus
acaggcaaaaacacucauacgcguaaaauaagauaaaaauucaaag

SEQ ID NO: 95218 - RNA, 46 nt, Mus musculus
uuaaaaccaucucugaggaaacccuaucucuaauagcagucccuag

SEQ ID NO: 95219 - RNA, 57 nt, Mus musculus
uucauccacauuggcaugcgugaguacuuuauuucccuuacacccuguaacacagca

SEQ ID NO: 95220 - RNA, 48 nt, Mus musculus
acagauucaaguuggaccugugacguguccccaggcuacccccaccca

SEQ ID NO: 95221 - RNA, 46 nt, Mus musculus
guguguuguggugcuggucucuccaugcagcuuucauuuccugaag

SEQ ID NO: 95222 - RNA, 46 nt, Mus musculus
agguauguuuuugacuuugaccaacccacccugacauaagcuggag

SEQ ID NO: 95223 - RNA, 45 nt, Mus musculus
gacaauaaaguguagcuuuauuggauguauaggauuuguuguucu

SEQ ID NO: 95224 - RNA, 46 nt, Mus musculus
guaagggaaauggcucaucacuugucaugugagcaugagggccugg

SEQ ID NO: 95225 - RNA, 45 nt, Mus musculus
acaacuagccaaugagcuuuauaauuuauuaguauuaaggcagag

SEQ ID NO: 95226 - RNA, 28 nt, Mus musculus
gagcaagauguaaggagaaggaaguuag

SEQ ID NO: 95227 - RNA, 23 nt, Mus musculus
gagacauaggugccaucagucuu

SEQ ID NO: 95228 - RNA, 41 nt, Mus musculus
caaguaaucuggagccgcauuuaagaaauugucaaguggcc

SEQ ID NO: 95229 - RNA, 45 nt, Mus musculus
ggaacagcacauaaaggaggggaaguaaggcagagauaaguccaa

SEQ ID NO: 95230 - RNA, 45 nt, Mus musculus
ugaccuuuggcaugaagauaaaucauuaaucauuagaaggggaga

SEQ ID NO: 95231 - RNA, 42 nt, Mus musculus
cauuagguucuguauaugaaggaagacacuauuugcagggua

SEQ ID NO: 95232 - RNA, 46 nt, Mus musculus
uugcacaggaucaguaaggacuuuagugugcucauauccagcaggu

SEQ ID NO: 95233 - RNA, 45 nt, Mus musculus
aauggucccaagguugcuggaccuugggugcacauggaaaaugag

SEQ ID NO: 95234 - RNA, 26 nt, Mus musculus
cagagagaagcaagccagggauuagg

SEQ ID NO: 95235 - RNA, 46 nt, Mus musculus
uccugagcuuugguugucccucuggcuaccccuucaucucugccau

SEQ ID NO: 95236 - RNA, 25 nt, Mus musculus
gaggaacauagcagaacaaaauuua

SEQ ID NO: 95237 - RNA, 45 nt, Mus musculus
ucacccagaaugagagaaggugaggguguccucacggguggcuag

SEQ ID NO: 95238 - RNA, 49 nt, Mus musculus
cuggccaagacgugcuugaaguugucuucucuaagcccaaucgagagcg

SEQ ID NO: 95239 - RNA, 93 nt, Mus musculus
aagagguguggcuguucuggagggacagcaacaaagagauccguaguaagaguguccgggaauuggcgcaagaugcuaaagagggacagaagg

SEQ ID NO: 95240 - RNA, 42 nt, Mus musculus
cugcauggccuuuguugaacuauaugaaauacaggggugcag

SEQ ID NO: 95241 - RNA, 46 nt, Mus musculus
ccuucucugaccauaaagaaggacacaaucuauggugauuggcuag

SEQ ID NO: 95242 - RNA, 45 nt, Mus musculus
gcaagaugacaaaaggagaagagaauaaagguaacaaugaugagg

SEQ ID NO: 95243 - RNA, 46 nt, Mus musculus
uuguuuguuuguuuguuuuguuuuguuuauguuguugugagagaag

SEQ ID NO: 95244 - RNA, 46 nt, Mus musculus
cauagcuaaugcgaaucuuacuacugcgggacaucuuugggguuga

SEQ ID NO: 95245 - RNA, 46 nt, Mus musculus
cuagcuaucauccuuuguaaaugucugcaggaguagagggaggggg

SEQ ID NO: 95246 - RNA, 42 nt, Mus musculus
gccggaagcagcagcaacgacugcugaggaacaugggcgcac

SEQ ID NO: 95247 - RNA, 45 nt, Mus musculus
uauuuuuugacaguguccuaucaucugaguauauauuuagaccaa

SEQ ID NO: 95248 - RNA, 41 nt, Mus musculus
ucuggcucuguguguguguguguguguguguguguaugugc

SEQ ID NO: 95249 - RNA, 46 nt, Mus musculus
gcuggcucaugaauuuuugcagaauuucugugcaggcaaccagcag

SEQ ID NO: 95250 - RNA, 46 nt, Mus musculus
cccaccucuuccucugggucaugcuggcaaaugcucccuugcccaa

SEQ ID NO: 95251 - RNA, 46 nt, Mus musculus
guggagaguaaggaagguguagguuuauaaaauacugaggccagug

SEQ ID NO: 95252 - RNA, 46 nt, Mus musculus
aaauaucaauuaaucgaaccguauuaaaucaaucucuaugcccaag

SEQ ID NO: 95253 - RNA, 46 nt, Mus musculus
guugauacucagcaucuuuauuacauuuuuuuaaagaaaggaggag

SEQ ID NO: 95254 - RNA, 45 nt, Mus musculus
gggguauaugcacguauaugcacguagaacacucauacccauaga

SEQ ID NO: 95255 - RNA, 46 nt, Mus musculus
ggcauugguacuucacuauuaccaaguaauacuuccucauguccag

SEQ ID NO: 95256 - RNA, 46 nt, Mus musculus
ccuugguugcuacuguuuccuucuguggacuaaauuuauccagcau

SEQ ID NO: 95257 - RNA, 41 nt, Mus musculus
cuucuccuuagcuacaucucaguucuuucucccucccgccu

SEQ ID NO: 95258 - RNA, 43 nt, Mus musculus
aguguggugccugcaacuggaggcauggggagaaaggugggca

SEQ ID NO: 95259 - RNA, 47 nt, Mus musculus
aguacugaagcuugcugcugggugguugggagcgcagggcaggcugu

SEQ ID NO: 95260 - RNA, 79 nt, Mus musculus
aagguaacuuccaugucacauaguuauuauccagguccaaaugagaucaugcaugacacaucuggcuuguaucacgcac

SEQ ID NO: 95261 - RNA, 46 nt, Mus musculus
augcauuuugcuacguggaaauuuucuuccugugaagcaccccuaa

SEQ ID NO: 95262 - RNA, 46 nt, Mus musculus
uaaugccaaggaaguaguucuaaguucuugccuagugaacuuccca

SEQ ID NO: 95263 - RNA, 77 nt, Mus musculus
aacuagaaggaaggcuugguuucuuugcaugucaccacuucugauggagauugagaaauggacaauuccugugaccu

SEQ ID NO: 95264 - RNA, 68 nt, Mus musculus
gguacuucuugguagaugagaaagcaggcauuuggcaugugucccaugugaggcacaguagggcaaga

SEQ ID NO: 95265 - RNA, 75 nt, Mus musculus
aauacccaguaacucauuggucagcccugggaagaaggcuugguaauuaaaccaccucucucccugucagaauag

SEQ ID NO: 95266 - RNA, 48 nt, Mus musculus
caaggucuuucacuagaagcuuaccugacaaaugaugcuccccaaaua

SEQ ID NO: 95267 - RNA, 83 nt, Mus musculus
ucagaggccagcacagccagugauacacagagaaaacauaucucaaaggaaaaaagaaaaaguaagggagagagagagagaga

SEQ ID NO: 95268 - RNA, 45 nt, Mus musculus
uucagaaucuugucuaggaucguacagcuaagaacaaggccccau

SEQ ID NO: 95269 - RNA, 45 nt, Mus musculus
uagcacagucauuuucccuuauuucauauguagcuuucccauuuu

SEQ ID NO: 95270 - RNA, 47 nt, Mus musculus
gacgauaaggacaguugaguaucucggggaauagauggcugcaaaca

SEQ ID NO: 95271 - RNA, 46 nt, Mus musculus
agaggcagucucuaucuuuaccccgacuugaucuuguucacuggag

SEQ ID NO: 95272 - RNA, 46 nt, Mus musculus
uguaauauucaggaugugaagggugggaguggggguaggggugcag

SEQ ID NO: 95273 - RNA, 45 nt, Mus musculus
ugcugguccuauaauagacucauauaaaagggcuggauagagaga

SEQ ID NO: 95274 - RNA, 42 nt, Mus musculus
cacaguacaacgacccuucucauugcccagcaagacccccau

SEQ ID NO: 95275 - RNA, 102 nt, Mus musculus
gaucauuucugcuguuguacggaacugacuucagauccugugcaaagaucacacacuuuugaaaaucuagacaagaaucucuaguuuucauagaaaccacca

SEQ ID NO: 95276 - RNA, 88 nt, Mus musculus
uccauccuucacagucaccggcuacgcuggcuaaaugaaggaccagaaucgauucaagugaguaagaucagagaaacuguuagggcag

SEQ ID NO: 95277 - RNA, 92 nt, Mus musculus
gcguguuuccaggugugaaagcuugcugucagaaacugugguagauugcaggaguucaggcugaaaugaaagguacuuuguuggagagaagu

SEQ ID NO: 95278 - RNA, 46 nt, Mus musculus
uuugaaaaaacaauuggcccaaaagcucacuugaaacaguguugug

SEQ ID NO: 95279 - RNA, 46 nt, Mus musculus
uucuuugaaaaggaacaaaauaaauguauguuugcauagauucuua

SEQ ID NO: 95280 - RNA, 46 nt, Mus musculus
ccugaggacaaaugucugguauuugucuucaugcucuagaugccau

SEQ ID NO: 95281 - RNA, 45 nt, Mus musculus
uccugguuugcuucauccauguuugucccuguggguucuggcaua

SEQ ID NO: 95282 - RNA, 46 nt, Mus musculus
uguggcagcauagcccuagugauugauagacuuuuccaguuggcag

SEQ ID NO: 95283 - RNA, 47 nt, Mus musculus
ugccccccccccuccagcuuguuucacaacccuucccccagucccag

SEQ ID NO: 95284 - RNA, 46 nt, Mus musculus
ugacuauuuuagagaccugcuaguucucagcaccucccucugccag

SEQ ID NO: 95285 - RNA, 46 nt, Mus musculus
auuuguuucucuuuguuguuguaacuucuuuuguguuugaugaaag

SEQ ID NO: 95286 - RNA, 46 nt, Mus musculus
uaguuuuaagcccuuuaaccauuuuuaacaucccauucugccugag

SEQ ID NO: 95287 - RNA, 62 nt, Mus musculus
cuacuugacccaacacacacuucaaaguuuauuaugcacagagauuuguggcaaugaguuac

SEQ ID NO: 95288 - RNA, 46 nt, Mus musculus
ugaaaagggguugggcuggggaaaccacuuguugacaaagguaaug

SEQ ID NO: 95289 - RNA, 46 nt, Mus musculus
ugccuugagagauuccugcuuugccccaagcuucuuuucucuggag

SEQ ID NO: 95290 - RNA, 46 nt, Mus musculus
agaaagauagaugcauguagaauagugugauuugaaucucugguaa

SEQ ID NO: 95291 - RNA, 45 nt, Mus musculus
uguagggagauccgccucaguuugauagggcagucacccugaaga

SEQ ID NO: 95292 - RNA, 46 nt, Mus musculus
aguacaaacugacaccagauucuccuucuuacaguuugcuuuggga

SEQ ID NO: 95293 - RNA, 31 nt, Mus musculus
acccagguuucugugcugacuuuguguccac

SEQ ID NO: 95294 - RNA, 42 nt, Mus musculus
uccuuacuggagguagcuguuugaauaaucaaaggccggcug

SEQ ID NO: 95295 - RNA, 46 nt, Mus musculus
caucaucaaucaagaaaaugauuccccuuaggcaaccccaucugag

SEQ ID NO: 95296 - RNA, 45 nt, Mus musculus
uauucuggaacccaaacaggcuugucucuucuauaauaugugcag

SEQ ID NO: 95297 - RNA, 42 nt, Mus musculus
gacucagugaucacccagucaggaagacagagaugggccuag

SEQ ID NO: 95298 - RNA, 45 nt, Mus musculus
aaaagugcucaggaagguguggaucaugugacaggagcuuagaug

SEQ ID NO: 95299 - RNA, 45 nt, Mus musculus
cgacagugacagugaacaccagcgacuugggaaacaaaaagaaag

SEQ ID NO: 95300 - RNA, 42 nt, Mus musculus
acauugucuguucugguuucuucugauucucugccgugaggu

SEQ ID NO: 95301 - RNA, 45 nt, Mus musculus
cuauccugcgcuuccugcagcugcugugugaaaaccacaaccgag

SEQ ID NO: 95302 - RNA, 42 nt, Mus musculus
guggauccaggaaugacccucaauuuuucuuaugacugccag

SEQ ID NO: 95303 - RNA, 42 nt, Mus musculus
ugaaggaagaggagucagaggagaggccaggagaguguguga

SEQ ID NO: 95304 - RNA, 45 nt, Mus musculus
guugugccagcaccaauuguugaaaaugcugucuuucuucccacu

SEQ ID NO: 95305 - RNA, 42 nt, Mus musculus
gggagcauucaugcaugcaaacauauaaacacauccaccaca

SEQ ID NO: 95306 - RNA, 46 nt, Mus musculus
aggcaagauucauuuucucccagagaggcugccucauuguuccaag

SEQ ID NO: 95307 - RNA, 45 nt, Mus musculus
ugaugugaguguuuuguaguguuaagaaaucaguauggggcugga

SEQ ID NO: 95308 - RNA, 45 nt, Mus musculus
aacaugcagcaggauuuggauuggcacagccuagaagauuagggg

SEQ ID NO: 95309 - RNA, 24 nt, Mus musculus
uggagaucugggggagacccagaa

SEQ ID NO: 95310 - RNA, 45 nt, Mus musculus
gcucacauagaaaagaggggagagguuagagggacuguucacaaa

SEQ ID NO: 95311 - RNA, 46 nt, Mus musculus
agcauuuugcuugucuuaggcuucauaggccuaaguggagcaauag

SEQ ID NO: 95312 - RNA, 45 nt, Mus musculus
uuagaguuuuguuuuguuuuagcaagauauacuauuuggugugua

SEQ ID NO: 95313 - RNA, 24 nt, Mus musculus
cugagaggaaaaugacauaggaaa

SEQ ID NO: 95314 - RNA, 46 nt, Mus musculus
caugucaggaccaaaguaagagcaacuugcaaagcccaggacccag

SEQ ID NO: 95315 - RNA, 46 nt, Mus musculus
aauagauaaagaauucaccaggauuagcucauuccauuagugagag

SEQ ID NO: 95316 - RNA, 46 nt, Mus musculus
ugggucccugguuguuguuuauucguuuguuuuguuuuguuuugag

SEQ ID NO: 95317 - RNA, 42 nt, Mus musculus
uacaaaguuccuaaacagcagcugacaggaugagggccccag

SEQ ID NO: 95318 - RNA, 46 nt, Mus musculus
gaucccacuggcuaucaguaacugagcugagauaucagcaguccag

SEQ ID NO: 95319 - RNA, 46 nt, Mus musculus
gcucccugccgaagaaacggaacaggauaaggaacacacgugugag

SEQ ID NO: 95320 - RNA, 42 nt, Mus musculus
ucaggaagccauccaaagagguaaacggaucacaagggaaaa

SEQ ID NO: 95321 - RNA, 45 nt, Mus musculus
ucucaaagacaagagaaagaggagggcuggagagauagcacggag

SEQ ID NO: 95322 - RNA, 23 nt, Mus musculus
aucauaucaggauuauucagaau

SEQ ID NO: 95323 - RNA, 42 nt, Mus musculus
uaaguaaccuugguauuccucacuuugcccauucagccccag

SEQ ID NO: 95324 - RNA, 45 nt, Mus musculus
cgguucauggcugugaccagauaccagaugagaagcggcuucagg

SEQ ID NO: 95325 - RNA, 55 nt, Mus musculus
gggguaagggaagagauuagcagagcaugcuucuggaaaggaucuggagggaggg

SEQ ID NO: 95326 - RNA, 48 nt, Mus musculus
gcagcgagcaaaagaugccaucaagagcaaguguccugucaugagagg

SEQ ID NO: 95327 - RNA, 46 nt, Mus musculus
ucuuccuuuagucacuguaacaaaugcccaacacaaacaaccaaag

SEQ ID NO: 95328 - RNA, 46 nt, Mus musculus
uucuuggaggcagaggccagaaagagauaucauccuuuaaaggcag

SEQ ID NO: 95329 - RNA, 42 nt, Mus musculus
acacugaccaagagaaaaggaccauuugguucaugcuuucag

SEQ ID NO: 95330 - RNA, 41 nt, Mus musculus
gauagauagauagauagauagauagauagauagggcugccu

SEQ ID NO: 95331 - RNA, 41 nt, Mus musculus
uuucaaaccagauuagaucauguacgcaggguuauggggaa

SEQ ID NO: 95332 - RNA, 45 nt, Mus musculus
agagagagagagagagagagaacacgagaacaaaauaucuggauu

SEQ ID NO: 95333 - RNA, 46 nt, Mus musculus
gcuauauccucaggaaugcacacuuucaauuggguuaacugcagag

SEQ ID NO: 95334 - RNA, 41 nt, Mus musculus
ccaccaacacgggagccacguguuugccaagcacagcacua

SEQ ID NO: 95335 - RNA, 42 nt, Mus musculus
gcaucucaguaaccaggauguuuguccauauguaaccagcag

SEQ ID NO: 95336 - RNA, 34 nt, Mus musculus
agaaagcuuuacagguugugaguuuaagacaaag

SEQ ID NO: 95337 - RNA, 25 nt, Mus musculus
uuucuuaaagggugaguaugccaag

SEQ ID NO: 95338 - RNA, 46 nt, Mus musculus
ucaucuuuccuagaagaagcagguaacuuuuuuucuaaccucgcag

SEQ ID NO: 95339 - RNA, 46 nt, Mus musculus
gaauaacagcauauugcugaccagucagugucaucucccgggugaa

SEQ ID NO: 95340 - RNA, 45 nt, Mus musculus
caaguuuguaaaugcauaccuaaaaauauuuaauaaacgaugcag

SEQ ID NO: 95341 - RNA, 42 nt, Mus musculus; identical to SEQ ID NO: 25152

SEQ ID NO: 95342 - RNA, 46 nt, Mus musculus
caccgccucucuucuuaagcuugccaucauggcugcucacauucag

SEQ ID NO: 95343 - RNA, 47 nt, Mus musculus; identical to SEQ ID NO: 25154

SEQ ID NO: 95344 - RNA, 113 nt, Mus musculus
acuggauuguucaguacgacccucccgaugaccccaaggaauacauucaucguguugguagaacagccaggggccugaauggaagagggcacgcccugcucauccugcgcccu

SEQ ID NO: 95345 - RNA, 46 nt, Mus musculus
caggccccuggcuguucuaccaacacgaugaauguauuccuugggg

SEQ ID NO: 95346 - RNA, 42 nt, Mus musculus; identical to SEQ ID NO: 25163

SEQ ID NO: 95347 - RNA, 42 nt, Mus musculus; identical to SEQ ID NO: 25165

SEQ ID NO: 95348 - RNA, 46 nt, Mus musculus; identical to SEQ ID NO: 25166

SEQ ID NO: 95349 - RNA, 46 nt, Mus musculus; identical to SEQ ID NO: 25168

SEQ ID NO: 95350 - RNA, 49 nt, Mus musculus
gaggagaccuuggaaaauggcaaaguuaaaaagucaccccagaaacuca

SEQ ID NO: 95351 - RNA, 42 nt, Mus musculus
aagaaacaggaaaagguggaaaagcgaaaaaggcccugaaac

SEQ ID NO: 95352 - RNA, 46 nt, Mus musculus
uuccugcgcaggaguuucaucuguaacugcgacaucuugccgggcc

SEQ ID NO: 95353 - RNA, 45 nt, Mus musculus
cggcaagaugucgcaguuacagaugaaacuccugcgcaggaagau

SEQ ID NO: 95354 - RNA, 42 nt, Mus musculus
uggauuuugcccacauguaccaaguguacaaguccaggcggg

SEQ ID NO: 95355 - RNA, 41 nt, Mus musculus
ccaagaaaaguuugcuuguuucaagguuggcugggggguuc

SEQ ID NO: 95356 - RNA, 45 nt, Mus musculus
acuuacaaacugccgcaccggcugauugagaaaaagagacgugac

SEQ ID NO: 95357 - RNA, 46 nt, Mus musculus
uuuuccuucgggaaaaguauuuggaaaggaagacaaaaagccagca

SEQ ID NO: 95358 - RNA, 45 nt, Mus musculus
guccuugagaggcagauggagccccuuaaauucauagccagccag

SEQ ID NO: 95359 - RNA, 45 nt, Mus musculus
gacgcagguucgccgugggagaacgugucagcacaauuaagcaag

SEQ ID NO: 95360 - RNA, 42 nt, Mus musculus
gagugcagagagaucagcccacccugcagacccacagagaag

SEQ ID NO: 95361 - RNA, 46 nt, Mus musculus
guauguauguuuguauauguaggacaauaaguuccuucugacacaa

SEQ ID NO: 95362 - RNA, 46 nt, Mus musculus
guacacagagcuaaguaaucaauugcuacacuuauugcacagcuag

SEQ ID NO: 95363 - RNA, 46 nt, Mus musculus
ccaagcuuagcuucucaaaggccuagcagagcuuuggcaccccaag

SEQ ID NO: 95364 - RNA, 46 nt, Mus musculus
aaggugugaaauuguaaauauuuuuaucuaaguaaauguuaagcag

SEQ ID NO: 95365 - RNA, 45 nt, Mus musculus
uugcccagugauuaaccauggcaacugucaggaauuaggcugaag

SEQ ID NO: 95366 - RNA, 42 nt, Mus musculus
guguuuguuagacacaccuguguuuacuuauagacuagguuu

SEQ ID NO: 95367 - RNA, 61 nt, Mus musculus
ucugucucugucucugucauuaucugauguucugcccaaagugagggaauuuguguggccc

SEQ ID NO: 95368 - RNA, 49 nt, Mus musculus
uaaaagaaaaaaaaauaugugcuuaauauauuaaagcccaggauuccuu

SEQ ID NO: 95369 - RNA, 45 nt, Mus musculus
cuauuucuggccuguuuuaggcuuccucuugaguacccagcagaa

SEQ ID NO: 95370 - RNA, 46 nt, Mus musculus
guuuuagugguugcucugacugccuucgccaaagaauccgugagau

SEQ ID NO: 95371 - RNA, 46 nt, Mus musculus
ccuuaauauuucuuauguuauuucuuaauuguauuagccaccaguc

SEQ ID NO: 95372 - RNA, 45 nt, Mus musculus
aagaauucaaagaaacaccacugguagaucaugaggccccuagau

SEQ ID NO: 95373 - RNA, 44 nt, Mus musculus
ugagguguacuggugguccagacagucuuaaaaagcuaggagug

SEQ ID NO: 95374 - RNA, 46 nt, Mus musculus
acccacccuggcaaaauuggggaagcauuaggaaucccugcaaguu

SEQ ID NO: 95375 - RNA, 45 nt, Mus musculus
uuguuguuguuguauuucuuuugauaaauguauaagguggcagag

SEQ ID NO: 95376 - RNA, 46 nt, Mus musculus
ggcaaaagaugauggcaaggaaaaccaccacagacaacagggagaa

SEQ ID NO: 95377 - RNA, 46 nt, Mus musculus
uaugccauagccauuucaaacagggcuaacauguuacugucagaca

SEQ ID NO: 95378 - RNA, 47 nt, Mus musculus
aggcauggguuauacaaccacaccagagucagacacuguagaacaga

SEQ ID NO: 95379 - RNA, 77 nt, Mus musculus
gauaaauagaacaaauuuaaaguggauuaaaaugcugcaauggaagauaucuggauaacaccaaagaagacagagau

SEQ ID NO: 95380 - RNA, 45 nt, Mus musculus
ucacuuuccuugccucuuuagcaguacuuucauaccaagcagaaa

SEQ ID NO: 95381 - RNA, 46 nt, Mus musculus
uguuucuuuaucuuccauuuuugcccuuugaaggccuccagacugc

SEQ ID NO: 95382 - RNA, 42 nt, Mus musculus
aagccugggaagcggcucacaagugaguucccacgaccagca

SEQ ID NO: 95383 - RNA, 46 nt, Mus musculus
gaguacacuguagcugucuucaugcacaccagaagagggcaucaga

SEQ ID NO: 95384 - RNA, 49 nt, Mus musculus
ccuacaguuagaacaguuacugcauaauaaggaggagccagaguugaga

SEQ ID NO: 95385 - RNA, 45 nt, Mus musculus
cuuggccauagggaguggcacuauuaggagguguggccuguaugc

SEQ ID NO: 95386 - RNA, 45 nt, Mus musculus
gcuugcauguagaaagggguggggcacagauuagggaucggaaga

SEQ ID NO: 95387 - RNA, 45 nt, Mus musculus
uaguucuucaguucuccaaguccucagaaagcaccaaggccagau

SEQ ID NO: 95388 - RNA, 45 nt, Mus musculus
caccauaaugauaaugaaccaugaaacuguaagccagccccaguu

SEQ ID NO: 95389 - RNA, 45 nt, Mus musculus
guuauacugcacauaaaauacuaaaauguaucaagaauuuagaag

SEQ ID NO: 95390 - RNA, 46 nt, Mus musculus
aagagcagguauuacaaggucuuagagacagugagagucugaggaa

SEQ ID NO: 95391 - RNA, 89 nt, Mus musculus
cuguuugauucauaaaaaugguucaauuuuuaaauguuggcagaauuaauuauucauugagaaaaaugaagaacaaaaaggaguagcga

SEQ ID NO: 95392 - RNA, 46 nt, Mus musculus
cuaagccuggcacacugaaggaauggggacaggguaugaaggagau

SEQ ID NO: 95393 - RNA, 44 nt, Mus musculus
uguguauguguguccaucuguccuucucccccacuugcugcagu

SEQ ID NO: 95394 - RNA, 46 nt, Mus musculus
gcgacuuggagaugcagaaaugaaauagccaggagucuuguuaguc

SEQ ID NO: 95395 - RNA, 46 nt, Mus musculus
gugaucuaaaggcaggcaacagaguccaagucagacagccccagcu

SEQ ID NO: 95396 - RNA, 45 nt, Mus musculus
cccauccgccauuaauuaauuaauuuauucacuugacauccugau

SEQ ID NO: 95397 - RNA, 46 nt, Mus musculus
ugccagugucauuuagugacuccaaaacuuaaauaguccaagagau

SEQ ID NO: 95398 - RNA, 46 nt, Mus musculus
gagaaugcuguagucugcugguggugccucagcaugacuguguggg

SEQ ID NO: 95399 - RNA, 46 nt, Mus musculus
uccuacuaucaauacuggauccucaccaagacuccugggaggugac

SEQ ID NO: 95400 - RNA, 46 nt, Mus musculus
guaauguggggaucuuaaacugacuuucuuuucucccccuugaguu

SEQ ID NO: 95401 - RNA, 46 nt, Mus musculus
cauaguccgggucaggucacuuucucuucuguuuaucugcagaguc

SEQ ID NO: 95402 - RNA, 45 nt, Mus musculus
guuuaacuugauggagccgauugguucuaugacuaguuuggagaa

SEQ ID NO: 95403 - RNA, 47 nt, Mus musculus
auugucaggagagaguaaagcccugucauauuggcacacacuguaaa

SEQ ID NO: 95404 - RNA, 25 nt, Mus musculus
cagcagagguuguggcucugcugug

SEQ ID NO: 95405 - RNA, 48 nt, Mus musculus
uacucauuuugauggaguuuuaccuuuuauaaacuaauguaagagggg

SEQ ID NO: 95406 - RNA, 51 nt, Mus musculus
cuaaugccaguuaauacccucagcaacaggguagauggaguugccagagag

SEQ ID NO: 95407 - RNA, 45 nt, Mus musculus
uuuagcgaguccaaaauaucugucuccugauugaaaggccaaguu

SEQ ID NO: 95408 - RNA, 73 nt, Mus musculus
gguauguguuuccuuguuguggagaccaucuauauuagucaggguucuuuagagaaauaaaacguacagaaua

SEQ ID NO: 95409 - RNA, 45 nt, Mus musculus
gaauacuguuuuuguauguguuaguucccagauaucuguucaaga

SEQ ID NO: 95410 - RNA, 52 nt, Mus musculus
acucugauguuuacuuuggauggaguguugugaugaagagucgaagcuaugu

SEQ ID NO: 95411 - RNA, 46 nt, Mus musculus
uugacucuaaaguagcuuauugcuugcuuuagaaacaagggaagag

SEQ ID NO: 95412 - RNA, 45 nt, Mus musculus
aaaacauaaaaccaaugucauuuacugaaguuaaucaguauuuaa

SEQ ID NO: 95413 - RNA, 42 nt, Mus musculus
caccagaaugcauuccagcuucugguggaucaggccaaaaaa

SEQ ID NO: 95414 - RNA, 45 nt, Mus musculus
auucauucauguuugcuuugggggaagagaaggaugcgggagacu

SEQ ID NO: 95415 - RNA, 50 nt, Mus musculus
uuacaaagugagucccugccucacuagaacaaaguaagaugggaaagaug

SEQ ID NO: 95416 - RNA, 53 nt, Mus musculus
ucuugaacauuagaaaaccaucuuuugaauguauuuuagaagugucaaucacc

SEQ ID NO: 95417 - RNA, 143 nt, Mus musculus
ccauaauggugaucuugaagucaggguuaugaaauuauguuuugaaguguuaacgugguaguaaagauugcuguuacguaucuuaagacaggagacauuggugagcugcgagugucaaauguuaaaagcauucugcuggggaa

SEQ ID NO: 95418 - RNA, 65 nt, Mus musculus
auuguuagaauuuuguuugugccauuauaguauuuucuaaacugggagggcauugcagacagugu

SEQ ID NO: 95419 - RNA, 104 nt, Mus musculus
cuccgggccuuagaaccucacuucaggccacuccuuggcccuuugaauugugcuaaauguagaagaaaccagccuuaaccaguguauugucagcuaugugggaa

SEQ ID NO: 95420 - RNA, 80 nt, Mus musculus
cuauagagaauuguuuucuaggccuguuuuuacgcauaauuugcagaagguauucaguggcuagaauccuggaaggguag

SEQ ID NO: 95421 - RNA, 51 nt, Mus musculus
uuacaaaaauaaaaauagaauuuuaaaaucuaacugaagauugggaagaug

SEQ ID NO: 95422 - RNA, 42 nt, Mus musculus
cuggaguuacagacagucauuagucaucaagucggugguaau

SEQ ID NO: 95423 - RNA, 26 nt, Mus musculus
cgcaaacucauauuuuagauucaaga

SEQ ID NO: 95424 - RNA, 46 nt, Mus musculus
uugguccuaagaggguccauaaagaggcugugcugggguuuaaaug

SEQ ID NO: 95425 - RNA, 42 nt, Mus musculus
aauucuaacauaguuaguguuguuucuugguaauggcuagga

SEQ ID NO: 95426 - RNA, 46 nt, Mus musculus
ggaaguguuacugugucugggagaggagaaaagugaauuugggguc

SEQ ID NO: 95427 - RNA, 46 nt, Mus musculus
ucuuggucuagacuugaggcggacggagcacuuggacauaagggau

SEQ ID NO: 95428 - RNA, 46 nt, Mus musculus
aaugugugugcauggggugaccauaugccacaaaaugcaucugcug

SEQ ID NO: 95429 - RNA, 44 nt, Mus musculus
aauacuuuaacagugaaauuguguauucacugaagggacgcugg

SEQ ID NO: 95430 - RNA, 45 nt, Mus musculus
ucaguaguguaguguguguacuagccagggcaguaagacaauaga

SEQ ID NO: 95431 - RNA, 46 nt, Mus musculus
aaagaaccaaacagagaaggaaauugaggaaguucacagugaauau

SEQ ID NO: 95432 - RNA, 45 nt, Mus musculus
gagcuucagguuuagugagagacccucucucaagaaaauaaggca

SEQ ID NO: 95433 - RNA, 42 nt, Mus musculus
cauuuguuugauugauuuuggccauucugacuggggcgagau

SEQ ID NO: 95434 - RNA, 46 nt, Mus musculus
uuuauuucaugugguaugaaauacuuuuugugaaugugugagugug

SEQ ID NO: 95435 - RNA, 40 nt, Mus musculus
uuauauuuuaaucaauucuuuuuccuucuccaacuccucc

SEQ ID NO: 95436 - RNA, 46 nt, Mus musculus
cugcaguuuuggggaccaaauuaacauaauacaugcagcauuagac

SEQ ID NO: 95437 - RNA, 45 nt, Mus musculus
ggaacucacuauauagaucaggcuggcuucaaacucagcagagau

SEQ ID NO: 95438 - RNA, 30 nt, Mus musculus
uuaacuucugagcuaucucuuuagccuauu

SEQ ID NO: 95439 - RNA, 46 nt, Mus musculus
cauaaagugaaaaugccuccugagaauacugugacuauccccaaau

SEQ ID NO: 95440 - RNA, 45 nt, Mus musculus
ugugcuaaggcagucuuccucucaggcugucucacugccccaggu

SEQ ID NO: 95441 - RNA, 45 nt, Mus musculus
caaaaggaagccguugcccaaaacuguauauaacuugcucucuga

SEQ ID NO: 95442 - RNA, 45 nt, Mus musculus
agauguagcuggaggaagcaugagcagcaaggucaaggggagauu

SEQ ID NO: 95443 - RNA, 62 nt, Mus musculus
agaguauguaugggauauauaugggauauguaugggagaguauguaugggauauguauggga

SEQ ID NO: 95444 - RNA, 67 nt, Mus musculus
ugggagaguauguaugggauauauaugggauauguaugggauauguaugggagaguauguaugggau

SEQ ID NO: 95445 - RNA, 67 nt, Mus musculus; identical to SEQ ID NO: 95444

SEQ ID NO: 95446 - RNA, 67 nt, Mus musculus; identical to SEQ ID NO: 95444

SEQ ID NO: 95447 - RNA, 46 nt, Mus musculus
aaggacucaccuguugcaguuugcuuuagagucaccacccauaucu

SEQ ID NO: 95448 - RNA, 51 nt, Mus musculus
uaugagacccuguacagggggaaaaaaaaauacaaaaagaaaggaaaggaa

SEQ ID NO: 95449 - RNA, 45 nt, Mus musculus
gcuuuuauuguuguugcuuuguuuuuaaguagcauuuuaucagau

SEQ ID NO: 95450 - RNA, 45 nt, Mus musculus
augauuuauauaaaauuuuuuuuauuuguuuccuaagaccaagau

SEQ ID NO: 95451 - RNA, 28 nt, Mus musculus
agugcugcuguuaagagacacagcaaga

SEQ ID NO: 95452 - RNA, 46 nt, Mus musculus
aaauugaauaauaaguuaugggaaauaauuuuaagagguuucagau

SEQ ID NO: 95453 - RNA, 56 nt, Mus musculus
ugauagccaccgcacagggggaaggucuaauaagggugauagccaccgcacagggg

SEQ ID NO: 95454 - RNA, 56 nt, Mus musculus
ggagccaaagaagggaaguggugauagccaccgcacaggggaaggucuaauaaggg

SEQ ID NO: 95455 - RNA, 45 nt, Mus musculus
ggagcaagaggacacuagaaacuuggaaugaaaucacuuucuagu

SEQ ID NO: 95456 - RNA, 41 nt, Mus musculus
acauaccaaaaccaaacaacccccccauuucuuggcccagu

SEQ ID NO: 95457 - RNA, 46 nt, Mus musculus
aaaauaaaaacgaucuccuuuccgccaugucccucauugcccaguc

SEQ ID NO: 95458 - RNA, 42 nt, Mus musculus
ccuugccuuggaugcaucaaagaguuuaggagcagccaguau

SEQ ID NO: 95459 - RNA, 46 nt, Mus musculus
acauacuaacuuuuguguuggugcgagcaauauuguguagucauuu

SEQ ID NO: 95460 - RNA, 46 nt, Mus musculus
uaccauuuuaaguauuguagcuuucuuuguaugugaggauaaaggu

SEQ ID NO: 95461 - RNA, 46 nt, Mus musculus
uggucagugacaguaaugucacuguguuaaauguugcuaugcaguu

SEQ ID NO: 95462 - RNA, 46 nt, Mus musculus
gguacuaguggcacuuaagcaacuuccuacggauauacuagcagau

SEQ ID NO: 95463 - RNA, 41 nt, Mus musculus
gcugcugagauuugcagccugauuuccagggugggguuggg

SEQ ID NO: 95464 - RNA, 45 nt, Mus musculus
aaacucccuggacugagaauaggcccaaauguggaacaccaccug

SEQ ID NO: 95465 - RNA, 45 nt, Mus musculus
cgguuuugucgggaaguuuuuuaauaggggcaaauaaggaaaaug

SEQ ID NO: 95466 - RNA, 41 nt, Mus musculus
gugugggcguuguccugcaggggaauugaacagguguaaaa

SEQ ID NO: 95467 - RNA, 45 nt, Mus musculus
gcgugcugagccagaccuccaucgcgcacuccggggaguggaggg

SEQ ID NO: 95468 - RNA, 47 nt, Mus musculus
aaaacuggcccuugccauuggcucguguucgugcaaguugaguccau

SEQ ID NO: 95469 - RNA, 41 nt, Mus musculus
cgcgcgagcggccgcccacccuccccuuccucugggggagu

SEQ ID NO: 95470 - RNA, 42 nt, Mus musculus
uggugggcaggaaugcgguccgcccugcagcaaccggagggg

SEQ ID NO: 95471 - RNA, 93 nt, Mus musculus
gaggcugugcuuuggggcuccggcuccucagagagccucggcuagguaggggaucgggacucuggcgggagggcggcuuggugcguuugcggg

SEQ ID NO: 95472 - RNA, 45 nt, Mus musculus
ccacguuuauacccuuuucaggagaggccucccaacccugcucuc

SEQ ID NO: 95473 - RNA, 46 nt, Mus musculus
gauaucccuguugaauuuguaggguucuagccuggaauugagccag

SEQ ID NO: 95474 - RNA, 50 nt, Mus musculus
cucuaaagaagagggggagggauaugccccuaugaauccgugcaagccaa

SEQ ID NO: 95475 - RNA, 87 nt, Mus musculus
uugcuuauauguuaaauaccuauacuuuugauuggggaggauccagauggaggagguuccaggaggagguuugugugcagcauauug

SEQ ID NO: 95476 - RNA, 46 nt, Mus musculus
uucucaggaggaucauuaguucucuguccaaaauuuguggccuguu

SEQ ID NO: 95477 - RNA, 46 nt, Mus musculus
auucauaacuguauccauuuauggauaucagcaucugaaaacugga

SEQ ID NO: 95478 - RNA, 39 nt, Mus musculus
uuuuggaucugauuguggucuuacaguaaucucuggaag

SEQ ID NO: 95479 - RNA, 44 nt, Mus musculus
uuucauggcacauugaagugauaaucauacauguauauaccaga

SEQ ID NO: 95480 - RNA, 45 nt, Mus musculus
uaugucaagcacauacuuuuaaaacccaaauuucauacggucuag

SEQ ID NO: 95481 - RNA, 46 nt, Mus musculus
aacuguuuuuccaagagcacaucuguugcuugagugagauagagaa

SEQ ID NO: 95482 - RNA, 46 nt, Mus musculus
auguuacccauguaacauuuuauuuuaaguauggcagucuuggcag

SEQ ID NO: 95483 - RNA, 45 nt, Mus musculus
cugaaauuuuuauuuuuugccauuuuuguuguauuuuggugcuca

SEQ ID NO: 95484 - RNA, 46 nt, Mus musculus
aaauaguuccguucuuucuagacaaauuuacuuuuauuuauaccag

SEQ ID NO: 95485 - RNA, 46 nt, Mus musculus
ggagucacaaccaacauguugaaaaccacuguauagaggaucagga

SEQ ID NO: 95486 - RNA, 46 nt, Mus musculus
agaccaucaacuggaggaaacucuuagucccuaccuagcaaaccag

SEQ ID NO: 95487 - RNA, 50 nt, Mus musculus
auuuuuagaauguauuuuuuuuuuauuuaauaguauggcaagaaguagcu

SEQ ID NO: 95488 - RNA, 46 nt, Mus musculus
aacacugucucagucuuccagagguucugaguucaauucccagcaa

SEQ ID NO: 95489 - RNA, 46 nt, Mus musculus
ugguuugguuucucccuguuguuuacuguauguacuaugagccaag

SEQ ID NO: 95490 - RNA, 46 nt, Mus musculus
guguagccuugguugcccuggaacuuccuuuauagaccagacugag

SEQ ID NO: 95491 - RNA, 46 nt, Mus musculus
uauaaaacucuagguguuuugguacaucccuauuauuagcaugcag

SEQ ID NO: 95492 - RNA, 46 nt, Mus musculus
uuuuauguucauaguaauuguuuguugucauugauaaagggagaag

SEQ ID NO: 95493 - RNA, 46 nt, Mus musculus
aguacugcuaguuuuuuuucccuugggauaguuggguuuuggcuag

SEQ ID NO: 95494 - RNA, 45 nt, Mus musculus
uaaagcaggacaagcuggguuugcuaguggauccaguauucugua

SEQ ID NO: 95495 - RNA, 46 nt, Mus musculus
agucauaagaaaaacugauuuaagagaaaauucaacucacaugcag

SEQ ID NO: 95496 - RNA, 46 nt, Mus musculus
aaauauuuuugguguuucauuugaaauauaauuaugagugguggag

SEQ ID NO: 95497 - RNA, 82 nt, Mus musculus
agcagggaagacaaagggcucucuaagaaaagggcuugggaugcgugggguagggauauucccuuuauuuuaucagagacug

SEQ ID NO: 95498 - RNA, 46 nt, Mus musculus
ggauugcaucaucucugggagaguggccaagguccacagccucagu

SEQ ID NO: 95499 - RNA, 46 nt, Mus musculus
uauuggaagacaggcuggguuuguuaguggauccgguauuuuguag

SEQ ID NO: 95500 - RNA, 41 nt, Mus musculus
uccugaggggaacaguuuugauagaagggaagagaagggca

SEQ ID NO: 95501 - RNA, 47 nt, Mus musculus
uuuaucagaauaguagcaguaguacaguuauauaacaauuggcaaga

SEQ ID NO: 95502 - RNA, 44 nt, Mus musculus
acuucauuugcauuuuaguuuuaguuuuaacagugucacccuga

SEQ ID NO: 95503 - RNA, 42 nt, Mus musculus
aggauuccucauguccguaacauguuggcugaggcucugcag

SEQ ID NO: 95504 - RNA, 64 nt, Mus musculus
cgucaugagcauugcaaucccucugggagucaccacaccagauacuuccuacucagauauggcu

SEQ ID NO: 95505 - RNA, 63 nt, Mus musculus
gugguauuuccuagauaauaggauugcuacaaguucgugugaggauggauuucuucugggcag

SEQ ID NO: 95506 - RNA, 45 nt, Mus musculus
ugcaaagcagugguuacauuuuccuuuguuuuauggguggggaag

SEQ ID NO: 95507 - RNA, 44 nt, Mus musculus
ccucuuccuauguacuugucauuauucuagaauaaaggggcuga

SEQ ID NO: 95508 - RNA, 122 nt, Mus musculus
gaccuucaaagucagugguaccaaacuuguuuuucagcuaagagcagcguuaggaauucagaauuuguggaaaggcccaaucccuaaaauagacucaguucuuugaagaauuuaaaugccaa

SEQ ID NO: 95509 - RNA, 110 nt, Mus musculus
uggaagcccccuaccuuucaagacgaaguggcacuacaccaggaugugaaaguccagcgaaagagacccaaggggccuagggggcagcacacccccagaagccaagucua

SEQ ID NO: 95510 - RNA, 95 nt, Mus musculus
gcaaagcaaagcgacuguuccagaauucuggguugaauggcgucccuuguuaauagugguuuccuuaaaacugaggauacuauuaaagagcaugu

SEQ ID NO: 95511 - RNA, 46 nt, Mus musculus
gaauugaaagucauuuuuaagcuuauucccauaauacaaugggagg

SEQ ID NO: 95512 - RNA, 46 nt, Mus musculus
gugugugugugguuugguuuugguuaugguuucugcaugccaacaa

SEQ ID NO: 95513 - RNA, 45 nt, Mus musculus
guuaacaaaugauguaucaguagaaaguacuaauauauaugaaaa

SEQ ID NO: 95514 - RNA, 45 nt, Mus musculus
uuuguccuuacuucaucaugucuaaccauuguuccaagcauucuc

SEQ ID NO: 95515 - RNA, 42 nt, Mus musculus
ugauuguaguaguuuacauuuuacaauuauauauaccagguu

SEQ ID NO: 95516 - RNA, 46 nt, Mus musculus
aaggauaaucauuugcauaaaaugguugucuaauaaagacaugcaa

SEQ ID NO: 95517 - RNA, 46 nt, Mus musculus
uccauggccaucuuuuauuucaugcaacuuuuuuuuucugucccac

SEQ ID NO: 95518 - RNA, 41 nt, Mus musculus
ucucuggaguuguguuaacacugguguugcuaaugggugaa

SEQ ID NO: 95519 - RNA, 46 nt, Mus musculus
uuuauagauagaauguuauccuugcuuucaaacaaugcauaauggg

SEQ ID NO: 95520 - RNA, 46 nt, Mus musculus
gccauuguuuuugccuguacuuucuucaggguauccugucuuggua

SEQ ID NO: 95521 - RNA, 46 nt, Mus musculus
ugugagguuucauggaaguauuaagagauccaauuaagaagaauag

SEQ ID NO: 95522 - RNA, 46 nt, Mus musculus
uuacacacaaauccacauucaauaacacuauuauuuauaggcguag

SEQ ID NO: 95523 - RNA, 48 nt, Mus musculus
augcuaucaugcauugcuuuucgccuuugugcagcccugaaucugugg

SEQ ID NO: 95524 - RNA, 46 nt, Mus musculus
ggagccccuccuccuccgacaccuccugcuucucccccuguccaga

SEQ ID NO: 95525 - RNA, 46 nt, Mus musculus
uggucuuucucaggauggcuuccuucucaacugugacaagugcagg

SEQ ID NO: 95526 - RNA, 58 nt, Mus musculus
uaaguuuauuuucccucuuuaggggaaugagcagggggaagguuauuagacuucaucg

SEQ ID NO: 95527 - RNA, 87 nt, Mus musculus
acacaccuacaagcaucaccuuaacuguuagaagaaccaaacccaagaagcggaaaaagaguccagaaaagggucgugcagcaccaa

SEQ ID NO: 95528 - RNA, 45 nt, Mus musculus
augccaguguuuggccacuuuuuuucuacuuucaaaaagucaccu

SEQ ID NO: 95529 - RNA, 46 nt, Mus musculus
cuuguuuuccucuuugggauaggcauuucgagagggaucccggaag

SEQ ID NO: 95530 - RNA, 45 nt, Mus musculus
uaucuucuuuuguccugcccaugaguaaguugacauaccuccuaa

SEQ ID NO: 95531 - RNA, 44 nt, Mus musculus
aaguuauaaauuuugucuuuggaauuaaugaaaacuuucauaaa

SEQ ID NO: 95532 - RNA, 47 nt, Mus musculus
cacagaauuuagaugaaaauaccacugagggcugggaaaaucggaua

SEQ ID NO: 95533 - RNA, 85 nt, Mus musculus
cuucucugggaccacuaauuggaacauguuuccuggaaacuugagauuaugucaaaaagaaaauuuuccaaucuucaaccuauuu

SEQ ID NO: 95534 - RNA, 49 nt, Mus musculus
cuauugcuauucuuaaacauuaacacuguuuuuauucaguuacagcugg

SEQ ID NO: 95535 - RNA, 47 nt, Mus musculus
uuauaauagaauaucgugggaaagucauguuacgacaacaauuugag

SEQ ID NO: 95536 - RNA, 42 nt, Mus musculus
aucguguauguacacuagugaugacuccuuuccaagcccaac

SEQ ID NO: 95537 - RNA, 35 nt, Mus musculus
cguacuuucgguaaugaugcucgguucaucagaag

SEQ ID NO: 95538 - RNA, 63 nt, Mus musculus
guagcuaauaguuguaugauuuuuaaugcagagaugaaaaaguaaaaguguggugucuuaugg

SEQ ID NO: 95539 - RNA, 46 nt, Mus musculus
uuuuaagaauaaaauaauaguuucacccuuuucuauuuugaagaag

SEQ ID NO: 95540 - RNA, 32 nt, Mus musculus
gaagucaccauugcauuugauuaugaauauag

SEQ ID NO: 95541 - RNA, 46 nt, Mus musculus
caaaguggacugugcuugucacaagggaaaccggaauugcccuaua

SEQ ID NO: 95542 - RNA, 46 nt, Mus musculus
caugaauauacuuacuuagauuuucuuuucacuuuaugauauucag

SEQ ID NO: 95543 - RNA, 45 nt, Mus musculus
auccagaagaaaaaccagaagaagaagaaaaagaagaggcuacag

SEQ ID NO: 95544 - RNA, 42 nt, Mus musculus
uagcagcacaaggucuugaguucgaucccaaauuacugggag

SEQ ID NO: 95545 - RNA, 45 nt, Mus musculus
uucaggucuguugucuucauugcuuucagagcaagccgaaauaag

SEQ ID NO: 95546 - RNA, 46 nt, Mus musculus
cauugcuaccaggaagcugagaggaaaaaaagccaagaggccaaag

SEQ ID NO: 95547 - RNA, 45 nt, Mus musculus
guugaugcuuuuuuuauuguuguuuuuaauacuuuucuaccccca

SEQ ID NO: 95548 - RNA, 46 nt, Mus musculus
cgaccgaaaaguagaauuucucgguaccggaccaguucagcccaaa

SEQ ID NO: 95549 - RNA, 46 nt, Mus musculus
uaccaggucuuauucauuccccauuaauuuguaccacccccaaaca

SEQ ID NO: 95550 - RNA, 45 nt, Mus musculus
auucgagaaucucuagauaacuuugugaguuuauauuguguuguu

SEQ ID NO: 95551 - RNA, 72 nt, Mus musculus
uagguaggguucuuuucccuggaccacccuuuucucugauccucagaucaggauucaggcugccgcccucau

SEQ ID NO: 95552 - RNA, 52 nt, Mus musculus
aggcaggucuucccugauuccucuaaacuuaaaaagauuuuuuucuuucccc

SEQ ID NO: 95553 - RNA, 47 nt, Mus musculus
aauauaaaggaucaacagaaugacauggccuauugaaggggagcaag

SEQ ID NO: 95554 - RNA, 93 nt, Mus musculus
gcacuuacuugguuuguauggggaaaacucccaaauggaagauuuucugagaaauuagauuucaagguccuugucaaagagauuuuggauaau

SEQ ID NO: 95555 - RNA, 46 nt, Mus musculus
uagaaagauuuugaaaaucugaucacuauaggaauuuugucuaggu

SEQ ID NO: 95556 - RNA, 46 nt, Mus musculus
gcuaauuaggcaaacacuugaauucuaucccuugacucauguaaaa

SEQ ID NO: 95557 - RNA, 46 nt, Mus musculus
uauaaaaagggaagauuagagugaaugggaaugggagaggaauaag

SEQ ID NO: 95558 - RNA, 46 nt, Mus musculus
guaacuacauggugguucacaacugcuguaauccccggucccgaag

SEQ ID NO: 95559 - RNA, 46 nt, Mus musculus
uuaaucuuuuuuuaaaaggagcgauugaugguaauuuagcagggau

SEQ ID NO: 95560 - RNA, 45 nt, Mus musculus
uugcuugagcuuuuguuguuguugcauuacuauguauagggggag

SEQ ID NO: 95561 - RNA, 46 nt, Mus musculus
aauucaguuuaaauugcugcuuuaauauuuccugagaaaaauccag

SEQ ID NO: 95562 - RNA, 46 nt, Mus musculus
uacuaauagaccuacuguuucauauaucauugaaaaaccuccuaag

SEQ ID NO: 95563 - RNA, 45 nt, Mus musculus
uucucccucauuuucaaaaaugccucaccuaccuuuugggccuuc

SEQ ID NO: 95564 - RNA, 42 nt, Mus musculus
gggaaauggagcuugguugauagaaucccucccuuggcccag

SEQ ID NO: 95565 - RNA, 44 nt, Mus musculus
agcaucauuaucagggugaucuuuagauacuuaggauguuugag

SEQ ID NO: 95566 - RNA, 39 nt, Mus musculus
uggaagaagggaugacucagacuucaucugugccccaag

SEQ ID NO: 95567 - RNA, 46 nt, Mus musculus
cauuugagguucacagugaaauuuucaguguugguucucugauaua

SEQ ID NO: 95568 - RNA, 46 nt, Mus musculus
cuaagacauaaagauaugggccaaauggcuaugaaaaaaggaccug

SEQ ID NO: 95569 - RNA, 87 nt, Mus musculus
ugguggguauguugcacacauauacacauauauaguugauuuggagaacagacugcauguccuggcugucacacacucagagagaac

SEQ ID NO: 95570 - RNA, 92 nt, Mus musculus
aucaacuuguauuacauuucuauucuucucuccagcaagcugugagaaacauuguuagaaaacaccuugcccuuaaguaucaauauaaacca

SEQ ID NO: 95571 - RNA, 97 nt, Mus musculus
aaggaaagcauuacauaaagagauuaauggcacagaauuacuguuuguugaguuuuaaaaguuuuguuuacaacaauauggaggaaaguugaugaag

SEQ ID NO: 95572 - RNA, 54 nt, Mus musculus
ugaauaauuuuuacuaagugcuuaguucaguaucagacccauaucugaauuacg

SEQ ID NO: 95573 - RNA, 49 nt, Mus musculus
aaagauaaaauugaauaaaaauaagauguauuaccauugacauaaagaa

SEQ ID NO: 95574 - RNA, 46 nt, Mus musculus
cugaaaaauucagaacuaauaacaguugaauaaaauccuugguuag

SEQ ID NO: 95575 - RNA, 46 nt, Mus musculus
aaagaaaauugcuuucuaaaaagaaaaguuuucaguuacuugggag

SEQ ID NO: 95576 - RNA, 63 nt, Mus musculus
gcuggaaccaauauguaaacauuucauuauaacauuaagauggacaaauggagaacaugggaa

SEQ ID NO: 95577 - RNA, 45 nt, Mus musculus
gaaucaaggcuugaauagcuaaaagaaaucaugcauagucauugg

SEQ ID NO: 95578 - RNA, 46 nt, Mus musculus
gguaugugccuagaaucuaguacuggagaggcugagaaagaaaaac

SEQ ID NO: 95579 - RNA, 45 nt, Mus musculus
auaauagucuaauggagaaaagauucuuuuuaauucaaugaagaa

SEQ ID NO: 95580 - RNA, 46 nt, Mus musculus
aaccguguaagugugacuaaucccagcacugcuguggcaagaugag

SEQ ID NO: 95581 - RNA, 48 nt, Mus musculus
cauucucaagcuuguucaacucccaccuuaaaguugagagagagagag

SEQ ID NO: 95582 - RNA, 46 nt, Mus musculus
uuuacuuaaguauauuuuuccucugagguguguuuuguuccugaag

SEQ ID NO: 95583 - RNA, 46 nt, Mus musculus
ggcucaaagaguccccagcugaccacaccuggccagacucacccag

SEQ ID NO: 95584 - RNA, 46 nt, Mus musculus
gauacagccucauguucucaccaaucacaucucuuacuacugcuag

SEQ ID NO: 95585 - RNA, 45 nt, Mus musculus
ucauuugcauguuucuuuauuuaaauggauauuuguggggggggg

SEQ ID NO: 95586 - RNA, 74 nt, Mus musculus
gaugagguacacagucacagagaaggaggggaaagaaucuagaagaaggaaaacaagagcccugugcuuuguac

SEQ ID NO: 95587 - RNA, 46 nt, Mus musculus
ccugaauuggggggugagggggcuggacuggaggguggccucucau

SEQ ID NO: 95588 - RNA, 45 nt, Mus musculus
ggauaccaauuucaguacuuugcuaagaaacccuccuacccuaaa

SEQ ID NO: 95589 - RNA, 46 nt, Mus musculus
aaacugaaaagauuauauuccacuaguuuauuguuaacuuccugag

SEQ ID NO: 95590 - RNA, 42 nt, Mus musculus
aguggagaugguccucagaccuugcugagaaacucagaccag

SEQ ID NO: 95591 - RNA, 45 nt, Mus musculus
uaaggaaugaacaagaagucuuuuauuucgcuuauuugaggggua

SEQ ID NO: 95592 - RNA, 92 nt, Mus musculus
uuuguuucagaaauauuucuaaaauauuugggcacuugugauuuuuguacuaaauguuaacaguaaaaaaagcuaaggacuggaugacugga

SEQ ID NO: 95593 - RNA, 65 nt, Mus musculus
gagauggcucugcaugaaaaagcacuuacagcucugucagaggaccuaacaccuauaugcagcag

SEQ ID NO: 95594 - RNA, 46 nt, Mus musculus
agcuaacuuuaauuuuauuaaagcuaaagcauauaugugauaccau

SEQ ID NO: 95595 - RNA, 89 nt, Mus musculus
auaucaggaccugggugacugagguaggaagauccuaaguccaaugccugccugagcuacaaagauccugucucacaaaaaugaaugag

SEQ ID NO: 95596 - RNA, 46 nt, Mus musculus
gguuuguuucugauagcaggaugauauaugaguaaauaauuagaag

SEQ ID NO: 95597 - RNA, 24 nt, Mus musculus
guuccaacuccugcacucagccug

SEQ ID NO: 95598 - RNA, 46 nt, Mus musculus
gguauccuugcuagaguaccgcaaaagaaaacaagaagcuaaggag

SEQ ID NO: 95599 - RNA, 45 nt, Mus musculus
ccgucagauuccaggggcacuucuuccucucacugcagaccucaa

SEQ ID NO: 95600 - RNA, 44 nt, Mus musculus
gcaucacagcuaggaguacagcauucauucuuuucuuuuuucag

SEQ ID NO: 95601 - RNA, 46 nt, Mus musculus
auaaaggaucgcucacugaaccuggagcucacugauuaaucccgag

SEQ ID NO: 95602 - RNA, 46 nt, Mus musculus
aaaaaaaaaaaaaaaagaaagaaagaaaacuauuucaagaacacag

SEQ ID NO: 95603 - RNA, 47 nt, Mus musculus
gaguugcccagaagggagagccuucuccaacaugggagaguaacauc

SEQ ID NO: 95604 - RNA, 46 nt, Mus musculus
cuagcuuccagcucagucuuacucuuugggcuacaguauacgugag

SEQ ID NO: 95605 - RNA, 42 nt, Mus musculus
aaaggagcaacuguuuacagcccuuccagauauagcuaccag

SEQ ID NO: 95606 - RNA, 45 nt, Mus musculus
ugauguuugacugcuuuuguuagccauuaaaauguucugggggaa

SEQ ID NO: 95607 - RNA, 42 nt, Mus musculus
cucucacgguucuucagaauccucccucucuuccacguccua

SEQ ID NO: 95608 - RNA, 46 nt, Mus musculus
aguuccaccuccuuuccucagaacucuaggucuucauugccaucag

SEQ ID NO: 95609 - RNA, 44 nt, Mus musculus
cccauagcugcuuccuuccagcugccucuggaaucaaggccgag

SEQ ID NO: 95610 - RNA, 63 nt, Mus musculus
agaaaugagacuuguggucaugacuggccuccggccuuggagaaagauguaaaucuugucuga

SEQ ID NO: 95611 - RNA, 53 nt, Mus musculus
ucuuuuucaauaauuuuuuuuuuuuucuuuucaaaagaaaaaagugggaaaga

SEQ ID NO: 95612 - RNA, 42 nt, Mus musculus
aaucuuugaauuuuaauuuuccuauucccaguuaaucaggag

SEQ ID NO: 95613 - RNA, 46 nt, Mus musculus
agaguuagcaagucacccauaccccuaacacuguucuguaggagag

SEQ ID NO: 95614 - RNA, 46 nt, Mus musculus
cuuucaucuccuuuucuacccugaccuacaacuaucauaugcacag

SEQ ID NO: 95615 - RNA, 38 nt, Mus musculus
cauaguacuuucuguuguuuuccccacaaacccaucag

SEQ ID NO: 95616 - RNA, 45 nt, Mus musculus
guggaguguuuacaccuugcuguaacauuugaacuuucacaagag

SEQ ID NO: 95617 - RNA, 45 nt, Mus musculus
gucuagauaaaccaacugucaccacuuguccucucagcagcccaa

SEQ ID NO: 95618 - RNA, 46 nt, Mus musculus
gugucacuauuaugagguauggccuuguuggaguagguguagccuu

SEQ ID NO: 95619 - RNA, 46 nt, Mus musculus
gaaaagcaguugaaugcuuuaagugaggccuagacaguggugcuga

SEQ ID NO: 95620 - RNA, 46 nt, Mus musculus
cauuuuccagccccagccagcagcaaaacuaaagaaaguuacugag

SEQ ID NO: 95621 - RNA, 45 nt, Mus musculus
agcccaagauaaagaaguauguugcagccaacaaagcugaaagga

SEQ ID NO: 95622 - RNA, 46 nt, Mus musculus
aauuauaaaguagcagugaaauaauuuuaugguuaggggccaccac

SEQ ID NO: 95623 - RNA, 23 nt, Mus musculus
gugagguggcagguuggaacuag

SEQ ID NO: 95624 - RNA, 41 nt, Mus musculus
aguacccacaugguggcuuacaauccuguaacuccagccca

SEQ ID NO: 95625 - RNA, 46 nt, Mus musculus
acauuauuaauaaauacuuuuuaaaacauaaaaggaauuacccagc

SEQ ID NO: 95626 - RNA, 45 nt, Mus musculus
ggagcauaaacaaaaaauauagauaccauacaagucaagccacag

SEQ ID NO: 95627 - RNA, 45 nt, Mus musculus
cagaggcagaggcagaggcagaggcgcagggaggcagagaggcag

SEQ ID NO: 95628 - RNA, 41 nt, Mus musculus
gcccuguguaaaauacuucugugaacuagaccugggagcug

SEQ ID NO: 95629 - RNA, 42 nt, Mus musculus
ugccugucgcugcugggccaucccuccaaugccaaccccacg

SEQ ID NO: 95630 - RNA, 46 nt, Mus musculus
aagggcaguggccaaagcucaggaggaggugucuacccuggaggag

SEQ ID NO: 95631 - RNA, 46 nt, Mus musculus
cccuuguucucaccuguaacccgguguucauaaugccugccugcag

SEQ ID NO: 95632 - RNA, 45 nt, Mus musculus
uguggaagacaugugagguugugugagaucagaguacagccuggg

SEQ ID NO: 95633 - RNA, 48 nt, Mus musculus
cccagcaaccauaugguggcucgcaaccauccguaacgagaucuggca

SEQ ID NO: 95634 - RNA, 42 nt, Mus musculus
caaccucagcucaagcucuggcugcaagcaccuaaggcacug

SEQ ID NO: 95635 - RNA, 46 nt, Mus musculus
uucccgagagcagggacugcacaucguaggcuuaagauucuugugg

SEQ ID NO: 95636 - RNA, 44 nt, Mus musculus
ggagaucaauauuggagcauuaacaagcaccgaauagagagagc

SEQ ID NO: 95637 - RNA, 41 nt, Mus musculus
gggaacaggcgaucgaggccagcgggcagucugggccugga

SEQ ID NO: 95638 - RNA, 41 nt, Mus musculus
cgauagauggacgagagcugcccauucuuguaguuaagccu

SEQ ID NO: 95639 - RNA, 42 nt, Mus musculus
ucucucugagagagagagagagagagagagagagagcgagag

SEQ ID NO: 95640 - RNA, 46 nt, Mus musculus
caaauuccccauguuuugaaaugauuuacuuuuguaaaaaccugag

SEQ ID NO: 95641 - RNA, 42 nt, Mus musculus
uccagcucugaucauacccuuauucugggagcacaguugcac

SEQ ID NO: 95642 - RNA, 53 nt, Mus musculus
guggaguaugacauggaugaagaggacuauaucuggcuggauaucaugaauga

SEQ ID NO: 95643 - RNA, 47 nt, Mus musculus
agucccaucccacaagagaucuuugaguacuuaauggaccguuugga

SEQ ID NO: 95644 - RNA, 46 nt, Mus musculus
aggcugggcuugaacuccauagucagaugugaccuugagcuucugg

SEQ ID NO: 95645 - RNA, 42 nt, Mus musculus
ugaaacgacaaucacggaauggggucccacuacucaggcgcc

SEQ ID NO: 95646 - RNA, 45 nt, Mus musculus
aaagagcuuacaguuuuucuaaguuaaauuaacauccccacccca

SEQ ID NO: 95647 - RNA, 46 nt, Mus musculus
cgugagcaggguggugcugugcuccgucaagcccggcgacaggcag

SEQ ID NO: 95648 - RNA, 45 nt, Mus musculus
cacaaccuggccggagaugaggucucacaccacacugaagauggu

SEQ ID NO: 95649 - RNA, 46 nt, Mus musculus
ucuuucauuuguaaaaacugaggcccagagauacuaccccgccaga

SEQ ID NO: 95650 - RNA, 57 nt, Mus musculus
uuaaggacaccaguguuguuguuuucugaauaguuguuaccuaggaucgucuuggcc

SEQ ID NO: 95651 - RNA, 46 nt, Mus musculus
gaggcccuugcaggugguaagguaaaucagcaucaucccagccuag

SEQ ID NO: 95652 - RNA, 46 nt, Mus musculus
acccacggugcuacacucccgguguguguggucacuugugugcgag

SEQ ID NO: 95653 - RNA, 42 nt, Mus musculus
aauaaauaaauaaauaaaucuuaaaaaagaaagaaagaaaga

SEQ ID NO: 95654 - RNA, 30 nt, Mus musculus
cacugggcuucuguagacucccacuuccaa

SEQ ID NO: 95655 - RNA, 45 nt, Mus musculus
gcggguacauuaugugcacugcuguuuguauguagaaguuuucag

SEQ ID NO: 95656 - RNA, 46 nt, Mus musculus
uugugagccaccacgugguugcugggauuugaacuucggaccuuug

SEQ ID NO: 95657 - RNA, 46 nt, Mus musculus
accccaggcugugcccguggauguccauguauggcagauugcccau

SEQ ID NO: 95658 - RNA, 46 nt, Mus musculus
ucccuuuauuacaagaaggaacaauaaaauagaaacauuuguaugg

SEQ ID NO: 95659 - RNA, 46 nt, Mus musculus
uucaugagagggguuggaggcagccugcuuccuccucacuccagau

SEQ ID NO: 95660 - RNA, 42 nt, Mus musculus
ccuaguuuggcucacuagcaucauacaagacugggcacagug

SEQ ID NO: 95661 - RNA, 46 nt, Mus musculus
auacagcucuggauaagaauauccaccagucagugagcgagcagau

SEQ ID NO: 95662 - RNA, 45 nt, Mus musculus
ugaugguaaaaucugaguggcuuuugagccaguuuaggugugauc

SEQ ID NO: 95663 - RNA, 46 nt, Mus musculus
caucuaccaaauaaauacuaacaggcaggggucuggagagauggcg

SEQ ID NO: 95664 - RNA, 44 nt, Mus musculus
gccaagaaagcccuggagggcaaagaaggcagcauggagaacga

SEQ ID NO: 95665 - RNA, 41 nt, Mus musculus
gcuuaugugaaagacaaagguggucaugacuacggggaaug

SEQ ID NO: 95666 - RNA, 24 nt, Mus musculus
uggaauucacaauuagggcugggg

SEQ ID NO: 95667 - RNA, 46 nt, Mus musculus
cauggugcagacuaguccggccuucugguuuuggcuaacugugggg

SEQ ID NO: 95668 - RNA, 45 nt, Mus musculus
cccaggcugccggaaaccugauuuccgagaggcuaggguggcaag

SEQ ID NO: 95669 - RNA, 44 nt, Mus musculus
ggagggcauagacaggacuaaguugcuaugucugguauguggga

SEQ ID NO: 95670 - RNA, 44 nt, Mus musculus
auguccaagcgcuaggccugaccauggaagggcgugggcauuug

SEQ ID NO: 95671 - RNA, 41 nt, Mus musculus
gcagaagaagcgcaccccuacaaagaaggaaaaggaccagg

SEQ ID NO: 95672 - RNA, 46 nt, Mus musculus
aagagucaggggcagauggagcgagcaccuccccgcgcaaucagaa

SEQ ID NO: 95673 - RNA, 46 nt, Mus musculus
ggaaugaucaaagcuuuggaggaaucuuuuuaacaugggugggaug

SEQ ID NO: 95674 - RNA, 30 nt, Mus musculus
gcgcucgggcagcagcuguggcugacaaga

SEQ ID NO: 95675 - RNA, 45 nt, Mus musculus
aaaugcacuaaccugaauuugaaaaucauuuaucugcaaccagag

SEQ ID NO: 95676 - RNA, 46 nt, Mus musculus
cagugaggagguacggacacuagaggagcuccugaagcccccagaa

SEQ ID NO: 95677 - RNA, 42 nt, Mus musculus
cucggugcuccccccaaacacggaaagcccaagaagcagaaa

SEQ ID NO: 95678 - RNA, 46 nt, Mus musculus
auccagggaccccccuagugaacuucuggcaccccugcccccuuac

SEQ ID NO: 95679 - RNA, 46 nt, Mus musculus
ggggugccagaaguucacuaggggggucccuggauccggugccugg

SEQ ID NO: 95680 - RNA, 45 nt, Mus musculus
ccugcucagacaccuccgccuaaguccuucccaaguggcccagau

SEQ ID NO: 95681 - RNA, 42 nt, Mus musculus
aggcagccacuugggacuaagacuauugcuuucuggccagaa

SEQ ID NO: 95682 - RNA, 45 nt, Mus musculus
cuggggcuugguggucucggcuggccacagaaagcgcuggcccag

SEQ ID NO: 95683 - RNA, 42 nt, Mus musculus
ccagcgcuuucuguggccagccgagaccaccaagccccagag

SEQ ID NO: 95684 - RNA, 46 nt, Mus musculus
ccccaagaauuggacagagcuguagagccauguguaccugcagcug

SEQ ID NO: 95685 - RNA, 42 nt, Mus musculus
aaguaagaugaaaugaccucggccuccagagaggaucaugag

SEQ ID NO: 95686 - RNA, 41 nt, Mus musculus
ccucugaagauggaacaaaugaaugacguugaucuuguaag

SEQ ID NO: 95687 - RNA, 45 nt, Mus musculus
ucauuuguuccaucuucagaggcaugcagacuguccccucugaag

SEQ ID NO: 95688 - RNA, 44 nt, Mus musculus
gcggcuugcugucuggggacagcuggagaggagcacaaguccgg

SEQ ID NO: 95689 - RNA, 40 nt, Mus musculus
gccccagggccuggcucagcugcggcagcacagauagcag

SEQ ID NO: 95690 - RNA, 41 nt, Mus musculus
ccacagggucugccugugacagguaugggcaugggcaggga

SEQ ID NO: 95691 - RNA, 42 nt, Mus musculus
guagcagggaagggguucgcagggugcuuggcugggugugug

SEQ ID NO: 95692 - RNA, 24 nt, Mus musculus
ggcagcgacuuucagcaccgggag

SEQ ID NO: 95693 - RNA, 46 nt, Mus musculus
uguguguguguguguauuugugcacgugagagcaacugcucgcaga

SEQ ID NO: 95694 - RNA, 46 nt, Mus musculus
cuacagcaaaaaacucuuagacucuugguucaccagcacacaggag

SEQ ID NO: 95695 - RNA, 46 nt, Mus musculus
auggcugugacacacuuuaccugguugaacuugaggcccuuuagag

SEQ ID NO: 95696 - RNA, 45 nt, Mus musculus
cagggcaaguucugucaccaacucaccugcauacacuggugugau

SEQ ID NO: 95697 - RNA, 46 nt, Mus musculus
acaggaaagcacucaccuuuccugcgguccuuuuuuagaaggagga

SEQ ID NO: 95698 - RNA, 45 nt, Mus musculus
aaaauuagagagaggguuggaucccaaaauauuccgagagaaagg

SEQ ID NO: 95699 - RNA, 42 nt, Mus musculus
gaauauuuugggauccaacccucucucuaauuuuggccccua

SEQ ID NO: 95700 - RNA, 46 nt, Mus musculus
gauagagggcagggggaggguucacuggagaagccaggcuguaagg

SEQ ID NO: 95701 - RNA, 45 nt, Mus musculus
agacccgccugguggaggugcuggagggcgugugcagcaggucag

SEQ ID NO: 95702 - RNA, 42 nt, Mus musculus
ggucgggggcuuccugcugccugugagaaaggggcagaaagg

SEQ ID NO: 95703 - RNA, 46 nt, Mus musculus
ggccacacuggccacaggccucgcccccauagccggcuuggcaguc

SEQ ID NO: 95704 - RNA, 44 nt, Mus musculus
uaugggggcgaggccuguggccaguguggccuuggcuacuuuga

SEQ ID NO: 95705 - RNA, 46 nt, Mus musculus
caaaucccaacaaccacaugguggcucaaaaccauccguaauggag

SEQ ID NO: 95706 - RNA, 45 nt, Mus musculus
aaaagugcagccguggcuaccagcaggugggcuccaagugccuag

SEQ ID NO: 95707 - RNA, 41 nt, Mus musculus
acaggucagggugcugacugccacaggcuccccgcacagcu

SEQ ID NO: 95708 - RNA, 55 nt, Mus musculus
guuccccucccccacccccagauguggaugagugugagacugugguguguccagg

SEQ ID NO: 95709 - RNA, 42 nt, Mus musculus
gcuccuccuccgggccccaccccacugcuacccagcccccag

SEQ ID NO: 95710 - RNA, 46 nt, Mus musculus
uccuagccuaggacacuggcaggccucaccguguaugaaucccaag

SEQ ID NO: 95711 - RNA, 71 nt, Mus musculus
ggugcaugcugccagcuccagcuguguauucaccgcccacgcccuagccaucgacuuauuuauucaucuca

SEQ ID NO: 95712 - RNA, 45 nt, Mus musculus
guuguggaguccccaccuccugcaaaccccauauaaggccuaauc

SEQ ID NO: 95713 - RNA, 41 nt, Mus musculus
gcagugaguagcaaggggaagggcaaguuguauagcaccag

SEQ ID NO: 95714 - RNA, 45 nt, Mus musculus
uccccccugcuuccccaacaccagcguccucacagcaucugucuc

SEQ ID NO: 95715 - RNA, 41 nt, Mus musculus
ucccagaagccuggaggcacagcagggcagcagccagcuag

SEQ ID NO: 95716 - RNA, 42 nt, Mus musculus
ccugcuccugagucuuuguauaugcuauugccgcugccaaag

SEQ ID NO: 95717 - RNA, 45 nt, Mus musculus
gggccccaaguccuuccuucgcacaccucauccccagccucagaa

SEQ ID NO: 95718 - RNA, 42 nt, Mus musculus
caggugaggagcuggccgagggaaggggagauggcgggaccc

SEQ ID NO: 95719 - RNA, 45 nt, Mus musculus
aaaaugugucagaauauauuguaaaaugaugaggagaaaggcaag

SEQ ID NO: 95720 - RNA, 78 nt, Mus musculus
auaggaagguagauagauagauaggaagguagauagauagauaggaagguagauagauagauaggaagguagauagau

SEQ ID NO: 95721 - RNA, 46 nt, Mus musculus
agaaacccugucuugaaaaaccaaaaaagaaaaaaaaaaugacuau

SEQ ID NO: 95722 - RNA, 45 nt, Mus musculus
ucacccugcaaaggacaccuugucagccauaaggugguaacagaa

SEQ ID NO: 95723 - RNA, 46 nt, Mus musculus
guucauuugugugagaauuuuuaauauaaaugcaagauguaaagca

SEQ ID NO: 95724 - RNA, 42 nt, Mus musculus
ucaaacagcaaucaaacuguccccacagugauagaggcaacu

SEQ ID NO: 95725 - RNA, 46 nt, Mus musculus
uuuaacuuucuuuacacacguaauauacuuuucucuaccacaauuu

SEQ ID NO: 95726 - RNA, 45 nt, Mus musculus
cagugggcgcucgaugauguggaagaagaacucauggccagagac

SEQ ID NO: 95727 - RNA, 46 nt, Mus musculus
gaugcaggagcagaugacaggagcagcgauggccaugccugcagac

SEQ ID NO: 95728 - RNA, 46 nt, Mus musculus
uccggagcauuuacucucuaauccugggccaagauaacgguaagaa

SEQ ID NO: 95729 - RNA, 46 nt, Mus musculus
cugugcuacugagcagcuguggguagugcagaugugagcgccguuc

SEQ ID NO: 95730 - RNA, 46 nt, Mus musculus
cucuccacuaaguggggaacacacaaacacaccaacacuccuaggg

SEQ ID NO: 95731 - RNA, 45 nt, Mus musculus
uggcuucccaagucggguggugagauaaaggcuagacgaucaagu

SEQ ID NO: 95732 - RNA, 45 nt, Mus musculus
uacaggagucuugccaaaagaagguuuguuagccucucuucuuag

SEQ ID NO: 95733 - RNA, 46 nt, Mus musculus
cccguuuccacugacacuucgcuucaagccuaugcuucagcaagga

SEQ ID NO: 95734 - RNA, 45 nt, Mus musculus
uucggugcuguaggaacuugggagcaguuccuacccagugucuag

SEQ ID NO: 95735 - RNA, 45 nt, Mus musculus
gucauguaaaggacuuggaaaccaucuaacuaucucugggcugug

SEQ ID NO: 95736 - RNA, 46 nt, Mus musculus
ucuuucuuaacacgaaaauauuacuucaacaacccagaggauggau

SEQ ID NO: 95737 - RNA, 48 nt, Mus musculus
aauucgaagcagaguccucagggaaaauggaaaauacauucccaagca

SEQ ID NO: 95738 - RNA, 46 nt, Mus musculus
aggagaguuccuuugugucucccgucaaauccagaaaggccaagug

SEQ ID NO: 95739 - RNA, 38 nt, Mus musculus
uaaaaaaucaccaauaauguauucaguaacuguuaaag

SEQ ID NO: 95740 - RNA, 48 nt, Mus musculus
acagaagguuaagaaauuuguaugcaguaaaagccagauuggacagau

SEQ ID NO: 95741 - RNA, 45 nt, Mus musculus
uauauguguguguguguguguauguauguguguauguguguguau

SEQ ID NO: 95742 - RNA, 41 nt, Mus musculus
uguaugugucgugccugcggaggcuagaggaggggggugga

SEQ ID NO: 95743 - RNA, 71 nt, Mus musculus
cgugggcaugauccgccacuacgugucaauccuacugcagagcgacaagaagcucacccaggaacaagugu

SEQ ID NO: 95744 - RNA, 46 nt, Mus musculus
aauccccagcaacuacaugguggcucacaaccaucuguaaugggau

SEQ ID NO: 95745 - RNA, 46 nt, Mus musculus
ugcucuggcucuugcucucgugcuccuaaagauguaagcaauagag

SEQ ID NO: 95746 - RNA, 92 nt, Mus musculus
uaaauaaaucuuuaaaaaacuauuuaaaaaaaaaagaaagaaaggaaggaaggaagaaagaaaagaaaaaaagaaaaaggaaaagaaggaga

SEQ ID NO: 95747 - RNA, 45 nt, Mus musculus
ucuuggucugcgugcuggugcuguagaugaugagcagcaugacca

SEQ ID NO: 95748 - RNA, 42 nt, Mus musculus
ucaaaaccagguuugacaccacaggguaaaucaaggcaggga

SEQ ID NO: 95749 - RNA, 41 nt, Mus musculus
agguuggcaaauucaucauaauacagagaagaggcccaagg

SEQ ID NO: 95750 - RNA, 46 nt, Mus musculus
cagcagggagcucagugcugcccagcagguagagagcaucacaguu

SEQ ID NO: 95751 - RNA, 46 nt, Mus musculus
uuccaucauguugucuugccacgcaaagucucagcagccggaaaug

SEQ ID NO: 95752 - RNA, 45 nt, Mus musculus
uuucuguuuuuugcugcaacagcagaacugcuccuaggcaucaua

SEQ ID NO: 95753 - RNA, 46 nt, Mus musculus
uauccuaagauucaaugagauaacuauuauaacagaguccaaagua

SEQ ID NO: 95754 - RNA, 46 nt, Mus musculus
uuguugggcuugguggcgcaugccuuuaaucccagcacucgggagg

SEQ ID NO: 95755 - RNA, 45 nt, Mus musculus
acaaguccagaauguagaauagagaagaccucaauguccagcucu

SEQ ID NO: 95756 - RNA, 46 nt, Mus musculus
uaacgagaucugacucccucuucuggagugucugagaacagcuaca

SEQ ID NO: 95757 - RNA, 41 nt, Mus musculus
auaaugcaaucaauagaauuuaggguuacaugugggaaaga

SEQ ID NO: 95758 - RNA, 46 nt, Mus musculus
aacgcgcaauuuuaacaaaaugugugaaagcuagaccaggagagaa

SEQ ID NO: 95759 - RNA, 45 nt, Mus musculus
aucagaugagcaucauggugcaugucugcaguccuagcaguaagg

SEQ ID NO: 95760 - RNA, 45 nt, Mus musculus
aaugaacaggggucaugggagggaguuaacagggcccgaggaagg

SEQ ID NO: 95761 - RNA, 44 nt, Mus musculus
gcaacagcacaaugaagugccgauuaaauggagcaagcccaaag

SEQ ID NO: 95762 - RNA, 46 nt, Mus musculus
ugagccaucaugugguugcugggauuugaacucgggaccuucggaa

SEQ ID NO: 95763 - RNA, 52 nt, Mus musculus
ucaccaggacugggcgaaccgggaguacauugagaucaucaccagcagcauc

SEQ ID NO: 95764 - RNA, 42 nt, Mus musculus
cuuucggucagcgggcgagcaggggaggcugggaggagggag

SEQ ID NO: 95765 - RNA, 42 nt, Mus musculus
uccucuuuggcugcccgccggccccagugcccucaccccgag

SEQ ID NO: 95766 - RNA, 42 nt, Mus musculus
cauccaucauccgccccgguuugcgccgcgcuuccgugccag

SEQ ID NO: 95767 - RNA, 45 nt, Mus musculus
uauugcucccguuuaaccacucccggcagguucauucauccccgg

SEQ ID NO: 95768 - RNA, 46 nt, Mus musculus
guguguaggauucuguauaaucuuacauggauuuucuuaacaggga

SEQ ID NO: 95769 - RNA, 46 nt, Mus musculus
aguaaagaguucauguguccccagaagaauuagauuuaaggaguau

SEQ ID NO: 95770 - RNA, 45 nt, Mus musculus
caucaggaagcuguucccucagacguugccuaacugccuugagaa

SEQ ID NO: 95771 - RNA, 42 nt, Mus musculus
aaacaccauuuugguuuugaguugugguuucucugccacaag

SEQ ID NO: 95772 - RNA, 44 nt, Mus musculus
acugacaaaauuugucagacagggucucaacuaauuuuccagga

SEQ ID NO: 95773 - RNA, 42 nt, Mus musculus
uucuaauucuuuauuaauuucaacuauuuaaaaaaccaccua

SEQ ID NO: 95774 - RNA, 45 nt, Mus musculus
gaaauguuccuuuuccugcguuacaagggagaagacugcggagau

SEQ ID NO: 95775 - RNA, 47 nt, Mus musculus
gcuaguacuaauuuugguugugauaagguaguauaugaaauaauuca

SEQ ID NO: 95776 - RNA, 44 nt, Mus musculus
ucuaacgguuguauuugucaggaacccagaaaccacggggaaga

SEQ ID NO: 95777 - RNA, 46 nt, Mus musculus
aagucagacuuggaaacuagaggaggcagcaauagcagauaguaag

SEQ ID NO: 95778 - RNA, 46 nt, Mus musculus
uuuggugacaaagaaugauuagauaagcaagaugaugagaguugag

SEQ ID NO: 95779 - RNA, 25 nt, Mus musculus
agguuacaacuugaucuaugcgcau

SEQ ID NO: 95780 - RNA, 42 nt, Mus musculus
ccuucucucuggagcuccucuuccucccuuccuugccuuaau

SEQ ID NO: 95781 - RNA, 46 nt, Mus musculus
ugucguucaagacucgcaacacuaaaugagaaauugacagcccuug

SEQ ID NO: 95782 - RNA, 47 nt, Mus musculus
gaagugcgccgccgcguugcugcugggaaguugcuguacagaacacu

SEQ ID NO: 95783 - RNA, 46 nt, Mus musculus
ccucuuggaaacagcauuaggcuuuuucccuuuucaguaacauugu

SEQ ID NO: 95784 - RNA, 42 nt, Mus musculus
aguggcuggagagggucuccuuguugagagucuggugggcaa

SEQ ID NO: 95785 - RNA, 47 nt, Mus musculus
ugaaugcuuaggguguaguccuaaggauuaguuugaaaguggugaag

SEQ ID NO: 95786 - RNA, 45 nt, Mus musculus
cugggauuaugucuccugacauugggaacacaugugugcacacag

SEQ ID NO: 95787 - RNA, 48 nt, Mus musculus
ggccaacucucuagccugcaguagugugugugugcauugggggguggg

SEQ ID NO: 95788 - RNA, 41 nt, Mus musculus
cuauuacacagauguguaauucccgaauguaggaaguagag

SEQ ID NO: 95789 - RNA, 31 nt, Mus musculus
aggaacacagugguuucccuugccauacugg

SEQ ID NO: 95790 - RNA, 42 nt, Mus musculus
guggaccuccugugucaccuggaacucuaccgagcugcccag

SEQ ID NO: 95791 - RNA, 45 nt, Mus musculus
uuaauuuuaagaacuuaaaaaaaauauuggagagccaguuaggag

SEQ ID NO: 95792 - RNA, 46 nt, Mus musculus
cuggaaccaggaggcauuucauuugaucacugugaccagcccccaa

SEQ ID NO: 95793 - RNA, 35 nt, Mus musculus
guguguggugggggguuguguauauguguguguca

SEQ ID NO: 95794 - RNA, 47 nt, Mus musculus
uuuuucucagggcuuuaacaaaaucccaacaaagcagcuggaggaag

SEQ ID NO: 95795 - RNA, 41 nt, Mus musculus
ugugggugagcaugugugggugagcauguguguguggguga

SEQ ID NO: 95796 - RNA, 53 nt, Mus musculus
ugagcaugugugugugggugagcgugugugggugagcaugugugggugagcau

SEQ ID NO: 95797 - RNA, 26 nt, Mus musculus
ggguguggggggggggaugcgcgcac

SEQ ID NO: 95798 - RNA, 44 nt, Mus musculus
ccaccaucauugaggguuccccaaacuauauauacuaugcagaa

SEQ ID NO: 95799 - RNA, 46 nt, Mus musculus
gauggaaagugacuuuuuggaagucacagaacuaccaagucagaag

SEQ ID NO: 95800 - RNA, 45 nt, Mus musculus
cucauuacaguguuaaguuuacaaauaccauuuucagaguggguc

SEQ ID NO: 95801 - RNA, 85 nt, Mus musculus
aggaagauaggucuccaaguuugaaaaaagaaagaaaagaaaagagaagaaaaaggaagaaaagaagagaagagaagaaaaagga

SEQ ID NO: 95802 - RNA, 48 nt, Mus musculus
uaugaagugugugugugugugugaugcauggaguuugguguguuuaug

SEQ ID NO: 95803 - RNA, 46 nt, Mus musculus
cccagcaaccacaugguggcucaucaccaucuguaaugggauccca

SEQ ID NO: 95804 - RNA, 45 nt, Mus musculus
ucuuaaaaaaaaacaaaacaaaacaaaaacaguggguggugauua

SEQ ID NO: 95805 - RNA, 46 nt, Mus musculus
uagacacguggaugguucacauguggagcaugagauguggcuagag

SEQ ID NO: 95806 - RNA, 45 nt, Mus musculus
gccagacugcacagcagggaaauagggugaggccaccagggacca

SEQ ID NO: 95807 - RNA, 45 nt, Mus musculus
uuuuaaaaaagagagaaaagaaaaaagaggugagagggcagcaug

SEQ ID NO: 95808 - RNA, 45 nt, Mus musculus
gauguaacuggguuauaaaggaugccagugucuggguuggcccca

SEQ ID NO: 95809 - RNA, 46 nt, Mus musculus
gaggcuaagcagcccuacuuggagaaccaguggcucucugggagag

SEQ ID NO: 95810 - RNA, 41 nt, Mus musculus
gcaacaugauuuaauaagacuagaugcaaacuguaauggca

SEQ ID NO: 95811 - RNA, 47 nt, Mus musculus
cuaauugaacuuuuaucuggauacuugauauuugaaccagaucuuga

SEQ ID NO: 95812 - RNA, 96 nt, Mus musculus
agaaagaagaaaagagaagaagaaggaggaagaagaggagaaggaggaggauggagaguaggaggauggagaggaggaggagggagaggaggagga

SEQ ID NO: 95813 - RNA, 41 nt, Mus musculus
uaggagggggaggaggaggagaaggagaagaaggaggagga

SEQ ID NO: 95814 - RNA, 30 nt, Mus musculus
aaguagaauguguguguguguguauguaug

SEQ ID NO: 95815 - RNA, 46 nt, Mus musculus
ggagcaggguuucugaggccacaggcucaucuuccaauaccccgga

SEQ ID NO: 95816 - RNA, 44 nt, Mus musculus
agccucagcgucccuucuuugguuaugauggcaucgugcccagg

SEQ ID NO: 95817 - RNA, 38 nt, Mus musculus
aauaugggagccucuuuguggaaaagguguauaugugu

SEQ ID NO: 95818 - RNA, 46 nt, Mus musculus
gggaacccacguuguugaccaccccaagagaugcuguugcccccaa

SEQ ID NO: 95819 - RNA, 66 nt, Mus musculus
ggcucgcaaucaggaagccaggggaagcggccucacccacaccugagcccgaagagagagaggacg

SEQ ID NO: 95820 - RNA, 48 nt, Mus musculus
guagagaagccauuucuucuagagaggagugggcagggugcagagggg

SEQ ID NO: 95821 - RNA, 45 nt, Mus musculus
uccaguuccacuguccauuuacaaucacucgaagguugcagagau

SEQ ID NO: 95822 - RNA, 42 nt, Mus musculus
guuaagugcacaugaagauagauacccaugggagcccgagga

SEQ ID NO: 95823 - RNA, 45 nt, Mus musculus
cgaaaaaccaaaaaagaaaaaaaagagauaacaagagggcaaagu

SEQ ID NO: 95824 - RNA, 47 nt, Mus musculus
caucacucugacccucagcuucuguugcaaauucagaguucguagag

SEQ ID NO: 95825 - RNA, 45 nt, Mus musculus
uuaggacagucucccaagcuugccuuccccugagugguggcagcu

SEQ ID NO: 95826 - RNA, 42 nt, Mus musculus
acuauacaaaugaggaggguacauuacacagucaguggggaa

SEQ ID NO: 95827 - RNA, 45 nt, Mus musculus
gcgcucacucacaugucaaccccugaccauuuauuucuagccagg

SEQ ID NO: 95828 - RNA, 45 nt, Mus musculus
agcaagaaaaggaaggaagaggaagaggaggaagaugaagaagau

SEQ ID NO: 95829 - RNA, 46 nt, Mus musculus
acaagugagaagaauggcuugcagcgugugugugugugugugugug

SEQ ID NO: 95830 - RNA, 36 nt, Mus musculus
uaacucucauagacucuucuuuuccucuuaggagca

SEQ ID NO: 95831 - RNA, 46 nt, Mus musculus
uggaaucaaggcccuauauguguaaaggcuucuaaccauuccagaa

SEQ ID NO: 95832 - RNA, 46 nt, Mus musculus
augugugcaugcauguguggguaaguguguguauguguguacugga

SEQ ID NO: 95833 - RNA, 46 nt, Mus musculus
gaggcaaaccuguagggcauuuucuuaauuagugauggaugcgaga

SEQ ID NO: 95834 - RNA, 45 nt, Mus musculus
ggugugcuggcuaguuuugugucagcuugacacaggcuacaaguc

SEQ ID NO: 95835 - RNA, 45 nt, Mus musculus
agaagacaggaagucuucauggguaugggguaaggacuuaggaga

SEQ ID NO: 95836 - RNA, 44 nt, Mus musculus
cagagagcaaaggggaaaggcagagggaagaggcagcagguagg

SEQ ID NO: 95837 - RNA, 47 nt, Mus musculus
auggcuagauggacuagccgcagcgaguguggcauggccaggccccu

SEQ ID NO: 95838 - RNA, 46 nt, Mus musculus
ccauuuguaauggggucugaugcccucuucuggugugacauaagau

SEQ ID NO: 95839 - RNA, 31 nt, Mus musculus
gcacacaaguuucuuccuuuucagcaacuag

SEQ ID NO: 95840 - RNA, 43 nt, Mus musculus
guacacuguagcugucuggacacaccagaagagggcaucagau

SEQ ID NO: 95841 - RNA, 42 nt, Mus musculus
gaagcuggcuucaccagcaagcauucccuuuuggggacagcg

SEQ ID NO: 95842 - RNA, 45 nt, Mus musculus
cuuuucauaaacacacaguuuggagcagggugugguggcccagac

SEQ ID NO: 95843 - RNA, 41 nt, Mus musculus
ggcugugcacacauggcaacaaggggccagaaagcugaagg

SEQ ID NO: 95844 - RNA, 45 nt, Mus musculus
gaucuguuccauacuugagccccacuuugggcacccagccuuuac

SEQ ID NO: 95845 - RNA, 44 nt, Mus musculus
aagugccuaagagccuugugcuagaauccaaagccugagagaga

SEQ ID NO: 95846 - RNA, 46 nt, Mus musculus
gggaccagugcucuccauauucuugccucuguguauguccugagac

SEQ ID NO: 95847 - RNA, 45 nt, Mus musculus
ggcuccuugaaugaggauuauccagccaaucuuguugacacucug

SEQ ID NO: 95848 - RNA, 24 nt, Mus musculus
caugguaaaauggagggccuuucc

SEQ ID NO: 95849 - RNA, 41 nt, Mus musculus
agauggcugguuugcagggacucccuucccagucuuggaag

SEQ ID NO: 95850 - RNA, 44 nt, Mus musculus
agacaggaagggaauuuacuucaguguggccaacaucaagaaca

SEQ ID NO: 95851 - RNA, 41 nt, Mus musculus
caagagguccugaguucagaucccagcaaccacgugguggc

SEQ ID NO: 95852 - RNA, 45 nt, Mus musculus
caaaucccagcaaccacaugguggcucgcaaccacccauaaugag

SEQ ID NO: 95853 - RNA, 47 nt, Mus musculus
ggggauguuguuguuguuguuguuauggugguggugacggugauaau

SEQ ID NO: 95854 - RNA, 46 nt, Mus musculus
guucaaggccagccugggcuaagugaacaacaacaaaaaguuaaag

SEQ ID NO: 95855 - RNA, 45 nt, Mus musculus
gguguuuuugccucucucucucugugugugugugugugugugugu

SEQ ID NO: 95856 - RNA, 45 nt, Mus musculus
uauacaagucagcugaguauuuguagggcaaguggccuuggagaa

SEQ ID NO: 95857 - RNA, 45 nt, Mus musculus
gaagaagagucagcaggcaccacuuucuguuuccuugggggcaga

SEQ ID NO: 95858 - RNA, 48 nt, Mus musculus
ugaggacaucaaugcuugcacgcugacuacauccccaaggcuaccagu

SEQ ID NO: 95859 - RNA, 52 nt, Mus musculus
uugguggcugacugugugaagaaagucaaagaagagagaccuuuguuucccc

SEQ ID NO: 95860 - RNA, 42 nt, Mus musculus
cccaaaagggccuuuuugcacacaugguucauggugccagaa

SEQ ID NO: 95861 - RNA, 42 nt, Mus musculus
ugcuuuugugggacuggaucgaguggcucuuugacagcagau

SEQ ID NO: 95862 - RNA, 48 nt, Mus musculus
caaaggacaaccuggcgauugugacucaguggugugaaggcagcaguc

SEQ ID NO: 95863 - RNA, 46 nt, Mus musculus
cugccucaaacaaaacaaaagaaaacaagguaagaugcacauagau

SEQ ID NO: 95864 - RNA, 46 nt, Mus musculus
cugugcuggacugguggcuucagcacugcuucucuuucacucagau

SEQ ID NO: 95865 - RNA, 45 nt, Mus musculus
uucagacauggugcugauaaccuuuauagauaauggggcagagau

SEQ ID NO: 95866 - RNA, 46 nt, Mus musculus
uuuccauaccagguuuuuaacaccuggauuuaggauguuagcagua

SEQ ID NO: 95867 - RNA, 45 nt, Mus musculus
aaaacuggacacuuccugaccagugucucucuuugggccccagau

SEQ ID NO: 95868 - RNA, 45 nt, Mus musculus
cucuugacaccaacagcuggaagggaccuuauaacagguacaagg

SEQ ID NO: 95869 - RNA, 49 nt, Mus musculus
ucggaucgggucagguuccuuuggcacuguguacaagggcaaguggcau

SEQ ID NO: 95870 - RNA, 45 nt, Mus musculus
cagccagccaaccaaccaaaaucaugucuggagugauggcccagc

SEQ ID NO: 95871 - RNA, 48 nt, Mus musculus
gaccuggauucuuacuuaucucuguggaugguuuacauauggcuuggg

SEQ ID NO: 95872 - RNA, 46 nt, Mus musculus
aguaggagacauuaaaaacuauccugcuguacuguggaccagaaau

SEQ ID NO: 95873 - RNA, 84 nt, Mus musculus
aaauaaaauaaaaaagacucaaaaucaaauaaaaaagacucaagagacguggccaaguaacugcuuucuccacacuaugaacug

SEQ ID NO: 95874 - RNA, 42 nt, Mus musculus
cuauugagacaacuauacauucauuuauacuucuagccagac

SEQ ID NO: 95875 - RNA, 45 nt, Mus musculus
cuuuggacuagaguaacagccugaaugcuucucccagggcgugcu

SEQ ID NO: 95876 - RNA, 42 nt, Mus musculus
gguggugaugagcagcaguaguuaauauugggaagcagagaa

SEQ ID NO: 95877 - RNA, 46 nt, Mus musculus
cucagacaguuugcauauaaaagauugaggcucucuguuaggagau

SEQ ID NO: 95878 - RNA, 46 nt, Mus musculus
uuguuguuguugcugcugcugcugcuguuguugcaguacuggagac

SEQ ID NO: 95879 - RNA, 94 nt, Mus musculus
gucccugaagcuugcuggccugcuuaccuaauugcugugcuccagaucagugagagaacuugucucaaaggcaagauagauggcgcccggagaa

SEQ ID NO: 95880 - RNA, 46 nt, Mus musculus
uacuguugaugcagaugacguacgacuggcaauccagugccgugcu

SEQ ID NO: 95881 - RNA, 44 nt, Mus musculus
gcaagauggcgucucccaagagcaugcugaaagaugcacagaug

SEQ ID NO: 95882 - RNA, 46 nt, Mus musculus
aguaacaguucugguauguuuaucaccuggcuuacccuuggcugau

SEQ ID NO: 95883 - RNA, 45 nt, Mus musculus
ccaucuccuaggaaaagauauuuuauuauuuuauaggcccaagau

SEQ ID NO: 95884 - RNA, 45 nt, Mus musculus
gagaucaaacucaggaccuguagaagaacagucagccgcucagau

SEQ ID NO: 95885 - RNA, 46 nt, Mus musculus
ucucucucuauauauaaguguucugucuucaugcauaccaaaagag

SEQ ID NO: 95886 - RNA, 41 nt, Mus musculus
cuaccauuguucagcaguuuggcuaucagcgccgggccuca

SEQ ID NO: 95887 - RNA, 46 nt, Mus musculus
uauaauuauuugucuuucagguauaaguauuguuuaaacugcauca

SEQ ID NO: 95888 - RNA, 45 nt, Mus musculus
cagucugcauuugcucaggccccucauauagaggacauaguauuu

SEQ ID NO: 95889 - RNA, 42 nt, Mus musculus
uacuauguacuucauggcgugggguucucuccaagggcagug

SEQ ID NO: 95890 - RNA, 41 nt, Mus musculus
ugucugucugucugucucucucucugucugucugucucuuu

SEQ ID NO: 95891 - RNA, 46 nt, Mus musculus
uauauuggaaguucucugcuaaucucuuuuguuaacaggacaagau

SEQ ID NO: 95892 - RNA, 48 nt, Mus musculus
acccauccccagucucacuguggcuuggguggaucuggagccuggagu

SEQ ID NO: 95893 - RNA, 52 nt, Mus musculus
guguagaagguuucuagaagacugaauuagaacuucuuuaauuguggagagu

SEQ ID NO: 95894 - RNA, 58 nt, Mus musculus
auaauaagcuuacggggcuaaguucccagaaaacaaaaguaaaacaaaaagcauaucu

SEQ ID NO: 95895 - RNA, 42 nt, Mus musculus
agcagacacugugacauacuguugccuuucuagccuccagac

SEQ ID NO: 95896 - RNA, 45 nt, Mus musculus
aacugucacugggaaccaugaaaauaaagauaaaaaauucuggga

SEQ ID NO: 95897 - RNA, 46 nt, Mus musculus
uuugcuuagcugauuaaaacauguguccugucuuguagagugagau

SEQ ID NO: 95898 - RNA, 45 nt, Mus musculus
gcuaagaagacucagauacuaaaucaugugguggagccccuagau

SEQ ID NO: 95899 - RNA, 48 nt, Mus musculus
ugcuugaacaaaacagcucacauggugauggcuaggcaggagaaaggc

SEQ ID NO: 95900 - RNA, 45 nt, Mus musculus
gaaguucauaauuuuaauguaucuucuuucauuuaauggcuaaga

SEQ ID NO: 95901 - RNA, 44 nt, Mus musculus
ggggcacagcauggugacacuagacauguacaugucaaguagaa

SEQ ID NO: 95902 - RNA, 42 nt, Mus musculus
guuccgcaguguuuguuauuuuaaaauuaugugucucugugu

SEQ ID NO: 95903 - RNA, 47 nt, Mus musculus
ucucucucugucgcucucucucugucucugugaaaucacucuguaga

SEQ ID NO: 95904 - RNA, 42 nt, Mus musculus
ugauuacuagaguuuuggcuucguagguguacauguccagaa

SEQ ID NO: 95905 - RNA, 42 nt, Mus musculus
cagcucauguuugcucagcagaaacuuugugaggccccuccc

SEQ ID NO: 95906 - RNA, 46 nt, Mus musculus
uacauauaauaaauaaguaaaucuuuaaaaaaaaauacuaguagau

SEQ ID NO: 95907 - RNA, 46 nt, Mus musculus
acucuagccuugaucuaauccuguuucagucucccauaugcuagga

SEQ ID NO: 95908 - RNA, 46 nt, Mus musculus
ugcauguaugugcauccugcauuugucuguuggauucccuggaacu

SEQ ID NO: 95909 - RNA, 46 nt, Mus musculus
auuuaugugaugcuaaguaucaaacccaggaccuccugccccagau

SEQ ID NO: 95910 - RNA, 42 nt, Mus musculus
caugcucccuccuguacccuacuuucuguucccaccccaguu

SEQ ID NO: 95911 - RNA, 42 nt, Mus musculus
guagagagauacacugcacuauguaucucuauguaacaagaa

SEQ ID NO: 95912 - RNA, 45 nt, Mus musculus
gcacuuagauguucuccugccuucuguuccucaguggauccugaa

SEQ ID NO: 95913 - RNA, 46 nt, Mus musculus
uggucuggugugcuuugcaaagguuuuguacauauugucccaauug

SEQ ID NO: 95914 - RNA, 46 nt, Mus musculus
acugcuugaaucaaguucuccccucuuuauuuccuuccauccuauu

SEQ ID NO: 95915 - RNA, 47 nt, Mus musculus
uugugugucugaguguauaugcaccaaugucugcaguguuaguggag

SEQ ID NO: 95916 - RNA, 42 nt, Mus musculus
auuaacccuauuuauguaguagacucuuuucuuuggacagag

SEQ ID NO: 95917 - RNA, 45 nt, Mus musculus
uaguucuugcugguuacugcuuugcuccccucccgcuaugguagu

SEQ ID NO: 95918 - RNA, 45 nt, Mus musculus
uucugcgcggaguuugaaggacuguuccgccaggugaggcagagg

SEQ ID NO: 95919 - RNA, 46 nt, Mus musculus
ucuuucccgguugagacguaacuggguccuggggaaugggccaggu

SEQ ID NO: 95920 - RNA, 41 nt, Mus musculus
aggcccucggacgggccagcuggccgagcuuuggggcgcgu

SEQ ID NO: 95921 - RNA, 46 nt, Mus musculus
uucuccuauccuccucuccaaacaccacagaaacacaggaacagag

SEQ ID NO: 95922 - RNA, 46 nt, Mus musculus
aacggggcagguccugguagacuguucuuuguucuuugggcccaag

SEQ ID NO: 95923 - RNA, 94 nt, Mus musculus
uauguguauauauguggggauauuauaugucuuucugugugugugugugugggugugugugcaugaaguguucucauacauucgcuguauggga

SEQ ID NO: 95924 - RNA, 46 nt, Mus musculus
ugugagccaccaugugguugcugggacuugaacucgggaccuucgg

SEQ ID NO: 95925 - RNA, 45 nt, Mus musculus
gaaaugguggcauggacagggucccuccagguucugugggcggcc

SEQ ID NO: 95926 - RNA, 46 nt, Mus musculus
agugaccugugacucuuaauuccagcacgucggaggcagaggcaag

SEQ ID NO: 95927 - RNA, 42 nt, Mus musculus
accacaucacagcgugccuucuguguguuuccccucacccag

SEQ ID NO: 95928 - RNA, 44 nt, Mus musculus
gagucuucaugggcccaucagaucuaggucaucacagagggcag

SEQ ID NO: 95929 - RNA, 45 nt, Mus musculus
ucuggguccuaacagacuugagccgaggcuugugcauggugagcu

SEQ ID NO: 95930 - RNA, 45 nt, Mus musculus
uagguaaaggcugcagcagagugaccugggccagacacaggagag

SEQ ID NO: 95931 - RNA, 27 nt, Mus musculus
uuggucccaguuuucuucucugcgaua

SEQ ID NO: 95932 - RNA, 45 nt, Mus musculus
uggaugcuugguucaggacagacacauuggucacuacagccccag

SEQ ID NO: 95933 - RNA, 41 nt, Mus musculus
gcucacugcaccuguuuacaaccagguuggggacgggggac

SEQ ID NO: 95934 - RNA, 86 nt, Mus musculus
agaugagaguuguguguguguguguguguguguguguguguguuagucaaggagaagaagccaguguguauguaugugaguuugug

SEQ ID NO: 95935 - RNA, 46 nt, Mus musculus
uguguguaggugugugagugugugugugugugugugagagagagag

SEQ ID NO: 95936 - RNA, 46 nt, Mus musculus
gggguggaggggcaaggucuuuuuggcuuuguugguuuguuuguuu

SEQ ID NO: 95937 - RNA, 45 nt, Mus musculus
cagucaaguuccucaucucagaccagccucacuccaucgacccuc

SEQ ID NO: 95938 - RNA, 45 nt, Mus musculus
ucaacuauaaaauggggugcugaugcaugcaaaggcacugugcca

SEQ ID NO: 95939 - RNA, 46 nt, Mus musculus
aaagaacacuggucccauuuuacaaauggggaaacugagucccaag

SEQ ID NO: 95940 - RNA, 42 nt, Mus musculus
ccucuucgagagcauccaaaaggacacagccuccggccccag

SEQ ID NO: 95941 - RNA, 46 nt, Mus musculus
acccugaaccuagccauggguaggguauguagagcccauacaagag

SEQ ID NO: 95942 - RNA, 41 nt, Mus musculus
guugggacaggguugagagcagagguuugucugguccccag

SEQ ID NO: 95943 - RNA, 46 nt, Mus musculus
ucacugcucuugcagaggucccagguucaguucccagcacccacau

SEQ ID NO: 95944 - RNA, 46 nt, Mus musculus
gcugaauaagcaaauagcugagaucuuggcucugggggcuggagag

SEQ ID NO: 95945 - RNA, 45 nt, Mus musculus
ugccucugccucccaagugcugggaucaaaggcgugugcaccacu

SEQ ID NO: 95946 - RNA, 46 nt, Mus musculus
aggccaccugucugcaagaggguggcugggauaacaccugauaggc

SEQ ID NO: 95947 - RNA, 45 nt, Mus musculus
uugacgaucacagacgcugguaagugacagugcucuucauggaga

SEQ ID NO: 95948 - RNA, 46 nt, Mus musculus
ggagguggaagggaagaaagguucucccgccuccuucuugcaagug

SEQ ID NO: 95949 - RNA, 45 nt, Mus musculus
agcuccuggggaucugucaccuucuuuuggcuucauuggguaccu

SEQ ID NO: 95950 - RNA, 89 nt, Mus musculus
aguguucaguuuagguuuuccaaugaugaaauucaacacgccaaugcucaaauccaguuaccagcacuccugcuaaagaaagccuaaac

SEQ ID NO: 95951 - RNA, 58 nt, Mus musculus
agaaucaugaaaaauuaagucuaucuugaagcugccuguuugaaguuucccaugcguc

SEQ ID NO: 95952 - RNA, 42 nt, Mus musculus
ugagccaccacgugguugcugggauuugaccuaaggaccuuc

SEQ ID NO: 95953 - RNA, 57 nt, Mus musculus
gguauccgauugagcuucauggcauugguaaauauggcaacgacuccuaccggaucu

SEQ ID NO: 95954 - RNA, 48 nt, Mus musculus
agagaagcauuuccucugucuauuuauauuucgcaaagcacacaggag

SEQ ID NO: 95955 - RNA, 42 nt, Mus musculus
cuggauaacagccaacauucuuuuuaauacugagggccaggu

SEQ ID NO: 95956 - RNA, 46 nt, Mus musculus
auucccuaagguguagacuauaaacuaauuuugcuucucagaagac

SEQ ID NO: 95957 - RNA, 45 nt, Mus musculus
uuuagcuucucugugccucaguuuccuuaugaauaaaguggagau

SEQ ID NO: 95958 - RNA, 45 nt, Mus musculus
gaagcaaaucgugagcagacuuuuuuagaaucagaggaaaucaga

SEQ ID NO: 95959 - RNA, 42 nt, Mus musculus
uaucuucucaaaaauggggagacuuuucuuaagccugaagau

SEQ ID NO: 95960 - RNA, 46 nt, Mus musculus
gaaaacugcaggaaaauuugauguauacuuuaucagguaagcauuu

SEQ ID NO: 95961 - RNA, 42 nt, Mus musculus
uaguacuacagcgacagaaggccacaagccugucccgugugg

SEQ ID NO: 95962 - RNA, 46 nt, Mus musculus
guuggacugggaggagugggagaagauggaaaggaccuggugauaa

SEQ ID NO: 95963 - RNA, 46 nt, Mus musculus
guuguuagagcuggacaauccucauggcacaagacuagcucacuga

SEQ ID NO: 95964 - RNA, 46 nt, Mus musculus
acagccaagacuacacagagaaacccuguuugaaaaucaaggugga

SEQ ID NO: 95965 - RNA, 41 nt, Mus musculus
guucgagcgacagcaccgaauauccgggcuuggcggcgucu

SEQ ID NO: 95966 - RNA, 90 nt, Mus musculus
cugcaccagaaugagauccugaacuuaaagcaggaguuggccagcauggaagagaaaaucgccuaucagucauaugaacgggcccgggau

SEQ ID NO: 95967 - RNA, 45 nt, Mus musculus
ggguuggcuuacagguucagagguucaguccauuaucaucagggu

SEQ ID NO: 95968 - RNA, 45 nt, Mus musculus
acuauuuaaagguguggcuuuguuggaauagguguagucuuguug

SEQ ID NO: 95969 - RNA, 46 nt, Mus musculus
cuguacgaccaaaagaagaaagaagagaagguaggagacuggagaa

SEQ ID NO: 95970 - RNA, 45 nt, Mus musculus
gcagagguccacaagcauagggggugcuguucuauaacagcagga

SEQ ID NO: 95971 - RNA, 46 nt, Mus musculus
caagggaugauuucagccugcuuuaaaaaccaagcugcacucaaga

SEQ ID NO: 95972 - RNA, 45 nt, Mus musculus
gccaucucuccaaccccuauauaggacuuuaaauuaugagugaga

SEQ ID NO: 95973 - RNA, 45 nt, Mus musculus
ugugaaccaccaugugguugcugggauuuaaacucaggaccuucg

SEQ ID NO: 95974 - RNA, 46 nt, Mus musculus
acgcgaagcucaagcuuucugagguauuucuucaguucacugagau

SEQ ID NO: 95975 - RNA, 44 nt, Mus musculus
gagcauuaucagagggacuacuccuuaauaaugcagaccuuaca

SEQ ID NO: 95976 - RNA, 45 nt, Mus musculus
uuaggggugauuucaaacuuucagucaaguccaaaauaugguagu

SEQ ID NO: 95977 - RNA, 45 nt, Mus musculus
ucuagacugcuucuaauauccaccucuuguuuuuaaaauguuaga

SEQ ID NO: 95978 - RNA, 45 nt, Mus musculus
cuugcuuagaagugaguaugaucuggaaucuacuaaugaugagau

SEQ ID NO: 95979 - RNA, 42 nt, Mus musculus
cucccacaagcuguucucugaucuccacacaugucccauggu

SEQ ID NO: 95980 - RNA, 45 nt, Mus musculus
guguaaagauaguuguuaaagcaggcauggacaucagcuggagau

SEQ ID NO: 95981 - RNA, 46 nt, Mus musculus
augaauacacuguagcugucagacacaccagaagagggcaucagau

SEQ ID NO: 95982 - RNA, 41 nt, Mus musculus
agaaaggacuaaaggaacugaagggauuugcaaccccauag

SEQ ID NO: 95983 - RNA, 46 nt, Mus musculus
cagaauauccaagauauaauuuacagaccacaugaagcucaagaag

SEQ ID NO: 95984 - RNA, 46 nt, Mus musculus
uucuggcugcauggagacaacagauacgugucauaccucucgaguc

SEQ ID NO: 95985 - RNA, 45 nt, Mus musculus
gucaggguucucuagagucacugacaaccaggaauagccacuaca

SEQ ID NO: 95986 - RNA, 46 nt, Mus musculus
caggagcuguagguuacggauggucaugauagaagauggccaagag

SEQ ID NO: 95987 - RNA, 46 nt, Mus musculus
auaaaaaacuacuuaagacuuaaucuucucagagagagccagaugu

SEQ ID NO: 95988 - RNA, 44 nt, Mus musculus
gagguuguucucuauacacacacacacacacacacacacacaca

SEQ ID NO: 95989 - RNA, 45 nt, Mus musculus
ccaauuuaggguacuuaaaugaguacauguauaugcucacacaca

SEQ ID NO: 95990 - RNA, 45 nt, Mus musculus
aaaaaaauguaaaaccaggucagaagauuggagaaacaaaagagg

SEQ ID NO: 95991 - RNA, 45 nt, Mus musculus
ugugaagaugccaggcaugcauaacaaauaggaauuugaguuaaa

SEQ ID NO: 95992 - RNA, 23 nt, Mus musculus
augaucgguguugaagguguuuu

SEQ ID NO: 95993 - RNA, 46 nt, Mus musculus
gaaauggaaaaagcaguauaauacucagaaaaaagcacagaaaggc

SEQ ID NO: 95994 - RNA, 41 nt, Mus musculus
uacuauguagaaacucugugugugugugugugugugugugu

SEQ ID NO: 95995 - RNA, 46 nt, Mus musculus
cuuaggcugggacauaagauauggcuuguuacccuagugcuuaggc

SEQ ID NO: 95996 - RNA, 33 nt, Mus musculus
aagagguauaugagcugucugucacuuagacug

SEQ ID NO: 95997 - RNA, 46 nt, Mus musculus
cagcaaugggccuguuaugugaugggaaacuaaaauguggagaggu

SEQ ID NO: 95998 - RNA, 42 nt, Mus musculus
ucuuccuugggaauugguuaaucagcugagauaggccacagu

SEQ ID NO: 95999 - RNA, 41 nt, Mus musculus
aauccagggacuuauaugaaacuacaccccuaacccauaga

SEQ ID NO: 96000 - RNA, 46 nt, Mus musculus
uuguacugcuaagacagaaacucagauuaaaacacuagcccaaguu

SEQ ID NO: 96001 - RNA, 23 nt, Mus musculus
cagaccaagggaaaccaucuuug

SEQ ID NO: 96002 - RNA, 46 nt, Mus musculus
cuacaaagucuucaguuucucuuuguuucuuccccgacccagagau

SEQ ID NO: 96003 - RNA, 47 nt, Mus musculus
ggcugucuccugagagaggcccugccagagccuuacaaauacagaga

SEQ ID NO: 96004 - RNA, 42 nt, Mus musculus
auuugacaaguaagagaaaaauauugagaguuggggcagaaa

SEQ ID NO: 96005 - RNA, 44 nt, Mus musculus
cuggacuauguagccagacugucaaauugagaagaaggauaagg

SEQ ID NO: 96006 - RNA, 45 nt, Mus musculus
gaguuugccaugagagauccauuagaugguguauuuuuggugaga

SEQ ID NO: 96007 - RNA, 33 nt, Mus musculus
cuuuuuauauaggaagcugaaaguauaacuaga

SEQ ID NO: 96008 - RNA, 46 nt, Mus musculus
cuccaauguccuuguguaggucuccagcaaaagguguggcccagau

SEQ ID NO: 96009 - RNA, 46 nt, Mus musculus
cagcuguacaauaggguuaguauaaaaugaaguuuauuuuggagca

SEQ ID NO: 96010 - RNA, 46 nt, Mus musculus
uugaauugacuugauuacuauagcuguggaacaaauaguagaagau

SEQ ID NO: 96011 - RNA, 43 nt, Mus musculus
gaaggagauguggggugugggagggacccaaacuaucuggauu

SEQ ID NO: 96012 - RNA, 45 nt, Mus musculus
cuaucuauagauauaagaacagauauuuagcauguaguuagaaau

SEQ ID NO: 96013 - RNA, 48 nt, Mus musculus
aaaauuaauauacauaacuaaauuuaaauuuuuuagcuuaggaauaaa

SEQ ID NO: 96014 - RNA, 46 nt, Mus musculus
caaagacuucauuuuaagauuuaaucuuagcuaagaggcccaaaag

SEQ ID NO: 96015 - RNA, 48 nt, Mus musculus
aaugcuaacacucgaacuucaacaaaaugucaauacuacccauagauc

SEQ ID NO: 96016 - RNA, 45 nt, Mus musculus
aagaauugacuguguuugaaaccaaauaucuuuuaggccagugua

SEQ ID NO: 96017 - RNA, 42 nt, Mus musculus
cauguaugugguugcugggauuugaacucaggaccuucggaa

SEQ ID NO: 96018 - RNA, 42 nt, Mus musculus
uuuaagugccuacuauaaggcauuguucuuuagccagguggu

SEQ ID NO: 96019 - RNA, 45 nt, Mus musculus
gaaaauguugugggaaaaggggugagaaaaauguaagagccagag

SEQ ID NO: 96020 - RNA, 46 nt, Mus musculus
aacugcuuucugauucaguugaaugccuguuuuaugguugggagau

SEQ ID NO: 96021 - RNA, 71 nt, Mus musculus
ggagagggagagaggagagguuuguagguuuguauaugugugugaagggcugaggagagaauacaagggua

SEQ ID NO: 96022 - RNA, 45 nt, Mus musculus
aaacuacucuuuugugucagaaagcagauagugcuuacagggaga

SEQ ID NO: 96023 - RNA, 45 nt, Mus musculus
aauacacaugcacagaaauuaacuucaaauaagcauaggccuaga

SEQ ID NO: 96024 - RNA, 46 nt, Mus musculus
cauucuucucaacaaaugguacuagaccaacuggggagccauguac

SEQ ID NO: 96025 - RNA, 45 nt, Mus musculus
auuggagcuugggcaauuguuggaauaaaaagguggacagggaag

SEQ ID NO: 96026 - RNA, 38 nt, Mus musculus
ccuuugucauuuuuagcuggaagaauuuacuuagggaa

SEQ ID NO: 96027 - RNA, 46 nt, Mus musculus
gcuuuuucuuuauaauaagcaacuuuuucuuuuuauccuguuagaa

SEQ ID NO: 96028 - RNA, 46 nt, Mus musculus
acauccauuugcccaagauaaauucauuguuuguaauagcugagua

SEQ ID NO: 96029 - RNA, 46 nt, Mus musculus
cccaggugggguagucucuggaugguuuauccuuucaucuuagcuc

SEQ ID NO: 96030 - RNA, 46 nt, Mus musculus
gagggaacucaauagagucuaccuccaguagaaagacagggcauca

SEQ ID NO: 96031 - RNA, 45 nt, Mus musculus
gagggagcagaaugaaugaaaauauguauccccaaggggugggag

SEQ ID NO: 96032 - RNA, 42 nt, Mus musculus
gggagaggggagggugaagggaaaaggagaauaugaucagau

SEQ ID NO: 96033 - RNA, 46 nt, Mus musculus
aaauggaguuuccuaaacagaacuccaauggcuuacucucuaagau

SEQ ID NO: 96034 - RNA, 48 nt, Mus musculus
aaauaaagcaucuucaauaaaugguguggucuaacuggcagucggcau

SEQ ID NO: 96035 - RNA, 40 nt, Mus musculus
aauagaaaaaagugaagauuucuagcucaaaggaccagaa

SEQ ID NO: 96036 - RNA, 46 nt, Mus musculus
caguagcccugucaaccuuauucagaaaucuauucuguaacuagua

SEQ ID NO: 96037 - RNA, 45 nt, Mus musculus
ugugaagaagcuaaaagaucugagauaauugagauaauugccagg

SEQ ID NO: 96038 - RNA, 45 nt, Mus musculus
uauauuuguguguauaugugugugugugugugugugugugugugu

SEQ ID NO: 96039 - RNA, 45 nt, Mus musculus
aguacacuguagcuguuuucagacgcaccagaagagggcaucaga

SEQ ID NO: 96040 - RNA, 45 nt, Mus musculus
aacaaaacucuuauucuagugguggaaaaggaacacaugggaaaa

SEQ ID NO: 96041 - RNA, 49 nt, Mus musculus
ggaguuugugcuagaacagcugaguugaaucagcaagccagagaucaga

SEQ ID NO: 96042 - RNA, 41 nt, Mus musculus
uaaacaagcuagacacugaugaagaccaaaugagccagaga

SEQ ID NO: 96043 - RNA, 46 nt, Mus musculus
acacuccuuuaauccuaaacaaugaagguaaaguuaguuuguagaa

SEQ ID NO: 96044 - RNA, 46 nt, Mus musculus
aacucaaguaccucugcggugagguacuccaggauggcugcgcugu

SEQ ID NO: 96045 - RNA, 46 nt, Mus musculus
ucuaugguaauugagaguuuugcuggguaugguagucuggguuggc

SEQ ID NO: 96046 - RNA, 46 nt, Mus musculus
gaaaagaaguuuguugcaaucaaggagaugaaaaggaguuggagau

SEQ ID NO: 96047 - RNA, 46 nt, Mus musculus
cuugguaauguguaagaaucacccgggugguacugguuuugaaggu

SEQ ID NO: 96048 - RNA, 46 nt, Mus musculus
gacaauucacauugguuagcuggaucuaagaaauuagcggugauua

SEQ ID NO: 96049 - RNA, 46 nt, Mus musculus
aauaugcuuggcccagggaguggcacuauuaggagguguggacuua

SEQ ID NO: 96050 - RNA, 46 nt, Mus musculus
uuauuuaugguggagguaaauguacacaucuuacucagggugaacc

SEQ ID NO: 96051 - RNA, 46 nt, Mus musculus
uaacuaaauauauuucaaacaagaggguguaguccucuccagagaa

SEQ ID NO: 96052 - RNA, 44 nt, Mus musculus
auauauacuguguguaaacucugcuguuauaaaggccuguagau

SEQ ID NO: 96053 - RNA, 46 nt, Mus musculus
auuguguaguuaaaucuucuucuucccuccuucccucccucucucc

SEQ ID NO: 96054 - RNA, 45 nt, Mus musculus
cuguuuauucucaaguauccaguguauguggcuccuuuagucaga

SEQ ID NO: 96055 - RNA, 46 nt, Mus musculus
guuucaucugcaugucacaggugugcaguguccaugguggccaaaa

SEQ ID NO: 96056 - RNA, 46 nt, Mus musculus
caauauuaauagauuauuauuaaauucucucuuuccagcccuuuuc

SEQ ID NO: 96057 - RNA, 25 nt, Mus musculus
auucaacuuuuuacauuuuagggau

SEQ ID NO: 96058 - RNA, 45 nt, Mus musculus
gguaguuuuaucagugucucguaacagagauacuuagagguggga

SEQ ID NO: 96059 - RNA, 46 nt, Mus musculus
aaaaagaaaaauagaaagaaaacaaacacaguaaaaaccccaagau

SEQ ID NO: 96060 - RNA, 27 nt, Mus musculus
gagcugaggagaagauuaaggguguug

SEQ ID NO: 96061 - RNA, 50 nt, Mus musculus
ugcccaacagucaaccuggauaaacuguggacauuggucagcgagcagac

SEQ ID NO: 96062 - RNA, 46 nt, Mus musculus
cucacagcagacuaucuccaggacucaugaaaucaagaagcaggug

SEQ ID NO: 96063 - RNA, 44 nt, Mus musculus
aagagaauuacucaaguccacagcauccugaaauuauuagauga

SEQ ID NO: 96064 - RNA, 45 nt, Mus musculus
gaagaaguggaggagcaggugcucaaggcagaggccgagaaagca

SEQ ID NO: 96065 - RNA, 102 nt, Mus musculus
uuuuggaaguucacacaaggagacacuugcugauaaaccagcugggaaaagccucaaggaugagauuuuauucagaugaugaaggaagggcugaguuagagg

SEQ ID NO: 96066 - RNA, 58 nt, Mus musculus
uguucuguguucugggacuugcacaaagcgccucccgcgcauuggaugagcuuucuac

SEQ ID NO: 96067 - RNA, 78 nt, Mus musculus
aacugagcuucaugcccauuccuuuggacuagguuuguggaagauaguggaggucagcaaagagagggaaaggaagaa

SEQ ID NO: 96068 - RNA, 46 nt, Mus musculus
agagggcaugacuuuagaguugguauauuggaggcacacacugaag

SEQ ID NO: 96069 - RNA, 47 nt, Mus musculus
ggauagcgcguuugagcaacuugacauaaaagcggggaauucggacu

SEQ ID NO: 96070 - RNA, 46 nt, Mus musculus
ugcuguuuaaggugaccgagaguacaggcuuccccucugccugaca

SEQ ID NO: 96071 - RNA, 57 nt, Mus musculus
gaagaagaggaugaugauggugaccucuuugcugacucugagaaggagggggacgau

SEQ ID NO: 96072 - RNA, 45 nt, Mus musculus
uuuugguguaucugugugucuguauuugcacacauguacgugggu

SEQ ID NO: 96073 - RNA, 46 nt, Mus musculus
cuugacauuuagauaccaugaguguccgauuucucccuugccccag

SEQ ID NO: 96074 - RNA, 42 nt, Mus musculus
gaaccccugcagaugguaaguccuuugcucauuaggagccuu

SEQ ID NO: 96075 - RNA, 44 nt, Mus musculus
gaaauuuagucacacuuccuccuagcaacuccggguaguuacau

SEQ ID NO: 96076 - RNA, 46 nt, Mus musculus
gggcuuugcuggcuuugaggcagguagagaaaacacaagccccaag

SEQ ID NO: 96077 - RNA, 42 nt, Mus musculus
uaucuguggaagagaagaagugugugucugugugucugugug

SEQ ID NO: 96078 - RNA, 55 nt, Mus musculus
gacaaagucaaguccacugccauuaucuuugaugaugacgaaggagaucuguuua

SEQ ID NO: 96079 - RNA, 66 nt, Mus musculus
aagaaaaagcagaagcuuugccggcagcuucugugagccagacacaugaaagcaaaacgcgggcag

SEQ ID NO: 96080 - RNA, 45 nt, Mus musculus
ucuggcagcaccucucaggagacagcuauaucaggcuccugucag

SEQ ID NO: 96081 - RNA, 45 nt, Mus musculus
cuucucaaaguucaaguaagccaaaaagugcaucacuuccaucca

SEQ ID NO: 96082 - RNA, 46 nt, Mus musculus
aaaguguuuaaguaauguguuaaacauuaauacauucaaaauggag

SEQ ID NO: 96083 - RNA, 105 nt, Mus musculus
ugacaaagaacaacguuugggagaagcacaguaggacuggagagaggucugcagugaagcugaaggggagaggucugcagugaagcugaaggggagaggucugca

SEQ ID NO: 96084 - RNA, 167 nt, Mus musculus
gugaagcugaaggggagaggucugcagugaagcugaaggggagaggucugcagugagaagcugaaggggagaggucugcagugaagcugaaggggagaggucugcagugaagcugaaggggagaggucugcagugagaagcugaaggggagaggucugcagugaagc

SEQ ID NO: 96085 - RNA, 89 nt, Mus musculus
cugaaggggagaggucugcagugaagcugaaggggagaggucugcagugaagcugaaggggagaggucugcagugaagcugaaggggag

SEQ ID NO: 96086 - RNA, 105 nt, Mus musculus
aggucugcagugagaagcugaaggggagaggucugcagugaagcugaaggggagaggucugcagugaagcugaaggggagaggucugcagugaagcugaagggga

SEQ ID NO: 96087 - RNA, 46 nt, Mus musculus
gaggucugcagugagaagcugaaggggagaggucugcagugaugcu

SEQ ID NO: 96088 - RNA, 51 nt, Mus musculus
ucugcagugagaagcugaaggggagaggucugcagugaagcugaaggggag

SEQ ID NO: 96089 - RNA, 49 nt, Mus musculus
gcagugaagcugaaggggagaggucugcagugagaagcugaaggggaga

SEQ ID NO: 96090 - RNA, 46 nt, Mus musculus
gaaagccuggguuuaauccccagguacggucugaguuucugguacu

SEQ ID NO: 96091 - RNA, 41 nt, Mus musculus
ccaagaagcaaagcugugaaagaccaaccuauuugaggagg

SEQ ID NO: 96092 - RNA, 41 nt, Mus musculus
cagacagacagacagacagacagacagacagacagggcugc

SEQ ID NO: 96093 - RNA, 78 nt, Mus musculus
agagcccugugugugugccgcuggagagcccugugugugugccgcuggagagcccugugugugugccgcuggagagcc

SEQ ID NO: 96094 - RNA, 98 nt, Mus musculus
cugugugugugccgcuggagagcccugugugugugccgcuggagagcccugugugugugccgcuggagagcccugugugugugccgcuggagagcccu

SEQ ID NO: 96095 - RNA, 69 nt, Mus musculus
gugugugugccgcuggagagcccugugugugugccgcuggagagcccugugugugugccgcuggagagc

SEQ ID NO: 96096 - RNA, 45 nt, Mus musculus
aguguccccagaaguggggagugcugauguggccagcauagcaca

SEQ ID NO: 96097 - RNA, 74 nt, Mus musculus
gugcuuaguuuguuugaugaggaugaggacaaaguagaggaugaaagcagcaccugugcaccacaggacggacg

SEQ ID NO: 96098 - RNA, 45 nt, Mus musculus
gaaaacaguggaaaucaggcaucgugugaaaacaguggaaaucag

SEQ ID NO: 96099 - RNA, 45 nt, Mus musculus
gaaaacaguggaaaucaggcaucgugugaaaacaguggaaaucaa

SEQ ID NO: 96100 - RNA, 45 nt, Mus musculus; identical to SEQ ID NO: 96098

SEQ ID NO: 96101 - RNA, 45 nt, Mus musculus; identical to SEQ ID NO: 96098

SEQ ID NO: 96102 - RNA, 45 nt, Mus musculus; identical to SEQ ID NO: 96098

SEQ ID NO: 96103 - RNA, 46 nt, Mus musculus
uaagugggguguccauguuagaagcugguucugucagggaauaggg

SEQ ID NO: 96104 - RNA, 46 nt, Mus musculus
aaaacagaaccagcacagguuaggacugaucuccgugagggcccag

SEQ ID NO: 96105 - RNA, 46 nt, Mus musculus
acugagaauucuuaguuaaggaggaaauggccaccaacacccccuc

SEQ ID NO: 96106 - RNA, 45 nt, Mus musculus
uuaaaagcagagagccauccagucgcaucgggaaaauacaaguaa

SEQ ID NO: 96107 - RNA, 46 nt, Mus musculus
gugaguuuugaucuuccagcccaggcagacaccuuacacagugcaa

SEQ ID NO: 96108 - RNA, 45 nt, Mus musculus
gccuggcugcccaggaguccagugaggcugaggaugugacuguag

SEQ ID NO: 96109 - RNA, 46 nt, Mus musculus
ccacggccccaccuugggaagguggaccuguuuuaucugcagccga

SEQ ID NO: 96110 - RNA, 45 nt, Mus musculus
agcagaggaucacaguccguggagggagcaggcgucauggccggg

SEQ ID NO: 96111 - RNA, 46 nt, Mus musculus
gaagagccuggcauuuccugaucucagugagggcagcagcaccgag

SEQ ID NO: 96112 - RNA, 42 nt, Mus musculus
gugucugagugugguaucugcaugugggauggauccccaggu

SEQ ID NO: 96113 - RNA, 45 nt, Mus musculus
gcagcagguccucucgcaggcccauggugucgaacgugagggucc

SEQ ID NO: 96114 - RNA, 45 nt, Mus musculus
uuggguuucucgaaccuggauauccaagcacuggagcacugagau

SEQ ID NO: 96115 - RNA, 46 nt, Mus musculus
ccagcaucuugauagcccgugucgguaaacuucuccggcggaucau

SEQ ID NO: 96116 - RNA, 41 nt, Mus musculus; identical to SEQ ID NO: 92475

SEQ ID NO: 96117 - RNA, 49 nt, Mus musculus; identical to SEQ ID NO: 92476

SEQ ID NO: 96118 - RNA, 45 nt, Mus musculus
uauuuauuuauuuauuuuuguuuccuaggagaaagauuucgguuu

SEQ ID NO: 96119 - RNA, 42 nt, Mus musculus
ucgucacaaguuaguuugccuuaguuucuugauugcccagau

SEQ ID NO: 96120 - RNA, 42 nt, Mus musculus
guugucucuuggagacccgcuuuuuuucugaagggaaacgga

SEQ ID NO: 96121 - RNA, 46 nt, Mus musculus
accauuaaauuauuuauuauuuggugauagcagguuugucuaccag

SEQ ID NO: 96122 - RNA, 46 nt, Mus musculus
caccuuccggagcagaugauacuauuucuguaaguucacccuggau

SEQ ID NO: 96123 - RNA, 45 nt, Mus musculus
ugccuaguccgagggaaauguucuguaaaagaauagucaguugcu

SEQ ID NO: 96124 - RNA, 42 nt, Mus musculus
auccggcagagggaggcuccuuuauccaguucagugccaggg

SEQ ID NO: 96125 - RNA, 42 nt, Mus musculus
ugaugaaaauaauaauaauaauaauaauaacgaauaagccag

SEQ ID NO: 96126 - RNA, 42 nt, Mus musculus
gaauauauuuguagucaauucauauauuugaaguggagccau

SEQ ID NO: 96127 - RNA, 46 nt, Mus musculus
auuacuggaguugagucuggggaucacaugaggauguuaggagaac

SEQ ID NO: 96128 - RNA, 44 nt, Mus musculus
gaaaaaguggggaaaaaagaaaagauaggaaaaaagaagcgaca

SEQ ID NO: 96129 - RNA, 46 nt, Mus musculus
cagaagaggucuuggugcucaggagguggucucuggagcugcaggu

SEQ ID NO: 96130 - RNA, 42 nt, Mus musculus
auggauggauggaugagacagaaugaugagcaugguggguug

SEQ ID NO: 96131 - RNA, 31 nt, Mus musculus
cacaaagcagacuguaugucuccaccccuuu

SEQ ID NO: 96132 - RNA, 45 nt, Mus musculus
ccuggcccauuuuaagguaaucucauucuucaaaauguuccauag

SEQ ID NO: 96133 - RNA, 42 nt, Mus musculus
uuguuucaguucugucucccagauaaugugaaaacgguccag

SEQ ID NO: 96134 - RNA, 43 nt, Mus musculus
ucuuccuaacugaagaaguuaaugacacaaggguugagauuug

SEQ ID NO: 96135 - RNA, 41 nt, Mus musculus
gcuaggccaggagagcagaguucacgccuagggagagagcc

SEQ ID NO: 96136 - RNA, 46 nt, Mus musculus
ggcuucuucaagguuagaagucacuugcaccuuucucuggcaauag

SEQ ID NO: 96137 - RNA, 45 nt, Mus musculus
aggugggguucggggaaggccagcccgcggucacgccggcugugg

SEQ ID NO: 96138 - RNA, 44 nt, Mus musculus
uccgggugcucggggcgugggccgagcggggagcggaccgggga

SEQ ID NO: 96139 - RNA, 41 nt, Mus musculus
gccgucccgcgagcgcgccuguggggguuuccauggugaca

SEQ ID NO: 96140 - RNA, 41 nt, Mus musculus
gguccggaugugagugggagcguggagccgagaagccggag

SEQ ID NO: 96141 - RNA, 42 nt, Mus musculus
cucugucagcggccccccggcaggcccgggcggugguuguag

SEQ ID NO: 96142 - RNA, 46 nt, Mus musculus
uuagauccuccugcguuaagcccccugagcgauuaagugcggccac

SEQ ID NO: 96143 - RNA, 45 nt, Mus musculus
cgacacccaauacuugcuuuuuuucuuuugaccaugggcucgagg

SEQ ID NO: 96144 - RNA, 45 nt, Mus musculus
ggaaaggcuccaagagggaaacuucuaggugaccagguaaaguac

SEQ ID NO: 96145 - RNA, 84 nt, Mus musculus
gguugagaacaaaaagaugcaccuggacuuuccccggagcccucugcguuuuuaaggcgucggguggaguuugaguucguaagc

SEQ ID NO: 96146 - RNA, 42 nt, Mus musculus
aggguguagugguucuguugguccuagaacuuuauccccgua

SEQ ID NO: 96147 - RNA, 42 nt, Mus musculus
ggcucagacucaggcuggaucgaugucccucuucuccuaggu

SEQ ID NO: 96148 - RNA, 42 nt, Mus musculus
guacugugaggcaaugucuccucuuugcccccacccccagac

SEQ ID NO: 96149 - RNA, 70 nt, Mus musculus
guggcuuugugggacgucuuuacaagcacccacuugcccuauaaauacgugcuugcccacauggcacuua

SEQ ID NO: 96150 - RNA, 45 nt, Mus musculus
uagguacgucauguaauagcaucucauggggacaagugccaugag

SEQ ID NO: 96151 - RNA, 46 nt, Mus musculus
ccucauuuacauugcuugugacaccccuugugcagcugaguuuuag

SEQ ID NO: 96152 - RNA, 45 nt, Mus musculus
acacccaggguagagccagugcuggguccuggcuccuucaagcua

SEQ ID NO: 96153 - RNA, 46 nt, Mus musculus
aaagggggccuccucagucuaccuaggucuuacgagaaagcuccag

SEQ ID NO: 96154 - RNA, 46 nt, Mus musculus
ucuuaucaaauguacaauauauucauuuacuaguauucauguagau

SEQ ID NO: 96155 - RNA, 81 nt, Mus musculus
cuaaagaaaaaauauaugaucugcugaauuuaaaaagagaaaaaggaagaaaaaguagaagugggacuuuuugggagagag

SEQ ID NO: 96156 - RNA, 46 nt, Mus musculus
ugagugggcuuuagguucaguuagacacuguugguuacccccaagg

SEQ ID NO: 96157 - RNA, 46 nt, Mus musculus
guucuuugauuuugaccagugcuggucucugugauagucuccaugu

SEQ ID NO: 96158 - RNA, 50 nt, Mus musculus
uccuacaagucuguugcugaaggaagucaagucaggaacugggagugagg

SEQ ID NO: 96159 - RNA, 32 nt, Mus musculus
gcuuguuuccauggccacugugguucucacac

SEQ ID NO: 96160 - RNA, 45 nt, Mus musculus
acaugguggagcacagccaagcacagcaguacgcgcgggaggucg

SEQ ID NO: 96161 - RNA, 42 nt, Mus musculus
ucuacaucuggguaaaaaaaaucagcugcuucagcaggaguu

SEQ ID NO: 96162 - RNA, 45 nt, Mus musculus
auguugucacacugugcuuacagauaguguguacugucccuagag

SEQ ID NO: 96163 - RNA, 42 nt, Mus musculus
caauccaagagcaucaggccuaucuagagagggacugggaga

SEQ ID NO: 96164 - RNA, 42 nt, Mus musculus
cagcaguggugcugugggaacgaacgcacacagugggcagug

SEQ ID NO: 96165 - RNA, 46 nt, Mus musculus
uugaacuugaaaaauccaaguucgaaauuacaauuaaaaagcaauc

SEQ ID NO: 96166 - RNA, 47 nt, Mus musculus
gcgcgggaucaacacagagaggcuguacaccaugcugagaagaugga

SEQ ID NO: 96167 - RNA, 46 nt, Mus musculus
guaguugugaggcaacuccagcaagaauuggcugauacccuaaaaa

SEQ ID NO: 96168 - RNA, 53 nt, Mus musculus
gugagugcagccaucuaagagaaagacugugucaguacgagaacgagaaagcc

SEQ ID NO: 96169 - RNA, 70 nt, Mus musculus
cuaaccagguuccaagcugagagucagcggcacagccugaggcuagaagacagaaaccaggaguuaguca

SEQ ID NO: 96170 - RNA, 124 nt, Mus musculus
uggcguuaaagcaugcgcagagagaccugagccagacccagugccagaugaaggagguggagcacauguuucaggacgaacaaggcaaagugagcaaguucauggggaagcaggaguccauaga

SEQ ID NO: 96171 - RNA, 47 nt, Mus musculus
acaaugagguucucucccaacagcuuucuaaaacugaaaggaaguug

SEQ ID NO: 96172 - RNA, 45 nt, Mus musculus
agacagcaaaaagagaccuagaaauugcuuuccagagagcgagag

SEQ ID NO: 96173 - RNA, 58 nt, Mus musculus
cuuaaagcugagaacacaaugcugaguucuaagcuggacaacgaaaaacaaaauaagg

SEQ ID NO: 96174 - RNA, 88 nt, Mus musculus
uugcuguguuacgacuggaaauggacacaauaaaaagccauaaccaggagaaggaaaagagguaucuugaggauauuaagauugcaaa

SEQ ID NO: 96175 - RNA, 56 nt, Mus musculus
uagucaugaaaaagaaaaagaucuauugcauaaaaaccagaggcugcaggaugaag

SEQ ID NO: 96176 - RNA, 48 nt, Mus musculus
acaagaugggauucuugcaagucaccucugcaagcaaaaggagauaga

SEQ ID NO: 96177 - RNA, 46 nt, Mus musculus
cagcuugaagccucucucagaacccuggagauggagcugaagacgg

SEQ ID NO: 96178 - RNA, 42 nt, Mus musculus
ucaucaagagcauaugggcuuuagaagagauuaacagcagag

SEQ ID NO: 96179 - RNA, 46 nt, Mus musculus
guuuuuaauuuuauuaauuuggauagucuuguuuaacucggcuaaa

SEQ ID NO: 96180 - RNA, 71 nt, Mus musculus
auaagggauugcagaaggaaaugucagagacagaagaagugaagucacgguuggaacaugaaaaggucgga

SEQ ID NO: 96181 - RNA, 57 nt, Mus musculus
uuaaaagaagccacugugaacuacuuacaggaaaacugaaaagaauggaaaacaaau

SEQ ID NO: 96182 - RNA, 42 nt, Mus musculus
ggauucuuaaugguuuuguuuuuuuuuauuuuaggcccacaa

SEQ ID NO: 96183 - RNA, 45 nt, Mus musculus
ugacugauuuaauagucuucuuuaaaaucagaauguuuguguagu

SEQ ID NO: 96184 - RNA, 46 nt, Mus musculus
gaaggaagcaaagaaaauggaaaaugaaaaauggguauccagagag

SEQ ID NO: 96185 - RNA, 46 nt, Mus musculus
gagaagaacagacaaggcucaguggcagcgaggacagccagcagaa

SEQ ID NO: 96186 - RNA, 47 nt, Mus musculus
gccuaccaucgaaaggagggcuccuguucugaacaaaacggagacag

SEQ ID NO: 96187 - RNA, 46 nt, Mus musculus
guuuuucauugaauagauuucugauacauggguggccuuagcagag

SEQ ID NO: 96188 - RNA, 37 nt, Mus musculus
gcauuucuuuguaaauucucaauauuagcccccuguu

SEQ ID NO: 96189 - RNA, 56 nt, Mus musculus
cgagagugugucacugaaagacguaggucacuucucugggacugcagaucaaacgg

SEQ ID NO: 96190 - RNA, 45 nt, Mus musculus
ucacucaggaugauaguuucuagauccauccauuugccugcuaau

SEQ ID NO: 96191 - RNA, 42 nt, Mus musculus
gaagguggaggcugggaaugggaaagugagugagcuggaaaa

SEQ ID NO: 96192 - RNA, 46 nt, Mus musculus
aaaacaacauuccuggggauggagaucuuuuuacuuuggcccugaa

SEQ ID NO: 96193 - RNA, 46 nt, Mus musculus
caugaccaaccauuauaaaagaacaauuuaucuuccacugcaauua

SEQ ID NO: 96194 - RNA, 72 nt, Mus musculus
acagguaaaaccuggugugauaacaaacacucagaaauacaaguggaagaggaggagaaggaggaagaagga

SEQ ID NO: 96195 - RNA, 45 nt, Mus musculus
gauucagugaaagaccuugucucgaaacaggaaguggagccuaau

SEQ ID NO: 96196 - RNA, 46 nt, Mus musculus
gccacccagaaguggugacucucuuaguagagagaaaaugugagau

SEQ ID NO: 96197 - RNA, 46 nt, Mus musculus
aaaacuagcaacauuucuaugucacuaaaauaaaucccugauagaa

SEQ ID NO: 96198 - RNA, 46 nt, Mus musculus
gccaaagugcagcauauccuuauccuuggaaaaaguggcgugaacg

SEQ ID NO: 96199 - RNA, 46 nt, Mus musculus
cuguaauuuugcuacucuucuuauuguaaugcaauuauguuuggag

SEQ ID NO: 96200 - RNA, 45 nt, Mus musculus
agcacacauuaaauucugaauuagaauaaucucauuacuaguuaa

SEQ ID NO: 96201 - RNA, 94 nt, Mus musculus
gguguguuuuccuggcguucuguaaguucccucugccuuagaaugaagagacguacagaugggauguguuugcuuuguuucuaggagaagacug

SEQ ID NO: 96202 - RNA, 47 nt, Mus musculus
gcaguuuuacuuccaugaauaacagccaaauccaucugaaauuacca

SEQ ID NO: 96203 - RNA, 46 nt, Mus musculus
uugaacacuacgcacugccaagagauaagaggugcacuguuaggaa

SEQ ID NO: 96204 - RNA, 45 nt, Mus musculus
aagcagaacuaggguaaccaguucugggaacacagcaugggaaca

SEQ ID NO: 96205 - RNA, 42 nt, Mus musculus
caucguauuauuucuauugguuaauguugagaugaugguaau

SEQ ID NO: 96206 - RNA, 42 nt, Mus musculus
cuuuuugcauuaauugcccaguaaugugaguuauaugcuagg

SEQ ID NO: 96207 - RNA, 45 nt, Mus musculus
agccagagcggaaggugaaugaaagaacauuacuuuaaaggcauc

SEQ ID NO: 96208 - RNA, 45 nt, Mus musculus
aagaagggaaagaaggaaagaauggagggagagaaggaaggauag

SEQ ID NO: 96209 - RNA, 45 nt, Mus musculus
aacuguauggauagguuacacuuucuuuuaaaauuucggcccaag

SEQ ID NO: 96210 - RNA, 42 nt, Mus musculus
ggaaguccgaaucaguucauguuaguuuagcagucgguacag

SEQ ID NO: 96211 - RNA, 46 nt, Mus musculus
gagugaugugaggucccauuguaauuuugauuagcauuacccugau

SEQ ID NO: 96212 - RNA, 46 nt, Mus musculus
ggugaggaaagucuguuuccuugcuuaaaaugaagucauucugcag

SEQ ID NO: 96213 - RNA, 46 nt, Mus musculus
gaaagggaauaacauuugaaauguaaauaaagaaaauauucaauua

SEQ ID NO: 96214 - RNA, 54 nt, Mus musculus
uggugcauaugcacuguggaguacaauucagcuguaaagagaaaugaaaucaug

SEQ ID NO: 96215 - RNA, 50 nt, Mus musculus
uaaagggggagaacuaggaaacguccugaguaaggcaggccagccccaga

SEQ ID NO: 96216 - RNA, 33 nt, Mus musculus
agcuuugcccguguacuacagggagggccggcc

SEQ ID NO: 96217 - RNA, 45 nt, Mus musculus
uuuaucagcagaccagauacugugguauaacaguccugggggcag

SEQ ID NO: 96218 - RNA, 47 nt, Mus musculus
ccaggucauguaagguucgauuuuuccuccauuuaugaggccauuug

SEQ ID NO: 96219 - RNA, 42 nt, Mus musculus
caaaucucucucacccucaaccuaggacaucaugcggccacu

SEQ ID NO: 96220 - RNA, 46 nt, Mus musculus
cucucaagauacaaccacagagccacagccuuguaccugccuagaa

SEQ ID NO: 96221 - RNA, 45 nt, Mus musculus
uguguguguguaaguguguguguaucuacacacaccuaucacaga

SEQ ID NO: 96222 - RNA, 46 nt, Mus musculus
auauuugugucaucgugagaaguuacaaauuaagggaccuguaaag

SEQ ID NO: 96223 - RNA, 46 nt, Mus musculus
ucugugggucacugagcuuagauucuaaucccuguucccagcacuu

SEQ ID NO: 96224 - RNA, 45 nt, Mus musculus
gcauucaugcauacauauuuucacgccaacacacaugcaugcaca

SEQ ID NO: 96225 - RNA, 46 nt, Mus musculus
cuagagccaccagucccaccauguguuuucuuuucucgguucuuug

SEQ ID NO: 96226 - RNA, 46 nt, Mus musculus
cuuucuaaacaucugcuuugacuagaacacuuuguccuuauuugau

SEQ ID NO: 96227 - RNA, 27 nt, Mus musculus
gcgugaggggagggaaggggaggggug

SEQ ID NO: 96228 - RNA, 41 nt, Mus musculus
uuucuagcauauuauauauuaaguucagugcccggccgcuu

SEQ ID NO: 96229 - RNA, 46 nt, Mus musculus
uccuuaaggugcugugguagguaagcuauagacauugcgcccugcc

SEQ ID NO: 96230 - RNA, 46 nt, Mus musculus
gcacugcucucugucccuuccaacaccugauccuuccccccacccc

SEQ ID NO: 96231 - RNA, 46 nt, Mus musculus
gucuuuccuuuggacaggaacauuucuagguuaacaauuuugacau

SEQ ID NO: 96232 - RNA, 44 nt, Mus musculus
acggaaaacaucagacugcaaaauacaguuagcauacagcagau

SEQ ID NO: 96233 - RNA, 44 nt, Mus musculus
agaaaauuugucuguagaagggacguauuaaauaagucagcaga

SEQ ID NO: 96234 - RNA, 46 nt, Mus musculus
gcuauuauuagaaauaccaucuaaguacuguguuuauuucagagau

SEQ ID NO: 96235 - RNA, 71 nt, Mus musculus
aacuaugaggaugaccacuucagauccucccguuccaaucagacgaaccauaaacccuccccagaccaggu

SEQ ID NO: 96236 - RNA, 46 nt, Mus musculus
aacaacuuuuaaggccaccaaguugcagcaugauaaauauguagau

SEQ ID NO: 96237 - RNA, 46 nt, Mus musculus
ugaaacgggaaaaggaccgccuggugcagcagcucaaacagcaggu

SEQ ID NO: 96238 - RNA, 23 nt, Mus musculus
ucuaauaagcaccuaauaaccag

SEQ ID NO: 96239 - RNA, 46 nt, Mus musculus
agcaggcugagauaccaucucaagagagacaggaaaaaagacaggu

SEQ ID NO: 96240 - RNA, 25 nt, Mus musculus
ucuguuucacagaccauggguuuga

SEQ ID NO: 96241 - RNA, 45 nt, Mus musculus
cuggugccaucuagacgagcacuccaaaacugagcauccccaacu

SEQ ID NO: 96242 - RNA, 46 nt, Mus musculus
guguguguguguguguguguguguguguaugugugucuguggggua

SEQ ID NO: 96243 - RNA, 46 nt, Mus musculus
gcucauuuaaucuauucugccaauuaugaaauaacuuagcccagua

SEQ ID NO: 96244 - RNA, 86 nt, Mus musculus
cagauccaaacagugacaagaaaaaaaaauuagacuccagauguaauaugguauguuuguccuaugucguccuaccguccccacaa

SEQ ID NO: 96245 - RNA, 47 nt, Mus musculus
uugaccuuuagcaccacauaaaaacaacagcaacaacaacaacaagg

SEQ ID NO: 96246 - RNA, 42 nt, Mus musculus
gacaacuuacucugccugacaucucguaacugauuugaagca

SEQ ID NO: 96247 - RNA, 23 nt, Mus musculus
cacaaauuaaacagucaggauua

SEQ ID NO: 96248 - RNA, 78 nt, Mus musculus
gccguguggugauguguguugugccguguggugauguguguugcuuggauuuggaguuucacuaagacaccugccaga

SEQ ID NO: 96249 - RNA, 58 nt, Mus musculus
gugauguguguugugccguguggugauguguguugugccguguggugauguguguugu

SEQ ID NO: 96250 - RNA, 46 nt, Mus musculus
uuucaaaacaguguuucucugugcccuggcuucucuggaguucacu

SEQ ID NO: 96251 - RNA, 67 nt, Mus musculus
uagggacccagaaguccaucuuggugaguaacaauggccagaaggagcaggaagcugagcucacguc

SEQ ID NO: 96252 - RNA, 48 nt, Mus musculus
ucacaagccuaugugcacaucuaacuuacuauguccccucucaguccc

SEQ ID NO: 96253 - RNA, 42 nt, Mus musculus
gugauaggguggagaagacauggcagaggaaaggugccagaa

SEQ ID NO: 96254 - RNA, 46 nt, Mus musculus
agaagagaggaucagaucucccuagaauuacaguaagcuaacaggu

SEQ ID NO: 96255 - RNA, 46 nt, Mus musculus
ggucuauuuccaguuuucugaggaaccuccagauuaauuucuagag

SEQ ID NO: 96256 - RNA, 46 nt, Mus musculus
gccaagcuaggcuccugucuguaagcacaccauagcaugaguaagu

SEQ ID NO: 96257 - RNA, 42 nt, Mus musculus
ucugcuguccugcgcggggcagaccuuacagcaguccccguc

SEQ ID NO: 96258 - RNA, 45 nt, Mus musculus
caaccuaaaaggaucuggacuuaaggugugcucagcugcuugggu

SEQ ID NO: 96259 - RNA, 46 nt, Mus musculus
uauuauuuuguggcuuauauuucauuuguuguguguggggcuggug

SEQ ID NO: 96260 - RNA, 46 nt, Mus musculus
guaauacaaacuucagcagucagugcuccaugcuuaccugugagau

SEQ ID NO: 96261 - RNA, 46 nt, Mus musculus
gaagggggguguguguguguguguguguguguguguguguguguua

SEQ ID NO: 96262 - RNA, 46 nt, Mus musculus
guuccaucccugaggucgcuacugaagaaucugcaggcagacagca

SEQ ID NO: 96263 - RNA, 42 nt, Mus musculus
gggcauggugcucuauaacaccagcccaugagugguagaggc

SEQ ID NO: 96264 - RNA, 46 nt, Mus musculus
caaauuaaauuacaguguaaggaaacuaccaagugaauccagaaag

SEQ ID NO: 96265 - RNA, 45 nt, Mus musculus
aggaaagaauaaauuuacuuggauauauguaugaucagaggcaga

SEQ ID NO: 96266 - RNA, 46 nt, Mus musculus
cugcuucuuuguuagugcuauuugagaaagaaauuguggccuagua

SEQ ID NO: 96267 - RNA, 42 nt, Mus musculus
uaagaguaggaaaguauaugucucaacauccuagcccccugu

SEQ ID NO: 96268 - RNA, 46 nt, Mus musculus
cagcuugaaaauuugacuugagguuuuaaauccaccuaccacagau

SEQ ID NO: 96269 - RNA, 46 nt, Mus musculus
aaacaugcaacauguauguucuuuacaugacugcaaaaccccagcu

SEQ ID NO: 96270 - RNA, 42 nt, Mus musculus
cugcugcugcagaacuacuucaucaagugguaaugguuagac

SEQ ID NO: 96271 - RNA, 42 nt, Mus musculus
gaaucagccaggaccaaugcugagaaacaggucugcgauuuu

SEQ ID NO: 96272 - RNA, 86 nt, Mus musculus
uuuuccaggacagucuccguaagaaggaugacaggauugaagagcuggaagaagcacugagagaaaguguacagauaacugcagag

SEQ ID NO: 96273 - RNA, 42 nt, Mus musculus
uauccccaacccacugucaugaaacacccccugcccccaguu

SEQ ID NO: 96274 - RNA, 44 nt, Mus musculus
guaugauaaggggaaauaccgugauaugccaugugcuuguaugg

SEQ ID NO: 96275 - RNA, 42 nt, Mus musculus
uacuuagcucauuucaguuaacuugauguccucugggguuau

SEQ ID NO: 96276 - RNA, 58 nt, Mus musculus
agggagggaaucugaacacauuccaguuggguuugaacucccagaaaagcccccaauu

SEQ ID NO: 96277 - RNA, 46 nt, Mus musculus
acuuugauaggaucuuggguaagugaguggcauucagcagcgguga

SEQ ID NO: 96278 - RNA, 46 nt, Mus musculus
gugaagacagcaaaagaguuagaugugggaggauaguagagaaauc

SEQ ID NO: 96279 - RNA, 52 nt, Mus musculus
aauaagaagguagcaaaucugaaacacaaggaacagguggagaagaagaaga

SEQ ID NO: 96280 - RNA, 46 nt, Mus musculus
cauuacagagagagagagagagagacagacagacagagucacagag

SEQ ID NO: 96281 - RNA, 42 nt, Mus musculus
auagaguagaaacuguccugagauucacuauguaagccagau

SEQ ID NO: 96282 - RNA, 45 nt, Mus musculus
uuuacuuuguguguguguguguguguguguguguguguaagggcu

SEQ ID NO: 96283 - RNA, 45 nt, Mus musculus
ucuguggccggaauuaugucaguauauccaauuuuggcuuuagac

SEQ ID NO: 96284 - RNA, 46 nt, Mus musculus
ucauaaaacaaauaucguuggacauacagggauaguugguuccaga

SEQ ID NO: 96285 - RNA, 45 nt, Mus musculus
ugguggaaaugagaggcaguugguuccaaugugucugccuuuagg

SEQ ID NO: 96286 - RNA, 24 nt, Mus musculus
gcaucugggucuuccaaacucuua

SEQ ID NO: 96287 - RNA, 42 nt, Mus musculus
uccagcaaccacaugguggcucacaaccaucuacacugaggu

SEQ ID NO: 96288 - RNA, 50 nt, Mus musculus
cuugaaagaaguggaaaaugagaagaaugacaaagauaagaagauagcug

SEQ ID NO: 96289 - RNA, 46 nt, Mus musculus
accccaguaaugaacacuggcacaucaagcuucagcacacggagga

SEQ ID NO: 96290 - RNA, 32 nt, Mus musculus
cucaagacccuagaaauugcucuugagcagaa

SEQ ID NO: 96291 - RNA, 46 nt, Mus musculus
aauugaacgcuuaaaggagcagcgggacagggaugagcgggagaag

SEQ ID NO: 96292 - RNA, 48 nt, Mus musculus
uagaaaaucuucaggaacaacuaagagauaaagaaaagcagaugagca

SEQ ID NO: 96293 - RNA, 45 nt, Mus musculus
auugucuguguguugaaaucugaaugugugaaugcaggugcaagu

SEQ ID NO: 96294 - RNA, 46 nt, Mus musculus
uauucucagcaugcugccacucuccuucuguuuggauuaugcagag

SEQ ID NO: 96295 - RNA, 46 nt, Mus musculus
guguagcucuauuccuagcacugauaugcuucagggucuuccagag

SEQ ID NO: 96296 - RNA, 45 nt, Mus musculus
acccucccucaaauggaaaagcacuggcaucagagagggaucaaa

SEQ ID NO: 96297 - RNA, 27 nt, Mus musculus
gagugacagacacagaaccucagaaga

SEQ ID NO: 96298 - RNA, 46 nt, Mus musculus
agucuugacuuaauccccucaccccaacagauacacggucauuaaa

SEQ ID NO: 96299 - RNA, 46 nt, Mus musculus
uccugguucaaaggugugccaugguucugggagggaauggugauug

SEQ ID NO: 96300 - RNA, 46 nt, Mus musculus
uuucaaggucuggcccuaguuugugcauagaucuuacucaacagau

SEQ ID NO: 96301 - RNA, 25 nt, Mus musculus
aaagaaacugauggaugaugaaugu

SEQ ID NO: 96302 - RNA, 26 nt, Mus musculus
gcccuuuaugccccccagccccaccc

SEQ ID NO: 96303 - RNA, 45 nt, Mus musculus
uuuuuuuaagaaguucuguucuuucauaguuuuauugggcugaau

SEQ ID NO: 96304 - RNA, 24 nt, Mus musculus
uuuuagguacaggaauguguaaau

SEQ ID NO: 96305 - RNA, 45 nt, Mus musculus
gguguacaggagccacucaaaguuuaugaaaaauaagguauggag

SEQ ID NO: 96306 - RNA, 61 nt, Mus musculus
ugggcuccgagaccuggaagaggaaauucagaugcugaagucaaauggggcuuugaguagu

SEQ ID NO: 96307 - RNA, 46 nt, Mus musculus
agaacuagaaaaggcuuuaccuauaguucccccaaccccacuagaa

SEQ ID NO: 96308 - RNA, 46 nt, Mus musculus
aauccucuugucucauucuuaauacccaggacuauagacaugagcc

SEQ ID NO: 96309 - RNA, 46 nt, Mus musculus
uugauaguggguugauuuuguccuguguuguugguauugguggaga

SEQ ID NO: 96310 - RNA, 42 nt, Mus musculus
ucaagguguagauccucgagcgcccuguaggaguggcugaca

SEQ ID NO: 96311 - RNA, 45 nt, Mus musculus
agguauaggauaugaagcaaguuccuaaccucuuuauaccucaga

SEQ ID NO: 96312 - RNA, 46 nt, Mus musculus
aucacuacuaagcuacaaccuuuacuuuuucauuuauucccaagau

SEQ ID NO: 96313 - RNA, 45 nt, Mus musculus
uaaguacguaaguaugauauccaguuaaauacuuaaggcugaagu

SEQ ID NO: 96314 - RNA, 42 nt, Mus musculus
acaugucacauggggagccucacaggguuuugaguguggagg

SEQ ID NO: 96315 - RNA, 46 nt, Mus musculus
cuguggguagaaaugugcugugauaggauucagguuuuucaauggg

SEQ ID NO: 96316 - RNA, 46 nt, Mus musculus
ccaaacucuauaaagaacucaagaauuuagauaccagcaaccaaac

SEQ ID NO: 96317 - RNA, 45 nt, Mus musculus
uagaagaaaacauaagcaaaaaaaccuuuaaauauagucuuuggc

SEQ ID NO: 96318 - RNA, 56 nt, Mus musculus
gagagaacgcgacggcucgcagaggcggagaugcacguccaccaccucgagagucu

SEQ ID NO: 96319 - RNA, 55 nt, Mus musculus
ucuggagaugcuccagagcaaaggacuuucugccaaagcuacagaggaagaccau

SEQ ID NO: 96320 - RNA, 46 nt, Mus musculus
cacaugcagaugacaauccaggcucuccaggaugagcugcggaucc

SEQ ID NO: 96321 - RNA, 45 nt, Mus musculus
aagcacaaauuaaguuacugacaauuauagauuauuaccaugguu

SEQ ID NO: 96322 - RNA, 41 nt, Mus musculus
gcuagaaagggcuggcccacaggaugaggacaacaggaauc

SEQ ID NO: 96323 - RNA, 45 nt, Mus musculus
cuauuuaauaaagggugcuggcauaugggauauccacaugcagaa

SEQ ID NO: 96324 - RNA, 46 nt, Mus musculus
gauuauuauaaguuuaugguuuguauuaauugcuuauuggugauug

SEQ ID NO: 96325 - RNA, 46 nt, Mus musculus
aagcagcugauguauuuagcagccuugcuucuccauuugccaaguc

SEQ ID NO: 96326 - RNA, 46 nt, Mus musculus
aacuuguucuggaaaguuuuagcugaaaacaguuuaacgucuaggu

SEQ ID NO: 96327 - RNA, 46 nt, Mus musculus
aguguugggaauaaaggcuugugucaccauaccugcccucucauuc

SEQ ID NO: 96328 - RNA, 45 nt, Mus musculus
uuuaaaaaccauuuuuauuuuguuuuuuagcaucucagcccagga

SEQ ID NO: 96329 - RNA, 46 nt, Mus musculus
ugguugugauuugcuuuaauagucucguuuguuucaaagguaaguu

SEQ ID NO: 96330 - RNA, 46 nt, Mus musculus
cauguuccucaucugauugguuacucucucaguaccucacagaacc

SEQ ID NO: 96331 - RNA, 46 nt, Mus musculus
cagcaagaaugaagccacaauaggauccuucuguacacguuuauug

SEQ ID NO: 96332 - RNA, 45 nt, Mus musculus
ggcacacauuugugagauguucuugaagaacucauugggcaaaga

SEQ ID NO: 96333 - RNA, 42 nt, Mus musculus
aaugcuauucaagggcagccuuuguugcugccagcagaggug

SEQ ID NO: 96334 - RNA, 41 nt, Mus musculus
ugcccaccuuugauuccagcacucaggaggcaggggcaggu

SEQ ID NO: 96335 - RNA, 56 nt, Mus musculus
uaaguucaucaaugaauaguaucaagaccuucuggagcccagaguuaaagaaagag

SEQ ID NO: 96336 - RNA, 97 nt, Mus musculus
agagauaacaccaucauggaucugcagacacagcugaaggaaguauuaagagaaaacgaucuuuugaggaaagauguggaaguaaaggagagcaaau

SEQ ID NO: 96337 - RNA, 61 nt, Mus musculus
agaacaucaccucccuccuguuaguauggcaucuacuguaccucacucucuucgucaggca

SEQ ID NO: 96338 - RNA, 45 nt, Mus musculus
cucgguccccucgcuuaggucaucggcgaacaaauaguacaggag

SEQ ID NO: 96339 - RNA, 47 nt, Mus musculus
guuuuuuucuucauaccauuucuggcaccuaaguucacccugcaacc

SEQ ID NO: 96340 - RNA, 44 nt, Mus musculus
uccccguacccccagcccccguuccuuugggaccccuugacuga

SEQ ID NO: 96341 - RNA, 41 nt, Mus musculus
cugauaugauuuaauaaaaauaguuaaugugcacccugagg

SEQ ID NO: 96342 - RNA, 46 nt, Mus musculus
cuuaauaaaacuauuuaagauguuauuuggcugugggccuggugga

SEQ ID NO: 96343 - RNA, 45 nt, Mus musculus
ugaaguuggcgccugugcauccugagaugguugucagcagucagu

SEQ ID NO: 96344 - RNA, 46 nt, Mus musculus
caagugauugaauggcugaagccagaaaauagaguugcuuacugag

SEQ ID NO: 96345 - RNA, 45 nt, Mus musculus
agugcauuggacaaucucucaggcuucuuugugugugugugugug

SEQ ID NO: 96346 - RNA, 46 nt, Mus musculus
uguuuuuguuuuguuuuguuuuguuuuguuugaauaaccagaacaa

SEQ ID NO: 96347 - RNA, 26 nt, Mus musculus
augugaauggcucagaccgugauagg

SEQ ID NO: 96348 - RNA, 45 nt, Mus musculus
ucaugaacagacuuucaucuaccagaaaaaauaacuaccuguaga

SEQ ID NO: 96349 - RNA, 46 nt, Mus musculus
guaaaauguuuaagaugaucuuauuauuuugaaccugguuagauag

SEQ ID NO: 96350 - RNA, 42 nt, Mus musculus
cuggcugggcagggcagagcgccccuggggaggggcggagcu

SEQ ID NO: 96351 - RNA, 45 nt, Mus musculus
acugaggcgagggucuuuugccaugaccgcuuggacagcccagau

SEQ ID NO: 96352 - RNA, 45 nt, Mus musculus
gacccucgccucaguagguggcuuuuuuugcaaggaucauuccag

SEQ ID NO: 96353 - RNA, 42 nt, Mus musculus
gcguuaccuuuuuuauuuagcccucacaccaagcaaggcgaa

SEQ ID NO: 96354 - RNA, 46 nt, Mus musculus
caggucgugcuaccaaaguguugacucauuuauuccuuuugggagc

SEQ ID NO: 96355 - RNA, 60 nt, Mus musculus
cuguaagagucuuguucuuuuuaaguuggucgaggcccaaagauacaagugagagcugaa

SEQ ID NO: 96356 - RNA, 45 nt, Mus musculus
acuuaaaaucuagcccacuccccucuuuuuguuuaaucucuucua

SEQ ID NO: 96357 - RNA, 83 nt, Mus musculus
aagcuuguuugaagugaugcuuggccagugaacaaacgagaucuagaagagauuaaacaaaaagaggggagugggcuagauuu

SEQ ID NO: 96358 - RNA, 46 nt, Mus musculus
cagucguuucaauuuugccuagagcagguguaaggugagcacagug

SEQ ID NO: 96359 - RNA, 42 nt, Mus musculus
uguggaaagaaaucuuagguccacaugaccccagcaguggau

SEQ ID NO: 96360 - RNA, 45 nt, Mus musculus
gaaaacaauaacguucccugcggacauguaacuuugccaucaguu

SEQ ID NO: 96361 - RNA, 46 nt, Mus musculus
ugcuuaaagcauuaaugaccuauguaagaaaggguugcaaccccag

SEQ ID NO: 96362 - RNA, 60 nt, Mus musculus
cucaacaaugcacaccuuaagacaaagguucucucccacucugaucccuacccccacuuu

SEQ ID NO: 96363 - RNA, 47 nt, Mus musculus
cuugagacugcuuuucuguuuuuguaccccucaguaaggccuagaac

SEQ ID NO: 96364 - RNA, 45 nt, Mus musculus
ucaugggaacacacagcugcccaggagcagagaacuuccuugcca

SEQ ID NO: 96365 - RNA, 46 nt, Mus musculus
aguagccaggcugcccaggcucagccuccugcuaugacuuccagua

SEQ ID NO: 96366 - RNA, 91 nt, Mus musculus
ugggauauaacuuuggggaaaggggaaaaugucauaggguaaugauuggcaagccacggaauggggagaauauuugggaagccaugcagga

SEQ ID NO: 96367 - RNA, 46 nt, Mus musculus
aaagaaguacugugcacugggcaaguuauauaguacaaaggcagag

SEQ ID NO: 96368 - RNA, 46 nt, Mus musculus
gaugggguuuccagacagcauguaugcuguggcauucguucuuuag

SEQ ID NO: 96369 - RNA, 46 nt, Mus musculus
ugguuucaggugaaaacuuuuaaacaaagcauguagcaucuccuua

SEQ ID NO: 96370 - RNA, 42 nt, Mus musculus
uugggaagaauggggagaagggaugagaauccuugaccaguu

SEQ ID NO: 96371 - RNA, 46 nt, Mus musculus
uccuggguugaagcaacaggaaaaugcagcugaggcaggggugcag

SEQ ID NO: 96372 - RNA, 42 nt, Mus musculus
guguacagacagccauguucucaucucauucauagcgcagua

SEQ ID NO: 96373 - RNA, 42 nt, Mus musculus
ccagugugaccaacaguggugggagcaugcucccugccucag

SEQ ID NO: 96374 - RNA, 46 nt, Mus musculus
aaaagaacuugauuagaguuugaauaauuggugaaggccucaaacu

SEQ ID NO: 96375 - RNA, 46 nt, Mus musculus
ccugagccuuuucuccaaccuccacauguaccaauacacaagagag

SEQ ID NO: 96376 - RNA, 46 nt, Mus musculus
uuacacccccaacagacccuccaucccgcaggaaacacccccgaga

SEQ ID NO: 96377 - RNA, 46 nt, Mus musculus
aggagacccacuaaaagcaaaggcagcaagucuagucgcagcagcu

SEQ ID NO: 96378 - RNA, 46 nt, Mus musculus
cuuugacuuagauucuggacgggaaggcucuuugaacacaggugag

SEQ ID NO: 96379 - RNA, 45 nt, Mus musculus
uccuuagaugucccagacagcacccacaaagcaccuaccccagaa

SEQ ID NO: 96380 - RNA, 90 nt, Mus musculus
ucaguuacaauggaugaugcccagaaagaacguaaaaauaggucagaagauacaaagucgguucauuuugaaucuagcacaucagaguca

SEQ ID NO: 96381 - RNA, 45 nt, Mus musculus
cuggcuaggcuuuaauccuagcacuccagagguagaggcaggaag

SEQ ID NO: 96382 - RNA, 46 nt, Mus musculus
aaauacccaaaugguccuagacucugcucuagauaguuggggguag

SEQ ID NO: 96383 - RNA, 46 nt, Mus musculus
guuucauuauuuucaguuugccuuaauuauauagaauaggugccag

SEQ ID NO: 96384 - RNA, 41 nt, Mus musculus
aagcuuagcuacauagcuguacacugucucaagcggggaaa

SEQ ID NO: 96385 - RNA, 46 nt, Mus musculus
uauuaguggacuaaugagucuugaaugauuauauuggggugaagag

SEQ ID NO: 96386 - RNA, 45 nt, Mus musculus
gcucacaggguacaguaccggcugaaaguucaguacccacuggug

SEQ ID NO: 96387 - RNA, 42 nt, Mus musculus
aauauuccuuauuguagauuccuuugauaaaaauugggaguu

SEQ ID NO: 96388 - RNA, 87 nt, Mus musculus
caacugcauucagaaugcucauacucccacaaagacaugcauagauauaaauaguuuaacaauauaagucuguugaaaaggacaggu

SEQ ID NO: 96389 - RNA, 45 nt, Mus musculus
ccugggcagguuucuaccccaggcacacacgcuucagccccaguc

SEQ ID NO: 96390 - RNA, 46 nt, Mus musculus
gcugcuccuaaugguaaacugguuggugguaagcaaguacuuguag

SEQ ID NO: 96391 - RNA, 63 nt, Mus musculus
agcaugcuucugucucccuagagacaccuuuaguaguagagacgacugucacaccgggcauca

SEQ ID NO: 96392 - RNA, 63 nt, Mus musculus
ccugcuguacagcaaacacucauucacagucagccucaaccagcucugcuucccaaccagccu

SEQ ID NO: 96393 - RNA, 73 nt, Mus musculus
aucagcuguaguuucuacaccuggccucccccaaccaguaguaccuacuucuacaccuuuauuaccccaagua

SEQ ID NO: 96394 - RNA, 45 nt, Mus musculus
auaccaggcugagaaacagaaguagacacagcuguuccagaggag

SEQ ID NO: 96395 - RNA, 46 nt, Mus musculus
aucugggagcauugcuucaaguacaggcaguuuuccuccuggaaca

SEQ ID NO: 96396 - RNA, 42 nt, Mus musculus
cacgugauuucauugcucaggagacagagagaagggggauga

SEQ ID NO: 96397 - RNA, 55 nt, Mus musculus
gcugaugaaauguuaagugaggaugucaguguggagccugagggugaccagggau

SEQ ID NO: 96398 - RNA, 64 nt, Mus musculus
ugacuuuauucuagcaauagagagagagucuuuuguggcucaagugcgggaaauuauugaaaag

SEQ ID NO: 96399 - RNA, 99 nt, Mus musculus
ucaaauaaaggagaccgaguaguagaaugucaauuagagacucauaaucggaagaugguuacauuuaaauuugaccuagauggugacaacccugaagag

SEQ ID NO: 96400 - RNA, 46 nt, Mus musculus
acauuuaaaauccucaguuuugggcgagaagucuuuucaugccgag

SEQ ID NO: 96401 - RNA, 53 nt, Mus musculus
gccagguucaagugucccaaccagcagugaguuuaacgcaacaacccccaacu

SEQ ID NO: 96402 - RNA, 62 nt, Mus musculus
acuguaggaaaguaaccuuggguggccaaugcuucugucggcauagaaggaggggcuaggac

SEQ ID NO: 96403 - RNA, 43 nt, Mus musculus
cguggcuucuguuugcauccauucuacaguccuagccccuccu

SEQ ID NO: 96404 - RNA, 80 nt, Mus musculus
uguagaauggaugcaaacagaagccacguuggaagagggagcaauauuugaaucuccuggguauugugguggcagucgag

SEQ ID NO: 96405 - RNA, 46 nt, Mus musculus
gucacagggcuucccaucucgacugccaccacaauacccaggagau

SEQ ID NO: 96406 - RNA, 45 nt, Mus musculus
ggugaguuagugcagguugagacaucaaauuagcaaaucaguaga

SEQ ID NO: 96407 - RNA, 46 nt, Mus musculus
gcagccauuguuauaggaacggaugagaaaccugucugcgccgugg

SEQ ID NO: 96408 - RNA, 46 nt, Mus musculus
agacaggauacugugggaguaaagaaguagggauuggcugucccau

SEQ ID NO: 96409 - RNA, 46 nt, Mus musculus
ccuacuuuauucuuaaguccaauuaaaguugacauccgggauuacc

SEQ ID NO: 96410 - RNA, 46 nt, Mus musculus
ugcuuuuggucguggcauuagaucacaucaguaguuaaccccaaau

SEQ ID NO: 96411 - RNA, 46 nt, Mus musculus
uuauguaccuaugagcaauuuaaaagauaagaguuaaaaggaagaa

SEQ ID NO: 96412 - RNA, 46 nt, Mus musculus
ucauaguaacucugaugaaagagguacaaggucuguuaaaaaacaa

SEQ ID NO: 96413 - RNA, 46 nt, Mus musculus
acuuucacaauucuuuuaaacuacccuauuauacaccagugcauuu

SEQ ID NO: 96414 - RNA, 46 nt, Mus musculus
gcaaugagaacagaagcaacuguguauuugaauuucaugcucaaac

SEQ ID NO: 96415 - RNA, 96 nt, Mus musculus
uuaagauuagauucuggaccaaguccagcaucaccccucucuaguauuucugcgccuaacaguacagaugcuacacaucugaaauuucacccuguc

SEQ ID NO: 96416 - RNA, 51 nt, Mus musculus
acucaccaguacugucaaguccuaugaaacagauaucugaacagaagccag

SEQ ID NO: 96417 - RNA, 82 nt, Mus musculus
caccugguagcagcccaacuaacuggacaccagaggccauaguuauguugggugcuacagccaauagaguaaauagagagcu

SEQ ID NO: 96418 - RNA, 67 nt, Mus musculus
gcuaccagguggaagaugauuuuggccaacaguccucagcagggguuggaaguggcgaguuugggcu

SEQ ID NO: 96419 - RNA, 45 nt, Mus musculus
cucuuacgucguugggaaauggcuacuuucgguggacagguggga

SEQ ID NO: 96420 - RNA, 46 nt, Mus musculus
gaauguaugaauuacuugucuuauucauguugauacagccucaguc

SEQ ID NO: 96421 - RNA, 42 nt, Mus musculus
uggaauuuauagcaaaaauccauuaaauacauccagggccaa

SEQ ID NO: 96422 - RNA, 46 nt, Mus musculus
uuuucauucaaggaagugccacagauuaacuuuauuggcccuggau

SEQ ID NO: 96423 - RNA, 45 nt, Mus musculus
augggagaugguaauagacucuccagaaucucaugugcccuguag

SEQ ID NO: 96424 - RNA, 82 nt, Mus musculus
aauauaagcauucugauuugguggaggauacuuuagcagguugaagaaauggcuccauaacuuaaauacuugcugcauaagc

SEQ ID NO: 96425 - RNA, 46 nt, Mus musculus
ugcugcuuuuccaaacaagagaauauucugaacuaaugacaccaga

SEQ ID NO: 96426 - RNA, 45 nt, Mus musculus
cacuuuuuuguucaccucuuagauuacauaaaauggggcauagac

SEQ ID NO: 96427 - RNA, 46 nt, Mus musculus
cacaaauggguaucagaaauauuuuauaccguuauaaaggagccag

SEQ ID NO: 96428 - RNA, 45 nt, Mus musculus
uaaagauaggaauucuucaaaguucagauuaaagccuucugagga

SEQ ID NO: 96429 - RNA, 42 nt, Mus musculus
caaauacuauaaucuauauaaaguacuuagccagcugcagau

SEQ ID NO: 96430 - RNA, 46 nt, Mus musculus
uacuggcacagcaccaggacauacaguuucuaguauccaagcacaa

SEQ ID NO: 96431 - RNA, 75 nt, Mus musculus
ggaucauccguauucacagaauccagagugagcagccaacagacuguuuccuaugguucccaacaugagcaggca

SEQ ID NO: 96432 - RNA, 53 nt, Mus musculus
aagaaaacaagaagagagcaguuucaaacagcagaaugaacaacaagcaagcg

SEQ ID NO: 96433 - RNA, 65 nt, Mus musculus
gauaggguguccuuaauuaagagaaaacgagagcagcggcaguugguucgagaagagcaagaaaa

SEQ ID NO: 96434 - RNA, 45 nt, Mus musculus
uucuuucuuugugcauuuugauauuguuuugauaaucugguuuga

SEQ ID NO: 96435 - RNA, 48 nt, Mus musculus
auacaaagacaaugaagcuauugaguuuuccuuugacuuggagaggga

SEQ ID NO: 96436 - RNA, 47 nt, Mus musculus
agaugauggagaaaagauagcuauuaaauuauggcugcguauugaag

SEQ ID NO: 96437 - RNA, 46 nt, Mus musculus
acaguuauuaaaaaaacagauuguaauaugacuauaugcuggagau

SEQ ID NO: 96438 - RNA, 45 nt, Mus musculus
gaagcaaaaagaagaaaacuacugggcagacaguggucagaagua

SEQ ID NO: 96439 - RNA, 46 nt, Mus musculus
uaaaaaaaaagaacaagaaaaaagugaauuugucaaauugccaggu

SEQ ID NO: 96440 - RNA, 46 nt, Mus musculus
uaaugcgcaguguuuacuggcuugguccucauggcuuggcucgggg

SEQ ID NO: 96441 - RNA, 46 nt, Mus musculus
ucauauuacugaagguacuacauacuaguaccuagaacauggagaa

SEQ ID NO: 96442 - RNA, 45 nt, Mus musculus
cuccuugacacuauaagguauuuuaaaaaaaaaaaaagccccagu

SEQ ID NO: 96443 - RNA, 45 nt, Mus musculus
cuaauuucuugaguucuuuauauauuuuggauauuagcccucucu

SEQ ID NO: 96444 - RNA, 42 nt, Mus musculus
cuuuacaaauaaagcugcugugaacauaguggagcauauguc

SEQ ID NO: 96445 - RNA, 46 nt, Mus musculus
gcauaaaagacucuaaagccucuacuagaaaauucuggccacugau

SEQ ID NO: 96446 - RNA, 46 nt, Mus musculus
cauggaaucaucuguuucuaacaugacauaaauuuaaauggcagua

SEQ ID NO: 96447 - RNA, 46 nt, Mus musculus
auauuucuauuuucuaugugcaugaguguuuugucugcaucuauuu

SEQ ID NO: 96448 - RNA, 46 nt, Mus musculus
gcauauagucuuaaacaaucuuccucauauguguaagcugaaagaa

SEQ ID NO: 96449 - RNA, 47 nt, Mus musculus
gaaaccaugucuugaaaaaauaaaaacaacaaaaaaaaaccccaaaa

SEQ ID NO: 96450 - RNA, 46 nt, Mus musculus
ggcagugguaccuuuaaucucagcacuuugggaggcauaggcaggc

SEQ ID NO: 96451 - RNA, 46 nt, Mus musculus
ccuaugccucccaaagugcugagauuaaagguaccacugcccaguc

SEQ ID NO: 96452 - RNA, 46 nt, Mus musculus
ugguugcugggauuugaacucaugaucuuaagaaaagcagucagug

SEQ ID NO: 96453 - RNA, 72 nt, Mus musculus
aguucaaaucccagcaaccacaugguggcucgcaaccaucuauaacaagaucugacucccucuucugguacc

SEQ ID NO: 96454 - RNA, 45 nt, Mus musculus
uagauagauagauagauagauagauagauagagaauagauagaua

SEQ ID NO: 96455 - RNA, 42 nt, Mus musculus
ucuauuuacauguucauugcguaugacaugguacgggcauuu

SEQ ID NO: 96456 - RNA, 41 nt, Mus musculus
ggagaagaaaagaggucacuaguuauaaacuucaggucagu

SEQ ID NO: 96457 - RNA, 45 nt, Mus musculus
auccuuauaguaaucagcuaguggggaaauaacugaaaauguaga

SEQ ID NO: 96458 - RNA, 46 nt, Mus musculus
cacauaagcaggccuagauuuuauaaagauuuuucuggauguagau

SEQ ID NO: 96459 - RNA, 46 nt, Mus musculus
uacuuuaaaaaucaaccaaccaaacaaacaaacaaaaccuguagac

SEQ ID NO: 96460 - RNA, 47 nt, Mus musculus
aaaugugacaacaucuuuaucacugguccuacuggcucagucaagau

SEQ ID NO: 96461 - RNA, 45 nt, Mus musculus
uaggaccagugauaaagauguugucacauuuaagaucccggugaa

SEQ ID NO: 96462 - RNA, 46 nt, Mus musculus
uguaugugcuaguccagacaugugccauggcacaaguauagaggua

SEQ ID NO: 96463 - RNA, 46 nt, Mus musculus
ucucauugccuuuuuaaagugcacuuuaucauggguauaggggagg

SEQ ID NO: 96464 - RNA, 44 nt, Mus musculus
ugagccaccaugugguugcugggauuugaacucaggacccaugg

SEQ ID NO: 96465 - RNA, 45 nt, Mus musculus
gugcuagaguugauuacagauacuacacaccaggaagaagaagag

SEQ ID NO: 96466 - RNA, 25 nt, Mus musculus
agaggaugaagaugaugauggguau

SEQ ID NO: 96467 - RNA, 46 nt, Mus musculus
ugcuuggggugugugugugugugugugugugugugugugucugugu

SEQ ID NO: 96468 - RNA, 46 nt, Mus musculus
gagugaagguugagagaaauuuauuucaaggggggcggggagagaa

SEQ ID NO: 96469 - RNA, 54 nt, Mus musculus
auauuaaugaaaaaaacuuuguaggccuugcuuccaauggagauuauauagcgu

SEQ ID NO: 96470 - RNA, 28 nt, Mus musculus
ugcuaacuuuuaaguuugauaccguuaa

SEQ ID NO: 96471 - RNA, 45 nt, Mus musculus
ugugcuugcaugggugcuugcauggguguguuuaggccagaggac

SEQ ID NO: 96472 - RNA, 46 nt, Mus musculus
ccuccaaacucaaucucacaaguacuaaguauaaucaugcccaguu

SEQ ID NO: 96473 - RNA, 45 nt, Mus musculus
uacguaaaagugacaguaaacugagauucuaaaguugugugugug

SEQ ID NO: 96474 - RNA, 46 nt, Mus musculus
aacaaacuuaaguaaauuagaagcuugucaacagaaacauaggaua

SEQ ID NO: 96475 - RNA, 46 nt, Mus musculus
agaagcaguucagagaagagacagaagcaucagaauagagccagug

SEQ ID NO: 96476 - RNA, 46 nt, Mus musculus
gaugcagaaaagaauucuaagcuuagcugaacgauauaagcagaau

SEQ ID NO: 96477 - RNA, 46 nt, Mus musculus
ugaauuuuaaaacacuuuguacauugaauuuauuuucuuuguagug

SEQ ID NO: 96478 - RNA, 46 nt, Mus musculus
ucucuaaaaggaugaaauuguuauaaaaacaaacaaaaacagagaa

SEQ ID NO: 96479 - RNA, 46 nt, Mus musculus
uucagauguuaccaaauauauaauaccauagaaauuaggaugacuu

SEQ ID NO: 96480 - RNA, 42 nt, Mus musculus
caugugcgugcgugcaugcaugccuacauauagaggccagau

SEQ ID NO: 96481 - RNA, 46 nt, Mus musculus
uguguguauguauguauauauguaugugugugugugugugugugug

SEQ ID NO: 96482 - RNA, 42 nt, Mus musculus
aaacaugcaccauucacuuagcagucuuaauuacccaggauc

SEQ ID NO: 96483 - RNA, 45 nt, Mus musculus
aaaauauauuuuuaaaaaagacaaaaaugcuaaaggcagcaaaca

SEQ ID NO: 96484 - RNA, 45 nt, Mus musculus
agcuacauuugcuuucuuauauaccccuaggaacuccuggccaga

SEQ ID NO: 96485 - RNA, 78 nt, Mus musculus
auuuuuauuuuaaagauuuuaguuuuaauuaguguguaugguuagauaggaagaggguugugcauacauaugcaguau

SEQ ID NO: 96486 - RNA, 42 nt, Mus musculus
ccucuuccagugugucugaaaacagcuacaguguacucauau

SEQ ID NO: 96487 - RNA, 42 nt, Mus musculus
gguguacgaugccccaguguaggaaaaugccauugugggagg

SEQ ID NO: 96488 - RNA, 46 nt, Mus musculus
aaacauugccuaaaaggcuauuuaaauggagauuuguuucaggaag

SEQ ID NO: 96489 - RNA, 44 nt, Mus musculus
aaugggaucugaugcccucuucugaugugucugaagauagcaac

SEQ ID NO: 96490 - RNA, 42 nt, Mus musculus
ucaaauccuagcaaccacaugguagcugacaaaccacccagc

SEQ ID NO: 96491 - RNA, 45 nt, Mus musculus
guugaggaguauguguugggggcauauaaaaggacuuggagggga

SEQ ID NO: 96492 - RNA, 46 nt, Mus musculus
gaaauuacaaacauuaaaauaguuaugauauagcaauuuggaaggu

SEQ ID NO: 96493 - RNA, 42 nt, Mus musculus
acauggaauuauuggaaaaggguuucccuucguguuggggau

SEQ ID NO: 96494 - RNA, 46 nt, Mus musculus
acaccgaaaccacuguggaagucgccuggugugaauugcagguaau

SEQ ID NO: 96495 - RNA, 46 nt, Mus musculus
ccugcaauucacaccaggcgacuuccacagugguuucgguguccag

SEQ ID NO: 96496 - RNA, 45 nt, Mus musculus
agcgccaaagaggcgcaggaggauaggagccagcaacaggaugau

SEQ ID NO: 96497 - RNA, 42 nt, Mus musculus
cucuaucccgcaaccuaguguaccugcaguggugccccagag

SEQ ID NO: 96498 - RNA, 26 nt, Mus musculus
accacccccacggagcaccgauucuu

SEQ ID NO: 96499 - RNA, 50 nt, Mus musculus
guccugccaacucccgagucggcgaccguagcccccaguuucucgcccac

SEQ ID NO: 96500 - RNA, 41 nt, Mus musculus
agugucccgcgucgcccucggggcgccuugucagugcugag

SEQ ID NO: 96501 - RNA, 43 nt, Mus musculus
ggcgccuucugucagcgaagaagggaguacggaauagccgagc

SEQ ID NO: 96502 - RNA, 44 nt, Mus musculus
gaggaaggagcggguuuugaaaagaaguaauagucucagagaag

SEQ ID NO: 96503 - RNA, 29 nt, Mus musculus
gggaucuacaagucugaccuggacaagau

SEQ ID NO: 96504 - RNA, 45 nt, Mus musculus
gcacugagccccaccuccugcccuaguguggucuuucuaaugaga

SEQ ID NO: 96505 - RNA, 47 nt, Mus musculus
cuucggguuggaugugagcaucaacuuggguuguuguccaggaaaga

SEQ ID NO: 96506 - RNA, 78 nt, Mus musculus
auugaacguuguugugugguuagcaaacaguggaacugagaucugaugcugaguugaggcugguacuuucugucgugu

SEQ ID NO: 96507 - RNA, 46 nt, Mus musculus
agaguuuguuguuguugaagguuuauuuugaucccagcacucagga

SEQ ID NO: 96508 - RNA, 46 nt, Mus musculus
aagaugguuguaagccaccaugugggagcugggaaccaaaccuagg

SEQ ID NO: 96509 - RNA, 46 nt, Mus musculus
cugcugcaggaauguagcagaccuuugcugguauucucggguguaa

SEQ ID NO: 96510 - RNA, 42 nt, Mus musculus
ggcuggcguccugaggaggacguggugauagcggcggaccag

SEQ ID NO: 96511 - RNA, 46 nt, Mus musculus
ugccuuuccaaccaggacaagcaacaucccaguccagcggccagag

SEQ ID NO: 96512 - RNA, 42 nt, Mus musculus
uucuuuagacaauccagcucacaaccuucugagaggggggau

SEQ ID NO: 96513 - RNA, 41 nt, Mus musculus
agagagcagcacccacaccuuccauuucagagccauguaga

SEQ ID NO: 96514 - RNA, 42 nt, Mus musculus
gcagagagugaauggucuugauaacagugaagggagacagau

SEQ ID NO: 96515 - RNA, 46 nt, Mus musculus
aaaagaguaugauaaacccaggucuagacuggagacaagaaaagaa

SEQ ID NO: 96516 - RNA, 44 nt, Mus musculus
cucacaaccaucuguaacaagaucugaugcccucuucuggggug

SEQ ID NO: 96517 - RNA, 42 nt, Mus musculus
aaucucauccaguauccucaggcaacugccccacccccaaag

SEQ ID NO: 96518 - RNA, 42 nt, Mus musculus
ggaagaagacaguguccaaggauccccaagacacccccacag

SEQ ID NO: 96519 - RNA, 41 nt, Mus musculus
aaccaucuguaaugggaucugaugcucuuuucuggugugua

SEQ ID NO: 96520 - RNA, 42 nt, Mus musculus
gccccgauauccucccuucuaaaugagacaagcugacaagua

SEQ ID NO: 96521 - RNA, 41 nt, Mus musculus
aagacugggagugggaagucaguagggcaaggagggugugu

SEQ ID NO: 96522 - RNA, 41 nt, Mus musculus
agaucugaugcccuccuccggugugucuaaagacagcuaca

SEQ ID NO: 96523 - RNA, 46 nt, Mus musculus
cccaagaguuauguucucaaaccauuaaaucccagcuauuccagga

SEQ ID NO: 96524 - RNA, 42 nt, Mus musculus
uugaugagagcuagaggaggguuauucuaacaucggggugua

SEQ ID NO: 96525 - RNA, 46 nt, Mus musculus
acuuaaacagaugaaaugggcacacaaacauuugcugcaaaccuac

SEQ ID NO: 96526 - RNA, 45 nt, Mus musculus
uuguugucagacacaccagaagagggcaucagaucccaguacaga

SEQ ID NO: 96527 - RNA, 25 nt, Mus musculus
gcugagugcagguaucuaucuugcc

SEQ ID NO: 96528 - RNA, 46 nt, Mus musculus
ccugacucucaaauccaaacccccaacucaggaacuguuaggagaa

SEQ ID NO: 96529 - RNA, 41 nt, Mus musculus
augggaaggugauggaaggaccacaaaguccgugccacaga

SEQ ID NO: 96530 - RNA, 46 nt, Mus musculus
ugaaugaaugcuacuaggugauaaugauaaagguaaaauucaggac

SEQ ID NO: 96531 - RNA, 45 nt, Mus musculus
gaagguaguuuagagaugguaggagaacaaggauggucuggugua

SEQ ID NO: 96532 - RNA, 51 nt, Mus musculus
uaaaucagaaaaggaaaggaaauggucuggcgugugugugugugggcgugu

SEQ ID NO: 96533 - RNA, 45 nt, Mus musculus
cucagaccgugcaggccuagcaguuggcuggcacccacaucagau

SEQ ID NO: 96534 - RNA, 42 nt, Mus musculus
cagugcauacaaaccccugaaguuuuacuuaagugaccuuuu

SEQ ID NO: 96535 - RNA, 46 nt, Mus musculus
agcuucaggcccaucagagcuagauagugaggagugggggugagag

SEQ ID NO: 96536 - RNA, 46 nt, Mus musculus
aauuuuugccauuggucuuucuccaaacuuguuuugugucucagau

SEQ ID NO: 96537 - RNA, 46 nt, Mus musculus
gcucaguugauaagaguucuugcuuugcauauaugaggccuuagau

SEQ ID NO: 96538 - RNA, 30 nt, Mus musculus
gugcugagugugugugugugugagagagag

SEQ ID NO: 96539 - RNA, 49 nt, Mus musculus
uuugcaucuuacccaacaaauugccuacaacagagucuuugagacaugg

SEQ ID NO: 96540 - RNA, 42 nt, Mus musculus
aucuggagcaaaguccagaaaucauuuaagccucagucuuau

SEQ ID NO: 96541 - RNA, 42 nt, Mus musculus
aaaacguggcuacuccaggacugagaaacaguagccccagca

SEQ ID NO: 96542 - RNA, 45 nt, Mus musculus
gauucuagacuugagaucuagacaacucugccaacagaggaaauc

SEQ ID NO: 96543 - RNA, 46 nt, Mus musculus
aaacaggagaaagaaaagaagagaaaaacaaaagaaaagaaaagaa

SEQ ID NO: 96544 - RNA, 46 nt, Mus musculus
ugaucuaaaggcaggcagaaaguguuugagcacuaggggcccucaa

SEQ ID NO: 96545 - RNA, 42 nt, Mus musculus
agaggccucagccgugauuacagguguggaguggaagaggca

SEQ ID NO: 96546 - RNA, 44 nt, Mus musculus
aaaguugugggaaagaaagaaaaccaaggucaauaaaaggaagg

SEQ ID NO: 96547 - RNA, 46 nt, Mus musculus
aaguuuuuccccuguucuuuuugguaguggcuuguugggcccaguu

SEQ ID NO: 96548 - RNA, 45 nt, Mus musculus
uauauaucuaguuucgggccagugagcccaucuugaaaggcagag

SEQ ID NO: 96549 - RNA, 42 nt, Mus musculus
cuucccaagaacaaguagagauugguaguuuugugugaaguu

SEQ ID NO: 96550 - RNA, 72 nt, Mus musculus
uaccugacuugagauccuaauugcucuggaggacugccuuccugagguggcuuguguugggacucaacugga

SEQ ID NO: 96551 - RNA, 42 nt, Mus musculus
uuuauuuuuccuuuuauagguuaaguaaacugaggcugagaa

SEQ ID NO: 96552 - RNA, 84 nt, Mus musculus
aauauugguuaccuagugaauuucaggcugggaggagacagagagagaagaggagaggagaggagagagagagagagagagaga

SEQ ID NO: 96553 - RNA, 47 nt, Mus musculus
ccugcgccaguuucccugccuuaggaguucuuuagagaaaagaaagg

SEQ ID NO: 96554 - RNA, 46 nt, Mus musculus
aacaaaaaauccuccagacagcggagucuuggggugggggucagaa

SEQ ID NO: 96555 - RNA, 45 nt, Mus musculus
guccugcacauagcugugcacagaggcaaaauacccguacacauu

SEQ ID NO: 96556 - RNA, 42 nt, Mus musculus
caccaccacacccggccugaguuacucuguuugcccaaaauc

SEQ ID NO: 96557 - RNA, 45 nt, Mus musculus
agagaugcugugucagugccauaucucaaaaguguucuugugaga

SEQ ID NO: 96558 - RNA, 46 nt, Mus musculus
ugugggaauugucuugcuugcugguugaaguaggaggcgguaggua

SEQ ID NO: 96559 - RNA, 46 nt, Mus musculus
ucuacugccggaggcaccaucucuuccuucaugaugucggcccuga

SEQ ID NO: 96560 - RNA, 42 nt, Mus musculus
cuuauagauucgcuaauacaaaagaguacugcugggacagau

SEQ ID NO: 96561 - RNA, 46 nt, Mus musculus
ugggacacagcuuucgaguaauuucauagaaguggagacauuugga

SEQ ID NO: 96562 - RNA, 63 nt, Mus musculus
uguuuccuaguccacacccugcauacuagcugcgccagagucggaaagcuauuaacccccccc

SEQ ID NO: 96563 - RNA, 45 nt, Mus musculus
gggauagucuacauaaaauagacagggaagcagucgcuuugugau

SEQ ID NO: 96564 - RNA, 41 nt, Mus musculus
gcgacgaggagaggcguggagcggacacuuggggaggagga

SEQ ID NO: 96565 - RNA, 48 nt, Mus musculus
gucuacaaacaaacaaacaaacaaaaacaaaaauaaaacaucaaaacc

SEQ ID NO: 96566 - RNA, 42 nt, Mus musculus
gcucacaccuauaaucccagggcuugggaaucugaggcagga

SEQ ID NO: 96567 - RNA, 46 nt, Mus musculus
ucuucuacaugauaacaaccuuaaaccaucuuucuagccccaagaa

SEQ ID NO: 96568 - RNA, 46 nt, Mus musculus
aaugacaaagcgcuaucaggccuuggagcaucgacgagcccuagaa

SEQ ID NO: 96569 - RNA, 42 nt, Mus musculus
gagaaaaagcuguccaacauguaccaagaacagugcauuucc

SEQ ID NO: 96570 - RNA, 45 nt, Mus musculus
uuuauuuauuuuuauuuuuaaaauugcauuuauuuaugugggaug

SEQ ID NO: 96571 - RNA, 45 nt, Mus musculus
gacauccccauaagacuggugcuuugcugaggccuguaauauaga

SEQ ID NO: 96572 - RNA, 42 nt, Mus musculus
agacagugaucgaaagggccuccuuuggccccauguugaguu

SEQ ID NO: 96573 - RNA, 55 nt, Mus musculus
agagaagguauggaugcuugagaaagaucaccugaugucaaagauuacgcaguau

SEQ ID NO: 96574 - RNA, 46 nt, Mus musculus
ccugguguucauugacauggaaaacagugacuaagcucagcuacgg

SEQ ID NO: 96575 - RNA, 101 nt, Mus musculus
gcgcagcugggagagcagacaaagcuuucgagagagcaaguggaggggcucauggaggacagacggauccgagucgaggagauccaaguucagcaccagag

SEQ ID NO: 96576 - RNA, 41 nt, Mus musculus
guuggugcuuguacagcccaguaccauuuauaaggcauuag

SEQ ID NO: 96577 - RNA, 45 nt, Mus musculus
accuggaucucauuguguagaccaggcuagccuccaacucugaga

SEQ ID NO: 96578 - RNA, 46 nt, Mus musculus
cagauggcacaauaaccuugacagaccauuucguuucucuccacac

SEQ ID NO: 96579 - RNA, 45 nt, Mus musculus
aaggacaaggagggcauuucugagcgccaccagagggacacagag

SEQ ID NO: 96580 - RNA, 46 nt, Mus musculus
acuaaacuccuucagggucagugcuggugcuugaguagcagaagua

SEQ ID NO: 96581 - RNA, 45 nt, Mus musculus
guuuaaugcaagggguuuuguuguuuugugugugugugugugugu

SEQ ID NO: 96582 - RNA, 46 nt, Mus musculus
ucaggaccucugaaagagcagucagugcucuuaaccaaugagccgu

SEQ ID NO: 96583 - RNA, 45 nt, Mus musculus
uccagugguccugaguucaaaucccaacaaccauccguaaugaga

SEQ ID NO: 96584 - RNA, 46 nt, Mus musculus
agacaagaaaaagauucagaaucuguuagcucuggugggcccagau

SEQ ID NO: 96585 - RNA, 45 nt, Mus musculus
cuuugugcugacacuaaaggugugcucuaccacagcuggccagaa

SEQ ID NO: 96586 - RNA, 41 nt, Mus musculus
aaaaucuaguagacucacugugaauuagaucugggccaaaa

SEQ ID NO: 96587 - RNA, 46 nt, Mus musculus
uuuuucaaaacaagguuucacuauguagucuuggcuauccuggaag

SEQ ID NO: 96588 - RNA, 46 nt, Mus musculus
aggaaacaaacuuggauagagauuaccuguaagacaguugcuaggg

SEQ ID NO: 96589 - RNA, 79 nt, Mus musculus
ucugagugauaugcaggucugccucuuccaggaaagggaacauguuuuacgacucuacucagaaaaugaccgacuaaga

SEQ ID NO: 96590 - RNA, 81 nt, Mus musculus
ucgucuggcuguccuuugcccuucucaggagcuucuggaguauuaucagaagaagauggcuaacugugagucagagaauga

SEQ ID NO: 96591 - RNA, 91 nt, Mus musculus
aacguggugcuggcucuggcuuuggugauaccaacagguggaagaaaauggcagacucaauggagucaacaccccugccuucagucgagga

SEQ ID NO: 96592 - RNA, 52 nt, Mus musculus
uccuuugaaacuggaguuauagacacuugugagcugccaugaagugaugaga

SEQ ID NO: 96593 - RNA, 38 nt, Mus musculus
uuaagacauuuucucugugcagcccugacaguucugga

SEQ ID NO: 96594 - RNA, 48 nt, Mus musculus
aucaauacuucuguagguuuuauccagucgguauaggagauaaggaag

SEQ ID NO: 96595 - RNA, 46 nt, Mus musculus
gaagacagcaugaacuucacuccgacacggacacccaucugcagaa

SEQ ID NO: 96596 - RNA, 23 nt, Mus musculus
ccccccccccaacccgggauugu

SEQ ID NO: 96597 - RNA, 42 nt, Mus musculus
aauuuauuauuguguuuaugugugaguauguagaggucggag

SEQ ID NO: 96598 - RNA, 46 nt, Mus musculus
aaaaaaccaagaugaucuuuccuccucaguuacuuguugucaguua

SEQ ID NO: 96599 - RNA, 48 nt, Mus musculus
gaggugacaacuugaggcugacccuccuagagauaccagggaguaggg

SEQ ID NO: 96600 - RNA, 51 nt, Mus musculus
aacacccauacacauaaaauaaucauauuuuuaaaauuauuagagccaaca

SEQ ID NO: 96601 - RNA, 46 nt, Mus musculus
ccuaaccuuucccuuaaaucauuagacaggggcuagagggacgguu

SEQ ID NO: 96602 - RNA, 45 nt, Mus musculus
gaagggagcuacaggagacuaaaccuagggccagucaaggaaaga

SEQ ID NO: 96603 - RNA, 41 nt, Mus musculus
ggacggcggaggguggugaagaggugucagaggggcgggcg

SEQ ID NO: 96604 - RNA, 42 nt, Mus musculus
gguagcgcgaggcggggugacaauuccgucugggccucggaa

SEQ ID NO: 96605 - RNA, 45 nt, Mus musculus
ugguuuuuccagccccuuccccuccacuuccacagcugaccccag

SEQ ID NO: 96606 - RNA, 87 nt, Mus musculus
gagugacaucuucagacagggccaaagugucaaaacauagaggauugcuguuugugucuggcuaguccuuugccaagggccucacga

SEQ ID NO: 96607 - RNA, 41 nt, Mus musculus
caagagugcuuugcacaaucggugugugcagaauccaggga

SEQ ID NO: 96608 - RNA, 42 nt, Mus musculus
ccagacccucagcuacagucccugccauaaaucuuggggguc

SEQ ID NO: 96609 - RNA, 45 nt, Mus musculus
uguuggccugccuagguaggccucuuaguuccccauuuacugcca

SEQ ID NO: 96610 - RNA, 46 nt, Mus musculus
uccuggugugaacuucacagaguacacauacgugcauagaccugga

SEQ ID NO: 96611 - RNA, 46 nt, Mus musculus
gggcuguauaaagaaugaguauccuucauagaguaugaguguccuu

SEQ ID NO: 96612 - RNA, 45 nt, Mus musculus
gugcaucacacacacaauaaauaaaaaugaaaaaaaaaaguugua

SEQ ID NO: 96613 - RNA, 46 nt, Mus musculus
uuucaaaacccuucuccccaaacauuccuugguucuuuguccgcag

SEQ ID NO: 96614 - RNA, 46 nt, Mus musculus
auguaggacucugugguuguccuuuuguuugucugcuuguuggcug

SEQ ID NO: 96615 - RNA, 42 nt, Mus musculus
aagcaaguuucacuggugcugccaucaccacgugcaggugag

SEQ ID NO: 96616 - RNA, 43 nt, Mus musculus
uacagugaaauuuuguaaaaguuaguauuucuaaagucagcag

SEQ ID NO: 96617 - RNA, 45 nt, Mus musculus
acuuaagagucuaguucccuuucuuuacuucaaggacaccaggag

SEQ ID NO: 96618 - RNA, 44 nt, Mus musculus
ccgacugguucgagcgugagaaccucugcuuagcugauggccaa

SEQ ID NO: 96619 - RNA, 42 nt, Mus musculus
gguccucgagggcugcacacccucugaggaggagcagcggca

SEQ ID NO: 96620 - RNA, 46 nt, Mus musculus
ugagccugcuacuuaagaggguguauauuguacucugugugugcgu

SEQ ID NO: 96621 - RNA, 42 nt, Mus musculus
agaugugaggguagugggcaugggggcguggcauaacaggag

SEQ ID NO: 96622 - RNA, 44 nt, Mus musculus
aagagagguuguuuaaaguagcuccagggcgcccucauggggca

SEQ ID NO: 96623 - RNA, 42 nt, Mus musculus
ugucuagcacacaugugccucaggaaaaaacagaaaaagaug

SEQ ID NO: 96624 - RNA, 46 nt, Mus musculus
ugagccuaauugagaaaugaggugugugugugugugugugugugug

SEQ ID NO: 96625 - RNA, 45 nt, Mus musculus
caggacgauucugugccacacuugccugcaguggggauguuagug

SEQ ID NO: 96626 - RNA, 46 nt, Mus musculus
aguguacaauuuccccccaaccacucuccacucuagaacagcaguu

SEQ ID NO: 96627 - RNA, 46 nt, Mus musculus
ccagcucaucugaggccacagcuguucacuggguuugcagcaggac

SEQ ID NO: 96628 - RNA, 46 nt, Mus musculus
aaacgagaacagccagaggcaucuggaagaguccagaacagaagga

SEQ ID NO: 96629 - RNA, 46 nt, Mus musculus
gcggggggcugugauuaggauguaaaguuuauauaaauauauagaa

SEQ ID NO: 96630 - RNA, 100 nt, Mus musculus
ccauuguguaguaucuucaagucuaagacagcacugucauggccagguauacuaacauuucccaauugacacacaggaaaagcuaggcauggggcaccuu

SEQ ID NO: 96631 - RNA, 45 nt, Mus musculus
uagcaggugugagaucaagucccaucaucagcaccaaagacagac

SEQ ID NO: 96632 - RNA, 45 nt, Mus musculus
ggcuucaguuuugguuuuuuuguuuuuguuauucuggugguaaga

SEQ ID NO: 96633 - RNA, 43 nt, Mus musculus
gaaaagguuuauuuggccaacacuucgagaucacaguccauca

SEQ ID NO: 96634 - RNA, 37 nt, Mus musculus
gagacucaguaaggugguaaaagauacgacccguuac

SEQ ID NO: 96635 - RNA, 97 nt, Mus musculus
aagaguucaacauugagaaaggucgccuugugcaaacgcaaagacugaagauuauggaauacuacgagaagaaagaaaagcagauugagcagcagaa

SEQ ID NO: 96636 - RNA, 42 nt, Mus musculus
ugaggacuauuuuuguguugcaauagauuuucuguuucagau

SEQ ID NO: 96637 - RNA, 42 nt, Mus musculus
uguugcuuuucucaacacaagauuucucuuaguggccuugac

SEQ ID NO: 96638 - RNA, 46 nt, Mus musculus
ccggacuuugccuucgccauggcgcucagcgaugcagauguacaga

SEQ ID NO: 96639 - RNA, 45 nt, Mus musculus
auacuuaugaaguccagaaucgaggauuuaagcggcuccuggaaa

SEQ ID NO: 96640 - RNA, 46 nt, Mus musculus
cuccauggaucaaggugccuuccaucaagcauugggacccacauau

SEQ ID NO: 96641 - RNA, 46 nt, Mus musculus
uugucagagcaggggaaauauagguccaggagaaaaaggcuggcca

SEQ ID NO: 96642 - RNA, 49 nt, Mus musculus
caguaugggaaaggggccggaacaauuggaacaauucgcaguaauagag

SEQ ID NO: 96643 - RNA, 113 nt, Mus musculus
aucccccaaguaaauaguggacaaaaagaugagucaccaguuaucauaaaaucucguuuuauugucaccuccagggugcuuccccccaugauguugcuucuaaaugaaagcac

SEQ ID NO: 96644 - RNA, 46 nt, Mus musculus
uguaucccaggaccauguuuucaacacugaaaggcaaaccaagagu

SEQ ID NO: 96645 - RNA, 41 nt, Mus musculus
ccaugacuuagauucuuucgaagggcgcuucccgaggaugg

SEQ ID NO: 96646 - RNA, 46 nt, Mus musculus
accagaaccuauucuccuaugugaggaacuugguuagaaacguaag

SEQ ID NO: 96647 - RNA, 44 nt, Mus musculus
ccaaauaggcgaugagauggaccacaacauccagcccacacugg

SEQ ID NO: 96648 - RNA, 26 nt, Mus musculus
agcagugagcaccagagaggccuuga

SEQ ID NO: 96649 - RNA, 46 nt, Mus musculus
aaacuuuaacauaugugacuugcuauuaccuaaagagaugaccgag

SEQ ID NO: 96650 - RNA, 46 nt, Mus musculus
uggaccaauauuuaaaacaugguuuuuaaaacauaugucccaaaca

SEQ ID NO: 96651 - RNA, 46 nt, Mus musculus
agccaggccagccgcuccuucaaccaaggaagaauagagccaggua

SEQ ID NO: 96652 - RNA, 42 nt, Mus musculus
cugggucgggaacugccugugcaagcuuacugggaggcagac

SEQ ID NO: 96653 - RNA, 46 nt, Mus musculus
uaggauuuuuaaaaaguguguuucaauguuacauuugcgguaagaa

SEQ ID NO: 96654 - RNA, 28 nt, Mus musculus
uggggucgaauccccuggaacuagaguu

SEQ ID NO: 96655 - RNA, 46 nt, Mus musculus
ugugaugccagcacuuggcaggccagggcaggaaugagaaggagaa

SEQ ID NO: 96656 - RNA, 46 nt, Mus musculus
cugcuagccaucuugucccacccaaugcuuagauauuucagaagcc

SEQ ID NO: 96657 - RNA, 47 nt, Mus musculus
cuaggcacucccagucccucuguggcuaagcuaagaaaaagagagaa

SEQ ID NO: 96658 - RNA, 45 nt, Mus musculus
ccuaucuucccuugaguucuagacaaggcaaguuucuggccagga

SEQ ID NO: 96659 - RNA, 46 nt, Mus musculus
acucccaguuuaacuguaccaccugauucucaggcugcgcccugcu

SEQ ID NO: 96660 - RNA, 42 nt, Mus musculus
gauaaacugaagcuucagguuggagggcagugaugggcaagu

SEQ ID NO: 96661 - RNA, 45 nt, Mus musculus
cgcuccgcuauggccacccacaaaaaucaacaaggaacggcuaca

SEQ ID NO: 96662 - RNA, 41 nt, Mus musculus
gggccgaguguggcuccgcaaaccuuugccuuagcccguuc

SEQ ID NO: 96663 - RNA, 46 nt, Mus musculus
agcgucaggcacaggugcccaggcaaaagcacacuuaaaagcaggu

SEQ ID NO: 96664 - RNA, 45 nt, Mus musculus
uggcuaaagacuuaguuaggccugacaugcaaccaacagacagug

SEQ ID NO: 96665 - RNA, 46 nt, Mus musculus
cccaaugucuccugguggaauuuggagucuuuacaugcugggaggu

SEQ ID NO: 96666 - RNA, 41 nt, Mus musculus
agccgcuucaguuccuccugcuuagccugucuccgagccgc

SEQ ID NO: 96667 - RNA, 46 nt, Mus musculus
ucacagacaaaaccugcuccaccuugacuguggugauuggugguug

SEQ ID NO: 96668 - RNA, 90 nt, Mus musculus
ucaauaccugcagauuagcaaucacuguuuauuuuuuuaaaaagaucuaaagaagcguggagggaauugaaugacaguugaugacaugag

SEQ ID NO: 96669 - RNA, 65 nt, Mus musculus
cacaggucauaguaggauuacagagagucugugaugguugugcauuuugggggaguaggugguaa

SEQ ID NO: 96670 - RNA, 46 nt, Mus musculus
cacauaugugccugguaccugcugaggucaaaagagggugucagau

SEQ ID NO: 96671 - RNA, 50 nt, Mus musculus
uucggcagcacuagucuugaacagacagucuugaacaggccagugcccca

SEQ ID NO: 96672 - RNA, 50 nt, Mus musculus
cuccuuccugguccuuccuuaggaacagaccuggagaggcgcggagggga

SEQ ID NO: 96673 - RNA, 47 nt, Mus musculus
uguccuccugacgugugaggagaccuggucgaacccaggcuggcuau

SEQ ID NO: 96674 - RNA, 46 nt, Mus musculus
gugucccccgcggugcaccugcuggaagaggcguccgaccuguugg

SEQ ID NO: 96675 - RNA, 46 nt, Mus musculus
augcucccugugugugguggggauccaggcucuggcagaaauggau

SEQ ID NO: 96676 - RNA, 45 nt, Mus musculus
ggucuccugacuccuuuguccucauucccagucaguucccuucga

SEQ ID NO: 96677 - RNA, 44 nt, Mus musculus
guauggugugugugcaugugggugcacaugcaugugugggugga

SEQ ID NO: 96678 - RNA, 44 nt, Mus musculus
ugugugcacaugaaugcuggugcccucggaauccagaagauggu

SEQ ID NO: 96679 - RNA, 46 nt, Mus musculus
ucuuucucucucucucuuucucucucuuucucuuucucucucucuc

SEQ ID NO: 96680 - RNA, 46 nt, Mus musculus; identical to SEQ ID NO: 96679

SEQ ID NO: 96681 - RNA, 46 nt, Mus musculus
uuaucugugaguaagggagauugucccacaaggaaccaucacagaa

SEQ ID NO: 96682 - RNA, 45 nt, Mus musculus
uagguaccuguuucccucacuuccccucgccuuuguuggacccug

SEQ ID NO: 96683 - RNA, 47 nt, Mus musculus
guucacaugcuugcaugcuagagguugauguuggcuacuccagauga

SEQ ID NO: 96684 - RNA, 46 nt, Mus musculus
uuuuaaagucuauaauccagacaaggaaacgaaacaaaugguagag

SEQ ID NO: 96685 - RNA, 56 nt, Mus musculus
ucacuguaguuaauuugugguaaaacugucacagggcuccaaccugaaaagcaaag

SEQ ID NO: 96686 - RNA, 46 nt, Mus musculus
accuggcugucucuaccucuuacacuccacaucuauagaagcggag

SEQ ID NO: 96687 - RNA, 42 nt, Mus musculus
cccucugggacccagugucuucccaccacaccccaccccacc

SEQ ID NO: 96688 - RNA, 46 nt, Mus musculus
gguauucccaggcucagcugagcauggguggguccucagggcugag

SEQ ID NO: 96689 - RNA, 42 nt, Mus musculus
agaucugaugcccucuucuguugugucuaaggacagcuacag

SEQ ID NO: 96690 - RNA, 45 nt, Mus musculus
gcuggcaguuuaagcacagcccaggguauauguuaguuuugggca

SEQ ID NO: 96691 - RNA, 45 nt, Mus musculus
gcuuagaaacuaaaggcugaagagaaauaaaggauaggcuaggag

SEQ ID NO: 96692 - RNA, 42 nt, Mus musculus
gaacaagggugggcagauguaagggauguaugcucgggcagg

SEQ ID NO: 96693 - RNA, 44 nt, Mus musculus
ccaagcgggccuuuguacauugguauguuggagaggguauggaa

SEQ ID NO: 96694 - RNA, 42 nt, Mus musculus
uggaaccaacacaaagaaagaggcauagucauggggcaagug

SEQ ID NO: 96695 - RNA, 44 nt, Mus musculus
caacucuccagacaggagcccagagcaucaauaaguggcugugg

SEQ ID NO: 96696 - RNA, 45 nt, Mus musculus
uuuaauggggaauauccagcuaaaggugagagcaccacgguggaa

SEQ ID NO: 96697 - RNA, 46 nt, Mus musculus
gaaaaauucuauuugucaaaacaacaacaacaaaaccagcacacag

SEQ ID NO: 96698 - RNA, 41 nt, Mus musculus
cucaaagucuuuuaagaguaacaacuguagaaauugcccug

SEQ ID NO: 96699 - RNA, 42 nt, Mus musculus
agagagcuguugugaagaacuaggaaacacuaaagccuucag

SEQ ID NO: 96700 - RNA, 46 nt, Mus musculus
aaguuugaagucaaaguugcaguaccagagacaaucaccauccugg

SEQ ID NO: 96701 - RNA, 45 nt, Mus musculus
gucacaugagaaaggaaaggaaagagaacacgugugucaagaaag

SEQ ID NO: 96702 - RNA, 57 nt, Mus musculus
ggcaagaguaugagaugcagcuugaugugaaugccaagauccaagaagaaggaacag

SEQ ID NO: 96703 - RNA, 45 nt, Mus musculus
ucuguaugauugacucuucacaucucccaaugccuuucccucucu

SEQ ID NO: 96704 - RNA, 45 nt, Mus musculus; identical to SEQ ID NO: 96703

SEQ ID NO: 96705 - RNA, 45 nt, Mus musculus; identical to SEQ ID NO: 96703

SEQ ID NO: 96706 - RNA, 65 nt, Mus musculus
ucuguaugauugacucuucacaucucccaaugccuuucccucucuguaugauugacucuucacau

SEQ ID NO: 96707 - RNA, 64 nt, Mus musculus
cucccaaugccuuucccucucuguaugauugacucuucacaucucccaaugccuuucccucucu

SEQ ID NO: 96708 - RNA, 45 nt, Mus musculus; identical to SEQ ID NO: 96703

SEQ ID NO: 96709 - RNA, 45 nt, Mus musculus; identical to SEQ ID NO: 96703

SEQ ID NO: 96710 - RNA, 46 nt, Mus musculus
augucccuguuucauaugcaaacauggaaagauuaauucagaugaa

SEQ ID NO: 96711 - RNA, 49 nt, Mus musculus
ccaagucauaguaggcagccuggguuuauuauuauaguguuaauuaaug

SEQ ID NO: 96712 - RNA, 25 nt, Mus musculus
gucuucagagucucccacagagacu

SEQ ID NO: 96713 - RNA, 46 nt, Mus musculus
uuggugaucguggaguaaguuacuuauuuuuauauaagaugcagag

SEQ ID NO: 96714 - RNA, 46 nt, Mus musculus
acaguucuuuagaguaacuuaugagauuuacuucauuugggaucag

SEQ ID NO: 96715 - RNA, 44 nt, Mus musculus
cuucugccuguccaaugacacuggguugggccucucuccuguga

SEQ ID NO: 96716 - RNA, 44 nt, Mus musculus
gagaggccuucacgcucaaggccacugugcugaacuaccuccag

SEQ ID NO: 96717 - RNA, 89 nt, Mus musculus
gguguacagcuggaggccucuccugauuuccuagcuaccccagaggagaaggaacaaaagucucacugcaucuguaugaacgagcggca

SEQ ID NO: 96718 - RNA, 48 nt, Mus musculus
gacucuaaggagcuguguaggaaugaggugccagugguuccugaacgu

SEQ ID NO: 96719 - RNA, 42 nt, Mus musculus
cugguauagaaccccaacaccuaguuguuguacaaauggcag

SEQ ID NO: 96720 - RNA, 45 nt, Mus musculus
uucauuuuccucuuuauauauucuaccaggauuaaaauggcacau

SEQ ID NO: 96721 - RNA, 42 nt, Mus musculus
guccuggacuaucugaaugaaacagagcagcugacacaggag

SEQ ID NO: 96722 - RNA, 25 nt, Mus musculus
gcucagaaacccagagugccagcag

SEQ ID NO: 96723 - RNA, 45 nt, Mus musculus
cagagcaaccgcggcucagaagcccccaagaaugugucucugagg

SEQ ID NO: 96724 - RNA, 46 nt, Mus musculus
cucccuagggcucccuagcaggaucuccagccagaaccacggccaa

SEQ ID NO: 96725 - RNA, 44 nt, Mus musculus
ugaaggcauuuguggucaaacuucugauaaauacaggcccaaau

SEQ ID NO: 96726 - RNA, 26 nt, Mus musculus
cuugauucagugugguguauguuuga

SEQ ID NO: 96727 - RNA, 45 nt, Mus musculus; identical to SEQ ID NO: 76267

SEQ ID NO: 96728 - RNA, 46 nt, Mus musculus
auuaccugaggagggacaagaacaauggagagcacuacggagagca

SEQ ID NO: 96729 - RNA, 45 nt, Mus musculus; identical to SEQ ID NO: 76269

SEQ ID NO: 96730 - RNA, 92 nt, Mus musculus
uuuucccauagauaagugggucagacacuucccugagccagcaggagagacaggugcagcaguguccccacccaaagcagagaccugcagag

SEQ ID NO: 96731 - RNA, 42 nt, Mus musculus
uccuguguucagauuaacuguguuguuacuuaguggccuagg

SEQ ID NO: 96732 - RNA, 36 nt, Mus musculus
aguaaggauuccccacgaaugacugaguaaaagcag

SEQ ID NO: 96733 - RNA, 46 nt, Mus musculus
agucucugaucacaacucuuuguccguacuuccccgguggccuuuc

SEQ ID NO: 96734 - RNA, 59 nt, Mus musculus
cugcauuccaccuuuagcagucaaauaauaaauugaggagggagaggaggaggauagug

SEQ ID NO: 96735 - RNA, 46 nt, Mus musculus
uguuaguuacuuuugcuguuguugugauuaaaacaccaugaccaag

SEQ ID NO: 96736 - RNA, 46 nt, Mus musculus
aaauguuccuuucacgaagguguguacguacuucugagcagauagg

SEQ ID NO: 96737 - RNA, 47 nt, Mus musculus
ggccacaaguuccaccacacuauuggugguucccgccgugcagccug

SEQ ID NO: 96738 - RNA, 41 nt, Mus musculus
uccacaaacacagagaaaugcgugggcugacaucugcuggc

SEQ ID NO: 96739 - RNA, 49 nt, Mus musculus
acuuacggcaagccuguccaccaugguguuaaccagcugaaauuugccc

SEQ ID NO: 96740 - RNA, 45 nt, Mus musculus
cagcucucugcgcugcacagggcuccccgccccacccggccugau

SEQ ID NO: 96741 - RNA, 46 nt, Mus musculus
acuaggcaaacuguggggaccaggaagacccacacucaugucagug

SEQ ID NO: 96742 - RNA, 41 nt, Mus musculus
guaagcaagaauaguucucgggaugaaaaacugcaggcauu

SEQ ID NO: 96743 - RNA, 46 nt, Mus musculus
aaaaaaauaaauaaauaaaaauaucccaccaucuuuucugcuagua

SEQ ID NO: 96744 - RNA, 46 nt, Mus musculus
uacaguguacuuacauauaauaaauaaauuuuaaaaaggccaguca

SEQ ID NO: 96745 - RNA, 45 nt, Mus musculus
aaucaaucaaucaaucacauaauuaugauuuuaacaggcgcauag

SEQ ID NO: 96746 - RNA, 46 nt, Mus musculus
gaaacaaacugggaaauauauaaaucacauaauuggggcuggagag

SEQ ID NO: 96747 - RNA, 45 nt, Mus musculus
agaaaggaaaaaagccaggcacaccuuuauuuccagcacccagga

SEQ ID NO: 96748 - RNA, 59 nt, Mus musculus
ucugacugccagggcuacauagagagagccugccucaaagaaccaaagaucacaagaaa

SEQ ID NO: 96749 - RNA, 46 nt, Mus musculus
aaaucccagcaaccacaugguggcucacaaccauacguaacaagau

SEQ ID NO: 96750 - RNA, 45 nt, Mus musculus
auuaauguuacuguaguuucuguuuugaaauaaaacuucugaaug

SEQ ID NO: 96751 - RNA, 73 nt, Mus musculus
uugggauuuaaaaacucagauugcuauggaaaggggcuuugcugggaaaggcgacuccucuaacuucaccucu

SEQ ID NO: 96752 - RNA, 60 nt, Mus musculus
caggucacuggaucccacugucacccucggugcuuacacauuucagacccuuuaggcaaa

SEQ ID NO: 96753 - RNA, 43 nt, Mus musculus
ccaucaggguugucuccauuuauggaaguggaggaggggacag

SEQ ID NO: 96754 - RNA, 65 nt, Mus musculus
uccugaagacccaguugugggccaaggguggcuuuauuuaaagggaguuaagaaacauggcauau

SEQ ID NO: 96755 - RNA, 45 nt, Mus musculus
cagcccugaccucacaccuuuccauugcgccuccuagcuguagug

SEQ ID NO: 96756 - RNA, 86 nt, Mus musculus
cccuguuggagagaggugcuuccuugaggucugagguuggaaggcucuaccucacuacagcuaggaggcgcaauggaaagguguga

SEQ ID NO: 96757 - RNA, 76 nt, Mus musculus
uguguacagaagcagcacugccucugcuagguggagcuugcacccaggauuagaugccacccauuggguucccugu

SEQ ID NO: 96758 - RNA, 97 nt, Mus musculus
gguuuaaagggauucauagcuaacuuggauuuuguuaccucagcucugggagaggauuuucgcuggaugacuauuaaugacuuguuuugagggagua

SEQ ID NO: 96759 - RNA, 53 nt, Mus musculus
gagaggcauuaguuucuucaacuuaguuuuuuuuuaagagauuuuagguguug

SEQ ID NO: 96760 - RNA, 45 nt, Mus musculus
gacagagaggguguugguccagggaaaggagaggcuugcggugac

SEQ ID NO: 96761 - RNA, 79 nt, Mus musculus
uuacuaaaaucuaggcuuguuacuaaaguggucuuuguaguuagugauauugauggauuuuuauguugcauggagucca

SEQ ID NO: 96762 - RNA, 79 nt, Mus musculus
agggaggauggauguuacugguggccugugagucacuuccuuuguagaugaagggacacuaucccuuguuauuucucag

SEQ ID NO: 96763 - RNA, 45 nt, Mus musculus
auagugucccuucaucuacaaaggaagugacucacaggccaccag

SEQ ID NO: 96764 - RNA, 71 nt, Mus musculus
gagguuggagggagguguuuaaagagagguucaggaggaaagaaaguuuggugcuggagagagguuacaac

SEQ ID NO: 96765 - RNA, 80 nt, Mus musculus
caaccugaagauaaaauaaauaaaacucaaguuacuuugcugugcagagcuguaucaagugaggagggggucuuuuguuc

SEQ ID NO: 96766 - RNA, 71 nt, Mus musculus
gugcagcaccgcccccaccaccaccuuaguuugccaggaaacagaucuucauacccaguguggagggcccu

SEQ ID NO: 96767 - RNA, 47 nt, Mus musculus
gaagaucuguuuccuggcaaacuaaggugguggugggggcggugcug

SEQ ID NO: 96768 - RNA, 49 nt, Mus musculus
guuguccuaguuagcggguuuuagaaccuaaggggagcugcggccccuu

SEQ ID NO: 96769 - RNA, 49 nt, Mus musculus
acacacuccaugaaaacucagcugcacccaaugcugggguugaccagau

SEQ ID NO: 96770 - RNA, 60 nt, Mus musculus
cucagaagcaguccugguucauccugaugaggucuccccacuuaaggggagguggcuuuc

SEQ ID NO: 96771 - RNA, 50 nt, Mus musculus
gccaccuccccuuaaguggggagaccucaucaggaugaaccaggacugcu

SEQ ID NO: 96772 - RNA, 45 nt, Mus musculus
ucgaaaguccugccuuuggucuccgggacuuugaagaaggugaag

SEQ ID NO: 96773 - RNA, 122 nt, Mus musculus
ggccuacuuaggagccuacguuuuuaucaucuucgcugccuuccucaucuucuuccuaaucuucaccuucuucaaagucccggagaccaaaggcaggacuuucgaggacauugcccgggccu

SEQ ID NO: 96774 - RNA, 46 nt, Mus musculus
ugggccagcauggggcucacggcugcaauccuagcacuugggaagc

SEQ ID NO: 96775 - RNA, 41 nt, Mus musculus
aauucaaaauuaaacauggccucucacaaaccagccgacug

SEQ ID NO: 96776 - RNA, 46 nt, Mus musculus
aagagcauuccgaccagaaaguuggagguccaguuacaacagccag

SEQ ID NO: 96777 - RNA, 48 nt, Mus musculus
gccauugcgguggcuggcuguuguaacuggaccuccaacuuucugguc

SEQ ID NO: 96778 - RNA, 49 nt, Mus musculus
cuugaucuacguagccuucuuugagauuggaccuggccccauucccugg

SEQ ID NO: 96779 - RNA, 65 nt, Mus musculus
gaucaggugccccagacucacaugguacaaagcagcuggaagauuaggaauucaaggcuacccua

SEQ ID NO: 96780 - RNA, 45 nt, Mus musculus
cagcgaaaucgucaugaaaacggagcaaacagccaugccucccag

SEQ ID NO: 96781 - RNA, 49 nt, Mus musculus
gagagggcagggaggagaacccugcauaugauaggccugggaggcaugg

SEQ ID NO: 96782 - RNA, 46 nt, Mus musculus
uaauaguggaugaugagcauacuaagccaucuucagucacucagaa

SEQ ID NO: 96783 - RNA, 45 nt, Mus musculus
acagugaagauaguauugaccacgccugcuccaaucguggcauag

SEQ ID NO: 96784 - RNA, 33 nt, Mus musculus
gaaucuucaaggacgcggguguccaggaaccga

SEQ ID NO: 96785 - RNA, 42 nt, Mus musculus
acagauaccuucuuauaauccuugcacuggagaggcagagac

SEQ ID NO: 96786 - RNA, 59 nt, Mus musculus
aaucuuuagaaagaaagaaagaaagaaagaaagaaagagagagagagagagagagagag

SEQ ID NO: 96787 - RNA, 41 nt, Mus musculus
caucuuuaaucuuaacuaggaaggguaagacaggaggauua

SEQ ID NO: 96788 - RNA, 45 nt, Mus musculus
aaaaccaggacuacauagaggggccuugucucaaaagcagcaaca

SEQ ID NO: 96789 - RNA, 45 nt, Mus musculus
uagaguaaaaaggauaaugcugaucagggccugaggacugcagag

SEQ ID NO: 96790 - RNA, 45 nt, Mus musculus
aaaucaggagaccugaguggggucugucaaaauuccuugggagag

SEQ ID NO: 96791 - RNA, 45 nt, Mus musculus
acagcaaugggacaagccccaaggcaauagaaaaagccagaagua

SEQ ID NO: 96792 - RNA, 45 nt, Mus musculus
caacuacguccagccgcuucucaucuccauuguccuccagcuguc

SEQ ID NO: 96793 - RNA, 47 nt, Mus musculus
agcgcuuguggggcaccucggacgugguccaggagauccaggagaug

SEQ ID NO: 96794 - RNA, 49 nt, Mus musculus
guguucugacccugcugucugagucaggaccugagaaugaaguaggaag

SEQ ID NO: 96795 - RNA, 46 nt, Mus musculus
auuauauagaaguacaccauagcugucuucaaauacaccagaagag

SEQ ID NO: 96796 - RNA, 47 nt, Mus musculus
ucugacauccaacaagaauaagcauaaauugaauguaaauguuugca

SEQ ID NO: 96797 - RNA, 45 nt, Mus musculus
gaaggucguuugaguucagaugaacauguaaaugaacaccaguga

SEQ ID NO: 96798 - RNA, 45 nt, Mus musculus
uaagguugugcacagcaauagacuauaggucuuucagguccgcag

SEQ ID NO: 96799 - RNA, 42 nt, Mus musculus
uccuuuuuguuaaugagcaagaaucuuggacucucagggcaa

SEQ ID NO: 96800 - RNA, 80 nt, Mus musculus
uccagcuauccugcaaagcgcagcccuuccauuuugcccugagaguccaagauucuugcucauuaacaaaaaggaggaag

SEQ ID NO: 96801 - RNA, 49 nt, Mus musculus
agaaauagaaacaauuuguuuucucuuuccuauuuaugguaaaaggaua

SEQ ID NO: 96802 - RNA, 46 nt, Mus musculus
aucuggcauguguucaauuguguauuuauauguacauguuucagau

SEQ ID NO: 96803 - RNA, 46 nt, Mus musculus
ucuagauagagugcuucacguaugucaguucauucauggcgcacag

SEQ ID NO: 96804 - RNA, 86 nt, Mus musculus
uggagaggugucucccacugcccuucggggugcauuuggcacacuaaaccagcugggcaucguuguugggauucugguagcucagg

SEQ ID NO: 96805 - RNA, 45 nt, Mus musculus
ccagcugguuuagugugccaaaugcaccccgaagggcagugggag

SEQ ID NO: 96806 - RNA, 45 nt, Mus musculus
cccgugcacaggccacagaaaaugccaaugaguaagcggcccagg

SEQ ID NO: 96807 - RNA, 69 nt, Mus musculus
gcaacucuaugcuucuagucaacuugcuggccaucauugcgggcugccuuaugggauucgccaagauag

SEQ ID NO: 96808 - RNA, 46 nt, Mus musculus
agcccacagcagcaaaaaggaaagagauugacaucuacggaggcuu

SEQ ID NO: 96809 - RNA, 45 nt, Mus musculus
agugacuuuuucccuuuagacaaagaaccucacuaaagaagagaa

SEQ ID NO: 96810 - RNA, 45 nt, Mus musculus
auggcucggugguuaagagcacugacugcucuuucagagguccuc

SEQ ID NO: 96811 - RNA, 46 nt, Mus musculus
gcaaacacacaaugcuagcaccccagagacucaggcacggggauua

SEQ ID NO: 96812 - RNA, 45 nt, Mus musculus
agccgccugccucugcuuccugggugccaugacauccagccagaa

SEQ ID NO: 96813 - RNA, 52 nt, Mus musculus
cggaaguucccauuuuagcucccaggcugguuuaauuuugcuagagugaggu

SEQ ID NO: 96814 - RNA, 58 nt, Mus musculus
gccugcacugguuacccgaaagacagcagagcacaucgggucagggggauaaugcugu

SEQ ID NO: 96815 - RNA, 49 nt, Mus musculus
auuggcucuuuuucuguuggacucuuugucaaccgcuuuggcagguacu

SEQ ID NO: 96816 - RNA, 43 nt, Mus musculus
uuuuucgugcagauccuaaaggacuuucuuaacuacacuuugg

SEQ ID NO: 96817 - RNA, 47 nt, Mus musculus
gccgaaaugaaaagggauugcaaacugaguuuuaaguaggacuggga

SEQ ID NO: 96818 - RNA, 45 nt, Mus musculus
aaagucccaguccuacuuaaaacucaguuugcaaucccuuuucau

SEQ ID NO: 96819 - RNA, 97 nt, Mus musculus
aggugaccccaucucugguguucgccgugacuguugccacgaucggcucuuuccaguuuggcuacaacacuggagucaucaaugcaccugagacagu

SEQ ID NO: 96820 - RNA, 55 nt, Mus musculus
cuuggaguacagagcgugggaccuccucucaaagagaggaagaggagaugagaga

SEQ ID NO: 96821 - RNA, 69 nt, Mus musculus
caccucgcaccugugacuccaaaccugagaggcugaagcaggagaagugaggagcugacuugagguuag

SEQ ID NO: 96822 - RNA, 58 nt, Mus musculus
agggaaguccaguuguccuuacuaugguugugagugcaggauguaucggaguuagugu

SEQ ID NO: 96823 - RNA, 46 nt, Mus musculus
gguagcugugaugagagcgaagaggguaggacuuggccgcgggggu

SEQ ID NO: 96824 - RNA, 46 nt, Mus musculus
ccgugcuccgguuucuccuaagucaccgagccauccggacggaggc

SEQ ID NO: 96825 - RNA, 62 nt, Mus musculus
aggaacacuugcugccgagaacauuggcuggauaccucuagaucuaccuuaagacuugagaa

SEQ ID NO: 96826 - RNA, 41 nt, Mus musculus
cuucaggggaggggucgccuucccucccccgcaccgggagu

SEQ ID NO: 96827 - RNA, 46 nt, Mus musculus
ugaagcaaaccuggucccuuucuccuuaaaggagggucuuugccaa

SEQ ID NO: 96828 - RNA, 45 nt, Mus musculus
aagguguuuuucuuuuuuucuuuuccuuuucuuuuuuucuuuaag

SEQ ID NO: 96829 - RNA, 45 nt, Mus musculus
aaacgcaacaguucaugucugcaauccuagcacuccuaaagugag

SEQ ID NO: 96830 - RNA, 26 nt, Mus musculus
agcaaacaauuucugcagggcacggu

SEQ ID NO: 96831 - RNA, 46 nt, Mus musculus
ugggaggucacuaacaaaauugaucuuuuuaaaagguauuuauaag

SEQ ID NO: 96832 - RNA, 45 nt, Mus musculus
uaauaauaaauaaaucuuaaaaaaaaaagaaagaaagaaagagca

SEQ ID NO: 96833 - RNA, 46 nt, Mus musculus
aaacagucucaaaaaaaguuaaaaagaugcuaguacaaggggagau

SEQ ID NO: 96834 - RNA, 42 nt, Mus musculus
gugcaagcauauguguguguguguguguguguguguauaaaa

SEQ ID NO: 96835 - RNA, 45 nt, Mus musculus
caaaucccagcaaccacauggugcucacaaccaucuguaauggga

SEQ ID NO: 96836 - RNA, 45 nt, Mus musculus
uugugagcaccaugugguugcugggauuugaacucaggaccucug

SEQ ID NO: 96837 - RNA, 45 nt, Mus musculus
uaugauuaaugaaaacaaaacuuagccaagaaaaaaaagaaaaga

SEQ ID NO: 96838 - RNA, 45 nt, Mus musculus
aguacacuguaacugucuacagacacuccagaagaggacaucaga

SEQ ID NO: 96839 - RNA, 49 nt, Mus musculus
cgucugcauuacgcagcccaccccccaaaaagaaagugagacgucagca

SEQ ID NO: 96840 - RNA, 45 nt, Mus musculus
aaagggugggccugggaaggaucagaugugugugagcaugcgcag

SEQ ID NO: 96841 - RNA, 41 nt, Mus musculus
ucacguucccuugacguuuuugguugacuugucgggaggag

SEQ ID NO: 96842 - RNA, 45 nt, Mus musculus
uauguaaagcugacugaaauaaaaagaagcaggcagcgugggaaa

SEQ ID NO: 96843 - RNA, 46 nt, Mus musculus
cccauuccagcuguucggguagaugacuaauuuuugaugccugcag

SEQ ID NO: 96844 - RNA, 42 nt, Mus musculus
agaaagaaagagagagagagagagagagagagaaaacaauua

SEQ ID NO: 96845 - RNA, 46 nt, Mus musculus
gugucugguguggugugucuggugugugugugugugugugugugug

SEQ ID NO: 96846 - RNA, 46 nt, Mus musculus
guaggaugcuaggaucgauaaacuauagucuggaccuggcacagga

SEQ ID NO: 96847 - RNA, 41 nt, Mus musculus
uaugugccugugugaguuuuguguaccaugcagcugcccga

SEQ ID NO: 96848 - RNA, 46 nt, Mus musculus
guuuccuuauguaugugucaaaaggccagaggccagcaaagggaga

SEQ ID NO: 96849 - RNA, 46 nt, Mus musculus
gccaagaaagaccacugugaaggcucugagauuuauacauugaagg

SEQ ID NO: 96850 - RNA, 41 nt, Mus musculus
guguagagcuggaauaagcaacacugacuggagcuggguau

SEQ ID NO: 96851 - RNA, 46 nt, Mus musculus
uagggucaaggaagcaaugggaaggcaaacaguaaaagcauuaggu

SEQ ID NO: 96852 - RNA, 41 nt, Mus musculus
gaaagguggaggaagaaagagggaguagagagagcucgaga

SEQ ID NO: 96853 - RNA, 30 nt, Mus musculus
aagaagaagaagaagaagaagaggaagcag

SEQ ID NO: 96854 - RNA, 46 nt, Mus musculus
ucuaauacacagcacuccuaggaagaaaaccagaaggauuccagug

SEQ ID NO: 96855 - RNA, 42 nt, Mus musculus
uuccccgcauccacaugguggcucacaaccaucuguaaugga

SEQ ID NO: 96856 - RNA, 46 nt, Mus musculus
guccuuguaugaaggguucucagaaaaaggggacauuccacaccug

SEQ ID NO: 96857 - RNA, 41 nt, Mus musculus
acaggaggcuggagagauggcucagugguuaagagcaguua

SEQ ID NO: 96858 - RNA, 41 nt, Mus musculus
ucccagcaaccaucuguaaugggaucugaugcccucuuaug

SEQ ID NO: 96859 - RNA, 46 nt, Mus musculus
accuggcagagagguuccugucugggucaaacuuaagaugguugag

SEQ ID NO: 96860 - RNA, 46 nt, Mus musculus
uuaacucucaaccaaaccuuuuaccacgugagccuugggugugggg

SEQ ID NO: 96861 - RNA, 43 nt, Mus musculus
cggaugauaaaaggaauggaaggagagauaguggccugggagc

SEQ ID NO: 96862 - RNA, 41 nt, Mus musculus
ugaggcaggugccuugugaacuguuuuuaauuaggccuaga

SEQ ID NO: 96863 - RNA, 76 nt, Mus musculus
ugguagguaaaaauaaaauaaaaucuuguuaagauaagauaauugcaggcagagaaaauacugguuugaagaaaga

SEQ ID NO: 96864 - RNA, 41 nt, Mus musculus
uugcuuagcacggacgagucucuagauucaguccccaguga

SEQ ID NO: 96865 - RNA, 46 nt, Mus musculus
ggagcuaaggaaggcugggaagauguagcuuaaaaacuaaucagag

SEQ ID NO: 96866 - RNA, 25 nt, Mus musculus
uuuuuuaaaaaaaaagaggcuaaug

SEQ ID NO: 96867 - RNA, 46 nt, Mus musculus
aaucccagcaaccacaugguggcucgcaaccauccguaacgaaauc

SEQ ID NO: 96868 - RNA, 41 nt, Mus musculus
gguugcgagccaccaugugguugcugggauuugaacucggg

SEQ ID NO: 96869 - RNA, 42 nt, Mus musculus
uguuucuaaggggucacucuggcuguugucuagagauuagau

SEQ ID NO: 96870 - RNA, 41 nt, Mus musculus
ugacacagggccucacaugugcaggacaugagaacgccuaa

SEQ ID NO: 96871 - RNA, 42 nt, Mus musculus; identical to SEQ ID NO: 67340

SEQ ID NO: 96872 - RNA, 46 nt, Mus musculus
cagcaccgaggcgggcccaacgggcgcaaccacaagaggaccuucc

SEQ ID NO: 96873 - RNA, 42 nt, Mus musculus
uugaccacccagaugcuuuugauaaugaucugaugcacaaga

SEQ ID NO: 96874 - RNA, 46 nt, Mus musculus
uguuugugagccaccaugugguugcuggaaauugaacucaggaccu

SEQ ID NO: 96875 - RNA, 42 nt, Mus musculus
gauuaagucuggguucuacagcaaguuggcauuggugccagg

SEQ ID NO: 96876 - RNA, 46 nt, Mus musculus
ugaagagaaauuugaagaaggaucaagucuugcuacaauagagaga

SEQ ID NO: 96877 - RNA, 47 nt, Mus musculus
aguguacucauacauaaaauaaauaaaucuuaaaaaaaaaaaaaauu

SEQ ID NO: 96878 - RNA, 46 nt, Mus musculus
cauccuuaacgauaucugacucccucuucuagaaugucugaagaca

SEQ ID NO: 96879 - RNA, 42 nt, Mus musculus
ucccagcaaccacaugguggcucacaaccauccguaaugcuc

SEQ ID NO: 96880 - RNA, 46 nt, Mus musculus
uucuaugcaugaaagaaagaaagaaagaaagaaagaaagaaagaaa

SEQ ID NO: 96881 - RNA, 45 nt, Mus musculus
uuguuuaacuagccaugcacacugguucagcaaaggaaggaagaa

SEQ ID NO: 96882 - RNA, 41 nt, Mus musculus
cacccccacccgugugugugugugugugugugugugugugu

SEQ ID NO: 96883 - RNA, 42 nt, Mus musculus
acuggacuggaacuguagauccucuuacauaagccuccagag

SEQ ID NO: 96884 - RNA, 42 nt, Mus musculus
acaccugugaugugaggugaaggcaggaugaggauguucaga

SEQ ID NO: 96885 - RNA, 45 nt, Mus musculus
aaauggugaaaaggaaacgcaagggauuuaucuccacguagagaa

SEQ ID NO: 96886 - RNA, 45 nt, Mus musculus
gucccguggaugugauggagucugcccuuuggcugccuuucccag

SEQ ID NO: 96887 - RNA, 45 nt, Mus musculus
gucaaucgccacugcccucuacgaacggggaagugaggagguaag

SEQ ID NO: 96888 - RNA, 46 nt, Mus musculus
acugagguuugcauuuggagggcugcccucuuggggaaggaauagu

SEQ ID NO: 96889 - RNA, 45 nt, Mus musculus
ggccuccagggggcgcccggaagugcuccccaggcucgcccacag

SEQ ID NO: 96890 - RNA, 53 nt, Mus musculus
agccacgguacagcuaugccacccucaucaccuacgccaucaacuccucccca

SEQ ID NO: 96891 - RNA, 45 nt, Mus musculus
cgcuggaucugcgacaacuuccccuauuacaagaacgcuggcauc

SEQ ID NO: 96892 - RNA, 45 nt, Mus musculus
caucagcuucaaaagcuuuaucagggccuuuaaucccagcacucg

SEQ ID NO: 96893 - RNA, 42 nt, Mus musculus
cugcgcacugacacaugcgcacugcggcuuucccuuucccca

SEQ ID NO: 96894 - RNA, 41 nt, Mus musculus
auugggaaagaaggaaaaagcaaaggaggaaaacccagcca

SEQ ID NO: 96895 - RNA, 45 nt, Mus musculus
ucucucucucucccccccccucucucucucucucucucucucucu

SEQ ID NO: 96896 - RNA, 46 nt, Mus musculus
uggaacaaucagugaauccccuaaaaguagcaugaauugucaccag

SEQ ID NO: 96897 - RNA, 45 nt, Mus musculus
ccucaucagcaccauccccacucccacccugcccagcagccacca

SEQ ID NO: 96898 - RNA, 23 nt, Mus musculus
gcaguccuagaggagaaaacccu

SEQ ID NO: 96899 - RNA, 45 nt, Mus musculus
cugacuguaccaguguuaucuccagcuuccuucuuggugucauug

SEQ ID NO: 96900 - RNA, 45 nt, Mus musculus
ucacagcagacucauaccugugauacugcugacgggagguugggg

SEQ ID NO: 96901 - RNA, 46 nt, Mus musculus
uuccuccagcagugugcgauguacuggagagcaucuggugggccag

SEQ ID NO: 96902 - RNA, 45 nt, Mus musculus
cccauccagguguagucuccacagcuucccuuugguuuccucgag

SEQ ID NO: 96903 - RNA, 42 nt, Mus musculus
gcaagacagucuauaaagggcauucuggaagcagccuucagc

SEQ ID NO: 96904 - RNA, 32 nt, Mus musculus
ucagaaugcgaaaaaccaacuucaccaagucu

SEQ ID NO: 96905 - RNA, 46 nt, Mus musculus
gaacguagcacggcaaugcuugguagcaaugccuguccggccagca

SEQ ID NO: 96906 - RNA, 33 nt, Mus musculus
gaguaaguauuuuaauggguagaauuuuagugu

SEQ ID NO: 96907 - RNA, 73 nt, Mus musculus
ucauuuugcuucacuuacagcugagucguauguccuuguguuucaggaugucuucuucaggcccgugggagag

SEQ ID NO: 96908 - RNA, 46 nt, Mus musculus
ggcucauaggcaauggcacuacuaagagaugugaccuugguguagg

SEQ ID NO: 96909 - RNA, 42 nt, Mus musculus
gugugugugugcauguggguauacauggaugcccauggaggu

SEQ ID NO: 96910 - RNA, 37 nt, Mus musculus
agagagaagagagagaagagagaggagagagagaaga

SEQ ID NO: 96911 - RNA, 46 nt, Mus musculus
ucagugucucauauaauguugauuguuuuaauguuguuucuugggu

SEQ ID NO: 96912 - RNA, 45 nt, Mus musculus
augugcugauuaagggaauucuaugcuaaaucuuggacuuggugg

SEQ ID NO: 96913 - RNA, 46 nt, Mus musculus
ggagagacuccugaaugaggaagagaaggcuggaagucugguuugu

SEQ ID NO: 96914 - RNA, 42 nt, Mus musculus
agagagagagagagagagagagagagacagacuaaggaaccu

SEQ ID NO: 96915 - RNA, 41 nt, Mus musculus
uccaugugguuacaagucaggaugacucugauggccacgag

SEQ ID NO: 96916 - RNA, 46 nt, Mus musculus
gacugugugucuuugggauagaaauaucaaggaagcacggugucau

SEQ ID NO: 96917 - RNA, 42 nt, Mus musculus
uuaaaggggggggggauugauuaucugagagauucaggggag

SEQ ID NO: 96918 - RNA, 46 nt, Mus musculus
cuucacagccaaagcaggccuaauuacauacuuuacaggcccccag

SEQ ID NO: 96919 - RNA, 45 nt, Mus musculus
accaucagaugggucuaagggcacuuguaaucccagcacucagga

SEQ ID NO: 96920 - RNA, 45 nt, Mus musculus
cuccccauucucccuagcuagugcucucaauucagggcugcagau

SEQ ID NO: 96921 - RNA, 46 nt, Mus musculus
gcauuguuacuggucguggcaguauugguaauagguguggugguga

SEQ ID NO: 96922 - RNA, 42 nt, Mus musculus
ggugauguugguguugccuauggcuuugcuguugcugcuguu

SEQ ID NO: 96923 - RNA, 46 nt, Mus musculus
auuaaguaaaccugaaugcaaaagaucacagcguggcagccugaga

SEQ ID NO: 96924 - RNA, 42 nt, Mus musculus
agagagagugagagacagggacagagagagugagagagaguc

SEQ ID NO: 96925 - RNA, 46 nt, Mus musculus
ggagagagagaaagagagccagagacagagagagacagagacagag

SEQ ID NO: 96926 - RNA, 46 nt, Mus musculus
ugggguuggcauugucguuuuccuuguugugaugcuugggguagau

SEQ ID NO: 96927 - RNA, 47 nt, Mus musculus
aauuuacagcaaagcaugcuuccaaccugguucuggcuguauggaga

SEQ ID NO: 96928 - RNA, 45 nt, Mus musculus
auuacuacauggaacaugaagaaggugguagguucuucuaccaga

SEQ ID NO: 96929 - RNA, 46 nt, Mus musculus
ccuucuucagccuguggguugguacacuagccccccugccccauac

SEQ ID NO: 96930 - RNA, 45 nt, Mus musculus
ucucuccucuagucaacuguaguggagauguguucacugcccuga

SEQ ID NO: 96931 - RNA, 84 nt, Mus musculus
gggucagugaccagguggaucaucacgaaagggagucagaugguagagcaaaguugcucaucacagggcagcagggaggcagag

SEQ ID NO: 96932 - RNA, 42 nt, Mus musculus
gagcuugucuagggguuacuuauagguacaucggcaccuuac

SEQ ID NO: 96933 - RNA, 54 nt, Mus musculus
cugcugacugcccuuuaccuccaaaaucagagagccagagagccagagagccag

SEQ ID NO: 96934 - RNA, 43 nt, Mus musculus
ggggcgcccgcaguuaagauggcgucuacagcggacggggaca

SEQ ID NO: 96935 - RNA, 25 nt, Mus musculus
uuugagccugggcuaaugguuugag

SEQ ID NO: 96936 - RNA, 46 nt, Mus musculus
acaugguggcucacaaucaucugugaugagaucugacacccucuuc

SEQ ID NO: 96937 - RNA, 55 nt, Mus musculus
ugagaagaauaaauaaaagaaaaaaaaaguuggagacaauugggcugggaagagu

SEQ ID NO: 96938 - RNA, 46 nt, Mus musculus
ccuugcuucugacccaguuuguuggcguuggcguugggguuggcaa

SEQ ID NO: 96939 - RNA, 41 nt, Mus musculus
aaggauaauucagagauuaucauuugagagaggaagguagg

SEQ ID NO: 96940 - RNA, 45 nt, Mus musculus
ucucucucccucucucccccucucucucucucucucucucucucu

SEQ ID NO: 96941 - RNA, 46 nt, Mus musculus
cgagccuaauuaauaacucuugcacaucaaaggguagugucgugag

SEQ ID NO: 96942 - RNA, 46 nt, Mus musculus
ggauuaucccaaucuaagugagaucauguguccagaaagcgggaga

SEQ ID NO: 96943 - RNA, 45 nt, Mus musculus
auguaaucccagcguuugggaguagaggcaggaguucacgggcau

SEQ ID NO: 96944 - RNA, 44 nt, Mus musculus
ggccacaugugucuuugccugcugugccaucucacuugcccaag

SEQ ID NO: 96945 - RNA, 46 nt, Mus musculus
uuuauauacauguuuuaaauaauuuacuuauuuccugugcuuuggu

SEQ ID NO: 96946 - RNA, 46 nt, Mus musculus
aagccguucugagagaaagaugagauggugccauaagaugugggag

SEQ ID NO: 96947 - RNA, 42 nt, Mus musculus
aguaagaccuugucgaaggaaggaaggaaggaaggaaggaag

SEQ ID NO: 96948 - RNA, 44 nt, Mus musculus
uuaagugacacaacucugggagcccucugccucauccugccguc

SEQ ID NO: 96949 - RNA, 42 nt, Mus musculus
ggucaggaaacaagaugaaucagaaaaaaaaaugggccagag

SEQ ID NO: 96950 - RNA, 84 nt, Mus musculus
gaccuacagaauuugcugauucggggaaggaagcuaaagacgauagcaggauuuuagaucugagaaacagaaaaguugcagucu

SEQ ID NO: 96951 - RNA, 50 nt, Mus musculus
accaagacugcauagugagaccuugucuuaaaacaaaaauaagauaaagu

SEQ ID NO: 96952 - RNA, 40 nt, Mus musculus
caagcaggaaucaacagaggcgccuuggcuagagacagcg

SEQ ID NO: 96953 - RNA, 46 nt, Mus musculus
auuagagaaacaagcuugaaacuuuuaggagccagaaaaagagucu

SEQ ID NO: 96954 - RNA, 42 nt, Mus musculus
aguccuguacucuuacccacugagccaucucaccagccccua

SEQ ID NO: 96955 - RNA, 42 nt, Mus musculus
gggcaccacgguccuaaacgcugcucucuucucugcacccag

SEQ ID NO: 96956 - RNA, 56 nt, Mus musculus
cgcugcauguacaugcugaucuggggcaaauuugugcuguacaaauacgucaccug

SEQ ID NO: 96957 - RNA, 45 nt, Mus musculus
cugucgggccugggcuuuaauggcuucgaugaaaaugggaccgug

SEQ ID NO: 96958 - RNA, 85 nt, Mus musculus
caacaugaaaguguggcucuuugaaaccaccccucgcuucaauggcaccaucgccucuuucaacaucaauaccaaugccugggua

SEQ ID NO: 96959 - RNA, 42 nt, Mus musculus
gacccucaggacucagcuguaccugcugaagcaagcggccag

SEQ ID NO: 96960 - RNA, 46 nt, Mus musculus
cagacccagaugcaggagucaagucugagcuucauccuuaccccac

SEQ ID NO: 96961 - RNA, 44 nt, Mus musculus
gcccucuggcauggccuacacucaggauaccugauuugcuucca

SEQ ID NO: 96962 - RNA, 48 nt, Mus musculus
gacagcccugcccugagcagccuggccuccaucacugcccuacagccc

SEQ ID NO: 96963 - RNA, 55 nt, Mus musculus
auucauauugccuuauauccacaaagcaauggugccaagaaaagaaaaguuaaaa

SEQ ID NO: 96964 - RNA, 45 nt, Mus musculus
gacucccccaugcacguugccuuaucucuccccucuagccaggaa

SEQ ID NO: 96965 - RNA, 89 nt, Mus musculus
gcaucccagacugcuuucuuucauacauaauucuccaugcuugcuaaaggucaucauggucucucauugagagccacagaaaucuagga

SEQ ID NO: 96966 - RNA, 46 nt, Mus musculus
uacacuaccauguacugcuaaguuuaagaacccucaaaacaaucag

SEQ ID NO: 96967 - RNA, 45 nt, Mus musculus
cucaguuuguguaaaagcugaacugggggggaaagagaguucaga

SEQ ID NO: 96968 - RNA, 90 nt, Mus musculus
agcacguucuucuguguguggauguaaaccuguagcaagccagcucgguucagggggcuguccauaagcaucagcaggcucugagaaagg

SEQ ID NO: 96969 - RNA, 44 nt, Mus musculus
ccugggucccguccauucuucaacaacauggacuugugccuguc

SEQ ID NO: 96970 - RNA, 46 nt, Mus musculus
gcuuacagaccucgccuugcacacgaggaucggcggccuuagagcu

SEQ ID NO: 96971 - RNA, 77 nt, Mus musculus
gaacacggauucgcggacgccguaggccaccgccccggcccccagcagcagcuucagcgccgugcccaugccccgag

SEQ ID NO: 96972 - RNA, 45 nt, Mus musculus
aguagugcuauugaucuggccuuacagcagggagucaggccuuag

SEQ ID NO: 96973 - RNA, 45 nt, Mus musculus
uucauccuguagauucagcacaagguugucagcugugagauagau

SEQ ID NO: 96974 - RNA, 44 nt, Mus musculus
uugguagaccugcggguggggugaagguguaguugggccugaga

SEQ ID NO: 96975 - RNA, 58 nt, Mus musculus
accacccccaucuucuuguaauuuaagugacuguggucaucugaaucuguauauagcc

SEQ ID NO: 96976 - RNA, 67 nt, Mus musculus
cagccuugaucccugcagaggcuuccacccgauagacugagaccuguggcccucaccagacccuagg

SEQ ID NO: 96977 - RNA, 45 nt, Mus musculus
gugcggccccuucuguguguucuuucucucccugcccccauuucc

SEQ ID NO: 96978 - RNA, 45 nt, Mus musculus
ggcacaaggaggagguguacgaaaacgugcauagcaagagcaaga

SEQ ID NO: 96979 - RNA, 45 nt, Mus musculus
uggccauugcccaguucaucgaaacgaccaagaagaaacuggaga

SEQ ID NO: 96980 - RNA, 46 nt, Mus musculus
cuggacagagcuuggugaaagcaaggucgcugagguggucacaggu

SEQ ID NO: 96981 - RNA, 42 nt, Mus musculus
cuuaccucuugagucaugaauauuuacugccuugccccugug

SEQ ID NO: 96982 - RNA, 46 nt, Mus musculus
gccuugcgaguuugagguccuaaguucaaacccuaggacugcagaa

SEQ ID NO: 96983 - RNA, 42 nt, Mus musculus
cuguguggcuacgggcagcacaaauugcagcaucuugcccau

SEQ ID NO: 96984 - RNA, 43 nt, Mus musculus
ugcuccgcgcucagggccgcgggcugagccgaggcggacgcca

SEQ ID NO: 96985 - RNA, 43 nt, Mus musculus
ggaacacagaagagauccggagaacccugcagccagccaccuc

SEQ ID NO: 96986 - RNA, 46 nt, Mus musculus
cuggggaacugugaggauguuuuuguuugguugguuuuggucagga

SEQ ID NO: 96987 - RNA, 54 nt, Mus musculus
cugguccaagauacugugcacuuucugcccccacccuugccacuucccaccucu

SEQ ID NO: 96988 - RNA, 60 nt, Mus musculus
gcacacaaccccgggcccugaccuugucugucccuucuucccucccucccucuacccagc

SEQ ID NO: 96989 - RNA, 43 nt, Mus musculus
accaaaaagcuggugacgaagaacuucguucucgugcagaggg

SEQ ID NO: 96990 - RNA, 42 nt, Mus musculus
acuagaacggcaaucucaggagaugggaguucuggccagaag

SEQ ID NO: 96991 - RNA, 43 nt, Mus musculus
gcccagcugccagcgcuagccguucucguuccaggggccccag

SEQ ID NO: 96992 - RNA, 81 nt, Mus musculus
acugagggggcccagguggcgaagcuguuuuguagccugcuggcgaggaagccacgguggcgaugacaguggaaaggguag

SEQ ID NO: 96993 - RNA, 88 nt, Mus musculus
cuggugggaagggguaggaugcuccuugggggcccugggaugaagaggggugugaacaugaauaggaggcuugagaggaagacccgga

SEQ ID NO: 96994 - RNA, 41 nt, Mus musculus
cccugggggguagggccuuaaagaccccagggagggugaca

SEQ ID NO: 96995 - RNA, 45 nt, Mus musculus
ggggcccagaguuuccaugaugauguuguugcuguggcugcugcu

SEQ ID NO: 96996 - RNA, 48 nt, Mus musculus
gggaaagggccuggauggguguuguuguuggccaagaggcggccauag

SEQ ID NO: 96997 - RNA, 45 nt, Mus musculus
ggauaacugggcagggccugggaagcaggguacugggaggcagag

SEQ ID NO: 96998 - RNA, 44 nt, Mus musculus
cuacuggaggaugaauauggauaucgcauuggaggcccaggggc

SEQ ID NO: 96999 - RNA, 44 nt, Mus musculus
aggaggagaggcugaggcauuguugaggggucucagggcaggug

SEQ ID NO: 97000 - RNA, 100 nt, Mus musculus
gggcuccaucggagcaugauauccaguaggcggcacagaaggaugagguucaaagccagacucuggcugucggggagugcugucuggugguggaggggaa

SEQ ID NO: 97001 - RNA, 35 nt, Mus musculus
aagaaggaauggaacugggaagagguuggggucag

SEQ ID NO: 97002 - RNA, 48 nt, Mus musculus
aacaacacacauuugcccucaucaccuuauggcaaaaagaaagcaagg

SEQ ID NO: 97003 - RNA, 46 nt, Mus musculus
aggguaaccuaccccaggcacaaagagaucucugagaucaaggcag

SEQ ID NO: 97004 - RNA, 46 nt, Mus musculus
cauccucccaaccuucccaauucucccuucaguaucccugccuuuc

SEQ ID NO: 97005 - RNA, 44 nt, Mus musculus
gcuacaacccucauuuuaccaccuaccacaccccuuucccuguu

SEQ ID NO: 97006 - RNA, 46 nt, Mus musculus
cgguuuaccuccgccaagucuccaccucggcguuccuccccuuuag

SEQ ID NO: 97007 - RNA, 55 nt, Mus musculus
gcaccccuauuccauguggcuucauuccaagaugacccaggauggggauuuugcu

SEQ ID NO: 97008 - RNA, 44 nt, Mus musculus
gcuggcccaggagaauggcugggggguuauggugagccaucgcu

SEQ ID NO: 97009 - RNA, 42 nt, Mus musculus
auggggugcagagucuggggccaggugagguccugaggaggc

SEQ ID NO: 97010 - RNA, 46 nt, Mus musculus
ugugugaugcaguaugggggagggggaccaacauuaguaacuagua

SEQ ID NO: 97011 - RNA, 45 nt, Mus musculus
uagggugaaagcagagugauagaccugggaugguuaggggaccaa

SEQ ID NO: 97012 - RNA, 45 nt, Mus musculus
aaauucagagccuuugggucucccucagcugagguggcgguggaa

SEQ ID NO: 97013 - RNA, 42 nt, Mus musculus
caagacauauagaaaugauauuaaacaccauggcagccuggg

SEQ ID NO: 97014 - RNA, 42 nt, Mus musculus
cucaggaggguacagcguggauuaggccacaagauggggcag

SEQ ID NO: 97015 - RNA, 69 nt, Mus musculus
auggcccacacagguucauaggccaggaccaccuugcuccagucuuucacauuaucuguggggcagaga

SEQ ID NO: 97016 - RNA, 46 nt, Mus musculus
ccacucccaagggcgaucuucuuugcacccugcccccaaccccaag

SEQ ID NO: 97017 - RNA, 85 nt, Mus musculus
ccugccggcacguuggcugcguucagggugcagaugaguucucccaggcacuucuuccucccguucaucuuccaguugcccccaa

SEQ ID NO: 97018 - RNA, 41 nt, Mus musculus
uuuucuacucagaaacugagcgcccagacgcauuuagggga

SEQ ID NO: 97019 - RNA, 42 nt, Mus musculus
gggcucuagagccccagcucucucccauccaagugaccagau

SEQ ID NO: 97020 - RNA, 44 nt, Mus musculus
gaguccuucugucccauaccuguaaguaguguacucucuccagc

SEQ ID NO: 97021 - RNA, 42 nt, Mus musculus
gagugagacuccaagaaagucaaagacagaggaacccaggag

SEQ ID NO: 97022 - RNA, 67 nt, Mus musculus
uuccacucaggagugcucagagaaugaucuccagggagaagcagggaauagauaaaggcucagggca

SEQ ID NO: 97023 - RNA, 45 nt, Mus musculus
cugaagaauagaaguggaagcaaggaauggucaaaggagcugggg

SEQ ID NO: 97024 - RNA, 46 nt, Mus musculus
gcguggcugguagaacuggaaggcccuguauauuaaaaaaaggcug

SEQ ID NO: 97025 - RNA, 45 nt, Mus musculus
gucuuggugcacagggguggagcucagucaccuggacaagcugug

SEQ ID NO: 97026 - RNA, 86 nt, Mus musculus
ugacaucagaagcauccagaaauggaaagagggggaacuagggagaaggaggagaguuugagcuggagagaaagaggggggaaacu

SEQ ID NO: 97027 - RNA, 41 nt, Mus musculus
ggagagagcaggaggguucuggucuuagugauacgguucag

SEQ ID NO: 97028 - RNA, 46 nt, Mus musculus
cccccuagcccaguacauccuaguugccauggcaauggacagccag

SEQ ID NO: 97029 - RNA, 46 nt, Mus musculus
cacccucaucccacccccagacccaguuggugguuccgaaagaaag

SEQ ID NO: 97030 - RNA, 42 nt, Mus musculus
gagauuuauguuuauaauccagcaccaaggaaagccacugag

SEQ ID NO: 97031 - RNA, 45 nt, Mus musculus
aggcaccugcagaacaaaggaaauuacuaacagucacagucuuaa

SEQ ID NO: 97032 - RNA, 42 nt, Mus musculus
cucccuggaggggugaaggagggacgucccagagaccggucu

SEQ ID NO: 97033 - RNA, 46 nt, Mus musculus
gggacagcugggagccuccaguauauagaccacugaagguugaagg

SEQ ID NO: 97034 - RNA, 55 nt, Mus musculus
ucaggagcccuggaaaggagaaggaauaagacgacaggaggaagagagagagagg

SEQ ID NO: 97035 - RNA, 46 nt, Mus musculus
agacacccacugcuuaaauccauaaauaaaucuuuaaaaacagcag

SEQ ID NO: 97036 - RNA, 45 nt, Mus musculus
uuucuguggagcuagccuucccuucuuacuaacuagucguggccu

SEQ ID NO: 97037 - RNA, 46 nt, Mus musculus
auaguauaauaaaaaauacauuuaguccaaauucaaaaguucccau

SEQ ID NO: 97038 - RNA, 46 nt, Mus musculus
ucuugauacgauaucugagauucacacaugaacuucugggcuccuc

SEQ ID NO: 97039 - RNA, 46 nt, Mus musculus
uagugacaagccucagcuguucuucaugacuccuucauaccuucaa

SEQ ID NO: 97040 - RNA, 46 nt, Mus musculus
gguacaaccuuggcuaucucuggaacacagccucuuugugcccuca

SEQ ID NO: 97041 - RNA, 45 nt, Mus musculus
accacuauuucuuaacuccagcuaacgagcaucaauugucccagu

SEQ ID NO: 97042 - RNA, 46 nt, Mus musculus
gcucccucacugccuaagcuuggcuguccugguucuugcucuguag

SEQ ID NO: 97043 - RNA, 42 nt, Mus musculus
ucuucaucugaaggcugcuagcagaauacuggcuucaggcag

SEQ ID NO: 97044 - RNA, 45 nt, Mus musculus
cauuuuauaaccccacauuucaguuugggaguugagagcauagcu

SEQ ID NO: 97045 - RNA, 46 nt, Mus musculus
cagauuugcauggcugggagacugguucuguccuuaguguaccgag

SEQ ID NO: 97046 - RNA, 46 nt, Mus musculus
agcauuauuuacuugaauuguauaguuuuucuauggagacguccac

SEQ ID NO: 97047 - RNA, 41 nt, Mus musculus
ugagccuguuggguuugccagccugucucaguccuggcuca

SEQ ID NO: 97048 - RNA, 46 nt, Mus musculus
guuaagguuaugaaggagcaaagaaauaauuuugugguuggggggg

SEQ ID NO: 97049 - RNA, 46 nt, Mus musculus
uugcuuggccaggugccggaugugcucccugaccuucuacuccaag

SEQ ID NO: 97050 - RNA, 46 nt, Mus musculus
gugcaauugguuccaaacucaggguuuccugucauuaagggcuuag

SEQ ID NO: 97051 - RNA, 46 nt, Mus musculus
ccuucaagugccacaacugucaccgagcauauacagacgcagccuc

SEQ ID NO: 97052 - RNA, 41 nt, Mus musculus
acccuccaccccaguguuccuuugacuugacccccuauaag

SEQ ID NO: 97053 - RNA, 45 nt, Mus musculus
aaaaaaaaaaaaaaaguucaguuuccggcggauguauccgaggca

SEQ ID NO: 97054 - RNA, 46 nt, Mus musculus
guuuugcuucaagauggcugcugggauguauuuggaacauuaucug

SEQ ID NO: 97055 - RNA, 45 nt, Mus musculus
cugaagaucacaggaaaaggguuccgugggaagauuuauucgagg

SEQ ID NO: 97056 - RNA, 48 nt, Mus musculus
aagaucuggacgagggaagggcugcuccgugggaucagggcugggcuu

SEQ ID NO: 97057 - RNA, 70 nt, Mus musculus
aaagaaaguaacugaucaaauaaugguagcaguccaaaucagaagugcagaccuggucuuagagaaugac

SEQ ID NO: 97058 - RNA, 41 nt, Mus musculus
guaauccuagugaacugcugucacagacuuaagaagccccc

SEQ ID NO: 97059 - RNA, 45 nt, Mus musculus
uugaagaaugagaagaaguggagugggggaagcagguacugugug

SEQ ID NO: 97060 - RNA, 47 nt, Mus musculus
uacuggacgguuacagaacgcaugaugagugcuaaaguugagagcaa

SEQ ID NO: 97061 - RNA, 45 nt, Mus musculus
gcaugaaugcauguccccuuguaacucagaaacauuguaucccca

SEQ ID NO: 97062 - RNA, 45 nt, Mus musculus
uggaugugguggcacacacauggaaucucagcuuucagggggcug

SEQ ID NO: 97063 - RNA, 45 nt, Mus musculus
guaaguucuaagacaucuugagcuacagagacuugguacucggaa

SEQ ID NO: 97064 - RNA, 46 nt, Mus musculus
ccguuccaaagggaaaaacucagaugaagaagcccccaaggcugcc

SEQ ID NO: 97065 - RNA, 41 nt, Mus musculus
uccuucauguuggguuuuagguuuugcccacgcugcuccca

SEQ ID NO: 97066 - RNA, 46 nt, Mus musculus
cucagaauuuuguaauuacgaaucuccucuccgugaaacaccuuua

SEQ ID NO: 97067 - RNA, 45 nt, Mus musculus
ugcucgccuuggucagcccugcuucauuuuaacuuugggccuguu

SEQ ID NO: 97068 - RNA, 42 nt, Mus musculus
gaaugaguuaagagacagagaagcaaagugugguggccaugu

SEQ ID NO: 97069 - RNA, 46 nt, Mus musculus
cacugcacccaucgguaccuggcuggagaccacugcgggcaucuag

SEQ ID NO: 97070 - RNA, 42 nt, Mus musculus
agggcgagggaggggcaggagcaaggagagaaggggcccgag

SEQ ID NO: 97071 - RNA, 42 nt, Mus musculus
aggcucagccucaugguugguccaagccauuagcggaagcag

SEQ ID NO: 97072 - RNA, 44 nt, Mus musculus
ugggugugaguuucaugaggcuccugauggaugcgccaaugugg

SEQ ID NO: 97073 - RNA, 88 nt, Mus musculus
uugaguccucuaaugagaaagacuucaaaacuaaagcaaacccaguucuuccguaguugauaaacacaacuuuuugcuuuuccuaaag

SEQ ID NO: 97074 - RNA, 27 nt, Mus musculus
cugcccaaggauaccagaagaggccau

SEQ ID NO: 97075 - RNA, 47 nt, Mus musculus
uacuggucuacuuccguuucucuuucuccuuucuucgcccgcagccu

SEQ ID NO: 97076 - RNA, 45 nt, Mus musculus
gucucuucugucugucccccuuccugcuggcccugccucacccug

SEQ ID NO: 97077 - RNA, 41 nt, Mus musculus
gugccgaggaggagagcacagcccucagcaucaacgaggag

SEQ ID NO: 97078 - RNA, 45 nt, Mus musculus
ggauggauggauggauggauggauggauggauggauggaguguca

SEQ ID NO: 97079 - RNA, 41 nt, Mus musculus
aguacugccuuaugcuuugagagacuauaauggaggugggg

SEQ ID NO: 97080 - RNA, 46 nt, Mus musculus
guguguugguaugaaugggugacagcugcucucugaccuguaauag

SEQ ID NO: 97081 - RNA, 47 nt, Mus musculus
guguguugguauguaugggugacagcugcucucugaccuguaauagu

SEQ ID NO: 97082 - RNA, 45 nt, Mus musculus
ggaccgguaagggccugccccgagcgggcugggucucucucccag

SEQ ID NO: 97083 - RNA, 46 nt, Mus musculus
cccgcacauggguguggccugcagguuacuggugcucggggccugu

SEQ ID NO: 97084 - RNA, 44 nt, Mus musculus
ucucuugaauaccaucaauaaaguucgcugcacccaccucuccu

SEQ ID NO: 97085 - RNA, 68 nt, Mus musculus
guguugggggccgaguugggauagggccucucuugcucaguguccuugcuggggugggugguccaggg

SEQ ID NO: 97086 - RNA, 45 nt, Mus musculus; identical to SEQ ID NO: 66997

SEQ ID NO: 97087 - RNA, 82 nt, Mus musculus
ugcugggcaagcaaucaccucuuggacaggaaagaaaccuccacuuuauaaccgugcuauaaaagcccugccaggccucggc

SEQ ID NO: 97088 - RNA, 46 nt, Mus musculus
ccaagcuuguacccagacuggggcaaacugccacuucuuaagagac

SEQ ID NO: 97089 - RNA, 46 nt, Mus musculus
uaggguuggaaaccccccacauguuuucucagucuuuccccuuagu

SEQ ID NO: 97090 - RNA, 44 nt, Mus musculus
agaccccagauccagaaaggucacacggcuaaauuuaaccucag

SEQ ID NO: 97091 - RNA, 49 nt, Mus musculus
uaaugaccuuuacauccuggccuauagggccugggucagugcgaggcug

SEQ ID NO: 97092 - RNA, 41 nt, Mus musculus
ccgcuugaccucccaaccccagagguaguuauggcguagug

SEQ ID NO: 97093 - RNA, 42 nt, Mus musculus
auccccaguccggggcuucuuucuuuacuuucgcgcccugag

SEQ ID NO: 97094 - RNA, 53 nt, Mus musculus
cccccagcugcugcaccucugguaacuccgccuuugcggggaugagcggcccg

SEQ ID NO: 97095 - RNA, 46 nt, Mus musculus
acacacacgcacacggcacacugugaaagucagccgagcugcauag

SEQ ID NO: 97096 - RNA, 46 nt, Mus musculus
gaagucagaggcuguagccuugagacuagaaaagaaaggcaagggg

SEQ ID NO: 97097 - RNA, 46 nt, Mus musculus
cagggcuggaaacauuaucucccugcuuaaaaagaaauagccauga

SEQ ID NO: 97098 - RNA, 29 nt, Mus musculus
acauacaguaggcuaggucucgguacuga

SEQ ID NO: 97099 - RNA, 42 nt, Mus musculus
cucuuccacuccgcccucugggucugacaggcgacugaugau

SEQ ID NO: 97100 - RNA, 28 nt, Mus musculus
augaggaguccagggauccaccagguua

SEQ ID NO: 97101 - RNA, 41 nt, Mus musculus
cuccgccucugugucgucagcaguggccccccccaccagcc

SEQ ID NO: 97102 - RNA, 46 nt, Mus musculus
aggagagcuuggcaccuucuccguugcccguucccauagcagcugg

SEQ ID NO: 97103 - RNA, 46 nt, Mus musculus
ggagagucuuuacugccugucagcccugggucuguguccccaugag

SEQ ID NO: 97104 - RNA, 42 nt, Mus musculus
cugugugacugaaggguucagacuccuggaagugacugguag

SEQ ID NO: 97105 - RNA, 45 nt, Mus musculus
gcugcuaacacagcauugcgcaucauguaauucugagagagagag

SEQ ID NO: 97106 - RNA, 76 nt, Mus musculus
gcacauguuggccaucaggacagcugggauucgcucugcuagcucagugaggaaagccgcaaagcccuuugccccu

SEQ ID NO: 97107 - RNA, 45 nt, Mus musculus
acuguuccuacuuucauuccaguuaccacaauuccucccuggcag

SEQ ID NO: 97108 - RNA, 45 nt, Mus musculus
gcuguagacuguaucgaagugcuccaguauggcgaggggccccug

SEQ ID NO: 97109 - RNA, 46 nt, Mus musculus
auucagaaaacacaaaaaucuuauuuaaaaaagaagaaagaaagaa

SEQ ID NO: 97110 - RNA, 45 nt, Mus musculus
caauucauuuccucuccagccucgaagccauacugggcccuugau

SEQ ID NO: 97111 - RNA, 48 nt, Mus musculus
cuaucuguacuucccaugucgguuaaaguguuuguagagauagcugau

SEQ ID NO: 97112 - RNA, 42 nt, Mus musculus
ugcacaugugcaugccugucuccaugggaagcccagaaacug

SEQ ID NO: 97113 - RNA, 45 nt, Mus musculus
ugcaaugcgccauuucccgucccgcagagucggacacugcggggg

SEQ ID NO: 97114 - RNA, 84 nt, Mus musculus
acagagaaacccuauauggaaaagccaaacaaagaagggggauagagagagcgaggaagagggagagagagaggaagagggaga

SEQ ID NO: 97115 - RNA, 44 nt, Mus musculus
agaaguuguggauguuuaaauacauauacugagccaguguaugg

SEQ ID NO: 97116 - RNA, 46 nt, Mus musculus
aguaaaaaaguagacuggacacaggaaccagcaagucccagacgga

SEQ ID NO: 97117 - RNA, 42 nt, Mus musculus
ggugaggugagauagaaaguagaaggacuaacacccccagaa

SEQ ID NO: 97118 - RNA, 45 nt, Mus musculus
uuuaggaagacagaagagggcguuagacuccuggaauuaguuaca

SEQ ID NO: 97119 - RNA, 45 nt, Mus musculus
aagggaaggaggaaugggggugggucuucaugcagagguacuaga

SEQ ID NO: 97120 - RNA, 46 nt, Mus musculus
gguugugagccaccaugugguugcugggauuugaacuccagaucuu

SEQ ID NO: 97121 - RNA, 33 nt, Mus musculus
gucugugaagucccagaaacaacaacagcgcag

SEQ ID NO: 97122 - RNA, 46 nt, Mus musculus
aagaacaaggaguaagauuuuagagguauccgaccagagcccucag

SEQ ID NO: 97123 - RNA, 41 nt, Mus musculus
uaacauccuggguaaggacaggccuuggguuuucugggaua

SEQ ID NO: 97124 - RNA, 41 nt, Mus musculus
cagauguaguuccccucauccuuuagagugagguuggguaa

SEQ ID NO: 97125 - RNA, 42 nt, Mus musculus
gccuagucaguccaggggaggauaucuauguuagucggguag

SEQ ID NO: 97126 - RNA, 46 nt, Mus musculus
aaccugguaggagguacuaagugggagagaaugaggaaugggcuca

SEQ ID NO: 97127 - RNA, 46 nt, Mus musculus
caaacaaacaaaaaacaaauuaaaaaaacaacaaccccccccccaa

SEQ ID NO: 97128 - RNA, 46 nt, Mus musculus
ugcauuuuguuuucucaccuugagucuucacugugcccugggcacu

SEQ ID NO: 97129 - RNA, 44 nt, Mus musculus
aaggcaccuuuaccugcugcucagcccggggcuuggugaagggg

SEQ ID NO: 97130 - RNA, 45 nt, Mus musculus
cacagaggcaguugaagugaaagugaaagagaaacgauaagagaa

SEQ ID NO: 97131 - RNA, 42 nt, Mus musculus
uucucuccacugcugaccgauuguguuugcacagaugaagac

SEQ ID NO: 97132 - RNA, 41 nt, Mus musculus
cuuggggagucugggggaaggacacuugaggagccagagua

SEQ ID NO: 97133 - RNA, 66 nt, Mus musculus
gugcuuucucuguggaguggggauuaggaagacaacucacaugaccgcuggcuauagacagucgag

SEQ ID NO: 97134 - RNA, 42 nt, Mus musculus
ugagggaggggcagaggggaaauagguaaggcgcggggagug

SEQ ID NO: 97135 - RNA, 45 nt, Mus musculus
ggcccauggaaaaugcuauuaggauguguggccuuggccuuguug

SEQ ID NO: 97136 - RNA, 42 nt, Mus musculus
gagacagagaagaccaaccaagggaacgagcagcaggcaugg

SEQ ID NO: 97137 - RNA, 42 nt, Mus musculus
uugguucucggucugcuucuguagaugcaagcaagcccugac

SEQ ID NO: 97138 - RNA, 44 nt, Mus musculus
cagcuggggaacgguacugaugaagagaaagaagaaggaugaag

SEQ ID NO: 97139 - RNA, 41 nt, Mus musculus
ggcgcaguuggggaggagggagguggggaagagggggguaa

SEQ ID NO: 97140 - RNA, 87 nt, Mus musculus
cuggaucugagcugcauagaaagacccagucucagagaaacaaagaagagaaaggaggaggaagaaaggagaagagagaagaggaaa

SEQ ID NO: 97141 - RNA, 45 nt, Mus musculus
uguguguagaacugagcagguuguuugcuuggcauuguuagggug

SEQ ID NO: 97142 - RNA, 56 nt, Mus musculus
cuaagggagcuuaggggggagaaaccggugcaucagagcagacaacaaagcaggaa

SEQ ID NO: 97143 - RNA, 45 nt, Mus musculus
ugugcuucagcucauuagaguaaucaggguacaaauaacagaagc

SEQ ID NO: 97144 - RNA, 45 nt, Mus musculus
ggagcacagaaugaggggucuggcugugggagaugucuugggagg

SEQ ID NO: 97145 - RNA, 45 nt, Mus musculus
ccaaaggcuuuuuggucuucuagggacgcuuaugaaaugcaaaua

SEQ ID NO: 97146 - RNA, 23 nt, Mus musculus
agucugggguguaugucucagug

SEQ ID NO: 97147 - RNA, 45 nt, Mus musculus
caucccuccagacccugucugacagcucuccugacuucgccagau

SEQ ID NO: 97148 - RNA, 46 nt, Mus musculus
aagagaauuuuuuuugccuuuaaauagauaaaaguaucuaucagau

SEQ ID NO: 97149 - RNA, 48 nt, Mus musculus
uuuaaugcuuuauucauuauugacauuuguaguugagggauccggggg

SEQ ID NO: 97150 - RNA, 69 nt, Mus musculus
ggcaugaucuucagcaugauccugugcugcgccauccgcaggagccgagaaauggucuagagucugccc

SEQ ID NO: 97151 - RNA, 40 nt, Mus musculus
aagaaagccaugccugggcacuguuagaagugcuguagcg

SEQ ID NO: 97152 - RNA, 47 nt, Mus musculus
aacuccaggaguuuuacaaggacaccuaccaaaaguuacggagcaag

SEQ ID NO: 97153 - RNA, 44 nt, Mus musculus
cauaaguacacuuggguccuacagugauuugaguuucugagcug

SEQ ID NO: 97154 - RNA, 42 nt, Mus musculus
ugaggaugcuauuuuguuaagaaaaugucucugucccuagaa

SEQ ID NO: 97155 - RNA, 25 nt, Mus musculus
ggggcugaagaaguggccaggggcg

SEQ ID NO: 97156 - RNA, 45 nt, Mus musculus
gcucuaggacagucagagccauauagugauacccuuucuaucuug

SEQ ID NO: 97157 - RNA, 46 nt, Mus musculus
uaaagauugaacccggugccucuaugugugccucaagcccccaguc

SEQ ID NO: 97158 - RNA, 44 nt, Mus musculus
gguuuuccaguaaccccacgugacuucacgucacaacggcgaua

SEQ ID NO: 97159 - RNA, 46 nt, Mus musculus
accggccgugggagggagagaaggcaggaaugagcugggguggggg

SEQ ID NO: 97160 - RNA, 42 nt, Mus musculus
ugaugaugaugaugaugaugaugaugaugauuugggggaggg

SEQ ID NO: 97161 - RNA, 45 nt, Mus musculus
gcuuccugaauagacaaucaaaauugagauuaauggggauggaga

SEQ ID NO: 97162 - RNA, 42 nt, Mus musculus
ucuuacgucagaaaccauuguccugugugcaucugcagagcc

SEQ ID NO: 97163 - RNA, 46 nt, Mus musculus
uggcuccgauucgacucucagaccaagagcaucuucgagcaagaga

SEQ ID NO: 97164 - RNA, 47 nt, Mus musculus
cacacuugacgcucaaugugcccaauccuauugccacaggucgggga

SEQ ID NO: 97165 - RNA, 42 nt, Mus musculus
uuacccaagagcccuugcccccaccccaccccaccccacccc

SEQ ID NO: 97166 - RNA, 44 nt, Mus musculus
cuggaaggagacugaagcuuuauggggaagagacaggcaggcgg

SEQ ID NO: 97167 - RNA, 45 nt, Mus musculus
acauggugggcagaggcaggaauucuaggguugaaaaaccgagau

SEQ ID NO: 97168 - RNA, 53 nt, Mus musculus
ucccugcacugcaccuuuuguuguuguuguuguuguuguuguuggcagggcgu

SEQ ID NO: 97169 - RNA, 42 nt, Mus musculus
aguccaaggccuggguucccggguuaacaccagaaggcagaa

SEQ ID NO: 97170 - RNA, 46 nt, Mus musculus
agccagggagggggccugccucucggucuucccccgccccccaacc

SEQ ID NO: 97171 - RNA, 42 nt, Mus musculus
caacccuggcuggccaugggcgccucuuccaacugcccugag

SEQ ID NO: 97172 - RNA, 45 nt, Mus musculus
uuuaaaaauaaaaaggaaaaucucuuacaagagucugggguagua

SEQ ID NO: 97173 - RNA, 46 nt, Mus musculus
uuauuggcagccucuguuggaaacauuguguauuuccccucaccug

SEQ ID NO: 97174 - RNA, 47 nt, Mus musculus
agugaauugcuuaacaccucugauaucccuaguuacaaguaaaagaa

SEQ ID NO: 97175 - RNA, 46 nt, Mus musculus
uugucuggagcuuagagcuggucccaacauuucuauccacccagau

SEQ ID NO: 97176 - RNA, 45 nt, Mus musculus
uaagcccagggaugaauacacacacacacacacaaaugcaaaaga

SEQ ID NO: 97177 - RNA, 46 nt, Mus musculus
aaaagagucuuagggaccugggccaggugucacauaccuguaggaa

SEQ ID NO: 97178 - RNA, 62 nt, Mus musculus
ucuggucaggucaaggucaccacgcaggucggcuguguucucaggcggccagacacacagaa

SEQ ID NO: 97179 - RNA, 71 nt, Mus musculus
guguuaucuaguagaagguccauugugaaaauagcucaagugaauucauugcguaagguaggguauagguc

SEQ ID NO: 97180 - RNA, 42 nt, Mus musculus
caauugaaccauucucuuaaagucagacggauuccugcagua

SEQ ID NO: 97181 - RNA, 46 nt, Mus musculus
ccacgcggugucucauaaccaccuauaacucaaguucccagggauc

SEQ ID NO: 97182 - RNA, 42 nt, Mus musculus
auuucaacuaaagaaguuuugguuuuuaaguuagccuuagua

SEQ ID NO: 97183 - RNA, 46 nt, Mus musculus
ccuuggguuuacaagaaacauguuuucuuugguagcacgcacagag

SEQ ID NO: 97184 - RNA, 46 nt, Mus musculus
guucuggggugguuccgccuaguuuuggguucaguucaguuuuuau

SEQ ID NO: 97185 - RNA, 25 nt, Mus musculus
aaaugaagcugaagagacucuagag

SEQ ID NO: 97186 - RNA, 46 nt, Mus musculus
gucucaaagguccauucaagaucagccuauagaacgagccccggcc

SEQ ID NO: 97187 - RNA, 47 nt, Mus musculus
agagaugacaucaccuucacggaagcagcuuggaaauguaggcagag

SEQ ID NO: 97188 - RNA, 50 nt, Mus musculus
agcgaagucuuuuaugguuuuuagccucggcaaaggaaagcccagauuga

SEQ ID NO: 97189 - RNA, 46 nt, Mus musculus
uuucucucagaucuccaugucuaucccuccacucccuccaaaagag

SEQ ID NO: 97190 - RNA, 46 nt, Mus musculus
gcccacaaccaagccagcaaucggucuguuuuccgacaaccucaga

SEQ ID NO: 97191 - RNA, 42 nt, Mus musculus
uuuccucccucuaccuuuuagucucuucccugcuagucuguc

SEQ ID NO: 97192 - RNA, 41 nt, Mus musculus
aaccugcagagacugcccuggguuucuaggagccaccacac

SEQ ID NO: 97193 - RNA, 41 nt, Mus musculus
cagcgugucucagucgguugucgagucccuucugucccagu

SEQ ID NO: 97194 - RNA, 45 nt, Mus musculus
cuccaguggugugggcugaacaccaagaucuuccaggccaggcag

SEQ ID NO: 97195 - RNA, 44 nt, Mus musculus
auagcaaagaauugcuaccagucccagggaacagcaucccucug

SEQ ID NO: 97196 - RNA, 46 nt, Mus musculus
cggcauacugcaggcagacaagauuggcagcaagaggcucacugag

SEQ ID NO: 97197 - RNA, 41 nt, Mus musculus
aagcuugcaacagcaagaaacagcacaggucucuggucccu

SEQ ID NO: 97198 - RNA, 45 nt, Mus musculus
aagugagaacggcugaggcugugaccccgucaggacagacagcaa

SEQ ID NO: 97199 - RNA, 49 nt, Mus musculus
cucuuugggcugaguccauuugagcccuggacgacgaaggacaaggugg

SEQ ID NO: 97200 - RNA, 46 nt, Mus musculus
agggaugaagguccgaugggucaugccaaagauguacuucaccaag

SEQ ID NO: 97201 - RNA, 42 nt, Mus musculus
uggaaagggaggaagagaaagagaggaaggaaagcaggugcc

SEQ ID NO: 97202 - RNA, 46 nt, Mus musculus
caaaucccaccuucaaagauucuacuugauuuggucuaggguacag

SEQ ID NO: 97203 - RNA, 46 nt, Mus musculus
guauguuuauagagucaggguuuaugcaaaugaguacagugcccag

SEQ ID NO: 97204 - RNA, 45 nt, Mus musculus
gcggccuccuuucccgugagguaugacagcauggugaagcuggcg

SEQ ID NO: 97205 - RNA, 41 nt, Mus musculus
ugccaugccuuuauaaccccaguaacucacuaucuccuaua

SEQ ID NO: 97206 - RNA, 24 nt, Mus musculus
aucaauuacaguuugaguuaucuc

SEQ ID NO: 97207 - RNA, 47 nt, Mus musculus
acacuauggaaaacuguaagugaagcgggcauguuuguggcguggag

SEQ ID NO: 97208 - RNA, 45 nt, Mus musculus
aagguucagaaagugauccugauuuugaugagaguaaagaaagug

SEQ ID NO: 97209 - RNA, 42 nt, Mus musculus
uucugaaggcagcgauggcagcagugcuaacgacacggaguc

SEQ ID NO: 97210 - RNA, 45 nt, Mus musculus
aaaagugcucaaauaugugggcuuacagggacagucaagccacca

SEQ ID NO: 97211 - RNA, 46 nt, Mus musculus
cuuuuaauauuccaaccaggaugguaucuuuacacaguacguagua

SEQ ID NO: 97212 - RNA, 45 nt, Mus musculus
aguuuugaggacaucuuagguacuugaugcccuaucucaaggaga

SEQ ID NO: 97213 - RNA, 45 nt, Mus musculus
gcacaugccuuuaaucccagcacuuaggaagcagaggcaggcgga

SEQ ID NO: 97214 - RNA, 74 nt, Mus musculus
auaagcccugcaaacacaggguaaucaggagugacugcugauggauauggcuuaggaaguguucuaaaacuaga

SEQ ID NO: 97215 - RNA, 46 nt, Mus musculus
gcaugaccagacuauccugggccaccgcccgcaguccccagcccca

SEQ ID NO: 97216 - RNA, 47 nt, Mus musculus
ggugaugaucuuguauggcucugugaugacuuccccauuacugguuc

SEQ ID NO: 97217 - RNA, 41 nt, Mus musculus
aguuacuuuguuaaaaggcugggcaagucuaagggcauuuu

SEQ ID NO: 97218 - RNA, 46 nt, Mus musculus
ugugacuuuggcacugugugugugugugugugugugguguggagau

SEQ ID NO: 97219 - RNA, 45 nt, Mus musculus
gugcguccuaucaggugagugguuggugacgucccgcggggcaga

SEQ ID NO: 97220 - RNA, 46 nt, Mus musculus
ucgggcucaugaugaacaugucaaccugaagagguuuucagcacaa

SEQ ID NO: 97221 - RNA, 78 nt, Mus musculus
guaugugcaugugugacucuaugagguguaucuaucuuuggggaguguaugucuguggggugugugaaugugugugug

SEQ ID NO: 97222 - RNA, 64 nt, Mus musculus
ugugugugugucaggggagguuauaugugggcaugugaguguggaggguucaugugugggcuug

SEQ ID NO: 97223 - RNA, 45 nt, Mus musculus
uggaacacaacuacuucguuagcaucucagagcugauuggugaaa

SEQ ID NO: 97224 - RNA, 46 nt, Mus musculus
auguauguagguggguggugugugugugugugugugugugugugug

SEQ ID NO: 97225 - RNA, 45 nt, Mus musculus
guauugaaauggaaaaggugaugcaggagcuggggaaaucgcuca

SEQ ID NO: 97226 - RNA, 45 nt, Mus musculus
augcuagcgcaugucguaagcauugguauacagccaggcuggcuu

SEQ ID NO: 97227 - RNA, 42 nt, Mus musculus
gacauccuuguaugacaacacccuuugaaaagugugcaccga

SEQ ID NO: 97228 - RNA, 56 nt, Mus musculus
uauguggucauagcuucucuaggauaacuuuaccccagagcaaagaaaacugucua

SEQ ID NO: 97229 - RNA, 39 nt, Mus musculus
acuguuauuauaauggucaucaucauuaucauuauaauc

SEQ ID NO: 97230 - RNA, 46 nt, Mus musculus
cgcuccacaaaggcuagaguuuauguucuagcuaacauauuugcag

SEQ ID NO: 97231 - RNA, 45 nt, Mus musculus
ugguuuugcuaguagauaaucgaauuaauucauauagcggcauca

SEQ ID NO: 97232 - RNA, 44 nt, Mus musculus
guuguucuagagagagagagacagagagagagagagagggagag

SEQ ID NO: 97233 - RNA, 46 nt, Mus musculus
ccacagcugaugguggauaacugagaccacagaagggaaaacugag

SEQ ID NO: 97234 - RNA, 45 nt, Mus musculus
agcuaguguguucagaaagggagcguuacacagcuaguguguuca

SEQ ID NO: 97235 - RNA, 46 nt, Mus musculus
agcuaguguguucagacagggagcuuaacacagcuaguguguucag

SEQ ID NO: 97236 - RNA, 42 nt, Mus musculus
aguuucucacuuccuuccucagaccuugaacacucgggccac

SEQ ID NO: 97237 - RNA, 45 nt, Mus musculus
uguuauucuuuguaggcccaugcccugagucaucacacuggcuuu

SEQ ID NO: 97238 - RNA, 41 nt, Mus musculus
ugcuuuuaacugcuggaccuuuguaucuccuguugggucag

SEQ ID NO: 97239 - RNA, 45 nt, Mus musculus
uaaguacacuauagcugucuucagacacuccagaagaggccguca

SEQ ID NO: 97240 - RNA, 45 nt, Mus musculus
accaucuguaacaagaucugacucccucuucuggagugugugaag

SEQ ID NO: 97241 - RNA, 45 nt, Mus musculus
uagaucucgaauucagguguggcuguaugaacaagugaauauggg

SEQ ID NO: 97242 - RNA, 46 nt, Mus musculus
aaaggagauaauauuacucugcuccaaaguguuuccaacuagcagu

SEQ ID NO: 97243 - RNA, 44 nt, Mus musculus
cgcgcucucucucucucucucucucucucucuguguguggugug

SEQ ID NO: 97244 - RNA, 45 nt, Mus musculus
ccgggggaaguacauuguauugacuacaaugcugaugugauguag

SEQ ID NO: 97245 - RNA, 46 nt, Mus musculus
ccaagacaagagagaccauaacugauagaucugagguacauggcag

SEQ ID NO: 97246 - RNA, 42 nt, Mus musculus
agugccuuacugacuuacaguagccacucaguuucaacaggu

SEQ ID NO: 97247 - RNA, 45 nt, Mus musculus
cuuuugauguuucuggauuuucaacagcacaaaagaguccucgag

SEQ ID NO: 97248 - RNA, 59 nt, Mus musculus
ucucucagugcagacuccaggugguggucaacagcugcggcaugcuuaucuauuuguac

SEQ ID NO: 97249 - RNA, 46 nt, Mus musculus
agcccaaaggacucccccuugcuuaccuuagacaguccaaccuugg

SEQ ID NO: 97250 - RNA, 45 nt, Mus musculus
agggaaggaucaaaauuuggcaggcugggggaacgacuuagcccc

SEQ ID NO: 97251 - RNA, 46 nt, Mus musculus
uggccacucuacaggacucguuccacuaggcuccaaggaaggcaaa

SEQ ID NO: 97252 - RNA, 74 nt, Mus musculus
uggugaguuagcgagacccuaaauucuaggggcuuugugguaggacggugggugaugguuugggaaguuugaga

SEQ ID NO: 97253 - RNA, 47 nt, Mus musculus
ggcaagguaggaggcccaaguugaaugagucuggaaugcaaguugaa

SEQ ID NO: 97254 - RNA, 41 nt, Mus musculus
cagacaguuaggagacccucccuccaucuuguagcccauuc

SEQ ID NO: 97255 - RNA, 66 nt, Mus musculus
uccccuuugacgcaggcucccuucuuaugauagaagacagugacgaagggcuccucuacccaaggc

SEQ ID NO: 97256 - RNA, 45 nt, Mus musculus
ucuguuuggaaggccgcuggcacgaggcacagggcaggcagaaga

SEQ ID NO: 97257 - RNA, 46 nt, Mus musculus
uauaauauauuauuuuacugcuuaaauuucaagucccgagguagau

SEQ ID NO: 97258 - RNA, 46 nt, Mus musculus
uuguucuguuuauuauuauuauuuuucgcugcuaagaagcuaagau

SEQ ID NO: 97259 - RNA, 46 nt, Mus musculus
aguuauacacagguucugccuuguuucacagugugaggguugaaga

SEQ ID NO: 97260 - RNA, 45 nt, Mus musculus
agaaaugaacaguaacuggacgagggucaggaaggggaggggcaa

SEQ ID NO: 97261 - RNA, 49 nt, Mus musculus
uaugggccaugaccaaaacgcaucuaaaugggggcagauggagaccaua

SEQ ID NO: 97262 - RNA, 46 nt, Mus musculus
gagguugcgcaaaaccacccaaccacaugacugaaccauuuuggau

SEQ ID NO: 97263 - RNA, 52 nt, Mus musculus
aggaccgcaugaguaguuugcaaagcagugaacccaaggaggaaucagaaac

SEQ ID NO: 97264 - RNA, 44 nt, Mus musculus
gaaaaaaaaaaaacaaaaaacaaaaacaaaaucugcccccaccu

SEQ ID NO: 97265 - RNA, 46 nt, Mus musculus
ggaccaagccaccaccccuacagacgugcgggauguugaccuguga

SEQ ID NO: 97266 - RNA, 41 nt, Mus musculus
ccuuuauguuuguggaaaaaaaauaucaauuccuagguggu

SEQ ID NO: 97267 - RNA, 46 nt, Mus musculus
auagugcaaauguacuuucuguacuuuucugugagcuggcaaaaag

SEQ ID NO: 97268 - RNA, 42 nt, Mus musculus
caugccuguguguguguguguguguguguguguguaggggug

SEQ ID NO: 97269 - RNA, 42 nt, Mus musculus
auucauagaaacaaaaaacggaaggaaaguuggucaaaaggu

SEQ ID NO: 97270 - RNA, 46 nt, Mus musculus
gaugcugugaagguucugugccccaguauaggggauugccagggcc

SEQ ID NO: 97271 - RNA, 42 nt, Mus musculus
ugcuuuuuagccaggacucuaggacauggauugugaggcucc

SEQ ID NO: 97272 - RNA, 46 nt, Mus musculus
guguguguguguguguguguguguguguguguuacuagggguuggg

SEQ ID NO: 97273 - RNA, 41 nt, Mus musculus
caggccuaccuggcuccugggauugagcccaggugagcagg

SEQ ID NO: 97274 - RNA, 42 nt, Mus musculus
ccggaggcugcuuuacucuuguuguccacuagggggagggag

SEQ ID NO: 97275 - RNA, 45 nt, Mus musculus
caggcaaucccagaccaccucucucucagaaaccacuguaggcug

SEQ ID NO: 97276 - RNA, 46 nt, Mus musculus
uggcagucccuccgagggggcgugcugagcguaugugugugugaaa

SEQ ID NO: 97277 - RNA, 42 nt, Mus musculus
ccgguagcgcacagagcgaugaaggucugcgcaugcuugcgg

SEQ ID NO: 97278 - RNA, 41 nt, Mus musculus
uucuucauggugugucaaaggggaagguguuggcagcagag

SEQ ID NO: 97279 - RNA, 72 nt, Mus musculus
ugcaaggugugcaaaccacuguaaaagagagcugcagaaccuucaguguguggcauuaacauggggguaggg

SEQ ID NO: 97280 - RNA, 46 nt, Mus musculus
acacuaaccaagacuguaagaaaaaaaaaaaagauguccuuuagua

SEQ ID NO: 97281 - RNA, 46 nt, Mus musculus
aaucugagauaacaaaaagaauuuuuuauguguguguggggagggg

SEQ ID NO: 97282 - RNA, 45 nt, Mus musculus
uugugggccgcagccgaacacuccgcaaguuucccccacugagau

SEQ ID NO: 97283 - RNA, 29 nt, Mus musculus
uacgugggcacccugcucucucggcaaag

SEQ ID NO: 97284 - RNA, 45 nt, Mus musculus
ggagcgcuaccucccgcaguguuccuauuucaagugcgugcagaa

SEQ ID NO: 97285 - RNA, 74 nt, Mus musculus
cuucccuuaccuccuuccuuuggcugaaugggagauuugggagaggaaagaaauggcaaagagagagagggaga

SEQ ID NO: 97286 - RNA, 42 nt, Mus musculus
uccucagcucgcucuccucucucgcucaggcagugacgcaag

SEQ ID NO: 97287 - RNA, 45 nt, Mus musculus
gagaucuaacugcccuuccagcuugcgucacugccugagcgagag

SEQ ID NO: 97288 - RNA, 45 nt, Mus musculus
ugaaguuuggucaggccagcugcugugcuccuuaauaacaagagg

SEQ ID NO: 97289 - RNA, 46 nt, Mus musculus
uccugauaacuuucaagcuguuguccgccccgagccacgugcgugg

SEQ ID NO: 97290 - RNA, 45 nt, Mus musculus
augugugagaucugccaggaacuggcugcuggacuuuagccucag

SEQ ID NO: 97291 - RNA, 46 nt, Mus musculus
uuggggaggugaagagagaaggaaggaagaggagaaagaagaggag

SEQ ID NO: 97292 - RNA, 46 nt, Mus musculus
gccucuuucggccuucuucuucuucuguucugaguaccgcccccaa

SEQ ID NO: 97293 - RNA, 42 nt, Mus musculus
uguuuuccuccagugcugaguuccagccagaggaggugcuag

SEQ ID NO: 97294 - RNA, 46 nt, Mus musculus
uaaaagccucugccugccugucuuucucccugaccuaagccccacu

SEQ ID NO: 97295 - RNA, 45 nt, Mus musculus
gugccguuucuaccguggaauaacuugaacuacuccuaaccaggc

SEQ ID NO: 97296 - RNA, 42 nt, Mus musculus
ugagaagucaggcuuccacugcccccacagcauuggggagaa

SEQ ID NO: 97297 - RNA, 42 nt, Mus musculus
cagagucucaggacaacccaggaagggaggcagaccccacca

SEQ ID NO: 97298 - RNA, 42 nt, Mus musculus
ccucugguucagaccccgcucuccucacccugauccggagag

SEQ ID NO: 97299 - RNA, 46 nt, Mus musculus
gcacugcauugcuucuacagcccucagugguaaaaagcccagagag

SEQ ID NO: 97300 - RNA, 46 nt, Mus musculus
aagggucuacagucaguguggagggaaaaggaaaugaaguggauau

SEQ ID NO: 97301 - RNA, 45 nt, Mus musculus
uuugucauacagaucuuucacuuguuugguuagagacacaccaag

SEQ ID NO: 97302 - RNA, 41 nt, Mus musculus
agagacagagagagagacagagagagagagaggaaaggaug

SEQ ID NO: 97303 - RNA, 44 nt, Mus musculus
cucuaguagaacacugagcacagagagagagagagagagagaga

SEQ ID NO: 97304 - RNA, 46 nt, Mus musculus
aagaauuuggggacugucaaaaaauauauaugagaacuuagaagcc

SEQ ID NO: 97305 - RNA, 46 nt, Mus musculus
uuuuuuuccuggaagaaagguuuauugcauaaggaaaucaauagug

SEQ ID NO: 97306 - RNA, 48 nt, Mus musculus
acucaggaaggcacugucagccgcucggagcggaaccccuuucccaga

SEQ ID NO: 97307 - RNA, 70 nt, Mus musculus
uaguccaggggagaggaggccagggcggcccuggagagguuguaggugcagcggaucggccguagagacc

SEQ ID NO: 97308 - RNA, 45 nt, Mus musculus
ggcuccgggcagcggugauaacccagcaaggaagcagagucgcau

SEQ ID NO: 97309 - RNA, 46 nt, Mus musculus
guggcgaaugucaacacccaugauggcgccuccugcucggcccucu

SEQ ID NO: 97310 - RNA, 42 nt, Mus musculus
aagaggcugaggggauagggacaggacagggacaaccuggau

SEQ ID NO: 97311 - RNA, 46 nt, Mus musculus
ugguugguggaacucuuuggggaaggacuagaggguauggccuuau

SEQ ID NO: 97312 - RNA, 42 nt, Mus musculus
cacauggccagauugaggugugaggccagucggagugcaugg

SEQ ID NO: 97313 - RNA, 46 nt, Mus musculus
cuccuuucuccaugcgcugaauggccuccuccagcccacagggcag

SEQ ID NO: 97314 - RNA, 37 nt, Mus musculus
cagagcucccgcuggucaaagaggcgguccuuguggu

SEQ ID NO: 97315 - RNA, 46 nt, Mus musculus
uccaccauagcaccaucauugggccuggcauagccuucaccccgag

SEQ ID NO: 97316 - RNA, 42 nt, Mus musculus
guugggggggaucuucggagggcugccugcugcgccauaggc

SEQ ID NO: 97317 - RNA, 44 nt, Mus musculus
cuaccuuuucccaggucaaaggagaauuuguccuugcgguccag

SEQ ID NO: 97318 - RNA, 43 nt, Mus musculus
cuguuuggggcugauguccacuccuucgagaggcaggggcgcc

SEQ ID NO: 97319 - RNA, 46 nt, Mus musculus
ugugucguuuuuguuaagauuugcuuuucugguugauggccccuag

SEQ ID NO: 97320 - RNA, 42 nt, Mus musculus
ccgggccugccucguggccggcccugcucacccaggcccaca

SEQ ID NO: 97321 - RNA, 46 nt, Mus musculus
ugaaagugugggccccguagggacaguuucagcccaggugcacaga

SEQ ID NO: 97322 - RNA, 73 nt, Mus musculus
acacaacuuugcccucccugcagccuggcaggcccaccgcaaaaaugccaugagcagauuuauaagagccaua

SEQ ID NO: 97323 - RNA, 46 nt, Mus musculus
uuauugguuagcaauaagcaaaggguuggcucaccuugcaguauag

SEQ ID NO: 97324 - RNA, 86 nt, Mus musculus
aucgagaauguucccacaggccccaacaauaagcccaaacugccaguggugaucucacaguguggggaaauguaaucuagacaaga

SEQ ID NO: 97325 - RNA, 56 nt, Mus musculus
auggaaagcauguaguguuuggaaaaaucauugacggacuucuagugaugaggaag

SEQ ID NO: 97326 - RNA, 50 nt, Mus musculus
auucaggguggagauuuuguuaauggcgauggcacuggagucgccaguau

SEQ ID NO: 97327 - RNA, 45 nt, Mus musculus
cuucgaugucagcauuggcggccaggaaguuggucgcaugaagau

SEQ ID NO: 97328 - RNA, 44 nt, Mus musculus
uggacuggacuugaauuugccacugccauggcuuugacccggaa

SEQ ID NO: 97329 - RNA, 47 nt, Mus musculus
cuuucugcgcuggcauuggaaccuacuucuuugggauuucagcagau

SEQ ID NO: 97330 - RNA, 46 nt, Mus musculus
uuugagauauuaggaaaaaguaaauaaaauccaugaagcagcccua

SEQ ID NO: 97331 - RNA, 45 nt, Mus musculus
gaucaaugugcggauugagcacaucaagcacucaaagggcagaga

SEQ ID NO: 97332 - RNA, 91 nt, Mus musculus
ccggagagcugaacggauuucccaggagaaaguccauugccgcggcuaccgcugccaccagcucccagaaucaggugacagcaaccgccgg

SEQ ID NO: 97333 - RNA, 45 nt, Mus musculus
acagauuuccauguugagggcccaguccucgcucugcagggagcc

SEQ ID NO: 97334 - RNA, 42 nt, Mus musculus
ucaccagcacauucucuacaaaguccugguuggccaccagua

SEQ ID NO: 97335 - RNA, 45 nt, Mus musculus
ucuggauggugucucugaguugaauacaguucucuggggugugug

SEQ ID NO: 97336 - RNA, 32 nt, Mus musculus
cucagcggagaguuuguguaaagccgguggag

SEQ ID NO: 97337 - RNA, 46 nt, Mus musculus
acacuagcucucuugagagauggcaagacacaagauuauguuguug

SEQ ID NO: 97338 - RNA, 46 nt, Mus musculus; identical to SEQ ID NO: 40493

SEQ ID NO: 97339 - RNA, 41 nt, Mus musculus
gcccaccauuucacagucuauugccaccaucuucccuggca

SEQ ID NO: 97340 - RNA, 45 nt, Mus musculus
gccaagacaauggugcuuucuugucuuuggacugcucugaguccc

SEQ ID NO: 97341 - RNA, 41 nt, Mus musculus
ccuauuucuuuaccuggugguccuuuaccuucaggccgcga

SEQ ID NO: 97342 - RNA, 46 nt, Mus musculus
gauuaggaagaaauacccggaccgggugccggugagugggggcggg

SEQ ID NO: 97343 - RNA, 42 nt, Mus musculus
ccaaacuccucaagcuugccuucucccuccccgcccccacuc

SEQ ID NO: 97344 - RNA, 45 nt, Mus musculus
agcgugcgcguggugggugagucagcaggauucagcacccaugga

SEQ ID NO: 97345 - RNA, 41 nt, Mus musculus
ugcagagcacggaccuucuuuuuccacacauggcccaggag

SEQ ID NO: 97346 - RNA, 41 nt, Mus musculus
cagcucggauuucuguuaaaguucugaauaauggggguagg

SEQ ID NO: 97347 - RNA, 45 nt, Mus musculus
aucguggagaaggcuccuaaagccagggucccugaucuggauaag

SEQ ID NO: 97348 - RNA, 42 nt, Mus musculus
gaaugaaaggucagaagagagaaagaugguuaccagugaggu

SEQ ID NO: 97349 - RNA, 45 nt, Mus musculus
uuuuuaaaugugugugugugugugugugugugugugugugcuugc

SEQ ID NO: 97350 - RNA, 46 nt, Mus musculus
gagugcucuccuuuaaauaacuggguuaacaaagcaagacugagag

SEQ ID NO: 97351 - RNA, 66 nt, Mus musculus
uuggggguaggggaggggugcgcgugggacuuggggaaccagagggagggcucccaaccauggagg

SEQ ID NO: 97352 - RNA, 55 nt, Mus musculus
ucacaagcucaauuguuacuuuucucugcuuccucagcccaggaagaacuugugu

SEQ ID NO: 97353 - RNA, 46 nt, Mus musculus
aggggcaggcauugcauucucacaugacauuucaauucaucucuac

SEQ ID NO: 97354 - RNA, 46 nt, Mus musculus
acagcuugauggacacuugcuggcucguucccuuuguaguuguuag

SEQ ID NO: 97355 - RNA, 46 nt, Mus musculus
auucuugguuagucuuccauuuuauugcuuagauguuucuuuggug

SEQ ID NO: 97356 - RNA, 45 nt, Mus musculus
cagaguagguuuuauaacuggagccagaaagaaauacauaaacgg

SEQ ID NO: 97357 - RNA, 42 nt, Mus musculus
cuucagccucuccaauagcaggggcaggucgugggcgagcag

SEQ ID NO: 97358 - RNA, 46 nt, Mus musculus
aacauguaagacacaacaucccagaaguaccauuuguuccccucac

SEQ ID NO: 97359 - RNA, 42 nt, Mus musculus
cauagcuagaagcaguugagggaggugucggacuggcaggag

SEQ ID NO: 97360 - RNA, 46 nt, Mus musculus
uuauccgcuuaugauaaguuuagcauuuaaaaguauguuuuuggag

SEQ ID NO: 97361 - RNA, 42 nt, Mus musculus
ucaaucagagauccugucucaaaaguaagauggaggggccag

SEQ ID NO: 97362 - RNA, 45 nt, Mus musculus
cuugguuucaggaagugugccuuauaugcccaauaguaggaccag

SEQ ID NO: 97363 - RNA, 42 nt, Mus musculus
ucugacacuccuuguuauuuuuagcacauuugucaggggcag

SEQ ID NO: 97364 - RNA, 45 nt, Mus musculus
cuuccaaaaaaugaucacgugccuuaucucuagaauauggcgcuu

SEQ ID NO: 97365 - RNA, 46 nt, Mus musculus
uaaauccauauccauuucugacguugaaccauuugacagugccaag

SEQ ID NO: 97366 - RNA, 41 nt, Mus musculus
aaaaagcuccagaaaguucccagggccggggauuuggcuca

SEQ ID NO: 97367 - RNA, 46 nt, Mus musculus
ucuggacuuuuugagguggcaggaugaaagacaucagacucaucac

SEQ ID NO: 97368 - RNA, 45 nt, Mus musculus
cuggggauugcggaaauuaaccuuccuuuaucgcccuaccaccac

SEQ ID NO: 97369 - RNA, 53 nt, Mus musculus
cuucuccgcguccucgccgcccgcgggggcugaugaggccggggcgggcccgg

SEQ ID NO: 97370 - RNA, 46 nt, Mus musculus
gaugagcucaaggccagccuggucuccuugagacccuagcagagaa

SEQ ID NO: 97371 - RNA, 45 nt, Mus musculus
guugcucugauauauuuuaacaucuuuaaugaccuucacagcuag

SEQ ID NO: 97372 - RNA, 42 nt, Mus musculus
ucauauagugcagaccacuuauccuugaggauguccaggcag

SEQ ID NO: 97373 - RNA, 42 nt, Mus musculus
gggugguaacagggugugaggaacuucacugugggugcguug

SEQ ID NO: 97374 - RNA, 45 nt, Mus musculus
guacugcuuacuuuuaugucagcuuggcacagcuagagucaucag

SEQ ID NO: 97375 - RNA, 46 nt, Mus musculus
gaagccagccuggacuccaugaccccauggcaaagagacggaaaag

SEQ ID NO: 97376 - RNA, 44 nt, Mus musculus
ggagaauggaggggaagaaggccuugaggaaagaggaggugagg

SEQ ID NO: 97377 - RNA, 45 nt, Mus musculus
cgcuagcacaugcugggagaaugugauagagagacugaaguggaa

SEQ ID NO: 97378 - RNA, 26 nt, Mus musculus
agcugacacuagaagcaguagcccuu

SEQ ID NO: 97379 - RNA, 51 nt, Mus musculus
ucugauaagcauagauuauuuuagauaugguuauccauuugcaaguagagg

SEQ ID NO: 97380 - RNA, 46 nt, Mus musculus
ggaauuuauuuggcaauuuuauuagacccuauuuuuugaccgguga

SEQ ID NO: 97381 - RNA, 46 nt, Mus musculus
accaguaagaagggggaaauguauguaugugaacagaagaggucag

SEQ ID NO: 97382 - RNA, 45 nt, Mus musculus
gcugguggugacacaugcaccuuuaaucucagcacuccagaggca

SEQ ID NO: 97383 - RNA, 46 nt, Mus musculus
agaggcgaggcggugguccacacccgcccgaggaggaagaugucaa

SEQ ID NO: 97384 - RNA, 46 nt, Mus musculus
ggguuagcggagcaguguccagggaugaggaagcgaccugcugcag

SEQ ID NO: 97385 - RNA, 45 nt, Mus musculus
aaccuuauuuuguguccuuagaugcuaccggggaugacgggucca

SEQ ID NO: 97386 - RNA, 30 nt, Mus musculus
uagauucuucuucgcaaaacaaaagggcca

SEQ ID NO: 97387 - RNA, 46 nt, Mus musculus
uacaucuuuaaacagcguuucuucauugccuguguaugagaaaaac

SEQ ID NO: 97388 - RNA, 46 nt, Mus musculus
uguuuugugcauuuguaaaugcuguauuggauagacuagccccccc

SEQ ID NO: 97389 - RNA, 42 nt, Mus musculus
aagaguuuguuaagaucuaggaggauucaauuaguagaacag

SEQ ID NO: 97390 - RNA, 46 nt, Mus musculus
ccaucacuuguauuagaccuguucuacuaauugaauccuccuagau

SEQ ID NO: 97391 - RNA, 45 nt, Mus musculus
uggaggcuaaggcugggcuucuggcuaaaacagacugaaaggaga

SEQ ID NO: 97392 - RNA, 46 nt, Mus musculus
ugaagggcuccagagggggaaucggguuccucguccgccgccaucu

SEQ ID NO: 97393 - RNA, 46 nt, Mus musculus
caggcuaguaaaauacuguguugaaaugaaaagauaacuucaagaa

SEQ ID NO: 97394 - RNA, 46 nt, Mus musculus
cagggcauucaggaugggcaaagcaaaggcaccuguuuucccagau

SEQ ID NO: 97395 - RNA, 45 nt, Mus musculus
cucuuaaguugaagccuuugguauuuuccaaguggucaaucaguc

SEQ ID NO: 97396 - RNA, 30 nt, Mus musculus
agcucaggaaagauggugaaacccccaggu

SEQ ID NO: 97397 - RNA, 42 nt, Mus musculus
cagacagacagacagacagacacacacacacacagagccaga

SEQ ID NO: 97398 - RNA, 46 nt, Mus musculus
uaugaaacuggcaaagaguaagcuuuuaaaaugggccugggcagau

SEQ ID NO: 97399 - RNA, 42 nt, Mus musculus
cuucugaccuugagauugaccuuuggggggaggcauagugga

SEQ ID NO: 97400 - RNA, 44 nt, Mus musculus
cacucaguuuuuggcaaacaugugugaccauuuggauagauucc

SEQ ID NO: 97401 - RNA, 45 nt, Mus musculus
ggcagucaaucuuaguccaaaauacuugcucagaaucacugugca

SEQ ID NO: 97402 - RNA, 45 nt, Mus musculus
gugauuguaagccaccaugugguugcugggauuugaacucaagcc

SEQ ID NO: 97403 - RNA, 26 nt, Mus musculus
uguguguggggggggggcgcgggggg

SEQ ID NO: 97404 - RNA, 46 nt, Mus musculus
uugucucacagugaugguccucggcuugauugauggcuguuggcuu

SEQ ID NO: 97405 - RNA, 46 nt, Mus musculus
auuuguauccugauaaaaacaaaacaaaacaaaaaacccaaaccag

SEQ ID NO: 97406 - RNA, 68 nt, Mus musculus
cuucuuccucuucggaguccucuucgccaucugcuucucuugccuccuggcccacgcuuucaacuuga

SEQ ID NO: 97407 - RNA, 42 nt, Mus musculus
ugaacaggaccaacgucaaugucuuuucugagcugccugcuc

SEQ ID NO: 97408 - RNA, 83 nt, Mus musculus
auaugcuucaccucguuccucuccauugccaucuggguggccuggaucguucugcuccugauucccgacauugaccggaaaug

SEQ ID NO: 97409 - RNA, 69 nt, Mus musculus
caacggcuggguuuuccuggcguuuuauaucuugcccgaguuucgacagcucccaaggcaacggagccc

SEQ ID NO: 97410 - RNA, 41 nt, Mus musculus
cagcucaugaagcagagcuaugguguggagaacagagccua

SEQ ID NO: 97411 - RNA, 42 nt, Mus musculus
cucuuggucuuaauuguacuauaaucccauccaaggucccua

SEQ ID NO: 97412 - RNA, 45 nt, Mus musculus
auccauccauccacacauauacuuuuuugaaggcauuccuggcag

SEQ ID NO: 97413 - RNA, 42 nt, Mus musculus
gacacacucuaugcaccuuauuccacccauuuucagcuacag

SEQ ID NO: 97414 - RNA, 49 nt, Mus musculus
caccaaaaggauuucucuaucccgagggcccaggccccggccaguccgu

SEQ ID NO: 97415 - RNA, 59 nt, Mus musculus
aaaggucugggucuccgccuuguccaucucauccacacuggaagcuaaucugaucgcgc

SEQ ID NO: 97416 - RNA, 44 nt, Mus musculus
ccacauuuucaucccaaucgccuccaaacucacugccaacccca

SEQ ID NO: 97417 - RNA, 42 nt, Mus musculus
ggacucccggggcagacauugcuggaggugcgcggggccggg

SEQ ID NO: 97418 - RNA, 42 nt, Mus musculus
uggggugauggauucuuguguuuggaaggcaguuuggcccua

SEQ ID NO: 97419 - RNA, 64 nt, Mus musculus
uacgcucuucccacuauccauguagcccaggcuggucuggaacucaccauacagcagagaucga

SEQ ID NO: 97420 - RNA, 45 nt, Mus musculus
ccuaaguguugugaucauaggcauguguuaccacaaguaggggaa

SEQ ID NO: 97421 - RNA, 42 nt, Mus musculus
ccuggaaucccaggcagcccccuacccaacccccugccgcug

SEQ ID NO: 97422 - RNA, 46 nt, Mus musculus
ggaggcauuucugucugaaagcugcuacauaguuuccugaggggag

SEQ ID NO: 97423 - RNA, 41 nt, Mus musculus
cggucuguucacugggucuugccagugguuucagucgggca

SEQ ID NO: 97424 - RNA, 46 nt, Mus musculus
ggucaaaggcuguugacauacuuaggcaauaauaauagaggcucag

SEQ ID NO: 97425 - RNA, 46 nt, Mus musculus
guagaugauaauuuuuauaguuuaaaguggagaaauugggaccaua

SEQ ID NO: 97426 - RNA, 42 nt, Mus musculus
gcccagaccucggugaguacgacccccucacgcaggccgaca

SEQ ID NO: 97427 - RNA, 46 nt, Mus musculus
ccugguguccuaugugcgcacgucugucuuccugcugacacuggug

SEQ ID NO: 97428 - RNA, 42 nt, Mus musculus
cccugcccucccagagaccugcauagcgcuuggagccggcgc

SEQ ID NO: 97429 - RNA, 46 nt, Mus musculus
ccuucccccacauacacaaaaaggaagaaggaaggaaggaaggaag

SEQ ID NO: 97430 - RNA, 46 nt, Mus musculus
agagagagagagagagagagagagagagagagagacccaaguccua

SEQ ID NO: 97431 - RNA, 41 nt, Mus musculus
ucagaaggugcuugguuauuaaggguaagagauaaagggcu

SEQ ID NO: 97432 - RNA, 46 nt, Mus musculus
uuuugcucacucccuuuugagacaugguuuuuacacuguaccccag

SEQ ID NO: 97433 - RNA, 42 nt, Mus musculus
cgugacaguuacaggauauucuaggauggauuuaggcagcgg

SEQ ID NO: 97434 - RNA, 42 nt, Mus musculus
guaaugauaaacagcagcaaacacuuuacugaaggggcuggc

SEQ ID NO: 97435 - RNA, 46 nt, Mus musculus
cgggcaaaaucaauggaggggaggaagcuuucacugugucuuacag

SEQ ID NO: 97436 - RNA, 42 nt, Mus musculus
gacgacgacacauuugccccgcuucuuaucuccagggggaaa

SEQ ID NO: 97437 - RNA, 23 nt, Mus musculus
aguuggugaaggcgccagauucc

SEQ ID NO: 97438 - RNA, 46 nt, Mus musculus
ccaugguuaacaaccugaguuugaucccugggaaccccaugguaag

SEQ ID NO: 97439 - RNA, 46 nt, Mus musculus
cucagagguuucuuaaagcacgguuggcagcaaacgagugcagcug

SEQ ID NO: 97440 - RNA, 59 nt, Mus musculus
uuaccaccuuuaccuccugcacccagccuuccccuccauccuccuggaccugagcaaca

SEQ ID NO: 97441 - RNA, 45 nt, Mus musculus
cgaagauuccugucuaggauaaaguuuguugauucucccuaccag

SEQ ID NO: 97442 - RNA, 50 nt, Mus musculus
ggguugugcagcacuugggaucacuguccugcggcagcguguugaagcug

SEQ ID NO: 97443 - RNA, 45 nt, Mus musculus
cucucuguguaugugugugugucucuguaugugugugugugccca

SEQ ID NO: 97444 - RNA, 45 nt, Mus musculus
augaccaaguucuuuagaauuauugccauccuuuucugcccccuu

SEQ ID NO: 97445 - RNA, 45 nt, Mus musculus
uugcagcuugaggaaauggauaggaucugauguggaaaagcccca

SEQ ID NO: 97446 - RNA, 46 nt, Mus musculus
uuuucuggaccucucuccucuuucaguaaggaaaaacuugggcgag

SEQ ID NO: 97447 - RNA, 78 nt, Mus musculus
cucguuauauugguaauaaaagaacaguaacucugaaaguaaagaaggcaaaauccaagggaaaagaccaggccuaca

SEQ ID NO: 97448 - RNA, 46 nt, Mus musculus
cugaacccgauaauaauauggcaggaguggccaugaucaucaagag

SEQ ID NO: 97449 - RNA, 42 nt, Mus musculus
gacacagggaaacucuacaccuugauccucacagacccggau

SEQ ID NO: 97450 - RNA, 47 nt, Mus musculus
gcugggccaagugcugacgcccacccagguuaagcacagacccggaa

SEQ ID NO: 97451 - RNA, 42 nt, Mus musculus
gccaguucucagcgcagcacgcgccuucagcagcacccaacc

SEQ ID NO: 97452 - RNA, 46 nt, Mus musculus
agagaaacaggagcacagcagagagagagagagagagagagagaga

SEQ ID NO: 97453 - RNA, 41 nt, Mus musculus
cucccgggacucacccggcacguccguccauccugggcuug

SEQ ID NO: 97454 - RNA, 56 nt, Mus musculus
aggcuggccucuaggagcuuugagugcuguguuucuaagccauuggaaugggaggg

SEQ ID NO: 97455 - RNA, 41 nt, Mus musculus
uggaaccacgugggauuugcccugucuacacuggcgcaucu

SEQ ID NO: 97456 - RNA, 25 nt, Mus musculus
gaaaagagaaagugaaucagaagga

SEQ ID NO: 97457 - RNA, 46 nt, Mus musculus
ggacuucauuucaguguguuuaauuuuuagaauaaauuugccagaa

SEQ ID NO: 97458 - RNA, 42 nt, Mus musculus
ccuuaaaauauuaacauucuacacaaguuuacaaaggcaggg

SEQ ID NO: 97459 - RNA, 49 nt, Mus musculus
ggaccugacucccgagguuauaaguuuccugggcugaugugcuggggug

SEQ ID NO: 97460 - RNA, 42 nt, Mus musculus
cagaggcaagaagagaggggagggcuucaaggagccuaagag

SEQ ID NO: 97461 - RNA, 45 nt, Mus musculus
gggcugcuggacauccgguuuggcauccuugccagagagccccca

SEQ ID NO: 97462 - RNA, 46 nt, Mus musculus
caaccuuucucaaggucuggggacagacaucuguccucuggcaaag

SEQ ID NO: 97463 - RNA, 46 nt, Mus musculus
ggccaaccagugaaacuuggucucaagaacaaaccaacgacgagag

SEQ ID NO: 97464 - RNA, 45 nt, Mus musculus
ggggaacaggcacagguguggaugagagcaaauggagggcauacu

SEQ ID NO: 97465 - RNA, 41 nt, Mus musculus
agagagagagggagagcaagagggagagggagagggagaga

SEQ ID NO: 97466 - RNA, 41 nt, Mus musculus
gucccagccacuaagaccccaucucauaaauacaacagcaa

SEQ ID NO: 97467 - RNA, 46 nt, Mus musculus
guuuucugucuucuaucugaggugugugugugugugugugugugug

SEQ ID NO: 97468 - RNA, 41 nt, Mus musculus
cuccauggacacaauggaagacaagcggaaaugagagggag

SEQ ID NO: 97469 - RNA, 41 nt, Mus musculus
ugugguuagaauauagaguaaagaacagcaaauggguuaga

SEQ ID NO: 97470 - RNA, 42 nt, Mus musculus
cuuagugcugagcuaacauccugaguguauagagcugaacaa

SEQ ID NO: 97471 - RNA, 42 nt, Mus musculus
guccccaacaacagaugacacacuuugagucuguccaugcag

SEQ ID NO: 97472 - RNA, 42 nt, Mus musculus
aguggggaagaggauuuuuuuuggagaguagaaaccagugug

SEQ ID NO: 97473 - RNA, 42 nt, Mus musculus
uagaggaggaaguagaagaaaauagaagugcaguucaggcag

SEQ ID NO: 97474 - RNA, 44 nt, Mus musculus
caugcaaagucauuccaugucaaaaugcagcaucaagggcucca

SEQ ID NO: 97475 - RNA, 46 nt, Mus musculus
caucaucuucuccaucaucucccuuguggucuucguguuccagcuc

SEQ ID NO: 97476 - RNA, 41 nt, Mus musculus
gcucuggauacucacagcacaccagcaugguggacccugag

SEQ ID NO: 97477 - RNA, 42 nt, Mus musculus
uuuacaugagagcaucaguuucccccccacccccgccccacu

SEQ ID NO: 97478 - RNA, 45 nt, Mus musculus
cuaaacaaauacccuaauacugagcuacauacauagucccacagg

SEQ ID NO: 97479 - RNA, 46 nt, Mus musculus
gccaccaacagauaacuagaggagagaacagcccagagaggcagcu

SEQ ID NO: 97480 - RNA, 100 nt, Mus musculus
uuacugcaaugcaccaucuucuccauucuuuccagaaacacccaguuagguaaaaggccaggcuucucucauaacaccauaccuaguuguauggaggccc

SEQ ID NO: 97481 - RNA, 81 nt, Mus musculus
aggaugcgucaugauuuauucuucauuacacacaaaucaguacagauaggagagcccagcuaucucuuauucaccaacaua

SEQ ID NO: 97482 - RNA, 47 nt, Mus musculus
uccugguuggagugucaaucuacacucaucauuacgcccacagcgaa

SEQ ID NO: 97483 - RNA, 41 nt, Mus musculus
gaugaugaagcugaaacagaagcagauccaggucaggauga

SEQ ID NO: 97484 - RNA, 45 nt, Mus musculus
cagguuagguugcuuccuccuacccagcccaccccgcccccagac

SEQ ID NO: 97485 - RNA, 60 nt, Mus musculus
ggggcggggugggcuggguaggaggaagcaaccuaaccugggagggaagcaggagucacu

SEQ ID NO: 97486 - RNA, 56 nt, Mus musculus
uuccaaggaugggugcuuggcaguagagaaucccaccgccccagauaugguuuggg

SEQ ID NO: 97487 - RNA, 70 nt, Mus musculus
cauaucuggggcggugggauucucuacugccaagcacccauccuuggaagaaaguuguuggcugauaugc

SEQ ID NO: 97488 - RNA, 45 nt, Mus musculus
guauguaauugaggauggacggggccauauuugguggcuagagga

SEQ ID NO: 97489 - RNA, 46 nt, Mus musculus
ccauauuaucaaguucugauggugguucaggucuuagcaagagcag

SEQ ID NO: 97490 - RNA, 73 nt, Mus musculus
uuuguuuuuaggucacaaggacaaaguggcuuccagacuuagccucagcauagagcaauaucugcucuugcua

SEQ ID NO: 97491 - RNA, 66 nt, Mus musculus
ggccaggaagccaaugugcauauuugguggccuuucuaacaaaaguauaggaagagagaugguuug

SEQ ID NO: 97492 - RNA, 56 nt, Mus musculus
uaaguucaagcugauggaauugguuuagccaagaaauggaaguuucuaccccagag

SEQ ID NO: 97493 - RNA, 42 nt, Mus musculus
ggcagcuuuucuggaguuuuucuagauucucuagagccaaag

SEQ ID NO: 97494 - RNA, 61 nt, Mus musculus
auuugaggaaguccaaugaugaccaacaacacuggggaccagaauauaacaucuaaaugca

SEQ ID NO: 97495 - RNA, 46 nt, Mus musculus
caucuuuagcuggaaaauagugugaugaaagcuguugagaggagac

SEQ ID NO: 97496 - RNA, 50 nt, Mus musculus
gcuguaagccaauuaacauauacaccaaccuaaacuaaagaaccaguccu

SEQ ID NO: 97497 - RNA, 46 nt, Mus musculus
gagaagagaaugccugcccucagggaaaaaaaugucauugugugag

SEQ ID NO: 97498 - RNA, 45 nt, Mus musculus
uuaaaacaggagaaacucuuagggcauccagacagaugguagcua

SEQ ID NO: 97499 - RNA, 46 nt, Mus musculus
ugcagccccaacaauuuagcuaccaucugucuggaugcccuaagag

SEQ ID NO: 97500 - RNA, 45 nt, Mus musculus
ucuuuuuagaaauaguuucuuuuauugcccuuagaagaucacccc

SEQ ID NO: 97501 - RNA, 80 nt, Mus musculus
aggaauauucuuauccauuucuuauauacauuucuuuugggagggaguuuuuaugcuauaguugcugguauuuauguaaa

SEQ ID NO: 97502 - RNA, 45 nt, Mus musculus
guagguuacugaacugccgggcugauguuagagacacuggccaga

SEQ ID NO: 97503 - RNA, 46 nt, Mus musculus
uuuuuuucugugacauuuacgucucauguaauuugcaucgcauugg

SEQ ID NO: 97504 - RNA, 46 nt, Mus musculus
acuauaauuguaaauauuuugauacaaauguuuauaacucuaggga

SEQ ID NO: 97505 - RNA, 42 nt, Mus musculus
ugauuacauuuauguuuauaagcucucuauagauggggccag

SEQ ID NO: 97506 - RNA, 46 nt, Mus musculus
uggugcagcuucagauuugggcagguucucugcugguuuguuagau

SEQ ID NO: 97507 - RNA, 46 nt, Mus musculus
ucuauuuuuauuucuuccuguuugaggcaugcucuuuagcccagau

SEQ ID NO: 97508 - RNA, 45 nt, Mus musculus
agacacuucuacugcaaacauggucaacguaccaaaaacccgaag

SEQ ID NO: 97509 - RNA, 49 nt, Mus musculus
gcuggccauuaagagaugcaagcauuuugaacugggaggcgacaagaag

SEQ ID NO: 97510 - RNA, 47 nt, Mus musculus
caugaggaaggaaguugaggauggaguagagacagaaaggcaaagag

SEQ ID NO: 97511 - RNA, 69 nt, Mus musculus
gaacauguggugagagaggauggaggggaauggagagagaagggagagagagaguaauaggauaagaga

SEQ ID NO: 97512 - RNA, 46 nt, Mus musculus
agagucaggcguucaaggucauccaaguggccauacugaguuggag

SEQ ID NO: 97513 - RNA, 45 nt, Mus musculus
acagcaucuuuguggaggggguugagauuaagcaaggguacgaag

SEQ ID NO: 97514 - RNA, 42 nt, Mus musculus
uaggcuauuuccaaguugaggcuuuccacucagaugcuguag

SEQ ID NO: 97515 - RNA, 28 nt, Mus musculus
cugcaaucccagugcucuggaggccagg

SEQ ID NO: 97516 - RNA, 42 nt, Mus musculus
aagaaucuggcacccuggcugugauaaaaugagaaggcuuua

SEQ ID NO: 97517 - RNA, 46 nt, Mus musculus
uucagauggcacuucuauuaccaggacagacuguuuaaaagaaaau

SEQ ID NO: 97518 - RNA, 46 nt, Mus musculus
aaaaaauaauaagacuuaagccugcaacuucaaaaaaugcccacaa

SEQ ID NO: 97519 - RNA, 44 nt, Mus musculus
caggggcuguucuaaccacugucggagaaaugacuauuguauuu

SEQ ID NO: 97520 - RNA, 46 nt, Mus musculus
cgcguuuaguuagguauuucuggauucgcguuccauuuagggagau

SEQ ID NO: 97521 - RNA, 46 nt, Mus musculus
gaauggaaggacggggaaggaagucuucuccuccuguagcuagcag

SEQ ID NO: 97522 - RNA, 45 nt, Mus musculus
cacuguggagguagaaguagcagauacauuucaaguauaguugug

SEQ ID NO: 97523 - RNA, 46 nt, Mus musculus
cauggaggaagaggcuuaaguaucuccucauucagucugcacucug

SEQ ID NO: 97524 - RNA, 46 nt, Mus musculus
aauguugcugugacccucuuacuuauuuucagaccuugcuagguuu

SEQ ID NO: 97525 - RNA, 46 nt, Mus musculus
uaacuuguugccaagugcuucuugaaauacguuuuuggccuuccag

SEQ ID NO: 97526 - RNA, 45 nt, Mus musculus
cuguggcuuggccagguaagguaucacaaauaccuucggggggua

SEQ ID NO: 97527 - RNA, 46 nt, Mus musculus
aaaaauguauauguaauauaucaaguguauacagaaauagaaugag

SEQ ID NO: 97528 - RNA, 45 nt, Mus musculus
cucaaaaaaagagcaagaggaggagggagggagacaaggaaggag

SEQ ID NO: 97529 - RNA, 41 nt, Mus musculus
aacaccauuguagugucugugccuggcugucaaccugcuua

SEQ ID NO: 97530 - RNA, 48 nt, Mus musculus
cuaauacaaccgugaaguaaugauggagcuaagucuuguacuaaagga

SEQ ID NO: 97531 - RNA, 46 nt, Mus musculus
ucacuuuccaacuuuagagaaggaauuaaaagcuucagcaacaaag

SEQ ID NO: 97532 - RNA, 46 nt, Mus musculus
guuaaugauacaagaaaggguuguggaaccucccucugcugcuaag

SEQ ID NO: 97533 - RNA, 41 nt, Mus musculus
gagagcugcagagacaacaacauuggaaggaguuggggaga

SEQ ID NO: 97534 - RNA, 44 nt, Mus musculus
uucuuuuaguggcuagcuagcuagauggcuucuagaaccagcca

SEQ ID NO: 97535 - RNA, 45 nt, Mus musculus
uagguauuuuaaauuguuguaauuguauuuguggaauagguguaa

SEQ ID NO: 97536 - RNA, 46 nt, Mus musculus
ugauuacaauaauaauacaaaucagcuuugaguaauuuugagguag

SEQ ID NO: 97537 - RNA, 41 nt, Mus musculus
uuaaaaguugagggccaagccauagcaaauuaagaugggga

SEQ ID NO: 97538 - RNA, 45 nt, Mus musculus
acuagaggcuaaggcaggauccccacuaacuucaguccagcccgg

SEQ ID NO: 97539 - RNA, 46 nt, Mus musculus
cgugcacaugguguacacuuaugcucgugagugacuuuggccccua

SEQ ID NO: 97540 - RNA, 45 nt, Mus musculus
uauugucuuuugagauaaacauguuauugaaucuuguccuauuua

SEQ ID NO: 97541 - RNA, 41 nt, Mus musculus
auuuggugugugauuguguguucaugugugucuugggaguc

SEQ ID NO: 97542 - RNA, 41 nt, Mus musculus
uugacuaggaaaagcuaauaaagauagugaauuuggggcaa

SEQ ID NO: 97543 - RNA, 69 nt, Mus musculus
guguagaagaaccucagaaaaaagucuucaaggcucggaaaacaaugagagcgagcgaucgccagcagc

SEQ ID NO: 97544 - RNA, 46 nt, Mus musculus
gacuuggaucccacuucacccuuggaaaacacagauuguauucaag

SEQ ID NO: 97545 - RNA, 45 nt, Mus musculus
cccaauguugcuguaaaaaacaaacaagaagauuugaauagugaa

SEQ ID NO: 97546 - RNA, 45 nt, Mus musculus
acaagacagagccgaguagcaauaacagugaugauuguccaggca

SEQ ID NO: 97547 - RNA, 46 nt, Mus musculus
agacuccugugaugagggaaauaaagugaacaguaaugucgucgag

SEQ ID NO: 97548 - RNA, 46 nt, Mus musculus
agaggaucuuucguguggaaaagaugaguccgaagcuguagcgcag

SEQ ID NO: 97549 - RNA, 46 nt, Mus musculus
gauccaugaggaagauuuuauagaaugcagcuagguggguugacac

SEQ ID NO: 97550 - RNA, 40 nt, Mus musculus
ucgucguccaucuggggacacgcuguugcauagugcuaaa

SEQ ID NO: 97551 - RNA, 47 nt, Mus musculus
cuacacagucuuuacugcuguuugaucuuuuucuucauuuucagauc

SEQ ID NO: 97552 - RNA, 46 nt, Mus musculus
aauuuugcugcuguuuuucauuguaauguaaauauuuuauaugcag

SEQ ID NO: 97553 - RNA, 52 nt, Mus musculus
cgaaugggaacgauagcauuugcacuguaguacugguguaaagcuuggaaac

SEQ ID NO: 97554 - RNA, 46 nt, Mus musculus
uuggccauuaaaaggaaaauaacuuauuaaauguaaugcuaucagg

SEQ ID NO: 97555 - RNA, 48 nt, Mus musculus
aagcugaggaagaggagcgaguuccagccgaggagcagccaccuguga

SEQ ID NO: 97556 - RNA, 40 nt, Mus musculus
aagacauggacaguguagaguccaaacgccggcgauauau

SEQ ID NO: 97557 - RNA, 52 nt, Mus musculus
gcccuacagugugcuguguuugauaagacguuggcagaauuaaaaacucgag

SEQ ID NO: 97558 - RNA, 46 nt, Mus musculus
uuaucuuuugaucgugugcuaccacuuuuauaucuuugagguugag

SEQ ID NO: 97559 - RNA, 44 nt, Mus musculus
ugaagguaucagcagaauagcuuucucuggaggucuaguauugu

SEQ ID NO: 97560 - RNA, 46 nt, Mus musculus
auacuuucucuguggauauugugccuuaaugauaguuuauuguguu

SEQ ID NO: 97561 - RNA, 44 nt, Mus musculus
uaaagcacaguucaguggaaauagagaacaguguaggaaaggac

SEQ ID NO: 97562 - RNA, 45 nt, Mus musculus
uaaguauacuguagcuaucuucagauacuccagaagagggcauca

SEQ ID NO: 97563 - RNA, 82 nt, Mus musculus
uuugugagacugaagaaugauugcuucaguagugugggccacacuugaugucuauguuuacuuuaaaacauggagugaccaa

SEQ ID NO: 97564 - RNA, 46 nt, Mus musculus
cagagcccuccaaacccacccauaucaccaggaaagccugccaaug

SEQ ID NO: 97565 - RNA, 42 nt, Mus musculus
cucaccugucaguugcagguuucuauucauucucauggccau

SEQ ID NO: 97566 - RNA, 42 nt, Mus musculus
ugguuauaguuauaccaagauauuuuauauuauuuguggcua

SEQ ID NO: 97567 - RNA, 44 nt, Mus musculus
uugucgaauugcucuagcuaauacuucaaguacuauauugagua

SEQ ID NO: 97568 - RNA, 46 nt, Mus musculus
agaaaucagucugaaguucucuuucucuauugagucuugugugguu

SEQ ID NO: 97569 - RNA, 45 nt, Mus musculus
uucacauccuuucugucaguuagugucuuuuuauuggggaacuga

SEQ ID NO: 97570 - RNA, 46 nt, Mus musculus
guagguauugggaagggggugaaccucaaugguucuaguagggcag

SEQ ID NO: 97571 - RNA, 46 nt, Mus musculus
agugagugugagugugugugugugugagugugugugugagugugug

SEQ ID NO: 97572 - RNA, 46 nt, Mus musculus
ugagugugugugugugacugugugugugugugugugugugagugag

SEQ ID NO: 97573 - RNA, 47 nt, Mus musculus
ugugagugugugugugagugagugugugugugugugugugagugagu

SEQ ID NO: 97574 - RNA, 49 nt, Mus musculus
ugugugugugugugugagugugugugugugagugacugugugugugugu

SEQ ID NO: 97575 - RNA, 42 nt, Mus musculus
gugugugugugugugagugacugugugugugugugugugugu

SEQ ID NO: 97576 - RNA, 44 nt, Mus musculus
gugugugagugacugugugugugugugugugugugugaguguau

SEQ ID NO: 97577 - RNA, 48 nt, Mus musculus
aagaaauacagucucacccaggcagauggaaacaggcugcccuuacau

SEQ ID NO: 97578 - RNA, 46 nt, Mus musculus
ugauagagucaaagccagucagcguuuguacgggaagauggccaua

SEQ ID NO: 97579 - RNA, 45 nt, Mus musculus
acuuacugucucugugccccuuuaccugucuccccucugccccga

SEQ ID NO: 97580 - RNA, 36 nt, Mus musculus
aguguagcagugcacaagcugagauuagaggacacc

SEQ ID NO: 97581 - RNA, 46 nt, Mus musculus
gaccuuguaaauaauauaguaaguaaauaacuuugcauuccuugag

SEQ ID NO: 97582 - RNA, 46 nt, Mus musculus
guaacugaucaucuauaacugaucguuuaagaauaagguugccagg

SEQ ID NO: 97583 - RNA, 46 nt, Mus musculus
cagugacucaaguggugucauugaucucacgauggacgaugaagag

SEQ ID NO: 97584 - RNA, 45 nt, Mus musculus
agagucuuugacauuagaauuaaaagcagcagucagcuccugagu

SEQ ID NO: 97585 - RNA, 45 nt, Mus musculus
ggcuauacagagaaacccugucucgaaaaaccaaaaaaaagagaa

SEQ ID NO: 97586 - RNA, 60 nt, Mus musculus
cuuccggaggucccgaguucaaaucccaucacccacaugaaggcucuuaaccauccuuaa

SEQ ID NO: 97587 - RNA, 47 nt, Mus musculus
cauauaauaauaaauaaauguuuaauuaaaaaaaagaaaucuugccu

SEQ ID NO: 97588 - RNA, 46 nt, Mus musculus
gagaacagaaaaacaugguuucugaagaggacaaugugaugugcag

SEQ ID NO: 97589 - RNA, 42 nt, Mus musculus
agguuagacaugacccacauuccaaguacugaguagcaccga

SEQ ID NO: 97590 - RNA, 46 nt, Mus musculus
cugcugacaggccugacagcucgacuucaguccuuagugccaccag

SEQ ID NO: 97591 - RNA, 42 nt, Mus musculus
cuugcccauggcuugcacucucacgcaguuugugucuggcag

SEQ ID NO: 97592 - RNA, 41 nt, Mus musculus
aggacauuuauggccgcuuugggccuuucugugacccacag

SEQ ID NO: 97593 - RNA, 45 nt, Mus musculus
uugaaaguuucacaucuugggcuuguuuuuaaucuugugcaugaa

SEQ ID NO: 97594 - RNA, 46 nt, Mus musculus
uuuguuuugaauuuuuaaauuucuaguuguguguguaucacagugc

SEQ ID NO: 97595 - RNA, 46 nt, Mus musculus
ggaaggaaggaaggaaggaagggaaagaaaaguauuuagcuuaaag

SEQ ID NO: 97596 - RNA, 47 nt, Mus musculus
aggaagccugcagcuggcagguguaauugcuccugucacucugagaa

SEQ ID NO: 97597 - RNA, 46 nt, Mus musculus
ccuguuuauuccagauuggaaagaagguauagacagaaacgaguug

SEQ ID NO: 97598 - RNA, 46 nt, Mus musculus
ugucuuguaugcaaauugagcugccugggugcacuuuuucauugga

SEQ ID NO: 97599 - RNA, 45 nt, Mus musculus
gauccgcgacgccgucaccuacaccgagcacgccaagcgcaagac

SEQ ID NO: 97600 - RNA, 68 nt, Mus musculus
gcggcaagggucuggggaaagguggcgccaagcgacaccgcaagguucuccgcgacaacauccagggc

SEQ ID NO: 97601 - RNA, 55 nt, Mus musculus
aguuucuccugucucuuuauuagguuguuuacuaauaugucaggacgaggaaaag

SEQ ID NO: 97602 - RNA, 29 nt, Mus musculus
ugccucgcccggacaugcucgaccccgcg

SEQ ID NO: 97603 - RNA, 47 nt, Mus musculus
ucagguacuccagcaccgccgccagguacacgggcgcucccgcgccc

SEQ ID NO: 97604 - RNA, 45 nt, Mus musculus
gggcagcagcacggccuggauauugggcaggacgccgcccugcgc

SEQ ID NO: 97605 - RNA, 46 nt, Mus musculus
accaauacugggaaugaaauaaauuucgaggggaaauacugcaaau

SEQ ID NO: 97606 - RNA, 45 nt, Mus musculus
aaaacaaguaacuaagaccucgcugacagaauucccaaaauggag

SEQ ID NO: 97607 - RNA, 132 nt, Mus musculus
uucuucucgaugguggcggcacuugcaucauccgccuucggucgcugaaugaggcuggguggggcacucaacaccccuggguugggcaagggagcuggugggaaaaggccaggcggggcagguccaagagga

SEQ ID NO: 97608 - RNA, 48 nt, Mus musculus
aauaaauaaacaaaucuuuuaaaaaaaggaaguuuagggggcugguga

SEQ ID NO: 97609 - RNA, 46 nt, Mus musculus
auccguaaugagaucugacucccucuucuggagggucugaggacag

SEQ ID NO: 97610 - RNA, 117 nt, Mus musculus
ggaggugcaggaggagguagccuugguggggguccccgaggaggggguccagggggcagaccuggaggugggccugggggagggccaggaggucggccugguggugguccuggaggu

SEQ ID NO: 97611 - RNA, 45 nt, Mus musculus
aggcggcccaggaggaaggccuguaggugguccaggaggccguaa

SEQ ID NO: 97612 - RNA, 50 nt, Mus musculus
gagaagcaggagcagacuguggaggagccugcugcugggaagaggcugca

SEQ ID NO: 97613 - RNA, 45 nt, Mus musculus
uucuuuuucauaaaggcguagaaugcguucaaagguuucccgcag

SEQ ID NO: 97614 - RNA, 44 nt, Mus musculus
cggauaauuuguuuggggucuuucaucuucaaaacugcagcccg

SEQ ID NO: 97615 - RNA, 46 nt, Mus musculus
uaagcauuaaacaaaucuacuuucuuucuacauuaggaaagggaag

SEQ ID NO: 97616 - RNA, 30 nt, Mus musculus
cugugaggccuccuggaguggacccggacc

SEQ ID NO: 97617 - RNA, 42 nt, Mus musculus
ccgcccgcuagcugcucucgccgucccgggagccucgcaguc

SEQ ID NO: 97618 - RNA, 45 nt, Mus musculus
ucccggaggacucucugcgaaggggccuucaccucugccccucgg

SEQ ID NO: 97619 - RNA, 29 nt, Mus musculus
uuccugaaaaacagcauccauuuacacac

SEQ ID NO: 97620 - RNA, 42 nt, Mus musculus
augaagauuucguuuuaaaugcuuaccuuuaaggggaaagga

SEQ ID NO: 97621 - RNA, 45 nt, Mus musculus
agggaggaaacaucgaaacugcacuuuaagauccgaacccaugaa

SEQ ID NO: 97622 - RNA, 44 nt, Mus musculus
guguugcuugcuccuuacaugaucuccuagcuggcuggcccacu

SEQ ID NO: 97623 - RNA, 47 nt, Mus musculus
ccaacaccuuuauguccccucagcagagguggcgagcuaaagcccaa

SEQ ID NO: 97624 - RNA, 52 nt, Mus musculus
uugaucaucacaaacucccuccucccucccuguuccuagcuaggcccuuucu

SEQ ID NO: 97625 - RNA, 63 nt, Mus musculus
gagugcgucuguccgucccuccugucaccuuccucacccaccagaagaguucucccgaccaug

SEQ ID NO: 97626 - RNA, 46 nt, Mus musculus
ggaggagaggcagagagacagugcucuugucucuuaacaaagaaau

SEQ ID NO: 97627 - RNA, 44 nt, Mus musculus
guuaagucuugugauugggucucuucgauuucgguuuagcuaga

SEQ ID NO: 97628 - RNA, 68 nt, Mus musculus
acaggcgaucucgaggcccucaaaaaggauacauuugugcuaaaggaaggcauugaauacagggugaa

SEQ ID NO: 97629 - RNA, 46 nt, Mus musculus
agcucaauuauaagccacccccucagaaguccuugaaggagcugca

SEQ ID NO: 97630 - RNA, 45 nt, Mus musculus
cucuuuucaagaaugagaauccacagcuuuugcagggccaugaga

SEQ ID NO: 97631 - RNA, 98 nt, Mus musculus
agaagagagaggggaagagaggaagaugccagcugggaacaaguggaggagagggagagagaggagagagagagagagagagagagagagggagagag

SEQ ID NO: 97632 - RNA, 45 nt, Mus musculus
aagguuuagguaaaagaaagaugauuuacaucuuguuggggggag

SEQ ID NO: 97633 - RNA, 46 nt, Mus musculus
cuagauucauuaauuuuucauagugccuuuuucacaaaagucagcu

SEQ ID NO: 97634 - RNA, 45 nt, Mus musculus
cugcuuauuguguaaaauguaauuaaacaugagaaagcacgaguc

SEQ ID NO: 97635 - RNA, 46 nt, Mus musculus
guaauuuacaaacuuuuaaaagaaaauguaauuuaaaaagccagac

SEQ ID NO: 97636 - RNA, 41 nt, Mus musculus
ucugugcacauuaguuugauuaaaacugagaagcggguagg

SEQ ID NO: 97637 - RNA, 45 nt, Mus musculus
cacggcagaacguuccagugaucaauaucacuuaugacuccucac

SEQ ID NO: 97638 - RNA, 46 nt, Mus musculus
uaaccaugaccgcucccucuccguguccaggaaggaagucccagau

SEQ ID NO: 97639 - RNA, 45 nt, Mus musculus
ugucuguuagcagaggaugacaggagaugcgggggugugauggag

SEQ ID NO: 97640 - RNA, 45 nt, Mus musculus
uagggaguggaggagagacagauaauuuccucugagagguagaga

SEQ ID NO: 97641 - RNA, 85 nt, Mus musculus
agcugagggagcugcacauggagucagguagguauauuggugagaugagggggauuccaagcaaaagaggccguaauggccaaua

SEQ ID NO: 97642 - RNA, 46 nt, Mus musculus
aaaauagaccaaauuaacacauacgcuugcuucuuuaaccucagau

SEQ ID NO: 97643 - RNA, 46 nt, Mus musculus
uuaacacacaggucagacuucauuccuaaauguuuuggugccuuuu

SEQ ID NO: 97644 - RNA, 46 nt, Mus musculus
gccucuaugcuguuaggaucuacuuuccuaugaauaacccugaguu

SEQ ID NO: 97645 - RNA, 46 nt, Mus musculus
agcuccagugacagugggggcagcauugugcgggacagccagagau

SEQ ID NO: 97646 - RNA, 51 nt, Mus musculus
uauaagagaacuaucuuguggguuuguaaugacacaccaaugcuuuccgag

SEQ ID NO: 97647 - RNA, 46 nt, Mus musculus
ccguuuucagcacagaauuucagagaggccaaauuucaagggagaa

SEQ ID NO: 97648 - RNA, 46 nt, Mus musculus
aguagggauuaaauaaugaccaguguccaagaaaccauugccaggu

SEQ ID NO: 97649 - RNA, 46 nt, Mus musculus
caacuucucucaagggauuccuguccuuaaggaacuuguaguaguu

SEQ ID NO: 97650 - RNA, 30 nt, Mus musculus
cucgguuaugaaagaugaugucuuagaggu

SEQ ID NO: 97651 - RNA, 46 nt, Mus musculus
guucuaaaaacaaaacaaaacaacuuaugugugcgugcccauuccc

SEQ ID NO: 97652 - RNA, 42 nt, Mus musculus
augauugaauuccaaauuugccuuugaguauggccccgaguu

SEQ ID NO: 97653 - RNA, 46 nt, Mus musculus
gcuuugaauggcugagugacugugucugacacugcaguccccagag

SEQ ID NO: 97654 - RNA, 55 nt, Mus musculus
ggagaagcugucccuccaaauguacagugggcgaugauagaugaaaacaccagau

SEQ ID NO: 97655 - RNA, 46 nt, Mus musculus
aagugguacacacuauuuuucauauuguaaauccaauuuguauuua

SEQ ID NO: 97656 - RNA, 46 nt, Mus musculus
aagacacaguugauuucuuaaacuacacagccacugcggaggaacg

SEQ ID NO: 97657 - RNA, 44 nt, Mus musculus
uucccaaaagauguagcgccugaguuggauucugggugcuggag

SEQ ID NO: 97658 - RNA, 41 nt, Mus musculus
ccgaagucuaaagcagcgagccaaaaaagaauggagccuau

SEQ ID NO: 97659 - RNA, 30 nt, Mus musculus
uggugaugccugugccugcaguccagacac

SEQ ID NO: 97660 - RNA, 46 nt, Mus musculus
uuccuuaauuaccuuacaugggcccuguuuuucuuagcaugcuugu

SEQ ID NO: 97661 - RNA, 46 nt, Mus musculus
uccaaaaagccgccgaagcguuuucugagcuuucuaaaaggaagaa

SEQ ID NO: 97662 - RNA, 46 nt, Mus musculus
ucgagaagccccggcaguaccacgagcaagaagagacgcccgagau

SEQ ID NO: 97663 - RNA, 46 nt, Mus musculus
agucacugcuggcaagauuguuuucaacaucucuccuccagcagcc

SEQ ID NO: 97664 - RNA, 41 nt, Mus musculus
ugacuuccuuuuauguaaucaguguucauauaugggcgguc

SEQ ID NO: 97665 - RNA, 42 nt, Mus musculus
agauaugauucuccaaguggaugaccgagcugugagccugau

SEQ ID NO: 97666 - RNA, 46 nt, Mus musculus
gcaaugaucacugucgaggacggaauaagaaagcugaaguugcugg

SEQ ID NO: 97667 - RNA, 42 nt, Mus musculus
ugucagcagugugucggacgugucccaguaccgcguggaagu

SEQ ID NO: 97668 - RNA, 46 nt, Mus musculus
aaucccacucacaauguccucacaaauaaaaguaaauagccaagau

SEQ ID NO: 97669 - RNA, 45 nt, Mus musculus
aaaagacccuaaugccucuaacaguaaacucuuacagcaguagaa

SEQ ID NO: 97670 - RNA, 24 nt, Mus musculus
agagagaggggggcggggaagaga

SEQ ID NO: 97671 - RNA, 46 nt, Mus musculus
cacacacacacacacacacacacacacacacauuuauauggagaga

SEQ ID NO: 97672 - RNA, 54 nt, Mus musculus
cacccuauucccagauggacagagaacacagcucaagaacaagugcaaaggccc

SEQ ID NO: 97673 - RNA, 45 nt, Mus musculus
uugcuccuauuggcuagcuacuucagcuagcauaaacucaguaug

SEQ ID NO: 97674 - RNA, 92 nt, Mus musculus
uacauuacuuuuauaaugagguaacaggcuaacaucuugcagaguugacauguaauauaagcagaaaauagaauuacacacuucauguagau

SEQ ID NO: 97675 - RNA, 45 nt, Mus musculus
auuauucauucuuauucuucuuacuauugugugcauuccauggag

SEQ ID NO: 97676 - RNA, 46 nt, Mus musculus
gcuuguggcuguauggcugaggccguaucauuuguucaccacaggc

SEQ ID NO: 97677 - RNA, 46 nt, Mus musculus
cagucucuggugcucaaggcugucccccagccuccuacguuaagau

SEQ ID NO: 97678 - RNA, 45 nt, Mus musculus
uguguaccagaggguguuugaguuugugcaggcggagggcacagg

SEQ ID NO: 97679 - RNA, 46 nt, Mus musculus
uuuugaagaaacuuuugucucucucacuugcaacagcagccccacc

SEQ ID NO: 97680 - RNA, 46 nt, Mus musculus
cuuuucaguaaaaccagcugcugugguuuugaaaugcaaaccagau

SEQ ID NO: 97681 - RNA, 46 nt, Mus musculus
ccaagaaucuuacagacugcucuuuuaaaacagaacacaagccacg

SEQ ID NO: 97682 - RNA, 47 nt, Mus musculus
uggaaugccacaugaccacagugacaagugagacuacagcggcccag

SEQ ID NO: 97683 - RNA, 46 nt, Mus musculus
accacaagugacaaaccacaagccaauacuguugaugugaugagau

SEQ ID NO: 97684 - RNA, 45 nt, Mus musculus
cucauccauuuuuuuuuaauguauugagcauuauuuuguguauuu

SEQ ID NO: 97685 - RNA, 42 nt, Mus musculus
ggagagcagugccuguugacauaauaacacaaggcagcucag

SEQ ID NO: 97686 - RNA, 45 nt, Mus musculus
uguucccuccuccugcuggccuaacauagccugcuuaccccaaca

SEQ ID NO: 97687 - RNA, 45 nt, Mus musculus
gcuuggaauuaauuuagaaggauuuuuguuuagaaaaguugacaa

SEQ ID NO: 97688 - RNA, 45 nt, Mus musculus
ugaggaaagcuggagagggagaggauauaauugcaggggugugcu

SEQ ID NO: 97689 - RNA, 41 nt, Mus musculus
ggcgagugagucagcggacugcacuuuuccucugagucagu

SEQ ID NO: 97690 - RNA, 46 nt, Mus musculus
cggggaguuucagacgaauguaugaaagagacagguagaucuaggu

SEQ ID NO: 97691 - RNA, 46 nt, Mus musculus
ccgucauuaggcauuccuucauccuuuucuucucuugguuccaguc

SEQ ID NO: 97692 - RNA, 41 nt, Mus musculus
aggaaaaagaaaggggguuaguuuagaagaaaaggcaaagc

SEQ ID NO: 97693 - RNA, 46 nt, Mus musculus
uugcuaaugggggcuuugcucaaaggcguuaauuaugacagaagau

SEQ ID NO: 97694 - RNA, 45 nt, Mus musculus
gaggaggaagucuuagcugaggccugggagaguccaaaggagaga

SEQ ID NO: 97695 - RNA, 46 nt, Mus musculus
guaauuucuuucuuucuuuuuuuaauuuuuauuuuaaacuccagau

SEQ ID NO: 97696 - RNA, 33 nt, Mus musculus
cucagcuucuaagaaugaggcgaccaagcagag

SEQ ID NO: 97697 - RNA, 46 nt, Mus musculus
ggauccagucuguggcaaagaaggaaggaaguacuacagagcaggg

SEQ ID NO: 97698 - RNA, 46 nt, Mus musculus
augugccuuagauuugcuuauggcaucagccaucucagcccacaaa

SEQ ID NO: 97699 - RNA, 46 nt, Mus musculus
auagugccacuuccugggccaagcauauucaaaucacgacagagau

SEQ ID NO: 97700 - RNA, 46 nt, Mus musculus
ugaacauguuuucuacaugccccgcccaaccccaucaggcgcacag

SEQ ID NO: 97701 - RNA, 45 nt, Mus musculus
ugugggcaguguccuccuggcauccuugaccucuguggcucagau

SEQ ID NO: 97702 - RNA, 46 nt, Mus musculus
ucuuuaugugugugugugugugugugugugugugugcgugugucca

SEQ ID NO: 97703 - RNA, 41 nt, Mus musculus
uauguuguguguauuuguguauuuucaacauuugcugagau

SEQ ID NO: 97704 - RNA, 64 nt, Mus musculus
gugagcuaggccuguaaaagacaagaggauaggaaggaagauguggauaggaaaaaagugggag

SEQ ID NO: 97705 - RNA, 26 nt, Mus musculus
uugaugaggagcaggggccagcccuc

SEQ ID NO: 97706 - RNA, 46 nt, Mus musculus
gugugcuaaucucauuuguuaagaugagcaaguccaggcccggcca

SEQ ID NO: 97707 - RNA, 46 nt, Mus musculus
gucgguauccaugguagcaggaguucaugcacacaacaguccuguc

SEQ ID NO: 97708 - RNA, 45 nt, Mus musculus
aaggaaggcgaagcgaacagaaggucuccauuagaaaugaugguc

SEQ ID NO: 97709 - RNA, 42 nt, Mus musculus
augugauacagcacgcacugcauugaaguggcagcacaagaa

SEQ ID NO: 97710 - RNA, 46 nt, Mus musculus
ucaucauucuagagacugaaaguucaaggugggauagcccccugau

SEQ ID NO: 97711 - RNA, 46 nt, Mus musculus
agaggugaaacucgggugaagaucuucugagauucuagccccagau

SEQ ID NO: 97712 - RNA, 42 nt, Mus musculus
agcauccacucauguguucuauuuaguuaauuuagugugggu

SEQ ID NO: 97713 - RNA, 41 nt, Mus musculus
aaacuuuauaugccccaauacaagggaaugccagggccaag

SEQ ID NO: 97714 - RNA, 46 nt, Mus musculus
cauuauaggaaaguaaaagguacuuauaaccugauccaugaucaaa

SEQ ID NO: 97715 - RNA, 46 nt, Mus musculus
ucauacaaacacacacacacacacacagacacacacacacacacac

SEQ ID NO: 97716 - RNA, 41 nt, Mus musculus
uggaggagguggacagaccuguauuagacugaaccaguaga

SEQ ID NO: 97717 - RNA, 56 nt, Mus musculus
ucucuaaaacgcugugagguuuucuuguagccggcacauacaccuuaguauccucu

SEQ ID NO: 97718 - RNA, 46 nt, Mus musculus
aucuauccgugcaucgggcacaucgcuuuuauauucagccacagcc

SEQ ID NO: 97719 - RNA, 46 nt, Mus musculus
uuacccacugagccuucuccucaacacuuuucucuguuucccagac

SEQ ID NO: 97720 - RNA, 67 nt, Mus musculus
cucugccuuacaggaaccuuuucugucucuucgaccuccuugcagacuuuccgaacgucucccagac

SEQ ID NO: 97721 - RNA, 46 nt, Mus musculus
uguaucuuauucuccucuucuuugguagacuuuuuggcagacacau

SEQ ID NO: 97722 - RNA, 46 nt, Mus musculus
cugccgauagcauuuacagaguggaaucgcuauuuugugcugaugg

SEQ ID NO: 97723 - RNA, 46 nt, Mus musculus
uucugcccacaauucuggcugagccuaaagagagacaccaugaaca

SEQ ID NO: 97724 - RNA, 45 nt, Mus musculus
aacaauaacauaagauaaaaugaaaacacacaaagccaaguagaa

SEQ ID NO: 97725 - RNA, 34 nt, Mus musculus
agagggagagagggggaaagggagggagagaagg

SEQ ID NO: 97726 - RNA, 34 nt, Mus musculus
aggagggagggagagagaggagaaagagagaaga

SEQ ID NO: 97727 - RNA, 25 nt, Mus musculus
aagaaagaagaaagagguggcugcc

SEQ ID NO: 97728 - RNA, 45 nt, Mus musculus
gggcauuccaggcaaagagguagauacauuugaguuggucagagu

SEQ ID NO: 97729 - RNA, 45 nt, Mus musculus
uaaagaggaaacugagcaauuaggaaaaacaaaacacagaauggg

SEQ ID NO: 97730 - RNA, 46 nt, Mus musculus
gagggccugaauuucuuuugucuuuuguauucugugcccuggagac

SEQ ID NO: 97731 - RNA, 43 nt, Mus musculus
uuuuuaagucauggucucaauaugucauuuaugcuggccagaa

SEQ ID NO: 97732 - RNA, 46 nt, Mus musculus
uaaaauuccgcaagucauucacuuccuucauagcaggaaaagagag

SEQ ID NO: 97733 - RNA, 41 nt, Mus musculus
gcgucuagggaggucguggcacucccugaggagcgcggcug

SEQ ID NO: 97734 - RNA, 46 nt, Mus musculus
acaggcauggggagagcacuuggcuaccagaucguacuuaggagau

SEQ ID NO: 97735 - RNA, 46 nt, Mus musculus
augguuuaaguggagaguucugguccuuucaaaacacugccugucg

SEQ ID NO: 97736 - RNA, 41 nt, Mus musculus
gguugucuuagacacuaguuaaugaugccagguuugcucug

SEQ ID NO: 97737 - RNA, 46 nt, Mus musculus
ucuuggauaauguguguguguguguguguguguguguguguggugg

SEQ ID NO: 97738 - RNA, 44 nt, Mus musculus
ucauuuugucugaauaaaaaaggccuuucucuuacaauaagaag

SEQ ID NO: 97739 - RNA, 46 nt, Mus musculus
ugugagacuauaacuaucuagucuuuaaccacaucagagaccugag

SEQ ID NO: 97740 - RNA, 46 nt, Mus musculus
uauucucuauaacauuggagcaucugucuucuaguguucugcccca

SEQ ID NO: 97741 - RNA, 46 nt, Mus musculus
gguuuuugauugaucaguaaagagccaacugccaaugacuggccug

SEQ ID NO: 97742 - RNA, 46 nt, Mus musculus
gaucagauuuagagcggcagaaugaaaaucauccaaaaugucggug

SEQ ID NO: 97743 - RNA, 46 nt, Mus musculus
ggagggugcaaauuggauuugaaaacaaacaauaccaaaauagcag

SEQ ID NO: 97744 - RNA, 24 nt, Mus musculus
uuguaggaauccacaaauuuggaa

SEQ ID NO: 97745 - RNA, 45 nt, Mus musculus
cucaucaggugucuuaguguaaaaggucuuaguguaaaaggguug

SEQ ID NO: 97746 - RNA, 42 nt, Mus musculus
uucaacgacucuguuauaaagccaaauauccaauccgggcag

SEQ ID NO: 97747 - RNA, 27 nt, Mus musculus
aaugauagugacauggaagcuagcaua

SEQ ID NO: 97748 - RNA, 46 nt, Mus musculus
ggacggugaggaugugugcuaguauuaagcuuauuaaaugccccuu

SEQ ID NO: 97749 - RNA, 46 nt, Mus musculus
uugauuccuguuaacugagacugcagauauugaaacuaggcaccag

SEQ ID NO: 97750 - RNA, 46 nt, Mus musculus
ccuuccucuguagcuccucuguucccagguuguuuauaacggagag

SEQ ID NO: 97751 - RNA, 46 nt, Mus musculus
guguguguguuuuguuaaauuuugcauuauucugacuaauuugcag

SEQ ID NO: 97752 - RNA, 42 nt, Mus musculus
uuuuuaacaaugaacauauuuuacuuggaagugugugagcag

SEQ ID NO: 97753 - RNA, 45 nt, Mus musculus
gacagggcauugacugaguaaaauuuuacaucuguauaauggaag

SEQ ID NO: 97754 - RNA, 41 nt, Mus musculus
uguuuucuauucuucagggaauccagauuggagcagaaaga

SEQ ID NO: 97755 - RNA, 46 nt, Mus musculus
uaucuuuuccucgugguauaguaacuggaugcuauauguauggcag

SEQ ID NO: 97756 - RNA, 46 nt, Mus musculus
gccuacuuuuguguggcucuuuaguauucagucagaguagucccag

SEQ ID NO: 97757 - RNA, 107 nt, Mus musculus
caacccaaggucugaagaugagaauugagggugcuucuggagggggugaugugcggggaccuuugauugaaugagugggaaucuggugagagaagugggaguuaagg

SEQ ID NO: 97758 - RNA, 45 nt, Mus musculus
aagaggggcuguguuggcuuucaucgagucccuaaaggauggcaa

SEQ ID NO: 97759 - RNA, 45 nt, Mus musculus
cagugugcuuucuucuuaaaugauuaccaacucaaccaccccauu

SEQ ID NO: 97760 - RNA, 46 nt, Mus musculus
gguuacaauuuugacuucuuuuguuuggacauaauucaaccuguag

SEQ ID NO: 97761 - RNA, 46 nt, Mus musculus
aaacauuaaauauuuuuaucugcagaaagcauuugguaggacucuc

SEQ ID NO: 97762 - RNA, 49 nt, Mus musculus
aggcauuaggagauaaauuugcuuaugagcaagcgacagagacuuacag

SEQ ID NO: 97763 - RNA, 45 nt, Mus musculus
guccugccccguucugggcuauguggacugagaagaaggcuuaug

SEQ ID NO: 97764 - RNA, 45 nt, Mus musculus
gugaaugagguucaccacauacauucaagggaagaucugcugccg

SEQ ID NO: 97765 - RNA, 42 nt, Mus musculus
cagaggccaggagggaacguguacuuacggacacagggggag

SEQ ID NO: 97766 - RNA, 42 nt, Mus musculus
ucuggggaaggaggacgaugggguggcuggcaucagagagag

SEQ ID NO: 97767 - RNA, 42 nt, Mus musculus
aacaauaaaccucacauaauucccccagagaccucacguaag

SEQ ID NO: 97768 - RNA, 47 nt, Mus musculus
agugaagugcagugcaguggaggauggaagugugugucccuggagug

SEQ ID NO: 97769 - RNA, 24 nt, Mus musculus
ucccuggagugaagugcaguggag

SEQ ID NO: 97770 - RNA, 46 nt, Mus musculus
caaauucuuagccugcagagagaggaaacuucggaaccugccuaag

SEQ ID NO: 97771 - RNA, 46 nt, Mus musculus
ucuauuuaguaaugaguugcugaauagucauuaaauccacuggagg

SEQ ID NO: 97772 - RNA, 45 nt, Mus musculus
cuccuuaucuccccacuguucuuucuucuucccuucucccugcag

SEQ ID NO: 97773 - RNA, 42 nt, Mus musculus
aauguguauguguguuuguguggugugugugugugugugugu

SEQ ID NO: 97774 - RNA, 46 nt, Mus musculus
guucuaauuaaccugggauuuuuccuugcuuuugucuuaggaucag

SEQ ID NO: 97775 - RNA, 45 nt, Mus musculus
cacucuguguccuuuuauuaacugaagacaguuucagcacugacg

SEQ ID NO: 97776 - RNA, 42 nt, Mus musculus
agguuaauauagagauuuaacuuccucccggaauggaaagaa

SEQ ID NO: 97777 - RNA, 46 nt, Mus musculus
cuucacuaaaaaacuuccuucaagagggaaaaauaucagggcauag

SEQ ID NO: 97778 - RNA, 32 nt, Mus musculus
guaccaccugagugacuuuuacacauuaccaa

SEQ ID NO: 97779 - RNA, 66 nt, Mus musculus
guaauuuuggaacagcuaacugacuuuccccauuaaaaucuccccugaaaucaacucaaaacaaua

SEQ ID NO: 97780 - RNA, 46 nt, Mus musculus
guggauucagaucaggaaagguugaaauggucuucguuaccaggag

SEQ ID NO: 97781 - RNA, 48 nt, Mus musculus
aaauucugaacguacagugaaguuaaguugccugagaccugagauccu

SEQ ID NO: 97782 - RNA, 46 nt, Mus musculus
acucucugugcuauacuaaacauuuaguaauuguuuugcuaaugag

SEQ ID NO: 97783 - RNA, 46 nt, Mus musculus
auaugcaguaaaaauaaucauauuuaauugcucaaaaccugcucag

SEQ ID NO: 97784 - RNA, 48 nt, Mus musculus
gaagaggggacuauaauucagcuuuuagggucucuggugccaggaagg

SEQ ID NO: 97785 - RNA, 42 nt, Mus musculus
ugucacgacccacacucauggcucuugguaucuuuuggggag

SEQ ID NO: 97786 - RNA, 46 nt, Mus musculus
cagaaaagcaggcaccaccaucugagacuuucacuguaucugagaa

SEQ ID NO: 97787 - RNA, 42 nt, Mus musculus
ucuauaagccuaagacuuccggguuccucccucuggcaagau

SEQ ID NO: 97788 - RNA, 34 nt, Mus musculus
aagggugggugcugcauaaagcccauuaggcacg

SEQ ID NO: 97789 - RNA, 46 nt, Mus musculus
caaaaucauccaccaagccaggcuuggccacauuggcccuguagaa

SEQ ID NO: 97790 - RNA, 47 nt, Mus musculus
agccuggcuugguggaugauuuugaaaagcaguauaaugcccugaag

SEQ ID NO: 97791 - RNA, 46 nt, Mus musculus
aagagcugugcugaguuugcgucuggaccucagcucaggacccagg

SEQ ID NO: 97792 - RNA, 42 nt, Mus musculus
aaagagagagagaguggguggggaaaaggagagaggggagga

SEQ ID NO: 97793 - RNA, 45 nt, Mus musculus
uuugucuguuaagccauccuguuggccucaugugguguggguuug

SEQ ID NO: 97794 - RNA, 41 nt, Mus musculus
auggcgacgcgggcucggcucuggcguccgcacagcgauga

SEQ ID NO: 97795 - RNA, 46 nt, Mus musculus
ucaugggguucuccuuuuccucuugaucuugcaccaugguggagaa

SEQ ID NO: 97796 - RNA, 85 nt, Mus musculus
ugagaagauugcuguucacugcacaguccgcgaagccaaggcagaggaaauucuggagaaaggccugaaggugcgggaguaugag

SEQ ID NO: 97797 - RNA, 44 nt, Mus musculus
aucgacggccuggacuucuauguggugcuggguaggccaggguu

SEQ ID NO: 97798 - RNA, 46 nt, Mus musculus
cugaacccuggccuacccagcaccacauagaaguccaggccgucga

SEQ ID NO: 97799 - RNA, 46 nt, Mus musculus
gggaucauccuuccuggaaaauaaacuuuauccaaaaagccaauaa

SEQ ID NO: 97800 - RNA, 51 nt, Mus musculus
gaggguggagcggaggacuuuuaagagagaaaggaaaggagagagggagag

SEQ ID NO: 97801 - RNA, 42 nt, Mus musculus
gagcuggagaagagucaggaggcggcggccgaggaggaggag

SEQ ID NO: 97802 - RNA, 41 nt, Mus musculus
aaggcgaaauaaaggaaaggggggagggaaaagugggggau

SEQ ID NO: 97803 - RNA, 46 nt, Mus musculus
gcagcccuguuucuggcuuccuuggaaaaaucacaaaaaggugcag

SEQ ID NO: 97804 - RNA, 45 nt, Mus musculus
auauaauuuauuauuauuaucuuauuauauguuuuauuauccuaa

SEQ ID NO: 97805 - RNA, 43 nt, Mus musculus
uucccaugcacacacaugcacaggcacaugcacacgcacacag

SEQ ID NO: 97806 - RNA, 46 nt, Mus musculus
ucauggucacauuggagguuuguguucuacagccuagagacuggca

SEQ ID NO: 97807 - RNA, 46 nt, Mus musculus
cauacaucauaauuugugauuuuuuuuccugaugauacagcugcag

SEQ ID NO: 97808 - RNA, 42 nt, Mus musculus
ugucuuccaacacauccaccagggcaaguucaucagccagag

SEQ ID NO: 97809 - RNA, 45 nt, Mus musculus
uuaauguaggaaaccacaucccaggaugucagggucucuguguca

SEQ ID NO: 97810 - RNA, 47 nt, Mus musculus
uuccuaugaggaugaggugauaacaggccaagaaucgcagcaccugg

SEQ ID NO: 97811 - RNA, 42 nt, Mus musculus
agccacuaaaacuaagaggaacauaaagaagccaugguguga

SEQ ID NO: 97812 - RNA, 45 nt, Mus musculus
uguguauauacauaugcauguacauauauagagagagggagcaag

SEQ ID NO: 97813 - RNA, 43 nt, Mus musculus
uguccaacgcccacuacagugaucuuguuguucgggacggcag

SEQ ID NO: 97814 - RNA, 44 nt, Mus musculus
uaccagaaaagaggaggcucugcggcgcgcugaggcaggggagc

SEQ ID NO: 97815 - RNA, 41 nt, Mus musculus
agcaucagugugcaagugagaguaaaggaaaacggcaggag

SEQ ID NO: 97816 - RNA, 46 nt, Mus musculus
caagauaccaggagauguguugccauggggucuuucggguuaggau

SEQ ID NO: 97817 - RNA, 45 nt, Mus musculus
caaaagaagaauugcauuuuacgguugcuuguuuaucuagacggu

SEQ ID NO: 97818 - RNA, 44 nt, Mus musculus
ccucuuagaaguuuuggaaacuugauucuguuguaugcucagga

SEQ ID NO: 97819 - RNA, 46 nt, Mus musculus
ccgccagaaccagguaagauuacuucucaucaaaaagcccagagau

SEQ ID NO: 97820 - RNA, 46 nt, Mus musculus
cuguguuauucguaucugcgcaacccugacuacaaucucguuuuga

SEQ ID NO: 97821 - RNA, 46 nt, Mus musculus
ggaacuuuuguuucccauagauuugaaaaccugcugugguccagaa

SEQ ID NO: 97822 - RNA, 50 nt, Mus musculus
uggagcccaagaggaacagaaucugguccaacugggaauggguguggagu

SEQ ID NO: 97823 - RNA, 46 nt, Mus musculus
aggagggaggaccccuuccuggccuggugaaggcucaaggcugugg

SEQ ID NO: 97824 - RNA, 46 nt, Mus musculus
uacccuaaagaugaaaagucauuuuaaugcuacacaggugucaaua

SEQ ID NO: 97825 - RNA, 88 nt, Mus musculus
gaauguauuuaaguagugaaaauacaguugaccuaggaagaacaggauuguuuucuaaugauauauugcacucaauaaucuuagggau

SEQ ID NO: 97826 - RNA, 46 nt, Mus musculus
gccguugcuucauauuuaauugucuagaagaggcuuggcuccaaca

SEQ ID NO: 97827 - RNA, 45 nt, Mus musculus
agugaggacuuuguuagcuggaugggugauguguuuguuagcugg

SEQ ID NO: 97828 - RNA, 51 nt, Mus musculus
guaauuuguguugauuuuuaauaaaaguauaauuaaaaaugaaauggaaag

SEQ ID NO: 97829 - RNA, 45 nt, Mus musculus
aggagcagggaugcggcuggauagcuugugugcacaucugggaga

SEQ ID NO: 97830 - RNA, 42 nt, Mus musculus
accaggcauggaugugguacacagacagaaauacagacagaa

SEQ ID NO: 97831 - RNA, 42 nt, Mus musculus
uugaucucaccgcaacagaggccugcgcuguuaacuuaaggc

SEQ ID NO: 97832 - RNA, 45 nt, Mus musculus
cauuaacauguuuuucauucgggaaaccacuucucuccgcgaggu

SEQ ID NO: 97833 - RNA, 45 nt, Mus musculus
caacgucaguugauuacaguuccuuugcagacagaugcagcagcu

SEQ ID NO: 97834 - RNA, 46 nt, Mus musculus
uuaaguaaauuaaaaucaaauagaaguaacuaaauucucauaguga

SEQ ID NO: 97835 - RNA, 46 nt, Mus musculus
cugauguguguggcugguuuucugcugugugauguucccagguacu

SEQ ID NO: 97836 - RNA, 46 nt, Mus musculus
ugagugcuacccaaggcugcuaggaagggugugauucugggcguga

SEQ ID NO: 97837 - RNA, 44 nt, Mus musculus
ucccaucucuuucuagacuugcuacaucccucagucugcugaau

SEQ ID NO: 97838 - RNA, 44 nt, Mus musculus
cugaaaccuuacuggcuuugccuaguuagauuccuagucucguu

SEQ ID NO: 97839 - RNA, 46 nt, Mus musculus
guugugauaauaguaacuuaaaacgaguauuuaaauaggaaaauaa

SEQ ID NO: 97840 - RNA, 52 nt, Mus musculus
gcaggggagggaaugagaaugagaggcuagagagagguggccgagguguaau

SEQ ID NO: 97841 - RNA, 76 nt, Mus musculus
uguuguuuuuaauacacuuuuuaaaaugaugcauauaaaaaagggagagauuaaauauaguaaaaauauacagucu

SEQ ID NO: 97842 - RNA, 46 nt, Mus musculus
aaggcugugaaagucuaaggguggcagugaagaagauucgggagag

SEQ ID NO: 97843 - RNA, 46 nt, Mus musculus
aacagaauguauguguguguucacuaaauaagccaucgcacggucu

SEQ ID NO: 97844 - RNA, 46 nt, Mus musculus
gguugcuagguaacugcugugcaucugccucuuagccuccacagau

SEQ ID NO: 97845 - RNA, 46 nt, Mus musculus
uaugucugaauuuacauagaauucugguugagaaucuuaaucagga

SEQ ID NO: 97846 - RNA, 44 nt, Mus musculus
cucugccugaagaugaguuaauccagguaaugaaggugcauuug

SEQ ID NO: 97847 - RNA, 46 nt, Mus musculus
uacuccagcugccacccagggcacuggauccauucaggcugcaguu

SEQ ID NO: 97848 - RNA, 47 nt, Mus musculus
acguccauugagggcacaagaugggggcaggggacagauucagugag

SEQ ID NO: 97849 - RNA, 42 nt, Mus musculus
gugcucuuaacugcugagccaucuccagcccuggagccaaag

SEQ ID NO: 97850 - RNA, 46 nt, Mus musculus
gcucucuuuuuuuguuuucaccugcauuugguauuuugccugaaug

SEQ ID NO: 97851 - RNA, 46 nt, Mus musculus
aaaagucccugauguucucuucacaacuaucgaucugcccacagac

SEQ ID NO: 97852 - RNA, 45 nt, Mus musculus
ugacaguccacuauuuuaccagugcgcauguuuugccuggcaguu

SEQ ID NO: 97853 - RNA, 57 nt, Mus musculus
ggaaguuuccuaauagggcccaugaucaccgcaggcaaagaccaaguuuacagcacu

SEQ ID NO: 97854 - RNA, 85 nt, Mus musculus
cugcagggaggaacuucucugaccaaaggcuaagagcagcauuaguccauggguaacuauaaaugugaucguuuagaagccaacu

SEQ ID NO: 97855 - RNA, 61 nt, Mus musculus
ccagcaccagcacuucucccauccuccugugcucucagcauucuuaacaacccuuacugug

SEQ ID NO: 97856 - RNA, 46 nt, Mus musculus
gggugguuguuggugcucacuguugguuuauuuguaauacgcaugu

SEQ ID NO: 97857 - RNA, 42 nt, Mus musculus
gugucugaagacagcuacaguguacuuacauacaaauaaaua

SEQ ID NO: 97858 - RNA, 46 nt, Mus musculus
uuuaauuaauuuuuaaacacuccauguuuuagucccgcccccaucc

SEQ ID NO: 97859 - RNA, 46 nt, Mus musculus
gguuucugcaggaaggcacuguggagggcuguuuggaacaaagguu

SEQ ID NO: 97860 - RNA, 41 nt, Mus musculus
agauauucuaggaugcuucaggaucccagaggaccagaagu

SEQ ID NO: 97861 - RNA, 77 nt, Mus musculus
guagucaacugacuuaaacuuuauuuuucagaugaaccagaaacucgagaugcauggugggcagaaaucagacaaga

SEQ ID NO: 97862 - RNA, 46 nt, Mus musculus
gugcugaaugcagagcccagcguguuaacuacggaaaggagaaaga

SEQ ID NO: 97863 - RNA, 42 nt, Mus musculus
ggccugucagcugccugucaacuuucaagcaagggggcaggu

SEQ ID NO: 97864 - RNA, 45 nt, Mus musculus
uaucuugccaucacugaaaguaauaucagaugggaagugugcaga

SEQ ID NO: 97865 - RNA, 42 nt, Mus musculus
aaaacugaucaacuaauuugcuguuuugaacucagccuuugu

SEQ ID NO: 97866 - RNA, 66 nt, Mus musculus
aucauuaauuaauguuugaguuagcuguuauauuuguuuagggagaugagggauuuugcuguguau

SEQ ID NO: 97867 - RNA, 30 nt, Mus musculus
cacgucgguggcguugucagugcacgcucu

SEQ ID NO: 97868 - RNA, 45 nt, Mus musculus
auuguguaccuuacugggaaaugguguugaauaggaauucgagaa

SEQ ID NO: 97869 - RNA, 46 nt, Mus musculus
ucuuaccccgacacacugccuaucuuuucacuccauggccugugcu

SEQ ID NO: 97870 - RNA, 46 nt, Mus musculus
augcugccucucuccacacagucauuggcucacacuucaccuagau

SEQ ID NO: 97871 - RNA, 46 nt, Mus musculus
uucacauaauauuaucugaggcuuugaggcuagggaugucagauag

SEQ ID NO: 97872 - RNA, 46 nt, Mus musculus
caucccucuuugcagcuugcauaauguuuucuggcacuguggagau

SEQ ID NO: 97873 - RNA, 46 nt, Mus musculus
gccuuuaggauaucuugcgugcuguucauuguuauaggucauaggu

SEQ ID NO: 97874 - RNA, 45 nt, Mus musculus
gcuggcuaauaauguggccucacugggugggaaguguugauucag

SEQ ID NO: 97875 - RNA, 42 nt, Mus musculus
agcaccagucuucauggaugaaaagcagacagagccaaaggu

SEQ ID NO: 97876 - RNA, 41 nt, Mus musculus
cacucacacacacacacacgccccuuugggacaaggguaga

SEQ ID NO: 97877 - RNA, 48 nt, Mus musculus
augcugcaaguagauauguauacacacacacacacuuaugcugcaagu

SEQ ID NO: 97878 - RNA, 46 nt, Mus musculus
cuccaagcuuuuuuaugucugcuuuggaagcuugaagcacuuagag

SEQ ID NO: 97879 - RNA, 90 nt, Mus musculus
uaaacgugcgagagccuggucugugcuagaagcuuuucuaucuuguucucuugaguuuuauuugagcuuuuaacaauuguugcuggcauu

SEQ ID NO: 97880 - RNA, 78 nt, Mus musculus
auuucucucucucucuuuauaaccauccuugcaaagggaggaucgccucauagguucuguagaaggcggguauguuuc

SEQ ID NO: 97881 - RNA, 45 nt, Mus musculus
cagugggagugcuggaaaagaaggggggcccuuuaaagcccuuuu

SEQ ID NO: 97882 - RNA, 46 nt, Mus musculus
gcuuuucaauaaugcucacugauuauguucuugucguaccacagau

SEQ ID NO: 97883 - RNA, 23 nt, Mus musculus
cccaguauagcugggacucuggg

SEQ ID NO: 97884 - RNA, 46 nt, Mus musculus
gggguuagcaugugcauuguguuagguauuauaagcaguacaaaga

SEQ ID NO: 97885 - RNA, 63 nt, Mus musculus
gaacccuugggaaagcacuguaucuguccccgugcaggcagaguuuccugcuuccgucuggcc

SEQ ID NO: 97886 - RNA, 45 nt, Mus musculus
aguguuucuccuuuuccaucagacauuuacuuuaaauuguaaguu

SEQ ID NO: 97887 - RNA, 46 nt, Mus musculus
acauauauuuguuuagccuccuucgguggucuuuaguuauuuagau

SEQ ID NO: 97888 - RNA, 46 nt, Mus musculus
ugugauugacuuggccugugguuuuucacuuguuucaaaggaagau

SEQ ID NO: 97889 - RNA, 46 nt, Mus musculus
ccucacuaauuaauaaaaagcccuauaggcuugccuacagccagau

SEQ ID NO: 97890 - RNA, 85 nt, Mus musculus
caaacaaaccccaaaaccaaaacaacaacaacaacaaguguaagaaauaccuucaaaagaguucccaguccacgaccuaaggaca

SEQ ID NO: 97891 - RNA, 69 nt, Mus musculus
acacacacacaccaaaccaaacaaaacccagaaagccccuucccaccuaguaccagaccaagaaaaccc

SEQ ID NO: 97892 - RNA, 51 nt, Mus musculus
agcacugugcacauuuaagcaaacuuuucucugaaagacuagguaguaaau

SEQ ID NO: 97893 - RNA, 46 nt, Mus musculus
agggucugccccugcaggcaguucauaaaaauaaaaccuugaucca

SEQ ID NO: 97894 - RNA, 41 nt, Mus musculus
cuucagcuuguagccaguagcaucuuaccuccccagcgagg

SEQ ID NO: 97895 - RNA, 42 nt, Mus musculus
cuucauguuuuagaggcagagucucucacugaaccuggagcu

SEQ ID NO: 97896 - RNA, 45 nt, Mus musculus
cauuguguuauagguggucuaauguaaggggugcauuguguagau

SEQ ID NO: 97897 - RNA, 46 nt, Mus musculus
cugaaucaugaaaguacaguuuacguuuguuauucuuaugugagaa

SEQ ID NO: 97898 - RNA, 44 nt, Mus musculus
uguacugaguaacuacuguacuaguugguugucuggcuauggau

SEQ ID NO: 97899 - RNA, 45 nt, Mus musculus
ucuucuuuuaguaaaucuagaggcuuuccuuagaaauuguuaaga

SEQ ID NO: 97900 - RNA, 46 nt, Mus musculus
cagauuaugcaucaucauuccaagaggguggaaagggcgcacagug

SEQ ID NO: 97901 - RNA, 46 nt, Mus musculus
uugcaagagucaggaugcugugaaaugcaaugguaugauuggagaa

SEQ ID NO: 97902 - RNA, 46 nt, Mus musculus
uccaccccccuuuuuaagguaaucucuugcuaugcagacccgauug

SEQ ID NO: 97903 - RNA, 45 nt, Mus musculus
caugcccgcuguguugauagaauuuuuuauuuuuugggugaaccu

SEQ ID NO: 97904 - RNA, 46 nt, Mus musculus
cucuucacuuaaaguagccuugcccuuuuguguaaagcagccuugu

SEQ ID NO: 97905 - RNA, 45 nt, Mus musculus
agaaaacauuugaaugcucuuaaccaguauuaaagauugucagau

SEQ ID NO: 97906 - RNA, 46 nt, Mus musculus
aaaaagagggcugugagcauaacuuaaaauuaauacacugugagcu

SEQ ID NO: 97907 - RNA, 45 nt, Mus musculus
ugaaguaaacaagacuuaaggaacugugguuuucacuagaggggg

SEQ ID NO: 97908 - RNA, 41 nt, Mus musculus
aacugugcuguccuuuucuguguauccaagagucugaggga

SEQ ID NO: 97909 - RNA, 46 nt, Mus musculus
uuaaaucgugcuaccacauaaauauaagccagguuacggaucauau

SEQ ID NO: 97910 - RNA, 78 nt, Mus musculus
agucucacuuagggacuuagagaggauugggaugcgugagugagaaaguggccuaagcuaagcggccguggugccggg

SEQ ID NO: 97911 - RNA, 86 nt, Mus musculus
uuauuugaguaggaggauaaggggaaggaaacuguuauggguaugugaaaaauaaggaaaagaucaaaugucuuaguagguuggag

SEQ ID NO: 97912 - RNA, 46 nt, Mus musculus
gccuguagccugugucuguguaaaagggugaggaggcagaggagaa

SEQ ID NO: 97913 - RNA, 45 nt, Mus musculus
aaugcacuagaaagugguaaagaucaccauuuuuagguugugagg

SEQ ID NO: 97914 - RNA, 46 nt, Mus musculus
ggccggucgccauuugccggugauggaccgugccagugaccugacg

SEQ ID NO: 97915 - RNA, 47 nt, Mus musculus
cagauacuauacauuauguguuaaaugccaaauaaagggucagguug

SEQ ID NO: 97916 - RNA, 45 nt, Mus musculus
gcugucuuuccuguccauggacuccuccagacagcacagucaguu

SEQ ID NO: 97917 - RNA, 46 nt, Mus musculus
uaaucucacccaaggugucugaggcugguuguccgcacugcccuuu

SEQ ID NO: 97918 - RNA, 47 nt, Mus musculus
cuaauuggggcagauuugggcuccccaugcagcccugcuggccuggu

SEQ ID NO: 97919 - RNA, 77 nt, Mus musculus
uauacaugguagcaauugcuuacuguagucucccucacccuguaccagauccuuaguaggagaauggguucccaaac

SEQ ID NO: 97920 - RNA, 31 nt, Mus musculus
caaagcucaggguaucggugacggugccaca

SEQ ID NO: 97921 - RNA, 42 nt, Mus musculus
agaagauucgcuuuuauuuuuaauuaugugucuaugggaaua

SEQ ID NO: 97922 - RNA, 46 nt, Mus musculus
auuaucauuuuauugauugauugagauagucuuuuacaguccaggc

SEQ ID NO: 97923 - RNA, 46 nt, Mus musculus
aacaagaugaauauuauuaauaccaccaugccugccucggggcagc

SEQ ID NO: 97924 - RNA, 46 nt, Mus musculus
caaaccagagcuauugaagagacacggcagacaucacaucacagca

SEQ ID NO: 97925 - RNA, 46 nt, Mus musculus
agacaguaauauuucuucauugaaagaaggaaugagaugccaagau

SEQ ID NO: 97926 - RNA, 41 nt, Mus musculus
cugaaccuuccagaguucccccagagcaugugcggcacacc

SEQ ID NO: 97927 - RNA, 46 nt, Mus musculus
aaaaaaacccacaaaagaaaaauuaaaacccaaguucuugccagua

SEQ ID NO: 97928 - RNA, 47 nt, Mus musculus
gaugagugcuuaaaugcuugucacccacagaauucagguacccagaa

SEQ ID NO: 97929 - RNA, 46 nt, Mus musculus
ugaacgccaacucccgauguagaccaggcuggcuuugaacucagag

SEQ ID NO: 97930 - RNA, 46 nt, Mus musculus
gcugucuuaaccuaccaugugguaaugucaggucaugucucaauaa

SEQ ID NO: 97931 - RNA, 37 nt, Mus musculus
agauauuccugacagaauaagcagaguugaguaagac

SEQ ID NO: 97932 - RNA, 45 nt, Mus musculus
ugcugcauauuccaacgauggagaauggccccaagcuugcaaguc

SEQ ID NO: 97933 - RNA, 46 nt, Mus musculus
gcaagcuuggggccauucuccaucguuggaauaugcagcaucugag

SEQ ID NO: 97934 - RNA, 45 nt, Mus musculus
ccaggaagaccggagucugagggggagaggcgcgcauggugggaa

SEQ ID NO: 97935 - RNA, 45 nt, Mus musculus
acaggaagaccggagucugagggggagaggcaugcauggugggaa

SEQ ID NO: 97936 - RNA, 42 nt, Mus musculus
ggugggucagaucucauuacagaugguugugagccaccaugu

SEQ ID NO: 97937 - RNA, 45 nt, Mus musculus
cucaguggggaaacuaccugguuuuauguugauauggcagagaga

SEQ ID NO: 97938 - RNA, 52 nt, Mus musculus
gaggaggaggagaaggaagaggcgaaggaggagggggaagaggagggagaag

SEQ ID NO: 97939 - RNA, 45 nt, Mus musculus
gucacugugugucuuuggaucuggcugaacuuggauggugucaua

SEQ ID NO: 97940 - RNA, 79 nt, Mus musculus
ugugugugucuguaugagugugcaugugugaguaugucuguguaugucugugugugugucuguguauguguguaugucu

SEQ ID NO: 97941 - RNA, 30 nt, Mus musculus
acagaagaggagcuggcaacgcccccacua

SEQ ID NO: 97942 - RNA, 46 nt, Mus musculus
ucgugugcacauuccuacacacacacacacacacacacacacagag

SEQ ID NO: 97943 - RNA, 42 nt, Mus musculus
guguguguguguguguguguguguguuguacugcuguggagc

SEQ ID NO: 97944 - RNA, 46 nt, Mus musculus
ucucugugggaaacuccggaucgcccccauucaugcagcaccagug

SEQ ID NO: 97945 - RNA, 49 nt, Mus musculus
gugauauuuaaggcuuguugguccacauugcuagaugccaguagugaga

SEQ ID NO: 97946 - RNA, 46 nt, Mus musculus
cacgcugcccuguugcuuuggggcucccccagggccuugaauauag

SEQ ID NO: 97947 - RNA, 48 nt, Mus musculus
guuccuaucuauauucaaggcccugggggagccccaaagcaacagggc

SEQ ID NO: 97948 - RNA, 63 nt, Mus musculus
uagaugcgcuugcauccugagacagagagcuguagucccagggcuggaacacugcugugggau

SEQ ID NO: 97949 - RNA, 74 nt, Mus musculus
agauggaaaccaucagagagcaggagagauucuagcuccaccccguccugagacagagagaagcacuaggggaa

SEQ ID NO: 97950 - RNA, 71 nt, Mus musculus
cucucucugugugaaaacugcacacacacacacacacacacacacacacccaugcauuucucugucuagcu

SEQ ID NO: 97951 - RNA, 46 nt, Mus musculus
cuuugcgugugugaacacugcuguuuggguuuaacucgguguuguc

SEQ ID NO: 97952 - RNA, 41 nt, Mus musculus
ggaaccguuuguuuauuaauugugugugugugugugugugu

SEQ ID NO: 97953 - RNA, 45 nt, Mus musculus
ugugugugugugugagagagagagagagagagagagagacuuuau

SEQ ID NO: 97954 - RNA, 46 nt, Mus musculus
ugaaguaggcacaaugaaucuuuuccucuacuggauaaacgaagac

SEQ ID NO: 97955 - RNA, 57 nt, Mus musculus
cugugccagaagggaggcuccauaauugcuagggggagagagagagagacagagaga

SEQ ID NO: 97956 - RNA, 44 nt, Mus musculus
gccugaguaguuaguugaucacuaggcucauuccuuguagcauu

SEQ ID NO: 97957 - RNA, 45 nt, Mus musculus
uaacuccaccccucccugugaagcuugcuggaugcagacaaggug

SEQ ID NO: 97958 - RNA, 42 nt, Mus musculus
aauaugcacucuccgugugugugugugugugugugugugugu

SEQ ID NO: 97959 - RNA, 45 nt, Mus musculus
gccuggaaaggugggacuggagacugcaagaugggcggguaaguc

SEQ ID NO: 97960 - RNA, 46 nt, Mus musculus
agugcuaguaacugaaccaccuuuccaguucccuguuguccaugau

SEQ ID NO: 97961 - RNA, 25 nt, Mus musculus
ugucuuguauccauuugccaaagau

SEQ ID NO: 97962 - RNA, 46 nt, Mus musculus
agccuuuuccacaaauacaggaagacuauaaauuucucuagcacaa

SEQ ID NO: 97963 - RNA, 46 nt, Mus musculus
cacacggccucugggacuuggaguuucugauaauccacugcccuca

SEQ ID NO: 97964 - RNA, 42 nt, Mus musculus
guggcaggauguggcacgugugagcccagcacuccuauagag

SEQ ID NO: 97965 - RNA, 45 nt, Mus musculus
aaaacaaaaaccaaccaaccaaccauauucaaacuagccccacug

SEQ ID NO: 97966 - RNA, 45 nt, Mus musculus
uggaggccagccugggcuauagagugaguuccaugacagccagga

SEQ ID NO: 97967 - RNA, 45 nt, Mus musculus
ucugagaguuucuucaauggugagacugugugggcaaggugucag

SEQ ID NO: 97968 - RNA, 41 nt, Mus musculus
gaccuugguaaguuaguuugcauuuaguccacuagggggca

SEQ ID NO: 97969 - RNA, 41 nt, Mus musculus
augaaugaagcgacucaucaagaugcuuugucagcgggaga

SEQ ID NO: 97970 - RNA, 42 nt, Mus musculus
ugggggucaaggccaauuuagcugccuaagauuugggggcug

SEQ ID NO: 97971 - RNA, 44 nt, Mus musculus
ucuucuccuccuccuccucuucuagacuuauucagcccccaaau

SEQ ID NO: 97972 - RNA, 46 nt, Mus musculus
ugugugugccuggucccugcagaggccagaagaagacuuuagaucc

SEQ ID NO: 97973 - RNA, 42 nt, Mus musculus
cuucccgagugggauugccagcacacccccacacccccacau

SEQ ID NO: 97974 - RNA, 46 nt, Mus musculus
uggcuaguucugggguguggcucccucaugacagacccuuggagau

SEQ ID NO: 97975 - RNA, 50 nt, Mus musculus
gauucuucuacuaugugugcuguggggauggagcuuggguaguuuggauu

SEQ ID NO: 97976 - RNA, 88 nt, Mus musculus
uggguucccuacuccaccucugccagccucuacauccgccccacauuuaucggaacugagguacggccuggcucuauuuaggggauau

SEQ ID NO: 97977 - RNA, 27 nt, Mus musculus
ggauguagaggcuggcagagguggagu

SEQ ID NO: 97978 - RNA, 46 nt, Mus musculus
gcuggaacucaauagggauucuguccuuucagauguuugacaagga

SEQ ID NO: 97979 - RNA, 45 nt, Mus musculus
aaagcuguugaaggagccaaucggcacugcaacauggggacaguu

SEQ ID NO: 97980 - RNA, 46 nt, Mus musculus
gggaucuaacaucuuuuucaaaaaucucauuuauuuauuugggggc

SEQ ID NO: 97981 - RNA, 46 nt, Mus musculus
ugaugcuuuguuauacucaaucauaauauccaguuauaauugagaa

SEQ ID NO: 97982 - RNA, 45 nt, Mus musculus
caaauuuuaucuuuauuuucccuugugguuuguuuauguuuuaug

SEQ ID NO: 97983 - RNA, 45 nt, Mus musculus
accacuccaccacuccuggucagaaguuaaguaugaaucuuggaa

SEQ ID NO: 97984 - RNA, 51 nt, Mus musculus
caacacacacacacacacacacacagagagagagagagagagagagcaagc

SEQ ID NO: 97985 - RNA, 42 nt, Mus musculus
uuuucaauuagaggggaaaagagaacuggauuggggacgagg

SEQ ID NO: 97986 - RNA, 41 nt, Mus musculus
ucuaaugagagacggaaagggaggugaggucagagggaacu

SEQ ID NO: 97987 - RNA, 44 nt, Mus musculus
aggugccacagugugagaccugcuggccucuauaggaggugagc

SEQ ID NO: 97988 - RNA, 32 nt, Mus musculus
uuugcaucaaaugacaggugaacggaccauuc

SEQ ID NO: 97989 - RNA, 50 nt, Mus musculus
cauugccacaccagucugaacuuaaagauucuuagcuucauucccagauc

SEQ ID NO: 97990 - RNA, 46 nt, Mus musculus
acacuguguugguaaagagagacuccagaggcagggcuggccccuc

SEQ ID NO: 97991 - RNA, 45 nt, Mus musculus
gaagucugaagccaggaacugguucaagggcagaucagucugcuu

SEQ ID NO: 97992 - RNA, 93 nt, Mus musculus
uccucagguucacagggagagacaacccaggcagccccacugagagaggaagaugaagucacaucauuaaaggggugcucacaacacccagua

SEQ ID NO: 97993 - RNA, 45 nt, Mus musculus
acaugguggcugagacccaaagguugugagagccaccgcuguaga

SEQ ID NO: 97994 - RNA, 44 nt, Mus musculus
gccaccauguggguacugagaacuuugcuacaguucucugccag

SEQ ID NO: 97995 - RNA, 76 nt, Mus musculus
gacccggauucgcuggucuuuggagcuacguuuacugaccacaugcugacgguggagugguccucugcgucuggau

SEQ ID NO: 97996 - RNA, 42 nt, Mus musculus
cuuuacuugcuuugucaccuugucaggcccuguugcagagau

SEQ ID NO: 97997 - RNA, 41 nt, Mus musculus
gugugugcauacaucaugugcgugcuuggugcaugugaagg

SEQ ID NO: 97998 - RNA, 46 nt, Mus musculus
gugagacugaauucuagacauaucuuaaacacggagaagccagcag

SEQ ID NO: 97999 - RNA, 48 nt, Mus musculus
ugaagugaggguggugugcagucagccagagugagugaagcuggggcu

SEQ ID NO: 98000 - RNA, 50 nt, Mus musculus
gcacuacuacuuccugacauggaauggacagacagacaguaaacagcagg

SEQ ID NO: 98001 - RNA, 46 nt, Mus musculus
gggcaagcuguaaauuuuggcagcugccuggaggagagagaggggu

SEQ ID NO: 98002 - RNA, 41 nt, Mus musculus
guuuguuuuuguuuuuaagcuugaagacaguuauauuaaag

SEQ ID NO: 98003 - RNA, 46 nt, Mus musculus
uucacucgccaucugaauuaggauaauuugaaagugaacucgggcu

SEQ ID NO: 98004 - RNA, 46 nt, Mus musculus
gagcucucucccuacugugggaagauuuaaaaucuauaagcuagau

SEQ ID NO: 98005 - RNA, 126 nt, Mus musculus
uaaccgugauucccacaaacagagggaaugccuggaaauuuuaucauuuagaguuucgacuaguauucaaagguuagaauuagagcgccgauuucacuuguuuuuugaccuacuuaugaguuugua

SEQ ID NO: 98006 - RNA, 126 nt, Mus musculus
aaggaauuuagaguuucuuggugaaauuauaaaggccacaagaucuuguguuacuuugaaaaaacuggauauaggagggaaaucuuuauguucaaaucuggauuagagggaaauggucaggggaga

SEQ ID NO: 98007 - RNA, 68 nt, Mus musculus
gucucaaaaaaacaaaaacaaaaacaaacaaacaaacaaaaaacaaaacccuaacuuuuaaucucuag

SEQ ID NO: 98008 - RNA, 46 nt, Mus musculus
ggggucucauuguguagcccuggcugaccuagaacucaccagguag

SEQ ID NO: 98009 - RNA, 45 nt, Mus musculus
ccguauagcuggcccaggaacuuguucuuaauaugcccuguguca

SEQ ID NO: 98010 - RNA, 44 nt, Mus musculus
uuuagggguuaguucugcccuucuacugugugggauccacguag

SEQ ID NO: 98011 - RNA, 63 nt, Mus musculus
ugcaccgcaccgcgggcuuagacuaagcgaguuuagugaguuuccuuucguuuccagugcaga

SEQ ID NO: 98012 - RNA, 42 nt, Mus musculus
gccaaucagaggaaacuagaaugaagagagcucgucucugag

SEQ ID NO: 98013 - RNA, 53 nt, Mus musculus
ucauucaugugcacgcacgcaugcacgcacgcacaaacagagagagagagggg

SEQ ID NO: 98014 - RNA, 46 nt, Mus musculus
gguugucucucuccuuucccaccaagacuugagcguucuggaagga

SEQ ID NO: 98015 - RNA, 46 nt, Mus musculus
uuaaagcacuugacagcccuccauccuucuccaccagcccccagcc

SEQ ID NO: 98016 - RNA, 31 nt, Mus musculus
uguuuugucuuaugaauuagacauuuuaucg

SEQ ID NO: 98017 - RNA, 46 nt, Mus musculus
ggggugguuaagugacugaguuaguuaaugcauuucagguugagau

SEQ ID NO: 98018 - RNA, 45 nt, Mus musculus
aguaauggaugcuccgcgccguuugcuggagaaagaggaucagaa

SEQ ID NO: 98019 - RNA, 46 nt, Mus musculus
gccacaggaucuugggcacguuagggaugaugugauggcuggggau

SEQ ID NO: 98020 - RNA, 45 nt, Mus musculus
gcgagagccgaagcacaaaugcaggucccugcugcaaauccagau

SEQ ID NO: 98021 - RNA, 45 nt, Mus musculus
guuugcauguguaccaugugcaugucugaugcugugggggucaga

SEQ ID NO: 98022 - RNA, 45 nt, Mus musculus
caucuuggcagcaugguucccguuucuuuuuucauacccgcauuu

SEQ ID NO: 98023 - RNA, 45 nt, Mus musculus
aggaaaugcggguaugaaaaaagaaacgggaaccaugcugccaag

SEQ ID NO: 98024 - RNA, 46 nt, Mus musculus
ucaaauuccagcaaccacaugauggcucccaaccauccguaaugag

SEQ ID NO: 98025 - RNA, 32 nt, Mus musculus
ugcuccagucccguucccucuggcccaaagau

SEQ ID NO: 98026 - RNA, 46 nt, Mus musculus
guacucauauacauuaaauaaauaaaucuuaaaaaaaaaaaaagaa

SEQ ID NO: 98027 - RNA, 45 nt, Mus musculus
aguaacuauaaagaaggagagaagagaggagaaaggggugagaga

SEQ ID NO: 98028 - RNA, 46 nt, Mus musculus
gugccaccaugcccagaguuuuuuucuaaaguaagagaccacagau

SEQ ID NO: 98029 - RNA, 46 nt, Mus musculus
uuuaacacaugcacuaacacuuguuugaaauccagacccuguccca

SEQ ID NO: 98030 - RNA, 34 nt, Mus musculus
ugaaagauuuugcugggauauaaacuaugggaga

SEQ ID NO: 98031 - RNA, 42 nt, Mus musculus
aggcugacuagugaugauugacucuggggauauaagguagau

SEQ ID NO: 98032 - RNA, 48 nt, Mus musculus
aggcauugcugcuggagcagauuaaugauucaaucgccacccgaggag

SEQ ID NO: 98033 - RNA, 46 nt, Mus musculus
uggcgauugaaucauuaaucugcuccagcagcaaugccugaaagac

SEQ ID NO: 98034 - RNA, 42 nt, Mus musculus
gucuucuaguauacaagauaacggauuucuuccuggcaccgg

SEQ ID NO: 98035 - RNA, 49 nt, Mus musculus
agauccucugcugacagacagcaacugggaggacuuggagggaggaaug

SEQ ID NO: 98036 - RNA, 32 nt, Mus musculus
gauggucagcacugguuuuuaacugcccaaac

SEQ ID NO: 98037 - RNA, 46 nt, Mus musculus
cacccgaggcaccuccugggacaucacacuugagacagggccagaa

SEQ ID NO: 98038 - RNA, 42 nt, Mus musculus
gguuuaggccucuuaccagacaccucuucuguaaccccagug

SEQ ID NO: 98039 - RNA, 46 nt, Mus musculus
caugguggcucacaaccauccuaacgagaucugauucccucuucug

SEQ ID NO: 98040 - RNA, 45 nt, Mus musculus
gaugcaggcuccucccccagccccuacagguucuugaugagagag

SEQ ID NO: 98041 - RNA, 41 nt, Mus musculus
ucuaagcuacccaagaccaucucucaaaaacaaagcuaaac

SEQ ID NO: 98042 - RNA, 45 nt, Mus musculus
uuucuuacaauucaaaaauucuacacagauuguuuaagaccaguc

SEQ ID NO: 98043 - RNA, 41 nt, Mus musculus
ugcagccagggugugugugugugugugugugugugugugug

SEQ ID NO: 98044 - RNA, 46 nt, Mus musculus
gagcauuggcaaacagaugcagacaguacggcuaacagcagaggag

SEQ ID NO: 98045 - RNA, 45 nt, Mus musculus
agagugcagcuggagacacuuaaccacaaguccaggcuguguagg

SEQ ID NO: 98046 - RNA, 46 nt, Mus musculus
ucucaaaaacaaacaaacaaagagccuccccaacaaaagaggauau

SEQ ID NO: 98047 - RNA, 45 nt, Mus musculus
cuauuaaguguuccuuuucaauauuaauauuccuacuagcuagua

SEQ ID NO: 98048 - RNA, 46 nt, Mus musculus
ccaauaagaccacaucuaauagugccacuccuuaggaccaagaaau

SEQ ID NO: 98049 - RNA, 46 nt, Mus musculus
ugcuggagaaggagcugagaguucuauaucuggcccauagucaaca

SEQ ID NO: 98050 - RNA, 50 nt, Mus musculus
gcuucgaguuacuuggcugaggaauggggaaggaacuggagaaggaggaa

SEQ ID NO: 98051 - RNA, 46 nt, Mus musculus
aaagcagucagugcucuuaaccacugagccauuucuccagcccggu

SEQ ID NO: 98052 - RNA, 47 nt, Mus musculus
gggcaggugggcaaagcguuggauggaaugauagaugcauacaggag

SEQ ID NO: 98053 - RNA, 48 nt, Mus musculus
auacagaaaaagaaucaaaguaaauagaaaagacaaacauaagaaaau

SEQ ID NO: 98054 - RNA, 44 nt, Mus musculus
ccaucucuccaggccccacuuuuguaugauugugugcgguuauc

SEQ ID NO: 98055 - RNA, 44 nt, Mus musculus
augcuugugagcagccugauggugugcuggguacugaguucaga

SEQ ID NO: 98056 - RNA, 46 nt, Mus musculus
caucacuuuuagaaaugaauguguaugcucuuaaaauaguguagaa

SEQ ID NO: 98057 - RNA, 46 nt, Mus musculus
uagugacccugacuaagacaucucuauuccuucaaagccugcuagu

SEQ ID NO: 98058 - RNA, 46 nt, Mus musculus
cagagaaaggagcuucaguuggggaaaugccuccacaaguccagcu

SEQ ID NO: 98059 - RNA, 46 nt, Mus musculus
agcaguaagucucagaggcugaaagcauucuaggccaagauaagau

SEQ ID NO: 98060 - RNA, 46 nt, Mus musculus
gaacgagccagcgaaugagaaggagccagacguugccaacguuagu

SEQ ID NO: 98061 - RNA, 53 nt, Mus musculus
ggcaguuuuaccaggacaguuauagagagacaggaugcagagagagaacgagc

SEQ ID NO: 98062 - RNA, 46 nt, Mus musculus
auccugauguuuuauauuugaaauggguuggaacuuuuuggaagga

SEQ ID NO: 98063 - RNA, 46 nt, Mus musculus
acauaccuguagucccagugcuugugggguagagagagaagaauca

SEQ ID NO: 98064 - RNA, 46 nt, Mus musculus
auucuguauauaucuaccuuaaaauauaaguuccuagacuccauag

SEQ ID NO: 98065 - RNA, 45 nt, Mus musculus
gaagggaaaugaugcucugucggcugugcagucaccuagucuccc

SEQ ID NO: 98066 - RNA, 50 nt, Mus musculus
gcgcuguggcauccucuaaaucuggguaccgcauuuacagaaccaggaca

SEQ ID NO: 98067 - RNA, 46 nt, Mus musculus
ucccgcuccgguucuuguccugguucuguaaaugcgguacccagau

SEQ ID NO: 98068 - RNA, 42 nt, Mus musculus
guccgagauauuccgggugggugaguagcugcauuccagcau

SEQ ID NO: 98069 - RNA, 44 nt, Mus musculus
cguauugcugaaguucaugcuggaaugcagcuacucacccaccc

SEQ ID NO: 98070 - RNA, 53 nt, Mus musculus
aggaggcggcugugcagugacacguggcgcucagggucggucggcaagcgcgg

SEQ ID NO: 98071 - RNA, 45 nt, Mus musculus
uaauuuaacagguguguuuaacuaauaauauuaacagugggagua

SEQ ID NO: 98072 - RNA, 42 nt, Mus musculus
aauuaaagguuacuuuacaauuaacuagcagaaaauggagau

SEQ ID NO: 98073 - RNA, 23 nt, Mus musculus
gugggaucugggagggaagguac

SEQ ID NO: 98074 - RNA, 64 nt, Mus musculus
cuaaaauaaaaauaaauccuguaauaugggaacaagcuaguaccagauuauagaaaggucacua

SEQ ID NO: 98075 - RNA, 48 nt, Mus musculus
aaaaccacacacaugcacacaacacucaagucuacaggugcacaccuu

SEQ ID NO: 98076 - RNA, 45 nt, Mus musculus
gggucacagaacuaggaagguugagaaauaguuuucuaguacaua

SEQ ID NO: 98077 - RNA, 46 nt, Mus musculus
gccucuuacucugcauucuccuuaaggaccaaccuucuugaucuug

SEQ ID NO: 98078 - RNA, 46 nt, Mus musculus
aacaagaggguccuguagaccugcaaguuuguaaucccaguguaca

SEQ ID NO: 98079 - RNA, 47 nt, Mus musculus
ugaaagguuacacauccugggccauuggccucucuguggcagacuug

SEQ ID NO: 98080 - RNA, 46 nt, Mus musculus
cagcauggcagcuucuuccuuaaaacaccaaaaauugucuccagca

SEQ ID NO: 98081 - RNA, 24 nt, Mus musculus
cccagcgugcacuagcggucucaa

SEQ ID NO: 98082 - RNA, 61 nt, Mus musculus
uuuggacuuuaugccaugcacagcagggugaauguugcuugccaagacgucgacguggaca

SEQ ID NO: 98083 - RNA, 63 nt, Mus musculus
gagugcuuguucuagacauagagacagaggagagagcacccaggucaggcauuuuuuaccaag

SEQ ID NO: 98084 - RNA, 46 nt, Mus musculus
cucuguugagucauugcauugaucagauaaauugaaaccuugcuca

SEQ ID NO: 98085 - RNA, 46 nt, Mus musculus
ugaggcuucaguugguauugauagaaguugcccucugacugugcag

SEQ ID NO: 98086 - RNA, 26 nt, Mus musculus
guuaauguauuauuuuucuuuucuuu

SEQ ID NO: 98087 - RNA, 46 nt, Mus musculus
gggagaaauugagaguugggccaucuugaggcacuguggugggagc

SEQ ID NO: 98088 - RNA, 46 nt, Mus musculus
agguaccuauuuucaaagaagugagaaugcuuguugcccgguuaug

SEQ ID NO: 98089 - RNA, 45 nt, Mus musculus
ccaguggugugugugugugugugugugugugugugugccugucuu

SEQ ID NO: 98090 - RNA, 42 nt, Mus musculus
ggggcggccaacugcuucacacuuucaauacugcacugaaga

SEQ ID NO: 98091 - RNA, 46 nt, Mus musculus
uuuagagaauuucaaugaauuaucuuuuuuguacuaauucugagau

SEQ ID NO: 98092 - RNA, 42 nt, Mus musculus
gaaaccaaauuuagaauauugugaaaaauauuuugggcagaa

SEQ ID NO: 98093 - RNA, 46 nt, Mus musculus
ugcaaucccuuucuuaaagugcccacguucuccuguugugaauagg

SEQ ID NO: 98094 - RNA, 46 nt, Mus musculus
auaacagagcagagcuguaucaacaccuuaaggaggaaaauggguu

SEQ ID NO: 98095 - RNA, 30 nt, Mus musculus
cuccagaaccuccaaacaaaaagccccuug

SEQ ID NO: 98096 - RNA, 45 nt, Mus musculus
ggaaggagcacggcacggaaaaggcccggccggaugcagacaggu

SEQ ID NO: 98097 - RNA, 62 nt, Mus musculus
agaagcaucagagaguauuggagugucuaauggcauguaggagcaaacccccagaagaagaa

SEQ ID NO: 98098 - RNA, 68 nt, Mus musculus
agaugaacaguaccggaucauguggaaugaacuagagacucucgucagagcccauaucagcaacucug

SEQ ID NO: 98099 - RNA, 44 nt, Mus musculus
uuccuguuucuacagucgguaccagaggaaagggaccuaaaagg

SEQ ID NO: 98100 - RNA, 50 nt, Mus musculus
ugaaagagucuuugacagaagaggauguguuaaacugucagaagaccaua

SEQ ID NO: 98101 - RNA, 46 nt, Mus musculus
aaguaaauuuuuaaauuuguaauuggugccauuucucaagcaagau

SEQ ID NO: 98102 - RNA, 52 nt, Mus musculus
cuagaccccagauauaaaaucgaugcaagucuagagaucccguuggagcgug

SEQ ID NO: 98103 - RNA, 75 nt, Mus musculus
uuucugcauguccuuagcaguucucgauccauucuggaagauccgccuucaauuagugagggcuguggaggaaga

SEQ ID NO: 98104 - RNA, 46 nt, Mus musculus
uuugaauuuuuguuuucauugccuuaagggacucaguacagcagau

SEQ ID NO: 98105 - RNA, 45 nt, Mus musculus
aaggugacagccacucugggagcagcagcagagaagggccauuua

SEQ ID NO: 98106 - RNA, 46 nt, Mus musculus
uacuuccugaauaaaaccuauuauuuucucaccuaacauuccagau

SEQ ID NO: 98107 - RNA, 46 nt, Mus musculus
uguuuuaacuuagaagauuguauaacauucucuuggcuauggagau

SEQ ID NO: 98108 - RNA, 45 nt, Mus musculus
ucacuccuaauauugaaugacacuuuuaaggugugaagucuuuaa

SEQ ID NO: 98109 - RNA, 46 nt, Mus musculus
caacuaugacguggagcuacuucaucacaaagaugcacauguagau

SEQ ID NO: 98110 - RNA, 42 nt, Mus musculus
uuuuucuccccauaucauauuuuguuuugcuagcccacauuc

SEQ ID NO: 98111 - RNA, 46 nt, Mus musculus
aacauuuugacuuggcuucaacgaccaucacaaacauuccuaugaa

SEQ ID NO: 98112 - RNA, 42 nt, Mus musculus
uacuggaacucacacagggaggaagcaggaacugaggcagaa

SEQ ID NO: 98113 - RNA, 46 nt, Mus musculus
ggugaaugugugucuucacgguguguggauguguucaugucaagau

SEQ ID NO: 98114 - RNA, 42 nt, Mus musculus
uacucauggagaaugcagaacgaguugggaauagaggacgga

SEQ ID NO: 98115 - RNA, 46 nt, Mus musculus
uccauccauaauguuguuuaaguuugcuuccuucccacccccaaga

SEQ ID NO: 98116 - RNA, 46 nt, Mus musculus
acccaguaaaucaaaacucuugaagcuuauaauuaaccagucagau

SEQ ID NO: 98117 - RNA, 46 nt, Mus musculus
aguccuguauucaggaggucuugcugccucuaacuagccccaauug

SEQ ID NO: 98118 - RNA, 46 nt, Mus musculus
gugaaucuuccuucuuccaguguucuuauuuaggucuccagcaggu

SEQ ID NO: 98119 - RNA, 41 nt, Mus musculus
uuaaaggcgugcaccaccacgcccggcuuccaagguuaguu

SEQ ID NO: 98120 - RNA, 46 nt, Mus musculus
ccuaauuaaaaaaaauaaauuauaagaaaaaagaaaaaaaaaagaa

SEQ ID NO: 98121 - RNA, 45 nt, Mus musculus
augagauuuuuuugcuuggccaagguccuuaucaucuuaccugau

SEQ ID NO: 98122 - RNA, 42 nt, Mus musculus
ggugcguuccagagcagcaggagguaauagcgggacccuaag

SEQ ID NO: 98123 - RNA, 46 nt, Mus musculus
gcuugcacgcgcaugcgcgcgccccugcguuuaagcagccggagug

SEQ ID NO: 98124 - RNA, 47 nt, Mus musculus
ucugaaguguaauuccacugacagccagcaucccccacacggccagg

SEQ ID NO: 98125 - RNA, 46 nt, Mus musculus
gauucuguguuguggguugguuuugcuuuucaguauaugucucaag

SEQ ID NO: 98126 - RNA, 45 nt, Mus musculus
ugcaaggcaccaugugguugcugggaauugaacucaggaccucua

SEQ ID NO: 98127 - RNA, 45 nt, Mus musculus
gggugggugauggcaaagggugggacagaggcaggucaagagaag

SEQ ID NO: 98128 - RNA, 41 nt, Mus musculus
uuauacgagccccugccucaagaaauaaaugaagcugggaa

SEQ ID NO: 98129 - RNA, 46 nt, Mus musculus
acuccaauaaacuagaauuucuucuccucccuccgcuggccaccac

SEQ ID NO: 98130 - RNA, 46 nt, Mus musculus
ccaaugacugggcaccgggcaagacacuuaagaguugugcggguag

SEQ ID NO: 98131 - RNA, 46 nt, Mus musculus
aacaagaucugacgcccucuucuggagugucugaagacagcuaaag

SEQ ID NO: 98132 - RNA, 46 nt, Mus musculus
aaucccagcacccacauggcagcucacaacggucuguaacuccaag

SEQ ID NO: 98133 - RNA, 45 nt, Mus musculus
ucaaccauuaaggucuacaccagugucaaacacuucuggccccag

SEQ ID NO: 98134 - RNA, 46 nt, Mus musculus
ugguacuccacggauuaccuuggagagggaguuaccucuuucugag

SEQ ID NO: 98135 - RNA, 46 nt, Mus musculus
auccgugaacagacaccauaugcaugcuggguggcucagaggucag

SEQ ID NO: 98136 - RNA, 45 nt, Mus musculus
uagauggucaugagcugcucugugaguacugggaacugaacccag

SEQ ID NO: 98137 - RNA, 46 nt, Mus musculus
aguggacuaauucucaguccaaacacucagggcaagagguacagcu

SEQ ID NO: 98138 - RNA, 45 nt, Mus musculus
acccuucgacugucuguaauguccaugcugccuuucaccagccag

SEQ ID NO: 98139 - RNA, 46 nt, Mus musculus
cucucuuuuuuuuuuuuuaaagauuuauuuauuuauuauauggaag

SEQ ID NO: 98140 - RNA, 46 nt, Mus musculus
uagaccgggcgugguggcgcacaccuuuaaucccagcacuuggaag

SEQ ID NO: 98141 - RNA, 44 nt, Mus musculus
aaaaggguauuaaauccaugagguucguuugaaaugugggauaa

SEQ ID NO: 98142 - RNA, 46 nt, Mus musculus
uaauucuacaggagacuuaaagguucaguaaaauucuuacccccaa

SEQ ID NO: 98143 - RNA, 54 nt, Mus musculus
aucucuaacuugaaguuaaaacugacggccguagagaaggacaggcuggauuau

SEQ ID NO: 98144 - RNA, 44 nt, Mus musculus
ccccuuuguuuuguucacugaugguuugcuaauguugagucgag

SEQ ID NO: 98145 - RNA, 42 nt, Mus musculus
auguaugcucaaaaaccagcaagucugggucuaugccugaaa

SEQ ID NO: 98146 - RNA, 48 nt, Mus musculus
gaaaggaagggaaagaaaggaaaggaaagaaagaaaggaaaggaaaga

SEQ ID NO: 98147 - RNA, 85 nt, Mus musculus
ucccaaauugauccccgcguuaaagggggauauauuuuuuaagaaaaaggaaaaggaaagugaggaaaaauaaaaggaaucagug

SEQ ID NO: 98148 - RNA, 46 nt, Mus musculus
ugucucugucucucucugucucugucucucugugugugucuguguc

SEQ ID NO: 98149 - RNA, 42 nt, Mus musculus
gcgagcggcaggcacucccgcaggcggugcgggccggcagac

SEQ ID NO: 98150 - RNA, 45 nt, Mus musculus
caucuuccugaggaacaggcucaaguacgcccugaccggcgacga

SEQ ID NO: 98151 - RNA, 45 nt, Mus musculus
auccgcuacccugacccgcucaucaaggucaacgacaccgugcag

SEQ ID NO: 98152 - RNA, 42 nt, Mus musculus
uaaccggaggcgccaaccugggucgcaucggcgucaucacca

SEQ ID NO: 98153 - RNA, 106 nt, Mus musculus
cccggggaaaaggaauccgccucaccauugccgaagagagagacaagaggcuggcggccaagcagagcgggugaaguggacucugagggacauugcggggaagggg

SEQ ID NO: 98154 - RNA, 44 nt, Mus musculus
guuuauacuuaaaaguuuuuuaagcagcauguugaauuaaaaaa

SEQ ID NO: 98155 - RNA, 47 nt, Mus musculus
uggaaccgaucaugcuagucuuugugcacaaagaauaaaaaugugaa

SEQ ID NO: 98156 - RNA, 46 nt, Mus musculus
ucugcuccaaccgccacugucugauccgcaaauacgggcugaacaa

SEQ ID NO: 98157 - RNA, 44 nt, Mus musculus
uuauccaaaagauaccuaaauuaggaaggaggaaacagcugagg

SEQ ID NO: 98158 - RNA, 45 nt, Mus musculus
caugguggcacaugccuauaaccccaaagguggaauuaggaagau

SEQ ID NO: 98159 - RNA, 45 nt, Mus musculus
ggcggagcgcaaggcaauuccgcugggucgcaggggggccaagga

SEQ ID NO: 98160 - RNA, 42 nt, Mus musculus
aaauuacuaaagaaguauuuuugcuuugguauuaaagggcag

SEQ ID NO: 98161 - RNA, 46 nt, Mus musculus
uguuguugguaugguacuuaacaauuuuauuuuuugccuucaugag

SEQ ID NO: 98162 - RNA, 46 nt, Mus musculus
ccuggaaaagauuaugguagcuggugaauuaaaguuaccuaggcag

SEQ ID NO: 98163 - RNA, 47 nt, Mus musculus
uugugacccugucuaaaaaaucauucccaaacaaaaccagccaguca

SEQ ID NO: 98164 - RNA, 46 nt, Mus musculus
acuuaguuauauauaaguacacuguagcugucuucagacacagcag

SEQ ID NO: 98165 - RNA, 45 nt, Mus musculus
ucuuaaaauagcucccagcacauagucuauuuuuuacagccuuag

SEQ ID NO: 98166 - RNA, 110 nt, Mus musculus
gauuaguucugauaucuuguacauuaucagugcuuugauuuuuaggaauuuagcuguuuagggauuauaaucuuguuaaacuuuauaauaaaggugaacuucaagaauuu

SEQ ID NO: 98167 - RNA, 78 nt, Mus musculus
uuaggacugggaauucugguuuuuguuuuuggaggcaggguacuuaaaauucuuaguaugcuaaauuaacuaguaaau

SEQ ID NO: 98168 - RNA, 59 nt, Mus musculus
gaaggguguaguuacuguuggccuagugagguuagaacuaccaacaaacaacucugaag

SEQ ID NO: 98169 - RNA, 96 nt, Mus musculus
aagcuaucuuugagcugugcuauucucugccuuggguucuuaggcagucuuagaggagguugggguuuuuauuuucauacauacuaaaauguguaa

SEQ ID NO: 98170 - RNA, 41 nt, Mus musculus
ccucacuugaucaccaauugagaaaauaccucacagcugga

SEQ ID NO: 98171 - RNA, 46 nt, Mus musculus
aagggaguugggauauuucaaauaagcuuugucuauaucuauugag

SEQ ID NO: 98172 - RNA, 78 nt, Mus musculus
ggaucagcaugucuuucuaaaguggcagguuucugagaggagggaggauaaagagaugagaaguaaagaagacaggaa

SEQ ID NO: 98173 - RNA, 38 nt, Mus musculus
uucugcuuaguuggcagcaaacuucuuuuccuccugag

SEQ ID NO: 98174 - RNA, 42 nt, Mus musculus
agggucacagcuuugaggccagcuuugccuaugcagcaagau

SEQ ID NO: 98175 - RNA, 46 nt, Mus musculus
uuuauuuauuuauuuauuuauuuauuuuuuauaaguaucuucucag

SEQ ID NO: 98176 - RNA, 42 nt, Mus musculus
caaaaaugaacuucucuaucccagucauuagagugcccagau

SEQ ID NO: 98177 - RNA, 41 nt, Mus musculus
acucuaaugacugggauagagaaguucauuuuugggcagaa

SEQ ID NO: 98178 - RNA, 46 nt, Mus musculus
gcaggaauuugaagcacccuguuccauccccacaguuaagagcaag

SEQ ID NO: 98179 - RNA, 45 nt, Mus musculus
ggaaggcuaaggaaagagguguucagauagcuuacuacacaguaa

SEQ ID NO: 98180 - RNA, 46 nt, Mus musculus
uaugcucuuaguaauuuucuauugcuguguagacaagacaccauga

SEQ ID NO: 98181 - RNA, 45 nt, Mus musculus
aaugguucauguaggcucauauauaugagugcuuaguucccacca

SEQ ID NO: 98182 - RNA, 42 nt, Mus musculus
uuguccagacauuuucacagucuuguuuagcuucuucaguag

SEQ ID NO: 98183 - RNA, 45 nt, Mus musculus
uuuaugacauucaaaaccacagacuuuacaauacugcuaagucag

SEQ ID NO: 98184 - RNA, 48 nt, Mus musculus
acaaaacaagagaauguucccaaacccccaccauauucuaaaacccag

SEQ ID NO: 98185 - RNA, 45 nt, Mus musculus
ucccgacggagggacuaauaugccuuacaugcauccaccacagaa

SEQ ID NO: 98186 - RNA, 46 nt, Mus musculus
ccugaauacaggccaccuccaaagcaauacuccuacauacugccag

SEQ ID NO: 98187 - RNA, 89 nt, Mus musculus
guaauagauacaaaugccacaaaagaaaagcuggugagggauauuaaaucucuaguagaaaucaaaaagaaguuuucagaacuugcaag

SEQ ID NO: 98188 - RNA, 46 nt, Mus musculus
guagcuguaggaaaaggaacagagcuucagauugcuguggugucgc

SEQ ID NO: 98189 - RNA, 46 nt, Mus musculus
accaacagaaacuguugcuuuaccuuuugauguuauaggagcugua

SEQ ID NO: 98190 - RNA, 42 nt, Mus musculus
uggugcuauccauaggcuuaggcagaacuucagugcccaggg

SEQ ID NO: 98191 - RNA, 58 nt, Mus musculus
ccugggcacugaaguucugccuaagccuauggauagcaccauugugaguggaccuaug

SEQ ID NO: 98192 - RNA, 45 nt, Mus musculus
cccagauagcugagauauucaacucuguacaaacugagccccaga

SEQ ID NO: 98193 - RNA, 47 nt, Mus musculus
caaaaaugcuggagacacacucaaauugugcaguauucuuacagagu

SEQ ID NO: 98194 - RNA, 46 nt, Mus musculus
aagaguacuagaguuauaacagugcaggaauauuuacaacggcaga

SEQ ID NO: 98195 - RNA, 46 nt, Mus musculus
aaaagaacuggaacauaauucuagcagccaugguaaagacuucaag

SEQ ID NO: 98196 - RNA, 74 nt, Mus musculus
agaugccucuccagguaaaagaacaaaggaaacaguacuugaaucgaguugcguuuaaaugcacagaacgggaa

SEQ ID NO: 98197 - RNA, 53 nt, Mus musculus
agcauaugucucaccaaauuggauagugcauccaagaagcuuaguauagagaa

SEQ ID NO: 98198 - RNA, 46 nt, Mus musculus
uuuuuugcaggcucauucauucaguucccugaacaagguaggcaag

SEQ ID NO: 98199 - RNA, 46 nt, Mus musculus
gccucuacuaccucccacauacugaagguuuaugugcugcugagag

SEQ ID NO: 98200 - RNA, 46 nt, Mus musculus
ugaauguacugucuuggguuugugcauugagaauuagaagguagaa

SEQ ID NO: 98201 - RNA, 45 nt, Mus musculus
ucuuagucacugagucaucucucucuagcuccaaauugaacaaag

SEQ ID NO: 98202 - RNA, 46 nt, Mus musculus
uuucuguauuuucuccauuuuguuugguuauuuguuugguuuugag

SEQ ID NO: 98203 - RNA, 46 nt, Mus musculus
aagagaagccucagugcagaugaauuugaaauacuacaaaacccag

SEQ ID NO: 98204 - RNA, 44 nt, Mus musculus
uuuucagaagucuuguuuuauacuuuuguuaaagugaauggagu

SEQ ID NO: 98205 - RNA, 42 nt, Mus musculus
gcgccucugaggccgcagaaccggagucucuugcugcgcgag

SEQ ID NO: 98206 - RNA, 46 nt, Mus musculus
cauuguuuucaccaauagaaaaauuacccaagaaaugaaugcauaa

SEQ ID NO: 98207 - RNA, 41 nt, Mus musculus
uacaagccauuuagugugugugugugugugugugugugugu

SEQ ID NO: 98208 - RNA, 42 nt, Mus musculus
gaauaugguacuauuuagggaggauugauaagguggcucaag

SEQ ID NO: 98209 - RNA, 42 nt, Mus musculus
cccacucuagaucuuggugugaagccaggaugauucaggcag

SEQ ID NO: 98210 - RNA, 46 nt, Mus musculus
uuacauucugauccagugguaguagagauagaugauagauagauag

SEQ ID NO: 98211 - RNA, 46 nt, Mus musculus
gaacagcccgugcucuuaccugcugaacaguuuuuccagcccccuc

SEQ ID NO: 98212 - RNA, 70 nt, Mus musculus
augugcuuaaaaacaaagcaagguuauggaauaauaaaccuaucaggagcuagugggagagguaauauua

SEQ ID NO: 98213 - RNA, 36 nt, Mus musculus
acagguauaauaugccuuaucugcaguaauugguug

SEQ ID NO: 98214 - RNA, 46 nt, Mus musculus
augcuucauuugcaagaagaggaauucuaggugcuagcuagacaua

SEQ ID NO: 98215 - RNA, 46 nt, Mus musculus
acuggggacuaguuuguuuaguagguaggaaaaaagugcuggcuag

SEQ ID NO: 98216 - RNA, 45 nt, Mus musculus
ggagucauaaagaugagugagauuugguagaggaagaagaaaaua

SEQ ID NO: 98217 - RNA, 46 nt, Mus musculus
cagggcaggcagaggaagaaaacucagagaaugcugagaggugcag

SEQ ID NO: 98218 - RNA, 46 nt, Mus musculus
auucaaucagccaggcagugguggugcacaccuuuaaucccagcac

SEQ ID NO: 98219 - RNA, 45 nt, Mus musculus
ggcggccggucuccucgcggcuguggcacagcugcgcugguggcg

SEQ ID NO: 98220 - RNA, 45 nt, Mus musculus
auucuaugaggccacaguuacccugauaccaacaccacacauacu

SEQ ID NO: 98221 - RNA, 41 nt, Mus musculus
ugugugugugugugugagugugugugugugagugaguguac

SEQ ID NO: 98222 - RNA, 46 nt, Mus musculus
acacaguggcugcccucugggaaagggaggaaaggagagauggggg

SEQ ID NO: 98223 - RNA, 42 nt, Mus musculus
guucucagucucggacaucccaaacaccucuggacaccucag

SEQ ID NO: 98224 - RNA, 42 nt, Mus musculus
cagcaggccuugaugguuuuagagcuuuauuguagaaaggca

SEQ ID NO: 98225 - RNA, 45 nt, Mus musculus
caggaaguucugccuuccauggaguaaccagauauuggccaucag

SEQ ID NO: 98226 - RNA, 46 nt, Mus musculus
uguuauauauaacauauuaagcauuuuguauuuuuaugucaauagg

SEQ ID NO: 98227 - RNA, 46 nt, Mus musculus
auagacucugccuguauuucccagaauguguuuuuacuuauccuag

SEQ ID NO: 98228 - RNA, 46 nt, Mus musculus
cuuguuggcauugaaguuuucuuuaucaauguugcuauaguuuuag

SEQ ID NO: 98229 - RNA, 46 nt, Mus musculus
cagaaaauaguaaaauguggguuaaucagaagcaagagucuauuga

SEQ ID NO: 98230 - RNA, 74 nt, Mus musculus
caccaaacccggacacuauuguggaugccaagaaaugcuugcuaaaaggagccugauauagcugucuccugaug

SEQ ID NO: 98231 - RNA, 80 nt, Mus musculus
aauuauaaauacagaggcggaugcucgcagccaaccauuggacugagugugagauucccaacggaggaguuagagaaagg

SEQ ID NO: 98232 - RNA, 47 nt, Mus musculus
ugaaggcucgauggaugccccacaguauaggggaauugauggggggg

SEQ ID NO: 98233 - RNA, 89 nt, Mus musculus
agugaguggguggauggguggaggaacauccucauagaagcagggggaagggaauaggggaugggauagaggguuucugggagggggga

SEQ ID NO: 98234 - RNA, 36 nt, Mus musculus
aaccaaaaaaaaaagaaaagagagagagagagagag

SEQ ID NO: 98235 - RNA, 45 nt, Mus musculus
ugaacaaaggaauuuaggcucuuuaccagacauguuaaauacaaa

SEQ ID NO: 98236 - RNA, 46 nt, Mus musculus
uagacaauacaaagaggguagagaacuucuccuguaggggccauag

SEQ ID NO: 98237 - RNA, 46 nt, Mus musculus; identical to SEQ ID NO: 98236

SEQ ID NO: 98238 - RNA, 45 nt, Mus musculus
aaggccccaauguauuagccagacccaagguuuaaaugcucaagc

SEQ ID NO: 98239 - RNA, 45 nt, Mus musculus
gugcugggauuaaaggcgugugccaccacucccggccaggcccag

SEQ ID NO: 98240 - RNA, 45 nt, Mus musculus
guugaacccuuguuauaaguagguugcaaaaaauuuaugccucca

SEQ ID NO: 98241 - RNA, 46 nt, Mus musculus
gcuacuuaucuuugaauacugucugugcuacuuuauucacccacag

SEQ ID NO: 98242 - RNA, 46 nt, Mus musculus
aguaaugaaguaaaacauccuguuuuaugagaacaauaagaaacac

SEQ ID NO: 98243 - RNA, 41 nt, Mus musculus
uaugaguaguaggacugugugaaggaagagaaccacuggga

SEQ ID NO: 98244 - RNA, 45 nt, Mus musculus
aguggggaaaaggaacaaaugagaacaaagaaaagaauucacgua

SEQ ID NO: 98245 - RNA, 45 nt, Mus musculus
uugaaacuagcgccaucuuguaauggcguuuguggcuucccacaa

SEQ ID NO: 98246 - RNA, 46 nt, Mus musculus
aucuauggccaauaucagucaauacauguguuuacaauguguuuaa

SEQ ID NO: 98247 - RNA, 45 nt, Mus musculus
ccuauaguaaccuaggcagaugccuuuaaaacaaauaauaugugc

SEQ ID NO: 98248 - RNA, 80 nt, Mus musculus
ccuaaaggaugugucccagugaacuaacuucuucagucuucuaaagguuucaccacuucccaaagcccucaagaugcgag

SEQ ID NO: 98249 - RNA, 46 nt, Mus musculus
acagaccacuaaggaaugcugagaguggaagaaauacccuuuucua

SEQ ID NO: 98250 - RNA, 46 nt, Mus musculus
uggcuagcuuugugguuuaugucauccacccuguuuuuaaggagag

SEQ ID NO: 98251 - RNA, 46 nt, Mus musculus
cccugugucugacuuauucagugaguugaacauuucagaaauacag

SEQ ID NO: 98252 - RNA, 46 nt, Mus musculus
aguccaacuaagacucccacaaucucuccuguuauuacugccccac

SEQ ID NO: 98253 - RNA, 46 nt, Mus musculus
ugaugacugauuuauuuuccauuuuugaguuuuaccugagugugag

SEQ ID NO: 98254 - RNA, 46 nt, Mus musculus
gucacacaguuggaugagaugcagagacaguuagcagcugcagaag

SEQ ID NO: 98255 - RNA, 42 nt, Mus musculus
uuccccuuccaugagugaacucauccaagggcaucggcucag

SEQ ID NO: 98256 - RNA, 46 nt, Mus musculus
cucaaaaccagucaggagagggagagagggagggagagaaagagag

SEQ ID NO: 98257 - RNA, 44 nt, Mus musculus
guugugagccaccaugugguugcuaggauuugaacucaggcccu

SEQ ID NO: 98258 - RNA, 42 nt, Mus musculus
gcagauaaagauaaaagaaguugugugggcugaugugggcag

SEQ ID NO: 98259 - RNA, 46 nt, Mus musculus
ugguagaguccaggcauaacguuuuugaggaccaaacauaccagag

SEQ ID NO: 98260 - RNA, 25 nt, Mus musculus
cuuuuggucauggccauuuauuaua

SEQ ID NO: 98261 - RNA, 46 nt, Mus musculus
guuagaaagaaagaaagagagagagagagagagagagagagaaucu

SEQ ID NO: 98262 - RNA, 46 nt, Mus musculus
auagaaguaauaccuauaauccuagcacucagagcugacaccauua

SEQ ID NO: 98263 - RNA, 46 nt, Mus musculus
acgcccucuucuggaaugucuaaagacagcuacaguguacuuacau

SEQ ID NO: 98264 - RNA, 31 nt, Mus musculus
caauguaaaauagauaugcuguaaaaucauc

SEQ ID NO: 98265 - RNA, 45 nt, Mus musculus
uuggugcugcuccugugugugugugugugugugugugugugugug

SEQ ID NO: 98266 - RNA, 46 nt, Mus musculus
ucgagggaggucacuuuuacuggaccuacaauauaaaucaugguag

SEQ ID NO: 98267 - RNA, 46 nt, Mus musculus
aucaucuguuuugauucuguuuuauuuuacaguggugcaggguuaa

SEQ ID NO: 98268 - RNA, 46 nt, Mus musculus
ugcccuaccucuggcuagcaaguuguuguuguuguagugguggcgg

SEQ ID NO: 98269 - RNA, 50 nt, Mus musculus
gugagcacaggguuacugccaacaaccgggagaagcagggggcugagcag

SEQ ID NO: 98270 - RNA, 70 nt, Mus musculus
aguagaauuggugaugugaaggauuuacuaaugcuuagugucggaggccagcuccggcgaucuaagguag

SEQ ID NO: 98271 - RNA, 45 nt, Mus musculus
cucaggggaacucaggcuacuacuacaaauucacuuagauuuaag

SEQ ID NO: 98272 - RNA, 45 nt, Mus musculus
ccccggagggccugucuccgucgcuggguaagaugguuuuugcug

SEQ ID NO: 98273 - RNA, 44 nt, Mus musculus
aguguacccugagggccacuucauuuucacugacuguccgccga

SEQ ID NO: 98274 - RNA, 46 nt, Mus musculus
auguuuugugaugaaaacauuaaauuuuuuuaaacauuuuacagau

SEQ ID NO: 98275 - RNA, 76 nt, Mus musculus
acuugaacuugaucuucugaacauuauuauuuauggagagagagaaaacacaugugucacaguguuuguggaguuc

SEQ ID NO: 98276 - RNA, 46 nt, Mus musculus
gguaucuuuaggucaaggaaaaguuugaauauuugugggcuguaga

SEQ ID NO: 98277 - RNA, 46 nt, Mus musculus
uguggggcggguugggaaggcaguacugggaauugaacuuagaguc

SEQ ID NO: 98278 - RNA, 45 nt, Mus musculus
ugggcaucaguuuccuucccuucccuucccuuucccuuuccuccc

SEQ ID NO: 98279 - RNA, 42 nt, Mus musculus
uaggauuugcuaucuacuuuggauaugggauacagcacagcu

SEQ ID NO: 98280 - RNA, 45 nt, Mus musculus
aaugacuucugggaccugguuucgcuuuggaaucuggauggugau

SEQ ID NO: 98281 - RNA, 103 nt, Mus musculus
agcuauucucuggggacccaguuuugauugccauggcugcuucacuauugcuucuuacugucggagugaucacugucaucuggagacagccucagagcaccac

SEQ ID NO: 98282 - RNA, 25 nt, Mus musculus
gggaugccagggauugcaaggacac

SEQ ID NO: 98283 - RNA, 46 nt, Mus musculus
aaauuaggucuuacuuuauguguauguguuuugccugccugcaugu

SEQ ID NO: 98284 - RNA, 97 nt, Mus musculus
gccagguguuugugguacccugucccucuccagcuuucugcugagauccacuaauguagaauuagcuucuacuucuacuucuacaugcauacggagg

SEQ ID NO: 98285 - RNA, 46 nt, Mus musculus
gggccaggguaccaugcucggguuccgcauaucucuacagcuaugu

SEQ ID NO: 98286 - RNA, 46 nt, Mus musculus
auucugagagaggguuucucuguauaacccuggcuauccuggaacu

SEQ ID NO: 98287 - RNA, 46 nt, Mus musculus
cugguaagucacuuggaagacuguuucauaucgcuuuguuguaggu

SEQ ID NO: 98288 - RNA, 46 nt, Mus musculus
aaacccgugcugauucaccggcaucggccgcugcaacacgcuagcc

SEQ ID NO: 98289 - RNA, 42 nt, Mus musculus
gugaagcauuucgauucgcggcuccuccgggacgccccagcu

SEQ ID NO: 98290 - RNA, 42 nt, Mus musculus
gcagcggauugcagcuucugggagcgguuguuggcucggcag

SEQ ID NO: 98291 - RNA, 45 nt, Mus musculus
augaucuguggcugggauaagagaggcccuggccucuacuacgua

SEQ ID NO: 98292 - RNA, 67 nt, Mus musculus
uuccaccuuccaaauacuuucaagauucuuccugcccccacccugccuccugccuaucuccccucca

SEQ ID NO: 98293 - RNA, 45 nt, Mus musculus
ucauuuugguaugaaaacgauacagaacugaguguaguggcccau

SEQ ID NO: 98294 - RNA, 49 nt, Mus musculus
ucacaaccaucuguaacaagaccugaugcccucuucuggugucugaaga

SEQ ID NO: 98295 - RNA, 36 nt, Mus musculus
auuuucaauccacuugcuucucagacucacaugaaa

SEQ ID NO: 98296 - RNA, 45 nt, Mus musculus
uguauugguguuuugccuguauauguguuugugugagggugucag

SEQ ID NO: 98297 - RNA, 46 nt, Mus musculus
uuccuggcccuggaggucacugugccccaagugggguggcccaacc

SEQ ID NO: 98298 - RNA, 49 nt, Mus musculus
cucuuuuuuuucuugguagaugauuuuggguugcuugagguaggauggg

SEQ ID NO: 98299 - RNA, 45 nt, Mus musculus
cagguuguuggcauccacaaugacucgguacucaggagcugccuc

SEQ ID NO: 98300 - RNA, 45 nt, Mus musculus
gggacuccacauacucauagaugcgguguuuggaggcauucagcu

SEQ ID NO: 98301 - RNA, 42 nt, Mus musculus
uaaccaguaugaggcaacacugagguagaagagaagccagac

SEQ ID NO: 98302 - RNA, 23 nt, Mus musculus
acugaaccucugaccugggcuau

SEQ ID NO: 98303 - RNA, 46 nt, Mus musculus
auucucugucaucagagucuaagcuuccuaaccccacagccccccu

SEQ ID NO: 98304 - RNA, 45 nt, Mus musculus
guaaacuguccccucagccaacaucuauauaucaucaacccaucu

SEQ ID NO: 98305 - RNA, 46 nt, Mus musculus
uucuuuccaguagagagauuugaaaccaaggcuuaacaugcuaggg

SEQ ID NO: 98306 - RNA, 44 nt, Mus musculus
gaacucaacaaucagaacacucaccuacgaacucaggcccgaga

SEQ ID NO: 98307 - RNA, 46 nt, Mus musculus
gucacauagguuuugcgacaaacccagcuucuggcgaccggcaugu

SEQ ID NO: 98308 - RNA, 41 nt, Mus musculus
auuaauccucuuccucaucaucaccagcuccagccccgccc

SEQ ID NO: 98309 - RNA, 44 nt, Mus musculus
aaauuuuuuuuuggcggggggguggggguagagaaaggacugag

SEQ ID NO: 98310 - RNA, 41 nt, Mus musculus
ggccuccagaaccccauggggccaagagucccccacccgga

SEQ ID NO: 98311 - RNA, 46 nt, Mus musculus
ggguguguguuugggaguauauggggguugggcgcccuauagccaa

SEQ ID NO: 98312 - RNA, 42 nt, Mus musculus
ggauguugaaaaaggcccagugggggugaggcacagccccag

SEQ ID NO: 98313 - RNA, 45 nt, Mus musculus
ucugggcacaaugucuuuuacaaaagaauagggucuagggcauuu

SEQ ID NO: 98314 - RNA, 42 nt, Mus musculus
caguccaagcauuaaggaaaccagcuccugcccucaggccag

SEQ ID NO: 98315 - RNA, 101 nt, Mus musculus
ucccaccuucacucacggucuccucagucuccagaagccccagacuccagaucucaggcaccuggcgcuccuuaauccugcuucaccacccccugccccac

SEQ ID NO: 98316 - RNA, 47 nt, Mus musculus
uuuaucccucguccacaacccuaggcuuccgguaaccaccaccccag

SEQ ID NO: 98317 - RNA, 42 nt, Mus musculus
auggaagaacacuugccucgaaucugcugauaaaggauugag

SEQ ID NO: 98318 - RNA, 46 nt, Mus musculus
cuagaauccccccagugaaggguugggguguggcucacuuaccuag

SEQ ID NO: 98319 - RNA, 45 nt, Mus musculus
caggggaccugguggcacuuccuccauggguuuguuguggcgacc

SEQ ID NO: 98320 - RNA, 46 nt, Mus musculus
cuaucacacccacaggcauuuugccccuuucccauccugccuggau

SEQ ID NO: 98321 - RNA, 45 nt, Mus musculus
ggaagugggcccugggccuccguggucacaggguuggacuggagg

SEQ ID NO: 98322 - RNA, 56 nt, Mus musculus
gagggaggagaggaaggaaggggaacagaaggagggagagagaaaggaacgagggg

SEQ ID NO: 98323 - RNA, 41 nt, Mus musculus
uuccaacagguuaggaaugugggcaaaagacauggguguug

SEQ ID NO: 98324 - RNA, 42 nt, Mus musculus
uauuucccacaacauaggggcacgaacccacgacccugagau

SEQ ID NO: 98325 - RNA, 42 nt, Mus musculus
uguaugagcagucgaugcagugggaagugaggauagggagau

SEQ ID NO: 98326 - RNA, 46 nt, Mus musculus
ucauuccaucuguccaauaacagcuggugauccuuucugcacacaa

SEQ ID NO: 98327 - RNA, 46 nt, Mus musculus
ugcagccuuccaacccacuccuauuuuaucucaguuccccacuccc

SEQ ID NO: 98328 - RNA, 45 nt, Mus musculus
cugggucugagguccuaggggaacagggaugagucuuggccauga

SEQ ID NO: 98329 - RNA, 45 nt, Mus musculus
cccuguuuccugccauaccccagcgaucucaaccuauggcacuaa

SEQ ID NO: 98330 - RNA, 46 nt, Mus musculus
uagaagcaaugcagugcugagccuggacaagaggagaguugccuuu

SEQ ID NO: 98331 - RNA, 45 nt, Mus musculus
gcuucuauaaguaacaugugaauccugacaagggggaagaagcag

SEQ ID NO: 98332 - RNA, 46 nt, Mus musculus
gaaucaacuugcuuccuagcagcucacacccagcacaagacuccag

SEQ ID NO: 98333 - RNA, 45 nt, Mus musculus
ggugauaugaagggggaagguuuaaggaagauauuauaaauccag

SEQ ID NO: 98334 - RNA, 45 nt, Mus musculus
caggcucucucccagcugaccaggagcagcgaggcacagcauuac

SEQ ID NO: 98335 - RNA, 45 nt, Mus musculus
gacccaggcagaggcucucggcuccagucgaugguguaggcagag

SEQ ID NO: 98336 - RNA, 44 nt, Mus musculus
ucgugggagaccuggaugaggagcgggagcgugaauccgugcug

SEQ ID NO: 98337 - RNA, 36 nt, Mus musculus
ugccuugcaccugggcaguagaaaagagcagaguca

SEQ ID NO: 98338 - RNA, 42 nt, Mus musculus
guccacaagguagccagacaugcaaggugcauggcaauagag

SEQ ID NO: 98339 - RNA, 46 nt, Mus musculus
cguuaguggaggugacaggugcacacagaaccuguagccccgcccc

SEQ ID NO: 98340 - RNA, 42 nt, Mus musculus
aggcagccgaggcaauggguguggccggcuggugccccacug

SEQ ID NO: 98341 - RNA, 39 nt, Mus musculus
ugaagguggggcauagucuuuaaguggcuucccucaccc

SEQ ID NO: 98342 - RNA, 45 nt, Mus musculus
agggaaagaaaaaaaaaaaaucagaagaaacauuggggcagaggg

SEQ ID NO: 98343 - RNA, 46 nt, Mus musculus
aaagaagggaggguaaccauuuuaccuguguugaaccagggagugg

SEQ ID NO: 98344 - RNA, 46 nt, Mus musculus
cagcuguuugcaaccucauagcacauccuccaguuacauggcagaa

SEQ ID NO: 98345 - RNA, 51 nt, Mus musculus
uugaaagagaaacaagggauuucauuauaauagcagugaguguuaaaggug

SEQ ID NO: 98346 - RNA, 42 nt, Mus musculus
cugggggaagggcacagcagagaaggagguggggggacagag

SEQ ID NO: 98347 - RNA, 46 nt, Mus musculus
cagacagugaaacaaaaaacaaacacaaauugacacauagacagau

SEQ ID NO: 98348 - RNA, 46 nt, Mus musculus
gagcuuuauuguagaaaggcagggggaaggagagaagguagacaga

SEQ ID NO: 98349 - RNA, 46 nt, Mus musculus
caccacaacagcuuuauaauaggauguuaaaacuuuauuuggagau

SEQ ID NO: 98350 - RNA, 45 nt, Mus musculus
aaaaaaaaaaacaaaaaaaagaaaagaaaagagagaaagagagaa

SEQ ID NO: 98351 - RNA, 46 nt, Mus musculus
agaagauauuguuuaaagucacaauagcuugucccugaggaugaua

SEQ ID NO: 98352 - RNA, 46 nt, Mus musculus
cuuggcauccaaauuuuaaaauuuuaaaaauaaaaacaugauuuaa

SEQ ID NO: 98353 - RNA, 85 nt, Mus musculus
auagacaaggaaaggugggucaagaacauauguccaauacagcauuccugucaccguugucagggcacucagcaagcucacgguu

SEQ ID NO: 98354 - RNA, 46 nt, Mus musculus
aguacacuguagcugucuucagacauuccagaagagggcaccagau

SEQ ID NO: 98355 - RNA, 41 nt, Mus musculus
gaaaaaggcgccagagaggccaggagggaccccagcuuaag

SEQ ID NO: 98356 - RNA, 46 nt, Mus musculus
ggguugagccagauucuguggucaccugggguacaauuaugagcau

SEQ ID NO: 98357 - RNA, 67 nt, Mus musculus
cagcuggcggcccagcccagcacauaucuggccguggcagaagaacuggagaauguuucggggaagu

SEQ ID NO: 98358 - RNA, 46 nt, Mus musculus
gccugagacacaugcccugccugagacacaugccccugccugagac

SEQ ID NO: 98359 - RNA, 46 nt, Mus musculus
caaacacugggauuugccucccagcacucugcacauagaggcagag

SEQ ID NO: 98360 - RNA, 66 nt, Mus musculus
cuguggcaggcauucauaaugcccgagucacuuagugggcauguauuaagaauuuuagcgugagaa

SEQ ID NO: 98361 - RNA, 46 nt, Mus musculus
ggagagugaagggaggagaggcugcgguugggaucaacggugugag

SEQ ID NO: 98362 - RNA, 45 nt, Mus musculus
gagugccuguuugcaagugugugugagcaugugcacaugugugug

SEQ ID NO: 98363 - RNA, 45 nt, Mus musculus
gaugguuaugagccaccaugugguuauugagaauugaacucagga

SEQ ID NO: 98364 - RNA, 45 nt, Mus musculus
uggugcccugugaggcuggaauuggguaucagaucccguaggaua

SEQ ID NO: 98365 - RNA, 46 nt, Mus musculus
uuuagugaggguuucuguugcugaaaugaaacacgaugaccuagag

SEQ ID NO: 98366 - RNA, 45 nt, Mus musculus
gccaggauuaaagaccugugccacuaggcucagcagugacuuauu

SEQ ID NO: 98367 - RNA, 42 nt, Mus musculus
gacuguacggaugacugugagccagcaugugggagcugagaa

SEQ ID NO: 98368 - RNA, 45 nt, Mus musculus
gcuuauuucagaacugggucugaaguugaaggguaauggagaagg

SEQ ID NO: 98369 - RNA, 46 nt, Mus musculus
ccaggauuaaaggcaugcaccaccguaccugucccuguccccaucu

SEQ ID NO: 98370 - RNA, 42 nt, Mus musculus
uguggggugcugggagcugauccuggguccucuguaagagca

SEQ ID NO: 98371 - RNA, 47 nt, Mus musculus
acauuuccaauguggaaguaggaaugaaugcaauguuuggggagcag

SEQ ID NO: 98372 - RNA, 48 nt, Mus musculus
gugccacugggcaauggggcgccugggguuggccaacaugucagccca

SEQ ID NO: 98373 - RNA, 41 nt, Mus musculus
cucauaggcacccgcaccuccccgauggcaucguugcggga

SEQ ID NO: 98374 - RNA, 41 nt, Mus musculus
guucucgugaccggcucggcccccacuucuuucucgacccc

SEQ ID NO: 98375 - RNA, 46 nt, Mus musculus
accaauuauaaugacagauaugacgagauccgucgccacaggggag

SEQ ID NO: 98376 - RNA, 42 nt, Mus musculus
cugacguuggggccuugagauggcaggggucugagacuugug

SEQ ID NO: 98377 - RNA, 30 nt, Mus musculus
ggggaggcuugggaaagaagaaaaauugag

SEQ ID NO: 98378 - RNA, 45 nt, Mus musculus
gacauaccagaaggccagagagucagaauaaaaggccaggagagg

SEQ ID NO: 98379 - RNA, 45 nt, Mus musculus
gugcugaugaagguggguguuugugugugugugugugugugugug

SEQ ID NO: 98380 - RNA, 42 nt, Mus musculus
ucaugcuggacaaguaaaucgcucccuuuguguaggccucaa

SEQ ID NO: 98381 - RNA, 45 nt, Mus musculus
cucagggaaaaccaagaaaagaugaucuauuauuugcuuuuggau

SEQ ID NO: 98382 - RNA, 45 nt, Mus musculus
uuccuacuuaauaccauucccgcagcccuuugcuguaggacugug

SEQ ID NO: 98383 - RNA, 46 nt, Mus musculus
ucuuccaauucuuaguuccuugucaauuuuaauauguuauggucag

SEQ ID NO: 98384 - RNA, 45 nt, Mus musculus
aggaaauuguguucagagacuggaaggccaaggucaaggcagcaa

SEQ ID NO: 98385 - RNA, 42 nt, Mus musculus
acacacacacacagaggaagaagagggaaugauggcuggcag

SEQ ID NO: 98386 - RNA, 42 nt, Mus musculus
guccccacacaaaauaaauacauuaaaaagaaagaaaggaag

SEQ ID NO: 98387 - RNA, 42 nt, Mus musculus
cugacccugaucugaguagcucuccccgccgaggacccccua

SEQ ID NO: 98388 - RNA, 46 nt, Mus musculus
uccucacuuccuacauuauuuauuaaacgauuacuuuuuauauuaa

SEQ ID NO: 98389 - RNA, 51 nt, Mus musculus
caaccaucuguaauggaucugaugcccucuucggguacaucugaagacagc

SEQ ID NO: 98390 - RNA, 42 nt, Mus musculus
uuucugguuuacagagugaguuccaggauagccagggcuaca

SEQ ID NO: 98391 - RNA, 44 nt, Mus musculus
cagcuucuuucucaccagagagacaaauucccagcugacggaga

SEQ ID NO: 98392 - RNA, 33 nt, Mus musculus
gaaucuagaccccaguccuacucccucagaccc

SEQ ID NO: 98393 - RNA, 41 nt, Mus musculus
aauuuuggucuugaaggacuguggucuggacuuuacggucu

SEQ ID NO: 98394 - RNA, 42 nt, Mus musculus
ccggugcgcaucugucuggcucuuuaagcucucuguccgcac

SEQ ID NO: 98395 - RNA, 42 nt, Mus musculus
gcccugcuaggcagccggcucgucugaauggaaaaggcagga

SEQ ID NO: 98396 - RNA, 46 nt, Mus musculus
acguauauaaaaagcugagcauguguaacugcagcccugugggugg

SEQ ID NO: 98397 - RNA, 42 nt, Mus musculus
uucccucuugaggaggcuucugggaauauaugugagcugauu

SEQ ID NO: 98398 - RNA, 42 nt, Mus musculus
cccucucaggaggguuaaauaccugagaaccugggccugagg

SEQ ID NO: 98399 - RNA, 46 nt, Mus musculus
aacccucauuuuuauauagguggaaaaaauaugugauguccuacaa

SEQ ID NO: 98400 - RNA, 45 nt, Mus musculus
agccccauuguuagagaaggguuuccucagcaaccagaugagagg

SEQ ID NO: 98401 - RNA, 46 nt, Mus musculus
aaccuagcaacagcugggcuccgccccaaaagcuucagccccaaaa

SEQ ID NO: 98402 - RNA, 44 nt, Mus musculus
gguggggaggggaagacucagaaggccaggucccaauucuggaa

SEQ ID NO: 98403 - RNA, 44 nt, Mus musculus
uuucaauaaagccauaguggggagaggucuugagggugggccag

SEQ ID NO: 98404 - RNA, 45 nt, Mus musculus
gugagggcagaucccaggaaggaaggaauucagguuuggggaggg

SEQ ID NO: 98405 - RNA, 44 nt, Mus musculus
cccuagaauggaugcggagcccauggagcaucuauuaguuggga

SEQ ID NO: 98406 - RNA, 45 nt, Mus musculus
auuugguggggggagggagacauaagagggagagggcggcccaga

SEQ ID NO: 98407 - RNA, 46 nt, Mus musculus
gaguggggaauggccgccccccugaaacauggcuauauguacagag

SEQ ID NO: 98408 - RNA, 42 nt, Mus musculus
ucaucuuggugaccucuccacagcagcagcagagggggagcu

SEQ ID NO: 98409 - RNA, 46 nt, Mus musculus
ugauuaugguagacccuaagccauggagacacugggguugaaguag

SEQ ID NO: 98410 - RNA, 76 nt, Mus musculus
ucugggagauggugaggacuguaugguugugauugcugggagaugaagacccccuggcugugauggaugcugggag

SEQ ID NO: 98411 - RNA, 75 nt, Mus musculus
cauuacaaggcuuaucauacacaccaaggcucugagaccagaugggcccuuggaccggagaccacgccuccuuuu

SEQ ID NO: 98412 - RNA, 41 nt, Mus musculus
gcccccaggcccuagcagcagguuggagugugaggcagcca

SEQ ID NO: 98413 - RNA, 45 nt, Mus musculus
gagcaccugcugucacccccacgaaguccugcacugcccccagau

SEQ ID NO: 98414 - RNA, 42 nt, Mus musculus
agccucauaggacgggggaagaugagagagguuguggaagga

SEQ ID NO: 98415 - RNA, 24 nt, Mus musculus
cauagcacgccagucuguggccga

SEQ ID NO: 98416 - RNA, 45 nt, Mus musculus
uuggguauuggggugaauguggaaaagggacaucucacccccaac

SEQ ID NO: 98417 - RNA, 72 nt, Mus musculus
gcuaggguugcaggcaugacccacugugugaagccucaagcuagauccugagagagauuucauucaaauagg

SEQ ID NO: 98418 - RNA, 46 nt, Mus musculus
gaugguugugagccaucacgugguugcugggauuugaacucaggac

SEQ ID NO: 98419 - RNA, 41 nt, Mus musculus
caguaggcaggaaaaguucuggucuuauuugagccaggaaa

SEQ ID NO: 98420 - RNA, 45 nt, Mus musculus
ucaaauaagaccagaacuuuuccugccuacugugaccucggggag

SEQ ID NO: 98421 - RNA, 46 nt, Mus musculus
aagaaauguccacagcugauggauggagacuggaauggggucaggg

SEQ ID NO: 98422 - RNA, 45 nt, Mus musculus
ucuagauauugacaagugcugugcagaaaacaaagcaauguaaaa

SEQ ID NO: 98423 - RNA, 43 nt, Mus musculus
aaguguugcaguuccgcuauucuguaaguuaggcgccaagaaa

SEQ ID NO: 98424 - RNA, 42 nt, Mus musculus
gcuauuagcuacagcaguggugaccccuggcuggcccuggga

SEQ ID NO: 98425 - RNA, 46 nt, Mus musculus
ggugacggggguuccgggaaugcucacacaaauggaacaggagaaa

SEQ ID NO: 98426 - RNA, 51 nt, Mus musculus
uauuugaagaccaagauugauugucuaaacuaaaacuagagagaccucaga

SEQ ID NO: 98427 - RNA, 47 nt, Mus musculus
acagcguggauacacuagacacaggauuuguuuucuaacugcagugg

SEQ ID NO: 98428 - RNA, 45 nt, Mus musculus
ggaauacaagcacuccgguacuggguaacugagauggugccuuaa

SEQ ID NO: 98429 - RNA, 46 nt, Mus musculus
uugggaaacuaucacccgcuuuuaaggaaauaacccccuuuuagga

SEQ ID NO: 98430 - RNA, 42 nt, Mus musculus
ggcaggccuguaaucccagcgcgcagaugaaggcagcaggau

SEQ ID NO: 98431 - RNA, 46 nt, Mus musculus
uccuagcugcagauggcugacucucccuucugugaccaccuuagcc

SEQ ID NO: 98432 - RNA, 42 nt, Mus musculus
aagcaaaguuaggagggccuggaguggcaggugggggcugug

SEQ ID NO: 98433 - RNA, 41 nt, Mus musculus
aagggcgcucggcagaaugagugcgcuggugcagcagcagg

SEQ ID NO: 98434 - RNA, 23 nt, Mus musculus
caccccagaccuuccagcgaaga

SEQ ID NO: 98435 - RNA, 41 nt, Mus musculus
cacccaaugggccagacugggaccaccccauccgcuggcuu

SEQ ID NO: 98436 - RNA, 42 nt, Mus musculus
uggaagggagauuugaggaaagagagagagagagagagagag

SEQ ID NO: 98437 - RNA, 42 nt, Mus musculus
ccccaccggggcuggaaggcccauaucugcucucaugaggag

SEQ ID NO: 98438 - RNA, 42 nt, Mus musculus
cuagcuccccaaccagcagcaagcucccagaauggcccccgg

SEQ ID NO: 98439 - RNA, 46 nt, Mus musculus
cgccccugggggugccagauuuggaccuggugagggaccugugugg

SEQ ID NO: 98440 - RNA, 44 nt, Mus musculus
ucagcacgacugucaccaccgggaggaugcuggggccgugugug

SEQ ID NO: 98441 - RNA, 42 nt, Mus musculus
ugagcugaaggguuaugaggagaagcagagcugagggagcug

SEQ ID NO: 98442 - RNA, 46 nt, Mus musculus
gguauaaacggugcuggauuagcccagcaacaugugugugacaaca

SEQ ID NO: 98443 - RNA, 41 nt, Mus musculus
gccccucgggggcaugggggaagcacaacugugaccacgaa

SEQ ID NO: 98444 - RNA, 43 nt, Mus musculus
ugcgcggccuggacauacacuuuccugggcuaccacuacaaac

SEQ ID NO: 98445 - RNA, 41 nt, Mus musculus
ugcucccugccucuuugugugugucccucugccugccacug

SEQ ID NO: 98446 - RNA, 46 nt, Mus musculus
ucuugggacaauuuuauguaucaaggguuagaagaagguguaguag

SEQ ID NO: 98447 - RNA, 47 nt, Mus musculus
gacccccaccacaaccaagccuggauccacaguuaccacuagcacca

SEQ ID NO: 98448 - RNA, 46 nt, Mus musculus
aggaggggaccucuagcucccccaaaccaucucuacucaccccagg

SEQ ID NO: 98449 - RNA, 46 nt, Mus musculus
cacguuccccagagcuuucaggcagcccaacacccaccuccccuga

SEQ ID NO: 98450 - RNA, 55 nt, Mus musculus
ccagucccucuccagccucaaacuuggacccacuacccacagaugccuucaaacc

SEQ ID NO: 98451 - RNA, 42 nt, Mus musculus
agggaugauggguggguagaugauggaugaauggguggaugg

SEQ ID NO: 98452 - RNA, 42 nt, Mus musculus
gagauggaauuagggguagaaauaggguaagugaaagcaagg

SEQ ID NO: 98453 - RNA, 46 nt, Mus musculus
cugaacacuagauuagacuggcccuuuagguuggacuaacccagau

SEQ ID NO: 98454 - RNA, 95 nt, Mus musculus
cacuggugaccccagaaaaugaguauaaccgaaaucugccuuccgccaauuuugcuuccuguacugaaagaagaucaggguagaugccccccacc

SEQ ID NO: 98455 - RNA, 43 nt, Mus musculus
ggggguggggcaauaucuuagacuccuccaggaaccccucaaa

SEQ ID NO: 98456 - RNA, 45 nt, Mus musculus
uggacugaauaaccaggacaccccugcccacugaguccagagcca

SEQ ID NO: 98457 - RNA, 56 nt, Mus musculus
ucuggguacuggagccggcuaagagaagagagggggcggugucaguguggugaggg

SEQ ID NO: 98458 - RNA, 32 nt, Mus musculus
ucuauaaaucuuucuuaauucagccccauuac

SEQ ID NO: 98459 - RNA, 46 nt, Mus musculus
gccucgcaccuugaaagcauuccuuuaaaguuaguuguuagcaacc

SEQ ID NO: 98460 - RNA, 41 nt, Mus musculus
guuagccaucccacgguauuagggggcaucuacggguaaga

SEQ ID NO: 98461 - RNA, 46 nt, Mus musculus
acaaaguacuaaugcuacacccccuggaagcaauccuacaguagau

SEQ ID NO: 98462 - RNA, 46 nt, Mus musculus
ccuauaacuguccucggguguucucauuuugugugugguguaugau

SEQ ID NO: 98463 - RNA, 45 nt, Mus musculus
ugaagcucagagagaucugguaaauuccucaaaguccccauagcc

SEQ ID NO: 98464 - RNA, 46 nt, Mus musculus
aaagccaauacuguggggagagggaauauuccuugaaugcaaaguu

SEQ ID NO: 98465 - RNA, 46 nt, Mus musculus
cucaguccucugguuuugccacugcaaaaugaagauaagaauagau

SEQ ID NO: 98466 - RNA, 42 nt, Mus musculus
gggugggcccaccacguuucagguucccgaacaggugcuggu

SEQ ID NO: 98467 - RNA, 36 nt, Mus musculus
uccaguugguguugguggcacauccuuguggcagcg

SEQ ID NO: 98468 - RNA, 41 nt, Mus musculus
gcagcggaugcgcgcugagaagugggacaggcaccgcacca

SEQ ID NO: 98469 - RNA, 43 nt, Mus musculus
ugaagacagcuugugucuugggcuugguuggguccagggagag

SEQ ID NO: 98470 - RNA, 86 nt, Mus musculus
acaauugggcggggguaugguaacccucuggggcgggguuuagggaggagccuauggggaaugaggagcgaggccugguugaggcg

SEQ ID NO: 98471 - RNA, 46 nt, Mus musculus
auacauagugaaaacaugccuaaacaauaaaaaguggggagacauu

SEQ ID NO: 98472 - RNA, 45 nt, Mus musculus
agggaggaagggagggaggaaggaaagagggacagagggaaggaa

SEQ ID NO: 98473 - RNA, 45 nt, Mus musculus
uuuccacacacuucuaaaggucuguacagaagagagaggaaugga

SEQ ID NO: 98474 - RNA, 46 nt, Mus musculus
uuggaggccggccugggcuacaugaaaucgcaucugaaaacaagga

SEQ ID NO: 98475 - RNA, 42 nt, Mus musculus
uagaccuucugguuucuuguucccgcacagcuaccccuaacc

SEQ ID NO: 98476 - RNA, 46 nt, Mus musculus
ucccucaggucccucaauacccucagagccuccccaaucuccacag

SEQ ID NO: 98477 - RNA, 46 nt, Mus musculus
guaaccucaggagaacugggguaugugugggagugacgcugugugg

SEQ ID NO: 98478 - RNA, 46 nt, Mus musculus
gaugcacagccuuuaagacacucccccucucccuuccgccccaaaa

SEQ ID NO: 98479 - RNA, 41 nt, Mus musculus
gacccccacagccuuugaagaauaagaaacaugaggcauga

SEQ ID NO: 98480 - RNA, 46 nt, Mus musculus
gccugucagaagaggugacaccaccaugcuguuacuaguuguagau

SEQ ID NO: 98481 - RNA, 45 nt, Mus musculus
ggcugugagaugaaguugagucugauuguuuuguauauggagagu

SEQ ID NO: 98482 - RNA, 45 nt, Mus musculus
acacaugaggagccccauacaggaagagaaaggauaacaagaugg

SEQ ID NO: 98483 - RNA, 46 nt, Mus musculus
auuuaaacucucagaauaauacucugucuuugcaugggaugcagau

SEQ ID NO: 98484 - RNA, 42 nt, Mus musculus
uucccagcauauucccuuccuaguaagaccuggggcccaguu

SEQ ID NO: 98485 - RNA, 42 nt, Mus musculus
gauuccgcgagucuucgcguuccccgacaccagcccccucua

SEQ ID NO: 98486 - RNA, 46 nt, Mus musculus
cugacgcagggcuccagcuucacuuucucacaggucaucuuccuca

SEQ ID NO: 98487 - RNA, 46 nt, Mus musculus
ggcacacugggcuuggauguaguagccaucgcgcagccccccgaac

SEQ ID NO: 98488 - RNA, 42 nt, Mus musculus
ugaacuggaccugcggcucucccugggcggccaucgcggcga

SEQ ID NO: 98489 - RNA, 59 nt, Mus musculus
ucugugccgccgccaugucucuagugaucccugagaaguuccagcacauuuugcgagua

SEQ ID NO: 98490 - RNA, 57 nt, Mus musculus
cgcaaaaugugcuggaacuucucagggaucacuagagacauggcggcggcacagacg

SEQ ID NO: 98491 - RNA, 71 nt, Mus musculus
cucaacaccaacaucgauggguggcagaaaauagccuucgccaucacugccauuaagggcguagggcggag

SEQ ID NO: 98492 - RNA, 53 nt, Mus musculus
agacagguucuggccaacggucuagacaacaagcugcgugaggaccuggagug

SEQ ID NO: 98493 - RNA, 45 nt, Mus musculus
aagucuuugcucagcagacuguuaaggauguguagagaguuagaa

SEQ ID NO: 98494 - RNA, 42 nt, Mus musculus
agacgagaggagaggggaggggaggggaggggaggggagggg

SEQ ID NO: 98495 - RNA, 51 nt, Mus musculus
agaaggaggagaggagaggagaggagaggagaggagaggagaggagaggag

SEQ ID NO: 98496 - RNA, 42 nt, Mus musculus
gaaagucagguuauuguuucugagggacaaaaucggcuagau

SEQ ID NO: 98497 - RNA, 46 nt, Mus musculus
aaaacaguuacauauggauuaaggagaaaaaacacugaauuuggug

SEQ ID NO: 98498 - RNA, 45 nt, Mus musculus
acuggaggcaauuagggacagggacuggagggauugggugggagu

SEQ ID NO: 98499 - RNA, 45 nt, Mus musculus
aguggaaagaucuuggaaggggaaaagaaaaauuaucccagacau

SEQ ID NO: 98500 - RNA, 50 nt, Mus musculus
gaaaaacaaggacaaaaacaccaacccccccccaaaaaaaagaauaaaga

SEQ ID NO: 98501 - RNA, 41 nt, Mus musculus
uccaggacagccagggcuacacagagaaacccuggcuggaa

SEQ ID NO: 98502 - RNA, 45 nt, Mus musculus
cucauauacauaaaauaaauuaaucuuuaaaaauaaagagagaga

SEQ ID NO: 98503 - RNA, 44 nt, Mus musculus
guguguuucugccauguguacagacauggaggugggcaggcaga

SEQ ID NO: 98504 - RNA, 46 nt, Mus musculus
gaauguguguguguguguguguguguguuguguaugguguguggug

SEQ ID NO: 98505 - RNA, 41 nt, Mus musculus
cucagugugucaggugcauugacucagaggagccagguggg

SEQ ID NO: 98506 - RNA, 42 nt, Mus musculus
gcauccuagccuacauuagagaccacugcucagcgggcagag

SEQ ID NO: 98507 - RNA, 46 nt, Mus musculus
gagccucuggacacacucauacucugcuaguugauaagccagaguu

SEQ ID NO: 98508 - RNA, 41 nt, Mus musculus
aauuagugcacaauaaagaaagguugaaaauggcccagaag

SEQ ID NO: 98509 - RNA, 47 nt, Mus musculus
ucagugggaaugauugauagcgugugugugugugugugugugugugu

SEQ ID NO: 98510 - RNA, 50 nt, Mus musculus
gagacagagaccuguuugcgugggucgcucuggugaucugaguugauucg

SEQ ID NO: 98511 - RNA, 85 nt, Mus musculus
uccuucaggagacuccacguguguauaugugugugcgcgagagaagagaaguggaaggggggcgcgggagaagggaagugggagg

SEQ ID NO: 98512 - RNA, 104 nt, Mus musculus
ggggaagggagagggagagaccgacuaggccugugagccccaagaaacaggugcgaauaccaccaacugcgugaugugaccagugugcccuguguaaaggaaga

SEQ ID NO: 98513 - RNA, 72 nt, Mus musculus
cacuacaaggggccgcuaguggauguaggaacagaguucugagcaucucgguuguacuugugugugagugug

SEQ ID NO: 98514 - RNA, 30 nt, Mus musculus
aucucuaugucacuagcugugcugguguga

SEQ ID NO: 98515 - RNA, 46 nt, Mus musculus
gauacagugagccaucagaugacaauggcuuugugagugugugcca

SEQ ID NO: 98516 - RNA, 46 nt, Mus musculus
gugaaaugccuuguacaaugccugggacauacugagugcgguguag

SEQ ID NO: 98517 - RNA, 45 nt, Mus musculus
gagguuugcuguuguguuguuggccuguguacagguaggguugua

SEQ ID NO: 98518 - RNA, 46 nt, Mus musculus
agugugugugucugugucugugucugugucugugucuguuucugaa

SEQ ID NO: 98519 - RNA, 46 nt, Mus musculus
aggcuguggggagaaaaggaagaguugauagcauuuuagggcugaa

SEQ ID NO: 98520 - RNA, 42 nt, Mus musculus
aaauaggugggacacuggcaggaaggcagaggauucugggaa

SEQ ID NO: 98521 - RNA, 43 nt, Mus musculus
ugagacgggagacagaacaaggagauagagguaaacuagcagg

SEQ ID NO: 98522 - RNA, 45 nt, Mus musculus
ugacuaauuagucuuagaguugucauuccaggagacagggccggg

SEQ ID NO: 98523 - RNA, 46 nt, Mus musculus
ccaaaaaagcuucaguucucagguguuugaacaucagaauuaacag

SEQ ID NO: 98524 - RNA, 65 nt, Mus musculus
gaauaugcuuuuaguauuuauagcuuuauagagacacucacuuacuuugaaaguauuguucagcc

SEQ ID NO: 98525 - RNA, 46 nt, Mus musculus
ucacuacuaauccuaacuucuugguguuuuucagaaucagggucua

SEQ ID NO: 98526 - RNA, 46 nt, Mus musculus
aagaguucagucccaagcaaauccaagaaggaacauucaggcaaga

SEQ ID NO: 98527 - RNA, 45 nt, Mus musculus
uuuucaggcagaucuuaucccucauucuucaucagcggguucaca

SEQ ID NO: 98528 - RNA, 42 nt, Mus musculus
uaaaguguuuggccgccagucauuucuuagugaacaucagag

SEQ ID NO: 98529 - RNA, 46 nt, Mus musculus
cauguugaagcccuaauccuucaaugugaugauauuuucaaaugag

SEQ ID NO: 98530 - RNA, 45 nt, Mus musculus
auuguauuuuuuaaauuuguuuuuuaaaauugugugucuguguug

SEQ ID NO: 98531 - RNA, 44 nt, Mus musculus
ccgugcgugugugaaaggaacugggcuguaaguuuucgguguga

SEQ ID NO: 98532 - RNA, 45 nt, Mus musculus
gacaggaguauuguaucccugcauagaaauccugagaggccguug

SEQ ID NO: 98533 - RNA, 45 nt, Mus musculus
guguguguguguguguguguauguguguauguauguguuugugug

SEQ ID NO: 98534 - RNA, 74 nt, Mus musculus
cagucccugccccaaauuccauuguauguacagaccauauuuucuuucuucauucauuguugaugggcaucuag

SEQ ID NO: 98535 - RNA, 45 nt, Mus musculus
auuuuauucugauauccauagugaaagcauuagcuuauacuccca

SEQ ID NO: 98536 - RNA, 46 nt, Mus musculus
uuacugcagaggaggucugugauuggaaagggaaaaagggggcgga

SEQ ID NO: 98537 - RNA, 46 nt, Mus musculus
augugacacgguaguggaacugguucccaaaguucuguuguuccag

SEQ ID NO: 98538 - RNA, 42 nt, Mus musculus; identical to SEQ ID NO: 55379

SEQ ID NO: 98539 - RNA, 46 nt, Mus musculus
agauugcugguaauuaccagcgccgaucaauauuauagccauugau

SEQ ID NO: 98540 - RNA, 42 nt, Mus musculus
aaaacagcaugcauugcaagccuguccuauuguggccccaau

SEQ ID NO: 98541 - RNA, 46 nt, Mus musculus
aaaaacuuucaaaauuuaagauccaaauugaagacccaccccgcag

SEQ ID NO: 98542 - RNA, 46 nt, Mus musculus; identical to SEQ ID NO: 33895

SEQ ID NO: 98543 - RNA, 46 nt, Mus musculus
uaggacuacacauuuggaccagagaaacucaauauagacaccagaa

SEQ ID NO: 98544 - RNA, 47 nt, Mus musculus
ggggaaacauugaaaucaaggaccuuaugguuggugaugaggcaagu

SEQ ID NO: 98545 - RNA, 41 nt, Mus musculus
cagcggcucaccaggacgaaccauggacagccagggcagga

SEQ ID NO: 98546 - RNA, 81 nt, Mus musculus
ucaggguggcauggguaaacagcaggugcugaggaugaggguguaagaaagagaugagucagaggaaggaaacauguacau

SEQ ID NO: 98547 - RNA, 46 nt, Mus musculus
uagaauaugaccaggauagauaaggcagaggagucuauucuuggag

SEQ ID NO: 98548 - RNA, 28 nt, Mus musculus
gaagggggagaaagacaggaaggagcua

SEQ ID NO: 98549 - RNA, 42 nt, Mus musculus
uguaaggaguguggaaaagccuuugaauacaaauccagacuu

SEQ ID NO: 98550 - RNA, 46 nt, Mus musculus
ccaucauguuuaauuagcaauaagaugggcauuauuuugagaagau

SEQ ID NO: 98551 - RNA, 46 nt, Mus musculus
cggccccggaggggagaaccgccauuaucgguacuaacccaggaca

SEQ ID NO: 98552 - RNA, 45 nt, Mus musculus
augacagugucucuaguggucauuauguuugaacugacuggaggu

SEQ ID NO: 98553 - RNA, 45 nt, Mus musculus
cccaguauggcugucggagccauggcaggccggauggugggaauc

SEQ ID NO: 98554 - RNA, 41 nt, Mus musculus
uuauucuuucaugcgcagcaggccaaggggcuggccuugga

SEQ ID NO: 98555 - RNA, 42 nt, Mus musculus
cgagucuucucagcucugugacuacaucaacgaccccaacau

SEQ ID NO: 98556 - RNA, 46 nt, Mus musculus
gcaugucgguuccacagagagaaagaacuagugagaaagcagagaa

SEQ ID NO: 98557 - RNA, 47 nt, Mus musculus
ugugugugugcgugugugugugcgugugugugugugugugugcgcgu

SEQ ID NO: 98558 - RNA, 50 nt, Mus musculus
gugcgugugugugugugugugcgugugugugugugugcaugugugcgugu

SEQ ID NO: 98559 - RNA, 50 nt, Mus musculus
ugcgugugugcgugugugugugugugugugugcgugugugugugcgugug

SEQ ID NO: 98560 - RNA, 44 nt, Mus musculus
cgugugcgugugugcgugugugcgugugugugugugugcgugug

SEQ ID NO: 98561 - RNA, 53 nt, Mus musculus
ugugugcgugugugugugugugugugugugcgugcguguguguguaugugucu

SEQ ID NO: 98562 - RNA, 57 nt, Mus musculus
ggauggcgcugagugagugugugaggcaggggcaugaugcugugugaggcagggggu

SEQ ID NO: 98563 - RNA, 46 nt, Mus musculus
caucauuuagcuccuccaaauccguacuugagaaaaagccuuagau

SEQ ID NO: 98564 - RNA, 46 nt, Mus musculus
uggcaaauacucccuugaucaacaucagagaguccacaccggagag

SEQ ID NO: 98565 - RNA, 46 nt, Mus musculus
gaaacauaguacagaggcaaguucaaaaguugaucagcaccaagac

SEQ ID NO: 98566 - RNA, 46 nt, Mus musculus
aauauaauuguuaccagagguagugggacuggauauugcuugaggu

SEQ ID NO: 98567 - RNA, 41 nt, Mus musculus
uaagaguucgacccuuaacauugaggauaaaggggugaagg

SEQ ID NO: 98568 - RNA, 46 nt, Mus musculus
agauagugauacagcuaagauauggagaagggguuuaaagguaggu

SEQ ID NO: 98569 - RNA, 46 nt, Mus musculus
gugauuacaccagggugaagauggaggaaguggcaggagucuagau

SEQ ID NO: 98570 - RNA, 46 nt, Mus musculus
accccaaguguuuucuucugagggaagugaaagcagcagggcagga

SEQ ID NO: 98571 - RNA, 46 nt, Mus musculus
gguaacaaacaauagaaugugaucuguaagguugacgcaggcauug

SEQ ID NO: 98572 - RNA, 44 nt, Mus musculus
ccauaaguaagcacaagcacugaggauuuaggaucagauguaac

SEQ ID NO: 98573 - RNA, 46 nt, Mus musculus
cggagugguacagccagggccauaguguguguaauuucuuggagcg

SEQ ID NO: 98574 - RNA, 45 nt, Mus musculus; identical to SEQ ID NO: 26955

SEQ ID NO: 98575 - RNA, 42 nt, Mus musculus
uuuuucugaaaaagacccaagggagguaccaggguugcaguc

SEQ ID NO: 98576 - RNA, 63 nt, Mus musculus
gcuuuugaaacaacagcaaucugcaacaaggccaauaccagauaaugcacagaugccaguaga

SEQ ID NO: 98577 - RNA, 45 nt, Mus musculus
uuugauaugcacaacuaagucuaguuuauuuacauguuaguagag

SEQ ID NO: 98578 - RNA, 47 nt, Mus musculus
gaagaaaaaugauugccucaaauuaucaugaauauagcagaaaggag

SEQ ID NO: 98579 - RNA, 45 nt, Mus musculus
ucuggggcuuaguagaaggaaaggcagaaacauuugggguuuggg

SEQ ID NO: 98580 - RNA, 61 nt, Mus musculus
agaaguggaaagccagugguagcgauaugaggagauucauggagagucugacugaugagug

SEQ ID NO: 98581 - RNA, 73 nt, Mus musculus
cuugaagccuccugucauggugaguuccucuggggcuuaguagaaggaaaggcagaaacauuugggguuugga

SEQ ID NO: 98582 - RNA, 47 nt, Mus musculus
cugaagaaaaaugauugccucaaauuaucaugaauauagcagaaagg

SEQ ID NO: 98583 - RNA, 84 nt, Mus musculus
uagguuugauaugcacaacuaagucuaguuuauuuacauguuaguagagagaaugaagaauuguccuggggaggacuuuaagga

SEQ ID NO: 98584 - RNA, 76 nt, Mus musculus
uuugaaacaacagcaaucugcaacaaggccaacaccagauaaugagcagaugccaguagacaccacacaagauaga

SEQ ID NO: 98585 - RNA, 46 nt, Mus musculus
aaggcacccccagucaucauguagacuucccgagugcuccgacuac

SEQ ID NO: 98586 - RNA, 42 nt, Mus musculus
uguuuuucugaaaacgacccaagggagguaccaggguugcag

SEQ ID NO: 98587 - RNA, 76 nt, Mus musculus
ugaaacaacagcaaucugcaacaaggccaacaccagauaaugagcagaugccaguagacaccacacaagauagauu

SEQ ID NO: 98588 - RNA, 45 nt, Mus musculus; identical to SEQ ID NO: 98577

SEQ ID NO: 98589 - RNA, 47 nt, Mus musculus
ugaagaaaaaugauugccucaaauuaccaugaauauagcagaaagga

SEQ ID NO: 98590 - RNA, 44 nt, Mus musculus
gcuugaagccuccagucauggugaguuccucgggggcuuaguug

SEQ ID NO: 98591 - RNA, 103 nt, Mus musculus
agaaguggaaagccagugguagcgauaugaggagauucauggagagucugacugaugagugcuugaagccuccugucauggugaguuccuccgggguuuagua

SEQ ID NO: 98592 - RNA, 47 nt, Mus musculus; identical to SEQ ID NO: 98582

SEQ ID NO: 98593 - RNA, 84 nt, Mus musculus; identical to SEQ ID NO: 98583

SEQ ID NO: 98594 - RNA, 76 nt, Mus musculus; identical to SEQ ID NO: 98584

SEQ ID NO: 98595 - RNA, 46 nt, Mus musculus; identical to SEQ ID NO: 98585

SEQ ID NO: 98596 - RNA, 42 nt, Mus musculus
uguuuuucugaaaaagacccuagggagguaccaggguugcag

SEQ ID NO: 98597 - RNA, 82 nt, Mus musculus
augagugcuugaagccuccugucauggugaguuccuccggggcuuacuagaaggaaaggcagaaacauuugggguuugggaa

SEQ ID NO: 98598 - RNA, 47 nt, Mus musculus; identical to SEQ ID NO: 98582

SEQ ID NO: 98599 - RNA, 80 nt, Mus musculus
agucaucaagcuuuugaaacaacagcaauaugcaacaaggccaacaccagauaaugagcagaugccaguagacaccacac

SEQ ID NO: 98600 - RNA, 42 nt, Mus musculus; identical to SEQ ID NO: 98596

SEQ ID NO: 98601 - RNA, 45 nt, Mus musculus
caaucuugugauugucauauuucucaugguucgaacaugggggca

SEQ ID NO: 98602 - RNA, 47 nt, Mus musculus
gguuucuugcuccuuggaggccauguaggccaugagguccaccuccc

SEQ ID NO: 98603 - RNA, 50 nt, Mus musculus
gaaggaagaggaagaugaggaggaggaugaagaggaugaggaagaggagg

SEQ ID NO: 98604 - RNA, 46 nt, Mus musculus
acguggcaccuuccuuaagaggccacuuaccucucccucaccagag

SEQ ID NO: 98605 - RNA, 67 nt, Mus musculus
cucuuaaggaaggugccacgugugagccuugaacgccuggaucuggaccucaccucugacagccagc

SEQ ID NO: 98606 - RNA, 42 nt, Mus musculus
ccuugaagacugguggcuggcugucagaggugagguccagau

SEQ ID NO: 98607 - RNA, 44 nt, Mus musculus
ugucguucccuguccaguucucucauggcucgguucagggcccu

SEQ ID NO: 98608 - RNA, 44 nt, Mus musculus
uuuccgcuuccgggucacgccucuaccccuccgaagccuugaga

SEQ ID NO: 98609 - RNA, 42 nt, Mus musculus
augcugggaagugcuaggacgcacgcgcacagccagccacag

SEQ ID NO: 98610 - RNA, 46 nt, Mus musculus
cgaaccaaauuaggcccacacauggcauaaaggggcaagccuggaa

SEQ ID NO: 98611 - RNA, 46 nt, Mus musculus
cuugcaccucaucccagugaguggucccacccaauccacggccaca

SEQ ID NO: 98612 - RNA, 44 nt, Mus musculus
aacagguuaggcccauagaaggccuuuuaacauugaagugugag

SEQ ID NO: 98613 - RNA, 42 nt, Mus musculus
aaaaacaacuaagacagaaacagauugaccauaaaggggagg

SEQ ID NO: 98614 - RNA, 42 nt, Mus musculus
ucaccugaggauguugaggcagacguugcccucgaggucaau

SEQ ID NO: 98615 - RNA, 47 nt, Mus musculus
aguugaggaggucgucugggucugagaagcugaugucacacgucuug

SEQ ID NO: 98616 - RNA, 46 nt, Mus musculus
cuuacccagcuaaguccuccacaaguucccacaacauaguccccaa

SEQ ID NO: 98617 - RNA, 42 nt, Mus musculus
agcgagaacagcuugaucauccugccgccgccgccgcagccc

SEQ ID NO: 98618 - RNA, 24 nt, Mus musculus
ggggccucaccagacccaagcgga

SEQ ID NO: 98619 - RNA, 46 nt, Mus musculus
gcuaccccagucaguagaacuguaggaccagaaagauuagccagag

SEQ ID NO: 98620 - RNA, 45 nt, Mus musculus
guucugcccaucacaaggaaaccuguucagauagagcagccacuc

SEQ ID NO: 98621 - RNA, 45 nt, Mus musculus
cccuauaguccauugugccugaggcuggcaccuuggaaggcucac

SEQ ID NO: 98622 - RNA, 27 nt, Mus musculus
caucuugccuguuggauaacagaguag

SEQ ID NO: 98623 - RNA, 45 nt, Mus musculus
cccaaggagccaugcaggaauugccacugaaccuaccaaugaaag

SEQ ID NO: 98624 - RNA, 45 nt, Mus musculus
gcugcugccuugguugacagacuucgaugggagcuugauggaccu

SEQ ID NO: 98625 - RNA, 46 nt, Mus musculus
gaugucugggugcaaguagagaugcagcuauagaaaagaauaggau

SEQ ID NO: 98626 - RNA, 45 nt, Mus musculus
ucgaguugacuuagcacccuaaagagcagagguguaacccacaga

SEQ ID NO: 98627 - RNA, 42 nt, Mus musculus
acgucgucggggcccugacgccugaauucguggccgggagug

SEQ ID NO: 98628 - RNA, 45 nt, Mus musculus
cgggcuucuucugaugaggcugaacuaaaaagauguacauguaua

SEQ ID NO: 98629 - RNA, 45 nt, Mus musculus
cggcaacuucagcagcggcagggauugagaaagggacaucaucca

SEQ ID NO: 98630 - RNA, 44 nt, Mus musculus
caguuccguguguuugaccaagggcacucgaagaaacuggcucu

SEQ ID NO: 98631 - RNA, 46 nt, Mus musculus
ucuguccaguccacacuuagaacuuugucuucaugagcagcuagau

SEQ ID NO: 98632 - RNA, 46 nt, Mus musculus
cuugaaacuguggccuugucaaguacucuuccauuggccucuuccu

SEQ ID NO: 98633 - RNA, 46 nt, Mus musculus
aggcauugcugaaaagcagcgggugagguggggauggugcagagaa

SEQ ID NO: 98634 - RNA, 44 nt, Mus musculus
aucugaucuuugagugacuucaaaggaguaugcaugucauaaaa

SEQ ID NO: 98635 - RNA, 59 nt, Mus musculus
aaaaguucuuaucacaggauguuugggauagaaaguuggagauuaagaugcaaaggugg

SEQ ID NO: 98636 - RNA, 44 nt, Mus musculus
uaauccccugcaaaaucagagagagagagagagagagagagaga

SEQ ID NO: 98637 - RNA, 46 nt, Mus musculus
uuaaaaaacugguauccagcucauauugaggacauugacuacgaag

SEQ ID NO: 98638 - RNA, 46 nt, Mus musculus
aaacagaccacaaaagucuuucaucgucuccugagaaacgagagaa

SEQ ID NO: 98639 - RNA, 46 nt, Mus musculus
agaaaagccuuccuaagaaugaaaaggaagauaaggagaacauuuc

SEQ ID NO: 98640 - RNA, 45 nt, Mus musculus
uucaaacucucaaacuuugcaaccaauaacauuggaauugagaag

SEQ ID NO: 98641 - RNA, 42 nt, Mus musculus
cugcauuaacuugccaccccauuggggauggccugggggcug

SEQ ID NO: 98642 - RNA, 42 nt, Mus musculus
uuuccaugggauggagaagucaccagagccagaggagggccc

SEQ ID NO: 98643 - RNA, 44 nt, Mus musculus
ggaaaagacuaaagagaagaaauucaaagaacuugugagaguga

SEQ ID NO: 98644 - RNA, 42 nt, Mus musculus
cugcggcuauggugccagcccuggaaacagcacucgggggag

SEQ ID NO: 98645 - RNA, 53 nt, Mus musculus
guugaacgaagcaagucuuugcacaucuucaauuggaaucgugccacugauga

SEQ ID NO: 98646 - RNA, 46 nt, Mus musculus
uauuuaauugacuuuugagucagguagaggcauaugccaaccccuc

SEQ ID NO: 98647 - RNA, 64 nt, Mus musculus
uugaugucuucuugugggaagaagugcuccaagaguacacaugccaucacgguucuggauaauu

SEQ ID NO: 98648 - RNA, 59 nt, Mus musculus
uaucauagagcuacauuuugagacuuguaugauaauugucugaaagggaaagaaacaag

SEQ ID NO: 98649 - RNA, 46 nt, Mus musculus
uauauuagauaccaauuuggggccaucaaaguggcuuaguugggag

SEQ ID NO: 98650 - RNA, 28 nt, Mus musculus
agaaacugaaugaugcuaaucuugccau

SEQ ID NO: 98651 - RNA, 46 nt, Mus musculus
aaucauguguaauucuggaaaccuagccauuuacccagaggucaug

SEQ ID NO: 98652 - RNA, 25 nt, Mus musculus
ggagugacacauuagcagcuaauug

SEQ ID NO: 98653 - RNA, 41 nt, Mus musculus
agcaggaggucccagguaauugagaaauuugaggccuugga

SEQ ID NO: 98654 - RNA, 43 nt, Mus musculus
ggggcuggguggggagaguagugggggcagcuguuccucagcc

SEQ ID NO: 98655 - RNA, 41 nt, Mus musculus
guagccgcucucuacccguacuuuccgaccaccauccacac

SEQ ID NO: 98656 - RNA, 28 nt, Mus musculus
gagaaaguucccaccaccaaauccacac

SEQ ID NO: 98657 - RNA, 46 nt, Mus musculus
uuucccacccacccuccugcuuugcuuucccuuuccaccucaagac

SEQ ID NO: 98658 - RNA, 45 nt, Mus musculus
guugugagccaccaugugguugcugggauuugaacuucagaagag

SEQ ID NO: 98659 - RNA, 45 nt, Mus musculus
cgugacucaguucgcccuuuucauguacacacugggaggugcgac

SEQ ID NO: 98660 - RNA, 44 nt, Mus musculus
agaaagggcacaacgagccgggagcaggaaaagggggaacugca

SEQ ID NO: 98661 - RNA, 42 nt, Mus musculus
cuauuccaguuaaguguccaagauccaagcauuuuaggagau

SEQ ID NO: 98662 - RNA, 45 nt, Mus musculus
cccacuuucuguggaucaugaguuucuucuucaguuccuucagau

SEQ ID NO: 98663 - RNA, 45 nt, Mus musculus
acuuuugguugguucccuuaggcauccucuucaccccuacucuag

SEQ ID NO: 98664 - RNA, 38 nt, Mus musculus
gcuuccagaagagaaauaugauugagccccgagaacga

SEQ ID NO: 98665 - RNA, 42 nt, Mus musculus
ggcugggccaguugggccauugccuggggacugagggcacag

SEQ ID NO: 98666 - RNA, 44 nt, Mus musculus
gagaucucacccacuggugcugcugguccugagaagaggaugga

SEQ ID NO: 98667 - RNA, 46 nt, Mus musculus
aggcccaugagguggagcugcagcgugagaaagaggcagaaaagcu

SEQ ID NO: 98668 - RNA, 45 nt, Mus musculus
gaggugauuccugcaggagccuccuacaacccaaccuuugaagau

SEQ ID NO: 98669 - RNA, 44 nt, Mus musculus
gggaagggccugguaucagugccucccaugguggaaagcugagc

SEQ ID NO: 98670 - RNA, 44 nt, Mus musculus
ggagugcugggauuaaagggggugcaucaccuuugcucagcugg

SEQ ID NO: 98671 - RNA, 46 nt, Mus musculus
uccuuagcccucccacaccaaaggccaaaccugggccccaggacau

SEQ ID NO: 98672 - RNA, 45 nt, Mus musculus
aaagaagaggaccuugguccagaagaagucacagcgucuccagaa

SEQ ID NO: 98673 - RNA, 58 nt, Mus musculus
agcagccaggcacuuuaguaugcacgaugugagucaagggguccuguucaugaaaacc

SEQ ID NO: 98674 - RNA, 45 nt, Mus musculus
aagccaucuugccaagacauguuuccuuccuccuggcuaaaagag

SEQ ID NO: 98675 - RNA, 46 nt, Mus musculus
guacauuuuaaauucugugugaaagcuccagguguagcccaugguu

SEQ ID NO: 98676 - RNA, 41 nt, Mus musculus
uagaucucuuuggaugacuaccacuuuccaggggccugggg

SEQ ID NO: 98677 - RNA, 46 nt, Mus musculus
gugccaguuuguguacaguuugcccuuagucuccaaagcaccuucc

SEQ ID NO: 98678 - RNA, 45 nt, Mus musculus
cuaggcaagcacucuagcaacugagcuacauccacagccccaucc

SEQ ID NO: 98679 - RNA, 42 nt, Mus musculus
ucacauacacggagcuuaucacagaaacauacacagacaucc

SEQ ID NO: 98680 - RNA, 45 nt, Mus musculus
cuggauggugggcacaaagcuacccaacucugugcuggggagaau

SEQ ID NO: 98681 - RNA, 46 nt, Mus musculus
uagcacacccagcuacucggaaagcugaagcaggaagaugacagau

SEQ ID NO: 98682 - RNA, 42 nt, Mus musculus
acgguggcucacaaccaucuguaacuccaguuucagggcaug

SEQ ID NO: 98683 - RNA, 46 nt, Mus musculus
uguacaaggcaaggcguggaugaucgcucuggcucugcccguuggu

SEQ ID NO: 98684 - RNA, 46 nt, Mus musculus
cagggcgguuucaggacccagucuuugcuggagaagacagacagau

SEQ ID NO: 98685 - RNA, 46 nt, Mus musculus
aggacccggggaauuuaagggaggguugaaagggagaucaagagau

SEQ ID NO: 98686 - RNA, 45 nt, Mus musculus
acucauguggcagugcacauucuagugcugagaaagcugggacgg

SEQ ID NO: 98687 - RNA, 47 nt, Mus musculus
auggaaguaccucuaauugugacuaguugugauuuuaugugaucugg

SEQ ID NO: 98688 - RNA, 42 nt, Mus musculus
caagccccaggcccagccccagccccagccccagccccagcc

SEQ ID NO: 98689 - RNA, 54 nt, Mus musculus
gggcuacauagguccaggucagucagagcuacauagugagaauguagggggcgg

SEQ ID NO: 98690 - RNA, 42 nt, Mus musculus
accaagaugguaggaauuggagugcuugaggggucuggggag

SEQ ID NO: 98691 - RNA, 46 nt, Mus musculus
agcugugcagggguaggacacaaaaucagaagccuccaaagcaagg

SEQ ID NO: 98692 - RNA, 81 nt, Mus musculus
agacaaccaggaaguuggggaaagcucugggagagacuguuauaagcugggugaggacagaaagacaugaaggggagggag

SEQ ID NO: 98693 - RNA, 47 nt, Mus musculus
ucugguuaaugacaggcuaugucaguuagaugagaauguuucauuag

SEQ ID NO: 98694 - RNA, 44 nt, Mus musculus
uaguuuuccugauggcucagugucugaucucuuuggcccagaga

SEQ ID NO: 98695 - RNA, 40 nt, Mus musculus
agcuuucugguauaagguauacguuuguaucaugcacuua

SEQ ID NO: 98696 - RNA, 44 nt, Mus musculus
ccucugcucagguuacauggggcaaguaggcuacucucacccau

SEQ ID NO: 98697 - RNA, 35 nt, Mus musculus
uuuugaggaaagcaaaugucagcauucugggccau

SEQ ID NO: 98698 - RNA, 44 nt, Mus musculus
ccccugugacaagggggaagcuaggacauacugaagacagcuau

SEQ ID NO: 98699 - RNA, 46 nt, Mus musculus
aauccacauggugacucacgacugucugugacuacacuuucaguau

SEQ ID NO: 98700 - RNA, 45 nt, Mus musculus
uacagggucaaauauaaauccugauaauaaaacauacagugcugg

SEQ ID NO: 98701 - RNA, 45 nt, Mus musculus
ucuguggaagugguggcucugggguugcuggcacaggcugggugg

SEQ ID NO: 98702 - RNA, 46 nt, Mus musculus
cugcuuguuuagcugugaugugguggggcucaggccuggcaagcag

SEQ ID NO: 98703 - RNA, 46 nt, Mus musculus
ccuccacacagcuauccucgugcuuuccccucuuguauuucuggag

SEQ ID NO: 98704 - RNA, 35 nt, Mus musculus
ugggugguaguggcugccagcccgcaggaugccag

SEQ ID NO: 98705 - RNA, 42 nt, Mus musculus
cuggucaugucauuuuccucuggagacccaggugugggcaau

SEQ ID NO: 98706 - RNA, 42 nt, Mus musculus
ucaagcagccagcagggccaggaucuuuuggguacacuaagg

SEQ ID NO: 98707 - RNA, 46 nt, Mus musculus
gggcagauucacaaucgcagccaagcaccacaucuccaucgcugag

SEQ ID NO: 98708 - RNA, 45 nt, Mus musculus
ucugucuccagagcuggguauccucugcagaaaaaguaaggcagg

SEQ ID NO: 98709 - RNA, 42 nt, Mus musculus
gaccagugccauggacaguccccuccucaaguacagcgccaa

SEQ ID NO: 98710 - RNA, 46 nt, Mus musculus
gugagcaucggaucuggcucgcccugaucuggguguggaugggcag

SEQ ID NO: 98711 - RNA, 46 nt, Mus musculus
uccugccauccugcucaguucucuaccugaaacaaguacaguuaac

SEQ ID NO: 98712 - RNA, 44 nt, Mus musculus
ccuugcaguuucaccccacaacaucugcugggucuggcugacuc

SEQ ID NO: 98713 - RNA, 73 nt, Mus musculus
ucacccgcugcguccuucacccugccguuuauuuaagcccccagaggugcccuccugcccuggaaaguccacc

SEQ ID NO: 98714 - RNA, 46 nt, Mus musculus
uguacuaaggcuguuuccauaucuccuaccuuguccccuagcagag

SEQ ID NO: 98715 - RNA, 81 nt, Mus musculus
gggguucgauuagcgcggagagggcugagguagaaaacaggaauaggcgguuggaaaugugacagcuagggcgggagaaga

SEQ ID NO: 98716 - RNA, 55 nt, Mus musculus
ugccgugagagaugucuacggcuugggaggaggaagggucacuguuucaaaaggg

SEQ ID NO: 98717 - RNA, 97 nt, Mus musculus
caagcaagcagcagcagcggugauccggacacgaagacuccagaagcagcagcagucacugcaguuagagcagcaggagcagcagcaaggugccuca

SEQ ID NO: 98718 - RNA, 45 nt, Mus musculus
gaaggcaaccgcccgccaccccaucgccuccuuucuccggagugu

SEQ ID NO: 98719 - RNA, 45 nt, Mus musculus
aggugugugugcugcugggcucugugugugugugugugugugugu

SEQ ID NO: 98720 - RNA, 84 nt, Mus musculus
cauucagguguguuuugagaugaugguggugcaugugcuaaggaauaguaaggggggugucuuuggguugucuguguguaugcg

SEQ ID NO: 98721 - RNA, 42 nt, Mus musculus
guggccaguguggucuuuguguagcaagaaccaggaagacag

SEQ ID NO: 98722 - RNA, 46 nt, Mus musculus
uuggcacuggcaggguuaguccgcagucccccaggaggaaggagag

SEQ ID NO: 98723 - RNA, 41 nt, Mus musculus
ggggcccagcugcggcggauggcggacgaccucaacgcgca

SEQ ID NO: 98724 - RNA, 45 nt, Mus musculus
ggcuagcaugguggucuacauaguguguucuaggacagccagugu

SEQ ID NO: 98725 - RNA, 45 nt, Mus musculus
aaaagaaaaagaaaaagaaagaaaaggaaagaaagaaaaaaaaag

SEQ ID NO: 98726 - RNA, 45 nt, Mus musculus
aaugcuggcuucagggaaacucuuguucgaucccuggugguagag

SEQ ID NO: 98727 - RNA, 45 nt, Mus musculus
ugcuagagcacaggcuccuaacuggaaaaaucaaaccaaccaaac

SEQ ID NO: 98728 - RNA, 41 nt, Mus musculus
cuaaggggugggcugaaacgcagcccacucaaggugagaga

SEQ ID NO: 98729 - RNA, 45 nt, Mus musculus
acccgcagacaguggguuagugagcaaaagguguggguucgagau

SEQ ID NO: 98730 - RNA, 41 nt, Mus musculus
gggggacccuggccucccgaaagccagggaagggagggcug

SEQ ID NO: 98731 - RNA, 46 nt, Mus musculus
ugaagagcauaugagccaaaccugaccacuagccuccuggagccag

SEQ ID NO: 98732 - RNA, 42 nt, Mus musculus
ccccccccaauccccauccaucucauugcauagguuuagaga

SEQ ID NO: 98733 - RNA, 57 nt, Mus musculus
aguccccagggcaaagcgcuggggaggaagauggggagucagggaggggggaagucu

SEQ ID NO: 98734 - RNA, 62 nt, Mus musculus
agcggggagggacggcccagccuguaagauacuguacaugcacugcuguagauauacuggaa

SEQ ID NO: 98735 - RNA, 42 nt, Mus musculus
uaugugugugugugugugugugugugugugugagaaauggcu

SEQ ID NO: 98736 - RNA, 46 nt, Mus musculus
gauuggaccagcguguaaccaaugguagagaagguggcugcugauu

SEQ ID NO: 98737 - RNA, 42 nt, Mus musculus
aauuuuuuagccaagugcucuaccuuugagccacgcccccag

SEQ ID NO: 98738 - RNA, 46 nt, Mus musculus
cuggcgaccugaguuugauacucaggaccugcgugguagaagaaga

SEQ ID NO: 98739 - RNA, 24 nt, Mus musculus
cuguaggcccuuggagagugagau

SEQ ID NO: 98740 - RNA, 74 nt, Mus musculus
ucugaaccaguuugugauuggguaguggggcugugcacuggagggaagaaaaaaaaagggugaacuggccaagg

SEQ ID NO: 98741 - RNA, 46 nt, Mus musculus
gaggagcugagaguucuauauuuucaucugaaggcugcuagcagaa

SEQ ID NO: 98742 - RNA, 24 nt, Mus musculus
caggaggaggcggccgaugcgacc

SEQ ID NO: 98743 - RNA, 45 nt, Mus musculus
agagauaagacuggagaccuggcuuuuccuacccccaaauagagc

SEQ ID NO: 98744 - RNA, 45 nt, Mus musculus
gguuugaaaguccccauuuuacagagaaaaaaacugaggcuuaga

SEQ ID NO: 98745 - RNA, 46 nt, Mus musculus
ccaucacucagaaacacccccuaugaaacaaaacagaaaaccccga

SEQ ID NO: 98746 - RNA, 42 nt, Mus musculus
gucaugugaugccacauugcagauaaggaaaguaaagcccag

SEQ ID NO: 98747 - RNA, 42 nt, Mus musculus
cugcuucccagagcacugaagaaugucaaaccccaccccugg

SEQ ID NO: 98748 - RNA, 45 nt, Mus musculus
auucuaguauucauucaucagacguuuccuaaguucuaagcccaa

SEQ ID NO: 98749 - RNA, 46 nt, Mus musculus
gagaaagacugagguguccuggagaaaccccacccccucaccugag

SEQ ID NO: 98750 - RNA, 45 nt, Mus musculus
aaaucccaccaaccacaugguggcucacaaccauccguaaugaga

SEQ ID NO: 98751 - RNA, 44 nt, Mus musculus
gguugugagccaccaugugguuggugggauuugaacucaggucc

SEQ ID NO: 98752 - RNA, 46 nt, Mus musculus
auagcagggcuauauaauagagaccccugucaaggaggagagagag

SEQ ID NO: 98753 - RNA, 87 nt, Mus musculus
caguguaagcagugggugagggucagagcaagacaagaaauggagacuugaagggaucuugccaucaaccauauaggaggggaugag

SEQ ID NO: 98754 - RNA, 42 nt, Mus musculus
gaugccuugaucuucacgaagaccuuggcggggcccgcaggc

SEQ ID NO: 98755 - RNA, 41 nt, Mus musculus
gaggggcggccucuccaggacggcuauggacggcgggcagu

SEQ ID NO: 98756 - RNA, 46 nt, Mus musculus
ccguccuggagaggccgccccucuccccccacggggaggcgcccag

SEQ ID NO: 98757 - RNA, 45 nt, Mus musculus
gacccgaacagaauuacugcauuugcguacacccauuguacagau

SEQ ID NO: 98758 - RNA, 45 nt, Mus musculus
ccacuucucugacauagccuucucauuccucuuuuccuugcccag

SEQ ID NO: 98759 - RNA, 45 nt, Mus musculus
ucugcuccauccuuggacagucauggggaauugggagguuagaga

SEQ ID NO: 98760 - RNA, 42 nt, Mus musculus
auucuguguguuucucuaaccucuuuguaaauaaaugcacag

SEQ ID NO: 98761 - RNA, 102 nt, Mus musculus
gaaacgggagaucugggggacccaagaaggauaagagagggagauggcucccuaggaaggugaaaguagugagggaucagagugagaggacggaaaauggga

SEQ ID NO: 98762 - RNA, 42 nt, Mus musculus
gcaaggaaaaaggagagagauugggaggcacaggcagaagga

SEQ ID NO: 98763 - RNA, 43 nt, Mus musculus
gaggaguagaagcagcuacagacggaccagaaacggaggagau

SEQ ID NO: 98764 - RNA, 42 nt, Mus musculus
ggaaaauagacugaggauggagauagagguacugggggagag

SEQ ID NO: 98765 - RNA, 45 nt, Mus musculus
caggauggaggggugcacggauggagguaucaagaggcugcugga

SEQ ID NO: 98766 - RNA, 31 nt, Mus musculus
agaaaugucaaggaggugacagagaagugua

SEQ ID NO: 98767 - RNA, 26 nt, Mus musculus
gagaaggaaagaaacaggagagggac

SEQ ID NO: 98768 - RNA, 41 nt, Mus musculus
ggcauccugggugcccgacggaggucacacccaucggccuu

SEQ ID NO: 98769 - RNA, 46 nt, Mus musculus
gugcuccugcugauguuucuccugguuccuguuucucagccacucc

SEQ ID NO: 98770 - RNA, 55 nt, Mus musculus
cagagaaaguggaaccagggcccagagagggcaaagcccaagcuuggaccacaca

SEQ ID NO: 98771 - RNA, 46 nt, Mus musculus
ucucccaaaagaacacuuuaacacaggaccuggaaggaagccacag

SEQ ID NO: 98772 - RNA, 38 nt, Mus musculus
uuuucucccaaguaaguauauuuccaucacacucagaa

SEQ ID NO: 98773 - RNA, 42 nt, Mus musculus
gagaacgugaaggcugcucuaguugagguuagcgagggugug

SEQ ID NO: 98774 - RNA, 48 nt, Mus musculus
ucauauucuacauggaugcugcaauccguagucgggaugaagaagcaa

SEQ ID NO: 98775 - RNA, 30 nt, Mus musculus
agaccucaauuacgaugugguccccaggga

SEQ ID NO: 98776 - RNA, 45 nt, Mus musculus
aguugugaaauugcaacucaugugauagcuaucaaugcuacugug

SEQ ID NO: 98777 - RNA, 45 nt, Mus musculus
gagguaaaggaguucuucaaggauggaguacugagcagacaucag

SEQ ID NO: 98778 - RNA, 33 nt, Mus musculus
agacauuauuugaggugcguuuuuaccggugag

SEQ ID NO: 98779 - RNA, 45 nt, Mus musculus
acccuuccucaccuccaaaccaaguaugaggaagcaggccaggag

SEQ ID NO: 98780 - RNA, 45 nt, Mus musculus
uuuucucucgguucauuuuuugguguguaaaacaaugaguuuuua

SEQ ID NO: 98781 - RNA, 46 nt, Mus musculus
ugugugugugugucugugugugugugugucuguguguguguguuca

SEQ ID NO: 98782 - RNA, 42 nt, Mus musculus
cugagccacacccccaaccccucacugggagauucuaggcag

SEQ ID NO: 98783 - RNA, 42 nt, Mus musculus; identical to SEQ ID NO: 98782

SEQ ID NO: 98784 - RNA, 42 nt, Mus musculus; identical to SEQ ID NO: 98782

SEQ ID NO: 98785 - RNA, 42 nt, Mus musculus; identical to SEQ ID NO: 98782

SEQ ID NO: 98786 - RNA, 46 nt, Mus musculus
ucugcugaugcgguccauauuggcccuaugugauaaauugcuccgg

SEQ ID NO: 98787 - RNA, 46 nt, Mus musculus
gacuucucucuucuccuuuccucuuuccugagcccugggugugaag

SEQ ID NO: 98788 - RNA, 23 nt, Mus musculus
agcccuacagaaauggcgacccu

SEQ ID NO: 98789 - RNA, 45 nt, Mus musculus
aggucacuuccuguggcaucauagggaugaagcaugcgcuuccgg

SEQ ID NO: 98790 - RNA, 45 nt, Mus musculus
gggcaggccccauuuccuugacacacccccaucucccaccuccua

SEQ ID NO: 98791 - RNA, 58 nt, Mus musculus
ggccuuaagaggcaaagaaaacacuuuaggaugcugagcuaaauuggauccccuuccu

SEQ ID NO: 98792 - RNA, 46 nt, Mus musculus
aaacuggggauggagagaaagacuccacccucuuuugcuagcccaa

SEQ ID NO: 98793 - RNA, 46 nt, Mus musculus
cucuccgugggcgggaaaauuuugccgcaauaauuagcagggcagg

SEQ ID NO: 98794 - RNA, 45 nt, Mus musculus
cguucccaccucaguucuguuucuucagcccgccccuguggccaa

SEQ ID NO: 98795 - RNA, 29 nt, Mus musculus
cugcccagggcaucagccccaagcgccau

SEQ ID NO: 98796 - RNA, 41 nt, Mus musculus
cauaggugugcuuaccuucuggaauaucguauaaggaugug

SEQ ID NO: 98797 - RNA, 46 nt, Mus musculus
cggugguuaccuggaagcuccccagcuauaaaaagcaaaaaccaag

SEQ ID NO: 98798 - RNA, 46 nt, Mus musculus
aaauauuaaagcugagggucugcagggauuaugggggugcugggau

SEQ ID NO: 98799 - RNA, 42 nt, Mus musculus
aaaaguggaagggaaaagggugccacagcaggaguuagagga

SEQ ID NO: 98800 - RNA, 42 nt, Mus musculus
cggucgaagccugcggcugugaagaggcggcugcccgggacu

SEQ ID NO: 98801 - RNA, 45 nt, Mus musculus
agaauagaguuuauucagggcauggggaaaggagucaagagggua

SEQ ID NO: 98802 - RNA, 47 nt, Mus musculus
aaaucccagcaaccacaugguggcucacaaccccccguaaugagauc

SEQ ID NO: 98803 - RNA, 48 nt, Mus musculus
aauacaaguauuucaaacaaaugccucgauaguggccuagcgugugug

SEQ ID NO: 98804 - RNA, 46 nt, Mus musculus
gcucacaaccaucuguaacaagaucugacgcccucuucuggggugu

SEQ ID NO: 98805 - RNA, 52 nt, Mus musculus
cuuaugccccaguauaggggaaugccagggccaggaagcaggagugugagua

SEQ ID NO: 98806 - RNA, 33 nt, Mus musculus
ugcggggugacagggugacaaugaggcccucca

SEQ ID NO: 98807 - RNA, 45 nt, Mus musculus
agggauacaugaaacugucugaaacaaaacagaaaaagggcaggu

SEQ ID NO: 98808 - RNA, 41 nt, Mus musculus
ucauaaacaaugagcaucagcauuugacuuuugcuggaaug

SEQ ID NO: 98809 - RNA, 49 nt, Mus musculus
uccgcacacugcucaccugggacuuggccagcguugggggcagguuggc

SEQ ID NO: 98810 - RNA, 45 nt, Mus musculus
ugcuaggcauguuucgggcgaucucagccuggggcgugcccagau

SEQ ID NO: 98811 - RNA, 46 nt, Mus musculus
gucugacuggccugagaucugggcugacgccuuugacgucccugau

SEQ ID NO: 98812 - RNA, 45 nt, Mus musculus
caggcauggucucaggcagguacaccaugcugaugaggaccugug

SEQ ID NO: 98813 - RNA, 45 nt, Mus musculus
gugguuugggugcacaucaccuuggcuucucuguggacauuauag

SEQ ID NO: 98814 - RNA, 44 nt, Mus musculus
uuccaccugggcaucugucaggggcuucagcacaucgcucagac

SEQ ID NO: 98815 - RNA, 43 nt, Mus musculus
auacuuaccaggagauguggguggcaggguuuguggcaugaag

SEQ ID NO: 98816 - RNA, 45 nt, Mus musculus
uggacuugaaccgcgggaggagacgaguuaaccgguuagagcagg

SEQ ID NO: 98817 - RNA, 45 nt, Mus musculus
uugcuuauuuugaaaacauuugugggucaccuccccuggaccagu

SEQ ID NO: 98818 - RNA, 41 nt, Mus musculus
ggcaccaggugugcccggaagggugcggguacgggccagag

SEQ ID NO: 98819 - RNA, 46 nt, Mus musculus
aguggcaccucauggauccgagggcacagugccgugcccagcaccu

SEQ ID NO: 98820 - RNA, 41 nt, Mus musculus
caccgccuugccuggccgggcccaggugcagaugaggcccu

SEQ ID NO: 98821 - RNA, 46 nt, Mus musculus
uaaggauggaggagggacguguggggaagcggggagauggggucac

SEQ ID NO: 98822 - RNA, 28 nt, Mus musculus
agaauccuaaagccgauuuaaggggcag

SEQ ID NO: 98823 - RNA, 52 nt, Mus musculus
ggagcccauugcagcaaggcuuaaggagguccgacugcagagggaugauuuu

SEQ ID NO: 98824 - RNA, 47 nt, Mus musculus
auuaugaauaagugggacaugcugaagagaggcgaggugagggccag

SEQ ID NO: 98825 - RNA, 44 nt, Mus musculus
aucgguccagcagaauguuaucugguuugaugucccugugcaua

SEQ ID NO: 98826 - RNA, 42 nt, Mus musculus
auaugucucggcuguggaguccgcguagaagggggucugccc

SEQ ID NO: 98827 - RNA, 43 nt, Mus musculus
aggugggaugcugguuucuuaaaagccacagauagguggguag

SEQ ID NO: 98828 - RNA, 41 nt, Mus musculus
ggggcucaugcuuauggcuuguaacugauggcugggagagu

SEQ ID NO: 98829 - RNA, 45 nt, Mus musculus
gcgggauuuagggcagaccagaaguauuuuauucgcaagggucgg

SEQ ID NO: 98830 - RNA, 45 nt, Mus musculus
cuccacucccgacccuugcgaauaaaauacuucuggucugcccua

SEQ ID NO: 98831 - RNA, 41 nt, Mus musculus
cgguccaaaaagcggaugcgcguggcuugcgcaggcgcagu

SEQ ID NO: 98832 - RNA, 26 nt, Mus musculus
ggggaccgggggggggggcggcgagg

SEQ ID NO: 98833 - RNA, 43 nt, Mus musculus
cgcggcucggggggaggcggcggcggcgaccgaggagcaggag

SEQ ID NO: 98834 - RNA, 42 nt, Mus musculus
ucucuccacgcucagccuaugcacucgccgacgccaccgaag

SEQ ID NO: 98835 - RNA, 46 nt, Mus musculus
guucagccguggggagguggggcucaggccuguuggguacccagaa

SEQ ID NO: 98836 - RNA, 45 nt, Mus musculus
cuaccccagugacaauggggcuaccagacacaggguuggccagga

SEQ ID NO: 98837 - RNA, 41 nt, Mus musculus
ugcugagaagcuggaaagcaggccagaggaguccggggaga

SEQ ID NO: 98838 - RNA, 46 nt, Mus musculus
uaguauuauguagaggauggcaaagcccaagucaagaccccuagug

SEQ ID NO: 98839 - RNA, 44 nt, Mus musculus
auuuccagauggcacccucacuauaacacuauuaauagccccac

SEQ ID NO: 98840 - RNA, 46 nt, Mus musculus
uuuguauuguaaaucuuuauuuuucuaggauauguuaugccuccau

SEQ ID NO: 98841 - RNA, 42 nt, Mus musculus
ggccuguucagcuuccugcuuuucuuccaaguccugggacua

SEQ ID NO: 98842 - RNA, 46 nt, Mus musculus
gugcauucacaaccagaacauccuuugagacccugucuccaaagag

SEQ ID NO: 98843 - RNA, 42 nt, Mus musculus
ccugggcuaugugagauugucucagaacaacagagggggcau

SEQ ID NO: 98844 - RNA, 42 nt, Mus musculus
cuggggagugggggugagagcagcuggccaggcguggagaag

SEQ ID NO: 98845 - RNA, 42 nt, Mus musculus
cugcacacauauauaugcaccaugaaggccagaaucagcugg

SEQ ID NO: 98846 - RNA, 42 nt, Mus musculus
acaugcuugcaauggauccuaugagacuagaguuacagaagg

SEQ ID NO: 98847 - RNA, 46 nt, Mus musculus
ggucccaucgugaguuccuggacagccugcugaaccacagggagag

SEQ ID NO: 98848 - RNA, 46 nt, Mus musculus
agggcuacacagagaaacccugucuccaaaaaaacaaaacaaaagu

SEQ ID NO: 98849 - RNA, 56 nt, Mus musculus
agggaccagaggacccagaagauucuggcugcagggcaagaugagauaaggcccaa

SEQ ID NO: 98850 - RNA, 46 nt, Mus musculus
acuggguucugcccucuuaucagaaaagccccaggccacacccaag

SEQ ID NO: 98851 - RNA, 89 nt, Mus musculus
ccuggcccuugucccuagagguggcacuuguagggcucccccaaggggaugaaaaugacccauccccaggauuccccagacugaaacca

SEQ ID NO: 98852 - RNA, 53 nt, Mus musculus
ugaacuagggacagaggacacacauggcuaggugaugaggggaggacagagug

SEQ ID NO: 98853 - RNA, 45 nt, Mus musculus
gacucccuacucaugcaauguuacauauccccacaaagggagaag

SEQ ID NO: 98854 - RNA, 43 nt, Mus musculus
caaccaucuguaaugggauccaaugcccucuucuggugcaucu

SEQ ID NO: 98855 - RNA, 42 nt, Mus musculus
ugccaugcuggguccccaucccccagucagcugcagccccag

SEQ ID NO: 98856 - RNA, 23 nt, Mus musculus
gucugguuuuaaccaugcacacc

SEQ ID NO: 98857 - RNA, 42 nt, Mus musculus
uucuucccuguaguguaccacuggcuagagaugcggaccaag

SEQ ID NO: 98858 - RNA, 46 nt, Mus musculus
gagugguuuaugaauuuaaaauguuuuauaauuaaaggagccccag

SEQ ID NO: 98859 - RNA, 46 nt, Mus musculus
acagacgcccacacuuucccaguagcuauagcagaccguaccaguc

SEQ ID NO: 98860 - RNA, 45 nt, Mus musculus
cuccauccaauuccuucagucccaaagacgaguucugucccuucc

SEQ ID NO: 98861 - RNA, 80 nt, Mus musculus
acugaucagcuugaagaggaaaaggcagagcuggagucggagaucgccgagcugcaaaaagagaaggaacgccuggaguu

SEQ ID NO: 98862 - RNA, 42 nt, Mus musculus
uggcucgugcaacccacccucaucucuuccauggcccagucc

SEQ ID NO: 98863 - RNA, 48 nt, Mus musculus
uguuugcaaacugcaaagaauggagugauguuugcaaaagguuauuug

SEQ ID NO: 98864 - RNA, 67 nt, Mus musculus
cuuccucaaagugccucgaugaccugcugccaccuaggcccagugucacaauaaagaauuuuccaug

SEQ ID NO: 98865 - RNA, 37 nt, Mus musculus
ucugccucuuccucuuuuugguggggaacaggaaggu

SEQ ID NO: 98866 - RNA, 47 nt, Mus musculus
cccuuggacuucuuccucuucuugcugcugguggcagaugggacugg

SEQ ID NO: 98867 - RNA, 42 nt, Mus musculus
uccucuucccugaaguuggugaccucagagcugaggcugaac

SEQ ID NO: 98868 - RNA, 45 nt, Mus musculus
ucuauccucuagucccuucccccaucucucuccaugugcucaugg

SEQ ID NO: 98869 - RNA, 44 nt, Mus musculus
ggcgaaguuagcaaggagugugagcggggagaagucggccaggu

SEQ ID NO: 98870 - RNA, 41 nt, Mus musculus
ugccauugugacaggguggaaguccaggaucuugggguaga

SEQ ID NO: 98871 - RNA, 46 nt, Mus musculus
ugacacaugucaccaguagaaagagggagugaagucauauauaucu

SEQ ID NO: 98872 - RNA, 42 nt, Mus musculus
caaucccuucugauacuuugccccgagccacugagagcagaa

SEQ ID NO: 98873 - RNA, 45 nt, Mus musculus
uaaggucaccccagggccuggaaaggggacagaucccguguggua

SEQ ID NO: 98874 - RNA, 45 nt, Mus musculus
gaaacagaacaaguaucagcaggcagaggagcuauacaaggagau

SEQ ID NO: 98875 - RNA, 83 nt, Mus musculus
uuaguaugugagaacaugaaaggcuggaauuuaauucccaggagagagagagagagagagagagagagagagagagacuaugu

SEQ ID NO: 98876 - RNA, 41 nt, Mus musculus
aaagagauaagagagaaaaagagagagaacgauggggagga

SEQ ID NO: 98877 - RNA, 46 nt, Mus musculus
gauguuugugagccaccaugugguugcugggauuugaacuucggac

SEQ ID NO: 98878 - RNA, 46 nt, Mus musculus
ggacagccagggcuacauagagagcagagagagagagagagagaga

SEQ ID NO: 98879 - RNA, 46 nt, Mus musculus
ccuggcacuguggugggcaggggcagcuagucuccacaggagcaug

SEQ ID NO: 98880 - RNA, 45 nt, Mus musculus
acaccagcuguggagcuuuguuaugcaucagggauguggaguuga

SEQ ID NO: 98881 - RNA, 44 nt, Mus musculus
aaacaguucuguguacacaguaggaccagcauuccauggcaguu

SEQ ID NO: 98882 - RNA, 43 nt, Mus musculus
gaggaccacaggcgucccacagaggagcccuggccccuucccc

SEQ ID NO: 98883 - RNA, 43 nt, Mus musculus
accaacgguggaucuaccgcgucgaccccacccgugugaacga

SEQ ID NO: 98884 - RNA, 46 nt, Mus musculus
cuguggcccauuugcccuggcggaugcucaccuacaaggcccucaa

SEQ ID NO: 98885 - RNA, 42 nt, Mus musculus
cuacccaggcucacuuugcuccucuagcacagccuaccccag

SEQ ID NO: 98886 - RNA, 46 nt, Mus musculus
agugcagagagaaggcaggcacucacaaugaguacugaguacagac

SEQ ID NO: 98887 - RNA, 44 nt, Mus musculus
gcccgcugucacuauggcgcuggcaacucuaugcugcacagagu

SEQ ID NO: 98888 - RNA, 46 nt, Mus musculus
acuacuaccccaucaucuauuucaaugacuacuggaaccugcagaa

SEQ ID NO: 98889 - RNA, 42 nt, Mus musculus
ggacuauggcccuguagaaguaaucucgcacuggcaccccaa

SEQ ID NO: 98890 - RNA, 42 nt, Mus musculus
auuacuucuacagggccauaguccucagcccucuguggggag

SEQ ID NO: 98891 - RNA, 42 nt, Mus musculus
ggugggcugagcaaaccagggcacuucucuaaaggcauagaa

SEQ ID NO: 98892 - RNA, 46 nt, Mus musculus
gcuggauggcgcagagcaggagccguagcuuggagcaguuguagac

SEQ ID NO: 98893 - RNA, 46 nt, Mus musculus
gaucagaauccugcagcaggaagucugcagacaggucagcccaggc

SEQ ID NO: 98894 - RNA, 47 nt, Mus musculus
aagcguaggcgauuucagaaaaccaagaaccuacugacaggagagac

SEQ ID NO: 98895 - RNA, 42 nt, Mus musculus
ggccacucccuaaaccagcaaaggacacacaucugccuggag

SEQ ID NO: 98896 - RNA, 23 nt, Mus musculus
aagaggaucaaggccagccuaag

SEQ ID NO: 98897 - RNA, 45 nt, Mus musculus
uagaaaaagcaaacaguuaagaaagagcagguggagcuuagagaa

SEQ ID NO: 98898 - RNA, 42 nt, Mus musculus
acuccgggacauguggacaguggcaagccggcgguacagggc

SEQ ID NO: 98899 - RNA, 44 nt, Mus musculus
aggcccuguaccgccggcuugccacuguccacaugucccggagu

SEQ ID NO: 98900 - RNA, 45 nt, Mus musculus
ggaacucuugucuuuguacccaguaggcuuugggaaggggggagg

SEQ ID NO: 98901 - RNA, 34 nt, Mus musculus
acgagcacuuugcagagcuugacaucccacaggu

SEQ ID NO: 98902 - RNA, 49 nt, Mus musculus
guucucuccacugguccagucaccauacaccaggucaugcugcucccag

SEQ ID NO: 98903 - RNA, 42 nt, Mus musculus
ugaggggacggcccucggcggaaccagcugcugauggcccag

SEQ ID NO: 98904 - RNA, 46 nt, Mus musculus
auugaaacgggaaaguaauuauacuaagguuucuuacaguacagua

SEQ ID NO: 98905 - RNA, 42 nt, Mus musculus
aggaaggaagugagccugcagaggcuggaucagagccccugg

SEQ ID NO: 98906 - RNA, 45 nt, Mus musculus
aggugaccagcaauggcagcauugggagggacacgccagccgaga

SEQ ID NO: 98907 - RNA, 46 nt, Mus musculus
auuuggaagccucucucuggacacugcuggcuccaguccuguguua

SEQ ID NO: 98908 - RNA, 46 nt, Mus musculus
cuaaggugucucaggcaagaacaguggggagaacuacagcugagau

SEQ ID NO: 98909 - RNA, 42 nt, Mus musculus
ugccugagacaccuuagcaugacauuaggucggucaccccuu

SEQ ID NO: 98910 - RNA, 46 nt, Mus musculus
ucaaaucccagcagccacaugguggcucacaaccaucuguaauaag

SEQ ID NO: 98911 - RNA, 42 nt, Mus musculus
ugaguuuggucagguuucuagcaagucuggauagauucagag

SEQ ID NO: 98912 - RNA, 46 nt, Mus musculus
guacaauaauaguaaguauuuauguauuuacuuauuugagacagag

SEQ ID NO: 98913 - RNA, 42 nt, Mus musculus
gagugggagaggagaugguagcguaaacagacucgggaagug

SEQ ID NO: 98914 - RNA, 45 nt, Mus musculus
gggcagugguugguuaauugagaguuuucaagcucagggcaaaua

SEQ ID NO: 98915 - RNA, 62 nt, Mus musculus
ugcucccaggguugguugcuuugccacucgagcugaucugucaccuccggcucucccucggc

SEQ ID NO: 98916 - RNA, 42 nt, Mus musculus
ccuuccgaaacaaguccuuagccuccagggucugagcagggg

SEQ ID NO: 98917 - RNA, 45 nt, Mus musculus
ccgggaguccguuccgaaccacggccagugcuugacccagugccc

SEQ ID NO: 98918 - RNA, 42 nt, Mus musculus
cgcuuagcgcacgggguaggagcggagcccaggccgggaaga

SEQ ID NO: 98919 - RNA, 46 nt, Mus musculus
uuccugcuaauucuccaauagaaugucuuucuucuagggcgguggg

SEQ ID NO: 98920 - RNA, 42 nt, Mus musculus
guaaaagauuccaagauaguucauuagagaaaggccggaagg

SEQ ID NO: 98921 - RNA, 45 nt, Mus musculus
uaauaugaguuucuacuuugauaaagucuuguguuuucugugaga

SEQ ID NO: 98922 - RNA, 46 nt, Mus musculus
gagggugugagaaaccugagauuccugccugcaggaguagguggag

SEQ ID NO: 98923 - RNA, 46 nt, Mus musculus
cuccaggacccaauguuguggaggggguuucccugagucucgaaga

SEQ ID NO: 98924 - RNA, 42 nt, Mus musculus
agucaccucagucucaggauggcauccuagaucugcccccug

SEQ ID NO: 98925 - RNA, 45 nt, Mus musculus
cuagcccuggccccgaaacacucaggagcuaauaaaugccuuguc

SEQ ID NO: 98926 - RNA, 42 nt, Mus musculus
gggaccgguuggacugguucuucuggggcacacuggaguugg

SEQ ID NO: 98927 - RNA, 36 nt, Mus musculus
uggaggucagcauccccugagcccaugaggccagau

SEQ ID NO: 98928 - RNA, 46 nt, Mus musculus
uucuauugcagaucaucugcagcccaccaacacccuuuguugagau

SEQ ID NO: 98929 - RNA, 45 nt, Mus musculus
ccaggcaggaccugagccccucagaaacacaacaaauggcuuaga

SEQ ID NO: 98930 - RNA, 45 nt, Mus musculus
ucacccagauguaacccuauauaguuggaacaauugucaccgaga

SEQ ID NO: 98931 - RNA, 45 nt, Mus musculus
agaaguuggcuugggucuaugguggaggcaaggacuaauggcagc

SEQ ID NO: 98932 - RNA, 56 nt, Mus musculus
uguccacucuguggaucgaauggucaacacuaccuucaucuguacagccaccaacg

SEQ ID NO: 98933 - RNA, 41 nt, Mus musculus
cugcagagggagggcugacuguuggagucuucaggggagac

SEQ ID NO: 98934 - RNA, 41 nt, Mus musculus
ucugaggauggagggcugggguguguaccccugggacugag

SEQ ID NO: 98935 - RNA, 65 nt, Mus musculus
aaagggauuaggugucaucucugggucugagggaggagagcuggggugucaucucugggucugag

SEQ ID NO: 98936 - RNA, 45 nt, Mus musculus
gccauacugaccugugauguacgaagcaacccagagcccacagac

SEQ ID NO: 98937 - RNA, 25 nt, Mus musculus
gagcggauggcgucaaggucacgug

SEQ ID NO: 98938 - RNA, 44 nt, Mus musculus
agcaccuccccagugcuggcaugcaccacccaccacaccccauu

SEQ ID NO: 98939 - RNA, 45 nt, Mus musculus
guacaauagaaguuuuaagcaguuuuacaaccgcugucccuggau

SEQ ID NO: 98940 - RNA, 46 nt, Mus musculus
uccggggacugaggguagaggacgagggcaauuacaccugcgaguu

SEQ ID NO: 98941 - RNA, 45 nt, Mus musculus
aacucucaguucagcaaggaccgucuguccuuugucagagcgaga

SEQ ID NO: 98942 - RNA, 44 nt, Mus musculus
cggggccgcuugggaggcaccguggaguuaccgugccaccugcu

SEQ ID NO: 98943 - RNA, 46 nt, Mus musculus
cuauauuuguucacaguggggagacggugggguugaagagauagcu

SEQ ID NO: 98944 - RNA, 42 nt, Mus musculus
gcacacauagucugacuggagauaaaucuuagcgauagagcc

SEQ ID NO: 98945 - RNA, 44 nt, Mus musculus
uacugagcagcugggcauggacaugaagggucugagugagaaga

SEQ ID NO: 98946 - RNA, 42 nt, Mus musculus
uagauaaggaggaagccaggcugaccugcuacaacccaugca

SEQ ID NO: 98947 - RNA, 46 nt, Mus musculus
acuccaucuccccugcuuccccauccgacacccagaaccccuggcu

SEQ ID NO: 98948 - RNA, 42 nt, Mus musculus
gcacaaagaaugaaggaagauugcaagggagggcagaaagau

SEQ ID NO: 98949 - RNA, 60 nt, Mus musculus
cuguaggcaauggaauuuaaugaucaagggacucugaccuuuaccccucugcccccaaau

SEQ ID NO: 98950 - RNA, 53 nt, Mus musculus
gguccaggugcaguuaggguccagaggcacuaucuuggcagguucggauuuag

SEQ ID NO: 98951 - RNA, 44 nt, Mus musculus
cagaagggagggaacggggcaucgucccccaccucacucccagc

SEQ ID NO: 98952 - RNA, 45 nt, Mus musculus
aggcacccccugcccgggcccagucccuccccgggccccccaugg

SEQ ID NO: 98953 - RNA, 47 nt, Mus musculus
gagccggacacuucagaccccugacugcccucccagccgaucgguac

SEQ ID NO: 98954 - RNA, 41 nt, Mus musculus
gcguggucugggcgagaaggcauggcuucuccuggugggag

SEQ ID NO: 98955 - RNA, 42 nt, Mus musculus
cuggaaagaaaugaugcggcgacacgagaacccagggcagag

SEQ ID NO: 98956 - RNA, 46 nt, Mus musculus
ccguaccgagggcuuucuuggaaucucagaaaaacauugucguaag

SEQ ID NO: 98957 - RNA, 46 nt, Mus musculus
ccucuccuauguuccuuggagggcccaggaauacaacgccccaauc

SEQ ID NO: 98958 - RNA, 46 nt, Mus musculus
gagcauagaggcuauuaagugagggccaagaccccugagccaccac

SEQ ID NO: 98959 - RNA, 46 nt, Mus musculus
agaagcuggacauggugguacagguuugugaucucagcauugggag

SEQ ID NO: 98960 - RNA, 44 nt, Mus musculus
uaauuaggggcuguggaaaugcaauuccaccuaaggccagaaga

SEQ ID NO: 98961 - RNA, 44 nt, Mus musculus
gccagacaggaaagaggagaggacgagauacuaauaaaccaaga

SEQ ID NO: 98962 - RNA, 46 nt, Mus musculus
gucuguaugucucuguguguaugguauggugugucugugcugugug

SEQ ID NO: 98963 - RNA, 42 nt, Mus musculus
gugucugugcuaugugugucugugugugagugugugugucuc

SEQ ID NO: 98964 - RNA, 42 nt, Mus musculus
gugucugugcugugugugucugugugugagugugugugucuc

SEQ ID NO: 98965 - RNA, 41 nt, Mus musculus
cgcccccagccccucacugggggauucuaggcaggggggcu

SEQ ID NO: 98966 - RNA, 46 nt, Mus musculus
gguugcucuggacccagcuuggccucugggguccugauugggagug

SEQ ID NO: 98967 - RNA, 42 nt, Mus musculus
cuacuuccggccgcugcggcccagucucaacaaagaggaggc

SEQ ID NO: 98968 - RNA, 46 nt, Mus musculus
gggcgcgugcgcggucagauggaccauucccggaggucgaugggaa

SEQ ID NO: 98969 - RNA, 24 nt, Mus musculus
uuuuccuuuuggggagggcaucag

SEQ ID NO: 98970 - RNA, 43 nt, Mus musculus
uacuggaucaggccuuugaaggaccgagaaauagugacuggca

SEQ ID NO: 98971 - RNA, 47 nt, Mus musculus
aagcccaaaugucaaauuugcuguuggaggaaugcggcuggagcaag

SEQ ID NO: 98972 - RNA, 46 nt, Mus musculus
auucaggcuuugccauauuauuaguguccauaucuauuguccccag

SEQ ID NO: 98973 - RNA, 45 nt, Mus musculus
aggaggaagaaacgugugcauugagagaaacaggaauuaugggag

SEQ ID NO: 98974 - RNA, 42 nt, Mus musculus
ccagccacaagcuccucuaauacaggauguuggcagguagag

SEQ ID NO: 98975 - RNA, 42 nt, Mus musculus
ugccgguagaauggagaagggcucucccaggaaggagcagga

SEQ ID NO: 98976 - RNA, 42 nt, Mus musculus
agacugaggcaggaugaugaugaggcaauggccagcguggga

SEQ ID NO: 98977 - RNA, 46 nt, Mus musculus
guguugucuuagcuguagauaaugugaagggcugaauaaaagccag

SEQ ID NO: 98978 - RNA, 46 nt, Mus musculus
agcaugucagacccuuccuugguuccaucccuaguaccucagagag

SEQ ID NO: 98979 - RNA, 46 nt, Mus musculus
ucauaugcaccacugagcugcaauccccagccgccaccgccaccau

SEQ ID NO: 98980 - RNA, 45 nt, Mus musculus
uuugaucccuggcauugcauuaaccugggaagagaaggagacagg

SEQ ID NO: 98981 - RNA, 42 nt, Mus musculus
gaaggcccugagcaggaggccucagccuuuacuggauauaag

SEQ ID NO: 98982 - RNA, 45 nt, Mus musculus
ccaggauccugugcaggccagacaagugcucuaccauugucccac

SEQ ID NO: 98983 - RNA, 46 nt, Mus musculus
gucugcacaucgacacacaugcacauaaauacagucaaacuagaga

SEQ ID NO: 98984 - RNA, 45 nt, Mus musculus
cuagucguacuccagcugcagcuccagccucuaccccagcacaga

SEQ ID NO: 98985 - RNA, 46 nt, Mus musculus
agaccaaagcaccgucaccaggaccccaggacaauagugacacuga

SEQ ID NO: 98986 - RNA, 61 nt, Mus musculus
cccaggguggccaaacagagggaacaaaggcagcccccagccccagaggagaauggcgagg

SEQ ID NO: 98987 - RNA, 68 nt, Mus musculus
acccguaugcaggcuccacagaugagaacacagacagugagacccccucagaggcugaccugccaauc

SEQ ID NO: 98988 - RNA, 24 nt, Mus musculus
cccgcagacuucuucgagggcaaa

SEQ ID NO: 98989 - RNA, 46 nt, Mus musculus
uccccgcaaccacgugguggcucacaaccaucuguaaugggcugca

SEQ ID NO: 98990 - RNA, 65 nt, Mus musculus
cccugauggaaaacccuucccuggccuucgugcggccccgguggaucuacaguuguaaugagaag

SEQ ID NO: 98991 - RNA, 44 nt, Mus musculus
gucugcacugcaguggauagaaccgcuguaaauagcccggagcc

SEQ ID NO: 98992 - RNA, 41 nt, Mus musculus
cgcggggggguggggugguggugguggugguggugguggug

SEQ ID NO: 98993 - RNA, 43 nt, Mus musculus
agcugagaggcauugguggggagaacugagggaagggccuaga

SEQ ID NO: 98994 - RNA, 45 nt, Mus musculus
gcucagaaaaacuaggagggguuugaacacagaaccacagguagg

SEQ ID NO: 98995 - RNA, 45 nt, Mus musculus
ggucccuuggaagaagcugagggugugggguggaagaccugaaga

SEQ ID NO: 98996 - RNA, 70 nt, Mus musculus
uuuccuauuaagaggaugaacggggaaaucgaggaagaguagaauggaaacaagaugucaggagagggag

SEQ ID NO: 98997 - RNA, 44 nt, Mus musculus
uagaccaaucgaugcucagguuuccugaagccucgaccaauaga

SEQ ID NO: 98998 - RNA, 46 nt, Mus musculus
gcgcccgucgucucgccugcuccgcagccucgcucucaccccaggc

SEQ ID NO: 98999 - RNA, 35 nt, Mus musculus
agcugccucgccggagggcucucugguugcauggg

SEQ ID NO: 99000 - RNA, 58 nt, Mus musculus
gcugaggcagagaagagguuuuugagguaucuuuagagcgaagggagggaucaggugu

SEQ ID NO: 99001 - RNA, 46 nt, Mus musculus
ucuuuauuuauucuuacggguuucaauagguugagcuagaggggag

SEQ ID NO: 99002 - RNA, 41 nt, Mus musculus
gccaaagggaauauucgagcaaucuuggguguaguuggaga

SEQ ID NO: 99003 - RNA, 41 nt, Mus musculus
gugugcuggggcaguagcacagcacacuuggucuuggugga

SEQ ID NO: 99004 - RNA, 42 nt, Mus musculus
ucacagccagaugcgucucaccuuucugacacaccccuagag

SEQ ID NO: 99005 - RNA, 46 nt, Mus musculus
cucagcccagggccuugcugcugccaugacugaggagagugaagag

SEQ ID NO: 99006 - RNA, 46 nt, Mus musculus
ccaccagaggagccugcuauuagcuuuccugagccagccccugcag

SEQ ID NO: 99007 - RNA, 42 nt, Mus musculus
ccuaguagcugaauuugaaguucuaaauauugggggcuggag

SEQ ID NO: 99008 - RNA, 43 nt, Mus musculus
uucugcugccucuguaauccagccccgacaguuuuguucuggg

SEQ ID NO: 99009 - RNA, 46 nt, Mus musculus
gcugaggcuugagggcucuggcugccucuccucggaguguccagga

SEQ ID NO: 99010 - RNA, 41 nt, Mus musculus
ugacccuugccccuggcugggcaggggcagagaaggggaga

SEQ ID NO: 99011 - RNA, 44 nt, Mus musculus
uuggagguaagagagaugggugagggcgccgcagggcgggcggg

SEQ ID NO: 99012 - RNA, 45 nt, Mus musculus
cuggagcagcgcgggaugaucgacagcuccuuccugugugcccua

SEQ ID NO: 99013 - RNA, 44 nt, Mus musculus
ggcaugagcacaaguaaagagguaaggaaaguggccgauggcac

SEQ ID NO: 99014 - RNA, 43 nt, Mus musculus
gcaggcacacaguaacauaaacaaugacaaaaaaugguggcgg

SEQ ID NO: 99015 - RNA, 46 nt, Mus musculus
cucagcagacuaucaugugcacagagcuuggggagaccaucgccau

SEQ ID NO: 99016 - RNA, 44 nt, Mus musculus
gcggacuguugcaguuggauacggccuuugucugacacggcgca

SEQ ID NO: 99017 - RNA, 54 nt, Mus musculus
gaugucagagcugagaccugagggaucuaugucugucagccaggaagcgagaag

SEQ ID NO: 99018 - RNA, 47 nt, Mus musculus
ugcuaaaauguaguaugcuaaaacaguuaaaaggagaagccagaguc

SEQ ID NO: 99019 - RNA, 35 nt, Mus musculus
guaucaguccuuacuucccaccuuguuugaggcag

SEQ ID NO: 99020 - RNA, 46 nt, Mus musculus
uggaugguuguaagccaccaugugguuggugggauuugaacucagg

SEQ ID NO: 99021 - RNA, 45 nt, Mus musculus
ucugcuagaagguucagagggacagccauugaagcacauguggga

SEQ ID NO: 99022 - RNA, 42 nt, Mus musculus
agguuccaggcaugacccacuaguccacugcucuaauggcag

SEQ ID NO: 99023 - RNA, 45 nt, Mus musculus
auaaauaaauaaauaaauaaaucuuaaaaaaaaagaaggaagaaa

SEQ ID NO: 99024 - RNA, 45 nt, Mus musculus
aaaggccagaaaagccagucagagggugucagagaagacagugga

SEQ ID NO: 99025 - RNA, 46 nt, Mus musculus
ggcuggcuugaacucauggcagucuuccugccucccaaguguugag

SEQ ID NO: 99026 - RNA, 46 nt, Mus musculus
ggcagcagucucugcaaaugaggggugcuuggagagaagugggcag

SEQ ID NO: 99027 - RNA, 83 nt, Mus musculus
guucuuuuacuuacuuugagacagaggucuccuaagguugcccaugcuugucuagaacccagucuauucgaaacagaccucac

SEQ ID NO: 99028 - RNA, 45 nt, Mus musculus
gaacauggugagggauucuagaacauucuggggugauuuuuggua

SEQ ID NO: 99029 - RNA, 26 nt, Mus musculus
gcucuaucccugagcuaugcccccag

SEQ ID NO: 99030 - RNA, 46 nt, Mus musculus
ccucaacagugccaccugucaccugcgucaaggcagggcccacugu

SEQ ID NO: 99031 - RNA, 47 nt, Mus musculus
cucuguccacucugugaggagcaucgugacugucaugccugcaccca

SEQ ID NO: 99032 - RNA, 45 nt, Mus musculus
cgugcagccggcgaggccggggccgaggcgcucugaagaacccag

SEQ ID NO: 99033 - RNA, 42 nt, Mus musculus
cuguggcucucccugcccgcugggcuuaugcccgcuguccag

SEQ ID NO: 99034 - RNA, 46 nt, Mus musculus
gauucccacgcuuccuggacacugguguuguucagucagaccggag

SEQ ID NO: 99035 - RNA, 41 nt, Mus musculus
uaaggaggggaaucuuggcuagaaacagaagguaggggaca

SEQ ID NO: 99036 - RNA, 47 nt, Mus musculus
gauucaaugcuucugugggcucugcccgguguggaucaggagguccu

SEQ ID NO: 99037 - RNA, 58 nt, Mus musculus
gcugggcuggcccucacugccgcauggcucuguguccugagaauugcaacgcccacac

SEQ ID NO: 99038 - RNA, 49 nt, Mus musculus
acgaagcuggaugguggacaguuggucugggaaacgcucauggacagcc

SEQ ID NO: 99039 - RNA, 46 nt, Mus musculus
cagaugaugcuuauaagagauucucugugcagccgacucuagggag

SEQ ID NO: 99040 - RNA, 46 nt, Mus musculus
ccgccuaugugccugcuggccgaggugccauguaccugcugggggg

SEQ ID NO: 99041 - RNA, 46 nt, Mus musculus
uaggcaggggcuccaccaagccacgcccccagccccucacuggggg

SEQ ID NO: 99042 - RNA, 46 nt, Mus musculus
uaggcaggggcuccaccaagccacgcccccagccccucacugggag

SEQ ID NO: 99043 - RNA, 41 nt, Mus musculus
gggcaagugcauguggacgcggcaguucaagaggaccggua

SEQ ID NO: 99044 - RNA, 45 nt, Mus musculus
ucagggcccagugagacacugccaggaagggcugggagggcccag

SEQ ID NO: 99045 - RNA, 23 nt, Mus musculus
agugggggcggggccagcggccu

SEQ ID NO: 99046 - RNA, 29 nt, Mus musculus
agcuagaaauggccagaaaggagccagag

SEQ ID NO: 99047 - RNA, 46 nt, Mus musculus
cugcuggguguaggagaccccaacgggccuggugccaacgguucag

SEQ ID NO: 99048 - RNA, 46 nt, Mus musculus
agcaggaggugagaggagguucccucaucugguggggauugaguuc

SEQ ID NO: 99049 - RNA, 74 nt, Mus musculus
augaagcauuuggagaaacugggcugagaaaggugacagacggagggaagaccuuugggaaacaaauucaagag

SEQ ID NO: 99050 - RNA, 31 nt, Mus musculus
gguaaaugaggggcuucagcucuggggagaa

SEQ ID NO: 99051 - RNA, 52 nt, Mus musculus
uaacugggcaggaggaaggugaguggcaggaugugacaguggugcagauguu

SEQ ID NO: 99052 - RNA, 54 nt, Mus musculus
gggcuugugggcuuccaggugugacugcgggcucauacaggagggaaucuagug

SEQ ID NO: 99053 - RNA, 45 nt, Mus musculus
gaaccuggagauguaggcuuauuuaaaggcagccucagaggcaaa

SEQ ID NO: 99054 - RNA, 45 nt, Mus musculus
ugggacucugcacagaggccaccuacaccuggaucuccuuuuugg

SEQ ID NO: 99055 - RNA, 54 nt, Mus musculus
agcaugggucacaucucuaugauaggagggcaacugaggcaaagaauaaagugu

SEQ ID NO: 99056 - RNA, 42 nt, Mus musculus
agggcacgcacgguggcacggaggggaugcgggcuucaggag

SEQ ID NO: 99057 - RNA, 41 nt, Mus musculus
gggacuagggcacugggggagacgaacucucagggggggaa

SEQ ID NO: 99058 - RNA, 45 nt, Mus musculus
cugagggcuuacugggcacagauaccuugaagaagcugacaauaa

SEQ ID NO: 99059 - RNA, 46 nt, Mus musculus
ccagucuuaauacaugcacacccuccacuauaacacagccccaccu

SEQ ID NO: 99060 - RNA, 46 nt, Mus musculus
ccaccgagaggcugguucuguccuugguccuacaacaagcccuuag

SEQ ID NO: 99061 - RNA, 46 nt, Mus musculus
auuccaggacagccaggggaacgaagagaaacccugucucgaaaaa

SEQ ID NO: 99062 - RNA, 42 nt, Mus musculus
aaagugaggcagcccaauacccucaagagguuaaaggcagaa

SEQ ID NO: 99063 - RNA, 47 nt, Mus musculus
ggagguggguggcuugcuucuggauguccaguagauggggauaggug

SEQ ID NO: 99064 - RNA, 46 nt, Mus musculus
cagggcagagggagagacaccucaugaagcagagcaguaagaacua

SEQ ID NO: 99065 - RNA, 45 nt, Mus musculus
aggaucagcggggccugggccaggguggggacagagcaugagaga

SEQ ID NO: 99066 - RNA, 41 nt, Mus musculus
uggaucugggaggagcuggugagugagggccuuagagagau

SEQ ID NO: 99067 - RNA, 42 nt, Mus musculus
gagucuggauguccuggaaaugaucugagaggaacugcaaca

SEQ ID NO: 99068 - RNA, 41 nt, Mus musculus
guuggggcagcgcugcagggacagggaccgcagcuccuuca

SEQ ID NO: 99069 - RNA, 46 nt, Mus musculus
aggcaggcaaggccccguucugagauucuggggcagccagccagcg

SEQ ID NO: 99070 - RNA, 44 nt, Mus musculus
aucuucccaugcugcuccgugcugaaugagcuacaccagaagcc

SEQ ID NO: 99071 - RNA, 42 nt, Mus musculus
ucaugucagccacaguuccugcugauguguaugggcagaguu

SEQ ID NO: 99072 - RNA, 41 nt, Mus musculus
cggcugggcugucagauuuguuuauguuuggugguggugga

SEQ ID NO: 99073 - RNA, 46 nt, Mus musculus
ggacccaucuccuacuucacacugggagguggagaggccuggcaca

SEQ ID NO: 99074 - RNA, 45 nt, Mus musculus
gaaaggucacgggcagcuggcauaaagccagcacagggaugaaca

SEQ ID NO: 99075 - RNA, 45 nt, Mus musculus
agagaggccuacugagccaagggauguguuuguuugggguccaga

SEQ ID NO: 99076 - RNA, 46 nt, Mus musculus
ucuggagcacaguccaggcacaccucucucccuucaccucgcuuga

SEQ ID NO: 99077 - RNA, 45 nt, Mus musculus
ccccacagcagacagccuguccagacucgaccuacgugcccuccu

SEQ ID NO: 99078 - RNA, 53 nt, Mus musculus
cggcauccccaucuaccgugucauggaccgccagggccagaucaucaacccca

SEQ ID NO: 99079 - RNA, 45 nt, Mus musculus
uguauugacccucauaccuagcuuuuuguuuuguguucaugguga

SEQ ID NO: 99080 - RNA, 46 nt, Mus musculus
accugucugucucucccuucagccauccuuccccuugcccagaggu

SEQ ID NO: 99081 - RNA, 46 nt, Mus musculus
cugaccugagaggaagcccagcugcggugggagaaaagacgaagau

SEQ ID NO: 99082 - RNA, 45 nt, Mus musculus
aagagugaaaugcucucuuggguuucacaccugcagcacccagag

SEQ ID NO: 99083 - RNA, 44 nt, Mus musculus
agagagagagagacagagagagaggugugugugugugugugaga

SEQ ID NO: 99084 - RNA, 45 nt, Mus musculus
agcugaggccuugggagaaggguggggagguuauucagcuguggc

SEQ ID NO: 99085 - RNA, 45 nt, Mus musculus
agauauggaagcuaggaagguaaaagagaccauuaucagggagug

SEQ ID NO: 99086 - RNA, 46 nt, Mus musculus
gguaacccugacuguccuguccuggaacuugcuuuguagaccacac

SEQ ID NO: 99087 - RNA, 42 nt, Mus musculus
aucuggauauggcgacacaugucuguaauuucagcgcuuggg

SEQ ID NO: 99088 - RNA, 45 nt, Mus musculus
cguuauuuuuuugagacaggaucucacccacgaguccggaauggc

SEQ ID NO: 99089 - RNA, 48 nt, Mus musculus
gggacuuugccaugacuguccuuuacacaagaugauuaugaagggaga

SEQ ID NO: 99090 - RNA, 51 nt, Mus musculus
uuagaggaaaagcaaggcagcuacuugugggccucgauagaaggagacgag

SEQ ID NO: 99091 - RNA, 74 nt, Mus musculus
ucuuucuuagggagaaauagagacguaaaaguuauucuuacauugugugagacaccgcgggcugugaaggaaag

SEQ ID NO: 99092 - RNA, 45 nt, Mus musculus
agugguuauuagccaagauggcgauagugaugucugcggccaaga

SEQ ID NO: 99093 - RNA, 45 nt, Mus musculus
gagaagaaaugaguuggccagccugguaaaucccucucagaggag

SEQ ID NO: 99094 - RNA, 46 nt, Mus musculus
acagauggcugugagccaccaugugguugcugggaauucaacucag

SEQ ID NO: 99095 - RNA, 44 nt, Mus musculus
guugaggcuaagguguuuauuugcauaaauacccuuugagacag

SEQ ID NO: 99096 - RNA, 56 nt, Mus musculus
gccaacuuugagaggucaugagagggugagaaacuaccagaguagacagaugagag

SEQ ID NO: 99097 - RNA, 47 nt, Mus musculus
accuuauggcuaauaagcuagaggucauugcuuauagugguggguca

SEQ ID NO: 99098 - RNA, 46 nt, Mus musculus
ccccuaaucccaguacggggggagggagggcugguagaggccagag

SEQ ID NO: 99099 - RNA, 68 nt, Mus musculus
guguguacuccgacccggacugaggcugacagccccuuccugaagucucccuccagaggcuggaccaa

SEQ ID NO: 99100 - RNA, 41 nt, Mus musculus
gaagagccugaccgcuucccgucuccccaggcguggccgag

SEQ ID NO: 99101 - RNA, 42 nt, Mus musculus
gucaccugugcccuggacucugauggaaaucucgugcuggac

SEQ ID NO: 99102 - RNA, 46 nt, Mus musculus
uugucccagcucagaacaagccccucuguacgucccugcuggggag

SEQ ID NO: 99103 - RNA, 42 nt, Mus musculus
aacagcaacaaaagaucugugugugugcaggagugcccagag

SEQ ID NO: 99104 - RNA, 46 nt, Mus musculus
uuccgaucucaggcauuugaggucuuguugcuuucagagugugguc

SEQ ID NO: 99105 - RNA, 55 nt, Mus musculus
auuguggggugggaguuaggagguagugaagaagggcaugguccucgugauggug

SEQ ID NO: 99106 - RNA, 45 nt, Mus musculus
guuucugggcgaugugguccucuccgucaccacuguguacaccaa

SEQ ID NO: 99107 - RNA, 42 nt, Mus musculus
ugcauaugugcacaggcccagccccacggcaaggacccccag

SEQ ID NO: 99108 - RNA, 42 nt, Mus musculus
cuccguccugcuuccuguggcucucccccucccugcccccac

SEQ ID NO: 99109 - RNA, 46 nt, Mus musculus
uaugcgccaaaaccuuugcuucaaauacucuuuugauguaacucag

SEQ ID NO: 99110 - RNA, 46 nt, Mus musculus
cacuugcaaaagaggcugcuuuccgagaaaccgguggccccuauga

SEQ ID NO: 99111 - RNA, 46 nt, Mus musculus
uacagauaugcauaagcacaccuaguuugucuacuggccugaggac

SEQ ID NO: 99112 - RNA, 45 nt, Mus musculus
cucugucguagcuaaggaugaccuacgcuccccgggugacgagau

SEQ ID NO: 99113 - RNA, 46 nt, Mus musculus
aaguuccgaaguaggagcuagccugguggggccaaugaggcuagaa

SEQ ID NO: 99114 - RNA, 46 nt, Mus musculus
aaugcacagcugagugucccagccugacaguccaaugcuuggagau

SEQ ID NO: 99115 - RNA, 45 nt, Mus musculus
ucugaccucccuuuguggucucuucacucucccaggcccccaggu

SEQ ID NO: 99116 - RNA, 42 nt, Mus musculus
gccgaggagccguccgaggccccagagucugagaccagccgc

SEQ ID NO: 99117 - RNA, 42 nt, Mus musculus
ucucucccccgagaggcagaucucccucggaccugcuggcag

SEQ ID NO: 99118 - RNA, 45 nt, Mus musculus
cgccuaggcugggaaucagaacuuaaugguacuuauuucauccaa

SEQ ID NO: 99119 - RNA, 46 nt, Mus musculus
cugucuuuugacgucacuggaguuguacggcaguggcugaaccaag

SEQ ID NO: 99120 - RNA, 45 nt, Mus musculus
aggagagggcaucugagguaaugucucugagaugaauaaaggcaa

SEQ ID NO: 99121 - RNA, 65 nt, Mus musculus
aaacgucggggcgaccugggcaccauccaugacaugaaccggcccuuccugcuccucauggccac

SEQ ID NO: 99122 - RNA, 46 nt, Mus musculus
auguauguaggcuuggaagugugaaguguuggaauauaguacugag

SEQ ID NO: 99123 - RNA, 45 nt, Mus musculus
cagauggugggaaaccuagucauuucuucaacagauacagugcaa

SEQ ID NO: 99124 - RNA, 45 nt, Mus musculus
gaggaaagccagauagacucauggugauaacaggcauuugacgua

SEQ ID NO: 99125 - RNA, 45 nt, Mus musculus
gaaaaggagguggggagaauuggagaugggagaguaagugacuga

SEQ ID NO: 99126 - RNA, 41 nt, Mus musculus
agagagagagagagaggaagagagagagagagagaggccga

SEQ ID NO: 99127 - RNA, 42 nt, Mus musculus
gagauaagagacagaaauguagagauccugguggggagagag

SEQ ID NO: 99128 - RNA, 46 nt, Mus musculus
ucuuuugggaaguuguggcuuagguauuuuucacaguugaccagug

SEQ ID NO: 99129 - RNA, 46 nt, Mus musculus
uguagaaggugcagguguugugguacacaguaugguggcagguggu

SEQ ID NO: 99130 - RNA, 71 nt, Mus musculus
gggcccucuugcuucccccaagcucccaccuuacccuccaugccuccccacccuuguucacgcccauggau

SEQ ID NO: 99131 - RNA, 45 nt, Mus musculus
ucuuguucuuacucacuuucucccuucaugccacugccccaccuc

SEQ ID NO: 99132 - RNA, 41 nt, Mus musculus
acaacccugacuuugacaaccuggacauuguggcccgugau

SEQ ID NO: 99133 - RNA, 41 nt, Mus musculus
caagaaaaaacaagagaggggcuaggggagggagggagaga

SEQ ID NO: 99134 - RNA, 42 nt, Mus musculus
uccuucaggcugcccaccuggguaucuccgcagaccagaggu

SEQ ID NO: 99135 - RNA, 36 nt, Mus musculus
ucaaugcccgcacagcagccccgcaagcccccaggu

SEQ ID NO: 99136 - RNA, 41 nt, Mus musculus
gagccagacucccauuccaucuggaccgcaggagaaggaga

SEQ ID NO: 99137 - RNA, 46 nt, Mus musculus
aacugugugugguagagcaggccuguccuccuagcacugccaagac

SEQ ID NO: 99138 - RNA, 53 nt, Mus musculus
ggagcauugccacgaauuauagagccagaaaaaucuagagccauagaaucuca

SEQ ID NO: 99139 - RNA, 47 nt, Mus musculus
gagaacuuugaacucuaaacucaaaccuuaaaaucuagaacgcuggg

SEQ ID NO: 99140 - RNA, 47 nt, Mus musculus
uugaaacuguuauggauagggugcauaaggcauggacugcaucugag

SEQ ID NO: 99141 - RNA, 47 nt, Mus musculus
gagcuuucccccaguggcagugccuagcuuggguccugagaggaugu

SEQ ID NO: 99142 - RNA, 42 nt, Mus musculus
aauccuuaggaucagguuggguuggggggucagcuccuccag

SEQ ID NO: 99143 - RNA, 45 nt, Mus musculus
acauagaggauuucaucuggcuccugagcagggggcagagccuuc

SEQ ID NO: 99144 - RNA, 44 nt, Mus musculus
ggcaucuuggcaaugcgcccuuggcgguaguaauccccguugua

SEQ ID NO: 99145 - RNA, 47 nt, Mus musculus
uguguguguaugugugugugugugugugugugugugugccugugcac

SEQ ID NO: 99146 - RNA, 23 nt, Mus musculus
cugaacucaaucuagcccaggcc

SEQ ID NO: 99147 - RNA, 42 nt, Mus musculus
auggagugagggagagacaguuucagacagacaggaggggag

SEQ ID NO: 99148 - RNA, 42 nt, Mus musculus
gcuucagugguccgccggcuguaggacuuucggacacgguac

SEQ ID NO: 99149 - RNA, 45 nt, Mus musculus
gcggcagccacaagugcucccagcaguacauaccaccaaggccac

SEQ ID NO: 99150 - RNA, 45 nt, Mus musculus
ggcccuggcugcugcugcaggauauccggaugugauacggggugu

SEQ ID NO: 99151 - RNA, 41 nt, Mus musculus
cagccagauacccaccccaucgucugacagcacggccugag

SEQ ID NO: 99152 - RNA, 46 nt, Mus musculus
ugugcgugugugugagagagagagagagagagagagagagagagag

SEQ ID NO: 99153 - RNA, 42 nt, Mus musculus
uagcauuaugaccaucuuauagaugggagaacugaggcccag

SEQ ID NO: 99154 - RNA, 46 nt, Mus musculus
uugugggcuucacaugagaaagaagaugucuuguucaggccugggg

SEQ ID NO: 99155 - RNA, 42 nt, Mus musculus
ggacuccagauguguuuuccagauguacugccccgcccccac

SEQ ID NO: 99156 - RNA, 42 nt, Mus musculus
cuacacauuugggccacugaacagcauuagagauuugggaca

SEQ ID NO: 99157 - RNA, 42 nt, Mus musculus
guguuggcaggcacagcuuuguccucaggcuccuccaggaag

SEQ ID NO: 99158 - RNA, 46 nt, Mus musculus
uccugaaacucacuauguagaccaggcuggccuugaacucacagag

SEQ ID NO: 99159 - RNA, 81 nt, Mus musculus
accuggagcucacaccgaaguguccccgugaguccucuggcaccugugauauucccuggguuccccacaaacgggcugcca

SEQ ID NO: 99160 - RNA, 45 nt, Mus musculus
gagagagagagagagagagagagagagagagcacuccagcagggc

SEQ ID NO: 99161 - RNA, 44 nt, Mus musculus
ugccagaugccgacggcucgucucuucaucuuggucuugccaca

SEQ ID NO: 99162 - RNA, 46 nt, Mus musculus
gccgaccuucuuggugcguucagccaugucgccggaacccaagccc

SEQ ID NO: 99163 - RNA, 39 nt, Mus musculus
gcacggggaacugugcaaaugagugugggugcccauaga

SEQ ID NO: 99164 - RNA, 43 nt, Mus musculus
gagaagaaagcagagagaaagguuguuuguugauuuuggagga

SEQ ID NO: 99165 - RNA, 45 nt, Mus musculus
ugugguaaguguggugaugccugguuguuaucaguaggcugagau

SEQ ID NO: 99166 - RNA, 42 nt, Mus musculus
agacagugauggcugaauuagcuugcuuuuauacauccagag

SEQ ID NO: 99167 - RNA, 43 nt, Mus musculus; identical to SEQ ID NO: 99164

SEQ ID NO: 99168 - RNA, 45 nt, Mus musculus; identical to SEQ ID NO: 99165

SEQ ID NO: 99169 - RNA, 42 nt, Mus musculus; identical to SEQ ID NO: 99166

SEQ ID NO: 99170 - RNA, 45 nt, Mus musculus
gacagugagggguaaggacugugagaaagaacccagaugccauga

SEQ ID NO: 99171 - RNA, 46 nt, Mus musculus
uccuggagagagagagagagagagagagagagagagagagcccaaa

SEQ ID NO: 99172 - RNA, 41 nt, Mus musculus
gagcauccagggaccugggaaaggugagggucauugucaag

SEQ ID NO: 99173 - RNA, 41 nt, Mus musculus
ggucauuuuauccuuuucaugacagaaucaugguggggaga

SEQ ID NO: 99174 - RNA, 42 nt, Mus musculus
guuagaaaaucucuggaucucauugaucacagccugggugua

SEQ ID NO: 99175 - RNA, 46 nt, Mus musculus
accagagaaccaaaaaccaacaaacuccuccaggaggaggugggaa

SEQ ID NO: 99176 - RNA, 52 nt, Mus musculus
gccgcuuccugauuggcugcguguggcucccucuucguucugauuggccgcg

SEQ ID NO: 99177 - RNA, 46 nt, Mus musculus
cuagaccuggagguuaaucgacuggucaggaucccacagacagcag

SEQ ID NO: 99178 - RNA, 42 nt, Mus musculus
acagggcccagugacaguaaugguguuugggccaggcugggg

SEQ ID NO: 99179 - RNA, 46 nt, Mus musculus
gugugggaagagaccucauaauuuuuugaaauuaaaaccagcuuug

SEQ ID NO: 99180 - RNA, 23 nt, Mus musculus
gagacaaggggcgugggacauca

SEQ ID NO: 99181 - RNA, 42 nt, Mus musculus
ccugaggcaaggagggauugucggguagagauggggcuugcc

SEQ ID NO: 99182 - RNA, 44 nt, Mus musculus
cagugggacuagagcaggagaauaugaaacauuaguuggggggg

SEQ ID NO: 99183 - RNA, 49 nt, Mus musculus
gaggggaugaguaggcggggcaagaucauggggcgggacuagaagugcc

SEQ ID NO: 99184 - RNA, 46 nt, Mus musculus
caauaauugcccagauuaggauuaauagaucaauaauugcccagua

SEQ ID NO: 99185 - RNA, 161 nt, Mus musculus
aauaauugcccagauuaggauuaauagaucaauaauugcccagauuaggauuaauagaucaauaauugcccagauuaggauuaauagaucaauaauugcccagauuaggauuaauagaucaauaauugcccagauuaggauuaauagaucaauaauugccc

SEQ ID NO: 99186 - RNA, 64 nt, Mus musculus
uagccagauuaggauuaauagaucaauaauugcccagauuaggauuaauagaucaauaauugcc

SEQ ID NO: 99187 - RNA, 46 nt, Mus musculus
cucccccuggcugggagacgugcugcccuguuuucucucugcccag

SEQ ID NO: 99188 - RNA, 41 nt, Mus musculus
auagaugagggaagguucucaggagagugguccauggugca

SEQ ID NO: 99189 - RNA, 41 nt, Mus musculus
cacacugcccccuuggcaguggguugucuggguuagggggg

SEQ ID NO: 99190 - RNA, 42 nt, Mus musculus
gcuggaaaagaagcagacccugccucccuuccagccccagau

SEQ ID NO: 99191 - RNA, 41 nt, Mus musculus
agggucugcuucuuuuccagcaggucccagucuaugcugcg

SEQ ID NO: 99192 - RNA, 42 nt, Mus musculus
ccaagccaagcgcuuuaacaggggagcguacugcggccagug

SEQ ID NO: 99193 - RNA, 45 nt, Mus musculus
cugauuaccagcguggaugccaugacaacauucaaggaccucugu

SEQ ID NO: 99194 - RNA, 42 nt, Mus musculus
ccguuuguuuccuuucuuuuagaauaauuuguugauagccag

SEQ ID NO: 99195 - RNA, 45 nt, Mus musculus
acuguaacucaucugaguggcaaauuguauugcagauugcagaua

SEQ ID NO: 99196 - RNA, 47 nt, Mus musculus
cuuuagccacaggaugacccacuugucuaagagcaaugccaggaaag

SEQ ID NO: 99197 - RNA, 44 nt, Mus musculus
cagccuuagcaauuccagauaccucaaaaccuuuucaucugauu

SEQ ID NO: 99198 - RNA, 45 nt, Mus musculus
aggauugcugccaguucuucagaucccaacaccaaagaccaagag

SEQ ID NO: 99199 - RNA, 42 nt, Mus musculus
agugcaaggaauguggcaaaugcuuucgucaaaggucaaauu

SEQ ID NO: 99200 - RNA, 45 nt, Mus musculus
caugcaacaucagaaaauccauucuggugagagacccuuucagug

SEQ ID NO: 99201 - RNA, 46 nt, Mus musculus
gcccuggauggcugugaaggaagaaacagacaggccgagcccaggu

SEQ ID NO: 99202 - RNA, 42 nt, Mus musculus
ccuugucuggaaaaaccaaagagaagagaggagaggagagga

SEQ ID NO: 99203 - RNA, 70 nt, Mus musculus
ggagcaccagcaaguggaggggagcaccagcaaguggaggggagcaccagcaaguggaggggagcaccag

SEQ ID NO: 99204 - RNA, 125 nt, Mus musculus
ggaggggagcaccagcaaguggaggggagcaccagcaaguggaggggagcaccagcaaguggaggggagcaccagcaaguggaggggagcaccagcaaguggaggggagcaccagcaaguggagg

SEQ ID NO: 99205 - RNA, 46 nt, Mus musculus
gaaaaggaucaaacugagaaaggaaaaauacaaaaucuguguucag

SEQ ID NO: 99206 - RNA, 41 nt, Mus musculus
ucccacacugcccccuuggccguggguugucuggguuagga

SEQ ID NO: 99207 - RNA, 41 nt, Mus musculus
agaugagggaagguucucaggagagugguccauggugcaca

SEQ ID NO: 99208 - RNA, 45 nt, Mus musculus
agcucuagucuguacaguguacauuuuaaucucagcauuuuggga

SEQ ID NO: 99209 - RNA, 56 nt, Mus musculus
cgaccacaggaaccaaagcagaggacuaaguuucaguaaggagaggucaggcuagg

SEQ ID NO: 99210 - RNA, 46 nt, Mus musculus
cacccagcagauucuaguaccaccuggcgucaugcaggaagaagaa

SEQ ID NO: 99211 - RNA, 45 nt, Mus musculus
cauuuuuaaaaauuaaaacugauuauuuuugcccucugcccacau

SEQ ID NO: 99212 - RNA, 46 nt, Mus musculus
ugcuggucagccuucagacuuagugccaacuuauucaaucucagag

SEQ ID NO: 99213 - RNA, 45 nt, Mus musculus
aauaugaauguaaugagugugggaaaaccuuuaauuguucaaauc

SEQ ID NO: 99214 - RNA, 45 nt, Mus musculus
gcagugccuucacuguucuagcacagcucaucacucagccucaga

SEQ ID NO: 99215 - RNA, 46 nt, Mus musculus
cuagggaugagccuagggauuggaguuggaggaaucaaggagaggu

SEQ ID NO: 99216 - RNA, 45 nt, Mus musculus
acauacuguccugacugguaugguguuuuuguauaauauggcaga

SEQ ID NO: 99217 - RNA, 46 nt, Mus musculus
guccauuucauccagguucuccaguuuuguugauuauaggcuuuug

SEQ ID NO: 99218 - RNA, 45 nt, Mus musculus
uccuggcaauccaugagcaggggagaucuuuccaucuucugagau

SEQ ID NO: 99219 - RNA, 46 nt, Mus musculus
acauuuccaaugcuaucccaaaagucccccacaagcucccacaccc

SEQ ID NO: 99220 - RNA, 62 nt, Mus musculus
aucacaauacaguuaguucaaggaggccaaacacuugcccaguaaucaacacuacaagccuc

SEQ ID NO: 99221 - RNA, 38 nt, Mus musculus
acugagggagaggggauggagaagagaggaagggagaa

SEQ ID NO: 99222 - RNA, 45 nt, Mus musculus
gaugaguuauuucucugccagugaaaugagccaauucaagccaga

SEQ ID NO: 99223 - RNA, 42 nt, Mus musculus
cugguuggcuucggucuccacagaguaaggugggcuggguau

SEQ ID NO: 99224 - RNA, 41 nt, Mus musculus
ucucuuuacccaggauugguuuagucaauaaauggacguga

SEQ ID NO: 99225 - RNA, 70 nt, Mus musculus
cuacauuguccuggccaaggacuucgagaaagcauacaagaccgugaucaagaaagaugaacaggaacau

SEQ ID NO: 99226 - RNA, 46 nt, Mus musculus
gccuggaccgaaaaauugaauucccacucccugaccgucgccagaa

SEQ ID NO: 99227 - RNA, 46 nt, Mus musculus
ggauccugcuggaacuacugaaucaaauggauggauuugaccagaa

SEQ ID NO: 99228 - RNA, 47 nt, Mus musculus
ugaaauugaugccauugccaccaagagauucgaugcccagacaggag

SEQ ID NO: 99229 - RNA, 62 nt, Mus musculus
ugguggaggaauggcagacacugaccagucuaaaagagagacaggaggcugggagggugagg

SEQ ID NO: 99230 - RNA, 27 nt, Mus musculus
cgauaucggaggcauggacauccagaa

SEQ ID NO: 99231 - RNA, 45 nt, Mus musculus
gucuggguggccgcugcacucacaagucuugcuguagagaguaga

SEQ ID NO: 99232 - RNA, 23 nt, Mus musculus
gugggcuuugaggaagugaaggg

SEQ ID NO: 99233 - RNA, 49 nt, Mus musculus
ccaggaggaggugaagcggauccagagcauccccuuggucaucggucag

SEQ ID NO: 99234 - RNA, 47 nt, Mus musculus
ggaguuccuggaagugcaggaggaguauaucaaggacgagcagaaga

SEQ ID NO: 99235 - RNA, 46 nt, Mus musculus
gcaaucuacauaggggacugagcagcuccuguaucuauugagagau

SEQ ID NO: 99236 - RNA, 46 nt, Mus musculus
ugaaaucugaugcccucuucuggggugucugaagacugcuacagug

SEQ ID NO: 99237 - RNA, 46 nt, Mus musculus
aaaucccaacaaccaccugguggcucacaaccacccguaaugagau

SEQ ID NO: 99238 - RNA, 46 nt, Mus musculus
agaacuaggggguaaggggcaggaggaccaugagggauacccaggc

SEQ ID NO: 99239 - RNA, 46 nt, Mus musculus
cucugucuuacgcauccacgguaccaccuuugcaugcugcugggau

SEQ ID NO: 99240 - RNA, 46 nt, Mus musculus
ugaccuccacuggugucacucggggcuugcuguaaugcugggagau

SEQ ID NO: 99241 - RNA, 46 nt, Mus musculus
ccugaucauggccugagacaucaucucuaaugcagcugcaccacuu

SEQ ID NO: 99242 - RNA, 45 nt, Mus musculus
gccuguauguguguuguguuguaguaccccaagaagccgcaagag

SEQ ID NO: 99243 - RNA, 44 nt, Mus musculus
ucaagagaaguuagguuuauuaacagcaaagauugagggguagu

SEQ ID NO: 99244 - RNA, 41 nt, Mus musculus
aggcuuucuaaagaugguucuagagaauuggggguggggga

SEQ ID NO: 99245 - RNA, 45 nt, Mus musculus
auggggguccugaaagcuguagcuuagagggguguuucaguauug

SEQ ID NO: 99246 - RNA, 56 nt, Mus musculus
uaacaugaguuuggaaaucuauagaagggucuaagaaauaugagaagaggacaggg

SEQ ID NO: 99247 - RNA, 85 nt, Mus musculus
uuuggaauggggagagguagaaggguaaauucuuggggguauuugaagaagucugaaggagagaugacuugaauaugugaugcag

SEQ ID NO: 99248 - RNA, 43 nt, Mus musculus
gugaagacagaugacgaguagccaccaaggaauguguugcgau

SEQ ID NO: 99249 - RNA, 42 nt, Mus musculus
cccagaggaggcaguugaaagcugaggguggucuccggggag

SEQ ID NO: 99250 - RNA, 42 nt, Mus musculus
cuaaaauuguauggaggcuuaggagaagauucaucagggguc

SEQ ID NO: 99251 - RNA, 45 nt, Mus musculus
ccucagaacaucuccccagaagaacuuaaguuggaauugccagag

SEQ ID NO: 99252 - RNA, 45 nt, Mus musculus
gacuggaguacuaagcuaccacauacgugccuggugccugcauag

SEQ ID NO: 99253 - RNA, 46 nt, Mus musculus
caucuuuucaccucuuauaccaauaauuuuuuaagggguagacaaa

SEQ ID NO: 99254 - RNA, 45 nt, Mus musculus
aggguguccuauccuuugugcuucaucuucuccagccccgugggu

SEQ ID NO: 99255 - RNA, 45 nt, Mus musculus
ugaacaacagaugauguacgcaggaaguaaaaacaggcuggugca

SEQ ID NO: 99256 - RNA, 45 nt, Mus musculus
uuugauguauuuuauuacauuguauuugugugugugugugugugu

SEQ ID NO: 99257 - RNA, 45 nt, Mus musculus
cauaggcacacaggcacacaggcacacacacacacacacacacac

SEQ ID NO: 99258 - RNA, 45 nt, Mus musculus
acucaauaaaauaaaguaaauaaaugaaaaauaaaaagaauugag

SEQ ID NO: 99259 - RNA, 42 nt, Mus musculus
ccaaccgcccuugcccggauacuggaaggggaaacugaggag

SEQ ID NO: 99260 - RNA, 42 nt, Mus musculus
uucccagcaaccgcaugguggcucacaaccaucuguacuaag

SEQ ID NO: 99261 - RNA, 45 nt, Mus musculus
gggcuuuucuuccuagcccccauguguguguccacucucugucug

SEQ ID NO: 99262 - RNA, 45 nt, Mus musculus
uuccuuccucucaccucccucucuucccucccuucucucugcuuc

SEQ ID NO: 99263 - RNA, 56 nt, Mus musculus
cccgaggccaccuggaaauuggcgagaaacuggacaucauccggcagaagugagcu

SEQ ID NO: 99264 - RNA, 62 nt, Mus musculus
cccaacacccccauucuccccagaccucuccccuccccccccuuagcccaucauccccacac

SEQ ID NO: 99265 - RNA, 43 nt, Mus musculus
gcaggagucuggaaagaugagguccagccaggagauaagggau

SEQ ID NO: 99266 - RNA, 45 nt, Mus musculus
uugaggccagcaaggggugcauggugagacccuauguggggagug

SEQ ID NO: 99267 - RNA, 46 nt, Mus musculus
agcagaggccugaccagcaugcacagcccuugaguuccagccccag

SEQ ID NO: 99268 - RNA, 60 nt, Mus musculus
caugccccugcugccguggauucccaacccaacccagagaacgaagaggagccgcgugau

SEQ ID NO: 99269 - RNA, 75 nt, Mus musculus
ccccgucccagccacccaagagaugccucagauaccuaccucacucagagccaggacuguaccccagacaccagc

SEQ ID NO: 99270 - RNA, 44 nt, Mus musculus
uccugcaccggcugcauacaacuucucuacuguagaugccuccc

SEQ ID NO: 99271 - RNA, 45 nt, Mus musculus
gucauucugcaggucaagguacucggugccggcggagaagcccag

SEQ ID NO: 99272 - RNA, 46 nt, Mus musculus
caaguggguaucacuacaucccgccuggggagugugugugugugug

SEQ ID NO: 99273 - RNA, 45 nt, Mus musculus
aaggcuagccugggcuacaugagaccgucaaacacaaacaaucga

SEQ ID NO: 99274 - RNA, 42 nt, Mus musculus
gggccauauggugagacccagucucaaaaaaggagggaggaa

SEQ ID NO: 99275 - RNA, 42 nt, Mus musculus
ucccaacaucaugcccguaaucccagcuuuagagggguggag

SEQ ID NO: 99276 - RNA, 25 nt, Mus musculus
agaugggacaagcaugcaggugcau

SEQ ID NO: 99277 - RNA, 41 nt, Mus musculus
uucccuucccuucccuucccuucccuucccuuccccgcuaa

SEQ ID NO: 99278 - RNA, 36 nt, Mus musculus
agcugacccucgaaggagugacacgcuacaugcaga

SEQ ID NO: 99279 - RNA, 41 nt, Mus musculus
gagagagagacagagagagacagagagagagagacaaagag

SEQ ID NO: 99280 - RNA, 42 nt, Mus musculus
aaacaaauaacagcccauauacacacuagguggauggcccug

SEQ ID NO: 99281 - RNA, 46 nt, Mus musculus
ucaaauuuucuuuuuuaagugugugugugugugugugugugugugu

SEQ ID NO: 99282 - RNA, 46 nt, Mus musculus
aaaccuggagaaguaccaccuuccuuacccagaggccaucuuugag

SEQ ID NO: 99283 - RNA, 45 nt, Mus musculus
uucacaucagcacuguuacucuucucucagccaaccaucugccac

SEQ ID NO: 99284 - RNA, 46 nt, Mus musculus
uacucauuggaaucaggagaaaggucagaaauucaagguugcugga

SEQ ID NO: 99285 - RNA, 46 nt, Mus musculus
ggguagacccaacucacggugggcuuaugaggacagagccccauug

SEQ ID NO: 99286 - RNA, 45 nt, Mus musculus
ucggugagaaccuuccaucgcgcuucuucuccugcaugcagucag

SEQ ID NO: 99287 - RNA, 45 nt, Mus musculus
cuagccaccccacggcugcucauuaacaaggaaaagacaggccag

SEQ ID NO: 99288 - RNA, 46 nt, Mus musculus
cucaguccucugagcacucacacauagagagcacacaugcagucag

SEQ ID NO: 99289 - RNA, 45 nt, Mus musculus
gccugccaaggaggcggccaggaccaaagagaaagaggaacagca

SEQ ID NO: 99290 - RNA, 45 nt, Mus musculus
auuauucccagacaacaggcuaccccaaaaccccuaacagugcca

SEQ ID NO: 99291 - RNA, 46 nt, Mus musculus
gacuuggagacauugccaaggccugaaggcuucgggguuucuggag

SEQ ID NO: 99292 - RNA, 42 nt, Mus musculus
ucuggaccaacccccaguuccggcugacacugcuggagccug

SEQ ID NO: 99293 - RNA, 45 nt, Mus musculus
ccuugguguuuucuuccugcagauuccggaggagguggguaucag

SEQ ID NO: 99294 - RNA, 46 nt, Mus musculus
ugcucacgaccauugcccgcaccaucaaugagguggaaaaccagau

SEQ ID NO: 99295 - RNA, 46 nt, Mus musculus
cagagagucagguaucgggcagcgacaagcauaauuguaaagaguu

SEQ ID NO: 99296 - RNA, 42 nt, Mus musculus
uauucuuacuguuugugagaaagagaaaaagaggggguagag

SEQ ID NO: 99297 - RNA, 46 nt, Mus musculus
cgccaugaugucccuuuguccuaaugguuaacccuccucagaagau

SEQ ID NO: 99298 - RNA, 45 nt, Mus musculus
ugggacaauagaaaaguccuuugaauccuugugcuuguggcaggu

SEQ ID NO: 99299 - RNA, 56 nt, Mus musculus
gugaaugggcuaaugagugagugaguaaaugaaugaauggauuaaugaaugaguga

SEQ ID NO: 99300 - RNA, 45 nt, Mus musculus
ggauggguggauuaaugaaugaaugagugaguaagugagugagug

SEQ ID NO: 99301 - RNA, 44 nt, Mus musculus
gccaggcaugucagcacacacuggucaucccaucacgugggagg

SEQ ID NO: 99302 - RNA, 42 nt, Mus musculus
uacauaacuacauaauuaguugaagaccaaguucggccaaca

SEQ ID NO: 99303 - RNA, 45 nt, Mus musculus
aggcgugugacacgcccagcugcccuuuguucuuagugcacccca

SEQ ID NO: 99304 - RNA, 42 nt, Mus musculus
agauaugggggcaaugaaagguaaucauggaucagagguggg

SEQ ID NO: 99305 - RNA, 45 nt, Mus musculus
uacuacaaaacaauacugagcuuuucagagcaacccccaacugag

SEQ ID NO: 99306 - RNA, 24 nt, Mus musculus
ucuggggaucaauugcuggccccg

SEQ ID NO: 99307 - RNA, 46 nt, Mus musculus
cgggucacuugcacaugaacugauggcaaugucuguggacucucag

SEQ ID NO: 99308 - RNA, 46 nt, Mus musculus
gcagggccucgguaucucaguccucaguuugggguccagguaccag

SEQ ID NO: 99309 - RNA, 44 nt, Mus musculus
cucccugccccagcuaaagacucugaagguucaggaaucccagu

SEQ ID NO: 99310 - RNA, 42 nt, Mus musculus
gaagacauuuguauaaaaccucaaaagaaaagaucaggccag

SEQ ID NO: 99311 - RNA, 44 nt, Mus musculus
gucagagggcagggagucucugcaguguccugggaaggggagga

SEQ ID NO: 99312 - RNA, 44 nt, Mus musculus
aauaagauggagccagaggaggauucugaacagaaaggggacau

SEQ ID NO: 99313 - RNA, 42 nt, Mus musculus
ccagccguucaggaggggaaggggcggccacagcgcccccag

SEQ ID NO: 99314 - RNA, 46 nt, Mus musculus
gggcaccgggagccggggcgaggggggagggagggggaaccuggaa

SEQ ID NO: 99315 - RNA, 41 nt, Mus musculus
ggcggagcugggcggagcuuuaggaaagggguggagccuaa

SEQ ID NO: 99316 - RNA, 42 nt, Mus musculus
agcgacuagagaauggggcggggccugguuagacuaguguug

SEQ ID NO: 99317 - RNA, 42 nt, Mus musculus
uaagagccgggggcugagauaauauuggaggacagggcagac

SEQ ID NO: 99318 - RNA, 44 nt, Mus musculus
gcgguggcgguugcuggaacuugggaugugacuguggcuggagu

SEQ ID NO: 99319 - RNA, 41 nt, Mus musculus
gguggcucgcucaggugguugguaggugugcucagccugag

SEQ ID NO: 99320 - RNA, 45 nt, Mus musculus
uccaggagcaauuuaucuccaccaucacacuggggagacucgggc

SEQ ID NO: 99321 - RNA, 107 nt, Mus musculus
cucgaugacuuguuuggccaguucaguagaggggauggugcugucuucuggcuucugcugcuggcuggcaaagcuguaguaguuguuagggcccagcacccaaccuc

SEQ ID NO: 99322 - RNA, 41 nt, Mus musculus
ggcaauacacuaugagaaacaccagggcgucaaucauaggc

SEQ ID NO: 99323 - RNA, 45 nt, Mus musculus
ccuuguuguagcuacccuccaugagguacugccaaagccaaugga

SEQ ID NO: 99324 - RNA, 42 nt, Mus musculus
gaggacgccagauacacaaggaacuacccacuccugcuccag

SEQ ID NO: 99325 - RNA, 37 nt, Mus musculus
cuaaugcuuguaacucuuacccuacagcaccaucagg

SEQ ID NO: 99326 - RNA, 42 nt, Mus musculus
augcacgaacuagcaauauguggaugugcauaugugugaguc

SEQ ID NO: 99327 - RNA, 45 nt, Mus musculus
acugaaacaaccugauuguucaauuguaacuggacagaacccggg

SEQ ID NO: 99328 - RNA, 36 nt, Mus musculus
gccaugcuuuucugugcuaggcacacaguaguagau

SEQ ID NO: 99329 - RNA, 46 nt, Mus musculus
gccaaaugauuuccccauucuaaaccuuuauaucccagccauaaga

SEQ ID NO: 99330 - RNA, 42 nt, Mus musculus
uggagauguggaacucaguuguugacuggaaguauccuugag

SEQ ID NO: 99331 - RNA, 45 nt, Mus musculus
aaggaaaaagaagaauaggugggacacgugaauccaauaggcagu

SEQ ID NO: 99332 - RNA, 42 nt, Mus musculus
gugggugggugacagguggaaaaguaaguaaaggacgggcga

SEQ ID NO: 99333 - RNA, 45 nt, Mus musculus
gaaugaauggaugcauagaugagugggugaaucgauggcagggua

SEQ ID NO: 99334 - RNA, 42 nt, Mus musculus
ucuacgggagcagccuggccgcucagggcaaggagcugguag

SEQ ID NO: 99335 - RNA, 42 nt, Mus musculus
aaaccugaugggcucggcgcagccuccacuucugaccggcag

SEQ ID NO: 99336 - RNA, 42 nt, Mus musculus
cccucugccucugagucgcuggagcugcuacugcugcuggag

SEQ ID NO: 99337 - RNA, 44 nt, Mus musculus
gcugcagcgacggcuggacguggagaaguggaucgacggaugcu

SEQ ID NO: 99338 - RNA, 23 nt, Mus musculus
gacugcagccaaggagagagccc

SEQ ID NO: 99339 - RNA, 86 nt, Mus musculus
acaugccggacgaggucaacaucgaugagcuauuggaauuggacagugaagaggaaagaugccggaaaauccagguagguggagag

SEQ ID NO: 99340 - RNA, 46 nt, Mus musculus
cccagggaguaauuucagcuuccuccaaucuuucuaccugccccug

SEQ ID NO: 99341 - RNA, 46 nt, Mus musculus
cccuguuuggccccagaucccacuucgaauaagcuguugcccaaag

SEQ ID NO: 99342 - RNA, 45 nt, Mus musculus
ccgccaggaccgggcccacacugccccacccugacugcgcccgcc

SEQ ID NO: 99343 - RNA, 46 nt, Mus musculus
cccaaaguuccggugucuaggaaaacaacucacccaucuuagugag

SEQ ID NO: 99344 - RNA, 45 nt, Mus musculus
gccuuugggcgggcauagagggguaguggaugcuagccagcagca

SEQ ID NO: 99345 - RNA, 42 nt, Mus musculus
aggcaccacgcgggcgcagggcggggcucucaaggaggagga

SEQ ID NO: 99346 - RNA, 42 nt, Mus musculus
ugaggcaggcaggcagccagcccccugcagugagaagcacag

SEQ ID NO: 99347 - RNA, 42 nt, Mus musculus
caccccaaaagagguuagagauggaagcaguugugggcagag

SEQ ID NO: 99348 - RNA, 45 nt, Mus musculus
ucuucucuccagcaagacagggaggagcugggacaaagccacagg

SEQ ID NO: 99349 - RNA, 42 nt, Mus musculus
cugcacugcgccccguagucccuucccuuucuugccccaguu

SEQ ID NO: 99350 - RNA, 46 nt, Mus musculus
gggcuacacagugagaccuuuucuuuaaaaaggaaagaaagagaaa

SEQ ID NO: 99351 - RNA, 51 nt, Mus musculus
cgcucaaggucauucucuacugccuaacguuggguugcaagagagaaaaag

SEQ ID NO: 99352 - RNA, 45 nt, Mus musculus
ccggcuggacugcaggcuucagaggacugcaaaaacaagccaaca

SEQ ID NO: 99353 - RNA, 46 nt, Mus musculus
gguuuuugguuucuguauaaguuaucucucaccucucaguuugugu

SEQ ID NO: 99354 - RNA, 50 nt, Mus musculus
ucauugcagaguacggugauguucagagauguggcugugggcuuuucuca

SEQ ID NO: 99355 - RNA, 45 nt, Mus musculus
ccucuauguaugaggguaguauuaaucacauucaauggguuguua

SEQ ID NO: 99356 - RNA, 46 nt, Mus musculus
ucagaggguaaaaagaaaaaaagaaaaaaagaaaaggagaggccag

SEQ ID NO: 99357 - RNA, 45 nt, Mus musculus
acagaacucagagccaugcugggccucugggcucugcagcgggaa

SEQ ID NO: 99358 - RNA, 44 nt, Mus musculus
ucaggccgacaaugaccucccaguacacuugaaaggcgggggaa

SEQ ID NO: 99359 - RNA, 89 nt, Mus musculus
gggcugggccuccuucccccacaagaagugacaccaagaagcuuggaggacuuggacaaacaucaauaaauaugcuaaucucuugagaa

SEQ ID NO: 99360 - RNA, 45 nt, Mus musculus
cuuggugaauucguucuugaagggcggcgguggcggugggggagg

SEQ ID NO: 99361 - RNA, 46 nt, Mus musculus
cuuaccaucccggaucugacgaccaaaaaauauaagcccaaagauc

SEQ ID NO: 99362 - RNA, 45 nt, Mus musculus
uaaucuggacagcguugaauuuccagcaguguguguauggggacg

SEQ ID NO: 99363 - RNA, 42 nt, Mus musculus
gggcaugaagcuggcagccucuucaagccuuggguggaugug

SEQ ID NO: 99364 - RNA, 45 nt, Mus musculus
aggggugggagaugggggugagcagggagggagguagcauugaga

SEQ ID NO: 99365 - RNA, 45 nt, Mus musculus
agacuaggcaggaagcguuggugacagcuagaggcagggaggaau

SEQ ID NO: 99366 - RNA, 46 nt, Mus musculus
uaauaagcuugcuuuauaaacaucagcucauacaagaccuccugau

SEQ ID NO: 99367 - RNA, 41 nt, Mus musculus
ugcuguugcuuaccagugugaguccucaugugacgcuugag

SEQ ID NO: 99368 - RNA, 46 nt, Mus musculus
auggugaugcccagugccucccgagugccuucaccuccaggcccag

SEQ ID NO: 99369 - RNA, 46 nt, Mus musculus
uauggcagucacaguagccagcuucugugcacccagcccuguagac

SEQ ID NO: 99370 - RNA, 50 nt, Mus musculus
ccugcaccgcuuuccuggggcaaccaugaggcccgagccagccugaaacu

SEQ ID NO: 99371 - RNA, 85 nt, Mus musculus
aggccugacauccugugucccuccuuccucggugccacccacagacaggaagccuccaacacccacaucuguacugaccacaggc

SEQ ID NO: 99372 - RNA, 28 nt, Mus musculus
cccugcucccuucuuucuacccccagcc

SEQ ID NO: 99373 - RNA, 44 nt, Mus musculus
gcuccucaaacggacccuggcccucaccucaccaugacagcagg

SEQ ID NO: 99374 - RNA, 46 nt, Mus musculus
augaggaggagacagaggcaggaccugaagaccagcaaggcgacac

SEQ ID NO: 99375 - RNA, 42 nt, Mus musculus
ccauggguaacaggguaagaccuuaucuggaagaaggaagga

SEQ ID NO: 99376 - RNA, 45 nt, Mus musculus
gagcugugguacaggccuguaaucucagguguucaggagacugau

SEQ ID NO: 99377 - RNA, 45 nt, Mus musculus
gugagauucguucccugagcccuggagagcagacagaggaugaga

SEQ ID NO: 99378 - RNA, 45 nt, Mus musculus
ggcggggcucccucccagaugucauggagacuggaagaagcagag

SEQ ID NO: 99379 - RNA, 55 nt, Mus musculus
gauucuuaaagggagagagagcuggagcacuaggagaguuagugcagucuaugac

SEQ ID NO: 99380 - RNA, 45 nt, Mus musculus
aagguacucgcugccaagucugaugacccuggaacccacauagug

SEQ ID NO: 99381 - RNA, 46 nt, Mus musculus
uccccucuucugaggagaagggaggugggugagagggagagacugg

SEQ ID NO: 99382 - RNA, 46 nt, Mus musculus
augagggaugagccaaaugugguggugacaccuucuauccugguau

SEQ ID NO: 99383 - RNA, 46 nt, Mus musculus
cuuuuauacaacucacagcagacgguggaggagcugugguggcagg

SEQ ID NO: 99384 - RNA, 46 nt, Mus musculus
agcagguuuuaaggugguacguggccgcugugccagccuagaagga

SEQ ID NO: 99385 - RNA, 45 nt, Mus musculus
uucccagcacccacguggggguucacaaaaguucaacuuccagag

SEQ ID NO: 99386 - RNA, 25 nt, Mus musculus
guucaccuucgagcccauacccgcu

SEQ ID NO: 99387 - RNA, 70 nt, Mus musculus
ccaggcccacagccuacucuaccucaccaaccugcccaaaccacacuaccugggaguggacguggcccac

SEQ ID NO: 99388 - RNA, 45 nt, Mus musculus
ucaaaugcuaucccaaaaguccccuauacccuccccgccccuucc

SEQ ID NO: 99389 - RNA, 46 nt, Mus musculus
cuuggaggcggggucucccaggucacccagcuucuugggcauaaaa

SEQ ID NO: 99390 - RNA, 46 nt, Mus musculus
ggcaugugagguuuugguucuuagaagccucuacugaggccaaggu

SEQ ID NO: 99391 - RNA, 46 nt, Mus musculus
ccugagugcucuggccuucuccccagaugggaaguacauagugaca

SEQ ID NO: 99392 - RNA, 45 nt, Mus musculus
guuuccccagccuuggggaccaggaguggcuagaauggcaagagc

SEQ ID NO: 99393 - RNA, 42 nt, Mus musculus
uuugugcuaaguacuguuccagguguugaugaccuagcagug

SEQ ID NO: 99394 - RNA, 42 nt, Mus musculus
gugcguggugguggucuugaaccccaaggagaacaagcagca

SEQ ID NO: 99395 - RNA, 26 nt, Mus musculus
gacgaaccaguuccagaagcccccag

SEQ ID NO: 99396 - RNA, 45 nt, Mus musculus
guuccccuuaagagguagcauguggggaaaacccaggucggagca

SEQ ID NO: 99397 - RNA, 24 nt, Mus musculus
ggaccaauagcuccaguuggagaa

SEQ ID NO: 99398 - RNA, 45 nt, Mus musculus
aggggcagaaaugcauuuggaauugcaagaccacaaagcugcauu

SEQ ID NO: 99399 - RNA, 46 nt, Mus musculus
uggcacguuggagggacagaaggucaguuggcugaagggcuaaggg

SEQ ID NO: 99400 - RNA, 45 nt, Mus musculus
uuugagucucuauuuuuuuauugucugcuuuuguuugguuuugag

SEQ ID NO: 99401 - RNA, 46 nt, Mus musculus
ucuuccugcaguucucugccucagcaucugaagugcugggguugua

SEQ ID NO: 99402 - RNA, 42 nt, Mus musculus
ggccagugggugggcguggagcuagaugaaccagaaggcaag

SEQ ID NO: 99403 - RNA, 45 nt, Mus musculus
ugggcagucugcagcagcgugaaggggccaaagcugaaguuggag

SEQ ID NO: 99404 - RNA, 46 nt, Mus musculus
gauucccagugacuucagaauagaaaccccguuagccagcccucga

SEQ ID NO: 99405 - RNA, 46 nt, Mus musculus
agucuccucaaaauguugugaccccaaggucaccagaaagcccuua

SEQ ID NO: 99406 - RNA, 63 nt, Mus musculus
aguucaaauuccagagagaauauauauuauauauguccccaaauuucccaucccuccaagccc

SEQ ID NO: 99407 - RNA, 46 nt, Mus musculus
auccccagggaaucccaaacuuaagaccccaaucccaagcccucag

SEQ ID NO: 99408 - RNA, 33 nt, Mus musculus
gacgcuguagacggucagauuuauuuuggggag

SEQ ID NO: 99409 - RNA, 46 nt, Mus musculus
acaggggaagaaacuuuggcaaucuggcucagaucugagggugcug

SEQ ID NO: 99410 - RNA, 53 nt, Mus musculus
ggagauaagaggaagcugggaguggacaagucugagaaagcucagaaugggag

SEQ ID NO: 99411 - RNA, 55 nt, Mus musculus
ucuucggguggcuuugagaaacugaagacuccagcguugaagauuggaguuuaua

SEQ ID NO: 99412 - RNA, 23 nt, Mus musculus
gggcaaagacgagaagaacucag

SEQ ID NO: 99413 - RNA, 59 nt, Mus musculus
cuuuuugggggucucccagcuaaccauguccuugugaaccaguaucugccuggggaggg

SEQ ID NO: 99414 - RNA, 56 nt, Mus musculus
caucaugguaaccgcacauccucaucccaaguuccccugcuaaguaccucccccag

SEQ ID NO: 99415 - RNA, 47 nt, Mus musculus
cuauugucagguuuaaaacguaauagcaggagauagugaacagagaa

SEQ ID NO: 99416 - RNA, 46 nt, Mus musculus
cuuccagaaccaguuugucguaucuacuggcacagucugucaauag

SEQ ID NO: 99417 - RNA, 42 nt, Mus musculus
acaugucugugggaaauccagagcaucaagguguucgagcag

SEQ ID NO: 99418 - RNA, 41 nt, Mus musculus
caugacgagggaauguugaggaauuacaaggaggagggaga

SEQ ID NO: 99419 - RNA, 46 nt, Mus musculus
agagcuuauuugagagacauuaggacuagaaaagggucuuugagua

SEQ ID NO: 99420 - RNA, 42 nt, Mus musculus
ggcuguguacucucugggccgccuggucucccgaggucaagg

SEQ ID NO: 99421 - RNA, 42 nt, Mus musculus
cuuccgcugucccuugaccucgggagaccaggcggcccagag

SEQ ID NO: 99422 - RNA, 44 nt, Mus musculus
gcucacaaccauccguaaugagaucuggugcccucuucuaggug

SEQ ID NO: 99423 - RNA, 30 nt, Mus musculus
uuaaaaguauagaauagaguuuauucuggg

SEQ ID NO: 99424 - RNA, 45 nt, Mus musculus
aaggcgacucagucucagcaauguguuguuuccgggucccuagag

SEQ ID NO: 99425 - RNA, 45 nt, Mus musculus
cucugaaaaguguuagaaucucuugauucuuguuuugaguuuggu

SEQ ID NO: 99426 - RNA, 46 nt, Mus musculus
gcccugcacucaacaucuucuguuggcuuuguaguucuccagcucg

SEQ ID NO: 99427 - RNA, 46 nt, Mus musculus
ggcagaaaugcuucaaguucaggccuagccuggacuucacagugag

SEQ ID NO: 99428 - RNA, 45 nt, Mus musculus
aacuguauuaaagggucccagcauuaggaagguugagagccacug

SEQ ID NO: 99429 - RNA, 46 nt, Mus musculus
uugagauagaauaacaagauggcuguuagcacccuaugagcugugg

SEQ ID NO: 99430 - RNA, 42 nt, Mus musculus
uacaaggggcuuucuaggugauuucugugaaaucgagcccac

SEQ ID NO: 99431 - RNA, 42 nt, Mus musculus
guguaucccuguagcuaccaauuaaacucaauuuggccucag

SEQ ID NO: 99432 - RNA, 46 nt, Mus musculus
uuucuucacuaacaucccaauaaaguccucuuucccacccggccau

SEQ ID NO: 99433 - RNA, 48 nt, Mus musculus
uucauucuuguuuccccuuccuaguuccaaauuccacacccuuagaaa

SEQ ID NO: 99434 - RNA, 83 nt, Mus musculus
aauuuggaacuaggaaggggaaacaagaaugaauuugucaagaucucccucccccaccggaagcugggaguuggguuuggggg

SEQ ID NO: 99435 - RNA, 68 nt, Mus musculus
accuaccgcuuccuggaagaacgaccuugaccccuacccuagcugccuucagcugagcccuacugccc

SEQ ID NO: 99436 - RNA, 42 nt, Mus musculus
gcuucugcgcaagaagaaacccuaugggacuaucagccaugg

SEQ ID NO: 99437 - RNA, 43 nt, Mus musculus
uggagguuacagccuggaugccaaccucugaccucgcccccag

SEQ ID NO: 99438 - RNA, 45 nt, Mus musculus
gugaaugcauccgccccgaggggguuucccuuccacucgucagau

SEQ ID NO: 99439 - RNA, 45 nt, Mus musculus
ccucaugcucacucccccacagguccagacccaccuucaggugau

SEQ ID NO: 99440 - RNA, 45 nt, Mus musculus
agccacaggggaaggaagcuaaggcaggagaaaugggaugcagag

SEQ ID NO: 99441 - RNA, 41 nt, Mus musculus
auauggaaagagagagagagagagagagagagagagcuggg

SEQ ID NO: 99442 - RNA, 45 nt, Mus musculus
caguggauccugagaaggcccagcagaugcgcuuucagguaccac

SEQ ID NO: 99443 - RNA, 42 nt, Mus musculus
agggucugcagaauggacuggaagugcuagggagaggugcag

SEQ ID NO: 99444 - RNA, 45 nt, Mus musculus
gguagggucucaaaaaggcaaccaaccacagguaaguggggccaa

SEQ ID NO: 99445 - RNA, 42 nt, Mus musculus
auggacggaguggcccccaguagugggcggggcaugagggag

SEQ ID NO: 99446 - RNA, 46 nt, Mus musculus
gggccauggcugacagccaaucuaagaaccugccaaaggcggacag

SEQ ID NO: 99447 - RNA, 46 nt, Mus musculus
cuacgcuccuccagguccaucuuggcccucaggaaacccucaugcu

SEQ ID NO: 99448 - RNA, 44 nt, Mus musculus
aucggcgagcaugaggguuuccugagggccaagauggaccugga

SEQ ID NO: 99449 - RNA, 47 nt, Mus musculus
gaauggaagagauagcuguggcuuuggauaugguagauuagucugug

SEQ ID NO: 99450 - RNA, 46 nt, Mus musculus
cagccaguagacgauuacuucguagagcccccucaggcugaagaag

SEQ ID NO: 99451 - RNA, 42 nt, Mus musculus
gagagaaucuguaaagccagggaaagcuugggggucuguggu

SEQ ID NO: 99452 - RNA, 41 nt, Mus musculus
ccuucauucccaggcuccggggucggcucaaguggcuggac

SEQ ID NO: 99453 - RNA, 43 nt, Mus musculus
accagaggcucuuggaaagagccagguccgacgaugcgggugg

SEQ ID NO: 99454 - RNA, 47 nt, Mus musculus
accaacagagggcaggcaagugaucaaauuugaaagaaucacagagg

SEQ ID NO: 99455 - RNA, 102 nt, Mus musculus
ugugucuguguaugugugugugugucuguguguauguguauguguguguguguguguaugugugucuguguguaugugugucugugugugugucuguguaug

SEQ ID NO: 99456 - RNA, 46 nt, Mus musculus
ugugugugugugucuguguguguauguguguauguguguguguguc

SEQ ID NO: 99457 - RNA, 46 nt, Mus musculus
ugucugccugucuuuguguguguguauguguguguguguguguaug

SEQ ID NO: 99458 - RNA, 45 nt, Mus musculus
acaguugugaacuuccaccugggugcugggaguugaaucuagauc

SEQ ID NO: 99459 - RNA, 41 nt, Mus musculus
agccaccaugugguugcugggauuugaacuucggauuuuca

SEQ ID NO: 99460 - RNA, 46 nt, Mus musculus
uggggguguucauguuuuagcagaccaggaggcagagagugcaggu

SEQ ID NO: 99461 - RNA, 45 nt, Mus musculus
aggcaugguggcacauagcuguaaccucaacacccaggagguaaa

SEQ ID NO: 99462 - RNA, 42 nt, Mus musculus
ggcaaggcaguccaguuagaggaacaggauccacaggcaggc

SEQ ID NO: 99463 - RNA, 42 nt, Mus musculus
auauuguauacacguauugaaauaucauacugugccgcauaa

SEQ ID NO: 99464 - RNA, 45 nt, Mus musculus
uaacccgagacgucugucuuuacuuugacugcuaucccguccuga

SEQ ID NO: 99465 - RNA, 41 nt, Mus musculus
accagggaaaugucauuaagccuuuuuccauuucuguaagg

SEQ ID NO: 99466 - RNA, 46 nt, Mus musculus
cauuaguauuccuuauuuagaaacuucaauaauuacuuggccaguu

SEQ ID NO: 99467 - RNA, 45 nt, Mus musculus
cuucaagagggauccugugauuugaugaagggggucuugggcacu

SEQ ID NO: 99468 - RNA, 41 nt, Mus musculus
gaaauggugacuguggagucaaggacauggggugggggguu

SEQ ID NO: 99469 - RNA, 45 nt, Mus musculus
gucuugacggcgauugggacaucuggcugggcaguggagucagau

SEQ ID NO: 99470 - RNA, 29 nt, Mus musculus
uuuaaaguuaggguccuuuauuggggcag

SEQ ID NO: 99471 - RNA, 50 nt, Mus musculus; identical to SEQ ID NO: 78522

SEQ ID NO: 99472 - RNA, 46 nt, Mus musculus; identical to SEQ ID NO: 78523

SEQ ID NO: 99473 - RNA, 64 nt, Mus musculus; identical to SEQ ID NO: 78524

SEQ ID NO: 99474 - RNA, 71 nt, Mus musculus; identical to SEQ ID NO: 78525

SEQ ID NO: 99475 - RNA, 45 nt, Mus musculus
uuucugguucuucagagaggcguuccucgccccagccuacacaga

SEQ ID NO: 99476 - RNA, 45 nt, Mus musculus; identical to SEQ ID NO: 53051

SEQ ID NO: 99477 - RNA, 46 nt, Mus musculus
cugucuuugcaccucuuccaggguuaacugcucuuuuuacuuuaag

SEQ ID NO: 99478 - RNA, 45 nt, Mus musculus
cuggcugaaagucgguuuguugugaagucgggagcaccggucccc

SEQ ID NO: 99479 - RNA, 46 nt, Mus musculus
ucucggggacggugaccugugugggaccuuggaggugaccuaagaa

SEQ ID NO: 99480 - RNA, 42 nt, Mus musculus
ugaggccaacaugggcuacauaacaaguaccaggccacccag

SEQ ID NO: 99481 - RNA, 77 nt, Mus musculus
cuuaacugaggccauggcugcccggauuccucacgugcccgcugccaucucacccuggccuguggcucccuagucuc

SEQ ID NO: 99482 - RNA, 48 nt, Mus musculus
cugacaagcgagagaaguucuaugaugggaagguaaguggcgugaagg

SEQ ID NO: 99483 - RNA, 45 nt, Mus musculus
gaucagcuauccauggacgaggucuguuuuguaaacgcaacaucg

SEQ ID NO: 99484 - RNA, 46 nt, Mus musculus
cugacuucugugguagagucaggauugucugacuagagggugcuag

SEQ ID NO: 99485 - RNA, 50 nt, Mus musculus
gcacccaggcagcuagccaagaaguugugcuaaggaucaggaggaguucg

SEQ ID NO: 99486 - RNA, 72 nt, Mus musculus
uacaagcucaaguggcugggcuuuaugcagcuauaggggguggaguaggggugcaucuaaugguugggauca

SEQ ID NO: 99487 - RNA, 53 nt, Mus musculus
ugggcuacauagugagacccugucucacaacagaaggaaacaaaacaccaagg

SEQ ID NO: 99488 - RNA, 45 nt, Mus musculus
cacauagagaaacccugucucaaaaacaccacaaaagaaaucaga

SEQ ID NO: 99489 - RNA, 42 nt, Mus musculus
gccccaucuccccuuccaccgucugaagaccugggcccagac

SEQ ID NO: 99490 - RNA, 45 nt, Mus musculus
ucccucaagaacguccaugcugcuguugcacguggaaggcagaug

SEQ ID NO: 99491 - RNA, 46 nt, Mus musculus
gggaagcagcuccacccaggacccugugauuuacaagcugugggaa

SEQ ID NO: 99492 - RNA, 42 nt, Mus musculus
gggaugucgaguggucuggagauuacagccucugccccaggu

SEQ ID NO: 99493 - RNA, 45 nt, Mus musculus
uuauuauacauaaauucacuguagcugucuucagacacccaagaa

SEQ ID NO: 99494 - RNA, 42 nt, Mus musculus
gcugccaguacuagaaccugaggagcagagccggccccgcaa

SEQ ID NO: 99495 - RNA, 41 nt, Mus musculus
agggagcugagcagaggaauuggauggggcuuagggggcag

SEQ ID NO: 99496 - RNA, 46 nt, Mus musculus
aggcugugucaggucugaagaugaauccauggaagcuaagagagau

SEQ ID NO: 99497 - RNA, 58 nt, Mus musculus
guuuagccuucuuaagagagcuaaggugcaguuauucaagaucgaucaacagcaacag

SEQ ID NO: 99498 - RNA, 46 nt, Mus musculus
agugagugcucgcuccucccguguuaucaagacaccccggcgauuu

SEQ ID NO: 99499 - RNA, 50 nt, Mus musculus
aguuucuccuccucccccacuuuccccucccccauauccagccccagaga

SEQ ID NO: 99500 - RNA, 40 nt, Mus musculus
cuguggcugaggaagaagcgaugcuagccaaggagaagga

SEQ ID NO: 99501 - RNA, 51 nt, Mus musculus
ggagaagagaaggaagaaaaagaugacaaugaggauaacaacaagcaagag

SEQ ID NO: 99502 - RNA, 49 nt, Mus musculus
ggucaacguggggaaagcuggcaggaugccccccaaagaaaagauggag

SEQ ID NO: 99503 - RNA, 42 nt, Mus musculus
cgccuagcagaugugacuccuguccccccaaaggccccuacu

SEQ ID NO: 99504 - RNA, 46 nt, Mus musculus
aguggccaaaauggcugaguuaugagaaucugaagugggcaaagcu

SEQ ID NO: 99505 - RNA, 24 nt, Mus musculus
aagauggugaggcugccaaugcug

SEQ ID NO: 99506 - RNA, 42 nt, Mus musculus
guggauccucaaccuuggguggagguggucugaucacuguag

SEQ ID NO: 99507 - RNA, 45 nt, Mus musculus
guggaguagcaaaaggaaacaaggcaaacucccaaguaguuggca

SEQ ID NO: 99508 - RNA, 46 nt, Mus musculus
gauauauuuaaaagccaggugugauggcuugguucucuaaggccag

SEQ ID NO: 99509 - RNA, 46 nt, Mus musculus
uguaugcguggguguuuauguaagggauuauguauuguguguauag

SEQ ID NO: 99510 - RNA, 47 nt, Mus musculus
uuuuuucaugaaauugguagagguugggagguagaggggaucuggga

SEQ ID NO: 99511 - RNA, 46 nt, Mus musculus
guaaauuuccacuaguuuucauuuuauacuuuauaauuugcagcuu

SEQ ID NO: 99512 - RNA, 42 nt, Mus musculus
uuggggcuucaggucagggcacuggaggccccaggggagcag

SEQ ID NO: 99513 - RNA, 46 nt, Mus musculus
uuggacaaaguagcccacgacaucaacaguggcaucggacacgcag

SEQ ID NO: 99514 - RNA, 44 nt, Mus musculus
gagacaaacaaaaucauccaucauggggucagccaggggggcag

SEQ ID NO: 99515 - RNA, 46 nt, Mus musculus
aggucaugaaacccaccaugcuuuuggucagggugggaauguggca

SEQ ID NO: 99516 - RNA, 46 nt, Mus musculus
uaggucaugaaacccaccaugcuuuuggucagggugggaauguggc

SEQ ID NO: 99517 - RNA, 47 nt, Mus musculus
uaggucaugaaacccaccaugcuuuuggucagggugggaauguggca

SEQ ID NO: 99518 - RNA, 46 nt, Mus musculus
ccaugggguacagaauggagucaaccaggcucaaaaggaagcagaa

SEQ ID NO: 99519 - RNA, 70 nt, Mus musculus
guccaaacuggggucaaccaggccgggaaggagacacagagaguuggccaagggguccaaacuggguuca

SEQ ID NO: 99520 - RNA, 63 nt, Mus musculus
accagggucaaaaggaagcagaaaaaguggcccaugggguccaaacuggggucaaccaggccg

SEQ ID NO: 99521 - RNA, 45 nt, Mus musculus
aggugaacagagguggggaaacuggggagaaggggguugugggag

SEQ ID NO: 99522 - RNA, 46 nt, Mus musculus
caguaguaucuggggugagucucuggguguaacauggguuuuggag

SEQ ID NO: 99523 - RNA, 45 nt, Mus musculus
cuuuuuuuaaacauuugaaauugugugugugugugugugugugug

SEQ ID NO: 99524 - RNA, 41 nt, Mus musculus
cuagguccggguuuaugaaacuagccacauuggaggcauua

SEQ ID NO: 99525 - RNA, 46 nt, Mus musculus
ccucggauggcuaacaaguucaauggaaagcccagcgcaaaggcag

SEQ ID NO: 99526 - RNA, 46 nt, Mus musculus
uguguguguguuuguauauuugaguguugugcauguuuguguguuu

SEQ ID NO: 99527 - RNA, 62 nt, Mus musculus
ucuguauuuguguaugaguuguguguguuuguguuguauugugugugaguguguguguugug

SEQ ID NO: 99528 - RNA, 61 nt, Mus musculus
uacauguauauguaugugguguguguauauauguguagugugugugugugugugugugugu

SEQ ID NO: 99529 - RNA, 46 nt, Mus musculus
aaugcuuuacccucccuucuagcccaccacccaccagaggcagugg

SEQ ID NO: 99530 - RNA, 46 nt, Mus musculus
aauccagacaagaggugggauggggcuggaagggagcaugggagau

SEQ ID NO: 99531 - RNA, 78 nt, Mus musculus
agccaccucaggugugccaagcaucuaugcccccagcaucuauacccaccucucuccugccaagacuccgccaccucc

SEQ ID NO: 99532 - RNA, 46 nt, Mus musculus
acuacaccaacucaccacccccugccuccucccucuaccccaagag

SEQ ID NO: 99533 - RNA, 46 nt, Mus musculus
uugucucaauuuugccugaaucgccacaggugagugcgggccagca

SEQ ID NO: 99534 - RNA, 44 nt, Mus musculus
agguaccccugcagucuccaggaucgagccucucagcccaucca

SEQ ID NO: 99535 - RNA, 47 nt, Mus musculus
ccaccucgaauccagugucagauccagggccacauacaagcagcaag

SEQ ID NO: 99536 - RNA, 45 nt, Mus musculus
ugcucccuucucacuucucucucugacccuguuuuuaccccagau

SEQ ID NO: 99537 - RNA, 46 nt, Mus musculus
acauggaccauguucaaccaugaggaccccaguucaauccccagag

SEQ ID NO: 99538 - RNA, 27 nt, Mus musculus
gcgacuacucgugacaaugucccaggu

SEQ ID NO: 99539 - RNA, 41 nt, Mus musculus
gaggcuguccugcaagggugugcaaagguccugcggcaaua

SEQ ID NO: 99540 - RNA, 45 nt, Mus musculus
gcuuuucagaugaggcaaaugaguggcucaggucacggagcgagg

SEQ ID NO: 99541 - RNA, 42 nt, Mus musculus
cgggggaggaugcugcuggggaggaugcucgaggccccaggu

SEQ ID NO: 99542 - RNA, 46 nt, Mus musculus
auaaagacaaucagaagcauggaauacacauuuaaagaugggagug

SEQ ID NO: 99543 - RNA, 46 nt, Mus musculus
cuagcaccugagaaacccacacagggaagggcagagcaggggagag

SEQ ID NO: 99544 - RNA, 45 nt, Mus musculus
uuccucuucucucccuauacagcccaacaugcaaauccuguaagu

SEQ ID NO: 99545 - RNA, 45 nt, Mus musculus
ggauaguccaggccuugaucauagagggcaggaucaagaugagga

SEQ ID NO: 99546 - RNA, 24 nt, Mus musculus
cucaugauugugcuugugcauguu

SEQ ID NO: 99547 - RNA, 42 nt, Mus musculus
cuaggaaagaggugggggaaucuaggagcuuaggggacagga

SEQ ID NO: 99548 - RNA, 46 nt, Mus musculus
ucacugcaggaugggugcacuugcugccucgccccaaccgccucuc

SEQ ID NO: 99549 - RNA, 45 nt, Mus musculus
uggucugggugggaggugaggggcgugguuugagguggggguggg

SEQ ID NO: 99550 - RNA, 41 nt, Mus musculus
gaggagaggacagguuagaggaaggaggcagggaggaggug

SEQ ID NO: 99551 - RNA, 41 nt, Mus musculus
agagagagacagacagagacagagacagugacagagagaca

SEQ ID NO: 99552 - RNA, 42 nt, Mus musculus
aauagggaccaggagaccacagcauacacagcagcaagacag

SEQ ID NO: 99553 - RNA, 45 nt, Mus musculus
aaaggccacagacuuacauuucaucuugaaacccccaugcccuua

SEQ ID NO: 99554 - RNA, 46 nt, Mus musculus
acagagaugggccucagcacccagacccagaccccugcacccagac

SEQ ID NO: 99555 - RNA, 46 nt, Mus musculus
cuaggaccaguugggaguggcaaaaaggacaauaguuggauucugg

SEQ ID NO: 99556 - RNA, 46 nt, Mus musculus
ucacccagggcaucccguaccaggacuacuucuacacugcccaccg

SEQ ID NO: 99557 - RNA, 53 nt, Mus musculus
gccaccagcgcagaguccugaccuacaccauccccauuagcaaccagcuaggc

SEQ ID NO: 99558 - RNA, 42 nt, Mus musculus
gggucugcucucaacugcccacaugugacuccagcuccagga

SEQ ID NO: 99559 - RNA, 45 nt, Mus musculus
gggucccuuggaucugcugucuagagaggaacuauugacagacac

SEQ ID NO: 99560 - RNA, 88 nt, Mus musculus
gaacagacggacggucuggaugccuccuccagccagacagugaccccaguagcagaaccgcugaguucugagccgacaccaccagaug

SEQ ID NO: 99561 - RNA, 41 nt, Mus musculus
agggaaaauaagaggugaaccgggcaaauacggcagacuug

SEQ ID NO: 99562 - RNA, 44 nt, Mus musculus
aagacguggccgggucaccccaaaccucucucgagccagcagug

SEQ ID NO: 99563 - RNA, 46 nt, Mus musculus
guccaucagugcuauggcucggagcugggccucaccagugaagacg

SEQ ID NO: 99564 - RNA, 49 nt, Mus musculus
gagaagacggcuaagcucauccccaaugccauucagaucuguacugaga

SEQ ID NO: 99565 - RNA, 46 nt, Mus musculus
gcuccucugagaaaaguggcgugucggggacacucagcacccagag

SEQ ID NO: 99566 - RNA, 24 nt, Mus musculus
uugcccccaauccggcccccuccg

SEQ ID NO: 99567 - RNA, 52 nt, Mus musculus
ugauaggcagguagauggcuaggcugguggaugcaugaaugggcagguagau

SEQ ID NO: 99568 - RNA, 46 nt, Mus musculus
aagggcaauguggacagggagaccggcaugaacuaaagauuauaug

SEQ ID NO: 99569 - RNA, 42 nt, Mus musculus
cuaaagucuugaaguguuguauaauauuugcaagggccaggc

SEQ ID NO: 99570 - RNA, 46 nt, Mus musculus
ggcggggcucugggggaguuaguucugccuacaucuagugagagaa

SEQ ID NO: 99571 - RNA, 45 nt, Mus musculus
gucccuuugccuuacauaucauuucuucuccacgcagccugagga

SEQ ID NO: 99572 - RNA, 41 nt, Mus musculus
cugugggguuuugugugugugugugugugugugugugugug

SEQ ID NO: 99573 - RNA, 41 nt, Mus musculus
cagauuuuaaguugagguuucugaugccgguggggguggag

SEQ ID NO: 99574 - RNA, 46 nt, Mus musculus
uuuguagcgagcgugcaugugugugugugugugugugugugugugu

SEQ ID NO: 99575 - RNA, 53 nt, Mus musculus
augucugggucacugggucccaugacuaggugccgugugaauaguuuuguugu

SEQ ID NO: 99576 - RNA, 41 nt, Mus musculus
uucuaaggcaggaacugagguucugaggcuggguggggaga

SEQ ID NO: 99577 - RNA, 25 nt, Mus musculus
cacagaaagauggaaggcagccaug

SEQ ID NO: 99578 - RNA, 45 nt, Mus musculus
uggaaauaggcugacgugcgaaacagccuaagguaauggcucaga

SEQ ID NO: 99579 - RNA, 42 nt, Mus musculus
uccucaguuuagcccaagaugcccuucagugggcccucagau

SEQ ID NO: 99580 - RNA, 46 nt, Mus musculus
cuugacaaaguugucauugagaguagugccagcccuggcaucaaag

SEQ ID NO: 99581 - RNA, 46 nt, Mus musculus
gaagggguuguugauggcaacaaccuccacuuugccauguggagag

SEQ ID NO: 99582 - RNA, 44 nt, Mus musculus
uuuucuuacaccuuggaggccauguaggccaugagguccacuac

SEQ ID NO: 99583 - RNA, 44 nt, Mus musculus
uagaacacagaauucuuccaugggcaucugcugauuuggaggcc

SEQ ID NO: 99584 - RNA, 46 nt, Mus musculus
cauaagcugaaacucaaacguccucuggccuccacagccacugcag

SEQ ID NO: 99585 - RNA, 42 nt, Mus musculus
gguacagcaucaggauuaggacuagacagcagggaaacccac

SEQ ID NO: 99586 - RNA, 46 nt, Mus musculus
aggucuggaagaguccucuuuugcuuaggggcagagcaggucucag

SEQ ID NO: 99587 - RNA, 72 nt, Mus musculus
ccuccucuucagcaacacagauauaauagggcuggaacuguggcacugcaguggggacugucagcccuuccc

SEQ ID NO: 99588 - RNA, 42 nt, Mus musculus
ucugacaucauuagagucacuucccaaaucugaggcgggugg

SEQ ID NO: 99589 - RNA, 46 nt, Mus musculus
auuauugggacuaaaaaaaaaaggaaaggacuacauuucccaggcu

SEQ ID NO: 99590 - RNA, 44 nt, Mus musculus
ugcauauauguaaacuggaaaguaaaaucuugggggcuggcgag

SEQ ID NO: 99591 - RNA, 46 nt, Mus musculus
accugcgcguuccaagucucuuucucuggcacuugcaggcacuggg

SEQ ID NO: 99592 - RNA, 46 nt, Mus musculus
agagcagucaguacucuuaacuguugagccaucucuccagccccau

SEQ ID NO: 99593 - RNA, 49 nt, Mus musculus
ccguuaguggaggaaucaugggaggucacagcagagcugcccuccagcu

SEQ ID NO: 99594 - RNA, 24 nt, Mus musculus
agugguggaugacuccaaggagac

SEQ ID NO: 99595 - RNA, 45 nt, Mus musculus
cuggacagggaugagaaagucacaggguaucaucuuggugccugu

SEQ ID NO: 99596 - RNA, 36 nt, Mus musculus
ggugguccacacgggccccggacuuggugauguacu

SEQ ID NO: 99597 - RNA, 45 nt, Mus musculus
aaauaggcagcaaagcggugcauguacuggucauagggcagcaag

SEQ ID NO: 99598 - RNA, 45 nt, Mus musculus
caguagagccagcaggacgggggcauucuucuccaggggcgucuu

SEQ ID NO: 99599 - RNA, 46 nt, Mus musculus
ccuucauaccuguucacaaucccaucuccucagaugaaggcagacc

SEQ ID NO: 99600 - RNA, 45 nt, Mus musculus
auaccucauaccugugccgugccucaucuccucagaugccggcag

SEQ ID NO: 99601 - RNA, 96 nt, Mus musculus
gccuuguaccugugccuacccuguguccuugaucaagggcagacucacuaauccauaccuauaucuaaccugucuucuaaguuacugacagaccca

SEQ ID NO: 99602 - RNA, 46 nt, Mus musculus
cagagccucagaccugcacccauucugccuccuuagcuacugacag

SEQ ID NO: 99603 - RNA, 45 nt, Mus musculus
aaggccaaauaccauauacuagugacugcagacuagggggcugca

SEQ ID NO: 99604 - RNA, 45 nt, Mus musculus
cucuguguuuuaugucaaggucucacuagguagcccaggcaggcu

SEQ ID NO: 99605 - RNA, 46 nt, Mus musculus
aggagauuacacccagcuaguaaagacccugccuaaaaacccugag

SEQ ID NO: 99606 - RNA, 41 nt, Mus musculus
augcuggugacauggaccugucuguaaguacuuaagcaacu

SEQ ID NO: 99607 - RNA, 45 nt, Mus musculus
uuaacuuuugcuugcuacauacuuaauaaacccacuuacucaaag

SEQ ID NO: 99608 - RNA, 45 nt, Mus musculus
ugugacaugugcccugugccuguggaggccacaagagggcaucag

SEQ ID NO: 99609 - RNA, 46 nt, Mus musculus
cagccauggcgagggacccgagagguacacggagcaggacgugcuc

SEQ ID NO: 99610 - RNA, 46 nt, Mus musculus
cuccucugaagcacccaggggugcaggcucauguaauguacaagag

SEQ ID NO: 99611 - RNA, 47 nt, Mus musculus
ucucaaacuuugaagguagcagaccccugagagccagcugaagaugg

SEQ ID NO: 99612 - RNA, 42 nt, Mus musculus
caacuguccccaaggcuaacuagcugauacuagcccccagaa

SEQ ID NO: 99613 - RNA, 56 nt, Mus musculus
uguacuaacuuaaauaaaaaaguauaaauacuaacuuaugaauagagagagagaga

SEQ ID NO: 99614 - RNA, 45 nt, Mus musculus
ugcuuugaggaaggcucacuggccuucauucacguuuccugagca

SEQ ID NO: 99615 - RNA, 45 nt, Mus musculus
aaaucacagcaaccacaugguggcucacaaccauccauagugaga

SEQ ID NO: 99616 - RNA, 46 nt, Mus musculus
cucaggcuuuaacaugggccagucccaucagggguccccacuggug

SEQ ID NO: 99617 - RNA, 45 nt, Mus musculus
auguguguguauguauguauauguguguguguguguguauguaug

SEQ ID NO: 99618 - RNA, 47 nt, Mus musculus
aagcaagauagagaacuuuuuaguaacuuuauuucaagaugggucag

SEQ ID NO: 99619 - RNA, 46 nt, Mus musculus
guggaugugcuuuacacagccgugcuagaccuaaaccgcuggagaa

SEQ ID NO: 99620 - RNA, 45 nt, Mus musculus
acaaccauccauaaugagaucuggcacccucuucuggagugucug

SEQ ID NO: 99621 - RNA, 42 nt, Mus musculus
cccagcaaccacauggugguucauaaccauccguaacaagau

SEQ ID NO: 99622 - RNA, 45 nt, Mus musculus
auuccagggaaucuaaugcuucuggucuccuuagacacugauagu

SEQ ID NO: 99623 - RNA, 47 nt, Mus musculus; identical to SEQ ID NO: 99611

SEQ ID NO: 99624 - RNA, 46 nt, Mus musculus
aacagcuucuacaaagcuaguuuauuuucuaccuugggucagaggu

SEQ ID NO: 99625 - RNA, 45 nt, Mus musculus
caaggagaugagaaaagguguaaccucacagugaucacagcaagu

SEQ ID NO: 99626 - RNA, 45 nt, Mus musculus
auagaccauaaugagcaguguuaucuucuuacugaagccacaggg

SEQ ID NO: 99627 - RNA, 53 nt, Mus musculus
gacacagcacagauugaaaauaaagaagccuaugcaccccagaucagucuuga

SEQ ID NO: 99628 - RNA, 46 nt, Mus musculus
aauagcuguguaguggugcauaccuuuaaucucagcauucaggagg

SEQ ID NO: 99629 - RNA, 45 nt, Mus musculus
gccuuuguuguagcugacaaaggcguuuaggaccauagccauagg

SEQ ID NO: 99630 - RNA, 42 nt, Mus musculus
acagucagagauagacuaacagaggcagagaugggggugggg

SEQ ID NO: 99631 - RNA, 45 nt, Mus musculus
cacauacacacacacacacacacacacacacacacauucucucau

SEQ ID NO: 99632 - RNA, 52 nt, Mus musculus
uugcaggccagccuagguuacacagggcaacccuguugaaagaaagagggag

SEQ ID NO: 99633 - RNA, 46 nt, Mus musculus
uccuagcaaccacaugguggcucacaaccauccaucauaacaagau

SEQ ID NO: 99634 - RNA, 42 nt, Mus musculus
gauggcucagugguuaagagugcugacuguucuuccagaggu

SEQ ID NO: 99635 - RNA, 42 nt, Mus musculus
ugcucuucuagaggaccaagguucaauucccagcacccagau

SEQ ID NO: 99636 - RNA, 33 nt, Mus musculus
agagaggccagagagggggcagggugaggagag

SEQ ID NO: 99637 - RNA, 42 nt, Mus musculus
augcucauggaacucagugcuggggcugcaaacuucacagau

SEQ ID NO: 99638 - RNA, 42 nt, Mus musculus
ucugaccgcugcaggcagcugccaccaugccaugccccacuc

SEQ ID NO: 99639 - RNA, 46 nt, Mus musculus
aguuccccacccguauguauugcugcagugcccaggacaauaagau

SEQ ID NO: 99640 - RNA, 46 nt, Mus musculus
ccugccucauggaaaugccuuuuuuaaaacuuagauuugcagaacu

SEQ ID NO: 99641 - RNA, 46 nt, Mus musculus
uugccacuuaacuaguuuuagguuaguuaguuggucugaaggagag

SEQ ID NO: 99642 - RNA, 44 nt, Mus musculus
caauaguccagguuggcauugucuucaggcuauaagcaggagau

SEQ ID NO: 99643 - RNA, 46 nt, Mus musculus
uuuaaggagagcuaggaaauauuuuuggcaaaggagaagaucaauc

SEQ ID NO: 99644 - RNA, 44 nt, Mus musculus
guuguuguacccugaauauuuggaagaggaauauggagggaaga

SEQ ID NO: 99645 - RNA, 45 nt, Mus musculus
aaaaguugauagaaaagaauaaaaaaaugaaacuaaggacagaga

SEQ ID NO: 99646 - RNA, 56 nt, Mus musculus
ugcucugaaagaacuaggcacauggcuagagagugcugaaugaagguacagguuaa

SEQ ID NO: 99647 - RNA, 44 nt, Mus musculus
gacacucauuucaggaauuacuaggguaggggaaggggaugaga

SEQ ID NO: 99648 - RNA, 46 nt, Mus musculus
ugccagcugcugagguguaugaagcaagugagauggccagauaauu

SEQ ID NO: 99649 - RNA, 46 nt, Mus musculus
gguuggugaugucagaaacagcaagggugccccacaggcucugagg

SEQ ID NO: 99650 - RNA, 46 nt, Mus musculus
aguauugagaaaacagauauuauguauuaccacaugcagccaagaa

SEQ ID NO: 99651 - RNA, 45 nt, Mus musculus
ugggauuaaaugugugugcuaccacugcccagcugaaugcugaga

SEQ ID NO: 99652 - RNA, 39 nt, Mus musculus
ucagagauucaccugccucugccuucugaaugcugagaa

SEQ ID NO: 99653 - RNA, 45 nt, Mus musculus
gcacaaaucugggaaugugauuauggguuaccuugcaggcaggua

SEQ ID NO: 99654 - RNA, 47 nt, Mus musculus
gugaguauagggcucagugaacaacugccucaaaagacagaguggag

SEQ ID NO: 99655 - RNA, 57 nt, Mus musculus
gaguaaaguacucagcacaagcaugaaguccggaguuaggaucacuggcaccugugu

SEQ ID NO: 99656 - RNA, 51 nt, Mus musculus
uggguauccugguaugcaaacaagggucaguugaagggaugggaauggguu

SEQ ID NO: 99657 - RNA, 46 nt, Mus musculus
aacuaauauauuuuuauauacuaaugagaucacugagcuggcagcc

SEQ ID NO: 99658 - RNA, 46 nt, Mus musculus
gcauguauguauguauacugugugcaugccugguaccuguggaggu

SEQ ID NO: 99659 - RNA, 45 nt, Mus musculus
auaguaagaaaaguaauuuuuaaguuuuuuuugacauauacuacu

SEQ ID NO: 99660 - RNA, 51 nt, Mus musculus
cuguccuagaacacaauauguagaccaaacuggccucaaacucacagagug

SEQ ID NO: 99661 - RNA, 42 nt, Mus musculus
ucauaucuaguuuagguaaugaaccuguuaaugccaacauau

SEQ ID NO: 99662 - RNA, 45 nt, Mus musculus
uguuuguggucagaaagcuuaaaccuaauuuuguauacuccaaga

SEQ ID NO: 99663 - RNA, 45 nt, Mus musculus
uaaaguucuaagaauguauuuguaaaagacuacuugcgagcuuga

SEQ ID NO: 99664 - RNA, 42 nt, Mus musculus
guauacaaagugucaggagggaaaaugaccacggcgacucgg

SEQ ID NO: 99665 - RNA, 45 nt, Mus musculus
gcacuuagcagccagguccuuuaccacugugcuucacucccagac

SEQ ID NO: 99666 - RNA, 45 nt, Mus musculus
cuccggccuucccuggggacccuacuuuaaaaagaccugucaaca

SEQ ID NO: 99667 - RNA, 46 nt, Mus musculus
cagcgacuucaaagagaacugaaagcuaucugacagagacugcccc

SEQ ID NO: 99668 - RNA, 42 nt, Mus musculus
gacuugugaucucgaaaggccguuucguaccguccagucgau

SEQ ID NO: 99669 - RNA, 41 nt, Mus musculus
accucgagaugaaugcggauguguugauuccucgggcaccc

SEQ ID NO: 99670 - RNA, 42 nt, Mus musculus
cgcuugggggccgggagggagcgaggcccgugaggaccgcag

SEQ ID NO: 99671 - RNA, 42 nt, Mus musculus
gcggcggcgccaugagcgggggcaccccuuacaucggcagca

SEQ ID NO: 99672 - RNA, 49 nt, Mus musculus
ugcccccgcucauggcgccgccgccgucgcccgccgcucgcacucaguc

SEQ ID NO: 99673 - RNA, 41 nt, Mus musculus
cgagcgggcgggcgggcggagcggcgggcgcagcgcgggau

SEQ ID NO: 99674 - RNA, 44 nt, Mus musculus
ccagcccauuguggguggagccaccucugggccgguuguccuau

SEQ ID NO: 99675 - RNA, 46 nt, Mus musculus
guaagggaagaaauucugacgcccccaaguugcuuuuuggucguag

SEQ ID NO: 99676 - RNA, 45 nt, Mus musculus
uguaagacccagacccaagcuuaccuagugcucuuaaccccagau

SEQ ID NO: 99677 - RNA, 45 nt, Mus musculus
cuggguccccagcucagggaaccacccuccacccuagcgccaguu

SEQ ID NO: 99678 - RNA, 49 nt, Mus musculus
gggggagagagagagagagagagagagagagagcaagagagcaagagag

SEQ ID NO: 99679 - RNA, 45 nt, Mus musculus
cagcccauggugcgugagcuggagcgcuggcagcaagaccaagag

SEQ ID NO: 99680 - RNA, 46 nt, Mus musculus
cucuacaguggacaugcccacccucguccacauuguguccugggag

SEQ ID NO: 99681 - RNA, 42 nt, Mus musculus
gcagaaaccagggauggaggagucuuuauggucacagcucau

SEQ ID NO: 99682 - RNA, 41 nt, Mus musculus
uggagaggaggucuggagccuggggcuugaggaccaggaaa

SEQ ID NO: 99683 - RNA, 41 nt, Mus musculus
ggcuggguuugaaagaaacaguguugcuuuaggggcuggag

SEQ ID NO: 99684 - RNA, 41 nt, Mus musculus
gacccuaguggugugugugugugugugugugugugugugug

SEQ ID NO: 99685 - RNA, 45 nt, Mus musculus
ugucuguguguaugugugugucagugugugugucugugugucagu

SEQ ID NO: 99686 - RNA, 46 nt, Mus musculus
ugugucucuuaucaauugcacgucuauguuugugaucucagcagug

SEQ ID NO: 99687 - RNA, 42 nt, Mus musculus
cccuucggguaccuuggccaccccgcccgcggggccggaggu

SEQ ID NO: 99688 - RNA, 46 nt, Mus musculus
uuuaccauacacaauuuagaauaaaaucacaaacugaggaacccag

SEQ ID NO: 99689 - RNA, 44 nt, Mus musculus
ucuuuuugcuuugcuugcuuggaggcacagccuugcccccuccc

SEQ ID NO: 99690 - RNA, 42 nt, Mus musculus
ccccagacggccuccacuccgagcggccccgcgcggcgcggc

SEQ ID NO: 99691 - RNA, 24 nt, Mus musculus
caaggcggcggcgggccccgcggg

SEQ ID NO: 99692 - RNA, 45 nt, Mus musculus
gaccgagagacuuuccgcggagcugagcugggggcccggcaguac

SEQ ID NO: 99693 - RNA, 45 nt, Mus musculus
acaaggcaccgcugggacacagagaccagauacaaguguugauau

SEQ ID NO: 99694 - RNA, 46 nt, Mus musculus
ccucgccaggaggccuuccgccucugcggcucagccaucccacccg

SEQ ID NO: 99695 - RNA, 58 nt, Mus musculus
ucuacagcccagccuggccccucaacuacccuccaggcaccaacugcagcugguacau

SEQ ID NO: 99696 - RNA, 46 nt, Mus musculus
gcagucaguucucuuaacugcugagccaucucuccagccccacccu

SEQ ID NO: 99697 - RNA, 46 nt, Mus musculus
cuuuugguauuguccuacugucucccagccccuucucagcccacac

SEQ ID NO: 99698 - RNA, 42 nt, Mus musculus
cacaggcuuguuauuccagccacucaagagacuaaggcagaa

SEQ ID NO: 99699 - RNA, 47 nt, Mus musculus
guggcuugguaccacugcaaacuagcaaaugcccuguacagcugaua

SEQ ID NO: 99700 - RNA, 48 nt, Mus musculus
uggucuugagcaaauuuaaauuuagugacauugauuucuuugacaaga

SEQ ID NO: 99701 - RNA, 45 nt, Mus musculus
ggcucagcagugcaguucccgccuuaggugaguaagccccuuucu

SEQ ID NO: 99702 - RNA, 41 nt, Mus musculus
cuuauucacuauguaguuccuaggguacacgugcuuauucu

SEQ ID NO: 99703 - RNA, 47 nt, Mus musculus
gugauugagcaguggaagggaaagguggagcuuuuagagagggagaa

SEQ ID NO: 99704 - RNA, 45 nt, Mus musculus
aaaguuuucaagucuucucauuucauagaacugugguggugccag

SEQ ID NO: 99705 - RNA, 46 nt, Mus musculus
ccuccaucacagaagcucuguaaguaucuguaccaagaggccccug

SEQ ID NO: 99706 - RNA, 42 nt, Mus musculus
acagaguguguucgguuucuugguugaaaacggacugcccag

SEQ ID NO: 99707 - RNA, 42 nt, Mus musculus
gaagcaagugacacaucaccaucuaggagugagaggcuuggg

SEQ ID NO: 99708 - RNA, 44 nt, Mus musculus
ugggugugguucaccaggacagguaugugugcaauugggaggca

SEQ ID NO: 99709 - RNA, 45 nt, Mus musculus
gcagccagggucuugcaguuggcugaagguguauuccuggguuag

SEQ ID NO: 99710 - RNA, 46 nt, Mus musculus
auggaguuuacagccuuguguguauguguagaagucagaggacagg

SEQ ID NO: 99711 - RNA, 46 nt, Mus musculus
uuaauuuuaaaguaaugauuauuuauugaaaguguauuuuggauag

SEQ ID NO: 99712 - RNA, 46 nt, Mus musculus
gcacaccuggagucccagcuacuuagagagugggguuacgaagauc

SEQ ID NO: 99713 - RNA, 46 nt, Mus musculus
ccccacggccugcccugcccacguuuuggaaggagagaaccaaguc

SEQ ID NO: 99714 - RNA, 45 nt, Mus musculus
gcucacuuggaucccccgaagucccuauggcucuauaugaugaag

SEQ ID NO: 99715 - RNA, 45 nt, Mus musculus
gcccuucagaaguggcgccccgacuugugcagcaagguggcccag

SEQ ID NO: 99716 - RNA, 46 nt, Mus musculus
auaugugguugaacagugaggggccaccucaaucuccuuccuggau

SEQ ID NO: 99717 - RNA, 30 nt, Mus musculus
cucuuguuuuugauauugagucucucauug

SEQ ID NO: 99718 - RNA, 49 nt, Mus musculus
gaaauagcgagagaauaaaagggaguuuugccuggaaacuaggggagac

SEQ ID NO: 99719 - RNA, 46 nt, Mus musculus
auaugcugaggcgaugcaaagaagaugcaaagaaagaaguggccag

SEQ ID NO: 99720 - RNA, 42 nt, Mus musculus
gcaggccuccugccaguucgaguccuauguuuugguacccac

SEQ ID NO: 99721 - RNA, 42 nt, Mus musculus
guggggcuggaguucuucccuccuucccucagccaagggagu

SEQ ID NO: 99722 - RNA, 45 nt, Mus musculus
cugacccagggcuggaacaggugggguucguagauaccgaggcag

SEQ ID NO: 99723 - RNA, 45 nt, Mus musculus
ugacaucccucuguggcucaugaggccuggcacguaacuaucaca

SEQ ID NO: 99724 - RNA, 46 nt, Mus musculus
ccuucucucugugcccauccucuuugaggagacuuucuacaacgag

SEQ ID NO: 99725 - RNA, 49 nt, Mus musculus
ccuucagcgccugcagauccuuucucccugaaaaccaucgaagauguga

SEQ ID NO: 99726 - RNA, 46 nt, Mus musculus
uuuuuccuuuuuaauuuaauuuaauuuuauuuuaguuuuaguuuag

SEQ ID NO: 99727 - RNA, 46 nt, Mus musculus
gcaucucucuguguggguguguguaugugagcucagguguccucag

SEQ ID NO: 99728 - RNA, 46 nt, Mus musculus
cuccacccagguuccaucccuagagccacuaaaaaguuaagacaaa

SEQ ID NO: 99729 - RNA, 46 nt, Mus musculus
ggugcugggucaguagcugagagcaugcaugaucuguaagcugcag

SEQ ID NO: 99730 - RNA, 45 nt, Mus musculus
gcuuuggugagagagagcagaucuguuucuauguaaauuauggga

SEQ ID NO: 99731 - RNA, 46 nt, Mus musculus
agggaaaagacaaauaaaguaaauauaauuaaaauaaacaaaagag

SEQ ID NO: 99732 - RNA, 45 nt, Mus musculus
gaugugugugcugagaaacugaacuaaagaccucuaggagagcag

SEQ ID NO: 99733 - RNA, 41 nt, Mus musculus
ggaagaaaggaaggaagaaauuaauuucagauuuagggcca

SEQ ID NO: 99734 - RNA, 46 nt, Mus musculus
ugcagugcgugaaggcccuggucuacuaugauguccaggccugcag

SEQ ID NO: 99735 - RNA, 41 nt, Mus musculus
uccuccaccuccagcuuuucuuccauaucggugagcuucag

SEQ ID NO: 99736 - RNA, 41 nt, Mus musculus
cguaugcucuuuaucauggcggugguaggcuuucccaggga

SEQ ID NO: 99737 - RNA, 46 nt, Mus musculus
ucuaugcuucccagggggaccuaggacgacuugagcacagguggaa

SEQ ID NO: 99738 - RNA, 45 nt, Mus musculus
ggaguucuggggacuuuucagaggguguauaaaugcuagggcccu

SEQ ID NO: 99739 - RNA, 46 nt, Mus musculus
ucaugggacccugacgugguuucauuguuguuuuguuguugcggag

SEQ ID NO: 99740 - RNA, 105 nt, Mus musculus
gugugugugugugugugucugugugucugugugucugugugaguguauauguguguguguuugaaggcguguguguuuguguuaaugugugugaguguaugugug

SEQ ID NO: 99741 - RNA, 46 nt, Mus musculus
uguguguaauguguguuaguauauguauguguguuaaugugagugu

SEQ ID NO: 99742 - RNA, 46 nt, Mus musculus
uggcugggagccaccaugugguugcugggauuugaacucuggaccu

SEQ ID NO: 99743 - RNA, 46 nt, Mus musculus
uguaaagucaccuuuauuugugugugugugugugugugugugugug

SEQ ID NO: 99744 - RNA, 46 nt, Mus musculus
ugugaagucaccuuuauuugugugugugugugcgugugugugugua

SEQ ID NO: 99745 - RNA, 46 nt, Mus musculus
ugugaagucaccuuuauuugugugugugugugugugugugugugug

SEQ ID NO: 99746 - RNA, 42 nt, Mus musculus
ucagggagaggacauccagggagacuaugggaagggauagaa

SEQ ID NO: 99747 - RNA, 46 nt, Mus musculus
ucaaaucccagcagccacaugguggcucacagccauccauaaugag

SEQ ID NO: 99748 - RNA, 42 nt, Mus musculus
cuucucagucuguguggcacuuaggccaaaagagggcaucag

SEQ ID NO: 99749 - RNA, 46 nt, Mus musculus
uccagugugacacgugcuacgggccugaguggagccucggcaguua

SEQ ID NO: 99750 - RNA, 46 nt, Mus musculus
uugcuguguuagggacuguggugguuugaaagaaaauggcccccag

SEQ ID NO: 99751 - RNA, 42 nt, Mus musculus
agcacauaggcuuguacauacgcaaacaggaaagaagaggag

SEQ ID NO: 99752 - RNA, 46 nt, Mus musculus
cuggugucaauguaagcuagagucaucagagaagaaggggccuaag

SEQ ID NO: 99753 - RNA, 46 nt, Mus musculus
guugugucugggauugugugugugugugugugugugugugugugug

SEQ ID NO: 99754 - RNA, 46 nt, Mus musculus
cccagguuacaagcccaccacucccugccuaacaccaccaaugcag

SEQ ID NO: 99755 - RNA, 42 nt, Mus musculus
acagggcuuccccaaaaugggugcacugaccauuacccccag

SEQ ID NO: 99756 - RNA, 46 nt, Mus musculus
aauucuaacuccugucucugagucuucuuuccggcuuucccaggau

SEQ ID NO: 99757 - RNA, 46 nt, Mus musculus
cuggccucugaauacugaagcagugucugagccaccaugcccggag

SEQ ID NO: 99758 - RNA, 42 nt, Mus musculus
guaagcagagcuauggggaauacugaagcaguauuuuauaag

SEQ ID NO: 99759 - RNA, 46 nt, Mus musculus
uuaaagaaaaaaauuugcucuaacaauguccuguacauaucacagu

SEQ ID NO: 99760 - RNA, 46 nt, Mus musculus
uaagcccuuagaacuuuggaauccugccuccucuggaccccuaaau

SEQ ID NO: 99761 - RNA, 46 nt, Mus musculus
uuuauuacacuaacgcgcggggagaaaacauuuaaaucacuuccaa

SEQ ID NO: 99762 - RNA, 23 nt, Mus musculus
aaaaauauaaagguuaaaaacac

SEQ ID NO: 99763 - RNA, 46 nt, Mus musculus
gagaaacccugucucgaaaaaccaaaaaaaaaaaaagaguucuagg

SEQ ID NO: 99764 - RNA, 47 nt, Mus musculus
gacggacccuaaccaaccacccacacuaugaagauaaaagucugaga

SEQ ID NO: 99765 - RNA, 46 nt, Mus musculus
agcugaaacaacaggaugcugaguuugaggcuagccugggcuauau

SEQ ID NO: 99766 - RNA, 46 nt, Mus musculus
acacacacacacacacacacagagagagagagagagagaaacacac

SEQ ID NO: 99767 - RNA, 45 nt, Mus musculus
cgcaugccuauauuuaaacccucccauuccuucauagcccucccg

SEQ ID NO: 99768 - RNA, 45 nt, Mus musculus
acacaaaauauguuuguuuaaaucaacauucaaaucaguugcggu

SEQ ID NO: 99769 - RNA, 45 nt, Mus musculus
augcccugcugaaugugauguuguucuugguuucagguuugguuu

SEQ ID NO: 99770 - RNA, 42 nt, Mus musculus
ugugugugugugugugugugucuuuuguggauggauguguag

SEQ ID NO: 99771 - RNA, 46 nt, Mus musculus
uguggggacaggguaguacaggacuggggacugacucugugugugu

SEQ ID NO: 99772 - RNA, 41 nt, Mus musculus
cugauuugguuuccgucaucguuguuguugugagggggaag

SEQ ID NO: 99773 - RNA, 42 nt, Mus musculus
agguaggacuuuaacacuuugaugaaguuguugaugauggga

SEQ ID NO: 99774 - RNA, 42 nt, Mus musculus
cgaugguauagcauagaauagaguuuauuuagggcaugggga

SEQ ID NO: 99775 - RNA, 46 nt, Mus musculus
gcucagcccuaaaugggacauccuucucaacccccaucucccaggu

SEQ ID NO: 99776 - RNA, 46 nt, Mus musculus
cgaaacucacaugaacaacauucuccuagccaaggaccagaaaaga

SEQ ID NO: 99777 - RNA, 33 nt, Mus musculus
uggcaaaacauucauauacauaaaacaaaaauc

SEQ ID NO: 99778 - RNA, 46 nt, Mus musculus
guguaugaaugccuguguguaaaugugugugugugugugugagaga

SEQ ID NO: 99779 - RNA, 46 nt, Mus musculus
uucucaggggaugugcggggggcauucuaauuuucaguggucguuu

SEQ ID NO: 99780 - RNA, 45 nt, Mus musculus
acucacuccuugguuucuagccucuucuugaauaagaccccaggu

SEQ ID NO: 99781 - RNA, 26 nt, Mus musculus
uugucucguuuuaauggccuguaguc

SEQ ID NO: 99782 - RNA, 45 nt, Mus musculus
acacaugaaggggaaggagaaaaagaccaaggcaauggagacauc

SEQ ID NO: 99783 - RNA, 44 nt, Mus musculus
ggacauuuuccuauuaccagcuuguagcugugugggugagauug

SEQ ID NO: 99784 - RNA, 42 nt, Mus musculus
guuugcaguucuccaggacacaguuccuucucgccaccagug

SEQ ID NO: 99785 - RNA, 42 nt, Mus musculus
ucccugggucagaguagucacagugcugcuuuuaagccaguc

SEQ ID NO: 99786 - RNA, 48 nt, Mus musculus
ccucugugggacuauguagccaaagguaaacgcuaguagcaguguggu

SEQ ID NO: 99787 - RNA, 58 nt, Mus musculus
gagccuucccauuuuccuuaagguuuaucuuauuauuuauauacagugugcacauagc

SEQ ID NO: 99788 - RNA, 46 nt, Mus musculus
ggaggguggccccaacaugaggguguggcuccccuugguaggagga

SEQ ID NO: 99789 - RNA, 46 nt, Mus musculus
gaguggacagagucaccaaggagauuugauguuucuauaggcagga

SEQ ID NO: 99790 - RNA, 44 nt, Mus musculus
uuccccccaaagaauggugccaaugacaacuguguguaugggga

SEQ ID NO: 99791 - RNA, 41 nt, Mus musculus
uauaaaaugucuuugauuuguguauaggccacaccacagau

SEQ ID NO: 99792 - RNA, 41 nt, Mus musculus
cugacugucagacagcaaggaagcaagggagccugggcaga

SEQ ID NO: 99793 - RNA, 45 nt, Mus musculus
agacccugccucaaacaaacgucucaacaaaaacaaguuguaggu

SEQ ID NO: 99794 - RNA, 42 nt, Mus musculus
cucugacugugacauuuagagaagacauuuuagcaaggaaac

SEQ ID NO: 99795 - RNA, 46 nt, Mus musculus
uucccaaagacugcaggccccacugagagacucauagcccccgggc

SEQ ID NO: 99796 - RNA, 73 nt, Mus musculus
uagguucgaauaaauacugggaaaaauaccacuuuaaaguucagugagaagaaagaggaagccaaacggaaac

SEQ ID NO: 99797 - RNA, 44 nt, Mus musculus
uugcauacaguaguaaagucaguggugguggagucggcuguuga

SEQ ID NO: 99798 - RNA, 60 nt, Mus musculus
ucaaauucuuaccacagcaacaaagaugaugaugaagaagaagaagaugacgaugaugau

SEQ ID NO: 99799 - RNA, 25 nt, Mus musculus
gugauugcaaauggagaagacagag

SEQ ID NO: 99800 - RNA, 46 nt, Mus musculus
uguguaugugugugugugugugugugugugugugugugagaacagg

SEQ ID NO: 99801 - RNA, 42 nt, Mus musculus
uccuuguauuucauuuacaaacuuucuguuuauugagcaggc

SEQ ID NO: 99802 - RNA, 46 nt, Mus musculus
guguaaauacuuacacugaaaaucacaaucuccaugauacucagau

SEQ ID NO: 99803 - RNA, 46 nt, Mus musculus
caagaagaacugcugggugaacuugaaaggugcuuaauggcagauu

SEQ ID NO: 99804 - RNA, 48 nt, Mus musculus
ucacaaaccucauuccaaaccaaaaacuucagauauuuuugaagcaga

SEQ ID NO: 99805 - RNA, 44 nt, Mus musculus
acuugugaagggcccuaucuuucucaacacuuuucccaaaagac

SEQ ID NO: 99806 - RNA, 46 nt, Mus musculus
uuuuccuuguuuaaaaauuaggcugcaggugauuuuguugacauaa

SEQ ID NO: 99807 - RNA, 45 nt, Mus musculus
guuguucuccuuacaucuagaaagcuuccucaguuucacauuaag

SEQ ID NO: 99808 - RNA, 30 nt, Mus musculus
cuugguucccagaacccagaugaagaucag

SEQ ID NO: 99809 - RNA, 46 nt, Mus musculus
aaacaggggggaaacuuuuggaaauaaaagaugauucauuucaaag

SEQ ID NO: 99810 - RNA, 49 nt, Mus musculus
uguguugcugauuacugguuuuauugugguucugucuguagaugggagg

SEQ ID NO: 99811 - RNA, 46 nt, Mus musculus
uuuauguauaaauguaagcuuauuaauaaaagaaaaauugugagag

SEQ ID NO: 99812 - RNA, 44 nt, Mus musculus
guagaagcucacagagauuuuaauggucguauuacuggugagac

SEQ ID NO: 99813 - RNA, 46 nt, Mus musculus
aucaaccaaauaugucaucaaguuacaaugugauuaggcaccuccc

SEQ ID NO: 99814 - RNA, 42 nt, Mus musculus
aguauuauuccaagggaaagaaccaguuacacaggcccaacu

SEQ ID NO: 99815 - RNA, 46 nt, Mus musculus
uuccagagguccugaguucaaaucccagcaaccacaugggggcuca

SEQ ID NO: 99816 - RNA, 46 nt, Mus musculus
uuuuguguauaugaguacacugucacagucuucagacauaccagaa

SEQ ID NO: 99817 - RNA, 46 nt, Mus musculus
uccaaagguaugaacugugagcagaggcaguacaacgcgcugugga

SEQ ID NO: 99818 - RNA, 47 nt, Mus musculus
ggucuaagcugagcugggccaugagaugagagagaaagacagagaua

SEQ ID NO: 99819 - RNA, 45 nt, Mus musculus
cauacacagaagaaauaccauaguagacaguuuauggggagaguu

SEQ ID NO: 99820 - RNA, 45 nt, Mus musculus
guguugggggaagaaagacaacuugaauuuuuauggcuggcgaca

SEQ ID NO: 99821 - RNA, 86 nt, Mus musculus
aaaauguccauauuuaaaaaaauaccuuugaucccagcacucggaagagagaggcaggugggucucugugaguuugaggccagcgu

SEQ ID NO: 99822 - RNA, 46 nt, Mus musculus
accacauacaugacugguauucucagaggucagaagaggggacuag

SEQ ID NO: 99823 - RNA, 46 nt, Mus musculus
cucuucugaccucugagaauaccagucauguauguggugcgcagac

SEQ ID NO: 99824 - RNA, 46 nt, Mus musculus
uggagaagaugagcagagucuuuauuuggacuccaaauauuaacag

SEQ ID NO: 99825 - RNA, 46 nt, Mus musculus
aaaacaccuaaaauugauguuuucaagaaaauaaguugacagagau

SEQ ID NO: 99826 - RNA, 46 nt, Mus musculus
uagugagacaauuucaaaaugaaaaaauaaacagagggcugguaau

SEQ ID NO: 99827 - RNA, 46 nt, Mus musculus
aaguuuagaauugaaggcugguaaucuugguggcacaggccauuca

SEQ ID NO: 99828 - RNA, 46 nt, Mus musculus
auaccuugcugcugccuuuuuaaaacuaaagguguuucacagagac

SEQ ID NO: 99829 - RNA, 45 nt, Mus musculus
ugaagugugugugugugugugugugugugugagagagagaccuca

SEQ ID NO: 99830 - RNA, 44 nt, Mus musculus
aaauguuggaaggcuuccuccaagaagacaguucagugcuaguu

SEQ ID NO: 99831 - RNA, 46 nt, Mus musculus
auuguuucuuagcuuuggcuuuuggcuauagauuauaacccaugua

SEQ ID NO: 99832 - RNA, 42 nt, Mus musculus
aaggaauucuccucgugcacaacuggaacacaucuguacgaa

SEQ ID NO: 99833 - RNA, 46 nt, Mus musculus
uaaaaaggaauacgucuccauuuugccuuaauuuuuuuggguagau

SEQ ID NO: 99834 - RNA, 46 nt, Mus musculus
ucaauucccagcaaccacaugguggcucacaaccauccguaauaag

SEQ ID NO: 99835 - RNA, 41 nt, Mus musculus
agagaaagagaaagagagggagagggagagggagagggaga

SEQ ID NO: 99836 - RNA, 56 nt, Mus musculus
uaucccgagguggagugggacuugccauggaacccagacugcucucagagucccag

SEQ ID NO: 99837 - RNA, 35 nt, Mus musculus
gcauacaauacaagcauauauaugauguuuccccu

SEQ ID NO: 99838 - RNA, 46 nt, Mus musculus
ugcuuaugggcuugaauaaaguagugcuuauggauggggcagaguc

SEQ ID NO: 99839 - RNA, 46 nt, Mus musculus
auauucugguguugagaggaacuuacagaggcagccagauucagaa

SEQ ID NO: 99840 - RNA, 46 nt, Mus musculus
cucuggugaacuaaggaauuaauaauaguauuuguucagauaagag

SEQ ID NO: 99841 - RNA, 46 nt, Mus musculus
agguacaauaaacuuuaaauuacucuacaggcacaugugccagcag

SEQ ID NO: 99842 - RNA, 56 nt, Mus musculus
uaguagaaaauaauuggaaucaauuguucaaaaaaggaauguuggaaauagggcac

SEQ ID NO: 99843 - RNA, 54 nt, Mus musculus
cauguguggguuugugugcaugugccuguguacauguauguguuggggagagaa

SEQ ID NO: 99844 - RNA, 57 nt, Mus musculus
auggaggaagucacuuguauuuaaauaaugauguguccuggggcuggugggugugug

SEQ ID NO: 99845 - RNA, 46 nt, Mus musculus
gaauaaaaaucacaggugaaaacauuuggagauaagcugacaaaau

SEQ ID NO: 99846 - RNA, 63 nt, Mus musculus
cuguuauugaguguugcugugugauugauacugacuguagaucuucauucgguagggacguuu

SEQ ID NO: 99847 - RNA, 88 nt, Mus musculus
cauuuauuuuuguuuguguuuuauaauuaauacugccugaucagaaacagugagauggaccgauguggcuuuaguggaaucuuccaga

SEQ ID NO: 99848 - RNA, 46 nt, Mus musculus
aaaaaaaaggguuggggagaggggaagugugaccagaaccaggcag

SEQ ID NO: 99849 - RNA, 46 nt, Mus musculus
cuuuuguuguuugcuuguuuuuggagacuugucuacagaaucagau

SEQ ID NO: 99850 - RNA, 46 nt, Mus musculus
gaggcaucuccagugcacuggugacugagcaacuuauuugcaagau

SEQ ID NO: 99851 - RNA, 45 nt, Mus musculus
uuagccuuaauuuuagcacaguucucuaacccgggacugggagag

SEQ ID NO: 99852 - RNA, 46 nt, Mus musculus
auacagaucuaacuugguagaacauuugguagaauggggcccggga

SEQ ID NO: 99853 - RNA, 46 nt, Mus musculus
cuugaaaggaauuucuccaagaauugacuguuggggggugguggag

SEQ ID NO: 99854 - RNA, 46 nt, Mus musculus
gagcgacccucccccuuuuguuuuaacuauuuguauuccugcuuaa

SEQ ID NO: 99855 - RNA, 45 nt, Mus musculus
ggugggagccaaggaagccuugcaccuuuaaugccagcacucaga

SEQ ID NO: 99856 - RNA, 44 nt, Mus musculus
auauagugaaacccaaucucaaucaguaaagcaaucaaucaaug

SEQ ID NO: 99857 - RNA, 45 nt, Mus musculus
auucuaagacacagaacaggccuggagauuggggaacugccuccu

SEQ ID NO: 99858 - RNA, 45 nt, Mus musculus
ugucuucaaguuaccuuuacuagauauuaguaugcauuuugagau

SEQ ID NO: 99859 - RNA, 47 nt, Mus musculus
agagaacccugucucaaaaaaacuagagaagagaagagagaggagag

SEQ ID NO: 99860 - RNA, 46 nt, Mus musculus
ccuguuuugucuaacacaaugauaccaugcguuuacuucagggaug

SEQ ID NO: 99861 - RNA, 46 nt, Mus musculus
ccugaaguaaacgcaugguaucauuguguuagacaaaacaggccag

SEQ ID NO: 99862 - RNA, 46 nt, Mus musculus
acgaaauagacuaugcuaccuuuuuguguaaggaagcaggguggag

SEQ ID NO: 99863 - RNA, 46 nt, Mus musculus
ugagguaaaccagaaauaaauuaaaaauaguuaccuauaauggcag

SEQ ID NO: 99864 - RNA, 44 nt, Mus musculus
uucucucuguggauucuggggauugaccuuggguggccacguuu

SEQ ID NO: 99865 - RNA, 46 nt, Mus musculus
ucagucaggacaggugacuugauuccaacauccacuaucucuagau

SEQ ID NO: 99866 - RNA, 45 nt, Mus musculus
aaguauuuuaccaacugagccaccuucucagcugcacucugaguu

SEQ ID NO: 99867 - RNA, 46 nt, Mus musculus
uguaacuacaagauuuuguuuacauauacacauagauuggcuagau

SEQ ID NO: 99868 - RNA, 46 nt, Mus musculus
uuuucaaggaagccagaguuguaaaaauaugugcuaugcaguguga

SEQ ID NO: 99869 - RNA, 46 nt, Mus musculus
aagcucuuccugguuuugcacaagacccugguucaguucccagcac

SEQ ID NO: 99870 - RNA, 46 nt, Mus musculus
uaugagugucuugccugcauacaugugcgcauaaucccaaugagau

SEQ ID NO: 99871 - RNA, 48 nt, Mus musculus
acguaacucaaugugauaaagcucacacaaaacacuugguuagaucuc

SEQ ID NO: 99872 - RNA, 46 nt, Mus musculus
uguuccucaggaauaacuaucuagaauaacauuaaaggcugaggug

SEQ ID NO: 99873 - RNA, 79 nt, Mus musculus
ucuuaauaugcuaccuugcguugagaccagcagucuguucauuauugauuugaguacucuuaggaauugaggcaguuuu

SEQ ID NO: 99874 - RNA, 45 nt, Mus musculus
aacaacaaaagaaauaaaaucaagaauucaaggucuaguuggcaa

SEQ ID NO: 99875 - RNA, 44 nt, Mus musculus
auuauaaauaaguacacuguagcugucuuagacacagcagaaga

SEQ ID NO: 99876 - RNA, 46 nt, Mus musculus
guugcaagcugcuaugugggugcugggaguugaacccggguccucu

SEQ ID NO: 99877 - RNA, 46 nt, Mus musculus
guuauaccaguuuacaugccugccagcugugguacacgguccagca

SEQ ID NO: 99878 - RNA, 42 nt, Mus musculus
caggcucacauaacagggagucuauucuguuuaggccaagca

SEQ ID NO: 99879 - RNA, 76 nt, Mus musculus
ucauuaaagcagaaaccucaguuaaguggaggugagccuguguggaagacauuuuugaguagaguuuuaugcagau

SEQ ID NO: 99880 - RNA, 46 nt, Mus musculus
ggcaaggacuggugggggaugcuccuuauauaagcaaccugucaga

SEQ ID NO: 99881 - RNA, 45 nt, Mus musculus
aguguguugugcugaaccagaguuucaaaugaagaggccacugga

SEQ ID NO: 99882 - RNA, 46 nt, Mus musculus
gcucugucagccagcuagugcaguaguuggaacccacgccauagga

SEQ ID NO: 99883 - RNA, 45 nt, Mus musculus
augcucuccuuauaccagagucuuggagaauuaaaugcggcagaa

SEQ ID NO: 99884 - RNA, 45 nt, Mus musculus
ccauucuaaccaaaccacaggaacucuucuuacaugucuugccag

SEQ ID NO: 99885 - RNA, 42 nt, Mus musculus
ggaugguauacauauuguuuacccuuuucuucaagcugccau

SEQ ID NO: 99886 - RNA, 46 nt, Mus musculus
cuccuauuucauguaagcuugaauuuuugcuaugaaacccaaacuc

SEQ ID NO: 99887 - RNA, 45 nt, Mus musculus
gcguguaaacuuuauguuauuuauuuggaauuuacuccuggagaa

SEQ ID NO: 99888 - RNA, 45 nt, Mus musculus
ggaugcggggauguggggaauacagaggaugcaggggauaggaua

SEQ ID NO: 99889 - RNA, 37 nt, Mus musculus
guggggaucucgguuucacgcagagggcuggccgcau

SEQ ID NO: 99890 - RNA, 41 nt, Mus musculus
gccucgcugaggcugcggcgccgggcauggagcccccgucc

SEQ ID NO: 99891 - RNA, 34 nt, Mus musculus
cugccaugaacucugucaugccuuccccugacaa

SEQ ID NO: 99892 - RNA, 76 nt, Mus musculus
uugcuguucuuucaggugacgauuuuggauccuccagcucuagugacucaacaccgucuucacaugcgcaaaaccc

SEQ ID NO: 99893 - RNA, 45 nt, Mus musculus
uuuuuaaaaaagaugaacaaaaugagccugucacucccaggagaa

SEQ ID NO: 99894 - RNA, 23 nt, Mus musculus
ucauggugacuuggaagccaaaa

SEQ ID NO: 99895 - RNA, 45 nt, Mus musculus
uacacaaggaaaccguucucucagauuccuuccaccggcugcaga

SEQ ID NO: 99896 - RNA, 26 nt, Mus musculus
gcucugugcagguauguggggagcag

SEQ ID NO: 99897 - RNA, 46 nt, Mus musculus
guacucacacaaccacacacacucacauacauauucacacacagaa

SEQ ID NO: 99898 - RNA, 46 nt, Mus musculus
uaaugucacaggguccccugugcaauguucaauuucaagucggagg

SEQ ID NO: 99899 - RNA, 46 nt, Mus musculus
cauugaacagagccuguggcugaaacagauuuaagagggauaagga

SEQ ID NO: 99900 - RNA, 45 nt, Mus musculus
uccaaauaugguuccuuuugcucuuggggguuagaagcccaagau

SEQ ID NO: 99901 - RNA, 45 nt, Mus musculus
gaaccgggugacgccucgggguugaagugcgugaaaugguaagga

SEQ ID NO: 99902 - RNA, 41 nt, Mus musculus
cauaaccccagcaugggggaggcuaugguaggacucccaga

SEQ ID NO: 99903 - RNA, 41 nt, Mus musculus
gacaggcuguggcuaaaugggaaguuagccuuggcaggagg

SEQ ID NO: 99904 - RNA, 44 nt, Mus musculus
cagcaaccacaugguggcucacaaccaaccaucuguaaugggaa

SEQ ID NO: 99905 - RNA, 45 nt, Mus musculus
uggcacaagccuacagucccagcuauguagcuugagcccaggacu

SEQ ID NO: 99906 - RNA, 44 nt, Mus musculus
uuuugucuuuucacacaaaugaauuauagauugcagccagcaga

SEQ ID NO: 99907 - RNA, 42 nt, Mus musculus
agcugagucacucaagggcugggaccaggcugggcgggaauc

SEQ ID NO: 99908 - RNA, 45 nt, Mus musculus
acacagagagugacuuuuucagggaaaaguaauuuauuaguaauu

SEQ ID NO: 99909 - RNA, 50 nt, Mus musculus
ggaggaaauuggaggagcuggcuuggcagaggcuuuuaaagaugagcuca

SEQ ID NO: 99910 - RNA, 46 nt, Mus musculus
uagaagcaggucuggauugaggcuuguccagaguuggaaaaggcag

SEQ ID NO: 99911 - RNA, 45 nt, Mus musculus
accaaauuaccuggacgugugcuccucacuuuccuuucccuuguc

SEQ ID NO: 99912 - RNA, 42 nt, Mus musculus
auggaugcuacucacuguggccuugcauucucucuuuugaua

SEQ ID NO: 99913 - RNA, 45 nt, Mus musculus
acauugggaucuaaaauuuuaucacacugguuugucacagccagg

SEQ ID NO: 99914 - RNA, 44 nt, Mus musculus
gcuuucugucccaaagaaaagugaacuuugggaacuuucuguag

SEQ ID NO: 99915 - RNA, 41 nt, Mus musculus
guaggcuguacuugaaaucacaaaaaccaaccugccucugg

SEQ ID NO: 99916 - RNA, 44 nt, Mus musculus
aacauaaucgaucaucaucaucaucaucaaauguugcucauaga

SEQ ID NO: 99917 - RNA, 41 nt, Mus musculus
ggaagcugcgccauggugagcgaggggccucugcccccaga

SEQ ID NO: 99918 - RNA, 46 nt, Mus musculus
gcgagcgcucagagccuauguucuuuuuugucccgagggccaguug

SEQ ID NO: 99919 - RNA, 47 nt, Mus musculus
uuugcgaaaguuguaaagucuacccaauauuuggucuauaucugcgu

SEQ ID NO: 99920 - RNA, 87 nt, Mus musculus
uaguuuugaaauacuguacuacuuugauuauugcaguuuuaucgggagucuuaaagucaggcaguguucuguuaaugcuucaguauc

SEQ ID NO: 99921 - RNA, 46 nt, Mus musculus
uuuuaguuauuuaacacuuucaguaguacuuuuccuucucuggcag

SEQ ID NO: 99922 - RNA, 42 nt, Mus musculus
ugcuuuuaugguucuuuuauguucgugcuaaugauggcccug

SEQ ID NO: 99923 - RNA, 46 nt, Mus musculus
uuguaagauguacuuuugauucuguugaaauauuuaaucucucgag

SEQ ID NO: 99924 - RNA, 42 nt, Mus musculus
aacacagauguguagugcauguauauaaucacauacggugag

SEQ ID NO: 99925 - RNA, 46 nt, Mus musculus
aaacagaaagaaagcauccuuaaaguguaaacgauaaagcuagaug

SEQ ID NO: 99926 - RNA, 45 nt, Mus musculus
ugugcacauagcaagugguuagagugauauaaauagguacuggag

SEQ ID NO: 99927 - RNA, 42 nt, Mus musculus
aguuacaggagacuuaacagggagagagcgauggaguuagag

SEQ ID NO: 99928 - RNA, 46 nt, Mus musculus
ucccuuuguaagucaucagaaugcugggcaaaacaacaccuggaag

SEQ ID NO: 99929 - RNA, 45 nt, Mus musculus
uuucuguuuuuuguuuuuauuucaugugauuuuauaaagguguaa

SEQ ID NO: 99930 - RNA, 46 nt, Mus musculus
aaacaguguggaauggccuucgcuugccacuguucgcuuucuauag

SEQ ID NO: 99931 - RNA, 42 nt, Mus musculus
augccuuuaauccuagcacuggggaggcaaaaguaggcagau

SEQ ID NO: 99932 - RNA, 47 nt, Mus musculus
ggguauguugcuaaguagguagaauacuuagcuggcaagcaugagac

SEQ ID NO: 99933 - RNA, 45 nt, Mus musculus
ggcuaggguagagaggucgaccgagcuggagucgucggcuugugg

SEQ ID NO: 99934 - RNA, 42 nt, Mus musculus
cugcgagcugggcccggagcccgugacagacgggccaaggag

SEQ ID NO: 99935 - RNA, 42 nt, Mus musculus
cggcgacaccaugucaucccccagucccggcaagaggcggau

SEQ ID NO: 99936 - RNA, 25 nt, Mus musculus
agaaaauuaaagaguacauccacuc

SEQ ID NO: 99937 - RNA, 45 nt, Mus musculus
gaagaggcccugaaggaacaggaagagggcacuggcgacagcuca

SEQ ID NO: 99938 - RNA, 45 nt, Mus musculus
cucuuggaugaagauagaacagugcuuuuccagagugggaaggaa

SEQ ID NO: 99939 - RNA, 45 nt, Mus musculus
uuuuuaguuuagaagugcuauauuccacaaggguuaagucaauga

SEQ ID NO: 99940 - RNA, 98 nt, Mus musculus
ugguucuggaaaaggagggaaaggaggugcagccucugggagugacagugcugacaagaagucucaggguccuaaaggugguggcaaugcaguaaagg

SEQ ID NO: 99941 - RNA, 50 nt, Mus musculus
ugggaugagauucagugaaguggccacacaauauagugaagauaaagcca

SEQ ID NO: 99942 - RNA, 50 nt, Mus musculus
ccuugccuguaagugggauggauaagccuguguuuacagacccaccaguu

SEQ ID NO: 99943 - RNA, 45 nt, Mus musculus
ugcccuccugcagaggcugcgugcuguagugcuacgaaauggggg

SEQ ID NO: 99944 - RNA, 46 nt, Mus musculus
augaggacaccaccugucaauggggacagguuauuaacagcccccg

SEQ ID NO: 99945 - RNA, 44 nt, Mus musculus
gugaagugaaaaaggcccuuucuaaacaagagaugcagccugcu

SEQ ID NO: 99946 - RNA, 46 nt, Mus musculus
acaacaaggucaccucagaauacauaaaagaacacauacuggagag

SEQ ID NO: 99947 - RNA, 45 nt, Mus musculus
ccuucgaaagcauaaaagaauucauauugaagagaagcccgauga

SEQ ID NO: 99948 - RNA, 46 nt, Mus musculus
aauugggaagaccauaauagugaacauuuucaacauucuagaagac

SEQ ID NO: 99949 - RNA, 46 nt, Mus musculus
guugcauagaccaccuugacauccaacucaaugaauaccccuaucu

SEQ ID NO: 99950 - RNA, 46 nt, Mus musculus
cuuucuaucuuuuuaauuuguuugauugauuuuuguacgggagaca

SEQ ID NO: 99951 - RNA, 46 nt, Mus musculus
uuuaugaucagcauuuacauuugcuuauauugacaucuguccauuu

SEQ ID NO: 99952 - RNA, 30 nt, Mus musculus
acacuguugguugguuauuacuggugacuc

SEQ ID NO: 99953 - RNA, 46 nt, Mus musculus
uccuuguguuggaguuuuccaccuagaauccucuguauggcuggau

SEQ ID NO: 99954 - RNA, 45 nt, Mus musculus
agucacuugagggacuaauugaagaucaacaacaacaugccagaa

SEQ ID NO: 99955 - RNA, 46 nt, Mus musculus
agacacccuacagauaaguagugugcuaaccagacccguuagagau

SEQ ID NO: 99956 - RNA, 47 nt, Mus musculus
aaggcaucucauguuggguagcacucccauaucaaacugugguguag

SEQ ID NO: 99957 - RNA, 46 nt, Mus musculus
aacuucacuaugagggcggcaucugcucaaagcaucuggcucagag

SEQ ID NO: 99958 - RNA, 94 nt, Mus musculus
ugggaaaggacgugcuuaguucugcugggacuggaugccccaggaagagaggaggcaacguggggagggauuuguaaagauggaauugggugga

SEQ ID NO: 99959 - RNA, 43 nt, Mus musculus
uuagagugggggcugucuuuuacuuaguugccugccccuggau

SEQ ID NO: 99960 - RNA, 49 nt, Mus musculus
aggagucacaugcagauuuaaacagaugcagacacccauagccaaacau

SEQ ID NO: 99961 - RNA, 46 nt, Mus musculus
ugguucuaagacaucucugggacuaacuauagacauggauggagga

SEQ ID NO: 99962 - RNA, 46 nt, Mus musculus
aguagauauuaaaagucucacaaccaaaaaaagucuaggggcagau

SEQ ID NO: 99963 - RNA, 46 nt, Mus musculus
uuuuagguuacaugaccagggucacagaaaugcuuuaaguugggga

SEQ ID NO: 99964 - RNA, 45 nt, Mus musculus
cuugacaaaguugucauugagagcaaugccagccccgacaucgaa

SEQ ID NO: 99965 - RNA, 45 nt, Mus musculus
gaugcagggaugauguucugggcagccccacggccaucaugccac

SEQ ID NO: 99966 - RNA, 42 nt, Mus musculus
aggccccacuaacaucaaauggggugaggccggugcugagua

SEQ ID NO: 99967 - RNA, 46 nt, Mus musculus
gguaaccacccagauuccacagauaauuaguuguaucagugugcag

SEQ ID NO: 99968 - RNA, 46 nt, Mus musculus
aauaugaugaagucuuugcuuguaacaguggucuguagauacacac

SEQ ID NO: 99969 - RNA, 45 nt, Mus musculus
cgcgcuucagguguuucuugggaccacgagucauggcugcgcugg

SEQ ID NO: 99970 - RNA, 29 nt, Mus musculus
cgccugaauuccccucacggcacccagca

SEQ ID NO: 99971 - RNA, 77 nt, Mus musculus
gaaguacuucuuaaguccaucagagaccugaaacagugacacaguccuaaguggaagaucccaaaggaagaaaagga

SEQ ID NO: 99972 - RNA, 49 nt, Mus musculus
gggaguagggguggaggagagagcaccaucucagaguaaaagaaggggg

SEQ ID NO: 99973 - RNA, 45 nt, Mus musculus
ucuuccugcugaucucuguguccuagcuacaaacuauggucaguc

SEQ ID NO: 99974 - RNA, 45 nt, Mus musculus
aagccagcccaugccuguaaucccaagagacugaggcaaggagau

SEQ ID NO: 99975 - RNA, 44 nt, Mus musculus
agucucuguuaccuugggacccaauacucaugguuggcccuagu

SEQ ID NO: 99976 - RNA, 46 nt, Mus musculus
guuuccuaugauugaugaugauuggauguaagucuacaccagagug

SEQ ID NO: 99977 - RNA, 46 nt, Mus musculus
uaugauccaaauugucacaucaguuacaaauacugucgggcuggag

SEQ ID NO: 99978 - RNA, 46 nt, Mus musculus
guggaaaagccuucaguagcaggucaucuuuucguaagcaucaguu

SEQ ID NO: 99979 - RNA, 46 nt, Mus musculus
gugugggaaaucauuuaacuuuccaugugaacuaaaggugcauuau

SEQ ID NO: 99980 - RNA, 42 nt, Mus musculus
ggaaaggccuucaaucagaaaucaauacuagaccggcaugag

SEQ ID NO: 99981 - RNA, 46 nt, Mus musculus
ggucauaaugaaagagaucagcucauugacauuguugcauccaguc

SEQ ID NO: 99982 - RNA, 58 nt, Mus musculus
cuguuugaagagaagaggagggaaggagagagagaauuguugauuuuuguacuaggga

SEQ ID NO: 99983 - RNA, 75 nt, Mus musculus
uuuuagaccauccugauuuauauaacaaguucugggccagugaguuccaggccagucgggccacagaaugaaacu

SEQ ID NO: 99984 - RNA, 41 nt, Mus musculus
guaugagaagucuuaugagguacauuguacaaguguacaga

SEQ ID NO: 99985 - RNA, 42 nt, Mus musculus
gagagguaggagggagagcaaguuggaagcugccagccaggg

SEQ ID NO: 99986 - RNA, 46 nt, Mus musculus
uuagaugcugacuacagaagggacugcauagauaugguggccaggg

SEQ ID NO: 99987 - RNA, 42 nt, Mus musculus
cguccaugaaaguugucagcugaggccauuagggggcgggac

SEQ ID NO: 99988 - RNA, 45 nt, Mus musculus
gggauggggguuccaagggcguuuccaucgggugucuuggagugc

SEQ ID NO: 99989 - RNA, 46 nt, Mus musculus
gcagaugaucuguuaccaccaaaugaacaaagcggccuggcaagag

SEQ ID NO: 99990 - RNA, 46 nt, Mus musculus
aguuaccuuuuugacagguccgugaaugaugcuugggaggccccgu

SEQ ID NO: 99991 - RNA, 44 nt, Mus musculus
guucuccaaaggucccuaguccauccucagaacucaugcucaga

SEQ ID NO: 99992 - RNA, 42 nt, Mus musculus
gcuacagucucaaucauagacaacuuccagagcugaccagau

SEQ ID NO: 99993 - RNA, 42 nt, Mus musculus
agagagaagggagucaucuggggagucuacacugcaggguug

SEQ ID NO: 99994 - RNA, 46 nt, Mus musculus
gcaagaaauggggccagagcgccgagaagugcuagacaaaugagaa

SEQ ID NO: 99995 - RNA, 45 nt, Mus musculus
acaggagacacagugggccagugaggagcuaauguggcagcgagg

SEQ ID NO: 99996 - RNA, 42 nt, Mus musculus
ggacuaagacaccccagggcugagacuggaguggggguagga

SEQ ID NO: 99997 - RNA, 45 nt, Mus musculus
gcgcguggcguuucccgggagcagcagagccugcgccgcuggaua

SEQ ID NO: 99998 - RNA, 26 nt, Mus musculus
gggcugguccccugggacugagggaa

SEQ ID NO: 99999 - RNA, 46 nt, Mus musculus
cugaccucacaucgaggugucuggacuccagcccucuuccccagau

SEQ ID NO: 100000 - RNA, 45 nt, Mus musculus
ccucccucggccuccucccugggacccagggugccagccccagcc

SEQ ID NO: 100001 - RNA, 25 nt, Mus musculus
gcucaggcuccuauuguacuucacu

SEQ ID NO: 100002 - RNA, 46 nt, Mus musculus
cugagagggaucaagagauggggguuggcagggugaaaagcagauu

SEQ ID NO: 100003 - RNA, 44 nt, Mus musculus
cugggauggggcuggagagauguuagaaguuggggugguaagga

SEQ ID NO: 100004 - RNA, 44 nt, Mus musculus
gagaggacgccaugcagggugucaucacacaccagggggccacc

SEQ ID NO: 100005 - RNA, 46 nt, Mus musculus
guuaggagagcuagacagacgaaggggcuagcuuccucauccccgg

SEQ ID NO: 100006 - RNA, 45 nt, Mus musculus
uccacaagguuccagugaaccuaugucaccaguggggccccaggu

SEQ ID NO: 100007 - RNA, 45 nt, Mus musculus
caccauggaaaaaaacugaguucaugcuaagauggacagacugga

SEQ ID NO: 100008 - RNA, 45 nt, Mus musculus
aucaccauucucuggaauagcccaacccucaggaucaccgccaag

SEQ ID NO: 100009 - RNA, 89 nt, Mus musculus
uuggggauccagacauuauaaaggaguucuggcccacuugugagauuggagagaaagaucugaggcugugacuccaacguccuggggaa

SEQ ID NO: 100010 - RNA, 71 nt, Mus musculus
uguuuccggagcugucuugagucuugcuggaggauggagcuaggggcugagaaagcuagggcagagcucua

SEQ ID NO: 100011 - RNA, 45 nt, Mus musculus
acggcuggauugcacaggguggggggcgucccaugguggccucug

SEQ ID NO: 100012 - RNA, 45 nt, Mus musculus
cugccgugaggacccaucugucuccaaccaggacacccccacaga

SEQ ID NO: 100013 - RNA, 45 nt, Mus musculus
gcuccggcugaucucugcucuggaggcuaugaucacccagacgca

SEQ ID NO: 100014 - RNA, 47 nt, Mus musculus
cugauaugaugcacuucuggccaacuuugggacacagauuggccagu

SEQ ID NO: 100015 - RNA, 45 nt, Mus musculus
gacagagagagacagggagagagagagagagagagagagagagag

SEQ ID NO: 100016 - RNA, 46 nt, Mus musculus
agagagagagacagagagagacagagagagagagagacacagagag

SEQ ID NO: 100017 - RNA, 46 nt, Mus musculus
aagaacagaugauggagggggauuucuugucacuagcccaccaggu

SEQ ID NO: 100018 - RNA, 84 nt, Mus musculus
gggcaauggagagggucuucguggucucuauggcaggcugcuuugugagugagugaggggaaugacaacauccuuggcaaauga

SEQ ID NO: 100019 - RNA, 42 nt, Mus musculus
cuguacuugguacugacugggggaagggaaugacacucagag

SEQ ID NO: 100020 - RNA, 46 nt, Mus musculus
ggagcccagggaagaaggcugggaucuggauuucugggguugaggg

SEQ ID NO: 100021 - RNA, 45 nt, Mus musculus
agaaagcacggaauguguuguccaaagacagaggcuccugacagc

SEQ ID NO: 100022 - RNA, 46 nt, Mus musculus
gggaaaguaggaauucauacugucauguugaugaccuggguucauc

SEQ ID NO: 100023 - RNA, 42 nt, Mus musculus
gcuaucuggucaagggucaccagaagcagagcuguggggcag

SEQ ID NO: 100024 - RNA, 45 nt, Mus musculus
cccaacugccagauccugggcuggggcaagauggaaaauggucag

SEQ ID NO: 100025 - RNA, 45 nt, Mus musculus
ugaagggucaaugagaagugagaacucaugggggagguuaugauu

SEQ ID NO: 100026 - RNA, 41 nt, Mus musculus
gagcagcagguguugcuucaugauguagcugcgcugaggag

SEQ ID NO: 100027 - RNA, 42 nt, Mus musculus
ggcucugaugagauaggacaggcaccugcagcucagggagug

SEQ ID NO: 100028 - RNA, 46 nt, Mus musculus
aaaaccuuuggacagaaauaaaaacagaucaagugaggccacuggg

SEQ ID NO: 100029 - RNA, 29 nt, Mus musculus
agugagagaaggaaauucugggggacugu

SEQ ID NO: 100030 - RNA, 46 nt, Mus musculus
uacauacauacauacauacauacauacauacauauugagucagaga

SEQ ID NO: 100031 - RNA, 46 nt, Mus musculus
ggagaugcagggugugagaggggaguaucagggugauuagucagag

SEQ ID NO: 100032 - RNA, 44 nt, Mus musculus
ugcuccccagcuugggcuccucagugggcaggucgaugggcuuc

SEQ ID NO: 100033 - RNA, 46 nt, Mus musculus
cuauuaaauggcugguucauugcccucuguagggugugcuguuuga

SEQ ID NO: 100034 - RNA, 42 nt, Mus musculus
aaauugcugagaauagcauccagcaggaucccugagggacag

SEQ ID NO: 100035 - RNA, 41 nt, Mus musculus
uuggacugcuggggucugcugagaucagaucaaggggccug

SEQ ID NO: 100036 - RNA, 42 nt, Mus musculus
gcuaaauuugauuacacaguccucagagaagucaggggccag

SEQ ID NO: 100037 - RNA, 24 nt, Mus musculus
caaaggucaacaaaguaccucuuc

SEQ ID NO: 100038 - RNA, 41 nt, Mus musculus
acagagacagacagaccuuggagacccagagaaaggacaga

SEQ ID NO: 100039 - RNA, 45 nt, Mus musculus
aggagaggcagacagacacacagacagaauacauagaaaccuaga

SEQ ID NO: 100040 - RNA, 41 nt, Mus musculus
gacccccccccacccccaaucucccugacuuaggaggggag

SEQ ID NO: 100041 - RNA, 45 nt, Mus musculus
gaaagagaggcucauagagccugggagugagaacuaagaaugaga

SEQ ID NO: 100042 - RNA, 45 nt, Mus musculus
agacacaugcagguggccaugguggacguggguuuuggaaaaggu

SEQ ID NO: 100043 - RNA, 41 nt, Mus musculus
cuuucguugcuaggcgaccagaagagacccuguuacccaga

SEQ ID NO: 100044 - RNA, 41 nt, Mus musculus
uaugugcccauagaagcacccugcagccuagaggugggaau

SEQ ID NO: 100045 - RNA, 46 nt, Mus musculus
gcucccucuugacacugcucgccaaggguccaggccuacagaggag

SEQ ID NO: 100046 - RNA, 46 nt, Mus musculus
uaggaagggagcagggcaacucaggcuccuggaaguugaagguagg

SEQ ID NO: 100047 - RNA, 46 nt, Mus musculus
agguagggccuaggcugugggcugcacugccucugggcguguggga

SEQ ID NO: 100048 - RNA, 46 nt, Mus musculus
auggcuccacuacucuugacuaacuucugucuuucccaccuuaauc

SEQ ID NO: 100049 - RNA, 45 nt, Mus musculus
gagacagguuuguugaugaaguauuuguuauguaagcagcaagau

SEQ ID NO: 100050 - RNA, 46 nt, Mus musculus
uggaggaaugaggccuggaagcaggaagcaaaagaucagcucggag

SEQ ID NO: 100051 - RNA, 42 nt, Mus musculus
ccaacccugcaguuccugccugucccacccuucccuggccag

SEQ ID NO: 100052 - RNA, 45 nt, Mus musculus
cacgccauggguagacagacuucuagacuuggucaacccccaccc

SEQ ID NO: 100053 - RNA, 48 nt, Mus musculus
uuauguagcucaggcuggucuugaacucacucucacuguguagcuagg

SEQ ID NO: 100054 - RNA, 42 nt, Mus musculus
gggaacuaaccuuacuuagaucaucuacuucuggccucaguu

SEQ ID NO: 100055 - RNA, 46 nt, Mus musculus
ucugaccguucccagcugcccucccacccacgcuuacaccucagcc

SEQ ID NO: 100056 - RNA, 42 nt, Mus musculus
cggcccagucccucgggcucagccucaaacucagcggcaguu

SEQ ID NO: 100057 - RNA, 42 nt, Mus musculus
cuuacacugcucccgcaugccagccuccuugcacuugcgcag

SEQ ID NO: 100058 - RNA, 59 nt, Mus musculus
ugagaggacggggcugcaacgccaagggaaagaucugcaggucggcgggcuccggagga

SEQ ID NO: 100059 - RNA, 41 nt, Mus musculus
gugcaccagggggaggcggggcucaugacugcaccggcgau

SEQ ID NO: 100060 - RNA, 37 nt, Mus musculus
ucucgccucccacggccguuuccagggcaacagaguc

SEQ ID NO: 100061 - RNA, 46 nt, Mus musculus
auucaguuuuugaguaauuucuucaucucuaucuuuuagcucacaa

SEQ ID NO: 100062 - RNA, 46 nt, Mus musculus
cguugucuuagaguuuccauugcugugaacagaccccauggccaag

SEQ ID NO: 100063 - RNA, 78 nt, Mus musculus
uggcuuccaggcagcuaggaggagggucucaaagccuaccccugcagugacauaccuacuccaacuaggcagcaacac

SEQ ID NO: 100064 - RNA, 44 nt, Mus musculus
aaacagaaaagccacuugagggacuguccaccucuaaacuguua

SEQ ID NO: 100065 - RNA, 46 nt, Mus musculus
uaacacauuucugggcauuuuguauagcucaguacauagccaagac

SEQ ID NO: 100066 - RNA, 50 nt, Mus musculus
guauuccagacuuaacagauaagaagaaaggaauggagagagguggguag

SEQ ID NO: 100067 - RNA, 46 nt, Mus musculus
gcagaugaggcagaaagacccucaagccaugcagaguugagcugga

SEQ ID NO: 100068 - RNA, 46 nt, Mus musculus
ggggcccaagagcaugccuuucaagggugcaucuuuuuuuuucaag

SEQ ID NO: 100069 - RNA, 46 nt, Mus musculus
gucauguuuccagagguucagauuucuaaucaggcagaguugggag

SEQ ID NO: 100070 - RNA, 63 nt, Mus musculus
uuggcucugguauuuuuuaacagaauaauauuagccaguuuagguuccuguuuuuccuuguuu

SEQ ID NO: 100071 - RNA, 84 nt, Mus musculus
uguuugagacaggauuuguagucaugguuggccuggaacucacagaaauacaccauccucggaugcugagaucaaaggcaucug

SEQ ID NO: 100072 - RNA, 69 nt, Mus musculus
guaggcuuuggucagggcuuuuuguaauuaggaaguacauaauaucuuugcuuuaacacugaauuauag

SEQ ID NO: 100073 - RNA, 46 nt, Mus musculus
ccaggacugggagggagauggcauuccugaggauuuccaacacugg

SEQ ID NO: 100074 - RNA, 112 nt, Mus musculus
uggcgagggaggggcgagcgguuacucacuccauggcggcgaaaaggcgaggaggcaacggcggcggcggccucggcugaagagacggugugagcggagagugaaggcgcgg

SEQ ID NO: 100075 - RNA, 63 nt, Mus musculus
cgacggggucgcggcuacagagccauugcgcgggcggaggcggcguggcgggagcguuaaggg

SEQ ID NO: 100076 - RNA, 42 nt, Mus musculus
uagcgaguucaaggcuauccugggcuaccuguguugggggau

SEQ ID NO: 100077 - RNA, 41 nt, Mus musculus
cuuuaucugguuaauggccuauauccccugacccugcguug

SEQ ID NO: 100078 - RNA, 45 nt, Mus musculus
aguuccaagacagccaaggcuacacagagaaacccuugacuugaa

SEQ ID NO: 100079 - RNA, 93 nt, Mus musculus
ucugugagguccuaggcaguguuagguaaacagagaugcucagggcuaagggggagggucugguagguagcagggacaugggaaacaggcuga

SEQ ID NO: 100080 - RNA, 70 nt, Mus musculus
cugaccaaugccugcgggacagaggagaggacccaguuggagcaaggaagagggaggacgaagaugauau

SEQ ID NO: 100081 - RNA, 46 nt, Mus musculus
agaggacagagaugauguacgcuguauggagggagaacgguguaua

SEQ ID NO: 100082 - RNA, 46 nt, Mus musculus
cucccugcuuccccagugcugggauugcaggauugugccagcacac

SEQ ID NO: 100083 - RNA, 46 nt, Mus musculus
uagcagaggcggggcuuacaugggaaggcccuuuccaggcagagau

SEQ ID NO: 100084 - RNA, 45 nt, Mus musculus
uggcaccagagggagguggaucucugugaguccgaggcuauccca

SEQ ID NO: 100085 - RNA, 42 nt, Mus musculus
uaaauccaagauaaggagacuauacugaaguuauugggggag

SEQ ID NO: 100086 - RNA, 42 nt, Mus musculus
agggucagucucuacucaccucguggaugccaaagugggcau

SEQ ID NO: 100087 - RNA, 42 nt, Mus musculus
ggggccaggaagggcucuguccuaagggguuagggggcacag

SEQ ID NO: 100088 - RNA, 54 nt, Mus musculus
uagcuacggggugauuggggaaggccuuuggggcggugagugguuuguagguug

SEQ ID NO: 100089 - RNA, 45 nt, Mus musculus
agaagucccagauaagccccauccuuuguccaauucccugcuguc

SEQ ID NO: 100090 - RNA, 46 nt, Mus musculus
cuggcacccgcgccgcacgggcgcccaauuccuccccugguaggua

SEQ ID NO: 100091 - RNA, 90 nt, Mus musculus
uugaaauagggugccagcuuuggauaauaggaguuuacauuuagaaaagggaaggaaccuauggguagaguucauauagaagacucuggg

SEQ ID NO: 100092 - RNA, 45 nt, Mus musculus
gcugcuauccacagucugggaguccggggugagugcggguggagg

SEQ ID NO: 100093 - RNA, 45 nt, Mus musculus
ggucuuuuugggcuuguugcuacccggggccaccuuggccaccuc

SEQ ID NO: 100094 - RNA, 72 nt, Mus musculus
cgaaucucggggcaggcagagcugggggagguggggguggaggaggaggaggaggagaaggugaagaugaag

SEQ ID NO: 100095 - RNA, 63 nt, Mus musculus
auggggaaggggaaggggaggaggaggcagaggagggggcaggugguggagcaggcccuccau

SEQ ID NO: 100096 - RNA, 45 nt, Mus musculus
ccagucaaauagaugcaaacucaacccugacuucgggugucauga

SEQ ID NO: 100097 - RNA, 46 nt, Mus musculus
uuccuaguccuugaagagagcuuccaggccucauaaauggucccag

SEQ ID NO: 100098 - RNA, 42 nt, Mus musculus
gauaauaacuaccgcaacauuuaauuugcauauccccgcccc

SEQ ID NO: 100099 - RNA, 42 nt, Mus musculus
gcggcagcagcagcgguggcgacaugagcagcggggcggcgu

SEQ ID NO: 100100 - RNA, 41 nt, Mus musculus
aaaccucauccucuccauuccuugcaccccuuuuagccuca

SEQ ID NO: 100101 - RNA, 45 nt, Mus musculus
cuucagccucagcagccaaguucagaaaauccagcccagccccgg

SEQ ID NO: 100102 - RNA, 42 nt, Mus musculus
cccuagcaccaagggccaaaccuggagauggccagaggccug

SEQ ID NO: 100103 - RNA, 45 nt, Mus musculus
gcugguguaaugaugacaaaggcugaagaagacagaggggcuaag

SEQ ID NO: 100104 - RNA, 46 nt, Mus musculus
cuguauauaagccccaucuuucagaaaaauaaauaucacugccaac

SEQ ID NO: 100105 - RNA, 42 nt, Mus musculus
ggagcccacagccccaagcccucgcuuacgacccgaggagag

SEQ ID NO: 100106 - RNA, 45 nt, Mus musculus
cuccuccccagcuccucccuucugugcucagccaugcccccagcc

SEQ ID NO: 100107 - RNA, 45 nt, Mus musculus
gcuggcugcaguggccccgcgguugucccccauguggucaugugg

SEQ ID NO: 100108 - RNA, 41 nt, Mus musculus
ugaccacaugggggacaaccgcggggccacugcagccagcc

SEQ ID NO: 100109 - RNA, 42 nt, Mus musculus
cauguuccaguugcucaagaucucagcuuugcucagccggcc

SEQ ID NO: 100110 - RNA, 64 nt, Mus musculus
ccaucccaggaccagccccugguggaggccaaccaccugcugcaugagagcgacacggacaagg

SEQ ID NO: 100111 - RNA, 90 nt, Mus musculus
ggagccuggggaggaggaaccugccugggugcagacagagcggcagcaguuccgagaguuccgggaucugaacaaggacgggcgacugga

SEQ ID NO: 100112 - RNA, 41 nt, Mus musculus
guggcccgugugugggugugugugugcagaugggauggaga

SEQ ID NO: 100113 - RNA, 45 nt, Mus musculus
agacccuggaggaccuugacaagaacaaagauggcuacgugcagg

SEQ ID NO: 100114 - RNA, 45 nt, Mus musculus
uagccaucuuuguucuugucaagguccuccagggucuccugggga

SEQ ID NO: 100115 - RNA, 42 nt, Mus musculus
auaucucagauaccagacauggaauguacuuacuggaaagau

SEQ ID NO: 100116 - RNA, 46 nt, Mus musculus
ucaaguggaacauuguaggugacaggacagaaagcagacuggggag

SEQ ID NO: 100117 - RNA, 45 nt, Mus musculus
ggaagagcaaaugacauuugaaauggagggaagguaucagggaua

SEQ ID NO: 100118 - RNA, 42 nt, Mus musculus
caugaaaaauacccacacaaaaaaagaaaaagaaggcuggag

SEQ ID NO: 100119 - RNA, 41 nt, Mus musculus
agccaccaugugguugcuggguuuugaacucaggaccccug

SEQ ID NO: 100120 - RNA, 57 nt, Mus musculus
gacgagacguggccaaggaauuugacaaacucagcccagaggaaagccaggcccgac

SEQ ID NO: 100121 - RNA, 54 nt, Mus musculus
ccccccacgaugacgcccacgggaauuuccaguacgaccaugaggcguuccugg

SEQ ID NO: 100122 - RNA, 30 nt, Mus musculus
ucagcguagggagcuaacucaggccgggua

SEQ ID NO: 100123 - RNA, 24 nt, Mus musculus
cgacguagagagacccuugucuuu

SEQ ID NO: 100124 - RNA, 45 nt, Mus musculus
uacucagauacauaaaauaaauaaauguuaaaaaaaaaaaaaaag

SEQ ID NO: 100125 - RNA, 46 nt, Mus musculus
caaggagugaaggcauugccuuugccauaaagcccggugaccuaag

SEQ ID NO: 100126 - RNA, 46 nt, Mus musculus
aguguauccauauguauuuaauuuucccacuuucuuugugugagag

SEQ ID NO: 100127 - RNA, 50 nt, Mus musculus
gaaaauuaaauacauauggauacacuuagauauaaaucugaagaaggagg

SEQ ID NO: 100128 - RNA, 45 nt, Mus musculus
gagaggacacagccacacugugacagaacuaggugagaacccaac

SEQ ID NO: 100129 - RNA, 46 nt, Mus musculus
caccuagguccacagugagaggcugugccagccccucaugcuccac

SEQ ID NO: 100130 - RNA, 45 nt, Mus musculus
agacacacagagugaaaaauauauaaaggggaaaaaaugcaaaga

SEQ ID NO: 100131 - RNA, 46 nt, Mus musculus
ucaucuguaucuauauaauaaguucaagacuggucugggcugagag

SEQ ID NO: 100132 - RNA, 24 nt, Mus musculus
cccuggguucgggccucagcucca

SEQ ID NO: 100133 - RNA, 42 nt, Mus musculus
gugugugcgugugugcgugugugugugugugugugcgcgugc

SEQ ID NO: 100134 - RNA, 45 nt, Mus musculus
uuagcgugugugagugguggugguggagguggugugugugugugu

SEQ ID NO: 100135 - RNA, 23 nt, Mus musculus
aacugagccaacuaagugagagg

SEQ ID NO: 100136 - RNA, 45 nt, Mus musculus
cuaagggcuugcugcuacuuaaagaugccucaaauucaguuccag

SEQ ID NO: 100137 - RNA, 46 nt, Mus musculus
guguuugcccucaauggugaggaguuuaugaaauucaacccaagaa

SEQ ID NO: 100138 - RNA, 46 nt, Mus musculus
accccuguggggccuggaugugggaaaaucaggugucuugguauug

SEQ ID NO: 100139 - RNA, 46 nt, Mus musculus
aaguucacagaggaacacuccugucugucgucuuggacugggucuc

SEQ ID NO: 100140 - RNA, 41 nt, Mus musculus
acuggaggcucuaagcagaggauccaucggcugcaggcaga

SEQ ID NO: 100141 - RNA, 25 nt, Mus musculus
caaucuuugcucugucccaggacac

SEQ ID NO: 100142 - RNA, 38 nt, Mus musculus
cagcuaaugcguaagacaacgaggacgccaagggauac

SEQ ID NO: 100143 - RNA, 46 nt, Mus musculus
cgggggaggacuaaggggcgggaagauccuaucaucucgcgagauu

SEQ ID NO: 100144 - RNA, 45 nt, Mus musculus
aaaguucucagaguggcaauccuuucuguacuguaaccucugagg

SEQ ID NO: 100145 - RNA, 52 nt, Mus musculus
acaaacaaacaaacaaaaaaagaaagaaagaaaagagaaagagagaaagaaa

SEQ ID NO: 100146 - RNA, 28 nt, Mus musculus
aagaggugcauguaguuaaaagagggga

SEQ ID NO: 100147 - RNA, 41 nt, Mus musculus
gagugagagaccucgucucagaagagggagaggguggguga

SEQ ID NO: 100148 - RNA, 46 nt, Mus musculus
uuuucaucaacaucugccacucucccuccaucccucccccggccga

SEQ ID NO: 100149 - RNA, 46 nt, Mus musculus
gguuaaucugagagggaaaaacugggguauccuagguucugggggu

SEQ ID NO: 100150 - RNA, 44 nt, Mus musculus
guauuauugguacacaggucauucuccuucccaagucccaaaug

SEQ ID NO: 100151 - RNA, 45 nt, Mus musculus
cagcccgccuacuuugaagaaguguucggcuuugagaucagcaag

SEQ ID NO: 100152 - RNA, 45 nt, Mus musculus
ggggcccucacgagucuaguuggaaccagacuuaaacuaggcugg

SEQ ID NO: 100153 - RNA, 47 nt, Mus musculus
caggcugugaguggggacuuagcacguucagcugagagugggguuca

SEQ ID NO: 100154 - RNA, 42 nt, Mus musculus
ugugagagaaguuacagaaucccaggaaagggagcggggcug

SEQ ID NO: 100155 - RNA, 46 nt, Mus musculus
cagagagggaguguaguuagugugugugugugugugugugugugug

SEQ ID NO: 100156 - RNA, 45 nt, Mus musculus
aguugguguggggucaguguauacagacucaggagacucuggggg

SEQ ID NO: 100157 - RNA, 45 nt, Mus musculus
uguccgggaccucacaccuaccugaacacaccagcgaggggcagg

SEQ ID NO: 100158 - RNA, 46 nt, Mus musculus
gcgucaugaagccgagcugggaaaaaaggagauacuucaggguugg

SEQ ID NO: 100159 - RNA, 45 nt, Mus musculus
agaugcugaaagcgaacgagucugaggagcccuuugugcccugcu

SEQ ID NO: 100160 - RNA, 25 nt, Mus musculus
gcaguuuggcaaguguggggaugag

SEQ ID NO: 100161 - RNA, 45 nt, Mus musculus
gggucgaaccaacaaacacucagccagcugaauaaaugcuaccaa

SEQ ID NO: 100162 - RNA, 41 nt, Mus musculus
gggggcucuaaaggagcugcgcugucuccugggccugguga

SEQ ID NO: 100163 - RNA, 46 nt, Mus musculus
aaggaaaggaaaggaaaggaaaggaaaggaaaggaaaguccaggaa

SEQ ID NO: 100164 - RNA, 45 nt, Mus musculus
ugacuggcaccccacuggcacugccaguaagcuggaugugugcug

SEQ ID NO: 100165 - RNA, 42 nt, Mus musculus
auggcuacccagccgggguuccagggccacaguggcccuuga

SEQ ID NO: 100166 - RNA, 46 nt, Mus musculus
aggcgaagauguccgcccaagagaguugccucagccucaucaagua

SEQ ID NO: 100167 - RNA, 42 nt, Mus musculus
caaagaaagacagagacugagaggcacaaaggaaaccggcag

SEQ ID NO: 100168 - RNA, 46 nt, Mus musculus
aguucuucucaccuccagcucacuggcuuccuuugcccggcuuagu

SEQ ID NO: 100169 - RNA, 45 nt, Mus musculus
auggguggcacagagguuggcagcacaugugacaugccccuaaga

SEQ ID NO: 100170 - RNA, 41 nt, Mus musculus
cugagcauggacaccaagcucacagauaucaggaucaugag

SEQ ID NO: 100171 - RNA, 46 nt, Mus musculus
uccacugagcaccggcaccagacccaaggccacaggaaggaagaag

SEQ ID NO: 100172 - RNA, 42 nt, Mus musculus
aggaggaggaggaggaggaggaggaggagaaagaggggggcc

SEQ ID NO: 100173 - RNA, 46 nt, Mus musculus
uucuccucugggccaucagggccuucagggccaagcucuccaggag

SEQ ID NO: 100174 - RNA, 47 nt, Mus musculus
cucauccuugucucgacuccgggagcgccuccuccggucccgagagc

SEQ ID NO: 100175 - RNA, 41 nt, Mus musculus
cggucccggucccggucucuguguggaagcggggaggggcc

SEQ ID NO: 100176 - RNA, 41 nt, Mus musculus
cuuaccucucaucauaucgggaagugucaucucggcccgaa

SEQ ID NO: 100177 - RNA, 24 nt, Mus musculus
aaacagugggccucaaggccucaa

SEQ ID NO: 100178 - RNA, 42 nt, Mus musculus
uggcaggggagggaacagacgucgggggugaggccgggcagc

SEQ ID NO: 100179 - RNA, 42 nt, Mus musculus
auauacaucuacccugggcuuaagcccuaauccugggggcag

SEQ ID NO: 100180 - RNA, 47 nt, Mus musculus
augaaggaagcuuucuaccugccugccugcccaccccgagucuccug

SEQ ID NO: 100181 - RNA, 46 nt, Mus musculus
agcugguauacaauccaguucuuauaauuauaagcuauaagccuag

SEQ ID NO: 100182 - RNA, 45 nt, Mus musculus
caaugccacaguaagguugguuaugguguuuuucauguggcagcu

SEQ ID NO: 100183 - RNA, 25 nt, Mus musculus
gugagauuuggagacggaugcugcu

SEQ ID NO: 100184 - RNA, 41 nt, Mus musculus
cgcgcgcaaaccagaccucuccucacaacccgcgcggccuc

SEQ ID NO: 100185 - RNA, 46 nt, Mus musculus
ccacccggcgcuuuuccguggaucucuugagcuuucccuuguaguc

SEQ ID NO: 100186 - RNA, 42 nt, Mus musculus
cucccgcagccgcgccagcgccgccgcgcccagcccguagaa

SEQ ID NO: 100187 - RNA, 42 nt, Mus musculus
guggaggggucugggagccuggauaccaggaguuggaggaag

SEQ ID NO: 100188 - RNA, 68 nt, Mus musculus
uauggucaaggcaccccugccugcagucucgaaagucaucagcagaugggaaaccaccucacagucua

SEQ ID NO: 100189 - RNA, 46 nt, Mus musculus
gguaagggagcaggggcuccaauguccaaccuucucacccccagau

SEQ ID NO: 100190 - RNA, 35 nt, Mus musculus
uggaagugggggucaggguacugaaucuugaacug

SEQ ID NO: 100191 - RNA, 45 nt, Mus musculus
ggucuagaacugguuuguugcugccuuggaagaggcucugaggau

SEQ ID NO: 100192 - RNA, 45 nt, Mus musculus
auagcuacugugggggucugaagggccgggugggcauuccaccua

SEQ ID NO: 100193 - RNA, 42 nt, Mus musculus
uuauugaaaacuggaccucugcuguguccucagagccuacua

SEQ ID NO: 100194 - RNA, 46 nt, Mus musculus
aaggcgaaacaauggacaccuccugagcugaccugacaccccagcc

SEQ ID NO: 100195 - RNA, 43 nt, Mus musculus
gcuggaccgcuugcucauuguaucaacgucacccuacagugag

SEQ ID NO: 100196 - RNA, 82 nt, Mus musculus
agacacaggggagaucaagucagaaguccgagaacagaucaaugcaaagguggcugaguggagagaggagggcaaggcagag

SEQ ID NO: 100197 - RNA, 45 nt, Mus musculus
gcagaaacgcaaggagguggugcacaccgugucccuccaugagau

SEQ ID NO: 100198 - RNA, 41 nt, Mus musculus
ucagagacgucaucaccauugacaaggccaccggcaagauc

SEQ ID NO: 100199 - RNA, 74 nt, Mus musculus
auccaaggugggcaaacugacccucaagaccacggagauggagaccaucuacgaccuggguaccaagaugaucg

SEQ ID NO: 100200 - RNA, 45 nt, Mus musculus
aucauugaaggggaggugguagagauccagauugaccggccagcc

SEQ ID NO: 100201 - RNA, 45 nt, Mus musculus
ugaggcucuaacgcaagccuuccgccguuccauugguguccggau

SEQ ID NO: 100202 - RNA, 57 nt, Mus musculus
cacugggccccgacacaccauucacagccaucgcaggcagugagaucuuuucucugg

SEQ ID NO: 100203 - RNA, 46 nt, Mus musculus
aauggcucauucggccgggcauggggcagaggcauggaugguuuag

SEQ ID NO: 100204 - RNA, 48 nt, Mus musculus
cagcuagcugcccggcgugcagcuggcguggugcuggagaugauccga

SEQ ID NO: 100205 - RNA, 58 nt, Mus musculus
agucgccaaggagggcuugggaggacacauggaucugugggaaguguugggaggagag

SEQ ID NO: 100206 - RNA, 52 nt, Mus musculus
caauggauacagaggagaaugcaugugucuaaaggaagagagcagaggagaa

SEQ ID NO: 100207 - RNA, 47 nt, Mus musculus
gagggagcuggagaggacucuuguaucugagggaggagugauaagga

SEQ ID NO: 100208 - RNA, 77 nt, Mus musculus
acgcccccuacaggaauuuuauauaucuuaugggccauagagaugacuggaugaccgggagccuagagaggauaaag

SEQ ID NO: 100209 - RNA, 76 nt, Mus musculus
caaucggacuuagcaguugcagggcgggggggaaggaggggggaggaggcuagguaagaggaggaggagcaagaga

SEQ ID NO: 100210 - RNA, 48 nt, Mus musculus
ugucaaucucagcuguaggcccaauuuggugaggaagguuggacagag

SEQ ID NO: 100211 - RNA, 42 nt, Mus musculus
uaacucuuuucccgucugaaacggaguuucggggccccaucc

SEQ ID NO: 100212 - RNA, 42 nt, Mus musculus
gccuuucugacacccgguacccacuggccuacuucaccagau

SEQ ID NO: 100213 - RNA, 46 nt, Mus musculus
ucucuuaaaaauucuagaauggguuugggguggggaaagcccagau

SEQ ID NO: 100214 - RNA, 46 nt, Mus musculus
cuguguuuccacacggcccaaaaggaaccagcagcaauccccauca

SEQ ID NO: 100215 - RNA, 62 nt, Mus musculus
gaccaacgccagccaaccauucguggaagugggcaaccacauacggcuucucuucguucugg

SEQ ID NO: 100216 - RNA, 45 nt, Mus musculus
cuccagguuguuguagaaguccacagcgccagcacacagguagcg

SEQ ID NO: 100217 - RNA, 44 nt, Mus musculus
gaucugccucucuccugcuuccuugucuacauugaacuggguag

SEQ ID NO: 100218 - RNA, 42 nt, Mus musculus
ugguuuucucuuaaggagguguugagccucgauugcggugau

SEQ ID NO: 100219 - RNA, 44 nt, Mus musculus
uagugagacccuggcucagagagagagagagagagagagagaga

SEQ ID NO: 100220 - RNA, 42 nt, Mus musculus
aggaggaauaauauucugagaggaacacccuggcacacaagu

SEQ ID NO: 100221 - RNA, 42 nt, Mus musculus
aagaaacccuaguuuucaccaagacuggaaaugcccccagac

SEQ ID NO: 100222 - RNA, 47 nt, Mus musculus
ugugugagugugugugugugugugugugugugugugucuguguguga

SEQ ID NO: 100223 - RNA, 45 nt, Mus musculus
uuguuuguuuguuuguuuguuuugugcauugguguuuugacagug

SEQ ID NO: 100224 - RNA, 24 nt, Mus musculus
aaaugaaugggugccauuuaaguc

SEQ ID NO: 100225 - RNA, 46 nt, Mus musculus
gcaugucccagcaucgcagucguggguugaaauggaggaccgugag

SEQ ID NO: 100226 - RNA, 43 nt, Mus musculus
gcccucccccucccaaaugcaaaccaaaggcacugggccagac

SEQ ID NO: 100227 - RNA, 45 nt, Mus musculus
cugcuuuuggaguaucaauaaaagacuggggcaagagaaagguga

SEQ ID NO: 100228 - RNA, 27 nt, Mus musculus
ggugugugugaggugaguguggaguga

SEQ ID NO: 100229 - RNA, 45 nt, Mus musculus
uauauauauauguguguguguguguguguguauauaugugugugu

SEQ ID NO: 100230 - RNA, 46 nt, Mus musculus
gcccuaggauaccagggaggugagcagguggcgugcgugcaggcag

SEQ ID NO: 100231 - RNA, 65 nt, Mus musculus
uggcuucaggccacacugcuguguccugcucugugccccaguuccauccaaauauagcccggcac

SEQ ID NO: 100232 - RNA, 66 nt, Mus musculus
uuaggguaggcugaugggguggugguaaaggccaggagucccaggcagagcugauagcuacuugaa

SEQ ID NO: 100233 - RNA, 48 nt, Mus musculus
cuaucagcucugccugggacuccuggccuuuaccaccaccccaucagc

SEQ ID NO: 100234 - RNA, 46 nt, Mus musculus
ccugugauccagugacacuagguacaggaagcagagaggcugagcc

SEQ ID NO: 100235 - RNA, 42 nt, Mus musculus
agcaggugaccagaaagaugugccugcuucugagaagaaggu

SEQ ID NO: 100236 - RNA, 45 nt, Mus musculus
ccuucuucucagaagcaggcacaucuuucuggucaccugcuggag

SEQ ID NO: 100237 - RNA, 71 nt, Mus musculus
ccagggcccagcgccucagccaggagacagaggcccuggggcgcucccaggaccgccuggaggcacagaag

SEQ ID NO: 100238 - RNA, 89 nt, Mus musculus
gcagacaguggaaauguccccagccuacacagaggaggagcugaagcguuuugaagaggagcuggcugcccgggaagcugagcugaaug

SEQ ID NO: 100239 - RNA, 46 nt, Mus musculus
uccacccagaggaaggaguucggggacacuggggagggguggaagg

SEQ ID NO: 100240 - RNA, 60 nt, Mus musculus
ccuuccucuggguggaugccaggaacuccuccagggucacaagccgguccugguuggugu

SEQ ID NO: 100241 - RNA, 56 nt, Mus musculus
ccgcaugcgaagccguucuuccuccaucucucucaugucauccuccucauucuucg

SEQ ID NO: 100242 - RNA, 46 nt, Mus musculus
agaagguguaugacccgaagaaugaggaggaugacaugagagagau

SEQ ID NO: 100243 - RNA, 46 nt, Mus musculus
accuccuugguaaagagagcuuccaguucuugcucaucuaggacac

SEQ ID NO: 100244 - RNA, 45 nt, Mus musculus
caugcaguaugaagaaggucuugggguugaaccuguuggggucca

SEQ ID NO: 100245 - RNA, 86 nt, Mus musculus
ggagacgauaccuggagucucugggagaggagcagcggaaggaggccgagaggaagcuccaagagcaacagcgcagacaccgggaa

SEQ ID NO: 100246 - RNA, 46 nt, Mus musculus
cccaguaugacgcugcacaccaugaagaguucaaacgcuacgagau

SEQ ID NO: 100247 - RNA, 48 nt, Mus musculus
uugaacucuucauggugugcagcgucauacugggcgaggucucgggug

SEQ ID NO: 100248 - RNA, 48 nt, Mus musculus
caugaaccuccugaagcaguuugagcaccuggacccucagaaccagca

SEQ ID NO: 100249 - RNA, 45 nt, Mus musculus
cagagaaacccugucucaaaaaacaaaaaagaaagaaagaaagaa

SEQ ID NO: 100250 - RNA, 45 nt, Mus musculus
agugcugugagcaguggaggccagggucagcucugaugguggaac

SEQ ID NO: 100251 - RNA, 46 nt, Mus musculus
uuucauucaguucuggagcccagcuuaugggauagugccgccagca

SEQ ID NO: 100252 - RNA, 46 nt, Mus musculus
acuuccgggagaagcugcaggcugccaacgcugaggacauuaaggu

SEQ ID NO: 100253 - RNA, 53 nt, Mus musculus
aaaguuauuuguguguguguguauguauuuauggugugugugugugugugugu

SEQ ID NO: 100254 - RNA, 45 nt, Mus musculus
ccucuccauucaucuccaggccugaggaucuccacugcuuuaguu

SEQ ID NO: 100255 - RNA, 41 nt, Mus musculus
agcagacaaguuguaaguuuuugcagguuccaggagggaga

SEQ ID NO: 100256 - RNA, 42 nt, Mus musculus
gaucugucuugauuuccacaucucaaaggucacugcccccag

SEQ ID NO: 100257 - RNA, 71 nt, Mus musculus
ugcgcgguccacgggcacugccagcacagcagacagcaucaguagaggugguaggagaagaaaaggggccc

SEQ ID NO: 100258 - RNA, 46 nt, Mus musculus
cuggcggagguugcuggccuuaaaaaacgcccucagcacuggagag

SEQ ID NO: 100259 - RNA, 41 nt, Mus musculus
cguccguuuucaaguaaaacucaaagcccugcaugcccagg

SEQ ID NO: 100260 - RNA, 46 nt, Mus musculus
gagcagucagugcucuuaaccauugagccaucucuccagcccccuc

SEQ ID NO: 100261 - RNA, 63 nt, Mus musculus
gugaacucugacggagaucauggagaccuggcacccugcaagguggaagaaaacacagcccag

SEQ ID NO: 100262 - RNA, 46 nt, Mus musculus
caauaccccuuggucagauaccgacucauagagacuacagggcaug

SEQ ID NO: 100263 - RNA, 46 nt, Mus musculus
ggccucacuccagaggggacagaucagagaaacaaaccccaaaucg

SEQ ID NO: 100264 - RNA, 45 nt, Mus musculus
gccucggaaaaugacugugauccuuccaggaauggacagccggaa

SEQ ID NO: 100265 - RNA, 45 nt, Mus musculus
uggcucacaaccaucuguaaugagaucugacacccucuacuggug

SEQ ID NO: 100266 - RNA, 41 nt, Mus musculus
gagaggguguggucacaucuugggucaagggaguggccuca

SEQ ID NO: 100267 - RNA, 41 nt, Mus musculus
ugcaaacugcucccagggaccucgacgggcagcuugggcug

SEQ ID NO: 100268 - RNA, 46 nt, Mus musculus
auacacccaggccuucaggaaggcacuuguaugggggguggcaccg

SEQ ID NO: 100269 - RNA, 46 nt, Mus musculus; identical to SEQ ID NO: 100268

SEQ ID NO: 100270 - RNA, 46 nt, Mus musculus; identical to SEQ ID NO: 100268

SEQ ID NO: 100271 - RNA, 41 nt, Mus musculus
caaaucuaagguccucucuauagaagacagaugggcgccag

SEQ ID NO: 100272 - RNA, 32 nt, Mus musculus
acgggguucauagccuggaaucccaagcccac

SEQ ID NO: 100273 - RNA, 42 nt, Mus musculus
cggugcugcgguucagaccacgagaggaagaggcgcuguugg

SEQ ID NO: 100274 - RNA, 45 nt, Mus musculus
ggggcucugugggaaagauauugggaccagaagggggaaccagaa

SEQ ID NO: 100275 - RNA, 27 nt, Mus musculus
uugggaguucuugggagauuccugaaa

SEQ ID NO: 100276 - RNA, 41 nt, Mus musculus
acuggguauaauggcucaugucuguaaucucagcacccagg

SEQ ID NO: 100277 - RNA, 45 nt, Mus musculus
uuucucuucuucucaccuacccuugcuucccauccacccugaagu

SEQ ID NO: 100278 - RNA, 44 nt, Mus musculus
cucccguucuggugacagccaggcuggaagucccaagaggaggg

SEQ ID NO: 100279 - RNA, 42 nt, Mus musculus
cuuuaaaagggcuaugugaaaacagaacuacaacucccagua

SEQ ID NO: 100280 - RNA, 41 nt, Mus musculus
gcuggauuccaggcaggaccugcuguguggauuggggcagg

SEQ ID NO: 100281 - RNA, 41 nt, Mus musculus
uuugcaguggggcgggucuaagcagaggggaccugggcuga

SEQ ID NO: 100282 - RNA, 45 nt, Mus musculus
aagaaggggacccccagacacguugaccacaggucgggaugcagg

SEQ ID NO: 100283 - RNA, 45 nt, Mus musculus
ccuguggucaacgugucuggggguccccuucuuuauagccaccga

SEQ ID NO: 100284 - RNA, 46 nt, Mus musculus
auagaguucuugguugaaguggauuagcugcaccugggguggaaga

SEQ ID NO: 100285 - RNA, 45 nt, Mus musculus
aggauccaggugacagucucagagcacggaggagugcugagagau

SEQ ID NO: 100286 - RNA, 44 nt, Mus musculus
gagccucagugguaauggccggcccuugcagccccuggcccaca

SEQ ID NO: 100287 - RNA, 46 nt, Mus musculus
cgccugcaugguaugcuuaguguguccccuccuucuccacguccug

SEQ ID NO: 100288 - RNA, 35 nt, Mus musculus
cugcagggaaacagcaagcccaaagaaccggccag

SEQ ID NO: 100289 - RNA, 45 nt, Mus musculus
auuaggucacuuaggucuuccaguccaucagccuccaggaccaaa

SEQ ID NO: 100290 - RNA, 42 nt, Mus musculus
gggaugagggugcugggggugggagaauuacugagcugucac

SEQ ID NO: 100291 - RNA, 84 nt, Mus musculus
ccucagcccccgucccgggacccggccuggaaacggcgggcccagccgaugccccgaguggggccguuaguggcgguggguccc

SEQ ID NO: 100292 - RNA, 45 nt, Mus musculus
accguggaggugcuaaugaccuuugaaccugaucccgcugaucuc

SEQ ID NO: 100293 - RNA, 49 nt, Mus musculus
cuaggagauggauguguccuaacaagcuggagccuuuaauuaagaggga

SEQ ID NO: 100294 - RNA, 46 nt, Mus musculus
ggugaugucuagagcaguguacacuucagugagauaacccccccag

SEQ ID NO: 100295 - RNA, 45 nt, Mus musculus
gagccggagguacaagaacaaugaagcagccaagaggucgagaga

SEQ ID NO: 100296 - RNA, 47 nt, Mus musculus
cuuccuccuugucccauggccaguggucuggccagcuaggugcccga

SEQ ID NO: 100297 - RNA, 45 nt, Mus musculus
gggaugaaggcagcagugggucuggggacagaggugcauccccag

SEQ ID NO: 100298 - RNA, 42 nt, Mus musculus
ccaaggcaggcuggggaaggggcaggggcaggucagacacag

SEQ ID NO: 100299 - RNA, 46 nt, Mus musculus
gcagacuguggccugggaugggcaaggcugguucugugguagcggg

SEQ ID NO: 100300 - RNA, 53 nt, Mus musculus
accgacaaccugcucaaaccuucaaaaucagagaaaggugucacaguggggaa

SEQ ID NO: 100301 - RNA, 41 nt, Mus musculus
gaaagacacuggaugacagaggcaggaggaaaauaggcuga

SEQ ID NO: 100302 - RNA, 42 nt, Mus musculus
gcuaggcagcucccauuauaagugagggcacacuggcagcag

SEQ ID NO: 100303 - RNA, 42 nt, Mus musculus
gcuccgaucaugucucugauucuccggucccuuuaccccugg

SEQ ID NO: 100304 - RNA, 44 nt, Mus musculus
agggcugugccccgggcuuccgccuucaucccuuucccccauua

SEQ ID NO: 100305 - RNA, 41 nt, Mus musculus
aggcagggccaagggucaauccaaauccuuagagauaccag

SEQ ID NO: 100306 - RNA, 42 nt, Mus musculus
aagacggugaagccugacagggcggugcugaucaggaccccc

SEQ ID NO: 100307 - RNA, 45 nt, Mus musculus
cugucgcaggucccagacuuugagggcaccaucauccccaccgcu

SEQ ID NO: 100308 - RNA, 42 nt, Mus musculus
acggucuguggaggaucugcaguggucaccaacugaggacac

SEQ ID NO: 100309 - RNA, 46 nt, Mus musculus
guucgaggccagccuggucuacagagcuagguccaggacagccaga

SEQ ID NO: 100310 - RNA, 45 nt, Mus musculus
cucugggcccaugaacauaacauacuagugggaaagggaacaaga

SEQ ID NO: 100311 - RNA, 46 nt, Mus musculus
gcucaccucaaguucaauaaauagagcacuuuaugaucagguagau

SEQ ID NO: 100312 - RNA, 42 nt, Mus musculus
ccuagauccaaaugucucucaguaccuccuccagccccucag

SEQ ID NO: 100313 - RNA, 47 nt, Mus musculus
cgucacccucagagggcagugaugacgaugaggaagaugaagaugaa

SEQ ID NO: 100314 - RNA, 46 nt, Mus musculus
uggagucugaggauugugacccugcagacugccggccuuuggagga

SEQ ID NO: 100315 - RNA, 49 nt, Mus musculus
ucagccuccauggguucuccgguuucacacgugcgacuccggcccuugc

SEQ ID NO: 100316 - RNA, 46 nt, Mus musculus
cacucgcucuggucagcggcacugucuacauccaccugcggaaacg

SEQ ID NO: 100317 - RNA, 46 nt, Mus musculus
caucuaugccauccacaccgaggagauccuggccaagcacccgagu

SEQ ID NO: 100318 - RNA, 41 nt, Mus musculus
ucucgaaaaaccaaaaacaaaacaaaaaaaaaaaaguggga

SEQ ID NO: 100319 - RNA, 50 nt, Mus musculus
aggggaggagggcuggagaauggcuuucuaaaucagagaggagggccagg

SEQ ID NO: 100320 - RNA, 41 nt, Mus musculus
cccugggccgugugggucuccauaugaaccaucaggagcag

SEQ ID NO: 100321 - RNA, 45 nt, Mus musculus
acaaaggcugagagaucaguucuucaauuaccagucuccucugga

SEQ ID NO: 100322 - RNA, 42 nt, Mus musculus
agaaaaccaccagaggagagagagaaagggagggagggagaa

SEQ ID NO: 100323 - RNA, 42 nt, Mus musculus
gcccuaacuucaucaguccuaguucaucacccacagccccua

SEQ ID NO: 100324 - RNA, 46 nt, Mus musculus
uuuccuucaucuguaaaagagggauagcaucgcggcuagcuuagau

SEQ ID NO: 100325 - RNA, 44 nt, Mus musculus
aauauuccuugagaguugaaaaaguucgguacuuggggugccua

SEQ ID NO: 100326 - RNA, 41 nt, Mus musculus
uggagguuaggagagcggggaaggggaggagcauagguagg

SEQ ID NO: 100327 - RNA, 87 nt, Mus musculus
gucucggccacuccacuaacaggaaauaacagcaaaccaccagaaaucaccuaacugucccaaagagggacaacucugccaacaguc

SEQ ID NO: 100328 - RNA, 45 nt, Mus musculus
cccaaggagauccuugaugacacugcugucacacuuagccuuguc

SEQ ID NO: 100329 - RNA, 46 nt, Mus musculus
uagucaauggagggcaauccaguuaggagacagagacauaggaugg

SEQ ID NO: 100330 - RNA, 41 nt, Mus musculus
ccauaggcugauaaccaaaccuucaacauacaagccugaga

SEQ ID NO: 100331 - RNA, 45 nt, Mus musculus
ggcucugguccagccuacagugcugggaguguuacagcucuuaga

SEQ ID NO: 100332 - RNA, 99 nt, Mus musculus
ggaagaggagaagggcgagccagggcgcgcgcaagaggccauaaccaaaagcaaccugggaaagaaagguuuuaucugucuuacaacaauuagaucccg

SEQ ID NO: 100333 - RNA, 45 nt, Mus musculus
aagguucaugaguuuuucucccauugacucuuuguggguaggucu

SEQ ID NO: 100334 - RNA, 49 nt, Mus musculus
agugaaggaaagggagagggaaaggaagggaaaggaaaggaaaggaaag

SEQ ID NO: 100335 - RNA, 48 nt, Mus musculus
aaauugaucccuggguuaaagggggauauguuuuuuaagaaaaaggaa

SEQ ID NO: 100336 - RNA, 46 nt, Mus musculus
gcgagccagggcacgugcaagaagugaugccgaaacccgggaaaag

SEQ ID NO: 100337 - RNA, 42 nt, Mus musculus
ucgugguaggcugcggggguuucgugaagucggacguggaga

SEQ ID NO: 100338 - RNA, 78 nt, Mus musculus
cuaccuuccccaccucuccuuuuuaaaguugccagccaccuugcauaguugcuggaauuacacuagagauuuguggag

SEQ ID NO: 100339 - RNA, 42 nt, Mus musculus
ugugaagugguuaucaacccggugggauucugacccagaaag

SEQ ID NO: 100340 - RNA, 45 nt, Mus musculus
uuucccaggagggcugguagugcugccagagaaaggagggagaug

SEQ ID NO: 100341 - RNA, 23 nt, Mus musculus
ugggcaucucagaagcugcccug

SEQ ID NO: 100342 - RNA, 46 nt, Mus musculus
acaaccaggacuugugugugugugugugugugugugugugugugug

SEQ ID NO: 100343 - RNA, 46 nt, Mus musculus
gaaucuccugaagaguugaaugcacuggccuuggugccugguacag

SEQ ID NO: 100344 - RNA, 45 nt, Mus musculus
acaugaagucacaguuucuccugaugccuuggaagaacaggggug

SEQ ID NO: 100345 - RNA, 48 nt, Mus musculus
uugugugacuguuaagggcggaugggguugugggucagcacacccuga

SEQ ID NO: 100346 - RNA, 46 nt, Mus musculus
uuguaucugaacuuuuaaucagaaguggcugagauguuagcagcag

SEQ ID NO: 100347 - RNA, 45 nt, Mus musculus
uguaauucuaguacuuugaaugcugaagcaggaggauugcuguga

SEQ ID NO: 100348 - RNA, 55 nt, Mus musculus
ugguccccucauaguggcuggcuauaauguguccggcucuguccgcagugacggg

SEQ ID NO: 100349 - RNA, 52 nt, Mus musculus
gagcccaugaaaggggugaaguuucuucucuuuucuucuuuagugaacaaag

SEQ ID NO: 100350 - RNA, 47 nt, Mus musculus
uccugggcugcaauguguccccaguguccggguuccagcccccagau

SEQ ID NO: 100351 - RNA, 47 nt, Mus musculus
uuagaucauaguuucaguuccugacugauggaggugaggcacgaggg

SEQ ID NO: 100352 - RNA, 44 nt, Mus musculus
cuagcaaggauagauugagugucccuaaaacuaaaaacccccag

SEQ ID NO: 100353 - RNA, 53 nt, Mus musculus
gaucaccuucgacguggcgcccucccggcuugacuucacgguggagcacgaca

SEQ ID NO: 100354 - RNA, 41 nt, Mus musculus
cuuugaaaggaaagggcaggccaguggucuuaggugauauu

SEQ ID NO: 100355 - RNA, 88 nt, Mus musculus
uuccacgucaugggcuucucugucaccgggagagucuugaauggaccugacggagaaggcgucccagaggcuguggucacccugaaca

SEQ ID NO: 100356 - RNA, 48 nt, Mus musculus
gaaggcugacggcuccuuccgccuggagaacauaacgacagggacaua

SEQ ID NO: 100357 - RNA, 46 nt, Mus musculus
ggagcaccucuacuucgagauggucaccaucaaaauugcccccaac

SEQ ID NO: 100358 - RNA, 45 nt, Mus musculus
acaggcuggugugugugugugugugugugugugugugugugauaa

SEQ ID NO: 100359 - RNA, 46 nt, Mus musculus
caagacaaggacaaggcuuugcucacuguggacagcgaugcccaug

SEQ ID NO: 100360 - RNA, 42 nt, Mus musculus
ggucucuggucuccauacacucacaugcccaccggcccccaa

SEQ ID NO: 100361 - RNA, 46 nt, Mus musculus
ggcugauguugaagccgcagguauucccccucacugugaccaacag

SEQ ID NO: 100362 - RNA, 45 nt, Mus musculus
agucaacuccaugacuuucaccuuugacaaaguucugccugggag

SEQ ID NO: 100363 - RNA, 48 nt, Mus musculus
aagcaucaugcaugaggacuggugcuggaggaacaagagucuggaagu

SEQ ID NO: 100364 - RNA, 75 nt, Mus musculus
cacacacacacagagagagagagagagaaugagagagagagagagagagagagggagagagagagagagagagag

SEQ ID NO: 100365 - RNA, 26 nt, Mus musculus
gccuaugugugucuguauuaccugug

SEQ ID NO: 100366 - RNA, 80 nt, Mus musculus
aagucugcacaggagcugcggagggaacagcagcuggcagagaucgagacucgcaggcaggagagggagaagaauggcaa

SEQ ID NO: 100367 - RNA, 49 nt, Mus musculus
ggcccggccuccugggcaggagaugguggaugaguuacagggccccuuc

SEQ ID NO: 100368 - RNA, 79 nt, Mus musculus
ggucuggagagaaaaucacuguuacacccucguccaaagagcuccucuuuuaucccccauccauggaagccacugucag

SEQ ID NO: 100369 - RNA, 69 nt, Mus musculus
aaguuaauugagauccaugggaaggcgggcuuguuccuggaaggccagauucacccagagcuggaggga

SEQ ID NO: 100370 - RNA, 73 nt, Mus musculus
gucgagauugucaucagcgagaagggagcaaguucacccuugaucacugucuucaccgaugacaaaggugccu

SEQ ID NO: 100371 - RNA, 63 nt, Mus musculus
agggcuacgugcugacugccguggaaggaaccgugggagacuucaaggcuuaugccuuggccg

SEQ ID NO: 100372 - RNA, 46 nt, Mus musculus
cacugagaacacagccauucguggaagcgauucaauggcuaggaag

SEQ ID NO: 100373 - RNA, 45 nt, Mus musculus
aucccucagugguggcguguuucguuccaaccuccugacccaaga

SEQ ID NO: 100374 - RNA, 57 nt, Mus musculus
uggcagagcccuggacaguacuacuuuaaacccaugaugaaggaguuccgcuuugag

SEQ ID NO: 100375 - RNA, 74 nt, Mus musculus
ccauccucacagaugauagaagugcaggaggggcagaaccugaggaucaccaucacuggcuuucgaacugccua

SEQ ID NO: 100376 - RNA, 45 nt, Mus musculus
auguuuuuaagaggaggaaacaucauaaugagcagaacuugcaga

SEQ ID NO: 100377 - RNA, 45 nt, Mus musculus
cccagcugcuacggcacugugucgucuuuaaauggagagccagag

SEQ ID NO: 100378 - RNA, 64 nt, Mus musculus
cagggugucgcgguggaggcuguggggcagaaagacugcagcaucuauggagaagacacgguga

SEQ ID NO: 100379 - RNA, 44 nt, Mus musculus
ggcaaugaccacaucgagcgggcgcugccccaccaccgggugau

SEQ ID NO: 100380 - RNA, 50 nt, Mus musculus
aacaaugacguggaugacguaaacaucauaguuuuccggcagaucaacca

SEQ ID NO: 100381 - RNA, 46 nt, Mus musculus
ccagucgcucuucuuccacuucccaccgcugcuccgagauggcgag

SEQ ID NO: 100382 - RNA, 66 nt, Mus musculus
agaacuauguggugcugcuggacaccacgcuccccagaucccaguacgacuacguccugccgcaag

SEQ ID NO: 100383 - RNA, 32 nt, Mus musculus
uauggaggcacccugugucucagucuguucag

SEQ ID NO: 100384 - RNA, 87 nt, Mus musculus
ucagagcccuuggccaggcggccucugacagcagcggcccagaagacaugaagagacaaaccaagaaacagaagaccagacgcacgu

SEQ ID NO: 100385 - RNA, 101 nt, Mus musculus
uugguguccugccugucuguccucuccuguguagcccuguggugcaaugcgacgaauggacccuccugucacccugcugaacacaauuuauuuucugaguu

SEQ ID NO: 100386 - RNA, 45 nt, Mus musculus
gaggcccgugccagaagcugcagcaacaucugucccucccagaag

SEQ ID NO: 100387 - RNA, 46 nt, Mus musculus
ugcugugcuaacaggacuugcauagggacagagcugaugaguugug

SEQ ID NO: 100388 - RNA, 41 nt, Mus musculus
uccuguagggucgaguccugccuuggugcuaagggugcuuu

SEQ ID NO: 100389 - RNA, 46 nt, Mus musculus
accuucccuuggcugguccuacucccaauuguguagaccuucagac

SEQ ID NO: 100390 - RNA, 46 nt, Mus musculus
ucccagcauccacauggcagcucacaaccaucuguaacuccaguuc

SEQ ID NO: 100391 - RNA, 44 nt, Mus musculus
ugguggugugguguaguggugauggugaugauggcgguggugaa

SEQ ID NO: 100392 - RNA, 46 nt, Mus musculus
gugguuaugguggcgaugaugguaguggugaugguggugguagcga

SEQ ID NO: 100393 - RNA, 44 nt, Mus musculus
uaauacuuaauggaauuaguguaauucugauaugaagccccaau

SEQ ID NO: 100394 - RNA, 46 nt, Mus musculus
caaccuuuuuccugaaaugacuuaaaaaucuaaaaagggggcugga

SEQ ID NO: 100395 - RNA, 46 nt, Mus musculus
accgaccagguacuagacuucccagagaucaaaaugaagaagagug

SEQ ID NO: 100396 - RNA, 46 nt, Mus musculus
uguguguguguguguguugguguguguguguguugguguguguggg

SEQ ID NO: 100397 - RNA, 44 nt, Mus musculus
gugcugucugaguggcagacucagaacuucucaggaaggcccuc

SEQ ID NO: 100398 - RNA, 45 nt, Mus musculus
cucuggaggcauagacaguaggcgaggccacaggcaggaacagug

SEQ ID NO: 100399 - RNA, 41 nt, Mus musculus
ugugugugugugugugugugugugugaguauguguguguuu

SEQ ID NO: 100400 - RNA, 46 nt, Mus musculus
aaugauauagauuaugaaaucuccucucaaacucauugcagcagau

SEQ ID NO: 100401 - RNA, 47 nt, Mus musculus
aaucugaagaggcuucuccuguuuuauauauuaugugaagaauuuag

SEQ ID NO: 100402 - RNA, 46 nt, Mus musculus
agauuacagaaaugaagaacuguugccuaauuggaaagugccagca

SEQ ID NO: 100403 - RNA, 46 nt, Mus musculus
uauuuuaugaccuggucagacagauaaauagaaaaacaccagugga

SEQ ID NO: 100404 - RNA, 46 nt, Mus musculus
caaugagggauuuguauaugaaaaauggccaaggguuugcacuagu

SEQ ID NO: 100405 - RNA, 45 nt, Mus musculus
caugcccugaauaaacuauaccgucauguggcuggucccucagug

SEQ ID NO: 100406 - RNA, 45 nt, Mus musculus
gugcacgaugggggggcgacuggcgaggagaagcagcguggcccg

SEQ ID NO: 100407 - RNA, 45 nt, Mus musculus
gcaaaggaaaaugcaaaccgcacggcugcuccgaagcacccgccc

SEQ ID NO: 100408 - RNA, 45 nt, Mus musculus
ugccaacagcaccaaccccaacaacuguaaucuuguucuggggag

SEQ ID NO: 100409 - RNA, 45 nt, Mus musculus
agacaauuuuugguguuuuaaggaagaggcugccaugcuggagau

SEQ ID NO: 100410 - RNA, 42 nt, Mus musculus
cuggauuggagacgaucagcagcuugcaguguggacuguacu

SEQ ID NO: 100411 - RNA, 50 nt, Mus musculus
cgugacagcucagcgcgugaacccccagccucucucccaucagguaacgg

SEQ ID NO: 100412 - RNA, 46 nt, Mus musculus
ccgccuaagguucuucauuaugcucucagccaagucugccacagag

SEQ ID NO: 100413 - RNA, 78 nt, Mus musculus
ucacacuaaccaggucaccacuacacaaguaccacuuggcagcagggcagagcuguggggagugagauguuuccccac

SEQ ID NO: 100414 - RNA, 46 nt, Mus musculus
aagcauucuuuucuucuucuuuuucucaucaguagaacccacaaua

SEQ ID NO: 100415 - RNA, 45 nt, Mus musculus
aaaugcuauugaagacacuaucuuuuaccuuggagaagcuuugcg

SEQ ID NO: 100416 - RNA, 45 nt, Mus musculus
aaaaaaggccaccagaaacuggaagagauggucacccgcuuagau

SEQ ID NO: 100417 - RNA, 46 nt, Mus musculus
uuauacuuauuuauuugugugugugugugugugugugugugugugu

SEQ ID NO: 100418 - RNA, 46 nt, Mus musculus
cacugguugcuuuuuccagaggucccuuguuugauacccagccccc

SEQ ID NO: 100419 - RNA, 45 nt, Mus musculus
augaugagaggcugcugucuuuuauguuuuccaaugucaugagau

SEQ ID NO: 100420 - RNA, 40 nt, Mus musculus
uagauauggauauagauauagauagauaugauagaaagag

SEQ ID NO: 100421 - RNA, 42 nt, Mus musculus
cuugcccugccagcucccacucugacucuuuagccccccagc

SEQ ID NO: 100422 - RNA, 46 nt, Mus musculus
uggauuucuucacaagugauaccuaguauguaagauaucaaaagag

SEQ ID NO: 100423 - RNA, 47 nt, Mus musculus
aaggguuugccugcucauggagggucuuccuucuuaguugucaaguu

SEQ ID NO: 100424 - RNA, 46 nt, Mus musculus
caauaugccuguggcugcuggacacauacccauauaaccccccuau

SEQ ID NO: 100425 - RNA, 41 nt, Mus musculus
uguauuagaguuacauauuguagauguguuuaggggccaag

SEQ ID NO: 100426 - RNA, 42 nt, Mus musculus
ugagacaaaauuguaacuuaagaaauaacaucugcggcugga

SEQ ID NO: 100427 - RNA, 46 nt, Mus musculus
gucauuaucagcuaaauacuagguuaaaacgggcuuuccauaugau

SEQ ID NO: 100428 - RNA, 28 nt, Mus musculus
gguaugguacaccauauagcaggcauug

SEQ ID NO: 100429 - RNA, 46 nt, Mus musculus
aaggcuacacagugagauucugucaccaaaaacacaccuccauaaa

SEQ ID NO: 100430 - RNA, 59 nt, Mus musculus
uuagugaugugagagauuuugaagggccuuguaggccaguguaaggauuuuggaauuug

SEQ ID NO: 100431 - RNA, 74 nt, Mus musculus
cagaaguucaccagcaaaaggcugguagcgagacugacugagcuacaggaaguagugcuguuugacauugagcu

SEQ ID NO: 100432 - RNA, 45 nt, Mus musculus
ugggaaguugacaacagcuuuggaaaguaaagcgagaagagaugg

SEQ ID NO: 100433 - RNA, 45 nt, Mus musculus
gcacaggccuuuaauuccagcgcucuguaggcaguugacgacaga

SEQ ID NO: 100434 - RNA, 41 nt, Mus musculus
gugaaguccagugacaaggaacccagucuagucagagagag

SEQ ID NO: 100435 - RNA, 39 nt, Mus musculus
uuguguagcgagcacuuuguuuguacaaugcccacacua

SEQ ID NO: 100436 - RNA, 42 nt, Mus musculus
agucacccggagaugggagcuuauuuaauuuugccaacacac

SEQ ID NO: 100437 - RNA, 46 nt, Mus musculus
gaccugguggauacuauuauaaacaauaaaaggaaagugcauucug

SEQ ID NO: 100438 - RNA, 45 nt, Mus musculus
uauacacuguagcugucuucagacacaccagaagaggguauagga

SEQ ID NO: 100439 - RNA, 46 nt, Mus musculus
uucccagcaacuaaaugauggcucacaaccaucuguaaugggaucc

SEQ ID NO: 100440 - RNA, 42 nt, Mus musculus
cacagaguaaccaauccauuguccuucuaagauuuacaagac

SEQ ID NO: 100441 - RNA, 45 nt, Mus musculus
uuccguguuucacguaagccaggcugguaggugauauguggcagc

SEQ ID NO: 100442 - RNA, 45 nt, Mus musculus
cugcuugcuaucccuuaucacaaaaccaucacuucagcucccugu

SEQ ID NO: 100443 - RNA, 36 nt, Mus musculus
cucugugugugugugcgugagcacgagagagagaga

SEQ ID NO: 100444 - RNA, 63 nt, Mus musculus
cauuaucaccaguguuuugaaggugcagacuucaggcaaagaaguguggguuguuggcgaaca

SEQ ID NO: 100445 - RNA, 45 nt, Mus musculus
cacuguguguguaacauuuaguggaaaucaugagcuaugugacgu

SEQ ID NO: 100446 - RNA, 80 nt, Mus musculus
caucaguauaauugccuuugcugauuuaaaacaaaaacaaaagccaaaucgccgugguguguaaggaauauucaguaaga

SEQ ID NO: 100447 - RNA, 45 nt, Mus musculus
ucacaaccaucuguaaugggaucugacgcccucuucugguagaca

SEQ ID NO: 100448 - RNA, 41 nt, Mus musculus
guguaguugcugcugaguauuauugugcuugguggggagga

SEQ ID NO: 100449 - RNA, 46 nt, Mus musculus
uuuuccuuccaagcuuucuguuacguugauuuuacaugaaguagau

SEQ ID NO: 100450 - RNA, 42 nt, Mus musculus
gcugaucauuguucuuuugcuacuucaaaaggagaaaaagau

SEQ ID NO: 100451 - RNA, 42 nt, Mus musculus
cauacugucguuugcaggcuaucauuugagugugcaguguuu

SEQ ID NO: 100452 - RNA, 46 nt, Mus musculus
gauauaaagaugaaagugacuaugccuuacguuacauggagagcag

SEQ ID NO: 100453 - RNA, 45 nt, Mus musculus
ucuucaaagaauauuauuagucggucaaguaauggacagauaaau

SEQ ID NO: 100454 - RNA, 42 nt, Mus musculus
uccgagccauuccaagccuggacccacgguucucucacacaa

SEQ ID NO: 100455 - RNA, 46 nt, Mus musculus
ugccaggcgagaggaccaagguagggucuggcaguagcacccagcc

SEQ ID NO: 100456 - RNA, 44 nt, Mus musculus
ccgaugccaaacuaccuccacccguguugaaaaaggcgcccucu

SEQ ID NO: 100457 - RNA, 46 nt, Mus musculus
gaagcagcugguggagagccaccugaaccagggaacugaccaggag

SEQ ID NO: 100458 - RNA, 41 nt, Mus musculus
uuggcgguggggccuccaaagaaagacccaaaagugaaagg

SEQ ID NO: 100459 - RNA, 108 nt, Mus musculus
uucaagccuaauuggcccuuagaauugucagacuuggaaauuggaaauacgcuugaguagaaauuguaacuuugauuguuagguugggaaaguauaccauuguuucag

SEQ ID NO: 100460 - RNA, 45 nt, Mus musculus
cugguuuacuauggguacaguucuuuauuuugaucgauggguaga

SEQ ID NO: 100461 - RNA, 42 nt, Mus musculus
uauccaagaguugaaaagggugugugugugugugugugugug

SEQ ID NO: 100462 - RNA, 45 nt, Mus musculus
ccuaaauuaaugaguaaacguaguuauauuuguaugcaugcacac

SEQ ID NO: 100463 - RNA, 46 nt, Mus musculus
uauguguguauacauacacacacauacuucguauucggcggcagcg

SEQ ID NO: 100464 - RNA, 42 nt, Mus musculus
ucugagcgcccagcgcgcgggagguauugugcuucaccccag

SEQ ID NO: 100465 - RNA, 41 nt, Mus musculus
uaccugguugccaggggaucuaagugucuugucccuucaga

SEQ ID NO: 100466 - RNA, 42 nt, Mus musculus
ggaguccugaaagcuccuuccccaggcucccuaguugggaag

SEQ ID NO: 100467 - RNA, 46 nt, Mus musculus
gggugcuuaacccagcucagagcugcccccccaaccccagcacacc

SEQ ID NO: 100468 - RNA, 44 nt, Mus musculus
gcuucccugguggugguggugguggugauaugugugugugugug

SEQ ID NO: 100469 - RNA, 42 nt, Mus musculus
uaagaagaagggacugagcaggggugggaggaggagucagac

SEQ ID NO: 100470 - RNA, 46 nt, Mus musculus
auaucacucacuccaaagcccagaaauauuucagaagaggagagga

SEQ ID NO: 100471 - RNA, 45 nt, Mus musculus
gaggaaaaugugagaauaugcucuguggaagcuaugauguggcag

SEQ ID NO: 100472 - RNA, 44 nt, Mus musculus
guguccagccuggcucugcuggccagguuguucuguggcacugg

SEQ ID NO: 100473 - RNA, 46 nt, Mus musculus
caucaacugucaugugugcugcaaucuggguccugucccuguugau

SEQ ID NO: 100474 - RNA, 41 nt, Mus musculus
aaccuugagaagaaacagaguggaagcuaugaugugacaga

SEQ ID NO: 100475 - RNA, 46 nt, Mus musculus
uuugaagauguuguuggaccacugaggcauccaaagucaguaagcu

SEQ ID NO: 100476 - RNA, 42 nt, Mus musculus
aaccuugagaagaagcauuguggaauuuaugaugugacagag

SEQ ID NO: 100477 - RNA, 45 nt, Mus musculus
ugaagguucuauugaugccccaguguaagggaaucgagggcagag

SEQ ID NO: 100478 - RNA, 85 nt, Mus musculus
auguagauaugaagucuggcagacuuuaaaacaucuccugaaggacccuggaaaaguaaaugggaaaucauauuaaagacaacca

SEQ ID NO: 100479 - RNA, 82 nt, Mus musculus
gaaaucaagcuccacaaacccagcagauaauuuaccuuugucaccucugguuugccccucuuacagauuugagccccagaag

SEQ ID NO: 100480 - RNA, 45 nt, Mus musculus
uucauggguaauuccuggaauugagcacaaggccaaaaggcacag

SEQ ID NO: 100481 - RNA, 56 nt, Mus musculus
gguggcaaaggcuugaacagaaacgucauagaagauuagcacauauagauauaagc

SEQ ID NO: 100482 - RNA, 46 nt, Mus musculus
uaaauugauggauagugcucuuuuaaagucucuuucaaguucccag

SEQ ID NO: 100483 - RNA, 55 nt, Mus musculus
uuacagguuuggugucuagcagcccuuuuaauauuauagcccagcauuguuacaa

SEQ ID NO: 100484 - RNA, 63 nt, Mus musculus
acuguguucugaucauggcuuucuuuccuugucucaaucccucccagaucaauucagucuccu

SEQ ID NO: 100485 - RNA, 62 nt, Mus musculus
caccuacccaguuccaugcccuuucauucauucaugugugcucccucucccucugcaccccc

SEQ ID NO: 100486 - RNA, 46 nt, Mus musculus
aaacauauacaaaagugugcacagaaguacuguuaguagucccaag

SEQ ID NO: 100487 - RNA, 46 nt, Mus musculus
aaagagcugguagaagcaggauaugaugucagacaaccagacagag

SEQ ID NO: 100488 - RNA, 49 nt, Mus musculus
aucuuuaugauuccagaacucucuuuuguuuuuguauggguuaggcaac

SEQ ID NO: 100489 - RNA, 46 nt, Mus musculus
uagucuagaagaagcaaugaaauauuuuggguuauaacaucaggcg

SEQ ID NO: 100490 - RNA, 46 nt, Mus musculus
ucugguggugcacaccugcauucccagcacucaggaaguggagaca

SEQ ID NO: 100491 - RNA, 46 nt, Mus musculus
gugcugugauagaucaguuggguggugaccuaaauucaacuccucu

SEQ ID NO: 100492 - RNA, 41 nt, Mus musculus
acguggcuaguggcagcaugucauaaccccagcugcaggca

SEQ ID NO: 100493 - RNA, 52 nt, Mus musculus
agggcauuugccuauggucauauuauugcuccagcacggugcagaccccacu

SEQ ID NO: 100494 - RNA, 50 nt, Mus musculus
cgguccuguuucagcacaugcccaucauagcguaucucaucucaaaggga

SEQ ID NO: 100495 - RNA, 45 nt, Mus musculus
guguuguugauaaaacacaucagaacacuccucuucacugggcag

SEQ ID NO: 100496 - RNA, 45 nt, Mus musculus
aguaaaaaccagcucauuagucacaugcuaagaacagaggccaag

SEQ ID NO: 100497 - RNA, 42 nt, Mus musculus
aauugacauuaagcauaaauauuacugaaccaugugacagca

SEQ ID NO: 100498 - RNA, 46 nt, Mus musculus
gugugguugaacugacaauugauggaaaguaaauaaugugggccac

SEQ ID NO: 100499 - RNA, 42 nt, Mus musculus
cugccuucauuccuauaguguacccacauagcacucaggcag

SEQ ID NO: 100500 - RNA, 46 nt, Mus musculus
ugccagguccaggaaugggaguggguggguuggggagcagggcgag

SEQ ID NO: 100501 - RNA, 46 nt, Mus musculus
ucacaaacaguucuugacaaaaacuugcuuacaagugaaggugaau

SEQ ID NO: 100502 - RNA, 46 nt, Mus musculus
cacaacaaaauauuauauccauuuguaacagcauacacauguccag

SEQ ID NO: 100503 - RNA, 46 nt, Mus musculus
ugcgucucuuucugauaaugguauuucugaaaagaagaggguguuu

SEQ ID NO: 100504 - RNA, 45 nt, Mus musculus
augugugcaguaaguaauguauuuggauuuuaugagaaggacugg

SEQ ID NO: 100505 - RNA, 104 nt, Mus musculus
gguagcccuuuguauuuugcuuuuauuuucagcaucauggccuuucucuauuuuuucuacaagacuugggcaacugauccaggcuucacuaaggcuucggagga

SEQ ID NO: 100506 - RNA, 45 nt, Mus musculus
ggccugugcuugcggcuuuccguuugggugcuuauccuucaugag

SEQ ID NO: 100507 - RNA, 45 nt, Mus musculus
ucagaauaucgucacccuagcagagacuggcucucuggacuucag

SEQ ID NO: 100508 - RNA, 46 nt, Mus musculus
aaguauaauaagagguaacucugcaguacuuagaaagaauaccugg

SEQ ID NO: 100509 - RNA, 42 nt, Mus musculus
agaauucugucaugaaaggaggugaauuuggauggaagggaa

SEQ ID NO: 100510 - RNA, 43 nt, Mus musculus
uguccugaaggcauuuggauuguguauuauguguugugcccac

SEQ ID NO: 100511 - RNA, 49 nt, Mus musculus
uagcuuagaugucaucaucugcaauugucaagcccuuaaaauuuucugg

SEQ ID NO: 100512 - RNA, 45 nt, Mus musculus
cccaucccuaagggcgaauuuagaucuauguuauuguugcucccu

SEQ ID NO: 100513 - RNA, 46 nt, Mus musculus
auaguggccuguucucccuggguucuguauaucuucaugcuagcag

SEQ ID NO: 100514 - RNA, 45 nt, Mus musculus
cugaagaccagcguccaguuccaccuccaaggcucccucugugag

SEQ ID NO: 100515 - RNA, 42 nt, Mus musculus
auagggaacaaaccauaguaguagcucuauuuuauggacaag

SEQ ID NO: 100516 - RNA, 45 nt, Mus musculus
gaaguucaaggccaguuugggcugcauagcaaaaccugucuguac

SEQ ID NO: 100517 - RNA, 46 nt, Mus musculus
auacuuuuaucugcauuauagcaaacugagcuugcaucgccuccug

SEQ ID NO: 100518 - RNA, 42 nt, Mus musculus
accucccaugagagaaucagccucuuaaagcaaagcaggcac

SEQ ID NO: 100519 - RNA, 45 nt, Mus musculus
aaggaaucagacugguuugagauuacaguguggauuuauagcgga

SEQ ID NO: 100520 - RNA, 46 nt, Mus musculus
cauaaaugaagagguuggauaggcuccucugagcagagagguaucu

SEQ ID NO: 100521 - RNA, 55 nt, Mus musculus
gguacacaggcugcuguugcgauccugggugggcugggagagacaucugggcgug

SEQ ID NO: 100522 - RNA, 46 nt, Mus musculus
cuauagauaggcuacuuuugaaauccuaugcaaugccgcugcugag

SEQ ID NO: 100523 - RNA, 46 nt, Mus musculus
agguuggggguggggugggagugugacaagggcaagacucacccag

SEQ ID NO: 100524 - RNA, 45 nt, Mus musculus
gagcaucaagaaaugaaaagcuugcuugauagugcuuuccccuua

SEQ ID NO: 100525 - RNA, 45 nt, Mus musculus
gaaaagacccacgcucccgugggaaggguuguuuagagguggcag

SEQ ID NO: 100526 - RNA, 41 nt, Mus musculus
caggacacccggcucauucucuacuucccucaccccgcagc

SEQ ID NO: 100527 - RNA, 45 nt, Mus musculus
uuauucuguugcuauuuaagcuguuuggugcggacuguuucugua

SEQ ID NO: 100528 - RNA, 46 nt, Mus musculus
gguacugacagcaccaaggugauugcguguccgugggucuuggggg

SEQ ID NO: 100529 - RNA, 42 nt, Mus musculus
ucucucucucucucucucucucucucucucuucccucgcccu

SEQ ID NO: 100530 - RNA, 46 nt, Mus musculus
acaauucuccuucugugcggcuuaauucauuuaacaacgucuagug

SEQ ID NO: 100531 - RNA, 41 nt, Mus musculus
uuccugucuccuaacaucacuaucuccuacccagcagugua

SEQ ID NO: 100532 - RNA, 46 nt, Mus musculus
guaaucucuagauuuuucaaaguucaaaaggagcucaaauccagag

SEQ ID NO: 100533 - RNA, 24 nt, Mus musculus
ucacagugggacugggcaaggacc

SEQ ID NO: 100534 - RNA, 46 nt, Mus musculus
caucguuucuuggaugucaacagucacaaaguagaaaaaacaauag

SEQ ID NO: 100535 - RNA, 45 nt, Mus musculus
uuuaugaaaaauucaccauucauucugaucucaacaaagcugcua

SEQ ID NO: 100536 - RNA, 46 nt, Mus musculus
uuuuaucaccucaaaucagacuaucaccauuaugaaaacuuaugag

SEQ ID NO: 100537 - RNA, 45 nt, Mus musculus
cugucugaaguuugcaguuuguauuuccaacacacuuucccuuga

SEQ ID NO: 100538 - RNA, 45 nt, Mus musculus
aauagggaucaacaccuguacagcagugacccucuguacgugcca

SEQ ID NO: 100539 - RNA, 46 nt, Mus musculus
agguuacuuucaggggugaaaaagauguuuauauuucaguugauag

SEQ ID NO: 100540 - RNA, 41 nt, Mus musculus
guccgggcaucucaccugcuuaacacccuguacaaggccau

SEQ ID NO: 100541 - RNA, 50 nt, Mus musculus
agcuuccaaauguauggcuggcuuaccagcuuuaauuaccagaagagcca

SEQ ID NO: 100542 - RNA, 85 nt, Mus musculus
gguugaaggccagccuggucuguaugagaaaguauagcccauguagaaagggcuacauagugagacccuuuuuaaaaaggaaaga

SEQ ID NO: 100543 - RNA, 45 nt, Mus musculus
uauuaaguggcuaagauaguugugaacaugugaagucagaggcug

SEQ ID NO: 100544 - RNA, 45 nt, Mus musculus
gcuucuuaugguacaagccucagcuacucuccauuuuguccucau

SEQ ID NO: 100545 - RNA, 24 nt, Mus musculus
uucuucguuucaaaauguauaggc

SEQ ID NO: 100546 - RNA, 45 nt, Mus musculus
ggucucccuccuguucucucucuggguggaaacagugaggcccua

SEQ ID NO: 100547 - RNA, 46 nt, Mus musculus
aaccuuauaaagaugcaguccauugcugaaaggcaccuugagcuag

SEQ ID NO: 100548 - RNA, 42 nt, Mus musculus
ccugucuuaaaaaucaacgugugguugcacagaccuagggaa

SEQ ID NO: 100549 - RNA, 42 nt, Mus musculus
agagcaagggcgugguggcacacaccuuuaaucccagcacuc

SEQ ID NO: 100550 - RNA, 46 nt, Mus musculus
gacaaauggauuguagguauuuuucugaagauuauuaucgaguaug

SEQ ID NO: 100551 - RNA, 48 nt, Mus musculus
cguaauuuguaacauuucgugagugugagaaaagaaggaagagauaug

SEQ ID NO: 100552 - RNA, 46 nt, Mus musculus
ugugggugcugggaacucagcauagguucuccugaaaagcuccuaa

SEQ ID NO: 100553 - RNA, 43 nt, Mus musculus
uuucauuccauggcccagacagccuugaauucauggugccucu

SEQ ID NO: 100554 - RNA, 46 nt, Mus musculus
ccuugagugcugacauuacagaaauaagauacaaccuagccugaaa

SEQ ID NO: 100555 - RNA, 24 nt, Mus musculus
ccauugaaaagggauggggcugca

SEQ ID NO: 100556 - RNA, 46 nt, Mus musculus
agugcagagacagaaauaagagagacagcgucagcaaaguggaagg

SEQ ID NO: 100557 - RNA, 46 nt, Mus musculus
cucugcauggguucccaaguagucuccuuucuguuucuguccccug

SEQ ID NO: 100558 - RNA, 46 nt, Mus musculus
cucacccugugagcaauuuucagacuucaguuuauagaaccccccu

SEQ ID NO: 100559 - RNA, 46 nt, Mus musculus
aacaguaucguaucccuggaggaagagaagaaauuaguggcaccau

SEQ ID NO: 100560 - RNA, 46 nt, Mus musculus
gugaaucaccaggcaacuggaaguacagacaggugugagcagccau

SEQ ID NO: 100561 - RNA, 45 nt, Mus musculus
uugaacccgaggucacaaaacugaugaauuuuauguacuuucagg

SEQ ID NO: 100562 - RNA, 46 nt, Mus musculus
guaggcacaggagaugguacggacaagggaaaagguuuuauuucag

SEQ ID NO: 100563 - RNA, 44 nt, Mus musculus
agccccugcagagauggaguacaggcuugcaugccgcaccagga

SEQ ID NO: 100564 - RNA, 42 nt, Mus musculus
cuucaguuaagacccaagucuugaagcuccguauaccugggu

SEQ ID NO: 100565 - RNA, 42 nt, Mus musculus
cagauguggugcugcgcaucuguaauccgcuccucuagcgag

SEQ ID NO: 100566 - RNA, 46 nt, Mus musculus
uuagccucgcuugguccucaauuggugguuggugcuguccagggag

SEQ ID NO: 100567 - RNA, 42 nt, Mus musculus
ggagucccaggugggcuuugagcguuuaugucuuggccccca

SEQ ID NO: 100568 - RNA, 46 nt, Mus musculus
cgguccugguguuuuaucauagcaacagagaaguaacuaagaugag

SEQ ID NO: 100569 - RNA, 43 nt, Mus musculus
gagagagagagagaucauugcuauucagauguugagagggacc

SEQ ID NO: 100570 - RNA, 46 nt, Mus musculus
uaacagcguuaguuauuuuccuagugauuauuuauuuggugccuag

SEQ ID NO: 100571 - RNA, 42 nt, Mus musculus
gaacuggcaagauacaucaagaccagcgcacacuaugaggag

SEQ ID NO: 100572 - RNA, 46 nt, Mus musculus
cagcccgcaguacaacaucugugagcagaugauccagauccgugag

SEQ ID NO: 100573 - RNA, 46 nt, Mus musculus
ugccagguaaagaauugaaagucaggaaaaaugaagcacgucaggu

SEQ ID NO: 100574 - RNA, 41 nt, Mus musculus
augugaaggccacagugcagucauaacuuguauuuauguga

SEQ ID NO: 100575 - RNA, 45 nt, Mus musculus
uguuuuuuuuuuuuuccgagacaggguuucucuguguagccaugg

SEQ ID NO: 100576 - RNA, 45 nt, Mus musculus
cuugcaguggcaagacuguuuaccagcaaugcuucuuuggccauc

SEQ ID NO: 100577 - RNA, 45 nt, Mus musculus
uuguacauccaacagacaaguacuccaacaaggacugccccgaca

SEQ ID NO: 100578 - RNA, 46 nt, Mus musculus
ggugauugccaugaucaaaggccugcaggugcugaugggcaggaug

SEQ ID NO: 100579 - RNA, 63 nt, Mus musculus
cccaggugacccucagggaaccacugcgacaggccaucaagaagaaaaagaacguaauccaga

SEQ ID NO: 100580 - RNA, 52 nt, Mus musculus
gggagacugggcaugagcccuuuaacgacccagcucugcggggagagaagga

SEQ ID NO: 100581 - RNA, 46 nt, Mus musculus
cucucuaucccuccuguagaaagguacuagcaaagcccauggcugg

SEQ ID NO: 100582 - RNA, 41 nt, Mus musculus
uuuggccauucuuggggucugugugaggcauaucacugccc

SEQ ID NO: 100583 - RNA, 46 nt, Mus musculus
augugacuaacggcucucucccgcuucuccuucccugucugucuau

SEQ ID NO: 100584 - RNA, 45 nt, Mus musculus
ggcauggaaaggcucuugcaugugguaaacgcguuucugaggcag

SEQ ID NO: 100585 - RNA, 46 nt, Mus musculus
acauagaaaaauuucaucgagaaucauucuucuacacucacuugau

SEQ ID NO: 100586 - RNA, 42 nt, Mus musculus
gccacguccuaaccuuuguggugguggccagacauccuggag

SEQ ID NO: 100587 - RNA, 46 nt, Mus musculus
cuuccuggagcugaccaugggcaggaggauccaguuccccauugag

SEQ ID NO: 100588 - RNA, 46 nt, Mus musculus
cagguacguccucuacuccuuggaccuguacaacgacagugcccac

SEQ ID NO: 100589 - RNA, 27 nt, Mus musculus
uuguguucuucccugggaagacgauuu

SEQ ID NO: 100590 - RNA, 42 nt, Mus musculus
uccaaauugccuuugcccaaguaggugguggcuugugggcag

SEQ ID NO: 100591 - RNA, 32 nt, Mus musculus
ucugggagcuaaacuaugacuucuugcccaac

SEQ ID NO: 100592 - RNA, 46 nt, Mus musculus
auguucuuguuuuuauuugugaaguauggguuuucauaaagcgcag

SEQ ID NO: 100593 - RNA, 42 nt, Mus musculus
uaggcaguguuuuggagaugggcuccacugggcuggcugcau

SEQ ID NO: 100594 - RNA, 46 nt, Mus musculus
gacgugccacucacaucccagcuacaugggaaacugaggacugaag

SEQ ID NO: 100595 - RNA, 42 nt, Mus musculus
cuuggaaucacacacacauaauuuauaaucaaaaagccuuag

SEQ ID NO: 100596 - RNA, 42 nt, Mus musculus
cacggcuaccuaggcccucacaaccaugccccaggccaccac

SEQ ID NO: 100597 - RNA, 42 nt, Mus musculus
augcagugauggcuggugguguggcagcuucaacgggcagau

SEQ ID NO: 100598 - RNA, 45 nt, Mus musculus
aguugagaaaaugaaaaggacguuuuccccauuuugaugcggagg

SEQ ID NO: 100599 - RNA, 73 nt, Mus musculus
ucgugaaggauauucguauaacccaugguuuugggagaagcagcagauuauguuaaaauguuuuggauaggga

SEQ ID NO: 100600 - RNA, 46 nt, Mus musculus
uuauguuaggcaugaugucucacaucuguaaaccaacaauugagag

SEQ ID NO: 100601 - RNA, 45 nt, Mus musculus
cuugacugugagauacauuuuuuggaguuggggggaaggggggug

SEQ ID NO: 100602 - RNA, 46 nt, Mus musculus
aaaaauguaucucacagucaaggacacugagaaaucuuaagaucag

SEQ ID NO: 100603 - RNA, 69 nt, Mus musculus
agauacagagacauagugauacuggccugcaaucacagcuccuauggaaggcggcaggacucccauuuc

SEQ ID NO: 100604 - RNA, 46 nt, Mus musculus
uaaguuauggaauuuaauugucugugccccuccaguuuuagggcag

SEQ ID NO: 100605 - RNA, 41 nt, Mus musculus
gaacauugauagauacuguauaaagaaaguaacuugcccag

SEQ ID NO: 100606 - RNA, 44 nt, Mus musculus
uugaccugauuuuuaauuaaaugaauugcaagugaaucaguuau

SEQ ID NO: 100607 - RNA, 45 nt, Mus musculus
uuucugaaacucauuccuuguuuucauuaguugauaccacucuuc

SEQ ID NO: 100608 - RNA, 46 nt, Mus musculus
gaaucauacugcuauuuuuuuggaaaggaaaagaugaaaugcauag

SEQ ID NO: 100609 - RNA, 46 nt, Mus musculus
uuuauuaguauuucucccuuaagauuucuauuuacuaugccccuuu

SEQ ID NO: 100610 - RNA, 30 nt, Mus musculus
auguguuguauaauguguauuuggacauaa

SEQ ID NO: 100611 - RNA, 46 nt, Mus musculus
augccacaggauuuacuaguaugugauaaaguuuaucuuuggggag

SEQ ID NO: 100612 - RNA, 46 nt, Mus musculus
uuuuuugaaauucauauugcaugaauuauuuuaauauuacggcuag

SEQ ID NO: 100613 - RNA, 45 nt, Mus musculus
auaugaacaagaaggucaaggaaauagacuuggcuguuaggcugu

SEQ ID NO: 100614 - RNA, 44 nt, Mus musculus
ucuuuggaaacuguucaacugaacauugaaccuaauaaagagga

SEQ ID NO: 100615 - RNA, 45 nt, Mus musculus
guuuuguuuuguuuuaagcucauucaaauuuguucuauguuuaua

SEQ ID NO: 100616 - RNA, 45 nt, Mus musculus
ggauaaaaccauaacaguauuggcauuuugucaggaguauaguau

SEQ ID NO: 100617 - RNA, 46 nt, Mus musculus
cucucugucucugucucucucucucucucucucuuucauguguggg

SEQ ID NO: 100618 - RNA, 24 nt, Mus musculus
uagagaguuacaguggaguuaaaa

SEQ ID NO: 100619 - RNA, 46 nt, Mus musculus
agccuuuuauaaacuuuuuguuuaaguugaauaucugaagucagug

SEQ ID NO: 100620 - RNA, 46 nt, Mus musculus
aauuaaaaaaagaaaaagaaggaacaacuuuaaauuguaucuagag

SEQ ID NO: 100621 - RNA, 47 nt, Mus musculus
auauuugaacaguguucuaggccaagucauugccaagguucugaagc

SEQ ID NO: 100622 - RNA, 51 nt, Mus musculus
cuuuucaaaauuugacaaugaggaaugaaaaaugaaaauaggaauaacuag

SEQ ID NO: 100623 - RNA, 41 nt, Mus musculus
guauagugaaaacaagccucugacuucuaaacacaccucuc

SEQ ID NO: 100624 - RNA, 78 nt, Mus musculus
ugaaagaauguggaacuggacuacaguccagaggaugacaaguaaggugguauagaccagacaggggaaaaaaggagu

SEQ ID NO: 100625 - RNA, 45 nt, Mus musculus
augaccuagcaauuguauuauagaaauauauaguguguuauaaga

SEQ ID NO: 100626 - RNA, 49 nt, Mus musculus
gggauauaacaugcacauugacauugauguccuuuagcccaugaguuua

SEQ ID NO: 100627 - RNA, 45 nt, Mus musculus
gggacagcuucgccuauacaguaaggcaagucaaaguuacaugag

SEQ ID NO: 100628 - RNA, 46 nt, Mus musculus
ccuaaagaguuggcucaguguccugcuuuccaacuauguggacuag

SEQ ID NO: 100629 - RNA, 45 nt, Mus musculus
ugguugaaauguguucauucagucuagauaauucagcaaguguca

SEQ ID NO: 100630 - RNA, 46 nt, Mus musculus
uuuaugagagcugaacauuuuuaucagggugacuucugguuauaag

SEQ ID NO: 100631 - RNA, 46 nt, Mus musculus
gucaaguucuggagaguaaccaaaaacuauggaaauaaauagccag

SEQ ID NO: 100632 - RNA, 42 nt, Mus musculus
gaauaggaucaucucuguuacuugccauauguuacggagcaa

SEQ ID NO: 100633 - RNA, 46 nt, Mus musculus
agcucacagagaucaccuguucaguaauguguuauuuaguucccau

SEQ ID NO: 100634 - RNA, 45 nt, Mus musculus
aguauucauauauuaugacuuuuucagugucuugauagguaguug

SEQ ID NO: 100635 - RNA, 45 nt, Mus musculus
ucuguguuuuauuuauuuauuuuuuaacuauaauauguugggaag

SEQ ID NO: 100636 - RNA, 45 nt, Mus musculus
aggcuucuucucauggagugggccuuaagucaaaucagacauugg

SEQ ID NO: 100637 - RNA, 42 nt, Mus musculus
guugugagccacccugugguugcuggaauuugaacucgggac

SEQ ID NO: 100638 - RNA, 46 nt, Mus musculus
aagcaaguuuaaaugaaaagaaguagaauacuaagaauaaugggaa

SEQ ID NO: 100639 - RNA, 46 nt, Mus musculus
uguuccuguaucuuuuaucuuuuucuuaucugauagcuaugccuag

SEQ ID NO: 100640 - RNA, 46 nt, Mus musculus
guauagaaccaaacggauuccuuagaaugacauuauuaugggccag

SEQ ID NO: 100641 - RNA, 50 nt, Mus musculus
ugagaacucaaaaggugcaucuaacaacucagagauaaaaaugaacaaga

SEQ ID NO: 100642 - RNA, 46 nt, Mus musculus
auuucugauugcagugauuuauaugcacacaugagagggguggggg

SEQ ID NO: 100643 - RNA, 46 nt, Mus musculus
auuuauucauuacugauauuuucuguguuuugguuacaguuuagag

SEQ ID NO: 100644 - RNA, 48 nt, Mus musculus
acagcacacaaaggaggaauugaaaucucuucaagaaaaggaugaaga

SEQ ID NO: 100645 - RNA, 52 nt, Mus musculus
cugcugcuauggaagaagacucagaagcaucuucuucaaggaugggugauag

SEQ ID NO: 100646 - RNA, 46 nt, Mus musculus
ucugucaccuaacguggaaugugauuugacauaucauaauguguau

SEQ ID NO: 100647 - RNA, 82 nt, Mus musculus
guugcugcuucaaaguguuugaaaaugguuuacuaugcaaauguagugggaggggauguggacacaaaucauaaugaggaag

SEQ ID NO: 100648 - RNA, 46 nt, Mus musculus
caaagaaucugggauuauauuaugacaauagaauucgcauguacag

SEQ ID NO: 100649 - RNA, 45 nt, Mus musculus
aacacaugacaaaugguauuguuauacacauuuuuaagaauggaa

SEQ ID NO: 100650 - RNA, 41 nt, Mus musculus
agagagagagagagagagagagagaaagaaagaaagguuau

SEQ ID NO: 100651 - RNA, 65 nt, Mus musculus
aaauccugcagacuugaagaagcaguuguauguggaauuugaaggagaacaaggaguagaugagg

SEQ ID NO: 100652 - RNA, 42 nt, Mus musculus
gucccauaugagucuauguaguaaaguuguugauagguacag

SEQ ID NO: 100653 - RNA, 42 nt, Mus musculus
uggaagaugauaugaugaucacuuuccagauaucacagacag

SEQ ID NO: 100654 - RNA, 46 nt, Mus musculus
aauaacauuuuugcugagcuggauacaguagcuaacuuaccaguac

SEQ ID NO: 100655 - RNA, 48 nt, Mus musculus
cauauggugacuaaugaaucgcccuuaaaauacuuauucagaccagaa

SEQ ID NO: 100656 - RNA, 46 nt, Mus musculus
gucauuuucaucacuuuggauuuucuaaaucucaagcauggcauag

SEQ ID NO: 100657 - RNA, 46 nt, Mus musculus
gaaaauugaagaugauuauagccaaaaauggcccagacacagaaag

SEQ ID NO: 100658 - RNA, 46 nt, Mus musculus
cauuuaacacugagcauauuuccaaugacucaugauuguccuguuu

SEQ ID NO: 100659 - RNA, 46 nt, Mus musculus
gccaaaggauuuggcaugcuguaaacaaaaagaaaaagaaaaagaa

SEQ ID NO: 100660 - RNA, 46 nt, Mus musculus
uagcccccaaagaguuuucuguacaaaauuuugagaaccaauaaag

SEQ ID NO: 100661 - RNA, 45 nt, Mus musculus
uguuuuuguuguuguuguuguuuuuguuguuuaaguuuacugggg

SEQ ID NO: 100662 - RNA, 42 nt, Mus musculus
acagcuacugugccuuguguuacuuauuuacacaguuagcag

SEQ ID NO: 100663 - RNA, 45 nt, Mus musculus
cauggaacaauacuuacgaguuaaaaaauaccuuuuaguagugua

SEQ ID NO: 100664 - RNA, 46 nt, Mus musculus
guaaugaagacuuauuuucuaaaaccugaccuuauaucguccaccu

SEQ ID NO: 100665 - RNA, 46 nt, Mus musculus
cuaagacaacuuaacauauauguacaagaauuaaacuagggcugaa

SEQ ID NO: 100666 - RNA, 29 nt, Mus musculus
aagaguggguggguugguguaaaggggga

SEQ ID NO: 100667 - RNA, 45 nt, Mus musculus
ucuuuuaugauugggcuaucucacucagaaugauauccuccagau

SEQ ID NO: 100668 - RNA, 101 nt, Mus musculus
agacgcagaaauucagaagcucaaagcugugaucacucagugggaggcaaaguauaaagaaguaaaagcaagaaauggacaauuacugaaaaugcuucagg

SEQ ID NO: 100669 - RNA, 45 nt, Mus musculus
uucaauucuuccaucuuuuagaccuacuuccugguugugcucugg

SEQ ID NO: 100670 - RNA, 47 nt, Mus musculus
auaacucucccgcuccagagcacaaccaggaaguaggucuaaaagau

SEQ ID NO: 100671 - RNA, 48 nt, Mus musculus
ugucacucaaagacuuccagugugaagaucauauuaguaaaaaggcag

SEQ ID NO: 100672 - RNA, 42 nt, Mus musculus
gcagaggagggccgcgcccaccagccccagaguccagcccgg

SEQ ID NO: 100673 - RNA, 41 nt, Mus musculus
aggcccuggaagaagcacuccaccuucggagacgugaggaa

SEQ ID NO: 100674 - RNA, 46 nt, Mus musculus
augaguaucuggaacaguuuguuggagaccaagaagccuggcauga

SEQ ID NO: 100675 - RNA, 68 nt, Mus musculus
cacagaguuaagcgguuaacaggcaugcgauuagaagcuauggaaagauaugacgaugcuauacaacu

SEQ ID NO: 100676 - RNA, 87 nt, Mus musculus
caagaagaaaacucgagaaauagugaacaaauuauggaaguuggagaagaauuaauuaaugauuaugcuucuaugcuuggggaugau

SEQ ID NO: 100677 - RNA, 45 nt, Mus musculus
uugggaggaauggggagcugaauuugaggcaugaugaccuggugg

SEQ ID NO: 100678 - RNA, 45 nt, Mus musculus
aggcgaggggguaagggaaggcagggggcgauuuaagcuuugugg

SEQ ID NO: 100679 - RNA, 45 nt, Mus musculus
cuugagguugaagcuagaaguggcccuaagccagugaccacagac

SEQ ID NO: 100680 - RNA, 46 nt, Mus musculus
gcaacagugggccuggucuucuccaguaaugggccaguacugagcu

SEQ ID NO: 100681 - RNA, 45 nt, Mus musculus
augagaggagagaguaggagggagaucaggagagaagccacagau

SEQ ID NO: 100682 - RNA, 46 nt, Mus musculus
cauacuuuuguuagguggcuuuccaucaccaugacugacagcugag

SEQ ID NO: 100683 - RNA, 45 nt, Mus musculus
acgacuacaaacgguauccauggagauuuuauuuagcagucagag

SEQ ID NO: 100684 - RNA, 75 nt, Mus musculus
ugggaugggauaaugggaugaggaggggaaaggguggaagagaaggucuagaugagcuaguggagauggggcaga

SEQ ID NO: 100685 - RNA, 65 nt, Mus musculus
gugguuaggguaacaggaugcguggggaggaaggcuggaaaagaacuaugugauccacuggagau

SEQ ID NO: 100686 - RNA, 44 nt, Mus musculus
gagagagagagagagagagagagaggaagaagaagaaggaagaa

SEQ ID NO: 100687 - RNA, 45 nt, Mus musculus
gacaggaggauuaccuugaguuuaaggucagaccaggcuacaaag

SEQ ID NO: 100688 - RNA, 45 nt, Mus musculus
uuagaaaacaguaccuuccugagguauccuaacuuugccagaagu

SEQ ID NO: 100689 - RNA, 46 nt, Mus musculus
gggggaaaguaaaaacaaccaaaacaaauucuuucauuuaaaggga

SEQ ID NO: 100690 - RNA, 45 nt, Mus musculus
ugaaggcuuccauguuguuaagcuuuuaaaaaaaacugccagagg

SEQ ID NO: 100691 - RNA, 86 nt, Mus musculus
gacuauaccuggaaugaacucugucugcuaagggaugagacgagcacacaauggccagugacugagugucuauggcaguaugugag

SEQ ID NO: 100692 - RNA, 45 nt, Mus musculus
aguugugacgacagguccuggguuuggacuaguguaucccagaua

SEQ ID NO: 100693 - RNA, 45 nt, Mus musculus
acugacacucacuggggccacuuccuccaugguuauggcuggcag

SEQ ID NO: 100694 - RNA, 45 nt, Mus musculus
aguccaugccggcuauaccagcaccugaaagguugaggcaggagg

SEQ ID NO: 100695 - RNA, 45 nt, Mus musculus
guauccucuguuuaaugauaucuucuagauggaggguggucuccu

SEQ ID NO: 100696 - RNA, 42 nt, Mus musculus
ccucgugcaagcaaugucaaaagaaaucugcuaucugccaag

SEQ ID NO: 100697 - RNA, 42 nt, Mus musculus
caggaaagcacucgcgcuacugagccagacccgcagccccgg

SEQ ID NO: 100698 - RNA, 46 nt, Mus musculus
uccuaguguucuuuguguuuguugaaugaaauuaacuuucuuggag

SEQ ID NO: 100699 - RNA, 46 nt, Mus musculus
gugccaccuuagaccaguuugaugcuauugauuuuucugacaauga

SEQ ID NO: 100700 - RNA, 42 nt, Mus musculus
cugaugagguccaggagcuguaaucuguggggauagaugcau

SEQ ID NO: 100701 - RNA, 78 nt, Mus musculus
uugucacauggucauuacugagcugacagugcccacaacuggauaagacugcugguggcgucccccagcaaccuucag

SEQ ID NO: 100702 - RNA, 37 nt, Mus musculus
gugagugagugagagagagagagagagugagagagag

SEQ ID NO: 100703 - RNA, 71 nt, Mus musculus
ugacccccaccuuacauggacugcaguaagguuagaacugucccuuuucuuacagcauccuaagaaacccu

SEQ ID NO: 100704 - RNA, 81 nt, Mus musculus
guaaccaauaagaagcauuaucgacuuuaugugauuuauaaaguuccacaagucagaguacuggacuuucagaaagugaaa

SEQ ID NO: 100705 - RNA, 73 nt, Mus musculus
cuuaguaagucaauuuuguuguuacuuugaaacuuaaccugugggaaagaaaacauuuaauuuggguuguuug

SEQ ID NO: 100706 - RNA, 45 nt, Mus musculus
cugguuugccaacugacaaaaagaaaggcgggccgucugcagggg

SEQ ID NO: 100707 - RNA, 48 nt, Mus musculus
gagaggcugaagggcuugcugcagucgggccagauaccuggcagagag

SEQ ID NO: 100708 - RNA, 41 nt, Mus musculus
aauauagguuggccaguauaauguuacaacauaugugggga

SEQ ID NO: 100709 - RNA, 46 nt, Mus musculus
gugugcuguguaucugcagugagauguaaggggauguuuaaguuag

SEQ ID NO: 100710 - RNA, 44 nt, Mus musculus
ccugggcaucuuucagccccgcccucuggucacacccccccugu

SEQ ID NO: 100711 - RNA, 50 nt, Mus musculus
guaccgccacggcagugagcgccacguguacauagggccgaaccggaagc

SEQ ID NO: 100712 - RNA, 77 nt, Mus musculus
ccuucgacugagggcuuugaggcagagacagcuggaccaagccgagacuguucuggguuagugccaugugguagaaa

SEQ ID NO: 100713 - RNA, 42 nt, Mus musculus
caaugcacaucuuguucggugcauggggaccagucccuggag

SEQ ID NO: 100714 - RNA, 92 nt, Mus musculus
guuaagcggcaagaggcuuuagcagcugcucguuugagaaugcaggaagaucuaaaugcccaaguugaaaaacauaaggaaaaacuaagaca

SEQ ID NO: 100715 - RNA, 46 nt, Mus musculus
cucacuagauucaagaugcauuucagagucagagaaaaguaugcua

SEQ ID NO: 100716 - RNA, 42 nt, Mus musculus
uguucuuuguuuguuuugaguuuggguuuguuuuguguuuug

SEQ ID NO: 100717 - RNA, 46 nt, Mus musculus
ccuggcuguccuggaacucacuuuguaguccaggcuggccucagag

SEQ ID NO: 100718 - RNA, 50 nt, Mus musculus
agaagagaaaagaagacagaagauugaaaugugggacagcaugcaagaag

SEQ ID NO: 100719 - RNA, 44 nt, Mus musculus
gcuccuggagaccuggacgcaggggcccaucaucuggcggcuga

SEQ ID NO: 100720 - RNA, 46 nt, Mus musculus
cucuguucuaaacuacuuguacuuuaagggcuuuggucagcaugag

SEQ ID NO: 100721 - RNA, 46 nt, Mus musculus
auuaaacucaaggaaauuucuuugugagcuugacuuugucagacag

SEQ ID NO: 100722 - RNA, 46 nt, Mus musculus
gaugguuggaacuuacaguguucagggguuaagugggaagcugggg

SEQ ID NO: 100723 - RNA, 41 nt, Mus musculus
gcgcgcaggaggcagacgcgcugcggaaccaggcgcuggag

SEQ ID NO: 100724 - RNA, 42 nt, Mus musculus
cugggggagagaugugugcgguggguugagcugcgacgggau

SEQ ID NO: 100725 - RNA, 46 nt, Mus musculus
uuuuccaaacuuugagcacacuggauugggugaaaggcgguuagau

SEQ ID NO: 100726 - RNA, 46 nt, Mus musculus
aacaggacggagcugggucuugcugaaggauauucuuuguccagag

SEQ ID NO: 100727 - RNA, 44 nt, Mus musculus
uugaguuggucucucccccccacccccaaauucaugagcuuuua

SEQ ID NO: 100728 - RNA, 42 nt, Mus musculus
gcuguaacagcggggauuggaugccaggcaagaaacagacaa

SEQ ID NO: 100729 - RNA, 46 nt, Mus musculus
caaaucuuuuguaauuuaaaaacgaauggacuuuuuuuuuuuuaag

SEQ ID NO: 100730 - RNA, 42 nt, Mus musculus
acugcauagugacuuggcucugaggcauggcaguggggguga

SEQ ID NO: 100731 - RNA, 45 nt, Mus musculus
guccccaagggcccagagggauguucugauuugucugugguaccu

SEQ ID NO: 100732 - RNA, 23 nt, Mus musculus
ggaggcgugacaaagcugaagug

SEQ ID NO: 100733 - RNA, 45 nt, Mus musculus
ccgagguuguacugaaguaaauaagugggagaucauuguccuuag

SEQ ID NO: 100734 - RNA, 65 nt, Mus musculus
gcucaccguucuuguacaaaccgucuggggaaaguagcagagacuuuuaauccaagguguuaggu

SEQ ID NO: 100735 - RNA, 26 nt, Mus musculus
aagugugacugaccaagucuuagguc

SEQ ID NO: 100736 - RNA, 46 nt, Mus musculus
cauguggaagcagacuuuauuaucagaccauauugagaaaugccag

SEQ ID NO: 100737 - RNA, 42 nt, Mus musculus
uuuaauucuuuggguaaaauuuguaacuucuuaugaggggau

SEQ ID NO: 100738 - RNA, 73 nt, Mus musculus
agagccuauggaggccaccacagggauagauaagcuaaacaccugccuaauaaagucuuaauucggcgaggua

SEQ ID NO: 100739 - RNA, 34 nt, Mus musculus
ucuuucacccucacggucacaagauggcccccau

SEQ ID NO: 100740 - RNA, 45 nt, Mus musculus
cagagagguucuuaaggauuggggucaucuuagcucugcuuagug

SEQ ID NO: 100741 - RNA, 45 nt, Mus musculus
uggugguggugcaacaggacuuuaaccccagcacuggggagggag

SEQ ID NO: 100742 - RNA, 81 nt, Mus musculus
ucuuugaguugaaggacagccagggcuacgcagagggcguccauuuuggguggaggggagauguuagggacauuguggagu

SEQ ID NO: 100743 - RNA, 48 nt, Mus musculus
augguuuuagagcuuuauuguagaaaggcagagagaaaaagagaaggu

SEQ ID NO: 100744 - RNA, 42 nt, Mus musculus
caauguuagugaaaugaaaucacuugaucuuaaaagcaacaa

SEQ ID NO: 100745 - RNA, 46 nt, Mus musculus
ugcuugugguaccaagugcaugcggcaggacaagacuuaguaccuc

SEQ ID NO: 100746 - RNA, 46 nt, Mus musculus
gcaucucacugaggcaggguagcuuugaagggaaagcuugcuugag

SEQ ID NO: 100747 - RNA, 84 nt, Mus musculus
aggggagcacuauaaaggcagcaggccaugaaagggaggagcugagccuguuggagguagugaacaagugugcuaagcaaagau

SEQ ID NO: 100748 - RNA, 42 nt, Mus musculus
aagucaucuuaagaaugaucucuguuuaaccauaugccccgc

SEQ ID NO: 100749 - RNA, 67 nt, Mus musculus
cagggacauuggaggagaagcccaugugugagaagaccaccaucaacaaugaguacaacuaccgcug

SEQ ID NO: 100750 - RNA, 45 nt, Mus musculus
acuaguuaugaagauugccccauaaaucccgcacagaacccccag

SEQ ID NO: 100751 - RNA, 46 nt, Mus musculus
ccacaccacucugucaugguggccaaacuaaguauggacaggaaag

SEQ ID NO: 100752 - RNA, 64 nt, Mus musculus
acugccccucacacuccugcaggcagcauccuugaccccccuuucccagucaucuuuguauuaa

SEQ ID NO: 100753 - RNA, 46 nt, Mus musculus
gacccccgaauggccuccuuauacuuugcugaguaaauguuaucag

SEQ ID NO: 100754 - RNA, 42 nt, Mus musculus
uccaguguugcuucccucacagacccgggaagggaagcgcag

SEQ ID NO: 100755 - RNA, 42 nt, Mus musculus
aucuugcugggcgcuguuacccuaagucuuggaaggccucag

SEQ ID NO: 100756 - RNA, 59 nt, Mus musculus
ggagucaccgcagcaugaggaacuguauuaaagggucccagcguuaggaagauugagaa

SEQ ID NO: 100757 - RNA, 46 nt, Mus musculus
gcuguugaaaugguauagcacaggaaagucuuccuuguugguuugu

SEQ ID NO: 100758 - RNA, 46 nt, Mus musculus
ucgugcuccuugcuacccuugcagcucagugucauugaugaagcag

SEQ ID NO: 100759 - RNA, 46 nt, Mus musculus
acuuaaggcagagauaaaguagugagaaaggucguuguuugagcga

SEQ ID NO: 100760 - RNA, 45 nt, Mus musculus
cuguacuguugauacuauuuugagagaauagagagaaugaagcag

SEQ ID NO: 100761 - RNA, 42 nt, Mus musculus
uggccugggguaaagugaagacauuuugugggcagagagaag

SEQ ID NO: 100762 - RNA, 45 nt, Mus musculus
gagcagccgaguaagccuuacugacacacugacccgacgguccag

SEQ ID NO: 100763 - RNA, 81 nt, Mus musculus
gggauagucacccaaggaaggacaggaagcagcacuuccaguauguaagugagcugggauaaguauagaaaaagauagaug

SEQ ID NO: 100764 - RNA, 46 nt, Mus musculus
ugaccaucgguguggugcuguuaacugggauugcaaaaaggcagag

SEQ ID NO: 100765 - RNA, 41 nt, Mus musculus
gugugugcaggcugagcugguguggaaacacagaccuggga

SEQ ID NO: 100766 - RNA, 41 nt, Mus musculus
ccaaggguccagaaggucccuugaggaccuagaagggccuu

SEQ ID NO: 100767 - RNA, 45 nt, Mus musculus
aaagaaagaaagaaagaaagaaagaaagaaagaaagaaagcgcgc

SEQ ID NO: 100768 - RNA, 32 nt, Mus musculus
agaaacacaggugaaaagaugaaggagccuug

SEQ ID NO: 100769 - RNA, 45 nt, Mus musculus
uuguaaaggagccacaagugaaggccauaaaguguugagucaaga

SEQ ID NO: 100770 - RNA, 46 nt, Mus musculus
uuauuaaauugaccauccaucuuguuuccccaaacaguggcaucca

SEQ ID NO: 100771 - RNA, 46 nt, Mus musculus
guuuuaaggagagcuaggucaucuccuccccccucccccacccccc

SEQ ID NO: 100772 - RNA, 42 nt, Mus musculus
uggugcugguacacaccuuugaucccagcacuugagaggcag

SEQ ID NO: 100773 - RNA, 46 nt, Mus musculus
ggcauguguaagggagaguaccaccugccuccgucccaaccugcgc

SEQ ID NO: 100774 - RNA, 46 nt, Mus musculus
aggaggccucccucuccucguuccccucugugcccucgagcccugc

SEQ ID NO: 100775 - RNA, 41 nt, Mus musculus
ccugcugaaccaccuagugcccaucagggagcugcgugcca

SEQ ID NO: 100776 - RNA, 41 nt, Mus musculus
caggccugagcgagcaagggauauggauccaagcaacugga

SEQ ID NO: 100777 - RNA, 46 nt, Mus musculus
aucucuuuaccuauuacccuccuuacuguaaaccuccuuucccaag

SEQ ID NO: 100778 - RNA, 45 nt, Mus musculus
uuauaccuuuauacagguuuaaggagaaaggacugugugugugug

SEQ ID NO: 100779 - RNA, 42 nt, Mus musculus
gguaacgacugcgcuuucuguguuucuucagacugcuggcuu

SEQ ID NO: 100780 - RNA, 45 nt, Mus musculus
gguaacagaagggccaucucguggccugcagagcacuuggcauuc

SEQ ID NO: 100781 - RNA, 45 nt, Mus musculus
uggucaguacagacuaccugugacagccagggagaggaaaggcau

SEQ ID NO: 100782 - RNA, 46 nt, Mus musculus
cugagaaacaaggucccucuaggccccucucccuuguaucggucau

SEQ ID NO: 100783 - RNA, 89 nt, Mus musculus
cguggcaggaggcgagcugcucauguauggaugauguuuagagagugucuagugucuguuuaggcagagacuucagagaagagacaaag

SEQ ID NO: 100784 - RNA, 78 nt, Mus musculus
cauaggaaagggagauguuaaaaggccugugucccgagagucauggagaaggcaaagccaauuguguggagcccugau

SEQ ID NO: 100785 - RNA, 70 nt, Mus musculus
uugggagggggcuucugggaggaggcugcagcccaccuguagggcagaaauaagucuuaggucagggugg

SEQ ID NO: 100786 - RNA, 41 nt, Mus musculus
gugaggguuugccauauaaauaagcgugggcuuugggggug

SEQ ID NO: 100787 - RNA, 46 nt, Mus musculus
aucacaaguuaaggacuccauucuguaagacagauauuagaugcug

SEQ ID NO: 100788 - RNA, 46 nt, Mus musculus
cuuccugcuguuuugggguuuuuuugaggauuuuuaaaagccggau

SEQ ID NO: 100789 - RNA, 54 nt, Mus musculus
aaacagccagucauucaaaagcaccugccuggggccaguguagagaaauaacgg

SEQ ID NO: 100790 - RNA, 42 nt, Mus musculus
ucuuuucucaaaguccuagaacuaugaggccaagaucagagu

SEQ ID NO: 100791 - RNA, 83 nt, Mus musculus
gucggagaugccucuuugccacucagaggagagcuaagagggacgggggauauagauguauggaauacaggggaugagccagg

SEQ ID NO: 100792 - RNA, 42 nt, Mus musculus
uugguugguugguugguugguugauugguugguuaguugguu

SEQ ID NO: 100793 - RNA, 42 nt, Mus musculus
uuaagaaguuaaaacuuuuaaagacuucuucauuuagaagca

SEQ ID NO: 100794 - RNA, 24 nt, Mus musculus
uguuaaaggaacuaugauggguau

SEQ ID NO: 100795 - RNA, 44 nt, Mus musculus
agagcuuuaguuauagauacucggccuacagagccaagacauga

SEQ ID NO: 100796 - RNA, 46 nt, Mus musculus
cuacagaauaaaguucaaccauaaaaguuuccugucaagagccaag

SEQ ID NO: 100797 - RNA, 46 nt, Mus musculus
auuuacccuaauguguuuuguguguguguguguuagagagagagag

SEQ ID NO: 100798 - RNA, 35 nt, Mus musculus
uaacuucuguagcuucuuuccuccuagauguucuu

SEQ ID NO: 100799 - RNA, 45 nt, Mus musculus
ucucucucucucucucucucucucucugugugucugugugugugc

SEQ ID NO: 100800 - RNA, 45 nt, Mus musculus
caauuuaacuuacugacaaaaggaaaagcaagggagauuccaaga

SEQ ID NO: 100801 - RNA, 48 nt, Mus musculus
gguuucucugguauagauagaugcauagcugcuauaguagccuagcug

SEQ ID NO: 100802 - RNA, 42 nt, Mus musculus
caguuagcuuuccaccucacccacacugccccaagcccucag

SEQ ID NO: 100803 - RNA, 46 nt, Mus musculus
aagccucccuuuuauuuucauuaaaaaaaaaaaauacacagaugag

SEQ ID NO: 100804 - RNA, 42 nt, Mus musculus
aaaggaaucggggaugugcagaguugauagcauaagagccag

SEQ ID NO: 100805 - RNA, 42 nt, Mus musculus
uccugaggcacggcuuccuuuuuguagauacuuuugcuguag

SEQ ID NO: 100806 - RNA, 46 nt, Mus musculus
cuuacccgcugagccagaccagguuugagggugguuguuguuguug

SEQ ID NO: 100807 - RNA, 47 nt, Mus musculus
ucucuggccacuggcuauagaugaccuuuuccugugacugaagauca

SEQ ID NO: 100808 - RNA, 45 nt, Mus musculus
cugugcuucuuaagccugcacuugcuccaucuaguccagcccaug

SEQ ID NO: 100809 - RNA, 42 nt, Mus musculus
cugucucacguucaagucucaaggcccacguggaggggagca

SEQ ID NO: 100810 - RNA, 46 nt, Mus musculus
uugaauggcaccaggccagcgugccagugugggcugagaaugucaa

SEQ ID NO: 100811 - RNA, 42 nt, Mus musculus
guguguguguuuguaaagcugauauuacaaaaugugcaggaa

SEQ ID NO: 100812 - RNA, 37 nt, Mus musculus
guuucagagguacagugaagucauaguaguaccuuua

SEQ ID NO: 100813 - RNA, 64 nt, Mus musculus
aggaggaggaggaggaggaggagcagcaggaggaggagcagcaggaggaggaggagcaggagga

SEQ ID NO: 100814 - RNA, 57 nt, Mus musculus
cagccuacugugcucuggggugugugugugugugugugugugugugugugugugugu

SEQ ID NO: 100815 - RNA, 28 nt, Mus musculus
uggcaucagcaauaaauagugucugggu

SEQ ID NO: 100816 - RNA, 46 nt, Mus musculus
uugcuaccuccaguuccccauccccucuguucaauuuccugacccu

SEQ ID NO: 100817 - RNA, 45 nt, Mus musculus
uggugcguuagauauaaucuagggguuccucaguauaagcgcaaa

SEQ ID NO: 100818 - RNA, 45 nt, Mus musculus
ucaguaugugaaggucauguugaaagcagacccccuaggcaguag

SEQ ID NO: 100819 - RNA, 46 nt, Mus musculus
ggacauguuugucuggucuguggguggauuuagaaauaacuguuua

SEQ ID NO: 100820 - RNA, 46 nt, Mus musculus
ugaccggaaccaagggacgccagagcaaaggggacauaaacaccag

SEQ ID NO: 100821 - RNA, 42 nt, Mus musculus
uugaguauccagauuuaucugauacucuacggauccaggagg

SEQ ID NO: 100822 - RNA, 42 nt, Mus musculus
cucacgggaccaggcaucaagugcuugucuucucugcaucag

SEQ ID NO: 100823 - RNA, 45 nt, Mus musculus
cgccgaugguaccaucgacguggaggaggugacggaaaaucccaa

SEQ ID NO: 100824 - RNA, 48 nt, Mus musculus
acaauaucacagacccggaggaguucgagacagaguacccuuucuuug

SEQ ID NO: 100825 - RNA, 45 nt, Mus musculus
cuucuggggcucucugguuuucuguuagaacagagcuggcugggu

SEQ ID NO: 100826 - RNA, 46 nt, Mus musculus
cuuaaagaucuaaguucaaguccuugacggaaaccaggggcgguag

SEQ ID NO: 100827 - RNA, 46 nt, Mus musculus
acauaacuuaggggguguugcucaaaagguacacaauuuuagguag

SEQ ID NO: 100828 - RNA, 46 nt, Mus musculus
ucuggcuccucccucucccagcuucuuccaugcccaccucucucag

SEQ ID NO: 100829 - RNA, 45 nt, Mus musculus
agugcacuuagacagcuguugguuguccccagaucaaggugccag

SEQ ID NO: 100830 - RNA, 45 nt, Mus musculus
aggcuauuccagaggcgguuuuaucauccuuccaaccauacacag

SEQ ID NO: 100831 - RNA, 66 nt, Mus musculus
cucugccgguugccauccugcugaucguuggggggcugguuaucaugcuguaugucuuccauagaa

SEQ ID NO: 100832 - RNA, 47 nt, Mus musculus
gcagguugggcaauggagugcuguaugcuucugugaaccccgaguau

SEQ ID NO: 100833 - RNA, 49 nt, Mus musculus
uacgugccugaugaaugggagguagcucgagagaagaucaccaugaacc

SEQ ID NO: 100834 - RNA, 57 nt, Mus musculus
augaaggaguggccaaggguguggucaaggaugaacccgaaaccagaguggccauca

SEQ ID NO: 100835 - RNA, 43 nt, Mus musculus
ggccagcccacccuggucaucauggaacuaaugacacgcggug

SEQ ID NO: 100836 - RNA, 50 nt, Mus musculus
agauggcauggccuaccucaaugccaacaaguucguccacagagaccuug

SEQ ID NO: 100837 - RNA, 46 nt, Mus musculus
aagguggugcgguugaguggaaaaucaaaaauggauaaagacacag

SEQ ID NO: 100838 - RNA, 42 nt, Mus musculus
acccuacaaccagcaggucagaauugcuuuggagagcccaag

SEQ ID NO: 100839 - RNA, 45 nt, Mus musculus
cggaaccuggagauccugaaacagguuccagcccucgugcugcag

SEQ ID NO: 100840 - RNA, 46 nt, Mus musculus
uccucgaccugcugauccucggacacaccgaagcacgcgccaacag

SEQ ID NO: 100841 - RNA, 46 nt, Mus musculus
aaaagggccauuguucauccguggcuaucauuuuucacgcugccau

SEQ ID NO: 100842 - RNA, 46 nt, Mus musculus
acucccgggccggaaaucccaaaguggaguagagcugacccuacag

SEQ ID NO: 100843 - RNA, 42 nt, Mus musculus
guuucgauuuagcacuucuuaccagagcagugacagcgcgag

SEQ ID NO: 100844 - RNA, 53 nt, Mus musculus
uuaggaguaggaaaacuguuggaugaugaugguugcaguugugacuggagauu

SEQ ID NO: 100845 - RNA, 86 nt, Mus musculus
guuuuaaucacuguagaaaagccccuguuauggauuuaaaugcugaggaaaggguacauguaucucuguguauguguguauuagau

SEQ ID NO: 100846 - RNA, 46 nt, Mus musculus
cucuggucuuucuccucaccugguccccuacuuuucaacccagcag

SEQ ID NO: 100847 - RNA, 44 nt, Mus musculus
gcagcuucauaaacuagaaaagcgaucacggugagacgagcaga

SEQ ID NO: 100848 - RNA, 46 nt, Mus musculus
caccccuuaagaaccagugaugauggucaaacuuuuaacaguccac

SEQ ID NO: 100849 - RNA, 46 nt, Mus musculus
gcacccuugguaaccggcaucgugacaugacgggaauugcugacag

SEQ ID NO: 100850 - RNA, 37 nt, Mus musculus
agacacuuggcauccugcucuggaaacuucuccuuag

SEQ ID NO: 100851 - RNA, 46 nt, Mus musculus
aaaaauaaaacagauaaaaauaaaaacaaaacaaaaggaaugccag

SEQ ID NO: 100852 - RNA, 46 nt, Mus musculus
gacaucuggcugguauggcugguccuagcucugcaacacuauggag

SEQ ID NO: 100853 - RNA, 46 nt, Mus musculus
aguaggugccugccuggugacaaccccugucugcuuccuaugccag

SEQ ID NO: 100854 - RNA, 45 nt, Mus musculus
ugacauagcacguaaacuacaggcuggaagcuaaaaaaaggacag

SEQ ID NO: 100855 - RNA, 46 nt, Mus musculus
acauuuacuggacauugguacaaaaaucccugaacgaaugcuccac

SEQ ID NO: 100856 - RNA, 46 nt, Mus musculus
cuggugucagaaaauuuucucaguucaugggagcaacagacuggag

SEQ ID NO: 100857 - RNA, 45 nt, Mus musculus
aucuuaagaaaucccaaaucaaaagaggacaggagcgugccuaaa

SEQ ID NO: 100858 - RNA, 47 nt, Mus musculus
gaaaagaggaacuguucaugaaaguguguguugugaagggcuguacu

SEQ ID NO: 100859 - RNA, 63 nt, Mus musculus
uuauggacuugguaggaagacaugauuuggggaacaagacagcuuugaaaugagugagaauga

SEQ ID NO: 100860 - RNA, 81 nt, Mus musculus
agcagaggcgucuuaggaccugggauguuacugaauguuacuggagugugcuuugaccagggcucacacacaguugugaac

SEQ ID NO: 100861 - RNA, 42 nt, Mus musculus
guggaugaaaauaggaauuggaaaacgggaaguccugguggu

SEQ ID NO: 100862 - RNA, 45 nt, Mus musculus
aauuccuauuuucauccacuuuuaaagcgugcaagggagcccacc

SEQ ID NO: 100863 - RNA, 46 nt, Mus musculus
aauccaagcuucuugaaucauuaaaaauacauaaaacagagcagca

SEQ ID NO: 100864 - RNA, 46 nt, Mus musculus
auuccaaacccagacguacuuggcuaguggaaagacaaagacaguc

SEQ ID NO: 100865 - RNA, 45 nt, Mus musculus
uugggaacaaccagccgagaugaacaauuuucuauuucugcauag

SEQ ID NO: 100866 - RNA, 26 nt, Mus musculus
acaguagcccuuucucucgaucuuga

SEQ ID NO: 100867 - RNA, 37 nt, Mus musculus
uguuggcuuuucaccucugguccugugucacugagcg

SEQ ID NO: 100868 - RNA, 85 nt, Mus musculus
accaauaagggcgguguguugacauccacgugacugacaaccuggagcucucgucugacgcucugaucuggaacuuggggucguu

SEQ ID NO: 100869 - RNA, 43 nt, Mus musculus
ugugugagggcuguuuuggaacgaccccaaguuccagaucaga

SEQ ID NO: 100870 - RNA, 41 nt, Mus musculus
uacugccauacuucccaguaaacgauguugccaaaggucug

SEQ ID NO: 100871 - RNA, 42 nt, Mus musculus
gaaagggaaacucguguuuuccugguuguaacaaggugacac

SEQ ID NO: 100872 - RNA, 46 nt, Mus musculus
gauaaaaggggugugugugugugugugugugugugugugugugugu

SEQ ID NO: 100873 - RNA, 46 nt, Mus musculus
ugagaacugaacgcugcuuugguaacaucugggcuaacaaauaggu

SEQ ID NO: 100874 - RNA, 59 nt, Mus musculus
gugauugcauuucaucaugaaaaugcuaguaaccgugagucagucuucucucaguggaa

SEQ ID NO: 100875 - RNA, 27 nt, Mus musculus
cuuggggcuaguguucgaagaugagag

SEQ ID NO: 100876 - RNA, 24 nt, Mus musculus
ucuugacacggccccgaggaccau

SEQ ID NO: 100877 - RNA, 42 nt, Mus musculus
ggcuaccccgaccuggggccacugcggaucuugguggcagag

SEQ ID NO: 100878 - RNA, 45 nt, Mus musculus
gggccaagggaaucggccuugauucaggaagaugaauccucagag

SEQ ID NO: 100879 - RNA, 45 nt, Mus musculus
uguucaugccaaaaccacguuggccgaaucuccgcagcagcagac

SEQ ID NO: 100880 - RNA, 45 nt, Mus musculus
ucuugucuucaagaaugugcuuaaugcagaacuccugccccucca

SEQ ID NO: 100881 - RNA, 42 nt, Mus musculus
ugacuaacucaccacacgaguuucuggagcaaggcaugucag

SEQ ID NO: 100882 - RNA, 46 nt, Mus musculus
gaagggcuaaaaugaaacaaacccuuuuauuccccaaguugcuuuu

SEQ ID NO: 100883 - RNA, 46 nt, Mus musculus
caugauuccaaaucacccuuggaucauaggucuccuuuggagagau

SEQ ID NO: 100884 - RNA, 127 nt, Mus musculus
caugacuccaagcggaggaggucagaugacuucaggccccagaauuaucaccagcaggauuuccgacgaaugucugaccacagacccaccauggguuaccacggccagggacccucagaccauuauc

SEQ ID NO: 100885 - RNA, 46 nt, Mus musculus
cauuuugaacaggaaccauugcuauagauuuguguuuuuggagaua

SEQ ID NO: 100886 - RNA, 57 nt, Mus musculus
ggccguaugagcaguacaacagcgaccgagaccaccggggacacagagacuauuaug

SEQ ID NO: 100887 - RNA, 45 nt, Mus musculus
guagguugaauuacauuuguuuagaaaaauauagagacagccaga

SEQ ID NO: 100888 - RNA, 38 nt, Mus musculus
gagcuggcugacaguucagaaguuuaguccauaacguc

SEQ ID NO: 100889 - RNA, 46 nt, Mus musculus
ucuuccauaugcagaauuuaacgaguugaguuuagaggaucagaga

SEQ ID NO: 100890 - RNA, 44 nt, Mus musculus
gauaacuacagucaccccaacaagagacacuuuaguaacgcagg

SEQ ID NO: 100891 - RNA, 53 nt, Mus musculus
cgaaaacuacauaaguuauauaagauggcucauaagaaaagaucucaagaaga

SEQ ID NO: 100892 - RNA, 47 nt, Mus musculus
gccgagugccuuaaagcuuacucagaccaggagcacaucaaauugug

SEQ ID NO: 100893 - RNA, 46 nt, Mus musculus
gaaacaguuggacaaaccugacaaagggcucagugugcaagaacag

SEQ ID NO: 100894 - RNA, 44 nt, Mus musculus
uggccacagcucucuugcagauggggaaagaacauucagagagg

SEQ ID NO: 100895 - RNA, 46 nt, Mus musculus
gcccuguggcuagagugguggcuuaagacgcgccaacuguugagga

SEQ ID NO: 100896 - RNA, 46 nt, Mus musculus
guguugcuuugcaagcauguccuuguuauguuuacagauuguaggc

SEQ ID NO: 100897 - RNA, 35 nt, Mus musculus
cgaugaucuggaccaggaaaccuucagcauuguaa

SEQ ID NO: 100898 - RNA, 75 nt, Mus musculus
aaaccagugagcucucggaaggacagggaaggagacaaagagaggaagaaguccaaagacaagaaagagaaggua

SEQ ID NO: 100899 - RNA, 70 nt, Mus musculus
ggaugauggucuagaaaaaaguccaacgaaaaaaaagcagaagaagaaagagaacaaggagaacaaagag

SEQ ID NO: 100900 - RNA, 46 nt, Mus musculus
cugaguguagccauuggcuugccagcuuguaauccaguuugcagaa

SEQ ID NO: 100901 - RNA, 42 nt, Mus musculus
gcugagagcuacauccugaaccucaaccagaggcugggggag

SEQ ID NO: 100902 - RNA, 46 nt, Mus musculus
guaaaauaacaguauauugucugucuuuaccuagccugccagaggg

SEQ ID NO: 100903 - RNA, 43 nt, Mus musculus
gcgucgccucgacacuccgacaacccaucugaagagggggaag

SEQ ID NO: 100904 - RNA, 64 nt, Mus musculus
cuaggccaaacuaaagaagcggaagccucgaguaaagaaggagaacaaagcccccaggcugaag

SEQ ID NO: 100905 - RNA, 58 nt, Mus musculus
gaguggacuacuugcugaagcugcucaggaagggucuggagaagaagggcaccguggc

SEQ ID NO: 100906 - RNA, 47 nt, Mus musculus
uuguugucucuauuuguccggauucacuaaccgggcuguggguggug

SEQ ID NO: 100907 - RNA, 46 nt, Mus musculus
uggcucaugagggauuuucagugacugggagccauggacaugagaa

SEQ ID NO: 100908 - RNA, 46 nt, Mus musculus
cuccuggaaggaggaaauccacgucggcugggaugcucuagcagau

SEQ ID NO: 100909 - RNA, 62 nt, Mus musculus
ucucgucuguugcuuggaaucuaugaacauggcuauggaaauugggagcuaauuaagacaga

SEQ ID NO: 100910 - RNA, 74 nt, Mus musculus
gaacgugaaguccauuauccaacacgaagaagaguuugagaugcugcauaaaucuaucccuguggacccugagg

SEQ ID NO: 100911 - RNA, 26 nt, Mus musculus
ggaauauaaaacuuauaaccuuuagg

SEQ ID NO: 100912 - RNA, 42 nt, Mus musculus
cucucccugcacugacuccuucucugaacaccuuccccgggu

SEQ ID NO: 100913 - RNA, 46 nt, Mus musculus
cugacaguucuccccuggggagcucaggguuagaaggcggcuaguu

SEQ ID NO: 100914 - RNA, 45 nt, Mus musculus
uugcgcgcgcucgacuggccaggaagaacgacacugcaacaggau

SEQ ID NO: 100915 - RNA, 71 nt, Mus musculus
gacuaaacaugaugauagguauauuucuauauuauagcagucguaagacauuuagagagagugagugagag

SEQ ID NO: 100916 - RNA, 76 nt, Mus musculus
cugggggagcugauucauaauagcugugugucagcaaugcaggaauaugaggagcaacugaaagaaagcaccagug

SEQ ID NO: 100917 - RNA, 46 nt, Mus musculus
auuagacaaggcucuuguuggccuuggacugaccuauacagcaggu

SEQ ID NO: 100918 - RNA, 46 nt, Mus musculus
ugccagguucuguuggugguuuuguuauuuuugugccgcugaagau

SEQ ID NO: 100919 - RNA, 46 nt, Mus musculus
ugugaucccacaggccuuaauuuuguuuuuauuugaaaaaucagau

SEQ ID NO: 100920 - RNA, 45 nt, Mus musculus
gaucugaaaguuaucagauucagaaaaccaaauaucacauuuuuu

SEQ ID NO: 100921 - RNA, 42 nt, Mus musculus
ugccaccaugcuccgccuacugucucuucauauuugaaaaua

SEQ ID NO: 100922 - RNA, 44 nt, Mus musculus
gguggcaagaugcuucaccugcugaacccuccccuccgcccucu

SEQ ID NO: 100923 - RNA, 47 nt, Mus musculus
gguguuggaccaucuggugauucagcgcauggauaccacuggcagga

SEQ ID NO: 100924 - RNA, 62 nt, Mus musculus
ugaauauuuaccgccugguuacaaaagggacuguggaagaggagaucauagaacgggccaaa

SEQ ID NO: 100925 - RNA, 45 nt, Mus musculus
ucuuuguguuuucauugcuuaauguugucaauuauggcuguuaga

SEQ ID NO: 100926 - RNA, 46 nt, Mus musculus
caagcccaaggaguugagucaggauacuauuagucccgucccucuu

SEQ ID NO: 100927 - RNA, 49 nt, Mus musculus
uuuuguuguggucgcauccauauuaaagcuucuuuaaccaaguuagaga

SEQ ID NO: 100928 - RNA, 42 nt, Mus musculus
auuucucugguccugaugcuuaaguagucuguuugccgaguu

SEQ ID NO: 100929 - RNA, 68 nt, Mus musculus
gugaugcuuccuacuggcuuaccacauuuauggguugaaagaacaggaaggcaagggcaugaugggcc

SEQ ID NO: 100930 - RNA, 61 nt, Mus musculus
gaaaacuuggcaugagaaaaguaccugugcuaccugucuuuaucuauugucaaaguagguc

SEQ ID NO: 100931 - RNA, 63 nt, Mus musculus
uuuaccugcuaacccuacgaucaguagcacuaaggacaauguagaaggaaagauuagcaacaa

SEQ ID NO: 100932 - RNA, 76 nt, Mus musculus
gccacauggacaggcguguguaccaugguucccgaauggagaugagacgauaacuaugaggacuugauuucucucu

SEQ ID NO: 100933 - RNA, 46 nt, Mus musculus
acgccugccugcagaugugaaggaucauguuuagguuacaggagac

SEQ ID NO: 100934 - RNA, 46 nt, Mus musculus
caaaaaagauguggagaaaucccuuccugccaaaguggagcagauu

SEQ ID NO: 100935 - RNA, 46 nt, Mus musculus
uuugaguucugggaagauuuugaagaagaccauggaaaagggagag

SEQ ID NO: 100936 - RNA, 46 nt, Mus musculus
aaaauuggccuuuccuggcaggacagauugagauuuuuuuccccua

SEQ ID NO: 100937 - RNA, 48 nt, Mus musculus
acugcauccauuuuuccuucccaagaaauuacagucacuggcggccau

SEQ ID NO: 100938 - RNA, 42 nt, Mus musculus
gaucgcagacugagcagcgcuguuuaauucugggcuggaguc

SEQ ID NO: 100939 - RNA, 45 nt, Mus musculus
uugcccacuacgggccaguugucacaacuaaaauaucugcagaua

SEQ ID NO: 100940 - RNA, 23 nt, Mus musculus
uagcugguggaagugaaacgauc

SEQ ID NO: 100941 - RNA, 46 nt, Mus musculus
acauauauuuacauuaccauucauaguaguagcaagauuacaguug

SEQ ID NO: 100942 - RNA, 44 nt, Mus musculus
aaauuuuaaacuauuuuuguugaauuuuaaaucaugguugcagu

SEQ ID NO: 100943 - RNA, 64 nt, Mus musculus
aacauuugucuucucaggcuuuaguuucuauuucaagaucagcucauuaauuucugggggaauu

SEQ ID NO: 100944 - RNA, 46 nt, Mus musculus
gugucuggauuguuuuauuuucauaacaucuuuugaagagacagau

SEQ ID NO: 100945 - RNA, 46 nt, Mus musculus
cugccucagaaagcauaaaucagaacaaagucucaaagccacauga

SEQ ID NO: 100946 - RNA, 45 nt, Mus musculus
acuagugaagcacauauucaugcaaaccaguucauuaggcgcaga

SEQ ID NO: 100947 - RNA, 45 nt, Mus musculus
augaguuuugcaguuuuacuuuuugagacuaaacaaaggccuaua

SEQ ID NO: 100948 - RNA, 83 nt, Mus musculus
uauucacagcacaugggagagugaagacuccuuacagcaacagaaagugaagggccuaaagaaacuggagaauuucaagaaga

SEQ ID NO: 100949 - RNA, 46 nt, Mus musculus
augcuguugaagcuaauggagauccuagcgaugacuuugacacgga

SEQ ID NO: 100950 - RNA, 42 nt, Mus musculus
aggugaugaacagcaagauaauagugaaacuauugaaaaggu

SEQ ID NO: 100951 - RNA, 46 nt, Mus musculus
aaguuaaaaagcaaccuaagauucagcguggaaagaggaaaaaaca

SEQ ID NO: 100952 - RNA, 46 nt, Mus musculus
ccccaccuagccccaaguguccuacugucccagucuggccccaagu

SEQ ID NO: 100953 - RNA, 46 nt, Mus musculus
gaagacgaacaggaacagggaaccagugcagagagugaggcagaac

SEQ ID NO: 100954 - RNA, 45 nt, Mus musculus
ggcuggugcccuuuuccccauuuuaaaauacauauauauccaaua

SEQ ID NO: 100955 - RNA, 46 nt, Mus musculus
cauaacugcugauucccuuuggagggguaaagaauuguucuaaguc

SEQ ID NO: 100956 - RNA, 46 nt, Mus musculus
ggguguuuugccuuuaugcauaauguuugccuguuguccuuagagu

SEQ ID NO: 100957 - RNA, 46 nt, Mus musculus
cugaugaguagucagacuacuugugugcuuacuuuacuuuggaguc

SEQ ID NO: 100958 - RNA, 41 nt, Mus musculus
ucugucugugugucugucugugugugacauagagagggagg

SEQ ID NO: 100959 - RNA, 41 nt, Mus musculus
ucccaauaguuuuuaugaagguacuguguguugguccaacu

SEQ ID NO: 100960 - RNA, 46 nt, Mus musculus
acuguauaguuucugcauuuuuuuuucuuuuuuugagaugggaguc

SEQ ID NO: 100961 - RNA, 46 nt, Mus musculus
uacaacaaauuauauucuguucauuauuuuuugcagcauuagagau

SEQ ID NO: 100962 - RNA, 46 nt, Mus musculus
gcucagcaagcacccuaucucuuaccuccguccccagugcccagau

SEQ ID NO: 100963 - RNA, 62 nt, Mus musculus
ugauguuuaugggguuaggaggucaaaucgaagcagacaagaaccaucacgauuuaauguua

SEQ ID NO: 100964 - RNA, 46 nt, Mus musculus
uguuugauugaaauaaauguucugauaaugaaaauagcgaguagag

SEQ ID NO: 100965 - RNA, 45 nt, Mus musculus
uuuucuguaucugauuuuuguuuguuuguuuguuuguuugguagg

SEQ ID NO: 100966 - RNA, 46 nt, Mus musculus
accaucuguaaugagaucugacucccucuucuggagugucagaaga

SEQ ID NO: 100967 - RNA, 49 nt, Mus musculus
uuccggaagccaaagagaagccugccucuaagaaggaacggauagcuga

SEQ ID NO: 100968 - RNA, 45 nt, Mus musculus
uucagcuucugaagaagugucggggucagacucaggcagucaguc

SEQ ID NO: 100969 - RNA, 46 nt, Mus musculus
auaugauucagagaaaacuugguggccauagugguguuccuuuagu

SEQ ID NO: 100970 - RNA, 45 nt, Mus musculus
gcuccuuugggcaaaucugcugucacugugguagccggguuggaa

SEQ ID NO: 100971 - RNA, 46 nt, Mus musculus
uauaauauaguaauauauaacaaagauuucuuauauugguccagua

SEQ ID NO: 100972 - RNA, 46 nt, Mus musculus
aggacucaugacuucacuacagaaaagaauuccauuucagggggau

SEQ ID NO: 100973 - RNA, 46 nt, Mus musculus
auuagcccacuccaaaucaguggccuucuguagauuaauagugaga

SEQ ID NO: 100974 - RNA, 44 nt, Mus musculus
ucccucaacaguccagcuccagcucugucaaagauggcccuaga

SEQ ID NO: 100975 - RNA, 45 nt, Mus musculus
ucugacacccucuuuggugcaucugaagacagcuacacuguacuu

SEQ ID NO: 100976 - RNA, 44 nt, Mus musculus
agugaaaguguggcauuugaagugguuuccuuggcuguaguuaa

SEQ ID NO: 100977 - RNA, 46 nt, Mus musculus
cuucaccuucccccauguggcuuauagagguauuaucuuaccagau

SEQ ID NO: 100978 - RNA, 46 nt, Mus musculus
uugcuggguuaucagaaguccuuuuuagacaaguuaggagagagau

SEQ ID NO: 100979 - RNA, 46 nt, Mus musculus
cacuguuuucuucuauuacggcuccccuaacccuuccccugcaguu

SEQ ID NO: 100980 - RNA, 45 nt, Mus musculus
uaguuuuaugguuuaauucucaguccuguucuuaugagucaagag

SEQ ID NO: 100981 - RNA, 49 nt, Mus musculus
ugccuggggcccuggaggccaggagagggcauuauccccugggacugga

SEQ ID NO: 100982 - RNA, 49 nt, Mus musculus
cgcuauuauauuuuuaaaaagguuguggauucucuuguaguuuggggaa

SEQ ID NO: 100983 - RNA, 46 nt, Mus musculus
gagcauuacuugaacaaagaaacuguuuaaacacuugcccuacacc

SEQ ID NO: 100984 - RNA, 41 nt, Mus musculus
auguuuuuuugggcucuauuauagauuaagucagugggggu

SEQ ID NO: 100985 - RNA, 45 nt, Mus musculus
ucauuccaguauaguuuagaacuauuaaacuauuccuuaggagac

SEQ ID NO: 100986 - RNA, 46 nt, Mus musculus
uaucaaacauuuucucaauugacauuugaggaagaaaaacucaggu

SEQ ID NO: 100987 - RNA, 47 nt, Mus musculus
acggguguuuaagcucugucauacauggcucauaaaccaagggaaga

SEQ ID NO: 100988 - RNA, 51 nt, Mus musculus
auguuccggugcguuuucucccguuuagucccucguucuguguaaggagau

SEQ ID NO: 100989 - RNA, 58 nt, Mus musculus
aaaagacacaguaaucguaaaucuccaaguaguaguacgcuaggucuuuuuauuuaca

SEQ ID NO: 100990 - RNA, 45 nt, Mus musculus
agaggaagggaauuuuggucgggacuuuccggugggcggcuucuu

SEQ ID NO: 100991 - RNA, 46 nt, Mus musculus
uccccacguucccauaaguacucugaugaugaaauaaaaggcagcu

SEQ ID NO: 100992 - RNA, 45 nt, Mus musculus
aaaucuuaacguuuuucgcuagccuuguaaggcagggaugauuag

SEQ ID NO: 100993 - RNA, 27 nt, Mus musculus
ccaaacacuuaaguuauauccaggaac

SEQ ID NO: 100994 - RNA, 39 nt, Mus musculus
uuaugacuuaucaaaaccuuaauaaauaguuccugagau

SEQ ID NO: 100995 - RNA, 46 nt, Mus musculus
auuuaagaauuaaaagaugaugagaaauaaggacaaaagccaagag

SEQ ID NO: 100996 - RNA, 46 nt, Mus musculus
uuugagaaacuuuccuuauugauagugaugcuucugucguucaguu

SEQ ID NO: 100997 - RNA, 46 nt, Mus musculus
ggaccuacuacauggaucagguaaguccaugauaaucagugauaau

SEQ ID NO: 100998 - RNA, 64 nt, Mus musculus
uugaggauuauuucauuuacuuuuuguuuuuuaacggagaauuuugcguuuuuaaaaauuauuu

SEQ ID NO: 100999 - RNA, 70 nt, Mus musculus
agaaaagcugcuuuuaggagcuuucuuuucgugccuuguuggaagaagcugccguauugagagcccaggu

SEQ ID NO: 101000 - RNA, 45 nt, Mus musculus
gaccccaguaagucacuagaagaggcagggggcugcgggggcccc

SEQ ID NO: 101001 - RNA, 50 nt, Mus musculus
ggggcccccgcagcccccugccucuucuagugacuuacuggggucgaucc

SEQ ID NO: 101002 - RNA, 46 nt, Mus musculus
ccagaggggguuaagaagcccuucccccucccucugauggaguggu

SEQ ID NO: 101003 - RNA, 50 nt, Mus musculus
cuguccagggaggaaguuauuuuagcucaaggacugaaauauuuagcaga

SEQ ID NO: 101004 - RNA, 46 nt, Mus musculus
gacucuaaagcucaguuuaagaacuaaucuuuaaaauaauuaacac

SEQ ID NO: 101005 - RNA, 50 nt, Mus musculus
auucccccuuaaucuuuagauguuuuuaggcaccauaaagaaggcaagag

SEQ ID NO: 101006 - RNA, 160 nt, Mus musculus
guaauuucuugaauucgaaguuauuaauuaugcccaaauauauguaagaaguaaauauguuugauguguggcacuuccaagauuaaugguuuacaaagaaguuuguuucuucugggggggaaaaugguuguauuaacuuuugcucuacugcaguugaaca

SEQ ID NO: 101007 - RNA, 112 nt, Mus musculus
ugauugaugaaaugugaguguacuuagaauucgauuucaaacaugagugaaaggguucuuuugauuuuggaguugagguugaguguuugauuuaaaggugaccaagguuggu

SEQ ID NO: 101008 - RNA, 45 nt, Mus musculus
caucuaccagccaauuaucaacugucaaagacaaacccccuccag

SEQ ID NO: 101009 - RNA, 66 nt, Mus musculus
aucuggaggggguuugucuuugacaguugauaauuggcugguagauguggccuauuuaaguggcgg

SEQ ID NO: 101010 - RNA, 46 nt, Mus musculus
uuaguuuuuucggcauuuguaugugguugguuacuugugugcaugg

SEQ ID NO: 101011 - RNA, 42 nt, Mus musculus
uguguguauugaagaacacaccuuaauuuuaguuaggaagac

SEQ ID NO: 101012 - RNA, 52 nt, Mus musculus
aaaaaaaaaaagaaagaaagaaaagaaaaaagaaaaggccagauacgguggc

SEQ ID NO: 101013 - RNA, 46 nt, Mus musculus
gcuggacauggugccacugucuuuaauccaagaucucaggaggcag

SEQ ID NO: 101014 - RNA, 45 nt, Mus musculus
gugcauagcuuuaucaaaccuguaaacaguguuuuaagaguagau

SEQ ID NO: 101015 - RNA, 48 nt, Mus musculus
ggagaaggaucuugcagaugguaggguuuuagaaauguaucagauggg

SEQ ID NO: 101016 - RNA, 46 nt, Mus musculus
cccugucucaaaaaaccaaaaaaaaaaagaaaaaaaacccaaagau

SEQ ID NO: 101017 - RNA, 48 nt, Mus musculus
gaacuugugcacgccgcgcgcgcgcgcgcacacacacacacacacaca

SEQ ID NO: 101018 - RNA, 93 nt, Mus musculus
uuagucuuggagcgauggcucagcauuuaagauccuguauauuggaaggaccuagugcgguucuugacacucauacuccuguaacucuagauc

SEQ ID NO: 101019 - RNA, 96 nt, Mus musculus
aaugggaagcauuucucauuuaguuuugaggaacuuaagucagaaauuagugaaaacucccgaaauugcauagauaaguguauauuuuuauuagug

SEQ ID NO: 101020 - RNA, 79 nt, Mus musculus
cuuuccuauuuugcgauuauuguaauuauacaaaaccaagguaaauggaaaacucauccaugucucagaaaguacuuga

SEQ ID NO: 101021 - RNA, 87 nt, Mus musculus
cauuuguuuguaugugugugugcuugcaaauucaaauuugaaggucagagaaguugaguaggaaucuuguggauuguuuuaggagau

SEQ ID NO: 101022 - RNA, 46 nt, Mus musculus
uuucugaucauaguuucuugaguauuuagaaauuuaggcuguuuuu

SEQ ID NO: 101023 - RNA, 46 nt, Mus musculus
uuuuuuuaauuguuauauuugaauauuugccaacauuuggguagga

SEQ ID NO: 101024 - RNA, 46 nt, Mus musculus
uggggagacuuacguagcucaucuaaaaucaaaggugcggguugau

SEQ ID NO: 101025 - RNA, 45 nt, Mus musculus
aaggaaguagauuugauaauuauggugcaagaugauggcguuuga

SEQ ID NO: 101026 - RNA, 46 nt, Mus musculus
ccgccgcagcgaagaggccauguugugugguguguggggcgggggg

SEQ ID NO: 101027 - RNA, 46 nt, Mus musculus
ccugccucauuagauuauuuuaguacauuauagugccauccagaga

SEQ ID NO: 101028 - RNA, 46 nt, Mus musculus
cccgagaagcgccggcagggaaggggguccgccgcagaguuggcac

SEQ ID NO: 101029 - RNA, 42 nt, Mus musculus
ugacaccagccgcucuaucauccgaaaugucaaaggcccugu

SEQ ID NO: 101030 - RNA, 46 nt, Mus musculus; identical to SEQ ID NO: 29737

SEQ ID NO: 101031 - RNA, 45 nt, Mus musculus; identical to SEQ ID NO: 29738

SEQ ID NO: 101032 - RNA, 46 nt, Mus musculus; identical to SEQ ID NO: 29739

SEQ ID NO: 101033 - RNA, 45 nt, Mus musculus
uaguaaugaacuuuguccugggcccggggaaacugagcacaucug

SEQ ID NO: 101034 - RNA, 45 nt, Mus musculus; identical to SEQ ID NO: 29741

SEQ ID NO: 101035 - RNA, 91 nt, Mus musculus; identical to SEQ ID NO: 29742

SEQ ID NO: 101036 - RNA, 49 nt, Mus musculus; identical to SEQ ID NO: 29743

SEQ ID NO: 101037 - RNA, 45 nt, Mus musculus
cauuuguugaaauggaaaugaauacaaagcuugaauuugcuccag

SEQ ID NO: 101038 - RNA, 42 nt, Mus musculus
ucacugugguaguuugaauaaaaugcccccaacaggcuccuu

SEQ ID NO: 101039 - RNA, 46 nt, Mus musculus
uucuccuggacucugauggacucagcugccugugaaugcugcucac

SEQ ID NO: 101040 - RNA, 45 nt, Mus musculus
gacuuugugcaggcugggaaaaagagccgccaugugugggccagu

SEQ ID NO: 101041 - RNA, 46 nt, Mus musculus
uuccaauucuuucuuuucucuucagaaaacaacauggaagccaagu

SEQ ID NO: 101042 - RNA, 46 nt, Mus musculus
cagugaguggcagccuggcaccuaggggagagagcauuugacuuga

SEQ ID NO: 101043 - RNA, 46 nt, Mus musculus
ggaugaugacuggagaacagagaagguggggguuaguuaguuagau

SEQ ID NO: 101044 - RNA, 42 nt, Mus musculus
ggauagaaaucuggaagaaauggcaugaggagaaagagagac

SEQ ID NO: 101045 - RNA, 46 nt, Mus musculus
cugcagcggccaccgcugaucaccaaggcgcucacuccauugcagg

SEQ ID NO: 101046 - RNA, 45 nt, Mus musculus
ccuggucauuccauguccagcccaggaccgcaggagccacgaccc

SEQ ID NO: 101047 - RNA, 45 nt, Mus musculus
gaauauccacaccggagccccgagauuagaagacucagcugccag

SEQ ID NO: 101048 - RNA, 46 nt, Mus musculus
uugccaucugugggagcuugugcaaaucagcacacuauacguggag

SEQ ID NO: 101049 - RNA, 66 nt, Mus musculus
gggagucuauaaccacuguguugaugugaagccauggggagcaagaauggaagcugagaagacuug

SEQ ID NO: 101050 - RNA, 58 nt, Mus musculus
uuagggauuacaggcaucuguccacacccagcuacagaucuguuaauauaaaauguga

SEQ ID NO: 101051 - RNA, 45 nt, Mus musculus
acagaaagcaaugcagugugcugagcuuuugaaaauaucccuaca

SEQ ID NO: 101052 - RNA, 32 nt, Mus musculus
ucagaagccacgucugcauuagcucacgagaa

SEQ ID NO: 101053 - RNA, 45 nt, Mus musculus
cuccuguggcacagaaggcuuucgcaaugccaagaagggcaccgg

SEQ ID NO: 101054 - RNA, 46 nt, Mus musculus
cuccacuuuccuuguggcuuacaguggggaagucucauuaaaccag

SEQ ID NO: 101055 - RNA, 46 nt, Mus musculus
uguggccagcucagccucugcuccaaaaauaaaaaacuauucucug

SEQ ID NO: 101056 - RNA, 43 nt, Mus musculus
ugugggaccucugcuggcuugcuacccaaguuaacaagcagau

SEQ ID NO: 101057 - RNA, 47 nt, Mus musculus
acugaagggagccccugacugcccaucccucucugcacaccacacau

SEQ ID NO: 101058 - RNA, 70 nt, Mus musculus
ccccacaggccuccugcuagcccccuucucucaggcauucugggggaguuggacaggucugagaugaaua

SEQ ID NO: 101059 - RNA, 64 nt, Mus musculus
gcguccuacaagguagcccacagugaugauggugugcaguggacuguauaugaggagcaaggaa

SEQ ID NO: 101060 - RNA, 41 nt, Mus musculus
gguuuuaggugagccaccauacauggcuuuaugcucauuuu

SEQ ID NO: 101061 - RNA, 72 nt, Mus musculus
acauggaaccugcgugcuuuuggcugguacccccacuugggaaggcuggauaaucagggcaagaucaaugcc

SEQ ID NO: 101062 - RNA, 46 nt, Mus musculus
ucaagccuacucccuucccuuuuaaaaguauagaguuaagccagua

SEQ ID NO: 101063 - RNA, 45 nt, Mus musculus
cgacggacgcaaguuugaguucauccaggaugaaagcgguggaga

SEQ ID NO: 101064 - RNA, 46 nt, Mus musculus
caggugugaugacgcagggugccagccgugccgggagggcggagua

SEQ ID NO: 101065 - RNA, 46 nt, Mus musculus
augccuggacagccagcaacuaugauagcaagcccuggauccaggu

SEQ ID NO: 101066 - RNA, 65 nt, Mus musculus
guguauauggguuucaugggcuugcagcgcuggggcccggagcuggcucgucuguaccgcacagg

SEQ ID NO: 101067 - RNA, 42 nt, Mus musculus
cccugugucacaugggaagggcuguguucagauaagggaggg

SEQ ID NO: 101068 - RNA, 44 nt, Mus musculus
cuggugacuuuggacacacagcguggggacaucuucaccgaaua

SEQ ID NO: 101069 - RNA, 46 nt, Mus musculus
cuccuccuccuccuccuccuccucugcucugagguccccaguagac

SEQ ID NO: 101070 - RNA, 44 nt, Mus musculus
agagcagagguggugagucacuaaaccagaaagcaagaggugga

SEQ ID NO: 101071 - RNA, 45 nt, Mus musculus
auuauaacacaagcuuucuaaccaacucuggcauuuucagcacag

SEQ ID NO: 101072 - RNA, 45 nt, Mus musculus
aaauaaauauguacuuuuaaacacaaccauccccaaguccaggag

SEQ ID NO: 101073 - RNA, 46 nt, Mus musculus
cauuaucaggcuagcucaugguacucaaauagguucugacuggcag

SEQ ID NO: 101074 - RNA, 39 nt, Mus musculus
ggcuuucaacucacugccuacccggucaggcugcaggaa

SEQ ID NO: 101075 - RNA, 46 nt, Mus musculus
gaucccaacagaagaaucaggguagaauguaccaauccccucacag

SEQ ID NO: 101076 - RNA, 46 nt, Mus musculus
guaaacacaaaguccuccuuacauaaacagagaaaucaagcccaag

SEQ ID NO: 101077 - RNA, 45 nt, Mus musculus
uccuccaucuugggcaggaaaucuuuggcaaagggacugcccaca

SEQ ID NO: 101078 - RNA, 45 nt, Mus musculus
cguugccauggugauacgugggcuggcuggauuugggggcacaag

SEQ ID NO: 101079 - RNA, 42 nt, Mus musculus
cuagagguuggcucagcccugaauucuccaucuuggccucag

SEQ ID NO: 101080 - RNA, 45 nt, Mus musculus
caccauaaaguuugaaaauucaaaagaagagagagagagagagag

SEQ ID NO: 101081 - RNA, 42 nt, Mus musculus
gagagagagagagagagaagagagagagagagagagagaaag

SEQ ID NO: 101082 - RNA, 44 nt, Mus musculus
ggggcagguuacugcagcggauucuacaguggggcucacuggcg

SEQ ID NO: 101083 - RNA, 26 nt, Mus musculus
gggacuucugcccucgcuuuguggac

SEQ ID NO: 101084 - RNA, 41 nt, Mus musculus
aagaaaagaucaggauugcuucaggcagacuagggggcaca

SEQ ID NO: 101085 - RNA, 30 nt, Mus musculus
aacuuugauugcagccauuggaguuucaaa

SEQ ID NO: 101086 - RNA, 42 nt, Mus musculus
ggaaaauuuuaaauacaugguuugaauauuaaagggcaccag

SEQ ID NO: 101087 - RNA, 46 nt, Mus musculus
auuguguugaggaaauauuugcugauuaaauuaaucacuuuugggg

SEQ ID NO: 101088 - RNA, 45 nt, Mus musculus
augguugugagccaccaugugguugcugggauuugaacauaggau

SEQ ID NO: 101089 - RNA, 46 nt, Mus musculus
aauauuuauuuaauguuguaugagcauccuguugcugacacaccag

SEQ ID NO: 101090 - RNA, 47 nt, Mus musculus
aggucuccagcuaaaggcgcuguggaacacuuugaaacgucguaaga

SEQ ID NO: 101091 - RNA, 46 nt, Mus musculus
ggauacccagggcuacacagaaaaacccugucuugaaaaaaaaaaa

SEQ ID NO: 101092 - RNA, 46 nt, Mus musculus
caagagaacacugauuaagggaauagauuaauuuaugcugaaagaa

SEQ ID NO: 101093 - RNA, 46 nt, Mus musculus
aauaugcuuuacuaacuauacagcuaauacaaagaaaauagccaag

SEQ ID NO: 101094 - RNA, 45 nt, Mus musculus
caaaucccagcaaccacaugguggcucacaaccauccguagcaag

SEQ ID NO: 101095 - RNA, 46 nt, Mus musculus
uacaaauaaaaacuacuuugggauuuuaucuuauaccugucacaau

SEQ ID NO: 101096 - RNA, 46 nt, Mus musculus
gggcuccagaaagcugucauuggcagaacagcagacaaauuggaag

SEQ ID NO: 101097 - RNA, 45 nt, Mus musculus
cccagaaccacauaacacuuagcaugcuauacguauaaucucagc

SEQ ID NO: 101098 - RNA, 41 nt, Mus musculus
guguaaauaaauauacaaacaaaucaaaugagcuaggggga

SEQ ID NO: 101099 - RNA, 46 nt, Mus musculus
agcuucuggcuuacauacaugacaacuaccaaaaggcuguggcuac

SEQ ID NO: 101100 - RNA, 46 nt, Mus musculus
ugagucaugugaacaguaaccucuuaaaaaccagcaagacccuuag

SEQ ID NO: 101101 - RNA, 45 nt, Mus musculus
ggcugccaccccgagcaugcucucauucucucagcuucccagcag

SEQ ID NO: 101102 - RNA, 45 nt, Mus musculus
gugucucacuaaggacucagcguaccugucagaguuucuggagga

SEQ ID NO: 101103 - RNA, 46 nt, Mus musculus
ugucucaagagagcaugucaccaccucccucaucaaguacucacag

SEQ ID NO: 101104 - RNA, 48 nt, Mus musculus
ugccuuugcccaucucauguacuaaguuggcaguugcccuuagaucag

SEQ ID NO: 101105 - RNA, 45 nt, Mus musculus
caucauugguuaaaaaaaauacgaauuccauguuuuagggaacaa

SEQ ID NO: 101106 - RNA, 42 nt, Mus musculus
agccauucuguaucugcuuuggaaugucuccaccauaaacag

SEQ ID NO: 101107 - RNA, 46 nt, Mus musculus
aagcuuuucuaaaacuacaccaagaagauucccucguacagcacag

SEQ ID NO: 101108 - RNA, 42 nt, Mus musculus
ggagaagaaagcucucaaaaucccaaagaaaccagcacacac

SEQ ID NO: 101109 - RNA, 63 nt, Mus musculus
cuccuccuagaaccccacagagaaugaccugccccauaccaccuucuccaccauccaagcuuc

SEQ ID NO: 101110 - RNA, 45 nt, Mus musculus
uucugcaggguaugguaguaagccuauaguccuagcacuugggag

SEQ ID NO: 101111 - RNA, 45 nt, Mus musculus
cuggaaugcuugcauggguucaauugccaguaacacugaugagua

SEQ ID NO: 101112 - RNA, 46 nt, Mus musculus
acggcuggcguaguuuaggguguugagggucucaucgaagucggag

SEQ ID NO: 101113 - RNA, 25 nt, Mus musculus
gaggagguugccgagugguuagagc

SEQ ID NO: 101114 - RNA, 45 nt, Mus musculus
cucuguguuaccaucuucauccacccacgcuugggcugggcucac

SEQ ID NO: 101115 - RNA, 45 nt, Mus musculus
caaggcuccgagccucaaaggcgcccugacaacuccacccgcgcg

SEQ ID NO: 101116 - RNA, 45 nt, Mus musculus; identical to SEQ ID NO: 26955

SEQ ID NO: 101117 - RNA, 45 nt, Mus musculus
ggccugcggaaggcggcugcgggagaaggcgggcggggggggggg

SEQ ID NO: 101118 - RNA, 46 nt, Mus musculus
uucacaaauaaauaaauacacaccaggcaaagcuugugccugcuuc

SEQ ID NO: 101119 - RNA, 45 nt, Mus musculus
acagacacuuuuccuuuggucuuggcaccuucggagggaguagau

SEQ ID NO: 101120 - RNA, 42 nt, Mus musculus
gccucuuccaggaucuacucccuccgaaggugccaagaccaa

SEQ ID NO: 101121 - RNA, 46 nt, Mus musculus
caugcccagagguauuuagagaacagaaccaagucccaggaaagag

SEQ ID NO: 101122 - RNA, 47 nt, Mus musculus
ugcuuccacaugcaaaccaugcacaaggaaggaagagagguucaagg

SEQ ID NO: 101123 - RNA, 29 nt, Mus musculus
ucuugaggguugcugugaguucaggggag

SEQ ID NO: 101124 - RNA, 45 nt, Mus musculus
uagcucccagccuuuccacccccaggaaggagagaaggagaaaag

SEQ ID NO: 101125 - RNA, 42 nt, Mus musculus
uggucugcugugguacuagaggucaucugcacauggggucag

SEQ ID NO: 101126 - RNA, 50 nt, Mus musculus
ccagguuggccucgaacucacagagauccucugccuccagaguucuggga

SEQ ID NO: 101127 - RNA, 79 nt, Mus musculus
aggcuggccccauauuaauggccauccugcaccaacccccccugaguguugagaguacaggugugaguccccaugccca

SEQ ID NO: 101128 - RNA, 46 nt, Mus musculus
auauaugcauagauauagauaacugggaagauacuccuggcaucag

SEQ ID NO: 101129 - RNA, 26 nt, Mus musculus
gggagguugaucagccuuucggugua

SEQ ID NO: 101130 - RNA, 46 nt, Mus musculus
ucuggaaucacauggugccauauuuagcuacuaaaaagcucuucgc

SEQ ID NO: 101131 - RNA, 45 nt, Mus musculus
ggccuuucuaggggacauuuuuuuacauauauauaugauggagau

SEQ ID NO: 101132 - RNA, 48 nt, Mus musculus
guuugcacagacgcuggagaaggugugcgugcagacuguggagagcgg

SEQ ID NO: 101133 - RNA, 45 nt, Mus musculus
acgugaaagagaggcucuggggaagaaaguaagacacacccaaga

SEQ ID NO: 101134 - RNA, 46 nt, Mus musculus
ggccagggaggaagggcucugauugcauaaguuggagacaggugau

SEQ ID NO: 101135 - RNA, 25 nt, Mus musculus
ucagagagccaaucaucugcaaaaa

SEQ ID NO: 101136 - RNA, 41 nt, Mus musculus
gggaagcaauuggcuaugucacucauuaugggaccgggaga

SEQ ID NO: 101137 - RNA, 44 nt, Mus musculus
agaaguacaguguggcugucaagugugccacaaucaccccugau

SEQ ID NO: 101138 - RNA, 46 nt, Mus musculus
agcccuucuaccuccuuuaauuucauucuuuguuguugccaaaguu

SEQ ID NO: 101139 - RNA, 44 nt, Mus musculus
gcugaaguuacgggugggugugaguuaucaugugggugcugaga

SEQ ID NO: 101140 - RNA, 41 nt, Mus musculus
uuguaugagguuucaagaguauugugagucuuggcugggcu

SEQ ID NO: 101141 - RNA, 44 nt, Mus musculus
gaucuccuggaacuaguguuacagacaacuaugagccaucagau

SEQ ID NO: 101142 - RNA, 100 nt, Mus musculus
uuaaauaaaaauugcuuuauguauaugaauguuuuaccugcauguauauuuauguguguaccuguguguaucuggugcucaaagcgggucagaagagggc

SEQ ID NO: 101143 - RNA, 46 nt, Mus musculus
caguggucaugggaccuaggcccuugggagauucaagcuggcuguc

SEQ ID NO: 101144 - RNA, 41 nt, Mus musculus
uaaugagcugacagauguggguguugggaaucaaguucagu

SEQ ID NO: 101145 - RNA, 54 nt, Mus musculus
gagguaggcagaucccugugaguuuaaggucuacagagcaacuucuaagacagc

SEQ ID NO: 101146 - RNA, 46 nt, Mus musculus
gaaaacgaaaguccuauaggguuucacagguguauugcaaucagau

SEQ ID NO: 101147 - RNA, 46 nt, Mus musculus
uggcagcuuugcagcaaaauaugguagaaguuaaaggcacucagug

SEQ ID NO: 101148 - RNA, 42 nt, Mus musculus
gagcacuugguggccucuuuugaugccuguugccacggaaau

SEQ ID NO: 101149 - RNA, 46 nt, Mus musculus
acaggcccacgucagcuauuuuuggaaccuuuacucgacagcugga

SEQ ID NO: 101150 - RNA, 42 nt, Mus musculus
aggaguggggcccagccauucucacagugcuuaccaaagaug

SEQ ID NO: 101151 - RNA, 45 nt, Mus musculus
uggacaugaagauugacuuaaagauggggggaggagcggucaugu

SEQ ID NO: 101152 - RNA, 46 nt, Mus musculus
cugggugucugaagacagcuacaguguacuuacauauaaugaauaa

SEQ ID NO: 101153 - RNA, 41 nt, Mus musculus
uuuccccuguaccugucacaccuuugcuguggugggcagag

SEQ ID NO: 101154 - RNA, 45 nt, Mus musculus
gcagcgagagggacagcauccgcaucagagcacuaguggugagau

SEQ ID NO: 101155 - RNA, 24 nt, Mus musculus
ggguacgugguguggagaggucua

SEQ ID NO: 101156 - RNA, 42 nt, Mus musculus
auguuucagauacuguuggaccccaaagagaaaggcacggag

SEQ ID NO: 101157 - RNA, 41 nt, Mus musculus
aaaaaguguguguguguguguguguguguguguuguguuua

SEQ ID NO: 101158 - RNA, 55 nt, Mus musculus
ccgccuggaccaggcuguccuugaccugaagagaugugugagccuagaacccaag

SEQ ID NO: 101159 - RNA, 53 nt, Mus musculus
uccacauucguaccccuaucuuccuuuggcccucgagaucuaucccuacugcu

SEQ ID NO: 101160 - RNA, 41 nt, Mus musculus
acacaggcccugagucucggcgcgacgccccaggaccaggc

SEQ ID NO: 101161 - RNA, 46 nt, Mus musculus
gugggcagcccaggugguaaaagggcuucaagggacaaaccagcaa

SEQ ID NO: 101162 - RNA, 46 nt, Mus musculus
ugggucuguuugcauggugagaccucuggccccucagggaccuaag

SEQ ID NO: 101163 - RNA, 46 nt, Mus musculus
cacacggcuuccuauucaugucuuggugacaggaaugagaugaaga

SEQ ID NO: 101164 - RNA, 48 nt, Mus musculus
uaccuaugagacuucuguuucaaaaacaaaacaaaacaaccuagggcu

SEQ ID NO: 101165 - RNA, 46 nt, Mus musculus
gaaggugacaggcugaggaugugaaguaguucugaauggccgaggu

SEQ ID NO: 101166 - RNA, 46 nt, Mus musculus
ccugcccgcuguguggacgaggaaggcagagacaaaauuaggaggu

SEQ ID NO: 101167 - RNA, 69 nt, Mus musculus
gaagggcuugcuucagacuccaggccagaggccacggaacacuucaggcacuagcacuaguucucagcu

SEQ ID NO: 101168 - RNA, 48 nt, Mus musculus
agggugauucugggaggagagggguaggcgcccauuauuaguggagua

SEQ ID NO: 101169 - RNA, 32 nt, Mus musculus
ucauccuuuucccaaaaugggauguaggaaga

SEQ ID NO: 101170 - RNA, 42 nt, Mus musculus
ccuuacaucagcaggcggcgggggcagagagacaggggagag

SEQ ID NO: 101171 - RNA, 46 nt, Mus musculus
uaguccucagcugucaggacuacgaggagcagaguggcuguguagg

SEQ ID NO: 101172 - RNA, 46 nt, Mus musculus
aaucccagcaaccacaugguggcucucaaccauccguaacgagauc

SEQ ID NO: 101173 - RNA, 46 nt, Mus musculus
aggaugacaaccggggacuaggccaagggcucaaagacaacaagau

SEQ ID NO: 101174 - RNA, 46 nt, Mus musculus
ugguugugagccaccaugugguuucugggauuugaacucggaaccu

SEQ ID NO: 101175 - RNA, 45 nt, Mus musculus
ucagugcccaaaagagggcagcaguucgaaggucaguggugguug

SEQ ID NO: 101176 - RNA, 46 nt, Mus musculus
uacaggagccccugggugggugguggggaggcacgguggcccagcc

SEQ ID NO: 101177 - RNA, 53 nt, Mus musculus
acuacagcacugagaaugauguggagaucauccgugccagcgucuguaccccc

SEQ ID NO: 101178 - RNA, 42 nt, Mus musculus
ucagccccaugggcacccgcuccacccuguuagcugccaggu

SEQ ID NO: 101179 - RNA, 42 nt, Mus musculus
ggccaccaccuacagcagcggcaaccagaaugagaagcagau

SEQ ID NO: 101180 - RNA, 44 nt, Mus musculus
uacaccaacagcaucuauacacuguccaucagcagcgccacaca

SEQ ID NO: 101181 - RNA, 45 nt, Mus musculus
uaaaaaaaaaaaaaaaaaaagaaagaauaaaagaaagaggaaaag

SEQ ID NO: 101182 - RNA, 42 nt, Mus musculus
aaggggauggagagaugacucagcaguuaagagcacuggcua

SEQ ID NO: 101183 - RNA, 42 nt, Mus musculus
guccugucagcguggggaggcagcucccaaugagggccgugu

SEQ ID NO: 101184 - RNA, 26 nt, Mus musculus
auugagaagaaucaucccgaccuagc

SEQ ID NO: 101185 - RNA, 41 nt, Mus musculus
cuggcacagagcagugacaaagcggucccugucgccucacc

SEQ ID NO: 101186 - RNA, 27 nt, Mus musculus
agcauggcuuccacaaccugggccagg

SEQ ID NO: 101187 - RNA, 45 nt, Mus musculus
ggcccuuacccuguccuccagcccugcccaucucggccccaugcc

SEQ ID NO: 101188 - RNA, 46 nt, Mus musculus
gugccaguguucuuagugaaacagagagggaaagggaggcaaagcc

SEQ ID NO: 101189 - RNA, 46 nt, Mus musculus
acccacugugugauguacccacugugugcugucagcaaagguccca

SEQ ID NO: 101190 - RNA, 45 nt, Mus musculus
aaggacagggugugaugguggugggacgucuagcuguuuaggggg

SEQ ID NO: 101191 - RNA, 42 nt, Mus musculus
agaaaagaagagagggaaggcgggagggagggagggaggaag

SEQ ID NO: 101192 - RNA, 46 nt, Mus musculus
cgugugugugugugcauguauaugugcacauguguguaugugugua

SEQ ID NO: 101193 - RNA, 45 nt, Mus musculus
ccuagacacuaugcuccucucucuuuagccaugcaggcugcaggg

SEQ ID NO: 101194 - RNA, 46 nt, Mus musculus
gcaacuaccccaaagagacuggaggggggcagggauccaaucuaau

SEQ ID NO: 101195 - RNA, 43 nt, Mus musculus
gaagaggaaaaagagagaaagagggggaagaagagaagaaaga

SEQ ID NO: 101196 - RNA, 45 nt, Mus musculus
auuuauacagaaaaugaugucacaccagugagggugggaacugag

SEQ ID NO: 101197 - RNA, 41 nt, Mus musculus
uucagucauuccuugaaaaucucuuuuaaacugggaaguga

SEQ ID NO: 101198 - RNA, 63 nt, Mus musculus
ucuagaguuucagugcaagggugagacagggagugacuaguauaugauuuaggaagaagguua

SEQ ID NO: 101199 - RNA, 65 nt, Mus musculus
gaaauauugauagguggacaugauuggaaagugaguguggggucuucuauuagagcuaucuggag

SEQ ID NO: 101200 - RNA, 45 nt, Mus musculus
auagauuuuaaaagagguucguggguggggccuauugagggcgag

SEQ ID NO: 101201 - RNA, 42 nt, Mus musculus
auaaagggaauggcaugguauuguuaguagguuggcuggcua

SEQ ID NO: 101202 - RNA, 24 nt, Mus musculus
gcucgggguagcagcuggggcugg

SEQ ID NO: 101203 - RNA, 43 nt, Mus musculus
ggugccaagguagaacguuuggagggaccugcaguuggcgcag

SEQ ID NO: 101204 - RNA, 48 nt, Mus musculus
guuggaaagcaggaagaacacauagcgggauuggaccggagaugaaug

SEQ ID NO: 101205 - RNA, 46 nt, Mus musculus
uguuguugcccauauucuggaaguuccugguguucauacuggcauc

SEQ ID NO: 101206 - RNA, 46 nt, Mus musculus
ccaguaaguccuggacuuacugcagaaagugcuccacccuggccag

SEQ ID NO: 101207 - RNA, 42 nt, Mus musculus
agagguacaggcuaucauggcagagagggccuggcggugugu

SEQ ID NO: 101208 - RNA, 41 nt, Mus musculus
ucuccccguccugcaaagcaguaccaagaaugcuagggcuc

SEQ ID NO: 101209 - RNA, 36 nt, Mus musculus
uuuuaaugguuuuagaguuuuauuguagaaaggcgg

SEQ ID NO: 101210 - RNA, 46 nt, Mus musculus
cugacuccaaauuucaugcucaguuuuccauaggcuuucccugggg

SEQ ID NO: 101211 - RNA, 29 nt, Mus musculus
agcuguaauccuagcacuugggaggcaua

SEQ ID NO: 101212 - RNA, 41 nt, Mus musculus
ugugcaagcgagcuuucuguuacuaggacaaagugccccag

SEQ ID NO: 101213 - RNA, 45 nt, Mus musculus
cuaagguguacauaaacuuggacaaagaaacaaaaacggggacau

SEQ ID NO: 101214 - RNA, 48 nt, Mus musculus
gguguaugaugaaaaagacuacaggaggauucguuuuguagaucguca

SEQ ID NO: 101215 - RNA, 48 nt, Mus musculus
gguuugauccccagcacugcacaaauuguuaagcccaauccucaguua

SEQ ID NO: 101216 - RNA, 46 nt, Mus musculus
cacaaccccuucauccagaagaaugaaaucagagaauccugacuca

SEQ ID NO: 101217 - RNA, 54 nt, Mus musculus
gggcacaguggcucaugccugaaaucucaacauuuggagcaucugggagcagca

SEQ ID NO: 101218 - RNA, 46 nt, Mus musculus
guucaaggccagcuugggcugugugagacccugaugagagagagag

SEQ ID NO: 101219 - RNA, 45 nt, Mus musculus
agcaaagccaggagggcagugccagggcuucaggaaaugggcaaa

SEQ ID NO: 101220 - RNA, 44 nt, Mus musculus
gcagccuugaccaagagaggaagaaauaaaggcuuaaagacaaa

SEQ ID NO: 101221 - RNA, 46 nt, Mus musculus
cacacagucugcacguagcugggaccaaauaucuuccuaaccucaa

SEQ ID NO: 101222 - RNA, 42 nt, Mus musculus
cccuaagacaaagcagggccgcugugagccaguccgcgaggg

SEQ ID NO: 101223 - RNA, 45 nt, Mus musculus
uucacuagcaaggucacuguggaguugucaaggccagacuuuugg

SEQ ID NO: 101224 - RNA, 42 nt, Mus musculus
ccggccggggucggacgcggcgagucaguuuucucccagcgg

SEQ ID NO: 101225 - RNA, 45 nt, Mus musculus
guguucaacuugaacacuuacgcuuuuauuuuuaaucggugugag

SEQ ID NO: 101226 - RNA, 38 nt, Mus musculus
uaauaaaagaucauuuauuuaauguguuguaagcuacu

SEQ ID NO: 101227 - RNA, 45 nt, Mus musculus
uaacaaaaagccaaaauacccuugagcuggugauuaaucugucag

SEQ ID NO: 101228 - RNA, 45 nt, Mus musculus
cacuuaaagaauguauaugagcuuagaagauaaaggaccaaaggg

SEQ ID NO: 101229 - RNA, 45 nt, Mus musculus
ugaagagacauuuagcacauuuuucuauuuaaaagagacucagag

SEQ ID NO: 101230 - RNA, 46 nt, Mus musculus
ugcugacaagauuugccucugcacaguuucccaauggcccucaauu

SEQ ID NO: 101231 - RNA, 46 nt, Mus musculus
acaggagccauccuggcagcaagaaauggaccgguagccaugguug

SEQ ID NO: 101232 - RNA, 46 nt, Mus musculus
uggcggcaucuuccaggccuucaaagguuuucgaaauucuccagug

SEQ ID NO: 101233 - RNA, 44 nt, Mus musculus
uuacauguaauaaauaaguaaaucuuaaaaaaaaaaaaaggcag

SEQ ID NO: 101234 - RNA, 44 nt, Mus musculus
acuuagaaggaugcuccgagaaugacauuacucauacauacaug

SEQ ID NO: 101235 - RNA, 46 nt, Mus musculus
uaacuauuuucaguggccaggagguagccuccaugauuggcagcag

SEQ ID NO: 101236 - RNA, 23 nt, Mus musculus
cuuauaaugauucugaagcaguu

SEQ ID NO: 101237 - RNA, 45 nt, Mus musculus
ucaaacaguuugaagcaacguaaagauuagagauguggggugggg

SEQ ID NO: 101238 - RNA, 45 nt, Mus musculus
ucuagaguuuugcacuuuacagaauaucuauuagcuaacuauuga

SEQ ID NO: 101239 - RNA, 42 nt, Mus musculus
ggagggcuuuuguccugugugagggagggcuguuguccugug

SEQ ID NO: 101240 - RNA, 42 nt, Mus musculus
ggagggcuguuguccugugugagggagggcuguuguccugug

SEQ ID NO: 101241 - RNA, 42 nt, Mus musculus; identical to SEQ ID NO: 101239

SEQ ID NO: 101242 - RNA, 45 nt, Mus musculus
gaucuguuucccagcuguauguucuauugacacuggagccccaaa

SEQ ID NO: 101243 - RNA, 46 nt, Mus musculus
uccugauuugugagcuccaggagagcagaggcuggcugggugggug

SEQ ID NO: 101244 - RNA, 46 nt, Mus musculus
cuugaaggagcauaagcuugaagcccuaugacauugccuaaagugu

SEQ ID NO: 101245 - RNA, 46 nt, Mus musculus
cuuuagagaaccugauucucuuuaaacacuucccaaagagccccau

SEQ ID NO: 101246 - RNA, 46 nt, Mus musculus
auaggaacuuuuguuuacauacaacucuggcuuuaaaggguuguaa

SEQ ID NO: 101247 - RNA, 46 nt, Mus musculus
uugacagugaggauuagcauauaaauauguucauauuccaagagag

SEQ ID NO: 101248 - RNA, 41 nt, Mus musculus
ucgaaaaacaaaaaccaaccaaacaaacaaaaaagggggau

SEQ ID NO: 101249 - RNA, 46 nt, Mus musculus
cccgccucuguguguguguguguguguguguccuggcugccccauc

SEQ ID NO: 101250 - RNA, 41 nt, Mus musculus
gagccccaggaacccuucuagcucugucucucuuacuugga

SEQ ID NO: 101251 - RNA, 41 nt, Mus musculus
ggcaggagaggugguagggaggggaacaggagugggggaca

SEQ ID NO: 101252 - RNA, 42 nt, Mus musculus
uggggggcaucucugcgaugagccagagaccuagacggggag

SEQ ID NO: 101253 - RNA, 44 nt, Mus musculus
aauugucuguuuguauuugucuagccuucuguguuuagcuucug

SEQ ID NO: 101254 - RNA, 41 nt, Mus musculus
aggcuuagguccagguuccucacuccaauuaguggccgugu

SEQ ID NO: 101255 - RNA, 46 nt, Mus musculus
aagaacagccagugcucuuaacuguugagccaucugagggucucuu

SEQ ID NO: 101256 - RNA, 46 nt, Mus musculus
gagcagaaacugcuauuaacugcugagccaucuccccagcccccua

SEQ ID NO: 101257 - RNA, 43 nt, Mus musculus
acuguucauuuaaacaaaaagaccauuucucaauucaaaucgg

SEQ ID NO: 101258 - RNA, 42 nt, Mus musculus
uuuuaagauccucgugucuuccaugcccccacucccagcuaa

SEQ ID NO: 101259 - RNA, 42 nt, Mus musculus
uguguggguggugcuggcccugugugggugauucugagguuu

SEQ ID NO: 101260 - RNA, 46 nt, Mus musculus
ugaaaagcuuuugguguguauguggcaugugugcauggugugugug

SEQ ID NO: 101261 - RNA, 45 nt, Mus musculus
agacucucaggacucaaagggaggggccuuagaugaaaugcccaa

SEQ ID NO: 101262 - RNA, 46 nt, Mus musculus
uccauuuuaaaauaaaaauauucugacaagucuuuauugcguccua

SEQ ID NO: 101263 - RNA, 45 nt, Mus musculus
uacgcugugcucagcaugcaccagcagcugcagcgaaaguaccag

SEQ ID NO: 101264 - RNA, 66 nt, Mus musculus
acugacaagaugaagaaucggguaggggguguaaaagcugcaucaacauaauggcccagaaagaac

SEQ ID NO: 101265 - RNA, 92 nt, Mus musculus
ggagggugcaugcguguggaggccagaggcugacacagggacugauuguucuucaccugauuuuuuaaggcagggucuuuuacugguccugg

SEQ ID NO: 101266 - RNA, 49 nt, Mus musculus
aggggcauggcugcauaacagaagggaagauuucgugaaggaagaugga

SEQ ID NO: 101267 - RNA, 46 nt, Mus musculus
agagcagccagugcucuuagccaugaagccaacucuuuagccccac

SEQ ID NO: 101268 - RNA, 46 nt, Mus musculus
ugcuuuuguuuuguuuuuacaggguuuuauuuuuaauuauguguau

SEQ ID NO: 101269 - RNA, 45 nt, Mus musculus
accaaaaccagaaaauaacagacuaggcuaccauuauucgcaaag

SEQ ID NO: 101270 - RNA, 46 nt, Mus musculus
aucuuaacuuaaggcuccuuuuguuacuggugcuggcauuugggag

SEQ ID NO: 101271 - RNA, 45 nt, Mus musculus
ucugcgcuguagcugcuuugcccucguuauuuaugaaccgugcca

SEQ ID NO: 101272 - RNA, 46 nt, Mus musculus
accagcaagcauaauuacugggauugaccuuaaaauuaguguuuuu

SEQ ID NO: 101273 - RNA, 45 nt, Mus musculus
caaagcaagaacauuugccuuggagaacucauuuuccagaguugg

SEQ ID NO: 101274 - RNA, 45 nt, Mus musculus
gaccagccuagucuguguagccaguuccaggcuggccagagcuac

SEQ ID NO: 101275 - RNA, 32 nt, Mus musculus
gcucuggguucaaagaguucugaagggccaag

SEQ ID NO: 101276 - RNA, 81 nt, Mus musculus
aagacugagaggagaggaaacauugaccagaaaaaugagauaacagugaggagaaggggaacaaguguggugacacaggac

SEQ ID NO: 101277 - RNA, 45 nt, Mus musculus
auguuucugaccagaaaaagcagcauugagugcugaggauaaggc

SEQ ID NO: 101278 - RNA, 42 nt, Mus musculus
ucauuuggcuaggccuaggcuaccugcuacucacguguggag

SEQ ID NO: 101279 - RNA, 46 nt, Mus musculus
ggggagugggaggcugacccugaggacgacgagggaagaucugaag

SEQ ID NO: 101280 - RNA, 46 nt, Mus musculus
ggccagaagguuuggaauccagccuuuggaaaugcuaggggccgag

SEQ ID NO: 101281 - RNA, 45 nt, Mus musculus
uugagcuggaaguagcaacccaaaauagguagguagagcuuguuu

SEQ ID NO: 101282 - RNA, 45 nt, Mus musculus
uuuuggaaugugugaguucuuacagugcucugagacaacgcugag

SEQ ID NO: 101283 - RNA, 45 nt, Mus musculus
gauggagagagaaggcuguuucccugagcagagacaaguagccag

SEQ ID NO: 101284 - RNA, 44 nt, Mus musculus
ugguugugagccacuuugugguugcugggauuugaacucaggac

SEQ ID NO: 101285 - RNA, 46 nt, Mus musculus
caagaaggucgugaguuugaagucaucuuggacuaugugugucuuu

SEQ ID NO: 101286 - RNA, 46 nt, Mus musculus
uguuuguuuugggguuuugcuuuuguauuuuggugugugugugugu

SEQ ID NO: 101287 - RNA, 46 nt, Mus musculus
agagagaggagaaaaggagcaagaagcuucaaagaggcagcugcug

SEQ ID NO: 101288 - RNA, 45 nt, Mus musculus
cuaaucacuaauaaagauaauauccuacaggcuugccuccagcca

SEQ ID NO: 101289 - RNA, 46 nt, Mus musculus
aaaauuauaaaauguugaaaaaaaucaaaauauacuguguucauag

SEQ ID NO: 101290 - RNA, 42 nt, Mus musculus
accuaauguacaaagcacaaggagcggagggucaggccuguc

SEQ ID NO: 101291 - RNA, 42 nt, Mus musculus
cagcugcguucccaccucaggugagcccccaggaagaggugc

SEQ ID NO: 101292 - RNA, 46 nt, Mus musculus
aucucuccucucucucucuucuuccugcaacuugauagagaugccu

SEQ ID NO: 101293 - RNA, 45 nt, Mus musculus
gaucuccucgcacacgcgcuuguugguguggaagucauuacccag

SEQ ID NO: 101294 - RNA, 42 nt, Mus musculus
gacccgggcagccuucuucacggucuuggugcgaacgcggcc

SEQ ID NO: 101295 - RNA, 42 nt, Mus musculus
gaaagccgcuuccgccuggcucgcgagagucccacagcggcc

SEQ ID NO: 101296 - RNA, 80 nt, Mus musculus
ucucuguguuuguuuuuucuccaucuuuuucaaagaggguugcuagcccacggaaugguggguagauauggaaggagaaa

SEQ ID NO: 101297 - RNA, 45 nt, Mus musculus
gucauucacucacaaagacacgaacauacauauauauaaagcuua

SEQ ID NO: 101298 - RNA, 23 nt, Mus musculus
ucuuaagcaagaucugagcuccc

SEQ ID NO: 101299 - RNA, 46 nt, Mus musculus
aaauauugacuaucuauugccuuguuagaaaaggaugagauuucag

SEQ ID NO: 101300 - RNA, 46 nt, Mus musculus
ugaagucaagcugacucugccuuuagccuccuacaugaaaagguag

SEQ ID NO: 101301 - RNA, 46 nt, Mus musculus
cgaccuccaugacuuccguagaggacucuccaaguuaggcacagau

SEQ ID NO: 101302 - RNA, 42 nt, Mus musculus
aaucauaccucagcucauguccgagugugaauaugucucuga

SEQ ID NO: 101303 - RNA, 47 nt, Mus musculus
caaaaguguucucuuuauaucuuuuaaagauucucuggaacauuucg

SEQ ID NO: 101304 - RNA, 45 nt, Mus musculus
cacaaccauccguaacaagaucugacucccucuucuggaguaucu

SEQ ID NO: 101305 - RNA, 94 nt, Mus musculus
uacauaauuuaaauaaauuacuugaaacuagaauauuggccaggcauaaugggaaguacguguaaucccagcacuugagggagacagacaacau

SEQ ID NO: 101306 - RNA, 48 nt, Mus musculus
uuauaaagaacguguuucaaauuaguccuuuucugagauguuuuaaga

SEQ ID NO: 101307 - RNA, 41 nt, Mus musculus
uccuggauagccaaggcuauauguuguguccggccagcaga

SEQ ID NO: 101308 - RNA, 46 nt, Mus musculus
gacucuucccauucaaagugggugccuaguugccuaaauccaagau

SEQ ID NO: 101309 - RNA, 42 nt, Mus musculus
uugccagaauauggauaauuguagccuaugcugggcccagac

SEQ ID NO: 101310 - RNA, 46 nt, Mus musculus
ggagcacggugguggcuaguuucugcauguaggcccaguuuaguga

SEQ ID NO: 101311 - RNA, 46 nt, Mus musculus
ugagaaauagaaacgauaaaguagacugugggaacaaguccuaagc

SEQ ID NO: 101312 - RNA, 46 nt, Mus musculus
aggagcuaccugaauacauaaccaaauuaucagugaccugugccag

SEQ ID NO: 101313 - RNA, 46 nt, Mus musculus
aaauacauuugaaagugcaaauaguacaucuuaaauuguuggcuag

SEQ ID NO: 101314 - RNA, 46 nt, Mus musculus
uauuguacauaugguuaaacuuuacacauggccuuaaaacugaaag

SEQ ID NO: 101315 - RNA, 45 nt, Mus musculus
gaagagaggccaaaguguuuggcuuuuugggucuguccuuuuuag

SEQ ID NO: 101316 - RNA, 46 nt, Mus musculus
uagccacauccuccuuccugcccgucacaacaaagacaggcuccuc

SEQ ID NO: 101317 - RNA, 46 nt, Mus musculus
gucuauacaauucaaggaacuucuacauaguaaguauaggcauuag

SEQ ID NO: 101318 - RNA, 46 nt, Mus musculus
agucucaaugccauaauaccugggcagucacaggaaagaggugagu

SEQ ID NO: 101319 - RNA, 46 nt, Mus musculus
uaaggaguuuugaacguguuaaccaugaugcaaugacugguaguag

SEQ ID NO: 101320 - RNA, 45 nt, Mus musculus
aggcuggauggccaguaaaccccaagaacccacuuguccccagau

SEQ ID NO: 101321 - RNA, 45 nt, Mus musculus
aaugguuucugccauuuauuaugcaucucacuucagcacaggcuc

SEQ ID NO: 101322 - RNA, 46 nt, Mus musculus
gccgauucacagcauggucucagaacuauccuccaugcccugagau

SEQ ID NO: 101323 - RNA, 45 nt, Mus musculus
cucacuguuaacuugggugcugcucauuauaaaccuggggccuua

SEQ ID NO: 101324 - RNA, 46 nt, Mus musculus
auccaaaccccaggcaacagggcagcagcaagaaaaccugacagau

SEQ ID NO: 101325 - RNA, 48 nt, Mus musculus
aagcuuaauauggagacaaaaccagagagagagagagagagagagaga

SEQ ID NO: 101326 - RNA, 46 nt, Mus musculus
cagggcguuuaccaaauucaccauugguuucgguguuggggaaggu

SEQ ID NO: 101327 - RNA, 46 nt, Mus musculus
auucuugcucugaagcaaaaugcgcaauucaaccaucucaucagua

SEQ ID NO: 101328 - RNA, 46 nt, Mus musculus
cauucugucaaaaccaccucuuccccucauggggaaucccacaggu

SEQ ID NO: 101329 - RNA, 59 nt, Mus musculus
caggccuuccucuucugucauaagccauuagaucucccccucuggguggugguggagga

SEQ ID NO: 101330 - RNA, 46 nt, Mus musculus
caucauuucuucuggaacaugagucauaaauagcugugaguuugug

SEQ ID NO: 101331 - RNA, 46 nt, Mus musculus
gucuucuuaguuucacauauccuuugugacauguguacacacacac

SEQ ID NO: 101332 - RNA, 46 nt, Mus musculus
ggaagagaacucuguacuuuagauaaacaugcacacauguacacag

SEQ ID NO: 101333 - RNA, 57 nt, Mus musculus
acuguuaguggggaggacuguuaguggggaggacuguuaguggggaggacuguuagu

SEQ ID NO: 101334 - RNA, 45 nt, Mus musculus
cacucuaaaauuccauuuucccucugguauuauuccucugagcau

SEQ ID NO: 101335 - RNA, 46 nt, Mus musculus
cuaauucaacaaaaauaacgacauacaaaaagguagcuacauccau

SEQ ID NO: 101336 - RNA, 45 nt, Mus musculus
ucuuuuuaauuaaugaaagguuaccucaguuuucccuccuuuaga

SEQ ID NO: 101337 - RNA, 51 nt, Mus musculus
aauucugugaauuagcacuccccacgcuccacccccaccccagccccuaua

SEQ ID NO: 101338 - RNA, 98 nt, Mus musculus
gggugcagccuucagacacggcgcaggccgaguuccucagccucucccugugguccgacaucuuggcgcucccaucugggugcugcgccagaucccug

SEQ ID NO: 101339 - RNA, 47 nt, Mus musculus
cacugggucaagagcacgcaggccgacaccacacucauggcaccucc

SEQ ID NO: 101340 - RNA, 43 nt, Mus musculus
cccgcgcuccucuaggagcagaggauuuugauuucaaaggaag

SEQ ID NO: 101341 - RNA, 41 nt, Mus musculus
agaagacuucagggcucuugagagagugcuuuacugggagg

SEQ ID NO: 101342 - RNA, 46 nt, Mus musculus
ccccccucaaaaaaaaccucccaacccccuacccauccagcaguga

SEQ ID NO: 101343 - RNA, 42 nt, Mus musculus
cacugucuggcgacuauacaaggcacucggaugggggcauag

SEQ ID NO: 101344 - RNA, 46 nt, Mus musculus
ucaaacucagaaaucugccugccucugccuccugagugcugugauu

SEQ ID NO: 101345 - RNA, 28 nt, Mus musculus
auuuuauuuucuauuuuacaagauuuug

SEQ ID NO: 101346 - RNA, 45 nt, Mus musculus
ccaggcauagcucccaucccggagcaugaagauggcgcggucgga

SEQ ID NO: 101347 - RNA, 42 nt, Mus musculus
cgugaaucugcccacucugcauaacgaguuugcuguccagau

SEQ ID NO: 101348 - RNA, 45 nt, Mus musculus
ccacucugguggcaaaggaccauguccguccuccauccuucagaa

SEQ ID NO: 101349 - RNA, 46 nt, Mus musculus
uuuauucaccagucuuugauuaaauaaaaaggaaaacucgaaaaaa

SEQ ID NO: 101350 - RNA, 46 nt, Mus musculus
cuuugagauuacuguucauuggucugugugugcacaauaugaagaa

SEQ ID NO: 101351 - RNA, 45 nt, Mus musculus
guguuucuauaaaauggugcugaucagagaccacacaugaucagu

SEQ ID NO: 101352 - RNA, 86 nt, Mus musculus
caaacaccaaaucuuacuaaauaauuaaauuugccacccuccuguuuuugucagcuucaguaucagauacgacacagcagccaucu

SEQ ID NO: 101353 - RNA, 46 nt, Mus musculus
uacuuauuuuguaaacaaggcucaaacagcaauccucuggguacug

SEQ ID NO: 101354 - RNA, 46 nt, Mus musculus
uuuugagguagguuauauacucuaucucuggugcacucaggaagac

SEQ ID NO: 101355 - RNA, 46 nt, Mus musculus
ugacuccugggagaggcucugguugugauuuuaaagugggcaaguu

SEQ ID NO: 101356 - RNA, 46 nt, Mus musculus
ggguuuccuauucugaaacugcaggcuacuucaggaaagacaagau

SEQ ID NO: 101357 - RNA, 45 nt, Mus musculus
cuguuuaagaaugguggauaaagaaauaaaauuuccuccuggaga

SEQ ID NO: 101358 - RNA, 45 nt, Mus musculus
acagaaucuucgacaaaucagauguaaguuucaguuucacccaag

SEQ ID NO: 101359 - RNA, 46 nt, Mus musculus
cacugugucccuguuucguuucuguuuccaugaucuguccauuugu

SEQ ID NO: 101360 - RNA, 41 nt, Mus musculus
ugauuguuuugauguguucuuggauucagauagggggaauu

SEQ ID NO: 101361 - RNA, 44 nt, Mus musculus
uuccuuaguuacuuucucuagcuccuacauuggaggcccuguga

SEQ ID NO: 101362 - RNA, 45 nt, Mus musculus
aaugaacaaagauuaaaguugcaguugagaguugaacgguuugau

SEQ ID NO: 101363 - RNA, 46 nt, Mus musculus
ggauaucccaggagcaauuaguuuugagagggagguuagcagagaa

SEQ ID NO: 101364 - RNA, 84 nt, Mus musculus
cucuagccuguuacagaaaaaugauguugagugaggcagaggugauaauguaaaauuugaaaaaauauuuggaagguguagaua

SEQ ID NO: 101365 - RNA, 46 nt, Mus musculus
uaaauaauauagauauccuuuacuucuugcccugucaguacuugac

SEQ ID NO: 101366 - RNA, 46 nt, Mus musculus
gcccagguguuuaacaccauucugggcaucagaacaagccccuauc

SEQ ID NO: 101367 - RNA, 45 nt, Mus musculus
uagggcaaacuauacagacaauuuaaggcuccucuugggcaaggg

SEQ ID NO: 101368 - RNA, 46 nt, Mus musculus
aucuucaaagacagaacaguagcaaugguagaauaagcccaccugg

SEQ ID NO: 101369 - RNA, 45 nt, Mus musculus
ugcuuugcuccacuggcugcggauuuuauggaaacccucguacaa

SEQ ID NO: 101370 - RNA, 46 nt, Mus musculus
ucagaaucucagauuauauucccagcuaacguguaaaguagcaucc

SEQ ID NO: 101371 - RNA, 46 nt, Mus musculus
uucucuugcauucucagacuaugcaaucuugaauuuuuauauagau

SEQ ID NO: 101372 - RNA, 46 nt, Mus musculus
gagagagagagaauaucugacaaacaauaagacugaugaaccagug

SEQ ID NO: 101373 - RNA, 44 nt, Mus musculus
ucucucucucucuucccccucucccccucccuucucccccuccc

SEQ ID NO: 101374 - RNA, 42 nt, Mus musculus
aagcuacaagguggcucugagauaagacagggaggcacagag

SEQ ID NO: 101375 - RNA, 45 nt, Mus musculus
ggggaaacauauguaagaagguaauacaacagaaaacagguaaug

SEQ ID NO: 101376 - RNA, 46 nt, Mus musculus
cuuauuuugaagacaauugguacaaaaccaagaucuguuuugagag

SEQ ID NO: 101377 - RNA, 45 nt, Mus musculus
uuugccaaccucauucuagaguaauugaaaauacaacucugagaa

SEQ ID NO: 101378 - RNA, 42 nt, Mus musculus
gaagccuuuggaguguggucucuaaagccagacuagggagaa

SEQ ID NO: 101379 - RNA, 40 nt, Mus musculus
uuagauugcuguuuauuuuacaguuaauuucagccaacua

SEQ ID NO: 101380 - RNA, 41 nt, Mus musculus
ucuugaacuguggugaaguguggggaagguuguaccaguuc

SEQ ID NO: 101381 - RNA, 46 nt, Mus musculus
ugugugucccucuguccuuacugguaucauacaggguuguuaagug

SEQ ID NO: 101382 - RNA, 46 nt, Mus musculus
ccauacaaaaauuaacggugggaaagauguugguuuuuugagagug

SEQ ID NO: 101383 - RNA, 42 nt, Mus musculus
uacuuaaauggcuuuuggguaccauuaaauucuugaagagaa

SEQ ID NO: 101384 - RNA, 46 nt, Mus musculus
aauagacauuuucauaagugcagugaacuaaauauggacccaagac

SEQ ID NO: 101385 - RNA, 45 nt, Mus musculus
aaaaguagggugugugugugugugugugugugugugugugugugc

SEQ ID NO: 101386 - RNA, 46 nt, Mus musculus
uggcaagcugaaaugaguugggaugaugguuuucuaggcccaguaa

SEQ ID NO: 101387 - RNA, 45 nt, Mus musculus
uguacaaaguaauugggucacugaggucauaauuaggucagaagg

SEQ ID NO: 101388 - RNA, 46 nt, Mus musculus
auucauauaucagaaucugucuccuucugucauugcuuggucauuu

SEQ ID NO: 101389 - RNA, 46 nt, Mus musculus
auaaaaaaggaucuaaauagaggagcaagauuuugaucagagagag

SEQ ID NO: 101390 - RNA, 45 nt, Mus musculus
ugcuagugguauucuugucuugauguuuguuuccagaaagucaga

SEQ ID NO: 101391 - RNA, 46 nt, Mus musculus
cacgcaguuuguucuuagcaaaauuuauagugaauuuuguguagau

SEQ ID NO: 101392 - RNA, 45 nt, Mus musculus
agaugauuuuauugucuaauauguguauauguguucagcaggugg

SEQ ID NO: 101393 - RNA, 45 nt, Mus musculus
auuguagaugcucaguagccauuggcuuacacuggauaggagaga

SEQ ID NO: 101394 - RNA, 46 nt, Mus musculus
cuggaguuuguaaguauaagaaugguaggcaauuaaagcaacagac

SEQ ID NO: 101395 - RNA, 46 nt, Mus musculus
cccaaucuccaccucauuguggauacuuuuggauuugcacacaaac

SEQ ID NO: 101396 - RNA, 46 nt, Mus musculus
acagaaguccggugaccagacuucaucgucaguuuccauguaaaga

SEQ ID NO: 101397 - RNA, 46 nt, Mus musculus
uguaagagcagaacuggaucuucacgucucaauucucucucuagua

SEQ ID NO: 101398 - RNA, 48 nt, Mus musculus
ucucauggagcuggaguuacaggugguugugagcugccuagugugagu

SEQ ID NO: 101399 - RNA, 80 nt, Mus musculus
ggcagugaaauauauuuugauuuaaccuaagaugcaguacuuugaauaugcggugaaugugagagauuauuugugggcua

SEQ ID NO: 101400 - RNA, 46 nt, Mus musculus
acaguuuuacugugguuuauauaaccuacacugguugugccaauag

SEQ ID NO: 101401 - RNA, 53 nt, Mus musculus
caagaacuuuuacccacuuaagccaucuugccagcccugaauguguuuauaga

SEQ ID NO: 101402 - RNA, 46 nt, Mus musculus
uaugugauaugauguaaagugaagugaaauguguguauguagaggu

SEQ ID NO: 101403 - RNA, 42 nt, Mus musculus
caaauacacaguuagaaacaucauaaacaaugggagcugcag

SEQ ID NO: 101404 - RNA, 46 nt, Mus musculus
uuuuaggauauuaucaacuguguugaagguuccugucaaaggagag

SEQ ID NO: 101405 - RNA, 42 nt, Mus musculus
cgcauauuaucagcuguguugaagguuccugucaaaggagag

SEQ ID NO: 101406 - RNA, 46 nt, Mus musculus
agaauuacuuucauauuucaauauaaaaagaaugaguacuugucag

SEQ ID NO: 101407 - RNA, 38 nt, Mus musculus
agacgucaacuucagccacguggggacgcuacggcggu

SEQ ID NO: 101408 - RNA, 48 nt, Mus musculus
ccuucccgggagcgugcaugcgacccaugauggcggaggucuggcagc

SEQ ID NO: 101409 - RNA, 49 nt, Mus musculus
uuuguaguuucaucuugugacucuuagucuaaaucuaucagcgaggaga

SEQ ID NO: 101410 - RNA, 46 nt, Mus musculus
acuaacaagaaucauacauucuaguaaauguuauguaaacagaauc

SEQ ID NO: 101411 - RNA, 41 nt, Mus musculus
auauugauauuuuuguaaugugugguuauuaugcuuccaga

SEQ ID NO: 101412 - RNA, 44 nt, Mus musculus
ucuucuugccagcaccaauggucuuuuugcacucauuguaggag

SEQ ID NO: 101413 - RNA, 55 nt, Mus musculus
guuagaaucacgccucuuaaauaugcccagauuugcuauuggauuaaaggaaacu

SEQ ID NO: 101414 - RNA, 46 nt, Mus musculus
auucuaacugccacguugaaauccuguggagagccauucaugucca

SEQ ID NO: 101415 - RNA, 46 nt, Mus musculus
ugacgcccagcccggggccagugguucaggggucuaugugaggaug

SEQ ID NO: 101416 - RNA, 60 nt, Mus musculus
cucuuccacauccucacauagaccccugaaccacuggccccgggcugggcgucacacugc

SEQ ID NO: 101417 - RNA, 42 nt, Mus musculus
cgggccggucauugucauaaccagagaaguggauccugcccc

SEQ ID NO: 101418 - RNA, 51 nt, Mus musculus
auuaugacuacgcccugcuggaacucaagaaaccccacaaaagacaguuca

SEQ ID NO: 101419 - RNA, 26 nt, Mus musculus
gucccuuucacauagguuuucccauc

SEQ ID NO: 101420 - RNA, 51 nt, Mus musculus
cacagggagaucucgcaggaagaggcagauuuauggcuacgauggcagguu

SEQ ID NO: 101421 - RNA, 53 nt, Mus musculus
uuuccuaugaaacccuuuaugccaauggcagccgcacagagacucgggugggc

SEQ ID NO: 101422 - RNA, 45 nt, Mus musculus
uuuugaaggcacuacauucauuuuuuuucugagugugccauaaau

SEQ ID NO: 101423 - RNA, 45 nt, Mus musculus
aauauacauuaucuuacugagucuguggaaccacacugccauaug

SEQ ID NO: 101424 - RNA, 23 nt, Mus musculus
aauguguaagcauugauagcauu

SEQ ID NO: 101425 - RNA, 47 nt, Mus musculus
uaaguaaaaauaccuugugaugcaugauacauucuaguaauccaaca

SEQ ID NO: 101426 - RNA, 44 nt, Mus musculus
uuuacuaaaaaccuguuugaaaaaaaauuuuuuuaauuguaugg

SEQ ID NO: 101427 - RNA, 46 nt, Mus musculus
cauagucuuaaguguucguuuuagcuguugaaagcugaggcucuag

SEQ ID NO: 101428 - RNA, 45 nt, Mus musculus
cugugagcaacugcaugaguuugugagacuuagguaaaaggcaau

SEQ ID NO: 101429 - RNA, 42 nt, Mus musculus
ucuucacucacaguccaggugcuuuuucuuggggcccaugau

SEQ ID NO: 101430 - RNA, 45 nt, Mus musculus
gcucgaccaggcacaggagccaucgugcagauaagacgcagggag

SEQ ID NO: 101431 - RNA, 45 nt, Mus musculus
ugacaagaagucaaaggaacuuaacggaagcuagaauggcaaaga

SEQ ID NO: 101432 - RNA, 46 nt, Mus musculus
guaacuuuucaaaacaugcugaagugugaagggaggguuggaaccc

SEQ ID NO: 101433 - RNA, 46 nt, Mus musculus
aaauuacuugaaaugaugcauuucucuauuacauauagccugagau

SEQ ID NO: 101434 - RNA, 47 nt, Mus musculus
uaaaugcuaccauuuuaaagaugaaauuguuucuuacucaguucaaa

SEQ ID NO: 101435 - RNA, 47 nt, Mus musculus
uaaauguaauaugaauugacucaaaauuuauggacaauaaucacuuc

SEQ ID NO: 101436 - RNA, 47 nt, Mus musculus
aaguacacuguagcugccuucaaacacaccagaagagggcgucagau

SEQ ID NO: 101437 - RNA, 42 nt, Mus musculus
aauuccuauuguuccucauuacucaucacugaaggcccaguu

SEQ ID NO: 101438 - RNA, 62 nt, Mus musculus
ggacgguagguaaggaggcugggaggagagggagggaagagaggagagagagaaggagggaa

SEQ ID NO: 101439 - RNA, 46 nt, Mus musculus
ggcaugaugucacacacguguaacucaauuacucuggccaccagaa

SEQ ID NO: 101440 - RNA, 46 nt, Mus musculus
acaggggaaugccagggccaagaagugggagugggugggcugggga

SEQ ID NO: 101441 - RNA, 42 nt, Mus musculus
ccuuaaacucaggugaaccuuaaacucagucuugccucagca

SEQ ID NO: 101442 - RNA, 46 nt, Mus musculus
cucuagcuguauauguagaugaggaugaccuagauggucaccaaug

SEQ ID NO: 101443 - RNA, 46 nt, Mus musculus
uuccaaaacagccaaagauacacaguaagaccuacaucauggagaa

SEQ ID NO: 101444 - RNA, 46 nt, Mus musculus
gaauacauuuuuaaacucaguacuuaggagguagaggcaggcagau

SEQ ID NO: 101445 - RNA, 46 nt, Mus musculus
aaguucuuagguuaaaucuucaguaccagaguaggucaggggagau

SEQ ID NO: 101446 - RNA, 46 nt, Mus musculus
uagggcagauggaauauagauuuuaguaaguaauaacucaggagua

SEQ ID NO: 101447 - RNA, 50 nt, Mus musculus
agagaggagagaagaaaaggaaggaggaagagauagaggaagggaaagaa

SEQ ID NO: 101448 - RNA, 68 nt, Mus musculus
gcaacaacaaauccaacuaauagcacuacuucaaaagauacacuuuaaagggaaagaggaaaggagac

SEQ ID NO: 101449 - RNA, 45 nt, Mus musculus
uagauaacacuggggaaaacuguaagaacaaaaacaccuucagag

SEQ ID NO: 101450 - RNA, 46 nt, Mus musculus
aacaagauggcugagcaugccacggaaaucucaggaguagguagac

SEQ ID NO: 101451 - RNA, 46 nt, Mus musculus
gucaacauuaaggccagcugaagaauguggcugugcaacuggagaa

SEQ ID NO: 101452 - RNA, 46 nt, Mus musculus
guuggcuaaagaugaauccaagucgucagacacuaauuuguuaggc

SEQ ID NO: 101453 - RNA, 46 nt, Mus musculus
uauuaagguugguugugucauuacagguacacuucccaucugagga

SEQ ID NO: 101454 - RNA, 45 nt, Mus musculus
ucccaucccgcugugggccuucauggguuacuggagcgcucuaau

SEQ ID NO: 101455 - RNA, 46 nt, Mus musculus
agagccucauccuagcugcuuugucuuccacuagcagucuucagau

SEQ ID NO: 101456 - RNA, 46 nt, Mus musculus
ccuacuuuacuucagacuguguuugcauccuaucuugggucuagac

SEQ ID NO: 101457 - RNA, 49 nt, Mus musculus
uauggguggucuguacccuauccuuuuggcuauacccgucaaugggggc

SEQ ID NO: 101458 - RNA, 42 nt, Mus musculus
aucagcauauauuggacuuaaugcugcuuuugggggccuaau

SEQ ID NO: 101459 - RNA, 45 nt, Mus musculus
gacucauguugucuuugauuauuauggggacauuaaccuuggcag

SEQ ID NO: 101460 - RNA, 44 nt, Mus musculus
uuagaaggggaugaagaguccugagauaagaaaauacaggggga

SEQ ID NO: 101461 - RNA, 46 nt, Mus musculus
caucaugggacaguacaacugaugguauacauuaacacugccaugg

SEQ ID NO: 101462 - RNA, 46 nt, Mus musculus
cuagaaaagggcauuagguccaguggaacuggaguugcagucagua

SEQ ID NO: 101463 - RNA, 36 nt, Mus musculus
auacauauacaguauuaaaacuugugauuuuuuuuc

SEQ ID NO: 101464 - RNA, 46 nt, Mus musculus
cccuuauguuuaauguguguuuuaaaacaugagugcagugccaguu

SEQ ID NO: 101465 - RNA, 44 nt, Mus musculus
cauugucaaaaacgaauugcaagaacccugugaaagucccaaag

SEQ ID NO: 101466 - RNA, 39 nt, Mus musculus
acucaacuagauuuucuucuaacuacacgauauuuaacg

SEQ ID NO: 101467 - RNA, 61 nt, Mus musculus
ugaacaguacugggaugaagaggaggaagaauggcacuuaaaaaaugcuauuagaguagac

SEQ ID NO: 101468 - RNA, 51 nt, Mus musculus
auuucauuuuaugauucuauuuuagaguugugaaaucugucaagaacaauu

SEQ ID NO: 101469 - RNA, 46 nt, Mus musculus
ccacugcagagguaaccgaggcuguugcucagccucccccugagga

SEQ ID NO: 101470 - RNA, 45 nt, Mus musculus
agcuagagaugauuaaauuggacauacagagugaaaugaagaggg

SEQ ID NO: 101471 - RNA, 46 nt, Mus musculus
ccaagguuaggaauucugacuucaacuuugcuaacuagcagcucuu

SEQ ID NO: 101472 - RNA, 46 nt, Mus musculus
uggauguuuuccugcauguauguauguauagcacgcguggguaguu

SEQ ID NO: 101473 - RNA, 45 nt, Mus musculus
gugguggugguaucagauuugagggcccuuugcuacagcaaggag

SEQ ID NO: 101474 - RNA, 41 nt, Mus musculus
gaggucagccuguaggaggacuuagauuugaagggggucau

SEQ ID NO: 101475 - RNA, 45 nt, Mus musculus
aguaggaacaccucugcgguuugaagggccaauuggucaaggagg

SEQ ID NO: 101476 - RNA, 46 nt, Mus musculus
guucucuucgguuugaugggucaccaggacaaauggggggaggagg

SEQ ID NO: 101477 - RNA, 46 nt, Mus musculus
ccagccaagaugauuuuugaaggaccuaauaaauuaagcccuagaa

SEQ ID NO: 101478 - RNA, 47 nt, Mus musculus
agaucaccauucaaugaucguuuuccacuuaagcgaccuagauauga

SEQ ID NO: 101479 - RNA, 48 nt, Mus musculus
aguaauuugcucucaaagugaaaugacaaguaccuugacaggauggga

SEQ ID NO: 101480 - RNA, 44 nt, Mus musculus
ucacacagcagugaagggaaaaugaacaagcuaaguggggcugg

SEQ ID NO: 101481 - RNA, 44 nt, Mus musculus
ucguacuuaugcugagaaucuuucaccccaugagggccggagaa

SEQ ID NO: 101482 - RNA, 45 nt, Mus musculus
aggacccagguucagcauucauuuccaagacuugaucucuuagau

SEQ ID NO: 101483 - RNA, 42 nt, Mus musculus
gcuggaaagaugcgucagucgggacuaaaacagucacauaug

SEQ ID NO: 101484 - RNA, 42 nt, Mus musculus
uaaaaucauaaauggcauuguccaaaaacaagacaugguuac

SEQ ID NO: 101485 - RNA, 46 nt, Mus musculus
caggauaaagcugagggcaaagaugaagauguaaaagaaaagagaa

SEQ ID NO: 101486 - RNA, 42 nt, Mus musculus
cuuacccaagaacaacuaauaaggcaacaguuacuggcaaaa

SEQ ID NO: 101487 - RNA, 45 nt, Mus musculus
aaaauuaugaggauaucuuuuguacccaaaguaguaguucaaaga

SEQ ID NO: 101488 - RNA, 46 nt, Mus musculus
uuucuaaaaaaucuccuuauauacauuacagugugaacaggcaaga

SEQ ID NO: 101489 - RNA, 46 nt, Mus musculus
gaugcuauauuuuaaaacuuguuauagaaaguaccaggugucugaa

SEQ ID NO: 101490 - RNA, 46 nt, Mus musculus
gagguguuuucugaaguaauucacacugagcaguagggcccuugaa

SEQ ID NO: 101491 - RNA, 42 nt, Mus musculus
uuauguaccuuauggauucuaucgugaaaaauguuggaagag

SEQ ID NO: 101492 - RNA, 42 nt, Mus musculus
uuucacgugguccuuucaaaucuuaauuuaaagagggggaaa

SEQ ID NO: 101493 - RNA, 45 nt, Mus musculus
ccuguuagcucaacauggcgccugcaaagcacaugaugcgaaagg

SEQ ID NO: 101494 - RNA, 45 nt, Mus musculus
uuucggaugggggaaauacuuagaggcaguugguguuuggggagc

SEQ ID NO: 101495 - RNA, 76 nt, Mus musculus
cuguauuguagcaugagucaguauguucuuuuuauggcuaaguaauauugugugugugugugugugugugugugug

SEQ ID NO: 101496 - RNA, 45 nt, Mus musculus
aucuuccuuuuuuggccaucuaugcuuauuuucuaauuugugaag

SEQ ID NO: 101497 - RNA, 46 nt, Mus musculus
cugaauguaauuuuuguccacauccaguaaaauaucugcuccugag

SEQ ID NO: 101498 - RNA, 46 nt, Mus musculus
uuucaacaacugcuagaaacuuguucagacuuucagagagugguag

SEQ ID NO: 101499 - RNA, 46 nt, Mus musculus
gaaaaagguauguuggauggguggagaacacggaaaaaucugggag

SEQ ID NO: 101500 - RNA, 45 nt, Mus musculus
caaacaagggucuuucuggccucaucugguuuuccccuggcuuuc

SEQ ID NO: 101501 - RNA, 46 nt, Mus musculus
gggaauuaaauaacuaaaacagaggaggagagccgugagcauaaag

SEQ ID NO: 101502 - RNA, 46 nt, Mus musculus
cacuaacuagagagucaucacuaucuccaggaauaagguaaaggag

SEQ ID NO: 101503 - RNA, 45 nt, Mus musculus
cacacacacacaugagagaaagagagagagacagagacagagaga

SEQ ID NO: 101504 - RNA, 46 nt, Mus musculus
ucuuaauucagugaaggaauuuuugcuaaggauguguaaaagccag

SEQ ID NO: 101505 - RNA, 45 nt, Mus musculus
gugggugaggaauggaaagaauugcagauguagagguuggggaaa

SEQ ID NO: 101506 - RNA, 42 nt, Mus musculus
cccuuuccuuacccucuaauugugaaagucugccggggccua

SEQ ID NO: 101507 - RNA, 46 nt, Mus musculus
aaugugacugcccuucaugaugguagccagcauuugaugucugcag

SEQ ID NO: 101508 - RNA, 86 nt, Mus musculus
ccagaaagaaaaugagaugaggaaauggagaaagcagcucagagaaagggaggacggagauaagggaaggcauggcacacaacaga

SEQ ID NO: 101509 - RNA, 45 nt, Mus musculus
agucauuuuccuagugauuuaaaaaugcagucuuugcaucggaga

SEQ ID NO: 101510 - RNA, 45 nt, Mus musculus
aaccacaguaguggaguguuuuuaaaucuuguuuuucgccuguag

SEQ ID NO: 101511 - RNA, 41 nt, Mus musculus
uccugaaacuccgcauccccuccccccugaaaucccggguc

SEQ ID NO: 101512 - RNA, 46 nt, Mus musculus
caggacaguuugugagauuacuguucugggguggagaaggugucag

SEQ ID NO: 101513 - RNA, 42 nt, Mus musculus
aggagaaaccucccauuuccaagguguccuuauccccagcag

SEQ ID NO: 101514 - RNA, 46 nt, Mus musculus
cccagcuuuccuucuguuuggaaaacagguagaaacaggccccaag

SEQ ID NO: 101515 - RNA, 45 nt, Mus musculus
ugcuauuggugucuguccugcgugagggaguuugggagggaggag

SEQ ID NO: 101516 - RNA, 46 nt, Mus musculus
uguuuuguuuuguuuuguuuuucuucugggccaacuuugggaguag

SEQ ID NO: 101517 - RNA, 42 nt, Mus musculus
gacagaguguccuggagccagacaguagaauaguauacaaag

SEQ ID NO: 101518 - RNA, 45 nt, Mus musculus
agaaaaggagaaagaaagaaaaaagcaagaaagagaagaagggaa

SEQ ID NO: 101519 - RNA, 28 nt, Mus musculus
guauauaaauaaauaauagaaagugcag

SEQ ID NO: 101520 - RNA, 46 nt, Mus musculus
agugcuuuucuguaaucucagcaacuugguguucugaggcaggaag

SEQ ID NO: 101521 - RNA, 45 nt, Mus musculus
ccacauuguuuugcuucuauaacacgagaacuggaagaggcagag

SEQ ID NO: 101522 - RNA, 46 nt, Mus musculus
aagguauuacuuuaaagauuuuacauauuuuuuucauguuugggag

SEQ ID NO: 101523 - RNA, 46 nt, Mus musculus
cccuuuauauccccauggguaacugcccacuuccccgucucugcuc

SEQ ID NO: 101524 - RNA, 44 nt, Mus musculus
ucauugcugaagcaaaacuuauuuucaaaauuaauuugugcucu

SEQ ID NO: 101525 - RNA, 45 nt, Mus musculus
acuaaguaucaaacgacaguggcaggaaugaguuucacgucccug

SEQ ID NO: 101526 - RNA, 45 nt, Mus musculus
aggcugaccucuguuuaagugcuggcucagcccucucugccugaa

SEQ ID NO: 101527 - RNA, 70 nt, Mus musculus
gcaguuuuaaaauauagcugugacaagcaaaugccugcccugugauugcacaaaaauuagucauuagaaa

SEQ ID NO: 101528 - RNA, 42 nt, Mus musculus
ggaggugaacagaggugagaucagccucagaaggcugacaag

SEQ ID NO: 101529 - RNA, 94 nt, Mus musculus
cugaucaguguguuuucaaacaucucugcuuaggauucugcaaagaguacagaggagagagagucacauuuucagaguaaaucccuuguggcag

SEQ ID NO: 101530 - RNA, 42 nt, Mus musculus
gcaaugcugcaggagccuacugugucuucucuuacaggugaa

SEQ ID NO: 101531 - RNA, 42 nt, Mus musculus
auaaagaauaaaggcuuaacuuuuuuuaauguuaucaggaag

SEQ ID NO: 101532 - RNA, 45 nt, Mus musculus
ccucucuucuucucuuaguuacacauauacaaguacaaagcgcag

SEQ ID NO: 101533 - RNA, 23 nt, Mus musculus
agcaagucucuuaagggaaaaug

SEQ ID NO: 101534 - RNA, 61 nt, Mus musculus
cagucauucacuuacucagccuuucaaguaguauuuauagagaacaucagauuuuccaggc

SEQ ID NO: 101535 - RNA, 45 nt, Mus musculus
uagagagugaucaaagaagcuauccagcugccuaccacaggcuag

SEQ ID NO: 101536 - RNA, 42 nt, Mus musculus
uaaccuguccuguguuccuagcaaacagggaaugaccgggug

SEQ ID NO: 101537 - RNA, 45 nt, Mus musculus
ugaccaguuucuaaagagaaugagagcugccgccggaggacuugg

SEQ ID NO: 101538 - RNA, 46 nt, Mus musculus
gucuaugugcagccucaguggggaugcagugacagccacacugcag

SEQ ID NO: 101539 - RNA, 46 nt, Mus musculus
gcuucacagagaaacccugucucaaaaaaaaaaaguaacaaggaaa

SEQ ID NO: 101540 - RNA, 45 nt, Mus musculus
ucuccugccugggcucugccuggaaaugcuaguccugaggcccca

SEQ ID NO: 101541 - RNA, 73 nt, Mus musculus
uccaucugcccaaugggaagaguuagcuaugacauccaaauacagaauauuauauagcuguucgauaaaguau

SEQ ID NO: 101542 - RNA, 45 nt, Mus musculus
cuaauaugucugugcauguaguuauguaguaucuuuagaagccag

SEQ ID NO: 101543 - RNA, 45 nt, Mus musculus
agucuggauggccacuaguggcuguucuguggaccagggaagaca

SEQ ID NO: 101544 - RNA, 46 nt, Mus musculus
guuagcaggucuuuggcuuuauccaggugguccaugagcuggaaaa

SEQ ID NO: 101545 - RNA, 46 nt, Mus musculus
gauagauugcaucuauuaguugcuucuugcugucaugaccugccag

SEQ ID NO: 101546 - RNA, 66 nt, Mus musculus
gguaggagucugucuauuccaaugggacuugaggaaacuugcccuaaaauaggugggcagcagagc

SEQ ID NO: 101547 - RNA, 41 nt, Mus musculus
gguucaauccucagcaccucagaaaacaaaauuaaagauga

SEQ ID NO: 101548 - RNA, 45 nt, Mus musculus
uagcacaaggccuacacaaguaacaccuuaaugagcgcuuagucu

SEQ ID NO: 101549 - RNA, 48 nt, Mus musculus
ucaaagcccagggaacaaguaagguaggccagcccauguaucucuuuu

SEQ ID NO: 101550 - RNA, 24 nt, Mus musculus
agugcucccgaaguuggaagggau

SEQ ID NO: 101551 - RNA, 45 nt, Mus musculus
gaaagcaaaaggaaaggaaggcaagguugaagaaaggaaaucaag

SEQ ID NO: 101552 - RNA, 44 nt, Mus musculus
uccaaucagaguggucauuuggcagcuauuucuucuaccuggaa

SEQ ID NO: 101553 - RNA, 45 nt, Mus musculus
ugggagccagaaagcuacaaauggugaguccauuuagcucuggag

SEQ ID NO: 101554 - RNA, 46 nt, Mus musculus
acuucuagaacaagaacuagauacauaaaguauaauaaugcaaaga

SEQ ID NO: 101555 - RNA, 46 nt, Mus musculus
agcaguccaugaaucuuccagaugugucagccauggaaaaguagag

SEQ ID NO: 101556 - RNA, 42 nt, Mus musculus
aggaugagggacaaggccuggacagaugccggaaaggaagag

SEQ ID NO: 101557 - RNA, 47 nt, Mus musculus
aguucacaauauauucuguccgacccgaugucagcacccauuuucug

SEQ ID NO: 101558 - RNA, 80 nt, Mus musculus
ugggaaaaauaaagacaauaaauagccucacaucacugcaggucagguuuugccaucaacugaguuauuaaaaaagagag

SEQ ID NO: 101559 - RNA, 42 nt, Mus musculus
ggaagcucauguuuucugugucuuaggccuucucucaucaga

SEQ ID NO: 101560 - RNA, 48 nt, Mus musculus
aaaaugugaguaagagaaaaaaagacuaaguguccaagaacccagauc

SEQ ID NO: 101561 - RNA, 46 nt, Mus musculus
gacaugauuaaccaucugcuguaaguuacccaaaaugcugacagag

SEQ ID NO: 101562 - RNA, 46 nt, Mus musculus
uacugguugucuaugggucucugcaucuguuucaguuagcugcugg

SEQ ID NO: 101563 - RNA, 46 nt, Mus musculus
caguggcugcauguccucacuccccaacccugaauauuacaagcug

SEQ ID NO: 101564 - RNA, 44 nt, Mus musculus
gugcugaaacagugagcuucagguucuaugacauauccugucuc

SEQ ID NO: 101565 - RNA, 42 nt, Mus musculus
aggaaggcagggagggaggcagggagggagggagggagggag

SEQ ID NO: 101566 - RNA, 46 nt, Mus musculus
aguccacccuguagcuuuccauauaggugaaauguaccaaaggaag

SEQ ID NO: 101567 - RNA, 45 nt, Mus musculus
augaaguguguguguguguguguguguguguguguguguauuacu

SEQ ID NO: 101568 - RNA, 45 nt, Mus musculus
guucuucugcugucguccauagcagaaagaacuugaaagcaaggu

SEQ ID NO: 101569 - RNA, 47 nt, Mus musculus
ugaaguagcaacaacaacaaaaaguuauuguugggagucaucauaac

SEQ ID NO: 101570 - RNA, 46 nt, Mus musculus
cucugcucuaaagaacaaaaccagcgaggcuucuugucccgagcag

SEQ ID NO: 101571 - RNA, 42 nt, Mus musculus
ggguggugagggcugaucacauuuccuguguguaguccccag

SEQ ID NO: 101572 - RNA, 46 nt, Mus musculus
guuuuuugaucuacuauucaaagguacuagaaggaaauuggcacag

SEQ ID NO: 101573 - RNA, 52 nt, Mus musculus
guuaaccugguaaaaugggagagguuauuggauauacagaaggauggaaugg

SEQ ID NO: 101574 - RNA, 46 nt, Mus musculus
ugcuggcucaucucauuaaauuuaaagaacuauuccugcaggccug

SEQ ID NO: 101575 - RNA, 79 nt, Mus musculus
gauuugguggcuucugggagcacugaggcuaucuccuaccagaauaugacaagccucagauggagaaaaaguugacaag

SEQ ID NO: 101576 - RNA, 45 nt, Mus musculus
aaagugagaguugcaauccaucccauauuuguccuacagucagag

SEQ ID NO: 101577 - RNA, 46 nt, Mus musculus
agugugccuauugcaucaaaaauggugcuagugaauaacuuugagu

SEQ ID NO: 101578 - RNA, 46 nt, Mus musculus
cauuguagcuagaauugugcauguaugugagacugaaguaggguua

SEQ ID NO: 101579 - RNA, 42 nt, Mus musculus
aacagguauuaguguaagaaccauugcuauuaauagcguaug

SEQ ID NO: 101580 - RNA, 82 nt, Mus musculus
uuuaaaaaguagguguucugacauuauucuguucauuguuccaagaaaaguuggaaccccaaauuuccaugugaaaauuugu

SEQ ID NO: 101581 - RNA, 60 nt, Mus musculus
guuccuaaucuguuaucaguuuauuugacuaaagcaaaauacgguacaaaguuacaguuu

SEQ ID NO: 101582 - RNA, 46 nt, Mus musculus
augcuccauagacauguaccauuguuacauaacaauuacaaaacag

SEQ ID NO: 101583 - RNA, 49 nt, Mus musculus
cucacacacugccucaguccuauagacgaaacacauuuuaaaagagaag

SEQ ID NO: 101584 - RNA, 46 nt, Mus musculus
uucuucuuucuucacgguagcucauuuguguugaucagggucucag

SEQ ID NO: 101585 - RNA, 46 nt, Mus musculus
cagccccuucauguuuuuccaauguaguucuuagucugguagacag

SEQ ID NO: 101586 - RNA, 46 nt, Mus musculus
agucaguaugauacacaugagaagacucauaggaaaggacauauga

SEQ ID NO: 101587 - RNA, 46 nt, Mus musculus
uacuguaggugaugguggguugguaacaugagcgcauaggaucuag

SEQ ID NO: 101588 - RNA, 46 nt, Mus musculus
uccucugagaggcuccacccagcaggugaugaaaacagaugcagag

SEQ ID NO: 101589 - RNA, 45 nt, Mus musculus
gaucauguuccccucacugcacugccuugucuagccucagugaga

SEQ ID NO: 101590 - RNA, 46 nt, Mus musculus
uacagaagagaggugauggugccagugggcaaaccaaaugacagag

SEQ ID NO: 101591 - RNA, 46 nt, Mus musculus
uuucuuauaaauccacuacucccaccauaagaguucaacccacaag

SEQ ID NO: 101592 - RNA, 46 nt, Mus musculus
gauaguauugcucaccacuguauccucaacaaaaacuggaccagag

SEQ ID NO: 101593 - RNA, 42 nt, Mus musculus
uugccaugguggcaccuguucauaaucccagcacuuggggag

SEQ ID NO: 101594 - RNA, 41 nt, Mus musculus
uagaacccauuuggaauccucaagcaaauaugagcaggcaa

SEQ ID NO: 101595 - RNA, 60 nt, Mus musculus
ugucuuggccucaugcccugagcaauccccuguuaccaccauguggauaaugacugaaac

SEQ ID NO: 101596 - RNA, 72 nt, Mus musculus
caagcuuuaguuaugcucaugugaggagcuagaagggccaaggccucaugaguccgagaguaaagccaccaa

SEQ ID NO: 101597 - RNA, 75 nt, Mus musculus
gggaaggaucacuuuguacagugcuucagggcuagaggggggaggcagggagagaaguguuguagcaggauggga

SEQ ID NO: 101598 - RNA, 46 nt, Mus musculus
ucaagugggcacugagccugaucuuccuuauccccugcaucuggag

SEQ ID NO: 101599 - RNA, 36 nt, Mus musculus
augcaaugcugaccacugagcuuccuaccccgggag

SEQ ID NO: 101600 - RNA, 46 nt, Mus musculus
uaugaggugauguguuuaucacagggcucagcauccaugacaugag

SEQ ID NO: 101601 - RNA, 46 nt, Mus musculus
ugacaggccuuuggugccuggggguggaaauggugggauugacuag

SEQ ID NO: 101602 - RNA, 45 nt, Mus musculus
cuugaauggccugguuaagcaagguccugguuuggccuagucuga

SEQ ID NO: 101603 - RNA, 46 nt, Mus musculus
cccaggcgaaaguagaaguaagaaaaacacacugagaugcacacag

SEQ ID NO: 101604 - RNA, 42 nt, Mus musculus
uaaggaugugggagaggagucaugagacaagcuuagccugag

SEQ ID NO: 101605 - RNA, 78 nt, Mus musculus
auccacacacacaagacagcaccaaggagaaauaucaggcagcuucggugcagaaggacccaaauaaauaaaagcagg

SEQ ID NO: 101606 - RNA, 47 nt, Mus musculus
cauuaaauaugcuuggaucccagagcacauguuuauacuaggagcag

SEQ ID NO: 101607 - RNA, 42 nt, Mus musculus
guuuggugcuuggugcuuaccugguugcauucagaggugcua

SEQ ID NO: 101608 - RNA, 45 nt, Mus musculus
uggccucucuauaacuuguuugugugugugugugugugugugugu

SEQ ID NO: 101609 - RNA, 45 nt, Mus musculus
ggaaagggcacagggaaggccagaguccagagccacaaaggacaa

SEQ ID NO: 101610 - RNA, 45 nt, Mus musculus
caaaucaauaauugcagucaaguaaauuuauuuuugaauauggga

SEQ ID NO: 101611 - RNA, 46 nt, Mus musculus
ugugauccaaccaguccacuagguuuuauguaccauuguccugcuc

SEQ ID NO: 101612 - RNA, 45 nt, Mus musculus
gucauugagcagugugugugugugugugugugugugugugugugu

SEQ ID NO: 101613 - RNA, 45 nt, Mus musculus
aucaagauagguuuauacccagguagggauauuuuuuguauaggu

SEQ ID NO: 101614 - RNA, 46 nt, Mus musculus
caaacccacaaaagaaauaagacuaggaucauuguacugccgggag

SEQ ID NO: 101615 - RNA, 42 nt, Mus musculus
ggagagcacagucauucggcaucagcuuucuguacaccccug

SEQ ID NO: 101616 - RNA, 46 nt, Mus musculus
ggcugguaagguucccugagguagcaaccagaagccccagccccag

SEQ ID NO: 101617 - RNA, 41 nt, Mus musculus
cagccaagccauugguggaugaggccaaaagaagggaggca

SEQ ID NO: 101618 - RNA, 24 nt, Mus musculus
cagggaggaggggcuuggagagac

SEQ ID NO: 101619 - RNA, 46 nt, Mus musculus
uuuguccuuauuuuauuaccuuuggauaauauuacaaauaaaguua

SEQ ID NO: 101620 - RNA, 42 nt, Mus musculus
gcagacagacagagacagagacagguagacauacagagagag

SEQ ID NO: 101621 - RNA, 45 nt, Mus musculus
aacaaaacaaaacaaaaaaaacauacacaaaagaaaaggaacaaa

SEQ ID NO: 101622 - RNA, 46 nt, Mus musculus
auuaagaguucaccagucaaagaagaaagcaaaggacauuccagag

SEQ ID NO: 101623 - RNA, 45 nt, Mus musculus
agcaagaagagauuaggaaacauguuaaagaggugucucuuaaca

SEQ ID NO: 101624 - RNA, 81 nt, Mus musculus
uauggugguuuguaccuagacucucagcacucaagaggccaaggagggaggauugaaaacccaaggccaccucauuuauac

SEQ ID NO: 101625 - RNA, 75 nt, Mus musculus
auagagacccuuuuucuauguggggaaaaagaggaaagaaggagagagaggaugaugaagagaaaggacuuggua

SEQ ID NO: 101626 - RNA, 76 nt, Mus musculus
aaucccaggucaaguucagacaaguucaauugaucaccccaacuggccuggcagcaggcaacugaagaguucaagu

SEQ ID NO: 101627 - RNA, 86 nt, Mus musculus
uguaaaacaggacaacaaccuucuccuccuagaguacugcuggaaaaaugcaaggagaccaugugugugaaaauugauacuaucag

SEQ ID NO: 101628 - RNA, 46 nt, Mus musculus
uauuuaucugcugaguuuuucguugguauaaugagaauauaaucag

SEQ ID NO: 101629 - RNA, 46 nt, Mus musculus
aguaccuaaggugauucuaucaacucccucugccugcaguugccag

SEQ ID NO: 101630 - RNA, 46 nt, Mus musculus
ggauugcacugauagccaaaauacaaccugcuuagguagguaggua

SEQ ID NO: 101631 - RNA, 42 nt, Mus musculus
uggcagugggggcaggggcccugauaauuuuugagugcuaua

SEQ ID NO: 101632 - RNA, 24 nt, Mus musculus
agccuggagaggaggcagcccaga

SEQ ID NO: 101633 - RNA, 45 nt, Mus musculus
gaggauccuuugucucgggccucuggcugaagaagccccucggag

SEQ ID NO: 101634 - RNA, 46 nt, Mus musculus
gguucucacucuggcaauaccucccgcauuaggguucaggaaggaa

SEQ ID NO: 101635 - RNA, 46 nt, Mus musculus
cagaacaugggaaggucaucagaaagagaacaacuuugggugagag

SEQ ID NO: 101636 - RNA, 42 nt, Mus musculus
gcagagaaccuuccuggccacuuucugcagcugcccgggaaa

SEQ ID NO: 101637 - RNA, 45 nt, Mus musculus
uuucuucugagggauuugaaggccagcuccagcuuuugucucugg

SEQ ID NO: 101638 - RNA, 46 nt, Mus musculus
cucugucucuucauccccagcccagucccucacauccaguagagag

SEQ ID NO: 101639 - RNA, 23 nt, Mus musculus
ucaggggggucauagugaagacu

SEQ ID NO: 101640 - RNA, 45 nt, Mus musculus
aaggcuaccucccccccaaaaaaagagaaaaagaaaaaagaaaga

SEQ ID NO: 101641 - RNA, 45 nt, Mus musculus
ggauggguauguuaauguauagauggaugaguagauuuaugagua

SEQ ID NO: 101642 - RNA, 46 nt, Mus musculus
auaaggacagguggguggacagauggcuaggugagcaaauggauag

SEQ ID NO: 101643 - RNA, 46 nt, Mus musculus
acagacuuggauuauaguggagguaccacuucacaccaccuuagag

SEQ ID NO: 101644 - RNA, 45 nt, Mus musculus
caauacugacuguuuaagaccaugagugucaguuucguaucacag

SEQ ID NO: 101645 - RNA, 45 nt, Mus musculus
ggguagggaaaagagccagagggcagugggaacacacccgggcau

SEQ ID NO: 101646 - RNA, 45 nt, Mus musculus
acugugacuuauuuuugcuuguggaaguuuagcucccggcccuca

SEQ ID NO: 101647 - RNA, 46 nt, Mus musculus
uguagguggcuuguauguuaagcuccuucccaagaucugcccccca

SEQ ID NO: 101648 - RNA, 46 nt, Mus musculus
ggcaauuaaugguguuaagugcacuucauagcucaaaggucucuag

SEQ ID NO: 101649 - RNA, 46 nt, Mus musculus
aucuaccauguagaauacauuuaagacaacucucugacaugcacgg

SEQ ID NO: 101650 - RNA, 46 nt, Mus musculus
cuaaaugcuucacuaaaggaggcucguuaggugaauuauggcuuac

SEQ ID NO: 101651 - RNA, 45 nt, Mus musculus
gccagagcuacacagagaaacccugucucagaaaaaaaaaagaaa

SEQ ID NO: 101652 - RNA, 46 nt, Mus musculus
gcaccagccuacuuucucuucuugaaugaaauuaagagacagacaa

SEQ ID NO: 101653 - RNA, 42 nt, Mus musculus
gacagggcucugcagagacucagaaccaagaggcuaguagau

SEQ ID NO: 101654 - RNA, 45 nt, Mus musculus
ggccaaguccuauugaaguuucauuccaggacugaccugcuguug

SEQ ID NO: 101655 - RNA, 42 nt, Mus musculus
aacucaucaauuuggcuaggcuggcuaguuaaugagccccag

SEQ ID NO: 101656 - RNA, 45 nt, Mus musculus
ucucuuucucuuucucuuucucuuucucuuuccccuucccucccu

SEQ ID NO: 101657 - RNA, 46 nt, Mus musculus
gugggccugggagggcugagcagguggguaaggagucugagcuaga

SEQ ID NO: 101658 - RNA, 24 nt, Mus musculus
agacagaacagaggaagaaacgaa

SEQ ID NO: 101659 - RNA, 45 nt, Mus musculus
cucugggauccgauggccuuggagagggggcugcagggcccgagg

SEQ ID NO: 101660 - RNA, 42 nt, Mus musculus
cauggaggcagagcccaaugaaggaggcugcagaggcaggag

SEQ ID NO: 101661 - RNA, 45 nt, Mus musculus
ggaguagucaccauggcccagggaaugacuaaacuggagguggcu

SEQ ID NO: 101662 - RNA, 46 nt, Mus musculus
aacagaggcgccugucacagcacucuccgcuccuaucacuugccug

SEQ ID NO: 101663 - RNA, 45 nt, Mus musculus
gaagacagaaugaguggaugaauaaaugaaugguugaguggucag

SEQ ID NO: 101664 - RNA, 57 nt, Mus musculus
guuugaguggauucacaguuuaaagucaauuaauccaauaaucaagacaaaagcauu

SEQ ID NO: 101665 - RNA, 60 nt, Mus musculus
uaauaaaggcagaacauuaggacaaagagaaggggaagaaagaccagaaagggaugugua

SEQ ID NO: 101666 - RNA, 46 nt, Mus musculus
uuggagaauagaagacuagaacuguauaggaaagcgucacuuuaua

SEQ ID NO: 101667 - RNA, 46 nt, Mus musculus
caauuagagguacuagggacucugcuauauucaaucaauuggcuag

SEQ ID NO: 101668 - RNA, 46 nt, Mus musculus
uuucuuaaaucucuguauagaacacgucaggacaaaagcccagcag

SEQ ID NO: 101669 - RNA, 35 nt, Mus musculus
augcaucuguaacucuggcacuagggagacaggca

SEQ ID NO: 101670 - RNA, 46 nt, Mus musculus
uuucuagauauguuuggcucuggugaccuaucucugaggcccccuu

SEQ ID NO: 101671 - RNA, 46 nt, Mus musculus
uucuacacaagcuaauuaguuuaaucuaaucuucaccaaagcccuc

SEQ ID NO: 101672 - RNA, 46 nt, Mus musculus
uagagauggaggucagagagguuaaguauauaacccaaggccacag

SEQ ID NO: 101673 - RNA, 42 nt, Mus musculus
cucuaugaagaguccgagccuguguucugcaaagacccacag

SEQ ID NO: 101674 - RNA, 46 nt, Mus musculus
cuugaacaucaaaacaaaaugccaaaugggaaaaugaaauaacagg

SEQ ID NO: 101675 - RNA, 46 nt, Mus musculus
gugggaacaggcccagccuguuucuagucauaccuuugacucugag

SEQ ID NO: 101676 - RNA, 41 nt, Mus musculus
uaauaucaugcccaaaauauacugcuuugaaaccugcaugc

SEQ ID NO: 101677 - RNA, 46 nt, Mus musculus
guacagaugcccaaggaaccuuuuaugagagaagagaaaagaaaua

SEQ ID NO: 101678 - RNA, 42 nt, Mus musculus
aaucugugaaaauggaaagaaccacuuuuccaccaccccccu

SEQ ID NO: 101679 - RNA, 42 nt, Mus musculus
accucauccucaauuaucugacugccuccaccaugaccccau

SEQ ID NO: 101680 - RNA, 41 nt, Mus musculus
aguuccugcuguacaaaugugcugauuaaagaggcagccgg

SEQ ID NO: 101681 - RNA, 41 nt, Mus musculus
cugaugguagcucucuccaaggcccacucucugcugcgggu

SEQ ID NO: 101682 - RNA, 46 nt, Mus musculus
gaggaaucagagaaagaaaaagugaauuaauauaucaaggagccag

SEQ ID NO: 101683 - RNA, 46 nt, Mus musculus
gcagguaggauggguagccugggagaugcagagagauaaggaauag

SEQ ID NO: 101684 - RNA, 44 nt, Mus musculus
agugaggcucccccaggcacucagucuaagugaggccgagcgag

SEQ ID NO: 101685 - RNA, 45 nt, Mus musculus
ggggaccaauggguagcuugggauacagaauuuucauaaugaggg

SEQ ID NO: 101686 - RNA, 46 nt, Mus musculus
ccagcuaagcucggaggagaaaagagcacacggugggggcgggggc

SEQ ID NO: 101687 - RNA, 46 nt, Mus musculus
gaucacggggcaggucucacagacagugagggagaagauguauuug

SEQ ID NO: 101688 - RNA, 46 nt, Mus musculus
ugcguacuucaaggauuauuugaaggacuauucuuagacccuuuua

SEQ ID NO: 101689 - RNA, 46 nt, Mus musculus
aaaagacuuagaugcuuccaaaaagagaguagaaaaacagccccca

SEQ ID NO: 101690 - RNA, 79 nt, Mus musculus
ccagagagggucucagagauauugagcugaagcuaaaaaccaaggauaaggaaugugccugcauaagguugcuggagaa

SEQ ID NO: 101691 - RNA, 42 nt, Mus musculus
auggguguaacggaaggacagccgauuguauuuuagugccag

SEQ ID NO: 101692 - RNA, 46 nt, Mus musculus
gcgugugucugugcaccacaugcuugccugcugcccggggagacag

SEQ ID NO: 101693 - RNA, 46 nt, Mus musculus
aaguagucagugcucuuaacugcggagcuaucucuccagcccccac

SEQ ID NO: 101694 - RNA, 45 nt, Mus musculus
caagugccuuuaccagauaaaccaucucacuaauugcauagcuag

SEQ ID NO: 101695 - RNA, 46 nt, Mus musculus
cuugggcaggccacugcaaaacagcagacagcccugaggacagagg

SEQ ID NO: 101696 - RNA, 46 nt, Mus musculus
uacugaauguuucuuauuuccuggaugugagaccccccccccggac

SEQ ID NO: 101697 - RNA, 46 nt, Mus musculus
ggcaggcuuguuuuauuuguuggacaaaauuuguuucagucugggg

SEQ ID NO: 101698 - RNA, 46 nt, Mus musculus
agguuagcaagcauccuauuugcagaucucuacugagaaaacguau

SEQ ID NO: 101699 - RNA, 74 nt, Mus musculus
gugcagggaagauauucuaggcagagggcaguguguggacaagguaaaggagcaaguagguggucaggauugag

SEQ ID NO: 101700 - RNA, 42 nt, Mus musculus
gcaagaagcaucagucacgcugacaaaucucugugcccccag

SEQ ID NO: 101701 - RNA, 46 nt, Mus musculus
guguccagccaccugccuauacguggggccuuggccugcugugugg

SEQ ID NO: 101702 - RNA, 39 nt, Mus musculus
auuuuacuugagagcccuugguuagcucuacgaaaccug

SEQ ID NO: 101703 - RNA, 46 nt, Mus musculus
guggaaguuuucaaccuucuuggcuguuuuuucucuuuucacucag

SEQ ID NO: 101704 - RNA, 46 nt, Mus musculus
acugauggugagucuuuugaggcuuuggaugaaaggauggaggcag

SEQ ID NO: 101705 - RNA, 23 nt, Mus musculus
uugagucucaggguaggacagcu

SEQ ID NO: 101706 - RNA, 42 nt, Mus musculus
ccuuacugucuagcaagccuagcuguaaacagugagccccag

SEQ ID NO: 101707 - RNA, 45 nt, Mus musculus
uagacucaaagccaguauggaguuaucugugaggagcauguccaa

SEQ ID NO: 101708 - RNA, 42 nt, Mus musculus
ccauaacaucacaaauaucuaugcuuugaacaaugcagggaa

SEQ ID NO: 101709 - RNA, 42 nt, Mus musculus
agaaggcaguuugaaucagcuuucaugcauggcacuuggcua

SEQ ID NO: 101710 - RNA, 42 nt, Mus musculus
gacaucggccucccacacuguggcuauuccaugggggccagc

SEQ ID NO: 101711 - RNA, 53 nt, Mus musculus
uccugccuguccagccgggccaacuccaaccucacacucacggacacggagca

SEQ ID NO: 101712 - RNA, 54 nt, Mus musculus
cugccagcucuaaaugcaagaaccuggauuuccagccagcaucugggucaggau

SEQ ID NO: 101713 - RNA, 60 nt, Mus musculus
gagaguuuagcccccuuuaacaagacagcuccagcugagcugcgaagaucaaagcccaga

SEQ ID NO: 101714 - RNA, 43 nt, Mus musculus
aaggagcuacucacuuucccugcguacgaggaggucaguccuc

SEQ ID NO: 101715 - RNA, 46 nt, Mus musculus
gaagaggccuggguggccucucugcuuuuauccaaggcgccaacuu

SEQ ID NO: 101716 - RNA, 46 nt, Mus musculus
ucaggucuucccucugcucccccaugauuauacagucuggcaucaa

SEQ ID NO: 101717 - RNA, 45 nt, Mus musculus
cuuaccaagucggcuugcuucacccuccacgcuccccggccccag

SEQ ID NO: 101718 - RNA, 46 nt, Mus musculus
auuaagcuuguagcaaacaaaaguaaaagaacaaacagcaaguagc

SEQ ID NO: 101719 - RNA, 68 nt, Mus musculus
cuuuuaacauccagcagggaccaacggaaugaccugauugagagagagaucaaaugcagguaacauca

SEQ ID NO: 101720 - RNA, 46 nt, Mus musculus
ucaggauuuggacgaugcuugauauaaacaggcuugagucugagac

SEQ ID NO: 101721 - RNA, 48 nt, Mus musculus
ccuaggaaugguuuuaaguacugagauucugucaaucaucaaaacuuc

SEQ ID NO: 101722 - RNA, 46 nt, Mus musculus
cugugugucaagauaguaagugcugugcgaacaagucccaggguga

SEQ ID NO: 101723 - RNA, 46 nt, Mus musculus
agguuguggaaugaaaaccaguagagggaaggacagcugcagggac

SEQ ID NO: 101724 - RNA, 46 nt, Mus musculus
gaacuuugagggaggaugggcagggucuaaccagugcaugaguaag

SEQ ID NO: 101725 - RNA, 41 nt, Mus musculus
auugcuuucuuaaaacuugguucagacccacugagcgugga

SEQ ID NO: 101726 - RNA, 44 nt, Mus musculus
cuguuugaacaucaucucacucaagaugaaagaauagccaguag

SEQ ID NO: 101727 - RNA, 46 nt, Mus musculus
cucccaaacccuuaccacaauuaaauuucacacuaauugcccaggu

SEQ ID NO: 101728 - RNA, 44 nt, Mus musculus
gcuggguguacuguuuaucaaauagcuagcguuuguuauggcug

SEQ ID NO: 101729 - RNA, 46 nt, Mus musculus
uaggucccugccaacuauauagacaagccaugcuuccagagggaag

SEQ ID NO: 101730 - RNA, 46 nt, Mus musculus
gcugggagaacuugccuggcgaggaacacuggaugcuaguacaggg

SEQ ID NO: 101731 - RNA, 46 nt, Mus musculus
ucagacuuugcuccgcaucgucucucaaggauccagaguaauagag

SEQ ID NO: 101732 - RNA, 46 nt, Mus musculus
agcccaucuuugccuggaaagcuuacugcacgggcagaaccaugag

SEQ ID NO: 101733 - RNA, 46 nt, Mus musculus
ccuucaauuuucacucgaaacgagucagcuacugaugugucucccu

SEQ ID NO: 101734 - RNA, 24 nt, Mus musculus
cagcagccuuccagggcaguagcu

SEQ ID NO: 101735 - RNA, 46 nt, Mus musculus
uuucuuccacuuuuuugguugaggcacagcaucucuggagagucag

SEQ ID NO: 101736 - RNA, 46 nt, Mus musculus
acauaaaaguaacagaccaggcugucaaaggaggcuaagaggaaag

SEQ ID NO: 101737 - RNA, 41 nt, Mus musculus
cagcuacggagaagggcaccauagggucacacaaugaggaa

SEQ ID NO: 101738 - RNA, 28 nt, Mus musculus
cauggauaaggcagagcugaauacacaa

SEQ ID NO: 101739 - RNA, 46 nt, Mus musculus
uauuuuucacaaacaacuuucuagagaucagaaaaccaagaaucag

SEQ ID NO: 101740 - RNA, 46 nt, Mus musculus
ggguucaggguacagugaccauaaaaagccaucuuguagcugcagg

SEQ ID NO: 101741 - RNA, 24 nt, Mus musculus
aagaaauaacuauccauuaaugcu

SEQ ID NO: 101742 - RNA, 46 nt, Mus musculus
ucucugaaaauaagcgaaucuugcccacaccaugaggcuuggggga

SEQ ID NO: 101743 - RNA, 48 nt, Mus musculus
ugggguucuuuguuuguuuguuaauuacacgucuuguagaauacuaaa

SEQ ID NO: 101744 - RNA, 46 nt, Mus musculus
auaauuuuaauaccuuuagauuuauugguauuugcuuucuggccuu

SEQ ID NO: 101745 - RNA, 46 nt, Mus musculus
cgauuaauacuaugauucugcuaaagcccuggaaugcugaccuaag

SEQ ID NO: 101746 - RNA, 42 nt, Mus musculus
auggaucacaugcguggcucucccagcuuuagccaagaggag

SEQ ID NO: 101747 - RNA, 24 nt, Mus musculus
agcaggcuuugcugaucuggagac

SEQ ID NO: 101748 - RNA, 48 nt, Mus musculus
auguauuugauugucgguauuaaacaaaacacagaaagcauaauugcu

SEQ ID NO: 101749 - RNA, 46 nt, Mus musculus
augauuugaggagcauuaguauuaacucauuuucagauuuugauag

SEQ ID NO: 101750 - RNA, 45 nt, Mus musculus
ugagugugugugugugugugagagagagagagagagagagaguca

SEQ ID NO: 101751 - RNA, 46 nt, Mus musculus
caaguucggcaaauuggugcugaugagagacucuaggcuggaccag

SEQ ID NO: 101752 - RNA, 36 nt, Mus musculus
uuuuccagcucucacuaccuuuuuaugaggcccggg

SEQ ID NO: 101753 - RNA, 45 nt, Mus musculus
ccgcaggugcucccuugcauuguucaucugcuucaucaaccccua

SEQ ID NO: 101754 - RNA, 46 nt, Mus musculus
ggccaaugagagccagaggcgguugcuaggcaacgguguggcccag

SEQ ID NO: 101755 - RNA, 45 nt, Mus musculus
agcgaaagaguaccacccagauccuguacuguuacacuuggccag

SEQ ID NO: 101756 - RNA, 45 nt, Mus musculus
uggcuccaguaaauguuuguaaaguuuaauuugauuuuaaggggg

SEQ ID NO: 101757 - RNA, 42 nt, Mus musculus
gauuccuauugcucaccucacgagcauuuaugaagcacccag

SEQ ID NO: 101758 - RNA, 41 nt, Mus musculus
uguuugguugguggguugguugguuggcuggcugacugguu

SEQ ID NO: 101759 - RNA, 45 nt, Mus musculus
uccacagccgaucacaccacaugugggcucaacaaagaugccaac

SEQ ID NO: 101760 - RNA, 45 nt, Mus musculus
uaaaucauauggaaaauuucacagagagagagagagagagagaga

SEQ ID NO: 101761 - RNA, 41 nt, Mus musculus
cacuguuugcccaaagccaggcaacuaacaggagacgggcc

SEQ ID NO: 101762 - RNA, 42 nt, Mus musculus
agcugaagugcaggggucuuguuaaccugcuuagggucacau

SEQ ID NO: 101763 - RNA, 45 nt, Mus musculus
ucccucucuauaaggcucuccucauaaaauugaaauccacucagg

SEQ ID NO: 101764 - RNA, 42 nt, Mus musculus
ugggugaccugacccaaagaaggauucugagcacauacacag

SEQ ID NO: 101765 - RNA, 46 nt, Mus musculus
ccuaauguguaucagcuggcugcguuugccuaauuuuagucauuag

SEQ ID NO: 101766 - RNA, 48 nt, Mus musculus
aguuauacagcaggagcugaggauguacaaaaagugcagaauuccagc

SEQ ID NO: 101767 - RNA, 49 nt, Mus musculus
aggacccacccucagcuagaggguuguuacaggcagugauggcagcugc

SEQ ID NO: 101768 - RNA, 46 nt, Mus musculus
auaaaagugacagcugaagcugaaguugggaaagcaggaggaauug

SEQ ID NO: 101769 - RNA, 42 nt, Mus musculus
aaaaagaccugugauguggccagucuggagagagagagagag

SEQ ID NO: 101770 - RNA, 45 nt, Mus musculus
cucccucuggaauguaaugauaaauauaguuaaaacuggcgggca

SEQ ID NO: 101771 - RNA, 41 nt, Mus musculus
gcucugagaauaugucaaugacuuagagaauuaugguggcu

SEQ ID NO: 101772 - RNA, 60 nt, Mus musculus
ccggacgccuccuccaccacugccccacgcccauacccccaaccagcaccacgcggccuc

SEQ ID NO: 101773 - RNA, 45 nt, Mus musculus
aacuucaccccaaggagcaaccccagcccagcacccacagaccac

SEQ ID NO: 101774 - RNA, 45 nt, Mus musculus
gggaaacggcacagcuucccaauggcuccagagccaugugacuga

SEQ ID NO: 101775 - RNA, 41 nt, Mus musculus
ugaguccuucagggaggagccuggaccuucuugugcccccu

SEQ ID NO: 101776 - RNA, 47 nt, Mus musculus
ugugugugugguguguguguguaugguguguggugugugugugugug

SEQ ID NO: 101777 - RNA, 46 nt, Mus musculus
guacuaaaccaaugcaaaagggucagugaagaguggcuggggauaa

SEQ ID NO: 101778 - RNA, 45 nt, Mus musculus
uacgaucugugggacuggucaggccuggggaggguuaggggcaga

SEQ ID NO: 101779 - RNA, 45 nt, Mus musculus
caucccaacugaccccacggcaaccauacuguuaucaugcccagu

SEQ ID NO: 101780 - RNA, 46 nt, Mus musculus
ucuucugcaccacauccccaggguacccccuaacgucuagcaccgu

SEQ ID NO: 101781 - RNA, 41 nt, Mus musculus
guguguguguguggugugguguguguguggugugugugugu

SEQ ID NO: 101782 - RNA, 42 nt, Mus musculus
gcuaaaacuuccagaagagguggagcuugcuaaucaagggag

SEQ ID NO: 101783 - RNA, 46 nt, Mus musculus
uacagcauuccuugcccaaguauaguuagcagagacauuugcugag

SEQ ID NO: 101784 - RNA, 42 nt, Mus musculus
uugcaaagaaacaccacaagucgauaaucuguguggcagcau

SEQ ID NO: 101785 - RNA, 41 nt, Mus musculus
ucacugggcaggaaaaggcgacaggaaaaugucagccccag

SEQ ID NO: 101786 - RNA, 42 nt, Mus musculus
cguuugccaccaugcacacccccagcacauagugagcagcuu

SEQ ID NO: 101787 - RNA, 45 nt, Mus musculus
agauggcuaucaauggaaucugugcugugaaacugaaucaugcug

SEQ ID NO: 101788 - RNA, 46 nt, Mus musculus
uuacugacagcgugcauuuuaacuuuuuuuuuuguuguuggcacau

SEQ ID NO: 101789 - RNA, 46 nt, Mus musculus
cccuuugggacccauacggcuuuggaagaaugaguaguuuuagcag

SEQ ID NO: 101790 - RNA, 46 nt, Mus musculus
aaauguccaucauccauucucauuuuagcuccaguauuagccaaag

SEQ ID NO: 101791 - RNA, 46 nt, Mus musculus
uguugcaaggaacacuagguucuugcaccuauauuuuugccucucu

SEQ ID NO: 101792 - RNA, 45 nt, Mus musculus
ggaugaaaucguaggucaauggacagcucaagucagcuuguugga

SEQ ID NO: 101793 - RNA, 75 nt, Mus musculus
gauacuccagaagagggcaucagaucucauuacggauaguugugacccaccaugugguugcugggauuugaacuc

SEQ ID NO: 101794 - RNA, 45 nt, Mus musculus
uucuugugggcauggaaaggagggcuguccccacugccaagguug

SEQ ID NO: 101795 - RNA, 42 nt, Mus musculus
gaugaaugaaugaaugaaugaaugaaugaaugaaauuugcua

SEQ ID NO: 101796 - RNA, 41 nt, Mus musculus
ggaguuccaagagaccucagcaugagggugagaagaggagg

SEQ ID NO: 101797 - RNA, 47 nt, Mus musculus
ccugaggaggaggcagguugacuggaaagguuuauguaaggugaggg

SEQ ID NO: 101798 - RNA, 42 nt, Mus musculus
ggagacccaggaggugaguaauagaagugggggaggcacagg

SEQ ID NO: 101799 - RNA, 102 nt, Mus musculus
ucuuccgaaggucccaaguucaaaucccagccaccacaugguggcucacacaaccauccauaacggaaucuucuggagugucugaaaacccccacaguguau

SEQ ID NO: 101800 - RNA, 46 nt, Mus musculus
uucagccuuaaacuggagugcucucuguaugagcaaccaaaugaug

SEQ ID NO: 101801 - RNA, 46 nt, Mus musculus
aguucucaaucccuucgagaaccucuuccuugcaauguagcuccug

SEQ ID NO: 101802 - RNA, 42 nt, Mus musculus
guuacucacgggcaguugaauucuuaauuccaauucaggcag

SEQ ID NO: 101803 - RNA, 41 nt, Mus musculus
ccugucuuaaaaaaaaagaaagaaagaaagaaagaaagaaa

SEQ ID NO: 101804 - RNA, 45 nt, Mus musculus
cagccucugucaagcaccuucuccgcccuuccucucuggccugug

SEQ ID NO: 101805 - RNA, 23 nt, Mus musculus
cgagcggaggggagaagagaaga

SEQ ID NO: 101806 - RNA, 42 nt, Mus musculus
aguguguauguaccucucucucucucucucucucugugugug

SEQ ID NO: 101807 - RNA, 46 nt, Mus musculus
cggagcgagaugcuuuaaugccagaaaaauugucugauguucaugg

SEQ ID NO: 101808 - RNA, 45 nt, Mus musculus
acucaaaguucagaauaauaaauaucuaagagauugacauuggca

SEQ ID NO: 101809 - RNA, 43 nt, Mus musculus
agaugcuuggcauauuuuugaauuaauuguaaacuucugguag

SEQ ID NO: 101810 - RNA, 44 nt, Mus musculus
guuugaauguauuugaugguaauuuuuuaauaucauggcccuga

SEQ ID NO: 101811 - RNA, 46 nt, Mus musculus
cauccguucuuucuguuucgccauuacuucaugucguuggucccuu

SEQ ID NO: 101812 - RNA, 42 nt, Mus musculus
acucugugaugccaguuucucuacuuccucagugacugggag

SEQ ID NO: 101813 - RNA, 42 nt, Mus musculus
ugccucuaaccucuaauuucucaggauccugucugcccagau

SEQ ID NO: 101814 - RNA, 46 nt, Mus musculus
auucagacacugggaacaagccuggguggccugagaaaggacgaag

SEQ ID NO: 101815 - RNA, 45 nt, Mus musculus
ucucaaaccaccugcucugaucuuuaguccagaaaauaaugccau

SEQ ID NO: 101816 - RNA, 23 nt, Mus musculus
accccucugaaaccaaagagaca

SEQ ID NO: 101817 - RNA, 42 nt, Mus musculus
acucauaaaagaggguuggcuguuaggaaaguaagggcucaa

SEQ ID NO: 101818 - RNA, 41 nt, Mus musculus
aacuggaaaaagaaagaaagagagagagagagagagagaga

SEQ ID NO: 101819 - RNA, 41 nt, Mus musculus
ggauuuugauucaagugaaagugauuggcaucuauuggcaa

SEQ ID NO: 101820 - RNA, 45 nt, Mus musculus
ccaacacugugggauuucaggaagacacgccucuccgccuagaga

SEQ ID NO: 101821 - RNA, 42 nt, Mus musculus
aggggucuuuuguucucaagagaucucacagaaaagggcagg

SEQ ID NO: 101822 - RNA, 42 nt, Mus musculus
auggagucuaggagaaaugcaguuaagauaugaagccucaca

SEQ ID NO: 101823 - RNA, 46 nt, Mus musculus
gaagcugugagcagcccugggggaggcccuggggaaggagagaagg

SEQ ID NO: 101824 - RNA, 45 nt, Mus musculus
ucacccucugcuggggcuguaauuauguguuuaagcaacgucuga

SEQ ID NO: 101825 - RNA, 45 nt, Mus musculus
gaagaccucacuaaccuggaagcugggaccauggcuacaccccag

SEQ ID NO: 101826 - RNA, 46 nt, Mus musculus
uggcaaggguccuaaggggcacacaggaggugcucuuaggcaggag

SEQ ID NO: 101827 - RNA, 46 nt, Mus musculus
auuuuucuugguuuuauacugaggauucagguuccagcaggguuag

SEQ ID NO: 101828 - RNA, 42 nt, Mus musculus
uauucaucccuccacacccaugacaccucagcaagggcccgu

SEQ ID NO: 101829 - RNA, 46 nt, Mus musculus
gccccuuggacgauauuuuccuuugccuacugaaaaugaacaucag

SEQ ID NO: 101830 - RNA, 39 nt, Mus musculus
aagcucuugagaguucuguuggauucuguuuuacacuag

SEQ ID NO: 101831 - RNA, 42 nt, Mus musculus
ggaaaacacugacugaauuaguauuagccagacugugcagag

SEQ ID NO: 101832 - RNA, 81 nt, Mus musculus
cugucuggggcagcaaagggccuggagaacacaaagccagaacaagaaucaggagcaugcauuacugcucagaacacccuu

SEQ ID NO: 101833 - RNA, 46 nt, Mus musculus
ucaaacugcuuagcugcuuaggacuucagaacaaccccuuugagag

SEQ ID NO: 101834 - RNA, 46 nt, Mus musculus
uauggccuuacugguauugauccagugaggaaguacagauucccag

SEQ ID NO: 101835 - RNA, 42 nt, Mus musculus
gggggcuggagucuggauaagcaccaugcccugaacauccag

SEQ ID NO: 101836 - RNA, 46 nt, Mus musculus
uuugggcucauuuauuucguggacggcaccaugaucagacguguug

SEQ ID NO: 101837 - RNA, 46 nt, Mus musculus
uucacacaauggagucuuguacaucgcugagaccgacgagaaaaag

SEQ ID NO: 101838 - RNA, 42 nt, Mus musculus
auccggaagaacaagccuuuccugaacacucagaacauguac

SEQ ID NO: 101839 - RNA, 54 nt, Mus musculus
cacuuacacaggggacggggacaucacacauaucaccgacaacaauggcaacau

SEQ ID NO: 101840 - RNA, 46 nt, Mus musculus
uggcaacucuggccucuuggcaaccaaaagcaaugaaaacgggugg

SEQ ID NO: 101841 - RNA, 46 nt, Mus musculus
gcuucugcgucuaauggguuauggcuugaccuuguccucgccacag

SEQ ID NO: 101842 - RNA, 42 nt, Mus musculus
uuacccagaccaacacacaaaggagaagagauaaacccacag

SEQ ID NO: 101843 - RNA, 40 nt, Mus musculus
ccgaagcgauacagacagcucagugcacgugcagguagag

SEQ ID NO: 101844 - RNA, 45 nt, Mus musculus
ugaccuccgugaccgcaucacuaggcugggugauguacaguacaa

SEQ ID NO: 101845 - RNA, 41 nt, Mus musculus
cagagaggcagagaggcagagaggcagagagagaggcagga

SEQ ID NO: 101846 - RNA, 45 nt, Mus musculus
aaauagacaucauuaauaagucagcaaucaaagauaaacuagaag

SEQ ID NO: 101847 - RNA, 45 nt, Mus musculus
gcauaccugggaccugggggguaaacacauauauuuugacagcgu

SEQ ID NO: 101848 - RNA, 46 nt, Mus musculus
guggguuuccugugagacauuuuggcauguuacuauagcuggggag

SEQ ID NO: 101849 - RNA, 46 nt, Mus musculus
ggucgagcaguacccagaacugucagacagcgccaacaauauccac

SEQ ID NO: 101850 - RNA, 44 nt, Mus musculus
gaaccccaggcaggagugguuuuguuuuuguuuuuaaauaagaa

SEQ ID NO: 101851 - RNA, 41 nt, Mus musculus
gacaugaguuaaugaaaccaagaaggucucuuaccgcagga

SEQ ID NO: 101852 - RNA, 44 nt, Mus musculus
guccccagcuaggucaaaaccauugucuauauuuugugagaggg

SEQ ID NO: 101853 - RNA, 46 nt, Mus musculus
aaaggggggaaagcauaaaaacaaaaccagaagugaucccguguag

SEQ ID NO: 101854 - RNA, 45 nt, Mus musculus
gcuacugcacgggccugauggacaacaugcugcggaugcgaccgg

SEQ ID NO: 101855 - RNA, 23 nt, Mus musculus
cagaguuaaagcaccuugcccac

SEQ ID NO: 101856 - RNA, 41 nt, Mus musculus
guguguacacucacacacacgugcacgugugugucugauca

SEQ ID NO: 101857 - RNA, 42 nt, Mus musculus
auaaauauacauuagguguuaaaugcugauugguauagccag

SEQ ID NO: 101858 - RNA, 46 nt, Mus musculus
accuuguggacuccacaaaauaggaaaccauuguagagguauugau

SEQ ID NO: 101859 - RNA, 41 nt, Mus musculus
agaaaggugcagagaggcaagaccugaagugcaagucccag

SEQ ID NO: 101860 - RNA, 47 nt, Mus musculus
cugugaaggaccaugacauguuugguuauauaaaauuacacccagaa

SEQ ID NO: 101861 - RNA, 46 nt, Mus musculus
uuuauauaucuguaaucacuugugaagcuagccaggaagaugaguu

SEQ ID NO: 101862 - RNA, 46 nt, Mus musculus
aguguauuucaacauauuaacaaucuaaaugugaaauuaagaagaa

SEQ ID NO: 101863 - RNA, 42 nt, Mus musculus
gaaaaaaaaaaaaucagcacuaaaauuuaaaggccaggagag

SEQ ID NO: 101864 - RNA, 45 nt, Mus musculus
aguuggucuaaugagaauguaaaguuagaagggagacacucuuua

SEQ ID NO: 101865 - RNA, 47 nt, Mus musculus
agguagccagauuuuuacaguuccagaacuuagaauugaaacagugu

SEQ ID NO: 101866 - RNA, 46 nt, Mus musculus
gugacagcuggcagugaagucacagcauuuucugagaguuacagau

SEQ ID NO: 101867 - RNA, 45 nt, Mus musculus
acaugugcaaaaggcugaauaagcucccuguucuuuuugccacug

SEQ ID NO: 101868 - RNA, 45 nt, Mus musculus
uugcuugagagucacauuuuuuuauaacuguacagcuuuuaaggg

SEQ ID NO: 101869 - RNA, 44 nt, Mus musculus
uuggcggccgccaggaggaggaagaggaggaggaggagaagaag

SEQ ID NO: 101870 - RNA, 68 nt, Mus musculus
aguugcaauuaaauuugagucuucaucuuugagcuuuagccccuucuuuccuucuuuccuuccuuuuu

SEQ ID NO: 101871 - RNA, 70 nt, Mus musculus
uaugguacuagggaucaggugcucuacugcugagcuauauccccagcccuuggaugucuuacacugagca

SEQ ID NO: 101872 - RNA, 46 nt, Mus musculus
uuuuagcuuccuaacugggagaccacuaaguucaguggccugugaa

SEQ ID NO: 101873 - RNA, 45 nt, Mus musculus
aaaauuuuuuucuuugacauguugaagaaugaaacuagccccccc

SEQ ID NO: 101874 - RNA, 48 nt, Mus musculus
agcuuaugcaaagucaccuuuugggaauucucuuuccuggcgaucaga

SEQ ID NO: 101875 - RNA, 46 nt, Mus musculus
ugugugugugcgugcgugcgugcguguuaguggaaauuuuguggag

SEQ ID NO: 101876 - RNA, 68 nt, Mus musculus
cugcucccagauuguuacauaagugcuggggaucugaacugaaguccacaugguuguaugaagcacuu

SEQ ID NO: 101877 - RNA, 67 nt, Mus musculus
uacugagccaucuccuuagcccaguguuuuugucaacuuucuuauuagucuuacacagcaugcccag

SEQ ID NO: 101878 - RNA, 43 nt, Mus musculus
uuuugcugaguacugaguaguuuaauauguguagaggauaggg

SEQ ID NO: 101879 - RNA, 45 nt, Mus musculus
augguugugagccaccaugugguugcugggauuugaaccccggac

SEQ ID NO: 101880 - RNA, 42 nt, Mus musculus
uuauuuaacuuucuuccauuaaaauaacaacucuggggcugg

SEQ ID NO: 101881 - RNA, 46 nt, Mus musculus
augucuugguaguuuggaaauuuaaguaguuugaagcaaaauccag

SEQ ID NO: 101882 - RNA, 49 nt, Mus musculus
ugguaaacaggagcaagaagcugagaagucaaaucuagaaccauaaguu

SEQ ID NO: 101883 - RNA, 46 nt, Mus musculus
ugccugcauguaugucuaugcaccacauaugugucugguaccagag

SEQ ID NO: 101884 - RNA, 82 nt, Mus musculus
ccuguucuuacucauuuuuucaguaagugccuuuuaauggcaagaucaugaacaucugacaauauggcagauuguaaaaugg

SEQ ID NO: 101885 - RNA, 46 nt, Mus musculus
aaaaggcucaugccaaauuuauuccauauguuauacuucaacaaag

SEQ ID NO: 101886 - RNA, 46 nt, Mus musculus
cuuucucugcugcaguuuguucugcagaaaaauguucuauguccag

SEQ ID NO: 101887 - RNA, 46 nt, Mus musculus
auggccucaaacucacuguccuccugcguuagccuucuguagcuag

SEQ ID NO: 101888 - RNA, 45 nt, Mus musculus
uuccugauucucagugauuauuucaggucuuggacccuugaucag

SEQ ID NO: 101889 - RNA, 44 nt, Mus musculus
aagucuuuaauuuuucucuuauuucuuccuugaccaaguuauca

SEQ ID NO: 101890 - RNA, 46 nt, Mus musculus
gucucccuuugugauuucuuuauuguuucuauuuccuuuuucuuag

SEQ ID NO: 101891 - RNA, 46 nt, Mus musculus
ucaaaucccagcaaccacaugguggcucacaaccaucccuuacgag

SEQ ID NO: 101892 - RNA, 41 nt, Mus musculus
gugucaaauuuguauggagaaaggaagcaaucuaggcuggg

SEQ ID NO: 101893 - RNA, 46 nt, Mus musculus
ugagaguuuaaaauaaguuugggcuaacuuucaguaaccuguguag

SEQ ID NO: 101894 - RNA, 42 nt, Mus musculus
ggagcgggugucuuucugccuuccggggaagggaauggggag

SEQ ID NO: 101895 - RNA, 45 nt, Mus musculus
agaacucccuuuguagaccaggcuggccucgaacucagagauccu

SEQ ID NO: 101896 - RNA, 42 nt, Mus musculus
auaucuggggagugaaacuagaagaaaugaaaaagcagccgc

SEQ ID NO: 101897 - RNA, 45 nt, Mus musculus
ccuuuucucuuuccagggugauuaagaauauuuaaugauggccag

SEQ ID NO: 101898 - RNA, 41 nt, Mus musculus
ugcccagaguuucaccuuuagcacaagaaggaaggaagggg

SEQ ID NO: 101899 - RNA, 47 nt, Mus musculus
aguagcugcugcugcugguggugacaaugucaaauaacggcguagac

SEQ ID NO: 101900 - RNA, 45 nt, Mus musculus
agaagaaaaagaaggaccgguuuuaucgauccaucuuaccuggag

SEQ ID NO: 101901 - RNA, 45 nt, Mus musculus
gaucuuuggucccauuuucaagauuuaguauuuaguguuaguaag

SEQ ID NO: 101902 - RNA, 46 nt, Mus musculus
ccaguaggaaaguugaagcuuagagaauaguaaacaaugcccaagg

SEQ ID NO: 101903 - RNA, 46 nt, Mus musculus
uaugaugguauaacagaccuuaugccuuggaaauucacagggggag

SEQ ID NO: 101904 - RNA, 45 nt, Mus musculus
ggagaaggagcgaccagagauuucucuuccuucagauuuugagca

SEQ ID NO: 101905 - RNA, 46 nt, Mus musculus
cacugggucugucugucuuuuuccauugaaagauuggaucauucug

SEQ ID NO: 101906 - RNA, 52 nt, Mus musculus
aagaagcuuaggguaaugaacugaauucaugugcucaucuuuuguuagccua

SEQ ID NO: 101907 - RNA, 46 nt, Mus musculus
auaggacagauggagaauuugaaaauaaggggcaauaagcacaagu

SEQ ID NO: 101908 - RNA, 28 nt, Mus musculus
gagagagaagguuagagggaaagggagu

SEQ ID NO: 101909 - RNA, 45 nt, Mus musculus
cuuugggucccugagaucaaacucagguugcuggguuccguggca

SEQ ID NO: 101910 - RNA, 46 nt, Mus musculus
aucuauguguuauuuaucuuuuuugguaauauaguuugggcagaag

SEQ ID NO: 101911 - RNA, 57 nt, Mus musculus
gaacacggaaaaacagaagaagaagccuaaaaugucugaugaggagaucuuagagaa

SEQ ID NO: 101912 - RNA, 48 nt, Mus musculus
cccaaguauugagaccuaucaucacuaguaugaaauuuaagguccaga

SEQ ID NO: 101913 - RNA, 51 nt, Mus musculus
ucuuauuaauucaaacuuuuugucuugauuuucauaagcuaccagaaguuu

SEQ ID NO: 101914 - RNA, 45 nt, Mus musculus
auauacauucuguaacuaaagaucucauggugaagauggucagac

SEQ ID NO: 101915 - RNA, 46 nt, Mus musculus
cauugguuguuuacccgaauuuacaggcuguggccagcgguagcaa

SEQ ID NO: 101916 - RNA, 42 nt, Mus musculus
uuuuuaccgggcuaguacuaaauaagagacuaauaugauaag

SEQ ID NO: 101917 - RNA, 41 nt, Mus musculus
agucuuugugaaugauuaugggguuguuagccagcuggaag

SEQ ID NO: 101918 - RNA, 41 nt, Mus musculus
uguuuuuaaagguaauguguauaauagaaagaacauacugg

SEQ ID NO: 101919 - RNA, 46 nt, Mus musculus
cuccuugacagauguggugacagaaaccuguauggaugaaggccag

SEQ ID NO: 101920 - RNA, 42 nt, Mus musculus
gccugcugcccauguguaaggacacagcacuuacugauggag

SEQ ID NO: 101921 - RNA, 46 nt, Mus musculus
gaccccucauguccucuucuccuuuccuugcuucucccauuuccug

SEQ ID NO: 101922 - RNA, 46 nt, Mus musculus
uugaucugacugcuuuuccaggucugggccugguuuuuauggagaa

SEQ ID NO: 101923 - RNA, 41 nt, Mus musculus
uuggguccacgugggaagauggaugggcccccuguggugaa

SEQ ID NO: 101924 - RNA, 45 nt, Mus musculus
ucacugacagccagcuucuuucuaagaccuccuggcccacaccca

SEQ ID NO: 101925 - RNA, 41 nt, Mus musculus
ucaguuucuuccucugggaugggagucccgcagcaucgaga

SEQ ID NO: 101926 - RNA, 45 nt, Mus musculus
gaaugguaacaggguacccagcaggggagggauggcagagccccc

SEQ ID NO: 101927 - RNA, 44 nt, Mus musculus
aggacuuagagagaaaaucaaauccacccuccuuguggggaaga

SEQ ID NO: 101928 - RNA, 45 nt, Mus musculus
uggggaccugagcaagcccaggcagcagucugucaaguggccuca

SEQ ID NO: 101929 - RNA, 47 nt, Mus musculus
ugcaggaacuagaccugucaggcuccagcuuggugccccugccugag

SEQ ID NO: 101930 - RNA, 41 nt, Mus musculus
gguucaggcucugaaugguaggugcaggcaggcuggcccgg

SEQ ID NO: 101931 - RNA, 45 nt, Mus musculus
ggugaaggcagauaucgagaccucucguagucgguuauggcucag

SEQ ID NO: 101932 - RNA, 82 nt, Mus musculus
aggccauuguggcugaggucaagugacuccagguagcgcagucgggagaaggcagagggcaugaugcuggugagcagguugu

SEQ ID NO: 101933 - RNA, 46 nt, Mus musculus
ccagcaucaugcccucugccuucucccgacugcgcuaccuggaguc

SEQ ID NO: 101934 - RNA, 46 nt, Mus musculus
ucucacaagcaucuuugggagucuggacacuggaucucaaguagaa

SEQ ID NO: 101935 - RNA, 46 nt, Mus musculus
gccucuguuuucuuacccaugccuuacuucccacuaacauagccag

SEQ ID NO: 101936 - RNA, 61 nt, Mus musculus
cagcacgugauugcaaaccuugagugugccuauacggacccaugugacccuuagauaugac

SEQ ID NO: 101937 - RNA, 45 nt, Mus musculus
cagagaaagaaauaggggugaagugagaggggugaggaccugccc

SEQ ID NO: 101938 - RNA, 73 nt, Mus musculus
ucuuuuguagagaccaauucgaggauuaaacccggcccaggugcauccugggcuuagucccagccaaggcagg

SEQ ID NO: 101939 - RNA, 46 nt, Mus musculus
uccuccucugguuucugcccccaccaugcuaguauccacgcuagag

SEQ ID NO: 101940 - RNA, 45 nt, Mus musculus
gguaaauagcauaacaaaugacuacaugugcuaauaaacggagau

SEQ ID NO: 101941 - RNA, 55 nt, Mus musculus
cccauuugagccugagugcagagagcugcuggagaaaacagaaccauggggcugg

SEQ ID NO: 101942 - RNA, 44 nt, Mus musculus
caggacgcugagccugggaguuuccugaagacaucuggccccac

SEQ ID NO: 101943 - RNA, 46 nt, Mus musculus
uuguaacuuagaacuuuggucaguacuaccccgucggagugggagu

SEQ ID NO: 101944 - RNA, 23 nt, Mus musculus
cagaaggagccugaaggacugga

SEQ ID NO: 101945 - RNA, 41 nt, Mus musculus
agagcauccuggucuccccacugggcuucuauacagcgcuu

SEQ ID NO: 101946 - RNA, 46 nt, Mus musculus
ucgaggacggugccuuugaggcccugccccaccugacucaccucaa

SEQ ID NO: 101947 - RNA, 46 nt, Mus musculus
gcuuucuugaacaccugaccucccugcgcuuccucaaccucagcag

SEQ ID NO: 101948 - RNA, 42 nt, Mus musculus
gaacuuccacccuauaccuuugccagccuggccagccugcag

SEQ ID NO: 101949 - RNA, 42 nt, Mus musculus
uggaccucuccaccaauccuggucuggauguggccacgggag

SEQ ID NO: 101950 - RNA, 45 nt, Mus musculus
ccaggcugcaucugugggccagcugugcagcucgaaguggggcag

SEQ ID NO: 101951 - RNA, 42 nt, Mus musculus
guucuucauuuccagagaggcugaaagucauuaucagcagau

SEQ ID NO: 101952 - RNA, 41 nt, Mus musculus
aggccuccuucuaucccagccccacccugacuuuugagcca

SEQ ID NO: 101953 - RNA, 42 nt, Mus musculus
acagccugcagguaccgcacuggcaaagcuuuggccccagag

SEQ ID NO: 101954 - RNA, 45 nt, Mus musculus
ccaaagcuuugccagugcgguaccugcaggcugucaaguggacag

SEQ ID NO: 101955 - RNA, 46 nt, Mus musculus
aggauccaagcacacuugcuacauauacccccucccucucagacag

SEQ ID NO: 101956 - RNA, 26 nt, Mus musculus
gcaaagaagggacacugaggcagaga

SEQ ID NO: 101957 - RNA, 42 nt, Mus musculus
auagggaaaguuaggugcaggccuugcucagaaucacgcaag

SEQ ID NO: 101958 - RNA, 46 nt, Mus musculus
ggaggaaggggaguccuggacccagucacagagccugcugcaucag

SEQ ID NO: 101959 - RNA, 42 nt, Mus musculus
uucucucuaccccacucuacaggugaggggacugaggcccag

SEQ ID NO: 101960 - RNA, 34 nt, Mus musculus
aaaauacagcagggguuggaagggcuuuuagcua

SEQ ID NO: 101961 - RNA, 46 nt, Mus musculus
acgcucgugcauauaccagagcagauuaaagaaaaaagcauagcca

SEQ ID NO: 101962 - RNA, 46 nt, Mus musculus
ggccaguuagggcuguagugugagucuugucucaugaacccguuua

SEQ ID NO: 101963 - RNA, 100 nt, Mus musculus
ggagagcugugcaauauguuggaaaagcaucuggaaacaguaagagugaagucaaggcaugcuugcugaugagguuuauaugggagacggaaauuguuua

SEQ ID NO: 101964 - RNA, 47 nt, Mus musculus
ggaaauuguuguccauggaagauauucuggugguuauccugagugaa

SEQ ID NO: 101965 - RNA, 45 nt, Mus musculus
agauaugagcaggaagaccaagggaagacuguugcaauaauccag

SEQ ID NO: 101966 - RNA, 88 nt, Mus musculus
agaaguggguugagaauuguaggagagcagacuuagaagauaaaacaccagaucaacuaaauaaacauuaucgacuuugugccaaaca

SEQ ID NO: 101967 - RNA, 46 nt, Mus musculus
uuuucauucacagucuaguuuuucuuaucuuugcuuugacugcuag

SEQ ID NO: 101968 - RNA, 45 nt, Mus musculus
cgugacuuaaccguacacacuuuaguuuuguuuucccauccuuuu

SEQ ID NO: 101969 - RNA, 42 nt, Mus musculus
cucgaggugcucucagcgugguaguagugacagaccacagag

SEQ ID NO: 101970 - RNA, 46 nt, Mus musculus
cuuauaaagggcagcauuuaauugcggcuagcuuacaguuucagag

SEQ ID NO: 101971 - RNA, 45 nt, Mus musculus
accugcccgugcuggugagguuugucgaugacgcccauaaccuga

SEQ ID NO: 101972 - RNA, 45 nt, Mus musculus
uuucacacuacaauaacugagaaauggggauugaauauggaguau

SEQ ID NO: 101973 - RNA, 45 nt, Mus musculus
gaaacucccagggaaguuccggagagcccagcaagguaaccugga

SEQ ID NO: 101974 - RNA, 46 nt, Mus musculus
acauacuauuagcuauugguaauccacguguuuaaauggccccugu

SEQ ID NO: 101975 - RNA, 46 nt, Mus musculus
ucaguuauuaaguuaucaggucuuuggaaaaugaauuuugugagag

SEQ ID NO: 101976 - RNA, 41 nt, Mus musculus
ugacuuggaguuucagguguuuccgagcugugguagcagca

SEQ ID NO: 101977 - RNA, 46 nt, Mus musculus
gugggaaccacauuggcgggucuggguugggguuaaagggagauug

SEQ ID NO: 101978 - RNA, 42 nt, Mus musculus
ccucgcgugcugucgccauagagacgcagccagcccagggag

SEQ ID NO: 101979 - RNA, 47 nt, Mus musculus
ggccccgcagcuggaaaggcaucuggugcagacgagcgcgacacgag

SEQ ID NO: 101980 - RNA, 46 nt, Mus musculus
uaauagucaacuuagaacuauccacacaggacugauuuaagcugag

SEQ ID NO: 101981 - RNA, 46 nt, Mus musculus
ugagaggucuuguuuccauuuauacucuccuaugugaugcccccuu

SEQ ID NO: 101982 - RNA, 46 nt, Mus musculus
augcaugcccuuguccacuuuccaauuacacaaauacuggcugcuu

SEQ ID NO: 101983 - RNA, 45 nt, Mus musculus
guggggacugagaccucauagucggucagugguuugacaggccca

SEQ ID NO: 101984 - RNA, 41 nt, Mus musculus
cuaacugcuggccuggcuaccuccccagcaguguaccccag

SEQ ID NO: 101985 - RNA, 46 nt, Mus musculus
aaguaauuuagacuaaauuugaucacauaaauacaucacaaggcau

SEQ ID NO: 101986 - RNA, 45 nt, Mus musculus
aauacucuugaaggacaaaguuguuauuccaauuuaauagauuag

SEQ ID NO: 101987 - RNA, 46 nt, Mus musculus
ugcucuccucucagugcccaugcagacugcaguccucuguuuggag

SEQ ID NO: 101988 - RNA, 46 nt, Mus musculus
uuaaucccagcacucagaaggcagaggcagaggcagagagagaggc

SEQ ID NO: 101989 - RNA, 42 nt, Mus musculus
gagagagagagagagagagagaggcagagagagaggcagaga

SEQ ID NO: 101990 - RNA, 80 nt, Mus musculus
aagccugugaaacccaucaaagccaagccccaguacaagcccccagaugacaagaugguucaugagaccagcuacagcgc

SEQ ID NO: 101991 - RNA, 23 nt, Mus musculus
cuauggcccugcagcugugcccc

SEQ ID NO: 101992 - RNA, 42 nt, Mus musculus
ugaaauaggucccaggauagauguuagcacugaaugaaagaa

SEQ ID NO: 101993 - RNA, 45 nt, Mus musculus
acaugcucuggccugagcagaauaagacauaauaauucuaaggag

SEQ ID NO: 101994 - RNA, 61 nt, Mus musculus
ggcaggugagcgcugcuacaggcugccuguggauucagaccagagaagccaggugccuaua

SEQ ID NO: 101995 - RNA, 56 nt, Mus musculus
guagagaaaccuaguguucagaguuccaaaccaaaaaagaccucaacgagccauaa

SEQ ID NO: 101996 - RNA, 46 nt, Mus musculus
uuggaagugucugcugcagggcauccuccccuugaacagccccaca

SEQ ID NO: 101997 - RNA, 46 nt, Mus musculus
gugggcuuugaauagugugucaaguaauaggccacuggcugagaag

SEQ ID NO: 101998 - RNA, 42 nt, Mus musculus
ccccagcuugcuuucuccuguggugaaugguucagagggcag

SEQ ID NO: 101999 - RNA, 42 nt, Mus musculus
cugcaugccugccauccugcuucuugcuuuuccaggccacag

SEQ ID NO: 102000 - RNA, 52 nt, Mus musculus
uguuaguuuucauuucagagacuaauuaggauugggagauaggacaggagag

SEQ ID NO: 102001 - RNA, 46 nt, Mus musculus
gcugugagcaaaguaggccugguucccacccucugaacaccuccag

SEQ ID NO: 102002 - RNA, 46 nt, Mus musculus
ggguagacuuuauucaggugaggagcuaagggaacauuuggggcag

SEQ ID NO: 102003 - RNA, 46 nt, Mus musculus
uucuggauacugacuagguauuagaucuucuucagacaaggcacau

SEQ ID NO: 102004 - RNA, 46 nt, Mus musculus
aguaguuaaagagauuuaacuacuaagguaaaaaguuugcuggcag

SEQ ID NO: 102005 - RNA, 46 nt, Mus musculus
aaauaaagacagaaaacgagaaagaaagaaagaaagaaagaaagaa

SEQ ID NO: 102006 - RNA, 45 nt, Mus musculus
uggcaacguuugccucagguggcaguguuugugcaugcucucugc

SEQ ID NO: 102007 - RNA, 37 nt, Mus musculus
ggcugcagucagccacacaaggcaagaauccccugag

SEQ ID NO: 102008 - RNA, 41 nt, Mus musculus
uaugaugaugaugaugaugaugaugaugaugauguguggac

SEQ ID NO: 102009 - RNA, 99 nt, Mus musculus
auguggggggggguaggugagaaggaugaucuggccccuuuucugauaugccgcagaccccuugguuugccaguagccaucccuuaauagagucggggg

SEQ ID NO: 102010 - RNA, 46 nt, Mus musculus
ggucccaaaggcacucaacugcccacagucucaccuucacccccag

SEQ ID NO: 102011 - RNA, 45 nt, Mus musculus
gggaagggaaauaugagccuuuguugcuuucaaaacgagaacagu

SEQ ID NO: 102012 - RNA, 70 nt, Mus musculus
cuccacucccuuuaaccgcaaaacuaggugcuguggccccagacuacccauccuuaaaaugauccuugcc

SEQ ID NO: 102013 - RNA, 78 nt, Mus musculus
gccauuuuguucugcccugcaaguuuuagauccaaucugccucaacagucaaucaguguucauauuuauggccaggca

SEQ ID NO: 102014 - RNA, 46 nt, Mus musculus
uuuuuagacagaauccacuccuaaguuaggacauggagcccagaua

SEQ ID NO: 102015 - RNA, 99 nt, Mus musculus
cauuggccgccugguccggcccaagggagacaagaugcgagaugaguuguagaguccaagagugggcguggcacggcaggaaguagccaaagguuccug

SEQ ID NO: 102016 - RNA, 60 nt, Mus musculus
agugggacaccgagggcaaccccuuugaccaagacaucuacgggcgcgaggagcugcgca

SEQ ID NO: 102017 - RNA, 47 nt, Mus musculus
cugggccugaccgaggccaucgacaagaacaaggcagaccuaucgcg

SEQ ID NO: 102018 - RNA, 95 nt, Mus musculus
gcucgagcgcuuggagaagcugcugaccaaggagcagcugaaggccuggaugggaaagaugcagaagaaggcugucgccaucucccugcccaagg

SEQ ID NO: 102019 - RNA, 45 nt, Mus musculus
gccuguacaacuacuaugacgacgagaaggagaagcugcagaugg

SEQ ID NO: 102020 - RNA, 46 nt, Mus musculus
caaccguggcuucauggugacccgcuccuauacuguggguguuacg

SEQ ID NO: 102021 - RNA, 44 nt, Mus musculus
ggugagucuaggugagaagucuaaucauaacuaguuugucugga

SEQ ID NO: 102022 - RNA, 48 nt, Mus musculus
acuucgugcgcagcagcaagcaacacuacaacugcgaacacuccaaga

SEQ ID NO: 102023 - RNA, 45 nt, Mus musculus
ugggugagcugcuccgcucccucagcaacuccacugcgcgcaacg

SEQ ID NO: 102024 - RNA, 32 nt, Mus musculus
uugugucacugggugguaaagccaccacagcg

SEQ ID NO: 102025 - RNA, 63 nt, Mus musculus
ccccuagaggcggcagccccugguacugcggagaagcuaaguuccaaggcgaccacacuggca

SEQ ID NO: 102026 - RNA, 46 nt, Mus musculus
gcucccuuaggaaauccaugccacuugaaguuucuaaaggcuugau

SEQ ID NO: 102027 - RNA, 42 nt, Mus musculus
gggaugggaacuugaagggaucuuugagguucuagaagagau

SEQ ID NO: 102028 - RNA, 45 nt, Mus musculus
auuugugaguguaccaugaguuacauggucccccugucuuugagg

SEQ ID NO: 102029 - RNA, 45 nt, Mus musculus
cucauucaugaaugugagggccaguguuagagaugguagggagau

SEQ ID NO: 102030 - RNA, 42 nt, Mus musculus
cgcauguuugacagugagaggcggacuaugagccggcgaaaa

SEQ ID NO: 102031 - RNA, 48 nt, Mus musculus
aaaaacugcgaccaccgagcagugacauggaucuggcccccaaggacc

SEQ ID NO: 102032 - RNA, 52 nt, Mus musculus
aacagccuaggagaggagccgauuccuucccugcgcagaggccggaaaaggc

SEQ ID NO: 102033 - RNA, 46 nt, Mus musculus
gcaggggaagaguuuccagguucugacacaauccauuccagcaagg

SEQ ID NO: 102034 - RNA, 54 nt, Mus musculus
auaugaggccagcccucgcauccucaagaagugggagcagaucuuccaggagcg

SEQ ID NO: 102035 - RNA, 46 nt, Mus musculus
agagacucccugauggccgggugcucaguccucucaucaucaaguc

SEQ ID NO: 102036 - RNA, 45 nt, Mus musculus
gcuccacccccauuauugguguucucuugucuacucaaaacaacc

SEQ ID NO: 102037 - RNA, 46 nt, Mus musculus
agagugaggagcaggcucagaacagcuccgcccaacagagccaagg

SEQ ID NO: 102038 - RNA, 45 nt, Mus musculus
ggauugcacauggcaguucacaaacacuuguaguucaauccuaga

SEQ ID NO: 102039 - RNA, 46 nt, Mus musculus
uuauuaugugugugcauuugugugcgcgugcgugugugugugugug

SEQ ID NO: 102040 - RNA, 70 nt, Mus musculus
caaggaauuucuggauccuuuaggcuuugcagguccuagggaggaaaagaguaugguuggaugguuguuu

SEQ ID NO: 102041 - RNA, 46 nt, Mus musculus
gggaugacaaagggcuuuugggugaguagaaggggugaaaagaggu

SEQ ID NO: 102042 - RNA, 45 nt, Mus musculus
cuuuguuucuaagaacagcuccugcuccuuagcguuccuggcagg

SEQ ID NO: 102043 - RNA, 44 nt, Mus musculus
ugcuuugggucccccauagaggaguuagagaaaagacugaagga

SEQ ID NO: 102044 - RNA, 46 nt, Mus musculus
cugaaaggagccugauauggcugucucuugagaggcccugccagag

SEQ ID NO: 102045 - RNA, 46 nt, Mus musculus
aaauggagauaaaguguagagcagagaauaaaggaaaggccaccca

SEQ ID NO: 102046 - RNA, 42 nt, Mus musculus
acagaauacaagagauagaagagagaaucuuguggggcagaa

SEQ ID NO: 102047 - RNA, 46 nt, Mus musculus
uuuuuaaauggguuaaaauuaaugaagccuuaacauaaauggagau

SEQ ID NO: 102048 - RNA, 58 nt, Mus musculus
gaucagauacacaagcuacugcaggaggauuccgaaauggggaagaggaaagcugaug

SEQ ID NO: 102049 - RNA, 46 nt, Mus musculus
cuuccccguacuucucuuccaucucagugaagacuuccucaaagaa

SEQ ID NO: 102050 - RNA, 47 nt, Mus musculus
cgguuuuugcuuggguaagaaauggaagacugaaaaguuguaguuag

SEQ ID NO: 102051 - RNA, 46 nt, Mus musculus
aagcaaauaaagaaaucaucuagcuguaacuguuaagccccuagua

SEQ ID NO: 102052 - RNA, 45 nt, Mus musculus
ccuguguauguguguuauauaaaaagcuauguauuugugccugug

SEQ ID NO: 102053 - RNA, 35 nt, Mus musculus
cuagggcgugguggucuaaauagggagaggcaggc

SEQ ID NO: 102054 - RNA, 45 nt, Mus musculus
guccaaagaaguuauuagaguugcauauuguuguuuugcuuuuga

SEQ ID NO: 102055 - RNA, 80 nt, Mus musculus
uccagaguuuauauucagaacgccaaucaaguuaagcaagccgggagaacucagugaggaguauggaugccugagaaagg

SEQ ID NO: 102056 - RNA, 42 nt, Mus musculus
gggugaaggugauagauugucuuccaaacugagcguggagug

SEQ ID NO: 102057 - RNA, 129 nt, Mus musculus
uguucuaaaagaauauccacuggaagaagaauccacaaccgugauagaaaggagaaguaguguucuucacuuacacagagagcuuuaacaaaccaggaagaugggcuuauguagucaauacggggacca

SEQ ID NO: 102058 - RNA, 54 nt, Mus musculus
gggaggcugagguagguggaccuuggaguuccaggaaaagagccugucuuuaaa

SEQ ID NO: 102059 - RNA, 76 nt, Mus musculus
auuaugucuuggucccaaggucuuccaaauaugaauugaagugcagaagccaugaaagaacaguuguaggucaggc

SEQ ID NO: 102060 - RNA, 46 nt, Mus musculus
aauuuaaaaagugcaucugagaagauuguuauaguuuguaccagaa

SEQ ID NO: 102061 - RNA, 46 nt, Mus musculus
uuauauaaaauaauagaauucauuguauacuaaauaaccagcaaga

SEQ ID NO: 102062 - RNA, 41 nt, Mus musculus
gucagugcucuuaccugcugaaccaucucacuagcccugua

SEQ ID NO: 102063 - RNA, 46 nt, Mus musculus
auuuaugucaguccuaauguuagucaauauacgauaacacccuacu

SEQ ID NO: 102064 - RNA, 27 nt, Mus musculus
ugugucucagcagaggagggaugugga

SEQ ID NO: 102065 - RNA, 27 nt, Mus musculus
ugugucucagcagaggagggaugugga

SEQ ID NO: 102066 - RNA, 46 nt, Mus musculus
cauguugucaccagagaaccuugcuggagaccuagugccuagaguu

SEQ ID NO: 102067 - RNA, 46 nt, Mus musculus
cuguugucugugucugucugucuguacccaaucaccacccacacgc

SEQ ID NO: 102068 - RNA, 46 nt, Mus musculus
uuuaguagugcauauuuguaauaucagcauucagaagucugaggca

SEQ ID NO: 102069 - RNA, 46 nt, Mus musculus
uaagaaauuaaacuuugugagaggggacacucaggcauguucaggg

SEQ ID NO: 102070 - RNA, 41 nt, Mus musculus
ugugguuuagccaggagccauaaacuguaaggaaggaguga

SEQ ID NO: 102071 - RNA, 47 nt, Mus musculus
cccuaggucgugggcuauaauaauuuccuauguccuuugucuguuag

SEQ ID NO: 102072 - RNA, 45 nt, Mus musculus
cugggaucuucguuggaccccuguggggugugcacaagggcagag

SEQ ID NO: 102073 - RNA, 61 nt, Mus musculus
uggggagccucacagaagccuuggagaaacaggcggccuuagcguuccuucaggguagagg

SEQ ID NO: 102074 - RNA, 46 nt, Mus musculus
gcucagggcgccaggcagccagacucgagaggccaggacccuagua

SEQ ID NO: 102075 - RNA, 45 nt, Mus musculus
agcaaggaugaauacuggagguaaaucuaggagaggguacaauug

SEQ ID NO: 102076 - RNA, 48 nt, Mus musculus
acagugaaggagagaaacaagugugaagucacaguguaaaucaaguua

SEQ ID NO: 102077 - RNA, 65 nt, Mus musculus
aguaggaaagcuuuggaaaagagaaggcagagaaaggguuugagguauggguagagaaucaucac

SEQ ID NO: 102078 - RNA, 46 nt, Mus musculus
gauugcagaaacagauagucuaagucuguugaaagggagcagagaa

SEQ ID NO: 102079 - RNA, 52 nt, Mus musculus
cugguuauucguucccaucuuuccagcgggagcagauccuguaacgacacgu

SEQ ID NO: 102080 - RNA, 45 nt, Mus musculus
acuauguguaaggcacuggacuaggugccuagaaggguggacuug

SEQ ID NO: 102081 - RNA, 46 nt, Mus musculus
agaugaaggauuugucagauguaggcauugcucauuacuagcagga

SEQ ID NO: 102082 - RNA, 41 nt, Mus musculus
gcuauggagacacuuagaagucauuugcauucaggacggga

SEQ ID NO: 102083 - RNA, 46 nt, Mus musculus
gcucuaccuggcacccaguagguucuuaaguauguucuggaugaau

SEQ ID NO: 102084 - RNA, 45 nt, Mus musculus
gauuagguuuugcaguuuauaggacuaaguuuauuggugacuagg

SEQ ID NO: 102085 - RNA, 52 nt, Mus musculus
cuggcuagcaguccauaguauuuucaguaauguuagcuacuuuuuagaaccu

SEQ ID NO: 102086 - RNA, 51 nt, Mus musculus
aucaggauauauuauguaagggggaaaaucuauuuucaauaaaagggggag

SEQ ID NO: 102087 - RNA, 49 nt, Mus musculus
uaguuuuucuuuuaucuuuuuauauuuuauuuucuaaugagagauggag

SEQ ID NO: 102088 - RNA, 45 nt, Mus musculus
uuagcagugauauuuaaacaguaaaaccacuuugaaaagggagau

SEQ ID NO: 102089 - RNA, 46 nt, Mus musculus
acgcuucacugacauuugcccacuuuuuguucauuuuagcucuaga

SEQ ID NO: 102090 - RNA, 46 nt, Mus musculus
cuuucuggcaguuaggugucgagagaaagaaacugaggcauaagaa

SEQ ID NO: 102091 - RNA, 45 nt, Mus musculus
uuacuauaacgaaugagcaaagacccuauguaucgucaugaauaa

SEQ ID NO: 102092 - RNA, 45 nt, Mus musculus
caucuccaacugcagaacugggaaaagugaacaguuuccuugaga

SEQ ID NO: 102093 - RNA, 45 nt, Mus musculus
uacaaaaccaaauagcccaggaaaguuagaacaauaauagcaggu

SEQ ID NO: 102094 - RNA, 41 nt, Mus musculus
cuaccaugugguugcugggauuugaacucaggaaaaagcag

SEQ ID NO: 102095 - RNA, 67 nt, Mus musculus
cuagugugugaggaaacgcccagaaaauagaaagagaacugaagagauugaucaggaagcuccaagg

SEQ ID NO: 102096 - RNA, 45 nt, Mus musculus
uuuugcauuucacauguguuggaaaccccaguugucuuugaaaga

SEQ ID NO: 102097 - RNA, 45 nt, Mus musculus
uaaugauuauuugguuccuauuaguuaggacacaguguccagaag

SEQ ID NO: 102098 - RNA, 42 nt, Mus musculus
ucuggguccucauuguugcacagagaaaagugacagggaggc

SEQ ID NO: 102099 - RNA, 46 nt, Mus musculus
uggucucccuacuacauugacuauauggucaaauagaauagcaguu

SEQ ID NO: 102100 - RNA, 44 nt, Mus musculus
gugggauuuaaguuuuggagacaaagauugguuuggcugggggc

SEQ ID NO: 102101 - RNA, 45 nt, Mus musculus
aucccaggcucagggggagcuuugcagacuugagagcagaguggg

SEQ ID NO: 102102 - RNA, 45 nt, Mus musculus
gcccuggaggaucccagcagcgcuuguuucaguguugggcagagg

SEQ ID NO: 102103 - RNA, 46 nt, Mus musculus
uguuggugaagguugaacuuuggagcgaacuguacgcguguugaau

SEQ ID NO: 102104 - RNA, 46 nt, Mus musculus
cacacuggccuagccuggagcugagucacucacuacaucaacggag

SEQ ID NO: 102105 - RNA, 44 nt, Mus musculus
ugacuaagacuuaaaagauuuacagaaaacagauuguggggucg

SEQ ID NO: 102106 - RNA, 46 nt, Mus musculus
acgugucccgugauggcagagcagcaucugauccaggcgaggcaag

SEQ ID NO: 102107 - RNA, 42 nt, Mus musculus
aguugcucaucacacucccuuuuccuggugcuuugcccccag

SEQ ID NO: 102108 - RNA, 44 nt, Mus musculus
uauaggaacucagcauucaguugggcagaaugacugguuugcag

SEQ ID NO: 102109 - RNA, 46 nt, Mus musculus
ucuuaaaacauccauuaguacuccuuucuugaaauuuugcccucag

SEQ ID NO: 102110 - RNA, 46 nt, Mus musculus
uucuguauaagacugccagacaccaaguagguaacaugcagcugag

SEQ ID NO: 102111 - RNA, 45 nt, Mus musculus
ggguguacagagggauaagaggccaccauggaaagugggguguca

SEQ ID NO: 102112 - RNA, 42 nt, Mus musculus
aggcccaccagcaagcaugaggaccggaggucggauccccag

SEQ ID NO: 102113 - RNA, 45 nt, Mus musculus
aagguccaucacacccaagucucuucauuuuuacgcuagcccgag

SEQ ID NO: 102114 - RNA, 42 nt, Mus musculus
augucacuaauguagaaacaucauggacuagcauccccaguc

SEQ ID NO: 102115 - RNA, 46 nt, Mus musculus
uuuuaaugacugaauuuaaccauuuucauaguugguuccuggaggu

SEQ ID NO: 102116 - RNA, 49 nt, Mus musculus
gcaaguaucccaagaaaccaaccuguaagucagguccagccaguccaag

SEQ ID NO: 102117 - RNA, 41 nt, Mus musculus
cccuaccucaugggaugggcaaugcacacacuggcccuuau

SEQ ID NO: 102118 - RNA, 45 nt, Mus musculus
uaccguucaucagggaggcaaaagcgaaacaguggcuuaccuaga

SEQ ID NO: 102119 - RNA, 46 nt, Mus musculus
gaccaagaaggaucacccauacaccuggagaauugagcuggcaaaa

SEQ ID NO: 102120 - RNA, 51 nt, Mus musculus
aaauccauaguggaaggaaucauagaggaggaggaagaagaugaggaagga

SEQ ID NO: 102121 - RNA, 45 nt, Mus musculus
accuaagacuuaauuuuaaauguuauauucuaaccugccccgccu

SEQ ID NO: 102122 - RNA, 42 nt, Mus musculus
acccagcaacaaaguauggcaggagugauggagccaggauuu

SEQ ID NO: 102123 - RNA, 46 nt, Mus musculus
augucuuugugucuuuauacaaucagcuagagaaaguacccaagau

SEQ ID NO: 102124 - RNA, 44 nt, Mus musculus
cugcaccaagaugaucaggaaguuagguguugggacccuggaga

SEQ ID NO: 102125 - RNA, 46 nt, Mus musculus
ugugagccaccaugugguagcugggaauugaacucaggaccacugg

SEQ ID NO: 102126 - RNA, 46 nt, Mus musculus
gcuucauggaggaggccauuccgcccuuuccugggcaguguucacg

SEQ ID NO: 102127 - RNA, 68 nt, Mus musculus
uaccccugucccauggagucaguacuuugagucaauggaagauguggaaguggagaaugaaacuggca

SEQ ID NO: 102128 - RNA, 46 nt, Mus musculus
uauggcugaauaguauuccacuauguauauguauguacgugcacac

SEQ ID NO: 102129 - RNA, 46 nt, Mus musculus
guguugguuaccucauucuauauauuuuuuaguuccauccacuuac

SEQ ID NO: 102130 - RNA, 46 nt, Mus musculus
ccugguuucuauugcuguucuauguggcauacccacaucugaagag

SEQ ID NO: 102131 - RNA, 76 nt, Mus musculus
acuucauucaaccuauauauguauuugacucauuauggccuuuuuagacauccuuacuguuauuuuauuacccccu

SEQ ID NO: 102132 - RNA, 44 nt, Mus musculus
aaaagaacaaaaucagaagucaggaaagcuaggaugccaacaag

SEQ ID NO: 102133 - RNA, 45 nt, Mus musculus
cuuuaaaaaauuaauuuugcccuuauuuauugaguuugugugugu

SEQ ID NO: 102134 - RNA, 46 nt, Mus musculus
uucuaugacugaauuuauucuauuguguuaguauauacccccaacu

SEQ ID NO: 102135 - RNA, 42 nt, Mus musculus
aaaugggaguaaaugguuugcuggaaagggaguagggcuuga

SEQ ID NO: 102136 - RNA, 41 nt, Mus musculus
cagaaguguaagagucaaguucagagaaugagggggugaau

SEQ ID NO: 102137 - RNA, 46 nt, Mus musculus
auugugaagggccuuaucugagcccgagacugagaaaaaccgggag

SEQ ID NO: 102138 - RNA, 45 nt, Mus musculus
uuggccucuacgacucugucaaacaguucuacaccaagggcucag

SEQ ID NO: 102139 - RNA, 46 nt, Mus musculus
caagccugcgggccacuaaccccgcccccaccccucuugcccacag

SEQ ID NO: 102140 - RNA, 45 nt, Mus musculus
gccauugucaacugugcugagcuggugaccuaugaccucaucaaa

SEQ ID NO: 102141 - RNA, 49 nt, Mus musculus
cccugcuucccagcccugcccugucuuuuucuucauccucugcccaguc

SEQ ID NO: 102142 - RNA, 81 nt, Mus musculus
ugaggaggccugacaccagacccugagcccucagcccuuucuacagcuaagcccacaucuucaucuucauccccagcccag

SEQ ID NO: 102143 - RNA, 45 nt, Mus musculus
uggaagcaagaaacucugaagccucagggaacagucugugccuag

SEQ ID NO: 102144 - RNA, 44 nt, Mus musculus
aacuggaguucccgagcgccuuuuugcuuauuuuuuaguacaga

SEQ ID NO: 102145 - RNA, 58 nt, Mus musculus
gguuuugguuuuaauaaauuagaggcuuuuuauaauaaagaaaagaaaagaggaaagg

SEQ ID NO: 102146 - RNA, 76 nt, Mus musculus
aaaggaaaggaaaaaaggaaaagaaaagagaaaaggaaaggaaagggaaaaggaaaaggaaaaggaaaaagaagga

SEQ ID NO: 102147 - RNA, 47 nt, Mus musculus
accagcucaucacccggucuggcugugcagccucccacuuugcagug

SEQ ID NO: 102148 - RNA, 51 nt, Mus musculus
gcugcagaggaggaaagagcaagccagugcucaacacugagaccuuauacc

SEQ ID NO: 102149 - RNA, 50 nt, Mus musculus
uagaagugguguaaaaucuggggacagucuucgggacaggauugacagcc

SEQ ID NO: 102150 - RNA, 42 nt, Mus musculus
cacccucuuuuucuuuuuaaagacagaaucuguguagcccag

SEQ ID NO: 102151 - RNA, 42 nt, Mus musculus
gagggguuccccaggcuggugccaaggugggucaggccccag

SEQ ID NO: 102152 - RNA, 42 nt, Mus musculus
ucucucuuccccccuucucguucugcugccaccuugccccuc

SEQ ID NO: 102153 - RNA, 42 nt, Mus musculus
gagacacaacccuaaccccaagaguuagucuugaacaugcag

SEQ ID NO: 102154 - RNA, 46 nt, Mus musculus
cagcaugagaguuguuaggaugaggggagaaccagaguagcagcag

SEQ ID NO: 102155 - RNA, 59 nt, Mus musculus
gaagagagggcacuucuagggccaggcagagguaaggggucaguagggcaggcaggugu

SEQ ID NO: 102156 - RNA, 70 nt, Mus musculus
acagguagggagaaggcaggcagaaguaaacggucaguacagcaggcagagagggagcaagacagcuuca

SEQ ID NO: 102157 - RNA, 45 nt, Mus musculus
ucuuguuccuccuccuaggcuuccugcaaucgccucccaccugag

SEQ ID NO: 102158 - RNA, 42 nt, Mus musculus
aucaucaagagagagagagagagagagagagagagaggagcu

SEQ ID NO: 102159 - RNA, 25 nt, Mus musculus
cugaguuuuggguagcaggggugac

SEQ ID NO: 102160 - RNA, 45 nt, Mus musculus
ugcugcaacucaaaguaaggucuguggcgcccucugccagcagau

SEQ ID NO: 102161 - RNA, 45 nt, Mus musculus
ucucauggggcuucugggcauccuggugugcaaccugcucaagcg

SEQ ID NO: 102162 - RNA, 46 nt, Mus musculus
gaagcuucaagaagcugagaaagaaaccuaagguggcuggcguaug

SEQ ID NO: 102163 - RNA, 25 nt, Mus musculus
ggcugggcaaauggcaccauagcua

SEQ ID NO: 102164 - RNA, 45 nt, Mus musculus
agcccccuuccacacacgccuacacuagccuuccugcuaccagau

SEQ ID NO: 102165 - RNA, 46 nt, Mus musculus
cugguagauagagacagcagucagcauuacaucccugcugugugcu

SEQ ID NO: 102166 - RNA, 42 nt, Mus musculus
aagacacuucucuacccaggucuccuuuuucagcccccuggu

SEQ ID NO: 102167 - RNA, 47 nt, Mus musculus
caaggaggaaccugacaccuuccaguguuugaggggccaaggaagau

SEQ ID NO: 102168 - RNA, 41 nt, Mus musculus
cuuagcuaggacccagguaccaguauguuuauugggagcca

SEQ ID NO: 102169 - RNA, 84 nt, Mus musculus
gaaaagggccuucaguccucacagcuggcucaagccccagccucugccuccccaugucucaugcacuggcacaauggucaccuu

SEQ ID NO: 102170 - RNA, 45 nt, Mus musculus
caugcauguguaugaaguuguuguccagggaagugucaugggagu

SEQ ID NO: 102171 - RNA, 46 nt, Mus musculus
gccucggcucucgaucugggcagguaucuagagaacuagucugugg

SEQ ID NO: 102172 - RNA, 42 nt, Mus musculus
guggcugggcaccgaggauggcugguaggggcagggggaguc

SEQ ID NO: 102173 - RNA, 46 nt, Mus musculus
cuacuaccaggaaggucugaggccugccuugcugguuuaaugggau

SEQ ID NO: 102174 - RNA, 35 nt, Mus musculus
uuuugggguguguguguguugugugugugugugca

SEQ ID NO: 102175 - RNA, 46 nt, Mus musculus
guugaggggaacaggcagaggacacaaccgaagcaaagaccaggac

SEQ ID NO: 102176 - RNA, 42 nt, Mus musculus
aggugggaagacagggucuaugcuugggccccuagccuggga

SEQ ID NO: 102177 - RNA, 46 nt, Mus musculus
cugucugugagccuggguguggccacccccugcaggguuggugaga

SEQ ID NO: 102178 - RNA, 46 nt, Mus musculus
cccaaagccuggucuggcucuccugucggucagaaaaccuccagug

SEQ ID NO: 102179 - RNA, 46 nt, Mus musculus
gucagaugcaagcuuggugagugugggaacccacaauguugaagga

SEQ ID NO: 102180 - RNA, 45 nt, Mus musculus
uagacacagagaguuggcuagggugaaacaaagaaguguguagga

SEQ ID NO: 102181 - RNA, 45 nt, Mus musculus
uuuaaauccgggucuagcuuuuccaguguguuggggugcccugga

SEQ ID NO: 102182 - RNA, 45 nt, Mus musculus
cagguggugccugggcuagacucguuccucucagacuuagcaguu

SEQ ID NO: 102183 - RNA, 42 nt, Mus musculus
cagguccccaucgaggaccucgcaguguaugcucuaccccag

SEQ ID NO: 102184 - RNA, 46 nt, Mus musculus
agagaggugcuccuggauucuguuacugucuuggcaaaguauagau

SEQ ID NO: 102185 - RNA, 46 nt, Mus musculus
uugauuucuagugaguccuugucccuuggaguccuaguuaucuauc

SEQ ID NO: 102186 - RNA, 46 nt, Mus musculus
gccguaggaaucuuggcuucucucucugaggugauuuaggugagaa

SEQ ID NO: 102187 - RNA, 41 nt, Mus musculus
cuagcuaaaaauagucuggggccuggccccaaagcuggagg

SEQ ID NO: 102188 - RNA, 45 nt, Mus musculus
agagucacccaucuggaaagacuccagacaucagcuuugccuucu

SEQ ID NO: 102189 - RNA, 45 nt, Mus musculus
uaguuaugucaugaagcguucugaccaccaccauccccccaagaa

SEQ ID NO: 102190 - RNA, 46 nt, Mus musculus
ucaagaaauguuaguucugccaagcucgcaagcuagcucggcaggu

SEQ ID NO: 102191 - RNA, 45 nt, Mus musculus
cuuggccucuagaggcggcuugccugagguuuguugacuagacau

SEQ ID NO: 102192 - RNA, 46 nt, Mus musculus
uuaaacucccagauggcucuccaggagcuguaggguucgcuggggu

SEQ ID NO: 102193 - RNA, 46 nt, Mus musculus
uggaggagaaagguugcucuccaggaaugagagcccacccagcggg

SEQ ID NO: 102194 - RNA, 46 nt, Mus musculus
uucuguaggaggggcucguucugcagccuagguaagggaauggggu

SEQ ID NO: 102195 - RNA, 46 nt, Mus musculus
caucuguucaccuucccaccuucuuccuguucaucccgggccucga

SEQ ID NO: 102196 - RNA, 41 nt, Mus musculus
ggccuacaggucccugagugacccuauuccacagcgucauc

SEQ ID NO: 102197 - RNA, 28 nt, Mus musculus
cuaaauccgggaggcuugggaucagcgg

SEQ ID NO: 102198 - RNA, 45 nt, Mus musculus
cugcucuaaccgccacggucugauccgcaaauacgggcugaacuu

SEQ ID NO: 102199 - RNA, 45 nt, Mus musculus
gcuuuuuacaacauuuaagaaaggaaaaauguaaguauggcuaag

SEQ ID NO: 102200 - RNA, 46 nt, Mus musculus
auuuuagauaggcugggucaagaaaccaugagaacaaugaagaggg

SEQ ID NO: 102201 - RNA, 46 nt, Mus musculus
ggagugccacacauggaagucagugucuaagagauacagggaucuu

SEQ ID NO: 102202 - RNA, 46 nt, Mus musculus
gaugaguugaccauugaggaacaugagguguuagaagugauugaag

SEQ ID NO: 102203 - RNA, 46 nt, Mus musculus
gaaggggaguucaguggucgaaucgguguuuucccaucggugcuag

SEQ ID NO: 102204 - RNA, 45 nt, Mus musculus
acacuccauggacaagagagauccaggcacgugcaaaggagcaag

SEQ ID NO: 102205 - RNA, 42 nt, Mus musculus
agacuaaagacaaugaaaccccagacuuggaaaugguuuaag

SEQ ID NO: 102206 - RNA, 45 nt, Mus musculus
gccacccagcagcccguaucccaguccagauaagaggagcuccca

SEQ ID NO: 102207 - RNA, 45 nt, Mus musculus
aagaugcuuucuuuuuuccauuguaugguuuugccuuuguccaaa

SEQ ID NO: 102208 - RNA, 45 nt, Mus musculus
gaacuguuuaaauaguuuaccugaucuuggcuuaacuuuggcaag

SEQ ID NO: 102209 - RNA, 46 nt, Mus musculus
guuauuugaacucuuuuguuauauuuuaaaauauuuuuuggaagag

SEQ ID NO: 102210 - RNA, 45 nt, Mus musculus
auaacccuucucuccaggccgaauaacccggcgucaccaugcaca

SEQ ID NO: 102211 - RNA, 42 nt, Mus musculus
cguggggcagcuacaaggacugauccuguguccugcagccug

SEQ ID NO: 102212 - RNA, 46 nt, Mus musculus
uucaucuuuaacuuggaagugagaagauaauauaaacugccucaga

SEQ ID NO: 102213 - RNA, 46 nt, Mus musculus
ucuccaacaccauauggggauacauauuugggaggugaaggcccag

SEQ ID NO: 102214 - RNA, 41 nt, Mus musculus
gagcagcacuaagcgcagucgccccagagacuggcacugug

SEQ ID NO: 102215 - RNA, 46 nt, Mus musculus
gggucccuguaggcuggucuccaguuucccgguguucacaucccag

SEQ ID NO: 102216 - RNA, 42 nt, Mus musculus
caguaggaaaguacauugauaguccuggaaccugagggccag

SEQ ID NO: 102217 - RNA, 45 nt, Mus musculus
gccucuuccauuuuucacaagucucacucucugagaacucaggca

SEQ ID NO: 102218 - RNA, 47 nt, Mus musculus
accaaugcuggggacaaacauggcuagguagcacuugaagagagaac

SEQ ID NO: 102219 - RNA, 46 nt, Mus musculus
aaggaaaacaaauuugauugcgugggugcaucaaaauuagcaccaa

SEQ ID NO: 102220 - RNA, 45 nt, Mus musculus
uuuggggcuaagcagcaccagagcuggaaacagcaggcaagccaa

SEQ ID NO: 102221 - RNA, 41 nt, Mus musculus
cuggcccuagcuuucacuggguagaugggacagggcuccca

SEQ ID NO: 102222 - RNA, 46 nt, Mus musculus
uuacuucgcuaugugguuccugcucacagguccccgguccucugau

SEQ ID NO: 102223 - RNA, 44 nt, Mus musculus
gcuccugacugcugucuugcccugagccacccugggggugcacu

SEQ ID NO: 102224 - RNA, 42 nt, Mus musculus
cucaucagccccucacugccaucccccuccucccugccccau

SEQ ID NO: 102225 - RNA, 46 nt, Mus musculus
agcauguugcugauugcaugugggcuccuccccacaguguccacca

SEQ ID NO: 102226 - RNA, 45 nt, Mus musculus
cuccuggcucgggcgggccgcgauggcagcuuccuggugcgagau

SEQ ID NO: 102227 - RNA, 42 nt, Mus musculus
aguugaggccggcgcugcgggcggcggcggcugcgcggagau

SEQ ID NO: 102228 - RNA, 43 nt, Mus musculus
cuuuccgaaccuugaucccgcaaggcugugggggugccgagua

SEQ ID NO: 102229 - RNA, 41 nt, Mus musculus
ggguaucggaucucuuugggaucuugugggaugugucagga

SEQ ID NO: 102230 - RNA, 43 nt, Mus musculus
gccugcggguguggggcguggugccaggcaauuugguggagau

SEQ ID NO: 102231 - RNA, 45 nt, Mus musculus
ggucugcaguaugucgcccauaggggaggauggagagccugagag

SEQ ID NO: 102232 - RNA, 32 nt, Mus musculus
uugaucucgcugcugcaggguggcauugagcc

SEQ ID NO: 102233 - RNA, 45 nt, Mus musculus
ugugugaccgaggucugcgcauugucccuagcaucauuggcagcc

SEQ ID NO: 102234 - RNA, 42 nt, Mus musculus
uccuucuguucccgcucccgcugcuccaucaggcuucgagac

SEQ ID NO: 102235 - RNA, 44 nt, Mus musculus
ucacuuccuucuccuggaccugcuggauggcuuuggccagacug

SEQ ID NO: 102236 - RNA, 46 nt, Mus musculus
cccucuccuguugcccacgcuccucuugcugcuggcccuggcucuu

SEQ ID NO: 102237 - RNA, 45 nt, Mus musculus
ucugccuuggcugccuucuccugagccaggucagccugggccugg

SEQ ID NO: 102238 - RNA, 45 nt, Mus musculus
caaagucuguugaagcuccuucagcucuguucuuugagcugccuc

SEQ ID NO: 102239 - RNA, 45 nt, Mus musculus
acuggguuccugggccagaagcaucuucuccacuggcacccccug

SEQ ID NO: 102240 - RNA, 48 nt, Mus musculus
cgggcuugaucuaguucuacuuccagaaacugccggccaagguuggcc

SEQ ID NO: 102241 - RNA, 46 nt, Mus musculus
cuccuguuccagaaagcucuaugugaguauggcucugcgaugaggc

SEQ ID NO: 102242 - RNA, 42 nt, Mus musculus
uuugauuaucccauuuucuuagaaugccuguagagacuagga

SEQ ID NO: 102243 - RNA, 46 nt, Mus musculus
uauuuucucuuccaucaaaagacagcuauuguugaaacagccagac

SEQ ID NO: 102244 - RNA, 47 nt, Mus musculus
aucaugaucuccacuguccugaagcaucccuucugagagaaagacgg

SEQ ID NO: 102245 - RNA, 44 nt, Mus musculus
augauauuccacacaguauugcuucuaacucauuugcagccaga

SEQ ID NO: 102246 - RNA, 24 nt, Mus musculus
ucugaucuucagagaauaccgugg

SEQ ID NO: 102247 - RNA, 26 nt, Mus musculus
guucagcugggucuggaggcgcugga

SEQ ID NO: 102248 - RNA, 46 nt, Mus musculus
aaggcuagucuccaagggggccugaccccgagcaggagugggggug

SEQ ID NO: 102249 - RNA, 81 nt, Mus musculus
ggcaacaguagcagugccaguuguggugguggcaaugcguggagaacggcggguuccacugcgaggauugggggagaccuu

SEQ ID NO: 102250 - RNA, 45 nt, Mus musculus
gaaaugugggguccucaauuaugaguggcuagccaagacagagau

SEQ ID NO: 102251 - RNA, 41 nt, Mus musculus
uggccgccauuggccugggagcugagagaaggcacugaggg

SEQ ID NO: 102252 - RNA, 46 nt, Mus musculus
cucucagcacuucagcuucuagcggcgaugcaugugaucaagcgag

SEQ ID NO: 102253 - RNA, 45 nt, Mus musculus
ugggaaucucccgugaugcauguuggaaaccaagucagguccuuu

SEQ ID NO: 102254 - RNA, 46 nt, Mus musculus
acuuacaaaaaacgauucuaguuuuaggccagccaaggguacauag

SEQ ID NO: 102255 - RNA, 46 nt, Mus musculus
gaauuuaugauacucugaagcagugugccuugauuucuaaguccgc

SEQ ID NO: 102256 - RNA, 45 nt, Mus musculus
uauuuuguuguuucuuauguuggguauuauauuuucauugcugag

SEQ ID NO: 102257 - RNA, 45 nt, Mus musculus
uucagacuaauggcaauucuaauggccuugugccaaugcugagag

SEQ ID NO: 102258 - RNA, 50 nt, Mus musculus
gcgaucucuucuuugcacuuuggaucccagaucucuucaugaagcgagug

SEQ ID NO: 102259 - RNA, 46 nt, Mus musculus
ggucuggacgaggucuggggagaggaguuugagaaguuauaugaaa

SEQ ID NO: 102260 - RNA, 42 nt, Mus musculus
cgcuugagaacgcugcucgcuuuucauguugcuaggcaccag

SEQ ID NO: 102261 - RNA, 45 nt, Mus musculus
auagaaaauagauuucaggguuggagaaaugguucaguaguuaag

SEQ ID NO: 102262 - RNA, 45 nt, Mus musculus
cauucauuuuuuucccucauuagcaaagcuuugagaauuugccua

SEQ ID NO: 102263 - RNA, 45 nt, Mus musculus
agacggagaccgguaccccauacaugcucuacaaagauuccugua

SEQ ID NO: 102264 - RNA, 42 nt, Mus musculus
ucacaccggaacauacguaugacuuugagaaacuggcagaag

SEQ ID NO: 102265 - RNA, 53 nt, Mus musculus
gaugagauaccccuuugagagcccagaagcccaguuauuaaauaagcagaucu

SEQ ID NO: 102266 - RNA, 45 nt, Mus musculus
ucccaggcugcuucugagcaauaugcuuaauggagccaugucuaa

SEQ ID NO: 102267 - RNA, 46 nt, Mus musculus
uuacgaaggggcuggcagucauagaggcacacagagaagaugagug

SEQ ID NO: 102268 - RNA, 48 nt, Mus musculus
aacaguuuacuuauugccccaaugccuacugcuucaacugcccagauu

SEQ ID NO: 102269 - RNA, 46 nt, Mus musculus
ugucugaccuucagcuuacccuguagcugaggauagccuugcacag

SEQ ID NO: 102270 - RNA, 45 nt, Mus musculus
aaguugcauuucuagugauuuuacucaaguacuauuguucaguca

SEQ ID NO: 102271 - RNA, 47 nt, Mus musculus
aauccucacuuacugaaagaucuuacugagcggggcuuguggaauga

SEQ ID NO: 102272 - RNA, 57 nt, Mus musculus
uaauccaauccaguucacucugaacaaggaaaaacugaaagauaaggaaaaggcacu

SEQ ID NO: 102273 - RNA, 46 nt, Mus musculus
agacgcagcgggcucuccugcccgccgaggcagacgauuugagcau

SEQ ID NO: 102274 - RNA, 27 nt, Mus musculus
cuuggacgugccugccaggacagggag

SEQ ID NO: 102275 - RNA, 45 nt, Mus musculus
ugcagucaccccaagacagcagagagaagucacagaaugugagag

SEQ ID NO: 102276 - RNA, 59 nt, Mus musculus
ggguugaagauaauggagcaccauaugaugguaggggugggaggaagaaagaggcaggg

SEQ ID NO: 102277 - RNA, 76 nt, Mus musculus
agacaugagauccugucuuuaaaagagagagagaaacagggagagagaggaggaggaggaggaaaagaagggagaa

SEQ ID NO: 102278 - RNA, 41 nt, Mus musculus
cacgcccccucucccucaccucuauucuaggugacuggaag

SEQ ID NO: 102279 - RNA, 45 nt, Mus musculus
aaacccagugaugggaggccuccaggccuggaaagccagugagga

SEQ ID NO: 102280 - RNA, 45 nt, Mus musculus
gccaguuaggaacaagcuggccauuuugggcaugguaacagaaga

SEQ ID NO: 102281 - RNA, 46 nt, Mus musculus
gauggagauccaggugugagaggucucaagaccaggaaugccagug

SEQ ID NO: 102282 - RNA, 46 nt, Mus musculus
auccaugcaccgcuuuggcaagcacaagucaccuauggccaugauc

SEQ ID NO: 102283 - RNA, 42 nt, Mus musculus
gagauugccauggcauugaaaaagaagauuuuaagcauggua

SEQ ID NO: 102284 - RNA, 45 nt, Mus musculus
uuuucaccuuccucacccaccgcuuuggucaccaugugccccgaa

SEQ ID NO: 102285 - RNA, 45 nt, Mus musculus
uuuucaccuuccucacccaccgcuuuggucaccaugugccccgag

SEQ ID NO: 102286 - RNA, 46 nt, Mus musculus
ggaaaaccuuaagcaugguaggaagagaggaaauggacagucccag

SEQ ID NO: 102287 - RNA, 45 nt, Mus musculus
gauggugugccccgaauaucucucaggguaagaguuuacaguaag

SEQ ID NO: 102288 - RNA, 42 nt, Mus musculus
acugguaccagcaaugcggggcagagucaggauggcggugua

SEQ ID NO: 102289 - RNA, 45 nt, Mus musculus
guguggugagaguuagacccaggucagugagggccagcauggaga

SEQ ID NO: 102290 - RNA, 45 nt, Mus musculus
gggcaggcgcuugagcaggaaaagggagggaagaacagccaagac

SEQ ID NO: 102291 - RNA, 44 nt, Mus musculus
guguggugagaguuagacccaggucagugagggccagcauagag

SEQ ID NO: 102292 - RNA, 45 nt, Mus musculus; identical to SEQ ID NO: 102290

SEQ ID NO: 102293 - RNA, 31 nt, Mus musculus
gccgcccaaagcgguguguaaagaaggugaa

SEQ ID NO: 102294 - RNA, 45 nt, Mus musculus
ugagaggcacuauuuaagcaugauuaggagaccaggucuuguugg

SEQ ID NO: 102295 - RNA, 42 nt, Mus musculus
cccaggcuggagugcgcgugcgucugcagaggaguggagauc

SEQ ID NO: 102296 - RNA, 46 nt, Mus musculus
agcuuucuugcuauggaaucuugcacauuuaugaucauggccuucg

SEQ ID NO: 102297 - RNA, 46 nt, Mus musculus; identical to SEQ ID NO: 102296

SEQ ID NO: 102298 - RNA, 46 nt, Mus musculus
cuuuggccacagcucccucugcuuugauccugagcacaacacggaa

SEQ ID NO: 102299 - RNA, 42 nt, Mus musculus
ccugauggugaugagaaggguggcauuggcccccauggccag

SEQ ID NO: 102300 - RNA, 78 nt, Mus musculus
aggcauaggagcugauggcuguggcaccaaaccagaaaauagccagcaucuugggcagaguggaaagggagaggacca

SEQ ID NO: 102301 - RNA, 46 nt, Mus musculus
caccagcccauguuuuuguuucuugcaaugcucucuuuuguugauc

SEQ ID NO: 102302 - RNA, 46 nt, Mus musculus
uugugacuuuuauaaguugauugcuacugcuacucuugucuuagau

SEQ ID NO: 102303 - RNA, 45 nt, Mus musculus
ccaggaagccacuuauaggcccauggugggaggaugggaccaagg

SEQ ID NO: 102304 - RNA, 46 nt, Mus musculus
cauuuaggaacacauaauuucauauuacuugcauuuaaggaaggaa

SEQ ID NO: 102305 - RNA, 41 nt, Mus musculus
acgcagcgguucuucucugaacagcaacagaacaaacagau

SEQ ID NO: 102306 - RNA, 42 nt, Mus musculus
uaaucccugcuggaacacagcauagcaugauggcgaccacag

SEQ ID NO: 102307 - RNA, 43 nt, Mus musculus
gauugcuuugccucagacacuucagccccaguuacagcacacg

SEQ ID NO: 102308 - RNA, 46 nt, Mus musculus
aaguacagaagccuggucagacaaauuuuuauaacacugcccaauc

SEQ ID NO: 102309 - RNA, 46 nt, Mus musculus
caaucaggucuugccuuucagcagacuucaaauacucagcccaucc

SEQ ID NO: 102310 - RNA, 48 nt, Mus musculus
gaauuauucaguucuucaauucaaccauacagaucacagccagccuuu

SEQ ID NO: 102311 - RNA, 41 nt, Mus musculus
guuagguaagugugugugugugugugugugugugugugugu

SEQ ID NO: 102312 - RNA, 30 nt, Mus musculus
ccacauguauguggacaccuguggaggaca

SEQ ID NO: 102313 - RNA, 46 nt, Mus musculus
uuggauguaagugcugcacucuauaaguacuuauuuugggacaagg

SEQ ID NO: 102314 - RNA, 41 nt, Mus musculus
uggggccaaaauagaggaaugggaagaugggggauggggag

SEQ ID NO: 102315 - RNA, 42 nt, Mus musculus
cgcacccaggccacucuguaugcgacgcacggagcccgccag

SEQ ID NO: 102316 - RNA, 46 nt, Mus musculus
cugagcuauccuccaggaauccaaagaagaacaacgcaguccagua

SEQ ID NO: 102317 - RNA, 42 nt, Mus musculus
ccagagugccuuuggguggcagaaccucacuugccccgccug

SEQ ID NO: 102318 - RNA, 45 nt, Mus musculus
uugaaaggacugggcccugccggcccuuuugaaaugguguacugg

SEQ ID NO: 102319 - RNA, 46 nt, Mus musculus
ugcuggacaacuccaguggcugguggaggagcuucaggcugcugag

SEQ ID NO: 102320 - RNA, 46 nt, Mus musculus
uuucucuaccauaagggccacccaccuucagagcccugcggcacac

SEQ ID NO: 102321 - RNA, 46 nt, Mus musculus
guaucagaaaagggauacauucccgagugcugcuuaucuaccugag

SEQ ID NO: 102322 - RNA, 46 nt, Mus musculus
aacccuguacuguuaccugauccugcaaggcuguuaaaauaaagag

SEQ ID NO: 102323 - RNA, 42 nt, Mus musculus
uuggagaaauggaacuaagaaaccucuuagaggucuggcagc

SEQ ID NO: 102324 - RNA, 46 nt, Mus musculus
augcagugggagcaccagauaaggggcaucuagcuuagacugaggu

SEQ ID NO: 102325 - RNA, 46 nt, Mus musculus
uuugugggggacuagaggaggguggauugguaagaaaugcccagua

SEQ ID NO: 102326 - RNA, 46 nt, Mus musculus
uguccuucuugauagccaaguugggcugggagcugcucacugcucc

SEQ ID NO: 102327 - RNA, 42 nt, Mus musculus
agauguggccaucaagcugaaguuccuggaagaaaacaaggu

SEQ ID NO: 102328 - RNA, 41 nt, Mus musculus
cuucuaagucuguccgguaggcaucauauuccagccuggga

SEQ ID NO: 102329 - RNA, 46 nt, Mus musculus
ugaccaguguguugaugcuagagacaaagaaguucacagccccuag

SEQ ID NO: 102330 - RNA, 42 nt, Mus musculus
gaacuucuuugucucuagcaucaacacacuggucaccaagac

SEQ ID NO: 102331 - RNA, 46 nt, Mus musculus
uucuucuuugggauggagggauaugaagggcucuacagcugcaguc

SEQ ID NO: 102332 - RNA, 32 nt, Mus musculus
ucuuaggugaguuuacaagacagaacacggag

SEQ ID NO: 102333 - RNA, 46 nt, Mus musculus
auuucuugacgaugucaaacuuuucuccagcgaugccccgggccac

SEQ ID NO: 102334 - RNA, 42 nt, Mus musculus
gcucuggugacggacucauccccacagguaugaaugauagag

SEQ ID NO: 102335 - RNA, 46 nt, Mus musculus
aggcuuugguaugcaugcaucuguagagauaauguccucagaagag

SEQ ID NO: 102336 - RNA, 45 nt, Mus musculus
gguaaacauugccucugcaggguuaaguucccagagagcauagac

SEQ ID NO: 102337 - RNA, 45 nt, Mus musculus
gccugcuggggagggccuaagggagucaggugcaugagauggaga

SEQ ID NO: 102338 - RNA, 45 nt, Mus musculus
uagaaugcugugaaauugcagaggagugggaggggagcgcugcag

SEQ ID NO: 102339 - RNA, 41 nt, Mus musculus
agcgcuccccucccacuccucugcaauuucacagcauucua

SEQ ID NO: 102340 - RNA, 46 nt, Mus musculus
cgugcagguagugaagccacaugcuccauuaauaaaguucccuaac

SEQ ID NO: 102341 - RNA, 46 nt, Mus musculus
uccgaauauccucaaagcggcugcugacuucagcuacuuugagaag

SEQ ID NO: 102342 - RNA, 46 nt, Mus musculus
cuuaaugaacaguuguacucagggcccagcagugcugcccgacgcc

SEQ ID NO: 102343 - RNA, 42 nt, Mus musculus
cugaguacaacuguucauuaagguagcgaaaucgggccccau

SEQ ID NO: 102344 - RNA, 46 nt, Mus musculus
uuccauagaggagacugaggugccuccugucccaaagucagauagu

SEQ ID NO: 102345 - RNA, 34 nt, Mus musculus
aguggcggaaccggcagaaaaauaagcggagaca

SEQ ID NO: 102346 - RNA, 45 nt, Mus musculus
gacgaguacugcuacaauugacccauccaagccaagcccugaguc

SEQ ID NO: 102347 - RNA, 51 nt, Mus musculus
ucuugguggggucucugcuggagaagaaaaaggaaagagaaaaugccagga

SEQ ID NO: 102348 - RNA, 45 nt, Mus musculus
aacccccagccuaccuggcagugacucugaggaggaggaggaggu

SEQ ID NO: 102349 - RNA, 42 nt, Mus musculus
acugggcuguuugaaggaggugaagccuacccuccggggguc

SEQ ID NO: 102350 - RNA, 34 nt, Mus musculus
cugacaccaacucgggaaacuagcaaagucuacc

SEQ ID NO: 102351 - RNA, 42 nt, Mus musculus
ggcaacgcgguggcggugcgcuuguggcuggacaacacagag

SEQ ID NO: 102352 - RNA, 54 nt, Mus musculus
caguguaaggaguaguaguaguaagcaaagccuguugauggaggaacgucuaca

SEQ ID NO: 102353 - RNA, 48 nt, Mus musculus
aaauugucuggaauuacauguagcuggaggaugaguuucugcgcccua

SEQ ID NO: 102354 - RNA, 46 nt, Mus musculus
uaugggaugugaagggguugucaaagaugaccugggguuuaaaagg

SEQ ID NO: 102355 - RNA, 45 nt, Mus musculus
ggaaacgcuuggcagguuguuagucaugcagauuuaaaguucagg

SEQ ID NO: 102356 - RNA, 46 nt, Mus musculus
acuggugacacgagaggugcccuuugcugaccucucuaauauggag

SEQ ID NO: 102357 - RNA, 45 nt, Mus musculus
agccccaaaaggggcugggcucagagcuuugucacuugccacaug

SEQ ID NO: 102358 - RNA, 55 nt, Mus musculus
gcaucauuggcaauaucugagaugaauuucugggcagcuagugagaugagccgaa

SEQ ID NO: 102359 - RNA, 45 nt, Mus musculus
ucaaagccagcgcgguucagguaguaaccagucacugcaucuggg

SEQ ID NO: 102360 - RNA, 42 nt, Mus musculus
acuagaaucugauucuuaacuuuguauuccuaggucccagcc

SEQ ID NO: 102361 - RNA, 46 nt, Mus musculus
ucaucucuuaaucuaugauauaaugccucuuucaaacaagccagaa

SEQ ID NO: 102362 - RNA, 46 nt, Mus musculus
ucuuaguuucuugcucuuaucauuuuauuaucaucccuugacagau

SEQ ID NO: 102363 - RNA, 43 nt, Mus musculus
ccauuaaaaaaaaaaaagaaaaagaacacauuggcugcaaucu

SEQ ID NO: 102364 - RNA, 46 nt, Mus musculus
aagcagggcaagaagguucagucuuccauuacugacacuagcaggu

SEQ ID NO: 102365 - RNA, 102 nt, Mus musculus
cucucaauccuacugugugccaucaaacucaggucuccaaacuucuacuucaagauccucaacaagaugcuauaaccagcauauuuugucucaccccaaccc

SEQ ID NO: 102366 - RNA, 99 nt, Mus musculus
auggcuccugcuucuuagcaaugagucaucuuugccacauguacauacugugaguuacggagacgaugaagacucccucagcagcaucuacauccagag

SEQ ID NO: 102367 - RNA, 42 nt, Mus musculus
caggccucaguagcaaaaguuguuggaaagcaagggcgaggc

SEQ ID NO: 102368 - RNA, 45 nt, Mus musculus
ggggcugcaccguuuccccccuucaucuccaagacaacguccaga

SEQ ID NO: 102369 - RNA, 45 nt, Mus musculus
uguauggugaggcaaggguguguguguguguguguguguguagaa

SEQ ID NO: 102370 - RNA, 46 nt, Mus musculus
acccuguaggcugccuccaggcugggugucccugggccgcguggau

SEQ ID NO: 102371 - RNA, 45 nt, Mus musculus
agggugaacaauggggagucagcuuugcaggaaguucuuuuuuca

SEQ ID NO: 102372 - RNA, 49 nt, Mus musculus
aucuagcuaagggauagagcaugugacugaaaaguaugaggccucaguu

SEQ ID NO: 102373 - RNA, 47 nt, Mus musculus
gcaggcauaucuugugugacaaaguuaugaguuuaggaauggggaug

SEQ ID NO: 102374 - RNA, 46 nt, Mus musculus
cuuaccaugaguauggcaauauguaccuucaaucucagcacaaggg

SEQ ID NO: 102375 - RNA, 46 nt, Mus musculus
acugagccaggagguagugccccauaccuuuaauccuaguacugag

SEQ ID NO: 102376 - RNA, 45 nt, Mus musculus
uaauccagacuauauccaccaugcagcaguccuccugucccugug

SEQ ID NO: 102377 - RNA, 93 nt, Mus musculus
guguagugugugaggccuggaaguagcauuguaaagcccccucauaaugagacccagaccucccugcugacucacacgauccucuuugcacag

SEQ ID NO: 102378 - RNA, 50 nt, Mus musculus
cgguuccaaggucagaaugggaacuacacaagaaugcuacagaucccgaa

SEQ ID NO: 102379 - RNA, 45 nt, Mus musculus
ggcgcuagcacuuuaaacagcuuugggaucaaguccuucuccuag

SEQ ID NO: 102380 - RNA, 42 nt, Mus musculus
gcugacuucuggcucacagugagugcucccuaccugcuagug

SEQ ID NO: 102381 - RNA, 47 nt, Mus musculus
agccauacgcauggcucguucguuggugucgcccagcuuuccauaau

SEQ ID NO: 102382 - RNA, 46 nt, Mus musculus
cuuugaggagaaaauccacaacagccuugggagugauaacugaugu

SEQ ID NO: 102383 - RNA, 44 nt, Mus musculus
acagcucuguacauguuggcucugauaagcaauggacugcugau

SEQ ID NO: 102384 - RNA, 46 nt, Mus musculus
gcacugggccugaaagagcaucucugugcauuauuguaacuguggg

SEQ ID NO: 102385 - RNA, 42 nt, Mus musculus
ugggcaggacagagcuuaguuuccugaaacuauuggcuugag

SEQ ID NO: 102386 - RNA, 45 nt, Mus musculus
uggcacaugcuuguaauccuaguuauuauuaguuggaaagcugag

SEQ ID NO: 102387 - RNA, 45 nt, Mus musculus
caccagcgaugagaccaggaugucccuccucuuugcuaaccaggu

SEQ ID NO: 102388 - RNA, 41 nt, Mus musculus
aguuuuaauguucacuggcucuggugugugugugugugugu

SEQ ID NO: 102389 - RNA, 23 nt, Mus musculus
ggccuggccacacagcccugacu

SEQ ID NO: 102390 - RNA, 45 nt, Mus musculus
uuucuuccugaucuggagucugggagggagucaccaguaccccau

SEQ ID NO: 102391 - RNA, 45 nt, Mus musculus
uggaacacagaugggguacuggugacucccucccagacuccagau

SEQ ID NO: 102392 - RNA, 43 nt, Mus musculus
cauaugaguuuagacuauagccugauggcagauaaugggucag

SEQ ID NO: 102393 - RNA, 46 nt, Mus musculus
guagaaauagaaacacacacagagagacagagaugaagagggggca

SEQ ID NO: 102394 - RNA, 86 nt, Mus musculus
caagacccagauuuacacugcuuaacauuaugaacuagccccuaugcccucaagcaucccaacuccccuucuuccuuuuugccccc

SEQ ID NO: 102395 - RNA, 46 nt, Mus musculus
uaggcagguucuguugacucucuaggaguuuugcuuugugguccag

SEQ ID NO: 102396 - RNA, 46 nt, Mus musculus
acccggggaccugagccuccaccuggaggaacacgugccuguagua

SEQ ID NO: 102397 - RNA, 66 nt, Mus musculus
aagccaccauuauagccccacgcccuggccgcugcgucccaccagcucggaggagacgugcaucaa

SEQ ID NO: 102398 - RNA, 62 nt, Mus musculus
ucagcuccuggugggcucaaggaugugcgugcuccgcggcccauccgcuccacaucacugag

SEQ ID NO: 102399 - RNA, 48 nt, Mus musculus
agcuguuauggcaaagacauggccaguugugacauuggcagugaggau

SEQ ID NO: 102400 - RNA, 52 nt, Mus musculus
aaaucagucugaagaccuucaggaaaucuuuuaaccugaguaaaagcaaaga

SEQ ID NO: 102401 - RNA, 90 nt, Mus musculus
ucagauuuuugucaacuggacacaagcuacaguuauuuggaaagaagaacucuaaauugagaaaaugccuccauaagauuugccuguagu

SEQ ID NO: 102402 - RNA, 42 nt, Mus musculus
gaagaggaggaaggaggagcggcgguaggaggagggccgagc

SEQ ID NO: 102403 - RNA, 44 nt, Mus musculus
ccccucaucuacagucugagaaacagagauguaaaagaggcucu

SEQ ID NO: 102404 - RNA, 44 nt, Mus musculus; identical to SEQ ID NO: 102403

SEQ ID NO: 102405 - RNA, 45 nt, Mus musculus
uggcuggaugacaagcauguggucuuugggaaggugaaagaaggc

SEQ ID NO: 102406 - RNA, 46 nt, Mus musculus
gugggacgugcagguggaaaaagccuuguuccuucccucagcagag

SEQ ID NO: 102407 - RNA, 44 nt, Mus musculus
cccgcuacacauguaguagaggucugccuuaucuggcaucaaug

SEQ ID NO: 102408 - RNA, 45 nt, Mus musculus
cacccgaggccacgaugaggugaaggcagaucuuuugggucauca

SEQ ID NO: 102409 - RNA, 44 nt, Mus musculus
cugaacuucaaggucagauguuuggggcuuuccuaguuauuuau

SEQ ID NO: 102410 - RNA, 44 nt, Mus musculus; identical to SEQ ID NO: 102409

SEQ ID NO: 102411 - RNA, 42 nt, Mus musculus
aggugcaaaaagagaaacaggcuaagaguucaggggcgaugg

SEQ ID NO: 102412 - RNA, 45 nt, Mus musculus
aucuaccucuuuauuucaguuacuuaucuucugggggcuagggca

SEQ ID NO: 102413 - RNA, 42 nt, Mus musculus
aaauuccaugucaacagccaccuaagggggaaggcaggagag

SEQ ID NO: 102414 - RNA, 46 nt, Mus musculus
aguuaacaagucauggcaauaccaguaguacuucagucaagccauu

SEQ ID NO: 102415 - RNA, 46 nt, Mus musculus
guuucuacuugcuggccucccugugccucuaaggcgaccagccacu

SEQ ID NO: 102416 - RNA, 41 nt, Mus musculus
uccauaugcccuaggcauucuacaguuacaaucccagacuu

SEQ ID NO: 102417 - RNA, 36 nt, Mus musculus
gugggcaaguacauccacccugcggccacggaccga

SEQ ID NO: 102418 - RNA, 45 nt, Mus musculus
ggaaaaacagcaaagugguuaggccugcuuagaggauggggagac

SEQ ID NO: 102419 - RNA, 45 nt, Mus musculus
accaggacaagcaccaugucaggaugugacucuagccucggccaa

SEQ ID NO: 102420 - RNA, 47 nt, Mus musculus
gacugguaagacuccaggggauggcagguauuucuuggcagguuggu

SEQ ID NO: 102421 - RNA, 42 nt, Mus musculus
gaaagggcauucugucagaagaacucucaaggcuggggaugg

SEQ ID NO: 102422 - RNA, 45 nt, Mus musculus
gcggaccguauucaggggucucgccacuccagaaccacuuuugug

SEQ ID NO: 102423 - RNA, 51 nt, Mus musculus
gcuacaaagaugaaacagucucucaaugaacaagagaagaaagaaaccaca

SEQ ID NO: 102424 - RNA, 41 nt, Mus musculus
guagcuagcugucuucagacacaccagaagagggcaucaga

SEQ ID NO: 102425 - RNA, 45 nt, Mus musculus
gcauacccuagcuuaaauccucaaugcuguaggaggauguugagg

SEQ ID NO: 102426 - RNA, 45 nt, Mus musculus
cuuguucauuaaaaagugagacaaucuggggauauagcuuagugg

SEQ ID NO: 102427 - RNA, 45 nt, Mus musculus
uauguguauagaaaauuucucagaucaaaugacuuagccuaaaaa

SEQ ID NO: 102428 - RNA, 45 nt, Mus musculus
ucccuacacauaugucuguguaccauaugcaugccuggugccaga

SEQ ID NO: 102429 - RNA, 45 nt, Mus musculus
aauaguccaauaaaauacauuuaaugcacugaguaggccagcugu

SEQ ID NO: 102430 - RNA, 46 nt, Mus musculus
gaaaggauauugacuguagauguuguugagaggaggggacaacugc

SEQ ID NO: 102431 - RNA, 45 nt, Mus musculus
aaaaagcucuagccaaacuaaguagaauucaggccaggggaagau

SEQ ID NO: 102432 - RNA, 46 nt, Mus musculus
gccuagguucacugaaauugcuauuucuggccccaguauggcaaca

SEQ ID NO: 102433 - RNA, 42 nt, Mus musculus
ggccgagcgccgccgucgcucgcccggcgcggagcccagcag

SEQ ID NO: 102434 - RNA, 45 nt, Mus musculus
aaggcuuguguguugcccccucccuuguucuuuucuuuccccaag

SEQ ID NO: 102435 - RNA, 45 nt, Mus musculus
cuccggauccuguacugcuccauuccucaggacggugucguggga

SEQ ID NO: 102436 - RNA, 44 nt, Mus musculus
uuacauuagcacuuagcucucaggagacagauaaucaguuacag

SEQ ID NO: 102437 - RNA, 45 nt, Mus musculus
guggcaacucacaaauggcuguaccucuaguuccaggggcuccau

SEQ ID NO: 102438 - RNA, 46 nt, Mus musculus
ccacaaaacgcuuuacacaaaucuuuaaaaaaaaaaaaaagccuag

SEQ ID NO: 102439 - RNA, 45 nt, Mus musculus
ugguaguugugagccaccacgugguugcugggauuugaacucagg

SEQ ID NO: 102440 - RNA, 42 nt, Mus musculus
gcuugagauacauacauucaaugucuuugguucacauggaua

SEQ ID NO: 102441 - RNA, 46 nt, Mus musculus
gggggucccuacccucaguccaaugguuggcuauaaguaucugcag

SEQ ID NO: 102442 - RNA, 68 nt, Mus musculus
uaagcagaccuaagaggacauuauaagucuauauucaaccccuccuacuauauauuauuuguaguuuc

SEQ ID NO: 102443 - RNA, 47 nt, Mus musculus
uuuuucucuuuuaaauuuuacagaacuauagccaucuaccgaaagca

SEQ ID NO: 102444 - RNA, 38 nt, Mus musculus
cuggugaagcauucaguguuguugucugcaucuagaaa

SEQ ID NO: 102445 - RNA, 37 nt, Mus musculus
aaauggcagccaaaguugcagcugaggaacgggcacu

SEQ ID NO: 102446 - RNA, 46 nt, Mus musculus
cuguugcaguguggugaaaggugucuuuccugguugugaccucuag

SEQ ID NO: 102447 - RNA, 46 nt, Mus musculus
uggcaccuggagcagcagcaggccauucagacaacagaggcggaga

SEQ ID NO: 102448 - RNA, 81 nt, Mus musculus
ggagcuggaacagcagcgugucaugaaggagcaggcauugcaggaggccauggcacagcuggaacaguuggaguuggagcg

SEQ ID NO: 102449 - RNA, 45 nt, Mus musculus
cuagggaguuaaaaagaagcuagagauggcaacacauaugaccaa

SEQ ID NO: 102450 - RNA, 45 nt, Mus musculus
ucaucugaucaccaacuggggacccgcagcguucacccaggcaga

SEQ ID NO: 102451 - RNA, 91 nt, Mus musculus
uuucggaacugcgaaggaguaucuggcccugcaguguccgcgccuaggaaagcgagugaacccaauaacaucagggugauggaaaccagcu

SEQ ID NO: 102452 - RNA, 46 nt, Mus musculus
agaaggaaggacaccucaucaaccggggcuuuggucccaaccaccu

SEQ ID NO: 102453 - RNA, 29 nt, Mus musculus
uccuugucuuugucuguuagcugguagau

SEQ ID NO: 102454 - RNA, 45 nt, Mus musculus
gaaaggugggcuccucucaagcaagacuggaggguagagauggag

SEQ ID NO: 102455 - RNA, 42 nt, Mus musculus
ccagccauggccacguggagagaagggggaagggaaggggag

SEQ ID NO: 102456 - RNA, 46 nt, Mus musculus
accaggucuccggugcaagucucacuugaccagaaaacaggcugcc

SEQ ID NO: 102457 - RNA, 42 nt, Mus musculus
aaacauuaaagaauaaaaagaggggacccagagaaucaccau

SEQ ID NO: 102458 - RNA, 42 nt, Mus musculus
acuguggagggauaggaguguagaaaacggggaggggggcac

SEQ ID NO: 102459 - RNA, 45 nt, Mus musculus
guagaccccagggaacuggaauuuccccuggaaucucaugcugga

SEQ ID NO: 102460 - RNA, 45 nt, Mus musculus
auugugguuauagugagugaagcuccacuuuucacugccauuuuu

SEQ ID NO: 102461 - RNA, 45 nt, Mus musculus
cuuauuaauuguuuucuauuuuacuuuacccucagaguggccuga

SEQ ID NO: 102462 - RNA, 46 nt, Mus musculus
uaucuugucuaccaauguccaaucaggaggcuggggucuagcagag

SEQ ID NO: 102463 - RNA, 45 nt, Mus musculus
cuaauuguugaagacaaaguaagaagagagggaagugggugccac

SEQ ID NO: 102464 - RNA, 50 nt, Mus musculus
guggcugugcacugggaggaaucauaguuaucuggggcugaagcuuuggc

SEQ ID NO: 102465 - RNA, 47 nt, Mus musculus
ucaucugcauuaagcuguccuuucuuagaaaaccgagguggcauauc

SEQ ID NO: 102466 - RNA, 43 nt, Mus musculus
uaaacuugccccccaucucuccaaacugcgauugcgugggagg

SEQ ID NO: 102467 - RNA, 44 nt, Mus musculus
ccccaagugggucccuauccauuuucauccuuggcggcaugaac

SEQ ID NO: 102468 - RNA, 46 nt, Mus musculus
gcugccaccgcagcugccuccucuggauccggucgucggggacggg

SEQ ID NO: 102469 - RNA, 45 nt, Mus musculus
uuagcgucugggagcuuugcugaagagagggacgugugcccaucg

SEQ ID NO: 102470 - RNA, 46 nt, Mus musculus
aaagaaaacuagaaaauggaaauugucuuuuucaaagcaggguaac

SEQ ID NO: 102471 - RNA, 42 nt, Mus musculus
agggccaggaagcuggagugguggguuggugagcagggggag

SEQ ID NO: 102472 - RNA, 45 nt, Mus musculus
caaaucccaacaaccacaugguggcucacaaccauccuuaaugag

SEQ ID NO: 102473 - RNA, 28 nt, Mus musculus
cuauagagaaacaggucuuaaaaaaaga

SEQ ID NO: 102474 - RNA, 45 nt, Mus musculus
aauaugacuggauaaauagaacaaaguggacggcuaaaaaugcgg

SEQ ID NO: 102475 - RNA, 42 nt, Mus musculus
ucaacucagggauaccgccuaagccaccucaaagggccccga

SEQ ID NO: 102476 - RNA, 24 nt, Mus musculus
uguuuuaacaggugggcugcagug

SEQ ID NO: 102477 - RNA, 46 nt, Mus musculus
gccggaggaugggaggaccggcuuccccguagugaaaagcgccuac

SEQ ID NO: 102478 - RNA, 47 nt, Mus musculus
cgaccgcucgucuccgcccugccugcgggggccugguggagguggcg

SEQ ID NO: 102479 - RNA, 42 nt, Mus musculus
ccuccaccaggcccccgcaggcagggcggagacgagcggucg

SEQ ID NO: 102480 - RNA, 41 nt, Mus musculus
uaagacucccggacuucuuggcuucccuugaacagucagua

SEQ ID NO: 102481 - RNA, 46 nt, Mus musculus
gugcuaucaaacucaguggagugccuguuugcuguuuaaggcugag

SEQ ID NO: 102482 - RNA, 46 nt, Mus musculus
acgaacuaaagaucuugccucuggaacaguuucaacaacugagagu

SEQ ID NO: 102483 - RNA, 46 nt, Mus musculus
uuuccaacauuuagaaaauagaacaacaaguacaacccugcauaau

SEQ ID NO: 102484 - RNA, 46 nt, Mus musculus
ugauagagaugugcacauauccugcuuugcacaaacuuaccuguug

SEQ ID NO: 102485 - RNA, 46 nt, Mus musculus
aguuccugcuuccugggauauacaccgaagugcucuugaaaugcag

SEQ ID NO: 102486 - RNA, 46 nt, Mus musculus
uucuauuucuccggguacuuguuuaguaagugacaauacagugcag

SEQ ID NO: 102487 - RNA, 46 nt, Mus musculus
aaaaaaaaaaccaaccaaauuccuguaacuuagucaguagaaccag

SEQ ID NO: 102488 - RNA, 47 nt, Mus musculus
agcaaguugguagagccaaggucuacauaguuagaauucaggagaga

SEQ ID NO: 102489 - RNA, 34 nt, Mus musculus
ugccugugcacaacaaauguucccgauacucuug

SEQ ID NO: 102490 - RNA, 24 nt, Mus musculus
ucuucugugaggaggaugccccuu

SEQ ID NO: 102491 - RNA, 45 nt, Mus musculus
ucuguggcgguguaacuaaagugguguaacuaaaaauggcuaugu

SEQ ID NO: 102492 - RNA, 46 nt, Mus musculus
guguccccagcauccacugcuuaaaacaguauaccuaacauaaaca

SEQ ID NO: 102493 - RNA, 46 nt, Mus musculus
acacagaaaaauccugucucgaaaaaaccgagagagagagagagag

SEQ ID NO: 102494 - RNA, 46 nt, Mus musculus
gagagauaagaaaugaccucauuuuaaaugccagucuagccuaaag

SEQ ID NO: 102495 - RNA, 46 nt, Mus musculus
cuacagaaauuaggagcggguacugcuccuuuagaggacugaguuc

SEQ ID NO: 102496 - RNA, 46 nt, Mus musculus
aggagagcagagguuggaugucacagcccagcccuucauguccuag

SEQ ID NO: 102497 - RNA, 45 nt, Mus musculus
aacagccacauugugaucuaguggguaaggaaaugagauugacua

SEQ ID NO: 102498 - RNA, 46 nt, Mus musculus
uaaugguaacauuucuucuugcauacaaaugugugucugcuuucau

SEQ ID NO: 102499 - RNA, 42 nt, Mus musculus
uuuauacuuuacucucacacauguuaaagaaguugggcgcua

SEQ ID NO: 102500 - RNA, 46 nt, Mus musculus
agacuauaaauucagucugcaguacgacacagugaggagaggugag

SEQ ID NO: 102501 - RNA, 44 nt, Mus musculus
cagaagcuggguagauauagguaacucauguugaggucgccauu

SEQ ID NO: 102502 - RNA, 67 nt, Mus musculus
accuagagucuuauguauaauacaagacacuacuaacucgaagacagugagugaacggaucacauua

SEQ ID NO: 102503 - RNA, 46 nt, Mus musculus
aaagaaguccuuuugagggucugugauuaagcugagcugggaugca

SEQ ID NO: 102504 - RNA, 46 nt, Mus musculus
ccacuggucauccgaccuuauggguccagccaagcguuugcuagug

SEQ ID NO: 102505 - RNA, 46 nt, Mus musculus
aggcacucauuuucacaagacucacuagauccucuuggaacccaag

SEQ ID NO: 102506 - RNA, 47 nt, Mus musculus
gaaacuuaaaauacccaagauaaaauuugcaaaacacaugaaacuca

SEQ ID NO: 102507 - RNA, 46 nt, Mus musculus
auaaaaaaauaucuaauaaaaacaaaaacaagaauuaaucaggcaa

SEQ ID NO: 102508 - RNA, 46 nt, Mus musculus
caccauuaugauguucuauaguuugcaaaauaucauuuuuaggaag

SEQ ID NO: 102509 - RNA, 46 nt, Mus musculus
uauaugggcuaggaaucaagccccaggccucugggaaagcagccag

SEQ ID NO: 102510 - RNA, 58 nt, Mus musculus
guggagcagaaaaugaaggcaguugccacagcgaccagaugaguaaugauuucuccac

SEQ ID NO: 102511 - RNA, 41 nt, Mus musculus
ugucugucugucugucugucucugucugucugucucucucu

SEQ ID NO: 102512 - RNA, 46 nt, Mus musculus
ucuagaaguggacgaguacccagaacacauuaagaaucuggugcag

SEQ ID NO: 102513 - RNA, 50 nt, Mus musculus
cuggaagagcaggaaaagaggcaacgagagauugaacgcaacacgugcaa

SEQ ID NO: 102514 - RNA, 50 nt, Mus musculus
uccugugaaacaaguaaugauggaaaacaagcuggagguucauaaggaua

SEQ ID NO: 102515 - RNA, 93 nt, Mus musculus
ugcuucuaggaggagucaaguccacauacauguuugaucugcuguuggaaacgagaaagccugaucaaauuuuucagucuuacaaaccuggag

SEQ ID NO: 102516 - RNA, 42 nt, Mus musculus
aaagcagagacugucgcugcuccuguaacagugcgugcguau

SEQ ID NO: 102517 - RNA, 46 nt, Mus musculus
uguuucaaaggaagacagaaguacagugaauuguuuguguuuauua

SEQ ID NO: 102518 - RNA, 45 nt, Mus musculus
gugaaacaggguuguugugaccaucaguaaauguucuaguuguga

SEQ ID NO: 102519 - RNA, 45 nt, Mus musculus
gagcgcugcuacaaugaccugcgccuucucagcaugcccagcaag

SEQ ID NO: 102520 - RNA, 46 nt, Mus musculus
agcauaccagaaagcuggaggugauucugguaauguggacgaugau

SEQ ID NO: 102521 - RNA, 46 nt, Mus musculus
agcacugaaaaacugaaaagcuugucacugcagcagcagcagcaag

SEQ ID NO: 102522 - RNA, 48 nt, Mus musculus
ucugaggaacgcucggacucagaugugaauaaugaccggaguacaagu

SEQ ID NO: 102523 - RNA, 66 nt, Mus musculus
ccucuggccaauggacuugacucucacaguaucacaaguaguagaagaacuaaagcaaacgagggg

SEQ ID NO: 102524 - RNA, 36 nt, Mus musculus
ggacaugcaguacauguacuucaaagcugaccccua

SEQ ID NO: 102525 - RNA, 23 nt, Mus musculus
uagcucuaagaccaccuuacaug

SEQ ID NO: 102526 - RNA, 45 nt, Mus musculus
gacgaugacucuucauaacuucuucaagcugaauaugggcguuga

SEQ ID NO: 102527 - RNA, 45 nt, Mus musculus
accugcuuauaagaggcagcuuuucaaaccaggauuuaaacccaa

SEQ ID NO: 102528 - RNA, 25 nt, Mus musculus
aaucaauaauaggagugcauggaua

SEQ ID NO: 102529 - RNA, 53 nt, Mus musculus
uuaggguugauggugcauguugauaagagaaucacccuggcagcuuucaaaca

SEQ ID NO: 102530 - RNA, 47 nt, Mus musculus
accguccgguugaaugagacccuuucaucauuuucagaugacaauaa

SEQ ID NO: 102531 - RNA, 46 nt, Mus musculus
ggguuugagaggaccuuguaguccuuucagugaagaaauaggaaag

SEQ ID NO: 102532 - RNA, 48 nt, Mus musculus
agaucacaauccgacuggggagagcacugaagaagggagaguacagag

SEQ ID NO: 102533 - RNA, 46 nt, Mus musculus
ggcuucuaguccuucaucucucugcugcaguacucacucugcuagg

SEQ ID NO: 102534 - RNA, 42 nt, Mus musculus
uaauuaugaaaggaaaucaggacaggaacucaaauagggcag

SEQ ID NO: 102535 - RNA, 93 nt, Mus musculus
cuagacgcuguguuugcuaaaggcaugacugugcggcaaucaaaagaggagcugauuccucaacucagggagcaguguggcuuagaccucagc

SEQ ID NO: 102536 - RNA, 55 nt, Mus musculus
ggaagaauccuggcacugucuuuuuggauuaucauauuuaugaagaagauauuaa

SEQ ID NO: 102537 - RNA, 42 nt, Mus musculus
gagugacuggaaaagcagucgguuagggacacugaugggcag

SEQ ID NO: 102538 - RNA, 32 nt, Mus musculus
ugaaguccaugucacagcuugccaucuuaaca

SEQ ID NO: 102539 - RNA, 50 nt, Mus musculus
cccuuccaggagcuuguguuggaaagcaauaguguugaugaacuccgaga

SEQ ID NO: 102540 - RNA, 46 nt, Mus musculus
uaggggaaccuuccccugugauauuucuguccuugauauucaucaa

SEQ ID NO: 102541 - RNA, 88 nt, Mus musculus
auaaagggauagaacagaagaagugauggaauugacagaugagcaaagaaaugaauugaugaaaaaggaaagcagccgacugcagaag

SEQ ID NO: 102542 - RNA, 42 nt, Mus musculus
aaagagaaagcacucaagaucuaccuggauggggcgccaaau

SEQ ID NO: 102543 - RNA, 69 nt, Mus musculus
aaucauguugugcacuauggucagauguacuguaaagccaaggaugugcaaagagaaacaagcaaagcc

SEQ ID NO: 102544 - RNA, 46 nt, Mus musculus
ucagcuuccuaaagcuuaggacaccauugcugaacccugcccucac

SEQ ID NO: 102545 - RNA, 45 nt, Mus musculus
cgauccaugaaaucucgucuaugacccccccacaccacaccccaa

SEQ ID NO: 102546 - RNA, 42 nt, Mus musculus
ucccagaaaagccgugccuuaguacuaccuuguagccgccag

SEQ ID NO: 102547 - RNA, 45 nt, Mus musculus
uacacguuugguuguuggaagccucgcauugagaugacagugcag

SEQ ID NO: 102548 - RNA, 46 nt, Mus musculus
uuuacuguguugcaaaggguaggccucacugaagucacgcaccauu

SEQ ID NO: 102549 - RNA, 42 nt, Mus musculus
caaaaggauguacaucuccuguuaccuccuugaaagaccaac

SEQ ID NO: 102550 - RNA, 42 nt, Mus musculus
gggaaaaaaaacaguaaaaacaaaaauaguacgugccugaaa

SEQ ID NO: 102551 - RNA, 46 nt, Mus musculus
ugaauuuaucuuuaguaugauaguuauaugaaaauuauaggguuug

SEQ ID NO: 102552 - RNA, 46 nt, Mus musculus
uucuagcuuucgcgguacauaugugugauaacuuuaauacccauga

SEQ ID NO: 102553 - RNA, 42 nt, Mus musculus
cgcgcccagcaggaggaguugcuagagcgccuguccgccgag

SEQ ID NO: 102554 - RNA, 45 nt, Mus musculus
acaugaagugaggccaugggggugagcucagaguucccacggaug

SEQ ID NO: 102555 - RNA, 47 nt, Mus musculus
ucugauaggccacgguggguaaacaaauagaauaaccauagauagca

SEQ ID NO: 102556 - RNA, 46 nt, Mus musculus
cugucgcaggcucggccgcggccccuccgcacuuggccgccguuuu

SEQ ID NO: 102557 - RNA, 59 nt, Mus musculus
gggcccgaguuaacggaggaggguggcggccugggauugagaggaagaaagugauggga

SEQ ID NO: 102558 - RNA, 44 nt, Mus musculus
cugggaaguagguaucaauggcguugcggagaaaucagcugaga

SEQ ID NO: 102559 - RNA, 45 nt, Mus musculus
aagguacacacagaaaccggaagguguccgaggaguggauuuuag

SEQ ID NO: 102560 - RNA, 56 nt, Mus musculus
uuaaagaaaagugcuaagggcaacauuuaaagagucugguuggggauggauaaugg

SEQ ID NO: 102561 - RNA, 46 nt, Mus musculus
guuuagagaagccuagagcugacuuuuuugaaagaaagaccuagag

SEQ ID NO: 102562 - RNA, 46 nt, Mus musculus
uugggggaaauagccuaugucaaccucuagcuuucauauauagaag

SEQ ID NO: 102563 - RNA, 42 nt, Mus musculus
uuuaagucuuuuauacuuuuuuauaauuuugacuagagccag

SEQ ID NO: 102564 - RNA, 54 nt, Mus musculus
uuuguauauuaagugcauagagagacaguuuuaaaagaaaaggaaauagagcca

SEQ ID NO: 102565 - RNA, 46 nt, Mus musculus
uggaaacuucagugucuuuucauuaaaacuaauaucuauggcucag

SEQ ID NO: 102566 - RNA, 46 nt, Mus musculus
aaggguagacauggagggguauccugaacuugguuguuaauuggau

SEQ ID NO: 102567 - RNA, 47 nt, Mus musculus
gaguaguauaauaacuaggcauauugugagugugucagcguuugagu

SEQ ID NO: 102568 - RNA, 97 nt, Mus musculus
cagacucagguaguauacuuguaguuaguaugcuugggccagacucagguaguauacuuguaguuaguaugcuugggccagacucagguaguauacu

SEQ ID NO: 102569 - RNA, 135 nt, Mus musculus
uguaguuaguaugcuugggccagacucagguaguauacuuguaguuaguaugcuugggccagacucagguaguauacuuguaguuaguaugcuugggccagacucagguaguauacuuguaguuaguaugcuugg

SEQ ID NO: 102570 - RNA, 46 nt, Mus musculus
cccuuaauguccuuucuguugucccguaucuccuuucuaaccccau

SEQ ID NO: 102571 - RNA, 45 nt, Mus musculus
uggaggagcugugauaaagauguagauauauauguuggggcuggg

SEQ ID NO: 102572 - RNA, 45 nt, Mus musculus
auauuuuuaauacaacugaacuaagguaaagaaacuugggaccag

SEQ ID NO: 102573 - RNA, 46 nt, Mus musculus
agccacugguuucuuaggcaaggugcuucuggaaaaguugcugaga

SEQ ID NO: 102574 - RNA, 87 nt, Mus musculus
caagagcgaguggaggaaauccucaguagcaagguaaguuugggagcugagcguauggaaggggguuaaaagaacaugcuugugugg

SEQ ID NO: 102575 - RNA, 26 nt, Mus musculus
auaaagaacauagauagaauauauau

SEQ ID NO: 102576 - RNA, 46 nt, Mus musculus
ugaacuuacccaaccuaaacuggcucucagugaagaagauaaggag

SEQ ID NO: 102577 - RNA, 45 nt, Mus musculus
aaauaggauauaagcaaacagugaacuagaagaaaauaggaugua

SEQ ID NO: 102578 - RNA, 44 nt, Mus musculus
gaaguggauacucacaacuauccauuggacaaagcgcagggucu

SEQ ID NO: 102579 - RNA, 45 nt, Mus musculus
gccccaguaugggggaaugccagggccaggaagcaggaaugggug

SEQ ID NO: 102580 - RNA, 42 nt, Mus musculus
uagaauaaugcugggaagggcuugugguggauccuggugcuu

SEQ ID NO: 102581 - RNA, 46 nt, Mus musculus
gaucaagcauacucaaaccacaguaacauuuuuacauagcccugaa

SEQ ID NO: 102582 - RNA, 46 nt, Mus musculus
aaagcauauugaugaaguaguuuauccacccccuguagaucccaag

SEQ ID NO: 102583 - RNA, 46 nt, Mus musculus
ggcuauguauuuuaagguguuguuuuuaauuucaacaaaggcaggg

SEQ ID NO: 102584 - RNA, 73 nt, Mus musculus
cacugacuuuuuaauguuagaauaccauaagguauuagggccucugaguuacaaagguauuccuauuucaguu

SEQ ID NO: 102585 - RNA, 74 nt, Mus musculus
gcuguuugaaaauaacuaccaguccugccuugugauccaucuuuaauguuucccaauaugagaauagccugaug

SEQ ID NO: 102586 - RNA, 47 nt, Mus musculus
cuguaagaguagguguaccaguuggucccuagaguuaacagugaagg

SEQ ID NO: 102587 - RNA, 45 nt, Mus musculus
uaauuuguuuuuaaaguagauuggugcugggaaucagccugcccc

SEQ ID NO: 102588 - RNA, 49 nt, Mus musculus
ccagcauuccuguaugauaucuaccucaggaugacuggaagaagcccaa

SEQ ID NO: 102589 - RNA, 42 nt, Mus musculus
acauauauugagagaaguauaagacaguguauuaaacaugag

SEQ ID NO: 102590 - RNA, 46 nt, Mus musculus
uguuuuggagacaggguugaauuuuaaaccaugcucacuccacauu

SEQ ID NO: 102591 - RNA, 46 nt, Mus musculus
caacuucccccaaucuauaugguuuauucuagauaauagccuuggg

SEQ ID NO: 102592 - RNA, 46 nt, Mus musculus
uuguaggauccuuguuauggauucuccuaaguucagggaagcuaaa

SEQ ID NO: 102593 - RNA, 47 nt, Mus musculus
ucgucuucacaaagccaugguauuccuugaguauuuuacaaguaacu

SEQ ID NO: 102594 - RNA, 46 nt, Mus musculus
guguccgauucugcuguuugagcccagucuaaaaccaggguaccuu

SEQ ID NO: 102595 - RNA, 45 nt, Mus musculus
gaauuccauauugaaaguagagaaccaacucauuccacuagcucg

SEQ ID NO: 102596 - RNA, 25 nt, Mus musculus
agcuguuacuaaaauccuaagccag

SEQ ID NO: 102597 - RNA, 110 nt, Mus musculus
uuuuuggcaaauuauaauaacuuuuuucuuuguacuauagaccuuuaauauugauguacggcaguuacauugggcagaauauauagaaaacuacugcauggggacuaaga

SEQ ID NO: 102598 - RNA, 46 nt, Mus musculus
ggauuaucgauuucugagauucauacuuuucacuugccaaggccac

SEQ ID NO: 102599 - RNA, 45 nt, Mus musculus
ccguuaugguuucaauacaauccuugugauacuuaucuggcgcau

SEQ ID NO: 102600 - RNA, 26 nt, Mus musculus
ucuguguuacaaauuucugucauacu

SEQ ID NO: 102601 - RNA, 44 nt, Mus musculus
ucaaauuaugauucaacauuuuaauccuuggaaugcaaagggua

SEQ ID NO: 102602 - RNA, 46 nt, Mus musculus
gcucuuaugaucagaaggccaaauauuauucuaaagacacuaauag

SEQ ID NO: 102603 - RNA, 42 nt, Mus musculus
auccucuccuccuuauaaauuuucccacaggacuugccccau

SEQ ID NO: 102604 - RNA, 46 nt, Mus musculus
uuauaauuaagcugaucaaguuguacuacauuuaaaucaucagcag

SEQ ID NO: 102605 - RNA, 46 nt, Mus musculus
ugaaaagaaucaggugcaaugugggcaggccuguaaacugaaccag

SEQ ID NO: 102606 - RNA, 46 nt, Mus musculus
aaugaugcucauccuagaauguauaauuuugaaauuaguauggagu

SEQ ID NO: 102607 - RNA, 56 nt, Mus musculus
aagggaagagaggagaggggggaagagagggggcagaggggagagaggaaaagaga

SEQ ID NO: 102608 - RNA, 55 nt, Mus musculus
cagccagguucuggccaacggucuagacaacaagcugcgugaggaccuggagcgg

SEQ ID NO: 102609 - RNA, 48 nt, Mus musculus
auggagcgagugaucaccaucaugcagaacccacgacaguacaagauu

SEQ ID NO: 102610 - RNA, 65 nt, Mus musculus
acacuggcgacaauaaucuguauuuuaaaccaacagcugcaguguauugggugguauguuuuaga

SEQ ID NO: 102611 - RNA, 46 nt, Mus musculus
uuguguuugacagaccacuuccugugucucgucuugugucucuaau

SEQ ID NO: 102612 - RNA, 73 nt, Mus musculus
aauugaauaugcaauggaagcuguuaagcaagguucagcaacaguuggucuaaaaucaaaaacgcacgcagug

SEQ ID NO: 102613 - RNA, 42 nt, Mus musculus
cuguguccgcugcugggucagguugucgcugcgccggagcua

SEQ ID NO: 102614 - RNA, 45 nt, Mus musculus
aagcauaugguuccauugagucacaacauuaccauguguccccag

SEQ ID NO: 102615 - RNA, 42 nt, Mus musculus
cuucaccacaccuccugaucugcucagcagaccugccagccg

SEQ ID NO: 102616 - RNA, 45 nt, Mus musculus
ucagugucacugcucagaagagauccugcaacacugccaccugug

SEQ ID NO: 102617 - RNA, 46 nt, Mus musculus
aggauggggcagugggagggggaugggggagagagagagagagaga

SEQ ID NO: 102618 - RNA, 42 nt, Mus musculus
cauucacaaggacucuugucccagucagacacaaguggcccu

SEQ ID NO: 102619 - RNA, 46 nt, Mus musculus
gaaagucccacaggcuaaaagagaaucacccaggaagauggcagag

SEQ ID NO: 102620 - RNA, 46 nt, Mus musculus
caguaauagccuggagagcaaccagagaggaacuacaugcaucaag

SEQ ID NO: 102621 - RNA, 42 nt, Mus musculus
cagcuuagaaacagaccaacccuggucuggcuccugcauuac

SEQ ID NO: 102622 - RNA, 46 nt, Mus musculus
gcaauaguaugagcgaagacugguaaagccuaaagucugcagagau

SEQ ID NO: 102623 - RNA, 42 nt, Mus musculus
caggacuauaugcagaugaaagccagggagcuggagcaggag

SEQ ID NO: 102624 - RNA, 53 nt, Mus musculus
cggggaaaaggaauccgccucaccauugccgaagagagagacaagaggcuggc

SEQ ID NO: 102625 - RNA, 46 nt, Mus musculus
uuagaaguuacugucuauuuuuaacuaacuccauaugcugccagua

SEQ ID NO: 102626 - RNA, 46 nt, Mus musculus
cuugcccacacacccugcucucuugcuccaucuaccagucccuuuc

SEQ ID NO: 102627 - RNA, 46 nt, Mus musculus
acacagucuugccaggcagggcaaaugguggugugggugggcagau

SEQ ID NO: 102628 - RNA, 25 nt, Mus musculus
uaaagcagagucucuggccccguuc

SEQ ID NO: 102629 - RNA, 45 nt, Mus musculus
gggcccaguccccugccugcugcucucagugacauguccuagaac

SEQ ID NO: 102630 - RNA, 46 nt, Mus musculus
gauuuaucaggaauccccagccggaacccuuagcuugaggccuaca

SEQ ID NO: 102631 - RNA, 45 nt, Mus musculus
uggguccccaagaucaaacuugagucauuagccuuggcagcaagc

SEQ ID NO: 102632 - RNA, 46 nt, Mus musculus
uaacucgguacuugaguuucuagguucuugguucuugcagucagua

SEQ ID NO: 102633 - RNA, 42 nt, Mus musculus
uuaggcagacuaucauacguggugggaaaauacagggcaggu

SEQ ID NO: 102634 - RNA, 42 nt, Mus musculus
caacgaaggacuugagaauguaggauuccaguagagcagaug

SEQ ID NO: 102635 - RNA, 45 nt, Mus musculus
ugaaucacaaucaggccaccauccuuuauaggccaaccuucagac

SEQ ID NO: 102636 - RNA, 46 nt, Mus musculus
cuucacucucuccaacugagagcaagccggcccugcagcccagccc

SEQ ID NO: 102637 - RNA, 46 nt, Mus musculus
cauggaccuacugucccccacucacucauaggugguucugggagau

SEQ ID NO: 102638 - RNA, 45 nt, Mus musculus
aauaggagauggaaaaugcauggaacgaguaccugaagcuggaga

SEQ ID NO: 102639 - RNA, 25 nt, Mus musculus
ugcuggaggugcugcacaggcagac

SEQ ID NO: 102640 - RNA, 45 nt, Mus musculus
gggggcuguaaaaugggcuguucuacuggccuggaagugugagag

SEQ ID NO: 102641 - RNA, 46 nt, Mus musculus
gguauggccgagcaugaguuuaugggaguugagagaagccuuagau

SEQ ID NO: 102642 - RNA, 44 nt, Mus musculus
caccaucacuugcuuaagcaguugcucuccugaccgccccacgc

SEQ ID NO: 102643 - RNA, 43 nt, Mus musculus
ccuguuacguuuuguuguauuugccuuucuguuuggaacagau

SEQ ID NO: 102644 - RNA, 24 nt, Mus musculus
agccucauggccugaaaccaggac

SEQ ID NO: 102645 - RNA, 45 nt, Mus musculus
cauucuccagcugucuuuucuuguccuguucaaagugugcaggga

SEQ ID NO: 102646 - RNA, 45 nt, Mus musculus
accugaaucucgcuucuugagcuguggagaguagcaggcugcuuc

SEQ ID NO: 102647 - RNA, 42 nt, Mus musculus
cgguggcugacucccuccccaugugucugcacgcccacagcu

SEQ ID NO: 102648 - RNA, 46 nt, Mus musculus
ccagcgacuacaaguacgcacaggaccgagccagccaccugaagau

SEQ ID NO: 102649 - RNA, 25 nt, Mus musculus
ucccagcucucagagaaaacugguu

SEQ ID NO: 102650 - RNA, 45 nt, Mus musculus
gaugguugugagccaccaugucggugcugagaauugaacccaggu

SEQ ID NO: 102651 - RNA, 46 nt, Mus musculus
gaagugaucuuaaaauuaccucaacugaaugaaaagaaacugagaa

SEQ ID NO: 102652 - RNA, 41 nt, Mus musculus
uugaugaaaugggacuccacaaggcucucaccacccacaga

SEQ ID NO: 102653 - RNA, 24 nt, Mus musculus
cccaggcagagcacuggacaaaag

SEQ ID NO: 102654 - RNA, 45 nt, Mus musculus
gagauacaaaccggguguagugguguaauccuguaaaggcaagau

SEQ ID NO: 102655 - RNA, 46 nt, Mus musculus
uguagcgugaguaacauaaaccagcguccaugcacacgggaaaggg

SEQ ID NO: 102656 - RNA, 41 nt, Mus musculus
ccaaggaacucaaaggcuucuggugggguugacaaagagga

SEQ ID NO: 102657 - RNA, 45 nt, Mus musculus
ugcaagcggcaagggcauuguugaguguauuuugugacucauggg

SEQ ID NO: 102658 - RNA, 42 nt, Mus musculus
cacacuaaggcccaucuuacucccaucacacuugaaccagac

SEQ ID NO: 102659 - RNA, 42 nt, Mus musculus
agguugugacauuuuucagauguggagacaaacuggccgaca

SEQ ID NO: 102660 - RNA, 24 nt, Mus musculus
agugggggaaggacugacccugau

SEQ ID NO: 102661 - RNA, 46 nt, Mus musculus
aggauuugcauuuggcuucuaaggauggguaguacuuggccagugu

SEQ ID NO: 102662 - RNA, 41 nt, Mus musculus
uacaaaaaacaaucaaacgcccagagcaauggcaccuauuu

SEQ ID NO: 102663 - RNA, 44 nt, Mus musculus
cgugcuuugucuuuggucuucagccagcucugagcucccaaguc

SEQ ID NO: 102664 - RNA, 43 nt, Mus musculus
guugaaguccagauuugccaaauucauuauccccacccccaga

SEQ ID NO: 102665 - RNA, 46 nt, Mus musculus
gcugggcucuuuuccagcuugucuuuaaggaauugagggggacggg

SEQ ID NO: 102666 - RNA, 61 nt, Mus musculus
aaaugcuguaguuuggugagagcaguggccacucgguagaucaggcaggaggaacagacag

SEQ ID NO: 102667 - RNA, 46 nt, Mus musculus
ucugcuggccaaauauguagcugugguggcuuugcuaugugaaagg

SEQ ID NO: 102668 - RNA, 56 nt, Mus musculus
cuuaguucacucagggccuaguggcaguuuuugguguggauguuuugaagggcuua

SEQ ID NO: 102669 - RNA, 47 nt, Mus musculus
cuuugccuguugcauuugguugccauggcagcagaaaagaugaggag

SEQ ID NO: 102670 - RNA, 46 nt, Mus musculus
cuggguuuuccugaaucaguugacuuaauuaagagaguccccagua

SEQ ID NO: 102671 - RNA, 46 nt, Mus musculus
uuugguuuguuguuuguuuugugucagguagagggggcuuggagug

SEQ ID NO: 102672 - RNA, 45 nt, Mus musculus
ugaauuuuugcaggcucagacagcucauuuauuucacuugaagau

SEQ ID NO: 102673 - RNA, 46 nt, Mus musculus
auaguucaggugccuuccccaugagcaucccuccucccaugcagga

SEQ ID NO: 102674 - RNA, 46 nt, Mus musculus
auuuuuucucaguaauuauuucuugaucuccuacugugugccagca

SEQ ID NO: 102675 - RNA, 45 nt, Mus musculus
agaguucagagcagagcacauggcuagggcugugugucggagagu

SEQ ID NO: 102676 - RNA, 41 nt, Mus musculus
guguguguguguauguguagguagauauguagguagguagg

SEQ ID NO: 102677 - RNA, 46 nt, Mus musculus
uuaagggguugcagcacuaggaagguugacaaucauugccucagau

SEQ ID NO: 102678 - RNA, 45 nt, Mus musculus
aaucccaggaaccacaugguggcucacaaccaccuguaaugagau

SEQ ID NO: 102679 - RNA, 46 nt, Mus musculus
aaucuaaaugugugaacccuauaaacucugagacauugaggcagac

SEQ ID NO: 102680 - RNA, 41 nt, Mus musculus
uuccagguaggaucuagagaagguaaaaagcuagcccagga

SEQ ID NO: 102681 - RNA, 41 nt, Mus musculus
uagaauuuccguaaaacugaugaauucuacucccaggagaa

SEQ ID NO: 102682 - RNA, 45 nt, Mus musculus
gacacaugugaggugccuugaaggugguggagguuaaacccagau

SEQ ID NO: 102683 - RNA, 45 nt, Mus musculus
uaugcaggcaaaauauucauacauauagacaaaguaaagcugaga

SEQ ID NO: 102684 - RNA, 45 nt, Mus musculus
gggaaaagaugugcuugggccagccgaaagauuugccucccaagc

SEQ ID NO: 102685 - RNA, 43 nt, Mus musculus
aaagauucugugugugugugugugugugugugagagagagaga

SEQ ID NO: 102686 - RNA, 42 nt, Mus musculus
gagggaaagaaccaucggggucugcuuuggggaugcaggcca

SEQ ID NO: 102687 - RNA, 45 nt, Mus musculus
cuuagagcagccaggggaggaagaagaggaggaagaggaagagga

SEQ ID NO: 102688 - RNA, 43 nt, Mus musculus
gagugagagugggcucauuguguguguucagaaagcccaaggu

SEQ ID NO: 102689 - RNA, 77 nt, Mus musculus
uuguaaaacuuaaauauuacagaaggagauaaagagggagaacuguggauacgaguggagauaagcacuuugcauuu

SEQ ID NO: 102690 - RNA, 46 nt, Mus musculus
cgagcaacauuauaaaggugugacucgaagccaugcauucugaguu

SEQ ID NO: 102691 - RNA, 45 nt, Mus musculus
aguuccccaaauguuagagagggaaaaaaaaugucagcaagaaga

SEQ ID NO: 102692 - RNA, 45 nt, Mus musculus
gaaauagggauaaggaaaccccacccuagccccauacuugggagg

SEQ ID NO: 102693 - RNA, 45 nt, Mus musculus
ugagggguugauuaaggcagggugugugugugugugugugugugu

SEQ ID NO: 102694 - RNA, 42 nt, Mus musculus
gggcaggacucugugaucgugggcugcggucuggugcuuugu

SEQ ID NO: 102695 - RNA, 46 nt, Mus musculus
uccuggcuacgggugcuggccaagacugccaguguuaggggcauac

SEQ ID NO: 102696 - RNA, 45 nt, Mus musculus
ucauguuaccaccguccucuuagggaugaagaccucccuuuuuag

SEQ ID NO: 102697 - RNA, 42 nt, Mus musculus
guauacuguagcuauacagaugguugugagccuucauguggu

SEQ ID NO: 102698 - RNA, 42 nt, Mus musculus
uucauaccccauaguccccagacccuaaauguagcccaaguc

SEQ ID NO: 102699 - RNA, 45 nt, Mus musculus
gggaugggaggccgaggaguccaaagguaagguuaggcaugugga

SEQ ID NO: 102700 - RNA, 55 nt, Mus musculus
ggaagagguauuugauuugggguuuaaggaccaugggguucagcaaggauggcag

SEQ ID NO: 102701 - RNA, 45 nt, Mus musculus
gcacaccugccuucccaggguccagggaggucagaagaggcacgg

SEQ ID NO: 102702 - RNA, 47 nt, Mus musculus
caggggguaagcagcugggaaggagugaacguggggcggguggggaa

SEQ ID NO: 102703 - RNA, 46 nt, Mus musculus
cucccgugcuggcagggagguugaccugaucagugagcaugccugc

SEQ ID NO: 102704 - RNA, 47 nt, Mus musculus
aauacaugaaaugucacguggcagcuucaugucaggggugugugugu

SEQ ID NO: 102705 - RNA, 46 nt, Mus musculus
cagaacugcauguuggaccaucauugauauuuuuucccucuaagcc

SEQ ID NO: 102706 - RNA, 45 nt, Mus musculus
uuggguaugugucauuguaccacuuaaaugccugguacccuggga

SEQ ID NO: 102707 - RNA, 46 nt, Mus musculus
gcggaagucagcucacugcugccuguaguccuagcuccuggggauc

SEQ ID NO: 102708 - RNA, 23 nt, Mus musculus
uaggcccagaagaaggcaauuca

SEQ ID NO: 102709 - RNA, 44 nt, Mus musculus
aguggaggggccaaaauguguuucaguguggaggaagccaagag

SEQ ID NO: 102710 - RNA, 45 nt, Mus musculus
ugaggaagguuuucugaaugacuccauuuucuuauaaccugagug

SEQ ID NO: 102711 - RNA, 45 nt, Mus musculus
ccacugugucuggucacagucaacuuuucuauuggggccccaaau

SEQ ID NO: 102712 - RNA, 45 nt, Mus musculus
cauguuucuuguaaauuaggcaguguagauaagcaauaaggagag

SEQ ID NO: 102713 - RNA, 45 nt, Mus musculus
uaagcaacagggauagguggccguuaguuaguuaaugcccgauuu

SEQ ID NO: 102714 - RNA, 46 nt, Mus musculus
cugcauguaugucuauauaccauguacaugcacaacuugcagaggu

SEQ ID NO: 102715 - RNA, 46 nt, Mus musculus
cggcgaaggacuccuguggguuguccugaucaccccgugccuuggg

SEQ ID NO: 102716 - RNA, 49 nt, Mus musculus
acuugguucaaauuugagcacacaguaggugcuuucugaaagccuugag

SEQ ID NO: 102717 - RNA, 24 nt, Mus musculus
gacugacugucugguguggugccc

SEQ ID NO: 102718 - RNA, 46 nt, Mus musculus
aaagccagagugaccaggaaagaucuugcggacccaggccccagau

SEQ ID NO: 102719 - RNA, 42 nt, Mus musculus
ggguuuagagcaucucuagcauuccuagaguagccagauuuu

SEQ ID NO: 102720 - RNA, 42 nt, Mus musculus
cagacagcccuaucugugcuuuuguguguuuagugucuaggu

SEQ ID NO: 102721 - RNA, 45 nt, Mus musculus
augccguuacagaugguugugagccaccauguggcugcugggaau

SEQ ID NO: 102722 - RNA, 46 nt, Mus musculus
cauccauuuauguaggcuuugaauaaugccuuuuuuuccuguguga

SEQ ID NO: 102723 - RNA, 47 nt, Mus musculus
augguuguagaacaagauaugaggcugggauggagaaugacuuugau

SEQ ID NO: 102724 - RNA, 59 nt, Mus musculus
gcaggggagagggaagcaggggagcagguggugugggucauagcaucugugugaggaga

SEQ ID NO: 102725 - RNA, 46 nt, Mus musculus
uagaaccuagguccucuagaauaagagggcucuuaaccucugaagc

SEQ ID NO: 102726 - RNA, 45 nt, Mus musculus
cggagucuauagcauaacuuucaggucuccagugcaaaaugaaaa

SEQ ID NO: 102727 - RNA, 46 nt, Mus musculus
cauugacuguggccccuccucucaaaggcugcuggugccaguaggu

SEQ ID NO: 102728 - RNA, 24 nt, Mus musculus
aggaggagaguggaauuccacgcu

SEQ ID NO: 102729 - RNA, 41 nt, Mus musculus
uggaaguuuugcugcaaagaaggguccaggcauuggcugau

SEQ ID NO: 102730 - RNA, 46 nt, Mus musculus
acaaagguuuguuucagcuuauacuucucaucccaguucaucagug

SEQ ID NO: 102731 - RNA, 46 nt, Mus musculus
acauuaugauucauaacagccaagugacaguuaugaaguagcagca

SEQ ID NO: 102732 - RNA, 45 nt, Mus musculus
auagguguuaagaaacucuauauuuuguucuguuauauauaagau

SEQ ID NO: 102733 - RNA, 59 nt, Mus musculus
gcaggagucagauagaggcugugcucuggaugcagagagagagagagagagagagagag

SEQ ID NO: 102734 - RNA, 82 nt, Mus musculus
cuuggaggaagugaccaagggcgaggauggcauuaaaggaaggcacaggaagggagguaaaggaugaaacuggagcagggua

SEQ ID NO: 102735 - RNA, 45 nt, Mus musculus
gaacaaaacccuucgaguucaaugagggguuggggauuuugcuca

SEQ ID NO: 102736 - RNA, 46 nt, Mus musculus
ggauuuggauaagcugcggguuucucagggcucccucugcagcccc

SEQ ID NO: 102737 - RNA, 41 nt, Mus musculus
acaaauuaggugaaagaggauacauuuugauuuagggggaa

SEQ ID NO: 102738 - RNA, 44 nt, Mus musculus
uugcaaaaucagaaagggguggaggggaagagaaugaaaaugaa

SEQ ID NO: 102739 - RNA, 102 nt, Mus musculus
cuacaaacuuaauauuguguagauuauuuuaccaccugagaucucaguggccucaucugugcaagaaagagaaaauuaaauaauaaaaaagauaaaaccuug

SEQ ID NO: 102740 - RNA, 41 nt, Mus musculus
acacaaacacacacacacacacacacaaacaaacacacaaa

SEQ ID NO: 102741 - RNA, 60 nt, Mus musculus
ugaagucuuggaaacagauccacauuucagagaaaagcuccagaaagcagacauagagga

SEQ ID NO: 102742 - RNA, 46 nt, Mus musculus
uggaggccacaaguggucagauaauggcuuuggagucaugagccag

SEQ ID NO: 102743 - RNA, 44 nt, Mus musculus
gcuggacuuaguaagucacaaagugaggacgagacuggaugagc

SEQ ID NO: 102744 - RNA, 45 nt, Mus musculus
gaaucaccaccuucuucugaagcaguuugaacaccugaaccacca

SEQ ID NO: 102745 - RNA, 46 nt, Mus musculus
uuugacccaguuucuucuuuuugagaucaguuuauauuuuguuugc

SEQ ID NO: 102746 - RNA, 61 nt, Mus musculus
gcaauaugaccggacucggcaugaagaguuuaagaaguacgagaugaugaaggaacacgag

SEQ ID NO: 102747 - RNA, 71 nt, Mus musculus
cggagagaguauuuaaaaacgcugagugaggagaagaggaaagaagaagagucuaaguuugaagagaugaa

SEQ ID NO: 102748 - RNA, 46 nt, Mus musculus
uggagaaaguguauaacccacaaaaugcagaggacgauaugauaga

SEQ ID NO: 102749 - RNA, 42 nt, Mus musculus
agaacucucuuuguagaccagacuggucucaaacucacagag

SEQ ID NO: 102750 - RNA, 23 nt, Mus musculus
cuaacuggcucacuaaauccagg

SEQ ID NO: 102751 - RNA, 45 nt, Mus musculus
aacaaccuaacuagccagugugcuggucuugagcauaucagguag

SEQ ID NO: 102752 - RNA, 45 nt, Mus musculus
ggaguucucuauguuauccuagcuguccuggaauuugauguguag

SEQ ID NO: 102753 - RNA, 45 nt, Mus musculus
ccuguuauggcuucuuccaugacacucgccaacuauccuggcccg

SEQ ID NO: 102754 - RNA, 46 nt, Mus musculus
agaguguucuagaaaaaaagacucagguuguuaagcuuagccaaag

SEQ ID NO: 102755 - RNA, 47 nt, Mus musculus
ucccaggccguccagcaccuggaacagaagaaacuucaacaaggcau

SEQ ID NO: 102756 - RNA, 45 nt, Mus musculus
uucuuuucucuccacucaauaaauacuuuaaagcacauuuggaau

SEQ ID NO: 102757 - RNA, 45 nt, Mus musculus
guaacaugguacugagaugcagccagugaaaucuaacugcagggg

SEQ ID NO: 102758 - RNA, 59 nt, Mus musculus; identical to SEQ ID NO: 21953

SEQ ID NO: 102759 - RNA, 114 nt, Mus musculus
ccuuuucuuuccuugggguaucuuuuuuagacuggcucucugcaaacuucuuagcaucaaacugagccaucuucucacacagcuucaccucccccaagauagcccugaacuggg

SEQ ID NO: 102760 - RNA, 78 nt, Mus musculus
caacuguaauaucagccagugucacucgcucgcccacuagaaaaguucgagucuucaagugaguguccagcagcccca

SEQ ID NO: 102761 - RNA, 46 nt, Mus musculus
guuuguuguggugcauaaugcccaagguggggaacacccagguacu

SEQ ID NO: 102762 - RNA, 46 nt, Mus musculus
aaaccagaggaaacaaauauccucaaauuacuuguggugaauaaag

SEQ ID NO: 102763 - RNA, 42 nt, Mus musculus
ccuggguugacccuugggcaaaguaagguaacugaggcagaa

SEQ ID NO: 102764 - RNA, 42 nt, Mus musculus
agacugagggagagggacggagggggaaagagagagggagag

SEQ ID NO: 102765 - RNA, 42 nt, Mus musculus
gacuaauacauguucuacgaguuaacuacuuuggcaguuuua

SEQ ID NO: 102766 - RNA, 44 nt, Mus musculus
uuguagcauguguguuuguuuuuuaauguuucaugacucccacu

SEQ ID NO: 102767 - RNA, 46 nt, Mus musculus
caaugaguagaaaacuagauuaucuauuaauauuuaagaccaggaa

SEQ ID NO: 102768 - RNA, 57 nt, Mus musculus
guccauaauggccuuugagcagcaagcuuucagaagauuauauuugaggauuguagc

SEQ ID NO: 102769 - RNA, 42 nt, Mus musculus
uauagacagcuguuaaguacugggaauuaaauucaggucccc

SEQ ID NO: 102770 - RNA, 41 nt, Mus musculus
uguacacccacccacuggcacauguaccuuagcauggagaa

SEQ ID NO: 102771 - RNA, 42 nt, Mus musculus
uguguguauguauguguguguaugugugugugcaugugugug

SEQ ID NO: 102772 - RNA, 46 nt, Mus musculus
ggcacuggagguguagcucaguauuuaaagugcuugcccagaacac

SEQ ID NO: 102773 - RNA, 45 nt, Mus musculus
acugaggcaggcaggucuaaguucaaggccagucuggucuacaga

SEQ ID NO: 102774 - RNA, 46 nt, Mus musculus
gcagagccaccuaccauuuauuagagccaaaaauucuuggugcuag

SEQ ID NO: 102775 - RNA, 69 nt, Mus musculus
cugucugguguuuccugcuuuguuauguuuuugugccuggcugacuaccuuguucccauucuagcacca

SEQ ID NO: 102776 - RNA, 47 nt, Mus musculus
gcaaggcuggggagaggugaugcugauggcugacaaaguccuucgau

SEQ ID NO: 102777 - RNA, 45 nt, Mus musculus
cccuacacacacacacacacacacacacacacacacaguaccaua

SEQ ID NO: 102778 - RNA, 27 nt, Mus musculus
caaauacaaggcuagccucgucaagcu

SEQ ID NO: 102779 - RNA, 28 nt, Mus musculus
ugauuuagcacggauuugacggagcuac

SEQ ID NO: 102780 - RNA, 45 nt, Mus musculus
uucuccuaaaacuuggcgcaaggguggagggucaaagggcugcua

SEQ ID NO: 102781 - RNA, 46 nt, Mus musculus
cgcacggcccaagccuuauggugcaggauuccgggggacguugggg

SEQ ID NO: 102782 - RNA, 41 nt, Mus musculus
acuucccagaagccggagugcggucuacccaaugaggagcg

SEQ ID NO: 102783 - RNA, 44 nt, Mus musculus
gauaugaaaucugguccuggaaguguuauauaugcagggauauu

SEQ ID NO: 102784 - RNA, 44 nt, Mus musculus
gcaacuuagacauaucuauuuauuuuuuauggcacacggugggg

SEQ ID NO: 102785 - RNA, 46 nt, Mus musculus
aaaaaaacaaacaaacaaacaaaaaaaacaaaauacagccacagau

SEQ ID NO: 102786 - RNA, 84 nt, Mus musculus
aguuuugggugaggaaauguguuuuuaaguaugugcuaguucaggucaggaguuacaaacuuagcagccuaaaggcagggagau

SEQ ID NO: 102787 - RNA, 115 nt, Mus musculus
acagugugaauggaugcaaauauucucugaggauuuguggggaggaggucuuaagguguaugugaaaggaagaguugggagggagaagggugaagacaccucaagggugggagag

SEQ ID NO: 102788 - RNA, 46 nt, Mus musculus
uggcucuaccaaaaaauaaaaagaguuguuuagccagugcccaaag

SEQ ID NO: 102789 - RNA, 46 nt, Mus musculus
gaaagagaguuguuuuggaggccaucccucuugauaccccagagau

SEQ ID NO: 102790 - RNA, 45 nt, Mus musculus
aaaucccuaaguguauuacugagacuggccacacuucccacgagg

SEQ ID NO: 102791 - RNA, 70 nt, Mus musculus
uccucucuccucgugggaaguguggccagucucaguaauacacuuagggauuuuuuuuuuuuaacaacaa

SEQ ID NO: 102792 - RNA, 44 nt, Mus musculus
gucuggaaggcaggaggauaggaggcacucgaggaugggauccu

SEQ ID NO: 102793 - RNA, 42 nt, Mus musculus
ugugugcuuggagaccugucagucuccagcagugggcagaag

SEQ ID NO: 102794 - RNA, 46 nt, Mus musculus
gguucuugauugccuaagcagccuuacaucguauugaaggccaguc

SEQ ID NO: 102795 - RNA, 59 nt, Mus musculus
cucaauaccuguucauuugagccaggcagaaugcagagggaaagauccuugauuaagac

SEQ ID NO: 102796 - RNA, 32 nt, Mus musculus
cuggucagagacuuucagagcaaguggcacuu

SEQ ID NO: 102797 - RNA, 53 nt, Mus musculus
cugauuacacuccaccugaccaaaugccccuuucccaugagaugagagagcgg

SEQ ID NO: 102798 - RNA, 45 nt, Mus musculus
gaaguuggugaaguuccuuagggacugccugcugagacgccgaga

SEQ ID NO: 102799 - RNA, 46 nt, Mus musculus
cagccagauccuugcaagagccaggccugagcaucuuacuggagag

SEQ ID NO: 102800 - RNA, 46 nt, Mus musculus
agacacgcuucuuuaccucguuguucaacguaguagaacguauuag

SEQ ID NO: 102801 - RNA, 46 nt, Mus musculus
uuguuuagagcccauuucaagccaccagcuugaugcccauacaggc

SEQ ID NO: 102802 - RNA, 41 nt, Mus musculus
aaguuaagaucugguuauugcuccaccccccacagaugaga

SEQ ID NO: 102803 - RNA, 41 nt, Mus musculus
ccacccagagacuguggcagccagcuucugacagagcaagg

SEQ ID NO: 102804 - RNA, 42 nt, Mus musculus
gaagcguggcugggaaacugagucauucagcagggggcagga

SEQ ID NO: 102805 - RNA, 45 nt, Mus musculus
cuccccugccacacaugcaaacacggaaucguccugcaaacuaaa

SEQ ID NO: 102806 - RNA, 31 nt, Mus musculus
gcaucugcgcgugcgcacacacacucucaga

SEQ ID NO: 102807 - RNA, 43 nt, Mus musculus
gcaucaccccuaauauuucuuguaaucauugagaccccccccc

SEQ ID NO: 102808 - RNA, 42 nt, Mus musculus
ggagacaucuuuuagucuaucaaaaauauauauccgccaaaa

SEQ ID NO: 102809 - RNA, 92 nt, Mus musculus
ccagcggaugggucuuugucaucuuccaugccauuccggagauccacuacacccuucucccaccccugcaggagaacccacccaacuacuuc

SEQ ID NO: 102810 - RNA, 42 nt, Mus musculus
caucacccuggcccagucccucuucacgcuguguggcaaguu

SEQ ID NO: 102811 - RNA, 46 nt, Mus musculus
aguaaaagauacugucucugccugggguaguagacaaagacaagaa

SEQ ID NO: 102812 - RNA, 41 nt, Mus musculus
cagacgcgcggguguccuggugcugcucauuucaggcugga

SEQ ID NO: 102813 - RNA, 26 nt, Mus musculus
ucaggcuggacuagaaguuaccaugu

SEQ ID NO: 102814 - RNA, 45 nt, Mus musculus
agggagggaaucugaagcugggggacaaauagugggcuggcaauc

SEQ ID NO: 102815 - RNA, 46 nt, Mus musculus
caugucuguuggguccagaagucuguauguaccuaucugauaaaga

SEQ ID NO: 102816 - RNA, 46 nt, Mus musculus
gaauguaucauucucauugacgcuuugcuguacuucuggggguugc

SEQ ID NO: 102817 - RNA, 42 nt, Mus musculus
gggacuuuggguuuucuguguaguugcuuugcuuugccaaga

SEQ ID NO: 102818 - RNA, 69 nt, Mus musculus
aaacaaauuauccacguguauugaaucauuaaauugugugcccucucccucuuugcugcgcccacguug

SEQ ID NO: 102819 - RNA, 46 nt, Mus musculus
ugccauuucuugcacaacuugauaggauuuguuuugugggggaggg

SEQ ID NO: 102820 - RNA, 70 nt, Mus musculus
gggagggaguccaagaccaaugcugaggagucuucuuugcagagguuggaagaacuauucaggcgcuaca

SEQ ID NO: 102821 - RNA, 41 nt, Mus musculus
guggcaaaccagcuggggauauucuugucaaugggaccaag

SEQ ID NO: 102822 - RNA, 42 nt, Mus musculus
ugacacacaucauagcagagaagaguaagcaaggccagcgau

SEQ ID NO: 102823 - RNA, 46 nt, Mus musculus
ugugggcuuggggagugggacacaacugcuuaccuccagucaaggu

SEQ ID NO: 102824 - RNA, 46 nt, Mus musculus
ugggggaaaaagcaaaaaauuggacuguggaccagugauaugagaa

SEQ ID NO: 102825 - RNA, 81 nt, Mus musculus
ccuuacuaugcaggucuuuuuuugucccuuuuuccugucugcuaggcauuagcagucagccuccaucaugggccucuagga

SEQ ID NO: 102826 - RNA, 46 nt, Mus musculus
guaugugugugugugugugugugugugugugugugugugaucugca

SEQ ID NO: 102827 - RNA, 46 nt, Mus musculus
aauugaauaaguuggcaaauacaauauguugaaaguauguguagau

SEQ ID NO: 102828 - RNA, 45 nt, Mus musculus
cuguuugcuacauaucugcugaugacccacugauagugugguggu

SEQ ID NO: 102829 - RNA, 46 nt, Mus musculus
cuuauguauuugaauguuugguccccaguuagauauuuagagagga

SEQ ID NO: 102830 - RNA, 45 nt, Mus musculus
gauucuggauuucacucugggagguaaaaauuagcuuauggagug

SEQ ID NO: 102831 - RNA, 45 nt, Mus musculus
agaaaaggcuuauuaauguauuuguccuguaaguuucugcugaga

SEQ ID NO: 102832 - RNA, 42 nt, Mus musculus
aggaaaaggaggcuacuuaagagcaccacagaaaagcgaggg

SEQ ID NO: 102833 - RNA, 46 nt, Mus musculus
ugauuaaaggaucaaaauucauagugaaagaaaaaaagagagagau

SEQ ID NO: 102834 - RNA, 46 nt, Mus musculus
uuaacuuuuauugucuauuuugccuuaauuggcaccgggaauaguu

SEQ ID NO: 102835 - RNA, 46 nt, Mus musculus
ucuuuugguuacuuaagacuuguguuccacaaaucagaagcuggug

SEQ ID NO: 102836 - RNA, 52 nt, Mus musculus
uuaaucugauuuuacuacugucuugauaugcguucuguagugaggagaguug

SEQ ID NO: 102837 - RNA, 69 nt, Mus musculus
uuuguaggggauagagaugugagugggggugggaguguugggggguggggaacuugaacauguugagaa

SEQ ID NO: 102838 - RNA, 81 nt, Mus musculus
gucuacuaucccucuucaugucaaugauuuauuacaauucaaguacaaaaauaucaucuaggcugacauuucaucagcuag

SEQ ID NO: 102839 - RNA, 52 nt, Mus musculus
ggguaagggaggaugcagccuguuugaaugcaaacagcagaucuuaguuugc

SEQ ID NO: 102840 - RNA, 45 nt, Mus musculus
aagugacuguagcauucuuugaaucagucuuuugagcuguguauu

SEQ ID NO: 102841 - RNA, 45 nt, Mus musculus
ggguguagauuuagggaguaaaaaguugaaagaaauagggucaga

SEQ ID NO: 102842 - RNA, 32 nt, Mus musculus
ugccuuucagcauguaaacagaaugcuagggc

SEQ ID NO: 102843 - RNA, 48 nt, Mus musculus
caaaucccagcagccacaugguggcucacaaccauccguaacgagauc

SEQ ID NO: 102844 - RNA, 42 nt, Mus musculus
ugcaaagauuauaugccucaguaugggagaaugccagggcca

SEQ ID NO: 102845 - RNA, 88 nt, Mus musculus
caagggcuauugaaguggguuccaguacuuugauaauagucccacugcauauuauaacagcaacuacaaaacugacuauucacuuaag

SEQ ID NO: 102846 - RNA, 46 nt, Mus musculus
auuguguuuuacaaacaaaaugaauuuauccaggucacgcugccuu

SEQ ID NO: 102847 - RNA, 42 nt, Mus musculus
uaaagaguaagacgagcaaaaguuuccugguuuugugaccag

SEQ ID NO: 102848 - RNA, 48 nt, Mus musculus
aauauguuaauugccugugugcccuagggcaguacucugggaaagcug

SEQ ID NO: 102849 - RNA, 46 nt, Mus musculus
aggaauugguguauuuucuuauuccucagagaaaauaaagugaauc

SEQ ID NO: 102850 - RNA, 42 nt, Mus musculus
ugcuagcacagcuuuggacccuagucgggcaggcaccggaug

SEQ ID NO: 102851 - RNA, 46 nt, Mus musculus
ugcugcguauuuacugccuugaacuggaacuccaccagggucugua

SEQ ID NO: 102852 - RNA, 45 nt, Mus musculus
uagcugggggacccuggguggagccccucaucucugugucuguag

SEQ ID NO: 102853 - RNA, 45 nt, Mus musculus
cuaaucugaaauggaugacauuaacaagcuccuuaagccccugaa

SEQ ID NO: 102854 - RNA, 59 nt, Mus musculus
uccaggaaaagccccagaagcaguagagggagagccauguacuugggaguaggcugaag

SEQ ID NO: 102855 - RNA, 45 nt, Mus musculus
uuaaggagauauuuaguugcaucaagaaaacaaagcaggaaauag

SEQ ID NO: 102856 - RNA, 46 nt, Mus musculus
agacuacugacuagggaccugacaggacuggucacgcagucugagg

SEQ ID NO: 102857 - RNA, 41 nt, Mus musculus
gcaugaaguggacacucaguacagugcccugaaagugaagu

SEQ ID NO: 102858 - RNA, 42 nt, Mus musculus
gggaugacaucgugaaggaccaugaggacacuugcaucagga

SEQ ID NO: 102859 - RNA, 42 nt, Mus musculus
cagcugggggccacagaugccuaccgagcccgggcccuggag

SEQ ID NO: 102860 - RNA, 45 nt, Mus musculus
ugaaaaaggcagugacgauguugcaggcccagcuaagucuagaga

SEQ ID NO: 102861 - RNA, 46 nt, Mus musculus
uggagggcacacagcuuuccugcaucuguuucuuaaccguccuuaa

SEQ ID NO: 102862 - RNA, 46 nt, Mus musculus
agugacagucaagaauugugaguugauuguucuguuguugccuuga

SEQ ID NO: 102863 - RNA, 46 nt, Mus musculus
auguucuugccauagguuaggauuuuugucuauuuugcugccaauc

SEQ ID NO: 102864 - RNA, 46 nt, Mus musculus
acaaaauacugaucggggaugagggauacuggucagcuggugagaa

SEQ ID NO: 102865 - RNA, 45 nt, Mus musculus
ccagaucuccagcuugcugcugaacuuggaaagacgcuacuggau

SEQ ID NO: 102866 - RNA, 41 nt, Mus musculus
auaucagaaagcaggagcugaggcagaggccaugggggcau

SEQ ID NO: 102867 - RNA, 45 nt, Mus musculus
cucucauugugugugugugugugugugagagagagagagagagag

SEQ ID NO: 102868 - RNA, 46 nt, Mus musculus
uuaagaccauccugaguuaugucgugagacucuugaugaaggagaa

SEQ ID NO: 102869 - RNA, 46 nt, Mus musculus
gguaaugauggcgcuugcuuugaagugugcccccaagaacaaggug

SEQ ID NO: 102870 - RNA, 44 nt, Mus musculus
guaucaaauugacacaaaaccagcccggguguauauggaagcca

SEQ ID NO: 102871 - RNA, 44 nt, Mus musculus
cccggcgacaugcuggcagauaaccuaguggaggaguucgagau

SEQ ID NO: 102872 - RNA, 45 nt, Mus musculus
uggguaaaaugcccgcaagucaaaagaaauuagaguuguccacag

SEQ ID NO: 102873 - RNA, 81 nt, Mus musculus
gcuucaggaugaaguucucauccucaaauuucucuccguagauggaccugccgccagugccauuauggcguguaaagucac

SEQ ID NO: 102874 - RNA, 65 nt, Mus musculus
uuuggaacuuugucugcaaacagcucgaaggagacgcggcccaagggcucgucaucagccgugau

SEQ ID NO: 102875 - RNA, 44 nt, Mus musculus
auuacuaauggacauacaaguacugauuucagaaaacugcagug

SEQ ID NO: 102876 - RNA, 43 nt, Mus musculus
aggaagauguaaggaagguuucuuuagaaaagggcaucuuagg

SEQ ID NO: 102877 - RNA, 41 nt, Mus musculus
guggcucacaaccauccaugaugagaucugacgcccucuua

SEQ ID NO: 102878 - RNA, 46 nt, Mus musculus
gcacugggacccacacagaaaacagggcuggcaggaugggccucag

SEQ ID NO: 102879 - RNA, 41 nt, Mus musculus
agcaguuaugugaucacauuuuucugccaagucaccucagg

SEQ ID NO: 102880 - RNA, 42 nt, Mus musculus
cuugggaaguucaggagagggauuauugugugugagggccag

SEQ ID NO: 102881 - RNA, 42 nt, Mus musculus
uguucuuccugaggacccagaaucaauuucuagcacccacau

SEQ ID NO: 102882 - RNA, 50 nt, Mus musculus
ugcugcaaaauucucgacaauacaguauuacccccagaaacugugguccc

SEQ ID NO: 102883 - RNA, 45 nt, Mus musculus
cuaggcugccuuugaacucagagaucugacuguaugugcccccua

SEQ ID NO: 102884 - RNA, 45 nt, Mus musculus
gaugcaucaguagagggcaucagaccccauuacagaugguuguga

SEQ ID NO: 102885 - RNA, 42 nt, Mus musculus
cugggcaccaggcaugcauguggugcacaaacauacauguag

SEQ ID NO: 102886 - RNA, 45 nt, Mus musculus
gcuucauaucuuuaauucuuuugaacucuuaagacgaaccuggag

SEQ ID NO: 102887 - RNA, 45 nt, Mus musculus
uucuuggaagagaagguagaugggaaagaccuuucccacuggaua

SEQ ID NO: 102888 - RNA, 44 nt, Mus musculus
uaaauacuucccugagccuacauagaggaccaggccugcacugg

SEQ ID NO: 102889 - RNA, 45 nt, Mus musculus
acaaacagccacuagaacucucuucagaaagggaaagaccccgag

SEQ ID NO: 102890 - RNA, 46 nt, Mus musculus
gagcagagcaggacccucugcaccgacucagccagguucguggagc

SEQ ID NO: 102891 - RNA, 48 nt, Mus musculus
uggacccacgcagccggcggcaguauguacgggggcgcuuucugggua

SEQ ID NO: 102892 - RNA, 74 nt, Mus musculus
gccuaagucuuugcugcucaagccccaccagaaggagaagaugucuauggagaucucaauucaccgcagccuag

SEQ ID NO: 102893 - RNA, 60 nt, Mus musculus
cacaccaacacgucguaggcuuccaugacuuuuuugaggacagcgacuuuguauuuguag

SEQ ID NO: 102894 - RNA, 45 nt, Mus musculus
gucauucacagggaccucaagcugggcaaccucuuccugaacgag

SEQ ID NO: 102895 - RNA, 46 nt, Mus musculus
ggggauuuuggcuuggcaaccaaaguggaauaugaaggggaacgaa

SEQ ID NO: 102896 - RNA, 42 nt, Mus musculus
agguauaccuugcuagugggcaagccucccuuugagaccucg

SEQ ID NO: 102897 - RNA, 54 nt, Mus musculus
agcacaucaacccaguggccgccucccucauccagaagaugcuucagacagacc

SEQ ID NO: 102898 - RNA, 42 nt, Mus musculus
uaccugccucaccaucccaccaagguuuucaaucgcucccag

SEQ ID NO: 102899 - RNA, 41 nt, Mus musculus
uauggccuugguaggugucccagaauguggaaugggcaggg

SEQ ID NO: 102900 - RNA, 45 nt, Mus musculus
guggguccgcagagagggggaggcggaccgucccaccgggcgggu

SEQ ID NO: 102901 - RNA, 25 nt, Mus musculus
aggcgggccgggggcggggccgucu

SEQ ID NO: 102902 - RNA, 48 nt, Mus musculus
gcagacaagaagcgcagaacaggcugcauuggggccaaacacagaauc

SEQ ID NO: 102903 - RNA, 40 nt, Mus musculus
cuccuggcacaggcacauccccaaagccaagcgcccgaag

SEQ ID NO: 102904 - RNA, 42 nt, Mus musculus
cuuuaccaccagauucuguucagaucuaagcuggccgcagag

SEQ ID NO: 102905 - RNA, 46 nt, Mus musculus
caguuaauacugcuuagagcagaaaaccagacuucucccccucccc

SEQ ID NO: 102906 - RNA, 46 nt, Mus musculus
gugcacagugacccucggggagaggugggcuaagagaagaguagac

SEQ ID NO: 102907 - RNA, 46 nt, Mus musculus
ugaccacggucccaaaccaggcucagacagguggcaacucccauca

SEQ ID NO: 102908 - RNA, 42 nt, Mus musculus
guuagacacuguuuuguuuugucugccauucuccagacggua

SEQ ID NO: 102909 - RNA, 44 nt, Mus musculus
acagcagcucagggggugggccugucuucucuucuacgggcaua

SEQ ID NO: 102910 - RNA, 49 nt, Mus musculus
gcagugauggaaggggacuuggugaagaaggagagguacgugcagagcu

SEQ ID NO: 102911 - RNA, 64 nt, Mus musculus
cucaucccauacuggaaaugacucugacucggggacucuggagaggaagcgaccugccagcaug

SEQ ID NO: 102912 - RNA, 42 nt, Mus musculus
uugugaaggucagaggauuaggguuuuauucuguagcuagug

SEQ ID NO: 102913 - RNA, 42 nt, Mus musculus
gcucgacacacaucucuguguggguaccacagggauagagcc

SEQ ID NO: 102914 - RNA, 47 nt, Mus musculus
guauguguguaugugagugugugugugugugugugugugugugugcg

SEQ ID NO: 102915 - RNA, 46 nt, Mus musculus
aguguguaugugugugugaguguguaugugugugugugaguaugug

SEQ ID NO: 102916 - RNA, 45 nt, Mus musculus
ugugugagugagugugugugugugugugugugugugugcgugcgc

SEQ ID NO: 102917 - RNA, 42 nt, Mus musculus
guccuagcucaggucaccagcugaaagaacaguugucaugug

SEQ ID NO: 102918 - RNA, 45 nt, Mus musculus
ucuuguccucuacccaugaggcagugcuucuuugcaaggcuagag

SEQ ID NO: 102919 - RNA, 45 nt, Mus musculus
agcuauuaaaggagauuacaauucucuaaagagcagcaaccuguu

SEQ ID NO: 102920 - RNA, 45 nt, Mus musculus
uuccccagagaaacagaaagucgugggagcaaagaggaguuuagu

SEQ ID NO: 102921 - RNA, 46 nt, Mus musculus
cuuggugucugugagggauuggcuuuccagaacaaaagucccagac

SEQ ID NO: 102922 - RNA, 46 nt, Mus musculus
uuuuugaaugugggucuguucucaguuauuagaagcccaagcagau

SEQ ID NO: 102923 - RNA, 46 nt, Mus musculus
uuugucuaaaaguaaaaaguagaacaugggcucagcgguagagauc

SEQ ID NO: 102924 - RNA, 32 nt, Mus musculus
aggagagggagaggaaagggaaggaaaagaaa

SEQ ID NO: 102925 - RNA, 42 nt, Mus musculus
ccagagaacccagguucaaauuccagcaccuucauggcagau

SEQ ID NO: 102926 - RNA, 45 nt, Mus musculus
gguuaacuugcaccccagauuuguucaguguaacccaccucacuc

SEQ ID NO: 102927 - RNA, 42 nt, Mus musculus
ggcacagcaauagcucuaccccgugggaagaagcaaggaagg

SEQ ID NO: 102928 - RNA, 45 nt, Mus musculus
ucaggugggcuuccuggaggagggcucagugccugcgccguagau

SEQ ID NO: 102929 - RNA, 41 nt, Mus musculus
uggaauacaguucaaacucuuagcauaaccuaaacccuuug

SEQ ID NO: 102930 - RNA, 41 nt, Mus musculus
agcacacauuuuuggcguuccuucuguaacgagcagcgagc

SEQ ID NO: 102931 - RNA, 56 nt, Mus musculus
cucccccaaguaucaacuugccugauggucauaguccugaugacugggguuuggau

SEQ ID NO: 102932 - RNA, 46 nt, Mus musculus
ugaucacauuuaaucuuugacauucugaguugagauccuuguaguu

SEQ ID NO: 102933 - RNA, 42 nt, Mus musculus
ccugcucucaagugccaggugcuggguggguggggccugguc

SEQ ID NO: 102934 - RNA, 47 nt, Mus musculus
gguaaggggacagucaccucugguugggaaucacuaguuuagauuuc

SEQ ID NO: 102935 - RNA, 45 nt, Mus musculus
ggcuggccucuaacucaucaguccuccaaacucggccucugggau

SEQ ID NO: 102936 - RNA, 46 nt, Mus musculus
ucucuccacucugugugugugugugugugugugugugugugugugu

SEQ ID NO: 102937 - RNA, 45 nt, Mus musculus
uaggaaagagguauaagacaucgaggaaauagcauaugacaagag

SEQ ID NO: 102938 - RNA, 46 nt, Mus musculus
augaucaucaagucaggaacauggcaauauccaggcaggcguggug

SEQ ID NO: 102939 - RNA, 42 nt, Mus musculus
cugcagcccauauauuucuaaccacagaacucuucaccagga

SEQ ID NO: 102940 - RNA, 57 nt, Mus musculus
agauggugcagcagggagucaggggugauggugggcaaguguugucuggauagagga

SEQ ID NO: 102941 - RNA, 46 nt, Mus musculus
ccuuucaugggaaaugaaauggacucaaccccacccaaauagagag

SEQ ID NO: 102942 - RNA, 45 nt, Mus musculus
gaaaggaugagcuaacaugaugcacuuugugugcagaggguggau

SEQ ID NO: 102943 - RNA, 25 nt, Mus musculus
ggcccggccuugggccccgcggggc

SEQ ID NO: 102944 - RNA, 86 nt, Mus musculus
auaauaguguuucuaaaaguuuaaggcuauaaggaagaagauaaggccugugaaguauuuaacugacucuuuaggccuguuuuaga

SEQ ID NO: 102945 - RNA, 45 nt, Mus musculus
acauuuauucauucagaagauauuugagugcuguuugcuguuaga

SEQ ID NO: 102946 - RNA, 46 nt, Mus musculus
auccuucaagagacccgauuuuaugaagcacuucaagccugccauc

SEQ ID NO: 102947 - RNA, 66 nt, Mus musculus
agagcuuauauccuuaucagcaaguagaaggcaaaaggagggaggaagggaagacaggggagagag

SEQ ID NO: 102948 - RNA, 46 nt, Mus musculus
agcuaggaaugcagggaaaguguggcgagagcagcaacaguggggu

SEQ ID NO: 102949 - RNA, 47 nt, Mus musculus
gcgcacagaggucucuaccacgaaaucaggaaggaaagugcagggag

SEQ ID NO: 102950 - RNA, 45 nt, Mus musculus
gacuugauacaugauacacacguguuugcuuaacucaguucuucu

SEQ ID NO: 102951 - RNA, 64 nt, Mus musculus
cuucuuccaagagacuuuuccuucauuucuuuuguagaagagguuggacucagucgucucagua

SEQ ID NO: 102952 - RNA, 46 nt, Mus musculus
augcucucgaugaggaagugacaacccagguaauguacucccaggu

SEQ ID NO: 102953 - RNA, 46 nt, Mus musculus
aaaauaccucacaggcuugucuacaggcuuguagucugguggagau

SEQ ID NO: 102954 - RNA, 46 nt, Mus musculus
gauguggugggaaaggcaggugggcagggcuacauuucuggaagaa

SEQ ID NO: 102955 - RNA, 45 nt, Mus musculus
ggucagaauucauacuauggaggagaaagugcaucuauaacaccg

SEQ ID NO: 102956 - RNA, 60 nt, Mus musculus
guguugauccuaagaagaccuccaugagagauguguauaagaaguuugauuugggccaag

SEQ ID NO: 102957 - RNA, 53 nt, Mus musculus
cugcaaggauuugcaagguuaagugcgauauauggagguaccuacauguugaa

SEQ ID NO: 102958 - RNA, 43 nt, Mus musculus
gcucgcuguaaauagcucaucugugaucccagcuauguaaaag

SEQ ID NO: 102959 - RNA, 58 nt, Mus musculus
gcaaagggcaaguauauugccauuguaaguacaaccuuggagaccaaggaaccagaga

SEQ ID NO: 102960 - RNA, 37 nt, Mus musculus
ucuuggaaccaauugaacaggaauuugucagcaucag

SEQ ID NO: 102961 - RNA, 93 nt, Mus musculus
aaagauaucuacaagaggaugacaggaucugaguuugacuuugaagaaaugaagcacaagaagaaugacauuuauggagaagacuaacagcag

SEQ ID NO: 102962 - RNA, 47 nt, Mus musculus
auaauguauauuguaugaaaucaauauuguaagcccugcuuuuauga

SEQ ID NO: 102963 - RNA, 46 nt, Mus musculus
uggagcagcaguggugaggaggucugagcuggggaaggagaguggg

SEQ ID NO: 102964 - RNA, 42 nt, Mus musculus
uuagcaugcaccggaccuugggcucaguccccuguacuagag

SEQ ID NO: 102965 - RNA, 45 nt, Mus musculus
guuccugaccucugugggcugucugauuuugcuguuggugacugg

SEQ ID NO: 102966 - RNA, 43 nt, Mus musculus
ccugugcuuuaacguggugcuucugagggagaguggcaccuag

SEQ ID NO: 102967 - RNA, 50 nt, Mus musculus
cacugugugugugugccacauggaaaugaauaggccgguccaaucagaca

SEQ ID NO: 102968 - RNA, 45 nt, Mus musculus
acuuacuguacaaagaccucaucuccauggucaacaucuccagag

SEQ ID NO: 102969 - RNA, 46 nt, Mus musculus
cugcaucccguuguuuugccuguucuguuacuucagcauuaccaag

SEQ ID NO: 102970 - RNA, 42 nt, Mus musculus
ggaucaguguggccuucgugcccugggaggagugacggccag

SEQ ID NO: 102971 - RNA, 47 nt, Mus musculus
auuaagaagauauggugggaccagauucccaccccagcacgcagucc

SEQ ID NO: 102972 - RNA, 46 nt, Mus musculus
acuugucuagacaagcugcugccuugcuugcugaagcacagaguaa

SEQ ID NO: 102973 - RNA, 47 nt, Mus musculus
aguguggugcgcuguauggagcuguuugaggccccaguacagaaugu

SEQ ID NO: 102974 - RNA, 42 nt, Mus musculus
gccuucacacccaggcccucuuucaggcagcccagcccagag

SEQ ID NO: 102975 - RNA, 46 nt, Mus musculus
aguuacccacauaugaccagaagccagggcuccugggauguggaag

SEQ ID NO: 102976 - RNA, 41 nt, Mus musculus
auaacuggcagucaaggcgauaccucgagggaacugugggg

SEQ ID NO: 102977 - RNA, 42 nt, Mus musculus
uaggcaggggauuugggguguggcaaccugccaggccagcag

SEQ ID NO: 102978 - RNA, 46 nt, Mus musculus
acuaccuaaggcuaccuguugggaauuccaacccucaccaguccca

SEQ ID NO: 102979 - RNA, 46 nt, Mus musculus
ugacacacacacacacacacacacacacacacacaccccgucuucu

SEQ ID NO: 102980 - RNA, 46 nt, Mus musculus
aguccugagucaaaauggccaaggaccucugacaacagugccaccu

SEQ ID NO: 102981 - RNA, 46 nt, Mus musculus
gcaaggcaggcagugucuggcgauggggacagguuugagcugaguc

SEQ ID NO: 102982 - RNA, 46 nt, Mus musculus
ugccucuuauaugcaugugcuacccaccccuuuucugccccccccc

SEQ ID NO: 102983 - RNA, 42 nt, Mus musculus
augguguggaugccaaucagaaaaacguucuggggcggaauu

SEQ ID NO: 102984 - RNA, 46 nt, Mus musculus
auuuuacucuaagguaguuuacacauaugcucaacccaaagcagau

SEQ ID NO: 102985 - RNA, 44 nt, Mus musculus
acaggcacugacuguagcaagagcagaguaaguauagacacaga

SEQ ID NO: 102986 - RNA, 46 nt, Mus musculus
cuccccagcauuaucgcgcugugcauggagcaaguguaccccauca

SEQ ID NO: 102987 - RNA, 45 nt, Mus musculus
uuguaaauuaaggugggugggugagagauuaggcaccauaacaga

SEQ ID NO: 102988 - RNA, 46 nt, Mus musculus
ugauuauucaccagacacuuagugucuuggaagauaucguggagaa

SEQ ID NO: 102989 - RNA, 42 nt, Mus musculus
cucagcucugcaguuugaacuucuacuccugucuccugagug

SEQ ID NO: 102990 - RNA, 88 nt, Mus musculus
cagaagaccugaaugugagcaagagaguucuuaugagccuguucuuagugcuuauuugugggucagagggcagcaucaaaggccauac

SEQ ID NO: 102991 - RNA, 80 nt, Mus musculus
gguugagaaacuauuugggaggcucagaguaguuuggagcaggaaguggaagagguguguggguuuacagacaaguucuu

SEQ ID NO: 102992 - RNA, 47 nt, Mus musculus
agcauuggcacaacuuaccgguuucucugacucacggccaagaucga

SEQ ID NO: 102993 - RNA, 73 nt, Mus musculus
cagugauuugaaccaaguuuuuuuuuuaaggcauguugaggugacagaaauagagaccaggagacuagugaga

SEQ ID NO: 102994 - RNA, 46 nt, Mus musculus
gugguggugaggaccuuuccccucagccaucuugccagcccucacg

SEQ ID NO: 102995 - RNA, 45 nt, Mus musculus
cugacugggugguaacaacuggauuguuucauguucucuuaaguu

SEQ ID NO: 102996 - RNA, 47 nt, Mus musculus
cucaucucuaccacaauggacgccaucacaccucucaucagcaccaa

SEQ ID NO: 102997 - RNA, 45 nt, Mus musculus
ucuugucuucccccuggagguggagacaagcccacgccaccagac

SEQ ID NO: 102998 - RNA, 46 nt, Mus musculus
cuagggauuuuuuuccccuuuguguuugcauacuuagguccuuuuu

SEQ ID NO: 102999 - RNA, 46 nt, Mus musculus
accuuacuucacaacgcuagcuguuuucuuggaaagaauuggagau

SEQ ID NO: 103000 - RNA, 45 nt, Mus musculus
agcuugaagcgcagagccugcugcuuucauucauagaguggucgc

SEQ ID NO: 103001 - RNA, 51 nt, Mus musculus
aacuuacacguacacauacacacucaugcacagagggaggagaaggggcag

SEQ ID NO: 103002 - RNA, 46 nt, Mus musculus
uuagugauagauggugaaagccuggaguggccacgggaggacagau

SEQ ID NO: 103003 - RNA, 45 nt, Mus musculus
uccacacaaaggauuuuauaguuguaaggugaacagauggcagau

SEQ ID NO: 103004 - RNA, 44 nt, Mus musculus
aaauggucaaaugucagcacuuucauuuuauucaggcccaaagu

SEQ ID NO: 103005 - RNA, 47 nt, Mus musculus
acuggaugaggcuccugugagagaucaggaaaagaugggcuugcaga

SEQ ID NO: 103006 - RNA, 46 nt, Mus musculus
guuguuuacugugucguuccauuuucuccucuacugugagacagaa

SEQ ID NO: 103007 - RNA, 44 nt, Mus musculus
uagguuggaguggaggguuaacauuuguuacucugcugaugaua

SEQ ID NO: 103008 - RNA, 42 nt, Mus musculus
aaaagcucugaaguguuuuuuacauacccuaaaacagcaagu

SEQ ID NO: 103009 - RNA, 45 nt, Mus musculus
aaguuuauuugggauuacagcaauuuguaguuacuucggggucag

SEQ ID NO: 103010 - RNA, 45 nt, Mus musculus
uauguacuuaccuuguauuugcauuuauaaauguacgugugugug

SEQ ID NO: 103011 - RNA, 46 nt, Mus musculus
uauguuuucuagugugaaaggaguuuucuuucugugagaauguuuu

SEQ ID NO: 103012 - RNA, 46 nt, Mus musculus
caacuggcagugaaguuuuugucucauuuaagaguucuguguagag

SEQ ID NO: 103013 - RNA, 43 nt, Mus musculus
gcccaacauauguacauucaauacuauaaauuuaccccuaagu

SEQ ID NO: 103014 - RNA, 45 nt, Mus musculus
cucuucuguaguuaaaggaguguagugaaagaacagccccaagau

SEQ ID NO: 103015 - RNA, 41 nt, Mus musculus
auuaaagauauauuuuuauuugugugugugugugugugugu

SEQ ID NO: 103016 - RNA, 46 nt, Mus musculus
cauucuuugauuacagaauaacuucugaguugcuuuacugucaggu

SEQ ID NO: 103017 - RNA, 45 nt, Mus musculus
gugggaagcauggguggagcaaggaugaucacaucauagugguug

SEQ ID NO: 103018 - RNA, 46 nt, Mus musculus
gacagauccuuggagacaggguccagcuccaggugcuauuccagua

SEQ ID NO: 103019 - RNA, 46 nt, Mus musculus
gcagucagugcucuuaaccucugagccaucucugcagcccccaacu

SEQ ID NO: 103020 - RNA, 25 nt, Mus musculus
guucucaaacuugagaugggucaca

SEQ ID NO: 103021 - RNA, 46 nt, Mus musculus
uccuuucucccucuauccaccugucccccuguguccaccccccacc

SEQ ID NO: 103022 - RNA, 46 nt, Mus musculus
aggcaguuccucaguugagcaucuuuauucccaguaugugucaguu

SEQ ID NO: 103023 - RNA, 45 nt, Mus musculus
gaguuucugcugacuuugaaaucuugguaaucuucuugccucaga

SEQ ID NO: 103024 - RNA, 46 nt, Mus musculus
auuuuugguguguguuaacuugacacaaacuggaaucgacugagag

SEQ ID NO: 103025 - RNA, 46 nt, Mus musculus
guagcagagagcuuacaucugauucacaaauuguaggcggagagag

SEQ ID NO: 103026 - RNA, 46 nt, Mus musculus
augucagcucccaagcaaagaccugauuguucuagguuugccagau

SEQ ID NO: 103027 - RNA, 46 nt, Mus musculus
uguaauuucuuuaagaucaguaagcuggcuggcuguugccccugaa

SEQ ID NO: 103028 - RNA, 45 nt, Mus musculus
aaguggggaguucuaaauuuuucugguuaaaaauugaguggaaga

SEQ ID NO: 103029 - RNA, 45 nt, Mus musculus
caccucuucaguuggauuccucugucugccagcaucaccccaucc

SEQ ID NO: 103030 - RNA, 46 nt, Mus musculus
gguacgguguguuguaaaagcauguuuugaauuuccaggugauuua

SEQ ID NO: 103031 - RNA, 46 nt, Mus musculus
uggcagagcugugugaguacuccuguagcuucccuugccccaagug

SEQ ID NO: 103032 - RNA, 60 nt, Mus musculus
ccuuaacuuucaguuuuuguuuuguuuuguuugcuuguuuguuuuugguaaacuagcugu

SEQ ID NO: 103033 - RNA, 51 nt, Mus musculus
gaagccacaacaguagacaguuucuccaguagagagaguaaacuaggagaa

SEQ ID NO: 103034 - RNA, 46 nt, Mus musculus
gagugauuucuaaaauucuuugaaaccucuugagccaggcccccac

SEQ ID NO: 103035 - RNA, 46 nt, Mus musculus
acagacaggcagcagucaguggaaagggaaggcggagauuuagaag

SEQ ID NO: 103036 - RNA, 100 nt, Mus musculus
agguagcagucaguggaaaggacagacagguagcagucaguggaaaggacagacagguagcagucaguggaaaggacagacagguagcagucaguggaaa

SEQ ID NO: 103037 - RNA, 46 nt, Mus musculus
aguuguaguagauggaccauguggagguaaaacuaagcuguuagga

SEQ ID NO: 103038 - RNA, 46 nt, Mus musculus
uccccugugacaaccccccuuggacugaucaugcugaagacaacuu

SEQ ID NO: 103039 - RNA, 45 nt, Mus musculus
uagauuuauuuauuuauauguaaguacacuguagcugccuucaga

SEQ ID NO: 103040 - RNA, 83 nt, Mus musculus
gguuugucuugauaugauuccuaaaugaucucuuuucugaagcuuagaaacgugguguagugcagggaaagcacagcagggaa

SEQ ID NO: 103041 - RNA, 47 nt, Mus musculus
ccuugaauuccauuacugaauuuaaaacaugauuugaaugugagagg

SEQ ID NO: 103042 - RNA, 46 nt, Mus musculus
cagacauuauuugaauguguuagaaauaauaaaauuuuguauagaa

SEQ ID NO: 103043 - RNA, 46 nt, Mus musculus
aaggcaaacaaccagguccaaacucuuaaggucucagaagugagga

SEQ ID NO: 103044 - RNA, 45 nt, Mus musculus
gggaaggucacacugccacauucaguuaauucauugagcuucagg

SEQ ID NO: 103045 - RNA, 46 nt, Mus musculus
ucucuuggagacagaauuucaccacugugcuauuuagccgggaagu

SEQ ID NO: 103046 - RNA, 45 nt, Mus musculus
ucauacauugucugucuuuauguucuguagcuuugcauaguggag

SEQ ID NO: 103047 - RNA, 46 nt, Mus musculus
uauuuucuguccagcacaaggaaugacuauguaaugauguacagcu

SEQ ID NO: 103048 - RNA, 26 nt, Mus musculus
guagaaaguuaggagcuguguuguga

SEQ ID NO: 103049 - RNA, 42 nt, Mus musculus
auuuuuccaugacugcacaaccaaugaaaggaagcgggagau

SEQ ID NO: 103050 - RNA, 45 nt, Mus musculus
aauaacaggaguucucaaguagauaaugccaaugaggguucagac

SEQ ID NO: 103051 - RNA, 46 nt, Mus musculus
ucguaguguucuuaaaugcuugagcugugucuucagcccagugagu

SEQ ID NO: 103052 - RNA, 46 nt, Mus musculus
ggguguguuuugacaucuuucauuuguucauuuauguuuaugagau

SEQ ID NO: 103053 - RNA, 41 nt, Mus musculus
cuaggacagacauaguucaucaucccauuuugcccaaagau

SEQ ID NO: 103054 - RNA, 46 nt, Mus musculus
ugguaucaaagugaccagcuaaaagaagcuaauuuuacaggcagua

SEQ ID NO: 103055 - RNA, 42 nt, Mus musculus
cugauuacaagacaaagacaaaggggaaaaacaaaaggagac

SEQ ID NO: 103056 - RNA, 44 nt, Mus musculus
uauguguuuguguggguguauaucccauggucuacauguggagg

SEQ ID NO: 103057 - RNA, 45 nt, Mus musculus
gagagaaacacaagauuuauaguucaacaacauagaggagcagag

SEQ ID NO: 103058 - RNA, 46 nt, Mus musculus
agagacugagugcgagugacuguuguucugacuacuagggcuagag

SEQ ID NO: 103059 - RNA, 46 nt, Mus musculus
acccauguaaggaaagagaaggguuucuuuuuggcucauagaggau

SEQ ID NO: 103060 - RNA, 41 nt, Mus musculus
uggaaguuuaaucugaggcugaagaguggauucagaugggc

SEQ ID NO: 103061 - RNA, 131 nt, Mus musculus
gcaugcaugugguacacagacauacauacaggcaaaacacccauacacaugaaauaaaaauaaauaaagcaagcaaacaaaacaccguguuagugcuuguuuuggcaacauauacauuaaaauuggaguga

SEQ ID NO: 103062 - RNA, 55 nt, Mus musculus
guuauuuuuagcaccuacaugauggcuuuccaaccaccugaaacuccaauuccag

SEQ ID NO: 103063 - RNA, 45 nt, Mus musculus
uaagucacauucauuaccugauugcauucagugcagugccagcuc

SEQ ID NO: 103064 - RNA, 46 nt, Mus musculus
ccuuuccccuagccuugcggguggguuaguaaaacaguucagaaug

SEQ ID NO: 103065 - RNA, 46 nt, Mus musculus
uuacauuugugccagucgguggugcuggcacucaggaggcagaggc

SEQ ID NO: 103066 - RNA, 45 nt, Mus musculus
gaagugcagcucacuaguagagcacccauccagcaugcccccagu

SEQ ID NO: 103067 - RNA, 51 nt, Mus musculus
uguagaaucacacaugcaucuggcuugcagcaguuaauaguggaaggggaa

SEQ ID NO: 103068 - RNA, 45 nt, Mus musculus
aaaccuugugucuacuuuaccaggugccuaggucauguccaaacc

SEQ ID NO: 103069 - RNA, 41 nt, Mus musculus
aguauguuaccaugccuagauauguugacuuuugggggaga

SEQ ID NO: 103070 - RNA, 45 nt, Mus musculus
ugaagagaaguagaggauuagaugccagucaugagcacugggaga

SEQ ID NO: 103071 - RNA, 46 nt, Mus musculus
gggacccuucucccacuuacuuguuuggaacucaucuuggccaggu

SEQ ID NO: 103072 - RNA, 41 nt, Mus musculus
cucaugcaugagugcuggguuuacaggugcucacccccaca

SEQ ID NO: 103073 - RNA, 45 nt, Mus musculus
auugaacuauggugugcacauuaaguuacggagagcuugcuggua

SEQ ID NO: 103074 - RNA, 42 nt, Mus musculus
uaucaagucauucaugugcuuaguuucaucuaguuggcagua

SEQ ID NO: 103075 - RNA, 46 nt, Mus musculus
acauuucuguuguguagcucucaugguuuauuuacaucgccacgga

SEQ ID NO: 103076 - RNA, 47 nt, Mus musculus
uccugagugcuggcauuaaaggugugggccacuguacccagcugaaa

SEQ ID NO: 103077 - RNA, 88 nt, Mus musculus
aaguaauuuaaagauaggaaacauauaugaaucccaccccuucauuauaauuuuaugaaauguuugaauuuaaauauccccacucccc

SEQ ID NO: 103078 - RNA, 44 nt, Mus musculus
uuguugaacuucaguuuguuuccugaucuauacaauguacagac

SEQ ID NO: 103079 - RNA, 46 nt, Mus musculus
agagcagagacagcuuccugaagcgggugaaggagaacaaccagaa

SEQ ID NO: 103080 - RNA, 46 nt, Mus musculus
uuuguguucgucauuuuggcgaguuacuggaagauggcugccagaa

SEQ ID NO: 103081 - RNA, 46 nt, Mus musculus
gcaccggcuccucagaugagcacgcuggacacggggacucggguag

SEQ ID NO: 103082 - RNA, 45 nt, Mus musculus
aggguagagugggcaggguaaugugggcaauggaagauggcacag

SEQ ID NO: 103083 - RNA, 75 nt, Mus musculus
accaaucaugagcuuucacuguggacauuuagauuccuauagagucgggcguaguagcgcauaccuuuaguccca

SEQ ID NO: 103084 - RNA, 45 nt, Mus musculus
gagggacgaucgagggaagcuggccuucuagaugcgcuucaggga

SEQ ID NO: 103085 - RNA, 46 nt, Mus musculus
gcuuggggcagugugugugugugaugaauacuuuuagauuggagau

SEQ ID NO: 103086 - RNA, 42 nt, Mus musculus
ccaguagaggugccggucgcccgccuccccgcgccggcuaaa

SEQ ID NO: 103087 - RNA, 44 nt, Mus musculus
ggguaggugauagacagguaaguagaccaaugagaacguggaua

SEQ ID NO: 103088 - RNA, 43 nt, Mus musculus
ugaaagccuuucaaggcaguggucccucacccuggccagaggu

SEQ ID NO: 103089 - RNA, 45 nt, Mus musculus
aggagaagcauaggcgagguguuguggcaaauuugauggauggag

SEQ ID NO: 103090 - RNA, 42 nt, Mus musculus
guaccccacaggacagccaaaguguggagccgggugccacag

SEQ ID NO: 103091 - RNA, 46 nt, Mus musculus
gauuggagacacguagauuucgcaccucugccacugacugcgccaa

SEQ ID NO: 103092 - RNA, 75 nt, Mus musculus
guacucggugaccgggaccgggaacuaggcacccggggcccgcgcgugcagggaaggacgggcacuugggacugc

SEQ ID NO: 103093 - RNA, 42 nt, Mus musculus
ccucgcaacuccgggcugccugcguccaacccgcccccucac

SEQ ID NO: 103094 - RNA, 45 nt, Mus musculus
gccuccacagcuaggccgcgacacaagaagggugaugcgggagcc

SEQ ID NO: 103095 - RNA, 45 nt, Mus musculus
aggguggucuugccaugguccacauguccgaugguacccacauuc

SEQ ID NO: 103096 - RNA, 46 nt, Mus musculus
guggagcuaaguucaagaaguacgaggagauagacaaugccccaga

SEQ ID NO: 103097 - RNA, 45 nt, Mus musculus
agugcuauacuccacaugggcugcauugauggugaugccccgagc

SEQ ID NO: 103098 - RNA, 46 nt, Mus musculus
acugcugcccgacacuaugcccacacagacuguccuggucaugcag

SEQ ID NO: 103099 - RNA, 45 nt, Mus musculus
ggccccaugccccagacccgagagcacuuacugcuagcuaaacag

SEQ ID NO: 103100 - RNA, 50 nt, Mus musculus
guugugguguacgugaacaaggcagacgcuguccaggacucagagauggu

SEQ ID NO: 103101 - RNA, 29 nt, Mus musculus
ccggggcacaguggugacagguacauuag

SEQ ID NO: 103102 - RNA, 45 nt, Mus musculus
caggggauaaccugggugcucugguccgaggcuuaaagcgcgaag

SEQ ID NO: 103103 - RNA, 46 nt, Mus musculus
gccugucgagucaucuugccuccagggaagguauguugaggcuggg

SEQ ID NO: 103104 - RNA, 64 nt, Mus musculus
ccuggagaggacuugaagcuuagucuaaucuugcggcagcccaugaucuuagagaaaggccaac

SEQ ID NO: 103105 - RNA, 44 nt, Mus musculus
uaauuuaaagucauccucaaauauuuagucugaggccagugggu

SEQ ID NO: 103106 - RNA, 45 nt, Mus musculus
aauaaaaauguaugugugggugguuugccuugcagguauguuggu

SEQ ID NO: 103107 - RNA, 42 nt, Mus musculus
gcuaagcugccgagucccucugagcaggugagacaggcacga

SEQ ID NO: 103108 - RNA, 45 nt, Mus musculus
acgccugggcuggcuucuuucuucuuccccaucgucaugggucug

SEQ ID NO: 103109 - RNA, 41 nt, Mus musculus
agugcagaguuacaaacaugcauggccacacuuggcuccaa

SEQ ID NO: 103110 - RNA, 45 nt, Mus musculus
aucucuggagaggaucucuucuccaagccucaggaaacuggucaa

SEQ ID NO: 103111 - RNA, 44 nt, Mus musculus
ugauuuucagaacuacccgugcuucagaguucucucucuuccca

SEQ ID NO: 103112 - RNA, 45 nt, Mus musculus
cucagcgaagcuggggguccuagucacaggagacagguaugagaa

SEQ ID NO: 103113 - RNA, 46 nt, Mus musculus
uauagagcaacacuuugucucaagacaaaguaaaaugagacaaaag

SEQ ID NO: 103114 - RNA, 63 nt, Mus musculus
gaacugaguucaggaauaguaggaauaagggaggcuagagaaagggaguaaacuucauugugg

SEQ ID NO: 103115 - RNA, 42 nt, Mus musculus
agggacaggugcgggggcuggacuggccaggggagcgcgggu

SEQ ID NO: 103116 - RNA, 35 nt, Mus musculus
auaggcaggcaggcaggcaggcaggcagaagcuug

SEQ ID NO: 103117 - RNA, 45 nt, Mus musculus
ggagcacauggccaucaacgugugcccuggacccaucaggcccau

SEQ ID NO: 103118 - RNA, 41 nt, Mus musculus
gcagggggccaggaccagaggguggcggcggcggcgguggc

SEQ ID NO: 103119 - RNA, 45 nt, Mus musculus
cuggaccaaagacucauacuaccuucucucucucuccuugcccuu

SEQ ID NO: 103120 - RNA, 45 nt, Mus musculus
gucagagaacuugccaccacccuaggugugagaaagcaccccuaa

SEQ ID NO: 103121 - RNA, 46 nt, Mus musculus
cuucacaggccugaagaucccuccugguugugaguugguuguuggu

SEQ ID NO: 103122 - RNA, 47 nt, Mus musculus
accgcuguugucaggggaagcuagaagaaaaagaaggggucgauaag

SEQ ID NO: 103123 - RNA, 42 nt, Mus musculus
aggacagacccgacccuuucgagggagaagacaggucaagga

SEQ ID NO: 103124 - RNA, 74 nt, Mus musculus
aacaacaacaaaaaagaaagcaccaacuccccaggaaggggcagcagacaguaggggaggggacagaaggagga

SEQ ID NO: 103125 - RNA, 46 nt, Mus musculus
gacuucaacacaacucaggggacagguguuuguagggucagcucug

SEQ ID NO: 103126 - RNA, 33 nt, Mus musculus
gcucacugguacccccucugccccagagaggga

SEQ ID NO: 103127 - RNA, 46 nt, Mus musculus
gaggguguggggucacaggagaguuaaagcuucggggaguagagag

SEQ ID NO: 103128 - RNA, 42 nt, Mus musculus
gugacccugagguggcgggaaggaguucaugaggccgcccac

SEQ ID NO: 103129 - RNA, 45 nt, Mus musculus
caggagcaauguuggcaaugaggaugcuaugagcugagccuccca

SEQ ID NO: 103130 - RNA, 45 nt, Mus musculus
acacagaaaaacccugucucgaaaaaccaaaaaaaaaaaaagagu

SEQ ID NO: 103131 - RNA, 41 nt, Mus musculus
gagauguggacaaauaccaacaagggaagcagacaggccag

SEQ ID NO: 103132 - RNA, 45 nt, Mus musculus
uugagcauggguggcaaaacuagagaggagcaaagggucccagag

SEQ ID NO: 103133 - RNA, 42 nt, Mus musculus
ggggcagacuuacuuacagugauccauaccauagaaacggag

SEQ ID NO: 103134 - RNA, 46 nt, Mus musculus
cacauguauguauuuguaaccacaugaauaccuggugcccuugaag

SEQ ID NO: 103135 - RNA, 54 nt, Mus musculus
cugagugcuugcugccugccaggcaccggagucacugggaagagagauguggcc

SEQ ID NO: 103136 - RNA, 45 nt, Mus musculus
aacaugccacuugauucuuggcuuggugaccuggugguuauggga

SEQ ID NO: 103137 - RNA, 46 nt, Mus musculus
ggugccugugaggguaaagguugaacaggggaguuacaggccaguu

SEQ ID NO: 103138 - RNA, 27 nt, Mus musculus
acccauggcugcaaaggugucccgaag

SEQ ID NO: 103139 - RNA, 46 nt, Mus musculus
caaacauggucaggaagacagugaaguugaugggcccacuggcuuc

SEQ ID NO: 103140 - RNA, 46 nt, Mus musculus
aaggacugggugacauuuuuauaauaacuaagggaagaaauucuag

SEQ ID NO: 103141 - RNA, 42 nt, Mus musculus
gagcugcuuaccacgcagugcgaccgauuuucccaggaggag

SEQ ID NO: 103142 - RNA, 45 nt, Mus musculus
ccgcccacgucuggggggaaggcugcccacauguucuugaucugu

SEQ ID NO: 103143 - RNA, 45 nt, Mus musculus
auacagagaaacccugucuugaaaaacaaacaaacaaacaaggac

SEQ ID NO: 103144 - RNA, 46 nt, Mus musculus
agcacacaccuuuaaucccacccaggaggcagaggcaaguggccau

SEQ ID NO: 103145 - RNA, 45 nt, Mus musculus
aaaaacauucgauaagaaugagcggagaggucagcaaguuggauc

SEQ ID NO: 103146 - RNA, 45 nt, Mus musculus
gccagggcuggcgaugagagguuuuugguguauaaaugucuagag

SEQ ID NO: 103147 - RNA, 46 nt, Mus musculus
aaaucaugcaugcaugauaaaaaaaucuuuuuugaggagaaggagg

SEQ ID NO: 103148 - RNA, 45 nt, Mus musculus
agccuuuggaaaggucuuaaaaucaacccuggccagcagucccug

SEQ ID NO: 103149 - RNA, 72 nt, Mus musculus
uaggguagcuuagauugguagcugcugagacccuugugaaaccaggaagagggcaaaggguaggcagugggg

SEQ ID NO: 103150 - RNA, 45 nt, Mus musculus
agaagagauggggucaaggaauuuauggauagaggaaaagcuggu

SEQ ID NO: 103151 - RNA, 42 nt, Mus musculus
ucauggauaaugagugcccucugguuaggggcagugccagau

SEQ ID NO: 103152 - RNA, 46 nt, Mus musculus
agaaagagagagagagagagagagagagagagagagagguugaaug

SEQ ID NO: 103153 - RNA, 58 nt, Mus musculus
ccgggggccccaucugcccugacuguggcuguaccuuuccugaccaccucgcccugga

SEQ ID NO: 103154 - RNA, 45 nt, Mus musculus
uuggauuucauuccuaugucuaguaacagauuuugaggaagcuga

SEQ ID NO: 103155 - RNA, 46 nt, Mus musculus
gaugcacaaagugacaagaccuguaggaacuaggaaguccccuguu

SEQ ID NO: 103156 - RNA, 42 nt, Mus musculus
uggagguuagagugaggugagugugcagguagagaaggaaug

SEQ ID NO: 103157 - RNA, 45 nt, Mus musculus
gcuuuuccugcacuagauguggcuucugaauaaagagcccccaca

SEQ ID NO: 103158 - RNA, 46 nt, Mus musculus
cauuguuuaggauuaaaacuguguauuaaguaaggguggaucuaua

SEQ ID NO: 103159 - RNA, 46 nt, Mus musculus
acauacauauaaaaauuacaaccacguuggcuuugaauacagagau

SEQ ID NO: 103160 - RNA, 46 nt, Mus musculus
caugguucucuuaucuaaaguuuucaucuugaauccacggucagca

SEQ ID NO: 103161 - RNA, 42 nt, Mus musculus
uuacuuaguugcauguccaucugggcagcaucuccugcagua

SEQ ID NO: 103162 - RNA, 42 nt, Mus musculus
gcucugucaaugcgauuauuaccugcagcuaaagguccagga

SEQ ID NO: 103163 - RNA, 41 nt, Mus musculus
cacccuaggugggcuaggcaacuguggcaaacaaggucaga

SEQ ID NO: 103164 - RNA, 44 nt, Mus musculus
ugugagccacaaugugguugcugggauuugaacuggggaccuuc

SEQ ID NO: 103165 - RNA, 51 nt, Mus musculus
aagaaaaaaaaaauuacuuuuaaaaaaaguauguuuuucagaucuuuguga

SEQ ID NO: 103166 - RNA, 46 nt, Mus musculus
gugucuuccucaauugaucuuuuuguuuuuguuugguuuuggagac

SEQ ID NO: 103167 - RNA, 44 nt, Mus musculus
ccaccuaaccaaagcuccuaacuccccaagaauuagcuguucug

SEQ ID NO: 103168 - RNA, 37 nt, Mus musculus
aagaagauaucagcaaagcuuucaagcuuugaucgga

SEQ ID NO: 103169 - RNA, 41 nt, Mus musculus
gccaccccuuuaaagaguccagaggccuucaaacagcgagu

SEQ ID NO: 103170 - RNA, 41 nt, Mus musculus
augaagcugacgaccagggacgggcgggcggcggcggugac

SEQ ID NO: 103171 - RNA, 45 nt, Mus musculus
cuucagcccccagaacgacuggaacaucggcugaagcauucuggg

SEQ ID NO: 103172 - RNA, 24 nt, Mus musculus
uucaagagauacaucaaagacagc

SEQ ID NO: 103173 - RNA, 24 nt, Mus musculus
agaggaaaggacaggacaucucuu

SEQ ID NO: 103174 - RNA, 45 nt, Mus musculus
caugaggaagccacucauucugucugggggaugggcagaggguug

SEQ ID NO: 103175 - RNA, 50 nt, Mus musculus
agauuugagaaccuagaguauuaggaaaauaguaagcugguugguagcgg

SEQ ID NO: 103176 - RNA, 45 nt, Mus musculus
ccuaaaugggaacauggggcauauugaaccagaauuaaguuuuga

SEQ ID NO: 103177 - RNA, 46 nt, Mus musculus
gacuggggucacuauccaauuuuaacuaauuauugcuacaugagaa

SEQ ID NO: 103178 - RNA, 46 nt, Mus musculus
uguuguuguuguuaauauuuucaaaccauacauaucagcaggccag

SEQ ID NO: 103179 - RNA, 44 nt, Mus musculus
cucaauauguagccuuggcuggucucaaacucagagacccgccu

SEQ ID NO: 103180 - RNA, 42 nt, Mus musculus
aggaugggcucaguuggcuuuggcaggaaccaagggccugug

SEQ ID NO: 103181 - RNA, 42 nt, Mus musculus
gugcugguggaacuggaaggccaggggccgggccgagccccc

SEQ ID NO: 103182 - RNA, 45 nt, Mus musculus
ccaggaaagauggaaggccuuuuccgacauaaugugagugugugu

SEQ ID NO: 103183 - RNA, 45 nt, Mus musculus
uagcaagacugauuuuuugauaggggucuucaaauguaagucaca

SEQ ID NO: 103184 - RNA, 42 nt, Mus musculus
gggaugaugguugaggaugcuguguggcaaggcugggcccag

SEQ ID NO: 103185 - RNA, 46 nt, Mus musculus
cacaacagcuccuggggcccauggacccuucuugagccccaguacc

SEQ ID NO: 103186 - RNA, 42 nt, Mus musculus
agccagcacaagucuagaggcuaguuaguaguuugcaagcag

SEQ ID NO: 103187 - RNA, 46 nt, Mus musculus
ggaacuucuguggcugacagcacuggaguggguuagguggcaguug

SEQ ID NO: 103188 - RNA, 41 nt, Mus musculus
ugcugcugccgcugcugccgcugcugcaaccacugggccuc

SEQ ID NO: 103189 - RNA, 42 nt, Mus musculus
cauagaagcgugguggccuggccaggcgugggggcccugcca

SEQ ID NO: 103190 - RNA, 46 nt, Mus musculus
guuuggcuccuccaccaccaccuacugcaacuccaggaaccccuca

SEQ ID NO: 103191 - RNA, 47 nt, Mus musculus
cccacaguccacgagauacuugcgugugugugugugugugugugugu

SEQ ID NO: 103192 - RNA, 42 nt, Mus musculus
agagguuauggcucaugacuuaaggugcaccaaugcccccuc

SEQ ID NO: 103193 - RNA, 46 nt, Mus musculus
ccuccuuccucagcccucggagggcaugagaacuugggugguaggc

SEQ ID NO: 103194 - RNA, 47 nt, Mus musculus
ggaauagggguuucauguacauauuuaucaccccuuccacaaauccc

SEQ ID NO: 103195 - RNA, 41 nt, Mus musculus
cagagguuagagaggccagaggcuaggaacacagcaccagu

SEQ ID NO: 103196 - RNA, 41 nt, Mus musculus
uccuagccucuggccucucuaaccucugguaggguguccca

SEQ ID NO: 103197 - RNA, 48 nt, Mus musculus
ccagaaggagguagaccaacggggaaagggaccuagacuauaagcugg

SEQ ID NO: 103198 - RNA, 44 nt, Mus musculus
gggacccaguacaacccaugacggauaacucacacagacucaaa

SEQ ID NO: 103199 - RNA, 45 nt, Mus musculus
cauaacuaauaauuaagaaaacaggauaaaaauaaaucagcgaug

SEQ ID NO: 103200 - RNA, 42 nt, Mus musculus
ccaguccaagaagcccaucgauccacaguaugucagggccag

SEQ ID NO: 103201 - RNA, 46 nt, Mus musculus
uuucgcucaacccgccugcguccagggucucuaguccccccacuag

SEQ ID NO: 103202 - RNA, 44 nt, Mus musculus
ccacccagauaaacucuuuucucugagucuugaacuugcccuca

SEQ ID NO: 103203 - RNA, 44 nt, Mus musculus
gaagcagggggagaaucuaaccaagaaccugcccccaacaggca

SEQ ID NO: 103204 - RNA, 46 nt, Mus musculus
uucgugguucuuccugucuggaagaauguugccuuuggaauggagc

SEQ ID NO: 103205 - RNA, 42 nt, Mus musculus
uuugcuuucucucccuugcccuuccauccuaggagccuccau

SEQ ID NO: 103206 - RNA, 46 nt, Mus musculus
cucauuaagugccuccuugcucuuaaggggaaaaccuuucagcuag

SEQ ID NO: 103207 - RNA, 46 nt, Mus musculus
auuuuguaagugguauggggaggguuccaguacagcaugcaaacag

SEQ ID NO: 103208 - RNA, 41 nt, Mus musculus
ggucucgagcaggaugacccgugcgagcggggagggggaag

SEQ ID NO: 103209 - RNA, 41 nt, Mus musculus
ugcagggacccaaagacuggccuugcuaggagguagagaga

SEQ ID NO: 103210 - RNA, 45 nt, Mus musculus
ucgaugagggugacuggggaaagaggcagaaaggcagagagagau

SEQ ID NO: 103211 - RNA, 45 nt, Mus musculus
aaucccagcaaccacauggugacucacagccaucuguaaugggau

SEQ ID NO: 103212 - RNA, 43 nt, Mus musculus
uuggggaagaugcugggaucacuuggucuuggucuugccuuug

SEQ ID NO: 103213 - RNA, 42 nt, Mus musculus
gagaggcugagaggaagcacuugccauaagagaaagggggag

SEQ ID NO: 103214 - RNA, 46 nt, Mus musculus
uaccuguggggugaagacauauuuguagagcuugaaguggcggaag

SEQ ID NO: 103215 - RNA, 46 nt, Mus musculus
uccacugccccuaguacucugagcuccaagauaaagugacaucgac

SEQ ID NO: 103216 - RNA, 90 nt, Mus musculus
uccuaguuugagauguugaaugcagagcuggaagaaaaucaggaauuggccaauagccgaauggcagagcuggagaagcugcaggcggag

SEQ ID NO: 103217 - RNA, 46 nt, Mus musculus
gggcucguugucugcugcaggugcaagccgcagcucugcccaguga

SEQ ID NO: 103218 - RNA, 46 nt, Mus musculus
guguugugugucaguaacaguguugugucaccguggucauguugaa

SEQ ID NO: 103219 - RNA, 46 nt, Mus musculus
aaacuaggaacagauucccucagacacaggucugaacccgugucau

SEQ ID NO: 103220 - RNA, 25 nt, Mus musculus
uguucugaaaggagaugggggcugg

SEQ ID NO: 103221 - RNA, 45 nt, Mus musculus
aaggucaacccaugccacagggcaagccaaacacagaacgcggaa

SEQ ID NO: 103222 - RNA, 46 nt, Mus musculus
aauauauauuuuaagcauguugcuuacauuauauguaggggaaggg

SEQ ID NO: 103223 - RNA, 46 nt, Mus musculus
caaaacucuucaaaugugcuggugcaccauuuugugucuuacagga

SEQ ID NO: 103224 - RNA, 46 nt, Mus musculus
guuaauucagugcugccaccuggcccugcuacucugugccccaguu

SEQ ID NO: 103225 - RNA, 46 nt, Mus musculus
uaaaagaaggagcuaagucccaagggacuggaaaaacccuuuaugu

SEQ ID NO: 103226 - RNA, 46 nt, Mus musculus
agaguugaaaggcagucaaagcugaaugagagccuauaucaaccag

SEQ ID NO: 103227 - RNA, 45 nt, Mus musculus
cccuggguuggacccugggagacaccagaauuaagccuggcccag

SEQ ID NO: 103228 - RNA, 46 nt, Mus musculus
gucguuccacugcccuaggcacugacugucuggccagaacugggag

SEQ ID NO: 103229 - RNA, 45 nt, Mus musculus
cagcgaacuccaguacaccccggagccgccaaaggccccaccccu

SEQ ID NO: 103230 - RNA, 42 nt, Mus musculus
ucuccaguuuggccauagucugccgaauugucugcaccuagg

SEQ ID NO: 103231 - RNA, 89 nt, Mus musculus
cagaacacaagaccaaaaagcacugaguucccaccucaugccagacuaaccuaacuugcuuugccuuggcacaugacccuugcccaagu

SEQ ID NO: 103232 - RNA, 46 nt, Mus musculus
ucucaccagcuggcaguacugggccucaucugccugguccuugauc

SEQ ID NO: 103233 - RNA, 42 nt, Mus musculus
ccuugucuucauguagcgccaaguggugaguagccagcauuc

SEQ ID NO: 103234 - RNA, 41 nt, Mus musculus
gauccagguccuuaugagcgauuccuccaccccggucugag

SEQ ID NO: 103235 - RNA, 45 nt, Mus musculus
acuaugguccaagaaauaucugaccguuguguaucuaugugagau

SEQ ID NO: 103236 - RNA, 44 nt, Mus musculus
ucauucugggugguugugagccaccaugugguugcugggauuug

SEQ ID NO: 103237 - RNA, 42 nt, Mus musculus
gagcgcaagaucacucgaaaccaaaagcgaaagcaugaugag

SEQ ID NO: 103238 - RNA, 46 nt, Mus musculus
aggaaacgguacaguuaggacuggaacucaaacuugaaguccaaag

SEQ ID NO: 103239 - RNA, 46 nt, Mus musculus
aaaugucuggggagaagccagaagugcuaaggaaaauagcuuagag

SEQ ID NO: 103240 - RNA, 45 nt, Mus musculus
cucucucgguggaagcaguacauauguggaaggcuggggcuggag

SEQ ID NO: 103241 - RNA, 46 nt, Mus musculus
cucuuaacccgcuuaucuagcucaagguccagagugagguguccag

SEQ ID NO: 103242 - RNA, 42 nt, Mus musculus
cccuggauucccagggccagugucaguggcggcagcccccag

SEQ ID NO: 103243 - RNA, 47 nt, Mus musculus
cugugucacaccuaagcugguagaggaacaccucaaaagugcccagu

SEQ ID NO: 103244 - RNA, 46 nt, Mus musculus
gugugugggguguguguguguguguguguguguguguguggugugu

SEQ ID NO: 103245 - RNA, 42 nt, Mus musculus
uacggccagagcagcuaugguucuucuuauggacagacccaa

SEQ ID NO: 103246 - RNA, 46 nt, Mus musculus
ugagcugcugggucucggauggacuaaaaguaaagcaaguguacuu

SEQ ID NO: 103247 - RNA, 46 nt, Mus musculus
acaaagcuccuauaacccaccucaggguuauggacaacagaaccag

SEQ ID NO: 103248 - RNA, 42 nt, Mus musculus
uggugguuauggcaaucaggaccagagugguggcggcggcgg

SEQ ID NO: 103249 - RNA, 45 nt, Mus musculus
uauuguucucugggcauuauguaagggcuucaguuuguggccagu

SEQ ID NO: 103250 - RNA, 46 nt, Mus musculus
auuguuaucucaggcaagaaacuugggaguaaagacuuguuugcag

SEQ ID NO: 103251 - RNA, 42 nt, Mus musculus
uaguuuguacaugguaaguauucagaggugggugggggcauu

SEQ ID NO: 103252 - RNA, 46 nt, Mus musculus
aaauugcacacgugugugugauaagcucaaaggucagacaagggug

SEQ ID NO: 103253 - RNA, 46 nt, Mus musculus
ucaaugcaauucuacauauguacucagacaaauauauaggaacuag

SEQ ID NO: 103254 - RNA, 61 nt, Mus musculus
ugcucaugggaaauaaccagguuuuacacagcacaaacuugaauucauggaaaaaaauggc

SEQ ID NO: 103255 - RNA, 50 nt, Mus musculus
uacaauauuuuuauauggugaauuuagauaaacauugguuaaagauggug

SEQ ID NO: 103256 - RNA, 47 nt, Mus musculus
auuuucuugaaguguguggcauuaucaauggggauucaaaguagcag

SEQ ID NO: 103257 - RNA, 46 nt, Mus musculus
cuuggauuuucuuagaaacaaaaaauacugcaaaaguggagaguga

SEQ ID NO: 103258 - RNA, 45 nt, Mus musculus
aggcgagaauguuacaauugaaucuguggcugauuacuucaagca

SEQ ID NO: 103259 - RNA, 45 nt, Mus musculus
cuaggauuuuguagcgacugucucaaaaaauaaaauucaguggaa

SEQ ID NO: 103260 - RNA, 87 nt, Mus musculus
uugcucaaagacaguguaaaccauggcuagauuuaaguuacaugacaggaagaguaauugggaagagaggagccaaaguuuggaaua

SEQ ID NO: 103261 - RNA, 97 nt, Mus musculus
aguguuaggggaaagauggagguuugguuucuacaggcucugcauuuguagauagaacuaacuuuagaucaguuguauuuaauuugaacuuguccag

SEQ ID NO: 103262 - RNA, 47 nt, Mus musculus
cguuuuggugccuuguuggagauugagcccuaugaauuguggcagag

SEQ ID NO: 103263 - RNA, 46 nt, Mus musculus
uggacagccuaugauuaauuuguacacagacagggaaacuggcaag

SEQ ID NO: 103264 - RNA, 84 nt, Mus musculus
cuugcuuuuuuguauggugcuggaguucuaaaucagacccuuucauauuauacugcuuuuacagcccugucuccccaccccguc

SEQ ID NO: 103265 - RNA, 90 nt, Mus musculus
uuucucuguguagccuugacuggucucaaacuagagaucugccucuugaguacuaggauugaaggcaugugccaccacugaccagcccca

SEQ ID NO: 103266 - RNA, 47 nt, Mus musculus
uagcuacuuguaaaauucuuacuuuuaaaaguuaaauuagccccuua

SEQ ID NO: 103267 - RNA, 46 nt, Mus musculus
ccccaaacacaugggcucacccccuuccucuaauuuccuccccaau

SEQ ID NO: 103268 - RNA, 42 nt, Mus musculus
gaauggggaauuuuccuggaaacugggagaagauuccuugau

SEQ ID NO: 103269 - RNA, 46 nt, Mus musculus
augccugggccaggaagcgggaguggguggguuuuuggggaggcag

SEQ ID NO: 103270 - RNA, 54 nt, Mus musculus
uacccgccgagcugacuucaaucggggugguggaaauggucgcggaggccgagg

SEQ ID NO: 103271 - RNA, 96 nt, Mus musculus
gggccguggaggcuauggaggagguggcagugguggugguggccggggaggauuccccaguggaggugguggagguggaggacagcaacgagcugg

SEQ ID NO: 103272 - RNA, 61 nt, Mus musculus
uucuugugugguguuaauauuuuaaguguuuggaaguuugcaaggucauguugucaauggg

SEQ ID NO: 103273 - RNA, 46 nt, Mus musculus
ugguugggagaauggagcugagcaggcaggcauggcaugggauaau

SEQ ID NO: 103274 - RNA, 101 nt, Mus musculus
uacaugugagaacaugaacuucucuuggagaaaugaaugcaaccaguguaaggcaccuaagccagauggcccaggagggggaccaggaggcucucauaugg

SEQ ID NO: 103275 - RNA, 67 nt, Mus musculus
gagccccacacuugagauuugcaaaggucacgggagggaagguagaagaauugaagaugauaacaug

SEQ ID NO: 103276 - RNA, 87 nt, Mus musculus
acuuuuuuucuagggggaaacuauggagaugaucgacguggcagaggaggauaugaccggggcggcuaccggggccgaggaggggac

SEQ ID NO: 103277 - RNA, 52 nt, Mus musculus
caagauggacuccaggugaguaagucaaaacaaaagucaagaaaauugguca

SEQ ID NO: 103278 - RNA, 90 nt, Mus musculus
uuguaaacuuacaauucaggaucgcucauggauauuuuuuuuugggggggguggggcgguuguguguguaugugugugugugugugucag

SEQ ID NO: 103279 - RNA, 46 nt, Mus musculus
gugcgcuaccacgccccgcucagauaaaguaaucuugaugcaggag

SEQ ID NO: 103280 - RNA, 46 nt, Mus musculus
cauuugacauuugaugcuuugaacucaacauuguguuucagcugag

SEQ ID NO: 103281 - RNA, 46 nt, Mus musculus
uuuuguguagcccaggcuguccuaguauucuugcucuguauaccag

SEQ ID NO: 103282 - RNA, 41 nt, Mus musculus
uauguuacacuugguauaugugugggaacucuuaggcccgg

SEQ ID NO: 103283 - RNA, 45 nt, Mus musculus
gauucaaaaaauuccauagguaggaccauaaauaacacuuggaag

SEQ ID NO: 103284 - RNA, 46 nt, Mus musculus
ugcugagauuaacagguauugccaucauucaguggacagaagacaa

SEQ ID NO: 103285 - RNA, 45 nt, Mus musculus
guacagaugagagaaacagaauggcccugaagcucacagcccaga

SEQ ID NO: 103286 - RNA, 46 nt, Mus musculus
gugugaauauaaacacgggugcaugucugcacagaagcuugaagac

SEQ ID NO: 103287 - RNA, 45 nt, Mus musculus
caggggaugaacucaaaaaguucaagaugaagcugcugacagugc

SEQ ID NO: 103288 - RNA, 42 nt, Mus musculus
cugucagcagcuucaucuugaacuuuuugaguucauccccug

SEQ ID NO: 103289 - RNA, 98 nt, Mus musculus
ccuaagcagcugacuuccuggucuuggcgggcuggcagcaggcaggcugcagcaggcgagcagcagcaagaguaaaaggugaccgcggcugcccaccc

SEQ ID NO: 103290 - RNA, 44 nt, Mus musculus
ugcuggggaaagaacaggagcuguaagaaaagagggugggggag

SEQ ID NO: 103291 - RNA, 45 nt, Mus musculus
ugccagaguaacaacuuagcuccacccucuguccccaccccacuu

SEQ ID NO: 103292 - RNA, 44 nt, Mus musculus
agugggguggggacagaggguggagcuaaguuguuacucuggca

SEQ ID NO: 103293 - RNA, 45 nt, Mus musculus
gcuccucaacccucagguuaaauguuacuuccuccgagaguccag

SEQ ID NO: 103294 - RNA, 45 nt, Mus musculus
aacuguggcagagacauggaagaacaucauggggagaaaacagag

SEQ ID NO: 103295 - RNA, 45 nt, Mus musculus
uacaggucagggcagugaauggggccagaugggaauaaauuguag

SEQ ID NO: 103296 - RNA, 49 nt, Mus musculus
agugguugggaaaugaauagguuaaccaacaaugucaaggaggaaggaa

SEQ ID NO: 103297 - RNA, 46 nt, Mus musculus
uggccuaaguucucccaccagacuugugaguccugugggccuugag

SEQ ID NO: 103298 - RNA, 45 nt, Mus musculus
acuguguagccgaggagagggggagaggagucuaagguccuuuga

SEQ ID NO: 103299 - RNA, 47 nt, Mus musculus
guggguguuugucuuauagaguucaggggaguacacagguuggggug

SEQ ID NO: 103300 - RNA, 45 nt, Mus musculus
gggaagauuacucaggucagugaggaaaccugaguuugggccaag

SEQ ID NO: 103301 - RNA, 46 nt, Mus musculus
aaguugaaagccagcaggacucuaucaaaaacaacaggggaagggg

SEQ ID NO: 103302 - RNA, 46 nt, Mus musculus
agucugauuauauugccuggcucaacuaacacuuaaaaucugccug

SEQ ID NO: 103303 - RNA, 50 nt, Mus musculus
uugucaucaaucaguccuaccagauggauuucaacauuuaaaccuggaga

SEQ ID NO: 103304 - RNA, 42 nt, Mus musculus; identical to SEQ ID NO: 33872

SEQ ID NO: 103305 - RNA, 46 nt, Mus musculus
aaaccauaccccugcccagaauguggccguugcuucagccucagcu

SEQ ID NO: 103306 - RNA, 46 nt, Mus musculus
aaagugcuaaguucccgacagaaaggucucgccaagcgaaugaaag

SEQ ID NO: 103307 - RNA, 46 nt, Mus musculus
gauauguagucggcgccaagcuuagugcaguuuaagugggugagaa

SEQ ID NO: 103308 - RNA, 45 nt, Mus musculus
aguuccaggacagccuagugagacgcugucucaaaggacggaaag

SEQ ID NO: 103309 - RNA, 41 nt, Mus musculus
ggccugcugcauaacccucagaaaucagccacaaccuacag

SEQ ID NO: 103310 - RNA, 42 nt, Mus musculus
ccccaaggcuccucaggaguggcagcagggaugcggccaggu

SEQ ID NO: 103311 - RNA, 42 nt, Mus musculus
uggguagggauaggggaaacauacccagcucucggugcuggc

SEQ ID NO: 103312 - RNA, 46 nt, Mus musculus
gccuuggccugagggcauaagugagugugccuagcacaguacagag

SEQ ID NO: 103313 - RNA, 42 nt, Mus musculus
uccaucgugcacagugggcagccagccggggccggccuaaac

SEQ ID NO: 103314 - RNA, 46 nt, Mus musculus
cagacacuggaggugccagauagcuggagacagacugaauguaauc

SEQ ID NO: 103315 - RNA, 46 nt, Mus musculus
cucccuacgggagaaacagcguuagccuacucaagcugcccaagcc

SEQ ID NO: 103316 - RNA, 45 nt, Mus musculus
gcccagucccguguuucaccccaaguuuuaggucuacaccgagaa

SEQ ID NO: 103317 - RNA, 42 nt, Mus musculus
ucuuuccaggacagucuuugccuucacacugaaccccgagcu

SEQ ID NO: 103318 - RNA, 46 nt, Mus musculus
ccaugcuggcacacagcuuugucacugucuacacacacacacacac

SEQ ID NO: 103319 - RNA, 45 nt, Mus musculus
ccaagcccaggacccagaacaggagcccagagaccaggaugaagc

SEQ ID NO: 103320 - RNA, 45 nt, Mus musculus
uuauuuuuauguaugugucugcccguguguaccuguguuaguuag

SEQ ID NO: 103321 - RNA, 46 nt, Mus musculus
ugaauaaguaaggaauggagaguuuugaaaaggcagauagugggag

SEQ ID NO: 103322 - RNA, 42 nt, Mus musculus
cuggagcucauccaaacugaauguuucaggucugcgccucag

SEQ ID NO: 103323 - RNA, 45 nt, Mus musculus
ugggaccauuguguuuucuuuuugucuggaacaagaucaugagaa

SEQ ID NO: 103324 - RNA, 46 nt, Mus musculus
cuuccccugugacuugaaguccaucucauuccuauaucugccagau

SEQ ID NO: 103325 - RNA, 86 nt, Mus musculus
ucacccggccagcagcccagcccuccuuccaccaagcccagaagacccacuacccagcucagcagggugaauaccagccccagcag

SEQ ID NO: 103326 - RNA, 44 nt, Mus musculus
uguagacagcuuugaaggcaagaagacugauaaaaaauaccuga

SEQ ID NO: 103327 - RNA, 41 nt, Mus musculus
uguuagccuuggacugaagggguuuuaaguuuugaggggua

SEQ ID NO: 103328 - RNA, 46 nt, Mus musculus
aggaauagcuauauguuggaauggcuuuaauguuguuacauuugag

SEQ ID NO: 103329 - RNA, 42 nt, Mus musculus
gggcuggguggggcgcgcgggccagcuggagcgcggggggcg

SEQ ID NO: 103330 - RNA, 46 nt, Mus musculus
accucacaggacuugaucgaaaacuaguguaugaauugccauuuuc

SEQ ID NO: 103331 - RNA, 45 nt, Mus musculus
uaguagcuccuguucucagacagcugcggucaguuaucgcucgga

SEQ ID NO: 103332 - RNA, 45 nt, Mus musculus
guguccauuguguccuuacggagaccugcaaaguuacucugcuag

SEQ ID NO: 103333 - RNA, 42 nt, Mus musculus
auacaccuuuaauccugguacuugagaggcagaggcaggcag

SEQ ID NO: 103334 - RNA, 46 nt, Mus musculus
ggcugaggaaaugaggaucaaacuuugaacuuuaagcuggcaccug

SEQ ID NO: 103335 - RNA, 46 nt, Mus musculus
uuuugguguuggugauugucagagcaauaauagccuuugucuuuag

SEQ ID NO: 103336 - RNA, 46 nt, Mus musculus
ugcccauguaccucccacccacaugugaucaagcacaucccaucag

SEQ ID NO: 103337 - RNA, 46 nt, Mus musculus
ccacggaucugcuucuugccuggaaccccauuuguuugggauuagu

SEQ ID NO: 103338 - RNA, 42 nt, Mus musculus
acaggaaggaaguaagaagaacagagcuggaaaggugggcag

SEQ ID NO: 103339 - RNA, 45 nt, Mus musculus
acuagagacaauguaguuuucuuuuacuagauucugaagugggaa

SEQ ID NO: 103340 - RNA, 45 nt, Mus musculus
cuucccuucguuuuauuguuaacauuucuagauuauccuguguug

SEQ ID NO: 103341 - RNA, 45 nt, Mus musculus
cugucuuuggugggcuuuaaaaaucucuucagcauaggcaggcag

SEQ ID NO: 103342 - RNA, 45 nt, Mus musculus
gcuaggucuacagagugaguuccaggacagacagagcuacacaga

SEQ ID NO: 103343 - RNA, 46 nt, Mus musculus
agucacaucucagagcagugaauaaaucacugacaucagucaggag

SEQ ID NO: 103344 - RNA, 62 nt, Mus musculus
gugguuagccuuguguaggcaguucccaccauagaaauggaaguaguggaagagggagucag

SEQ ID NO: 103345 - RNA, 45 nt, Mus musculus
uccucuuccuccacgcugccucaucccuccucugucuugcucaga

SEQ ID NO: 103346 - RNA, 45 nt, Mus musculus
cugugcugaaauucuugcuucucagcuggcuaggagcuuuggcua

SEQ ID NO: 103347 - RNA, 46 nt, Mus musculus
aaaguucuccagucaaaagagaaaugguugcuccuggaaguguggg

SEQ ID NO: 103348 - RNA, 23 nt, Mus musculus
cuaggcggugggaaucccccagc

SEQ ID NO: 103349 - RNA, 84 nt, Mus musculus
uauuagaauuuucucuuucagaucuuccaugguggcuuauuuuaauucggcagaaagcguugguaggcaaacucccaggagacc

SEQ ID NO: 103350 - RNA, 41 nt, Mus musculus
gugaggagggaagagagagagagagagagagagagagagag

SEQ ID NO: 103351 - RNA, 45 nt, Mus musculus
gauguggacuucuggaucauccccauuauccaggguuuugugcag

SEQ ID NO: 103352 - RNA, 44 nt, Mus musculus
cacgauuucuaguggcucuuauaucucgaagaaguaggcacaga

SEQ ID NO: 103353 - RNA, 41 nt, Mus musculus
aaccaggaaauaguuauuuuugggcuggagggaugucucag

SEQ ID NO: 103354 - RNA, 48 nt, Mus musculus
gguuuggucccagcacccacucacacaaagagaagagaagagaagaga

SEQ ID NO: 103355 - RNA, 42 nt, Mus musculus
gagaagagaagagaagagaagaggugacaugacaugugucuu

SEQ ID NO: 103356 - RNA, 42 nt, Mus musculus
aacccauuaaaaaggauguacaauacaaaaaaaacuggacag

SEQ ID NO: 103357 - RNA, 42 nt, Mus musculus
uguggcugcauugcgcuagcucauaauugguuuaggcuggag

SEQ ID NO: 103358 - RNA, 45 nt, Mus musculus
auaagcacaaggcagagaggagagagagggagauguuaacuggga

SEQ ID NO: 103359 - RNA, 65 nt, Mus musculus
gcuuaacuauauucagacuucaggcauuuugaaaguaacagagaaggaaaagaugcccagacucu

SEQ ID NO: 103360 - RNA, 46 nt, Mus musculus
uguuuuuuuaucugaaaaacucacuccauuaaaaauuggcagacag

SEQ ID NO: 103361 - RNA, 63 nt, Mus musculus
ucuguaacgagaucuggugcccucuucuggaaugucugaagacagcuacaguauacuuacaua

SEQ ID NO: 103362 - RNA, 41 nt, Mus musculus
guauuugugugugugugugugugcgugcgugcgugcguguc

SEQ ID NO: 103363 - RNA, 46 nt, Mus musculus
aaggacauaauguuuuugacugauguaaauacuaacucuagaauag

SEQ ID NO: 103364 - RNA, 52 nt, Mus musculus
cagaaugagucuauguuuuauuagguacgucuguucauucauugaggucuag

SEQ ID NO: 103365 - RNA, 46 nt, Mus musculus
caacaauucaccugaauuccauucuaaaauguuucaguggugguag

SEQ ID NO: 103366 - RNA, 45 nt, Mus musculus
guguguguguguguguguguguaugagaaagagagagagagagaa

SEQ ID NO: 103367 - RNA, 46 nt, Mus musculus
auuaugcgacuuucagcgucuccuugguuacaagcauaugaucaau

SEQ ID NO: 103368 - RNA, 45 nt, Mus musculus
cacacggacuggcuucacaaagcccauggauguuuacugccagag

SEQ ID NO: 103369 - RNA, 42 nt, Mus musculus
uuuauuuaaaaauucaaaaugaaguuuucaccuuucaggcua

SEQ ID NO: 103370 - RNA, 46 nt, Mus musculus
aauucuuaaguaugggcuugcccgucauaaaauaacuugcugcagg

SEQ ID NO: 103371 - RNA, 42 nt, Mus musculus
uggguuuccaaagaaaugacccaugaagagaugugacaacag

SEQ ID NO: 103372 - RNA, 45 nt, Mus musculus
uucucagaacacgagcaucuuuuaauggaauaaaugcagcuuugu

SEQ ID NO: 103373 - RNA, 46 nt, Mus musculus
caagaucugacccccucuucuggagugucugaggacagcuacagug

SEQ ID NO: 103374 - RNA, 46 nt, Mus musculus
auggcuauaggcagacaucaugcauagcuuuacacacuggucagga

SEQ ID NO: 103375 - RNA, 54 nt, Mus musculus
ugguugguugaaguauuuucacacugggagccagccagccccuuuaugucaguc

SEQ ID NO: 103376 - RNA, 45 nt, Mus musculus
uuuaaaagagauuucauuuuuugugcuuuuucuuagcagccuccu

SEQ ID NO: 103377 - RNA, 31 nt, Mus musculus
agguggauuacgacuucagcuaucaccagau

SEQ ID NO: 103378 - RNA, 45 nt, Mus musculus
guguguguaucuguguguguguguaucuguguguguguguguguu

SEQ ID NO: 103379 - RNA, 50 nt, Mus musculus
guguguguguaucuguguguguuguguaucugugugugugugugugugua

SEQ ID NO: 103380 - RNA, 98 nt, Mus musculus
uguacucauuuuauguuuuauuuugugguaauguagauuaaacccaggaucuuguguauacuuugaauguaucucugagucucauuccuagaccccug

SEQ ID NO: 103381 - RNA, 46 nt, Mus musculus
gaacuuagaagaacucaccucugcugcugcuguggggcuuggggau

SEQ ID NO: 103382 - RNA, 45 nt, Mus musculus
cagcacaucaauccguuguuacccacuugccuuaacaaggaggag

SEQ ID NO: 103383 - RNA, 42 nt, Mus musculus
ggccuuuugguucagaggggaaggacacagacuggggcagau

SEQ ID NO: 103384 - RNA, 46 nt, Mus musculus
cucgagucagucccucgaccuccuacacucccaguaggcacaagag

SEQ ID NO: 103385 - RNA, 45 nt, Mus musculus
ccuuguuuuccaucuuuuauuuucagaucuaguuguccaucuggu

SEQ ID NO: 103386 - RNA, 45 nt, Mus musculus
uuugccugcauguucgucugugugaaggugucagaagcccuagaa

SEQ ID NO: 103387 - RNA, 41 nt, Mus musculus
ggaaggaaggaaggaaggggaagggaaggaaaggagguagu

SEQ ID NO: 103388 - RNA, 42 nt, Mus musculus
agguauuaaaacuggaaguuagaaagcugaauggaaugacuu

SEQ ID NO: 103389 - RNA, 47 nt, Mus musculus
agaguuugugugucugccauagauagauagauagauagauagauaga

SEQ ID NO: 103390 - RNA, 42 nt, Mus musculus
acuuuacauaugggcuuuaaaaccaaguuuucaugggcagaa

SEQ ID NO: 103391 - RNA, 46 nt, Mus musculus
cuuacacuccuucagucgaauacacugagccccacucuggcuuucu

SEQ ID NO: 103392 - RNA, 45 nt, Mus musculus
acccugaguuuuacaugggaauuuaugagacaguuaaccagaaca

SEQ ID NO: 103393 - RNA, 64 nt, Mus musculus
ucuuuaaagaaagaaaacaaagacaaaacaaaaccaagaaaacaaaacugaaccaaaagaaggc

SEQ ID NO: 103394 - RNA, 46 nt, Mus musculus
aauuuccaacaacuaccuggauauucacaaccgucuauacugagau

SEQ ID NO: 103395 - RNA, 45 nt, Mus musculus
ugacacgagaggguucugaugaguuuggggcuagccugggcuacu

SEQ ID NO: 103396 - RNA, 45 nt, Mus musculus
uuuaugaaaucagaaaugcgaacugaaacccaaggcacauggaga

SEQ ID NO: 103397 - RNA, 45 nt, Mus musculus
gagaagggaagucauuguguguguucugucuguaauaagagagga

SEQ ID NO: 103398 - RNA, 46 nt, Mus musculus
guuaaagaauaaaaagucauaaauuugaaagagaguuuacugagag

SEQ ID NO: 103399 - RNA, 42 nt, Mus musculus
cuuuaacugacagguguugaauccauucaguacacaagagau

SEQ ID NO: 103400 - RNA, 46 nt, Mus musculus
uauagugugguuaguauucugucuguauuuucaucccucuguaaug

SEQ ID NO: 103401 - RNA, 46 nt, Mus musculus
ggcuauauagugaggcucuauuuuuaaguaagcaaaagcuugggug

SEQ ID NO: 103402 - RNA, 46 nt, Mus musculus
cccccacccaccccauauuaauaacuugaauuaauaccaccuccuc

SEQ ID NO: 103403 - RNA, 45 nt, Mus musculus
guuguugagacaauguuuuguguagcucagguuggccaccagcuc

SEQ ID NO: 103404 - RNA, 42 nt, Mus musculus
cuaaucagguaguuucccagggugaaacuaaagccggcagau

SEQ ID NO: 103405 - RNA, 46 nt, Mus musculus
gcuuccuaucucugaagaggcuagcaagauacugcaggugcuccag

SEQ ID NO: 103406 - RNA, 45 nt, Mus musculus
uaaaaggccugacauaaccccucuugggaggcaaagacugcaggg

SEQ ID NO: 103407 - RNA, 65 nt, Mus musculus
acaaacaaacaaacaaacaaacaaaacaaaaaggaagagaagagaagagaagagaagagaaggag

SEQ ID NO: 103408 - RNA, 23 nt, Mus musculus
uugcccaucccuuccccuguggg

SEQ ID NO: 103409 - RNA, 41 nt, Mus musculus
uaggcucuguucagaggagggcuggcguagaacuagccuag

SEQ ID NO: 103410 - RNA, 36 nt, Mus musculus
ggacaaaguugccuuuaguuacugccucaggagaag

SEQ ID NO: 103411 - RNA, 46 nt, Mus musculus
ugaguacacuguaggugucuucagacacacaggaagagggcaucag

SEQ ID NO: 103412 - RNA, 62 nt, Mus musculus
cccacgaggcccgaggaacaguaggcguucucacucagucucgcuuuucaaaauggcaucga

SEQ ID NO: 103413 - RNA, 51 nt, Mus musculus
cuucugguuggucgcuuguauuuucgaugauguguuuuugaggagccuggg

SEQ ID NO: 103414 - RNA, 46 nt, Mus musculus
aaaacaaaauggaaccagacaugguugcaaaaauuuguuacccuag

SEQ ID NO: 103415 - RNA, 46 nt, Mus musculus
acauauaauaaauaaauaaauaaauaaauaaauaaauaaaaggcaa

SEQ ID NO: 103416 - RNA, 46 nt, Mus musculus
accuguggacugaggaugggccucagccuucacgugccuaggccag

SEQ ID NO: 103417 - RNA, 45 nt, Mus musculus
gauugugacaaaugcucacguggucaccaacaaaaaccgggucaa

SEQ ID NO: 103418 - RNA, 43 nt, Mus musculus
aaaucccagcaagcacaugguggcucacaaccauccguaacaa

SEQ ID NO: 103419 - RNA, 42 nt, Mus musculus
cguaaagcagccugcagccuggaguaggccacacugccccgg

SEQ ID NO: 103420 - RNA, 45 nt, Mus musculus
aaagggcgccuugucuuuguguggugucuguagugguggcggcug

SEQ ID NO: 103421 - RNA, 46 nt, Mus musculus
gcauccacccaggacaaacaugucgugcugagcuugcugcgugcca

SEQ ID NO: 103422 - RNA, 46 nt, Mus musculus
agagcugagaccuggagaauuuguaguugccauuggaagccccuuu

SEQ ID NO: 103423 - RNA, 88 nt, Mus musculus
cacagucaccacugggaucgucagcaccacccagcgaggcggcaaagagcugggacuucggaacuccgauauggacuacauucagaca

SEQ ID NO: 103424 - RNA, 52 nt, Mus musculus
uccauccgauaagauaaaaaaguucuugacagagucccacgaucgacaggcc

SEQ ID NO: 103425 - RNA, 44 nt, Mus musculus
ugaggaucuaaguucaaauccccaggacccguguaaagccaggc

SEQ ID NO: 103426 - RNA, 46 nt, Mus musculus
ggagggcucaaggaaaaugacgucaucaucagcaucaacggacagu

SEQ ID NO: 103427 - RNA, 64 nt, Mus musculus
guccgcaggggcaaugaagacauugugauuaccgugauuccugaagaaaucgaccccuaggcag

SEQ ID NO: 103428 - RNA, 46 nt, Mus musculus
agggaacaccccugccgacagaauccuucuugauaguuugcgggca

SEQ ID NO: 103429 - RNA, 46 nt, Mus musculus
ccuucccuuagccuaaguugucugacuaaugcaguugacggaugcg

SEQ ID NO: 103430 - RNA, 67 nt, Mus musculus
aggaauccuggaacccggaguacagugacuuugaguuucagcuauuaaaauacuucuucauacguag

SEQ ID NO: 103431 - RNA, 94 nt, Mus musculus
augcagugaaaauggggguggucaaggcugaaaagagcaagaaaaagaaggaagaggaagaugaggaggaggaugaagaggaugaggaagagga

SEQ ID NO: 103432 - RNA, 45 nt, Mus musculus
agucuaagauaguuacuugacuuuggauuugguacuagugacaug

SEQ ID NO: 103433 - RNA, 45 nt, Mus musculus
uggaagagcaaccagaacuuaaccccugagccaucuagcccccaa

SEQ ID NO: 103434 - RNA, 46 nt, Mus musculus
acugaauuuuuagugcuauucuauauagcuuguuaggaauuugcag

SEQ ID NO: 103435 - RNA, 46 nt, Mus musculus
cuuggauauauauaauuccaucuguccauccauccauccugccuaa

SEQ ID NO: 103436 - RNA, 46 nt, Mus musculus
uugcaaaauaaauugguuuguuuucaaaagugaguuuuacacagaa

SEQ ID NO: 103437 - RNA, 46 nt, Mus musculus
uuuguuuuguuuugguuugguuuuugguuuuuuagauuggcggcgu

SEQ ID NO: 103438 - RNA, 42 nt, Mus musculus
aaguuggccuagugcucacccacuuagaacaaacagugcuuu

SEQ ID NO: 103439 - RNA, 46 nt, Mus musculus
gaauucuuuuauuauguuccuuccauaauuaauguauucuuaccag

SEQ ID NO: 103440 - RNA, 46 nt, Mus musculus
auagaugguugacuaugugaguguugggaguggacccuggguccuu

SEQ ID NO: 103441 - RNA, 43 nt, Mus musculus
ccaacagcuggauguauuuagaaaacagagauaccuggagagg

SEQ ID NO: 103442 - RNA, 46 nt, Mus musculus
aaaaaagaaaaaaaaauacaguuuuauguauaaauaaauccgggag

SEQ ID NO: 103443 - RNA, 46 nt, Mus musculus
auuuaaaauuuauuuacauuuuauuucugaaaaacuaaagggccag

SEQ ID NO: 103444 - RNA, 25 nt, Mus musculus
aaagcauuuguuuuguaagcacaga

SEQ ID NO: 103445 - RNA, 42 nt, Mus musculus
cugagguugucaucugacugccacguguacacuugcacccga

SEQ ID NO: 103446 - RNA, 46 nt, Mus musculus
uaaauuaccugguuuuaaaggaaguggggaaaacccuaacaugcag

SEQ ID NO: 103447 - RNA, 45 nt, Mus musculus
uacuuauuuggaucaucucaccguuuccuuuacaguaguaguaca

SEQ ID NO: 103448 - RNA, 46 nt, Mus musculus
aaacgucacuguguaugugggguguagauuuaauagacaggaacag

SEQ ID NO: 103449 - RNA, 46 nt, Mus musculus
ggucaugccacauguguacauauuugaacuggccaagagcaaucag

SEQ ID NO: 103450 - RNA, 69 nt, Mus musculus
accaucccagaccuaauaacauugaagcaauagaguuggcagagacugaagaggcuucuucaauaauua

SEQ ID NO: 103451 - RNA, 42 nt, Mus musculus
uguguguguguguguguguguguguguguguuaagcagggau

SEQ ID NO: 103452 - RNA, 47 nt, Mus musculus
uagagguagaacuggcaaaaguuggaagacuuuauauugucugagag

SEQ ID NO: 103453 - RNA, 52 nt, Mus musculus
aaaauagucaaguuuuuuugguuuggacaccuggguuggauaguuauauaga

SEQ ID NO: 103454 - RNA, 42 nt, Mus musculus
cacaucauaugccaccaaggauagcucugaauguggcccaaa

SEQ ID NO: 103455 - RNA, 46 nt, Mus musculus
aaagccuacccccacagaaacacacuuccuccaacaaggccacacc

SEQ ID NO: 103456 - RNA, 46 nt, Mus musculus
ucuacccuggaauucacuuuguagaccaggcugcccuugaacucag

SEQ ID NO: 103457 - RNA, 42 nt, Mus musculus
uucaguuuauaguuuuguaaaggauauguugaagacaggcag

SEQ ID NO: 103458 - RNA, 46 nt, Mus musculus
ucaaaggggacauucuaguuacugggcuccuaaaagcagucuggag

SEQ ID NO: 103459 - RNA, 37 nt, Mus musculus
cuggaagaugacucugugggaaaagguuugcccuuag

SEQ ID NO: 103460 - RNA, 44 nt, Mus musculus
caaaucccagcaaccacaugguggcucacaaccauccaugcccu

SEQ ID NO: 103461 - RNA, 46 nt, Mus musculus
guaauauuuucuggggcugauagaccaacuuggggugagggaagag

SEQ ID NO: 103462 - RNA, 44 nt, Mus musculus
uauggacuccaaguuaagcacaacuggccuaaggaggaugguug

SEQ ID NO: 103463 - RNA, 42 nt, Mus musculus
gaaagcaaggaucauagagcuauccuucugguaucuugggaa

SEQ ID NO: 103464 - RNA, 45 nt, Mus musculus
ugucacuuuauaaaguguuucuugcuaucucaaccuguuuccuga

SEQ ID NO: 103465 - RNA, 42 nt, Mus musculus
ugcucagagaguggcuggacugcugugugacugaagggggag

SEQ ID NO: 103466 - RNA, 45 nt, Mus musculus
uguuccacacucacaggagagaauugacugcaucugcaugaggag

SEQ ID NO: 103467 - RNA, 46 nt, Mus musculus
ucuguaauacggaagguacuccacgugagcucauuuuauagcgcag

SEQ ID NO: 103468 - RNA, 23 nt, Mus musculus
cguggagaugucuacacaggcaa

SEQ ID NO: 103469 - RNA, 45 nt, Mus musculus
gauauagcaaguccugcaggguguagacccuuugcacgcccagag

SEQ ID NO: 103470 - RNA, 46 nt, Mus musculus
cacacccaaaaaaccuugggcacuaacgccaaucuucaguccucua

SEQ ID NO: 103471 - RNA, 44 nt, Mus musculus
agcuucaggccugguggagagaggacugugugaggcauuacaga

SEQ ID NO: 103472 - RNA, 32 nt, Mus musculus
ccuuuuucuuuggugaaucccauucuuuguuc

SEQ ID NO: 103473 - RNA, 46 nt, Mus musculus
caccauuucaaagauuagaaaacaccacugucaucagaagccccag

SEQ ID NO: 103474 - RNA, 45 nt, Mus musculus
aggugcgugcugacuggcuucuugugacaaggaacucacuaggag

SEQ ID NO: 103475 - RNA, 46 nt, Mus musculus
agaguuacuguuucauagcaaguuccagcuugccugggcugcaaaa

SEQ ID NO: 103476 - RNA, 45 nt, Mus musculus
caguuccaugggcaccguguacgagguggaguaggcaguucuggg

SEQ ID NO: 103477 - RNA, 42 nt, Mus musculus
uucaaagauucuuuccaggaagccacagaaucacaguggcac

SEQ ID NO: 103478 - RNA, 41 nt, Mus musculus
aacaaauccacaaaggcauaauacauucaauaaaagaggga

SEQ ID NO: 103479 - RNA, 42 nt, Mus musculus
caucuauuuaaaggacaagcaauuccauauggguggcugcag

SEQ ID NO: 103480 - RNA, 42 nt, Mus musculus
cuuuguuguaagacuucagaguacaugcccuuccccccagag

SEQ ID NO: 103481 - RNA, 46 nt, Mus musculus
gguuggccuggggacccggauacagugggaaagucucaaauuuuag

SEQ ID NO: 103482 - RNA, 46 nt, Mus musculus
aucugggcuggaagcccggugugguggcgcacgccuuuaaucccag

SEQ ID NO: 103483 - RNA, 45 nt, Mus musculus
ucuguguaugauuuaugcuguucuggaaucuucuagcuggcccag

SEQ ID NO: 103484 - RNA, 46 nt, Mus musculus
uuuaucugcaagcuacaucuguaaacacgccauaaggcccauccca

SEQ ID NO: 103485 - RNA, 46 nt, Mus musculus
cuuaacauagcaauccauaugacauuccuuccacagaauuuccuag

SEQ ID NO: 103486 - RNA, 45 nt, Mus musculus
ugaagguugauucauuaacuguaacaaacaugaccauaacugaag

SEQ ID NO: 103487 - RNA, 46 nt, Mus musculus
cacacucaaauguucagugucccaggaagagucuguaaguccugug

SEQ ID NO: 103488 - RNA, 46 nt, Mus musculus
cucacgcuuaugcggcuuuauuaacugagccaccucucccgccuag

SEQ ID NO: 103489 - RNA, 45 nt, Mus musculus
ugggacuuggcauauaaaauggccuguguucagacuugcugccag

SEQ ID NO: 103490 - RNA, 45 nt, Mus musculus
acaccuaacaguagauuugguucagaacaaaacagacaggcuaua

SEQ ID NO: 103491 - RNA, 46 nt, Mus musculus
gaucauguauauaaagaaaagcuaccguuucacaacaugucaugag

SEQ ID NO: 103492 - RNA, 42 nt, Mus musculus
caucccaauucuaagagcuauuggcccucuagccaccccaag

SEQ ID NO: 103493 - RNA, 46 nt, Mus musculus
gucaugcugacaaccaggaaugccacuacagauguaaacaccauag

SEQ ID NO: 103494 - RNA, 50 nt, Mus musculus
uaugccuuuauucacacuaauccaucaacaggaacaaggaggcagauugg

SEQ ID NO: 103495 - RNA, 41 nt, Mus musculus
aagcacuccuggaaucuagcugcuucggggaagcucacagu

SEQ ID NO: 103496 - RNA, 46 nt, Mus musculus
uccuuguaagaccccuuuucuuucauuuuaggggcugaguguggag

SEQ ID NO: 103497 - RNA, 46 nt, Mus musculus
uuaaagaguugccauaacucauucaacugagauaaaacccagccag

SEQ ID NO: 103498 - RNA, 42 nt, Mus musculus
ggacagaaggagaaagcaucuccccuggccagagugcuggag

SEQ ID NO: 103499 - RNA, 45 nt, Mus musculus
ucaugugugugaugucagugcccccucacuggucacacugcucag

SEQ ID NO: 103500 - RNA, 46 nt, Mus musculus
gacaucccaaaccugccauggcugggugaagaccacuaggcugcug

SEQ ID NO: 103501 - RNA, 46 nt, Mus musculus
cauuuaguuagcaggaagacuuuauuuguaagcagcuuggggccag

SEQ ID NO: 103502 - RNA, 46 nt, Mus musculus
agcauccuccugucagacccagacaaauuauuaggcuaagcccagg

SEQ ID NO: 103503 - RNA, 46 nt, Mus musculus
uaggaggcauauacgcccaauucuacccugaagucuccacauacag

SEQ ID NO: 103504 - RNA, 46 nt, Mus musculus
gucuugaccauagcuugaaccucuaaacuacugagcuacacucaag

SEQ ID NO: 103505 - RNA, 46 nt, Mus musculus
aacaccagcaucacuuggcuccaaagcugcuucucguggggggggg

SEQ ID NO: 103506 - RNA, 44 nt, Mus musculus
uuggggaacucaaaagagcccacuguuccaucucucuaaccugg

SEQ ID NO: 103507 - RNA, 46 nt, Mus musculus
cauauaucacagcaaggaccaacauccuaauuagcuugggccacaa

SEQ ID NO: 103508 - RNA, 47 nt, Mus musculus
cuaaaacuacaaaaaguugugaaugaaggucaaagcaggagggaggg

SEQ ID NO: 103509 - RNA, 46 nt, Mus musculus
cugaucuguuuagccuuuuaaagaacaaggcaccagggcuggugag

SEQ ID NO: 103510 - RNA, 46 nt, Mus musculus
aaccaucuguaacaagaucugacucccucuucuggcgugucugcag

SEQ ID NO: 103511 - RNA, 46 nt, Mus musculus
cagccgguucucuucacggauggggagcugugcauuccagggucag

SEQ ID NO: 103512 - RNA, 67 nt, Mus musculus
uaaauauggaauuaaaggccaguuggaacuacaugacccuugaaggaaggaaggagggaaggaagga

SEQ ID NO: 103513 - RNA, 70 nt, Mus musculus
aaaccuucuuucaaccauguuugcaugccaaauguucaauaacuagacucaaguguguggguguagcgcu

SEQ ID NO: 103514 - RNA, 44 nt, Mus musculus
cccacagccaacuucuuaacuuaaaaugcacaggucaccuggag

SEQ ID NO: 103515 - RNA, 42 nt, Mus musculus
gcaugcgcacagccuuacaacacacaccuagaaccugccagg

SEQ ID NO: 103516 - RNA, 46 nt, Mus musculus
ggaauucuuucggcuguagcagacccucccaccuucuugaugucug

SEQ ID NO: 103517 - RNA, 46 nt, Mus musculus
cuuauuacauaccgccauucuacagacucagaaaccuaagcccccg

SEQ ID NO: 103518 - RNA, 46 nt, Mus musculus
agaccucugcgugaugaaguaaagggcgaccuguuugaaaacucag

SEQ ID NO: 103519 - RNA, 46 nt, Mus musculus
acuacagggauuuccccagcucacaggcccacaccuguucucgaag

SEQ ID NO: 103520 - RNA, 41 nt, Mus musculus
aggaaguccuacucugaccauuuuccaaacgucagguccca

SEQ ID NO: 103521 - RNA, 44 nt, Mus musculus
acaucguuaaacucuuaucauuaaguaacaacgcugcaaggaga

SEQ ID NO: 103522 - RNA, 46 nt, Mus musculus
cguucagaaauugguucaccauggagaacccucaauccaagucuag

SEQ ID NO: 103523 - RNA, 45 nt, Mus musculus
acuuaaaaaaaaaaaucacucuauccaagugacauucaucaccag

SEQ ID NO: 103524 - RNA, 59 nt, Mus musculus
cauggcacgcaccugagccaccagcuccaaaaggcagagaggcuauccagccagcagug

SEQ ID NO: 103525 - RNA, 46 nt, Mus musculus
uuuuaacuuucauaauaggaccaagaaaaacaaaguaucccauuag

SEQ ID NO: 103526 - RNA, 42 nt, Mus musculus
aaguaucuccccagacaagaaaccaaaaacgcaccuugucag

SEQ ID NO: 103527 - RNA, 46 nt, Mus musculus
uugaacucagcacgaggagagaaggccguaucuccuucaaaaagag

SEQ ID NO: 103528 - RNA, 42 nt, Mus musculus
uccgcgaaacaccccaggcgcaaggaggcgacugcggcggcc

SEQ ID NO: 103529 - RNA, 41 nt, Mus musculus
uuguccccgcggcgcgcagcgcgcucguccgagaucgccag

SEQ ID NO: 103530 - RNA, 41 nt, Mus musculus
gcucccagcucggucucuugcuccuccggccgcagcuggcu

SEQ ID NO: 103531 - RNA, 42 nt, Mus musculus
guaacuuggauccggggagggaagguccuggaagccgagcgc

SEQ ID NO: 103532 - RNA, 24 nt, Mus musculus
cauacuggcgcugcgggcagccga

SEQ ID NO: 103533 - RNA, 24 nt, Mus musculus
guuggauacucuggaauuggaguu

SEQ ID NO: 103534 - RNA, 48 nt, Mus musculus
uguguuaguguguguguuaguguguguguauguguguguuagugugug

SEQ ID NO: 103535 - RNA, 46 nt, Mus musculus
uauguguguguguuaguguguguguguuaguguguguguguaugug

SEQ ID NO: 103536 - RNA, 42 nt, Mus musculus
guugugauccaagguggcagugcaggcaacaaggagggagga

SEQ ID NO: 103537 - RNA, 46 nt, Mus musculus
aaaaguauauguaagaugguugagaauguucuaguauauguuagug

SEQ ID NO: 103538 - RNA, 45 nt, Mus musculus
augguugguggaaugcaaccaaccucaggcugaggagacagaagc

SEQ ID NO: 103539 - RNA, 46 nt, Mus musculus
uuuagaaagcaacacagugcagcuuguguguccuguacuuggucag

SEQ ID NO: 103540 - RNA, 42 nt, Mus musculus
uugaaagaguucuaucaaagacugaucgaucagaaguggcag

SEQ ID NO: 103541 - RNA, 46 nt, Mus musculus
agucagguuugucaguccuuggaucugauucugugaacucacucag

SEQ ID NO: 103542 - RNA, 41 nt, Mus musculus
uccacaguagaauauccagcaguuaacaugaaucaggguua

SEQ ID NO: 103543 - RNA, 46 nt, Mus musculus
gaagaagaaaaggauagggcuacaaaaaaagacccugucucaaaag

SEQ ID NO: 103544 - RNA, 46 nt, Mus musculus
ggcagugauauugugaaacucuacgaccucacgacucugugugaag

SEQ ID NO: 103545 - RNA, 46 nt, Mus musculus
ccacugugucgccaguaccuguuucugugcucuuaugucugccuca

SEQ ID NO: 103546 - RNA, 42 nt, Mus musculus
gaaucgccgcccuugugaagugugcggagucuuaagagcaag

SEQ ID NO: 103547 - RNA, 41 nt, Mus musculus
guuccagggaacuugacaccuucacaaaauaauuaccagug

SEQ ID NO: 103548 - RNA, 45 nt, Mus musculus
gaccuuagaagaugccaugacacugcugcuuucuucuccugccau

SEQ ID NO: 103549 - RNA, 45 nt, Mus musculus
uauguuaggauuuauacuucccaguuaugaguacuggaaguccaa

SEQ ID NO: 103550 - RNA, 46 nt, Mus musculus
uucuuaaugaccucauuuaauguuaaucaccucuucauaggccuga

SEQ ID NO: 103551 - RNA, 45 nt, Mus musculus
auauggaagcaggucgcagucuaacagaaaugacagguaagguca

SEQ ID NO: 103552 - RNA, 42 nt, Mus musculus
cugggcugcuucuuguacucauguaccucuagcuguuaggag

SEQ ID NO: 103553 - RNA, 46 nt, Mus musculus
uguguuauacauuguccaagauguucucucguguuuagggccucug

SEQ ID NO: 103554 - RNA, 44 nt, Mus musculus
cauaggcuuguaguuuagggaugaucauuugguuuuuuauuuua

SEQ ID NO: 103555 - RNA, 46 nt, Mus musculus
uccaaaaggauuuaccucauuaucacaaggauggauauuaggccag

SEQ ID NO: 103556 - RNA, 46 nt, Mus musculus
gaaaacacuggagcccagugguccaguuaccuucccaugucccaag

SEQ ID NO: 103557 - RNA, 46 nt, Mus musculus
gacugaggagaagguacaaaguguggccuagaacccagggacagua

SEQ ID NO: 103558 - RNA, 46 nt, Mus musculus
caacacucccaggagggacuccuaggcuaggguugagagcacagag

SEQ ID NO: 103559 - RNA, 46 nt, Mus musculus
guaggguguaguggcacacgccuuucaucccacccagcacucagga

SEQ ID NO: 103560 - RNA, 46 nt, Mus musculus
auaauaaauaaauaaaucuuaaaaaaaaaaaagacacaggcuugga

SEQ ID NO: 103561 - RNA, 41 nt, Mus musculus
auaaacaagugucaaguggguggagggaugaacggguagaa

SEQ ID NO: 103562 - RNA, 46 nt, Mus musculus
gucugugcucuuaaccgcugagccaucucuccagccucccagagug

SEQ ID NO: 103563 - RNA, 46 nt, Mus musculus
cccacaggggguggggucccaguuagcggggagacauuuugaggau

SEQ ID NO: 103564 - RNA, 44 nt, Mus musculus
ggaaaccagcuguugguugcuucuccauagcuguggcgcgagga

SEQ ID NO: 103565 - RNA, 79 nt, Mus musculus
uucuuccuccucccgcuggcccggggcucccagcggccgcugaauuccauuucccaccgcucgcuucuuagccuuagau

SEQ ID NO: 103566 - RNA, 26 nt, Mus musculus
gguugccuuuauaaucaacaucagag

SEQ ID NO: 103567 - RNA, 109 nt, Mus musculus
caggaucaaugauaaggugugucuggguacugaagggaaagcuaacaauuuacugauagucugauguagcgugagaaaggaggaguaauuaaaggcaaaggccaaauuu

SEQ ID NO: 103568 - RNA, 114 nt, Mus musculus
aggaggaggagcaggaggaggagcaggaggagaagcaggagcagcagcaggaagaggaggagcaggaggaggagcaggaggaggaggaagaggaggagcuuuauaguaagcagg

SEQ ID NO: 103569 - RNA, 41 nt, Mus musculus
ggaggaggagaaacaggaggaggagcaagaggaggaggagg

SEQ ID NO: 103570 - RNA, 55 nt, Mus musculus
aggaggaggagcaggaggaggaggaacaggaggaggaggaggagcaggaggagga

SEQ ID NO: 103571 - RNA, 44 nt, Mus musculus
gagcaggaggaggaggaggaggaggagcaggaggagcaggagga

SEQ ID NO: 103572 - RNA, 47 nt, Mus musculus
caggaggaggaggaggaggagcaggaggagcaggagcaggaggagga

SEQ ID NO: 103573 - RNA, 45 nt, Mus musculus
gcugugcaaagggugaauaccccagcuuugccagucugaccacag

SEQ ID NO: 103574 - RNA, 46 nt, Mus musculus
cgaguagcugaacuucaagauugccuucuguagcaaaggaagagac

SEQ ID NO: 103575 - RNA, 44 nt, Mus musculus
cccgaaggacgcugccugcuccacgcccgccauguugcccaaga

SEQ ID NO: 103576 - RNA, 42 nt, Mus musculus
uuguccuuugggaaauacaccauuaggauacaggucacauau

SEQ ID NO: 103577 - RNA, 42 nt, Mus musculus
ggauuccauaacuucuugaauggccucaccgacaucgcagaa

SEQ ID NO: 103578 - RNA, 45 nt, Mus musculus
uucacauucaucccuguucugcugcaacugccacggugccuuggg

SEQ ID NO: 103579 - RNA, 41 nt, Mus musculus
gagaagagagagagagggagacagagacagagagacagaga

SEQ ID NO: 103580 - RNA, 46 nt, Mus musculus
cagagagagaggagagagagagagggagagagagacagagacagag

SEQ ID NO: 103581 - RNA, 46 nt, Mus musculus
guuuguaaaugagaugcuguagugauuuauuuauuuauuccggaaa

SEQ ID NO: 103582 - RNA, 46 nt, Mus musculus
ugaaugggaagcuaggucccacaccagagaaggacuugaugagcag

SEQ ID NO: 103583 - RNA, 46 nt, Mus musculus
ucucuuuaucucucugucucucugucuguguaugucucucugugug

SEQ ID NO: 103584 - RNA, 42 nt, Mus musculus
uugaaacgcaaugguaaacaguuguuugcuuuccccagaaau

SEQ ID NO: 103585 - RNA, 46 nt, Mus musculus
guacgauuuauuucaaguccuuucugucuuguguguuuggcugccc

SEQ ID NO: 103586 - RNA, 38 nt, Mus musculus
gggacagcuuuuuaucucaacagcccugagacuggagu

SEQ ID NO: 103587 - RNA, 46 nt, Mus musculus
cuauguuuuuaccaguuuauaacauuuuuacuaggagacuggggag

SEQ ID NO: 103588 - RNA, 46 nt, Mus musculus
aucuguaaugggauccaacgcccucuucuggugugucugaagauua

SEQ ID NO: 103589 - RNA, 24 nt, Mus musculus
uccaggccgugugacugcugacug

SEQ ID NO: 103590 - RNA, 41 nt, Mus musculus
uucugcaagccaggacauugccggugcugauuuggagucug

SEQ ID NO: 103591 - RNA, 46 nt, Mus musculus
auucccagaauaugaccuaguuuggcauaggaucauuacugugagu

SEQ ID NO: 103592 - RNA, 42 nt, Mus musculus
ugaccagagagaaaguagaguuuucugucaaacuccagagag

SEQ ID NO: 103593 - RNA, 46 nt, Mus musculus
gucugaguuucuuuauuugguccuucacacguuccuucagccaaca

SEQ ID NO: 103594 - RNA, 47 nt, Mus musculus
caagguuugguaucucccccagagcauuggcugucuguggcagagac

SEQ ID NO: 103595 - RNA, 45 nt, Mus musculus
ggacagacaguucaauugccaaaguaauuguguacaagccugagg

SEQ ID NO: 103596 - RNA, 48 nt, Mus musculus
cucaggcuagugaggggcccuguuucaaaggaaagguagauaacagcc

SEQ ID NO: 103597 - RNA, 45 nt, Mus musculus
cccagaugcuugauccggucaaagaaagcuuauuucuuacuuuua

SEQ ID NO: 103598 - RNA, 46 nt, Mus musculus
cuuuauuauuauuauuuuuuuugguuccggccuucccucuauccag

SEQ ID NO: 103599 - RNA, 44 nt, Mus musculus
ggcugugagccaccaugugguugcugggauuugaacucgugacc

SEQ ID NO: 103600 - RNA, 42 nt, Mus musculus
ucacaccuucaaccccagcacucccaaaacaaaggcaggcag

SEQ ID NO: 103601 - RNA, 41 nt, Mus musculus
guuacugaugcgggggcaauggucauggcagugcaguggca

SEQ ID NO: 103602 - RNA, 45 nt, Mus musculus
cgaaaugaacaugcgaguaucacaaaaggucagguaaguagguca

SEQ ID NO: 103603 - RNA, 46 nt, Mus musculus
caguucagaagccucuguucuccucauguucugucuugaagaaggu

SEQ ID NO: 103604 - RNA, 42 nt, Mus musculus
cguagcuuuagauugcuuuggauaucacugacaugcugacag

SEQ ID NO: 103605 - RNA, 45 nt, Mus musculus
uuauuagcgugagcauauguguguugggcacauauucugcgguca

SEQ ID NO: 103606 - RNA, 24 nt, Mus musculus
cagugaguauagugcuugugguac

SEQ ID NO: 103607 - RNA, 46 nt, Mus musculus
uccuucuguuuaucaaccuugauuuucuuuuucuuuaugguccagg

SEQ ID NO: 103608 - RNA, 44 nt, Mus musculus
uaggacaucaguccuuugucacuuucagagaaaaaggggcauac

SEQ ID NO: 103609 - RNA, 42 nt, Mus musculus
cucacuggccaacaaggcuugucucaaaaagcaagguggaug

SEQ ID NO: 103610 - RNA, 46 nt, Mus musculus
ccaaggguauauuuccugcuucauauauucaucuuaaagaagccau

SEQ ID NO: 103611 - RNA, 45 nt, Mus musculus
gcagagguggcucauugguuaagagcaccuacuauuucugcagaa

SEQ ID NO: 103612 - RNA, 24 nt, Mus musculus
gcaggguggcagguugagcuaguu

SEQ ID NO: 103613 - RNA, 46 nt, Mus musculus
acuuuucuaaagagggguuucaaaugguuuucaaaauaggagcuag

SEQ ID NO: 103614 - RNA, 42 nt, Mus musculus
uugaauggcggucgcagauccuuucuggaacucugccccagg

SEQ ID NO: 103615 - RNA, 46 nt, Mus musculus
ugguauucuagaauucuugauuuggaccugguggugagggaugaag

SEQ ID NO: 103616 - RNA, 46 nt, Mus musculus
cagaacauggauaucaacagacaagccaaguuugcagccaccccau

SEQ ID NO: 103617 - RNA, 40 nt, Mus musculus
uaccaaaagauauugaucgguuacauaacuugcgagcugu

SEQ ID NO: 103618 - RNA, 49 nt, Mus musculus
ucuggggagcaaagacuugaaaagggagaaaauuaguuucgucugccag

SEQ ID NO: 103619 - RNA, 45 nt, Mus musculus
aggaagcugacuucggggcugcggcgaccuuucggcguggcuggu

SEQ ID NO: 103620 - RNA, 44 nt, Mus musculus
agcagcuggugaugcuguuuccauugucagagagcaagggggca

SEQ ID NO: 103621 - RNA, 48 nt, Mus musculus
ugauggaugugacagacauaauaaacgggaaagucgaugaugaagaua

SEQ ID NO: 103622 - RNA, 46 nt, Mus musculus
auuuguucucguagcaauucacauuuucaaaauacaauacuuucag

SEQ ID NO: 103623 - RNA, 36 nt, Mus musculus
cuugagagauagggggagcuugugaugauggguguc

SEQ ID NO: 103624 - RNA, 46 nt, Mus musculus
cguuuggaggacagugcagagcaacaucuaaggaugcccacagcag

SEQ ID NO: 103625 - RNA, 64 nt, Mus musculus
aucuuaggcucaagugcuggccuacaaccucuccugacucaguauuuuucuuuaacuucuaccu

SEQ ID NO: 103626 - RNA, 45 nt, Mus musculus
gguuuguggguaaccuugaaauuacuuccuggagacauccaucag

SEQ ID NO: 103627 - RNA, 44 nt, Mus musculus
agcuguggcccgcaagacaggguuuccugagauuauuaugccag

SEQ ID NO: 103628 - RNA, 67 nt, Mus musculus
ggauuuugauaaaggcaguaaaacaacugcgaagaacguggaggugacagugucugucuaugaugaa

SEQ ID NO: 103629 - RNA, 46 nt, Mus musculus
ugugugugugugugugugugcgcaugccuacacauguaggcgucag

SEQ ID NO: 103630 - RNA, 48 nt, Mus musculus
ccugaauugaauaaaguaaagccuggccccuggaauauagauccugac

SEQ ID NO: 103631 - RNA, 46 nt, Mus musculus
auguagauaccuuuauguaguggcuacaaugaagacaacgaaauag

SEQ ID NO: 103632 - RNA, 46 nt, Mus musculus
uuuucaaaagacauuuugccuuuggcagaaaucauauacggaugag

SEQ ID NO: 103633 - RNA, 45 nt, Mus musculus
augucauggcuccugggccauuucuuucaucugaacuugccccug

SEQ ID NO: 103634 - RNA, 46 nt, Mus musculus
cucuuuccagaucuccacucugguguguuccacgaaacugacccag

SEQ ID NO: 103635 - RNA, 49 nt, Mus musculus
cccacuguguccuuugauaaggaccuccauagaugucgaugagcuuggg

SEQ ID NO: 103636 - RNA, 42 nt, Mus musculus
cucacacuucuauuuugggcugaggacuaacuuagcagggag

SEQ ID NO: 103637 - RNA, 45 nt, Mus musculus
aaaaagcaaaacaaaacaaaaaucccucaaacaaccacaaccaaa

SEQ ID NO: 103638 - RNA, 45 nt, Mus musculus
gcuuaacaaugacuuaggugugugcgcagugcugcugaacucucu

SEQ ID NO: 103639 - RNA, 45 nt, Mus musculus
gacaccuuggaugcccucuucaacaucaugauggagaacucagag

SEQ ID NO: 103640 - RNA, 46 nt, Mus musculus
aaauacaguuauuauuuauguuuuaaaaauuaaauguuugggggug

SEQ ID NO: 103641 - RNA, 44 nt, Mus musculus
caguauaucuucauagagcaaaaagccccacaagagcaaacaga

SEQ ID NO: 103642 - RNA, 46 nt, Mus musculus
uguugcugugguaaaaggccucaacaaaaggcaauuuuggggagaa

SEQ ID NO: 103643 - RNA, 46 nt, Mus musculus
agacaggaugucucgggauggaaauauuuuggagaguucuggaaag

SEQ ID NO: 103644 - RNA, 42 nt, Mus musculus
gaagaggccgcugaaacagacauggagacauaauggagggag

SEQ ID NO: 103645 - RNA, 46 nt, Mus musculus
caagaggagcgggaugcuuaaaccuucccaggaagaaugacaucaa

SEQ ID NO: 103646 - RNA, 41 nt, Mus musculus
gagcucugugaacaguaaugcguuuuaagguuuguguccag

SEQ ID NO: 103647 - RNA, 45 nt, Mus musculus
gccagagaccccuggccugaaagagacuuagaauccugccaccuc

SEQ ID NO: 103648 - RNA, 42 nt, Mus musculus
gacuggggaugggaugguuagagaagguacuaagaaagggag

SEQ ID NO: 103649 - RNA, 44 nt, Mus musculus
uaaccacaagcugaccaagccauucuuacaggcaaaauguauca

SEQ ID NO: 103650 - RNA, 45 nt, Mus musculus
uacuguugcucuaauuaaacaacacgauccaaaccaacuucagac

SEQ ID NO: 103651 - RNA, 46 nt, Mus musculus
aaaggaucauggaaacauguuagccuacaaaggggagggugguuug

SEQ ID NO: 103652 - RNA, 46 nt, Mus musculus
uguguguguguguguguguguguguguauguaugugugugugcuug

SEQ ID NO: 103653 - RNA, 46 nt, Mus musculus
gcugcugucuccaucuguccucuucugaauuucaaguauguuguag

SEQ ID NO: 103654 - RNA, 46 nt, Mus musculus
uccgcugagaacaggguuugagugcauccaagcgccagaggagaga

SEQ ID NO: 103655 - RNA, 42 nt, Mus musculus
ccagaggcuguccaccaucucccuccaauuccccacccccag

SEQ ID NO: 103656 - RNA, 27 nt, Mus musculus
gcagugggugcucuggacaaaccccag

SEQ ID NO: 103657 - RNA, 46 nt, Mus musculus
cuuagcaggcauggacuucuaugcgccucccugggacauccuuggg

SEQ ID NO: 103658 - RNA, 42 nt, Mus musculus
cuuccucccuuccuuucuuuucuuucccccagcugccccuga

SEQ ID NO: 103659 - RNA, 23 nt, Mus musculus
uuccuuggagaaggacuucuacc

SEQ ID NO: 103660 - RNA, 46 nt, Mus musculus
gcguguguguguguguaugcguguguguguguauaugugugugugu

SEQ ID NO: 103661 - RNA, 60 nt, Mus musculus
gcgugugugugucugcgugugugugugucugcgugugcgugugugugugugugcgugugu

SEQ ID NO: 103662 - RNA, 46 nt, Mus musculus
cguguguguguguaugcgugugcgugugugugugugugugugugug

SEQ ID NO: 103663 - RNA, 46 nt, Mus musculus
guaacagagaaaaauaaaaucgugaauguugcauggaaauggauag

SEQ ID NO: 103664 - RNA, 41 nt, Mus musculus
ggaagcaaacauuugcugcgcagcuuguugccagagcccug

SEQ ID NO: 103665 - RNA, 42 nt, Mus musculus
uuugauaccgcaugugagcccagcagcucaguacacccgcuu

SEQ ID NO: 103666 - RNA, 46 nt, Mus musculus
cccugaggagucauuuuuccuucacuuuauauccaccuuaagccau

SEQ ID NO: 103667 - RNA, 42 nt, Mus musculus
gagaagggcaacuguauagguaauaggccauugagaguggag

SEQ ID NO: 103668 - RNA, 46 nt, Mus musculus
uuguugacuacaacugaagcuagaacaaauacauuucugccccgau

SEQ ID NO: 103669 - RNA, 46 nt, Mus musculus
gccacuggucacauugcagcugcaggcaggaagcagagacagauag

SEQ ID NO: 103670 - RNA, 47 nt, Mus musculus
caggugauucuagaccuugccacguugacaacacuaagccccauacc

SEQ ID NO: 103671 - RNA, 52 nt, Mus musculus
ccuucuaggucucauuaucuucuccccauaccaccccuguaccccuagacuu

SEQ ID NO: 103672 - RNA, 45 nt, Mus musculus
acguguauacaugcauuguguauaugaguacuaaagccugugugu

SEQ ID NO: 103673 - RNA, 42 nt, Mus musculus
uguuuuuucuuguaucugugcuuguuugguuuuagaggggag

SEQ ID NO: 103674 - RNA, 46 nt, Mus musculus
ugagauuaggaaauagugaagucagagugcccuucacaguagccag

SEQ ID NO: 103675 - RNA, 24 nt, Mus musculus
cucugaaaccauccagucaagcca

SEQ ID NO: 103676 - RNA, 46 nt, Mus musculus
gacuuccauucugauaaugaguccuuuacaaauguaauugggugag

SEQ ID NO: 103677 - RNA, 45 nt, Mus musculus
guaguggugguggugguggaaggugagcuuugaaaguagaaguga

SEQ ID NO: 103678 - RNA, 45 nt, Mus musculus
gugacaacccagccugucugggcugugguaccugagaaagcagua

SEQ ID NO: 103679 - RNA, 46 nt, Mus musculus
uguguauguguguguguguauguguguguguguguuugugugugug

SEQ ID NO: 103680 - RNA, 42 nt, Mus musculus
gucuggacauguccuguaugggaaaacaccagcaugguccag

SEQ ID NO: 103681 - RNA, 41 nt, Mus musculus
uugagggguaggggugugugugugugugugugugugugugu

SEQ ID NO: 103682 - RNA, 46 nt, Mus musculus
ggcucuucauuuucuuaaccaggucaggguugccuagaauacauag

SEQ ID NO: 103683 - RNA, 48 nt, Mus musculus
uuaaggcacugaccuacaaacaaaccagggaggcugagaaggcgcuga

SEQ ID NO: 103684 - RNA, 59 nt, Mus musculus
agacucuggcuccuacagucagaagugagugccacaacgaaguggaaggauaaauucug

SEQ ID NO: 103685 - RNA, 64 nt, Mus musculus
aauaguuuuagucacacaaguugaacccucuggaguccaguggcaaacauauuuguccuaugua

SEQ ID NO: 103686 - RNA, 44 nt, Mus musculus
gcccaucucucuaccuuuuugcccauccucauuccugagugagc

SEQ ID NO: 103687 - RNA, 41 nt, Mus musculus
cacuauuuguuuggguagaaggaauaaagacugaggaggaa

SEQ ID NO: 103688 - RNA, 45 nt, Mus musculus
caaggccuggcaugcccugagugccccucacuuccuaagccuaag

SEQ ID NO: 103689 - RNA, 28 nt, Mus musculus
uuaguaggcuugagaaccauuacuuuag

SEQ ID NO: 103690 - RNA, 45 nt, Mus musculus
uuaaguacaguccacgauauguagaggcugcgggucaggcucaaa

SEQ ID NO: 103691 - RNA, 46 nt, Mus musculus
ugaaugagcauagaggagaaugcaccuccugauguucuaacuuggg

SEQ ID NO: 103692 - RNA, 46 nt, Mus musculus
gggucaacauuuuauuccauaugcuaugggaacgccugugcauuag

SEQ ID NO: 103693 - RNA, 25 nt, Mus musculus
gcuaguuuaguguaacacauggaga

SEQ ID NO: 103694 - RNA, 46 nt, Mus musculus
uuucuacuucccaucucuguccuuggaggcucuaagcaaaguccag

SEQ ID NO: 103695 - RNA, 46 nt, Mus musculus
guuaacgcaugguaccgaaaggacauggugcugccuuuuggauaag

SEQ ID NO: 103696 - RNA, 45 nt, Mus musculus
cuucagccugugagugguccuuuugaauggugguuucauggucua

SEQ ID NO: 103697 - RNA, 46 nt, Mus musculus
cucacaaccaucuauaaugagaucugauguccucuucugguguguc

SEQ ID NO: 103698 - RNA, 46 nt, Mus musculus
auuauacugccagguaucaguaaggcugaaugaauccaggccccuc

SEQ ID NO: 103699 - RNA, 45 nt, Mus musculus
gcuauguagcuugcaugggauugacccauacauggagaucagauc

SEQ ID NO: 103700 - RNA, 46 nt, Mus musculus
uauaacuaaaauuuuuuauaaaauauagggauuuuuguucaaggag

SEQ ID NO: 103701 - RNA, 41 nt, Mus musculus
gagaugcagccucaauauaaguaaauaaauacauggggggg

SEQ ID NO: 103702 - RNA, 89 nt, Mus musculus
uguggugugugugugcguguaugugugugugugugugugugugcguguacauguguguguguguggugugguguguguguguguggugu

SEQ ID NO: 103703 - RNA, 41 nt, Mus musculus
aggggaacuuuguggcuugcaugacagccauuuuacggcag

SEQ ID NO: 103704 - RNA, 42 nt, Mus musculus
aauaacuccuuaguccuccucacacaaacaaugaugcaacuu

SEQ ID NO: 103705 - RNA, 46 nt, Mus musculus
gaauuaccuucuuggaugcuuagauucuauuuucccccuugcccuu

SEQ ID NO: 103706 - RNA, 32 nt, Mus musculus
agaccuugauagggcucagguuaacagcccag

SEQ ID NO: 103707 - RNA, 46 nt, Mus musculus
gcaggauuuucugauggagacauucaucauguuuaagaaccucauc

SEQ ID NO: 103708 - RNA, 46 nt, Mus musculus
gccucgaacucaaaaaucccccugccucugccucccaagugcuggg

SEQ ID NO: 103709 - RNA, 42 nt, Mus musculus
agcaugugugugugagugugugugugagugugugugggugug

SEQ ID NO: 103710 - RNA, 42 nt, Mus musculus
gugcgugggugugagugugugugugugugugugugugugugu

SEQ ID NO: 103711 - RNA, 45 nt, Mus musculus
ccgggaggaaaaaacaauguugcuagagacagggaguagagguag

SEQ ID NO: 103712 - RNA, 46 nt, Mus musculus
aggaaauccuuauauggcuucuauuucccaagacuaaaguuugguc

SEQ ID NO: 103713 - RNA, 46 nt, Mus musculus
cuguaaauaacuaauuuaugauaacagacuuaauugcauccauuag

SEQ ID NO: 103714 - RNA, 46 nt, Mus musculus
ugggaaagagucucucugaggguuuaccugcacggauuggccuuug

SEQ ID NO: 103715 - RNA, 55 nt, Mus musculus
aggacaguucccaugucugaaaggaauagaacauacaagcaaccagggauaauca

SEQ ID NO: 103716 - RNA, 60 nt, Mus musculus
guuguuaccccagaacagaagagcaugaagggcuuagcaggaugagauccgggagaggac

SEQ ID NO: 103717 - RNA, 46 nt, Mus musculus
auuuguuccagaaggcugugggagaaucuuucuguugugucuccag

SEQ ID NO: 103718 - RNA, 43 nt, Mus musculus
cuggucggaugacugaauguuagugaugcuggggacucgguag

SEQ ID NO: 103719 - RNA, 41 nt, Mus musculus
ugcuaugauauagcauguccucuucagucugcucucagagg

SEQ ID NO: 103720 - RNA, 46 nt, Mus musculus
augugugguaggagaaguuaagguuaagcugagguuaaaaggagag

SEQ ID NO: 103721 - RNA, 46 nt, Mus musculus
acuguguuacaagaagaugcauauucugugaugccuuucccaccag

SEQ ID NO: 103722 - RNA, 46 nt, Mus musculus
acuaggaggcugauuuaucuuuuguuaugucuuauuagauggcauu

SEQ ID NO: 103723 - RNA, 46 nt, Mus musculus
gcuccaccucugcaccacuaacucaagcuucucccccagcccccag

SEQ ID NO: 103724 - RNA, 42 nt, Mus musculus
aguagaaacacaugguucuuugggagcaugggagaaggagau

SEQ ID NO: 103725 - RNA, 45 nt, Mus musculus
aucaaguuugaucguaagccaacccaucagaugacaccauaugag

SEQ ID NO: 103726 - RNA, 50 nt, Mus musculus
aguguauguaugcucugucagggaaagaaaagaacugucaacuuugagag

SEQ ID NO: 103727 - RNA, 35 nt, Mus musculus
cacuugaguuggguagagaaacagaggaagauagu

SEQ ID NO: 103728 - RNA, 42 nt, Mus musculus
augaggucagagcuggguaagggaaguggggguaauccagag

SEQ ID NO: 103729 - RNA, 46 nt, Mus musculus
ugucugucucucucucucucucucucucucucucucucucuuguuc

SEQ ID NO: 103730 - RNA, 46 nt, Mus musculus
ucugaugcacaaacaugaggacuccaguuugaauccccagcaccua

SEQ ID NO: 103731 - RNA, 48 nt, Mus musculus
ugaugcaguaagcucugcguucagugagagaaccccauucuccaaaac

SEQ ID NO: 103732 - RNA, 70 nt, Mus musculus
ugguggaggcuuugcuacacaccaagggcuccggcugcuguggggugauggaggggguuuuacaacagac

SEQ ID NO: 103733 - RNA, 46 nt, Mus musculus
cuccuuagaagcuaugacuucugauccucuuuccccggugccccag

SEQ ID NO: 103734 - RNA, 44 nt, Mus musculus
agagcucuguucaaugcaggcuuacccuuuuucuuaagcauuga

SEQ ID NO: 103735 - RNA, 41 nt, Mus musculus
ugaacaagagauuucuggaucaagccaacuuugagcugcag

SEQ ID NO: 103736 - RNA, 45 nt, Mus musculus
uggauuggauucgugauuauuacauuauggcuuuuagagguacua

SEQ ID NO: 103737 - RNA, 55 nt, Mus musculus
ccguggcuuuccucacucaagagucccugcaacuggagaauuuuucaagugcuaa

SEQ ID NO: 103738 - RNA, 46 nt, Mus musculus
ugcuguuuuugauaccacuggcuucauugguggauugaggguauga

SEQ ID NO: 103739 - RNA, 44 nt, Mus musculus
ggcagauuggcuuugagaucagagacaugugguacaaccugggu

SEQ ID NO: 103740 - RNA, 45 nt, Mus musculus
ccccauuuuuuaauguuggucucuggugugugugugugugugugu

SEQ ID NO: 103741 - RNA, 46 nt, Mus musculus
ugaaccugguccuaucucuuuccaugucauuugccaugacccccag

SEQ ID NO: 103742 - RNA, 23 nt, Mus musculus
uucucuaaacaagaugagcccag

SEQ ID NO: 103743 - RNA, 45 nt, Mus musculus
ggaggcaaggcagcaggcugcuggagcuggaagcagagaaaggag

SEQ ID NO: 103744 - RNA, 41 nt, Mus musculus
ggaacagagcugagagagagagagagagagagagagagaga

SEQ ID NO: 103745 - RNA, 70 nt, Mus musculus
aaaggucaacacaagauaaaauucaucccagaaaugguuggcccaauauuggaaaugacauugauuccug

SEQ ID NO: 103746 - RNA, 43 nt, Mus musculus
ucuucuucgacaugaugcagugugaauuccacuccacccggag

SEQ ID NO: 103747 - RNA, 62 nt, Mus musculus
ugcuguuuaacuaauccaccacaaaugcaauuaucuaaccugauuagucacaucagugaggg

SEQ ID NO: 103748 - RNA, 46 nt, Mus musculus
cuuaaauugccuccacuuuuauagcagaugcacaaaccuaauggag

SEQ ID NO: 103749 - RNA, 46 nt, Mus musculus
uuguuuuuuccagaguugcccuugcauccccuaccccagccacgau

SEQ ID NO: 103750 - RNA, 42 nt, Mus musculus
guuagggaagauaaauguaaucuacauaaaaauauuagugug

SEQ ID NO: 103751 - RNA, 49 nt, Mus musculus
ugagaucaucacuaagcuggaucaugaaguggaaggaggcagaggagac

SEQ ID NO: 103752 - RNA, 46 nt, Mus musculus
aggcuccuggacuacaggaccaucaugcaugacgaaaacaaagaca

SEQ ID NO: 103753 - RNA, 42 nt, Mus musculus
aguuacacagagagagagagagagggagagagagagagggag

SEQ ID NO: 103754 - RNA, 46 nt, Mus musculus
aaaauaaguuaguuuaaaagaaaaagaaugacuaugucgguccuug

SEQ ID NO: 103755 - RNA, 41 nt, Mus musculus
augccgaucuaacaaggugucagguuugcaaaccuucagug

SEQ ID NO: 103756 - RNA, 41 nt, Mus musculus
cguucccagcugccauuccaguuguauugauaaaacaacaa

SEQ ID NO: 103757 - RNA, 45 nt, Mus musculus
cugucuuugccucuccaggacuggaguuauagauacacagcacaa

SEQ ID NO: 103758 - RNA, 42 nt, Mus musculus
aggagguaauugagugugacuauucccaauaacugccaggga

SEQ ID NO: 103759 - RNA, 45 nt, Mus musculus
cucugccacugugugugugugugugugugugagagagagagagag

SEQ ID NO: 103760 - RNA, 46 nt, Mus musculus
agggucaagggggaggaggguaucucuucuucauccaugccaugag

SEQ ID NO: 103761 - RNA, 46 nt, Mus musculus
auguuccaguuuuaauacauuaaagaaaguucugggucacugaagu

SEQ ID NO: 103762 - RNA, 46 nt, Mus musculus
ggugcgguggagggucacuggcaucccuuaauaguagcgcagugag

SEQ ID NO: 103763 - RNA, 46 nt, Mus musculus
ggguugugcuuguuucucuucccaaggcuccuauacacagugccgu

SEQ ID NO: 103764 - RNA, 57 nt, Mus musculus
gaagaagaagaagaagaagaagaagaagaagaagaagaaggugaugaagaugaugau

SEQ ID NO: 103765 - RNA, 45 nt, Mus musculus
ucaugggaaaguugaaagaaagucuguuuucuagcaacuucauua

SEQ ID NO: 103766 - RNA, 42 nt, Mus musculus
ggaaagaaugaggucaccaugaacaggaaggugugacaccag

SEQ ID NO: 103767 - RNA, 45 nt, Mus musculus
gugggaaauauuucucaugcagacugccaagccuucaugaucaca

SEQ ID NO: 103768 - RNA, 46 nt, Mus musculus
accuguaucucccccuaguccugacuucaucuuucuucuguaacaa

SEQ ID NO: 103769 - RNA, 46 nt, Mus musculus
gcagucugaggcugugauccuuucugaaacgguaauuuaacuguag

SEQ ID NO: 103770 - RNA, 42 nt, Mus musculus
guuuaauuugcagccagggcucaaguuuggaugacaggccgg

SEQ ID NO: 103771 - RNA, 44 nt, Mus musculus
aggaaagggcuuuacucccugcuagcacuuuuccuugcccagug

SEQ ID NO: 103772 - RNA, 42 nt, Mus musculus
aggagaaggagaaggagaaggagaaggagaagggggagguuu

SEQ ID NO: 103773 - RNA, 42 nt, Mus musculus
ggagggagaggaggaugagaagggagaggaugagaaggagga

SEQ ID NO: 103774 - RNA, 42 nt, Mus musculus; identical to SEQ ID NO: 103773

SEQ ID NO: 103775 - RNA, 44 nt, Mus musculus
aggagggagagaggaggaggagggagaggaggaggagggagagg

SEQ ID NO: 103776 - RNA, 44 nt, Mus musculus
ucuaugaagugagacccugccaaaaaaaaagaaaagauagcaga

SEQ ID NO: 103777 - RNA, 46 nt, Mus musculus
agguaaacaccaaggauaaguugccguuaaagaauugguugcaggg

SEQ ID NO: 103778 - RNA, 49 nt, Mus musculus
ucuuugcacuuucuucaacacucacaggguuacuggcaccagcuggugu

SEQ ID NO: 103779 - RNA, 45 nt, Mus musculus
uuggaguuuccaugaaggcugugcugucauuuucuuccugcacug

SEQ ID NO: 103780 - RNA, 84 nt, Mus musculus
aagacaucuuugcacuuuccucaacagucacugagucacuagcaccagcugguguuuggaagaguucuuggaagccauccaggu

SEQ ID NO: 103781 - RNA, 78 nt, Mus musculus
uuacacuuuccucaacagucacugagucauuggcaccagcugguguuuggaagaguucuuggaagccauccaggucuu

SEQ ID NO: 103782 - RNA, 45 nt, Mus musculus; identical to SEQ ID NO: 103779

SEQ ID NO: 103783 - RNA, 47 nt, Mus musculus
uaucuuugcacuuucuucaacacucacagggucacuggcaccagcug

SEQ ID NO: 103784 - RNA, 46 nt, Mus musculus
gcgcagaacuuguggaagaggccaaauggguguggcugcccugcug

SEQ ID NO: 103785 - RNA, 45 nt, Mus musculus
ggacgaagaugcagacaugaugaaguacauugagacggggcugaa

SEQ ID NO: 103786 - RNA, 46 nt, Mus musculus
uccaaccagaugcugaguggcaucccugagguggaccugggcauag

SEQ ID NO: 103787 - RNA, 45 nt, Mus musculus
gggccccaucugagccugucucuacucccucacugggccugccag

SEQ ID NO: 103788 - RNA, 42 nt, Mus musculus
agaucaguaggaagguggagcucagcaggcgggugggcccug

SEQ ID NO: 103789 - RNA, 46 nt, Mus musculus
ggauauuguggaccuccuaggaggcaagcaagcuauaaugugggug

SEQ ID NO: 103790 - RNA, 46 nt, Mus musculus
uugcugugcauaccugaagccccagugcuuaggagauggaggcgag

SEQ ID NO: 103791 - RNA, 46 nt, Mus musculus
uacagugugaucagccaccuccuaccaccaugccuuccccaccaga

SEQ ID NO: 103792 - RNA, 46 nt, Mus musculus
ucucuggaggcaggaacuguagcuguagagccuugggagaucaggg

SEQ ID NO: 103793 - RNA, 46 nt, Mus musculus
ggagcuggagcccacaggcuguacuccuuuaugugguagaugccag

SEQ ID NO: 103794 - RNA, 81 nt, Mus musculus
cucuguucuggguacgcugcuguucuuguuaguaaggcgucuagcacucaaggggaaguuucuagaauaaugggcaaagaa

SEQ ID NO: 103795 - RNA, 65 nt, Mus musculus
gaggcugcuuucagaaugcugcuucugacagauaaccagaaaguuuuuuaaagaaagaugagcag

SEQ ID NO: 103796 - RNA, 46 nt, Mus musculus
accgaggccuguguggaccugaggugggucuggguuucgaguggga

SEQ ID NO: 103797 - RNA, 41 nt, Mus musculus
gccaggugagcuaggaaucuuggcagcuguugcugaggagg

SEQ ID NO: 103798 - RNA, 45 nt, Mus musculus
caaagaaagagagaggaugucccgaggucagagaaagagacaguu

SEQ ID NO: 103799 - RNA, 46 nt, Mus musculus
uaguuauguccccagcccguauucauacauaccccucugcccauau

SEQ ID NO: 103800 - RNA, 46 nt, Mus musculus
auaaguacauuuuaaaauuuaugaaaguuuaaugaauggccagcaa

SEQ ID NO: 103801 - RNA, 42 nt, Mus musculus
gccuggcauguacagguuccccuuuucccucaacccagacca

SEQ ID NO: 103802 - RNA, 46 nt, Mus musculus
cagaccacucugaaguugguuacugagccugaggccaggaucagag

SEQ ID NO: 103803 - RNA, 43 nt, Mus musculus
agccguguccucuuucagaaacggcagagcagcagcagcagca

SEQ ID NO: 103804 - RNA, 45 nt, Mus musculus
uuggguuuagauaacacauuucccuuacuuagaaucacuugagca

SEQ ID NO: 103805 - RNA, 42 nt, Mus musculus
uuugaccugaaaguaagccaaauaaacuuuucaugccccaag

SEQ ID NO: 103806 - RNA, 45 nt, Mus musculus
cagugccuaucagguggccuucaggcaaaacacugcuggugggag

SEQ ID NO: 103807 - RNA, 45 nt, Mus musculus
gccagacaugaaaggcauguguuugcuaugauuccuauuacacga

SEQ ID NO: 103808 - RNA, 45 nt, Mus musculus
aucaagccaggguagagcuuacagauaauuuuauaauaaucccua

SEQ ID NO: 103809 - RNA, 47 nt, Mus musculus
accugucaccuuaccguuggugcuuaccugugcccauuuggcugcuu

SEQ ID NO: 103810 - RNA, 45 nt, Mus musculus
uuguuucuguccauguccagcugucuacuguuacucuagauaaau

SEQ ID NO: 103811 - RNA, 46 nt, Mus musculus
uuccagccuucaaacaggauggauuaugucuuugucaccuguagag

SEQ ID NO: 103812 - RNA, 44 nt, Mus musculus
cugggcccugugaccugagugguaguugguuuugguggguugga

SEQ ID NO: 103813 - RNA, 44 nt, Mus musculus
uuucguuguaaagcacugcagcccugcuggcuugggaggaccau

SEQ ID NO: 103814 - RNA, 53 nt, Mus musculus
gacaggaagggaaugaguguucucucuuuccuggagucagagaaggaagaggg

SEQ ID NO: 103815 - RNA, 42 nt, Mus musculus
uucauuuucugugaugcauuucuuauacguccccacgccuug

SEQ ID NO: 103816 - RNA, 45 nt, Mus musculus
aucucuggcauugucuagauugugagguauugucuagacuggcuu

SEQ ID NO: 103817 - RNA, 46 nt, Mus musculus
acccaagggugugucuccuaggugauucuaaaccuaguccaguuag

SEQ ID NO: 103818 - RNA, 51 nt, Mus musculus
ccucuaaaccgagcaucuuaaguggcuacuguaacacccagaggccauuuu

SEQ ID NO: 103819 - RNA, 42 nt, Mus musculus
gguugcagcccugcauccuuuagucacucccaaggagaggaa

SEQ ID NO: 103820 - RNA, 45 nt, Mus musculus
aggagagaaacuuuuaagacagccuauuacaauaggaagcuagag

SEQ ID NO: 103821 - RNA, 41 nt, Mus musculus
agccauuggaggacccaguguugugcuccagagagccaaaa

SEQ ID NO: 103822 - RNA, 42 nt, Mus musculus
cuccuucuggcaagcauccaggcauauuccagcaagcgggag

SEQ ID NO: 103823 - RNA, 45 nt, Mus musculus
ugagaaucuuugcaucuaccaggacuaaauauuauuauuagcaug

SEQ ID NO: 103824 - RNA, 46 nt, Mus musculus
gggaaggacugcccaggaagggaagcucauuggcugaacacucggc

SEQ ID NO: 103825 - RNA, 41 nt, Mus musculus
uugcccacucugugucuaucuggagcaucuugaggaaggug

SEQ ID NO: 103826 - RNA, 46 nt, Mus musculus
uuuugacugaaaaaaaauugacuauucaucgauucuugaccugcaa

SEQ ID NO: 103827 - RNA, 45 nt, Mus musculus
ccaugacuauuaauuuuacaauccuguaagagccugagggccagg

SEQ ID NO: 103828 - RNA, 46 nt, Mus musculus
uccuugugaagugcuuagucucaguauagcccagaguagcaacuag

SEQ ID NO: 103829 - RNA, 46 nt, Mus musculus
gugcauaagguguguccuggcccugugugugugugugugugugugu

SEQ ID NO: 103830 - RNA, 46 nt, Mus musculus
aacaacaacacccaauccuguuauaucacguuuugguacucucaag

SEQ ID NO: 103831 - RNA, 51 nt, Mus musculus
agcugugugugugcuggcaccugcaccuggcacaggggcuguguggcccag

SEQ ID NO: 103832 - RNA, 47 nt, Mus musculus
aaugaaccaacaucucaaacuguacucuuugcaaucuucagaggagc

SEQ ID NO: 103833 - RNA, 46 nt, Mus musculus
ggagcagagacuauaguguagaguagugggccuuagucucuagggg

SEQ ID NO: 103834 - RNA, 42 nt, Mus musculus
uaggcggcucaugucccuuacuuucccagaucacuaagguag

SEQ ID NO: 103835 - RNA, 45 nt, Mus musculus
cgugacaguggcuacuguucuuauccugccucuucuuccuugcca

SEQ ID NO: 103836 - RNA, 47 nt, Mus musculus
cucuaagaugcucaucaucuuaaaggggcugcucagggccuuuggag

SEQ ID NO: 103837 - RNA, 45 nt, Mus musculus
uaauuuauuagagucuaggaaccugaaccaaacuuaaauuguggg

SEQ ID NO: 103838 - RNA, 42 nt, Mus musculus
ucucagggcagguguggcugagagaugcugagcagcugacag

SEQ ID NO: 103839 - RNA, 46 nt, Mus musculus
gauuaacuggaugauggcaugugugugauaauggugugugugugug

SEQ ID NO: 103840 - RNA, 42 nt, Mus musculus
gacugucagugucccaggacagacacacuguuguaaggugag

SEQ ID NO: 103841 - RNA, 42 nt, Mus musculus
cuccaucuaauuggggaguuuuacuggguuuaguagccugag

SEQ ID NO: 103842 - RNA, 46 nt, Mus musculus
guuuucuguuuuauucauucacauuucuuacuguuuuccccccucu

SEQ ID NO: 103843 - RNA, 45 nt, Mus musculus
uaucucauacaugugcacagugacacucauuagaaaacaccccau

SEQ ID NO: 103844 - RNA, 25 nt, Mus musculus
uggagggagaagucuuacacaugag

SEQ ID NO: 103845 - RNA, 29 nt, Mus musculus
ugccugucguugguaacuuacacaugaaa

SEQ ID NO: 103846 - RNA, 45 nt, Mus musculus
ccuugaccuuucaagauucuaugccccaguacaggggaaugccag

SEQ ID NO: 103847 - RNA, 72 nt, Mus musculus
aauaucaaagagaagagaagagaagagaagagaagagaagagaagagaagagaagagaagagaagccaccag

SEQ ID NO: 103848 - RNA, 45 nt, Mus musculus
aauaagcuguccaaaauaacuccaacagaacguccgaugcgugug

SEQ ID NO: 103849 - RNA, 57 nt, Mus musculus
accaaauaaaggacuuucgugucccaaaugggcaccuucuaaagcuuugaaaagaau

SEQ ID NO: 103850 - RNA, 42 nt, Mus musculus
cugcuggaaccugagaaugacaauucugucagcagcccacag

SEQ ID NO: 103851 - RNA, 46 nt, Mus musculus
cguuauuaggcugaaguuguguugggaugcaguauuuaccugugag

SEQ ID NO: 103852 - RNA, 23 nt, Mus musculus
cugggcugggcggggaggugggg

SEQ ID NO: 103853 - RNA, 46 nt, Mus musculus
uuuggaacgauauagaagugggcaucuguuuaguuaaacgccccug

SEQ ID NO: 103854 - RNA, 42 nt, Mus musculus
uuaggcuagcaucacucugcaaaagauuuucauaugcaccag

SEQ ID NO: 103855 - RNA, 49 nt, Mus musculus
uaauguaaacauuucaaaauugguuuauccuaucccauaauaguucuuc

SEQ ID NO: 103856 - RNA, 45 nt, Mus musculus
guaaauuccagcccaggcaacuuagagagaaagagagagacagag

SEQ ID NO: 103857 - RNA, 46 nt, Mus musculus
cagacucauuuacuugcgugcacaaagccccagguucaauccccag

SEQ ID NO: 103858 - RNA, 46 nt, Mus musculus
cccagaaugaaagauuuguuugucuuuccagucccggugcccugag

SEQ ID NO: 103859 - RNA, 42 nt, Mus musculus
uuggaaucaaucuuuccauagagaacaucucagggcccccag

SEQ ID NO: 103860 - RNA, 49 nt, Mus musculus
cauccagagaguuggugcugugugcuuggcaaaggucagggugcaaauc

SEQ ID NO: 103861 - RNA, 46 nt, Mus musculus
ggcaucagcuuggggcuacugggugcuuggcaguggucacagcgua

SEQ ID NO: 103862 - RNA, 56 nt, Mus musculus
accaagggcauuggugucagauagugcagaucucugaguacaugaugcguugcaag

SEQ ID NO: 103863 - RNA, 48 nt, Mus musculus
auugguucuaaggcucuugugguuuccaagcccacugagaaugagauu

SEQ ID NO: 103864 - RNA, 42 nt, Mus musculus
ggagggagggagagagggagagagggagggacagagggacag

SEQ ID NO: 103865 - RNA, 42 nt, Mus musculus
aaggcugcugugugccguaggcaguggcaugguuauccccag

SEQ ID NO: 103866 - RNA, 46 nt, Mus musculus
aaaagcccucugaugccagaccagaaagugagggguaaaacgggag

SEQ ID NO: 103867 - RNA, 46 nt, Mus musculus
gugugcaaucagagcaagaggugugggcauucauuucugucgugag

SEQ ID NO: 103868 - RNA, 47 nt, Mus musculus
guuucuuauguuccugugagcaaguggggacguuauuuaaggguaga

SEQ ID NO: 103869 - RNA, 23 nt, Mus musculus
gcauaaaaagcuaaaaaccccua

SEQ ID NO: 103870 - RNA, 42 nt, Mus musculus
agccgcagcagugagccacucccaacaaccacagggccccau

SEQ ID NO: 103871 - RNA, 45 nt, Mus musculus
gugucaugcugcaacaugacuagacagacaucucuuucacagcca

SEQ ID NO: 103872 - RNA, 42 nt, Mus musculus
guuaugccacaugacacaagcuugaaaaggagagugccucag

SEQ ID NO: 103873 - RNA, 55 nt, Mus musculus
agagagagagagagagaaagagagagacagagagagacagagagagacagagaga

SEQ ID NO: 103874 - RNA, 46 nt, Mus musculus
ggcaugcuaguguccaaauaaaacuuuauuuaaaaaaaaagugcag

SEQ ID NO: 103875 - RNA, 46 nt, Mus musculus
augcugugugacaccuggggagugacaccuggggaaggauaggaag

SEQ ID NO: 103876 - RNA, 41 nt, Mus musculus
gaugcucugcuggccugggggguguggucagauccugcaca

SEQ ID NO: 103877 - RNA, 46 nt, Mus musculus
ugucugguacagauuguaaguacgaugugaccuuucuugccguagg

SEQ ID NO: 103878 - RNA, 71 nt, Mus musculus
gucacuccuugugguucauuucugggcaccaugggcuccacaguguguacagaugaacgaugucauggcag

SEQ ID NO: 103879 - RNA, 75 nt, Mus musculus
gaaugggcaaaggacagaaguguuugagaggacaaacagaccagauaauucccuggauaauuuuggcgugauagc

SEQ ID NO: 103880 - RNA, 46 nt, Mus musculus
cguauccuguuacugguuuagguaacacgcuguucucagcugccau

SEQ ID NO: 103881 - RNA, 46 nt, Mus musculus
uguguaccaugcugaugggaauacauauuugccaauuauacaguag

SEQ ID NO: 103882 - RNA, 46 nt, Mus musculus
cagaaacaacuuaagggagaaagguuuauuuagcucauaaucccag

SEQ ID NO: 103883 - RNA, 45 nt, Mus musculus
cccgcagagacaaugugaagaugcaguguggguaaaccagcccag

SEQ ID NO: 103884 - RNA, 42 nt, Mus musculus
agcgggaacucacuuuuccuuugucguuuuuguucugcugag

SEQ ID NO: 103885 - RNA, 46 nt, Mus musculus
uuuaagacaucagauggugauguuuuggagaacuuuauggcuguag

SEQ ID NO: 103886 - RNA, 42 nt, Mus musculus
ggggggcacuuuuagucgauccuuaggcaagaauggcagcag

SEQ ID NO: 103887 - RNA, 45 nt, Mus musculus
uauugcaaguagggucucuuucugagcagcgcucagcuagucaga

SEQ ID NO: 103888 - RNA, 46 nt, Mus musculus
uagauggugcacaugccccagaguugaccaaaaaaguccagcgaca

SEQ ID NO: 103889 - RNA, 42 nt, Mus musculus
agaucccauuacagcuguucugagccaccaugugguugcugg

SEQ ID NO: 103890 - RNA, 46 nt, Mus musculus
caucuugucuagaugaggacguuucuuauuccagucuaaagggcaa

SEQ ID NO: 103891 - RNA, 45 nt, Mus musculus
uuguggguaaagcucugguagauguuugccgugggagcuuuggga

SEQ ID NO: 103892 - RNA, 44 nt, Mus musculus
aauggccuaaagccaaaauaaagccuuuucucagccaguuacag

SEQ ID NO: 103893 - RNA, 47 nt, Mus musculus
uuucaugauuuguuuuuauuugaaaauaacugcugauguggggaaau

SEQ ID NO: 103894 - RNA, 121 nt, Mus musculus
acuauaguguaccuucaaagggaaucaucauccugcacacuaaagggaauguaaauaauuucaacaaaggcugagguggagucacaucagccuguaggugauucauguaacaacaaagaga

SEQ ID NO: 103895 - RNA, 54 nt, Mus musculus
cuugugauucugagugccauccauccugcucagacagagguggagaugagaagc

SEQ ID NO: 103896 - RNA, 45 nt, Mus musculus
auagagagcuuugucauugucaggguggagccugugguggguuuu

SEQ ID NO: 103897 - RNA, 50 nt, Mus musculus
aacacacacacuuugcuguaauuaugcucugugugagacucugggucaaa

SEQ ID NO: 103898 - RNA, 48 nt, Mus musculus
gugggcauuucuguccccuggacacuggguggcaaucacugugcgggc

SEQ ID NO: 103899 - RNA, 58 nt, Mus musculus
ccaccuauccucagcucuauguuucuggagagcuaauaggaggacuugacauaauuaa

SEQ ID NO: 103900 - RNA, 41 nt, Mus musculus
gcugugaaaccaucuuucuauuuaugagagaguacagccug

SEQ ID NO: 103901 - RNA, 46 nt, Mus musculus
agccaaagucagucugaagguugugugggaugaugucagaggggau

SEQ ID NO: 103902 - RNA, 46 nt, Mus musculus
aauguggauucagcaaacaaauucuggaaauacugaauaguacugg

SEQ ID NO: 103903 - RNA, 44 nt, Mus musculus
ucugaucauacuuugaauagauagccuguucucugaaguugcag

SEQ ID NO: 103904 - RNA, 41 nt, Mus musculus
ccuuuugcaggguugaauaugaaacuuuugauauacuggaa

SEQ ID NO: 103905 - RNA, 45 nt, Mus musculus
cuguaugugagaggggaucuuguuggaggauuggauauugucaag

SEQ ID NO: 103906 - RNA, 45 nt, Mus musculus
acauaucauaugcagguagacauuaagucacaaacugucuuuaga

SEQ ID NO: 103907 - RNA, 42 nt, Mus musculus
aaugacuugcucagucugagacccuagaaaaggcaccccuga

SEQ ID NO: 103908 - RNA, 45 nt, Mus musculus
guaggaagaccgugaaagacccgaugcuacugaagucuaccugau

SEQ ID NO: 103909 - RNA, 44 nt, Mus musculus
gauuuccguaaguuggcugcuuagugaguucuaggacacccaga

SEQ ID NO: 103910 - RNA, 48 nt, Mus musculus
gugagaggucccugcagguguuacgucaggaggagaaacaaacccgga

SEQ ID NO: 103911 - RNA, 46 nt, Mus musculus
uaggaacugaaagacaacggugaauugcugccuauacugaaaggag

SEQ ID NO: 103912 - RNA, 62 nt, Mus musculus
aggcauugcgcagugaaaaggaaagcaguguuugccgguaagugggaugaaagcggccaagg

SEQ ID NO: 103913 - RNA, 46 nt, Mus musculus
cugcugcugccuuguagccuggguccuguugcuuaagguggaggga

SEQ ID NO: 103914 - RNA, 46 nt, Mus musculus
guggcacugugacccaugcaacagguggugcuccugacacuggaag

SEQ ID NO: 103915 - RNA, 45 nt, Mus musculus
cuggguuggggacacgaugguccagaaggaagaaagggugcugga

SEQ ID NO: 103916 - RNA, 42 nt, Mus musculus
ucuaagggcuggauccuggccagccuggaggagauuggccag

SEQ ID NO: 103917 - RNA, 115 nt, Mus musculus
ggauagagaagaggggcuagcacauaggggacagauuggggauagagaagaggggcuagcacauaggggacagauuggggauagagaagaggggcuagcacauaggggacagauu

SEQ ID NO: 103918 - RNA, 89 nt, Mus musculus
ggggauagagaagaggggcuagcacauaggggacagauuggggauagagaagaggggcuagcacacagggcauauagggcaccagagca

SEQ ID NO: 103919 - RNA, 42 nt, Mus musculus
augagaucuggcgcccucuucuggugugucuaaagacagcua

SEQ ID NO: 103920 - RNA, 45 nt, Mus musculus
aggacaaacggcacauuaucucaugaggagguguaaggggccuga

SEQ ID NO: 103921 - RNA, 71 nt, Mus musculus
gaccuggggugcugcuccagccggacacauuaggguaagucccaggcaccaaggucaaguucacaagacca

SEQ ID NO: 103922 - RNA, 46 nt, Mus musculus
uuucuaaaauaagaaaagaaaagcaaagccagguaucuaucacugg

SEQ ID NO: 103923 - RNA, 45 nt, Mus musculus
gcagcucucagccucugcuucuacuuuugccuucccuucagacac

SEQ ID NO: 103924 - RNA, 45 nt, Mus musculus
acucagagacaguucuuucagaaacaacccugagugcugcuacug

SEQ ID NO: 103925 - RNA, 46 nt, Mus musculus
cuuaggugugcuccgugcuuguaaacccagcgccaacgagguggaa

SEQ ID NO: 103926 - RNA, 46 nt, Mus musculus
acuagcuguucucauuucuagcagccgcccaagacgucagccugag

SEQ ID NO: 103927 - RNA, 45 nt, Mus musculus
aucagaggccccgccugcccacggccgagcgcucucuauuggcag

SEQ ID NO: 103928 - RNA, 45 nt, Mus musculus
agacgcuagugagacaugcauuuaagaucguuauacaccccagac

SEQ ID NO: 103929 - RNA, 42 nt, Mus musculus
ccuaauuaucucuccccaacauuccuucuucaagcuugaguu

SEQ ID NO: 103930 - RNA, 41 nt, Mus musculus
ucuacaguucacuacuguauggggguggggguggggguuau

SEQ ID NO: 103931 - RNA, 45 nt, Mus musculus
cccaacuuuaaagaugcaaguagcugacucaguaaagaugaagaa

SEQ ID NO: 103932 - RNA, 46 nt, Mus musculus
aaaauauaaacaaauacaaaggauggcugagaacacacacacacac

SEQ ID NO: 103933 - RNA, 45 nt, Mus musculus
cauauucucaugcucuuuauaccugccuuauggacccacauaaga

SEQ ID NO: 103934 - RNA, 42 nt, Mus musculus
uaguauggaagagaacaucugaguucuuccuaugacucagau

SEQ ID NO: 103935 - RNA, 45 nt, Mus musculus
cugacacagguacaagagucagucuaaaggagcagcaccaugaga

SEQ ID NO: 103936 - RNA, 44 nt, Mus musculus
acugguuggaccaucucauuggcccuaaacauucauuuuuaaga

SEQ ID NO: 103937 - RNA, 41 nt, Mus musculus
accguuccagcagcacucgaacuugucaaagaugcagucgu

SEQ ID NO: 103938 - RNA, 46 nt, Mus musculus
acuugugaucuuugucuuuucuaaagugaacuagcaguugccauca

SEQ ID NO: 103939 - RNA, 46 nt, Mus musculus
gaggugggcaucuccugaucuacccagcaccugagugcagcaagag

SEQ ID NO: 103940 - RNA, 45 nt, Mus musculus
augcuuaugggcguggggauggagccaauagcaaaugcaacaaga

SEQ ID NO: 103941 - RNA, 47 nt, Mus musculus
cuuuuccucaaauuccauaccaaauaaaacuuaguuacagcuagucu

SEQ ID NO: 103942 - RNA, 41 nt, Mus musculus
uaauguauagaagagggaagaggagagaaaggagaggcaga

SEQ ID NO: 103943 - RNA, 46 nt, Mus musculus
aauggcacuguuuaggagacaaaagagggacacugaauacccagcg

SEQ ID NO: 103944 - RNA, 46 nt, Mus musculus
cugagcccuuagaaaugcagcugccuguacuauccaugccccagug

SEQ ID NO: 103945 - RNA, 59 nt, Mus musculus
aauacuauauuugcauauccauuaaucaggauccaaagcugcuuaaaucgggcguccuc

SEQ ID NO: 103946 - RNA, 45 nt, Mus musculus
uuaaauacaaacaagagaauucagcagagugauaaaggugccugc

SEQ ID NO: 103947 - RNA, 45 nt, Mus musculus
ucuguucacacagugaggauucaugucugagcugugacagcuaau

SEQ ID NO: 103948 - RNA, 46 nt, Mus musculus
gcccaaccaaggaauacguaaugaagccucccuuuucugcacucag

SEQ ID NO: 103949 - RNA, 56 nt, Mus musculus
cuuccauucuuucaugaaugcuacccucuuuaguccagauagcucacugcccaguc

SEQ ID NO: 103950 - RNA, 67 nt, Mus musculus
cucugaauuacaggccagccaggguuacguguggagaccuggucucaaaaaacaaaacagaacagaa

SEQ ID NO: 103951 - RNA, 67 nt, Mus musculus
gaacccuuuucucagaacuagcaagcaacaggguucaguggccguuggggaacauagguaggggaau

SEQ ID NO: 103952 - RNA, 46 nt, Mus musculus
uccaucucuguuacugucucaucugcuggccauuggcuugggguaa

SEQ ID NO: 103953 - RNA, 41 nt, Mus musculus
ucagcaugagaaacacaagcguuaugaagaaagggggaauu

SEQ ID NO: 103954 - RNA, 46 nt, Mus musculus
ugagagaagaagagaaguugaaaguauccugaagaaaaacucagau

SEQ ID NO: 103955 - RNA, 43 nt, Mus musculus
cuguggcugucuauuucagcucuguugguaucuuguggugucu

SEQ ID NO: 103956 - RNA, 46 nt, Mus musculus
caaaagggaagagacaugcuuuggagagucucuaccacccccuuaa

SEQ ID NO: 103957 - RNA, 46 nt, Mus musculus
aggcagcacuacuagggagcaaauccaagguguguggcugagaguc

SEQ ID NO: 103958 - RNA, 45 nt, Mus musculus
auuugucucuagguuuaauauagucccucuagacuugagccccag

SEQ ID NO: 103959 - RNA, 46 nt, Mus musculus
ccauuauaaauagagacggaggcuggaacgcugcucccauugccau

SEQ ID NO: 103960 - RNA, 46 nt, Mus musculus
aaaaaaaaaaagagagaagagaagagaaaaggaaagaagaaaaaag

SEQ ID NO: 103961 - RNA, 46 nt, Mus musculus
ggcucgcaaccaucuguaaugagaucugacgcccucuucuggagug

SEQ ID NO: 103962 - RNA, 42 nt, Mus musculus
uuuauaaggcaagcauacuuccacugaucuauagcaccagcc

SEQ ID NO: 103963 - RNA, 45 nt, Mus musculus
caaagaaagcaccaggggccauugagaugggaggggccauugaga

SEQ ID NO: 103964 - RNA, 46 nt, Mus musculus
ggaggagguccagcaaaagacaugaggcuggauuugcagaucacag

SEQ ID NO: 103965 - RNA, 46 nt, Mus musculus
ggagguauugugggaauauugaauucuuggacuccccugguugauu

SEQ ID NO: 103966 - RNA, 46 nt, Mus musculus
auauacaucuccugaguguagaaugucugggaacugaacucagguc

SEQ ID NO: 103967 - RNA, 44 nt, Mus musculus
ucccugcaguauaugcuguguaccauguaaguggcgcccaguua

SEQ ID NO: 103968 - RNA, 42 nt, Mus musculus
agucugacugagguaaagauaagcuuuuuuugggcuggagag

SEQ ID NO: 103969 - RNA, 46 nt, Mus musculus
aggcugugccugucugauacauccugagucagguggcuccagguac

SEQ ID NO: 103970 - RNA, 42 nt, Mus musculus
acaugguggcucggcaaaggagcccgaacccaacugcgacag

SEQ ID NO: 103971 - RNA, 43 nt, Mus musculus
gcucgaccuucauggugauagaugucggccugccgggggaaag

SEQ ID NO: 103972 - RNA, 42 nt, Mus musculus
gcgcaggggcagguucgucauuuuccgcagccagcggcagcu

SEQ ID NO: 103973 - RNA, 88 nt, Mus musculus
ugggaaaggccaggaggcucauucggggucuccacgucguggucggggguuggcgucggggaggauucgaagguauggcccggcucag

SEQ ID NO: 103974 - RNA, 42 nt, Mus musculus
gagccuccuggccuuucccagggccgugcuucuuccccgcag

SEQ ID NO: 103975 - RNA, 42 nt, Mus musculus
gcugguucagggucgacagcuggucgcgcagagggcccagaa

SEQ ID NO: 103976 - RNA, 45 nt, Mus musculus
caauaaagcuuuguuaucaguccucuucuccagaaacgacuccca

SEQ ID NO: 103977 - RNA, 46 nt, Mus musculus
aagugaugugauauuacuguggcuuuggacuuacagagcaguagag

SEQ ID NO: 103978 - RNA, 46 nt, Mus musculus
ggccuagcaauggugauucaucaggcuuuaaucccagcacucggga

SEQ ID NO: 103979 - RNA, 44 nt, Mus musculus
aagguggagaaccugugugggcacccccaaaagacuggcucaga

SEQ ID NO: 103980 - RNA, 27 nt, Mus musculus
caguuccuguaucuacaucccacucgu

SEQ ID NO: 103981 - RNA, 29 nt, Mus musculus
aggucaagccaaccuuugcacccccgaca

SEQ ID NO: 103982 - RNA, 43 nt, Mus musculus
guguccaguucaccacucccaguuccuguuuaugccccaaaga

SEQ ID NO: 103983 - RNA, 46 nt, Mus musculus
cuccagacccuucugagacaguuucuaccaaccagcccccaagacc

SEQ ID NO: 103984 - RNA, 45 nt, Mus musculus
gaguguggcacccaagccuaucucggggcucuccaacccccuauu

SEQ ID NO: 103985 - RNA, 45 nt, Mus musculus
ucgucaucuaccgaaaggcuccgagacaaauccagaggaggugag

SEQ ID NO: 103986 - RNA, 42 nt, Mus musculus
cccacccuggcacagcagugccgggaucugugggggccaggu

SEQ ID NO: 103987 - RNA, 93 nt, Mus musculus
ugcaugugucuauguggugugugugugguauaugugugucugugugugugugugugucuaugugggguguugugucuauguggugugugugug

SEQ ID NO: 103988 - RNA, 42 nt, Mus musculus
guguguguguguguguguguguguguggugugguguugugua

SEQ ID NO: 103989 - RNA, 46 nt, Mus musculus
ccccaauacucuuguagcugaguggucccagagccccaccccuuuc

SEQ ID NO: 103990 - RNA, 23 nt, Mus musculus
cugggugaccaacucucagguuc

SEQ ID NO: 103991 - RNA, 46 nt, Mus musculus
gcaaccagaccuggacaucagccucgggcucaagaagauggcagau

SEQ ID NO: 103992 - RNA, 42 nt, Mus musculus
cgugggaguggacagggaagaggugugucugagcccuguggc

SEQ ID NO: 103993 - RNA, 41 nt, Mus musculus
uucugaaaagugggacaguguuuaagaugucucgugggaaa

SEQ ID NO: 103994 - RNA, 48 nt, Mus musculus
cauauaauaaauaaauaaauaaauaaauaaaucuaaaagaagaagaag

SEQ ID NO: 103995 - RNA, 46 nt, Mus musculus
aaaucuggguuuaguguggggaugcguacucgaauccaggguccag

SEQ ID NO: 103996 - RNA, 46 nt, Mus musculus
aguagggggucagacaaaagaucuagaguuaggagagaagggccag

SEQ ID NO: 103997 - RNA, 45 nt, Mus musculus
cuggguccuuugggccuuagggcccaugguugcccuuuguccugu

SEQ ID NO: 103998 - RNA, 68 nt, Mus musculus
ugaggcaaggagaugacacagccuauccugaccuggcuuggggauuugggagaaggugaagaauaaaa

SEQ ID NO: 103999 - RNA, 69 nt, Mus musculus
aggcuuaaagacuauuggggguuagguuggccaaacacagggagggcguggugaaugagagaauaugga

SEQ ID NO: 104000 - RNA, 42 nt, Mus musculus
guguguguguguaacacuugaaaguucuaaggcaggcccggg

SEQ ID NO: 104001 - RNA, 41 nt, Mus musculus
cauacacagacacuucaaauaaaaauauaaagggcccccaa

SEQ ID NO: 104002 - RNA, 44 nt, Mus musculus
ugcuuguccucaacaaaauggacuuggcagaucuuacagagcag

SEQ ID NO: 104003 - RNA, 46 nt, Mus musculus
uucaagccagauuuuagaaaguugcuagcuuguuagugacacagaa

SEQ ID NO: 104004 - RNA, 46 nt, Mus musculus
caacguucucuucacgaacugugugaaagaugaaaacaucaagcag

SEQ ID NO: 104005 - RNA, 41 nt, Mus musculus
aggugugugugaggucucuacccuccuaagcgaggggucag

SEQ ID NO: 104006 - RNA, 25 nt, Mus musculus
agcugugacauccagaauccaggug

SEQ ID NO: 104007 - RNA, 45 nt, Mus musculus
ggcucacaaccaucuguaaugagaucugaugcccgcuucuggcau

SEQ ID NO: 104008 - RNA, 77 nt, Mus musculus
gaauauaguaaguauauguuccacugcugagcugccucccaacccauuuucuuaucuuuaaguugcaccgugaggga

SEQ ID NO: 104009 - RNA, 48 nt, Mus musculus
auaauggugcugcuucauaccuagagcuaugccuagccugaggccaua

SEQ ID NO: 104010 - RNA, 50 nt, Mus musculus
uuggugagggauuggucacuuuugacugggugucaggcauuugaauuuua

SEQ ID NO: 104011 - RNA, 46 nt, Mus musculus
ucuucccaggaacccaggcgcuggcucaucugaggugugggugagu

SEQ ID NO: 104012 - RNA, 45 nt, Mus musculus
accaaauagagugggugcugaagaacguggcuaucaagcugagga

SEQ ID NO: 104013 - RNA, 41 nt, Mus musculus
gucaggagguuuucuccaucucaaguaagagacaaaugcua

SEQ ID NO: 104014 - RNA, 46 nt, Mus musculus
acuccagcaucaggacuuugguuuuggguuccugcuguauaaccag

SEQ ID NO: 104015 - RNA, 42 nt, Mus musculus
uucacuacagggcggccguuuuacuauugugguaggguggag

SEQ ID NO: 104016 - RNA, 44 nt, Mus musculus
ucacuggguucauccaccuccccuacuuacuggucacaagccua

SEQ ID NO: 104017 - RNA, 46 nt, Mus musculus
uaccuuauguagcgcuugcuugaccucuugguuccgaaggcaguag

SEQ ID NO: 104018 - RNA, 57 nt, Mus musculus
aaguuugggguccucuuccagaaugacagaugugccaaucucuuugaagcauuggua

SEQ ID NO: 104019 - RNA, 50 nt, Mus musculus
ggaacucugaaagcugcaaaacgaaggaagauuguuacauacacagggga

SEQ ID NO: 104020 - RNA, 46 nt, Mus musculus
ugaguagcuggaugaagggcgaauguagguguagaugacaguggag

SEQ ID NO: 104021 - RNA, 45 nt, Mus musculus
gguaggaugguggaggugcaaaggauguccaccacagccagguug

SEQ ID NO: 104022 - RNA, 44 nt, Mus musculus
ucugccacaagagucauaacgcuauuuacauauguaggacuaca

SEQ ID NO: 104023 - RNA, 46 nt, Mus musculus
aguuuuucacuucgaacucuggguucaaacugucuugcugucagaa

SEQ ID NO: 104024 - RNA, 46 nt, Mus musculus
uacacccacggccagugcuccacagagcugugggcucauccuagag

SEQ ID NO: 104025 - RNA, 46 nt, Mus musculus
cugccacaagagucagaaugcuauucacauauguaggacuacagga

SEQ ID NO: 104026 - RNA, 47 nt, Mus musculus
guauguauguguguguguauguauguguguguguaugugugugugug

SEQ ID NO: 104027 - RNA, 46 nt, Mus musculus
ucaugcugaauauauuauacauguaaugaaugugagagacccuugu

SEQ ID NO: 104028 - RNA, 45 nt, Mus musculus
agagcgaguguguucuuaaccacuaaaccaacucuccagucuugu

SEQ ID NO: 104029 - RNA, 47 nt, Mus musculus
guguauaauguaugaaugucugugcaucacaugcacugcccacagaa

SEQ ID NO: 104030 - RNA, 46 nt, Mus musculus
acauaguugggggguugguuacauccuuccauguggucuuggggau

SEQ ID NO: 104031 - RNA, 42 nt, Mus musculus
ucguauauuguaugugcaaaguguuuucaccugcguccaguc

SEQ ID NO: 104032 - RNA, 57 nt, Mus musculus
ccuucuucagugacagguuccugagagagaaaggaccauggaaugagaggguagaga

SEQ ID NO: 104033 - RNA, 46 nt, Mus musculus
auaaaaaucuuauuuuauuauauaacuuuuuuuauuaugccaaggc

SEQ ID NO: 104034 - RNA, 42 nt, Mus musculus
gcccagacuuaccacagacgcagagcaggcuuagggccacca

SEQ ID NO: 104035 - RNA, 46 nt, Mus musculus
ggggagugugaagcgcuucuccacgauggcacggucugggcgagac

SEQ ID NO: 104036 - RNA, 45 nt, Mus musculus
ucuucaggcuccccagcccguccuugccugggcaugcacacaggu

SEQ ID NO: 104037 - RNA, 42 nt, Mus musculus
agccgggcauagugacgcacgccuucuuaaaucccagcacuc

SEQ ID NO: 104038 - RNA, 41 nt, Mus musculus
uacaggcgccuccgacuuaagguggagcaacccggcugugg

SEQ ID NO: 104039 - RNA, 41 nt, Mus musculus
uccaaggcauccgcaacugcccggggcuccauggccccugg

SEQ ID NO: 104040 - RNA, 42 nt, Mus musculus
auccggcugccgaggaaauuucaggaagagaggaagcagggg

SEQ ID NO: 104041 - RNA, 44 nt, Mus musculus
gggcuccuagggcaggcacgggcugaccccaagaagagggccua

SEQ ID NO: 104042 - RNA, 45 nt, Mus musculus
gauacagaugugaagagaguagcugccgaguuccucuuugucuua

SEQ ID NO: 104043 - RNA, 42 nt, Mus musculus
ggggccgacccgagggccaguacucagaggacgaggacacgg

SEQ ID NO: 104044 - RNA, 42 nt, Mus musculus
ucugagauucugaggcacagaauacaggagaguuugggacaa

SEQ ID NO: 104045 - RNA, 46 nt, Mus musculus
cagauaagacuauggcuucuucaccuggggaagucacacagcagau

SEQ ID NO: 104046 - RNA, 46 nt, Mus musculus
aucuuucagguggagccuuuugccagcuugucugaagcaguacaga

SEQ ID NO: 104047 - RNA, 42 nt, Mus musculus
gucuagaacaccuuuuccuccucacacccacaagcccuaguu

SEQ ID NO: 104048 - RNA, 45 nt, Mus musculus
gcaaaaugugggugugggaaguagagucaggagggaccuggguga

SEQ ID NO: 104049 - RNA, 44 nt, Mus musculus
cacugguggugacacuuaggguuugaggacaauggcuguguagg

SEQ ID NO: 104050 - RNA, 46 nt, Mus musculus
gccugcaagguuccuacuccauauggcugacuucgcuuuggcagau

SEQ ID NO: 104051 - RNA, 44 nt, Mus musculus
aggugaugucuaggacuugauuugaaauauuugcagcccccaac

SEQ ID NO: 104052 - RNA, 45 nt, Mus musculus
cuccagugucagggauucuggcucauguuuugggccugugacaag

SEQ ID NO: 104053 - RNA, 45 nt, Mus musculus
ccacauuggcuccuugcagcugguagggaugguggauguugcaug

SEQ ID NO: 104054 - RNA, 46 nt, Mus musculus
uaccugccauagaguuuuuuugaaaucaguuuugucaagcccagaa

SEQ ID NO: 104055 - RNA, 30 nt, Mus musculus
gcggcucuauacacagaacaucgacgggcu

SEQ ID NO: 104056 - RNA, 46 nt, Mus musculus
ccuucuccuuaaagguguuuuucuauguaacuauugcagcacaguc

SEQ ID NO: 104057 - RNA, 41 nt, Mus musculus
cgcucagagagcauuaguuaucacccgccuacucaaggagg

SEQ ID NO: 104058 - RNA, 46 nt, Mus musculus
acacacugaagaccaggacaugggguaacacacggugagcauagau

SEQ ID NO: 104059 - RNA, 45 nt, Mus musculus
cuacaccaaaacucagccacagaacugaccacaucccagccacca

SEQ ID NO: 104060 - RNA, 46 nt, Mus musculus
caaagcagcagcgaagugcaggcuggugaggggacaaaccacaguu

SEQ ID NO: 104061 - RNA, 43 nt, Mus musculus
uucugggcagcuauggggaugaccuuuguauccggccagcuga

SEQ ID NO: 104062 - RNA, 45 nt, Mus musculus
cugagggaucugaguggggcagcaucaaauacacaucguggacaa

SEQ ID NO: 104063 - RNA, 42 nt, Mus musculus
gugaccugagaggggggcuggagaugaaaaggaaugggguga

SEQ ID NO: 104064 - RNA, 45 nt, Mus musculus
ucaucuguguaggugcuguuucugccccuucuguuaaucucagag

SEQ ID NO: 104065 - RNA, 49 nt, Mus musculus
cacagaggugguagagaaaauaaugaugcagauaaugaccauaaggaug

SEQ ID NO: 104066 - RNA, 44 nt, Mus musculus
uucacagaguaggcauaggcaacgaagcccaggcagcaggcguu

SEQ ID NO: 104067 - RNA, 42 nt, Mus musculus
cacggugguccucacaacagcugaguugcuggguucccccag

SEQ ID NO: 104068 - RNA, 45 nt, Mus musculus
ugagaauuguggcucaugguacugacucuggaacaaucgccccgu

SEQ ID NO: 104069 - RNA, 42 nt, Mus musculus
gagggacgcagcugcggagggugaagcacuucaggaccggaa

SEQ ID NO: 104070 - RNA, 46 nt, Mus musculus
ugauaacaaccaucaggaugcugaggaccaaggugcugauguucag

SEQ ID NO: 104071 - RNA, 42 nt, Mus musculus
accuucacggaguaggcauaggcuaugaagcccaggcagcag

SEQ ID NO: 104072 - RNA, 46 nt, Mus musculus
uauucuuccuugauucuuucguaguuugggggcuguccuccacugg

SEQ ID NO: 104073 - RNA, 44 nt, Mus musculus
ccauugccuacuuagcagggccucgguuuccucaucuucuggaa

SEQ ID NO: 104074 - RNA, 42 nt, Mus musculus
cuucuuaugccuggacaacuguuuccagacaucuuccagcag

SEQ ID NO: 104075 - RNA, 46 nt, Mus musculus
gcaucuguugugcauccagucaguggcuacauaacugucugggcag

SEQ ID NO: 104076 - RNA, 41 nt, Mus musculus
ccccacugaaccucacccaccagacacccccauggcgggaa

SEQ ID NO: 104077 - RNA, 45 nt, Mus musculus
acagacaugccuggaaguuugucugcagugauucuagagccuguu

SEQ ID NO: 104078 - RNA, 46 nt, Mus musculus
gugccuaugcccccaccuauauccucaaggauuuccccauagccag

SEQ ID NO: 104079 - RNA, 45 nt, Mus musculus
aucuguacagcagagccacaggacccccaccccagcagccuccac

SEQ ID NO: 104080 - RNA, 46 nt, Mus musculus
ggagaagacugagacaucaccucaggacaaagaaaaucaugcagag

SEQ ID NO: 104081 - RNA, 43 nt, Mus musculus
ggggacucguacuucaacaucaucuugguggacuuugagagcg

SEQ ID NO: 104082 - RNA, 45 nt, Mus musculus
guauaugggcauccuacgaagcccauguguauauguuaaccacgg

SEQ ID NO: 104083 - RNA, 45 nt, Mus musculus
auguaggauccuggauggucuacauauauguuaauacaugaagau

SEQ ID NO: 104084 - RNA, 45 nt, Mus musculus
caggccaagcaaacaccacacuuuucuuucuuuagcugccucacg

SEQ ID NO: 104085 - RNA, 23 nt, Mus musculus
gggguagccuugugcuuagauag

SEQ ID NO: 104086 - RNA, 45 nt, Mus musculus
gaccugaguagguuuucagggagauuuauggacucuggauucugg

SEQ ID NO: 104087 - RNA, 46 nt, Mus musculus
uaguacacacgcguaucccugaugucccucccugauguccccagac

SEQ ID NO: 104088 - RNA, 45 nt, Mus musculus
ucuguaauuccagauccagcuaaucugacacccucacacagagau

SEQ ID NO: 104089 - RNA, 46 nt, Mus musculus
aggaggaauauguuugagaaggggagggauaacagguucguggggc

SEQ ID NO: 104090 - RNA, 46 nt, Mus musculus
aaccccccguggucgucuccguaugagaugucgaguguuuuuucgg

SEQ ID NO: 104091 - RNA, 46 nt, Mus musculus
aaucccaugaccuugggcuaacccuucaccuuuccuuguuugugag

SEQ ID NO: 104092 - RNA, 52 nt, Mus musculus
gguuuacauagugaguuuccaguacagccagacccuggagggagcgagagag

SEQ ID NO: 104093 - RNA, 42 nt, Mus musculus
gaagguaguaccccucugguacccacgggaauggucagucag

SEQ ID NO: 104094 - RNA, 46 nt, Mus musculus
uuucauuuaaaaaauuauuuuuacuuauguguauguauguauuggg

SEQ ID NO: 104095 - RNA, 46 nt, Mus musculus
gggaccugagcaaauaggauaaagugaggacuuuacuugcuuaaag

SEQ ID NO: 104096 - RNA, 46 nt, Mus musculus
uguccuauacaaaugugccccacugagcuacaacucuagccccuuu

SEQ ID NO: 104097 - RNA, 46 nt, Mus musculus
aaacaaccaacagaagaagucaggguuuggggugcuguagaagcag

SEQ ID NO: 104098 - RNA, 45 nt, Mus musculus
ugauaagaaauugaacauauuagaauucugagauuuucaccccug

SEQ ID NO: 104099 - RNA, 42 nt, Mus musculus
uucaucugcuacguuuacggggggaccugcugaggcuggggg

SEQ ID NO: 104100 - RNA, 42 nt, Mus musculus
cuucucuccccccaccccccaaaaaaaaaaaaacacgcacac

SEQ ID NO: 104101 - RNA, 46 nt, Mus musculus
aguaaaaauuagcaaggcauagugacacacauaccuuuaaucccag

SEQ ID NO: 104102 - RNA, 42 nt, Mus musculus
gccccaugagacccuguggucccacccacuuacagcagcaua

SEQ ID NO: 104103 - RNA, 46 nt, Mus musculus
accacgcaggacuauaaacugaaugguguauacaugacagucacag

SEQ ID NO: 104104 - RNA, 46 nt, Mus musculus
agcuacccgucuacuacauuguuucucacuggguguggggcuggug

SEQ ID NO: 104105 - RNA, 43 nt, Mus musculus
acagguaucugacacugacugauucagcuuggguuuugugugu

SEQ ID NO: 104106 - RNA, 41 nt, Mus musculus
uacuggacaaaugagguggaagaacagcuucgggcccugga

SEQ ID NO: 104107 - RNA, 46 nt, Mus musculus
guagagugagguuuggaagaugcugguguacccuggaagacgggau

SEQ ID NO: 104108 - RNA, 46 nt, Mus musculus
uugacggaggcuggcugugggauccugccuggcaugcugcgcucuu

SEQ ID NO: 104109 - RNA, 29 nt, Mus musculus
ucagccuucgcaccaaugaacugggugau

SEQ ID NO: 104110 - RNA, 46 nt, Mus musculus
agauacccuggcuagucagugauuuucacgguggucaugugcuuuu

SEQ ID NO: 104111 - RNA, 46 nt, Mus musculus
cagaggcagcagcacggcugggcaguggggaccggcucggguggau

SEQ ID NO: 104112 - RNA, 44 nt, Mus musculus
uaggccagccugaucacaagauauuaguugcaacacagguaggc

SEQ ID NO: 104113 - RNA, 45 nt, Mus musculus
gaugcuggguguggugacacuugccuuuccuaccagcagucaggg

SEQ ID NO: 104114 - RNA, 58 nt, Mus musculus
aguaaacaaggcaaguuuaaguacauugaaggguacaucagagagauugguacaacaa

SEQ ID NO: 104115 - RNA, 44 nt, Mus musculus
cuggguguggucuuuguagaaagcucacuuucaugcugguagaa

SEQ ID NO: 104116 - RNA, 42 nt, Mus musculus
uaaaguagguugugcgugguagcaguggcuuagugcggagga

SEQ ID NO: 104117 - RNA, 45 nt, Mus musculus
ccucuccgaaagcaccuccucgggauuugaggaguagguggaggg

SEQ ID NO: 104118 - RNA, 41 nt, Mus musculus
uaauuaauccucuuccucaucaucaccagcuccagccccgc

SEQ ID NO: 104119 - RNA, 46 nt, Mus musculus
gggucacauagguuuugcaacaaacccagcuucuggcgaccggcau

SEQ ID NO: 104120 - RNA, 44 nt, Mus musculus
uugucagcagggaggcccaaggagaagacccugauccuggugaa

SEQ ID NO: 104121 - RNA, 44 nt, Mus musculus
gcaccccagaugcguguuccuguacagccccauggccccagcag

SEQ ID NO: 104122 - RNA, 42 nt, Mus musculus
uagcacugugcggcccuuguacaugauggucacauccaggaa

SEQ ID NO: 104123 - RNA, 42 nt, Mus musculus
augcagcauggcagguggaagcuguccccagucccaggccuc

SEQ ID NO: 104124 - RNA, 45 nt, Mus musculus
aaauuggagcugccuguccaucuuagcccagcuucccaccccugu

SEQ ID NO: 104125 - RNA, 45 nt, Mus musculus
gaguuaaccugccacccccagaggcugaggcugcugagcgaagag

SEQ ID NO: 104126 - RNA, 41 nt, Mus musculus
ugguaccggagccgccgggacggguuuuaucucagugaaaa

SEQ ID NO: 104127 - RNA, 65 nt, Mus musculus
agugucuuggcuggccaggcagucccugagaacuccagauugacgauuccaagaagaauugccca

SEQ ID NO: 104128 - RNA, 41 nt, Mus musculus
agcucaucagagcaccuggcuuugcccgccuaccauugauc

SEQ ID NO: 104129 - RNA, 45 nt, Mus musculus
cauaagagaguagcaugcagauaggcuccacaugguguccuuugu

SEQ ID NO: 104130 - RNA, 98 nt, Mus musculus
ggagcugcagcggcucugacuacacacagauaaguuugcucugagaucaugugcacaacagagggaucccacuaaauauacuguguguacugucaguc

SEQ ID NO: 104131 - RNA, 54 nt, Mus musculus
agggaacaaccacaacaguggaugacagggaacuagacuauauaggcuuggaag

SEQ ID NO: 104132 - RNA, 46 nt, Mus musculus
uuggugauugacugaagugcuggugcugugucccucaagcccaacc

SEQ ID NO: 104133 - RNA, 87 nt, Mus musculus
gacccacacacacccagaauuauuuauugaauuuuccgugcccauguggcucuccuguccuccguccaucagucuuugccccugcug

SEQ ID NO: 104134 - RNA, 46 nt, Mus musculus
gggacaacagcuagacccuguccccugccccuuccccaagccagga

SEQ ID NO: 104135 - RNA, 46 nt, Mus musculus
auugcuuugaaggugaggacauccccucccccaccgccagccacca

SEQ ID NO: 104136 - RNA, 46 nt, Mus musculus
agauggaguagcggagagcugcuguaucuaguuuacacuuggagca

SEQ ID NO: 104137 - RNA, 46 nt, Mus musculus
gauauguaggagauagcaucucagggacagcagacugaagguagag

SEQ ID NO: 104138 - RNA, 45 nt, Mus musculus
cggguggccacacuucugugcuuugaaggguuucgggaguacaga

SEQ ID NO: 104139 - RNA, 41 nt, Mus musculus
guccugggaagugcugcccauccccccgucccauaggucag

SEQ ID NO: 104140 - RNA, 42 nt, Mus musculus
ggucucuuucccaucaccuuugcccugaggagggaagaggag

SEQ ID NO: 104141 - RNA, 81 nt, Mus musculus
agcuucgcgucaccaacaccagcauccaguucaaccuucgcaaucucuaccgccucucgaaggcucucuucccgccagagc

SEQ ID NO: 104142 - RNA, 45 nt, Mus musculus
caauguggccuucccgccggaugccuugcgcaugcgcgcaccugc

SEQ ID NO: 104143 - RNA, 45 nt, Mus musculus
cuccugguggggagggauggggagucgcccucccccggagcccac

SEQ ID NO: 104144 - RNA, 46 nt, Mus musculus
gaagaauuauuuauuuuugccaaagcagaucuaauaaaagccacag

SEQ ID NO: 104145 - RNA, 41 nt, Mus musculus
gacugacagguggcucuaauuagaggugggauguccauucc

SEQ ID NO: 104146 - RNA, 42 nt, Mus musculus
ccugucaguccaucccuugucuguugugguugucugggagag

SEQ ID NO: 104147 - RNA, 42 nt, Mus musculus
cuauccugucuuccuuaaucuuugucugaaggaccaauaaag

SEQ ID NO: 104148 - RNA, 46 nt, Mus musculus
gcuuaagcuucuguaguuggaguggcaagaucccaccugcuaggug

SEQ ID NO: 104149 - RNA, 45 nt, Mus musculus
ccaggaugggugaauucaaugagaagaaggcaacauguggcacag

SEQ ID NO: 104150 - RNA, 45 nt, Mus musculus
aguccccauguuggaggccuggccuggggggcucagucccagcuu

SEQ ID NO: 104151 - RNA, 42 nt, Mus musculus
cggccuggcugucauggcagugggcaucuggacacuggcccu

SEQ ID NO: 104152 - RNA, 46 nt, Mus musculus
cuggaguccugggcugcugugccacuuucaaggagcgacggaaccu

SEQ ID NO: 104153 - RNA, 41 nt, Mus musculus
ccuaguacuucauccugcuccucaucaucuuccuccuggag

SEQ ID NO: 104154 - RNA, 46 nt, Mus musculus
acaccauggucaagagauaccaccagucaggccacgagggugugag

SEQ ID NO: 104155 - RNA, 39 nt, Mus musculus
cugcuuguaccgaagccucaagcuggaacacuacugacc

SEQ ID NO: 104156 - RNA, 42 nt, Mus musculus
gccaggcugggcggccagccuugcacuaugucccagccccac

SEQ ID NO: 104157 - RNA, 44 nt, Mus musculus
gcaugcaccuucaagugccuuucacugcacaccaaagucccaaa

SEQ ID NO: 104158 - RNA, 69 nt, Mus musculus
gagcauggcuguuuucaucucacugcuguauuccagaugcugcccacaaaugcuccugcuauguaacag

SEQ ID NO: 104159 - RNA, 42 nt, Mus musculus
agacgacagugggccacaaggacucagcccagagccagagau

SEQ ID NO: 104160 - RNA, 46 nt, Mus musculus
cugaccccgcugacuuugagaagacacaacucuacagaccccaguu

SEQ ID NO: 104161 - RNA, 46 nt, Mus musculus
cucacugcugccugcugugggccaggugaaaacgcaacccccaucc

SEQ ID NO: 104162 - RNA, 82 nt, Mus musculus
acuggugaaauauaggccuuuucucuguuuaccaugagacagcugcuauggguccacacgcaugggugucuccuaguccagg

SEQ ID NO: 104163 - RNA, 72 nt, Mus musculus
gauuacuucuaugaccugcuguaggcuggaaagcaacccccaagugacuggacuuuucuaagccauggagug

SEQ ID NO: 104164 - RNA, 45 nt, Mus musculus
ugcccccaugucuaggguaauuugggauauauuguggggguagua

SEQ ID NO: 104165 - RNA, 45 nt, Mus musculus
ggaguugaaguguccagcaaccaacucaggcaucucugcccaucc

SEQ ID NO: 104166 - RNA, 45 nt, Mus musculus
cgccauccucugggcuuguuuaccgucucucuaucugccccuccu

SEQ ID NO: 104167 - RNA, 46 nt, Mus musculus
aagcauggucucaggaugaucugccaccccaucuuagccucuagaa

SEQ ID NO: 104168 - RNA, 42 nt, Mus musculus
cucucauagacagggccucucacagacagggccuccauagaa

SEQ ID NO: 104169 - RNA, 46 nt, Mus musculus
acugguuucuuucccauuccuucuccucuguuaaccccacccaggu

SEQ ID NO: 104170 - RNA, 46 nt, Mus musculus
uuggaggucaccacaacauagagaacuguauuaaagggccauagca

SEQ ID NO: 104171 - RNA, 41 nt, Mus musculus
gauggggaggucuaggggugggaggcucaagagccugcagu

SEQ ID NO: 104172 - RNA, 46 nt, Mus musculus
guggccaacaccuggggugugauggucacaauguuucccggggaag

SEQ ID NO: 104173 - RNA, 46 nt, Mus musculus
uggacuuaugaugauuuccgaaacgucuuagacagugaggaugaga

SEQ ID NO: 104174 - RNA, 41 nt, Mus musculus
uuucccgaugcugugaagaucugggaaagcugaugggagaa

SEQ ID NO: 104175 - RNA, 42 nt, Mus musculus
ucccagcaacuacaugguggcucacaaccauccguagugaga

SEQ ID NO: 104176 - RNA, 44 nt, Mus musculus
ugccauuccuggguucuauaagaaagcaggcuaaacgcuggaga

SEQ ID NO: 104177 - RNA, 46 nt, Mus musculus
aguagucagugcucuuaaccacugagccaucucaccagcccucuua

SEQ ID NO: 104178 - RNA, 46 nt, Mus musculus
agauacagggaguuauuuucucuuauuucucauuuuguuguaggag

SEQ ID NO: 104179 - RNA, 44 nt, Mus musculus
ccuuggcugucuuggaacuugaucuguagacccagccuuggaga

SEQ ID NO: 104180 - RNA, 46 nt, Mus musculus
caguagugaauguguuaaguuuauguaugugccaguguagcuggau

SEQ ID NO: 104181 - RNA, 68 nt, Mus musculus
ggugaggggagaugugagaacauggacuuuauuaggggugagaaagcgaguggggaugaguaugagca

SEQ ID NO: 104182 - RNA, 28 nt, Mus musculus
gugcggaauaagcagaugugagggugag

SEQ ID NO: 104183 - RNA, 51 nt, Mus musculus
agcaauaugggagcuaugaaugugagggcgaggaagugagugaggaugaga

SEQ ID NO: 104184 - RNA, 42 nt, Mus musculus
caggguugaaaaugaacuguaaaaaacaaaacuuagggugug

SEQ ID NO: 104185 - RNA, 45 nt, Mus musculus
gcaccucuccacugcaucuguccucaccuguagcucacagcccuc

SEQ ID NO: 104186 - RNA, 42 nt, Mus musculus
uugcucguccgcgccugcaaccagcugggccaguuccugcag

SEQ ID NO: 104187 - RNA, 44 nt, Mus musculus
cgaggccgucaagacccacauugagacggucaucaaugccuuga

SEQ ID NO: 104188 - RNA, 52 nt, Mus musculus
ggucuugucugagugguaguuuccguuggaacagugaaggauguagggguag

SEQ ID NO: 104189 - RNA, 45 nt, Mus musculus
uucaguguggguccagacagugcugggagaggugauuggggaggu

SEQ ID NO: 104190 - RNA, 46 nt, Mus musculus
agggaguagauggacaggaccaauugaagaacuggagauggcaguc

SEQ ID NO: 104191 - RNA, 45 nt, Mus musculus
agugucgacuugggcgauguggauugggguguagaggguguagac

SEQ ID NO: 104192 - RNA, 45 nt, Mus musculus
aacuaucaauaauuaaagaagucuuaaaagacccagucccuagau

SEQ ID NO: 104193 - RNA, 46 nt, Mus musculus
auugauagaugacuggacaaugaauugauggagagaugcaccaaug

SEQ ID NO: 104194 - RNA, 44 nt, Mus musculus
aaacacaaucacuuggguugaagucgggacaggugauguuggag

SEQ ID NO: 104195 - RNA, 42 nt, Mus musculus
uuugucuuggaauuucaugucagcgcccaucuagugcaagga

SEQ ID NO: 104196 - RNA, 45 nt, Mus musculus
caggggcuguucuuguugauagaccuucaucacagagcccagagu

SEQ ID NO: 104197 - RNA, 45 nt, Mus musculus
ugucuagcuuaucugccacugucuggcuaggcuucagccacagaa

SEQ ID NO: 104198 - RNA, 45 nt, Mus musculus
agugguccuguuuggggaccugcaucuccuguccucacccuauuc

SEQ ID NO: 104199 - RNA, 41 nt, Mus musculus
uuuuugaacugcagucccaucagucuguguauggaauuugu

SEQ ID NO: 104200 - RNA, 45 nt, Mus musculus
agagaaaccuuaaagcagugugguuguuccccaagagccuuagaa

SEQ ID NO: 104201 - RNA, 44 nt, Mus musculus
cugcuucuuugguaggcaguccugggacaaaguaggacaggagg

SEQ ID NO: 104202 - RNA, 42 nt, Mus musculus
cccugacuuuuguucucacugaaacugaaucucauuccucua

SEQ ID NO: 104203 - RNA, 42 nt, Mus musculus
agaagauagaagguagaugcaggcaccaguccagguggaguc

SEQ ID NO: 104204 - RNA, 56 nt, Mus musculus
gaacaaagucauucagugcacagugcccccagguguggacucguucuaccuugaga

SEQ ID NO: 104205 - RNA, 53 nt, Mus musculus
uaugcuguuuaugaaacucccacagcacacaauggggccaagaacccucgcug

SEQ ID NO: 104206 - RNA, 42 nt, Mus musculus
ggacuuccuccguauaacacccacacaacagcagcagcagau

SEQ ID NO: 104207 - RNA, 46 nt, Mus musculus
ucuuaaucucaccccaccccagcagucucuaucucuuuaaugaaag

SEQ ID NO: 104208 - RNA, 62 nt, Mus musculus
gucauuuguuaguauucaucuuauacucuuagauaaacugcaaaaaagaucuacugugaguc

SEQ ID NO: 104209 - RNA, 45 nt, Mus musculus
cacccugacagcuugguguugauugugugugugugugugcgugug

SEQ ID NO: 104210 - RNA, 46 nt, Mus musculus
agaacauuguucugaucagcaccucagugccuuuuccccugaaguu

SEQ ID NO: 104211 - RNA, 45 nt, Mus musculus
gcuaccuuuucaagccucaauuucuucauuuauaaacgaggagag

SEQ ID NO: 104212 - RNA, 47 nt, Mus musculus
cuuggucucccagauggacacaagcccugacucuuggucucccagau

SEQ ID NO: 104213 - RNA, 114 nt, Mus musculus
uaggguuccucuacacagaagaaaccuuaccccauugguccccagauggagugggaccccgacuucccuuaguuccucagauagaaagggcccugaaccccuuacguucucaga

SEQ ID NO: 104214 - RNA, 46 nt, Mus musculus
cgacucucgucuaucggacaucugggguggaggaaggcagaauuug

SEQ ID NO: 104215 - RNA, 42 nt, Mus musculus
cugcugagcgcccgaagggagccacugcgcaggcguguacgg

SEQ ID NO: 104216 - RNA, 46 nt, Mus musculus
gaggguuuaggaagugggauuuugucuggauuggaugaugcuaggg

SEQ ID NO: 104217 - RNA, 44 nt, Mus musculus
agccucaguuccuucauggacaaaugugaauggaauaacaggca

SEQ ID NO: 104218 - RNA, 23 nt, Mus musculus
uuaguucaucuguucagacauaa

SEQ ID NO: 104219 - RNA, 39 nt, Mus musculus
cgcuggagucaaggcguguuuccugacuucccuguugga

SEQ ID NO: 104220 - RNA, 45 nt, Mus musculus
aguaucuguguucauaguaauagagacucaaaaucagccagguug

SEQ ID NO: 104221 - RNA, 45 nt, Mus musculus
gaugcuaugggcacauggaaguguguguguguguguguguguggg

SEQ ID NO: 104222 - RNA, 41 nt, Mus musculus
ugacuuugaauucaaggagcugguagugcugccccgggaga

SEQ ID NO: 104223 - RNA, 42 nt, Mus musculus
ucuaaagcuaagccaaacggcaagaaaccugcugcagaggag

SEQ ID NO: 104224 - RNA, 45 nt, Mus musculus
gugcaucugcucagaugagaagcagcaaaaaacugagcaggagau

SEQ ID NO: 104225 - RNA, 46 nt, Mus musculus
ggaauaccacaaagucacacugcauaacaaacuucacacaagagau

SEQ ID NO: 104226 - RNA, 45 nt, Mus musculus
aagcuuugaugguagcugugcacauuucugaacuggccugccugg

SEQ ID NO: 104227 - RNA, 46 nt, Mus musculus
gagcaacauaguuuuauuuaaaaaacuaguuucaaagcaagguaga

SEQ ID NO: 104228 - RNA, 44 nt, Mus musculus
cucucucuccccccccaucucucucucucucucucucucugugu

SEQ ID NO: 104229 - RNA, 46 nt, Mus musculus
uucuccuuuccuggaguuucagccaguaguuugguauaugccagaa

SEQ ID NO: 104230 - RNA, 46 nt, Mus musculus
ggucaugucacugccagaauuguggcuggugacuuugcaccggagg

SEQ ID NO: 104231 - RNA, 46 nt, Mus musculus
ggaagucuucuuucaguguuuacauguuccuaagaaacccccauau

SEQ ID NO: 104232 - RNA, 45 nt, Mus musculus
gggcuauacagagaaacccugucucgaaaaaaauaaaaaauaaaa

SEQ ID NO: 104233 - RNA, 45 nt, Mus musculus
caaaagcauggucaggccuaucgcagcaauacccaacccccaguc

SEQ ID NO: 104234 - RNA, 54 nt, Mus musculus
uacauuaccaguucuucugucugguggcaugguccacugucccacagauaacca

SEQ ID NO: 104235 - RNA, 46 nt, Mus musculus
cuggucucuucuuaucuuaaucacugcuaauuucuuagccccagcu

SEQ ID NO: 104236 - RNA, 77 nt, Mus musculus
ccaauacuuccccuggccucucacagugccaagccucagcugcucucuaugacuccauaccuucaaaaccaguccca

SEQ ID NO: 104237 - RNA, 31 nt, Mus musculus
gauugcauaccuccaacaucacaggcuauac

SEQ ID NO: 104238 - RNA, 46 nt, Mus musculus
accuuucuauuuauaauaagccuuaaagcaugagagcuggggagau

SEQ ID NO: 104239 - RNA, 46 nt, Mus musculus
gaggaaggagagucugaucuaagagcccagagggcucugccagucc

SEQ ID NO: 104240 - RNA, 28 nt, Mus musculus
cuggugucacugagugggugggcugaga

SEQ ID NO: 104241 - RNA, 46 nt, Mus musculus
gauuuaccugcugaguaugcugccuggcaccuuguaauuggcagag

SEQ ID NO: 104242 - RNA, 46 nt, Mus musculus
uaaauuauuauuucuuauucuauauguauguauuuuggucugagua

SEQ ID NO: 104243 - RNA, 42 nt, Mus musculus
ugugugugagagagagagagagagagagagagagcgcgcaag

SEQ ID NO: 104244 - RNA, 45 nt, Mus musculus
uuuaccccuugaauggggaaggaguugggagaaguggcuggaaga

SEQ ID NO: 104245 - RNA, 46 nt, Mus musculus
acaggacaagcacaguggaaggaucagagaucugaggaagggaggg

SEQ ID NO: 104246 - RNA, 44 nt, Mus musculus
uggacaaccacgugcaggguaacacccaggggaagcugcucagg

SEQ ID NO: 104247 - RNA, 46 nt, Mus musculus
cccuccuuuuguauuugaaacaauguguuguaauaaaucaugagac

SEQ ID NO: 104248 - RNA, 46 nt, Mus musculus
agcuccugugggggcuguggcuccugugguggcugcaagggugguu

SEQ ID NO: 104249 - RNA, 46 nt, Mus musculus; identical to SEQ ID NO: 104248

SEQ ID NO: 104250 - RNA, 94 nt, Mus musculus
agcuccugugggggcuguggcuccugugguggcugcaagggaggcuguagcuccugugggggcuguggcuccugugguggcugcaagggugguu

SEQ ID NO: 104251 - RNA, 46 nt, Mus musculus
ccuccugaacagccacagcaggucaugguucuggaguucgguugag

SEQ ID NO: 104252 - RNA, 63 nt, Mus musculus
gccacagcaggucauggcucugguguuugguugaggauggaguagaucagaggagcaggugga

SEQ ID NO: 104253 - RNA, 46 nt, Mus musculus
cuggagccacagcccccacaauuugagccacaucccccacagccag

SEQ ID NO: 104254 - RNA, 53 nt, Mus musculus
agcaggucaugguucugguguuugguugaggauggaguagaucagaggagcag

SEQ ID NO: 104255 - RNA, 46 nt, Mus musculus
ugggagccaaaguugaaauacaaauaaaguuguuuugggccuugau

SEQ ID NO: 104256 - RNA, 44 nt, Mus musculus
ggagcaagaggacagaagcaaaacuaugaaccugggggguuacc

SEQ ID NO: 104257 - RNA, 46 nt, Mus musculus
ccaucacccagcuuggggauggcaccacguucuacugccccuccaa

SEQ ID NO: 104258 - RNA, 46 nt, Mus musculus
cgaggcugccuucaaaggccccuacugguuuaauagcugcugagau

SEQ ID NO: 104259 - RNA, 42 nt, Mus musculus
ccucguguacugggugggccuuggccuccuucagacaggcag

SEQ ID NO: 104260 - RNA, 52 nt, Mus musculus
caguagaggaagccagccagccccaucccuccaccugccccacucacacaua

SEQ ID NO: 104261 - RNA, 46 nt, Mus musculus
ggcuggcuggcuuccucuacuggacucugauccaguucccugacag

SEQ ID NO: 104262 - RNA, 110 nt, Mus musculus
cccccucccagugggccgcucuggauccugggcgaugucuucauugguuccuacuacacuguguuugacagagacaacaauagggucggcuuugccaaugcugucguacu

SEQ ID NO: 104263 - RNA, 46 nt, Mus musculus
gucaaacacaguguaguaggaaccaaugaagacaucgcccaggauc

SEQ ID NO: 104264 - RNA, 56 nt, Mus musculus
agccugcccacggucuaccugaagcuaggaggcaaaaacuaugaacuacacccaga

SEQ ID NO: 104265 - RNA, 46 nt, Mus musculus
uucauaguuuuugccuccuagcuucagguagaccgugggcaggcug

SEQ ID NO: 104266 - RNA, 64 nt, Mus musculus
ccuguggaagaggugaaggagcugcagaaggccaucggggcagugccucuuauccagggugagg

SEQ ID NO: 104267 - RNA, 98 nt, Mus musculus
gcagcuccuucaccucuuccacaggccccaccagaagagaugucccuguguccacaauagccucacagccucccuugcacagggucagcucauugccc

SEQ ID NO: 104268 - RNA, 56 nt, Mus musculus
ugugcaagggaggcugugaggcuauuguggacacagggacaucucuucuggugggg

SEQ ID NO: 104269 - RNA, 61 nt, Mus musculus
ccugccaguaggccuuucgagugacguucagguaggacagcuccccgugguaguacuugga

SEQ ID NO: 104270 - RNA, 45 nt, Mus musculus
gaacuaaugcuugguggcacugacuccaaguacuaccacggggag

SEQ ID NO: 104271 - RNA, 45 nt, Mus musculus
ucaguugugguuuuaucaguucguuucuccuggugcgcuaagagg

SEQ ID NO: 104272 - RNA, 45 nt, Mus musculus
cuguauagaaguuggaaguagagagcugauauaaacacagggaag

SEQ ID NO: 104273 - RNA, 45 nt, Mus musculus
aacauuuacugcuguagguacagaccacucucccuguguucuguu

SEQ ID NO: 104274 - RNA, 46 nt, Mus musculus
caggcaguguggguggaacgugggcgaggugaggagaggcagggcc

SEQ ID NO: 104275 - RNA, 46 nt, Mus musculus
ggucuggguguaaugacacgugccuuuaauuccagcacucaagcag

SEQ ID NO: 104276 - RNA, 46 nt, Mus musculus
ccuagccccuuguugaggcuuacuggccccaugcuagcccaaaguc

SEQ ID NO: 104277 - RNA, 48 nt, Mus musculus
gguguggaugggguguaaguagguggccuacugcucugaguugcugcu

SEQ ID NO: 104278 - RNA, 41 nt, Mus musculus
aggagucacuggggaggacuaagagcccuggguuauacauu

SEQ ID NO: 104279 - RNA, 45 nt, Mus musculus
aagauguucuuguccaccagcuucuguugcaucagguugucaaag

SEQ ID NO: 104280 - RNA, 80 nt, Mus musculus
gcagccuggaaucguauuuguugcagccaaguuugauggcaucuugggcaugggcuacccucauaucucuguuaacaacg

SEQ ID NO: 104281 - RNA, 45 nt, Mus musculus
aaacccuaucuguguuggaacaaguacugugaaggagccaggagg

SEQ ID NO: 104282 - RNA, 46 nt, Mus musculus
guacaacagugacaaguccagcaccuaugugaagaacggcacgucc

SEQ ID NO: 104283 - RNA, 76 nt, Mus musculus
ccccgccgcaguguuucacagucgucuuugauacuggcuccucuaaccuguggguccccuccauucauugcaagau

SEQ ID NO: 104284 - RNA, 55 nt, Mus musculus
ggcucuguggaagaccugauccucaaaggccccaucaccaaguacuccaugcagu

SEQ ID NO: 104285 - RNA, 24 nt, Mus musculus
uugugcaacucaggagggaggagg

SEQ ID NO: 104286 - RNA, 42 nt, Mus musculus
uguguguguguguguguguguguguguagcggggcggccgcu

SEQ ID NO: 104287 - RNA, 45 nt, Mus musculus
cacacacacacacacacacagaggcgagguuggagucagacccac

SEQ ID NO: 104288 - RNA, 45 nt, Mus musculus
uccuggcuaggguucauagccagaauagagaagauggaugcuugg

SEQ ID NO: 104289 - RNA, 39 nt, Mus musculus
ggugaccaggccucagggguucccaaagcugcuauguga

SEQ ID NO: 104290 - RNA, 46 nt, Mus musculus
gaggccuuuaggcugucagcugcuuaagggcaucugcaauuuaaag

SEQ ID NO: 104291 - RNA, 27 nt, Mus musculus
cuugcugauacugcugggugacaccua

SEQ ID NO: 104292 - RNA, 45 nt, Mus musculus
auauaugguugguuaggugaaugugggaugaauaggugaauuggu

SEQ ID NO: 104293 - RNA, 46 nt, Mus musculus
guggaguuagaugaaugaauggauggauugauaaauaaaugggugg

SEQ ID NO: 104294 - RNA, 46 nt, Mus musculus
agaugggugaguagauggguagaugaaugcaugcaugaguggauag

SEQ ID NO: 104295 - RNA, 41 nt, Mus musculus
uggaugaauggaugaagggguauauaugugaauguguuguu

SEQ ID NO: 104296 - RNA, 48 nt, Mus musculus
auauauggguaaguggaugguggauggauggauggauggauggaugga

SEQ ID NO: 104297 - RNA, 46 nt, Mus musculus
aauggauguguuggaggaugggcacaugggaugaaagaauagguag

SEQ ID NO: 104298 - RNA, 42 nt, Mus musculus
aggggcagcugaggcccagaccugggaggagaggaccagggg

SEQ ID NO: 104299 - RNA, 46 nt, Mus musculus
ugggcaagaggcucugaugauggugaggugaccuauggccaggcac

SEQ ID NO: 104300 - RNA, 45 nt, Mus musculus
ggagccagccccagacccccgcccccacgggcuggaggggcugag

SEQ ID NO: 104301 - RNA, 85 nt, Mus musculus
gacagggggaggaggguagggacaaggacacaaagagagggacaaggagaagggacagggcagggcagggaagaagaaaggaaaa

SEQ ID NO: 104302 - RNA, 41 nt, Mus musculus
cucagccuaagauccggcugugcagguugaucucccaagga

SEQ ID NO: 104303 - RNA, 46 nt, Mus musculus
cuauagccaggccuuuggggugagguagaucuggguacagccagca

SEQ ID NO: 104304 - RNA, 45 nt, Mus musculus
gaacgcuuaccauaguuggcaccaguugucaggggaaugcuuaag

SEQ ID NO: 104305 - RNA, 55 nt, Mus musculus
agaagggacugaacccucucaaagcgagagaccagaggagaaacaaacagaggag

SEQ ID NO: 104306 - RNA, 45 nt, Mus musculus
uacagggagcccgauccagaggaugcuguuggggguucuggggag

SEQ ID NO: 104307 - RNA, 41 nt, Mus musculus
aagaggugugucuacuuguucucuggccuucucaaagacag

SEQ ID NO: 104308 - RNA, 25 nt, Mus musculus
cuagaccugaagccagguucccacc

SEQ ID NO: 104309 - RNA, 44 nt, Mus musculus
ccggugaauguagcaacuuugggggacuugggccagggguccug

SEQ ID NO: 104310 - RNA, 41 nt, Mus musculus
accaugcugcacccgugugcgcacggcagccacgggaacau

SEQ ID NO: 104311 - RNA, 46 nt, Mus musculus
gcccaggcuaaggaagugguucuaaggaacagaggacauuucaggg

SEQ ID NO: 104312 - RNA, 45 nt, Mus musculus
ucacuugcagccccuacuaacgucuccaagauaagagguguaaga

SEQ ID NO: 104313 - RNA, 46 nt, Mus musculus
acuacaaguucagugugucagcauggcugagucccagccuggagcc

SEQ ID NO: 104314 - RNA, 46 nt, Mus musculus
gcaccaacccagggcucauuaaaagcaguccagcaaaggcccauuc

SEQ ID NO: 104315 - RNA, 128 nt, Mus musculus
ccccaguacccaccugucguccaucuccgucugagggcaacuggguguggccgugugcuugaggccucgccuuccccucgccuagucuggaagcaguuccaucauaaaguguucaacaugcccuacuu

SEQ ID NO: 104316 - RNA, 42 nt, Mus musculus
agauagcuuugagucucuccguaugaauguauacagcgagug

SEQ ID NO: 104317 - RNA, 50 nt, Mus musculus
agcacccgugacucuguuuccccauuuacccccuuuugaauuugcacuaa

SEQ ID NO: 104318 - RNA, 45 nt, Mus musculus
ucaagcaaggaaggaacaaaaggaaagaaacagaauuacaggaaa

SEQ ID NO: 104319 - RNA, 42 nt, Mus musculus
uggugucaacauuuugaaagagcagacucauagcacccaccc

SEQ ID NO: 104320 - RNA, 27 nt, Mus musculus
uccugaggcagguaguguagugguucu

SEQ ID NO: 104321 - RNA, 42 nt, Mus musculus
agagaacucaccuuucaucuugaggguucaagguagggggag

SEQ ID NO: 104322 - RNA, 45 nt, Mus musculus
uguucugcaaaggacagaauccugagugaguggguggacaauuag

SEQ ID NO: 104323 - RNA, 44 nt, Mus musculus
ggucuccagcagagguggaugugccugccagucacugaaggcga

SEQ ID NO: 104324 - RNA, 42 nt, Mus musculus
uccguggccaaggagggccuugcgggcggcgacggagcagug

SEQ ID NO: 104325 - RNA, 46 nt, Mus musculus
accgcucagucccugggucuggcaugacagacagaacauuuccagg

SEQ ID NO: 104326 - RNA, 86 nt, Mus musculus
agaguggcucuggcaaagucccaaguuugccagagccucaauaacuggagaauggaaaagaagggcagugcagggugucaccagaa

SEQ ID NO: 104327 - RNA, 44 nt, Mus musculus
uucuaagugaauuacggugggugggauguuguggcggcugggga

SEQ ID NO: 104328 - RNA, 48 nt, Mus musculus
cagcaagaacagaagcauucuaggcuggggucaaacagggcaagaugg

SEQ ID NO: 104329 - RNA, 57 nt, Mus musculus
gagccgagacagaaggaggcugggggaccauuggcgaccccagguggaaagagcucu

SEQ ID NO: 104330 - RNA, 125 nt, Mus musculus
uaacuauccugccuuucuaugugccauucugcugcgaggccagccgcuucuucucaccaggcccccucucuaaaccuucguuuagaaggucaguggagcgaggccaagagagaagaaggagacuc

SEQ ID NO: 104331 - RNA, 70 nt, Mus musculus
cggcuggccucgcagcagaauggcacauagaaaggcaggauaguuagcaaaggagacaucgucucggggg

SEQ ID NO: 104332 - RNA, 47 nt, Mus musculus
accccagaccugggcagugaagguauagcuggcagcagugggcaggu

SEQ ID NO: 104333 - RNA, 47 nt, Mus musculus
guccucaccugcccacugcugccagcuauaccuucacugcccagguc

SEQ ID NO: 104334 - RNA, 88 nt, Mus musculus
ugaagcugaagggccugagcuaggguuggagaggaauggggagccagacauucaucccgguuacuuuugguuacaggacguggcggcu

SEQ ID NO: 104335 - RNA, 47 nt, Mus musculus
cacguccuguaaccaaaaguaaccgggaugaaugucuggcuccccau

SEQ ID NO: 104336 - RNA, 97 nt, Mus musculus
gagcaccucggcaucuggagucuggcaggaauguugaaggacugaggggcuagcucaggcagagcaaaggcaucgcaaaggcuggaaaacaucggag

SEQ ID NO: 104337 - RNA, 45 nt, Mus musculus
uucaacauuccugccagacuccagaugccgaggugcuccucggac

SEQ ID NO: 104338 - RNA, 46 nt, Mus musculus
auccaaagcuuggguuuuguuuuuaaccuguuaacgcucgcaaacc

SEQ ID NO: 104339 - RNA, 47 nt, Mus musculus
agcaagugccuaaagaaugggccauuuggaacauuggacagaaacuc

SEQ ID NO: 104340 - RNA, 42 nt, Mus musculus
ggcggggaacagggcggcuggagguuuaccucacccccacuu

SEQ ID NO: 104341 - RNA, 46 nt, Mus musculus
ggaguuggggaagcuaggaggcuuaaagccuacagagccaggagaa

SEQ ID NO: 104342 - RNA, 45 nt, Mus musculus
cuccuagcuuccccaacuccgggccucaccccaccuugcccccag

SEQ ID NO: 104343 - RNA, 42 nt, Mus musculus
uucugaggaguggagggggcguggggcaguguccccucaggu

SEQ ID NO: 104344 - RNA, 42 nt, Mus musculus
accuucucaauuccuuuuauuucucugugggugcguggccag

SEQ ID NO: 104345 - RNA, 41 nt, Mus musculus
ugauuuuuuuuuuuaucucucucuaucgcuuggccugaguu

SEQ ID NO: 104346 - RNA, 63 nt, Mus musculus
uuuuaggggcuccccaggagacucacacugauguggggagugugggaagucuggcgguuggag

SEQ ID NO: 104347 - RNA, 42 nt, Mus musculus
caacuucgauuugaaccacauuccccaaaacaaggcccaucc

SEQ ID NO: 104348 - RNA, 49 nt, Mus musculus
cacccacaggcauuaacacacacauacacauaacacauaugcacacaca

SEQ ID NO: 104349 - RNA, 47 nt, Mus musculus
caugaaaacuggaaauagaacuuaauuggcacaagcccccaguccca

SEQ ID NO: 104350 - RNA, 45 nt, Mus musculus
aaccaaauuugauuggcucuaaacaacccaauugacaccccccaa

SEQ ID NO: 104351 - RNA, 47 nt, Mus musculus
ugcuccacucccuccccagguuucuccuuacccacccccaugccccg

SEQ ID NO: 104352 - RNA, 45 nt, Mus musculus
ccccgcccacgggggagccucuucggagauguccagcaaccauca

SEQ ID NO: 104353 - RNA, 45 nt, Mus musculus
cgaccuggcccuccuggagacauacugugccacccccgccaaguc

SEQ ID NO: 104354 - RNA, 42 nt, Mus musculus
uuucacguucacucugucucucucacuaucucugccccccaa

SEQ ID NO: 104355 - RNA, 67 nt, Mus musculus
acccgcuuacccgccaccuuuccuaagcuccccuccugcccccuccccguuccuccucgccucagac

SEQ ID NO: 104356 - RNA, 46 nt, Mus musculus
ccuccccccucaacaccguccucgguccuucgaaguugcauccucu

SEQ ID NO: 104357 - RNA, 42 nt, Mus musculus
cuccccaccgccuccuccucuaucuaccucaacaccccauuc

SEQ ID NO: 104358 - RNA, 46 nt, Mus musculus
caggguucccacacuggccaaacaucagcgucaguauaggcuucag

SEQ ID NO: 104359 - RNA, 42 nt, Mus musculus
acgcgauuugcaaugcaaacucaccccgccuccagcacccga

SEQ ID NO: 104360 - RNA, 45 nt, Mus musculus
ucuccgcaacgcaguucuccggcccgcaagcgcuccaggcuaucu

SEQ ID NO: 104361 - RNA, 46 nt, Mus musculus
ccauaccgcccgcuccaggaccaauccaagcuccgcaggccgcgca

SEQ ID NO: 104362 - RNA, 28 nt, Mus musculus
cacccagaagacgaaauugaagacgaag

SEQ ID NO: 104363 - RNA, 45 nt, Mus musculus
gguaaucaagagcccucagcuaugaaggggguacucgcacccucc

SEQ ID NO: 104364 - RNA, 46 nt, Mus musculus
cccagggcgggucagggugggguggaggggaauaagacguugggga

SEQ ID NO: 104365 - RNA, 46 nt, Mus musculus
gaaccucaguuauuaaaccucuagccuuagaguccagcugcccuag

SEQ ID NO: 104366 - RNA, 42 nt, Mus musculus
guugcgggugauaaggggacugagguuuccaagcaacuagcu

SEQ ID NO: 104367 - RNA, 45 nt, Mus musculus
auauacugcugucuugagguucaagagauugggcugggccaccca

SEQ ID NO: 104368 - RNA, 42 nt, Mus musculus
gccauucacaccacugccccuagccugucaguugggccccag

SEQ ID NO: 104369 - RNA, 60 nt, Mus musculus
gccuuguccccauccucuauaccccagaccaggcccaggaccccagcuagaaggacagca

SEQ ID NO: 104370 - RNA, 41 nt, Mus musculus
gaaaaaaaagaaauagaaagaaagaaagaaagaaagaaaga

SEQ ID NO: 104371 - RNA, 42 nt, Mus musculus
auccaggagggaugagcccccaaccuccaccagggccugaga

SEQ ID NO: 104372 - RNA, 42 nt, Mus musculus
uuaaagaggagucugagaaacugagaaagaagggguggaggg

SEQ ID NO: 104373 - RNA, 45 nt, Mus musculus
gccuucuucuacccuaggaucauguccgcugcuuaacccucagag

SEQ ID NO: 104374 - RNA, 45 nt, Mus musculus
cuugaauuccugauccuccugccucuaccucucaagugcugggau

SEQ ID NO: 104375 - RNA, 48 nt, Mus musculus
aggcgugauccuagguguagcucugugguugcgucaugauccacagac

SEQ ID NO: 104376 - RNA, 46 nt, Mus musculus
gugccgguuuguuucccaguuccagguacagcaggcugguggucug

SEQ ID NO: 104377 - RNA, 46 nt, Mus musculus
ccaaauacuucuucaguucucaggacaccaggucccucuuccaggg

SEQ ID NO: 104378 - RNA, 46 nt, Mus musculus
gguaaaauggacagcaguggaguccaggcaauaugggcaggggcag

SEQ ID NO: 104379 - RNA, 42 nt, Mus musculus
ggcucaccuaacucuaaggacgggauccugugugugggugga

SEQ ID NO: 104380 - RNA, 43 nt, Mus musculus
ugagguggcugcaggcaucuggggcuucguaaacaaagaccag

SEQ ID NO: 104381 - RNA, 101 nt, Mus musculus
cgccaaggaugugaagcaguucuaugaccaggcccuucagcaagcugugauggaugaugaugccaacaaugccaaggcuguggugaagacuuuccaugaga

SEQ ID NO: 104382 - RNA, 46 nt, Mus musculus
cuugcugaagggccuggucauagaacugcuucacauccuuggcgau

SEQ ID NO: 104383 - RNA, 42 nt, Mus musculus
acaggcuguuccucaguauggugguagucaguguggucagug

SEQ ID NO: 104384 - RNA, 47 nt, Mus musculus
gaggaacagccugugucccucaggcggcaacauacucacccccuuac

SEQ ID NO: 104385 - RNA, 47 nt, Mus musculus
gcugcaggcagcagguccgugugucuuaaauuuguuuugggguggaa

SEQ ID NO: 104386 - RNA, 67 nt, Mus musculus
cagaucuuugagaugauucugagcauggugcugugcuguggcauccggaacagcuccguguacugag

SEQ ID NO: 104387 - RNA, 98 nt, Mus musculus
gcccuuugcauugcaccagaggaucccuggagugaccagaggccaccuugggggacauggccuguguauauaauauuucuguaucacucugcuacacu

SEQ ID NO: 104388 - RNA, 49 nt, Mus musculus
uuuuuuuuuguccugaacuuuuccuguuaccuuuugggagcugacauca

SEQ ID NO: 104389 - RNA, 101 nt, Mus musculus
gauguagggguggagcuggcccuggcuugcagggcccuguacgucugggaccccuggagaguucugccugcugagccaaaccuccucuacagcuacuugcc

SEQ ID NO: 104390 - RNA, 46 nt, Mus musculus
ucacauugcucacaucuuuuuaaucuuuguuccuuuccugccucca

SEQ ID NO: 104391 - RNA, 93 nt, Mus musculus
uucaaugcacuuauucuuucuaacgugucaccuucaacuguaauuaaaucuugaaacagucauuuaauaaaggaggaaaaaaaucaggcaugc

SEQ ID NO: 104392 - RNA, 46 nt, Mus musculus
gaccuuagcuuaccuagugguguggagguccaaguguuguccccag

SEQ ID NO: 104393 - RNA, 42 nt, Mus musculus
cuucuuucaaccaggaccccucuagcuguggggagggaagag

SEQ ID NO: 104394 - RNA, 84 nt, Mus musculus
gugcuaucacucuaccccucaccugcuaguccaagugggaaggugugggcugucugugguagggggaugugugcagccgcucug

SEQ ID NO: 104395 - RNA, 45 nt, Mus musculus
cacagagagagagagagagagagagagagagagagaguuagaacu

SEQ ID NO: 104396 - RNA, 42 nt, Mus musculus
gacaaaccuaaaggucucuccuuauagaugagguggccagau

SEQ ID NO: 104397 - RNA, 41 nt, Mus musculus
caggggugguggcacacgcgccuuuaaucccagcacucggg

SEQ ID NO: 104398 - RNA, 46 nt, Mus musculus
ucuucagaccacagcucugcccacgcacaucaugcuaaccccagac

SEQ ID NO: 104399 - RNA, 44 nt, Mus musculus
gugugcacacacacacacacacacacacagagagagagagagag

SEQ ID NO: 104400 - RNA, 46 nt, Mus musculus
uguauauagauaacacugagaaacaccuaagacccccugugcagaa

SEQ ID NO: 104401 - RNA, 46 nt, Mus musculus
ugagguucagggguaucauuguauccuuagggggcaugccugggaa

SEQ ID NO: 104402 - RNA, 46 nt, Mus musculus
cgaacauggcaaaguuggggacagacaauggcucagcaguuaagau

SEQ ID NO: 104403 - RNA, 45 nt, Mus musculus
uaagccacagagcagcugucuuccuggagagaggcaccaacaguu

SEQ ID NO: 104404 - RNA, 45 nt, Mus musculus
ccuagguuuguugaguugaccauuaaagccaacuauuacaguaac

SEQ ID NO: 104405 - RNA, 46 nt, Mus musculus
auaugucccaugcauccuacuuucaaaaauaaaagcaauaaaagga

SEQ ID NO: 104406 - RNA, 46 nt, Mus musculus
ucgcgcacagagagagagagagagagagagagagagagagagagag

SEQ ID NO: 104407 - RNA, 42 nt, Mus musculus
ugcgugccuuaacugagucuuggaugcauuuucauguguagg

SEQ ID NO: 104408 - RNA, 41 nt, Mus musculus
aggaagaggaggagaggaggaggaagaggaggggaggagga

SEQ ID NO: 104409 - RNA, 45 nt, Mus musculus
auagauggacagauggauggauggauggauggauggauggaugga

SEQ ID NO: 104410 - RNA, 45 nt, Mus musculus
ggauggauagauggaugaauggaagaauggauggauagguagaug

SEQ ID NO: 104411 - RNA, 42 nt, Mus musculus
uauaacaacuguccagagagguuaacacacugagcccaggga

SEQ ID NO: 104412 - RNA, 46 nt, Mus musculus
acguggaagcugaccaacacccuacucaaugauaacuuggccaagg

SEQ ID NO: 104413 - RNA, 46 nt, Mus musculus
gcaauuaaaaacaaugaauuuaugaaauucuuaggcaaguggaugg

SEQ ID NO: 104414 - RNA, 46 nt, Mus musculus
ugagaaaacauuugacaaaguccaacaccccuucaugauaaaaguc

SEQ ID NO: 104415 - RNA, 46 nt, Mus musculus
aaucaggaaccaaacaugugagcaucagcaacagaauacaagagau

SEQ ID NO: 104416 - RNA, 42 nt, Mus musculus
gaacaggcuccagccagagacaacuauaacaacaccagagau

SEQ ID NO: 104417 - RNA, 46 nt, Mus musculus
cagggacaguauccaaaugaacaaauucagaaaugaaaagggagac

SEQ ID NO: 104418 - RNA, 46 nt, Mus musculus
cacaaagggagacaacccuggagauucaaaaccuaggaaagugauc

SEQ ID NO: 104419 - RNA, 46 nt, Mus musculus
ugaaauucuacaggcuaugaggugaugaaguaagauauuccaaguu

SEQ ID NO: 104420 - RNA, 46 nt, Mus musculus
aacuauaauuaaauauaccucacaaucacauaucauuucaugagag

SEQ ID NO: 104421 - RNA, 46 nt, Mus musculus
aagcaucaaggggugaaaaauauucagcaauuaaauuaauuaagau

SEQ ID NO: 104422 - RNA, 46 nt, Mus musculus
aaauauuuuaugaauuauuuuuaaaaguccaaaaaauagugaagau

SEQ ID NO: 104423 - RNA, 46 nt, Mus musculus
aaagaccaauuguaagcaaugcagauccuuauauugacacauagau

SEQ ID NO: 104424 - RNA, 46 nt, Mus musculus
gcauucuccacuuauaguaguggauaacucaucuguacaaagaauc

SEQ ID NO: 104425 - RNA, 46 nt, Mus musculus
gaucauuaaauuucccaauuguagaguuuaaauagaagagacagag

SEQ ID NO: 104426 - RNA, 46 nt, Mus musculus
gguguaacuuuaaccaagugaaagaucugaaugacaagaaggggaa

SEQ ID NO: 104427 - RNA, 45 nt, Mus musculus
cuagaguaguuagacaacaaaagaaucaaggggauauaaauugga

SEQ ID NO: 104428 - RNA, 45 nt, Mus musculus
cccaauauaaugagaaauacuaaaaacccaaagagagccgggaag

SEQ ID NO: 104429 - RNA, 24 nt, Mus musculus
acugcauccaaccaauucuugauu

SEQ ID NO: 104430 - RNA, 46 nt, Mus musculus
acucaaaauauacaauaaucaguuacuuuccuauaugccccaaguu

SEQ ID NO: 104431 - RNA, 46 nt, Mus musculus
ggaccaaaauaaagggaauauauauuuuguuuaaaaggagcaaagu

SEQ ID NO: 104432 - RNA, 46 nt, Mus musculus
cccauaauacaaaacagaaacaaaaagaccacacaaaccccuggaa

SEQ ID NO: 104433 - RNA, 46 nt, Mus musculus
agcacacacaaaacccucuagaauauuaaaaacuuagguagcugau

SEQ ID NO: 104434 - RNA, 46 nt, Mus musculus
uauaacuagacaaaaaauuugacaacauucuuuaccaacucaugau

SEQ ID NO: 104435 - RNA, 46 nt, Mus musculus
cuuaccuggcuucuuguaaaaguaugguagauaauauggcccauga

SEQ ID NO: 104436 - RNA, 46 nt, Mus musculus
cccagaacaugagaaauaugagaaacaaauuaggguaggauaagga

SEQ ID NO: 104437 - RNA, 46 nt, Mus musculus
gccaccacuaccacaacaaaagauaucugcuaacaagccaucagau

SEQ ID NO: 104438 - RNA, 45 nt, Mus musculus
gcuuaguugaaaauguauacaagauccagagaaaucaccccaaaa

SEQ ID NO: 104439 - RNA, 46 nt, Mus musculus
cuauaaaauagcaauaguacaaaccacauccaaucuguccucagaa

SEQ ID NO: 104440 - RNA, 46 nt, Mus musculus
aacuaaggacaacauccaaggacaauagcaaggaaggaaccaaacu

SEQ ID NO: 104441 - RNA, 46 nt, Mus musculus
acaaacaauaguguuuuucgucaaggguuuaccuucagggaaaguu

SEQ ID NO: 104442 - RNA, 46 nt, Mus musculus
uuuagauguagauagauguaagaacuaaaaagucaaaggcacuaag

SEQ ID NO: 104443 - RNA, 45 nt, Mus musculus
caugcaauagauauaaaauuugaaaccauguagaauugaaggaga

SEQ ID NO: 104444 - RNA, 46 nt, Mus musculus
uaauaucuuuguuggaaaucccaaaaaguaggugaaagaaggagca

SEQ ID NO: 104445 - RNA, 45 nt, Mus musculus
gauauaagaaucaguggacuuaaggaucaagucugagcaccaggg

SEQ ID NO: 104446 - RNA, 46 nt, Mus musculus
gaacucagaauuaaugucagugauuaauucugggaagcagucagua

SEQ ID NO: 104447 - RNA, 46 nt, Mus musculus
ugacucugugugcuuugguucaauguugccaagcuagacccgagaa

SEQ ID NO: 104448 - RNA, 46 nt, Mus musculus
ucaaggagaaauuacacaggaagaaaaaaauguuuuuaaucuaauu

SEQ ID NO: 104449 - RNA, 46 nt, Mus musculus
acaaacacccuaagacagucuuguuaagcuuugcagaguagaagac

SEQ ID NO: 104450 - RNA, 86 nt, Mus musculus
uuuaaggacacagaugaauauagcuaugcauguaucuauaggcagagagagggaaagagcacaaaaaggacaggguagaaggagga

SEQ ID NO: 104451 - RNA, 42 nt, Mus musculus
ccuucaauugcuauggggcuuaugugugccuggcccucagca

SEQ ID NO: 104452 - RNA, 46 nt, Mus musculus
ccccugcccuccuccuccuccuaacugauuauaauccugccugauc

SEQ ID NO: 104453 - RNA, 45 nt, Mus musculus
accuucccuuuccuagcuccauuacuccugcauugagcucccaga

SEQ ID NO: 104454 - RNA, 49 nt, Mus musculus
guccuuacucagccaccuccuccagucuguccuuaagaugcccaagaga

SEQ ID NO: 104455 - RNA, 46 nt, Mus musculus
cuuaaguacaaugcaaaucacccuaacgaguaggcccuuuggcuga

SEQ ID NO: 104456 - RNA, 46 nt, Mus musculus
ugcagggcagaacaaaacaauuuuguuuucuaggaaaaugggaggu

SEQ ID NO: 104457 - RNA, 46 nt, Mus musculus
gauaaaacauauaaaaaguuagguaaaucaguaagaacaaauagau

SEQ ID NO: 104458 - RNA, 46 nt, Mus musculus
aauccuaauguuuguggugaauacucugacaaguggauucugagau

SEQ ID NO: 104459 - RNA, 52 nt, Mus musculus
auguaauauaugcaaauaaaacacacaaauuaaaagggaaaagaagcagaau

SEQ ID NO: 104460 - RNA, 46 nt, Mus musculus
gcugaggacaaaguaaggauaaucagaaacaguauaaacucgaggu

SEQ ID NO: 104461 - RNA, 41 nt, Mus musculus
uagacuguguguugugaauacaugauagagcacugaagaga

SEQ ID NO: 104462 - RNA, 24 nt, Mus musculus
uuaucucuaaugaauuaaaaguuc

SEQ ID NO: 104463 - RNA, 46 nt, Mus musculus
gggcagacuucuguucuugucaguuuuucuuacucugcgacauucu

SEQ ID NO: 104464 - RNA, 42 nt, Mus musculus
ucuauugaagccuaaugagcuguccccauaccuucuucacag

SEQ ID NO: 104465 - RNA, 46 nt, Mus musculus
uggccaaaaucccacagggaaaugcuaaaaaauaauguuaacucuc

SEQ ID NO: 104466 - RNA, 46 nt, Mus musculus
acgucuuggcgugagauucugcaggguccaggagaaaguugaagac

SEQ ID NO: 104467 - RNA, 45 nt, Mus musculus
agaacaauucuaggagguugcugcaucccuuuucaugugcuuaga

SEQ ID NO: 104468 - RNA, 46 nt, Mus musculus
cuuggcucucagguagggagaaugcaguagguuuguacuggaaauc

SEQ ID NO: 104469 - RNA, 46 nt, Mus musculus
aggggugggugguucucagacaucagagugaaugaaagugccagau

SEQ ID NO: 104470 - RNA, 46 nt, Mus musculus
gcaacagcacauguggcuucccacaccuaucuacuuccccccauuc

SEQ ID NO: 104471 - RNA, 46 nt, Mus musculus
auggccuaaguguagucaaggccagggcaaggggacaggcccagaa

SEQ ID NO: 104472 - RNA, 42 nt, Mus musculus
ccauauccccagagggaagaauaucuucagugaggcccugag

SEQ ID NO: 104473 - RNA, 46 nt, Mus musculus
ucuagcccugcuggaggugacugacagaaccccauacagaggagau

SEQ ID NO: 104474 - RNA, 44 nt, Mus musculus
cauggggcugggaucauagcaacuuuuaacgagugaaguucaga

SEQ ID NO: 104475 - RNA, 46 nt, Mus musculus
uacuuuacaaaagucuuguuuggacauagcagguguaguuccagau

SEQ ID NO: 104476 - RNA, 42 nt, Mus musculus
aacucucccuuaaaaugcuuaucuagaauuagccuggcucuu

SEQ ID NO: 104477 - RNA, 46 nt, Mus musculus
aauccauuugaaauaaaaaucaauacauugugauaagcagaugauu

SEQ ID NO: 104478 - RNA, 42 nt, Mus musculus
uuuagguauuuauaaaggauaaaacccucaugguggagagau

SEQ ID NO: 104479 - RNA, 45 nt, Mus musculus
uuccaaauccagauaaacaaauaauauaaacauaaagcaugaaau

SEQ ID NO: 104480 - RNA, 54 nt, Mus musculus
cacagaaggacaucucauaaaguuauauaauaacaccagcaggaccaguauagu

SEQ ID NO: 104481 - RNA, 46 nt, Mus musculus
agcugaugccuugugauggaaaaugcauuuaaggagcacagcagac

SEQ ID NO: 104482 - RNA, 45 nt, Mus musculus
augcaaaaacauauacaaccugggugagccucagaggugggcaga

SEQ ID NO: 104483 - RNA, 45 nt, Mus musculus
uaaagucuugaaguaaaaauuccacugguaguggggccacagcga

SEQ ID NO: 104484 - RNA, 46 nt, Mus musculus
gacaaaacagaggagaaugguuuguccuggaacucacagaagagag

SEQ ID NO: 104485 - RNA, 82 nt, Mus musculus
gaugacgccaagagaauguuacaggagcugggcaccuucggcagaucgacuauucccuggcuuugugaccugggccccagac

SEQ ID NO: 104486 - RNA, 46 nt, Mus musculus
uuacuguauuucauuggugccuacauuucuagaacagcaggcagaa

SEQ ID NO: 104487 - RNA, 46 nt, Mus musculus
uagagaaaccuaaguaccaauguggcuuuuguagcagacugaauug

SEQ ID NO: 104488 - RNA, 46 nt, Mus musculus
uuccucuuugcccccccuccccccaccguugggucccuugccugac

SEQ ID NO: 104489 - RNA, 46 nt, Mus musculus
ugcaaagaacagaugcccuuagcccccacuccuccugcccugauuu

SEQ ID NO: 104490 - RNA, 45 nt, Mus musculus
gaauaggcugagaugaaaagcaaagagguugccaacgcuagagac

SEQ ID NO: 104491 - RNA, 46 nt, Mus musculus
gucuuaugaggguuggcaguggacagcaaccagccuagaaugugcc

SEQ ID NO: 104492 - RNA, 50 nt, Mus musculus
uggaaagcuaguuuuugucaguccaggagcuccugaugcugagggaaggg

SEQ ID NO: 104493 - RNA, 87 nt, Mus musculus
ucagcuaggaaagaaggcguuggaagugauugcaggguuucagguuuacacuacuggaagaauuuuuguuugggguggagcaugagu

SEQ ID NO: 104494 - RNA, 82 nt, Mus musculus
ccucccagaggagugacaauacaaaaggagggaauggguagaggggguaagcagccuggcuugguaguggacuaguuggguc

SEQ ID NO: 104495 - RNA, 42 nt, Mus musculus
ccuaguuaggcacuaagaccaagaggacacuguggaggaggg

SEQ ID NO: 104496 - RNA, 46 nt, Mus musculus
uggugcuuguguguuguuauacacugaagggaauauucuuugaggu

SEQ ID NO: 104497 - RNA, 42 nt, Mus musculus
gaauuauguguaggaggcagggaagugauuauugcuccauuu

SEQ ID NO: 104498 - RNA, 46 nt, Mus musculus
ugccaugugauccucccagaagagggucuaacuggagcauaaagau

SEQ ID NO: 104499 - RNA, 46 nt, Mus musculus
uguccagguuaacuaagccuggugaagguacuaaauaagcagaggu

SEQ ID NO: 104500 - RNA, 42 nt, Mus musculus
cuaauuguggcaauuaggcucugcaauagagaaggggcaggg

SEQ ID NO: 104501 - RNA, 59 nt, Mus musculus
ggacugagacccuuguuugcaauuuaaaugugcccuccuuuauggaagaaucccagcuc

SEQ ID NO: 104502 - RNA, 42 nt, Mus musculus
uucuuguuccuugggcguguccacuuaaguuagcugccuguc

SEQ ID NO: 104503 - RNA, 46 nt, Mus musculus
gauucccaguaaguacuguagcuacugaaccaucuccccagcccaa

SEQ ID NO: 104504 - RNA, 73 nt, Mus musculus
agggagcgagacuccccgccugccgcaggugagaggggagaccgacacagacauucuggaaagcuggccagca

SEQ ID NO: 104505 - RNA, 70 nt, Mus musculus
cccuucucaugcaaaguucugcccaugacaaauuacaagauaaccagaacacuaaaaccagggagcagca

SEQ ID NO: 104506 - RNA, 61 nt, Mus musculus
aguaaaagguaguugcuauuuauuaagaaaaacuacagagaauauuuucuaggguagggug

SEQ ID NO: 104507 - RNA, 94 nt, Mus musculus
ucaguggaaccuccuuggaagauguuaaaaaacaaguaaaagagaaacauccugugaacucagaguccuuagaaagggggagcuccaaacugua

SEQ ID NO: 104508 - RNA, 46 nt, Mus musculus
uuuuaagacaguguuuuugggaaaacuguaaauucccauuggagau

SEQ ID NO: 104509 - RNA, 45 nt, Mus musculus
cuuuauaacaauagugauguaaaagauguaagaagugcacucaga

SEQ ID NO: 104510 - RNA, 46 nt, Mus musculus
ccugaaagauaagguuuugcagcaaaagaauuauuuggguauauac

SEQ ID NO: 104511 - RNA, 57 nt, Mus musculus
uuuuccuagccaccuccuaauauaaggaaaagaaauggagauguaagacuuccgugg

SEQ ID NO: 104512 - RNA, 67 nt, Mus musculus
acugaggguuucuaguuauauucaggaccugacugggcaguacaguaagaauuaaaguugguuuuga

SEQ ID NO: 104513 - RNA, 49 nt, Mus musculus
ccugcagagucagaaucaggucugaauugggggaauagcagaacuggga

SEQ ID NO: 104514 - RNA, 46 nt, Mus musculus
cgacucggaauucaggugugggggauugggaacuugggguggaggc

SEQ ID NO: 104515 - RNA, 45 nt, Mus musculus
cguguuguuaugugguagcuguuuuaaugcugagagugaggggcu

SEQ ID NO: 104516 - RNA, 45 nt, Mus musculus
cgugcugaaacgauccacacggaagugacccaauugcugaggcag

SEQ ID NO: 104517 - RNA, 46 nt, Mus musculus
gcuuugcucaacgcgauccuccucaguguuuguccugagccuagac

SEQ ID NO: 104518 - RNA, 46 nt, Mus musculus
cuuuccuugcggcgccccuccgcguggucuaugauggugcauuuug

SEQ ID NO: 104519 - RNA, 46 nt, Mus musculus
auuuuuauuggccaagaggaaacagccugaugucuccagcauuugg

SEQ ID NO: 104520 - RNA, 46 nt, Mus musculus
ucugaguucuaauugugucuuuagucaugacauacccaacaaguag

SEQ ID NO: 104521 - RNA, 45 nt, Mus musculus
ugcagagagagagagagaaaaagagagaaagacagagacagagac

SEQ ID NO: 104522 - RNA, 46 nt, Mus musculus
ugugugugugugugugugugugugugugugugugucacagucaugg

SEQ ID NO: 104523 - RNA, 41 nt, Mus musculus
auaaacauggucugugucucugauaugaaacugcaugccag

SEQ ID NO: 104524 - RNA, 42 nt, Mus musculus
caucucagcuucuccaagccaccgcccuaacccacccuuggc

SEQ ID NO: 104525 - RNA, 42 nt, Mus musculus
cuucuuugaaaaucugucacuagcucuaggcuugccuccagg

SEQ ID NO: 104526 - RNA, 46 nt, Mus musculus
agggaggccaggaagaaacugaagaggcuacaaucauacccagggu

SEQ ID NO: 104527 - RNA, 40 nt, Mus musculus
cuuggaggaggagcaggcagcaggagucagaaagcugagg

SEQ ID NO: 104528 - RNA, 41 nt, Mus musculus
cuaaaugcuaucuugguucauucgugugugugugugugugu

SEQ ID NO: 104529 - RNA, 42 nt, Mus musculus
agagccaccccugccuuagcaaaguggggccagggcccaaag

SEQ ID NO: 104530 - RNA, 31 nt, Mus musculus
agaggugugugugugugugugcgugcgcgcg

SEQ ID NO: 104531 - RNA, 41 nt, Mus musculus
aauuuuauugcucugugagucagaguuugccagcccaugag

SEQ ID NO: 104532 - RNA, 44 nt, Mus musculus
guuacagggcaggguaaguuaaggauucagaauauagccacaua

SEQ ID NO: 104533 - RNA, 46 nt, Mus musculus
caaaugaaucaaauacaauaauagggagagauaagaggcuggugga

SEQ ID NO: 104534 - RNA, 45 nt, Mus musculus
uggccugaaaguccagggaaaccuguggggaacugccggguagaa

SEQ ID NO: 104535 - RNA, 46 nt, Mus musculus
cugcucuuaaacccuagacugcugcuagucagucauauauugaguc

SEQ ID NO: 104536 - RNA, 45 nt, Mus musculus
ucaagauaggcaggguauaaggccauuuucaugcugacuguuauu

SEQ ID NO: 104537 - RNA, 42 nt, Mus musculus
ucuaggcugguccuuuccuagggagggagggauggcucuagg

SEQ ID NO: 104538 - RNA, 42 nt, Mus musculus
agagggaagggauacagagcaguggaggagggagacccagga

SEQ ID NO: 104539 - RNA, 26 nt, Mus musculus
agccucuuccaggcuguggccaccau

SEQ ID NO: 104540 - RNA, 57 nt, Mus musculus
gagauucucacggguagcaggugggagauucugggacugaauaggagaugagugggg

SEQ ID NO: 104541 - RNA, 45 nt, Mus musculus
ggcuuuucauaaaugaauuaaaauagcauacacacagcaccgggg

SEQ ID NO: 104542 - RNA, 42 nt, Mus musculus
gcaggaguggugggcuguggagaaaguaugauagauggagag

SEQ ID NO: 104543 - RNA, 46 nt, Mus musculus
uguugcagcuugacgucaggguugcuguucccacaggggcccaggg

SEQ ID NO: 104544 - RNA, 42 nt, Mus musculus
agggauagguuaucuucaagacuaggugacuaggcaugggac

SEQ ID NO: 104545 - RNA, 42 nt, Mus musculus
ccuccuugggaugccacuuguauccucaggauuggguguuuc

SEQ ID NO: 104546 - RNA, 45 nt, Mus musculus
uguguguauguauguguguguauguguguguauaugugugugugu

SEQ ID NO: 104547 - RNA, 23 nt, Mus musculus
ugguagguagagaggggucacau

SEQ ID NO: 104548 - RNA, 42 nt, Mus musculus
uugucuagcuacucauaaauagaaucucuugcuugcccuggc

SEQ ID NO: 104549 - RNA, 42 nt, Mus musculus
ggaacgggaggagaaggaagaggggagaggaggagggcggag

SEQ ID NO: 104550 - RNA, 42 nt, Mus musculus
ggccuccucacgauuagcauaauguaguauuuucaguuucaa

SEQ ID NO: 104551 - RNA, 42 nt, Mus musculus
cagcacagcucauugcgcaguuaucaaaaacaccaggcccug

SEQ ID NO: 104552 - RNA, 40 nt, Mus musculus
gucaucauccucuauggccuccccagugaaguagaggaca

SEQ ID NO: 104553 - RNA, 43 nt, Mus musculus
gacuucacuuuaacuacagaaacuaaaggagaaaacggaucag

SEQ ID NO: 104554 - RNA, 46 nt, Mus musculus
aacuguuauagacauuugccccaagagaaaccccacuacuguccag

SEQ ID NO: 104555 - RNA, 45 nt, Mus musculus
guauaguucuaaguacaaacucuguguguguguguguaugugugu

SEQ ID NO: 104556 - RNA, 47 nt, Mus musculus
ucacaguaaccauugccucagcaggaguacagccccaacuaacaugc

SEQ ID NO: 104557 - RNA, 46 nt, Mus musculus
acaagguacuaauaagaaaaaaaaaggagagagagagagagagaaa

SEQ ID NO: 104558 - RNA, 47 nt, Mus musculus
guaggugagcuuguacuuuauauucuaagcaccuggaaggcugaggc

SEQ ID NO: 104559 - RNA, 46 nt, Mus musculus
ugaagccauuuugggguaguuucagucacaucuacauuggucauuu

SEQ ID NO: 104560 - RNA, 41 nt, Mus musculus
ucaagcggggugugguggcacacgccuuuaaucccagcacu

SEQ ID NO: 104561 - RNA, 45 nt, Mus musculus
augugccucagaugccacagugucaucauaaacucaugcacccag

SEQ ID NO: 104562 - RNA, 46 nt, Mus musculus
guagcauauaugugcaauacccaaagaggccagaggagggcacuag

SEQ ID NO: 104563 - RNA, 46 nt, Mus musculus
uccgcgccagcguaaaccauaguauucucccaucaugccccacguc

SEQ ID NO: 104564 - RNA, 42 nt, Mus musculus
aagagaaagggugugaacauagagaagacaggaggagcgaug

SEQ ID NO: 104565 - RNA, 46 nt, Mus musculus
gacagugaguaaguagcucaugggguuacaguuuuauuucaguaag

SEQ ID NO: 104566 - RNA, 47 nt, Mus musculus
acaaucaaguuuuuugggccaccccauaaugaugccccaaugucagc

SEQ ID NO: 104567 - RNA, 41 nt, Mus musculus
auucaccucuucagcugcuucuccccucuacuugcgcuaac

SEQ ID NO: 104568 - RNA, 46 nt, Mus musculus
gacaaaacuguuccauuucugguuagggggaaggguuuuauuguag

SEQ ID NO: 104569 - RNA, 46 nt, Mus musculus
gagcucucccuccuaucuacaauaaaacccuucccccuaaccagaa

SEQ ID NO: 104570 - RNA, 51 nt, Mus musculus
ugaccuacagacugauucaggccuuaagaggaggcugguggagagugggag

SEQ ID NO: 104571 - RNA, 43 nt, Mus musculus
gcaggguuaccugggaaugagaagcuaggggaagggaagucag

SEQ ID NO: 104572 - RNA, 46 nt, Mus musculus
ggagcugagauuucugcaucuugaucugcaagcaauaaaaggagac

SEQ ID NO: 104573 - RNA, 46 nt, Mus musculus
cuugauuugaagaccaggcuggccucaaaaucacagagauccagac

SEQ ID NO: 104574 - RNA, 42 nt, Mus musculus
acaugcaugaagcccuaaauucaauccccaguacugccaaaa

SEQ ID NO: 104575 - RNA, 31 nt, Mus musculus
ccagaggucugaggguauuuggugccccagu

SEQ ID NO: 104576 - RNA, 42 nt, Mus musculus
aaagagggggaggaggaagaggaggaggaggaagaggugaag

SEQ ID NO: 104577 - RNA, 42 nt, Mus musculus
gagaagaagaagaaagaggaggaggaggagaaggagaaggag

SEQ ID NO: 104578 - RNA, 42 nt, Mus musculus
ucuuuacuacuaugacccaaaauuuccagaaucgugccgccc

SEQ ID NO: 104579 - RNA, 46 nt, Mus musculus
aaucaauacacaauaaacauacaaacuuuaagcauuuguuggagga

SEQ ID NO: 104580 - RNA, 42 nt, Mus musculus
gcaggcagagcauggcagcacaucuguuuaaucccagcacuc

SEQ ID NO: 104581 - RNA, 44 nt, Mus musculus
agaaccaggguuccugauacagagcacaugugcuguuagcugag

SEQ ID NO: 104582 - RNA, 45 nt, Mus musculus
ugccuuuccugggccuuucgggucucugcuaaguucgucccgaga

SEQ ID NO: 104583 - RNA, 46 nt, Mus musculus
cagauucagcagcagcagcagcagcagcagcagcagccgccgccaa

SEQ ID NO: 104584 - RNA, 46 nt, Mus musculus
acaauuauauugcuuuauaaaacauaauaacaaggagggccaagag

SEQ ID NO: 104585 - RNA, 42 nt, Mus musculus
ggaaagcccaaagaggcugagaaguuuaagguacuggugggg

SEQ ID NO: 104586 - RNA, 42 nt, Mus musculus
guuacauggaaguuuacugagcagugagagcaagccacugac

SEQ ID NO: 104587 - RNA, 45 nt, Mus musculus
ggcaaguggaaauuuccugcuauggugaggagaagcaaaugguua

SEQ ID NO: 104588 - RNA, 46 nt, Mus musculus; identical to SEQ ID NO: 104568

SEQ ID NO: 104589 - RNA, 69 nt, Mus musculus
gccugcagacugacucaggccuuaagaggcggcugguggagagugggagaggaagagaaauaaggacca

SEQ ID NO: 104590 - RNA, 42 nt, Mus musculus
gcaggguuaccugggaaugagaagcuaggggaagggaagcca

SEQ ID NO: 104591 - RNA, 24 nt, Mus musculus
ccugaggguguucaaugccacagu

SEQ ID NO: 104592 - RNA, 41 nt, Mus musculus
ggaagaaggaggaggaggaggaggaggaggaggagaaagcc

SEQ ID NO: 104593 - RNA, 41 nt, Mus musculus
ucucucucucucucucucucucucucucucuguccgugugu

SEQ ID NO: 104594 - RNA, 46 nt, Mus musculus
agccuauaugcacagguaccccacccccuuacacacacgcacgcac

SEQ ID NO: 104595 - RNA, 42 nt, Mus musculus
ccgcacucaggugagaauucgugugcacggaccaggccagag

SEQ ID NO: 104596 - RNA, 94 nt, Mus musculus
guguguuugcacagguuuuagguagauugucgaacagaugugcagauuuagaggcgugugcacaggagagagaucuauguguucugguuugggg

SEQ ID NO: 104597 - RNA, 46 nt, Mus musculus
auaccuggccuccccagguuguggagaguccccugugcccuuaaag

SEQ ID NO: 104598 - RNA, 42 nt, Mus musculus
cuggggaaaguggugggccuagugaauccccacaugccauuu

SEQ ID NO: 104599 - RNA, 45 nt, Mus musculus
cgcuaacaccugcagagccggaucuuucuagcacugagugccaga

SEQ ID NO: 104600 - RNA, 43 nt, Mus musculus
acugcaggaggaucuugugucugccugcugccaaagccccaag

SEQ ID NO: 104601 - RNA, 46 nt, Mus musculus
ccauuuccaggauuuccuaccuuuccaucuuaaaauccaaccugag

SEQ ID NO: 104602 - RNA, 46 nt, Mus musculus
uggacacguggcccuggguuuacugugauuaguguaggcacuagag

SEQ ID NO: 104603 - RNA, 45 nt, Mus musculus
accaagugcauugugugugcugcugagcaggaagcagugugauag

SEQ ID NO: 104604 - RNA, 43 nt, Mus musculus
uuucacugauggugugugugugugugugugugugugugcgcgc

SEQ ID NO: 104605 - RNA, 45 nt, Mus musculus
cuuuuacauuagugcuguacagggacaucugugaacaugcuucga

SEQ ID NO: 104606 - RNA, 52 nt, Mus musculus
cauggcaugugaccaguacagcugcucccugacugcccccgcauuggauaua

SEQ ID NO: 104607 - RNA, 46 nt, Mus musculus
gguagggaaccacaugggaaucaagucacauuuuucucccaggcag

SEQ ID NO: 104608 - RNA, 46 nt, Mus musculus
ucuauaugugcgcuguguguuuacagugcucaguggaggccagaag

SEQ ID NO: 104609 - RNA, 45 nt, Mus musculus
aucuggagaauggagagccuggugucccacaguggcugcugacag

SEQ ID NO: 104610 - RNA, 41 nt, Mus musculus
cccuggcuaacuugauaaacaggguucccaggacuccccaa

SEQ ID NO: 104611 - RNA, 45 nt, Mus musculus
cuccaaagguuuugguggcaaauaugggauugacaaggacaaggu

SEQ ID NO: 104612 - RNA, 45 nt, Mus musculus
uaguggcuucgguggcaaauacggugugcaagcugaccguguaga

SEQ ID NO: 104613 - RNA, 45 nt, Mus musculus
cuguagacugcuucagcgagacgaggcuauuguuuuagggauagg

SEQ ID NO: 104614 - RNA, 24 nt, Mus musculus
cuccccaaacacacaaaagcaagu

SEQ ID NO: 104615 - RNA, 44 nt, Mus musculus
ucugguggcugaccugguggaagaagcccaggaaucugugagca

SEQ ID NO: 104616 - RNA, 41 nt, Mus musculus
gcagugucugguuaucggcaguuacuucuguuuugcguaga

SEQ ID NO: 104617 - RNA, 41 nt, Mus musculus
agcuaagaagugaaugugacuaaggcaucuuaaccccagug

SEQ ID NO: 104618 - RNA, 60 nt, Mus musculus
aggggagacagggagagguggagagagguggagauggagauaaggacggguggagcagga

SEQ ID NO: 104619 - RNA, 60 nt, Mus musculus
agaggaagggagggagagggggaccgggaagaggugggagacaggggagggaggaagagg

SEQ ID NO: 104620 - RNA, 46 nt, Mus musculus
uagaugacugaguguguagguggguggauagauggcaggcugagua

SEQ ID NO: 104621 - RNA, 46 nt, Mus musculus
guagacagagcaugcuggagguggcuggcuagcuggugugucagag

SEQ ID NO: 104622 - RNA, 45 nt, Mus musculus
uuucagaaaagguuguguugugucaaccagggucaaaugguagau

SEQ ID NO: 104623 - RNA, 41 nt, Mus musculus
gccacucuguggcuggcugugucugggcguccccuggcuca

SEQ ID NO: 104624 - RNA, 46 nt, Mus musculus
uaguucuggccaggagacauuuggggggcaagcuaagaucccauga

SEQ ID NO: 104625 - RNA, 46 nt, Mus musculus
uggggucaugggacagagacaagcuccuggggccuaaguggcagcu

SEQ ID NO: 104626 - RNA, 46 nt, Mus musculus
gcugccacuuaggccccaggagcuugucucugucccaugaccccag

SEQ ID NO: 104627 - RNA, 45 nt, Mus musculus
gguuggagagcccaggugaacucugggaaaggucagaggagaaga

SEQ ID NO: 104628 - RNA, 46 nt, Mus musculus
gucaaccuggaccccucauuuacaaacaagauuaggaagccccaaa

SEQ ID NO: 104629 - RNA, 46 nt, Mus musculus
aagacacacacacaauaaauuacuuauaaauaucaugcugccacgu

SEQ ID NO: 104630 - RNA, 44 nt, Mus musculus
auugugugugugucuucuauuuucuuacuuuauuuaugccccag

SEQ ID NO: 104631 - RNA, 45 nt, Mus musculus
aagcaggcaaacaacaggaaauuuuaacuaaaaaaugguugauga

SEQ ID NO: 104632 - RNA, 23 nt, Mus musculus
acuaucgguuuggaggggaggag

SEQ ID NO: 104633 - RNA, 41 nt, Mus musculus
aguguguggugagugaguauauuugaugugugugugugugu

SEQ ID NO: 104634 - RNA, 45 nt, Mus musculus
ugugugucugucaucuuccccaccugguacuggcgucggaggccc

SEQ ID NO: 104635 - RNA, 47 nt, Mus musculus
uugcccucaccagcaugguagggucccuucuuaacagaagcucaaga

SEQ ID NO: 104636 - RNA, 85 nt, Mus musculus
caaggcugcaucagaacaaacccuagagaacggugcuaucuggaacuggguccuguccacuggcauugcacucugcaaacaagcc

SEQ ID NO: 104637 - RNA, 45 nt, Mus musculus
ggaccuucugucaccauggguagcugacugcuuuucugaccccac

SEQ ID NO: 104638 - RNA, 45 nt, Mus musculus
uaaagacaagaaguaacaaauacuagugagaauauuaaggaaggg

SEQ ID NO: 104639 - RNA, 45 nt, Mus musculus
aggagccuugccugugcagcaggacugucucaagacaaacacaaa

SEQ ID NO: 104640 - RNA, 42 nt, Mus musculus
agaucucauuucagccccuuucccacccugcccaggggccag

SEQ ID NO: 104641 - RNA, 41 nt, Mus musculus
uggccagcgcgagugcagccaggccgggcaggggcgagggg

SEQ ID NO: 104642 - RNA, 42 nt, Mus musculus
ggccuagguagagaaacuguugggggaaacucagcgccccuc

SEQ ID NO: 104643 - RNA, 33 nt, Mus musculus
acuccuugauuaggguaugaagacuguuuuagg

SEQ ID NO: 104644 - RNA, 45 nt, Mus musculus
auuuuccaauuggcuuauaagauuguggauuuuaaccccuuggug

SEQ ID NO: 104645 - RNA, 28 nt, Mus musculus
ugcagcuucuggaacaggaccugcagua

SEQ ID NO: 104646 - RNA, 42 nt, Mus musculus
cccggugccacuaguucucgacccaagcaaugacacccccag

SEQ ID NO: 104647 - RNA, 46 nt, Mus musculus
ugggacuuucuccaguuggaagggcugggcuggaacugucgugagu

SEQ ID NO: 104648 - RNA, 28 nt, Mus musculus
agcugggggcuggucucaucccuugauc

SEQ ID NO: 104649 - RNA, 45 nt, Mus musculus
gaaacuacguuucccggcaugcauagcgggagaccuagucucucg

SEQ ID NO: 104650 - RNA, 44 nt, Mus musculus
ggggcagaggugauucaaaagacccuggaggagggcuuggggag

SEQ ID NO: 104651 - RNA, 41 nt, Mus musculus
gccguucguuccgcaggugcugggcgugaugaucggggccg

SEQ ID NO: 104652 - RNA, 76 nt, Mus musculus
gguggacacaucagucuccaccacuucccggccccgcaugaagaagaaacugaagaugcuuaacauugccaagaag

SEQ ID NO: 104653 - RNA, 42 nt, Mus musculus
uccaaaaggagacuccgacccuacaacggaaggagcccccac

SEQ ID NO: 104654 - RNA, 24 nt, Mus musculus
gcuuaguguagagccuagugguag

SEQ ID NO: 104655 - RNA, 45 nt, Mus musculus
agggaagaaacugugaggcuaggaucucacuuucagauguggaag

SEQ ID NO: 104656 - RNA, 29 nt, Mus musculus
uggcaccaugaagacuggauuaagcaggg

SEQ ID NO: 104657 - RNA, 42 nt, Mus musculus
gacugcaccuuccugcggaucuccaaaucccacuucuaugag

SEQ ID NO: 104658 - RNA, 46 nt, Mus musculus
uuuggggacugugggcugagccaucccaggguuaccuaaagcugga

SEQ ID NO: 104659 - RNA, 89 nt, Mus musculus
agccagcaaucugucuacuguagcuauccucccugugugugcugaggugcccaugauggccuuuacucuggaacugcagcaugcucugc

SEQ ID NO: 104660 - RNA, 56 nt, Mus musculus
ggacauucuuucagauugggcuggagaacuaggcuucugaaucgaggagucuugcc

SEQ ID NO: 104661 - RNA, 41 nt, Mus musculus
ucagcauucaagaauuccggcugucagggugguuggcccag

SEQ ID NO: 104662 - RNA, 42 nt, Mus musculus
uagcuggagcaaauguuagagaacacugcuguccgugccuug

SEQ ID NO: 104663 - RNA, 46 nt, Mus musculus
uccaucugggaccgaggcuugggcguggcuugaagaaaggcccuga

SEQ ID NO: 104664 - RNA, 52 nt, Mus musculus
cacagucgggcaggaccagggcuugggcaggaccagagagcugagacagagc

SEQ ID NO: 104665 - RNA, 42 nt, Mus musculus
gucacagcgacuucucccgcuuggcacgaguacucacaggaa

SEQ ID NO: 104666 - RNA, 42 nt, Mus musculus
auucuacagaggcugcucgcauauuggggugcugaaggcauu

SEQ ID NO: 104667 - RNA, 46 nt, Mus musculus
cagauacuugccuucccaaguucuggguucacugacuuggcugaga

SEQ ID NO: 104668 - RNA, 79 nt, Mus musculus
uugcuugacagaguaugaggaagaugcaggaccagacugcucaagagaugaagggggcuccccugagggugccagcccu

SEQ ID NO: 104669 - RNA, 45 nt, Mus musculus
uacaauuaacugcauaaagucaccccuccccaccacaugcuccca

SEQ ID NO: 104670 - RNA, 41 nt, Mus musculus
gugagcuugugggggagcucacacuauuauucccacugcug

SEQ ID NO: 104671 - RNA, 42 nt, Mus musculus
uucgggguggcggaggcucggcagcagcgcagcgcagcgcag

SEQ ID NO: 104672 - RNA, 60 nt, Mus musculus
ggugcugcgggccgcauucgggggagcagguaacccgagggccuuuggggaggggaccgg

SEQ ID NO: 104673 - RNA, 45 nt, Mus musculus
gccgguggccagcgugugugugugugugugugugugugugugugu

SEQ ID NO: 104674 - RNA, 45 nt, Mus musculus
auguggcaauaagucacaacugccagccuuuacggggccaucgag

SEQ ID NO: 104675 - RNA, 41 nt, Mus musculus
gcccacaggccugaaggacuagggccauuccuacugggcaa

SEQ ID NO: 104676 - RNA, 78 nt, Mus musculus
acagagguucauuaaggucuaggccuuacugggaguagaagaacgagacauacaugcacagagacagaaaaagauaga

SEQ ID NO: 104677 - RNA, 70 nt, Mus musculus
gacaguaggaacagauagagauagagagaaggagagggggagagacagaaacagagaugcaaagaugcag

SEQ ID NO: 104678 - RNA, 45 nt, Mus musculus
gagccaaugcuuggugcuuaggguguggaggagaugcugggagag

SEQ ID NO: 104679 - RNA, 45 nt, Mus musculus
caugaagcuccccauggugccuggaggucagagcaagagggugca

SEQ ID NO: 104680 - RNA, 44 nt, Mus musculus
ugugaggaaugcaagcuggugggcucaggagagacagacuugga

SEQ ID NO: 104681 - RNA, 46 nt, Mus musculus
auuuuuguuuguuuaagauuuauuuauuuuauguauaugaguacac

SEQ ID NO: 104682 - RNA, 46 nt, Mus musculus
uacuuggucuacaucugggaugaggggauaaggguaguauugugug

SEQ ID NO: 104683 - RNA, 46 nt, Mus musculus
gcagggaaaggcaggaaaagauggugauuaucaucacuaggaugua

SEQ ID NO: 104684 - RNA, 49 nt, Mus musculus
caagguggggugggacuugucccuuuggaguaagauagcaggaggaagg

SEQ ID NO: 104685 - RNA, 45 nt, Mus musculus
gggucuaggauggaagccagggccaugagguuuaggcagggggaa

SEQ ID NO: 104686 - RNA, 34 nt, Mus musculus
cacugggacaaauaccccuuccccuucucccuuu

SEQ ID NO: 104687 - RNA, 45 nt, Mus musculus
uguucuggcauugcuuguauucaaaugcuaaauucuguaccccaa

SEQ ID NO: 104688 - RNA, 45 nt, Mus musculus
cggcccagguggaacauggcaagugauaucuuggaguuaauauag

SEQ ID NO: 104689 - RNA, 25 nt, Mus musculus
gcuagccagggcuacugggaggccc

SEQ ID NO: 104690 - RNA, 46 nt, Mus musculus
agcuugauggaaaagcuaggcuuggaaaauggagguaggcuugaua

SEQ ID NO: 104691 - RNA, 46 nt, Mus musculus
gaaggguauagcaacuugagggaggagccagguaugaucugcagaa

SEQ ID NO: 104692 - RNA, 46 nt, Mus musculus
cccuuggcucugagcagcuuggagcacaaacuccuuuucuggguag

SEQ ID NO: 104693 - RNA, 42 nt, Mus musculus
gcaucuccugcagccccucuggauggggccucuccugcccag

SEQ ID NO: 104694 - RNA, 46 nt, Mus musculus
aacugauauuuacugauucuacuaguuggccagcaaguccccagag

SEQ ID NO: 104695 - RNA, 42 nt, Mus musculus
cacagaggugugccucaaggaccccaugucuguggcagacag

SEQ ID NO: 104696 - RNA, 45 nt, Mus musculus
uugaugacauuguagagguugucucagacaccagccaacccccag

SEQ ID NO: 104697 - RNA, 43 nt, Mus musculus
gagcucucugcagcgggacaugcagaggcucacagaccagcaa

SEQ ID NO: 104698 - RNA, 49 nt, Mus musculus
cugcccgacgcagcccugggccaggccccagcccaacaccccguagucc

SEQ ID NO: 104699 - RNA, 45 nt, Mus musculus
gagggaagguuaauugguagauggacaaguaguaguugggcauau

SEQ ID NO: 104700 - RNA, 46 nt, Mus musculus
ggaagcccggcggcgcaaacaguggcaggaggcagagaaggagcag

SEQ ID NO: 104701 - RNA, 41 nt, Mus musculus
cugggugaggacccuguuggaggggcccuaugauuguggag

SEQ ID NO: 104702 - RNA, 45 nt, Mus musculus
cucuucacaccaagguuauugggagccucguuggccaccguagau

SEQ ID NO: 104703 - RNA, 45 nt, Mus musculus
guucucgacugccaggcaggcggcuuggagacaugaggccugaug

SEQ ID NO: 104704 - RNA, 42 nt, Mus musculus
ucuccaagccgccugccuggcagucgagaacgugacugggag

SEQ ID NO: 104705 - RNA, 51 nt, Mus musculus
uguuagacuuggcgcuggguuccuuguauagccggggaccuggagggcagu

SEQ ID NO: 104706 - RNA, 46 nt, Mus musculus
ggcaggcaaggugaaugagccccagaagaacagaauucuagaggug

SEQ ID NO: 104707 - RNA, 42 nt, Mus musculus
uucucgauuuccugagggaugguggcaagaagcuggucaggc

SEQ ID NO: 104708 - RNA, 46 nt, Mus musculus
ggaucggguuagaaguuggcugcacaccaaaugcaaccacacggag

SEQ ID NO: 104709 - RNA, 42 nt, Mus musculus
uggucacucccccauaacuacccuucuaauacauccccucuu

SEQ ID NO: 104710 - RNA, 47 nt, Mus musculus
aggccaacccugaggagauccagcugggcgaggaugaggacgaggac

SEQ ID NO: 104711 - RNA, 42 nt, Mus musculus
ggcagaguggcauggaugacaugaagcugcuggaacagagag

SEQ ID NO: 104712 - RNA, 41 nt, Mus musculus
cugcccaggagccaggucagacacuggaggugcagggccaa

SEQ ID NO: 104713 - RNA, 42 nt, Mus musculus
ggcauauuuuggugggcagccaucgagugccugcucaaagag

SEQ ID NO: 104714 - RNA, 86 nt, Mus musculus
uaugaccgaauccuggaccugcgcauagccacgccacagaucguuauuaacuaugccauguuccuggaggagcacaaguacuuuga

SEQ ID NO: 104715 - RNA, 45 nt, Mus musculus
gagaggguugaguuccuagccacugguguggaacaggcugucaag

SEQ ID NO: 104716 - RNA, 45 nt, Mus musculus
cgacagcuacgcccaguuugaggagagcaugauugcagcgaagau

SEQ ID NO: 104717 - RNA, 46 nt, Mus musculus
uucuuacagcaagaggaagagaaacuaagacaguaaucuugucugg

SEQ ID NO: 104718 - RNA, 44 nt, Mus musculus
caggcagugggugggagcgcaggaaacguagauacaggggccag

SEQ ID NO: 104719 - RNA, 47 nt, Mus musculus
gcaacaaaacaaaacuuuaaaauguuauuauacaggccagguaugaa

SEQ ID NO: 104720 - RNA, 45 nt, Mus musculus
gaggaguaucagauugaagcuagccugggcugcauggggauagag

SEQ ID NO: 104721 - RNA, 45 nt, Mus musculus
ccugagaccuucaguuccucaagucccagcucccuuccccaccac

SEQ ID NO: 104722 - RNA, 52 nt, Mus musculus
agacuuccacuucaccaccgcaggaccauccaaagcagauagacugggagac

SEQ ID NO: 104723 - RNA, 54 nt, Mus musculus
gagagagagagagagagagagagagagagagagaggcggagagaagaggagagg

SEQ ID NO: 104724 - RNA, 65 nt, Mus musculus
ccagccaggaaccuguggagagagggggagggggaugaggagagagggagaaaggggucagggag

SEQ ID NO: 104725 - RNA, 46 nt, Mus musculus
ugggcacggagauguagguguuaaugagcggcucccucucgaugau

SEQ ID NO: 104726 - RNA, 45 nt, Mus musculus
ucccuuagucugggacucaggaccaggaucaggaucugggcagau

SEQ ID NO: 104727 - RNA, 45 nt, Mus musculus
uggguucugagacagccugagcuacacaggaaggaagggggagag

SEQ ID NO: 104728 - RNA, 46 nt, Mus musculus
aacaucagcagagaauagaugcaccagagacagcaauaggguagau

SEQ ID NO: 104729 - RNA, 45 nt, Mus musculus
guguguugugucaagggaggaccuucacucuggagggccugaaga

SEQ ID NO: 104730 - RNA, 45 nt, Mus musculus
uaucuuuaaaaaaaaaaagaaagaaagaaagaaagaaagaaagaa

SEQ ID NO: 104731 - RNA, 41 nt, Mus musculus
augguaggacacgaaaacuugggcuaugauacuguggaagu

SEQ ID NO: 104732 - RNA, 42 nt, Mus musculus
acgggaaggcugggguagauggcuaggggagacaucacaggu

SEQ ID NO: 104733 - RNA, 45 nt, Mus musculus
gcugacuggagugaggaccccagaagaagaaaagcuacaucaaga

SEQ ID NO: 104734 - RNA, 46 nt, Mus musculus
acucaccacuguccaaagacuccuuucuugcuuguugggacccaaa

SEQ ID NO: 104735 - RNA, 26 nt, Mus musculus
uccuacacaacaaacaaguucccauu

SEQ ID NO: 104736 - RNA, 46 nt, Mus musculus
cuacaucucuagggcccagacagaagcucgagagguaagagcagac

SEQ ID NO: 104737 - RNA, 51 nt, Mus musculus
ugauacucgucuaucgccuccaacagcuggccccaagagucgaagucggcg

SEQ ID NO: 104738 - RNA, 50 nt, Mus musculus
uaauucugaauuuacagaagaacaaaagaaaaccauaggcaaaauugcga

SEQ ID NO: 104739 - RNA, 46 nt, Mus musculus
gccuaaaaagagguuuaccagcacuaaguguuuugccuucauggag

SEQ ID NO: 104740 - RNA, 46 nt, Mus musculus
cucagaacccaucauagcucuguguagcauaaucacccuucaacag

SEQ ID NO: 104741 - RNA, 45 nt, Mus musculus
ccuauauuaaaaaauagacagucuuuccagauuuuugcauacuaa

SEQ ID NO: 104742 - RNA, 46 nt, Mus musculus
aguuuauuuugaauggacuauuuacuuuugguguaacaaggcauaa

SEQ ID NO: 104743 - RNA, 42 nt, Mus musculus
aacccuacauuaccuggguauuuucacauccugcccccagcu

SEQ ID NO: 104744 - RNA, 43 nt, Mus musculus
uccugggcauuggacucuagaugauaggaagcugugggaugug

SEQ ID NO: 104745 - RNA, 41 nt, Mus musculus
cuuucacagcacaccccucccaucucaacaguuaccaggga

SEQ ID NO: 104746 - RNA, 23 nt, Mus musculus
gcccaugagugcucucccccccc

SEQ ID NO: 104747 - RNA, 46 nt, Mus musculus
auacaggcuacugcugauucuaaacacaggacaaaagucugagugg

SEQ ID NO: 104748 - RNA, 42 nt, Mus musculus
ucaauccccauuucaaaaaacaauuaaagggaaggaugcugg

SEQ ID NO: 104749 - RNA, 62 nt, Mus musculus
cacauacauaugcaaacaaaaaaagagaaggaaaaauggaaggaagaagagaggagggagga

SEQ ID NO: 104750 - RNA, 46 nt, Mus musculus
uaccuaugaccccuauaaucaggacaugaggcaagauaagggccag

SEQ ID NO: 104751 - RNA, 44 nt, Mus musculus
ugggacucuguaucuaccaguuugaauacaugcuacagguaaga

SEQ ID NO: 104752 - RNA, 44 nt, Mus musculus
gguuaucuccagaaagccccugaacuggaaauucuaggccugag

SEQ ID NO: 104753 - RNA, 49 nt, Mus musculus
caugccuggagccuggcaaggugguacacauucaugaucacagugcaug

SEQ ID NO: 104754 - RNA, 47 nt, Mus musculus
uacauggcacauaagaguccuggguucaaugugaaguucuguggaga

SEQ ID NO: 104755 - RNA, 68 nt, Mus musculus
augcaucguccugguuccuuacgcuuuuccuuaccaccuucccccugccuguugccacccgggucuuu

SEQ ID NO: 104756 - RNA, 58 nt, Mus musculus
gcccugcugcaagugaaccagacagaguugaugcaacuggacauggagggcauguccc

SEQ ID NO: 104757 - RNA, 76 nt, Mus musculus
ccccauucacccagcccugccuucaggagguccucuggccagauugucuuaauuuuauuuauuauuaguguuaaug

SEQ ID NO: 104758 - RNA, 46 nt, Mus musculus
caguacuuccagagagucaucccccaccaguuugacagcugcccag

SEQ ID NO: 104759 - RNA, 47 nt, Mus musculus
ggcuggagaaggaguacgcagcuaugaagaguaaagagauggaggag

SEQ ID NO: 104760 - RNA, 46 nt, Mus musculus
ugccuucauguccccgaagcaccccaagucauggggcgaccuccaa

SEQ ID NO: 104761 - RNA, 42 nt, Mus musculus
ggaauagaaaagaaugucacagaccuugagaccacaggccag

SEQ ID NO: 104762 - RNA, 45 nt, Mus musculus
gcuaggcccaaguuccucugugagugguggugcuggauggguuca

SEQ ID NO: 104763 - RNA, 45 nt, Mus musculus
uucgaacagagaaccggcugcucaaacagcggauugagacccuag

SEQ ID NO: 104764 - RNA, 45 nt, Mus musculus
cacgggcacaggaggcugaggagaacuaugucaucaaacgggagu

SEQ ID NO: 104765 - RNA, 62 nt, Mus musculus
agaaacagcucacugccagaugagaacaauguagccaggcugcaggaggaacucaaggcacu

SEQ ID NO: 104766 - RNA, 27 nt, Mus musculus
cuucagaguaaggaggaagugauggcu

SEQ ID NO: 104767 - RNA, 31 nt, Mus musculus
gaaggaccagaucgaggagcucaagacugag

SEQ ID NO: 104768 - RNA, 45 nt, Mus musculus
ugggggcccacucacggggagccuggaggcccgcauugcuggcag

SEQ ID NO: 104769 - RNA, 45 nt, Mus musculus
ccugaagguaacagcacaaaggccaggugccagaaaaugguagga

SEQ ID NO: 104770 - RNA, 42 nt, Mus musculus
acucuagagguaaaaaccaauccagccaagugucacaggaag

SEQ ID NO: 104771 - RNA, 42 nt, Mus musculus
gcucgccuuggcgagcugccccugggggcccuucaggcgagc

SEQ ID NO: 104772 - RNA, 46 nt, Mus musculus
cugguuaagaggagcacuugucaccagaccugaaccucaccaccac

SEQ ID NO: 104773 - RNA, 38 nt, Mus musculus
agagcgagagggagagcgagagggagagcgagagggag

SEQ ID NO: 104774 - RNA, 41 nt, Mus musculus
ccugcuccugguccauagugugugugugugugugugugugu

SEQ ID NO: 104775 - RNA, 46 nt, Mus musculus
acacacacacacacacacacacacacacacacacuauggaccagga

SEQ ID NO: 104776 - RNA, 42 nt, Mus musculus
cuccucuggugugcucguggcacuacugcugugaccugccag

SEQ ID NO: 104777 - RNA, 45 nt, Mus musculus
cuguccgcagacuccaccuucucuggccuugcccucccugcaguc

SEQ ID NO: 104778 - RNA, 31 nt, Mus musculus
ggguuugcggagggggcguggccagggguga

SEQ ID NO: 104779 - RNA, 43 nt, Mus musculus
gcugagggagaaagagggcucuccagaggaggugaggcaggag

SEQ ID NO: 104780 - RNA, 76 nt, Mus musculus
ugaggaaagaggcaagggguauguaacaggaggugccugcaaagaaggcgaggguagagcgcguggcugcauaggg

SEQ ID NO: 104781 - RNA, 45 nt, Mus musculus
caaggccaaaggaggaggcguggccggcuggggugaggaggccag

SEQ ID NO: 104782 - RNA, 46 nt, Mus musculus
ccucuuuguugaccuugccgcccucacuggccuccucaccccagcc

SEQ ID NO: 104783 - RNA, 30 nt, Mus musculus
cagagguggugagauggagguagacgaaga

SEQ ID NO: 104784 - RNA, 51 nt, Mus musculus
gacgugacaagggaagugggcaaauucugcggggaaauuggcggggaagga

SEQ ID NO: 104785 - RNA, 45 nt, Mus musculus
cuccuccacaacuccuuccuuccccgccaauuuccccgcagaauu

SEQ ID NO: 104786 - RNA, 55 nt, Mus musculus
ccugagggagcguugcugaagaagccugguuagggggcauauucuguauaagggg

SEQ ID NO: 104787 - RNA, 48 nt, Mus musculus
gacugugaauggggcacugccugugaagaggcuugugguuggaguagu

SEQ ID NO: 104788 - RNA, 46 nt, Mus musculus
uaccacugauuuuugucuucucccugaagccaacaggcccccagcu

SEQ ID NO: 104789 - RNA, 42 nt, Mus musculus
ugaaucuggaagccggaggcauuucccuguuugccggauugg

SEQ ID NO: 104790 - RNA, 42 nt, Mus musculus
cgccccgcccccgggauuguucggccccgccucacuacagac

SEQ ID NO: 104791 - RNA, 42 nt, Mus musculus
auggaauaagagaugaagagacagaagauggaggccgaggua

SEQ ID NO: 104792 - RNA, 28 nt, Mus musculus
gagagugaaagacagugaggggacuagg

SEQ ID NO: 104793 - RNA, 45 nt, Mus musculus
caaggcccgagugguccauggagaaucaaagcacuugcccaggau

SEQ ID NO: 104794 - RNA, 42 nt, Mus musculus
ucacgcacagaacggaaggaguacucuuuuaggggccuaugg

SEQ ID NO: 104795 - RNA, 46 nt, Mus musculus
ggaagacugcaaagcguuuggaauagagggagucguacuggucaau

SEQ ID NO: 104796 - RNA, 25 nt, Mus musculus
gugcugggggcggggccggggccgg

SEQ ID NO: 104797 - RNA, 44 nt, Mus musculus
uuugcgugcaagauggaguucagggcggggguguggguggaauu

SEQ ID NO: 104798 - RNA, 53 nt, Mus musculus
ggcguuacgacuggguggagugagucuguggguaaggcuguggagaguuguga

SEQ ID NO: 104799 - RNA, 46 nt, Mus musculus
ggcuggauccuccacagagagagaccuugcuguggacuuugagaag

SEQ ID NO: 104800 - RNA, 47 nt, Mus musculus
agaaagccugccugccagggccaggacucaaggagugcacugaaauu

SEQ ID NO: 104801 - RNA, 61 nt, Mus musculus
gaaauaagagauaagagguguccgcauuuccaggaaagaauguagcaugccugguaguugg

SEQ ID NO: 104802 - RNA, 44 nt, Mus musculus
gacaggguagauaaaggcaccaggugggguucuggccuggccag

SEQ ID NO: 104803 - RNA, 46 nt, Mus musculus
gcaucuaggcauaacccugagcacaguccaggcugguggcaccccu

SEQ ID NO: 104804 - RNA, 41 nt, Mus musculus
guagaagacacagccacacaaaccuagguaguuaugcugag

SEQ ID NO: 104805 - RNA, 42 nt, Mus musculus
ucuuacugacuucaucaagacucuacugagacagaggcagag

SEQ ID NO: 104806 - RNA, 42 nt, Mus musculus
cuagauggcuguucaagagacaccagggaguaaucaggcaga

SEQ ID NO: 104807 - RNA, 46 nt, Mus musculus
aguacagucaaagcuggggaaacaaaagggacuaauggagggucaa

SEQ ID NO: 104808 - RNA, 51 nt, Mus musculus
gaaggcugguuacaaugccugaaggccaacugccucccuauguuuuaucaa

SEQ ID NO: 104809 - RNA, 42 nt, Mus musculus
uaaauacccaugcuuagugagacacucacagacagaggccag

SEQ ID NO: 104810 - RNA, 45 nt, Mus musculus
caggugagaggugaccaguuccaggguagcuucgagcauugccgc

SEQ ID NO: 104811 - RNA, 46 nt, Mus musculus
cccaaccguggaacccauaagaaaaaacgagagcgauccgggacug

SEQ ID NO: 104812 - RNA, 45 nt, Mus musculus
cacccgcggacagcggcaccagccaccccgcagagcugccgccgc

SEQ ID NO: 104813 - RNA, 45 nt, Mus musculus
auacuuggacaaaggcauccagggaugugucaauggggaauucag

SEQ ID NO: 104814 - RNA, 46 nt, Mus musculus
agggcguagcuuagugguaaaguacuuuccuagcacauccaaggag

SEQ ID NO: 104815 - RNA, 46 nt, Mus musculus
uggauauaguuuggugguugagugucuucaugacauacacaaagag

SEQ ID NO: 104816 - RNA, 42 nt, Mus musculus
cauaugaucaaaguuaaaaguuaugagaucuuuugccaggag

SEQ ID NO: 104817 - RNA, 46 nt, Mus musculus
cuaggagauagcuuaguggguaagagguuuacuaugcaagcgugag

SEQ ID NO: 104818 - RNA, 45 nt, Mus musculus
caacaucuuggggucuccaaggcaauacagccuuaaccuucacag

SEQ ID NO: 104819 - RNA, 46 nt, Mus musculus
accuccccagaaaugggauuacaaguguguaccaccgugccuguag

SEQ ID NO: 104820 - RNA, 45 nt, Mus musculus
uguuagaauagucauaagauuaugguaauggguuauugaccgaaa

SEQ ID NO: 104821 - RNA, 41 nt, Mus musculus
gcuucacugggcuacagaaacaguaaccauuacuaugaaga

SEQ ID NO: 104822 - RNA, 46 nt, Mus musculus
acacugaagaggugauggucaccuguucugaagaaucacagagaag

SEQ ID NO: 104823 - RNA, 46 nt, Mus musculus
acugucuuaaaaggguguauauguguguaguugucugaggccagaa

SEQ ID NO: 104824 - RNA, 41 nt, Mus musculus
cccacauguguuuucugucaacuccuuugaagcaagcugug

SEQ ID NO: 104825 - RNA, 46 nt, Mus musculus
ccugcuuccuccaacaagguccucccuccuaucagcccugucaguu

SEQ ID NO: 104826 - RNA, 45 nt, Mus musculus
ugaauaugcuuggccuagggaguggcacuauuaggagauguggcc

SEQ ID NO: 104827 - RNA, 45 nt, Mus musculus
aagggaaugguggggcuggaaguuuuagagaaggaaagggaggaa

SEQ ID NO: 104828 - RNA, 41 nt, Mus musculus
ucagcauggggcaaggaggaauggccaggauggaaguggag

SEQ ID NO: 104829 - RNA, 45 nt, Mus musculus
aaacccugucucgaaaaaugagagagagagagagagagagagaga

SEQ ID NO: 104830 - RNA, 46 nt, Mus musculus
cuuacuuugauuccaagcuccacugacucugcaaaguugcccccag

SEQ ID NO: 104831 - RNA, 25 nt, Mus musculus
gcaggaaccugaggguggauuccaa

SEQ ID NO: 104832 - RNA, 47 nt, Mus musculus
agaccuuaugacucgugugugugugugugugugugugugugugugug

SEQ ID NO: 104833 - RNA, 42 nt, Mus musculus
ugaagagggcgaugagaaucuugacagcuaggaaaaggcuag

SEQ ID NO: 104834 - RNA, 42 nt, Mus musculus
ugugugugugugugugcgcgcgugcgugugcgugugugugug

SEQ ID NO: 104835 - RNA, 41 nt, Mus musculus
uugguaggaggggcuuguuaggaagaagacauuaacaggag

SEQ ID NO: 104836 - RNA, 42 nt, Mus musculus
cuggguggugacaugucuuuacucccagcacuugggaggcag

SEQ ID NO: 104837 - RNA, 45 nt, Mus musculus
aaugaccucacugaaauaccauacagaguauuucacagccccuag

SEQ ID NO: 104838 - RNA, 46 nt, Mus musculus
uccauucuuucucucuccccaaucacaugaaaguagaaaguagcca

SEQ ID NO: 104839 - RNA, 53 nt, Mus musculus
auacauaugaauauagaaauaaagauuguuuuaagauaaggaacaagaggaga

SEQ ID NO: 104840 - RNA, 49 nt, Mus musculus
auagcugcuggucuuucccuuaugugcccccagucuacacccucaaaga

SEQ ID NO: 104841 - RNA, 42 nt, Mus musculus
ggagcgaagcgggagcgggaaacggaaucacugucugcagcu

SEQ ID NO: 104842 - RNA, 42 nt, Mus musculus
cuugaguguagugggaacagcauuaaagccgugugggcguga

SEQ ID NO: 104843 - RNA, 86 nt, Mus musculus
uguacugggagggccuaacguugugugggaggggccugaguauaguggaaguguccaaaagaugugaguguccuaaagaugugugu

SEQ ID NO: 104844 - RNA, 58 nt, Mus musculus
uaggaguggccuaaaaaagugugguaggggccugaguguagugggagggccuaaagau

SEQ ID NO: 104845 - RNA, 63 nt, Mus musculus
ugaguauagugggcggguccuaaagaugugugggagugucauaaagacgugugggaggggccu

SEQ ID NO: 104846 - RNA, 56 nt, Mus musculus
gaaguguccuaaaggaguaugggcauggucugagaguagugggugugcccugaagg

SEQ ID NO: 104847 - RNA, 45 nt, Mus musculus
gcaccuuccguggguguuaauccucacggauugcgaccccuagau

SEQ ID NO: 104848 - RNA, 46 nt, Mus musculus
guauauggacaaacaaucaauuaggauacccagugcagaucuauga

SEQ ID NO: 104849 - RNA, 24 nt, Mus musculus
ccgugggcaucauugucaacaggc

SEQ ID NO: 104850 - RNA, 46 nt, Mus musculus
uaugauaaaaagaaacaagaagaauuaaugcaacaguaccuuaaag

SEQ ID NO: 104851 - RNA, 46 nt, Mus musculus
aauguaagguguauuaaaugucacaaguggggccacgugaacacag

SEQ ID NO: 104852 - RNA, 42 nt, Mus musculus
gagaaacaguggguuugcacugaaacgaaauguacuggggag

SEQ ID NO: 104853 - RNA, 46 nt, Mus musculus
aagaaaagaaaaagaaaagugauaagaaaaagaagaaguuacagaa

SEQ ID NO: 104854 - RNA, 46 nt, Mus musculus
ucugguggacuacuccaagaaccuugugaacaaggaggugaugcaa

SEQ ID NO: 104855 - RNA, 47 nt, Mus musculus
cugcacgggacaacauguucagugguuccaagaucaacuacaccgag

SEQ ID NO: 104856 - RNA, 113 nt, Mus musculus
ccaggagaccaucaccaaugcagagacagcaaaggagugguuucucgaagcagccaaggauccaucugcaguugcaaagcacuuugucgcccugucuacgaacacggccaaag

SEQ ID NO: 104857 - RNA, 47 nt, Mus musculus
guuuggaauugacccucaaaacauguucgaguucugggauuggguag

SEQ ID NO: 104858 - RNA, 45 nt, Mus musculus
aguggcugaccacagcgaauagcggccaccuacccaaucccagaa

SEQ ID NO: 104859 - RNA, 49 nt, Mus musculus
gcuguccggggcucacuggauggaccagcacuuccucaagacgccccua

SEQ ID NO: 104860 - RNA, 45 nt, Mus musculus
guagagccagcaggacgggggcauucuucucuaggggcgucuuga

SEQ ID NO: 104861 - RNA, 45 nt, Mus musculus
auaggcagcaaagcgguacauguacuggucauagggcagcaaggc

SEQ ID NO: 104862 - RNA, 49 nt, Mus musculus
ccgcuuugcugccuauuuccagcagggugacauggaguccaacggaaag

SEQ ID NO: 104863 - RNA, 45 nt, Mus musculus
cagggaugagaaagucacaggguaucaucuuggugccuuggugga

SEQ ID NO: 104864 - RNA, 46 nt, Mus musculus
aauggucaacacgcauucuaccagcucauccaccaaggcaccaaga

SEQ ID NO: 104865 - RNA, 45 nt, Mus musculus
ucagucugggccaagaaguuagccaggaggaucuugugauguaga

SEQ ID NO: 104866 - RNA, 48 nt, Mus musculus
aagacuuggagaaacucuugccacacaaggucuuugaaggaaaccgcc

SEQ ID NO: 104867 - RNA, 45 nt, Mus musculus
gaacaaagaucuugugcucauacauggcaaucaaggcccccagaa

SEQ ID NO: 104868 - RNA, 67 nt, Mus musculus
uucauucugggggccuugauugccauguaugagcacaagaucuuuguucagggcaucaugugggaca

SEQ ID NO: 104869 - RNA, 46 nt, Mus musculus
uuaguggaggaaucaugggaggucacagcagagcugcccuccagcu

SEQ ID NO: 104870 - RNA, 50 nt, Mus musculus
ugauuccuccacuaacggacugaucagcuucaucaagcaacagugggaca

SEQ ID NO: 104871 - RNA, 67 nt, Mus musculus
cccuucucaccauaugcacugcaugguccugccccucccugcccagagcgcaccaccgguaguuggc

SEQ ID NO: 104872 - RNA, 75 nt, Mus musculus
cuggacuacaaggcuguugggagaagcuggucuggaacugccauccacccacuacgcacccucccuguugaagca

SEQ ID NO: 104873 - RNA, 42 nt, Mus musculus
gugugugugugugugugugucugugugucuguguggcuguuu

SEQ ID NO: 104874 - RNA, 42 nt, Mus musculus
aagcaggagaagaaggggaagaggaaagaggaggaggaagaa

SEQ ID NO: 104875 - RNA, 45 nt, Mus musculus
caucuucgggcgcacggugagcaagcgcagcagccuggacgagaa

SEQ ID NO: 104876 - RNA, 45 nt, Mus musculus
ugauguguaacgaggguaccagggacagguuuugaaggacugugc

SEQ ID NO: 104877 - RNA, 41 nt, Mus musculus
ggagcuccgggcuagacaguggcgacggcggccccucggcg

SEQ ID NO: 104878 - RNA, 46 nt, Mus musculus
ccaccgucagagcaccugggcuuuauguauugauagugcaucucag

SEQ ID NO: 104879 - RNA, 45 nt, Mus musculus
uauuuuguuaucauaauuauguuauccucuaaggugacuuaugaa

SEQ ID NO: 104880 - RNA, 46 nt, Mus musculus
uaagguagaguggaauuaggugacagacugggaguuuauucaacag

SEQ ID NO: 104881 - RNA, 60 nt, Mus musculus
gaaguauguuaugugcugcagugaauuucucacagcacucgcaaucggauguguauucag

SEQ ID NO: 104882 - RNA, 45 nt, Mus musculus
ugcccacggguauuccccaugaaaacauuuucaucagaaccaaag

SEQ ID NO: 104883 - RNA, 42 nt, Mus musculus
agagugaaucuugugcuuguggauuaccggggguacgggaag

SEQ ID NO: 104884 - RNA, 46 nt, Mus musculus
ggcuguauuuggauucugaagcugugcuagacuaugucaugacgag

SEQ ID NO: 104885 - RNA, 46 nt, Mus musculus
acaauuuaucaaggaagugaucaagagucauucucccgaagacaug

SEQ ID NO: 104886 - RNA, 45 nt, Mus musculus
caaaagguucuugcugguuaagugguauaaucuaaguuguacuca

SEQ ID NO: 104887 - RNA, 73 nt, Mus musculus
aauaacacuggucacaugccaauguauaugguuuccuggguuauaucuauuuuuauguaaacucuauuuuauu

SEQ ID NO: 104888 - RNA, 41 nt, Mus musculus
gcuaucuuagauagcuuucacaugggucacauaucagauag

SEQ ID NO: 104889 - RNA, 46 nt, Mus musculus
agccacagucgugaaaggugaggcccuuugaccuugaggauggggg

SEQ ID NO: 104890 - RNA, 57 nt, Mus musculus
agagaccuuuuccucuaccaccaccgucaccccaguguccccauccuuugcccacaa

SEQ ID NO: 104891 - RNA, 46 nt, Mus musculus
ucucucuccagaggcuucauccccauacccaccacugcccccacgu

SEQ ID NO: 104892 - RNA, 42 nt, Mus musculus
gacuauaugaaccuggacuucaguucucccaagucccccaag

SEQ ID NO: 104893 - RNA, 46 nt, Mus musculus
gagacaaugaccaguaugugcucaugagcuccccugugggccggau

SEQ ID NO: 104894 - RNA, 46 nt, Mus musculus
cuuugcguggaggcagugaaggccucaaaggcaucccgggccacug

SEQ ID NO: 104895 - RNA, 45 nt, Mus musculus
ugcccaugaccccuggggcagcccuuaggagugguggucccaaua

SEQ ID NO: 104896 - RNA, 39 nt, Mus musculus
gccgcagccuccgcggcuggaguacuacgagagcgagaa

SEQ ID NO: 104897 - RNA, 25 nt, Mus musculus
cagcagcagcggcagcaacggcagc

SEQ ID NO: 104898 - RNA, 41 nt, Mus musculus
gauuugggaugugugugugugugugccugccagagagagag

SEQ ID NO: 104899 - RNA, 46 nt, Mus musculus
aggaaaagagaaaagaggguuagcugaggauuacauccgggcucuu

SEQ ID NO: 104900 - RNA, 46 nt, Mus musculus
uucacaggguuaccaacaucaggccacugaaugugaaacaccagcu

SEQ ID NO: 104901 - RNA, 45 nt, Mus musculus
aagucauggcuuuccuguggaauaaagaugguccaaagguuagau

SEQ ID NO: 104902 - RNA, 46 nt, Mus musculus
uaacuaacacaccccgcuucguuggccucuguuugcugaaggagaa

SEQ ID NO: 104903 - RNA, 48 nt, Mus musculus
uuguccucuucucccucccauuguauuuguaacagcaaugaacccuag

SEQ ID NO: 104904 - RNA, 46 nt, Mus musculus
gugcaauuacuacgcaaaugcuuacagcuuuuggcucgccaccaua

SEQ ID NO: 104905 - RNA, 60 nt, Mus musculus
ugcugaagguuccggccaagcccucgcaucccccggguccugucuggaagaguuuagaag

SEQ ID NO: 104906 - RNA, 53 nt, Mus musculus
cggccauggugauggcgguacacagucagaccauucagauuccgcagugcccu

SEQ ID NO: 104907 - RNA, 38 nt, Mus musculus
ucugcaacaucaacaacgucugcaacuucgccuccagg

SEQ ID NO: 104908 - RNA, 45 nt, Mus musculus
augaauggagcacugcacuugcaguauaggcuacucuguuauuca

SEQ ID NO: 104909 - RNA, 45 nt, Mus musculus
ggguaccaagguaguccaugucuuagaagagagaggcuccugagg

SEQ ID NO: 104910 - RNA, 42 nt, Mus musculus
ggcauuggcggcucuccagggaucacagguucaaagggagau

SEQ ID NO: 104911 - RNA, 45 nt, Mus musculus
auggggccgccaggguucccaggaaucaaugggccaaaaggugac

SEQ ID NO: 104912 - RNA, 41 nt, Mus musculus
cuuaccuggcacuccuggucacccuguggaggggcccaaag

SEQ ID NO: 104913 - RNA, 45 nt, Mus musculus
uaaucaguuaaaugcauaugcuugaaugugugugugugugugugu

SEQ ID NO: 104914 - RNA, 49 nt, Mus musculus
aagggagagccgggcagcgauggaaucccggggucggcaggagagaagg

SEQ ID NO: 104915 - RNA, 48 nt, Mus musculus
aaaggccucccaggacuggauggcguuccuggugucaaaggagaagca

SEQ ID NO: 104916 - RNA, 46 nt, Mus musculus
agaccagggccuugcuggcuucccaggcagccccggugagaaggga

SEQ ID NO: 104917 - RNA, 58 nt, Mus musculus
aagggcagucaggucuaccuggcauugggauuccgggacggccuggugacaaggugau

SEQ ID NO: 104918 - RNA, 62 nt, Mus musculus
uggcaucccuggcucacagggugucccuggcucaccuggagagaagggagccaaaggagaga

SEQ ID NO: 104919 - RNA, 46 nt, Mus musculus
ugggacaccaggauccccuggacucccuggacccaaaggaucaguu

SEQ ID NO: 104920 - RNA, 45 nt, Mus musculus
agacccuggaacaccaggaguaccugggaaggaugggcaggcagg

SEQ ID NO: 104921 - RNA, 57 nt, Mus musculus
gggcuuccuggcaugccaggauccauggagcauguggacauggggagcaugaaggga

SEQ ID NO: 104922 - RNA, 42 nt, Mus musculus
agcgucggcugugugauuaguccauguugauuaggcgggugg

SEQ ID NO: 104923 - RNA, 46 nt, Mus musculus
aagggcaaccaggccuuccaggcauucccgguacaccuggagagaa

SEQ ID NO: 104924 - RNA, 46 nt, Mus musculus
gaggcuucccaggaaccccaggacguccaggcaucccgggagagaa

SEQ ID NO: 104925 - RNA, 42 nt, Mus musculus
aaacccaaggacuuuuccgugcagggcuucagggugccucag

SEQ ID NO: 104926 - RNA, 47 nt, Mus musculus
ggagagcgagguccucccggaggaguuggcuucccugguagucgugg

SEQ ID NO: 104927 - RNA, 45 nt, Mus musculus
caaaggugacaaaggagacccagguuuuccgggacagccuggcau

SEQ ID NO: 104928 - RNA, 50 nt, Mus musculus
uccacaagguucaccagggcuuauaggccagccuggagcuaagggagagc

SEQ ID NO: 104929 - RNA, 42 nt, Mus musculus
ugucucagcugccucagcauucacauacagcauccaggaguc

SEQ ID NO: 104930 - RNA, 42 nt, Mus musculus
uugauguggcuggaggcuggaaggcaugggccagagggaugu

SEQ ID NO: 104931 - RNA, 44 nt, Mus musculus
aggacuucguggcccuccagggccacaggggccuccgggagaga

SEQ ID NO: 104932 - RNA, 50 nt, Mus musculus
cuccugggacuccaggacagccagguuugacaggugaaguuggacagaaa

SEQ ID NO: 104933 - RNA, 46 nt, Mus musculus
ggccauucucgugagugggaaggaaguucccaggaugaggcuggcg

SEQ ID NO: 104934 - RNA, 45 nt, Mus musculus
aaaaggugaccagggauuuccaggcgugucauugccaggaccaag

SEQ ID NO: 104935 - RNA, 46 nt, Mus musculus
gagaagggugaagcuggacuuccaggccccccuggaacuguaagua

SEQ ID NO: 104936 - RNA, 44 nt, Mus musculus
ccuggcgauuccggguacccaggucucccaggccggcagggccc

SEQ ID NO: 104937 - RNA, 46 nt, Mus musculus
cucacugcgaagcauuccccucugauccccacacucgcagaaauga

SEQ ID NO: 104938 - RNA, 56 nt, Mus musculus
gucccccgggaguuccuggacaggcacaaguuaaggaaaaaggagacuuugcccca

SEQ ID NO: 104939 - RNA, 46 nt, Mus musculus
ccaacagggccagaugggcuccagcuuccaaggaccaaaaggugac

SEQ ID NO: 104940 - RNA, 42 nt, Mus musculus
ugaacgcaugacccaagguucugugguuugugagccugugag

SEQ ID NO: 104941 - RNA, 46 nt, Mus musculus
cuuugugcagaggagaggugcuguagagucagaggugccucaggau

SEQ ID NO: 104942 - RNA, 45 nt, Mus musculus
gugaaauucucggccacguucccggaacacugcugaaaggggaga

SEQ ID NO: 104943 - RNA, 42 nt, Mus musculus
ccagggagagagagggccgcucgguccuccuggcuugccugg

SEQ ID NO: 104944 - RNA, 46 nt, Mus musculus
uggcccuccaggucccccagguaucccaggaugcaacgguacaaag

SEQ ID NO: 104945 - RNA, 45 nt, Mus musculus
ugcuggagaaccuggacuuccuggcacaaaagggacgaggguaag

SEQ ID NO: 104946 - RNA, 41 nt, Mus musculus
acacccagcccugcuccccagucuuucuccagcccgcagug

SEQ ID NO: 104947 - RNA, 46 nt, Mus musculus
agggaccuggguuguauucugccugggauuuuccguuccuugggug

SEQ ID NO: 104948 - RNA, 45 nt, Mus musculus
acuggcagacagacagacaagacuggcagauagguagauagagau

SEQ ID NO: 104949 - RNA, 45 nt, Mus musculus
uccaugguccugaauaugauauauagcccuaguucagcuuugauu

SEQ ID NO: 104950 - RNA, 47 nt, Mus musculus
cgauugugguggcucuggcuguggaaaaugugacugucauggcguga

SEQ ID NO: 104951 - RNA, 45 nt, Mus musculus
uuaguaaccuccuuucucagugugggcuuuccuauccagguacuu

SEQ ID NO: 104952 - RNA, 45 nt, Mus musculus
uucuguagauaaacguaaucauacauuaaauaagccuuaacaaug

SEQ ID NO: 104953 - RNA, 45 nt, Mus musculus
agagcaggacacucagaauggcagcgucacucuccacaugcacag

SEQ ID NO: 104954 - RNA, 46 nt, Mus musculus
gccuuaagccagcaguccucugugugugugugugugugugugugug

SEQ ID NO: 104955 - RNA, 29 nt, Mus musculus
ugcugcugcugcugcugcugugguugcug

SEQ ID NO: 104956 - RNA, 41 nt, Mus musculus
ggugaacuuuaacucacucaaugugcaagacuugggccagu

SEQ ID NO: 104957 - RNA, 45 nt, Mus musculus
uggcuuagguaaaugccaaaaaguacauacggaauaucugguagg

SEQ ID NO: 104958 - RNA, 24 nt, Mus musculus
ccuuuucacaggaugaauguccug

SEQ ID NO: 104959 - RNA, 45 nt, Mus musculus
acagcacagcauaugaggagacaggaagugcccaugguccgggaa

SEQ ID NO: 104960 - RNA, 24 nt, Mus musculus
aaguuguugcuaugaaaaccauca

SEQ ID NO: 104961 - RNA, 45 nt, Mus musculus
gcuggugguccuggguuuuauaagaaagcaggcugagcaaacugu

SEQ ID NO: 104962 - RNA, 45 nt, Mus musculus
acauccauuacggaaccuccuuuguuauacacugggugcgggaga

SEQ ID NO: 104963 - RNA, 45 nt, Mus musculus
agcaaggcacgccggggccgagaguccggcgcccacggagcagag

SEQ ID NO: 104964 - RNA, 42 nt, Mus musculus
aggggcccaugcgcgcgggcagcagcuccugacccugaggug

SEQ ID NO: 104965 - RNA, 46 nt, Mus musculus
ucucugccugccaccuuugcuaacccgcuuugucucuugccuccag

SEQ ID NO: 104966 - RNA, 33 nt, Mus musculus
cuagcaacugugacagugggacuccuggcucag

SEQ ID NO: 104967 - RNA, 45 nt, Mus musculus
uggcuuuuucacagcuagugccggugacgugacuucuuggugugg

SEQ ID NO: 104968 - RNA, 41 nt, Mus musculus
aguucuccaacaacagcacuuuguuaucugcaucucaccug

SEQ ID NO: 104969 - RNA, 46 nt, Mus musculus
ggugcuuuugugggucccauuggauguuuucagucauggccaugaa

SEQ ID NO: 104970 - RNA, 45 nt, Mus musculus
guaaauacaggacaaugccagggcucagcaaagaagaagcugcug

SEQ ID NO: 104971 - RNA, 45 nt, Mus musculus
guuggggguggggguacagagagaggaauaaggaggaggaagaag

SEQ ID NO: 104972 - RNA, 41 nt, Mus musculus
gaggaggccaccauggaagaggugaaccaugagcagaugga

SEQ ID NO: 104973 - RNA, 42 nt, Mus musculus
cucuuugucuuggccuauggugacacuuggguccugggaggg

SEQ ID NO: 104974 - RNA, 42 nt, Mus musculus
acaccaccagggcugacaaccucggcuaagcauacccaggag

SEQ ID NO: 104975 - RNA, 45 nt, Mus musculus
uuauuuuuggguauuaagagcaucuucaaugcccuggguguagau

SEQ ID NO: 104976 - RNA, 42 nt, Mus musculus
gaggaaacucuuccugucugucuugugggacacggucccugg

SEQ ID NO: 104977 - RNA, 42 nt, Mus musculus
agauacagggagucuuagauauuugcaaaaauaaugguggag

SEQ ID NO: 104978 - RNA, 82 nt, Mus musculus
cuacagggugugaagaaguuggaugugcccugcggagggagagacugcaguggggguugccagugcuacccggagaaaggag

SEQ ID NO: 104979 - RNA, 42 nt, Mus musculus
uguucugugaccacacucaccccuccccucccucacccccac

SEQ ID NO: 104980 - RNA, 41 nt, Mus musculus
ggugcuucgugcguuucaaggacaaagugggguugcccaca

SEQ ID NO: 104981 - RNA, 44 nt, Mus musculus
gggcacagugucccaggggucaguuguguccuuaaggucagguc

SEQ ID NO: 104982 - RNA, 43 nt, Mus musculus
uaagcccuguugaauuauuaaaaaguguaacugcaguggcugg

SEQ ID NO: 104983 - RNA, 34 nt, Mus musculus
auccugucuucacgccugucugugcaugugccag

SEQ ID NO: 104984 - RNA, 45 nt, Mus musculus
gcccugcacacugcaccccacccccgcuccuaaccuuagccccau

SEQ ID NO: 104985 - RNA, 46 nt, Mus musculus
gugagucucagauaagcaccuucuuaaugcuucugggauuuggguu

SEQ ID NO: 104986 - RNA, 42 nt, Mus musculus
uggaagguguagauuaggauugagaaggaagccuaccaucag

SEQ ID NO: 104987 - RNA, 42 nt, Mus musculus
aaacaaguugcuucucuuuuaccugugaugggaagcugccau

SEQ ID NO: 104988 - RNA, 42 nt, Mus musculus
gggggggggggagcagagagagagagagcugagagaggagag

SEQ ID NO: 104989 - RNA, 41 nt, Mus musculus
gggcuggggugagauccgugcuggauuuagaaguugaggga

SEQ ID NO: 104990 - RNA, 41 nt, Mus musculus
ucuacugcccucagaggaagggagagucugcaaggggcugg

SEQ ID NO: 104991 - RNA, 45 nt, Mus musculus
gaugggggugugggaggaaggagauuuucaagggcauagcaggaa

SEQ ID NO: 104992 - RNA, 45 nt, Mus musculus
aucaucaacuguucaaaauugacaagauuggcuagagacaccgaa

SEQ ID NO: 104993 - RNA, 46 nt, Mus musculus
aaacaaccaaaagguagagccacucaaauaugcccacuggcugaug

SEQ ID NO: 104994 - RNA, 81 nt, Mus musculus
ccccaggguugcaaggauucccaggacuacagggccgcaaaggagacaagggcgaacggggaguuccuggaccaacuggac

SEQ ID NO: 104995 - RNA, 47 nt, Mus musculus
cggaccccgaggaaggccaggcuacgaugguugcaacggaaccaggg

SEQ ID NO: 104996 - RNA, 44 nt, Mus musculus
ggcagaaaggcgagccuuacgcacucucuaaagaagaccgugac

SEQ ID NO: 104997 - RNA, 45 nt, Mus musculus
ccucagucugccagggcuugugcaugccaugcuuguuugccacag

SEQ ID NO: 104998 - RNA, 60 nt, Mus musculus
ucccaucugacaucacacuuguugggcccacaacaucaacgauccacccggaucuguaca

SEQ ID NO: 104999 - RNA, 41 nt, Mus musculus
agggugaaaaaggagacgaaggagagcaagggauacccgua

SEQ ID NO: 105000 - RNA, 45 nt, Mus musculus
accgugcauuugauuuaaucacguggauacuuagcauuaucugaa

SEQ ID NO: 105001 - RNA, 44 nt, Mus musculus
caggguuuuccuggccuugauggagaaaaaggagucguaggaca

SEQ ID NO: 105002 - RNA, 46 nt, Mus musculus
agaggccccugaguugaauuccaugagccccaguucuuugccugag

SEQ ID NO: 105003 - RNA, 44 nt, Mus musculus
ggggggaacaaggacccccaggacccucugucuacucgccccau

SEQ ID NO: 105004 - RNA, 45 nt, Mus musculus
cgggagagccuggaaccgcggguccuccaggcccauccgucggag

SEQ ID NO: 105005 - RNA, 85 nt, Mus musculus
ggagaaccaggguccccugcacgcuaucuuggcccaccaggagcagauggaagaccagguccccaaggagucccuggaccugcag

SEQ ID NO: 105006 - RNA, 107 nt, Mus musculus
cguaggcuuccuguuuggccugaaaggaucagaagggagagugggcuacccgggaccuucagguuucccaggaacacgagggcagaaaggauggaaaggugaggacu

SEQ ID NO: 105007 - RNA, 41 nt, Mus musculus
ugccaggacccaaagguuuucccggugucaauggggagcuc

SEQ ID NO: 105008 - RNA, 48 nt, Mus musculus
uuuauuuuaugugguauggguguuuugccuguguuucgauguggagag

SEQ ID NO: 105009 - RNA, 23 nt, Mus musculus
agggcaucagauaagcaccaaac

SEQ ID NO: 105010 - RNA, 53 nt, Mus musculus
ggagcuccuggacccaaaggaauaaagggagacucuagaacaaucaccaccaa

SEQ ID NO: 105011 - RNA, 77 nt, Mus musculus
gggagcgaggacagccagguaucccugguguacacggaaugaaaggugaugacggcgucccaggacgggaugggcug

SEQ ID NO: 105012 - RNA, 45 nt, Mus musculus
ggcccuggguguugucaggagagggucuucccuguucccaggcag

SEQ ID NO: 105013 - RNA, 45 nt, Mus musculus
auguguguguauauauauauauauauauauauauagagagagaga

SEQ ID NO: 105014 - RNA, 46 nt, Mus musculus
aggagacaucgguccuccaggacagggcuuaccagguccgaaaggc

SEQ ID NO: 105015 - RNA, 43 nt, Mus musculus
uucccugguccuccaggucccccaggaaccccaggacagagag

SEQ ID NO: 105016 - RNA, 25 nt, Mus musculus
cagcucucaggcugcagagacaacc

SEQ ID NO: 105017 - RNA, 42 nt, Mus musculus
uuccaggagaagugcuaggggcccagccugggacacgaggag

SEQ ID NO: 105018 - RNA, 46 nt, Mus musculus
aggugguacuaaagugggggagaggacacauaagaaagggggcaac

SEQ ID NO: 105019 - RNA, 45 nt, Mus musculus
cccuggauuuaaaggaauggcagggaugccugguaucccugggca

SEQ ID NO: 105020 - RNA, 42 nt, Mus musculus
cuucgcaggcucucaugugagugacauggccgcagcguccag

SEQ ID NO: 105021 - RNA, 46 nt, Mus musculus
ggacuuaagggaagacagggcuucccagggaccaaaggagaagcug

SEQ ID NO: 105022 - RNA, 45 nt, Mus musculus
accaccuccucucauccugccggggaugaaggacaucaagggaga

SEQ ID NO: 105023 - RNA, 46 nt, Mus musculus
gauucccugggcuaccuggaaggccuggcuucaucaaaggagucaa

SEQ ID NO: 105024 - RNA, 46 nt, Mus musculus
gugacauuggggacacuguggacuuaccagggagcccaggccugaa

SEQ ID NO: 105025 - RNA, 46 nt, Mus musculus
ugcuuccaggucucaagggauucuuuggagagaaaggagcugcggg

SEQ ID NO: 105026 - RNA, 42 nt, Mus musculus
ggcauggcuggagcucagggcucuccuggacuuaaaggacag

SEQ ID NO: 105027 - RNA, 46 nt, Mus musculus
uacagguuuuccugggauccggggcaucagcggauugcacggccug

SEQ ID NO: 105028 - RNA, 46 nt, Mus musculus
augcucauggagacccaggguucccaggccccacuggagacagggg

SEQ ID NO: 105029 - RNA, 51 nt, Mus musculus
aggccaacacacuuccaggccccgugggaguuccagggcagaaaggggagc

SEQ ID NO: 105030 - RNA, 46 nt, Mus musculus
aaacagagacagggacacacagagagaaacagagacagagagagaa

SEQ ID NO: 105031 - RNA, 46 nt, Mus musculus
ccuccaggaccaccugggccaaacgcacuuccuggaaucaaaggag

SEQ ID NO: 105032 - RNA, 42 nt, Mus musculus
cgugggugacagaggccccaaaggacccaaaggcgaccaagg

SEQ ID NO: 105033 - RNA, 42 nt, Mus musculus
gaagauugcuguccagccuggaacgcuggguccccagggcag

SEQ ID NO: 105034 - RNA, 45 nt, Mus musculus
aacaagcucuggaguggguacagccugcuauauuuugagggccag

SEQ ID NO: 105035 - RNA, 46 nt, Mus musculus
ccuggcacgcuucagcaccaugccuuuccuguacugcaauccgggu

SEQ ID NO: 105036 - RNA, 46 nt, Mus musculus
cucugugugcgaggcuccggccguggccauugccgugcacagccag

SEQ ID NO: 105037 - RNA, 46 nt, Mus musculus
cagcacacugcagccggggaugaaggcgguggccagucacuggugu

SEQ ID NO: 105038 - RNA, 46 nt, Mus musculus
cacuacuucgcuaacaaguacagcuucuggcugaccacgaucccag

SEQ ID NO: 105039 - RNA, 50 nt, Mus musculus
cccagcuuggugcuuacucuuaacuuauuaccucagaugcugaucccaaa

SEQ ID NO: 105040 - RNA, 46 nt, Mus musculus
acacccaccuuggagagccaacaccuaggagcaacccacggaccuc

SEQ ID NO: 105041 - RNA, 47 nt, Mus musculus
cggcagcuggcacacagcucauggcucuagccaaacccacagcaaag

SEQ ID NO: 105042 - RNA, 42 nt, Mus musculus
ccugcggcaagcuguucuauggcuuuucuguguaacaccaua

SEQ ID NO: 105043 - RNA, 46 nt, Mus musculus
uguacaccaaaggagggcacccugagggggacauuaaagcaccuaa

SEQ ID NO: 105044 - RNA, 42 nt, Mus musculus
agcgcaggggucaucuccuccgcggcuaugcggaagccggau

SEQ ID NO: 105045 - RNA, 42 nt, Mus musculus
aguuugggauuauagggacggacgcaggacgguccuugaggg

SEQ ID NO: 105046 - RNA, 46 nt, Mus musculus
gccccagcuccuucccauaccuucuccaagcccuucuccagcccag

SEQ ID NO: 105047 - RNA, 26 nt, Mus musculus
ugaucucaguaugcucgcgcgcgcac

SEQ ID NO: 105048 - RNA, 42 nt, Mus musculus
cuggcauucucuggcgcuguguccccuuuagagucccuuugc

SEQ ID NO: 105049 - RNA, 42 nt, Mus musculus
ucccuccauuccguaguaaacacaugaaugcaggcagcaggu

SEQ ID NO: 105050 - RNA, 46 nt, Mus musculus
uuagccaacuggugugcuuuuccuugcggaagacuauuucucuugc

SEQ ID NO: 105051 - RNA, 46 nt, Mus musculus
uugugcugauuccacaaaaaaaauaaaauaaaaaaaauggcagaag

SEQ ID NO: 105052 - RNA, 46 nt, Mus musculus
gcuggagcacaggaaggccaugggagguuagaugugggguguuaga

SEQ ID NO: 105053 - RNA, 46 nt, Mus musculus
uuggcuuccuccucauugcuuuggggaucugagccaggaggccgug

SEQ ID NO: 105054 - RNA, 45 nt, Mus musculus
gaaggucuauuugcaaagagggaaaaucuucugacugggacagca

SEQ ID NO: 105055 - RNA, 40 nt, Mus musculus
gcuggucacugcccaggaaaugcgaaagagagagagagag

SEQ ID NO: 105056 - RNA, 45 nt, Mus musculus
acagagaaacccugucucggaaaaaaaaaaaagaaagaaagaaag

SEQ ID NO: 105057 - RNA, 41 nt, Mus musculus
cuggcuagucugucuaucgugcgucuaucuaugcucccuga

SEQ ID NO: 105058 - RNA, 45 nt, Mus musculus
ugaguagacacauauuuuauagccugaggagggcugcggggagug

SEQ ID NO: 105059 - RNA, 68 nt, Mus musculus
agcgaugccugccugccauacagcaacagguaccucauggucccugagagguagcucaggccugagag

SEQ ID NO: 105060 - RNA, 45 nt, Mus musculus
gguuaggaguggagcacuguaggaggaaccggagauuucugagaa

SEQ ID NO: 105061 - RNA, 46 nt, Mus musculus
gcuggccaugagcacauggagagaggggggaagaggcaagggggua

SEQ ID NO: 105062 - RNA, 44 nt, Mus musculus
augugcuuauaaaaagauaaagagaggagggauauguucuaugg

SEQ ID NO: 105063 - RNA, 42 nt, Mus musculus
acuuguguguguguaugugugugugugugugugugagugcau

SEQ ID NO: 105064 - RNA, 42 nt, Mus musculus
cgagcaaagcacucucagccacuggucgcuccacccagaguc

SEQ ID NO: 105065 - RNA, 42 nt, Mus musculus
caugcugggaucaguuacaagaaugcugcuucugggccagaa

SEQ ID NO: 105066 - RNA, 41 nt, Mus musculus
aucaagagagcuaacgagguaagcagccucccucacauuga

SEQ ID NO: 105067 - RNA, 45 nt, Mus musculus
cuuuugaguagccguguggaugcuaggacucaaacccggguccuc

SEQ ID NO: 105068 - RNA, 42 nt, Mus musculus
accucugcggccaaucuggacgagaaggagguguggugggau

SEQ ID NO: 105069 - RNA, 42 nt, Mus musculus
gagagcggagagagcggggccggcugcgggaagggcgcgcuc

SEQ ID NO: 105070 - RNA, 45 nt, Mus musculus
auuuggcgucgaucucccgcaucagcgagacguuccucugcaggu

SEQ ID NO: 105071 - RNA, 42 nt, Mus musculus
ucgcaacaucccccguggaauguccuuaucauugugcuacag

SEQ ID NO: 105072 - RNA, 45 nt, Mus musculus
ccuccuguguggggucuguuguucuuccaugaauaaugccugcag

SEQ ID NO: 105073 - RNA, 42 nt, Mus musculus
gauaguugaacagaaauuguggcaauuguggcaguggugggu

SEQ ID NO: 105074 - RNA, 45 nt, Mus musculus
ugaaggagcuggacgacuacuaugagaaguucaaacgggagacag

SEQ ID NO: 105075 - RNA, 45 nt, Mus musculus
uggaucuucucaucgccuagcuccuggcugcggaucagggcccuc

SEQ ID NO: 105076 - RNA, 44 nt, Mus musculus
cagccaggagcuaggcgaugagaagauccagaucgugagucaga

SEQ ID NO: 105077 - RNA, 50 nt, Mus musculus
ggcagauaagccgaauaacaagcgguccaggaggcagcgaaacaaugaga

SEQ ID NO: 105078 - RNA, 98 nt, Mus musculus
gucgaauaaucacgaccaugaugacaucaccucaggaacgcccaaggagaagaaagcaaaaaccucaaagaagaagaaacgcuccaaggccaaagcag

SEQ ID NO: 105079 - RNA, 45 nt, Mus musculus
cucaaccauaaaccaaagggcaagugguacugccccaagugccgu

SEQ ID NO: 105080 - RNA, 46 nt, Mus musculus
gcuuuguccauggucuucucgcucuccccacggcacuuggggcagu

SEQ ID NO: 105081 - RNA, 43 nt, Mus musculus
uaaccaugucagcgagugucagacugauuuuggggguugggga

SEQ ID NO: 105082 - RNA, 68 nt, Mus musculus
uuuugucuuaaaaauuuauacaccagcaguuuagacaaagccuuaagcaaauuguauauuauugaucu

SEQ ID NO: 105083 - RNA, 46 nt, Mus musculus
guguagacugcugccugugucuccuuagaaacagcucugcccagga

SEQ ID NO: 105084 - RNA, 42 nt, Mus musculus
uacugaaauccguauguuuauacuucuaaaucugccugagug

SEQ ID NO: 105085 - RNA, 45 nt, Mus musculus
cuccucaacagauccacuccauuuguccuucccuccuugccuaga

SEQ ID NO: 105086 - RNA, 46 nt, Mus musculus
gcuccauucugugcugugaccgugcacugaguggcacuugugggau

SEQ ID NO: 105087 - RNA, 46 nt, Mus musculus
uggauucaguaggaacuucucagcacugccuuugacccaagacuaa

SEQ ID NO: 105088 - RNA, 48 nt, Mus musculus
uguggaauaugucaugucucucugagcagccccaagcauugagaucaa

SEQ ID NO: 105089 - RNA, 46 nt, Mus musculus
auauauaaugggaucugaugcccucuucuugugucugaagacagau

SEQ ID NO: 105090 - RNA, 46 nt, Mus musculus
caccuguguguuuccuaacccacagguaauauugucaagcccagaa

SEQ ID NO: 105091 - RNA, 46 nt, Mus musculus
cugugagggugguggcuguggcuugugaccuacucaagacaaguuu

SEQ ID NO: 105092 - RNA, 42 nt, Mus musculus
agcaaauggagaggcugaagaugaugccgacagaaugcacgu

SEQ ID NO: 105093 - RNA, 45 nt, Mus musculus
uuucucccggguccucuggccugugccuguguguuugccuucagg

SEQ ID NO: 105094 - RNA, 46 nt, Mus musculus
ccauucuuacuagaauuaagaguccauuuguuagagaggggcuggu

SEQ ID NO: 105095 - RNA, 46 nt, Mus musculus
ucucugacccagaaauaauuguagguacuuauuaaaggaauguuaa

SEQ ID NO: 105096 - RNA, 46 nt, Mus musculus
ggaggaagaguuaccuuccuauguuuuguuuuucuuggcugaugug

SEQ ID NO: 105097 - RNA, 47 nt, Mus musculus
uggggugguacacaugucaaauccaaacauggugucguuaggauugg

SEQ ID NO: 105098 - RNA, 71 nt, Mus musculus
uacugcccacucacguuagccugggaacaaaccgaaagagaugccuggaagacucagaaucuuugggagug

SEQ ID NO: 105099 - RNA, 34 nt, Mus musculus
cagcagacauugcacaaacccaggguuuccaaga

SEQ ID NO: 105100 - RNA, 47 nt, Mus musculus
cgagagucuucagacuaacauaagacacagcuuugagaagucaaaca

SEQ ID NO: 105101 - RNA, 46 nt, Mus musculus
ugccaacauguacacuucugaaaacuuuccuauggagggccaaauc

SEQ ID NO: 105102 - RNA, 51 nt, Mus musculus
auagcuggcugaauagguauggaagcucuccucaccauuguuauauccagu

SEQ ID NO: 105103 - RNA, 46 nt, Mus musculus
ugugauuauccuugugaacuaagaaccauuauuuguccccaagucu

SEQ ID NO: 105104 - RNA, 45 nt, Mus musculus
agugaauuucagguucagugggagaccuaucuacaaacacaagau

SEQ ID NO: 105105 - RNA, 46 nt, Mus musculus
ucaagacccgaauuuggauccccagguauugggaagacagggagau

SEQ ID NO: 105106 - RNA, 47 nt, Mus musculus
uacucugcugucugaugaguuccacauguuuauaagaccugugagau

SEQ ID NO: 105107 - RNA, 42 nt, Mus musculus
cccagcaaccacaugguggcucacaacuaccuguaauagaau

SEQ ID NO: 105108 - RNA, 46 nt, Mus musculus
ugagggccucucacccaggaacagaguacauauggugaguggggau

SEQ ID NO: 105109 - RNA, 82 nt, Mus musculus
gcuaauaaagcaagcaaaugugaaaacagaauuuuaaggcccaagcuucuuucauuaaaaauuaguauuuugaugacuaagg

SEQ ID NO: 105110 - RNA, 136 nt, Mus musculus
augugccugccucccauggaacuuuggaacuuaggacgggaaaggugaaagugccuccuuaaacugggagcgcugcauagaggucaguuagcuuggaguauuuuacccaagaucgcagucccaccuguuaaaacac

SEQ ID NO: 105111 - RNA, 51 nt, Mus musculus
ucucucagugcugugaagauaguuggcuggagaacaguuauuuuccuguag

SEQ ID NO: 105112 - RNA, 45 nt, Mus musculus
uguaaguuaaauuuaauacucuguuuaaaguguuugagggcaguu

SEQ ID NO: 105113 - RNA, 46 nt, Mus musculus
cagauauagauucuuuagauuugcaugcuuugcuuacccuaauuua

SEQ ID NO: 105114 - RNA, 43 nt, Mus musculus
guguguauguauuuuuaauccaguguugccugcaaaugugauc

SEQ ID NO: 105115 - RNA, 72 nt, Mus musculus
uuacuaauguauuugcgauacagcauacaaauuuuaaaguaaccagaaucgugaguugaugguuuucagucc

SEQ ID NO: 105116 - RNA, 44 nt, Mus musculus
uagaaacuuuuaaaaauuaguuucuuccuacuguuaccugaaga

SEQ ID NO: 105117 - RNA, 64 nt, Mus musculus
uuauauuaaauuagugcuuuaaaaacaaaccagcaacuuccaaauaccaauuuucucucuguua

SEQ ID NO: 105118 - RNA, 65 nt, Mus musculus
cacugauccuguuagaugucucagcacugugacugaauuggucugaugcucuagcgcuccaagga

SEQ ID NO: 105119 - RNA, 49 nt, Mus musculus
gcaggugugucugcuucaccugagaggcagggcuagcaccgggacaaac

SEQ ID NO: 105120 - RNA, 30 nt, Mus musculus
gccuuugaaauauuuacgguuaacccaaga

SEQ ID NO: 105121 - RNA, 46 nt, Mus musculus
aggcauauugugcuuuuucucugauucagucuuaaugggguggaag

SEQ ID NO: 105122 - RNA, 46 nt, Mus musculus
aauuaaaaacuuuccuucuaugaauagguuaaaagcugccucuuac

SEQ ID NO: 105123 - RNA, 42 nt, Mus musculus
agcagugccuaggucuauaaugaugcuuacaaggccagauau

SEQ ID NO: 105124 - RNA, 46 nt, Mus musculus
gcugagaggugagguuagaacguccuugagugaauucccggaacug

SEQ ID NO: 105125 - RNA, 66 nt, Mus musculus
gcaaaagccuuacaagucuuuauucugaaauuagcaguagaguugugccuguuuggucagguguua

SEQ ID NO: 105126 - RNA, 51 nt, Mus musculus
cacaccgaguaagugucuucaauuauuccucccacuuagagauguagucaa

SEQ ID NO: 105127 - RNA, 45 nt, Mus musculus
aaaaaaaaaaaaacaaacuaaaaaacaacuuuuuccugaccagac

SEQ ID NO: 105128 - RNA, 78 nt, Mus musculus
cucccugcucuauguagcaaguuagaagacauggagaugugcaauagagagacccccaucuccaauaaagggggaaaa

SEQ ID NO: 105129 - RNA, 45 nt, Mus musculus
acucuugaggaugguuccucacugaagcuggggcucagcagugug

SEQ ID NO: 105130 - RNA, 46 nt, Mus musculus
ugcagagaguaugugucugugguauaugaauaaucuauuugcaggu

SEQ ID NO: 105131 - RNA, 46 nt, Mus musculus
uuccuuugaguuagcauuuaugguaguuucguuguuuucagcagau

SEQ ID NO: 105132 - RNA, 90 nt, Mus musculus
gucacagcugauaauagaaggcuguuggcccacagcccagauuucuuggcuccagcucacuacugccuuaacuucauagacacugcagaa

SEQ ID NO: 105133 - RNA, 42 nt, Mus musculus
uaagagcaggagccucacugaaugucucgaccacccgcuaug

SEQ ID NO: 105134 - RNA, 44 nt, Mus musculus
aacacuccacucagcauaaaugcuuuuaaaguuuugcuuaguga

SEQ ID NO: 105135 - RNA, 45 nt, Mus musculus
cuuuuuacaguacaguacaauuuguacaauuuuuacagcccgaug

SEQ ID NO: 105136 - RNA, 48 nt, Mus musculus
auacuugguuucuguucaguuuuaaaggccgagagagagagagagaga

SEQ ID NO: 105137 - RNA, 46 nt, Mus musculus
cuucuucacugccuguggucaguugaagagaaacagacaguccaaa

SEQ ID NO: 105138 - RNA, 51 nt, Mus musculus
cuguuugcuguggacugugcaaguuuugcagccugccgaucaauaaaaacu

SEQ ID NO: 105139 - RNA, 46 nt, Mus musculus
uggauggucuuaagauacggaaccaucuuguuaacccguuccaacu

SEQ ID NO: 105140 - RNA, 99 nt, Mus musculus
acuguuuaccagaauuugaucuaaagcuaaaggagcauuuucacgucuacggagaacgaguuguagacuugacuuuggagaccaguauuguagcggagg

SEQ ID NO: 105141 - RNA, 44 nt, Mus musculus
aauggaaaccgggugcagggcccccugaaggcacggagggaugg

SEQ ID NO: 105142 - RNA, 45 nt, Mus musculus
aggccguuugcgcggaggccgccgggcuucgggaaucguggcgag

SEQ ID NO: 105143 - RNA, 46 nt, Mus musculus
uugaggaggcuacauaguagagauuaaaauuacuguauugcagaaa

SEQ ID NO: 105144 - RNA, 46 nt, Mus musculus
uguuccagucuacauagacaagugugauguuuaauucacugagcag

SEQ ID NO: 105145 - RNA, 47 nt, Mus musculus
gugaaugugugugugugagugugugugugugugagugugugugugua

SEQ ID NO: 105146 - RNA, 46 nt, Mus musculus
gugaguguguguguguguguguguaugugugugagugugugugcau

SEQ ID NO: 105147 - RNA, 46 nt, Mus musculus
guauguguguguuggggagggggguguaugugucugucucugugug

SEQ ID NO: 105148 - RNA, 46 nt, Mus musculus
cagcgagagagagggagagagagagagagagagagagagagcaucc

SEQ ID NO: 105149 - RNA, 42 nt, Mus musculus
ccuucccucccucccuuguuucuuuugugugugugugugugu

SEQ ID NO: 105150 - RNA, 46 nt, Mus musculus
ccagacaugagcauagggucaucuuauggcuacuccacccaugcag

SEQ ID NO: 105151 - RNA, 46 nt, Mus musculus
cuugccuauuuuuucacuguaaauauuuauauacuacugaccagau

SEQ ID NO: 105152 - RNA, 45 nt, Mus musculus
cgcgugcguguguguguguguguguguguguguguguaugugaac

SEQ ID NO: 105153 - RNA, 46 nt, Mus musculus
ucccucuuacuuuccaaaggaaugcuuuccugagcccucaucagau

SEQ ID NO: 105154 - RNA, 46 nt, Mus musculus
ccugccucuacacaaaaccucuuuguacacaucuguugccugacuc

SEQ ID NO: 105155 - RNA, 46 nt, Mus musculus
uugucagaugcaugggcgucacugugugacaucuucccagggagau

SEQ ID NO: 105156 - RNA, 45 nt, Mus musculus
cacugguugguggcagugcaaucuguaugggcagggcaauaagac

SEQ ID NO: 105157 - RNA, 46 nt, Mus musculus
uccucucucaucacauaagugcugugcagaaagggcugccauguaa

SEQ ID NO: 105158 - RNA, 42 nt, Mus musculus
guguguguguguguauguguguaugugugugggggggggcuu

SEQ ID NO: 105159 - RNA, 46 nt, Mus musculus
guguauguguguguauauguguguguguguguguguaugugugugu

SEQ ID NO: 105160 - RNA, 49 nt, Mus musculus
gacgccagcuggguugguugugucagcagccugggcugccagauggaga

SEQ ID NO: 105161 - RNA, 46 nt, Mus musculus
uuguaucagcauaacuugacggggauucuugaaacugcugugagag

SEQ ID NO: 105162 - RNA, 46 nt, Mus musculus
ugagauuuuuaaaauuauuuuaauaaauuuugagcacagggauaag

SEQ ID NO: 105163 - RNA, 44 nt, Mus musculus
aaucugguagaaaaaccaggaagaaguacgcuuagcccauccua

SEQ ID NO: 105164 - RNA, 46 nt, Mus musculus
gagagguuccuguuaaguaaaccgugagaguucccagccugcagau

SEQ ID NO: 105165 - RNA, 45 nt, Mus musculus
cuuuagcaaguacaaggagacauguccuagcagaacugcagagag

SEQ ID NO: 105166 - RNA, 45 nt, Mus musculus
cagccauuggaagguguaaauacgggugaagagaaacuggauagg

SEQ ID NO: 105167 - RNA, 41 nt, Mus musculus
uugauuuucuuuguucacugagccauggcuccagccgggac

SEQ ID NO: 105168 - RNA, 45 nt, Mus musculus
agauacccaguugcuugaaauaugaguaagacuuaagguuugauu

SEQ ID NO: 105169 - RNA, 46 nt, Mus musculus
uaagaagugcauagauacuacacagaguacagcauucacggcagaa

SEQ ID NO: 105170 - RNA, 46 nt, Mus musculus
agagcuagagacagcacacucgaaaguauugccagcagcacagaga

SEQ ID NO: 105171 - RNA, 45 nt, Mus musculus
ugucuuuuuacauggguauguuauaaacuuggucggcuuggugcu

SEQ ID NO: 105172 - RNA, 42 nt, Mus musculus
auuccuucaaguuucaagaguuagaaaaucaagacuguagag

SEQ ID NO: 105173 - RNA, 48 nt, Mus musculus
ugugcccacagggcccaggcccuacaguggggccuuagcacuugaagu

SEQ ID NO: 105174 - RNA, 45 nt, Mus musculus
acagauuguaugacagucucacuucuuucugguugcguggaagac

SEQ ID NO: 105175 - RNA, 46 nt, Mus musculus
gguggugcuccucauagugcggguacccagagcacugugcccagag

SEQ ID NO: 105176 - RNA, 45 nt, Mus musculus
uuacuacuaugccaggccucagacccucccgcucaacuaccagga

SEQ ID NO: 105177 - RNA, 46 nt, Mus musculus
uugucaguugcuuuacugugugguuuuaaguuacccauaaucaagu

SEQ ID NO: 105178 - RNA, 47 nt, Mus musculus
ggaggcuguggccccacaaugauuggaccuaguaccuuugccuacug

SEQ ID NO: 105179 - RNA, 45 nt, Mus musculus
agugacaggcaguccucagcagucugugggagagcuguccugguc

SEQ ID NO: 105180 - RNA, 46 nt, Mus musculus
ugugagaguuaucggcagcaacuucgcuccaacuguugaacgagau

SEQ ID NO: 105181 - RNA, 84 nt, Mus musculus
gugaggagcuugaagauaaagcauaagcuguaguagagaccuaggaguguuggggaugccaggaucacaggguaugugccagga

SEQ ID NO: 105182 - RNA, 46 nt, Mus musculus
cuuacccuuauaacuuugaguguucuuuauuuaucuggguacagug

SEQ ID NO: 105183 - RNA, 46 nt, Mus musculus
ucuuuuuccugauucuguugagcaugacuucuuguuuggccauuca

SEQ ID NO: 105184 - RNA, 46 nt, Mus musculus
ucucuguggauggaguugagggaugcagagucagcuggguucucug

SEQ ID NO: 105185 - RNA, 45 nt, Mus musculus
uuaugucuugugaaucgcuggacuuucagagagauccaggguaaa

SEQ ID NO: 105186 - RNA, 82 nt, Mus musculus
gccauaccaucauuuuucuuuuauugcauuggguccaaaauuuuuaccuuccagaaagaaccucguaguuauagcuagauuu

SEQ ID NO: 105187 - RNA, 45 nt, Mus musculus
gcacguuggugaauacacaguguuugugggugauaaagggcuagg

SEQ ID NO: 105188 - RNA, 44 nt, Mus musculus
aaaugucaaggaucugguuucaugaagcucauuuuggagaugag

SEQ ID NO: 105189 - RNA, 45 nt, Mus musculus
ggguuaaccuguaagugucauaagaagagguuggcucugcuuaga

SEQ ID NO: 105190 - RNA, 92 nt, Mus musculus
caaauguuaucccccuucccaguuuccccucugcaagcccccuauuccaucccuccucucucugcuucuaugagggugcccacccacccacc

SEQ ID NO: 105191 - RNA, 45 nt, Mus musculus
uucauccgcuguggcaucuuccucauccuggagaagcugaagauc

SEQ ID NO: 105192 - RNA, 45 nt, Mus musculus
agccagaagaacaagaggaugauucugaucuaccugcugccagug

SEQ ID NO: 105193 - RNA, 41 nt, Mus musculus
acuguuuuguaguuuaauuauugcaaauaagguugcagaca

SEQ ID NO: 105194 - RNA, 41 nt, Mus musculus
gcuaaaacuguugaauaaaaugaccaucgagcuagggccag

SEQ ID NO: 105195 - RNA, 45 nt, Mus musculus
cgcauccccagaccuccagccucuugacgugacacaagcacccac

SEQ ID NO: 105196 - RNA, 48 nt, Mus musculus
ucucaguacccagauacaucauuguguaugugcaaguauuaauccgga

SEQ ID NO: 105197 - RNA, 46 nt, Mus musculus
caugugcuccaguagguuuauuuuguuuauuuuauuuuuuuaugag

SEQ ID NO: 105198 - RNA, 46 nt, Mus musculus
uuuauuaauguguuuaguauuugaaauagaauuccuuccaucccug

SEQ ID NO: 105199 - RNA, 42 nt, Mus musculus
ugcuucccucuuaucucacuguguagcuugcucugccugcaa

SEQ ID NO: 105200 - RNA, 46 nt, Mus musculus
aacuuuugccauaacugguaguaauagcacacuuauguaaccccag

SEQ ID NO: 105201 - RNA, 45 nt, Mus musculus
ugcugcuguggccgcucuguuaccuuucuuauguguugaguugag

SEQ ID NO: 105202 - RNA, 29 nt, Mus musculus
gaaggggucgaauccccuggaccuagagu

SEQ ID NO: 105203 - RNA, 46 nt, Mus musculus
ugagguaacucaaucacaaaagaacucaaauaauauguacucacug

SEQ ID NO: 105204 - RNA, 45 nt, Mus musculus
auacccgagauauaagauacaauuugcaaaacacacgaaacugaa

SEQ ID NO: 105205 - RNA, 42 nt, Mus musculus
gaaaucagguagagcccccacaguggcggggucagggggagu

SEQ ID NO: 105206 - RNA, 46 nt, Mus musculus
cuuuccaccuacagggacugcguucucuguguuaggaagcuugaag

SEQ ID NO: 105207 - RNA, 82 nt, Mus musculus
cauaacccacaugguagcucacaaccauccauaacuccaguuccaggggauccgaugcccuuucugcucuccuugggcacug

SEQ ID NO: 105208 - RNA, 46 nt, Mus musculus
agaauguccuaauaacaagguucaggccagcagaguauauggcgag

SEQ ID NO: 105209 - RNA, 55 nt, Mus musculus
acaaacaagcacagugugguggcugauaccuaaaaucccaacacgugggacacug

SEQ ID NO: 105210 - RNA, 44 nt, Mus musculus
acagagaaguacacuuugagucuagguggugcacagucugguca

SEQ ID NO: 105211 - RNA, 46 nt, Mus musculus
cuuuuuuacuguuggacauccuggucccaucagucaccagcuguag

SEQ ID NO: 105212 - RNA, 46 nt, Mus musculus
aacagaaagcaguccuacagagaggagagaauggaagucaaagcaa

SEQ ID NO: 105213 - RNA, 46 nt, Mus musculus
uagacagcguuuuauuucuaaagaagauuaacacaugcuggcaaga

SEQ ID NO: 105214 - RNA, 64 nt, Mus musculus
cuguuuaggaaccacaucaucagcgacaggauggugcagaguaagaccauugaugggauccugc

SEQ ID NO: 105215 - RNA, 77 nt, Mus musculus
ugcugauugggcgugaacgaaguggagaggcuguggacaggagucugcuucggaguuugcuaagcaugcucucagau

SEQ ID NO: 105216 - RNA, 73 nt, Mus musculus
uguaaguggggacuaguacccagaaguaugaguggacaucccgauugucuaguccuuaaggagagugauggag

SEQ ID NO: 105217 - RNA, 43 nt, Mus musculus
uuggaagagacuaacugucuauacgcugcugaaggccagaggc

SEQ ID NO: 105218 - RNA, 51 nt, Mus musculus
uaccuuaaccaugugagcaaacgucuagaagaggaagcagaccgagugauc

SEQ ID NO: 105219 - RNA, 46 nt, Mus musculus
uccugugcaggguguggugauucgagugugagcacaggugccugag

SEQ ID NO: 105220 - RNA, 45 nt, Mus musculus
uguggagaaacagcuguuaggagaacauuugacagcaauucuaca

SEQ ID NO: 105221 - RNA, 51 nt, Mus musculus
ccuagagcaccugcuggaugagaacagggugcccgaccucacccagaugua

SEQ ID NO: 105222 - RNA, 46 nt, Mus musculus
ucuagcaguccggucugccuccugcugugugucccucacuugccag

SEQ ID NO: 105223 - RNA, 47 nt, Mus musculus
aguccuucgagacguucaucaacaagagaccaaacaagccugcagag

SEQ ID NO: 105224 - RNA, 42 nt, Mus musculus
ugcucuuccagccaagcacguggacucaaaguuacgggccgg

SEQ ID NO: 105225 - RNA, 45 nt, Mus musculus
gucuuugaagcguuuuauaagaaagacuuagcaaaaaggcugcug

SEQ ID NO: 105226 - RNA, 46 nt, Mus musculus
gcaugcgacacuguguuguaaaaauuauacgauuuccaggccaggg

SEQ ID NO: 105227 - RNA, 45 nt, Mus musculus
gaggugggcaggaguccuuccuaagacauuuucacagauuaccag

SEQ ID NO: 105228 - RNA, 42 nt, Mus musculus
cuuccagacgcuggugcugcucauguucaacgaaggggaugg

SEQ ID NO: 105229 - RNA, 46 nt, Mus musculus
gagaagcuguaggcugugacacauccauggcuucucuccuggcuga

SEQ ID NO: 105230 - RNA, 66 nt, Mus musculus
aucuucaaugcagacuucaaacacaaguuguucagaauaaagaucaaucaaauccagaugaaggag

SEQ ID NO: 105231 - RNA, 45 nt, Mus musculus
agguuagcacuacagagagaguauuccaggauagacaguaccaga

SEQ ID NO: 105232 - RNA, 44 nt, Mus musculus
gcagaccuccgugaauuuggguccagccugguguacauagggag

SEQ ID NO: 105233 - RNA, 46 nt, Mus musculus
auggacaauagcucagacucugagcaggagcagcacgagggcccug

SEQ ID NO: 105234 - RNA, 28 nt, Mus musculus
acccagaggaggaaggagggaaccaagu

SEQ ID NO: 105235 - RNA, 87 nt, Mus musculus
aaggauugagucacuuauagacagagacuauauggaacgagacaaagacaguccaaaucaguaccacuacguggcaugacgcaccag

SEQ ID NO: 105236 - RNA, 46 nt, Mus musculus
gccgaggccggaggacggcgguugcgcgggcggcgaggccggcggg

SEQ ID NO: 105237 - RNA, 35 nt, Mus musculus
uuuguccccuaaucaguuaaagugccuacagcaca

SEQ ID NO: 105238 - RNA, 46 nt, Mus musculus
uucagcugggcauggcaaugcacaccuuuacucccagcacucagga

SEQ ID NO: 105239 - RNA, 46 nt, Mus musculus
gaaccauucgcagucucguagguggucagaaaggaggcagagaagc

SEQ ID NO: 105240 - RNA, 46 nt, Mus musculus
gugcuucccacucauugugugcacaccuuaauuccaaugugcagga

SEQ ID NO: 105241 - RNA, 46 nt, Mus musculus
aagaaaaaugucaugacaggugagcuguaaaucucaggacugagag

SEQ ID NO: 105242 - RNA, 46 nt, Mus musculus
uguugaugucugccuugaugucaguuguggaauccaugguguagau

SEQ ID NO: 105243 - RNA, 45 nt, Mus musculus
cucaagaagcccgaaggaaagcuaauaaggacagguagcccaggu

SEQ ID NO: 105244 - RNA, 46 nt, Mus musculus
ccuagggcaucaggaagagucauauucaagcgcacuccuugcagga

SEQ ID NO: 105245 - RNA, 25 nt, Mus musculus
cuugaugacaagguuacguuccagc

SEQ ID NO: 105246 - RNA, 46 nt, Mus musculus
uaggaagucugaccucacaagaccacaccaugucaccuguguccag

SEQ ID NO: 105247 - RNA, 46 nt, Mus musculus
cccaugagcugucuacagaguggcaauacucaugcggcugcuguag

SEQ ID NO: 105248 - RNA, 46 nt, Mus musculus
aaaacucaugucuguuuuucuuccaagccuguuuuacugccuggag

SEQ ID NO: 105249 - RNA, 23 nt, Mus musculus
ucacaaguauccaugucugggga

SEQ ID NO: 105250 - RNA, 46 nt, Mus musculus
uucuugcaucgcgcguccccacaggugucugagucugugcauucau

SEQ ID NO: 105251 - RNA, 46 nt, Mus musculus
acacaguggggaggucccaucugcuucuguguucuugggaguagag

SEQ ID NO: 105252 - RNA, 44 nt, Mus musculus
caggcacauuggaagcuuccugguuuguuguggcagaccuggcu

SEQ ID NO: 105253 - RNA, 41 nt, Mus musculus
gacaguaacaauaaaaagggaaaccagauaacagagaggcu

SEQ ID NO: 105254 - RNA, 45 nt, Mus musculus
uacccaucucgucccccugcaggguugaccacacagauaagcaga

SEQ ID NO: 105255 - RNA, 45 nt, Mus musculus
cuuugcugcacaccuccuccacgcacucccguuccagguggcccu

SEQ ID NO: 105256 - RNA, 49 nt, Mus musculus
gcaggagcagcagaagcgcagugcccagggcggcggcgggcccgggcgg

SEQ ID NO: 105257 - RNA, 47 nt, Mus musculus
gggagccuagcagccgggagcgugcggucagagcacccgggaggcug

SEQ ID NO: 105258 - RNA, 46 nt, Mus musculus
gguaggcuuaaguaggcuccacuccucaccugacaugguccugcag

SEQ ID NO: 105259 - RNA, 44 nt, Mus musculus
gccccgacccuaagugagagcggggccggcaagccucgcgagga

SEQ ID NO: 105260 - RNA, 46 nt, Mus musculus
acacauuuaugucugugcacagugugugccuggugcucaugaaggu

SEQ ID NO: 105261 - RNA, 45 nt, Mus musculus
aacuuucauagauauggacauaauccugugucaggcccccaccaa

SEQ ID NO: 105262 - RNA, 42 nt, Mus musculus
gcacucuucugguaaaagaugagcuugcccaggcccccggca

SEQ ID NO: 105263 - RNA, 45 nt, Mus musculus
acacgcucagggcaaggaacaggagcagcuuuugaggccucagca

SEQ ID NO: 105264 - RNA, 44 nt, Mus musculus
uacuggugacucuggagacaaagcugaaggggcagccccugugu

SEQ ID NO: 105265 - RNA, 42 nt, Mus musculus
cucuggagaugugggugguguuuuccaggaaccagaugagac

SEQ ID NO: 105266 - RNA, 42 nt, Mus musculus
uagguuucugagacuccauaaugaaggaagacuuccagagau

SEQ ID NO: 105267 - RNA, 42 nt, Mus musculus
uccauuccucuucucuuucuucuggauaccuugagggcagca

SEQ ID NO: 105268 - RNA, 46 nt, Mus musculus
aggcagagcuaccugggagacucaggguuaaacaggacugggagaa

SEQ ID NO: 105269 - RNA, 47 nt, Mus musculus
ugccccaguuaaugccugucuauagcccacacugaggagucgcugag

SEQ ID NO: 105270 - RNA, 41 nt, Mus musculus
caucuuggaguagugugguaugaguggagguggauggugcc

SEQ ID NO: 105271 - RNA, 42 nt, Mus musculus
caucagcaucugcagacaguuuccaagagaugcaagagggag

SEQ ID NO: 105272 - RNA, 46 nt, Mus musculus
gacaacauccuagagguagcagugacaguuguacacacuaucacag

SEQ ID NO: 105273 - RNA, 46 nt, Mus musculus
uaugucuaacaacuccuuccaacacagccauuccacagcgguccac

SEQ ID NO: 105274 - RNA, 23 nt, Mus musculus
cuccacugccaucacagaccagc

SEQ ID NO: 105275 - RNA, 42 nt, Mus musculus
aacuccgcucgcccgggccccgaccgguggcugccugagggu

SEQ ID NO: 105276 - RNA, 49 nt, Mus musculus
caucucaacuucugcgacagccaccacaaucaacaugccugagaucucc

SEQ ID NO: 105277 - RNA, 42 nt, Mus musculus
cuucacggaguaggcauaggcuaugaagcccaggcagcagaa

SEQ ID NO: 105278 - RNA, 44 nt, Mus musculus
gcugccugggcuucauagccuaugccuacuccgugaagucuaag

SEQ ID NO: 105279 - RNA, 44 nt, Mus musculus
uaggagaacguguguuuguuguuguuguuguuguugaagaagga

SEQ ID NO: 105280 - RNA, 41 nt, Mus musculus
cuccgcaagcacugugguaccuaccggucuauagccccgga

SEQ ID NO: 105281 - RNA, 27 nt, Mus musculus
uguucagugugucaaagcugggaccua

SEQ ID NO: 105282 - RNA, 42 nt, Mus musculus
aggacuggagguccccuggauggagcuggauuaaaaccgagg

SEQ ID NO: 105283 - RNA, 46 nt, Mus musculus
agcugagucacucuaagggugcaguuuuacauuacacaaguaugag

SEQ ID NO: 105284 - RNA, 42 nt, Mus musculus
uacaugcuaaccuuguacugugugagggucgucaccgcggag

SEQ ID NO: 105285 - RNA, 49 nt, Mus musculus
uuuuaagaucuguccugaccugaggugaaauccauacagaucgauacag

SEQ ID NO: 105286 - RNA, 45 nt, Mus musculus
aaggcuugcugugcagcugguuucuguguccuggaauugggcaag

SEQ ID NO: 105287 - RNA, 45 nt, Mus musculus
ucuuuuaaaaucucaacuuagaaggaagcuuuugacaguggguca

SEQ ID NO: 105288 - RNA, 26 nt, Mus musculus
uauccugggcccauuagccauguauu

SEQ ID NO: 105289 - RNA, 45 nt, Mus musculus
ucacacucuacuucuuugagaccaguuuuuuccuuccagcaugua

SEQ ID NO: 105290 - RNA, 34 nt, Mus musculus
aagaugacaguauuucauuucuucuguggcugag

SEQ ID NO: 105291 - RNA, 42 nt, Mus musculus
gacgacuuccugaugaauaggagugucgguucuguggggcag

SEQ ID NO: 105292 - RNA, 46 nt, Mus musculus
caguggucucuuucccugaugagucccacucuggcucugcccccuc

SEQ ID NO: 105293 - RNA, 24 nt, Mus musculus
gcagugccuguuucauucaaggau

SEQ ID NO: 105294 - RNA, 46 nt, Mus musculus
aucucuuucucagcggcaacuguguuuccgcccccuccuuuuugag

SEQ ID NO: 105295 - RNA, 46 nt, Mus musculus
cgggcaugugggcguuccuccugggaacacugggcauggagccgug

SEQ ID NO: 105296 - RNA, 46 nt, Mus musculus
uuggacuaguaucuuaaaacauuuggugcuuuuccuaucugcuaaa

SEQ ID NO: 105297 - RNA, 42 nt, Mus musculus
agauggacacuuccagugaugcugaggucucuguaggcagaa

SEQ ID NO: 105298 - RNA, 41 nt, Mus musculus
cccucuaugaagccuuguccucuaaccucuguuguccuguc

SEQ ID NO: 105299 - RNA, 45 nt, Mus musculus
ugguguuuguuuaacuuuucuaaagacaauuuagaucaugcagug

SEQ ID NO: 105300 - RNA, 45 nt, Mus musculus
uauugagcugaggucacgguuggucggcauuucuauuuccuguac

SEQ ID NO: 105301 - RNA, 46 nt, Mus musculus
ugccuguauaaagugagagcauacagccgaggggaggguuauuuag

SEQ ID NO: 105302 - RNA, 42 nt, Mus musculus
gcacugggaagaaagguggaagagaagagagaaaagcaaaag

SEQ ID NO: 105303 - RNA, 42 nt, Mus musculus
cacaggcgucagugguguggaaagggagaaaacuaggggcag

SEQ ID NO: 105304 - RNA, 28 nt, Mus musculus
uggguguguguguguguguugguuucuc

SEQ ID NO: 105305 - RNA, 46 nt, Mus musculus
gccccuggauaaguuuuugcuguuacuuaacuauucuaguuuucug

SEQ ID NO: 105306 - RNA, 45 nt, Mus musculus
ccuccuuguauuaaaucuuucaaagccuuaacuuuugcccuuuaa

SEQ ID NO: 105307 - RNA, 44 nt, Mus musculus
aaggguacaggagacggacccagccucauucugcaacagccaag

SEQ ID NO: 105308 - RNA, 46 nt, Mus musculus
aagagcaccauguucugguagacgcaguaaagccggucguccacgc

SEQ ID NO: 105309 - RNA, 42 nt, Mus musculus
agggcacugaguccgagguggugaugcugggacuggcuucau

SEQ ID NO: 105310 - RNA, 46 nt, Mus musculus
gcaaauguagguucuuuucuguuuucguuuuugcuaaaauucugag

SEQ ID NO: 105311 - RNA, 46 nt, Mus musculus
cgcugccugucuagcuccaguuuuaguagagacccuuuguuagggg

SEQ ID NO: 105312 - RNA, 46 nt, Mus musculus
auauguuuacuuagaggggacucacagguuauccaaucugacccuu

SEQ ID NO: 105313 - RNA, 46 nt, Mus musculus
cugggcagaaugugggaagaauucagucccgauacaagggucagau

SEQ ID NO: 105314 - RNA, 45 nt, Mus musculus
aaaaaaguaaaacaguaacaacaauaaaacuacacaggcagaaga

SEQ ID NO: 105315 - RNA, 45 nt, Mus musculus
uuauuuauuuuuuuguucccauuggcagagggcagauacagaagg

SEQ ID NO: 105316 - RNA, 44 nt, Mus musculus
guuaggaucugcccgacaggccccuuuacacacuccagcaguuc

SEQ ID NO: 105317 - RNA, 46 nt, Mus musculus
cauguuacaguuucuuagauaguggcugauauuguaauagcuagag

SEQ ID NO: 105318 - RNA, 46 nt, Mus musculus
cagcacaccaagguuuaccuuguuucucccguggcauuuaaggcag

SEQ ID NO: 105319 - RNA, 46 nt, Mus musculus
aaugaguuaaagaccaaaauaaauacauaaacaaacaacuuuggag

SEQ ID NO: 105320 - RNA, 42 nt, Mus musculus
guucaaggucaucuuacauaaugagucugaagacagccugag

SEQ ID NO: 105321 - RNA, 46 nt, Mus musculus
ugugaggagcaauuaguacauuauacuuuauaguuaaugagauaga

SEQ ID NO: 105322 - RNA, 42 nt, Mus musculus
auuauguagugacuaguguaaaagaagcuacuauaagggaua

SEQ ID NO: 105323 - RNA, 46 nt, Mus musculus
aucauggaccaggaaguguagaacaaagccagaacuaggggcccua

SEQ ID NO: 105324 - RNA, 46 nt, Mus musculus
ggagggaggggggaggaaggagggagagaggggggaaggagaagga

SEQ ID NO: 105325 - RNA, 46 nt, Mus musculus
caaguaacuuacauguaugucauggaacaaauuaaaaacuauguaa

SEQ ID NO: 105326 - RNA, 48 nt, Mus musculus
auaaagauuccugcugccaaagcugaugagcuaaaaguucgaucccua

SEQ ID NO: 105327 - RNA, 44 nt, Mus musculus
cgaggccaccuuaggcuucuacaaugaguuccagggcagucuga

SEQ ID NO: 105328 - RNA, 45 nt, Mus musculus
ccaugcuugccuggggccugcaggaaucagaaaagggcaucagau

SEQ ID NO: 105329 - RNA, 46 nt, Mus musculus
uuuuguucagcacacaaguggacuaacacaagacuccagcacacag

SEQ ID NO: 105330 - RNA, 42 nt, Mus musculus
uaguuuccaguauagaacuguauuuacuuccaaucaggucaa

SEQ ID NO: 105331 - RNA, 45 nt, Mus musculus
ccucauccaaaaucccacuuccuauauuuucuaaaccacggccac

SEQ ID NO: 105332 - RNA, 41 nt, Mus musculus
cuccuuuaccucuguguuagcuaugguccgggugucugugu

SEQ ID NO: 105333 - RNA, 45 nt, Mus musculus
agcgcacauguccuagggcauccugucuggcagccagcauguccg

SEQ ID NO: 105334 - RNA, 45 nt, Mus musculus
gaaaccuuacaaucaccugcagcaaucuuaccucacggccagagg

SEQ ID NO: 105335 - RNA, 45 nt, Mus musculus
uuuugaugaaguccugguaccauucuaguuuuuacauucugggua

SEQ ID NO: 105336 - RNA, 46 nt, Mus musculus
augaaucauuaaagugaguaaucaaucuuauaagugacugacccua

SEQ ID NO: 105337 - RNA, 45 nt, Mus musculus
uaucaccuccacucccaccauuaggugucucacaaauaccccaag

SEQ ID NO: 105338 - RNA, 42 nt, Mus musculus
gacccacaggggcauugagcacauguuccuaaggcauuggug

SEQ ID NO: 105339 - RNA, 42 nt, Mus musculus
ccauccucggauggccucggcuguaucacagugccacccuug

SEQ ID NO: 105340 - RNA, 46 nt, Mus musculus
auaaugccaccagcuggggaucagcuguugacagugcuggcccagg

SEQ ID NO: 105341 - RNA, 45 nt, Mus musculus
aaacuaauaauuaaaaacaagaaaacuguaucaaaagggagacag

SEQ ID NO: 105342 - RNA, 45 nt, Mus musculus
ccuagugcuuccugugaaauuguaaguacauacuggaguccagga

SEQ ID NO: 105343 - RNA, 45 nt, Mus musculus
uuuaugaugucacagugguuuaugaagggaaugagaaagguucag

SEQ ID NO: 105344 - RNA, 46 nt, Mus musculus
uauuuugcugcagacuaaagagaucucuuauaaucgcaguacuaag

SEQ ID NO: 105345 - RNA, 46 nt, Mus musculus
aauauuaccacacuccaguaaauacucuccagagauuucagaugag

SEQ ID NO: 105346 - RNA, 46 nt, Mus musculus
aggacagggaggcacucaggcaggagaaguaguugagagccacauu

SEQ ID NO: 105347 - RNA, 46 nt, Mus musculus
ccaagaacccaugccaggcucagucugucucucucugccuguagau

SEQ ID NO: 105348 - RNA, 46 nt, Mus musculus
cagacuaagugugaagaagacuuuaccuucaguguugaucuugggg

SEQ ID NO: 105349 - RNA, 41 nt, Mus musculus
gaacccuccuuggcugccugugguuuguuauuaaagcauaa

SEQ ID NO: 105350 - RNA, 42 nt, Mus musculus
uuguuguuuuuuuguuuuguuuuguucuguuuuaagccuuga

SEQ ID NO: 105351 - RNA, 46 nt, Mus musculus
guuucgcuauauugguuaucuuccauuugacuacuuggcagcucag

SEQ ID NO: 105352 - RNA, 56 nt, Mus musculus
ccaauugaaucacaauaaauaauuuuuuuuaauugagggaaaauuugcuucuuguu

SEQ ID NO: 105353 - RNA, 42 nt, Mus musculus
ggauaagacaacaggucaauacaucagacuggccgcucagca

SEQ ID NO: 105354 - RNA, 42 nt, Mus musculus
ugaggaguggaaggacgcggcaagggacccgaguaugcagag

SEQ ID NO: 105355 - RNA, 56 nt, Mus musculus
uggccaauauuagucccauuccagguagaaacuuccgccccagugcagagcuuccu

SEQ ID NO: 105356 - RNA, 45 nt, Mus musculus
gacaggagagcacaacacuguauuucagugccgccauggacagaa

SEQ ID NO: 105357 - RNA, 42 nt, Mus musculus
uuggagaaagggucugaguacguaggggcuccgaaagcagag

SEQ ID NO: 105358 - RNA, 46 nt, Mus musculus
ucaacacugugaucugcagaggaaaccccuguuuucccaucaagac

SEQ ID NO: 105359 - RNA, 46 nt, Mus musculus
ucuucagccaccaccacuggcuguugcugaaacucgcucucaagac

SEQ ID NO: 105360 - RNA, 46 nt, Mus musculus
cauggaaaugccccgacacggcucugaggagcaugacugaccucug

SEQ ID NO: 105361 - RNA, 45 nt, Mus musculus
ugaacucugauuuauaccgagguggugggaaaguuuagaagggag

SEQ ID NO: 105362 - RNA, 46 nt, Mus musculus
cuaggggguccauguggugcugccagggagacaaaggcagagacua

SEQ ID NO: 105363 - RNA, 41 nt, Mus musculus
cucuguccaugaguccugguuuauaaccaaaagccccagau

SEQ ID NO: 105364 - RNA, 46 nt, Mus musculus
gaggucugugcucuuguaaaacaacagggcuggcacuggcaggggg

SEQ ID NO: 105365 - RNA, 47 nt, Mus musculus
gaaauuuaccucugauuuacagaauaaucccugcagauucccguccc

SEQ ID NO: 105366 - RNA, 88 nt, Mus musculus
ugaucagcccauccuugaucagcuuccugaucugcugacgggaguuggcauuggcgauuucauuggucucauugggauccaaccagac

SEQ ID NO: 105367 - RNA, 46 nt, Mus musculus
augccugcccuuccgucgggccaggguguuuuucuggcaacgagcc

SEQ ID NO: 105368 - RNA, 45 nt, Mus musculus; identical to SEQ ID NO: 24288

SEQ ID NO: 105369 - RNA, 50 nt, Mus musculus; identical to SEQ ID NO: 50639

SEQ ID NO: 105370 - RNA, 45 nt, Mus musculus
aagaacagcuuccugccuuacaucuuacaugagagggacccaggc

SEQ ID NO: 105371 - RNA, 45 nt, Mus musculus
acacacacacacacacacacagagagagagagagagagagcaaga

SEQ ID NO: 105372 - RNA, 45 nt, Mus musculus
agcuuagcaucaggaguuaggaaauggaagucaagugcuacagau

SEQ ID NO: 105373 - RNA, 46 nt, Mus musculus
agguuagcaucaggaguuaggaaaugggagucaagugcugcagauc

SEQ ID NO: 105374 - RNA, 42 nt, Mus musculus
aaagaguggauugcauuuuaauaaaauaaaaagggggagaug

SEQ ID NO: 105375 - RNA, 41 nt, Mus musculus
gagucucugagagguaugcuuucuuacacaguagguccagu

SEQ ID NO: 105376 - RNA, 46 nt, Mus musculus
aaggaaacaacauguuagaguuaguagguugaguggugaggaggag

SEQ ID NO: 105377 - RNA, 45 nt, Mus musculus
gaaaagaugggagauuuguguuauuccccaagaucacucauagaa

SEQ ID NO: 105378 - RNA, 45 nt, Mus musculus
cuggggcuuccgcagcugcggguggccgcgggcucucgcgcuccg

SEQ ID NO: 105379 - RNA, 58 nt, Mus musculus
gcaggcugaggcuugugggacuguggcugcacacuuuugugggcuaucucuccaagug

SEQ ID NO: 105380 - RNA, 42 nt, Mus musculus
uuggucucugguugccaggcugggguggguggggccacagau

SEQ ID NO: 105381 - RNA, 29 nt, Mus musculus
caaagaugagugaaaugucagugguuagg

SEQ ID NO: 105382 - RNA, 47 nt, Mus musculus
guuggccagagcaucaguaggaacuuguuggaaccgagguggcccag

SEQ ID NO: 105383 - RNA, 42 nt, Mus musculus
gacucugggacagugauugguagagaacgggcaaugguagau

SEQ ID NO: 105384 - RNA, 41 nt, Mus musculus
cuuguccauuuggcaucuucucgaguggccugaccaguagg

SEQ ID NO: 105385 - RNA, 45 nt, Mus musculus
cuuuacugagcacacacugugcaccaagaguuggacugagcagca

SEQ ID NO: 105386 - RNA, 44 nt, Mus musculus
gugcagcugucacuuccuacaccaacagaguggcuuucuuuugg

SEQ ID NO: 105387 - RNA, 46 nt, Mus musculus
aaccucucuuggagcguugcagcaucugccccuccuugcccuucuc

SEQ ID NO: 105388 - RNA, 42 nt, Mus musculus
acauguaaaacagcaaaguaggaugaaagggauuggugagac

SEQ ID NO: 105389 - RNA, 46 nt, Mus musculus
uuaccuaaaagacugucucuuguuuuaucauaauaaguaguaagaa

SEQ ID NO: 105390 - RNA, 46 nt, Mus musculus
cuguggcugucuuuuuccucuuccuuucuguggacacagcacagcu

SEQ ID NO: 105391 - RNA, 41 nt, Mus musculus
gccucacaagaugccacggccaggaagcaggaguggguggg

SEQ ID NO: 105392 - RNA, 45 nt, Mus musculus
aauucccagcaaccacauggugguuuacugcuaccucuaaugaga

SEQ ID NO: 105393 - RNA, 47 nt, Mus musculus
ucauggguaucaaauguuagagguuaagucccgggggcuggugagau

SEQ ID NO: 105394 - RNA, 52 nt, Mus musculus
aauauaauccaccguuuuaaugcaauaugacugauguaauucuuaagaguuu

SEQ ID NO: 105395 - RNA, 46 nt, Mus musculus
cuauaaauuguauauuauaaauuguagauuccuguaacugugacuu

SEQ ID NO: 105396 - RNA, 48 nt, Mus musculus
gagucugauuguuuacuauggagacugaaaagaaagggugcaucugga

SEQ ID NO: 105397 - RNA, 44 nt, Mus musculus
gguaugcauauauacauauaugcauauagauaaauagauagaga

SEQ ID NO: 105398 - RNA, 48 nt, Mus musculus
uauaggggaaugccagggccaggaagugggaguaggagaguuggggag

SEQ ID NO: 105399 - RNA, 55 nt, Mus musculus
agaauucacaucugaggacaguguagucaagggaccagacaagaauaaguaaaag

SEQ ID NO: 105400 - RNA, 44 nt, Mus musculus
cauucucugcuggacauuuuggcaucuguuuuacuuugggaaga

SEQ ID NO: 105401 - RNA, 42 nt, Mus musculus
aucugagacaugccauguugagcuucaacagagagggaagga

SEQ ID NO: 105402 - RNA, 46 nt, Mus musculus
agaaugcuguuccccaaugucaugaaaauuacacguuucccucucu

SEQ ID NO: 105403 - RNA, 46 nt, Mus musculus
agagugcaauaaaugguaauuaaugaagaauggcuuuucaugaaag

SEQ ID NO: 105404 - RNA, 45 nt, Mus musculus
uuuccauaggugggauuaucugcaucagaggcugucacuuggaua

SEQ ID NO: 105405 - RNA, 90 nt, Mus musculus
guuuuaguuucuguuguauacugacucacuuuacuggucugcucuuuaucuuacagcauccuuugggaaccuaugcucacagcaggagau

SEQ ID NO: 105406 - RNA, 49 nt, Mus musculus
cauaaacuuuuuugaacacauuaaauagguacuauuaauuuuuugagug

SEQ ID NO: 105407 - RNA, 46 nt, Mus musculus
aauucccagcaaccacaugguggcucacaaucaucuguagugggau

SEQ ID NO: 105408 - RNA, 94 nt, Mus musculus
cauaucugaaucuauacuucaggacuucuagcaaaaagcuucagaaaucaaguccuacauaaacuaguagaaacaucacuaugggguuggagag

SEQ ID NO: 105409 - RNA, 46 nt, Mus musculus
ugcaaguaacaaugucuuuccucucagacacaagaauccugaagac

SEQ ID NO: 105410 - RNA, 45 nt, Mus musculus
aauauagccugcucaaagacaagucauuuuaacauggcaaacaua

SEQ ID NO: 105411 - RNA, 49 nt, Mus musculus
cuggaucaccacaugguacuccuccuuggcuucucuguccauauuggga

SEQ ID NO: 105412 - RNA, 50 nt, Mus musculus
ugacaucagucagagugaucgucacuuugguuguccccgagaguccaccc

SEQ ID NO: 105413 - RNA, 85 nt, Mus musculus
aauaagugauuguuacuugcaaucaucaagauguggggggggggguuuauggaaugaugagcaucagaucacgguucuguuagca

SEQ ID NO: 105414 - RNA, 47 nt, Mus musculus
cggaguucucaugaucagaacucagccacagaaaggcccauguggag

SEQ ID NO: 105415 - RNA, 46 nt, Mus musculus
ggccccuccaauguuacuuuaugguccucucauagaacugugaggu

SEQ ID NO: 105416 - RNA, 74 nt, Mus musculus
agaguuguuuuguuuggugcuagagugauggcucagaacuaagaccguauguuucucuuccugcugaccagagu

SEQ ID NO: 105417 - RNA, 44 nt, Mus musculus
gauuccagaaauuccuuaguccccucaauguccuuucccuagga

SEQ ID NO: 105418 - RNA, 47 nt, Mus musculus
guguaugugggugucugcagagaccagaaagugugucagacugucug

SEQ ID NO: 105419 - RNA, 46 nt, Mus musculus
cugacuuccuuuggguuuauuauuuuuuauauuguguguguguguc

SEQ ID NO: 105420 - RNA, 46 nt, Mus musculus
uaugugccucaauauuaucaaagaugcauaccuuuccaucugacaa

SEQ ID NO: 105421 - RNA, 45 nt, Mus musculus
gguagagacagaaaacuuucguuggaagaaaucugaacuccagug

SEQ ID NO: 105422 - RNA, 46 nt, Mus musculus
gacaauguaugugaguggacaccuaucaugguuaaguauguguaga

SEQ ID NO: 105423 - RNA, 45 nt, Mus musculus
cacuaugauguuauaggcuaaguaguauuguaugguaagggauaa

SEQ ID NO: 105424 - RNA, 46 nt, Mus musculus
ugccaaagauuccuugaacuaauugcucaaagaaaagcagccacag

SEQ ID NO: 105425 - RNA, 61 nt, Mus musculus
auggaugggaagaggaucccagauggccagcaugcaggagcaauguguuccuuccagcaug

SEQ ID NO: 105426 - RNA, 44 nt, Mus musculus
gcaaauuucucaaaggguuuaaaaucgaacuuuuuauugguaga

SEQ ID NO: 105427 - RNA, 46 nt, Mus musculus
caaggcuaacaacaacuaaccacaggcuugucucagggggcuaaau

SEQ ID NO: 105428 - RNA, 46 nt, Mus musculus
gccuaagggcaggaaagccuggcggguaagaagcuucccugagagu

SEQ ID NO: 105429 - RNA, 46 nt, Mus musculus
gcccacacggugggaaacuuuuauuaacagagaauuacugugaccc

SEQ ID NO: 105430 - RNA, 42 nt, Mus musculus
aucugaaugcaggaacuggaaaagcaugggcagaccccagaa

SEQ ID NO: 105431 - RNA, 48 nt, Mus musculus
aagaggagccagggggugagcuagugaauccuaaagcugguacagagg

SEQ ID NO: 105432 - RNA, 45 nt, Mus musculus
cacuuggcucccaggcaaggcagcagugggcuaggaggggcuggg

SEQ ID NO: 105433 - RNA, 50 nt, Mus musculus
ggaggaggaggaggaagauggaaggaagggauggaaagaggggaggaggg

SEQ ID NO: 105434 - RNA, 64 nt, Mus musculus
gaucaugaguuugugcccagccugcugggcuauuuggggggaaaggaggaggagaaaguggagg

SEQ ID NO: 105435 - RNA, 47 nt, Mus musculus
cagcccacacuggcaaaaacaagacaaaacaaaagggcaucaagagc

SEQ ID NO: 105436 - RNA, 42 nt, Mus musculus
aagaaaaggaaaauuuuggagcagccaaaucugacugcagag

SEQ ID NO: 105437 - RNA, 45 nt, Mus musculus
ggcacaaguacaugaagcaauacuuggugcuguaauagauuagau

SEQ ID NO: 105438 - RNA, 45 nt, Mus musculus
uugggcugagcauuaaaggguugggaggccuuggcuggcacagug

SEQ ID NO: 105439 - RNA, 41 nt, Mus musculus
gggcaggcuuugccacuggacagaugaggacuagaguuggg

SEQ ID NO: 105440 - RNA, 47 nt, Mus musculus
caucaauaaggugcuugcuaugcaagucuaaggacgugagcucagau

SEQ ID NO: 105441 - RNA, 45 nt, Mus musculus
cacaagguuggaacuuuuucugguguguacaagaagcccacaggc

SEQ ID NO: 105442 - RNA, 26 nt, Mus musculus
gcuuauuuuucguacggauuuuccag

SEQ ID NO: 105443 - RNA, 41 nt, Mus musculus
ugcugacauguaaucuuucuguuaaugaaucaaccccgugc

SEQ ID NO: 105444 - RNA, 81 nt, Mus musculus
ucggugcuaagggguaauagacagaaaggagauuccggccagaugguguggacuuuagauaagauggcccugccugucccc

SEQ ID NO: 105445 - RNA, 48 nt, Mus musculus
caucuggccggaaucuccuuucugucuauuaccccuuagcaccgagua

SEQ ID NO: 105446 - RNA, 45 nt, Mus musculus
agggcuguuguuaaggcauuccuaagaacaucuuggccguaaaga

SEQ ID NO: 105447 - RNA, 44 nt, Mus musculus
caucuuccuucauuuguuuuaucucuguuauuuccacagcccuu

SEQ ID NO: 105448 - RNA, 46 nt, Mus musculus
cuguggcaccgcauugggcggggccuauggccaggcgcccagcucg

SEQ ID NO: 105449 - RNA, 94 nt, Mus musculus
aguguccgccggagcgguuugggaagugcacagggcaaagauggcggcggaggagcaggaggcguugagggaguucauggcggugacgggcacu

SEQ ID NO: 105450 - RNA, 45 nt, Mus musculus
aggacgaaacgagcccuuuccuccucagugcccgucaccgccaug

SEQ ID NO: 105451 - RNA, 46 nt, Mus musculus
accugcagguagcgccgcgaggcgggccgcuucgggcgggcugugg

SEQ ID NO: 105452 - RNA, 45 nt, Mus musculus
guucauggacgcgggcgggcccggccugcuuuucagggccuccgu

SEQ ID NO: 105453 - RNA, 82 nt, Mus musculus
gugcacguuugggaucucugcacauuucguaguuaacuguaaaaugagaauuucuuaggacuuacugucuuguucgcuggca

SEQ ID NO: 105454 - RNA, 42 nt, Mus musculus
uccuuaaggaauuaauuuaaaagacaaagcuccaccaggcau

SEQ ID NO: 105455 - RNA, 42 nt, Mus musculus
ugaugacuaauauuucuagaguaccuacaacaagccaggcac

SEQ ID NO: 105456 - RNA, 45 nt, Mus musculus
gcacauucggugucccuuugaggguccaauuccucauccauaaga

SEQ ID NO: 105457 - RNA, 45 nt, Mus musculus
uaugauuuugaaagagggacuauuuacuccuggaacuauguagau

SEQ ID NO: 105458 - RNA, 46 nt, Mus musculus
guaaauagucccucuuucaaaaucauaacaaacaaaaagaggucag

SEQ ID NO: 105459 - RNA, 50 nt, Mus musculus
uagaagcuuuucucucauguauguccacucagcacagaggcuucacagcg

SEQ ID NO: 105460 - RNA, 45 nt, Mus musculus
ugugcugaguggacauacaugagagaaaagcuucuaucccagcag

SEQ ID NO: 105461 - RNA, 46 nt, Mus musculus
ugucaguuuaguacaccuccuacgauggcacaugacuucccagaag

SEQ ID NO: 105462 - RNA, 46 nt, Mus musculus
cuccacacaaagagagaagacagaacaaugaaguuccacagagaug

SEQ ID NO: 105463 - RNA, 46 nt, Mus musculus
ucaaccccaggcagcaugcucaggcccucacgcuuauguucuaaga

SEQ ID NO: 105464 - RNA, 42 nt, Mus musculus
augcugccugggguugaaccugaccccauuucuuaccuccag

SEQ ID NO: 105465 - RNA, 65 nt, Mus musculus
uaaaaugagacaauaauaauacuaauuacgaaauucugaguagaugaaaggaauuaacauauagu

SEQ ID NO: 105466 - RNA, 46 nt, Mus musculus
caucucaucuucuuuaauugugguuuccuguuauuuuuguugugag

SEQ ID NO: 105467 - RNA, 44 nt, Mus musculus
cacaggcaugaagaugggguugaggacaugaagcagcaagguag

SEQ ID NO: 105468 - RNA, 42 nt, Mus musculus
auuaccuucuucagagguuaguuuucacaucuaagacaguga

SEQ ID NO: 105469 - RNA, 79 nt, Mus musculus
auggacaaugggguccccuuagaaccuuaaaaauacuauauucugggauuacuuuaucucuguuugauuuagggugugg

SEQ ID NO: 105470 - RNA, 41 nt, Mus musculus
ucaauuuguucucaugauccuuuguacacaauagcaaggag

SEQ ID NO: 105471 - RNA, 49 nt, Mus musculus
uugaauuuguuaaucaacaaugugauccaaaggaaaggaaauuggcauu

SEQ ID NO: 105472 - RNA, 84 nt, Mus musculus
auaucccauucuuucugauaaauggcauuaauuuacugaaggaaaaaaaagaguguuuuaauggauggauuuauugaaacaaca

SEQ ID NO: 105473 - RNA, 46 nt, Mus musculus
uggaucuggguggcuaacaccauggauuauaaaucucugacagaag

SEQ ID NO: 105474 - RNA, 42 nt, Mus musculus
uucugucagagauuuauaauccaugguguuagccacccagau

SEQ ID NO: 105475 - RNA, 46 nt, Mus musculus
aaaaaaggcuugaugaagucuugcaaacugaucacuacaaccaggg

SEQ ID NO: 105476 - RNA, 41 nt, Mus musculus
acaagacuuucucucacuaucuaucagaaaacagacugaca

SEQ ID NO: 105477 - RNA, 46 nt, Mus musculus
aguaucuuuuauuucuuccaccucugacucuuuaaagagcacucuu

SEQ ID NO: 105478 - RNA, 85 nt, Mus musculus
uuuccauagauaugacaugaauggaaaacuauauuuaaugcaggagacaacaauccuaugaaaauuaauuuucacuuccugauau

SEQ ID NO: 105479 - RNA, 45 nt, Mus musculus
gaauaaaugaaaccaugaugaaaugaaaccaugucugcuucaggu

SEQ ID NO: 105480 - RNA, 48 nt, Mus musculus
gcagacaugguuucauuucaucaugguuucauuuauucauucuacuag

SEQ ID NO: 105481 - RNA, 46 nt, Mus musculus
uaccuucccagugucuccuuuaggaucugcugauuucaaaggccau

SEQ ID NO: 105482 - RNA, 66 nt, Mus musculus
agacaacuauuuauuugggaaaacauucagauggccuuugaaaucagcagauccuaaaggagacac

SEQ ID NO: 105483 - RNA, 46 nt, Mus musculus
cagucuuaauucacuaguucuucacucagaggauuguuaucaccag

SEQ ID NO: 105484 - RNA, 57 nt, Mus musculus
uccagauuucaaugaauucuauguuagugcguccuaaugaaguucuauaugagcagg

SEQ ID NO: 105485 - RNA, 46 nt, Mus musculus
uccucuaaaauaaaaggacagaaauauaucauuaaaugccucucug

SEQ ID NO: 105486 - RNA, 46 nt, Mus musculus
gaggcauuuaaugauauauuucuguccuuuuauuuuagaggagaau

SEQ ID NO: 105487 - RNA, 48 nt, Mus musculus
acagaacuuauauuauagcauacucaucuucccuuauggucuagagau

SEQ ID NO: 105488 - RNA, 64 nt, Mus musculus
aauggcauuuuauacaauugcacuaaugaucuucacaguggcaauauuucacaguuggccaaaa

SEQ ID NO: 105489 - RNA, 108 nt, Mus musculus
gccuaggucuucagagaaaugagaucacguguucugccauuugcaugguuuggggagagagagaugcuauaguuugacuuuugcuucuaacuaguuugguuguugccu

SEQ ID NO: 105490 - RNA, 81 nt, Mus musculus
ugacaaguaaaccauaaacuaaccauugaucauugcggccagggcgaccuguauucaaaugauuggcuaugggaaccagau

SEQ ID NO: 105491 - RNA, 78 nt, Mus musculus
ggccgcaaugaucaaugguuaguuuaugguuuacuugucagaacagcaggaaagguuucaucagccauaccucagaga

SEQ ID NO: 105492 - RNA, 42 nt, Mus musculus
uggagacuauggacaagcuuguuugcuuggaagaggccacaa

SEQ ID NO: 105493 - RNA, 94 nt, Mus musculus
aguguuguuagauccacucauuccucgaagacuuuuaccaaguucuauaauugucuaagcaucaaaaacacacugauuccuauguaucaccgag

SEQ ID NO: 105494 - RNA, 46 nt, Mus musculus
gggucucggugauacauaggaaucaguguguuuuugaugcuuagac

SEQ ID NO: 105495 - RNA, 46 nt, Mus musculus
uaaggauaaagaacacuuuuuauauauuuacuguuugggcccagag

SEQ ID NO: 105496 - RNA, 46 nt, Mus musculus
uguugauguauuuuauucauaucaaugaguaaaauuuagaaauauu

SEQ ID NO: 105497 - RNA, 44 nt, Mus musculus
uaucuucuauuauucaugcuccacucaauucuugagacagcuuu

SEQ ID NO: 105498 - RNA, 47 nt, Mus musculus
uauaacuaccuuauugcucaaauaugauugaauuauugugagacagg

SEQ ID NO: 105499 - RNA, 46 nt, Mus musculus
ugcauagcaugcuuuauacugcuggccaguauuauaaaaaccagau

SEQ ID NO: 105500 - RNA, 46 nt, Mus musculus
ucaucucuucuuagucaucugguuuuuauaauacuggccagcagua

SEQ ID NO: 105501 - RNA, 46 nt, Mus musculus
gagaauggaacgauauacauuaugauauuuuguguacugcccacug

SEQ ID NO: 105502 - RNA, 46 nt, Mus musculus
gaaaaagugaauccaaacuuaagucuugcaccaaaugcagaaaucu

SEQ ID NO: 105503 - RNA, 45 nt, Mus musculus
aguauaaguugauauacuacccugauaagggggaacucaccagac

SEQ ID NO: 105504 - RNA, 46 nt, Mus musculus
uuuaagauugaauucuaacauagcuaaagccuuuucccaguguucu

SEQ ID NO: 105505 - RNA, 45 nt, Mus musculus
uuaauagagugcacgugaaucuauacacuagacuaaugugguaga

SEQ ID NO: 105506 - RNA, 46 nt, Mus musculus
agugcccugacacuuccucucucccuccucuacgauuuucacagac

SEQ ID NO: 105507 - RNA, 46 nt, Mus musculus
caaaucacaggaauuaugccuugucugugaaaaucguagaggaggg

SEQ ID NO: 105508 - RNA, 45 nt, Mus musculus
ucuauuaugcaaauuaacucaagaauauuuuauucugcgcucaga

SEQ ID NO: 105509 - RNA, 46 nt, Mus musculus
aggagagaccagagucccuuugcucacccacaaggaaaccuugcag

SEQ ID NO: 105510 - RNA, 36 nt, Mus musculus
ucaaaauccuauuuuuguaucugcaagguuuccuug

SEQ ID NO: 105511 - RNA, 33 nt, Mus musculus
gauuugguuuucaguuuucuccuccccacagag

SEQ ID NO: 105512 - RNA, 65 nt, Mus musculus
ugucuuucauuuccuacccgauaacaauuuccagcaggaguccaaauauacuuaaacacccauau

SEQ ID NO: 105513 - RNA, 45 nt, Mus musculus
ugggagcacagugcuuggagggaaaaaauaaauguuguugaaagu

SEQ ID NO: 105514 - RNA, 45 nt, Mus musculus
uggccaggaugccuaagcaucaggguuccacuaacacauguaaga

SEQ ID NO: 105515 - RNA, 45 nt, Mus musculus
cauguguuaguggaacccugaugcuuaggcauccuggccagcugc

SEQ ID NO: 105516 - RNA, 46 nt, Mus musculus
gaugaaaaauugaggugacagcagaugcuggcguggauguggagaa

SEQ ID NO: 105517 - RNA, 46 nt, Mus musculus
agaauuucaagucucugaagaaagaaauuaaagaaggucucagaag

SEQ ID NO: 105518 - RNA, 46 nt, Mus musculus
gauuucucuaauuauuacccacaucaaggucuccuuaggagggcag

SEQ ID NO: 105519 - RNA, 45 nt, Mus musculus
uagaaauuuuaagauagagauuuaaggauaagaaaauaaagauua

SEQ ID NO: 105520 - RNA, 46 nt, Mus musculus
uaaaaaaaaaaaaaaugccaucgcuucucugccuuuuggcuaagau

SEQ ID NO: 105521 - RNA, 42 nt, Mus musculus
agggcuacacagagaaacccugucuggaaaaaaaccaaaaaa

SEQ ID NO: 105522 - RNA, 75 nt, Mus musculus
caaaccguuuuguugugcaaccucguuugaaaacgaugugaggaagaauaaacaaccgugaauguggagucaagg

SEQ ID NO: 105523 - RNA, 39 nt, Mus musculus
ucuguccucucuuuccugugcugggcagcguggugggga

SEQ ID NO: 105524 - RNA, 46 nt, Mus musculus
cucagaaccugagaccagauuuuaguuuaauuuuaauuaacauuua

SEQ ID NO: 105525 - RNA, 41 nt, Mus musculus
ggggcaggaucugggggacccccacuuaaugcuguagguga

SEQ ID NO: 105526 - RNA, 80 nt, Mus musculus
guacguuaucauaaaauauuuucucuuugcuaggcaugaugguguguguguauaaucucggaguccaggaggcuggggca

SEQ ID NO: 105527 - RNA, 96 nt, Mus musculus
ugguaugguacugucugucaguauuaacaagcauggguuucccuaaauguuuuuaucuuuguguguguguguguacuugggugcacacaacuagua

SEQ ID NO: 105528 - RNA, 45 nt, Mus musculus
accuucaaggaugcuucuggaacugggauauuuaucagagacaga

SEQ ID NO: 105529 - RNA, 96 nt, Mus musculus
ucucuauucuugcugaugcuaacaucuguggaccaccuuuuagcacugguugcucuugccuaacucuugucugcaucccuuggcugucagccaguu

SEQ ID NO: 105530 - RNA, 45 nt, Mus musculus
uuagagcuguggcucuaagcugugacagucuuagucuggggagac

SEQ ID NO: 105531 - RNA, 46 nt, Mus musculus
gcaacuucuuuguagugacuguguggauuuuuaacuugcagggaaa

SEQ ID NO: 105532 - RNA, 42 nt, Mus musculus
agaguuauggagcuguguauaaacagggucuccaggcccaga

SEQ ID NO: 105533 - RNA, 49 nt, Mus musculus
augcacacugugaguuuauagaacuuaaauauaugguucagugggggcg

SEQ ID NO: 105534 - RNA, 72 nt, Mus musculus
aacaacaacaacaacaacaaaaagaauacaguugauaaugcaaaacaaacaaaaccaaaaaacacaucgcug

SEQ ID NO: 105535 - RNA, 42 nt, Mus musculus
uaggagccagguuuguuugucuuggaacacuuccugcaagau

SEQ ID NO: 105536 - RNA, 46 nt, Mus musculus
cauccuagcuaccuggaagccaguauucugcuagcauccuucagau

SEQ ID NO: 105537 - RNA, 43 nt, Mus musculus
uguggacagaacugauuuaagaacuuguauggcuggagggaag

SEQ ID NO: 105538 - RNA, 49 nt, Mus musculus
aaaccaaaacccuuucaggaggagaaaguggguguugugagccugggug

SEQ ID NO: 105539 - RNA, 45 nt, Mus musculus
gcucuuccuacccucagggcuaacugacauuccuuugacaaacag

SEQ ID NO: 105540 - RNA, 38 nt, Mus musculus
agccaccugccucagaacaacuaaacggaacuggagau

SEQ ID NO: 105541 - RNA, 41 nt, Mus musculus
agaagaaaaagaauuuugacgucgccaucuagcggccagug

SEQ ID NO: 105542 - RNA, 47 nt, Mus musculus
caguccccugguggagaaacaucucugaaugaagaauggcacugagg

SEQ ID NO: 105543 - RNA, 41 nt, Mus musculus
agggucccaggaagugagugacucuugccuugggcugcagu

SEQ ID NO: 105544 - RNA, 46 nt, Mus musculus
aucagaacuugcuugaauuguugggugugaaguuggugcugcaguc

SEQ ID NO: 105545 - RNA, 42 nt, Mus musculus
agaguguggauaguuguaggagcugugguggacaauggagau

SEQ ID NO: 105546 - RNA, 46 nt, Mus musculus
uagguccuauaacagccuauauaggcugagauccuauaacagcgau

SEQ ID NO: 105547 - RNA, 46 nt, Mus musculus
uucauuaaauauguaauuauaaauguuuucaacuaaaccccaagcc

SEQ ID NO: 105548 - RNA, 45 nt, Mus musculus
aguguuuuuugugugaacauuuuaaauucuuccagcacugcagau

SEQ ID NO: 105549 - RNA, 46 nt, Mus musculus
aagcucauccuuuuauuauaguauaggauucagugugugugugugu

SEQ ID NO: 105550 - RNA, 47 nt, Mus musculus
augguggcucacaaccaucugcaauaaaaucugauugaugcccucuu

SEQ ID NO: 105551 - RNA, 51 nt, Mus musculus
caagcaccuuauugauggagccaucucccugucccagacuccuuuacauuc

SEQ ID NO: 105552 - RNA, 47 nt, Mus musculus
ugagcagugugagccucaaggauccaucuauguccaccuccgaguug

SEQ ID NO: 105553 - RNA, 45 nt, Mus musculus
cuuguuggagguugacauugggugucauauuucuuuccccuuuuu

SEQ ID NO: 105554 - RNA, 46 nt, Mus musculus
cucaucgaguugccugugagaucuggacucagucacuccaaaagua

SEQ ID NO: 105555 - RNA, 46 nt, Mus musculus
uucccauucccauuggaaaguccucuccuagccccucgcccccccc

SEQ ID NO: 105556 - RNA, 84 nt, Mus musculus
cuauuacagcaccaaguauugcuucauguacuugugccuagcuccaacuaagcuccuuccuggauaugucugccuggccuugcu

SEQ ID NO: 105557 - RNA, 45 nt, Mus musculus
cuacugugugacucuguguccuaggcuuuauaacuucucucagau

SEQ ID NO: 105558 - RNA, 41 nt, Mus musculus
uugccagugugggcugacuacuugguacuccugccugagcu

SEQ ID NO: 105559 - RNA, 61 nt, Mus musculus
aucuuguaugaccaucauuacuacuagcuugucuuacccgccuuggucuugucucccuucc

SEQ ID NO: 105560 - RNA, 47 nt, Mus musculus
cucaggaguggggcucccagcauuccucccagccgcuccuagcccac

SEQ ID NO: 105561 - RNA, 48 nt, Mus musculus
ccugguguggagcacagguggaguucucccucagugaggucuuggagu

SEQ ID NO: 105562 - RNA, 43 nt, Mus musculus
agagcucccuugaucuucucucugaccccgccuccucuguacc

SEQ ID NO: 105563 - RNA, 42 nt, Mus musculus
agaucugaaugcaggaacuggaaaagcaugggcagaccccag

SEQ ID NO: 105564 - RNA, 49 nt, Mus musculus
aguagcuggauuaggggguauuuaaaggaagaaaccacgacuuaaggau

SEQ ID NO: 105565 - RNA, 47 nt, Mus musculus
cuguuaauaaaaguuucccaccgugugggcauucaacguuagggcag

SEQ ID NO: 105566 - RNA, 46 nt, Mus musculus
augcccacacggugggaaacuuuuauuaacagagaauuacugugac

SEQ ID NO: 105567 - RNA, 45 nt, Mus musculus
ggccuaagggcaggaaagccuggcagguaagaagcuucccugaga

SEQ ID NO: 105568 - RNA, 46 nt, Mus musculus
agcaaggcuaacaacaacuaaccacaggcuugucucagggggcuaa

SEQ ID NO: 105569 - RNA, 60 nt, Mus musculus
ggugaaggcugaagacccagacauuggagaaaauggcuuagucacauacaauaucauuga

SEQ ID NO: 105570 - RNA, 58 nt, Mus musculus
aggcguguaccagaugucuguuucagaagcagcugucccugggggaggagguaggaag

SEQ ID NO: 105571 - RNA, 46 nt, Mus musculus
ccagcaaauuucucaaaggguuuaaaauugaacuuuuuauugguag

SEQ ID NO: 105572 - RNA, 53 nt, Mus musculus
gaugggaagaggaucccagauggccagcaugcaggagcaauguguuccuucca

SEQ ID NO: 105573 - RNA, 48 nt, Mus musculus
ccuuucucucguguugugggugaccucaucaucuuaccaggaccccaa

SEQ ID NO: 105574 - RNA, 46 nt, Mus musculus
aaugccaaagauuccuugaacuaauugcucaaagaaaagcagccac

SEQ ID NO: 105575 - RNA, 42 nt, Mus musculus
aaaauaaauaugaagugaugaaaccuuuuuaagcagggggua

SEQ ID NO: 105576 - RNA, 71 nt, Mus musculus
uaaauacuguaaacauaaauauaaauagguguggcaccauucuuuauuucugaaaaauauaaacauaaagg

SEQ ID NO: 105577 - RNA, 45 nt, Mus musculus
uacacuaugauguuauaggcuaaguaguauuguaugguaagggau

SEQ ID NO: 105578 - RNA, 51 nt, Mus musculus
gcuuaaacgcuuacacacacacacacccuacuucccuuuaucccuuaccau

SEQ ID NO: 105579 - RNA, 49 nt, Mus musculus
agguguccacucacauacauugucauagaaaaacauaucauaccccacu

SEQ ID NO: 105580 - RNA, 46 nt, Mus musculus
augacaauguaugugaguggacaccuaucaugguuaaguaugugua

SEQ ID NO: 105581 - RNA, 45 nt, Mus musculus
aagguagagacagaaaacuuucguuggaagaaaucugaacuccag

SEQ ID NO: 105582 - RNA, 42 nt, Mus musculus
cauuuguuguuccuuguucugugacacuuauugcccacauau

SEQ ID NO: 105583 - RNA, 42 nt, Mus musculus
ucuuagacagguugcuuuucaaaugugucaaaugauggugcu

SEQ ID NO: 105584 - RNA, 49 nt, Mus musculus
aaucacgaaaagaaugcagcacugcagcauauaauagcugcaguagagg

SEQ ID NO: 105585 - RNA, 46 nt, Mus musculus
gucaugggcuugaaugagauuuggagaaaauuacauugcaacagau

SEQ ID NO: 105586 - RNA, 46 nt, Mus musculus
uguaugugccucaauauuaucaaagaugcauaccuuuccaucugac

SEQ ID NO: 105587 - RNA, 45 nt, Mus musculus
ggacuccaaaagagaugggucaaccaugcuauuccuugucagaug

SEQ ID NO: 105588 - RNA, 46 nt, Mus musculus
acugacuuccuuuggguuuauuauuuuuuauauugugugugugugu

SEQ ID NO: 105589 - RNA, 67 nt, Mus musculus
agacagacagacagacacacacacacacacacacacacaauauaaaaaauaauaaacccaaaggaag

SEQ ID NO: 105590 - RNA, 87 nt, Mus musculus
cccacauacacauaguguacacucaaagacagacagacagacagacagacagacagacacauagcguacacucaaagacagacagac

SEQ ID NO: 105591 - RNA, 49 nt, Mus musculus
cacuauguguaugugggugucugcagagaccagaaagugugucagacuc

SEQ ID NO: 105592 - RNA, 86 nt, Mus musculus
uuauagauauaauuggcuccuagggaaaggacauugaggggacuaaggaauuucuggaaucauauuuuaguguguaugugcaaagg

SEQ ID NO: 105593 - RNA, 44 nt, Mus musculus
augauuccagaaauuccuuaguccccucaauguccuuucccuag

SEQ ID NO: 105594 - RNA, 95 nt, Mus musculus
uggagacagugguauugaaauauugaaauuaaugauagcugcuaauuuuaauaucuggucacuaauguuauaaauaucuaaaaagagccuauguu

SEQ ID NO: 105595 - RNA, 48 nt, Mus musculus
uagagugauggcucagaacuaagaccguauguuucucuuccugcugac

SEQ ID NO: 105596 - RNA, 46 nt, Mus musculus
agcugcagggaaaucugacaguccuggccucugugggucccuacag

SEQ ID NO: 105597 - RNA, 45 nt, Mus musculus
uagcaacaauauuauuggcucugaacagcugaaauucgggccagg

SEQ ID NO: 105598 - RNA, 52 nt, Mus musculus
uugaauacuguacaauauuuaugaaguuacugagggaaaauauuauuuggca

SEQ ID NO: 105599 - RNA, 46 nt, Mus musculus
caugggacuucuuucccuguagccuuaaggcugccagcauagcagu

SEQ ID NO: 105600 - RNA, 68 nt, Mus musculus
aaaacuagaacaagauagcaaagacuuaaaaacacaccgaggaaaguuaaacaguauagagaucauga

SEQ ID NO: 105601 - RNA, 47 nt, Mus musculus
gagagccucaucuuuucuuucacuccuaauuuacccagcuuucaaaa

SEQ ID NO: 105602 - RNA, 46 nt, Mus musculus
ggcuaaggacauggguggacacauggguggacucucagggacaacc

SEQ ID NO: 105603 - RNA, 61 nt, Mus musculus
uugugauuuuuaaauuuucguuugauaggaaucaucaggacagcccuucccaauauggaca

SEQ ID NO: 105604 - RNA, 45 nt, Mus musculus
uugucuuugagcaggcuauauuuuauguaucuuuagguucccagg

SEQ ID NO: 105605 - RNA, 47 nt, Mus musculus
gcaaagaaacaccucaacacugggcucagugaugcugcguaacauag

SEQ ID NO: 105606 - RNA, 46 nt, Mus musculus
uucaaacaacagcuuguggaguuauugucuaugguuucauggagau

SEQ ID NO: 105607 - RNA, 45 nt, Mus musculus
ccaaucuccugcugugagcauagguucccaaaggaugcuguaaga

SEQ ID NO: 105608 - RNA, 79 nt, Mus musculus
cccuuuauucaggaacaucaguuauccaagugacagccucugaugcagauaaucccaccuauggaaaaagugccaaguu

SEQ ID NO: 105609 - RNA, 46 nt, Mus musculus
ucauuuuaaaugaaauucuguaaacagcaaugaaauuugcaaaguu

SEQ ID NO: 105610 - RNA, 47 nt, Mus musculus
ugaccuugcugauaaaaaagaaauagaagaaggaaacuagagaggga

SEQ ID NO: 105611 - RNA, 45 nt, Mus musculus
auuugacaagaauguucauauuauuuuaaauagcaaaccaaccag

SEQ ID NO: 105612 - RNA, 45 nt, Mus musculus
uugcaugcaaagcaacagugaaaugauuuguucauugucacagau

SEQ ID NO: 105613 - RNA, 51 nt, Mus musculus
gacauuggggaacagcauucuauagaauauuuauagccacaaauuaauuaa

SEQ ID NO: 105614 - RNA, 47 nt, Mus musculus
ucucuguugaagcucaacauggcaugucucagaugcuuauugugaca

SEQ ID NO: 105615 - RNA, 42 nt, Mus musculus
cagcagagaauggaggcacuuuaccuggaauuuaccucagac

SEQ ID NO: 105616 - RNA, 46 nt, Mus musculus
aacauugucuugcguuucucauagaagucacagaaaacccucagaa

SEQ ID NO: 105617 - RNA, 46 nt, Mus musculus
auggaagaagcagaggaagcuagucauccaaacugauaacccaggu

SEQ ID NO: 105618 - RNA, 46 nt, Mus musculus
cuuuuacuuauucuugucuggucccuugacuacacuauccucagau

SEQ ID NO: 105619 - RNA, 46 nt, Mus musculus
aaauauccauggaaggaguuacagagacagaguucagaacugagac

SEQ ID NO: 105620 - RNA, 50 nt, Mus musculus
ggguccugucagcaaaaucuuguugcaauaguuuagaauacccaauauac

SEQ ID NO: 105621 - RNA, 46 nt, Mus musculus
uggcccuggcauuccccuauacuggggccuagaauccucgcaagau

SEQ ID NO: 105622 - RNA, 46 nt, Mus musculus
guaaaucugauucauuggccccaagugaaucuaaaagccaucaggg

SEQ ID NO: 105623 - RNA, 46 nt, Mus musculus
cccaguguguuuaaccuccccaugauuaaacuuugcaaagcaguca

SEQ ID NO: 105624 - RNA, 46 nt, Mus musculus
ucaacuuccuauuagcuaggaagucuggaagggggaaaaaugagau

SEQ ID NO: 105625 - RNA, 45 nt, Mus musculus
uaaaaaaagaaaacccuaacacauugaacagaagaaacaaacaga

SEQ ID NO: 105626 - RNA, 45 nt, Mus musculus
gcucuuuccaccccucccaguuacuccacacauccccugccaucc

SEQ ID NO: 105627 - RNA, 57 nt, Mus musculus
cagaguuucugcaugaaaucuaucauaccaaugugccugagagguccaaugugggua

SEQ ID NO: 105628 - RNA, 74 nt, Mus musculus
aggagaaggagcgggaaccauuuuugugauugaugacaaaucagggaacauucaugccaccaagacauuggaca

SEQ ID NO: 105629 - RNA, 68 nt, Mus musculus
uucuuuuuuguuuucuagcuucauucugacauugacgccggugauggaaacauuaaauacauucucuc

SEQ ID NO: 105630 - RNA, 50 nt, Mus musculus
agagggggagaacaugaaccugagaauuaaacauuugcaaauccaucagc

SEQ ID NO: 105631 - RNA, 49 nt, Mus musculus
aaggugauucauagcugaagcagugaugaaaugggaauaaacacugaga

SEQ ID NO: 105632 - RNA, 49 nt, Mus musculus
aucacauggugaauaaggaagcccuuuguaccuagauguugauggagcu

SEQ ID NO: 105633 - RNA, 49 nt, Mus musculus
caacccuauaggagcaacagcaauaugaccuaaccaguaacccccagau

SEQ ID NO: 105634 - RNA, 87 nt, Mus musculus
agcacuugcuguguucccaaacugcuuuccuguagaaccuaauaaauaguauugucaguacaguagaucaucuuugugacagaggaa

SEQ ID NO: 105635 - RNA, 71 nt, Mus musculus
ucccauguaugaccuugaaaaguaagguucguaaaaggacuuaguuggauggugugugugugugugugugu

SEQ ID NO: 105636 - RNA, 47 nt, Mus musculus
uuugugucucuggauauaaaaaaugucauaugaugcacucgggagaa

SEQ ID NO: 105637 - RNA, 106 nt, Mus musculus
agcucaagcaauguguagagcuggguaucaaauugcucugagaaaaugacccucugcuuugucacugucucagugggggacaguguguuuaggcuuggugguggca

SEQ ID NO: 105638 - RNA, 95 nt, Mus musculus
aaauaauguucuaaauaauuucauucaugugaaaaagauguagacguagucuugauaacauggaaguaggggaaaauaauugaccagcagaaucc

SEQ ID NO: 105639 - RNA, 50 nt, Mus musculus
guuaaacagaacugauucaauauagagaaaugcaaggacagaugauagag

SEQ ID NO: 105640 - RNA, 45 nt, Mus musculus
gcaauaccugacuccaaacaagcaagaaaaagaggcagccacuua

SEQ ID NO: 105641 - RNA, 46 nt, Mus musculus
caagagacagucuuuuagguaauauugacacuaguucacaggagau

SEQ ID NO: 105642 - RNA, 46 nt, Mus musculus
acuggaggaauuucuuagacuauauucuaaccccaacuugccuguu

SEQ ID NO: 105643 - RNA, 48 nt, Mus musculus
cugucauuaaaaagagaaucauauuauguguauacgcauccagucuuc

SEQ ID NO: 105644 - RNA, 46 nt, Mus musculus
gaauaggcgaaagcaagauaaguaaaacuaaaacaaugaaacagaa

SEQ ID NO: 105645 - RNA, 42 nt, Mus musculus
accugcaucccucuuuccauggacaccaugagaagggcaagg

SEQ ID NO: 105646 - RNA, 48 nt, Mus musculus
gacagcugcauucuccugugccuacugcauaaccaaaaaugaaggaga

SEQ ID NO: 105647 - RNA, 45 nt, Mus musculus
gaagcugacugcagaggugaacaacccuggugugauguccucagu

SEQ ID NO: 105648 - RNA, 42 nt, Mus musculus
aaauagaagcuuuugcuuuaguauucaauucagucaccauau

SEQ ID NO: 105649 - RNA, 46 nt, Mus musculus
caaauugaugcgguagcuguaauugacuucaguagcauuaguagau

SEQ ID NO: 105650 - RNA, 46 nt, Mus musculus
caacagguuaacuguucaauuuuucuucuugugauuggggugagac

SEQ ID NO: 105651 - RNA, 57 nt, Mus musculus
uauauagggggaaauucaagaagucugggagcuagagggacucuaggucagagaaau

SEQ ID NO: 105652 - RNA, 52 nt, Mus musculus
gaagaagcagauauuucuaaacaaggaaagaugaauuuuaagugggaggagu

SEQ ID NO: 105653 - RNA, 42 nt, Mus musculus
aacucuacuuccuuuuucucugagugcuucccugcccguuuu

SEQ ID NO: 105654 - RNA, 77 nt, Mus musculus
aagggauuugcuaugugaauaagaagucuaccagagccgggcggugguguugcacaccuuuaauccuagcacucggg

SEQ ID NO: 105655 - RNA, 47 nt, Mus musculus
auacacagacacacgcauacaccauuauacacuuacagagagagaga

SEQ ID NO: 105656 - RNA, 46 nt, Mus musculus
ccaucuucaguggaucugauggauucuggccuugugaacaucugaa

SEQ ID NO: 105657 - RNA, 46 nt, Mus musculus
aagcagcacuuugugcaucauuaaacugaugcuuuucugggcagua

SEQ ID NO: 105658 - RNA, 47 nt, Mus musculus
cacuccccacaaucauucaucaaaaccccaaucacauauaagaagau

SEQ ID NO: 105659 - RNA, 46 nt, Mus musculus
guaguaaauacaacuaauuaagaagcuaccagucacagcccuagca

SEQ ID NO: 105660 - RNA, 46 nt, Mus musculus
uugugaaugaacacuuaauacuuggcaugauauaaaaugggcagga

SEQ ID NO: 105661 - RNA, 90 nt, Mus musculus
gauuccuucuuuggguaugugugaagacagaacacucauguagaauagauaaauaaguaaauauuuuaaaaauuaaacauuaaaaaaaga

SEQ ID NO: 105662 - RNA, 47 nt, Mus musculus
agaaacccugucuggaaaaaaccaagaaagaaagaaagaaagaaaga

SEQ ID NO: 105663 - RNA, 45 nt, Mus musculus
gaaauuuuaagauagagauuuaaggauaagaaaauaaagauuagu

SEQ ID NO: 105664 - RNA, 46 nt, Mus musculus
uuucucuaauuauuacccacaucaaggucuccuuaggagggcagcc

SEQ ID NO: 105665 - RNA, 47 nt, Mus musculus
uacguguguuaguggaacccugaugcuuaggcauccuggccagcugc

SEQ ID NO: 105666 - RNA, 65 nt, Mus musculus
ucuuucauuuccuacccgauaacaauuuccagcaggaguccaaauauacuuaaacacccauauau

SEQ ID NO: 105667 - RNA, 46 nt, Mus musculus
auaaccugucuuuagcugucaauuagcuugcuagauauaaaaagau

SEQ ID NO: 105668 - RNA, 46 nt, Mus musculus
gagagaccagagucccuuugcucacccacaaggaaaccuugcagau

SEQ ID NO: 105669 - RNA, 46 nt, Mus musculus
ugauuugaauugaaagagggaccagcucugcgcugagugaugagau

SEQ ID NO: 105670 - RNA, 45 nt, Mus musculus
aauagagugcacgugaaucuauacacuagacuaaugugguagaaa

SEQ ID NO: 105671 - RNA, 46 nt, Mus musculus
aaaagugaauccaaacuuaagucuugcaccaaaugcagaaaucuga

SEQ ID NO: 105672 - RNA, 46 nt, Mus musculus
cauagcaugcuuuauacugcuggccaguauuauaaaaaccagauga

SEQ ID NO: 105673 - RNA, 47 nt, Mus musculus
uaacuaccuuauugcucaaauaugauugaauuauugugagacaggag

SEQ ID NO: 105674 - RNA, 46 nt, Mus musculus
uugauguauuuuauucauaucaaugaguaaaauuuagaaauauuaa

SEQ ID NO: 105675 - RNA, 46 nt, Mus musculus
aagcauaaagaacacuuuuuauauauuuacuguuugggcccagagg

SEQ ID NO: 105676 - RNA, 94 nt, Mus musculus
uguuguuagauccacucauuccucgaagacuuuuaccaaguucuauaauugucuaagcaucaaaaacacacugauuccuauguaucaccgagac

SEQ ID NO: 105677 - RNA, 42 nt, Mus musculus
gagacuauggacaagcuuguuugcuuggaagaggccacaaga

SEQ ID NO: 105678 - RNA, 48 nt, Mus musculus
ugguuuacuugucagaacagcaggaaagguuucaucagccauaccuca

SEQ ID NO: 105679 - RNA, 51 nt, Mus musculus
uucagagaaaugagaucacguguucugccauuugcaugguuuggggagaga

SEQ ID NO: 105680 - RNA, 56 nt, Mus musculus
uuuuauacaauugcacuaaugaucuucacaguggcaauauuucacaguuggccaaa

SEQ ID NO: 105681 - RNA, 53 nt, Mus musculus
cagaacuuauauuauagcauacucaucuucccuuauggucuagagaucuuugg

SEQ ID NO: 105682 - RNA, 45 nt, Mus musculus
gcuuuuaaugauauauuucuguccuuuuauuuuagaggagaauuu

SEQ ID NO: 105683 - RNA, 57 nt, Mus musculus
cagauuucaaugaauucuauguuagugcguccuaaugaaguucuauaugagcaggcc

SEQ ID NO: 105684 - RNA, 46 nt, Mus musculus
gucuuaauucacuaguucuucacucagaggauuguuaucaccagaa

SEQ ID NO: 105685 - RNA, 46 nt, Mus musculus
ccuucccagugucuccuuuaggaucugcugauuucaaaggccaucu

SEQ ID NO: 105686 - RNA, 48 nt, Mus musculus
agacaugguuucauuucaucaugguuucauuuauucauucuacuagug

SEQ ID NO: 105687 - RNA, 47 nt, Mus musculus
uuuucuaaugaaaugaaaacaaacaaaaaaaccgaaacaaaacaaga

SEQ ID NO: 105688 - RNA, 80 nt, Mus musculus
uccauagauaugacgugaauggaaaacuauauuuaaugcaggagacaacaauccuaugaaaauuaauuuucacuuccuga

SEQ ID NO: 105689 - RNA, 46 nt, Mus musculus
uaucuuuuauuucuuccaccucugacucuuuaaagagcacucuuag

SEQ ID NO: 105690 - RNA, 41 nt, Mus musculus
aagacuuucucucacuaucuaucagaaaacagacugacagu

SEQ ID NO: 105691 - RNA, 48 nt, Mus musculus
aucuggguggcuaucaccauggauuauaaaucucugacagaagaucug

SEQ ID NO: 105692 - RNA, 84 nt, Mus musculus
aucccauucuuucugauaaauggcauuaauuuacugaaggaaaaaaaagaguguuuuaauggauggauuuauugaaacaacagu

SEQ ID NO: 105693 - RNA, 47 nt, Mus musculus
gaacaauagauuauucuuguacauaaguaaaaaucacaucaguaauu

SEQ ID NO: 105694 - RNA, 49 nt, Mus musculus
gaauuuguuaaucaacaaugugauccaaaggaaaggaaauuggcauuuc

SEQ ID NO: 105695 - RNA, 41 nt, Mus musculus
aauuuguucucaugauccuuuguacacaauagcaaggagua

SEQ ID NO: 105696 - RNA, 42 nt, Mus musculus
auggacaaugggguccccuuagaaccuuaaaaauacuauauu

SEQ ID NO: 105697 - RNA, 42 nt, Mus musculus
uaccuucuucagagguuaguuuucacaucuaagacagugagu

SEQ ID NO: 105698 - RNA, 44 nt, Mus musculus
caggcaugaagaugggguugaggacaugaagcagcaagguaguc

SEQ ID NO: 105699 - RNA, 46 nt, Mus musculus
ucucaucuucuuuaauugugguuuccuguuauuuuuguugugagag

SEQ ID NO: 105700 - RNA, 75 nt, Mus musculus
uauaaaaugagacaauaauaauacuaauuaugaaauucugaguagaugaaaggaauuaacauauaguguacagac

SEQ ID NO: 105701 - RNA, 42 nt, Mus musculus
gcugccugggguugaaccugaccccauuucuuaucuccagaa

SEQ ID NO: 105702 - RNA, 46 nt, Mus musculus
ucaguuuaguacaacuccuacgauggcacaugacuucccagaaacu

SEQ ID NO: 105703 - RNA, 45 nt, Mus musculus
ugcugaguggacauacaugagagaaaagcuucuaucccagcagau

SEQ ID NO: 105704 - RNA, 46 nt, Mus musculus
aaauagucccucuuucaaaaucauaacaaacaaaaagaggucagau

SEQ ID NO: 105705 - RNA, 42 nt, Mus musculus
augacuaauauuucuagaguaccuacaacaagccaggcacug

SEQ ID NO: 105706 - RNA, 42 nt, Mus musculus
cuuaaggaauuaauuuaaaagacaaagcuccaccaggcauga

SEQ ID NO: 105707 - RNA, 49 nt, Mus musculus
ggcgcacguuugggaucucugcacauuucguaguuaacuguaaaaugag

SEQ ID NO: 105708 - RNA, 53 nt, Mus musculus
uguuagcgagacuuugggcgcugcggcagucugcguggagucgucgccugggg

SEQ ID NO: 105709 - RNA, 25 nt, Mus musculus
gugucuggggucgcuugccacgcgu

SEQ ID NO: 105710 - RNA, 46 nt, Mus musculus
cugcagguagcgccgcgaggcgggccgcuucgggcgggcugcggaa

SEQ ID NO: 105711 - RNA, 47 nt, Mus musculus
uguccgccggagcgguuugggaagugcacagggcaaagauggcggcg

SEQ ID NO: 105712 - RNA, 41 nt, Mus musculus
auuaaggugagguucauauaggggccaccagagggcgcgag

SEQ ID NO: 105713 - RNA, 45 nt, Mus musculus
gcagggcuguuguuaaggcauuccuaagaacaucuuggccguaaa

SEQ ID NO: 105714 - RNA, 46 nt, Mus musculus
caucuggccggaaucuccuuucugucuauuaccccuuagcgccgag

SEQ ID NO: 105715 - RNA, 46 nt, Mus musculus
gguugagugccccagggaccuuuccccagaaaaaaacggcacagga

SEQ ID NO: 105716 - RNA, 46 nt, Mus musculus; identical to SEQ ID NO: 55906

SEQ ID NO: 105717 - RNA, 43 nt, Mus musculus; identical to SEQ ID NO: 50770

SEQ ID NO: 105718 - RNA, 43 nt, Mus musculus; identical to SEQ ID NO: 55908

SEQ ID NO: 105719 - RNA, 46 nt, Mus musculus; identical to SEQ ID NO: 50771

SEQ ID NO: 105720 - RNA, 42 nt, Mus musculus; identical to SEQ ID NO: 55909

SEQ ID NO: 105721 - RNA, 46 nt, Mus musculus
cuuugcccuuacugaagauuuuuuagaaaacucccaaucgccaucu

SEQ ID NO: 105722 - RNA, 46 nt, Mus musculus
cauucaauuguugucccauuaaccauggggcauuuagugaagagau

SEQ ID NO: 105723 - RNA, 50 nt, Mus musculus
gugcuuugucuaaaugaacuuuuaugagccggcugccauccaguuucaca

SEQ ID NO: 105724 - RNA, 57 nt, Mus musculus
ucuggggucugcccaugcuuuuccaguuccugcauucagaucuuaaucuuguuugca

SEQ ID NO: 105725 - RNA, 42 nt, Mus musculus; identical to SEQ ID NO: 105563

SEQ ID NO: 105726 - RNA, 49 nt, Mus musculus; identical to SEQ ID NO: 105564

SEQ ID NO: 105727 - RNA, 47 nt, Mus musculus; identical to SEQ ID NO: 105565

SEQ ID NO: 105728 - RNA, 46 nt, Mus musculus
aggccuaagggcaggaaagccuggcggguaagaagcuucccugaga

SEQ ID NO: 105729 - RNA, 46 nt, Mus musculus; identical to SEQ ID NO: 105568

SEQ ID NO: 105730 - RNA, 55 nt, Mus musculus
gaagacccagacauuggagaaaauggcuuagucacauacaauaucauugauggag

SEQ ID NO: 105731 - RNA, 68 nt, Mus musculus
aggcguguaccagaugucuguuucagaagcagcugucccugggggaggaaguaggaagggugaaggcu

SEQ ID NO: 105732 - RNA, 44 nt, Mus musculus
cagcaaauuucucaaaggguuuaaaaucgaacuuuuuauuggua

SEQ ID NO: 105733 - RNA, 46 nt, Mus musculus
gcaggagcaauguguuccuuccaggaugacaaaacaacauuggggu

SEQ ID NO: 105734 - RNA, 48 nt, Mus musculus; identical to SEQ ID NO: 105573

SEQ ID NO: 105735 - RNA, 46 nt, Mus musculus; identical to SEQ ID NO: 105574

SEQ ID NO: 105736 - RNA, 42 nt, Mus musculus; identical to SEQ ID NO: 105575

SEQ ID NO: 105737 - RNA, 71 nt, Mus musculus; identical to SEQ ID NO: 105576

SEQ ID NO: 105738 - RNA, 45 nt, Mus musculus; identical to SEQ ID NO: 105577

SEQ ID NO: 105739 - RNA, 51 nt, Mus musculus; identical to SEQ ID NO: 105578

SEQ ID NO: 105740 - RNA, 46 nt, Mus musculus; identical to SEQ ID NO: 105580

SEQ ID NO: 105741 - RNA, 42 nt, Mus musculus
ccuucucaucuacacauacuuaaccaugauagguguccacuc

SEQ ID NO: 105742 - RNA, 45 nt, Mus musculus; identical to SEQ ID NO: 105581

SEQ ID NO: 105743 - RNA, 42 nt, Mus musculus; identical to SEQ ID NO: 105582

SEQ ID NO: 105744 - RNA, 42 nt, Mus musculus; identical to SEQ ID NO: 105583

SEQ ID NO: 105745 - RNA, 49 nt, Mus musculus; identical to SEQ ID NO: 105584

SEQ ID NO: 105746 - RNA, 46 nt, Mus musculus
gucaugggcuugaaugagauuuggagaaaauuacuuugcaacagau

SEQ ID NO: 105747 - RNA, 46 nt, Mus musculus; identical to SEQ ID NO: 105586

SEQ ID NO: 105748 - RNA, 45 nt, Mus musculus; identical to SEQ ID NO: 105587

SEQ ID NO: 105749 - RNA, 92 nt, Mus musculus
auaccaauuaaggaggcacuaugguuauucaaaguuacccaagauaacaaucuaccaaaugaagauaucaugguagaggaucaugagacaca

SEQ ID NO: 105750 - RNA, 78 nt, Mus musculus
acacccacauacacauaguguacacucaaagacagacagacagacagacacauagcguacacucaaagacagacagac

SEQ ID NO: 105751 - RNA, 81 nt, Mus musculus
ugucuuugaguguacacuauguguaugugggugucugcagagaccagaaagugugucagacucucuguaacuggagccaug

SEQ ID NO: 105752 - RNA, 86 nt, Mus musculus; identical to SEQ ID NO: 105592

SEQ ID NO: 105753 - RNA, 44 nt, Mus musculus; identical to SEQ ID NO: 105593

SEQ ID NO: 105754 - RNA, 95 nt, Mus musculus; identical to SEQ ID NO: 105594

SEQ ID NO: 105755 - RNA, 48 nt, Mus musculus; identical to SEQ ID NO: 105595

SEQ ID NO: 105756 - RNA, 46 nt, Mus musculus; identical to SEQ ID NO: 105596

SEQ ID NO: 105757 - RNA, 45 nt, Mus musculus; identical to SEQ ID NO: 105597

SEQ ID NO: 105758 - RNA, 52 nt, Mus musculus; identical to SEQ ID NO: 105598

SEQ ID NO: 105759 - RNA, 45 nt, Mus musculus
gauaggaucagccuggacuuggaaggccagcaggaaaagggcaga

SEQ ID NO: 105760 - RNA, 46 nt, Mus musculus
gaggggacuauaauugagcuuuuacagauucagguaccaggaaggg

SEQ ID NO: 105761 - RNA, 60 nt, Mus musculus
ucuaccuaucccucccucccccucucucucucuuucuuuauguguuuguguguguguuug

SEQ ID NO: 105762 - RNA, 45 nt, Mus musculus
gucuguggaccagaagcuggccucugugugugugugugugugugu

SEQ ID NO: 105763 - RNA, 46 nt, Mus musculus
gcuucugccacagcacauccaagaugguucaagauacagcccaaag

SEQ ID NO: 105764 - RNA, 45 nt, Mus musculus
cuccccaugauuacucuuuaucaucuucuuaaacuuuugccuucu

SEQ ID NO: 105765 - RNA, 42 nt, Mus musculus
aacacacacacauuuggaaaggaaaaugugcagugacgaaag

SEQ ID NO: 105766 - RNA, 45 nt, Mus musculus
ccaggcuggauggguaaaggaugcaugaagcccuggcagaggaga

SEQ ID NO: 105767 - RNA, 46 nt, Mus musculus
uuccucuccaacaccgucagcucccucgguaccgccucccgcagcc

SEQ ID NO: 105768 - RNA, 46 nt, Mus musculus
acauuuuugacucucucauaguauugauggucuggucuggucuggu

SEQ ID NO: 105769 - RNA, 46 nt, Mus musculus
guggcgcgauagcucuacacagagagcuuucuauguuuguggagau

SEQ ID NO: 105770 - RNA, 41 nt, Mus musculus
cuugcucgcaguguagcgguucucuugaguuggcgugcaga

SEQ ID NO: 105771 - RNA, 45 nt, Mus musculus
caagcguugagauuuguggguagguguugguaguugaaagacaga

SEQ ID NO: 105772 - RNA, 94 nt, Mus musculus
agucagugcucuuaacugcugauacaucucuucagccccaaaauuucauucuuaaauggugugugugucucugugugugucucugugugugugu

SEQ ID NO: 105773 - RNA, 45 nt, Mus musculus
aacagaugcuccguuuauuauuuauuuauuuaaucguggugccag

SEQ ID NO: 105774 - RNA, 28 nt, Mus musculus
agcaagaacaaaguacagcgacugugcu

SEQ ID NO: 105775 - RNA, 42 nt, Mus musculus
caaugguggaccaagauguacaauuguauguugaucugguag

SEQ ID NO: 105776 - RNA, 42 nt, Mus musculus
caaauuuuagcacaggagaucugauaaucauauuugggggug

SEQ ID NO: 105777 - RNA, 46 nt, Mus musculus
ugggaauuaguuuguuguuuagaauuaagacacuugguacuguaaa

SEQ ID NO: 105778 - RNA, 42 nt, Mus musculus
gaagagggcagcagauccccauggagcuggagucaugggcug

SEQ ID NO: 105779 - RNA, 41 nt, Mus musculus
augaugggcccuuggagagacggugggaggagauagauccg

SEQ ID NO: 105780 - RNA, 44 nt, Mus musculus
ggaaagccuucacucccucagcagucucaaaaugaaguuugcga

SEQ ID NO: 105781 - RNA, 42 nt, Mus musculus
cacaagaaaggucagaaggguagaagucccugcaguugguag

SEQ ID NO: 105782 - RNA, 46 nt, Mus musculus
aguugucaaccaaaaauauccaucacaaguccaucccugucaccuu

SEQ ID NO: 105783 - RNA, 46 nt, Mus musculus
ccucucuggaaccaaaaugucuagaucaacaaaauuuaaggucaug

SEQ ID NO: 105784 - RNA, 42 nt, Mus musculus
ugucgcacuucucaggcugugaagugagcuacuuggccagaa

SEQ ID NO: 105785 - RNA, 47 nt, Mus musculus
ccccagaaguccuucucaccaaucauacuuauuucucgucccugauc

SEQ ID NO: 105786 - RNA, 33 nt, Mus musculus
agcugucuguuaaagggagaauaauugucugca

SEQ ID NO: 105787 - RNA, 48 nt, Mus musculus
ggaagauagguguuagagcagcaacaggcagaggcagaggcagagagg

SEQ ID NO: 105788 - RNA, 44 nt, Mus musculus
guuuuauugaucuuggccaugaguaguuuaguuuguaauucccu

SEQ ID NO: 105789 - RNA, 46 nt, Mus musculus
uaagaacgaucaggcagcauccugccuggaguggaggaagguucag

SEQ ID NO: 105790 - RNA, 46 nt, Mus musculus
ugaguguacugucgcugucuucagacacaccagaagagggcaucag

SEQ ID NO: 105791 - RNA, 46 nt, Mus musculus
uauugcuuuguuuuugucucuuguuguugcuuuaacaaaugaguag

SEQ ID NO: 105792 - RNA, 46 nt, Mus musculus
aguuugcuaguuauuuacauuuuuuuaaaugauaggaaauaaguag

SEQ ID NO: 105793 - RNA, 45 nt, Mus musculus
cuuugcaguaucagggguucgauacaccuauucuagaucuagaag

SEQ ID NO: 105794 - RNA, 46 nt, Mus musculus
ugguuggaggucaccaugauauggugaacugucugaguagcggcca

SEQ ID NO: 105795 - RNA, 46 nt, Mus musculus
ucuuccuaaagugacuaucgugguaauuuuaucugccuugggaaaa

SEQ ID NO: 105796 - RNA, 46 nt, Mus musculus
cagagugugcgcuagugguuucugugcggcaaaaaggauguaggag

SEQ ID NO: 105797 - RNA, 47 nt, Mus musculus
gcuguugcuucagcuccagcagcagcaguuucaaauggagauacaaa

SEQ ID NO: 105798 - RNA, 45 nt, Mus musculus
uagccagggaacgauggccguaggauuuuagcacuugaaagagga

SEQ ID NO: 105799 - RNA, 53 nt, Mus musculus
ggccuuagagcgggacacagagucuggggagaagcaaggccuuagagcaggac

SEQ ID NO: 105800 - RNA, 44 nt, Mus musculus
gaacuuagagcgggacacagagucuggggagaagcaaggacuua

SEQ ID NO: 105801 - RNA, 46 nt, Mus musculus
agaauucuuugcaagugcaguagcucaaagcaaaauaacaguggag

SEQ ID NO: 105802 - RNA, 46 nt, Mus musculus
auucggacgccccacaacaauacacaaguaaaggacagaaagcgag

SEQ ID NO: 105803 - RNA, 49 nt, Mus musculus
agagggucaaagagcagggacuaagagacaaaggcaggagauagaggac

SEQ ID NO: 105804 - RNA, 42 nt, Mus musculus
cuccucaaccuaucaagauggcuggguauaaaaaaaggggaa

SEQ ID NO: 105805 - RNA, 44 nt, Mus musculus
uggggaucaaaguguagacccauaugcacuaucucccuaucccu

SEQ ID NO: 105806 - RNA, 46 nt, Mus musculus
aaagaaaacuaucaaaagcgaauaccaccugugugaccuggauuag

SEQ ID NO: 105807 - RNA, 41 nt, Mus musculus
cauguuuguaagaugcuuuuaagauggcuugaggggcugag

SEQ ID NO: 105808 - RNA, 45 nt, Mus musculus
uccuuaaaggaaagcuuuaagugagcuuucagguaaaaauagcac

SEQ ID NO: 105809 - RNA, 47 nt, Mus musculus
ggucaucuuuggagacauaaaacuauaacgcaaaacaaaacugucua

SEQ ID NO: 105810 - RNA, 45 nt, Mus musculus
gugcagugcccaaggagaccagaagggcaggccugcaguccucca

SEQ ID NO: 105811 - RNA, 49 nt, Mus musculus
cuuuguuuaugucaccugagcgugacguaaaugacagauagaugggugg

SEQ ID NO: 105812 - RNA, 45 nt, Mus musculus
uuggguuguuuuguuuuaaguccuucuggauauaaagugcuuugg

SEQ ID NO: 105813 - RNA, 40 nt, Mus musculus
uuuucaugugugugugcguguguaugugugugggugugag

SEQ ID NO: 105814 - RNA, 106 nt, Mus musculus
accguaaccaaacgaacuguaccgacaguaguuugaaagccagcaguuagcaguuucuucagacuucaacacuguccagcgcuuuccagagcagacucacuguuua

SEQ ID NO: 105815 - RNA, 83 nt, Mus musculus
caagaacucuuggccucccgaaguuagcaaccucagauuuuguuuauuuaaagaauuucugugaaagaaaaggaccccagagc

SEQ ID NO: 105816 - RNA, 47 nt, Mus musculus
ggauggucauuuuggguuucauuauugcuuucauccuggcguuuuca

SEQ ID NO: 105817 - RNA, 44 nt, Mus musculus
ugaaucucuacaacgagaccguggaaacgcuaauggcuggggaa

SEQ ID NO: 105818 - RNA, 42 nt, Mus musculus
cugaguccccacagagggaguguggcgucccaccgcugucag

SEQ ID NO: 105819 - RNA, 29 nt, Mus musculus
agacccuuuaagacccuugcuuagcccua

SEQ ID NO: 105820 - RNA, 46 nt, Mus musculus
gcaagccuccuccccuccacuuccuguccucacucagcaccugccc

SEQ ID NO: 105821 - RNA, 46 nt, Mus musculus
aagagugaggcggcucccacgcacugccugacucccaugcagacac

SEQ ID NO: 105822 - RNA, 44 nt, Mus musculus
guacuuucauugccaggacucaccuggaguuugagucacgggug

SEQ ID NO: 105823 - RNA, 46 nt, Mus musculus
uuuaaaaaaaaaaaaaaccagaacauugaaaucaaauuuggggcau

SEQ ID NO: 105824 - RNA, 43 nt, Mus musculus
agagagugugugcaugugugagugugaguguguguguguggac

SEQ ID NO: 105825 - RNA, 46 nt, Mus musculus
cucucuauaauucauacuaccaugaagguguauucuaagacuccag

SEQ ID NO: 105826 - RNA, 45 nt, Mus musculus
caaccaccacccaagugcacccuacccuauccaaccauagcccac

SEQ ID NO: 105827 - RNA, 41 nt, Mus musculus
aacuggauagauuggaaggaagaagaaaaaaagaacaggag

SEQ ID NO: 105828 - RNA, 42 nt, Mus musculus
gggcaacauucagaacauguguaguaaaaugauagguaagag

SEQ ID NO: 105829 - RNA, 87 nt, Mus musculus
uauggcuuccucgugugcaggacugggugcuauagccauuucacauuucguaagaguucuuacuguuagaaacaguccuggggagag

SEQ ID NO: 105830 - RNA, 45 nt, Mus musculus
agggacagaaaagaaacuagauacagcucauagcugagcuacaaa

SEQ ID NO: 105831 - RNA, 65 nt, Mus musculus
ucuuccacauugcaaagcuguucuugauuccugagccuucccacauaaacgaacaaguaucuuua

SEQ ID NO: 105832 - RNA, 47 nt, Mus musculus
cucuggcuccuguaguuccuuggucauuuugugaccugcgugaagau

SEQ ID NO: 105833 - RNA, 45 nt, Mus musculus
uucaaggagcucccuggugccaaacccagcgaugacagcgcuguc

SEQ ID NO: 105834 - RNA, 46 nt, Mus musculus
ggcuuccuaugguaaggcuaaccuggagaacuuggguacaccccag

SEQ ID NO: 105835 - RNA, 57 nt, Mus musculus
cauacuguacacaaagacucggggcucuacaaagacuugcugcacaaaauccacgua

SEQ ID NO: 105836 - RNA, 50 nt, Mus musculus
gacaggggcuccgaggagaaacccacucaggaaaacaacuacaggcugcu

SEQ ID NO: 105837 - RNA, 46 nt, Mus musculus
ugacaggcccugccauuuaacaggaccacucugcgacugucaugag

SEQ ID NO: 105838 - RNA, 45 nt, Mus musculus
ggccuaugccccaaagccaguggugcuggguagagaucccgggag

SEQ ID NO: 105839 - RNA, 42 nt, Mus musculus
cuagagccuggggccggccuguuccaaacucccuagccacau

SEQ ID NO: 105840 - RNA, 46 nt, Mus musculus
aggaggaucguaucuggcaaagacucaagcaucugcugacagguag

SEQ ID NO: 105841 - RNA, 49 nt, Mus musculus
uuucuuccagucgguagacggcuggagggauguucugacguggcuaaga

SEQ ID NO: 105842 - RNA, 46 nt, Mus musculus
auugccuagaccgcaagacucuguuaauuguauauaaugauuucag

SEQ ID NO: 105843 - RNA, 87 nt, Mus musculus
aaacuacuuuuaaccgucugcuuccuguacaccuuuuugauuggagaaacuuggaaaguaccaaagaaauaggggauaacgugccag

SEQ ID NO: 105844 - RNA, 49 nt, Mus musculus
uucauuaaucaagcauauuaaauuuauaauaaaaaaaagugccccucaa

SEQ ID NO: 105845 - RNA, 42 nt, Mus musculus
gggaaagaaccgggaagaauagaggaaaggaggggaggggag

SEQ ID NO: 105846 - RNA, 45 nt, Mus musculus
uggagacagcaucagagacagaaaguaggaaaucacacaggcaga

SEQ ID NO: 105847 - RNA, 44 nt, Mus musculus
ccuuuaaaaaugacucgaaccuuuggguuguuucccagccggga

SEQ ID NO: 105848 - RNA, 63 nt, Mus musculus
auauguagugugugugugguguguguguguguguguguguguaaguguguugugccugugugu

SEQ ID NO: 105849 - RNA, 46 nt, Mus musculus
cgggggucuguaucuucuuagcaggauauggacuacgcccugagaa

SEQ ID NO: 105850 - RNA, 42 nt, Mus musculus
cccacgacuacccauuggcuaagagacacauaaggggcagag

SEQ ID NO: 105851 - RNA, 46 nt, Mus musculus
gccuggcugggaaggccacugagaugaagagaguugacggugcucu

SEQ ID NO: 105852 - RNA, 45 nt, Mus musculus
gaugucaauacuuugauagcugggccuuggaagucagccuuagga

SEQ ID NO: 105853 - RNA, 42 nt, Mus musculus
agaugggcccgugcucugaauacucagcaaauaaaucaaccg

SEQ ID NO: 105854 - RNA, 46 nt, Mus musculus
aacgacaagaaaacauacuaguagaaccagaagccgaugagcagag

SEQ ID NO: 105855 - RNA, 46 nt, Mus musculus
ccuucacuuuucagugugugaccugcagucacccauggccuaagau

SEQ ID NO: 105856 - RNA, 45 nt, Mus musculus
aaagaaugccugcugaggugggcauggucuuucaugccuccagaa

SEQ ID NO: 105857 - RNA, 45 nt, Mus musculus
gccccaggucugacuugcuugauguuguggugcuugcuggcggug

SEQ ID NO: 105858 - RNA, 46 nt, Mus musculus
gagccaagaagggggaucugaaggucagcauccaucgcauggagau

SEQ ID NO: 105859 - RNA, 45 nt, Mus musculus
gaaugaaaaguuugccccugagcuccuggaaagcaaggcugagau

SEQ ID NO: 105860 - RNA, 42 nt, Mus musculus
ggaucuccacggacaggacucugauggggguagugaggagau

SEQ ID NO: 105861 - RNA, 41 nt, Mus musculus
ccucaguccguggugucccccgagcgugccggcuaggagag

SEQ ID NO: 105862 - RNA, 46 nt, Mus musculus
cuagucugucugccuuuuaaacuuguugcaauaaugucgccaagau

SEQ ID NO: 105863 - RNA, 45 nt, Mus musculus; identical to SEQ ID NO: 86316

SEQ ID NO: 105864 - RNA, 45 nt, Mus musculus; identical to SEQ ID NO: 86317

SEQ ID NO: 105865 - RNA, 46 nt, Mus musculus
uuaaggcaguauuuaugcaauuccgguuguuucuuugaaagcaguu

SEQ ID NO: 105866 - RNA, 46 nt, Mus musculus
uugagggugugugugccugugguccggcugacccgccgcccgaguc

SEQ ID NO: 105867 - RNA, 46 nt, Mus musculus
aauucaaagccauuuaaaacacaggcaguuggccagcccaagacag

SEQ ID NO: 105868 - RNA, 46 nt, Mus musculus
acagguccugccuccagcugggaccuucgucuauccacuggccgau

SEQ ID NO: 105869 - RNA, 45 nt, Mus musculus
cagagccuaauguaucuauaguaagauaacagugaauguuugaga

SEQ ID NO: 105870 - RNA, 42 nt, Mus musculus
guuugucuuuaugccuuguuuuuaaggaagccaggggacauu

SEQ ID NO: 105871 - RNA, 46 nt, Mus musculus
aguacacagugugucccguguacagcugauaacugugucccgugua

SEQ ID NO: 105872 - RNA, 26 nt, Mus musculus
uuaacugauggcagcuuauggauagu

SEQ ID NO: 105873 - RNA, 46 nt, Mus musculus
acugauaucugugugcucuccacauggaaugagcaucccagcagag

SEQ ID NO: 105874 - RNA, 35 nt, Mus musculus
cagagaacaccgcugagauacuuucucacacuguc

SEQ ID NO: 105875 - RNA, 45 nt, Mus musculus
uuuauuauuuucuccaaaauaaggauuuggaauuuuccuuuuaga

SEQ ID NO: 105876 - RNA, 46 nt, Mus musculus
uauauugcacauauacacaugccagggcaccaguagagaccagaga

SEQ ID NO: 105877 - RNA, 46 nt, Mus musculus
uuugcucagcguucagaugcuuguuuuaggaauacagacucucaau

SEQ ID NO: 105878 - RNA, 46 nt, Mus musculus
uacggucuaguauuuggagaaagaccacuaaggcuaaugcucagag

SEQ ID NO: 105879 - RNA, 50 nt, Mus musculus
guccuguccucgccaugaggccgcagcaggcaccgguguccgggaaggug

SEQ ID NO: 105880 - RNA, 42 nt, Mus musculus
aggacccgccgcucugcgaguucgggcaagacacggggucag

SEQ ID NO: 105881 - RNA, 45 nt, Mus musculus
ugagguucaguccauuaucaucauggugggaagcauggcagcuuc

SEQ ID NO: 105882 - RNA, 41 nt, Mus musculus
gagaaagagaccggggugggaggugcgaggagaaagagaga

SEQ ID NO: 105883 - RNA, 46 nt, Mus musculus
uggcuaggaugaccuuagucagcguauuguaaagguggauucuuug

SEQ ID NO: 105884 - RNA, 44 nt, Mus musculus
ccugucucuuuugacuaauauuuucguaaacauuaggcuggaga

SEQ ID NO: 105885 - RNA, 46 nt, Mus musculus
agccauuuauauggacuuaugucucuuaaugcacaaagaagcagau

SEQ ID NO: 105886 - RNA, 55 nt, Mus musculus
aauuaacuguauuaguguaagcuuugucacuaugcgcuaaacguaauccugacuu

SEQ ID NO: 105887 - RNA, 45 nt, Mus musculus
aauguuuucucuggccauuuguggauuuaaugcacuugacgugga

SEQ ID NO: 105888 - RNA, 48 nt, Mus musculus
ugaaaagccuuucucuuccaaccaugaaugaacacaaaccaccacaaa

SEQ ID NO: 105889 - RNA, 46 nt, Mus musculus
accacaaccgaaaauaucuucucagggaaacuugauuccggcucgg

SEQ ID NO: 105890 - RNA, 46 nt, Mus musculus
caucuuucuuugaugaagggugaggacuacaguaucagugggugua

SEQ ID NO: 105891 - RNA, 46 nt, Mus musculus
aaagcaguaguaaaaugaaaaauauuuaccagcugaggaacgggau

SEQ ID NO: 105892 - RNA, 46 nt, Mus musculus
aaucuugacuaaaacuaaaucauacaccaugaacagaaccagagau

SEQ ID NO: 105893 - RNA, 62 nt, Mus musculus
acaaacuucccaggcuuuguuuggggacagagggccagagauguucuauacucgauugauuu

SEQ ID NO: 105894 - RNA, 45 nt, Mus musculus
cuuagauuggacagacugaggaggcagggaacugugcagccaggg

SEQ ID NO: 105895 - RNA, 46 nt, Mus musculus
gucaaugccuuacaguuucccauuuaauguugacuuagggcaaggu

SEQ ID NO: 105896 - RNA, 45 nt, Mus musculus
cugggcauggaaacagauucccaguaccaaccuacgccgccaagc

SEQ ID NO: 105897 - RNA, 42 nt, Mus musculus
gggcucccuuuguagcuauuugaaauguacaauaggccaccu

SEQ ID NO: 105898 - RNA, 46 nt, Mus musculus
ggucagauggcagaaaucaagcaaacgucucuagacagccaggaga

SEQ ID NO: 105899 - RNA, 50 nt, Mus musculus
cggcugccauuuuccucuuuaucaagagagaugaacuacggaaaaccuuc

SEQ ID NO: 105900 - RNA, 45 nt, Mus musculus
uuuaugaaggauauucaucuauaauucucccccaccccaccucac

SEQ ID NO: 105901 - RNA, 60 nt, Mus musculus
ggcucccccacacugugacaccaaaggauauggaggaagcguggacagcgggccgacgua

SEQ ID NO: 105902 - RNA, 46 nt, Mus musculus
cuuuaguuugcucauaguuguauuucugagccaauagucuugggga

SEQ ID NO: 105903 - RNA, 46 nt, Mus musculus
ucauuaauuaauuuauugacuuuacauccugauugcacccccugcu

SEQ ID NO: 105904 - RNA, 45 nt, Mus musculus
cguuuccuggcuguuauggguagaggagcagugaacacagauaaa

SEQ ID NO: 105905 - RNA, 46 nt, Mus musculus
gagagagagagagagagaauguguguguguguaugugucugugggg

SEQ ID NO: 105906 - RNA, 45 nt, Mus musculus
ccccuggaggcauuuuauauuuacaguguuugucuugcccgguag

SEQ ID NO: 105907 - RNA, 42 nt, Mus musculus
cuaaaggugacagauuuggcaacugugguuucuccggcagug

SEQ ID NO: 105908 - RNA, 42 nt, Mus musculus
gucaaguauaucuuacaucacauggugaaguuaggauaagag

SEQ ID NO: 105909 - RNA, 45 nt, Mus musculus
guuccugaguacugcaacgguuccucucaguucugcccgccagau

SEQ ID NO: 105910 - RNA, 42 nt, Mus musculus
cucauuuuauaauauguuugcauugacuguuuggggcuuugu

SEQ ID NO: 105911 - RNA, 46 nt, Mus musculus
cacccacuucugugcauuuaaacugcacuuuuuaugaugaggggca

SEQ ID NO: 105912 - RNA, 45 nt, Mus musculus
cagcuaggcgagcaggcugugucgaggucagcugaaaucacaggc

SEQ ID NO: 105913 - RNA, 46 nt, Mus musculus
ccuauccagagacaagagccaucccguggguaguggggcccugagc

SEQ ID NO: 105914 - RNA, 46 nt, Mus musculus
ggagucuccuggccgacaacuagagaggaaauuucuccugcuuaga

SEQ ID NO: 105915 - RNA, 45 nt, Mus musculus
cucucaguguacccagugaaccuucuccccuugggcugccauuag

SEQ ID NO: 105916 - RNA, 44 nt, Mus musculus
agcugguggacccuggagaggagugugacugcggcacagcgaag

SEQ ID NO: 105917 - RNA, 45 nt, Mus musculus
uuacuauuuauuguagcggguccagaaacuuuagcaguugcagug

SEQ ID NO: 105918 - RNA, 46 nt, Mus musculus
agagacagagagacauaucaagagagacagagagaaucagagagac

SEQ ID NO: 105919 - RNA, 46 nt, Mus musculus
ggaacaaaaugggguugguuugaaugcuuuaauaauaaacccagag

SEQ ID NO: 105920 - RNA, 46 nt, Mus musculus
uuggugauuagugaugcuggccacccucuucauguaagcucuuggg

SEQ ID NO: 105921 - RNA, 68 nt, Mus musculus
uuuucugcuggcuuugcuuuuuucacagccuuaccuggacuuuucuuuuaggguuuuguaacagccac

SEQ ID NO: 105922 - RNA, 46 nt, Mus musculus
uccauguucgcugcugcuaacuuuccuguuaacuuagccagcuuug

SEQ ID NO: 105923 - RNA, 46 nt, Mus musculus
cuccauuuucuugcugccuucccccccugcccccccaccaucagac

SEQ ID NO: 105924 - RNA, 46 nt, Mus musculus
acuucuuauagauaagauacauuuuggguugaaaguuuggugagug

SEQ ID NO: 105925 - RNA, 46 nt, Mus musculus
uugcucaugaauuggggcauaaccuuggaaugaaucaugaugaugg

SEQ ID NO: 105926 - RNA, 58 nt, Mus musculus
ggcuuugguggaacugcaggaauggcguuuguaggaacaguauguucaaggagccacg

SEQ ID NO: 105927 - RNA, 59 nt, Mus musculus
cuggagaugugcugggcaacuuuguucaguggcgggaaaaguuccuuauaacucguugg

SEQ ID NO: 105928 - RNA, 50 nt, Mus musculus
agagcuguucuaccacagacccgcuauguggagcuguucauuguuguaga

SEQ ID NO: 105929 - RNA, 58 nt, Mus musculus
agauguggagucucuaacagggacacagagaaggaaggcacacagggggaugaggagg

SEQ ID NO: 105930 - RNA, 42 nt, Mus musculus
caggauugcagugucuugaugguuuugaggagcacagcaaua

SEQ ID NO: 105931 - RNA, 46 nt, Mus musculus
acuuaaaauguuaacuaugcuguuucugggcugaaaggucacgggg

SEQ ID NO: 105932 - RNA, 46 nt, Mus musculus
augaaauguuaguaaaagugaagguauugggucuuucuuggcagac

SEQ ID NO: 105933 - RNA, 46 nt, Mus musculus
auguagcuagauugucccuuauaauaccauaccacugccugcagua

SEQ ID NO: 105934 - RNA, 46 nt, Mus musculus
agguauuucaguuauuucuugguuauugaacauuguucagguaaau

SEQ ID NO: 105935 - RNA, 46 nt, Mus musculus
gcggugucuuuucuuggagcauaaacauuucuagcuuugcucagga

SEQ ID NO: 105936 - RNA, 47 nt, Mus musculus
ugauguaguugguggugauguaguugguggugauguaguugguggug

SEQ ID NO: 105937 - RNA, 130 nt, Mus musculus
uaguuggguggugauguaguugguggugauguaguuggguggugauguaguugguggugauguaguuggguggugauguaguugguggugauguaguuggguggugauguaguugguggugauguaguug

SEQ ID NO: 105938 - RNA, 43 nt, Mus musculus
auguaguuggguggugauguaguugguggugauguaguugggu

SEQ ID NO: 105939 - RNA, 49 nt, Mus musculus
gugauguaguuggguggugauguaguugguggugauguaguuggguggu

SEQ ID NO: 105940 - RNA, 49 nt, Mus musculus
aacguuuccuuuagcaauugacagcagccauuugucuucauaagucggu

SEQ ID NO: 105941 - RNA, 46 nt, Mus musculus
gauguguauguauguguguguauaugaaggauguguauguaugugu

SEQ ID NO: 105942 - RNA, 46 nt, Mus musculus
agagugaaguauguaggagugagugcgcgugugcaucugugugugu

SEQ ID NO: 105943 - RNA, 44 nt, Mus musculus
cccaaggaaaacagcauauuauucacuuggaaagaaacacguaa

SEQ ID NO: 105944 - RNA, 42 nt, Mus musculus
uuugaaagucauuucucgucuucuaccaugugggucccagga

SEQ ID NO: 105945 - RNA, 45 nt, Mus musculus
uucugacaugguucuccauugacaaaauaucuggaugguaguuga

SEQ ID NO: 105946 - RNA, 44 nt, Mus musculus
uuccuuuacaguaauaugagagaaaugauguuuuggcucccaca

SEQ ID NO: 105947 - RNA, 71 nt, Mus musculus
guuaauagguuaauacacuauggggguuggacucuaggagaguggagagagcgaggcggagccagguuuug

SEQ ID NO: 105948 - RNA, 46 nt, Mus musculus
ugaugcuuuuggaggaucuaaagggugaccauguggacuaagauau

SEQ ID NO: 105949 - RNA, 42 nt, Mus musculus
cucgcuacucccgggcugcagcgagugcuuugcggguggagu

SEQ ID NO: 105950 - RNA, 46 nt, Mus musculus
aaaucugguuguguguuuuccuggucagaucucguggccgugggug

SEQ ID NO: 105951 - RNA, 42 nt, Mus musculus
cuucccaugucgccuguuuaaccuccucccccacccccaccc

SEQ ID NO: 105952 - RNA, 48 nt, Mus musculus
acaugagacuugcaaguuagaacauuguuaauagcggugcccagaaaa

SEQ ID NO: 105953 - RNA, 38 nt, Mus musculus
cggguccuuacagaaaguugagagguuucgguacacac

SEQ ID NO: 105954 - RNA, 42 nt, Mus musculus
caggaacuccugaagggccucgaacaugcccuggcucaagga

SEQ ID NO: 105955 - RNA, 86 nt, Mus musculus
cuuugucuggccuugugauccugaugaaaagaaaaccaaacaaaaaucagugggcuucuuucucuuucuguucaugaucuugugug

SEQ ID NO: 105956 - RNA, 52 nt, Mus musculus
ugagaggaagcaugcucuuucaaaugugacugugacccugaaucuggugcca

SEQ ID NO: 105957 - RNA, 45 nt, Mus musculus
cccuguuuuuaauuagaaauuuguagcucuaagagacuaggaggc

SEQ ID NO: 105958 - RNA, 46 nt, Mus musculus
gggaauaaagaaauugaaucagaggaugaauuguuggcuaggaauu

SEQ ID NO: 105959 - RNA, 54 nt, Mus musculus
gaccagaacagagacuucccuugaaacugaggugugugugugugugugugugug

SEQ ID NO: 105960 - RNA, 51 nt, Mus musculus
gucaugucccgaggauaugcgguuaucagggucaaauguuaugauugcaga

SEQ ID NO: 105961 - RNA, 45 nt, Mus musculus
ucccaggggagcagacaggaccucuugugagucaugagggcuaau

SEQ ID NO: 105962 - RNA, 46 nt, Mus musculus
agagcggucguaagagucuggggagugaaaggugaauuuuugggau

SEQ ID NO: 105963 - RNA, 45 nt, Mus musculus
ucuuugacucgaccuggaaguucuacccuuacaagcgcgccuaac

SEQ ID NO: 105964 - RNA, 44 nt, Mus musculus
cacacacacacacacacacacacacacacacacuuuggagcuca

SEQ ID NO: 105965 - RNA, 41 nt, Mus musculus
acacacacacacacacacacacacacacuuuggagcucagu

SEQ ID NO: 105966 - RNA, 45 nt, Mus musculus
ugccaucaaggacagaaaccagaauacacauaagaucagggcagg

SEQ ID NO: 105967 - RNA, 45 nt, Mus musculus
cagggauugaguccaucaggcaggaaauauaugccaugguaacag

SEQ ID NO: 105968 - RNA, 44 nt, Mus musculus
aggugggagcaugacagcauccaggcaggcauggagcaggcaga

SEQ ID NO: 105969 - RNA, 25 nt, Mus musculus
ucccuaugaggucacagcagcuagc

SEQ ID NO: 105970 - RNA, 46 nt, Mus musculus
uuaaugagggacaaccuguuugaaaucauaaccaccuccaggacgu

SEQ ID NO: 105971 - RNA, 45 nt, Mus musculus
aucacuaauuaagaaaaugcccuacaggccugccuacagcccaau

SEQ ID NO: 105972 - RNA, 42 nt, Mus musculus
aaacagcaugcaccuggggcaguggauggaaaggggacagga

SEQ ID NO: 105973 - RNA, 46 nt, Mus musculus
cucugcguaccauaccgcucaaggauguucucaagacucacgagug

SEQ ID NO: 105974 - RNA, 34 nt, Mus musculus
ugccgcccuuccacugggccuccccucauuaaga

SEQ ID NO: 105975 - RNA, 44 nt, Mus musculus
guucuucgacugacauuauaucaaaaagaccagaggugugguga

SEQ ID NO: 105976 - RNA, 46 nt, Mus musculus
cucccacccuagagaagaagccgcagguggccuacaagacugagau

SEQ ID NO: 105977 - RNA, 42 nt, Mus musculus
gguaugacaucccacaggaaauuagcgaggguggccugagga

SEQ ID NO: 105978 - RNA, 46 nt, Mus musculus
aagggauugcuaacaagaagcagaggaacuggggaagcgcacgaga

SEQ ID NO: 105979 - RNA, 42 nt, Mus musculus
ucugaaggacuggguagaagccuugaaccaagccagcaagau

SEQ ID NO: 105980 - RNA, 46 nt, Mus musculus
ccuggaacuuugcuccugcugcacccagacuccaaugugcugagau

SEQ ID NO: 105981 - RNA, 23 nt, Mus musculus
cccaugggaacuguauccuguau

SEQ ID NO: 105982 - RNA, 41 nt, Mus musculus
gaguugccucuguucaugggcaacauaaauagaccuucaga

SEQ ID NO: 105983 - RNA, 44 nt, Mus musculus
ggguggcuggcaugaaggaaaguaccacaaagcaucuggcaauc

SEQ ID NO: 105984 - RNA, 46 nt, Mus musculus
gcuuuuaguucagcuucaaaaguccccagucuuucagucucaagau

SEQ ID NO: 105985 - RNA, 46 nt, Mus musculus
aagacauuugcuuuguuuaaaaaccaaccaaccaaccaaccaacca

SEQ ID NO: 105986 - RNA, 46 nt, Mus musculus
guaaaugugugaguguguguguuauauguuuugugugugugugugu

SEQ ID NO: 105987 - RNA, 42 nt, Mus musculus
ugcagagguguguguguguguguguguguguguguguaugug

SEQ ID NO: 105988 - RNA, 32 nt, Mus musculus
cgcuguaguuuuccauuucuauugcuucuuga

SEQ ID NO: 105989 - RNA, 45 nt, Mus musculus
gaaaggggugggcauggaaggugucuuguccucauucuggaagca

SEQ ID NO: 105990 - RNA, 45 nt, Mus musculus
augugcuuuaagaugugagcuggaggguugacaagaugggucagu

SEQ ID NO: 105991 - RNA, 45 nt, Mus musculus
gccuauuaucuucuggagaccaggcacaaagaugaggaaccaagu

SEQ ID NO: 105992 - RNA, 44 nt, Mus musculus
ggauauugaagacaaugagaacaguggcaaauuccuccggagau

SEQ ID NO: 105993 - RNA, 45 nt, Mus musculus
uauggugcagggugaugugaacagagcccaggaaugccuuaugug

SEQ ID NO: 105994 - RNA, 127 nt, Mus musculus
ugugugugguguguguguguggugugugugugguguguguggugugugugugguguguaugugguguguguguggugugugugugguguguaugugguguguguguggugugugugugugugugugu

SEQ ID NO: 105995 - RNA, 55 nt, Mus musculus
guguguguggugugugugugguguguguggugugugugugguguguguguggugu

SEQ ID NO: 105996 - RNA, 46 nt, Mus musculus
uaaauucagggucuacaugaauaaacuacauagcccagacuggccu

SEQ ID NO: 105997 - RNA, 46 nt, Mus musculus
uguguuacaugugugugggucauggguguguguugcauguguauuu

SEQ ID NO: 105998 - RNA, 30 nt, Mus musculus
gugucugagaggcauuaucucuguuauagg

SEQ ID NO: 105999 - RNA, 46 nt, Mus musculus
ugggaaggugaucugaugagccuuuauuucuugccugcggccccuc

SEQ ID NO: 106000 - RNA, 47 nt, Mus musculus; identical to SEQ ID NO: 74518

SEQ ID NO: 106001 - RNA, 41 nt, Mus musculus
aagccugacuugaguucugccuccaggacucccgugguaga

SEQ ID NO: 106002 - RNA, 45 nt, Mus musculus
gauguuugauccuggguuggcagaacuguucugggacagagugag

SEQ ID NO: 106003 - RNA, 45 nt, Mus musculus
augcugcucaguucuuugccacuucccaccagaacacaccccagu

SEQ ID NO: 106004 - RNA, 46 nt, Mus musculus
ggacuccccagggcugagcugcagcagccacccacaagggccagga

SEQ ID NO: 106005 - RNA, 45 nt, Mus musculus
ugcucugcacaucaucgcgaagccgacagcgaagcuguagcaggu

SEQ ID NO: 106006 - RNA, 42 nt, Mus musculus
ccugagacauugacggagaaguaggugguaucgcugccagag

SEQ ID NO: 106007 - RNA, 42 nt, Mus musculus
cuggcugccccuccgcaccagcccuuccugucccucugccuc

SEQ ID NO: 106008 - RNA, 41 nt, Mus musculus
gagaccggggcuggguugccgggugucugcugggagaggug

SEQ ID NO: 106009 - RNA, 42 nt, Mus musculus
acccauaaggagugagacccuggaagagaaggggccgcggau

SEQ ID NO: 106010 - RNA, 128 nt, Mus musculus
gcuucuucugggaaucaaggagagaaacuagugaaucaaaguggaggaaaagauaagauuaggaaauagggaugaaaaaugauugugucaggaugcaagagcaggauaggaaauagacgcaggaaacu

SEQ ID NO: 106011 - RNA, 41 nt, Mus musculus
aguguuggaaaggaugagaauuaucgaccaggcgucacaga

SEQ ID NO: 106012 - RNA, 87 nt, Mus musculus
ggcuagagaaauagagaagcuagugguuaugggguugugauuguugugaaaugagggagguguggguguuacuguucugagagaaga

SEQ ID NO: 106013 - RNA, 51 nt, Mus musculus
gauuuaaagggggcaggggcagccauguuuguuacccggcacugcagugua

SEQ ID NO: 106014 - RNA, 45 nt, Mus musculus
aguaaacaaggaaacugcauugguuauuuuacuuggggcgcguug

SEQ ID NO: 106015 - RNA, 45 nt, Mus musculus
gccaguucagcagcgugaucugugaaguaggcauguaguccuuag

SEQ ID NO: 106016 - RNA, 46 nt, Mus musculus
acaaagcugguauuugaguguaggucuuuuaaguuauagaacccag

SEQ ID NO: 106017 - RNA, 46 nt, Mus musculus
gugugacuggauuauauccagccuaucuuggaguuuguguuuggug

SEQ ID NO: 106018 - RNA, 61 nt, Mus musculus
gcugucaaccacagagucaccucuccaacucccuccucuuagauugggugggcacuggacu

SEQ ID NO: 106019 - RNA, 46 nt, Mus musculus
ucuauauauaaagaggcccuagauuugauuuucagcuuuaaaaaga

SEQ ID NO: 106020 - RNA, 41 nt, Mus musculus
aggucucacuauauguagcugacugaccugaaacucaugga

SEQ ID NO: 106021 - RNA, 45 nt, Mus musculus
caaaccaguaacaucaguugugauucauguuacaagcaucuagug

SEQ ID NO: 106022 - RNA, 23 nt, Mus musculus
ccuuagcuucugguaccuacccu

SEQ ID NO: 106023 - RNA, 41 nt, Mus musculus
gucuaauaguaaacacuugcgcuauuagagaaaucugaaua

SEQ ID NO: 106024 - RNA, 45 nt, Mus musculus
guguauuaacaccugaauggaaucauaagacugagugguggcuga

SEQ ID NO: 106025 - RNA, 46 nt, Mus musculus
ggacucuuccagcauaagcagugagugagugggaggcaguggacag

SEQ ID NO: 106026 - RNA, 46 nt, Mus musculus
uacacacauggugcacacacacacacacacacacacacacacacac

SEQ ID NO: 106027 - RNA, 42 nt, Mus musculus
aggcucacauuucagaaauguuucugucuugcuuaccuccug

SEQ ID NO: 106028 - RNA, 42 nt, Mus musculus
ugagucaggagacuccccaguuuaaggacagccugggcucca

SEQ ID NO: 106029 - RNA, 46 nt, Mus musculus
cgaugagagaaagggaaaguuaaggaugcuggagcagaacaaugga

SEQ ID NO: 106030 - RNA, 42 nt, Mus musculus
cacaugaaauucuggaaaaaccuucuccuccucagccaccuc

SEQ ID NO: 106031 - RNA, 45 nt, Mus musculus
gcacagucaaugaaugcucuuaaccacugagccaucucuccagac

SEQ ID NO: 106032 - RNA, 45 nt, Mus musculus
cugggaacugaacccagguccucugaaagagcaaaagugcccuca

SEQ ID NO: 106033 - RNA, 42 nt, Mus musculus
gauuuguuuaacuuucuguguguguuuguguuuugccugcau

SEQ ID NO: 106034 - RNA, 46 nt, Mus musculus
aguuuuaagaaaggaaaaagccagucugcuuaacagugcuguuuag

SEQ ID NO: 106035 - RNA, 46 nt, Mus musculus
cuagagaccaaaugagaggguggacacugcaccagagaagccaaga

SEQ ID NO: 106036 - RNA, 45 nt, Mus musculus
aucucugagaguaccugagggauucucuuaguuguguuaguaguu

SEQ ID NO: 106037 - RNA, 93 nt, Mus musculus
cccgggaauaucauguccaauuuuuuagcaaccagccagagagggcauggguucaugagaaacggguacgggaauacaaaggucaugaacagu

SEQ ID NO: 106038 - RNA, 46 nt, Mus musculus
acucacuauauccugaaacuaccaagcuggccucaaacucacagaa

SEQ ID NO: 106039 - RNA, 46 nt, Mus musculus
auuuaaacacuuagucaucaacauuuaguuuauacuaugccaucuc

SEQ ID NO: 106040 - RNA, 69 nt, Mus musculus
ggagcucacucuguagaccaggcuggccuugaacuccugcagaucugccuuucucugucuccugagucu

SEQ ID NO: 106041 - RNA, 44 nt, Mus musculus
ugucuugugggucccagggaugguuagugaggcguagaggccag

SEQ ID NO: 106042 - RNA, 41 nt, Mus musculus
cauugcucaugcagagaaagcauugaaaaugacucgggagg

SEQ ID NO: 106043 - RNA, 42 nt, Mus musculus
ccuccuguuaaaaucgccuggaaaacagcagccgcaaggaag

SEQ ID NO: 106044 - RNA, 46 nt, Mus musculus
guugugaaaauugaacaaguguuugcucuccagaaugcaacaggag

SEQ ID NO: 106045 - RNA, 48 nt, Mus musculus
ccucucacuccccacuccccucuuucucauuuccuuuccuugccagau

SEQ ID NO: 106046 - RNA, 45 nt, Mus musculus
gcauauacaauagugggaaacaguuuuuuaacguggguccugggg

SEQ ID NO: 106047 - RNA, 47 nt, Mus musculus
acuuuuuauuauauuguaauauuauacugaucaaagaaucuucugga

SEQ ID NO: 106048 - RNA, 46 nt, Mus musculus
gucccagaaucucaucccuuuaaugccagcacuuaggaggcagagc

SEQ ID NO: 106049 - RNA, 46 nt, Mus musculus
ucgaucugagucagagaaguccgccgagguugugccaaagaagaag

SEQ ID NO: 106050 - RNA, 45 nt, Mus musculus
aauuuaauuuauauucuuauauuuaagaaucagguaaucauaaau

SEQ ID NO: 106051 - RNA, 49 nt, Mus musculus
guucaacugguguaaucgauguaguaauaauauacaugugaaauuaccu

SEQ ID NO: 106052 - RNA, 45 nt, Mus musculus
uucuagcagcacaaguauugagcuuccagcuguauggagccaugu

SEQ ID NO: 106053 - RNA, 45 nt, Mus musculus
ggucacagaaacagacacugaggaaaaugcucuggcucuccucua

SEQ ID NO: 106054 - RNA, 42 nt, Mus musculus
gaguaacuggccagccugcaguacauaggaaguuccaggaua

SEQ ID NO: 106055 - RNA, 42 nt, Mus musculus
aaaaccccuaaaaacuaaaagaaagaaaaggaaggaaggaag

SEQ ID NO: 106056 - RNA, 46 nt, Mus musculus
cagucugcugcuauaaacguaggcuuuuguuucguuugugccagag

SEQ ID NO: 106057 - RNA, 46 nt, Mus musculus
auuucauuaugcaaagugcauuuaauccaacauuaaaggcccccau

SEQ ID NO: 106058 - RNA, 46 nt, Mus musculus
cugaagaucaaaacuuuuuguuguuuguuuuugcuuuaggacacag

SEQ ID NO: 106059 - RNA, 46 nt, Mus musculus
agaccugaugcccucuucuggugugucugaagacagacagcuacag

SEQ ID NO: 106060 - RNA, 46 nt, Mus musculus
gcuuccuuaaggugggcaggggccugcauuacuccucaacaagaua

SEQ ID NO: 106061 - RNA, 45 nt, Mus musculus
aggcuugcaggauccgcucccugaacaaaagggcucaaagacaag

SEQ ID NO: 106062 - RNA, 42 nt, Mus musculus
agaucugaugcccucuucuggugugucuaaggacagcuacag

SEQ ID NO: 106063 - RNA, 46 nt, Mus musculus
cucuugcuuaagugguccuccugccccagccucucaagugggugag

SEQ ID NO: 106064 - RNA, 46 nt, Mus musculus
acuucauucccagagaacaugacaucuuauuucuaaaggcaccagg

SEQ ID NO: 106065 - RNA, 46 nt, Mus musculus
auaaacuauauguaguuaugucuuaugugaaaaguguagccgggca

SEQ ID NO: 106066 - RNA, 31 nt, Mus musculus
cugcccucacuccccaaacacuggaguccag

SEQ ID NO: 106067 - RNA, 45 nt, Mus musculus
guaugaaagaaaaaacacuacaagauggaaguuuguuuggcugaa

SEQ ID NO: 106068 - RNA, 44 nt, Mus musculus
ucauguauuuauaaauacccuacccugaccuaucucucuccugc

SEQ ID NO: 106069 - RNA, 34 nt, Mus musculus
acugccugugccaucaucgcagccugggucuuag

SEQ ID NO: 106070 - RNA, 45 nt, Mus musculus
gggaaugggaauguggggagaaagggagggaaagguacagugcag

SEQ ID NO: 106071 - RNA, 46 nt, Mus musculus
gaaaaucaauuguuuggcuuuugucaauccauugcaaaaguggcag

SEQ ID NO: 106072 - RNA, 45 nt, Mus musculus
cauuuguguccauuuaaauauuacacaauaaacacauaucugcag

SEQ ID NO: 106073 - RNA, 42 nt, Mus musculus
gucgguagcgucagcuuuccuuagaaacuuggcgaggaagau

SEQ ID NO: 106074 - RNA, 42 nt, Mus musculus
uugguaaagacaccauucagagcuagggcaaggcuggcagcu

SEQ ID NO: 106075 - RNA, 42 nt, Mus musculus
auccucgucccccgugcacgucagaucagaaugggccagccc

SEQ ID NO: 106076 - RNA, 45 nt, Mus musculus
gccuuguggcgugaagcaguguaacuucccugccagguagaagga

SEQ ID NO: 106077 - RNA, 46 nt, Mus musculus
gcucacaaccaucuauaauggggucugaugcccuuuuugguguguc

SEQ ID NO: 106078 - RNA, 46 nt, Mus musculus
auuagcuaauacaacugauaccagcaguuaguuacauacaccagau

SEQ ID NO: 106079 - RNA, 45 nt, Mus musculus
uuugaacugauuuuuuucuuucugucuuuaaaguuuuguggguuu

SEQ ID NO: 106080 - RNA, 44 nt, Mus musculus
gaguguguauaugugauuugaaccaugugggaauugaacuuagg

SEQ ID NO: 106081 - RNA, 44 nt, Mus musculus
aaauaaagaaaaauaaagcuagaacaauaagaugggcacagaga

SEQ ID NO: 106082 - RNA, 46 nt, Mus musculus
aagaagaggcucccaucagugugggcaugcugaauggaggccagcg

SEQ ID NO: 106083 - RNA, 46 nt, Mus musculus
aacuguaccucuuuacaaaauaaauguaauuacuuuuaucucagau

SEQ ID NO: 106084 - RNA, 46 nt, Mus musculus
guuuguuuguuuguuuuuuaauauagguucuagggaucagacuuag

SEQ ID NO: 106085 - RNA, 43 nt, Mus musculus
ugcagagcugguugcuggacagccugagcuaagaagugacuag

SEQ ID NO: 106086 - RNA, 46 nt, Mus musculus
gauccaagucuugauccaguauuuguauuauaugcaacccccagag

SEQ ID NO: 106087 - RNA, 42 nt, Mus musculus
uaggacccagaaagaagauacugaaccauuucagugccagga

SEQ ID NO: 106088 - RNA, 42 nt, Mus musculus
uuuaucaaaguuacuuguguguuauaccuuaagggagcugga

SEQ ID NO: 106089 - RNA, 45 nt, Mus musculus
aaucccagcaaccucaugguggcucacaaccacccguaaugagau

SEQ ID NO: 106090 - RNA, 50 nt, Mus musculus
uugaagaagcuucaacucucugaguuugucacugucuuugagaaggagaa

SEQ ID NO: 106091 - RNA, 46 nt, Mus musculus
acuaaugauacaauucuggaugucuucuucuacaauagccccaccu

SEQ ID NO: 106092 - RNA, 43 nt, Mus musculus
auccuugaugacaauuuggcaacuucaggaauaaacggcaguu

SEQ ID NO: 106093 - RNA, 46 nt, Mus musculus
acuuagacgaagaccuuguguucaguccucagcucuguggggaaac

SEQ ID NO: 106094 - RNA, 45 nt, Mus musculus
cugaaaacagcuacaguguacuuauguauaauaauaaauagaucu

SEQ ID NO: 106095 - RNA, 51 nt, Mus musculus
uccuugaaccugcuccaaacacauuuuaagaaagcccaagaaaaugagcag

SEQ ID NO: 106096 - RNA, 44 nt, Mus musculus
agucuguuaccuuaaguacauaagaagcuuuguagcuaaggaug

SEQ ID NO: 106097 - RNA, 47 nt, Mus musculus
gucugaugaaugggguucaacauccacugagcaaggucggccaagau

SEQ ID NO: 106098 - RNA, 41 nt, Mus musculus
cgccugauugauugcugauccuaaagucaugugccacgaug

SEQ ID NO: 106099 - RNA, 49 nt, Mus musculus
ugguuuuacaagggagacaaagacaauaaguauguccccuacucggaga

SEQ ID NO: 106100 - RNA, 46 nt, Mus musculus
ugagaggauuguucccaccgaugggggcagauaugauguucauuua

SEQ ID NO: 106101 - RNA, 45 nt, Mus musculus
acagcuccuguggcuguuuuggacuguaacuuacaaguguauuug

SEQ ID NO: 106102 - RNA, 46 nt, Mus musculus
caaguaaaaacuucagaaaaaaucuauguauguaucuguaugagac

SEQ ID NO: 106103 - RNA, 52 nt, Mus musculus
gguguggggauuggggcgcggccgcaggcuccgcccguccgccccgcccggc

SEQ ID NO: 106104 - RNA, 41 nt, Mus musculus
gcacugacuggaggggaagagaacguggucggccaccgacu

SEQ ID NO: 106105 - RNA, 46 nt, Mus musculus
cgggcgacuggacgcccucgcggccguccggugcagccuugcgaga

SEQ ID NO: 106106 - RNA, 41 nt, Mus musculus
ugggaacgugaagggcagagcacgcgaaggaagucgccuga

SEQ ID NO: 106107 - RNA, 48 nt, Mus musculus
cgucuuuccggcaucuuucuucuucuugucgucuuugggcggcauggc

SEQ ID NO: 106108 - RNA, 46 nt, Mus musculus
cugccacaccuggcuugguguaugcgcuuuauuuuugagcggggca

SEQ ID NO: 106109 - RNA, 46 nt, Mus musculus
aaagaaaaaagaaaagaaaaaaacaaggcuagugagauggugcagu

SEQ ID NO: 106110 - RNA, 46 nt, Mus musculus
accucuccuuugcuugcuuuucuaaacgaugcuuaucacacuucag

SEQ ID NO: 106111 - RNA, 47 nt, Mus musculus
ucugaugcccuucuucuggugugucugaagacagcuacaguguacuc

SEQ ID NO: 106112 - RNA, 45 nt, Mus musculus
ccuaaacagccagcugugcgccugggucccagggacuuacgggua

SEQ ID NO: 106113 - RNA, 50 nt, Mus musculus
augugggcaaaaaguacggugauauuccucgagggauuuucguggucaga

SEQ ID NO: 106114 - RNA, 46 nt, Mus musculus
uuagucugugaccuuuggcauuuuaaagauuugauuucacucgcaa

SEQ ID NO: 106115 - RNA, 46 nt, Mus musculus
ucuucagacuuccaacuccuuucaucuuuguuuacugcagcacaau

SEQ ID NO: 106116 - RNA, 46 nt, Mus musculus
ucuucuggugcaacuaggcuucaccaguacugucucauaggcucuc

SEQ ID NO: 106117 - RNA, 45 nt, Mus musculus
cacaugaccaaaacugccuugcaggagcuggaacauggcccccuu

SEQ ID NO: 106118 - RNA, 45 nt, Mus musculus
ucucuacuuggaacuuguucuauaccaggcuggccuugaacucag

SEQ ID NO: 106119 - RNA, 44 nt, Mus musculus
aggccacauacuaacauucuucuccauugaaaucucuugggcca

SEQ ID NO: 106120 - RNA, 46 nt, Mus musculus
ccaauaaguccuauuuaaagcauuacacuguuuucuaaacccaaag

SEQ ID NO: 106121 - RNA, 41 nt, Mus musculus
ugucaucaaggcaggagcgugguagcaucuaagcaggcaug

SEQ ID NO: 106122 - RNA, 46 nt, Mus musculus
uuuaaaggggaaaaaacagaaacagguuagaaaaagccauucugag

SEQ ID NO: 106123 - RNA, 46 nt, Mus musculus
uccucagcaccacaaaagaagagagggaaggaagaagaaauuaaag

SEQ ID NO: 106124 - RNA, 42 nt, Mus musculus
cauggcugcuucaggcucuuuuaaugucucccgaggcccuuc

SEQ ID NO: 106125 - RNA, 46 nt, Mus musculus
agaaauguaggcuguauccauauauaaccauuuauccaguugccuu

SEQ ID NO: 106126 - RNA, 45 nt, Mus musculus
uucccagaaugagaaguuagaguggaguugguaucaaugggugag

SEQ ID NO: 106127 - RNA, 41 nt, Mus musculus
gccuggcaaguccgagacacugucugggaagaagagcagaa

SEQ ID NO: 106128 - RNA, 42 nt, Mus musculus
cucaacaaccaggaaggcuggaagaaggaaagccagcaggua

SEQ ID NO: 106129 - RNA, 46 nt, Mus musculus
ggaccgcauggaggccaugggagaguggaacccaaaugucaaggag

SEQ ID NO: 106130 - RNA, 45 nt, Mus musculus
gucagaguacaugccuggccaucugauaaguuccuggggcccacg

SEQ ID NO: 106131 - RNA, 46 nt, Mus musculus
ucauagcuacuuaucccuuagccuucacagcuaugcagugggagac

SEQ ID NO: 106132 - RNA, 45 nt, Mus musculus
uguacaggcugaagugugcauguauguucuuuauugucaugggau

SEQ ID NO: 106133 - RNA, 46 nt, Mus musculus
ccucugccucucaagugcugggauuaaugguggggccugcaggcau

SEQ ID NO: 106134 - RNA, 45 nt, Mus musculus
uugacaugcauacuguagcagcucacuaaauacuugggaaaugau

SEQ ID NO: 106135 - RNA, 42 nt, Mus musculus
gauucagguugcugucacauacagugggacagcucagcugug

SEQ ID NO: 106136 - RNA, 46 nt, Mus musculus
aagauuugccuuaaagugucugacuugcugccuuuuuugagaugag

SEQ ID NO: 106137 - RNA, 45 nt, Mus musculus
ucuuccuguuaucugaaauuuugcuucuaaaagcauucuuuagug

SEQ ID NO: 106138 - RNA, 46 nt, Mus musculus
ccugccuuggcucucucugcugggguuacgugugugaggcgcagug

SEQ ID NO: 106139 - RNA, 46 nt, Mus musculus
uuugcaccuccucacugcaucaccaugaacacaccaggacucccag

SEQ ID NO: 106140 - RNA, 42 nt, Mus musculus
ugcagccacacacaaacacaaugcacagaccucauacgggag

SEQ ID NO: 106141 - RNA, 72 nt, Mus musculus
aagagauguguucuugguaaaggaacacccugacccaggaagcaaagacccagaagaagauuaccccaaguu

SEQ ID NO: 106142 - RNA, 45 nt, Mus musculus
auaacaagucaagugagagcacucagagcccggucaggcugggag

SEQ ID NO: 106143 - RNA, 45 nt, Mus musculus
ggucucuuguagcccaggcauugaacucaguguguagccaagggu

SEQ ID NO: 106144 - RNA, 45 nt, Mus musculus
aaauguagaaaauggcuguacacagaugccaaucagagaccuggc

SEQ ID NO: 106145 - RNA, 46 nt, Mus musculus
ucagaacauuauugucaauuuccaaacaagucacggggucguuacu

SEQ ID NO: 106146 - RNA, 45 nt, Mus musculus
ccuucagugcagaaaacugugccagaaaaggaaagaaaauacagg

SEQ ID NO: 106147 - RNA, 46 nt, Mus musculus
aucauuucucaguuguucaguguucaggcguggccagugggcagca

SEQ ID NO: 106148 - RNA, 41 nt, Mus musculus
agccaggaugguggcacacacccauaaucccagcagcaggc

SEQ ID NO: 106149 - RNA, 46 nt, Mus musculus
uuuaccuuggcuuuuuucuuaacuuuaacuugcaaagguuucaucu

SEQ ID NO: 106150 - RNA, 46 nt, Mus musculus
ccuacuuguugcucacacacacacacacuauugcaaaucccaaaga

SEQ ID NO: 106151 - RNA, 42 nt, Mus musculus
gauaaaagguagccuaauuaacgaauauuuaggccaagagaa

SEQ ID NO: 106152 - RNA, 45 nt, Mus musculus
uaccuaggauaaucaagacccuacgcccagucaguaguaccgagg

SEQ ID NO: 106153 - RNA, 36 nt, Mus musculus
uaugagauucugucuucaaaaaaauaaauaaacgug

SEQ ID NO: 106154 - RNA, 46 nt, Mus musculus
ucucaggcuugugagguaaaagugaaaauauuugugagggcuagga

SEQ ID NO: 106155 - RNA, 43 nt, Mus musculus
uccuuacaagauuguugguuguugagaaauuauaccuggagaa

SEQ ID NO: 106156 - RNA, 42 nt, Mus musculus
gagcacuacagugggacagagagcagcaggcacaggagauag

SEQ ID NO: 106157 - RNA, 46 nt, Mus musculus
gggcagucauuucuggcuaggcaaagacaagcaaccagcacaagaa

SEQ ID NO: 106158 - RNA, 42 nt, Mus musculus
ggcagagaacaaugggcgcacagcuuagugaacuagagggga

SEQ ID NO: 106159 - RNA, 46 nt, Mus musculus
agaugguuuugcucacucucuggcuuucuuauucuaccccucaggc

SEQ ID NO: 106160 - RNA, 29 nt, Mus musculus
auuuggugauguuugaaagggagacaucg

SEQ ID NO: 106161 - RNA, 78 nt, Mus musculus
uguagaauauugaggaagaagaaagaggaggaggggggagaaaggaggaggaggaggaauuggggauuggguggcaga

SEQ ID NO: 106162 - RNA, 46 nt, Mus musculus
gugcuuuucgccaggcuccucacuaucccgagguguacucaaaggu

SEQ ID NO: 106163 - RNA, 50 nt, Mus musculus
cuuaggugguuugaagggguagucuguagggaaaugaauugucaaaaaga

SEQ ID NO: 106164 - RNA, 45 nt, Mus musculus
uuagaauaucaagacaaaugcugccauuacuguuaauauuuggau

SEQ ID NO: 106165 - RNA, 47 nt, Mus musculus
auucccgauauauucuguuguacuuaucucugucuguuuuauagauc

SEQ ID NO: 106166 - RNA, 30 nt, Mus musculus
ggggugggguggggggugguggagggagca

SEQ ID NO: 106167 - RNA, 42 nt, Mus musculus
ccuuaaaacauauacccaagaagaagaaaauaagcaaaagaa

SEQ ID NO: 106168 - RNA, 45 nt, Mus musculus
ugaauauagccaaguauuccauuuauuaacaaaauagucuuagca

SEQ ID NO: 106169 - RNA, 45 nt, Mus musculus
aguugagaaacaacgugaugggacuuuaaaagugaggcacuaaga

SEQ ID NO: 106170 - RNA, 44 nt, Mus musculus
gcuuccaguuucuuuugugcaucucucuucucagcugugcacaa

SEQ ID NO: 106171 - RNA, 45 nt, Mus musculus
gguuuccaucucaugcucccguucaucacauccuauaagucugua

SEQ ID NO: 106172 - RNA, 42 nt, Mus musculus
cuuauuugaaauucaaaacuauaaauauaauuucauggggag

SEQ ID NO: 106173 - RNA, 41 nt, Mus musculus
cccagaauaaggcuggugagcccagcaaguaagagaggaga

SEQ ID NO: 106174 - RNA, 46 nt, Mus musculus
ggcugugcgagugacaaagcccaauauaccugaggcaauccgcagg

SEQ ID NO: 106175 - RNA, 31 nt, Mus musculus
gaaggugguggaaaaggaggcagaaacagag

SEQ ID NO: 106176 - RNA, 46 nt, Mus musculus
acagguugcagaaaucaccuaugggcaaaaggugauggagaaggag

SEQ ID NO: 106177 - RNA, 42 nt, Mus musculus
uuuggccuagaagaugagccccucgaggcacccacaaaggag

SEQ ID NO: 106178 - RNA, 44 nt, Mus musculus
gaagaaauggacacaaacuuacccccuucugggaagggagagca

SEQ ID NO: 106179 - RNA, 45 nt, Mus musculus
cccaugucauagcauaaauucaguagcuauugguaucugucccag

SEQ ID NO: 106180 - RNA, 46 nt, Mus musculus
aagccuaaguuuaauaauuuuuauauaacuaaaaauagguguggag

SEQ ID NO: 106181 - RNA, 46 nt, Mus musculus
aacuggugauugaauaguuaaagcaauuuuuucagugugccccaag

SEQ ID NO: 106182 - RNA, 80 nt, Mus musculus
gguggcagcaugacggcggagcugggagucggguucgcgcugcgggccgugaacgagcgaguccagcagaguguggcgcg

SEQ ID NO: 106183 - RNA, 41 nt, Mus musculus
gcuggaagggggacaccuacgugggacgaggugucacggug

SEQ ID NO: 106184 - RNA, 42 nt, Mus musculus
auggcggucggucuggccuugaggaucgggacuugccgggag

SEQ ID NO: 106185 - RNA, 46 nt, Mus musculus
ggcauguccaguuaacuacucuagcccuagcuaggguuccucacag

SEQ ID NO: 106186 - RNA, 64 nt, Mus musculus
uccaaccccggcucguugcggucagcaaaacaaaaccugcagacauggugaucgaggccuaugg

SEQ ID NO: 106187 - RNA, 67 nt, Mus musculus
ccacggccagcgcacuuuuggagagaacuauguaagauuccucuuauaaagaacuguugggcugggc

SEQ ID NO: 106188 - RNA, 41 nt, Mus musculus
uuuagguucaggaacuacuagaaaaagcaucaaacccuaag

SEQ ID NO: 106189 - RNA, 46 nt, Mus musculus
guggcacuucauuggucauuuacagaaacaaaacgucaacaaacug

SEQ ID NO: 106190 - RNA, 46 nt, Mus musculus
gccuucucugugauuguauggcuuacaccaccgucuaaguaagcag

SEQ ID NO: 106191 - RNA, 46 nt, Mus musculus
gcuuauucggcuuauacuuccacagcagugaaagaagccacggcag

SEQ ID NO: 106192 - RNA, 42 nt, Mus musculus
cuuacugguguguuccccagggcuacugucuuauacaccaag

SEQ ID NO: 106193 - RNA, 44 nt, Mus musculus
cauuuuauuagaacaauuugaucuuuuuaggguuuuggguuuuu

SEQ ID NO: 106194 - RNA, 45 nt, Mus musculus
ccaaccucucuaugcuggaaaccguagacucggugaagcuggcag

SEQ ID NO: 106195 - RNA, 45 nt, Mus musculus
ccuacagaaccacugaaggugaugguccagauuaacaccagcgga

SEQ ID NO: 106196 - RNA, 46 nt, Mus musculus
accagugugaugacccaauauaauucuuuaauauauuucggcuugu

SEQ ID NO: 106197 - RNA, 46 nt, Mus musculus
ugucauacuucuuaggacaauuacccaguacuuuauugggcaagag

SEQ ID NO: 106198 - RNA, 46 nt, Mus musculus
agcaccugcccguaaccccaacauuugugggaugcagccaggaaga

SEQ ID NO: 106199 - RNA, 51 nt, Mus musculus
auaaacaaagacuaagucagacucuucuuuaucuaaaaacaacaauaaacc

SEQ ID NO: 106200 - RNA, 46 nt, Mus musculus
gccaccuggcuuguacauugagacccugucucaaaaaaagaguaaa

SEQ ID NO: 106201 - RNA, 42 nt, Mus musculus
ggccgggcacgagaagggcugggccgaggugccgcgggguug

SEQ ID NO: 106202 - RNA, 33 nt, Mus musculus
cgagggguucgguagcuggccagaacggacgag

SEQ ID NO: 106203 - RNA, 73 nt, Mus musculus
cucugccaggaccaccaugugcuuaagggcgaccucugugggugucagggcaguuuggggugggacaagauca

SEQ ID NO: 106204 - RNA, 64 nt, Mus musculus
gggaaagaggcuggccuggagauuaaguuuaguugaucucccuuggaauaagugacgccugcac

SEQ ID NO: 106205 - RNA, 44 nt, Mus musculus
uuagaguguagcauuugcuucuuaacugaaagaaagcaguguca

SEQ ID NO: 106206 - RNA, 46 nt, Mus musculus
aaccauuauaugcuugauuggcucacauuccauuuugaguacucag

SEQ ID NO: 106207 - RNA, 45 nt, Mus musculus
augacacuguuuuguaagggguaaaguugaauguaauggugcaga

SEQ ID NO: 106208 - RNA, 45 nt, Mus musculus
ucacacagaggggagaaguuacagcugaggauauuauuaagggcc

SEQ ID NO: 106209 - RNA, 42 nt, Mus musculus
agcucagggcaacuguagccauauccuuccguacacaggcag

SEQ ID NO: 106210 - RNA, 42 nt, Mus musculus
ucguguguucuuagggggcaguccagcuuuaaguggggguga

SEQ ID NO: 106211 - RNA, 42 nt, Mus musculus
aaggauuaggagguguggccuuguuggaggagguguggcauu

SEQ ID NO: 106212 - RNA, 54 nt, Mus musculus
cuuaauaguauagaauagaguuuauucagggcauggggaggguaguagagacag

SEQ ID NO: 106213 - RNA, 46 nt, Mus musculus
cugggguuuaggcuucaacaccugaguuugaaggaacacaguacag

SEQ ID NO: 106214 - RNA, 42 nt, Mus musculus
gcaacugguggcagcuggucaccuuaaaccuugaugggacag

SEQ ID NO: 106215 - RNA, 46 nt, Mus musculus
gauaauaaaugagcaggcccauuuugaggccuuggagaggccacug

SEQ ID NO: 106216 - RNA, 46 nt, Mus musculus
ggcauaacgacagggugaaaaugcccuugagaacagcugggggggg

SEQ ID NO: 106217 - RNA, 45 nt, Mus musculus
cccggcugauucauuuuuaaaacauguauuuauauacuuauugag

SEQ ID NO: 106218 - RNA, 53 nt, Mus musculus
uggagugucggaacucaccuguggccaaaacacccccaaaggaccugccagcc

SEQ ID NO: 106219 - RNA, 45 nt, Mus musculus
cucccaugcaagccagccagagccaacugcccagcagcccggaag

SEQ ID NO: 106220 - RNA, 115 nt, Mus musculus
ugugauuccuguagcugucuucagacacuccagaagagggccucagaucucauuacuaaugguugugagccaccauguguuugcugggauuugaagucaggaacuucagaagagc

SEQ ID NO: 106221 - RNA, 48 nt, Mus musculus
gccccugggauuucuaauuaccccaggaguucagcagcccaagacaaa

SEQ ID NO: 106222 - RNA, 40 nt, Mus musculus
cucugccuugaauuuugugaacaccagcacauaccuccuu

SEQ ID NO: 106223 - RNA, 43 nt, Mus musculus
gaaugaucuggcaauccuagccccagccuccggagcacaccca

SEQ ID NO: 106224 - RNA, 48 nt, Mus musculus
acuucuuucccugacaggaaauaaaagccacauuuacccuaggcccgc

SEQ ID NO: 106225 - RNA, 46 nt, Mus musculus
uccaguguuuauggugugauuucccuguacaauauuuuuuaaaaag

SEQ ID NO: 106226 - RNA, 46 nt, Mus musculus
accgcaugccuagcuugaugccugccuccagauggaccggguuacu

SEQ ID NO: 106227 - RNA, 45 nt, Mus musculus
cucccuaggccccuccuguuauggggaucuggggugaaaguugug

SEQ ID NO: 106228 - RNA, 51 nt, Mus musculus
agugagugaaacuugcgacuccaggacuuugggaaggaccucggauaaaau

SEQ ID NO: 106229 - RNA, 42 nt, Mus musculus
guucccaggucccaggaaaggaaguugaguggcuaggggcuc

SEQ ID NO: 106230 - RNA, 44 nt, Mus musculus
uuaaucuucuugguauugauuucggggucacugguaaccaagcg

SEQ ID NO: 106231 - RNA, 46 nt, Mus musculus
ucuccagaugcacugucaccaccuugccauccucgaugagccacga

SEQ ID NO: 106232 - RNA, 43 nt, Mus musculus
cacugccagauccaguucugccagggucuggguccagcgguag

SEQ ID NO: 106233 - RNA, 41 nt, Mus musculus
ggggaacaccagggccaagaagugggagugggugugggggg

SEQ ID NO: 106234 - RNA, 35 nt, Mus musculus
caucuucuucuucuucuucaucuucagagucacuu

SEQ ID NO: 106235 - RNA, 46 nt, Mus musculus
uaaggccagucugggauaucauuagguauggacucaaaacaacaag

SEQ ID NO: 106236 - RNA, 45 nt, Mus musculus
guuuuucccuucguucaaccuucuuacucaaaggaacaagcuucc

SEQ ID NO: 106237 - RNA, 47 nt, Mus musculus
auccuaaaugagcgaaaugccgcgcaaaacccaguggugccaaggcg

SEQ ID NO: 106238 - RNA, 46 nt, Mus musculus
cagccacagcagaaugaaugaccgggaguaaauuuuguuaucagug

SEQ ID NO: 106239 - RNA, 42 nt, Mus musculus
gcccaucugggccugaaaggccacagacaggagcauggccag

SEQ ID NO: 106240 - RNA, 41 nt, Mus musculus
gcagaagcacucugcacccuccccaccggugucaguggggu

SEQ ID NO: 106241 - RNA, 88 nt, Mus musculus
gacaauaggaaauacuaccuggaccuaaaggaaaaccaacgaggucgcuuccuaaggauuagacaaaccaugaugcggggcacuggca

SEQ ID NO: 106242 - RNA, 46 nt, Mus musculus
auuucgugaugccuugguucagcugauugaagacuacggcgaagga

SEQ ID NO: 106243 - RNA, 55 nt, Mus musculus
acuauuacuguuccguucaaagcuuggacaagguuuggggagaauuuuaucaagu

SEQ ID NO: 106244 - RNA, 46 nt, Mus musculus
uucaaguucugccacauuuuauuauuuuuccuucuuaaagccccaa

SEQ ID NO: 106245 - RNA, 46 nt, Mus musculus
uaacaaggaacuuuaaaguagauuuuguauuuguauuaaagacuag

SEQ ID NO: 106246 - RNA, 32 nt, Mus musculus
agacuucccauaauacuccaaaaauuaaauua

SEQ ID NO: 106247 - RNA, 42 nt, Mus musculus
gguggauggguguguguguguguguguguguguguguagggg

SEQ ID NO: 106248 - RNA, 46 nt, Mus musculus
uaggaagcuaaggagcuauaaguacaaccgagucaucugcugggag

SEQ ID NO: 106249 - RNA, 30 nt, Mus musculus
gcgugacacaaacagccgcuuucuauagaa

SEQ ID NO: 106250 - RNA, 46 nt, Mus musculus
uuuaaaaaaaaaaaaaaaggaaggaaggaaggaaggaagaaaaaug

SEQ ID NO: 106251 - RNA, 46 nt, Mus musculus
ucccugacagcugacugacagcucacccggcccccauacucugcag

SEQ ID NO: 106252 - RNA, 46 nt, Mus musculus
aagaaaaaaauuagaacuaguacccugcuaccuggacugccuugag

SEQ ID NO: 106253 - RNA, 41 nt, Mus musculus
cucucacuuuucaacaccuaucucaagaucuagcuggcagg

SEQ ID NO: 106254 - RNA, 46 nt, Mus musculus
uugcucacccaauaaagcuuuaucuucuuacaguucuagcaugcaa

SEQ ID NO: 106255 - RNA, 45 nt, Mus musculus
gucuaguccccaugauuaaccucgugugugugugugugugugugu

SEQ ID NO: 106256 - RNA, 42 nt, Mus musculus
cugacaaaugucuguaaucucaggacugccaguucagcuaag

SEQ ID NO: 106257 - RNA, 46 nt, Mus musculus
guuucagugaccauggagacaaggaacaucgccauuacccaaagag

SEQ ID NO: 106258 - RNA, 46 nt, Mus musculus
aaugugaccuacuuucauguagaauuucucauuuuuaaaaggccag

SEQ ID NO: 106259 - RNA, 46 nt, Mus musculus
uauucugugauugaccugucagcauauugggcuuaguuugguagag

SEQ ID NO: 106260 - RNA, 46 nt, Mus musculus
aagagccaucuuuaacucuuaccugaugacaugggaauucaacaau

SEQ ID NO: 106261 - RNA, 46 nt, Mus musculus
aauuuucuuauguccugaccucaacaccuucaaagaaugcuuccag

SEQ ID NO: 106262 - RNA, 46 nt, Mus musculus
cagccuucccugcuuaaggcugcacaaucauuuucaaugaaggaag

SEQ ID NO: 106263 - RNA, 91 nt, Mus musculus
cuguuucuuuaaaccuuucauuuuccaaauagcuauuugccagcauugagggaggaggagacauauagacuugaaaauacuuucuuaagag

SEQ ID NO: 106264 - RNA, 46 nt, Mus musculus
gacaaaccucacugugaccugacuaugagguauugacccugccaag

SEQ ID NO: 106265 - RNA, 36 nt, Mus musculus
agaaggaagaggaggaugaagaggaugaggaagaag

SEQ ID NO: 106266 - RNA, 42 nt, Mus musculus
gugauuuucgaaguuacuucauuuauuuugauuuuaagggag

SEQ ID NO: 106267 - RNA, 46 nt, Mus musculus
cuggggcauuucuccacguggugcuggcuacacauuuggacaagac

SEQ ID NO: 106268 - RNA, 54 nt, Mus musculus
guuucagaaaugucuuguccaaauguguagccagcaccacguggagaaaugccc

SEQ ID NO: 106269 - RNA, 30 nt, Mus musculus
cucuuucugccucugcuccuuugggguucc

SEQ ID NO: 106270 - RNA, 52 nt, Mus musculus
auuuugguuguauuagguaagaaauuaacauuaacuuaauaugcaagugaga

SEQ ID NO: 106271 - RNA, 46 nt, Mus musculus
aaagauuugcccuauaauuuuaaaauguaaauagcguguucuagaa

SEQ ID NO: 106272 - RNA, 42 nt, Mus musculus
aucugucuccuucuucuggagugucugaagacagcuacagug

SEQ ID NO: 106273 - RNA, 67 nt, Mus musculus
augagcagagacuaugguuuuagagcuuuauuguagaaaggcagggagaaagagaaaagguagaaaa

SEQ ID NO: 106274 - RNA, 45 nt, Mus musculus
cugugugcuuuuuagucuggggugugugugugugugugugugugu

SEQ ID NO: 106275 - RNA, 44 nt, Mus musculus; identical to SEQ ID NO: 73787

SEQ ID NO: 106276 - RNA, 46 nt, Mus musculus
aaaaaucacauuagagacaggaaauauuaauagcuuagcgggaaga

SEQ ID NO: 106277 - RNA, 46 nt, Mus musculus
ugugaagagacuauacaucauuagagaauacuuguagugcagagau

SEQ ID NO: 106278 - RNA, 45 nt, Mus musculus
cuaggaaaacauuucauaauauauugaauaaguaagcaacaacaa

SEQ ID NO: 106279 - RNA, 41 nt, Mus musculus
uacugcucuugauccagguugaauucaaaugagacagagau

SEQ ID NO: 106280 - RNA, 46 nt, Mus musculus
uucaaguaugcaaggaaccuaauacucuaacaaaacaacagaaggc

SEQ ID NO: 106281 - RNA, 50 nt, Mus musculus
ugcuaaguguucugaauaaaccugcuugaagaaggucgacgugguguugg

SEQ ID NO: 106282 - RNA, 41 nt, Mus musculus
acugggaggagucaguaggguauuuaaggcgcgccccgggg

SEQ ID NO: 106283 - RNA, 46 nt, Mus musculus
aagggaagagaagcaguuaacacuuccauuccaacaacaacaauga

SEQ ID NO: 106284 - RNA, 46 nt, Mus musculus
gucauauaagugucuuucuaauaaaauaaaacaaacaaacccagaa

SEQ ID NO: 106285 - RNA, 45 nt, Mus musculus
aauccagaggaagguggaucucugugaguucaaggcaagucugau

SEQ ID NO: 106286 - RNA, 46 nt, Mus musculus
guaguauccuuccagaaugcuccaagaagcuagugugcugggagag

SEQ ID NO: 106287 - RNA, 45 nt, Mus musculus
ugaucuguguuaaugaacagcaaagagaaggaaaagacagggaca

SEQ ID NO: 106288 - RNA, 46 nt, Mus musculus
ccuuuccuucccgggacuuagccgggcaccaaacaagacagcagac

SEQ ID NO: 106289 - RNA, 45 nt, Mus musculus
uauauauaccuagauauuucugacuccugcccucccccaccccca

SEQ ID NO: 106290 - RNA, 33 nt, Mus musculus
uuugcuugcuuuucaucacaagguuucccaggg

SEQ ID NO: 106291 - RNA, 45 nt, Mus musculus
caggcagcaaggaguucuggguucggggugcacaggauaggccag

SEQ ID NO: 106292 - RNA, 46 nt, Mus musculus
cccguguggauccuguuugaggagcagcaagcaaaagccaaaagaa

SEQ ID NO: 106293 - RNA, 45 nt, Mus musculus
uagucggugcucuuaaccgcuaagccaucucuccagcccgcaagc

SEQ ID NO: 106294 - RNA, 45 nt, Mus musculus
ugagcagcugugccaggcaggcaacgcacauuuucaguggcagca

SEQ ID NO: 106295 - RNA, 46 nt, Mus musculus
cgaguauauugucacucucuucagacacaccagaagagggcaucag

SEQ ID NO: 106296 - RNA, 36 nt, Mus musculus
ccgacucaauuacuucccagccuguugggccugccg

SEQ ID NO: 106297 - RNA, 46 nt, Mus musculus
augucuguguaucagcucgguaaaccagacagcugaggucugccag

SEQ ID NO: 106298 - RNA, 44 nt, Mus musculus
aaugcuaucaaagguuauaaugaaggagcaaaaagaagggccug

SEQ ID NO: 106299 - RNA, 46 nt, Mus musculus
cacucuugcuuuaaggaagucucuuuuacauuacuuaucccucaaa

SEQ ID NO: 106300 - RNA, 28 nt, Mus musculus
ucauuaacuuagugaagaaaauauagaa

SEQ ID NO: 106301 - RNA, 46 nt, Mus musculus
ugaagcugugugcggguguauguguccucaugugugugguguucag

SEQ ID NO: 106302 - RNA, 58 nt, Mus musculus
uggaagucacaggagggcaucagauccucuggaacugaaguugcagaugggugugguc

SEQ ID NO: 106303 - RNA, 53 nt, Mus musculus
uucucaauacggacucuuagaaucaaagcagaacuccacaagagcaauaagca

SEQ ID NO: 106304 - RNA, 42 nt, Mus musculus
agaggaaggaggaggaggaggaagaggaggaggaggagccug

SEQ ID NO: 106305 - RNA, 42 nt, Mus musculus
aucuuuuaaaaggaaagcauuuaauuggggguucgcuugcag

SEQ ID NO: 106306 - RNA, 46 nt, Mus musculus
uaacacgugcugggcacuccacccagagccagaugugcauccccag

SEQ ID NO: 106307 - RNA, 32 nt, Mus musculus
gcuuuccuggaugcuugaagacugaucacugu

SEQ ID NO: 106308 - RNA, 45 nt, Mus musculus
ugaagaaagacugaaagguaguggaauaggggagcugaggacaga

SEQ ID NO: 106309 - RNA, 46 nt, Mus musculus
aggguuuuggcgucgauccucaguuacauagcaaauugaggaccag

SEQ ID NO: 106310 - RNA, 46 nt, Mus musculus
gagaagucaguguucuuaaccacugaaccaucucuccagccccccc

SEQ ID NO: 106311 - RNA, 41 nt, Mus musculus
uccucagcaaucucagagucuccaagggugucacggagaga

SEQ ID NO: 106312 - RNA, 45 nt, Mus musculus
cuaagaguguuuguggagcgugauuugcuaugagaucugugggca

SEQ ID NO: 106313 - RNA, 46 nt, Mus musculus
aauacugcuuaggaaaugccagaagaugccuugaugaauaauguau

SEQ ID NO: 106314 - RNA, 46 nt, Mus musculus
ucaaaagcccaguccuaguuuagcgucuuucccuguagcuugccga

SEQ ID NO: 106315 - RNA, 50 nt, Mus musculus
ccugccaugaugauaauggacuaaaccccuggaauuauaagucagcccca

SEQ ID NO: 106316 - RNA, 46 nt, Mus musculus
uuuucaugaguaugcgccaacacauugucguccuaccguggagaga

SEQ ID NO: 106317 - RNA, 63 nt, Mus musculus
gcgcuuggccauagacuccuuucuaacagcugcauauucuuucuggguacuaacuaaucuuag

SEQ ID NO: 106318 - RNA, 42 nt, Mus musculus
auucacaagugacuuguuagucuugcagguaauccaggaacg

SEQ ID NO: 106319 - RNA, 46 nt, Mus musculus
guguaaaaacaaguuccgggauccaguuucuauccguguguguuau

SEQ ID NO: 106320 - RNA, 46 nt, Mus musculus
acuggccccucuucguucucuucuuuuacauccucucgcccauccc

SEQ ID NO: 106321 - RNA, 46 nt, Mus musculus
ccucucaaguucuagaauuccagggauccgucacugugcccaguau

SEQ ID NO: 106322 - RNA, 45 nt, Mus musculus
ucugcaaugagcugguggcagaaacucagcccugcugcccaugau

SEQ ID NO: 106323 - RNA, 36 nt, Mus musculus
gagagaaagguuaauucaccaacauagaccuuuucc

SEQ ID NO: 106324 - RNA, 66 nt, Mus musculus
uuguuuugcagcuuuaauuaguuuguccuuuggaggagcgaucgggcugauguuccugaugcuugg

SEQ ID NO: 106325 - RNA, 57 nt, Mus musculus
gacaugggugaccaaagcugaccaggaacauuuggaaaggaaagauguuugggaagc

SEQ ID NO: 106326 - RNA, 44 nt, Mus musculus
aaagguaacuaguuagugggcaauaggggacacaaugcuguugc

SEQ ID NO: 106327 - RNA, 46 nt, Mus musculus
cugggugugcaccagcaccucuggcagccuuuucuuauuuauaaaa

SEQ ID NO: 106328 - RNA, 48 nt, Mus musculus
guuguuguuguugugguuguuguuguuguuguuguuguuguuguuuga

SEQ ID NO: 106329 - RNA, 42 nt, Mus musculus
gucugcgcgaguuugcacccagagacauugagggcugcgauc

SEQ ID NO: 106330 - RNA, 75 nt, Mus musculus
ugcucaauucagugagcggacauaaacaacaaacagcuucacuucuuugguuuuauuuuucaugacuguugaguu

SEQ ID NO: 106331 - RNA, 89 nt, Mus musculus
gaacaaugccaccugcacucgggucuacgagaaggugcaaugagagcuuccucgucauccuggacaggaguuagcugccagagugaaua

SEQ ID NO: 106332 - RNA, 33 nt, Mus musculus
ggugcccugguccagcaccagcaaugggaaggg

SEQ ID NO: 106333 - RNA, 30 nt, Mus musculus
cgaccguguucucuuguacccugggagaga

SEQ ID NO: 106334 - RNA, 45 nt, Mus musculus
uuccaucaggcgccacuucccuucgagauccuuaaggcuggccau

SEQ ID NO: 106335 - RNA, 45 nt, Mus musculus
gggccaccacaacgugaggaacgguauaaaagggcggcagcauua

SEQ ID NO: 106336 - RNA, 42 nt, Mus musculus
gacaccgugcuguccucccggagacucucggcgcgcgggcug

SEQ ID NO: 106337 - RNA, 42 nt, Mus musculus
aaaagaaaagaaaaaaaucgcccuggcaguucagccucagau

SEQ ID NO: 106338 - RNA, 46 nt, Mus musculus
gacauuuccuucuugcucuaccaagaccuuucaauagcuggcagag

SEQ ID NO: 106339 - RNA, 42 nt, Mus musculus
gagauuaccaccugagccugggucucacucuggcccagaaag

SEQ ID NO: 106340 - RNA, 43 nt, Mus musculus
ugcacuuguacugguaaugacccucaaagugauugggacaguc

SEQ ID NO: 106341 - RNA, 45 nt, Mus musculus
agcaccuugguaaagauggcguuuaccacagaccaauagccagau

SEQ ID NO: 106342 - RNA, 42 nt, Mus musculus
cuccacuuggaaaggcuccuuuaaaaugguguuggcccaguu

SEQ ID NO: 106343 - RNA, 42 nt, Mus musculus
ccuugaaugauuugugaacucuaaggaagggguggggcacua

SEQ ID NO: 106344 - RNA, 46 nt, Mus musculus
guuguccaucuguaggcuugucagacaaaguacaagaugcccaguu

SEQ ID NO: 106345 - RNA, 46 nt, Mus musculus
accucucccagugugcaggaagaaaaacuagaaaacgccacaguaa

SEQ ID NO: 106346 - RNA, 92 nt, Mus musculus
guggaaguuguuuuuaaaucauuuuaaaguauauacuaugacagaugaaacuuaaaacuugucggaagcugaagauuuuauuucugugagau

SEQ ID NO: 106347 - RNA, 46 nt, Mus musculus
ugugucagugagugggcgugucuguucauuucauaccugguaagug

SEQ ID NO: 106348 - RNA, 45 nt, Mus musculus
ccucacaugugugccagccuucauccuguguuucuguugggcaga

SEQ ID NO: 106349 - RNA, 78 nt, Mus musculus
ggcaguacagucuggguucuaacccugcuuucccucccucacagagcucugagcagccuaaguagaguaacagcacua

SEQ ID NO: 106350 - RNA, 46 nt, Mus musculus
gcacgucugccuguaccuuugcuucuccccagauugcaaagcuagu

SEQ ID NO: 106351 - RNA, 46 nt, Mus musculus
cagugccacuuuacugguuuggccagcuuggauacuuaacucaggc

SEQ ID NO: 106352 - RNA, 68 nt, Mus musculus
gcacaugaacgagcuguuuaaaaagaacaaguccuggaaaaaaaauuaaaaauaaaugguccauagag

SEQ ID NO: 106353 - RNA, 49 nt, Mus musculus
ugguucccucaaccaccagggcuguggcucauguucugagcugaguaga

SEQ ID NO: 106354 - RNA, 69 nt, Mus musculus
acggcugugauuuuaauuuaguaacgagcuacugugguauaguaaaacaaacugaaccgugaaccucca

SEQ ID NO: 106355 - RNA, 67 nt, Mus musculus
ugggcaucuguauaguuuuaguagcuauaauauuuggcccaacugaaauuaguuuaacaugcuaaac

SEQ ID NO: 106356 - RNA, 57 nt, Mus musculus
gggugcuuguggauuuggcugcguguuuaauagcaacucgacuaccauacagagcuu

SEQ ID NO: 106357 - RNA, 45 nt, Mus musculus
uugaaaccaaaggcaguuugaccuauuuuuuuagacgccacugau

SEQ ID NO: 106358 - RNA, 41 nt, Mus musculus
cacaaacgucucuuugaccuaaagagccagagccgggugga

SEQ ID NO: 106359 - RNA, 46 nt, Mus musculus
cuugaccguuccaggcauauccagaauaucucaucaccuaccagau

SEQ ID NO: 106360 - RNA, 23 nt, Mus musculus
aucccuacauugcccuguggauu

SEQ ID NO: 106361 - RNA, 41 nt, Mus musculus
gggcuggcauaugcugaauaugucaucuacagaggggaaca

SEQ ID NO: 106362 - RNA, 46 nt, Mus musculus
gcucaucccuguguuucuuaguuguugcaucuacaaaauaccacaa

SEQ ID NO: 106363 - RNA, 45 nt, Mus musculus
caaaguaaaccuaaaaugaacaacaaagugaacuuagcugaggau

SEQ ID NO: 106364 - RNA, 46 nt, Mus musculus
uuuaucuggucaucccaguucuaagauggaugccauacggucagaa

SEQ ID NO: 106365 - RNA, 52 nt, Mus musculus
caauaauauaucaccuccccugagggggagcaggcagcccuuaccgaccaug

SEQ ID NO: 106366 - RNA, 46 nt, Mus musculus
gcaagccuaggcuccgugagggacccaucucacauaaggugcagag

SEQ ID NO: 106367 - RNA, 46 nt, Mus musculus
cauuuuuaaagaucuggauugucaaucuauuuguuauugaugagau

SEQ ID NO: 106368 - RNA, 41 nt, Mus musculus
cucauaaaggccgcuggggucagcaccacagcagccccgcc

SEQ ID NO: 106369 - RNA, 30 nt, Mus musculus
aguaagccugcugguuguucugggggaauc

SEQ ID NO: 106370 - RNA, 44 nt, Mus musculus
caagacacuaaagguuuuuccauaauaauuauuaaaguuugaga

SEQ ID NO: 106371 - RNA, 52 nt, Mus musculus
uugcuagaucuugcuccagaagauaaagaauaucaaucaguagaagaagagg

SEQ ID NO: 106372 - RNA, 46 nt, Mus musculus
auaucaggcuguguuuuuauugucaaccauaucuaaacugaaagau

SEQ ID NO: 106373 - RNA, 51 nt, Mus musculus
gugcagcgggcuugggcaaggauuuuuauauucauuuugugauuggaaguc

SEQ ID NO: 106374 - RNA, 41 nt, Mus musculus
cuuuguauaguguauuccgcuguucucguccugccugagaa

SEQ ID NO: 106375 - RNA, 46 nt, Mus musculus
auguugacauagcagcguuacugauaaaauacaacacguguguaaa

SEQ ID NO: 106376 - RNA, 45 nt, Mus musculus
agcagauccaacuaagaagaacagagauggaaauacaccccuaga

SEQ ID NO: 106377 - RNA, 46 nt, Mus musculus
gccuccuuaauucuaggauuaaaggcaugcacuacuauggccagug

SEQ ID NO: 106378 - RNA, 45 nt, Mus musculus
cauauguaaagucaaaggaaucaguuaucuccuuccaccacgggc

SEQ ID NO: 106379 - RNA, 46 nt, Mus musculus
ucuugcaugccagucauccugcuucagucuauguuuguugacagau

SEQ ID NO: 106380 - RNA, 46 nt, Mus musculus
uccuaaacaucuauauuaaacaauuguggugugauagcuuggagau

SEQ ID NO: 106381 - RNA, 41 nt, Mus musculus
ucucaaagcauuuuaggggggcucuggggcuucaggggaag

SEQ ID NO: 106382 - RNA, 46 nt, Mus musculus
aauaaggagaggaagaaggaaaaaaggaaggaacuggaagggaggg

SEQ ID NO: 106383 - RNA, 45 nt, Mus musculus
gacuuguaccucuucauaaugcaugcucauacggacacuaugagg

SEQ ID NO: 106384 - RNA, 46 nt, Mus musculus
cuuacaugauuuuaaguuagcauaccaagaaugguuugugcuggaa

SEQ ID NO: 106385 - RNA, 46 nt, Mus musculus
uuagauuaugagauucauuuuguuugauaacuuggaagucugagag

SEQ ID NO: 106386 - RNA, 23 nt, Mus musculus
aaaaagaggaagauagacuucug

SEQ ID NO: 106387 - RNA, 83 nt, Mus musculus
uguacuucauugcagugaccugagagucugagcaugccuugccacagauacuaacuuacuugccacucagucauagcugucca

SEQ ID NO: 106388 - RNA, 46 nt, Mus musculus
uauaacuuugaauucagacauuugcauucuuuccuaaagaugaggc

SEQ ID NO: 106389 - RNA, 47 nt, Mus musculus
gaagggaaaaaggucaaccuaacacaacaacuaucuauuaaaaacau

SEQ ID NO: 106390 - RNA, 45 nt, Mus musculus
ucaccagucaugacuucuacacagcugucucucuguguccgcaga

SEQ ID NO: 106391 - RNA, 46 nt, Mus musculus
gucauaauuucaaugauucaauuaaauugaaauuauaaugccaguu

SEQ ID NO: 106392 - RNA, 45 nt, Mus musculus
ugugucagccaugcaaguuuucucacuaagaaaauaguuuguagu

SEQ ID NO: 106393 - RNA, 45 nt, Mus musculus
uagaguauuuuccccucuuggcaaaaauaccaaaaaaccccagcu

SEQ ID NO: 106394 - RNA, 46 nt, Mus musculus
uaauguugauuugaauuccauaaacuguguucaguaaagcgcagag

SEQ ID NO: 106395 - RNA, 46 nt, Mus musculus
aaauacaaaugaaauaaaucuuuaaaaaauuauuuuauauguagau

SEQ ID NO: 106396 - RNA, 46 nt, Mus musculus
aauguuucuuauacggugacuaguggguagaaaauugcuuagagau

SEQ ID NO: 106397 - RNA, 59 nt, Mus musculus
auaaugugagaaagaacuguauuauuuucaugugggagaccucugugguaacauaccug

SEQ ID NO: 106398 - RNA, 45 nt, Mus musculus
cuuuuaccauuuggaaaaauaaaucuguaguguaugaaugagaga

SEQ ID NO: 106399 - RNA, 45 nt, Mus musculus
uugucuucuacuguucucugaggcuuuuguauuuggcacaggauc

SEQ ID NO: 106400 - RNA, 64 nt, Mus musculus
aacauggcucuguuucugcaucaaccacauggcuuuugccagagcuuuccuuccacugcauuua

SEQ ID NO: 106401 - RNA, 87 nt, Mus musculus
gguaagcggcagucucaucuguagugaguacagcugugcauuguagaagugucuagagcccagcaucgucaaguucucuguaagcac

SEQ ID NO: 106402 - RNA, 80 nt, Mus musculus
cuuuaacccccacgaguccuuugagcuccaaguuuuauuuggaucaucucagcaggguagaguuccuucucucacuaugu

SEQ ID NO: 106403 - RNA, 45 nt, Mus musculus
ucuauaacaguucuccuuuuuucaaaaacuuaauuguggcauauu

SEQ ID NO: 106404 - RNA, 44 nt, Mus musculus
ucagugaagaaaauuagcagcaugcguucugugugccaugaugc

SEQ ID NO: 106405 - RNA, 46 nt, Mus musculus
ugauuccauucauuuuaaguaaguauaaugcauuuagggagaaacg

SEQ ID NO: 106406 - RNA, 46 nt, Mus musculus
uuucuaaacuacuuccuuuuuuucagagcaaacaugauacuuggau

SEQ ID NO: 106407 - RNA, 33 nt, Mus musculus
uccagggaggcaaagggaagaacgaaaggagaa

SEQ ID NO: 106408 - RNA, 46 nt, Mus musculus
guuucuauagauguuuauaguagcuucauuuauaacugccaaagac

SEQ ID NO: 106409 - RNA, 45 nt, Mus musculus
uaauacuagguucauguuacuuuaaaauuuguuucaagccccaga

SEQ ID NO: 106410 - RNA, 46 nt, Mus musculus
auggagaaacccugucuugaaaaccaaaacaaaaaaagaaagagga

SEQ ID NO: 106411 - RNA, 46 nt, Mus musculus
ccuaggacucuguucaagaauuaaggccaacaauugacaaggggaa

SEQ ID NO: 106412 - RNA, 42 nt, Mus musculus
aaaaaauggcuauacccacauagcgaaaaucagcauccagca

SEQ ID NO: 106413 - RNA, 42 nt, Mus musculus
aauaucccaaacagaaacaugaauggugaugauauggaagca

SEQ ID NO: 106414 - RNA, 46 nt, Mus musculus
aaugauuagucaguagauggauaauuauugauagacuagaccagac

SEQ ID NO: 106415 - RNA, 48 nt, Mus musculus
guucuaaaaccuguguaauaaugucucccagcaugcucuagguaccag

SEQ ID NO: 106416 - RNA, 46 nt, Mus musculus
aagaguacuuagguuugaggcgguacuguuaauuauauaguaagau

SEQ ID NO: 106417 - RNA, 46 nt, Mus musculus
aaucccauagucuucccuuuugucaucuucucccuaugcuguuuau

SEQ ID NO: 106418 - RNA, 53 nt, Mus musculus
cauacucaccuaaagauuuauucuagaugccaugagcaugccagugcccagga

SEQ ID NO: 106419 - RNA, 59 nt, Mus musculus
uuuuacaauguauuguaaucauauuuaucuuaauuccuccccagaucuacccaccccuu

SEQ ID NO: 106420 - RNA, 45 nt, Mus musculus
ugauugucccuuuuacuucauuuguagugaucuuccuguagcaga

SEQ ID NO: 106421 - RNA, 48 nt, Mus musculus
uguuauuugaauugguguauguagauuucuccaaggccugugauagau

SEQ ID NO: 106422 - RNA, 51 nt, Mus musculus
gguaguaaaauuuuaacuaaaauuguaaauuuguagcuccuuuaaguucug

SEQ ID NO: 106423 - RNA, 47 nt, Mus musculus
ugugaguaugauaacagaccaugagguagcuaaauguauccuagaug

SEQ ID NO: 106424 - RNA, 46 nt, Mus musculus
caugaugggccucugaaucucaguucucgucagugcagccagagua

SEQ ID NO: 106425 - RNA, 42 nt, Mus musculus
ugucaaugggcugaaucaggcuaggugaaaacuggcuaagac

SEQ ID NO: 106426 - RNA, 46 nt, Mus musculus
caauauuugauuuaauaguguagauauaugcuucuguggccugggc

SEQ ID NO: 106427 - RNA, 42 nt, Mus musculus
caguccuccucacacuguccugaaggggagggaggcucuuga

SEQ ID NO: 106428 - RNA, 46 nt, Mus musculus
ugccugguccugaaaccuucagucucuuauuaaacagucaugugca

SEQ ID NO: 106429 - RNA, 42 nt, Mus musculus
acccugaggguagagagcacccuucgucauggucggcaagau

SEQ ID NO: 106430 - RNA, 46 nt, Mus musculus
uaauauauugucuuucuacuucuguaaugcagauuuggggcuuauu

SEQ ID NO: 106431 - RNA, 46 nt, Mus musculus
uuuaguucuagaaauuugauggaggaucauaauacaggauagaguu

SEQ ID NO: 106432 - RNA, 46 nt, Mus musculus
aauggcuuuauaaacaauaugacucaguacuuaguaauaugaagau

SEQ ID NO: 106433 - RNA, 46 nt, Mus musculus
cucauguguuucaauacuuagcccauagggaguggcacuauuagga

SEQ ID NO: 106434 - RNA, 46 nt, Mus musculus
uuuaguauauauuuugcuaaagaaugaaaaauuuuguugcuuagga

SEQ ID NO: 106435 - RNA, 46 nt, Mus musculus
agccaacuacuucagcaaagaucuaggaagcuaaagacagcaaggu

SEQ ID NO: 106436 - RNA, 46 nt, Mus musculus
cucucucucucucucucucucucccucucucucucuccccccccuc

SEQ ID NO: 106437 - RNA, 46 nt, Mus musculus
agcuaauuaaaccucuugaaagacaaauguuuagucuccuguggau

SEQ ID NO: 106438 - RNA, 46 nt, Mus musculus
ugugugugugugugugucugucugucugucugucuguuagucuguc

SEQ ID NO: 106439 - RNA, 45 nt, Mus musculus
ccagaucacuaggaacccacagugaguagugugaaaugugcugau

SEQ ID NO: 106440 - RNA, 45 nt, Mus musculus
aacucagucaguagaccccauuuaucagggaagaaugccacaccc

SEQ ID NO: 106441 - RNA, 44 nt, Mus musculus
ugguaauguguaagagucacucuggugguacuguuugugaagga

SEQ ID NO: 106442 - RNA, 41 nt, Mus musculus
agccaagccggcucacacgguucccaggggguggggcuguc

SEQ ID NO: 106443 - RNA, 46 nt, Mus musculus
uuauccaguauuccccauacaaggcaguauucauaauguagcagug

SEQ ID NO: 106444 - RNA, 42 nt, Mus musculus
uuuggggaauaguuccuaaucagaaggcugggugggccaguu

SEQ ID NO: 106445 - RNA, 46 nt, Mus musculus
uaaaaacuucucauauugcuggaaauuugagaucagggucccagga

SEQ ID NO: 106446 - RNA, 45 nt, Mus musculus
gcaggcuucuguauuguccuguauauuagcaggcauuuuaguauc

SEQ ID NO: 106447 - RNA, 46 nt, Mus musculus
cagcuuuacuugcucuuuuuuucguucaguucuuuagcucauuugu

SEQ ID NO: 106448 - RNA, 46 nt, Mus musculus
ggcuuguuucucgucauggcuucucuuccucacagauugcugagga

SEQ ID NO: 106449 - RNA, 46 nt, Mus musculus
gaguacauguaauucauuaauguucuguggugugaugccaggugcg

SEQ ID NO: 106450 - RNA, 46 nt, Mus musculus
gcucauuuucuuagagacaaagaugagagguuguuugagcaaggau

SEQ ID NO: 106451 - RNA, 46 nt, Mus musculus
gacugcaggugacaguccguggcucagaucaagauggaggcgagag

SEQ ID NO: 106452 - RNA, 45 nt, Mus musculus
ucggguguuuuuauuuaugguguguauuauaaaaagauaggggag

SEQ ID NO: 106453 - RNA, 46 nt, Mus musculus
uuuguguuuuaucuaagcaggccauguaucuccuagauggguguac

SEQ ID NO: 106454 - RNA, 40 nt, Mus musculus
ggaaucuguucagugguauggaugaucuucagacauuccg

SEQ ID NO: 106455 - RNA, 45 nt, Mus musculus
aguccgugggcugugcuugacuuccuuaucaaggcugucacucag

SEQ ID NO: 106456 - RNA, 46 nt, Mus musculus
ggcuaggaugauggauggauccuaauccccagacauugugauccag

SEQ ID NO: 106457 - RNA, 45 nt, Mus musculus
uuaaaaaaaaucacaagaauggaugugugugugugugugugugug

SEQ ID NO: 106458 - RNA, 45 nt, Mus musculus
uuuaaaacgucccugaacguacaguauucuaaguuaccgugagcc

SEQ ID NO: 106459 - RNA, 41 nt, Mus musculus
cuucugggcggcuucucucuggcgcucagcuuugcgcccug

SEQ ID NO: 106460 - RNA, 42 nt, Mus musculus
gcgaccuuugcucgagcccuaaaccauccgggcgggcuggga

SEQ ID NO: 106461 - RNA, 44 nt, Mus musculus
caccaaaucaaccugauaaagguugaugacaacaagaaacuagg

SEQ ID NO: 106462 - RNA, 45 nt, Mus musculus
gguuucuuacuccuuggaggccauguaggcgaugagguccaccac

SEQ ID NO: 106463 - RNA, 44 nt, Mus musculus
agcuugacaaaguugucauugagagcaaugccagccccgggcau

SEQ ID NO: 106464 - RNA, 42 nt, Mus musculus
cugguccucaguguagacaagaugcccuucagugggcccuca

SEQ ID NO: 106465 - RNA, 46 nt, Mus musculus
ggcaaggguuagauuacucuuacccugaugaauaauauaugcugac

SEQ ID NO: 106466 - RNA, 46 nt, Mus musculus
ccuguagggcauuuucuuaauuagugauugaugggggaagguccug

SEQ ID NO: 106467 - RNA, 45 nt, Mus musculus
ucucagcauagcaguaguaacccuaacuaagacauuuagccugaa

SEQ ID NO: 106468 - RNA, 46 nt, Mus musculus
acuugaugguccacaaucuuaaauaccuauaaguacugcagaauag

SEQ ID NO: 106469 - RNA, 23 nt, Mus musculus
aaaaaaaauccaaaagguggucc

SEQ ID NO: 106470 - RNA, 45 nt, Mus musculus
ucucuuuuagccucugcuaccucuugcuguaaacuuccacagaag

SEQ ID NO: 106471 - RNA, 46 nt, Mus musculus
ccacaguacauuaagaaaaagguccacuuagguggcagacaggcag

SEQ ID NO: 106472 - RNA, 45 nt, Mus musculus
ccccgagucccagggaaaccuuuuugucuuaggaguaggcagugg

SEQ ID NO: 106473 - RNA, 46 nt, Mus musculus
augucuacuuagaaaacuguagacuguguuaguacuacuauugcag

SEQ ID NO: 106474 - RNA, 48 nt, Mus musculus
uggaacuuuugaaacacuagagucucuuacugcuaaggcuaguauaug

SEQ ID NO: 106475 - RNA, 48 nt, Mus musculus
aguuucaaauagaguuaauaaaaugguaauuguuccuugaaggagauc

SEQ ID NO: 106476 - RNA, 46 nt, Mus musculus
ugugaaagggucauucaauccccaaagguguuaccacccgcaccag

SEQ ID NO: 106477 - RNA, 41 nt, Mus musculus
ugguggcacacgccuuuaaucccagcauuugggaggcaggc

SEQ ID NO: 106478 - RNA, 42 nt, Mus musculus
augcucuagggagggaagagucugagauaaucauucugggga

SEQ ID NO: 106479 - RNA, 45 nt, Mus musculus
guaucauguuguagucagggaugugaauacaaucagaaaguggua

SEQ ID NO: 106480 - RNA, 46 nt, Mus musculus
caaaguauuaucuuucuuuuuuccuuuuuaaaaguuuaccugcuau

SEQ ID NO: 106481 - RNA, 45 nt, Mus musculus
uaaucucccaaauaugguuuuaaaaaucugaguggauuaaaguag

SEQ ID NO: 106482 - RNA, 46 nt, Mus musculus
auuguguaaaugucauuuaaaaugaugcaguaguuuuguaggaaga

SEQ ID NO: 106483 - RNA, 46 nt, Mus musculus
gucaucguaaccuaacaaagacagacaagaacaggaauacaaggag

SEQ ID NO: 106484 - RNA, 46 nt, Mus musculus
aggucaucuagcccaccccgauacacacacacacauacacacacag

SEQ ID NO: 106485 - RNA, 46 nt, Mus musculus
uaaaaacaaacaauuccuuuuguuaagaaaugguaaaucuaggcag

SEQ ID NO: 106486 - RNA, 49 nt, Mus musculus
gcauaauuucucccuaaaaauucagagagccucuuuacaauccagacau

SEQ ID NO: 106487 - RNA, 46 nt, Mus musculus
auaucugaauaugccagugugaauuugcauucuuuauuugcaggag

SEQ ID NO: 106488 - RNA, 46 nt, Mus musculus
ccuagguagaauuugucaaggauauuuaaagguaagcuguaacaag

SEQ ID NO: 106489 - RNA, 45 nt, Mus musculus
aaugacuccaugaacauaccuaaauuaugucuuguaaagggaugg

SEQ ID NO: 106490 - RNA, 45 nt, Mus musculus
ugugaacaauacaauauaguacacuaccuggaaauggagccccac

SEQ ID NO: 106491 - RNA, 54 nt, Mus musculus
agaaggaagaggaagaugaggaggaggaugaagaggaugaggaagaggaggaag

SEQ ID NO: 106492 - RNA, 41 nt, Mus musculus
cucguuaugaaagagaaaugaaaaccuacauacccccaaag

SEQ ID NO: 106493 - RNA, 46 nt, Mus musculus
agaaugucugcuccaaagcuuugugcaggcguuguguggggcucca

SEQ ID NO: 106494 - RNA, 46 nt, Mus musculus
uguuaauaguguacaugcaguuauuuuugaauagagggguuuaaau

SEQ ID NO: 106495 - RNA, 46 nt, Mus musculus
gagcacagaguuaagccaacaguucuguguugaguagauccaagag

SEQ ID NO: 106496 - RNA, 46 nt, Mus musculus
ccaagagaucccccaccuccucggccaucccuuuccagucccccag

SEQ ID NO: 106497 - RNA, 70 nt, Mus musculus
gguugauaguccugggaggccuguccuuuucugaagagaagugggaggagaggagggaggggaaaucgug

SEQ ID NO: 106498 - RNA, 90 nt, Mus musculus
uguaucuggagcaagaacuagaaagccugaaggcuguguuagagaucaagaaugagaagcugcaccagcaggacaugaagcuaaugaaga

SEQ ID NO: 106499 - RNA, 50 nt, Mus musculus
uuuaaacgaaagguugaaaucagaggagcaaaagcaacugucaagagaga

SEQ ID NO: 106500 - RNA, 51 nt, Mus musculus
gaagaagucacuggaggaucugcuuaaugagaagcaggaaucgcuggaggu

SEQ ID NO: 106501 - RNA, 65 nt, Mus musculus
uuaaaagaaaaaaacccacaacaaaaccccugccuuccagaaaucaagaagagccaugagaugga

SEQ ID NO: 106502 - RNA, 46 nt, Mus musculus
uuccuacugggagagggcuuaauuuuagauuucuguuuucuucugg

SEQ ID NO: 106503 - RNA, 68 nt, Mus musculus
gugugugugagagagagagagagagagagagagagggagagagggagagagagagagagagaauuaca

SEQ ID NO: 106504 - RNA, 46 nt, Mus musculus
ccauuuuggcucuuuccuccaacauuccugcuuugugaacugguuu

SEQ ID NO: 106505 - RNA, 47 nt, Mus musculus
gaaguccuuauucccccaccacacacauguaugucccgucagacagg

SEQ ID NO: 106506 - RNA, 46 nt, Mus musculus
uuuuguacaaagucgguuccccaaagguuuacaauuggugggagau

SEQ ID NO: 106507 - RNA, 45 nt, Mus musculus
cacugugagcagcuuucugcagccugacacaggcuagggcauaag

SEQ ID NO: 106508 - RNA, 33 nt, Mus musculus
auuucucaggcuugagucuuagaacacaccgac

SEQ ID NO: 106509 - RNA, 46 nt, Mus musculus
cuggcuccacugauauccaaaagcccaugcucuuuugcccacagau

SEQ ID NO: 106510 - RNA, 46 nt, Mus musculus
auuacauuuauuugcauguguuacccacaugugugugccacagcag

SEQ ID NO: 106511 - RNA, 45 nt, Mus musculus
gaaaauucuuguagcuuucagcuggauuuguguuuugggccagag

SEQ ID NO: 106512 - RNA, 46 nt, Mus musculus
gaaucagacaggcuugcucaaggaccagugcuugcuuaagggccag

SEQ ID NO: 106513 - RNA, 45 nt, Mus musculus
gucaggaaacagccagccuuugucgucucaccucucuguccauga

SEQ ID NO: 106514 - RNA, 55 nt, Mus musculus
uaaugauucagguuucuauucuccgagagaaggcaggaccaagacagaggaggac

SEQ ID NO: 106515 - RNA, 50 nt, Mus musculus
uuguuucugugccuuaaguacgguaauggauacagaauaaggagacaagg

SEQ ID NO: 106516 - RNA, 41 nt, Mus musculus
cagggacuacguacugcagacccugucuggaaccaggggga

SEQ ID NO: 106517 - RNA, 46 nt, Mus musculus
acuaugggaaacccggggcuuuaauaugaucuacucaaaaaugcag

SEQ ID NO: 106518 - RNA, 33 nt, Mus musculus
gaagcaagcacagagugaggaguuaucauauag

SEQ ID NO: 106519 - RNA, 46 nt, Mus musculus
ucucaaggugucagagcugaaugggcuguuaggagguagaacauga

SEQ ID NO: 106520 - RNA, 42 nt, Mus musculus
ggggaccugaguucaaaucuccaaugcccuaaagcuaagcau

SEQ ID NO: 106521 - RNA, 46 nt, Mus musculus
cccaaacuauaauuuuaucacccacuuucuacuugugccagucucu

SEQ ID NO: 106522 - RNA, 46 nt, Mus musculus
auaugauaaaccaaaaaagguuuaucuuuuuaaaauacagccauau

SEQ ID NO: 106523 - RNA, 45 nt, Mus musculus
auuuauaagcaaguuuauaucauauuucucuuucucguuccagau

SEQ ID NO: 106524 - RNA, 44 nt, Mus musculus
acaggagaaagagagucacaagagcaggcacaagagucagagau

SEQ ID NO: 106525 - RNA, 42 nt, Mus musculus
acccagccaccaacuggggacggaguauggaaagccaagauu

SEQ ID NO: 106526 - RNA, 45 nt, Mus musculus
cuuaagaggguaguagaggcagagaaagagagggagggaggaagg

SEQ ID NO: 106527 - RNA, 46 nt, Mus musculus
aaagcucacuagugcaugcaugcacacauaggcacauagggcagaa

SEQ ID NO: 106528 - RNA, 46 nt, Mus musculus
ggcuuaacauuugauugucuguaguauuuuugugaagcagguaguu

SEQ ID NO: 106529 - RNA, 41 nt, Mus musculus
gacaagguacuucggguuaucuguaaucugcuguuggggga

SEQ ID NO: 106530 - RNA, 46 nt, Mus musculus
uguacuaacucaacaguuaguucuauguuucugacuucccccauac

SEQ ID NO: 106531 - RNA, 46 nt, Mus musculus
gcacagaugcugggugagggccaggaaagccugugugugugugugu

SEQ ID NO: 106532 - RNA, 46 nt, Mus musculus
gucaaauugccuuguaaaaugggcgauuaaaugucuugguauagau

SEQ ID NO: 106533 - RNA, 45 nt, Mus musculus
accuacaucaaccacuacagacagguuaguagggccaguaagagc

SEQ ID NO: 106534 - RNA, 46 nt, Mus musculus
uaaguugaguagauauaagacagauauggaguagugccuguaagug

SEQ ID NO: 106535 - RNA, 46 nt, Mus musculus
ggguggugccuuuucacugagcuagaaagauugaagggguggaggu

SEQ ID NO: 106536 - RNA, 32 nt, Mus musculus
uugguagguagagacaaggagauugccccaga

SEQ ID NO: 106537 - RNA, 46 nt, Mus musculus
gaguguguggauauuagauuagugagacuagauagaggucagaagu

SEQ ID NO: 106538 - RNA, 45 nt, Mus musculus
auuugagauaguucuauguauccagggagaggucauaagucaaaa

SEQ ID NO: 106539 - RNA, 43 nt, Mus musculus
agucuuucuugacaugucccaugguucucagcacuaauuggga

SEQ ID NO: 106540 - RNA, 46 nt, Mus musculus
aaaugagggaaacuagaaaacaagugaaugaaauguucaguagaca

SEQ ID NO: 106541 - RNA, 46 nt, Mus musculus
guuuucuaugacguaaauacuucuuucuauaggauuauugaaaacu

SEQ ID NO: 106542 - RNA, 46 nt, Mus musculus
caacaugggugaguucagugacauacauacacugagguuuugcugc

SEQ ID NO: 106543 - RNA, 46 nt, Mus musculus
cucuguuuuguuuuuguuuuguuaaugaacucaauuaaauaugauu

SEQ ID NO: 106544 - RNA, 46 nt, Mus musculus
ugggagguauuuggagaggggggacaggaaaugugacaccgcugag

SEQ ID NO: 106545 - RNA, 41 nt, Mus musculus
auaaggguggagaagcagaccccagaugacguggagagaga

SEQ ID NO: 106546 - RNA, 46 nt, Mus musculus
aaaaauagugacuaguauugaauguuuaaaaaaugugccccuaacg

SEQ ID NO: 106547 - RNA, 42 nt, Mus musculus
uagaacccuaggcuccgacagggccuuaucgccucagaggau

SEQ ID NO: 106548 - RNA, 45 nt, Mus musculus
uuuguguguguguauguguguguguguauauauguguguguguau

SEQ ID NO: 106549 - RNA, 46 nt, Mus musculus
ggggcuggcuuacagguucagagguucaguccaagaucauuaaggu

SEQ ID NO: 106550 - RNA, 45 nt, Mus musculus
aguguggauggcgugcuguguacuggaggaaaggcugguagcagu

SEQ ID NO: 106551 - RNA, 46 nt, Mus musculus
guaggucacauaggugugugcucaaugauaagaaaacacuggagau

SEQ ID NO: 106552 - RNA, 45 nt, Mus musculus
ggucaccuguaggucaccugcagugacuucuaaugcaugaaagaa

SEQ ID NO: 106553 - RNA, 46 nt, Mus musculus
agaagaucaaaggcauucuccccgugaaaaugaaaagcucagagug

SEQ ID NO: 106554 - RNA, 46 nt, Mus musculus
aaacauuaaagccaaaguuauauccagaucaguguugcaacccaaa

SEQ ID NO: 106555 - RNA, 45 nt, Mus musculus
aaucugagcuucagacuugaaccugcugaagugaagaaguacaau

SEQ ID NO: 106556 - RNA, 45 nt, Mus musculus
gggaacgacaagucauuucagcuuuggagcaucucagacuacagu

SEQ ID NO: 106557 - RNA, 46 nt, Mus musculus
cuuuuuguaccaacaaagaacaugauagauuauuuaugcagcagcu

SEQ ID NO: 106558 - RNA, 46 nt, Mus musculus
uguuaauguuguuaaauacuauuauuuauugacucgaauguaaaga

SEQ ID NO: 106559 - RNA, 46 nt, Mus musculus
gaugcaugccagagcugauucucaugagcuggagcgguuggggagg

SEQ ID NO: 106560 - RNA, 59 nt, Mus musculus
agcaccacaugguggcucacaaccaucuguaaugggauccgaugcccucuucuggugug

SEQ ID NO: 106561 - RNA, 45 nt, Mus musculus
cuuagggcacaacacgggcuucugucucacauuuuuacuccagau

SEQ ID NO: 106562 - RNA, 23 nt, Mus musculus
gaggaggcaggccuaucuuauug

SEQ ID NO: 106563 - RNA, 46 nt, Mus musculus
ucaaggcuggaugaggcagcucagaaggaggaacagggucccaaga

SEQ ID NO: 106564 - RNA, 43 nt, Mus musculus
uaccacaguuucccccucucuucucccagucccaccccccaaa

SEQ ID NO: 106565 - RNA, 46 nt, Mus musculus
cacaagaaauuaaagcaucaguaucauagucguccuacccccaguu

SEQ ID NO: 106566 - RNA, 46 nt, Mus musculus
uaaaacccagaugaggaauaaagaagaggcuauuuuuauuucagac

SEQ ID NO: 106567 - RNA, 80 nt, Mus musculus
uaguuuguucugauguaaaaucuuuuuacaggaucagagucauccggagaaaggcauguguggauuguuuauuuaaaagg

SEQ ID NO: 106568 - RNA, 45 nt, Mus musculus
uggccagcucuccucugagagcuaggcuaggaaauuagcaucucg

SEQ ID NO: 106569 - RNA, 46 nt, Mus musculus
accuccaggccugaguuagcugagucauaaagacauagaccuguua

SEQ ID NO: 106570 - RNA, 48 nt, Mus musculus
gcuaauaucaggaucagagaugccaaacucgaagauagcggagauugu

SEQ ID NO: 106571 - RNA, 46 nt, Mus musculus
aauuacuggugcuagcacauucgauauauuggcauuuaagugagau

SEQ ID NO: 106572 - RNA, 46 nt, Mus musculus
ccuguguguuggguauauccagucaugagagcuauuuuauauagaa

SEQ ID NO: 106573 - RNA, 46 nt, Mus musculus
ugguuuuuucuuacauuugagcugaaucuuuucaaucaaggcagau

SEQ ID NO: 106574 - RNA, 46 nt, Mus musculus
uaacacuauuaauagauuaaguuauguuuuuugaagggggcgaaaa

SEQ ID NO: 106575 - RNA, 63 nt, Mus musculus
gggaucaaagguaugugcuaccaucaccuggcccagauuauuuuuaauauucauuauuguagu

SEQ ID NO: 106576 - RNA, 45 nt, Mus musculus
gcgccuaguuagcuaauguagagaaggcggccauuggggcuuugg

SEQ ID NO: 106577 - RNA, 46 nt, Mus musculus
ccaggaguuggguagcugagacaguaggaucaggaauuuggggcua

SEQ ID NO: 106578 - RNA, 45 nt, Mus musculus
auuacacuuauaaaauaauuuuacuaaaaggaaaaauuagggaag

SEQ ID NO: 106579 - RNA, 46 nt, Mus musculus
gcaaaugucagcugagguggaaaacccagaaaggaacagugacaug

SEQ ID NO: 106580 - RNA, 55 nt, Mus musculus
caaggaugcuaacaggacauuuuauauuacuugguuuggggcaagaaugcaaaag

SEQ ID NO: 106581 - RNA, 45 nt, Mus musculus
gcucuucuguugcuucuguccaaagcaaaaagaaccuuucccagc

SEQ ID NO: 106582 - RNA, 23 nt, Mus musculus
agaguaaggugaaguguucaggc

SEQ ID NO: 106583 - RNA, 46 nt, Mus musculus
cauuccugcucugcuucuuuacuuagggcucuaaauuuagcacaag

SEQ ID NO: 106584 - RNA, 42 nt, Mus musculus
guguguguguguguguguguucaugcaugaaaguggcugcau

SEQ ID NO: 106585 - RNA, 46 nt, Mus musculus
uuaggaaguaaugauauagaaauauauugggcuauaucuuugggag

SEQ ID NO: 106586 - RNA, 45 nt, Mus musculus
aggcaacauggccacaggaggagguccuuuugaagaagucaugca

SEQ ID NO: 106587 - RNA, 44 nt, Mus musculus
caauagaucaucagaaaagaauaagaaaaaguuugguguagcaa

SEQ ID NO: 106588 - RNA, 46 nt, Mus musculus
aaaaaugagaguaauaacauuuugauaauguagcauaauuuuguag

SEQ ID NO: 106589 - RNA, 46 nt, Mus musculus
ucagcuuagugaaaaccgaaagcccuucaacuuuuugccuaugcag

SEQ ID NO: 106590 - RNA, 46 nt, Mus musculus
gcucuaaguaaugaccuuuugcaaaacugucaagucucugaagaag

SEQ ID NO: 106591 - RNA, 45 nt, Mus musculus
caauuauuuguaaagagauagaacuauuaaaggacuguuuagggg

SEQ ID NO: 106592 - RNA, 46 nt, Mus musculus
ucuuggggauggcuuuggguuaaauuuauuuuuaaggugaaacgag

SEQ ID NO: 106593 - RNA, 50 nt, Mus musculus
auauguuacacuauuuaaugaaggaggcaucuuuuagucuugagaauucg

SEQ ID NO: 106594 - RNA, 45 nt, Mus musculus
ccaacccuagucuugguuauuaauguuauccuaaugcagcacacc

SEQ ID NO: 106595 - RNA, 46 nt, Mus musculus
cuguauguaugaguggguauccuaugcaugucugaugcccacagag

SEQ ID NO: 106596 - RNA, 45 nt, Mus musculus
cugggaguggugggaagugaaccugggcuggguccuaugcaagag

SEQ ID NO: 106597 - RNA, 44 nt, Mus musculus
acagaagagguugcaggaacaacuccuggcuaucauaccguaca

SEQ ID NO: 106598 - RNA, 46 nt, Mus musculus
uagagcaguagguauugucaguauugucuucagaaacgugcuuuag

SEQ ID NO: 106599 - RNA, 46 nt, Mus musculus
aaucccucaguuucugaacauuuaccugaugagaaaguacagcuuu

SEQ ID NO: 106600 - RNA, 46 nt, Mus musculus
auuuuaaucuaguagcuguaaugcaaaaguucuagacagucuggaa

SEQ ID NO: 106601 - RNA, 45 nt, Mus musculus
agauaugaugacagaugcuguaaaugaaaauacaaaagaugaaga

SEQ ID NO: 106602 - RNA, 47 nt, Mus musculus
gugaauacuaacaguaauacacagugugguucuaacaauagagaugg

SEQ ID NO: 106603 - RNA, 48 nt, Mus musculus
acaauagagaaggagagcagagguugcauguagcacauggagaagaug

SEQ ID NO: 106604 - RNA, 41 nt, Mus musculus
aauuaugauggccagaguuuauagccucgagcaaagccuga

SEQ ID NO: 106605 - RNA, 42 nt, Mus musculus
caauauuggcaaacuccuuuaauuccagcauucgggaggcaa

SEQ ID NO: 106606 - RNA, 46 nt, Mus musculus
gaaaauucuaauaaaauagauacuggaguaaaugaaaaaacaaggu

SEQ ID NO: 106607 - RNA, 97 nt, Mus musculus
uauagagagaaauuuuaugaggcuaaacuacagcagcaacagagagagcuuaaacaauugcaggaggaaagaaagaaauugauugaaauucaagaga

SEQ ID NO: 106608 - RNA, 45 nt, Mus musculus
acccacccagucugguuaacuuuacuguguaguuaaacuuguuua

SEQ ID NO: 106609 - RNA, 45 nt, Mus musculus
aaagauuuuaacuuuaguauuuuuaauuaugugcguugugugugg

SEQ ID NO: 106610 - RNA, 27 nt, Mus musculus
acaugagaagacaugaaauguuaaggg

SEQ ID NO: 106611 - RNA, 46 nt, Mus musculus
uuaacuagcuauauaguaauauuuaauuuaaaaauuugaaguccag

SEQ ID NO: 106612 - RNA, 46 nt, Mus musculus
uuuuuucauuuuguuuuuuugagacagaacuuuucuguguagccaa

SEQ ID NO: 106613 - RNA, 47 nt, Mus musculus
ggagaugaggauggcuaucuuucagaaggaauuguucgcacagauga

SEQ ID NO: 106614 - RNA, 45 nt, Mus musculus
uagcaugaaucaaaauucuuacaauguaaaggaaaccaaaaccag

SEQ ID NO: 106615 - RNA, 46 nt, Mus musculus
gacaccaaguaguucugaaguucacacuaauuaaccaaaugcccag

SEQ ID NO: 106616 - RNA, 46 nt, Mus musculus
cuuuccuuuucuacauaaagauguugcuguaguaguucccaccuag

SEQ ID NO: 106617 - RNA, 42 nt, Mus musculus
uaaaacugugccacuugaugaagucaagaaugaaggguggaa

SEQ ID NO: 106618 - RNA, 46 nt, Mus musculus
acucguuaucucauaugauaacuuaaugcuguaaauucuacauuag

SEQ ID NO: 106619 - RNA, 41 nt, Mus musculus
cucuuacauagaagagaaggagcaguggcaagaacagauua

SEQ ID NO: 106620 - RNA, 52 nt, Mus musculus
caucagcugaaccaaugcuacacacagcuaacauggcagcagaacaaugucc

SEQ ID NO: 106621 - RNA, 55 nt, Mus musculus
uuaaaacaaaugcuaacugaacuuaugcgccaacaaaaucagcacccagaaaagc

SEQ ID NO: 106622 - RNA, 46 nt, Mus musculus
uagggaggugaagggugaguaagacucuacuucagagcagccacag

SEQ ID NO: 106623 - RNA, 47 nt, Mus musculus
guagagaaagcuacaaauaguaaccgcaaaaaucaaccagauacaag

SEQ ID NO: 106624 - RNA, 27 nt, Mus musculus
ugccugauccuauagacccaacaacag

SEQ ID NO: 106625 - RNA, 45 nt, Mus musculus
aagggcccacugagcccgguccguggcauaugugugugugugugu

SEQ ID NO: 106626 - RNA, 45 nt, Mus musculus
cuggcucuuccauucuugaugcugucuguucugagauacaccuga

SEQ ID NO: 106627 - RNA, 46 nt, Mus musculus
cugcuaguuguuuuucuaauuucuuauauucagccuacaaccguga

SEQ ID NO: 106628 - RNA, 46 nt, Mus musculus
uucagcugacauucacugccauuguuaagguccuguuucacagcag

SEQ ID NO: 106629 - RNA, 46 nt, Mus musculus
acauaggaauaaauaaaauuuaaaaugugauauaaaaauucaaaag

SEQ ID NO: 106630 - RNA, 45 nt, Mus musculus
gagucaagagccacacauguucuuaaucauugaaccagccccagc

SEQ ID NO: 106631 - RNA, 46 nt, Mus musculus
gcauuugguaguccaagaaggacuuaauucguuuaaaggcauucag

SEQ ID NO: 106632 - RNA, 45 nt, Mus musculus
auagugggcugggacggcaauuuaagaauccuauauucagcuaag

SEQ ID NO: 106633 - RNA, 46 nt, Mus musculus
ucuuacacaccugcagccucaaaccuauggaggcugagucaagaag

SEQ ID NO: 106634 - RNA, 46 nt, Mus musculus
gcuacaaagucgcagacuacauccugucccaaggaaccaaaaagag

SEQ ID NO: 106635 - RNA, 46 nt, Mus musculus
ucacaguuguguacaccuguagccccagcacuauguucaagagcag

SEQ ID NO: 106636 - RNA, 38 nt, Mus musculus
cauauauggaaagauaaacaucuaauuuuggccaagaa

SEQ ID NO: 106637 - RNA, 45 nt, Mus musculus
ucauauagaauaaaagaaauugaguugugucauacaauaaaauga

SEQ ID NO: 106638 - RNA, 46 nt, Mus musculus
uuuacagcagucuaacaguugaaaagaaauacaugugaagugccag

SEQ ID NO: 106639 - RNA, 41 nt, Mus musculus
gugguguaguagcaguagcaguagcaguagcaguagcagua

SEQ ID NO: 106640 - RNA, 41 nt, Mus musculus
aauugucuuuguauauguguuuaaacuugauuuugugugug

SEQ ID NO: 106641 - RNA, 46 nt, Mus musculus
ugucauucacucacacagauacauacaugcacauaaauaaaaauag

SEQ ID NO: 106642 - RNA, 42 nt, Mus musculus
agucacucaaauaugagaugcacuugcaggguuauugaggau

SEQ ID NO: 106643 - RNA, 48 nt, Mus musculus
cucacuucaguaagacguauggucuugacccuuacccagcagaaugau

SEQ ID NO: 106644 - RNA, 45 nt, Mus musculus
gcaagacuuggauaauaauagcauagcuguuaaacagaggugcaa

SEQ ID NO: 106645 - RNA, 46 nt, Mus musculus
guaaguccugaaccagacuaaugccaaaggaaaagcuguggugaga

SEQ ID NO: 106646 - RNA, 46 nt, Mus musculus
ggccaaaaggauucuugaaggagaucauggcucaccugcuggagag

SEQ ID NO: 106647 - RNA, 48 nt, Mus musculus
ugcuaaaggucccaaaaauguaagaucugauguuucugaucaagaaga

SEQ ID NO: 106648 - RNA, 51 nt, Mus musculus
aaagcugaaagucaggcuuuaacuaauuauggaaguggagaagaugagaau

SEQ ID NO: 106649 - RNA, 46 nt, Mus musculus
guggacauccagacuucacuucaggcuaacacugaaacuacagaag

SEQ ID NO: 106650 - RNA, 47 nt, Mus musculus
augaucuugaaaaaacaccagaaaguacaaauguaccaucagaccaa

SEQ ID NO: 106651 - RNA, 46 nt, Mus musculus
cuuugugaaaguugaggauuugccgcucaaacugacagucuauuca

SEQ ID NO: 106652 - RNA, 46 nt, Mus musculus
cagaaaaaccauuuaucuggugaaauaugugaaaugcagacagaag

SEQ ID NO: 106653 - RNA, 45 nt, Mus musculus
aacauugaucauuauucuucuuuucagaaacagugggagcccaga

SEQ ID NO: 106654 - RNA, 46 nt, Mus musculus
uaucuauuagauuaauauuuuucagaauuuaaaauguugccucauu

SEQ ID NO: 106655 - RNA, 46 nt, Mus musculus
gaugcccucuucucuucucacugugaguaguugccugcaccuggaa

SEQ ID NO: 106656 - RNA, 42 nt, Mus musculus
agcaaaguccuguaagcaucaucagcucugcaaaagggggga

SEQ ID NO: 106657 - RNA, 45 nt, Mus musculus
gccaccuaagaaagaacaauaugaagaauggaaauaauagcccag

SEQ ID NO: 106658 - RNA, 44 nt, Mus musculus
guuaugcuucuaaauuuauucacagugccuaaaagauugucaga

SEQ ID NO: 106659 - RNA, 45 nt, Mus musculus
gggccugauaacuuuaguucaaucugugguacauauauggcagag

SEQ ID NO: 106660 - RNA, 84 nt, Mus musculus
aaaaaagaauaaguguucucuuuuuccuaguuauucugccugccaguaaccccaggaagagucuagcuucaaaaacccacaaac

SEQ ID NO: 106661 - RNA, 42 nt, Mus musculus
acagcagugcaaugucgcuaugcuuggcuggaguaccucaga

SEQ ID NO: 106662 - RNA, 52 nt, Mus musculus
auucuuuaagggacaccacauagaaauugccaguucauuucacuuugccacu

SEQ ID NO: 106663 - RNA, 41 nt, Mus musculus
gccuugaggacguacugagacccgaagauguguugugcaga

SEQ ID NO: 106664 - RNA, 46 nt, Mus musculus
uguuaccaaaggucaauuugaaagucaccuucgagauugcccagac

SEQ ID NO: 106665 - RNA, 46 nt, Mus musculus
aaaugaaucuuaaaguguucaugauuacuauuaaauaucauuauaa

SEQ ID NO: 106666 - RNA, 47 nt, Mus musculus
uuuuaucuuucccugaaccauaaccaagaaaccuaaucagcccacuu

SEQ ID NO: 106667 - RNA, 60 nt, Mus musculus
cuuguuuauugaugaccgcagaacaccggccaagaagugucuaaaucacaccacacagaa

SEQ ID NO: 106668 - RNA, 48 nt, Mus musculus
ucuggagaggguugugugaucacacgggaaagaaaagagucuuuggau

SEQ ID NO: 106669 - RNA, 68 nt, Mus musculus
gaagaagccaagaacacacugaccaagaccaagauaauggcgccaguauauuuuauccugggaggcaa

SEQ ID NO: 106670 - RNA, 46 nt, Mus musculus
ggguaggguuuaucacucgaucaguucuggaaaacaccacaaggug

SEQ ID NO: 106671 - RNA, 42 nt, Mus musculus
guguuuucugcauaucugcauagucccuuuauccccaccugu

SEQ ID NO: 106672 - RNA, 67 nt, Mus musculus
auucaacauuuucuaugaauuguuuaccauguguacaucaaucauaacugaagaugagaaagguaau

SEQ ID NO: 106673 - RNA, 25 nt, Mus musculus
acaaacccuaauuauaagcagcuca

SEQ ID NO: 106674 - RNA, 44 nt, Mus musculus
ccugguaugauuggcagccuuccugacccuuuuggagaggaaau

SEQ ID NO: 106675 - RNA, 46 nt, Mus musculus
uuguguugaucgagauaguggaucaccuaaagucaugcagguagaa

SEQ ID NO: 106676 - RNA, 41 nt, Mus musculus
aaucuguggugcagguuuugaugccuugaaauuacugcauu

SEQ ID NO: 106677 - RNA, 46 nt, Mus musculus
uguagcuaggcaaucacuaagucauuuccuucccugaccccgaguc

SEQ ID NO: 106678 - RNA, 46 nt, Mus musculus
uaaacacauggacauagaguuuuaaaauacaugcuuagguggagaa

SEQ ID NO: 106679 - RNA, 53 nt, Mus musculus
ugaauuccauaacgaguuuagugaauacauuugugccaaguggaaaacuaaug

SEQ ID NO: 106680 - RNA, 46 nt, Mus musculus
ggccagccuggucuacauaaugaguuucaaaguacccucugcuaua

SEQ ID NO: 106681 - RNA, 79 nt, Mus musculus
aguuccguggcacaccauaaaucuugauuuaccacccuacaaaagauggcaugaauuauuggcucaaaaggcaccagcg

SEQ ID NO: 106682 - RNA, 46 nt, Mus musculus
ugaguaggaagucgagaauguugguggcagauuagacaggcaagag

SEQ ID NO: 106683 - RNA, 46 nt, Mus musculus
auaaugaaaaggucccccaccccaccccaccccaaagacuccaguc

SEQ ID NO: 106684 - RNA, 46 nt, Mus musculus
aauucauagguaaagcaccagccaccgucaggcaucacuucaagag

SEQ ID NO: 106685 - RNA, 46 nt, Mus musculus
guggagguuuuauuaucaggguuuccugucuucuuagucccacaaa

SEQ ID NO: 106686 - RNA, 46 nt, Mus musculus
uaauuauuagaacaacuuucuuaaucagaucuuucuuaaagcaguu

SEQ ID NO: 106687 - RNA, 46 nt, Mus musculus
ugcccucauaaaggagacaccuccugugucuauaggaaguagaggu

SEQ ID NO: 106688 - RNA, 69 nt, Mus musculus
gcuuugcaccugcucucuauuuguacacaugugcauugugucacucgggcuaguuuacaagccaccugg

SEQ ID NO: 106689 - RNA, 46 nt, Mus musculus
aaugcauggauaucuugguggcaugcagcagcaaaugugagggagg

SEQ ID NO: 106690 - RNA, 41 nt, Mus musculus
cuuggagccauguaggcuuaggcaggaugguuuaugcagug

SEQ ID NO: 106691 - RNA, 46 nt, Mus musculus
auaaaguuuucaggcaaaagaagaucaaaaaccauaagacaaagac

SEQ ID NO: 106692 - RNA, 46 nt, Mus musculus
aaaaucaacguauccuccuucuggaccaacgugagugagcgcagau

SEQ ID NO: 106693 - RNA, 45 nt, Mus musculus
aaaucccagcacccacaugguggcucacaaccauccuuaacgaga

SEQ ID NO: 106694 - RNA, 41 nt, Mus musculus
gaucuggggauuugagaggcaagaguuuuguuuuguuuugu

SEQ ID NO: 106695 - RNA, 46 nt, Mus musculus
uagcugagguugaaacauuuuugagcaagaacuuuuacaaucagua

SEQ ID NO: 106696 - RNA, 46 nt, Mus musculus
gacucuucuguauauaaacauauauauaauauuucagcauauagac

SEQ ID NO: 106697 - RNA, 24 nt, Mus musculus
gacaugauaccugccucucucuuu

SEQ ID NO: 106698 - RNA, 45 nt, Mus musculus
cugaagacagcuacaguguacuuagauauaauaauuaauaaaucu

SEQ ID NO: 106699 - RNA, 46 nt, Mus musculus
gacuggagagggacucagccagccugcuuugaacucaguauguccu

SEQ ID NO: 106700 - RNA, 45 nt, Mus musculus
ucugucugugugugugucugugugugugugugucugugugucugu

SEQ ID NO: 106701 - RNA, 46 nt, Mus musculus
gugucugugugugugugucucugugugucugugugugugugugugu

SEQ ID NO: 106702 - RNA, 45 nt, Mus musculus
gugugugucugugugugugugugugugugucucugugucugugug

SEQ ID NO: 106703 - RNA, 42 nt, Mus musculus
aguacagugacagaaaggcaaugcagcaggaugaggagugau

SEQ ID NO: 106704 - RNA, 46 nt, Mus musculus
agcccaaaugggcaagcucccauggcaggacgggcaaggaagggau

SEQ ID NO: 106705 - RNA, 36 nt, Mus musculus
cugccuggaagccuggggaccuuguuuucugacaga

SEQ ID NO: 106706 - RNA, 46 nt, Mus musculus
agaguaauuucagugaccaaaacccacauaguauguacaaaagauu

SEQ ID NO: 106707 - RNA, 45 nt, Mus musculus
aauuuuauuccuagaaggagaaaugcuuuuuugaauuugagagag

SEQ ID NO: 106708 - RNA, 42 nt, Mus musculus
augcggggccaaagucuucucaccuggguccuagccgcggca

SEQ ID NO: 106709 - RNA, 42 nt, Mus musculus
gacaugaagguucgcaagucuucaacaccagaagaagugaag

SEQ ID NO: 106710 - RNA, 33 nt, Mus musculus
guaugccccacaucuccuaccaggaucuccuug

SEQ ID NO: 106711 - RNA, 111 nt, Mus musculus
ugccagacaaggacugcugcuaugcacucuaugaugcaaccuaugagaccaaggagagcaagaaggaggaccugguguucaucuucugggcccccgagaaugcaccccuua

SEQ ID NO: 106712 - RNA, 51 nt, Mus musculus
auuuugcucuuaaggggugcauucucgggggcccagaagaugaacaccagg

SEQ ID NO: 106713 - RNA, 57 nt, Mus musculus
gccaucaagaagaagcugacaggaaucaagcaugaauuacaagcuaacugcuacgag

SEQ ID NO: 106714 - RNA, 96 nt, Mus musculus
ggcagccugcaacacccaagagcaggucuggggcuguuaagaugcuccaggcagggggcuggagguggcucacaaaggcuugcccuccagggaaau

SEQ ID NO: 106715 - RNA, 45 nt, Mus musculus
ugagccaccuccagcccccugccuggagcaucuuaacagccccag

SEQ ID NO: 106716 - RNA, 53 nt, Mus musculus; identical to SEQ ID NO: 63932

SEQ ID NO: 106717 - RNA, 61 nt, Mus musculus
ggggggaucccagcagggggagggcuaucccuucaccccaguugccaaacaucccucccac

SEQ ID NO: 106718 - RNA, 68 nt, Mus musculus
aaugacaccccuacuccguaucccuccccaucccaugcugccaacuucuaaccacaauagugacucug

SEQ ID NO: 106719 - RNA, 59 nt, Mus musculus
ugcuuaucuguuuaguucuguguguaaaugaaauguggaaaugacccucccugccccag

SEQ ID NO: 106720 - RNA, 46 nt, Mus musculus
uucagcaccaagaauagaaagaugauacccugccuuuaacccaguu

SEQ ID NO: 106721 - RNA, 42 nt, Mus musculus
cucuucauugcacaacuggguuuguggaaagucuuuggggag

SEQ ID NO: 106722 - RNA, 49 nt, Mus musculus
ucauuaacgugguuacuguauucaaagacaucacauaucagauuacccc

SEQ ID NO: 106723 - RNA, 67 nt, Mus musculus
cuuugcucaaggcucagggcaugucccucagauguggcagaugauaagagggucuguauucgucccc

SEQ ID NO: 106724 - RNA, 27 nt, Mus musculus
cuuuccaugaagcucucagaccuaucu

SEQ ID NO: 106725 - RNA, 69 nt, Mus musculus
cuuuaugcacggguucucggacauguugcccuuucaggggagaugaaacccagagacuguaaucgucgc

SEQ ID NO: 106726 - RNA, 78 nt, Mus musculus
caauuuuuaagccuaugagugagaagagguccccgggcgguuuggggagauuccccuuucuguucacagaguccuugc

SEQ ID NO: 106727 - RNA, 68 nt, Mus musculus
cugcaacuguguugggagcucagaucuucaccugcgggagacacuacugggaaguggaagugggaaag

SEQ ID NO: 106728 - RNA, 47 nt, Mus musculus
cuagauccagccacagccaaugcuuaccugcuuuuguccgaagaucu

SEQ ID NO: 106729 - RNA, 75 nt, Mus musculus
cacacuuuucagaucuucggacaaaagcagguaagcauuggcuguggcuggaucuagaguuauaucugcugcaag

SEQ ID NO: 106730 - RNA, 46 nt, Mus musculus
aauuuuaaccuaaauucuuaauagauaguccuauuauuauuuguuu

SEQ ID NO: 106731 - RNA, 47 nt, Mus musculus
gaggggaugggauaugggguuuucggagguggaacccaagaaggaga

SEQ ID NO: 106732 - RNA, 57 nt, Mus musculus
acauauggagugacccacggcuccggccaaauauguagcagaggauggccuuguugg

SEQ ID NO: 106733 - RNA, 82 nt, Mus musculus
caaccauuggacugaacacaagguccucaaugaaggagcuagagaaaggacugaaggagcugaaggggucugcagccccaua

SEQ ID NO: 106734 - RNA, 61 nt, Mus musculus
auagcugucuccugagaggcucugccagcaccugauaaauacagaaauggaugcucacagc

SEQ ID NO: 106735 - RNA, 46 nt, Mus musculus
acaauaguaucuggguuugcugauuguaugugugauggauccccag

SEQ ID NO: 106736 - RNA, 45 nt, Mus musculus
cuuugggggcaacaaaauauccaugggaggagauacagagacaaa

SEQ ID NO: 106737 - RNA, 46 nt, Mus musculus
agucucuuccucacuuucucuucuauuaguuuuaguguaucugguu

SEQ ID NO: 106738 - RNA, 46 nt, Mus musculus
uggggaggaggggguccugagguugccaggugcauuguuuggagau

SEQ ID NO: 106739 - RNA, 45 nt, Mus musculus
uggggauauuugaguggaaacugaauuggauuguaccucugagau

SEQ ID NO: 106740 - RNA, 46 nt, Mus musculus
ucccugugugugggcaggcagugggagugauuguuguacgggugug

SEQ ID NO: 106741 - RNA, 42 nt, Mus musculus
uuucgcagcaucucccucaucccagugaugugacacaggcuc

SEQ ID NO: 106742 - RNA, 42 nt, Mus musculus
acugaaacaacagggacucauaccuuccaagagaaaacagag

SEQ ID NO: 106743 - RNA, 46 nt, Mus musculus
aguaaagccucagcuuuuucuaaggaugguuuuuaaugaacaugag

SEQ ID NO: 106744 - RNA, 46 nt, Mus musculus
gugaucaucacuuacaaaagggauagcaaauauuuaauaaucagau

SEQ ID NO: 106745 - RNA, 47 nt, Mus musculus
aacaaagugaaaaggaaacaaaaaacauuucacaaacaagcccaggg

SEQ ID NO: 106746 - RNA, 55 nt, Mus musculus
augucauuuccuuaagguaucuaucuggguaucaaaaauucuugaaaaggaggag

SEQ ID NO: 106747 - RNA, 46 nt, Mus musculus
gguacugguuaguucauaauguaguugcaccuacaggguugcagau

SEQ ID NO: 106748 - RNA, 28 nt, Mus musculus
uaaaaaaaauuuuauaaaaaaaaaaauu

SEQ ID NO: 106749 - RNA, 42 nt, Mus musculus
ggaacagcuccagcuccagcuccuggagagggaggagaaggc

SEQ ID NO: 106750 - RNA, 45 nt, Mus musculus
uaacauguguguuuguguguguguaugugugugugugcgugcuug

SEQ ID NO: 106751 - RNA, 46 nt, Mus musculus
cauucauguuucauaauuuuuuccuuuuaaauuuuauuucauuuuu

SEQ ID NO: 106752 - RNA, 46 nt, Mus musculus
gcaacauuuugugauguauuucuaguauguaauuugaugccaaguu

SEQ ID NO: 106753 - RNA, 31 nt, Mus musculus
aaugaggaauuuugcuuuaaacagcccuucc

SEQ ID NO: 106754 - RNA, 45 nt, Mus musculus
gaucuaauuaauguuauuuaaaacacaagcaauguauuuucgaga

SEQ ID NO: 106755 - RNA, 45 nt, Mus musculus
caaccaucuguaaugggaucugaugcccucuucuggugggucuaa

SEQ ID NO: 106756 - RNA, 50 nt, Mus musculus
uauuuuacggaaaaagaagaaggaaguucaggccauccugaaccaugaga

SEQ ID NO: 106757 - RNA, 46 nt, Mus musculus
uuggcagacagcugagaucgcaggugcugcagagcgaggaugagca

SEQ ID NO: 106758 - RNA, 45 nt, Mus musculus
agauauacucccuagcaaauaucauauaggagggcaugacaagaa

SEQ ID NO: 106759 - RNA, 46 nt, Mus musculus
uucuaacagcuauugugaagcuguguccaaauagcagucuggaaau

SEQ ID NO: 106760 - RNA, 46 nt, Mus musculus
uuuucauguuaaaggcaauaugugauguagugugcugaccaaagac

SEQ ID NO: 106761 - RNA, 44 nt, Mus musculus
uuucuuuaaauaugcugcguagggucagucuggggugagcuaaa

SEQ ID NO: 106762 - RNA, 42 nt, Mus musculus
aacaaacaaagaagcaaaaaccucccaaaccaaaccaaagaa

SEQ ID NO: 106763 - RNA, 59 nt, Mus musculus
gagaguuaagucaauuuugaucccaaaaucugugccuuccaaacuuuauaguacaccag

SEQ ID NO: 106764 - RNA, 46 nt, Mus musculus
aagcaagauggcuuuggcaggagggaguauaaaacaguguccuaga

SEQ ID NO: 106765 - RNA, 46 nt, Mus musculus
agacauuuguccccucuugagacagaaugugucaucaucuucagau

SEQ ID NO: 106766 - RNA, 28 nt, Mus musculus
uguuuugauuuuuuuuuuugagagagag

SEQ ID NO: 106767 - RNA, 46 nt, Mus musculus
gucuguggacuugaauuugaucauggagacaaagaugaaggaaaaa

SEQ ID NO: 106768 - RNA, 46 nt, Mus musculus
uuucuccaaacccuauuagguuggaaaaagugaugcuugagcagag

SEQ ID NO: 106769 - RNA, 46 nt, Mus musculus
uuuucauaauaacaaaaucaaauaguccaaagugcaauccuaggaa

SEQ ID NO: 106770 - RNA, 102 nt, Mus musculus
acuauuugauuuuguuauuaugaaaagagucuuuaggcagaggugaguggguagaaggagagaagagagaggaaagaggagacagagagagagagacagaga

SEQ ID NO: 106771 - RNA, 45 nt, Mus musculus
uugcucaaggcccuaaauucaauugcccuacugccaaggaaaaag

SEQ ID NO: 106772 - RNA, 46 nt, Mus musculus
uucucuuuuuccuuggcaguagggcaauugaauuuagggccuugag

SEQ ID NO: 106773 - RNA, 32 nt, Mus musculus
aagaggaggaggagcaagagguggggagggaa

SEQ ID NO: 106774 - RNA, 46 nt, Mus musculus
agugcucugucugcacguacacuuccgugccagaagagggcaucag

SEQ ID NO: 106775 - RNA, 46 nt, Mus musculus
aaagggaucugaugcccucuucuggcacggaaguguacgugcagac

SEQ ID NO: 106776 - RNA, 45 nt, Mus musculus
uguguguguguguguguguguguguguguguaugugccugccuuu

SEQ ID NO: 106777 - RNA, 45 nt, Mus musculus
caauaggugaagugguagugugagauacaguagauaagccauuaa

SEQ ID NO: 106778 - RNA, 44 nt, Mus musculus
cuugaggauguugccaggguugguggauggguaccgugaguagu

SEQ ID NO: 106779 - RNA, 46 nt, Mus musculus
ggcuggagggaaucuucacuggcaauuggagaguuguccaggugau

SEQ ID NO: 106780 - RNA, 48 nt, Mus musculus
ugauauuuagcugucaucugccaagagacuaaaggcauuagcauuacu

SEQ ID NO: 106781 - RNA, 61 nt, Mus musculus
gagacugcuggaaagacuucaggagggacaagagagcaugcuacuggagagacagcuggag

SEQ ID NO: 106782 - RNA, 41 nt, Mus musculus
uuccagcagucucuccagcuuccucaccugcucucccagcc

SEQ ID NO: 106783 - RNA, 46 nt, Mus musculus
aggagaaaucacuggagcugucauggaggcucccaaagagauggcu

SEQ ID NO: 106784 - RNA, 46 nt, Mus musculus
ccuuuguccugggaaggcuugaugccccaguguagguuaaugccag

SEQ ID NO: 106785 - RNA, 41 nt, Mus musculus
agccauugguggcagggggagacuugguauuguggccccug

SEQ ID NO: 106786 - RNA, 42 nt, Mus musculus
gagaaggcuaagaacaaggagguucccaaagugaagcgggac

SEQ ID NO: 106787 - RNA, 42 nt, Mus musculus
gggaaaggaagagcccagagccaggccauccuguagagcaga

SEQ ID NO: 106788 - RNA, 91 nt, Mus musculus
ucaggcagaggcugguggucagucagccagacacauauccccagugggcuucuucaucuccuccaagauaacccacugccucugccgcccc

SEQ ID NO: 106789 - RNA, 46 nt, Mus musculus
cccuccugcaggacucucagacuaggaacaucuuugguaaggucaa

SEQ ID NO: 106790 - RNA, 51 nt, Mus musculus
ugacaccuuucccccccaagaucuuuagggacugacaggaggagggcagac

SEQ ID NO: 106791 - RNA, 49 nt, Mus musculus
ucauugaugauaauggcggaacuguugagcucaggcacaaggaaggcug

SEQ ID NO: 106792 - RNA, 47 nt, Mus musculus
uuuaccuccucuuccuccucuucucugucacuaguuuccuccaugau

SEQ ID NO: 106793 - RNA, 46 nt, Mus musculus
gucaaagagauggagagguugauguugcaacaucuaucauuccaga

SEQ ID NO: 106794 - RNA, 41 nt, Mus musculus
agaagaaaagaagaagaagaagaagaggaagaggaagagga

SEQ ID NO: 106795 - RNA, 46 nt, Mus musculus
agcgguuuuuaaccaaugacacugccuggagcaucugggaugagug

SEQ ID NO: 106796 - RNA, 46 nt, Mus musculus
gaaguagagggguuggaguuaguuaauucucucuuuacagagacuc

SEQ ID NO: 106797 - RNA, 45 nt, Mus musculus
ggcaggguugugucucaucaggcucgggcuccuccaaggacugag

SEQ ID NO: 106798 - RNA, 42 nt, Mus musculus
ggugcuugccuuagauguagcucacuuggugggggguuugau

SEQ ID NO: 106799 - RNA, 46 nt, Mus musculus
cauguucagugguucauugaacuuugacuuucgccugcugccuacg

SEQ ID NO: 106800 - RNA, 46 nt, Mus musculus
acacacacaccagagccaaagacagaaguuucagcaaccaccaaau

SEQ ID NO: 106801 - RNA, 42 nt, Mus musculus
guuaugagcagccaugugggugcuggaaauugaaccuggguc

SEQ ID NO: 106802 - RNA, 46 nt, Mus musculus
acacacacacacacacauuuuggugauugaaccuagggccgcauag

SEQ ID NO: 106803 - RNA, 65 nt, Mus musculus
ggcauuuauaaaucuuuagucaucaauuucagcacagacacaaacauacaacaaauauucacaca

SEQ ID NO: 106804 - RNA, 45 nt, Mus musculus
cuacauucuaagaauggcugcaucccaguuggagauccugggaug

SEQ ID NO: 106805 - RNA, 42 nt, Mus musculus
uuugaugacuaguggauaacugucauuucauuuuauugguga

SEQ ID NO: 106806 - RNA, 46 nt, Mus musculus
caggagagaccucugugggacauacuuguggaagaucuagccugag

SEQ ID NO: 106807 - RNA, 45 nt, Mus musculus
ucucuaagcagcacucucauuuuauaguggaugaaacagaaaaca

SEQ ID NO: 106808 - RNA, 59 nt, Mus musculus
guauaaaaugagauggcagcagcuggucaguuguauaaccgaggggauugagcacagau

SEQ ID NO: 106809 - RNA, 45 nt, Mus musculus
ucaagagaauggcaucuuucagaggcuagagagaaggcuuggggg

SEQ ID NO: 106810 - RNA, 45 nt, Mus musculus
uguuguuugccaaaugcuugagcaaauucugagucucagccagag

SEQ ID NO: 106811 - RNA, 45 nt, Mus musculus
uggggggugggggagaauuuaggaggggaaauucugugugagaga

SEQ ID NO: 106812 - RNA, 42 nt, Mus musculus
cugcaucucuugcucuguccauucccccagucucagccccag

SEQ ID NO: 106813 - RNA, 45 nt, Mus musculus
cauugcauggcgucugcuacagagcuggggcugagacugggggaa

SEQ ID NO: 106814 - RNA, 41 nt, Mus musculus
uucuauuagucuuagguuugaucuuuucauagugucccaga

SEQ ID NO: 106815 - RNA, 46 nt, Mus musculus
aucugggacacuaugaaaagaucaaaccuaagacuaauagaaauag

SEQ ID NO: 106816 - RNA, 46 nt, Mus musculus
uugaccuaaagaagaaaauauuuaucaagguacaagaagcguacag

SEQ ID NO: 106817 - RNA, 46 nt, Mus musculus
gugugugugccuuuccuuaugaagcugaaaauuguccuuucaagau

SEQ ID NO: 106818 - RNA, 48 nt, Mus musculus
uuuuauuuuucaggauuauuuuagauauccaugugugugugugugugu

SEQ ID NO: 106819 - RNA, 57 nt, Mus musculus
aacaacagcaaaaauaaugcaugguggggggaggaggaggacaagagcccaagagag

SEQ ID NO: 106820 - RNA, 77 nt, Mus musculus
uucagauccauuuucucuccauuucucauuaauaaacaagcaggcuucuaagggauaauaauaaaauaagcuaaaac

SEQ ID NO: 106821 - RNA, 41 nt, Mus musculus
cugcuuguuuauuaaugagaaauggagagaaaauggaucug

SEQ ID NO: 106822 - RNA, 46 nt, Mus musculus
ccauuuuuugauuaacuugcccuuugaaugaauucagcuaccgaaa

SEQ ID NO: 106823 - RNA, 46 nt, Mus musculus
ccuuaaacuccgagucuccuaugcugagauuuuaggugugucccgc

SEQ ID NO: 106824 - RNA, 53 nt, Mus musculus
uagcugucgggacugugauaaaagucaaaguuugccaggauaaaaagagcauc

SEQ ID NO: 106825 - RNA, 46 nt, Mus musculus
uucucucccucaaaggucccucccucccucuacuuccggugauuau

SEQ ID NO: 106826 - RNA, 64 nt, Mus musculus
caauccuacauagaaaggggagcaaaauaaucaccggaaguagagggagggagggaccuuugag

SEQ ID NO: 106827 - RNA, 50 nt, Mus musculus
cuggccuucuguacuucucuucugucccuccccauaccugauccugcuuc

SEQ ID NO: 106828 - RNA, 44 nt, Mus musculus
ggaaauugaauagaaauauccauuggacugagcuggggaacccc

SEQ ID NO: 106829 - RNA, 45 nt, Mus musculus
cuaaguuuguccuguucauuagaaguagggacaagaaagauugac

SEQ ID NO: 106830 - RNA, 68 nt, Mus musculus
gcaaaaaacaugugugagauuuugaccugcccccuuuuuggguuuugagacagccuugugugugugug

SEQ ID NO: 106831 - RNA, 65 nt, Mus musculus
ucuuuagucuggagaggauuuucuuuuuaaaaauauacccaaucucuuuucuucuaagccuuggg

SEQ ID NO: 106832 - RNA, 46 nt, Mus musculus
ggagagccacggugcuagaugccuagugcugaaucugaucuggaag

SEQ ID NO: 106833 - RNA, 46 nt, Mus musculus
uccagaauguuugcuucagggaagggucacugcuuugcagggagau

SEQ ID NO: 106834 - RNA, 46 nt, Mus musculus
agucccccagggagauggagggagaggaagggggccaacuaaagca

SEQ ID NO: 106835 - RNA, 59 nt, Mus musculus
agagagaagagagagcauacauugggauggggugugaaagaggaaaauggaacagcaga

SEQ ID NO: 106836 - RNA, 42 nt, Mus musculus
cagacagacagacagacagacagacagacacggggggggggg

SEQ ID NO: 106837 - RNA, 45 nt, Mus musculus
uacccagcuuggaucacagagauucugaaaacagauaaaccacua

SEQ ID NO: 106838 - RNA, 68 nt, Mus musculus
aucauuuccaggcguucucucaaacuuuugaaguccaccaguccacaaugacaaaaaaucuaccucaa

SEQ ID NO: 106839 - RNA, 50 nt, Mus musculus
ugggguguggugguauacaucuuugaucccagcauccagaaaguauaggc

SEQ ID NO: 106840 - RNA, 46 nt, Mus musculus
cacucaggaggccgaggcaggcagaucuuugaaauugaagccagcc

SEQ ID NO: 106841 - RNA, 45 nt, Mus musculus
auaguuaaaugugaauaguuacaaaaaaguugauccaucugaaga

SEQ ID NO: 106842 - RNA, 76 nt, Mus musculus
ucaggcuggguagucuuaaugacagaggcacuggggauacacgcauuauguacagauuguuauuuguagggauaga

SEQ ID NO: 106843 - RNA, 45 nt, Mus musculus
cacaccggggagaggcgcuuuguguguccuuuugauggcugcgag

SEQ ID NO: 106844 - RNA, 31 nt, Mus musculus
ccacgggccccggcggcacgugugugcagag

SEQ ID NO: 106845 - RNA, 48 nt, Mus musculus
uggugucuuaucgaugcuggaguguccucaagccgggugcaagaagaa

SEQ ID NO: 106846 - RNA, 53 nt, Mus musculus
gagucuucuuuggaguacaugacaaaggggacgaagcaagagaagagagaggu

SEQ ID NO: 106847 - RNA, 67 nt, Mus musculus
uuuccuuuuuaaauccuucgaaagcuuggaggaaguggagcaaaaccuuucucgccagguucuggaa

SEQ ID NO: 106848 - RNA, 48 nt, Mus musculus
ugacccuaaagcaagacgaggcaaggccaguccagaauaccagagugg

SEQ ID NO: 106849 - RNA, 60 nt, Mus musculus
gaaugaacaaaaaaugaaugaacaaaugaagaaaacggcaaagacaaguggccagaaagg

SEQ ID NO: 106850 - RNA, 46 nt, Mus musculus
gcugaguggcaggcaaguuccuagugagccaucccccugccuagag

SEQ ID NO: 106851 - RNA, 42 nt, Mus musculus
ugugguaauccauugauuuacaggucuacauaacguuaauau

SEQ ID NO: 106852 - RNA, 45 nt, Mus musculus
ugguaagauggccauuucacuguuaauccuacggauccaugagca

SEQ ID NO: 106853 - RNA, 46 nt, Mus musculus
uuuucccccauauggaauuacguauugucuuuugaaaggcuguaaa

SEQ ID NO: 106854 - RNA, 44 nt, Mus musculus
guuuuuauuacuacuauugcuuaguauguuuuuacagcuugaga

SEQ ID NO: 106855 - RNA, 42 nt, Mus musculus
ugcuccaccaccgcccggcucauuaucuauuucuguccuuau

SEQ ID NO: 106856 - RNA, 46 nt, Mus musculus
ccaguuagaccauuuguugacaaugcugucuuuucuugcccauuau

SEQ ID NO: 106857 - RNA, 46 nt, Mus musculus
uuucuugaguucaguauauauuuuggauauuagcccucugucagau

SEQ ID NO: 106858 - RNA, 46 nt, Mus musculus
cucuuucccuuuacuagagagguccacgcacccuccacccccuuuu

SEQ ID NO: 106859 - RNA, 45 nt, Mus musculus
ggaguucccaguguacuguuuguuuccacauuguucccaaaaaga

SEQ ID NO: 106860 - RNA, 35 nt, Mus musculus
cugccuaagguugggcuucgugugacucugcaucu

SEQ ID NO: 106861 - RNA, 46 nt, Mus musculus
gaggugcaaacccucacacaucaaggcuguaagaggcaagccagua

SEQ ID NO: 106862 - RNA, 46 nt, Mus musculus
uuuauuuccuuuuuauucuuuucucauacaauguaucccaucugcu

SEQ ID NO: 106863 - RNA, 46 nt, Mus musculus
aaccucuggugcccugccuccucauuuccaguuacaagccucuacu

SEQ ID NO: 106864 - RNA, 47 nt, Mus musculus
uaauacuccauuuaaaauagcaaauucauacuuucugccagucccuu

SEQ ID NO: 106865 - RNA, 60 nt, Mus musculus
aagcaggaucgccucacugugcugccuccaaguguuguccccaaauaccacugaccaaaa

SEQ ID NO: 106866 - RNA, 49 nt, Mus musculus
aaucagaagauggccuagcaggcuaucaguggaaagagaggcccauugg

SEQ ID NO: 106867 - RNA, 48 nt, Mus musculus
aagggaucugcaacccuauauagguggaacaauaauaugaacuaacca

SEQ ID NO: 106868 - RNA, 46 nt, Mus musculus
gaguucuuuuguggguggguuaccucauucaggaugaugcccucca

SEQ ID NO: 106869 - RNA, 46 nt, Mus musculus
gugucuguaacuccuuccauggguguuuuguucccaauuuuaagaa

SEQ ID NO: 106870 - RNA, 65 nt, Mus musculus
augauaaaagagcuacuguuccugccucaguaaaagaagcaggauccaguuuagagugaguuaag

SEQ ID NO: 106871 - RNA, 76 nt, Mus musculus
uucagaaagagauggguuuagacagagaugggagccugucaaucauaucuugcucuguacaaaaaaauuaauaaug

SEQ ID NO: 106872 - RNA, 46 nt, Mus musculus
auugggauuccguagguuucauuuuuuuauuuuuuggaccccagag

SEQ ID NO: 106873 - RNA, 46 nt, Mus musculus
uuuaauuucuguucccacaguuaagacaugagaacaaugaagagau

SEQ ID NO: 106874 - RNA, 47 nt, Mus musculus
gaaaugugcuuuguuuucucuuugauauauuuaucuuuuugccagau

SEQ ID NO: 106875 - RNA, 65 nt, Mus musculus
uauggccuugauaaaucaggucaguuuaaagaauagguaggugugugugugugugugugugugug

SEQ ID NO: 106876 - RNA, 46 nt, Mus musculus
caugcgccauaacuguccugguaaacuuuuuugaaucauaggagaa

SEQ ID NO: 106877 - RNA, 45 nt, Mus musculus
ccuggaacuaacuuugcagaccaagcuggccuagaacucacagau

SEQ ID NO: 106878 - RNA, 47 nt, Mus musculus
cagauaguuuugagccaccgugugguugcugcgaauugaacuaagga

SEQ ID NO: 106879 - RNA, 46 nt, Mus musculus
gaagaugcauuuauuuaauuuauaugaguauacuguacagucagac

SEQ ID NO: 106880 - RNA, 45 nt, Mus musculus
acugucggugguguauuagugauagagaagaacaugcaaggacua

SEQ ID NO: 106881 - RNA, 50 nt, Mus musculus
uaaguauggagggaaacucugaggaagugauguccaagcacagaucugaa

SEQ ID NO: 106882 - RNA, 46 nt, Mus musculus
uucuucucucaauagagugagugugcagugcagccagcagguaaga

SEQ ID NO: 106883 - RNA, 55 nt, Mus musculus
uaacuaaugcauauucaugaccucauuucacuagagaaauggacuaagagcuggg

SEQ ID NO: 106884 - RNA, 42 nt, Mus musculus
uuaggaaauaccauucuaccuacauagcauuugcaagcaacu

SEQ ID NO: 106885 - RNA, 46 nt, Mus musculus
uugaccuuuuauuugcuauucucaugagguuguauauuggguagaa

SEQ ID NO: 106886 - RNA, 46 nt, Mus musculus
guaguuccagaauuuggaggaguucaagccaguuuugaccacauag

SEQ ID NO: 106887 - RNA, 44 nt, Mus musculus
gcugggaggugguggcgcucgccagcacuugggaggcagaggca

SEQ ID NO: 106888 - RNA, 47 nt, Mus musculus
ccuguuugagaaaugaaacauuaguuuuaucccaagccauuagauuu

SEQ ID NO: 106889 - RNA, 46 nt, Mus musculus
ccccacaugauaaaagcuugacucugugugugauaacuggguuuuu

SEQ ID NO: 106890 - RNA, 25 nt, Mus musculus
ugcuaaagccggggauuugggggau

SEQ ID NO: 106891 - RNA, 46 nt, Mus musculus
cuguggugacuauggcuuccuccuguaguaaauaugacggccuucu

SEQ ID NO: 106892 - RNA, 85 nt, Mus musculus
gguuuccuuugguguugaacugcaacgcaaauggcuuuccguagaauucccaggcuccuuugcacuuggacccuggccgccauac

SEQ ID NO: 106893 - RNA, 48 nt, Mus musculus
caaauugccugaggaguucccuguucacuguuguccuuuaguaguaga

SEQ ID NO: 106894 - RNA, 45 nt, Mus musculus
uuuuccaguuuccucacuccauuuuccaaucaagcauccagccgg

SEQ ID NO: 106895 - RNA, 46 nt, Mus musculus
cacuuaccucuauaaaauucaauagauuauucuagaaaaagaaaau

SEQ ID NO: 106896 - RNA, 46 nt, Mus musculus
uguuccaaguguucgugugcuuuuaucuuaucucaauucccuagau

SEQ ID NO: 106897 - RNA, 61 nt, Mus musculus
uccauuggccaucacguuuucaaacauauuaaggagcacaguagaugcacauugaggaaag

SEQ ID NO: 106898 - RNA, 57 nt, Mus musculus
gcugugggcauuagguaaguccuguuucaugaaauggcugggauuugucuuuuuucu

SEQ ID NO: 106899 - RNA, 43 nt, Mus musculus
uguggccggaacagaguucguccaucuaaaaagggaggggucc

SEQ ID NO: 106900 - RNA, 49 nt, Mus musculus
gagagagagagagggagagagagaagagaguuuggauauggggggaguu

SEQ ID NO: 106901 - RNA, 44 nt, Mus musculus
caguccugcauaggucugugacagaaggguucccagggccaaga

SEQ ID NO: 106902 - RNA, 46 nt, Mus musculus
ugugagccaccaugugguugcugggaauugaacucacggccucuga

SEQ ID NO: 106903 - RNA, 44 nt, Mus musculus
aauauccccauguauaggaauaagguaagcacuccaguuuaaga

SEQ ID NO: 106904 - RNA, 46 nt, Mus musculus
agcaaggucaagugucuccccauuuuuuaacuccuggccaccugua

SEQ ID NO: 106905 - RNA, 45 nt, Mus musculus
uuuguauccagcacuuguacccgaaccuucgcucgggccucagca

SEQ ID NO: 106906 - RNA, 42 nt, Mus musculus
ucccugggaaagaccucacuguuuuaaacugcugaaggaggu

SEQ ID NO: 106907 - RNA, 46 nt, Mus musculus
auauccuccacgucccccugacuguguaacuuauucgccugcagga

SEQ ID NO: 106908 - RNA, 45 nt, Mus musculus
uauauuggcacccaccgggagguucuccuuuaccucaauuccagu

SEQ ID NO: 106909 - RNA, 42 nt, Mus musculus
cugugagaauagcguaggucacaugcccgcuggggcccagau

SEQ ID NO: 106910 - RNA, 45 nt, Mus musculus
cuacacccuucuccacaaagcuggagaacaccggaguguguaggu

SEQ ID NO: 106911 - RNA, 46 nt, Mus musculus
cagaaaccaacugggaauucugaugcaaagaagaggagagagggga

SEQ ID NO: 106912 - RNA, 41 nt, Mus musculus
ggcuuaucuaggggguggcaagccuuuaaucccagcacuug

SEQ ID NO: 106913 - RNA, 42 nt, Mus musculus
acgcagagagaguagaggccggccaugagcacauggagaggc

SEQ ID NO: 106914 - RNA, 45 nt, Mus musculus
uguugucuuuuuauaaaagauaagaagagaaggaauauguuugcu

SEQ ID NO: 106915 - RNA, 46 nt, Mus musculus
aauagguuccuagcaagacaauuccuacauucaccagccccaagaa

SEQ ID NO: 106916 - RNA, 42 nt, Mus musculus
acuguacacacucacugcuaaugagcaguccuuggggcacag

SEQ ID NO: 106917 - RNA, 45 nt, Mus musculus
ugaagaauaaaauaauuccagcacuacccagaccggccucaagcu

SEQ ID NO: 106918 - RNA, 55 nt, Mus musculus
uagaccucuaugaaggacgacagaggcaccacgcccugaucuguggcauagaccg

SEQ ID NO: 106919 - RNA, 48 nt, Mus musculus
gucauuggagcuagaauccgggucaaaagccucaaucuggaccacaga

SEQ ID NO: 106920 - RNA, 46 nt, Mus musculus
uuagcauggcuacaaaauauaauucuucauauauuucuuuccagag

SEQ ID NO: 106921 - RNA, 46 nt, Mus musculus
gagcacuugagaucuguagcaggugaaauuuacaaacaguaaagcu

SEQ ID NO: 106922 - RNA, 23 nt, Mus musculus
uauacaugggacuuggcaggaca

SEQ ID NO: 106923 - RNA, 58 nt, Mus musculus
uucuagaaugugcucguccugcuguucucgguccagcuuccucgacgugguugugaug

SEQ ID NO: 106924 - RNA, 42 nt, Mus musculus
gguacuaagggguacuuggggcugaguuccuuuccucugagg

SEQ ID NO: 106925 - RNA, 42 nt, Mus musculus
gaggccuguugucguucucaucgaggauuuucacgaugacuc

SEQ ID NO: 106926 - RNA, 42 nt, Mus musculus
ugguggacgacuucugggggcgcccguugucaacugccuuaa

SEQ ID NO: 106927 - RNA, 42 nt, Mus musculus
gaugucaaaccacagaggcaugccagggggcucaacugagau

SEQ ID NO: 106928 - RNA, 42 nt, Mus musculus
acaaaacacacacacacacacacacacacacacacaucauca

SEQ ID NO: 106929 - RNA, 45 nt, Mus musculus
ccagguccucaucaaaguaauagauaccaaugaccaccgccccca

SEQ ID NO: 106930 - RNA, 54 nt, Mus musculus
guuccugaggacacagagccagaaguggagauucugcagaucagugcaguagau

SEQ ID NO: 106931 - RNA, 45 nt, Mus musculus
cgccuguugcgggaucgaggcggaauuucuugaggcuggcuggau

SEQ ID NO: 106932 - RNA, 46 nt, Mus musculus
gcucaguugugcugcaagugacagcucuggacaaagacaaagggag

SEQ ID NO: 106933 - RNA, 45 nt, Mus musculus
agcaaauaagauuucccuguggaaaaauaagauaaacacguguag

SEQ ID NO: 106934 - RNA, 46 nt, Mus musculus
aagugaaaagcauguguuucuucauaguccagacucagcacuguac

SEQ ID NO: 106935 - RNA, 88 nt, Mus musculus
gcguucaccgugaugacguucacgccucuguaugucggcaggagaagagacacuucguacagugacuuagagaagacaggggggcagu

SEQ ID NO: 106936 - RNA, 99 nt, Mus musculus
gaggggacucucucugcucuccuuuacguugauuuucacggaggccaugcuugugaaccugccgucggaggcgcggacggucagcucauagcggcuucg

SEQ ID NO: 106937 - RNA, 46 nt, Mus musculus
gaugacagcuaacguucuggcuuccguggaguucucuuucacaacu

SEQ ID NO: 106938 - RNA, 44 nt, Mus musculus
aaacguugaggcuguagaacggcuucaggguguggcggcggagg

SEQ ID NO: 106939 - RNA, 42 nt, Mus musculus
gaaagcaaccuuccccccagcauccuuagccaucaagcggau

SEQ ID NO: 106940 - RNA, 45 nt, Mus musculus
cucaggaguauugccuuugacaaggauguaaagaacagccccgcc

SEQ ID NO: 106941 - RNA, 26 nt, Mus musculus
aagccaccaccucguagucaucaaga

SEQ ID NO: 106942 - RNA, 45 nt, Mus musculus
caccugaaccaaauaaaguguaaguaaucucugcguuggaccgga

SEQ ID NO: 106943 - RNA, 25 nt, Mus musculus
guguucucgaauaccgugauggugu

SEQ ID NO: 106944 - RNA, 42 nt, Mus musculus
cacuuaugauggcguaggugauuuccgcguuggccucgauau

SEQ ID NO: 106945 - RNA, 42 nt, Mus musculus
ucaucauuuccacucacaauagugaagaagaaggggggaccg

SEQ ID NO: 106946 - RNA, 46 nt, Mus musculus
aguauuccucuccaaaggcggugaugaaaaucuccagcggcaagau

SEQ ID NO: 106947 - RNA, 46 nt, Mus musculus
gugcaaucagcuugccccccgugcuggagacagagaacaggccauc

SEQ ID NO: 106948 - RNA, 55 nt, Mus musculus
auccacagacaccuucucaucacagaacuuccacgggcaauccagccccgcacag

SEQ ID NO: 106949 - RNA, 42 nt, Mus musculus
ucccagcuauaaacacaauaauaccuauucccucggccaguc

SEQ ID NO: 106950 - RNA, 107 nt, Mus musculus
ugggaucgcggagccuucgaaggaauugcggucaagguuguuucucgagucgcuuggaaugcugggaguguaggaaaugggacggaccggcaccuggggcgggaugu

SEQ ID NO: 106951 - RNA, 44 nt, Mus musculus
cccagcuaggcuucuguauggagucgcugucugagggcgaguug

SEQ ID NO: 106952 - RNA, 47 nt, Mus musculus
ggagggcuuuuccuccaggggcuucuuagagagacagggauccagau

SEQ ID NO: 106953 - RNA, 23 nt, Mus musculus
cagccccgagucuucaacaguga

SEQ ID NO: 106954 - RNA, 45 nt, Mus musculus
cucucucccagugaccacauuacacacagaccucuggccccaagu

SEQ ID NO: 106955 - RNA, 46 nt, Mus musculus
uaauuggggaacucuuguaugucuggcagagggacacuuggcaucc

SEQ ID NO: 106956 - RNA, 46 nt, Mus musculus
ccccaggguaauagucaguaucgauggcguuuggaucagccgagua

SEQ ID NO: 106957 - RNA, 42 nt, Mus musculus
acucgaacuggucgcugaacucuggaggcaaugguggcaguu

SEQ ID NO: 106958 - RNA, 42 nt, Mus musculus
uuuuaccugguucauugcccccgcuuuccuuuacccccucag

SEQ ID NO: 106959 - RNA, 46 nt, Mus musculus
caggccuagugacaucugcaguguagguggccuguggguuggagug

SEQ ID NO: 106960 - RNA, 47 nt, Mus musculus
ggccaggaacacauggagagagggggcaaggccaucuggagagaggg

SEQ ID NO: 106961 - RNA, 45 nt, Mus musculus
cacagacacacagagagagacagagagaggaagaagaggaggagg

SEQ ID NO: 106962 - RNA, 45 nt, Mus musculus
gguguuugugagccaccaugugguuucugggaauugaacucagga

SEQ ID NO: 106963 - RNA, 46 nt, Mus musculus
uucugguaucagacuccuuuagaugcuauaguuuauugaaauguua

SEQ ID NO: 106964 - RNA, 51 nt, Mus musculus
gccgucugugguguuagagccacagaugauggaagguaaggagugagagac

SEQ ID NO: 106965 - RNA, 53 nt, Mus musculus
gucucagaacccaaaagauagagaggcuaaaaaucgugauugugguugaaaaa

SEQ ID NO: 106966 - RNA, 46 nt, Mus musculus
acuuucgcccuguucaucuagaaauguuuaucaagaacgcacugag

SEQ ID NO: 106967 - RNA, 42 nt, Mus musculus
cuccgacaucaauuggcaaugaagaaaguacccucaagccag

SEQ ID NO: 106968 - RNA, 41 nt, Mus musculus
uaaguuucaguagagaagcuuuagagagaccuguccagcau

SEQ ID NO: 106969 - RNA, 45 nt, Mus musculus
aucucuucaaucugccucaugacagaccuuauuucaaaaggauca

SEQ ID NO: 106970 - RNA, 46 nt, Mus musculus
uuauaaaaccuaccauugugugugugugugugugugugugugugug

SEQ ID NO: 106971 - RNA, 41 nt, Mus musculus
cauuucagagaaagcuauaaacuucauauuauuugccccua

SEQ ID NO: 106972 - RNA, 46 nt, Mus musculus
auuugugugguccagggcaccuaugcuuaucaucauuauaugcaag

SEQ ID NO: 106973 - RNA, 46 nt, Mus musculus
uugcucucacaauaggaauuguaugaaucaguaagaauaauggcag

SEQ ID NO: 106974 - RNA, 42 nt, Mus musculus
acacaauacuaggagucgcauggaaugaaaccacggggcaga

SEQ ID NO: 106975 - RNA, 46 nt, Mus musculus
accugacagcaguuguucuaagucuguugaguaauccuggcccuau

SEQ ID NO: 106976 - RNA, 46 nt, Mus musculus
ccuuccucaacgaccuaaugcucuuuaaauuaucuuggaggcaaga

SEQ ID NO: 106977 - RNA, 58 nt, Mus musculus
ugacccccgugcuccugugcugagacagaagcggaguuucaggacuguggagagugga

SEQ ID NO: 106978 - RNA, 49 nt, Mus musculus
ggcuuuccagaaugugccagguuucuaacaaugauuaaauguaugcaga

SEQ ID NO: 106979 - RNA, 79 nt, Mus musculus
ggagaaacuccacuccacaaggcagcaaagguuggaagccuggacugccugagccuccuuguggccagugauguccaga

SEQ ID NO: 106980 - RNA, 46 nt, Mus musculus
cucuugcugugcuaauacaaaguuuccauuaauaaaaacaugccau

SEQ ID NO: 106981 - RNA, 46 nt, Mus musculus
aauuaagggaaugccagcacacuauagaguucuauagaagccaaag

SEQ ID NO: 106982 - RNA, 78 nt, Mus musculus
uauauauauuugaaaugugguucgacuucacugagcuaugccauaaaaguaaaauacacacugaauugggaaccgugg

SEQ ID NO: 106983 - RNA, 46 nt, Mus musculus
uguguauuuuacuuuuauggcauagcucagugaagucgaaccacau

SEQ ID NO: 106984 - RNA, 46 nt, Mus musculus
gaaacggacaucuaggaaauguccgugcagacacuggguggaggag

SEQ ID NO: 106985 - RNA, 59 nt, Mus musculus
agcugcagguggcggccuugcgugcuuucuucucuggcagcugcaaacaggugcugacc

SEQ ID NO: 106986 - RNA, 47 nt, Mus musculus
ugcuggagacaggagcaucagugaacgcaccuccggauccccaggag

SEQ ID NO: 106987 - RNA, 91 nt, Mus musculus
gugacagugacaaacugcuggguuaccaagucaaaccuugucagaucuuguuuucuuuuuuuuuccguggagggguggauuuucagcucag

SEQ ID NO: 106988 - RNA, 50 nt, Mus musculus
uugucaucugcuuuaggugggcgaugcuguugcuuaguugcaacuuggag

SEQ ID NO: 106989 - RNA, 45 nt, Mus musculus
aggccgugggaacgcucccaggcuggggagcggcggggaggagcc

SEQ ID NO: 106990 - RNA, 42 nt, Mus musculus
ccgcgcagcaggcuccgcccccuccucuuuugcuugggguuc

SEQ ID NO: 106991 - RNA, 46 nt, Mus musculus
ccuugcucacaaaggcaacacugacugauagguaauucacuggguu

SEQ ID NO: 106992 - RNA, 42 nt, Mus musculus
agucugagaagcagaccaaaagaaacaauaauuuagggugag

SEQ ID NO: 106993 - RNA, 42 nt, Mus musculus
gguuuucaaauagcugugugugugugugugugugugugugug

SEQ ID NO: 106994 - RNA, 45 nt, Mus musculus; identical to SEQ ID NO: 81117

SEQ ID NO: 106995 - RNA, 55 nt, Mus musculus; identical to SEQ ID NO: 81118

SEQ ID NO: 106996 - RNA, 46 nt, Mus musculus
gaccccgucaccagaguccaugacaaugccaguggugcgcccaguu

SEQ ID NO: 106997 - RNA, 47 nt, Mus musculus
gggaucuucaugagguagucugucagguccgggccagccagguccag

SEQ ID NO: 106998 - RNA, 44 nt, Mus musculus
guugaagguggucucauggauaccacaggacuccaugcccagga

SEQ ID NO: 106999 - RNA, 42 nt, Mus musculus
gaaacuggguccuaaggcucggacuuucccaccguguuagac

SEQ ID NO: 107000 - RNA, 25 nt, Mus musculus
cagagaggcuaugccaaggugucag

SEQ ID NO: 107001 - RNA, 41 nt, Mus musculus
uggcugugcguguguuuucucucgagggcauguugacgggg

SEQ ID NO: 107002 - RNA, 46 nt, Mus musculus
ccugaugcuuugacacgauguuuugcagacggaaaaaugccggggu

SEQ ID NO: 107003 - RNA, 41 nt, Mus musculus
ggggcugcugaggcugcaaagaggaggagguagagagggag

SEQ ID NO: 107004 - RNA, 46 nt, Mus musculus
gggaaccggguucuucucggugcccagcggcccuucuuucccggcg

SEQ ID NO: 107005 - RNA, 45 nt, Mus musculus
uuuuccuaucagauaagagcaguuaauuuagacaaauggccacag

SEQ ID NO: 107006 - RNA, 23 nt, Mus musculus
aaaaaucuuggaaugggauggau

SEQ ID NO: 107007 - RNA, 46 nt, Mus musculus
cauuuccgggacuuccugagacccgggaguuguuuaauauccccag

SEQ ID NO: 107008 - RNA, 42 nt, Mus musculus
gagagacagugucaggcaauugugguuggaagaacagaagag

SEQ ID NO: 107009 - RNA, 42 nt, Mus musculus
guuggggauaaaaccccagagguucuguauaugcauggcaag

SEQ ID NO: 107010 - RNA, 46 nt, Mus musculus
ccaguuaugcauucuggagggcagugaagugcuuuucacagggcag

SEQ ID NO: 107011 - RNA, 42 nt, Mus musculus
uuuaaacuugaccagaacucuuuggggugcagccucccugag

SEQ ID NO: 107012 - RNA, 45 nt, Mus musculus
acauuuacguuuacuuguuuguuugccuggugugugugugugugu

SEQ ID NO: 107013 - RNA, 42 nt, Mus musculus
cacuauuaggagguguggauuuguuggaguauguguggccuu

SEQ ID NO: 107014 - RNA, 42 nt, Mus musculus
aaaacccuaacuaacgcccugugcuauggugugaguguggag

SEQ ID NO: 107015 - RNA, 45 nt, Mus musculus
gacaucaguggguuuucagcagacggacagaaucuuaacuggugu

SEQ ID NO: 107016 - RNA, 41 nt, Mus musculus
caucuuucccaggcaaugaagcucagaggcucauggaccag

SEQ ID NO: 107017 - RNA, 46 nt, Mus musculus
cuaucuuauuccaugauaaggaaagacaaugcugggcccuauggag

SEQ ID NO: 107018 - RNA, 45 nt, Mus musculus
uucuugugcuucucccagcaacuggcaggagguagagaugggcag

SEQ ID NO: 107019 - RNA, 42 nt, Mus musculus
uaucuguugaggguaacuggggacccagacagcaugugccug

SEQ ID NO: 107020 - RNA, 42 nt, Mus musculus
uucucuuuuuuuuuucuuuucuuuucuuuuuuuuuuuuuucu

SEQ ID NO: 107021 - RNA, 46 nt, Mus musculus
cuucaucugaaaacuauaggagagacuccaucuuguuugauuccag

SEQ ID NO: 107022 - RNA, 42 nt, Mus musculus
ucaugucauggugcuuguuuucuuggcaccagugggggacag

SEQ ID NO: 107023 - RNA, 47 nt, Mus musculus
ggggccgaguuugggugggaagaaaagagccgacuguauagucuggu

SEQ ID NO: 107024 - RNA, 42 nt, Mus musculus
ggaaaugcuggaugcagugacuaagagauuguacuaggggag

SEQ ID NO: 107025 - RNA, 46 nt, Mus musculus
aaaaaagaaaggaaggaagucaggcagguaggcaaguaggcaggca

SEQ ID NO: 107026 - RNA, 45 nt, Mus musculus
aggagaagaagauuuuccagauccccuggaugcaugcggcucggc

SEQ ID NO: 107027 - RNA, 78 nt, Mus musculus
gauccaaaaacauggaaagcaaauuuucgaugugccaugaauucccugcccgacauugaggaagugaaggacagaagc

SEQ ID NO: 107028 - RNA, 47 nt, Mus musculus
ucagagucuaccggaugcugcccuuauccgaacgaccuuccaagaaa

SEQ ID NO: 107029 - RNA, 46 nt, Mus musculus
ggagcuggaguuaaggacaguugugagccuccagguagaugcugag

SEQ ID NO: 107030 - RNA, 45 nt, Mus musculus
uuucuuugagacacagugucacuguguagccuaggcuagccccag

SEQ ID NO: 107031 - RNA, 23 nt, Mus musculus
cauucacuguauguuccuugcug

SEQ ID NO: 107032 - RNA, 45 nt, Mus musculus
gacccaucauguucugggcuucaguuacauuuuguaaggccaucu

SEQ ID NO: 107033 - RNA, 46 nt, Mus musculus
acuugaaaacacaucagagcugcuuuggauaaagccagcuaggaag

SEQ ID NO: 107034 - RNA, 46 nt, Mus musculus
aaauuuaaaccacaucggugggugccucagagaggcuuucucggug

SEQ ID NO: 107035 - RNA, 46 nt, Mus musculus
gcuuuugauauccccauuucuaacuguuucaaaagucuuggcugag

SEQ ID NO: 107036 - RNA, 46 nt, Mus musculus
ggugaggugcgcaugugcagggucugcaggugauucaggcugucaa

SEQ ID NO: 107037 - RNA, 43 nt, Mus musculus
uccugacuucagcuauaaaaaaugaaguggauaguacggugaa

SEQ ID NO: 107038 - RNA, 61 nt, Mus musculus
gcccagagaacccaugaauaaaguggcccugguggcagagauggagguuauacacgggcuu

SEQ ID NO: 107039 - RNA, 41 nt, Mus musculus
gguccaucguuauuuaaaccaccacacaguguauaugugag

SEQ ID NO: 107040 - RNA, 46 nt, Mus musculus
ccuuagagaugauaauuguauagacuaucuaguucuuagccccaga

SEQ ID NO: 107041 - RNA, 41 nt, Mus musculus
acagaaaaguggacuagauugaugacugccagggacgagag

SEQ ID NO: 107042 - RNA, 64 nt, Mus musculus
uaggacagucccaucuggacagcaacauugaagaucaagagaucgucacuaacccgccagacau

SEQ ID NO: 107043 - RNA, 46 nt, Mus musculus
gguaaggggaguggggugugugugugugugugugugugugugugug

SEQ ID NO: 107044 - RNA, 44 nt, Mus musculus
aagaguuggccugaaguggcagauuucuggaauuguugcucugg

SEQ ID NO: 107045 - RNA, 27 nt, Mus musculus
aaggggaagaaagacaggaaggagcug

SEQ ID NO: 107046 - RNA, 42 nt, Mus musculus
auggacugggcucaugggauccuagaacccugccgaccacag

SEQ ID NO: 107047 - RNA, 45 nt, Mus musculus
aaggggaaaggcacaggagacuuuaggauuuacagagaggcauua

SEQ ID NO: 107048 - RNA, 42 nt, Mus musculus
acagaaagcgaaacuaccgacaguguggccagugaugaagag

SEQ ID NO: 107049 - RNA, 45 nt, Mus musculus
aucugcugcccagcauggcgaccuuugucaccuccaacaagccag

SEQ ID NO: 107050 - RNA, 45 nt, Mus musculus
uaaaggcauuuuauauugaaaauccuuuaaauaauaaucuuuuga

SEQ ID NO: 107051 - RNA, 46 nt, Mus musculus
ggccuucuggcuuucuaggaacugcacacuggacaauaauggagau

SEQ ID NO: 107052 - RNA, 42 nt, Mus musculus
agcacugaaguuauuucucaagaagaaggugguggugaagau

SEQ ID NO: 107053 - RNA, 42 nt, Mus musculus
gcacuucacaguugccuucgaaaaguaccucccaggccagug

SEQ ID NO: 107054 - RNA, 45 nt, Mus musculus
gguugccaaggugaagaaaagagggauaucaaguagcaaugguua

SEQ ID NO: 107055 - RNA, 46 nt, Mus musculus
caggaaaugcagucugcgcacuccugcauuccucacgcugccagua

SEQ ID NO: 107056 - RNA, 41 nt, Mus musculus
ccccugauucuucuccaugugacuuuuuaugaucugccugg

SEQ ID NO: 107057 - RNA, 41 nt, Mus musculus
uuguucguggugguggugguggugaugguaguauuggugau

SEQ ID NO: 107058 - RNA, 45 nt, Mus musculus
aggaggccauguguggugucauacacauuuaauaucaguguucag

SEQ ID NO: 107059 - RNA, 42 nt, Mus musculus
cacaguggagaauuccagaaauggggaaguugagacuggcag

SEQ ID NO: 107060 - RNA, 39 nt, Mus musculus
agcaguccaggccacagccagaggccagcaagcccagca

SEQ ID NO: 107061 - RNA, 42 nt, Mus musculus
cccuguuccugggcugguuugcuggcuucugccuggugcuag

SEQ ID NO: 107062 - RNA, 50 nt, Mus musculus
ucaugguucauaccuagaaaauggaacuguacagccuaaaguguaagcca

SEQ ID NO: 107063 - RNA, 39 nt, Mus musculus; identical to SEQ ID NO: 107060

SEQ ID NO: 107064 - RNA, 45 nt, Mus musculus
gucugaggcggauaacagccacaggagggaaguaugcauuucaga

SEQ ID NO: 107065 - RNA, 46 nt, Mus musculus
auaaauacuuuuucagguaauuuaaaccacacucacguacucuguc

SEQ ID NO: 107066 - RNA, 41 nt, Mus musculus
cugcggucgggggcagaaagaaaacuguggggaggggaggc

SEQ ID NO: 107067 - RNA, 45 nt, Mus musculus
aucaaaccauaaagcaggguuaaagugggacguuaucauggagau

SEQ ID NO: 107068 - RNA, 45 nt, Mus musculus
aguguaagcugaauaaacccuuugcuucucaacugacuuuuuggu

SEQ ID NO: 107069 - RNA, 43 nt, Mus musculus
gagaggaugugccuaauguuguaaagacuugaugccccaggga

SEQ ID NO: 107070 - RNA, 46 nt, Mus musculus
gucacagaagaaaggacagggcagaaaggaagaauauucagcaggu

SEQ ID NO: 107071 - RNA, 46 nt, Mus musculus
uuaggucagcuucuguggugugugugugugugugugugugugugug

SEQ ID NO: 107072 - RNA, 45 nt, Mus musculus
augagacuaaagggaaucacgagucugccugagucugagcuggug

SEQ ID NO: 107073 - RNA, 46 nt, Mus musculus
cggcggggacuuuuuucacgcugcucggcgggucacucagcuaugg

SEQ ID NO: 107074 - RNA, 46 nt, Mus musculus
gagguucugcccuggaugcaguggagaacggcugugcuguguguga

SEQ ID NO: 107075 - RNA, 46 nt, Mus musculus
cagugggaggccuuagaagaauuaaaaacgcgauuggcguggcgcg

SEQ ID NO: 107076 - RNA, 46 nt, Mus musculus
aguaugggguuuacuaaugaggacuugucuaccaaaaccucaagag

SEQ ID NO: 107077 - RNA, 46 nt, Mus musculus
acugcugcuggcacauccacaaaugguauaaaauucaaaauaccug

SEQ ID NO: 107078 - RNA, 46 nt, Mus musculus
uuuuaagaauucagaaauacuauccaaacuucuuuggagcggucau

SEQ ID NO: 107079 - RNA, 45 nt, Mus musculus
uuaacagauaagccacagaaggcucaaauuuacauuuagcagggu

SEQ ID NO: 107080 - RNA, 40 nt, Mus musculus
uuuuccuaaggaagggauugaaagagcaaaauaauagcag

SEQ ID NO: 107081 - RNA, 46 nt, Mus musculus
uguauaaagcucacuuuuguagguguaaaauguagcagaagcucag

SEQ ID NO: 107082 - RNA, 42 nt, Mus musculus
gggaggcuuuuucugucuguuuacaaagcuaagcuuaagcag

SEQ ID NO: 107083 - RNA, 46 nt, Mus musculus
aagaaaaaaaaaaucaaugaagaaaccgggaagagaugagaugcaa

SEQ ID NO: 107084 - RNA, 46 nt, Mus musculus
auaaauacacuguagcugucuucaagcacaccaggagagggcauca

SEQ ID NO: 107085 - RNA, 46 nt, Mus musculus
caaugaguucaaaagaaugaggacuuagucuuucggagaaaaacag

SEQ ID NO: 107086 - RNA, 41 nt, Mus musculus
gcucugcuucccgcggccgaccaguccccgcccacccgcgc

SEQ ID NO: 107087 - RNA, 44 nt, Mus musculus
cagaagagaagccccaggagcaagcaucccaggaaguccgcgga

SEQ ID NO: 107088 - RNA, 45 nt, Mus musculus; identical to SEQ ID NO: 29896

SEQ ID NO: 107089 - RNA, 42 nt, Mus musculus; identical to SEQ ID NO: 29897

SEQ ID NO: 107090 - RNA, 44 nt, Mus musculus
agaggagaggcugcaaaccgucauaggccgccuccaaagcacaa

SEQ ID NO: 107091 - RNA, 83 nt, Mus musculus; identical to SEQ ID NO: 29899

SEQ ID NO: 107092 - RNA, 44 nt, Mus musculus; identical to SEQ ID NO: 107087

SEQ ID NO: 107093 - RNA, 45 nt, Mus musculus; identical to SEQ ID NO: 29896

SEQ ID NO: 107094 - RNA, 42 nt, Mus musculus; identical to SEQ ID NO: 29897

SEQ ID NO: 107095 - RNA, 44 nt, Mus musculus; identical to SEQ ID NO: 107090

SEQ ID NO: 107096 - RNA, 83 nt, Mus musculus; identical to SEQ ID NO: 29899

SEQ ID NO: 107097 - RNA, 42 nt, Mus musculus
ggugggcgggcggguaguaucuuggagaaggcaggcaggcag

SEQ ID NO: 107098 - RNA, 45 nt, Mus musculus
cucccuguaaggcaacuggugagcucagcuugcuugucuguguuc

SEQ ID NO: 107099 - RNA, 45 nt, Mus musculus
cgcuccagguggcccagaagcugacacugcaccggcaccggguac

SEQ ID NO: 107100 - RNA, 42 nt, Mus musculus
uccgcgccacggcaacuugaccagaccagucgcgggccacac

SEQ ID NO: 107101 - RNA, 54 nt, Mus musculus
cugcugcgagcgcugcuucccucagaccuccgcagagagacuuccuuccccaag

SEQ ID NO: 107102 - RNA, 50 nt, Mus musculus
uucaccgacgagucgggaugcuucuucuugugcuccucgcggcaggucug

SEQ ID NO: 107103 - RNA, 46 nt, Mus musculus; identical to SEQ ID NO: 29216

SEQ ID NO: 107104 - RNA, 42 nt, Mus musculus; identical to SEQ ID NO: 29217

SEQ ID NO: 107105 - RNA, 45 nt, Mus musculus
ugacaaaguugucauuaagagcaaugccagccccggcaucgaagg

SEQ ID NO: 107106 - RNA, 47 nt, Mus musculus
guacauugugccaaagaugucaaucacuuuaaaucacagucugcagu

SEQ ID NO: 107107 - RNA, 46 nt, Mus musculus
ucugagcuguuuccgacuuguugauccuuggguuaguggucccuga

SEQ ID NO: 107108 - RNA, 46 nt, Mus musculus
guacccagugguucacgccugucgucuaagcuuucuaccgccugag

SEQ ID NO: 107109 - RNA, 45 nt, Mus musculus
ccuuuuucuauaacauacuucguaauuguuacaucagcugccccc

SEQ ID NO: 107110 - RNA, 42 nt, Mus musculus
uuuuuuaaugaaaugguugaaauggaaagaaacuugcaguag

SEQ ID NO: 107111 - RNA, 44 nt, Mus musculus
uuaaugaggaaggagagcugcacuuaacacuacaguggcccaua

SEQ ID NO: 107112 - RNA, 44 nt, Mus musculus
uccagggucaaaucugggucuugagaggcuugagucccugugga

SEQ ID NO: 107113 - RNA, 45 nt, Mus musculus
ccgaguuucgccuggauucagaaccacaaggaucuaaguucccag

SEQ ID NO: 107114 - RNA, 45 nt, Mus musculus
agguaaacuaagaauuugcaucaaggcuauuuacuggagagagag

SEQ ID NO: 107115 - RNA, 46 nt, Mus musculus
uaagagucagggcuguauagauuaaacccugacucaagaaaaggaa

SEQ ID NO: 107116 - RNA, 42 nt, Mus musculus
agugagacccugucuccaaaagggggagcaggguggagagag

SEQ ID NO: 107117 - RNA, 46 nt, Mus musculus
uuggguucagaagaacuuugcagccaaguaagauaauguagaccag

SEQ ID NO: 107118 - RNA, 46 nt, Mus musculus
cuaaagugaaggugaccagcaguuguuuguaauacuauguugacag

SEQ ID NO: 107119 - RNA, 46 nt, Mus musculus
uuauaaauuguugauaaaaacaaauucuagaaaccacaucuagcag

SEQ ID NO: 107120 - RNA, 42 nt, Mus musculus
auaaugggaugaacuugguggagugagaaguuucaacgugag

SEQ ID NO: 107121 - RNA, 45 nt, Mus musculus
ugagccagcccuuccaggcagaauaccauuucucaguuuccagca

SEQ ID NO: 107122 - RNA, 42 nt, Mus musculus
gauacucacuggaacagagaaccgugaagaugagacagagag

SEQ ID NO: 107123 - RNA, 44 nt, Mus musculus
ugaaguaucaacacaaacuuguaaaugacuagcaugggcuggug

SEQ ID NO: 107124 - RNA, 45 nt, Mus musculus
cguauaaucuauugaagagggaucuguuugcaaaaauuauugaag

SEQ ID NO: 107125 - RNA, 92 nt, Mus musculus
gcuuugaagugggaccagcagacggggcuuuguuuuuaaggaauggagaaauaaauaaugggaauuuuauuaaaaacuuuauaauacggcuc

SEQ ID NO: 107126 - RNA, 46 nt, Mus musculus
acaacugucuaacuggcuucugacuaccuuacuuguacauauacag

SEQ ID NO: 107127 - RNA, 46 nt, Mus musculus
ggacugcuucaaaaggacacaccagagagguuucguuacagcucca

SEQ ID NO: 107128 - RNA, 46 nt, Mus musculus
guaagaaaucaagaggcaauccugaaagauuauguaggugaggcag

SEQ ID NO: 107129 - RNA, 45 nt, Mus musculus
agcucucaguuucugagguaacaaccuacacacuguguaugcugg

SEQ ID NO: 107130 - RNA, 45 nt, Mus musculus
aauauuuagaaacauuucccucaugaaacaauagcuggggcuaga

SEQ ID NO: 107131 - RNA, 25 nt, Mus musculus
caagagcaagccugugauuccacuc

SEQ ID NO: 107132 - RNA, 45 nt, Mus musculus
ucuuaaauacaaauaagcacauuacagcuuucuugcuugcuacca

SEQ ID NO: 107133 - RNA, 68 nt, Mus musculus
uaaaauucauuugaucuggguaggguuuuacguagcuuggacaaggaucuggguuugagucuaacauc

SEQ ID NO: 107134 - RNA, 46 nt, Mus musculus
gaaaccuaaaguuuuauuccaauaucucaacuguucaccucuacag

SEQ ID NO: 107135 - RNA, 45 nt, Mus musculus
uuauuauguguaacuguuugccugaguauuacaucugagcaccug

SEQ ID NO: 107136 - RNA, 46 nt, Mus musculus
caacaguuauggaccaccaugugagguguugugacucaaaccuagg

SEQ ID NO: 107137 - RNA, 41 nt, Mus musculus
cagcaaugcagucaggccuggcuuuggggauuggcccuggg

SEQ ID NO: 107138 - RNA, 46 nt, Mus musculus
auacaggcaaccuucaauacuuaauguugguacaaagaggggagag

SEQ ID NO: 107139 - RNA, 42 nt, Mus musculus
cauuaacaacugaagaucucuguaccacacaaggcugcccag

SEQ ID NO: 107140 - RNA, 49 nt, Mus musculus
cugcccuuagcauuucuaggcaugcaugaaauugcugaugaggagaaau

SEQ ID NO: 107141 - RNA, 42 nt, Mus musculus
cgucugugccuuucucuguccuuacacuucucucgcacccag

SEQ ID NO: 107142 - RNA, 46 nt, Mus musculus
gauuuuuaaaaaucauaauauaguuauauacagauauccuuuuuug

SEQ ID NO: 107143 - RNA, 45 nt, Mus musculus
augaggcuggaaccaagcaccaggcacuggauuugaacucucuau

SEQ ID NO: 107144 - RNA, 45 nt, Mus musculus
gaucgagaagcuugcuagauuaaaaagacuggcauuuucccuucc

SEQ ID NO: 107145 - RNA, 45 nt, Mus musculus
gacugugaccggguaauuaccacgcguuacacuuagggguguggu

SEQ ID NO: 107146 - RNA, 46 nt, Mus musculus
cauauaauaaauaaauaaaucuuuaaaaaaaaaaagaaagaaaaag

SEQ ID NO: 107147 - RNA, 46 nt, Mus musculus
uaguuggcaccugggaaaaaaggucucugaaagaaagacugggcug

SEQ ID NO: 107148 - RNA, 46 nt, Mus musculus
aacgagagggaccaacuaggguuguuacagagaaaaaagcugcaca

SEQ ID NO: 107149 - RNA, 42 nt, Mus musculus
ucacaaccaucuguaacgagaucugacuccaucuucuggagu

SEQ ID NO: 107150 - RNA, 32 nt, Mus musculus
gaagugaaaguuggaggaaggcuacuugggag

SEQ ID NO: 107151 - RNA, 46 nt, Mus musculus
auacacacacacacauacacacacacacacacacacacacagaaac

SEQ ID NO: 107152 - RNA, 46 nt, Mus musculus
uacacccgggaagagaaacccucaauugaggaacugccuccaucag

SEQ ID NO: 107153 - RNA, 46 nt, Mus musculus
gguuagcauuuuaucauagcaacagaaaacaaagcacaacagggag

SEQ ID NO: 107154 - RNA, 30 nt, Mus musculus
cuugcgaucgcgcgccagccgccccgggag

SEQ ID NO: 107155 - RNA, 46 nt, Mus musculus
uaauucaguguaacuuugggaaggggucuuggggauuggaugacag

SEQ ID NO: 107156 - RNA, 45 nt, Mus musculus
gaaaaugccuuaggagggaaccauggagaaguaugugagacugca

SEQ ID NO: 107157 - RNA, 46 nt, Mus musculus
ccuguuccuuauaacguuugaaacguauacgcauauguagcuacaa

SEQ ID NO: 107158 - RNA, 41 nt, Mus musculus
ugcaggcaguggguugauggaugggaggaaaagugggggag

SEQ ID NO: 107159 - RNA, 46 nt, Mus musculus
cacuugcacuaaguuacaucuccaccuuugauacaagaucuugcag

SEQ ID NO: 107160 - RNA, 45 nt, Mus musculus
gcauugcucagugagcacuuagaaacccccaccccaccccaagga

SEQ ID NO: 107161 - RNA, 46 nt, Mus musculus
cauagcugauuaucuuugcucuuuucugucuuuauucugacgcauu

SEQ ID NO: 107162 - RNA, 46 nt, Mus musculus
uauuaaguuacuugcuuuuucucuccuaccaucuuuauagccccag

SEQ ID NO: 107163 - RNA, 42 nt, Mus musculus
agccagggcuacacagagaaacccugucaugaaaaaaaaaaa

SEQ ID NO: 107164 - RNA, 42 nt, Mus musculus
agaacauauuucuaaccaaagaugggacagugcagcuuggag

SEQ ID NO: 107165 - RNA, 42 nt, Mus musculus
aguguguguguguguguuugugugugugugugugcgugugug

SEQ ID NO: 107166 - RNA, 49 nt, Mus musculus
uuacaaaaucuugcauuuuguuccaaagaaagaaagagagagagagaga

SEQ ID NO: 107167 - RNA, 46 nt, Mus musculus
uugauaucauaauuugauugucauacugaaaaauguaggugaaaga

SEQ ID NO: 107168 - RNA, 46 nt, Mus musculus
acuggcugcauuacuggauuuuaaucaguuuauuuagcgacguuua

SEQ ID NO: 107169 - RNA, 62 nt, Mus musculus
agugugcgugugugugugucuguguguaugugugugucugugugugugugugugugucugug

SEQ ID NO: 107170 - RNA, 42 nt, Mus musculus
uauguguguugauggggacccaggaggaauugguggggagag

SEQ ID NO: 107171 - RNA, 42 nt, Mus musculus
uccacugccucucugccuccauucuuuuaccuggauagccag

SEQ ID NO: 107172 - RNA, 45 nt, Mus musculus
ugucagcugccuucucccccuuugcuuucagaaguacaggccugu

SEQ ID NO: 107173 - RNA, 46 nt, Mus musculus
ccaguaugaacauuaccaugccauuuuugaccaaaugcagcggcua

SEQ ID NO: 107174 - RNA, 50 nt, Mus musculus
acauucuuucguaguagucaacgaaagaugcugaaaugaggugagaaaag

SEQ ID NO: 107175 - RNA, 46 nt, Mus musculus
guaaguaagaugaaucauaucauuguaaaaugaaucuugucaagag

SEQ ID NO: 107176 - RNA, 45 nt, Mus musculus
gaauuccuacagcguaaacgagaagcuaugcagaauaaagcccga

SEQ ID NO: 107177 - RNA, 46 nt, Mus musculus
acacacacacacacacacauuauaguauuuguugaaaagcauguua

SEQ ID NO: 107178 - RNA, 24 nt, Mus musculus
uuuuauugacucacuaaauccauc

SEQ ID NO: 107179 - RNA, 46 nt, Mus musculus
guauccaauaauaacacugcauuuuauaguccugaguuugcagguu

SEQ ID NO: 107180 - RNA, 46 nt, Mus musculus
caauuccauguuaacaaugaauucaauaacaagaauguauuugaag

SEQ ID NO: 107181 - RNA, 45 nt, Mus musculus
caagacugaggcaaauaagacuacaaaauuuuaaugagcgccaac

SEQ ID NO: 107182 - RNA, 45 nt, Mus musculus
agagcuguacagagaggagaccugaugugugggaaagguguagga

SEQ ID NO: 107183 - RNA, 46 nt, Mus musculus
ugcacgugcugcuguacuaaaagaacagcuggagcgaaaaagaaag

SEQ ID NO: 107184 - RNA, 64 nt, Mus musculus
ugcaccacauuuuggauucaauuccuaguacugagaaaaagaggaggaggagggagcgagggag

SEQ ID NO: 107185 - RNA, 86 nt, Mus musculus
aggaaaggaaaaaggaaagggaaaaggaaaaaaggaaggaaaggaaaggagaaaggaaaggaggggaaaggaaagggaagggaagg

SEQ ID NO: 107186 - RNA, 45 nt, Mus musculus
aaccucuucuucuuucauuaucacuguuucucugucugucugucu

SEQ ID NO: 107187 - RNA, 41 nt, Mus musculus
accccagcaaccacaugguggcucacaacaauccguaacaa

SEQ ID NO: 107188 - RNA, 42 nt, Mus musculus
uguguguguguguguguguguguguguguguguauaacguaa

SEQ ID NO: 107189 - RNA, 46 nt, Mus musculus
acagaaaaacccugucucgaaaaaccaaaaaaaaaaaaaaaauugu

SEQ ID NO: 107190 - RNA, 46 nt, Mus musculus
aucauguuagguuacuauaucugucccucuccucugcucagucuau

SEQ ID NO: 107191 - RNA, 49 nt, Mus musculus
gaccugagugaaaucuaaaugaggaaacuaaaugaaggaaaccuggaug

SEQ ID NO: 107192 - RNA, 51 nt, Mus musculus
ugugugguaaguuuguguaucauuauucuuggacugggaagaauagcuguc

SEQ ID NO: 107193 - RNA, 46 nt, Mus musculus
auucuggacccaugaauuuuagguguuugagugucacagcagcacu

SEQ ID NO: 107194 - RNA, 55 nt, Mus musculus
ggucauaguugucacaaacccacaaagucaacccacuguaggaagccaggccugc

SEQ ID NO: 107195 - RNA, 46 nt, Mus musculus
ucuucuaagcuagaugaacuucucuucuaaugccccugaccuccag

SEQ ID NO: 107196 - RNA, 50 nt, Mus musculus
gaugggaguuugccaccuguucuuaaugauguguggacuagagagaagga

SEQ ID NO: 107197 - RNA, 44 nt, Mus musculus
guauacacaauuguguauugcacauguagucuugcuacccauga

SEQ ID NO: 107198 - RNA, 46 nt, Mus musculus
aaaauucauaauucauuuuauuucucuuuaauaguuuuggggcuau

SEQ ID NO: 107199 - RNA, 42 nt, Mus musculus
ccagacuggugcaccauaucuccagaaaaaucccaaccaaag

SEQ ID NO: 107200 - RNA, 41 nt, Mus musculus
cuugggugagucagaaugacuuucccgucgcuuagcucccu

SEQ ID NO: 107201 - RNA, 25 nt, Mus musculus
ucccaugucacacauaagcaacuug

SEQ ID NO: 107202 - RNA, 42 nt, Mus musculus
ugcuacuuuauauucuucuggcucaguacacacauggcccaa

SEQ ID NO: 107203 - RNA, 45 nt, Mus musculus
ucccguuaaaaacaacucaagaucccuuuuuaaaaaugcauccag

SEQ ID NO: 107204 - RNA, 46 nt, Mus musculus
uuucaugugccgccuucaaguucagguuaauucugaucccuuuaag

SEQ ID NO: 107205 - RNA, 46 nt, Mus musculus
augugaaauacauugucugaguaaaagcuagcacacauagucacug

SEQ ID NO: 107206 - RNA, 97 nt, Mus musculus
aaaaucugauccagcucauucaaaguaaagcuaguaaggggcauacuagaaacaagauuucuugaaagacugucucauaagugaggugaagagauug

SEQ ID NO: 107207 - RNA, 70 nt, Mus musculus
accugcacacauaccugcucuugugcauauacccacaccacaaacaacauuuuaaccuuuaaagucauug

SEQ ID NO: 107208 - RNA, 46 nt, Mus musculus
guuuauguagugaaauucuauacagcuauucaaauaaaugaaccaa

SEQ ID NO: 107209 - RNA, 46 nt, Mus musculus
aucagaucccauuacagaugguugugcgccacuauguaguugcugg

SEQ ID NO: 107210 - RNA, 46 nt, Mus musculus
auucuagccuugaaguuuguauucucgaguuauuuucaaccacugg

SEQ ID NO: 107211 - RNA, 46 nt, Mus musculus
uuaucuuuacucaucuuuuauuuuuuacuucucuuucuccaugugu

SEQ ID NO: 107212 - RNA, 42 nt, Mus musculus
ccugccccuugggcagggggagauggcuacagcaggcugcag

SEQ ID NO: 107213 - RNA, 46 nt, Mus musculus
uugcuuugcuuuagcugaaaugaauguaggcaaguggacucucgag

SEQ ID NO: 107214 - RNA, 46 nt, Mus musculus
aauucuagaacuagagaggcugaggcaggaggauugugaguuugag

SEQ ID NO: 107215 - RNA, 46 nt, Mus musculus
guuccaguccacgggcccugcccauguacccggguuugcgccccag

SEQ ID NO: 107216 - RNA, 42 nt, Mus musculus
aggagagaauggacgcgauuauacugaaaguagagaagucag

SEQ ID NO: 107217 - RNA, 45 nt, Mus musculus
uuguuuucccaggcccuuugauuguauuccuauuccagccccccc

SEQ ID NO: 107218 - RNA, 45 nt, Mus musculus
ucgugaguuuggugauagggaucagggaguucuauggagccaccu

SEQ ID NO: 107219 - RNA, 73 nt, Mus musculus
ugcuggccacaaccuuacaguaguaaucuccuaucccaaagcugagacggaagguauacacuaccaugcccag

SEQ ID NO: 107220 - RNA, 46 nt, Mus musculus
aaaccuuaucucaaagcaaaacaaaaacaaaacacucauacacaag

SEQ ID NO: 107221 - RNA, 46 nt, Mus musculus
agcuuaauaguaauguuuguaggauaauaaauguaauaauaauagg

SEQ ID NO: 107222 - RNA, 46 nt, Mus musculus
uucugcuauuuuaaaauagugugugugugugugugugugugugugu

SEQ ID NO: 107223 - RNA, 46 nt, Mus musculus
ugcacacuaaccuccugggcuccaugcugaccuguaaagcugccau

SEQ ID NO: 107224 - RNA, 41 nt, Mus musculus
cuagauugcucccucucuaccccuucuacuuuccacagcaa

SEQ ID NO: 107225 - RNA, 45 nt, Mus musculus
agagcuagcaaaugugcacuugugguguacuuacccgugcacuaa

SEQ ID NO: 107226 - RNA, 46 nt, Mus musculus
cuuucuccccuaccuaguguuaggggguugaaaagguggauaagga

SEQ ID NO: 107227 - RNA, 48 nt, Mus musculus
ggcccugagaagagguaguuugcugguuggugguugaaugcuguuggu

SEQ ID NO: 107228 - RNA, 46 nt, Mus musculus
caaaaacacauucuuaugauauuucuguguuuuacaaagcaaccaa

SEQ ID NO: 107229 - RNA, 46 nt, Mus musculus
uguuuauuaggcacacugcaggggauauugcuuucucuugguaggu

SEQ ID NO: 107230 - RNA, 46 nt, Mus musculus
cccuucuggcuuugagaguccgguugagaagcagguuugauucuag

SEQ ID NO: 107231 - RNA, 46 nt, Mus musculus
uuuggaccugaguuucuucuccuuccuuuauuuccauuaugcauag

SEQ ID NO: 107232 - RNA, 44 nt, Mus musculus
aaggagaggcagcauccagcagugugcuccagaucuggguauaa

SEQ ID NO: 107233 - RNA, 74 nt, Mus musculus
acuuguaccacaggacacuuucuugcuuuauuuucuuagguccagaaacaguuugcugucuccuccagaucucc

SEQ ID NO: 107234 - RNA, 57 nt, Mus musculus
aacauaaaagaauguuugguugucuguguaucucccuuuuccuccuugcuuguacaa

SEQ ID NO: 107235 - RNA, 50 nt, Mus musculus
ucaugugagccugaggaagauaaaacguguaagaguuucaaaaucccaga

SEQ ID NO: 107236 - RNA, 57 nt, Mus musculus
uuuccuuguuauguuguuuuuuucucauggaauuaaggaaguaaaauaagaaagaaa

SEQ ID NO: 107237 - RNA, 46 nt, Mus musculus
uuuuuuuuuauuauuuuuaaaaaauaaaaaguauuuuuccacagag

SEQ ID NO: 107238 - RNA, 45 nt, Mus musculus
uuccugaucagcauagaaaugucuccccuuuuaaguaggacuaag

SEQ ID NO: 107239 - RNA, 46 nt, Mus musculus
gggaggggauccaacagcagggaacagagacugagagagccccacu

SEQ ID NO: 107240 - RNA, 45 nt, Mus musculus
acucauggagcccugcucaucacuacugaacuauugaauacugaa

SEQ ID NO: 107241 - RNA, 46 nt, Mus musculus
aaggccaauuuaaagaguaaguuccagguuagccaagcuuaggcag

SEQ ID NO: 107242 - RNA, 46 nt, Mus musculus
ggaguggauuguguugguuugaauauggcucagggaauagcacuau

SEQ ID NO: 107243 - RNA, 41 nt, Mus musculus
gggaaaagagaaaagguaaaagagagagagagacuggccau

SEQ ID NO: 107244 - RNA, 45 nt, Mus musculus
caaguucuggcuagccugcuucaggcuuaugggaggcuacaggag

SEQ ID NO: 107245 - RNA, 45 nt, Mus musculus
cauugccuaugugaugucuaaccauguuucuuuuuugggggcugg

SEQ ID NO: 107246 - RNA, 58 nt, Mus musculus
ucaaugaauccuuucucauucauuuaggaacaggaacaggaacaggaagaggaggagg

SEQ ID NO: 107247 - RNA, 71 nt, Mus musculus
ucucuaauuugucuuucaaaaauuauuuuauuuauuauuucuguguguuuguaugaugaacgugggggcca

SEQ ID NO: 107248 - RNA, 86 nt, Mus musculus
auauguggaaggcaaugggggagaugcugugguguauauguggaaggcaaugggggagaugcugugguguauauguggaaggcaau

SEQ ID NO: 107249 - RNA, 74 nt, Mus musculus
ggggagaugcugugguguauauguggaagucaauggggagaugcugugguguauauguggaagucaauggggag

SEQ ID NO: 107250 - RNA, 46 nt, Mus musculus
uuugauagaucauuggcacaggaauaccguauagguucagaaagag

SEQ ID NO: 107251 - RNA, 46 nt, Mus musculus
ugggcaggagaccaaggcugaaauaauuaaaagagaaaauaagaag

SEQ ID NO: 107252 - RNA, 39 nt, Mus musculus
gcuauuuuaguuauuugugugugugugugugugugugug

SEQ ID NO: 107253 - RNA, 42 nt, Mus musculus
ccuuauuucccuuucuugcuuuaugaucauuuccuuucucau

SEQ ID NO: 107254 - RNA, 45 nt, Mus musculus
uccguccacuuccuugacagguucauuuaaacucccauuggcccu

SEQ ID NO: 107255 - RNA, 42 nt, Mus musculus
uuuaacaaccacuggcauggagugugcuuguguaggccauuu

SEQ ID NO: 107256 - RNA, 45 nt, Mus musculus
caaaugaguaaauaauucuaaacauuguuuaguauacucagacua

SEQ ID NO: 107257 - RNA, 45 nt, Mus musculus
ccuuucaccccgagaaagcauacagcuguaugacacuaugugcca

SEQ ID NO: 107258 - RNA, 43 nt, Mus musculus
uuaauaguacuauuacuauuaguaguaauaguaauagccccaa

SEQ ID NO: 107259 - RNA, 42 nt, Mus musculus
augggggccagucucauucaaauuacuauacuguguccugag

SEQ ID NO: 107260 - RNA, 45 nt, Mus musculus
agauuucuugguaaaugauccuuuuuaggauagcucgguuucagg

SEQ ID NO: 107261 - RNA, 46 nt, Mus musculus
cuuuauuauccaauuaauuagggggaaauucugcuacaagccucag

SEQ ID NO: 107262 - RNA, 45 nt, Mus musculus
aauuuauaaccauaaacaucaucagaaaacaguacaaacagccac

SEQ ID NO: 107263 - RNA, 45 nt, Mus musculus
cacucucaucuaguucuuauuagugaucaugcaaucuaacggcag

SEQ ID NO: 107264 - RNA, 46 nt, Mus musculus
uggagggaguuagcaaggucaacugaggaacuagggucacaggaag

SEQ ID NO: 107265 - RNA, 46 nt, Mus musculus
uugcccagcuccagggacugaccuaacuagggcagcauguaguaag

SEQ ID NO: 107266 - RNA, 46 nt, Mus musculus
ggaagacuugccuuucugauggcaaaacuauauaacuuggcagcac

SEQ ID NO: 107267 - RNA, 45 nt, Mus musculus
uguuuuuuguuuguuuguuuguuuauuuuuguuuuuugcccacac

SEQ ID NO: 107268 - RNA, 44 nt, Mus musculus
acggugcucuuuuguguguguucaagaaaauaugggcuggguua

SEQ ID NO: 107269 - RNA, 46 nt, Mus musculus
uaguuuuguauauuuuguuguuaggcacugagauguuguugaauag

SEQ ID NO: 107270 - RNA, 45 nt, Mus musculus
agaaauuuaaguauuauauaaugagguucagcaaucccuuuucaa

SEQ ID NO: 107271 - RNA, 45 nt, Mus musculus
guccaugugucucuguuuaguuucuguuuccaggaucugucuacu

SEQ ID NO: 107272 - RNA, 46 nt, Mus musculus
gaauauuacauauauacauuuaaagacaguuuuuacacuccaugag

SEQ ID NO: 107273 - RNA, 45 nt, Mus musculus
aaugcuaaaaaggaaaaagaucguggaaaggggauaaucugguaa

SEQ ID NO: 107274 - RNA, 46 nt, Mus musculus
ugcaaacagugcagcaaaagaauacaggggagcuguuuaauaugag

SEQ ID NO: 107275 - RNA, 46 nt, Mus musculus
uccacuuaucagugaguacauaucgugugaguuaauuaucuuaaag

SEQ ID NO: 107276 - RNA, 45 nt, Mus musculus
guauguaaaaccuucaaagaccugucccuacugacagccaggccc

SEQ ID NO: 107277 - RNA, 42 nt, Mus musculus
caucuuuaaaucacugcuaugauuaacacaaaagcuacccuu

SEQ ID NO: 107278 - RNA, 46 nt, Mus musculus
accaguagccauuguagauacaacauaagacagcuccuacugcuau

SEQ ID NO: 107279 - RNA, 46 nt, Mus musculus
acccuuaacagacauucauucccaugugcccuuucuccugccccac

SEQ ID NO: 107280 - RNA, 45 nt, Mus musculus
cugaaagcaugaugaucacaugugcuuccuagaaaaugcccccag

SEQ ID NO: 107281 - RNA, 42 nt, Mus musculus
uaaaucugacccacagaaagacagagacaaagggggagguag

SEQ ID NO: 107282 - RNA, 46 nt, Mus musculus
uucaggaacucagcaaccaauggccacagguggcuauagguggcac

SEQ ID NO: 107283 - RNA, 25 nt, Mus musculus
guacaagaacuaauggaaaaauauu

SEQ ID NO: 107284 - RNA, 46 nt, Mus musculus
auauccacacguacauaaaaucaguuauaaacauaaauucggccag

SEQ ID NO: 107285 - RNA, 41 nt, Mus musculus
aaggggccgcucaccauggcgaugucuuggccaccgaggcc

SEQ ID NO: 107286 - RNA, 47 nt, Mus musculus
caacaagaccauuggcacuggccuuguuacugauguaccagccauga

SEQ ID NO: 107287 - RNA, 77 nt, Mus musculus
ugccuggagaggacuugaagcuuagucuaaucuugcggcagcccaugaucuuagagaaaggccaacguuucaccuug

SEQ ID NO: 107288 - RNA, 45 nt, Mus musculus
ggggauaaccugggugcucugguccgaggcuuaaagcgcgaagau

SEQ ID NO: 107289 - RNA, 29 nt, Mus musculus
ggggcacaguggugacagguacauuagag

SEQ ID NO: 107290 - RNA, 50 nt, Mus musculus
ugugguguacgugaacaaggcagacgcuguccaggacucagagauggugg

SEQ ID NO: 107291 - RNA, 46 nt, Mus musculus
ugcugcccgacacuaugcccacacagacuguccuggucaugcagau

SEQ ID NO: 107292 - RNA, 45 nt, Mus musculus
gcagugcuauacuccacaugggcugcauugauggugaugccccga

SEQ ID NO: 107293 - RNA, 46 nt, Mus musculus
ggagcuaaguucaagaaguacgaggagauagacaaugccccagagg

SEQ ID NO: 107294 - RNA, 45 nt, Mus musculus
acuuagcuccaccucccucggcuagaauuuucgugauggcugcag

SEQ ID NO: 107295 - RNA, 45 nt, Mus musculus
uggccuccacagcuaggccgcgacacaagaagggugaugcgggag

SEQ ID NO: 107296 - RNA, 43 nt, Mus musculus
gguaguacucggugaccgggaccgggaacuaggcacccggggc

SEQ ID NO: 107297 - RNA, 45 nt, Mus musculus
cacauuuacuuauaauuugagaaguuucagaugcuggacggucag

SEQ ID NO: 107298 - RNA, 42 nt, Mus musculus
gugaguuucuggugcagcgagcccgggaacuagugccccagg

SEQ ID NO: 107299 - RNA, 45 nt, Mus musculus
acgagugucgcugcgacuguucucuuugguuauuucuggccugug

SEQ ID NO: 107300 - RNA, 45 nt, Mus musculus
agaguguuauuuuuuucuguugcugugacugauagaaagcagcuc

SEQ ID NO: 107301 - RNA, 46 nt, Mus musculus
ccccaccaaaucauguucaauaauaaaucucacauccagucugcuu

SEQ ID NO: 107302 - RNA, 42 nt, Mus musculus
acaauguguuagcauuuaagugagagucagagcacuggccag

SEQ ID NO: 107303 - RNA, 42 nt, Mus musculus
ugaccuaucuuccaccccagguccaucauuagcccugaggag

SEQ ID NO: 107304 - RNA, 46 nt, Mus musculus
ccacugugauguacaguacuuuugucuugugaaugaagagucagau

SEQ ID NO: 107305 - RNA, 46 nt, Mus musculus
uaauagaaggacugacugagaaaucaucccacaucgucgaccccug

SEQ ID NO: 107306 - RNA, 45 nt, Mus musculus
uguuguuggaaugagaugcgaauggcagauggauaaagggagacg

SEQ ID NO: 107307 - RNA, 46 nt, Mus musculus
aauaauauuuaguuauaagacuugauaguacaucauuuuuggcaaa

SEQ ID NO: 107308 - RNA, 46 nt, Mus musculus
gaaauugaucgcaguaaacacauacacaagaagaggaagcuagcug

SEQ ID NO: 107309 - RNA, 42 nt, Mus musculus
gcacccuuucugucucccugguucaucugacagugucuggag

SEQ ID NO: 107310 - RNA, 47 nt, Mus musculus
agucugcaucacuuagcagcucugcaaggaucccuuucucagccaca

SEQ ID NO: 107311 - RNA, 41 nt, Mus musculus
gaguacagagugaguaccgggaagcucauguggcggcguua

SEQ ID NO: 107312 - RNA, 42 nt, Mus musculus
ccacucagaccuguuacuuaauuuguugcugaaaaucacaau

SEQ ID NO: 107313 - RNA, 46 nt, Mus musculus
ucugauguguuacauggugcuccccauacaagauggcgggaagcca

SEQ ID NO: 107314 - RNA, 46 nt, Mus musculus
gcagugugauucccugcuuaacagauugcaggagaaaaggcccaau

SEQ ID NO: 107315 - RNA, 46 nt, Mus musculus
guagacaaacacagacaggucaaaagauucucaauaaagacaccaa

SEQ ID NO: 107316 - RNA, 46 nt, Mus musculus
gugguacacguacauauaugcagccuaaauauuuauacaugcacag

SEQ ID NO: 107317 - RNA, 48 nt, Mus musculus
gcaggaguggccacggggagagaaccuuuuccugaaagccaucaguaa

SEQ ID NO: 107318 - RNA, 46 nt, Mus musculus
ccacuaggacccguugagcuuuuacuauuuguggggaaagaaggag

SEQ ID NO: 107319 - RNA, 45 nt, Mus musculus
ccucucaaguuguaggauguguguacuacauauuucccagugccu

SEQ ID NO: 107320 - RNA, 46 nt, Mus musculus
cagacauugauaugcuggaggaauuugcuuauuuaagaacccaaga

SEQ ID NO: 107321 - RNA, 51 nt, Mus musculus
ugggucauggguauucaaggaccuugacacacaugugccacaaguaaauuu

SEQ ID NO: 107322 - RNA, 97 nt, Mus musculus
uauuuaguacguaagcuaaaaugaugcuguuuauuuggcuagauucuccuguucuuaagccguaagaccuagcuaucucuaugugccacuugacacc

SEQ ID NO: 107323 - RNA, 46 nt, Mus musculus
uugcuguuaauguguggaaacaaucccacaggaccaugacaagcag

SEQ ID NO: 107324 - RNA, 23 nt, Mus musculus
cuuucccguccuaacgcacggcu

SEQ ID NO: 107325 - RNA, 46 nt, Mus musculus
cuccuggccaccagcggcucagccaugacaagcgcugccagaccag

SEQ ID NO: 107326 - RNA, 46 nt, Mus musculus
acaccaaguucuaacucccuuaguugcuuaaaagucaauccgaaga

SEQ ID NO: 107327 - RNA, 46 nt, Mus musculus
acuaguuuagugugucacacauacauuuaacgaugguuacuuauag

SEQ ID NO: 107328 - RNA, 42 nt, Mus musculus
ccccuuguucuuucuuacuuaaacucccauaguagcccagag

SEQ ID NO: 107329 - RNA, 42 nt, Mus musculus
ugagaguugggugcccaaacuuguggccgcccuguacaagag

SEQ ID NO: 107330 - RNA, 92 nt, Mus musculus
gcaagcgguucuuugcguguaacaggaucugugaggggugcacgcgagcuuggaagccacgcuauggugagcaagggaccgcagucuuggga

SEQ ID NO: 107331 - RNA, 48 nt, Mus musculus
cuguaguucccuguaccaaaguggugaccucugaagaacuucacccug

SEQ ID NO: 107332 - RNA, 47 nt, Mus musculus
ugugcauggaaucuuauguguugguagcacuccacuauuuugcugag

SEQ ID NO: 107333 - RNA, 46 nt, Mus musculus
uagaaaaaaaaaguuaaaauauauuagagcuuugagagggcccuag

SEQ ID NO: 107334 - RNA, 42 nt, Mus musculus
uuugcagucuucuauauucagauaaucuaguuagaccagcac

SEQ ID NO: 107335 - RNA, 45 nt, Mus musculus
uguuuaucaccuguaggaguuccuugguaaaauuuuggggccccu

SEQ ID NO: 107336 - RNA, 46 nt, Mus musculus
guuucuagaaguuuugaguauugcauuccacuuucauuacaaauag

SEQ ID NO: 107337 - RNA, 44 nt, Mus musculus
cuguugacuauugagcuaggcagcaucuaugaauauagcaggau

SEQ ID NO: 107338 - RNA, 45 nt, Mus musculus
acauuuggcucaaccuuagaucucugagccauccaccuggccauc

SEQ ID NO: 107339 - RNA, 46 nt, Mus musculus
ggccaaacccacaagcucugagccaccagcacaucuugcaggcaag

SEQ ID NO: 107340 - RNA, 46 nt, Mus musculus
uauaaauagucuauaaauauaauugauaaaguguccuuguguuaag

SEQ ID NO: 107341 - RNA, 46 nt, Mus musculus
auucauuaauuguugaucuuagugcuagcacgguugguguucuguu

SEQ ID NO: 107342 - RNA, 44 nt, Mus musculus
ugauguagaggacauuauuacaccuuauucgaacuuugcccaga

SEQ ID NO: 107343 - RNA, 25 nt, Mus musculus
auguccacauuaauuucacuccgga

SEQ ID NO: 107344 - RNA, 46 nt, Mus musculus
agaugucaugcuggagaccuacaagaaccucguugcuauagguaag

SEQ ID NO: 107345 - RNA, 46 nt, Mus musculus
ucaagcugauauaaauaugccuuugaagaaauuugaauguccccua

SEQ ID NO: 107346 - RNA, 42 nt, Mus musculus
ccugcggaaggcggcugcgggagaaggcgggcgugggggacg

SEQ ID NO: 107347 - RNA, 42 nt, Mus musculus
caggaagcaggucaucacccuuacuugcaucagcaaaggggu

SEQ ID NO: 107348 - RNA, 71 nt, Mus musculus
gguuuucauaauuguucuuauuguauauagcuuauugaugguagagaaagacccuuuauuggacuaaaagg

SEQ ID NO: 107349 - RNA, 46 nt, Mus musculus
cuucccuauucccuccccccucuccacaugcucaugggcagcucuc

SEQ ID NO: 107350 - RNA, 48 nt, Mus musculus
caaugugguaaagccuuugcauaucacagucaucuuaaaguucaugga

SEQ ID NO: 107351 - RNA, 46 nt, Mus musculus
auagcaguagucuucagauacaugaaauaauccauacugcagagaa

SEQ ID NO: 107352 - RNA, 48 nt, Mus musculus; identical to SEQ ID NO: 107350

SEQ ID NO: 107353 - RNA, 46 nt, Mus musculus
uuugcacaucauaguucucuccagaaacaugaaaaaacucauacug

SEQ ID NO: 107354 - RNA, 46 nt, Mus musculus
acagagcaguggucuucaaaaucaugaaagaauucauacuggagag

SEQ ID NO: 107355 - RNA, 46 nt, Mus musculus
cuguugcagcagucuucaaaaacaugaaaaagaucauacuagagau

SEQ ID NO: 107356 - RNA, 46 nt, Mus musculus
ggaagaauacaauauugaagaauauugucaaaauucuagaauacau

SEQ ID NO: 107357 - RNA, 46 nt, Mus musculus
cuacaaagauguuauccuggagaccuacaggaaccucacugcuaua

SEQ ID NO: 107358 - RNA, 87 nt, Mus musculus
auuaugcuuucuguuguacaugugugggauauuuuaggaugcagugaccuaugaugaugugcacauaaacuucacucaggaagaaug

SEQ ID NO: 107359 - RNA, 46 nt, Mus musculus
ucuaaaauguacucaguauuacuaaucucuuuguuuaaugacaggg

SEQ ID NO: 107360 - RNA, 42 nt, Mus musculus
uucugaguacuauaguuaaaugcaugagacaggccugcuugc

SEQ ID NO: 107361 - RNA, 46 nt, Mus musculus
ugugacacuucacauuucugugaaaugaauagugagaccuucagag

SEQ ID NO: 107362 - RNA, 46 nt, Mus musculus
aaauacugacaauugaacugauuuccuuuauaagaccagcaaguaa

SEQ ID NO: 107363 - RNA, 46 nt, Mus musculus
guguugagcuucaucuacaucuuaaaauuugaacuuggacagaggg

SEQ ID NO: 107364 - RNA, 90 nt, Mus musculus
cuauaccuuuaacaugcacuguauugcuaaauaacauaagauagagaagaaguauuggcuuuucauugauaagccauuugcuagccagau

SEQ ID NO: 107365 - RNA, 46 nt, Mus musculus
aauguauuugaacacuugucucucauugguuguugucuuuggagug

SEQ ID NO: 107366 - RNA, 48 nt, Mus musculus
aaguuuaacacguguauguuuugaugaucaaaagcacauaguaaccug

SEQ ID NO: 107367 - RNA, 46 nt, Mus musculus
gccuuugucaaaucuuucuucuauuuucaaaugggaauguguagua

SEQ ID NO: 107368 - RNA, 46 nt, Mus musculus
auaccuaggaaaagggaguuucuagaguaguacagagaguggaggu

SEQ ID NO: 107369 - RNA, 41 nt, Mus musculus
cuuugagacauuuuguugauugaugauugguaugggaagga

SEQ ID NO: 107370 - RNA, 69 nt, Mus musculus
gguuuaggauucucaguuuuaggaccuggaggaggaggaaggagaacagagaagcuccaugcugggaga

SEQ ID NO: 107371 - RNA, 49 nt, Mus musculus
gagagagagagagaguauauauacucuuucuuuaaguaaaaaugccagc

SEQ ID NO: 107372 - RNA, 48 nt, Mus musculus
accuggaggaggaggaaggagaacagagaagcuccaugcugggagagu

SEQ ID NO: 107373 - RNA, 42 nt, Mus musculus
acucaugcuuuuagucccagaacucaggaggcugaggcaggc

SEQ ID NO: 107374 - RNA, 42 nt, Mus musculus
cacacacacacacacacacacacacacaacauagucacagag

SEQ ID NO: 107375 - RNA, 45 nt, Mus musculus
gagagauucugagaaggccugccagaaagaaacaccaguggaagg

SEQ ID NO: 107376 - RNA, 46 nt, Mus musculus
auuucuguucucuuuccucugcucuccuacucaugaugccccuucu

SEQ ID NO: 107377 - RNA, 47 nt, Mus musculus
auaucccccacugcaaggugucuuagcuagagucgccccaaaacauu

SEQ ID NO: 107378 - RNA, 41 nt, Mus musculus
agucccuguccucuuuggguccuucaauccuucccacaacu

SEQ ID NO: 107379 - RNA, 42 nt, Mus musculus
ucccucuuugguuggugguucagucucuggaagccccaaaga

SEQ ID NO: 107380 - RNA, 46 nt, Mus musculus
aaacaaagcaaaugaaaaucccaaagaaaacaauauccaagcuaga

SEQ ID NO: 107381 - RNA, 46 nt, Mus musculus
ccuuuggaauguuuguuuccaggcugauacuauccucacaagucag

SEQ ID NO: 107382 - RNA, 45 nt, Mus musculus
guguccucuccugucuuuaugaccugaauuuugaauuccagccag

SEQ ID NO: 107383 - RNA, 46 nt, Mus musculus
gcuccccaugcuaacugauucagucuggauucucucuuggccucug

SEQ ID NO: 107384 - RNA, 45 nt, Mus musculus
auggcugaccuauucuggaaaggauuagaaguuguggccuuuuug

SEQ ID NO: 107385 - RNA, 42 nt, Mus musculus
uucuuacagccauagaaaguaacuaacauaaccaucaucuag

SEQ ID NO: 107386 - RNA, 46 nt, Mus musculus
ugcauauauauuaugcauuuauauucuaguuuuaaaauaaagggga

SEQ ID NO: 107387 - RNA, 45 nt, Mus musculus
accauuauuauguacauucuguaucaucauaaauauucuauuuag

SEQ ID NO: 107388 - RNA, 45 nt, Mus musculus
gagggcuuacauuaagauaauuagcuagcuguuaacaguaggcag

SEQ ID NO: 107389 - RNA, 46 nt, Mus musculus
guguucaugcuaaagcauuuucagacaauguguaaaucagggucag

SEQ ID NO: 107390 - RNA, 44 nt, Mus musculus
gggagucaccacaacaugaggaacucuauuaaagaaagggucac

SEQ ID NO: 107391 - RNA, 46 nt, Mus musculus
aaaucauuaaaaugucacuuaucagucacacauccccucacucuau

SEQ ID NO: 107392 - RNA, 41 nt, Mus musculus
auucucugucaccaccuccagucucaccauaagggccccag

SEQ ID NO: 107393 - RNA, 46 nt, Mus musculus
guuacucuacucuagaucuucugaggaagaugcuaaaggcccucag

SEQ ID NO: 107394 - RNA, 46 nt, Mus musculus
uuaggauuccaaauagaagucaacauguguauuuuucaaggaguuu

SEQ ID NO: 107395 - RNA, 46 nt, Mus musculus
aaucauccuaaauuauguaaacucucagacaagagaaaugccugaa

SEQ ID NO: 107396 - RNA, 41 nt, Mus musculus
cuggucucccagaagugcugacacagacuuacaggccccca

SEQ ID NO: 107397 - RNA, 42 nt, Mus musculus
uagaaacaaaagaagauaccacaaagggagacagcucuggag

SEQ ID NO: 107398 - RNA, 46 nt, Mus musculus
augauuccauaaauccaguccuccaaaggaugauaaaucccagaag

SEQ ID NO: 107399 - RNA, 46 nt, Mus musculus
aagaacucaagauguuagacuccugauaaccguucagaauggcuaa

SEQ ID NO: 107400 - RNA, 46 nt, Mus musculus
ugaaguucuuaggcaaaugaauggaacuaguaaauauuauccugag

SEQ ID NO: 107401 - RNA, 46 nt, Mus musculus
auacagagacaauguuuggagcagaaacugaaggaaacgccaucca

SEQ ID NO: 107402 - RNA, 77 nt, Mus musculus
acauauguaacagagaauggacuugugggacaucaaggagaggagaggcccuugugcuugugaugggccccagugua

SEQ ID NO: 107403 - RNA, 42 nt, Mus musculus
uucaacuauuaauaguaaagacauaaugaauuuugcaggcaa

SEQ ID NO: 107404 - RNA, 48 nt, Mus musculus
aaccugacuuagaacagagaauaaaauagucauaggagcaaaauggaa

SEQ ID NO: 107405 - RNA, 42 nt, Mus musculus
ucccaggucugcugauagaggcuaaaauaaucaccugaggaa

SEQ ID NO: 107406 - RNA, 45 nt, Mus musculus
gagacacugaaacuuauagaggagaaaguggggaaaagcccugaa

SEQ ID NO: 107407 - RNA, 77 nt, Mus musculus
aauagacauuaggauuugauuuagggagggaaauuugugggagauggagagggaacuaagguggggagcaagaguag

SEQ ID NO: 107408 - RNA, 42 nt, Mus musculus
ggggcucuuaggaaucuauaggggugagucaacuagcagcag

SEQ ID NO: 107409 - RNA, 47 nt, Mus musculus
agacaggagccuaggauaacacuuccaagaggcuucauccagcagag

SEQ ID NO: 107410 - RNA, 41 nt, Mus musculus
cacaaacacacacacacacacuaaaaagaauuaaagacaag

SEQ ID NO: 107411 - RNA, 46 nt, Mus musculus
accucaguuuuauucuucuagcugagcuacuuuuucuguccucaga

SEQ ID NO: 107412 - RNA, 46 nt, Mus musculus
uuucagcauaaagagauguauuccauauggaaaaagcauguggcau

SEQ ID NO: 107413 - RNA, 46 nt, Mus musculus
gauuaagcauagcuguuaucuuacccggggcugcugggaggcuuca

SEQ ID NO: 107414 - RNA, 45 nt, Mus musculus
ggaagcuugacugggcagagaaacauaaugguauaagacuggaaa

SEQ ID NO: 107415 - RNA, 46 nt, Mus musculus
augauugguaaaacucaauugguaaaacacuugcccuggaaaccug

SEQ ID NO: 107416 - RNA, 46 nt, Mus musculus
cugagaauuagugugcuccaagagaguaaaucaaacauaccauggg

SEQ ID NO: 107417 - RNA, 46 nt, Mus musculus
gucuucaaaguuuuaguguaacauaaaaauaaaaugauguaguuua

SEQ ID NO: 107418 - RNA, 46 nt, Mus musculus
uccugggugccugggcaaagcacugucaguuuugacucugcacuag

SEQ ID NO: 107419 - RNA, 47 nt, Mus musculus
cuaugaucuaaauaaccgcacaggauuaguaucuuguaagaaaccag

SEQ ID NO: 107420 - RNA, 42 nt, Mus musculus
guuuccuuugguuaugcaagcacccacagcccuggcaugcag

SEQ ID NO: 107421 - RNA, 45 nt, Mus musculus
caaggcuccaacuacacauccugugccaccaaguuacaccuccag

SEQ ID NO: 107422 - RNA, 45 nt, Mus musculus
uaaccaaaggguccuacauuaagccucaacuaucagcacaggcua

SEQ ID NO: 107423 - RNA, 45 nt, Mus musculus
cugggucuaacuagacucuucacccuacuaaccagaguucauaag

SEQ ID NO: 107424 - RNA, 75 nt, Mus musculus
guugugagacuuuuuuuuuuuuaguauagaauggagcuuauguaggucauggggaggggaguuaagaggguagca

SEQ ID NO: 107425 - RNA, 54 nt, Mus musculus
aggagaaaguagagacauaggggcuggccauggucacauggagagagaggggaa

SEQ ID NO: 107426 - RNA, 44 nt, Mus musculus
uucuagaaugucuuuaauuucuuuauuucuuccuugacccagag

SEQ ID NO: 107427 - RNA, 46 nt, Mus musculus
uaguuuuauuauuucuccauuuaguuuuugucuggaugaccuguag

SEQ ID NO: 107428 - RNA, 43 nt, Mus musculus
ccuccacuggccaucagacaaaccuggaacacuugaaggagca

SEQ ID NO: 107429 - RNA, 43 nt, Mus musculus
aguucaucacuaucugcauccauuaaacugugucuuuggcagu

SEQ ID NO: 107430 - RNA, 52 nt, Mus musculus
aaugaauauacaaugucaguuucugaccucaucucagauaaauaggaggggg

SEQ ID NO: 107431 - RNA, 46 nt, Mus musculus
cuuucuucucuugauguuggcacucagaccuggcucacucacauag

SEQ ID NO: 107432 - RNA, 45 nt, Mus musculus
uucucauccacuggcagcugcgugcuccuccggaugggcagguag

SEQ ID NO: 107433 - RNA, 46 nt, Mus musculus
ccuugucuuuuuugauaacuuuugguuaaaaauugauuuuauucag

SEQ ID NO: 107434 - RNA, 46 nt, Mus musculus
auuaaaaguaauuguuacauccuguuauuuuuguuguuggaggugg

SEQ ID NO: 107435 - RNA, 58 nt, Mus musculus
augugauuuuaaaucagagacuugcuuuugugguguguugggguauccagggcucgcu

SEQ ID NO: 107436 - RNA, 42 nt, Mus musculus
cuuuugcccuugccucuugacaucugguuaucucuggcgcua

SEQ ID NO: 107437 - RNA, 46 nt, Mus musculus
cuauggaugauugauaggauauagguuuucccucaagaugauugcc

SEQ ID NO: 107438 - RNA, 42 nt, Mus musculus
uuaaccgauugugggcuuguccuuuggacgagugacaggguu

SEQ ID NO: 107439 - RNA, 41 nt, Mus musculus
uugacaggcuguuggcauugccuaugaaugauugacaggcu

SEQ ID NO: 107440 - RNA, 41 nt, Mus musculus
cuugacagggaagaggaacauaaagauauaagaauaggaag

SEQ ID NO: 107441 - RNA, 46 nt, Mus musculus
acaaaugccauugcuguguguggacagccucagcagcugcuccaau

SEQ ID NO: 107442 - RNA, 46 nt, Mus musculus
agucagaauacccaaaauacaauuugcaaaacacgugaaccucaag

SEQ ID NO: 107443 - RNA, 63 nt, Mus musculus
gauucuaugaccugguauaggggaaugccagggccaggaaguggcagugaauggguuggggag

SEQ ID NO: 107444 - RNA, 46 nt, Mus musculus
caugcauugcacacagucaaaacugcucacaucacaccucacccag

SEQ ID NO: 107445 - RNA, 85 nt, Mus musculus
uaugcuguucuagcuggacugcccugacuggacucagugggaguggaagcaccuagccuccagagauuucauauuccagggcugg

SEQ ID NO: 107446 - RNA, 42 nt, Mus musculus
caaggggaggguaagaaggggcaaggauugugggagagacug

SEQ ID NO: 107447 - RNA, 46 nt, Mus musculus; identical to SEQ ID NO: 107381

SEQ ID NO: 107448 - RNA, 46 nt, Mus musculus
agauucagaacugucagaaggacauggggaaggaauuuuaccaaua

SEQ ID NO: 107449 - RNA, 46 nt, Mus musculus
aaguaguuggcucaacaucagcaggagccccauugacagcagcaca

SEQ ID NO: 107450 - RNA, 45 nt, Mus musculus; identical to SEQ ID NO: 107382

SEQ ID NO: 107451 - RNA, 46 nt, Mus musculus
gcuccccaugcuaacugauucagccuggauucucucuuggccucug

SEQ ID NO: 107452 - RNA, 45 nt, Mus musculus; identical to SEQ ID NO: 107384

SEQ ID NO: 107453 - RNA, 42 nt, Mus musculus
uucuuacagccauagaaaguaacuaacauaaccauuaucuag

SEQ ID NO: 107454 - RNA, 49 nt, Mus musculus
ucucucucucuuguguguuucuguauguguguuugugugugugugugug

SEQ ID NO: 107455 - RNA, 47 nt, Mus musculus
uguauauauauuaugcauuuauauucuaguuuuaaaauaaagggaag

SEQ ID NO: 107456 - RNA, 45 nt, Mus musculus
accauuauuauguacauucuguaucaucauaaaaauucuauuuag

SEQ ID NO: 107457 - RNA, 42 nt, Mus musculus
gcauuacauuaagauaauuaguuagcuguuaacaguaggcag

SEQ ID NO: 107458 - RNA, 44 nt, Mus musculus; identical to SEQ ID NO: 107390

SEQ ID NO: 107459 - RNA, 46 nt, Mus musculus
aaaucauuaaaaugucacuuaucagucacacauccccucacucuag

SEQ ID NO: 107460 - RNA, 42 nt, Mus musculus
gauucucugacaccaccuccagucucaccauaagggccccag

SEQ ID NO: 107461 - RNA, 46 nt, Mus musculus; identical to SEQ ID NO: 107393

SEQ ID NO: 107462 - RNA, 46 nt, Mus musculus; identical to SEQ ID NO: 107394

SEQ ID NO: 107463 - RNA, 46 nt, Mus musculus; identical to SEQ ID NO: 107395

SEQ ID NO: 107464 - RNA, 45 nt, Mus musculus
cgaucagacucauuguuaguaucaauuucuaugagaccaaucuag

SEQ ID NO: 107465 - RNA, 41 nt, Mus musculus; identical to SEQ ID NO: 107396

SEQ ID NO: 107466 - RNA, 42 nt, Mus musculus; identical to SEQ ID NO: 107397

SEQ ID NO: 107467 - RNA, 46 nt, Mus musculus; identical to SEQ ID NO: 107398

SEQ ID NO: 107468 - RNA, 46 nt, Mus musculus; identical to SEQ ID NO: 107399

SEQ ID NO: 107469 - RNA, 46 nt, Mus musculus; identical to SEQ ID NO: 107400

SEQ ID NO: 107470 - RNA, 46 nt, Mus musculus; identical to SEQ ID NO: 107401

SEQ ID NO: 107471 - RNA, 77 nt, Mus musculus; identical to SEQ ID NO: 107402

SEQ ID NO: 107472 - RNA, 42 nt, Mus musculus; identical to SEQ ID NO: 107403

SEQ ID NO: 107473 - RNA, 48 nt, Mus musculus; identical to SEQ ID NO: 107404

SEQ ID NO: 107474 - RNA, 46 nt, Mus musculus; identical to SEQ ID NO: 107394

SEQ ID NO: 107475 - RNA, 46 nt, Mus musculus; identical to SEQ ID NO: 107395

SEQ ID NO: 107476 - RNA, 42 nt, Mus musculus
cuggucucccagaagugcugacacagacuuacaggcccacag

SEQ ID NO: 107477 - RNA, 46 nt, Mus musculus
aaagaggucaggaguuauagaugcaagcaucaccaacaaaauacaa

SEQ ID NO: 107478 - RNA, 75 nt, Mus musculus
agacuccugagaaccuuucagaauggcuaagaucagaaacucaggggagagcaguuguuggugaggaugugaaga

SEQ ID NO: 107479 - RNA, 59 nt, Mus musculus
acauauguaacagagaauggacuugugggacaucaaggagaggagaggcccuugggcuu

SEQ ID NO: 107480 - RNA, 66 nt, Mus musculus
gugaugggccccaguguaggggaaugccaggacagggaagcaguagucgguggguuagugggcagg

SEQ ID NO: 107481 - RNA, 42 nt, Mus musculus
uucaacuauuaauaguaaagacauaaugaauuuugcaggcag

SEQ ID NO: 107482 - RNA, 48 nt, Mus musculus; identical to SEQ ID NO: 107404

SEQ ID NO: 107483 - RNA, 46 nt, Mus musculus
cacaggggagaugaccugauguccaugagaaugaagggauauccgc

SEQ ID NO: 107484 - RNA, 77 nt, Mus musculus; identical to SEQ ID NO: 107407

SEQ ID NO: 107485 - RNA, 42 nt, Mus musculus; identical to SEQ ID NO: 107408

SEQ ID NO: 107486 - RNA, 47 nt, Mus musculus; identical to SEQ ID NO: 107409

SEQ ID NO: 107487 - RNA, 41 nt, Mus musculus; identical to SEQ ID NO: 107410

SEQ ID NO: 107488 - RNA, 46 nt, Mus musculus; identical to SEQ ID NO: 107411

SEQ ID NO: 107489 - RNA, 46 nt, Mus musculus; identical to SEQ ID NO: 107412

SEQ ID NO: 107490 - RNA, 46 nt, Mus musculus; identical to SEQ ID NO: 107413

SEQ ID NO: 107491 - RNA, 45 nt, Mus musculus; identical to SEQ ID NO: 107414

SEQ ID NO: 107492 - RNA, 46 nt, Mus musculus
cugagaaucagugugcuccaagagaguaaaucaaacauaccauggg

SEQ ID NO: 107493 - RNA, 46 nt, Mus musculus; identical to SEQ ID NO: 107417

SEQ ID NO: 107494 - RNA, 46 nt, Mus musculus; identical to SEQ ID NO: 105685

SEQ ID NO: 107495 - RNA, 47 nt, Mus musculus
gacaugguuucauuucaucaugguuucauucauucauucuacuaggg

SEQ ID NO: 107496 - RNA, 43 nt, Mus musculus
gaaugaaugaaaccaugaugaaaugaaaccaugucugcuucag

SEQ ID NO: 107497 - RNA, 46 nt, Mus musculus
uccauagauaugacgugaauggaaaacuauauuuaaugcaggagac

SEQ ID NO: 107498 - RNA, 45 nt, Mus musculus
aucucuuauuucuuccaccucugacucuuuaaagagcacucuuag

SEQ ID NO: 107499 - RNA, 41 nt, Mus musculus; identical to SEQ ID NO: 105690

SEQ ID NO: 107500 - RNA, 46 nt, Mus musculus
uaaaaaaaggcuugaugaagucuugcaaacugaucacuacaaccag

SEQ ID NO: 107501 - RNA, 49 nt, Mus musculus
ucugggaggcuaacaccauggauuauaauucucugacagaagaucuggu

SEQ ID NO: 107502 - RNA, 41 nt, Mus musculus
ucuucugucagagaauuauaauccaugguguuagccuccca

SEQ ID NO: 107503 - RNA, 91 nt, Mus musculus
aauaucccauucuuucugauaaauggcauuaauuuacugaaggaaaaaaaagaguguuuuaauggauggauuuauugaaacaacagugaga

SEQ ID NO: 107504 - RNA, 46 nt, Mus musculus
aacaauagauuauucuucuacauaaguaaaaaucacaucaguaauu

SEQ ID NO: 107505 - RNA, 46 nt, Mus musculus
uuguuaaucaacaaugugauccaaaggaaaggaaauuggcauuucu

SEQ ID NO: 107506 - RNA, 73 nt, Mus musculus
aaugggguccccuuagaaccuuaaaaauacuauauucugggauuacuuuaucucuguuugauuuagggugugg

SEQ ID NO: 107507 - RNA, 45 nt, Mus musculus
uaaauggaacuagugcauuaagacacuugggacuaaagcguaacu

SEQ ID NO: 107508 - RNA, 42 nt, Mus musculus
cauuaccugcuucagagguuaguuuucacaucuaagacagug

SEQ ID NO: 107509 - RNA, 46 nt, Mus musculus
caugaagaugggguugaggacaugaagcagcaagguagucguagau

SEQ ID NO: 107510 - RNA, 46 nt, Mus musculus; identical to SEQ ID NO: 105699

SEQ ID NO: 107511 - RNA, 46 nt, Mus musculus
augaaauucugaguagauuaaaggaauuaacauauaguguacagac

SEQ ID NO: 107512 - RNA, 42 nt, Mus musculus
gcugccugggguugaaccugaccccacuucuuaccuccagaa

SEQ ID NO: 107513 - RNA, 46 nt, Mus musculus
uucaaccccaggcagcaugcucaggcccucaugcuuauguucuaag

SEQ ID NO: 107514 - RNA, 46 nt, Mus musculus
uucuccacacaaagagagaagacagaacaaugaaguuccacagaga

SEQ ID NO: 107515 - RNA, 45 nt, Mus musculus
guccuggcgcuguuagucaaguuaccacacagguaagagccucag

SEQ ID NO: 107516 - RNA, 46 nt, Mus musculus
aaauagucccucuuucaaaaacauaacaaacaaaaagaggucagau

SEQ ID NO: 107517 - RNA, 46 nt, Mus musculus
uguuauguuuuugaaagagggacuauuuacuccuggaacuauguag

SEQ ID NO: 107518 - RNA, 44 nt, Mus musculus
agcacauucgguguuccuuugaggguccaauuccucauccauaa

SEQ ID NO: 107519 - RNA, 42 nt, Mus musculus; identical to SEQ ID NO: 105705

SEQ ID NO: 107520 - RNA, 42 nt, Mus musculus
auuaaggaauuaauuuaaaagacaaagcuccaccaggcuuga

SEQ ID NO: 107521 - RNA, 45 nt, Mus musculus
acuuugggcgcugcggcagucugcguggagucgccgccuggggac

SEQ ID NO: 107522 - RNA, 45 nt, Mus musculus
ucauggacgcgggcgggcccggccugcuuuucagggccuccguuu

SEQ ID NO: 107523 - RNA, 41 nt, Mus musculus
gcaaggcgggccgcuucgggcgggcuggggaaugcggagug

SEQ ID NO: 107524 - RNA, 44 nt, Mus musculus
caggaagaaacgagcccuuuccuccucagugcccgucaccgcca

SEQ ID NO: 107525 - RNA, 42 nt, Mus musculus
uguacccagagcuauuuggagcgguuugggaagugcacgggg

SEQ ID NO: 107526 - RNA, 45 nt, Mus musculus
aaauauguagaccauagccucaaacucagaaaaaugccugccccu

SEQ ID NO: 107527 - RNA, 42 nt, Mus musculus
auccugggccuugugaauguuaugcaccugcuacauccccag

SEQ ID NO: 107528 - RNA, 45 nt, Mus musculus
agaggcugagaaucaagccaacacugaguugacggccugccagga

SEQ ID NO: 107529 - RNA, 45 nt, Mus musculus
gucuccuggcaggccgucaacucaguguuggcuugauucucagcc

SEQ ID NO: 107530 - RNA, 46 nt, Mus musculus
aagcagcugggguuuggguccugcugccaucaggggccgggcagaa

SEQ ID NO: 107531 - RNA, 47 nt, Mus musculus
acgagucugaagacccgaguucaaucccugaaacccacauaaagaua

SEQ ID NO: 107532 - RNA, 42 nt, Mus musculus
uacauauaauaaauaaaucuuuaaaaaagaagaagaagaagu

SEQ ID NO: 107533 - RNA, 45 nt, Mus musculus
uuuacccuagguccaaguacaugagcagaaaguuacgugaucgau

SEQ ID NO: 107534 - RNA, 42 nt, Mus musculus
cccuuguuucauuguccuuaggcaccagcccugagcccccag

SEQ ID NO: 107535 - RNA, 46 nt, Mus musculus
cuguaccucaccuccguuacccucucuuguccugcucccaccccag

SEQ ID NO: 107536 - RNA, 41 nt, Mus musculus
ugaacgggcugccuacuccauucucuaucccaucccccaga

SEQ ID NO: 107537 - RNA, 42 nt, Mus musculus
ccaagugcagagaaugugaagccuucauggucagcgggacag

SEQ ID NO: 107538 - RNA, 45 nt, Mus musculus
uucccugaggagguucccuuugugauuaccagaugcacagcugag

SEQ ID NO: 107539 - RNA, 45 nt, Mus musculus
ucccagggucguccccagggucugcaugcagggucuuugccagag

SEQ ID NO: 107540 - RNA, 45 nt, Mus musculus
auggacaguguuaaaguuaggugugggcauccacaguucagaguu

SEQ ID NO: 107541 - RNA, 45 nt, Mus musculus
gccuugaauccaguccccagcacccagccucacuucuugcccaag

SEQ ID NO: 107542 - RNA, 46 nt, Mus musculus
agagagagagagagagagagagagagagaaagagagagagcgagag

SEQ ID NO: 107543 - RNA, 46 nt, Mus musculus
gauuuaaacagcuaggcaacacaggugcagguguuucggggucaag

SEQ ID NO: 107544 - RNA, 41 nt, Mus musculus
cuuugugagccacaaauccucugccucccaagugcuggcua

SEQ ID NO: 107545 - RNA, 42 nt, Mus musculus
aauuucuuuagcaaccuuagagauguaacuugagagcugaca

SEQ ID NO: 107546 - RNA, 42 nt, Mus musculus
aaacccugucuccaaacaccaaaauaaaauaaaugaauagau

SEQ ID NO: 107547 - RNA, 41 nt, Mus musculus
cagggaaacccugucucgaaaaaccaaaaaaaaaagaccag

SEQ ID NO: 107548 - RNA, 46 nt, Mus musculus
cguguggcucuguggcagaaugcuaggcaacaagcaagagccccag

SEQ ID NO: 107549 - RNA, 44 nt, Mus musculus
uuuuggguucaaucuccuuagaaaagcccagauguuugggagaa

SEQ ID NO: 107550 - RNA, 42 nt, Mus musculus
acucaccagguagacgagcacacacaugugcuccuugggcag

SEQ ID NO: 107551 - RNA, 42 nt, Mus musculus
ggagggugguugcucauaccaaugccagcccacugcacgcau

SEQ ID NO: 107552 - RNA, 46 nt, Mus musculus
auaguauauuuauacacauaaaacacuuauauccagggcuggagag

SEQ ID NO: 107553 - RNA, 46 nt, Mus musculus
gaaguagaauaccaaagaggcuugaaaugggcagagcuagccucag

SEQ ID NO: 107554 - RNA, 46 nt, Mus musculus
ugaguccacuguugcucucuucagacacaccaguagaaggcaucag

SEQ ID NO: 107555 - RNA, 45 nt, Mus musculus
auaccuuucuuucugagccaaaggugucugcugauagacauccac

SEQ ID NO: 107556 - RNA, 42 nt, Mus musculus
auagacugcaccacuagaugcugggaauugaaccuaggcccu

SEQ ID NO: 107557 - RNA, 45 nt, Mus musculus
aauccagugggauugcuugagguuuccuuuuggacuuguuguuuu

SEQ ID NO: 107558 - RNA, 32 nt, Mus musculus
uuuguuguugucacuguuguugcugucuuuac

SEQ ID NO: 107559 - RNA, 42 nt, Mus musculus
gcuucugucccuaggauauuaaaaauaugugucgggcuggag

SEQ ID NO: 107560 - RNA, 45 nt, Mus musculus
ucaaaucccagccaccacaugguggcucacaaccauccguaauga

SEQ ID NO: 107561 - RNA, 41 nt, Mus musculus
ccugcaggcaaugaacgcacaagcggaucuugggcgggcua

SEQ ID NO: 107562 - RNA, 43 nt, Mus musculus
agagguguaggaucagagaugcagagacucagagguagaggaa

SEQ ID NO: 107563 - RNA, 67 nt, Mus musculus
ugcacucagagacacagagaugcagagacacagagauagagacgcagagauagaaacucauaaauag

SEQ ID NO: 107564 - RNA, 46 nt, Mus musculus
uggguuccaaggcagccagggcuacauggugagaccuugucuagaa

SEQ ID NO: 107565 - RNA, 46 nt, Mus musculus
gaaccuggagcagccugggggcggagccaggugguagagucccgug

SEQ ID NO: 107566 - RNA, 42 nt, Mus musculus
aaguugacuuuugaggacaccaccgacuuuuuuggccgugua

SEQ ID NO: 107567 - RNA, 46 nt, Mus musculus
uuuauuuaaguaugaauguuuuguauguaugucugucuaccgugug

SEQ ID NO: 107568 - RNA, 44 nt, Mus musculus
uacccauuaaaaauuauuuacaaagggucuuacuuguugguguu

SEQ ID NO: 107569 - RNA, 46 nt, Mus musculus
cuuuaaucccaacauuggugaaccagaggcagguagauuucuguag

SEQ ID NO: 107570 - RNA, 42 nt, Mus musculus
aagugcucugacguaacacagguuauuuauagagcagguggg

SEQ ID NO: 107571 - RNA, 35 nt, Mus musculus
acuuuagauaccugcucucagaaggccgaggcaga

SEQ ID NO: 107572 - RNA, 26 nt, Mus musculus
uggggagggggacagagagggagugg

SEQ ID NO: 107573 - RNA, 83 nt, Mus musculus
cauuucuucuaggcucugcccaacagccaacagccagguauaggcaugugugugugugugugugugugugugugugugugugu

SEQ ID NO: 107574 - RNA, 46 nt, Mus musculus
agacaccaaaacaggaaaaauaggagaaagcuggauuacaaaaggc

SEQ ID NO: 107575 - RNA, 46 nt, Mus musculus
aucaaaaagcaugucacaaggcuagcuuggcguuuggaaagcagag

SEQ ID NO: 107576 - RNA, 42 nt, Mus musculus
gaggucauuaggccaccuccaaccaaacacuaguacccccag

SEQ ID NO: 107577 - RNA, 42 nt, Mus musculus
gacucaacagagaagcauaccuacccggcuccaggcccagcu

SEQ ID NO: 107578 - RNA, 46 nt, Mus musculus
ugcaguggcuuaugagccauagugugggugggaaugugggccccau

SEQ ID NO: 107579 - RNA, 46 nt, Mus musculus
ugguugugagccaccauguguuugcugggauuugaacucgggaccu

SEQ ID NO: 107580 - RNA, 46 nt, Mus musculus
ucaaaucccagcaaacacaugguggcucacaaccaccuguaaugag

SEQ ID NO: 107581 - RNA, 42 nt, Mus musculus
cugccaggcgcaacaggcacagcgccaccaacacccagaggc

SEQ ID NO: 107582 - RNA, 41 nt, Mus musculus
uggagcagcugcgcaaggaggcuggccgcauugaggcccgu

SEQ ID NO: 107583 - RNA, 41 nt, Mus musculus
cugcaguaccugaccccgcucauccucacucugcacugcac

SEQ ID NO: 107584 - RNA, 47 nt, Mus musculus
uccugcagggucuacagggaucaaagccucugagggcugggaugggg

SEQ ID NO: 107585 - RNA, 42 nt, Mus musculus
gaggcuuugaucccuguagacccugcaggagaugaggcccag

SEQ ID NO: 107586 - RNA, 45 nt, Mus musculus
caggcagcuguccaccagaugauguaagccagcaugccucugagg

SEQ ID NO: 107587 - RNA, 45 nt, Mus musculus
aauccuggugggcaggaaucagacacuagagccuagugccuuccu

SEQ ID NO: 107588 - RNA, 46 nt, Mus musculus
gguugguguggggacucccuaccaucucucucacuucagugccuag

SEQ ID NO: 107589 - RNA, 78 nt, Mus musculus
cacguuuuacagaaauaucccagagacugggggaugagcaggggagaccuggauagugagaggggccugggagagagu

SEQ ID NO: 107590 - RNA, 69 nt, Mus musculus
aggguuagccuagacuaguaacaagacuauguaaaacaagaagaaaaagggggccgggggaagcuugaa

SEQ ID NO: 107591 - RNA, 42 nt, Mus musculus
ucccaaccccucagccugcaccccgcagcuccugggccccgc

SEQ ID NO: 107592 - RNA, 42 nt, Mus musculus
uccuaguccccaccaugugaacagggaacaggaccgggagaa

SEQ ID NO: 107593 - RNA, 48 nt, Mus musculus
gcuuuguaguggggucgaucuggaauacgugcgcccgggugcugaaga

SEQ ID NO: 107594 - RNA, 46 nt, Mus musculus
cuuagcaacuuuaaguagacagcccuauuccacucgcaggcagaug

SEQ ID NO: 107595 - RNA, 46 nt, Mus musculus
aacuggaggcuucgcauuuugaugaaaagaaagagaucaacaagcg

SEQ ID NO: 107596 - RNA, 42 nt, Mus musculus
agugcgaagggagugcgaaauaguaaguguggccagccuguc

SEQ ID NO: 107597 - RNA, 46 nt, Mus musculus
ccgugcagguggucaucaaccacaacaccccugggcuucccaagau

SEQ ID NO: 107598 - RNA, 72 nt, Mus musculus
caaaccuuuucucaccuauggcacagaaagagcgcuuugcggcccuggccaaauucaaguccagcaucuauc

SEQ ID NO: 107599 - RNA, 46 nt, Mus musculus
cuguuaacugggcauaguggucugucacucaggaggugaggcagga

SEQ ID NO: 107600 - RNA, 41 nt, Mus musculus
caacuuccccacaguggcacugcacuccaugaugaagcagg

SEQ ID NO: 107601 - RNA, 49 nt, Mus musculus
gcugcuggagcaggguugcaccgacuucaccacagaccuggagaccauc

SEQ ID NO: 107602 - RNA, 48 nt, Mus musculus
ugcgcaguuccaacacuuucaacaugaagaaaauccaauuccugguga

SEQ ID NO: 107603 - RNA, 46 nt, Mus musculus
cuagguucucugcccgggucuggagcauggcgggguucgcugagau

SEQ ID NO: 107604 - RNA, 46 nt, Mus musculus
aggagaucuccaagacaaggauggcuauggaccccuggaaguggag

SEQ ID NO: 107605 - RNA, 45 nt, Mus musculus
uaggaauuaucagugaucuaggaggggcagagauaugcuuucuaa

SEQ ID NO: 107606 - RNA, 46 nt, Mus musculus
ugaagugugccaaaaugggguagugcagguagggcuaggggcuugc

SEQ ID NO: 107607 - RNA, 46 nt, Mus musculus
ggaugugugugugugaaugggugugggggggugaguggggguguga

SEQ ID NO: 107608 - RNA, 44 nt, Mus musculus
gcuagggguggugccuaccaucgcuugcaugggcugguggccaa

SEQ ID NO: 107609 - RNA, 44 nt, Mus musculus
ggaccugacaggagaggguuguggcucagugggguggguagggc

SEQ ID NO: 107610 - RNA, 46 nt, Mus musculus
aaggaaggggcagggucuggcgagugggugagucugccaagccaag

SEQ ID NO: 107611 - RNA, 43 nt, Mus musculus
agugagugacaaguggcuggugaggaugguagggaggagcugg

SEQ ID NO: 107612 - RNA, 46 nt, Mus musculus
ggugaagaagcagagagaugugguuuaauaauuuuuguuuugaaag

SEQ ID NO: 107613 - RNA, 42 nt, Mus musculus
ccagagcuacacaguaaaacccugucucaaaaaggagaggaa

SEQ ID NO: 107614 - RNA, 45 nt, Mus musculus
gugugugccacaccuucgggcauccugcuuucuuauagcacacag

SEQ ID NO: 107615 - RNA, 46 nt, Mus musculus
agcaugagugagcuuguguuuauggcucagacugcuguuugucuag

SEQ ID NO: 107616 - RNA, 46 nt, Mus musculus
ggacccuagucaguucugucuggaauggaagcggguccuuguggag

SEQ ID NO: 107617 - RNA, 103 nt, Mus musculus
cgguuccuguccaggggucugagagcggcggucggcuuugaggcgagcagcguuacggaggggcgcggcggcggcggcggcggcggcggcggcggcggcggcg

SEQ ID NO: 107618 - RNA, 46 nt, Mus musculus
ucagcuagaaggacagccugguaaggagugggaaauagaugccagg

SEQ ID NO: 107619 - RNA, 46 nt, Mus musculus
caccaccacuuuccgguugucugucugaagggaauauguccaggag

SEQ ID NO: 107620 - RNA, 42 nt, Mus musculus
acacccucauugcaggcaccucaguuccucccacuccugaag

SEQ ID NO: 107621 - RNA, 45 nt, Mus musculus
cauccaggccccuucccaggaccccaaucugcacuagcauaccag

SEQ ID NO: 107622 - RNA, 46 nt, Mus musculus
ucgugcacgaggugacccaggccuucgccgcugccucgcgggaggu

SEQ ID NO: 107623 - RNA, 46 nt, Mus musculus
ggguaaaaggaucugugacacugaagccugucuauuugggggaguu

SEQ ID NO: 107624 - RNA, 46 nt, Mus musculus
ccuccacaucugcuuuuugccuggugcacugggaaauaguuaagaa

SEQ ID NO: 107625 - RNA, 46 nt, Mus musculus
aaaagaaaaaauguguggcuuugaguggguagggaccuggggagaa

SEQ ID NO: 107626 - RNA, 52 nt, Mus musculus
uuuuuaauuagaaaagaaacaggcaaauaaaacaaaaccagaauaggaugag

SEQ ID NO: 107627 - RNA, 46 nt, Mus musculus
caugcacaggacccgugggggucuaagccagaaaagggccacagug

SEQ ID NO: 107628 - RNA, 46 nt, Mus musculus
gugugcugauauggaaaugcaguuacugaugacuguggauacugag

SEQ ID NO: 107629 - RNA, 43 nt, Mus musculus
ggcggugcggaaggugaaacgcguagcccugggcugcaccuaa

SEQ ID NO: 107630 - RNA, 46 nt, Mus musculus
ugagcagcacuagguccagcaugaugggcgcggccaggagcgaauc

SEQ ID NO: 107631 - RNA, 47 nt, Mus musculus
gacaucaaaaggcauggggacaggguagagaagggugaggaagagga

SEQ ID NO: 107632 - RNA, 41 nt, Mus musculus
uugugagcugccaugugggugcugggaauugaaccagaguc

SEQ ID NO: 107633 - RNA, 42 nt, Mus musculus
aauguagaauaauagcagggucugcaggaaagauggccagga

SEQ ID NO: 107634 - RNA, 23 nt, Mus musculus
cugugguuaugucuccugaugcu

SEQ ID NO: 107635 - RNA, 63 nt, Mus musculus
cugaaucaguaacuuucagaagagugggagucacacacugaguuggaaaacggguaggagcag

SEQ ID NO: 107636 - RNA, 26 nt, Mus musculus
ucugugcuggggggggggggggcgag

SEQ ID NO: 107637 - RNA, 44 nt, Mus musculus
ggcaccuucauccuccuccuccaucuucuaucugagccugagac

SEQ ID NO: 107638 - RNA, 46 nt, Mus musculus
cgugugaaccaucaccuggagcuguggauuuucuccaucuugagau

SEQ ID NO: 107639 - RNA, 46 nt, Mus musculus
cacuugaugcuggagcuggaagcugaacucagguccucuggaagag

SEQ ID NO: 107640 - RNA, 46 nt, Mus musculus
augccuggcaucacauccugucgcccauuuugggagauggaggcag

SEQ ID NO: 107641 - RNA, 41 nt, Mus musculus
uccucaaccuauuccuuuaaaauauuuuauuuguuuuugca

SEQ ID NO: 107642 - RNA, 45 nt, Mus musculus
uucugaggucugcagcacggggagggugacaggcugguggugggg

SEQ ID NO: 107643 - RNA, 45 nt, Mus musculus
gccauccaagaagugacucuacuaacuuguauuuccuugccagau

SEQ ID NO: 107644 - RNA, 35 nt, Mus musculus
uuaaacccaagauguaauucuauauagcccaagcu

SEQ ID NO: 107645 - RNA, 45 nt, Mus musculus
gauucauaacaauagcaaaauuacaguuaugaaguagcaaaagag

SEQ ID NO: 107646 - RNA, 25 nt, Mus musculus
ugguaagagccugcugccaguguua

SEQ ID NO: 107647 - RNA, 45 nt, Mus musculus
ccaaccaaccaaauaaacacccccacccccagaaugcuccaaugg

SEQ ID NO: 107648 - RNA, 41 nt, Mus musculus
ccgccuuuguccccggggucagcggguggggacaugccaga

SEQ ID NO: 107649 - RNA, 42 nt, Mus musculus
uccugguaaccuggaaaguccggggucacgcggccgggaguu

SEQ ID NO: 107650 - RNA, 42 nt, Mus musculus
acgccuccuagaaaccacaccccuagccaaccccgcccccag

SEQ ID NO: 107651 - RNA, 46 nt, Mus musculus
ugggaguaggcggagguacaugaccugggcccaguuguuuuaagga

SEQ ID NO: 107652 - RNA, 41 nt, Mus musculus
aacgcgccccucgacagagcagggggaaaccuggccuccuu

SEQ ID NO: 107653 - RNA, 25 nt, Mus musculus
gcuuuacacagagcagcugcaggug

SEQ ID NO: 107654 - RNA, 45 nt, Mus musculus
gccaccacaaccccccacuccccuacugugugugcagugggagag

SEQ ID NO: 107655 - RNA, 42 nt, Mus musculus
aaacacuugcugaacacgcagggguggggacacccagcacag

SEQ ID NO: 107656 - RNA, 46 nt, Mus musculus
gcuauggcccagcacagccuggaggcagcgauggcaagguccagcc

SEQ ID NO: 107657 - RNA, 46 nt, Mus musculus
ugaagcucuagcccacuuccugcagaggcuuccuggaaggguagga

SEQ ID NO: 107658 - RNA, 23 nt, Mus musculus
aagcagcacgggaggggcgggag

SEQ ID NO: 107659 - RNA, 45 nt, Mus musculus
uguugagagcugacuugaguucacaggacccacagaaugggagag

SEQ ID NO: 107660 - RNA, 41 nt, Mus musculus
ggcgaagguccugaggugcaaaggagcuccaaugggguaca

SEQ ID NO: 107661 - RNA, 81 nt, Mus musculus
agauagacgcacagaugagguccaguuugagaaacagagaggcaagaucuagagggaaguaaagaggggaggaagagaaag

SEQ ID NO: 107662 - RNA, 27 nt, Mus musculus
gcagcaugcugaagaaagacgcgcuga

SEQ ID NO: 107663 - RNA, 41 nt, Mus musculus
cuaccccgaccaguacgcaguuccucuacccgaagguggca

SEQ ID NO: 107664 - RNA, 42 nt, Mus musculus
ccccggggccacggagaccccggucuacgccaaccugagcag

SEQ ID NO: 107665 - RNA, 41 nt, Mus musculus
acggcgaccguggcgacugcgcuggcgaccgggccccagaa

SEQ ID NO: 107666 - RNA, 34 nt, Mus musculus
gcccauagcgagagucuguggcggaagccaucug

SEQ ID NO: 107667 - RNA, 46 nt, Mus musculus
caaggucaaaaccaucuaccgcaacgacaagaggaucaagcugcag

SEQ ID NO: 107668 - RNA, 46 nt, Mus musculus
aggcgccaugggcuucauccuaauguaugacaucaccaaugaggag

SEQ ID NO: 107669 - RNA, 46 nt, Mus musculus
ucgugggacaaugcccaggugcugcuggugggaaacaagugugaca

SEQ ID NO: 107670 - RNA, 46 nt, Mus musculus
uccucaauaaauaaauaaauagcuacaauaauaaauaggguagucg

SEQ ID NO: 107671 - RNA, 46 nt, Mus musculus
aaaaagcucugggccauguccaaaacccaggcugacugccccugga

SEQ ID NO: 107672 - RNA, 42 nt, Mus musculus
ugaacuuccucuucaucccuucucauuuccgagucaccuaua

SEQ ID NO: 107673 - RNA, 42 nt, Mus musculus
gucagacacuagaggagagcugccaggagcugcgggccaaau

SEQ ID NO: 107674 - RNA, 49 nt, Mus musculus
gccucgcuaugaaaaccuugcacaugucccacaaagcccagacuccaga

SEQ ID NO: 107675 - RNA, 54 nt, Mus musculus
ggucugcuauaaguaaaggcauaaccucaaacucgucccaggaaaaacugccca

SEQ ID NO: 107676 - RNA, 43 nt, Mus musculus
guuugagguuaugccuuuacuuauagcagaccuuccuggggga

SEQ ID NO: 107677 - RNA, 34 nt, Mus musculus
uccugagcauagucugucagcuguaccagguaag

SEQ ID NO: 107678 - RNA, 44 nt, Mus musculus
ggggcacacagcucaugcaugagaaugcccagcucacagaugcc

SEQ ID NO: 107679 - RNA, 49 nt, Mus musculus
gaaaaggaggcagcguuccuaaccaucgucuguauggaggagauggaug

SEQ ID NO: 107680 - RNA, 42 nt, Mus musculus
ccagcacggggagcuggaguguagacugaacaugguggaggu

SEQ ID NO: 107681 - RNA, 42 nt, Mus musculus
caugaacaucacccuggugcccuacgggaaugcacagguacu

SEQ ID NO: 107682 - RNA, 42 nt, Mus musculus
ccacgaugugugccucuuggggccacgcccauugcccccuuc

SEQ ID NO: 107683 - RNA, 45 nt, Mus musculus
aauagagucuucgugggugaaaggcaucgcugugaugcgcaaaau

SEQ ID NO: 107684 - RNA, 45 nt, Mus musculus
ccucagcuauguccucaacccaagccagggcccagaaccagagau

SEQ ID NO: 107685 - RNA, 42 nt, Mus musculus
ugaaaccagucacaggggguuaccccgcagcugccgagaauc

SEQ ID NO: 107686 - RNA, 41 nt, Mus musculus
ggccugggcgcccugaguucuucaagccauauccccggggu

SEQ ID NO: 107687 - RNA, 48 nt, Mus musculus
acccugugcgugcccccgggccuggcccaccgucugcagcacgcugag

SEQ ID NO: 107688 - RNA, 46 nt, Mus musculus
uguacgggucccugaaggagcuggugcugcacuaccagcacgcauc

SEQ ID NO: 107689 - RNA, 45 nt, Mus musculus
aggagcgcacgugguacgugggcaagaucaaccgcacacaggcgg

SEQ ID NO: 107690 - RNA, 42 nt, Mus musculus
gaacgagacugaggagugagugaugugcugcaaggggcaaaa

SEQ ID NO: 107691 - RNA, 46 nt, Mus musculus
uuggagcaggaucugcgggcgcaggccuccgacaaccgugagaucg

SEQ ID NO: 107692 - RNA, 41 nt, Mus musculus
guauuuggagcgcuuccggcgagagggaaaugagaaggaga

SEQ ID NO: 107693 - RNA, 45 nt, Mus musculus
ggcugugggcgcccagcucaaggucuaccaccagcaguaccagga

SEQ ID NO: 107694 - RNA, 37 nt, Mus musculus
cuccgugguggaacucaucucccacuaccgccacgaa

SEQ ID NO: 107695 - RNA, 36 nt, Mus musculus
acuggggggacaucuccagguaguucugcugcagca

SEQ ID NO: 107696 - RNA, 45 nt, Mus musculus
gugggaccaaaagcuuuggggucuuuaagguagguggggucaggg

SEQ ID NO: 107697 - RNA, 41 nt, Mus musculus
gugcuggagugauggcuguccacucccacaccuugcacuga

SEQ ID NO: 107698 - RNA, 42 nt, Mus musculus
cccuagaggagccgagcauugcuccacagccucguugguggg

SEQ ID NO: 107699 - RNA, 27 nt, Mus musculus
ggccucacagccucugaggguggguua

SEQ ID NO: 107700 - RNA, 45 nt, Mus musculus
auucuuugugcuuuuuugagccaggaucuugguguagagcaggcu

SEQ ID NO: 107701 - RNA, 46 nt, Mus musculus
ugagcugacuccuuagcccuuggugcagguuugauuggugccuggg

SEQ ID NO: 107702 - RNA, 45 nt, Mus musculus
uaagcaucuuccagcuccuucuguuucuuggcaucagcggccgcc

SEQ ID NO: 107703 - RNA, 45 nt, Mus musculus
auauaacaacucuguacccacaaaacguaggcagggccuccacag

SEQ ID NO: 107704 - RNA, 42 nt, Mus musculus
guucauugggguccauggaagcucuggugggugagugagggg

SEQ ID NO: 107705 - RNA, 46 nt, Mus musculus
gaaaagugccuacgugguuccccaugacugccaggccgcgcggcag

SEQ ID NO: 107706 - RNA, 46 nt, Mus musculus
ggcagagggagaaaugggauguccacagaacacagagccccaagga

SEQ ID NO: 107707 - RNA, 45 nt, Mus musculus
cccugcccgcccugaagucccugugucccaccugugccccccaaa

SEQ ID NO: 107708 - RNA, 44 nt, Mus musculus
aacauuacuuaauucagaauuacauaagaaaugggggggcugga

SEQ ID NO: 107709 - RNA, 46 nt, Mus musculus
gcauuggagagguccuggguuccuucuagaaaaaugcagagaaaga

SEQ ID NO: 107710 - RNA, 42 nt, Mus musculus
acucucuacauagccaaagaugacccugaacaaaccccugau

SEQ ID NO: 107711 - RNA, 46 nt, Mus musculus
acagcuggccggcggcacuugccagcugcaaucucuuccaccuuca

SEQ ID NO: 107712 - RNA, 46 nt, Mus musculus
gcaguggucaggucccuguacucccgauacauguugugugugccac

SEQ ID NO: 107713 - RNA, 53 nt, Mus musculus
acuucuucaucuucuucagcugugacacaaaguaccagaagcgggacuuggcc

SEQ ID NO: 107714 - RNA, 42 nt, Mus musculus
ugcccgaggccuucauggcacugcgcacucguucaccgccag

SEQ ID NO: 107715 - RNA, 45 nt, Mus musculus
ggucuaacuucgacccggauugcuguagcuccagguucguucuuc

SEQ ID NO: 107716 - RNA, 48 nt, Mus musculus
ccacucgggaaccauggagguggcagaggcgaacagccccacggagga

SEQ ID NO: 107717 - RNA, 45 nt, Mus musculus
ccuguacucucuuucuucucuuuauguuucagaucaucugucugg

SEQ ID NO: 107718 - RNA, 46 nt, Mus musculus
caugaagaaguaggcucugaugccagugaaggagcaaacuugcuaa

SEQ ID NO: 107719 - RNA, 42 nt, Mus musculus
ucucagaagaugguugagauguuuguucgcacaaagcacaag

SEQ ID NO: 107720 - RNA, 23 nt, Mus musculus
aggugucagcuagugugacugaa

SEQ ID NO: 107721 - RNA, 44 nt, Mus musculus
guugugagccaucaugugguugcugggauuugaacucaggaugu

SEQ ID NO: 107722 - RNA, 44 nt, Mus musculus
guugugagccaccaugugguugcugggauuugaacucaccucua

SEQ ID NO: 107723 - RNA, 42 nt, Mus musculus
cgcaccauccuggucuacagccgcccacccugccagccccag

SEQ ID NO: 107724 - RNA, 44 nt, Mus musculus
cuacuucuucuucgacaucguuuauauccacaauggcacugagg

SEQ ID NO: 107725 - RNA, 41 nt, Mus musculus
gugucacuuugggcucacugagaccuguuauuaaugucaca

SEQ ID NO: 107726 - RNA, 42 nt, Mus musculus
ccagguggaugaggaagcccuggcucagugcuuucagcggcu

SEQ ID NO: 107727 - RNA, 46 nt, Mus musculus
caguguguuuucuugugugugugugugugugugugugugugugugu

SEQ ID NO: 107728 - RNA, 46 nt, Mus musculus
gugugugugcguguauguguguguuuuuaaauaugugacaguauuu

SEQ ID NO: 107729 - RNA, 45 nt, Mus musculus
uauacagagaaaccaugucccccaaaacaaaccaaaaaacaacaa

SEQ ID NO: 107730 - RNA, 67 nt, Mus musculus
uguagaaggaagcaugguuuucguguguguguguguguguguguguguguguauaugagugugggca

SEQ ID NO: 107731 - RNA, 42 nt, Mus musculus
ggcuggcugggcggggccucaugccgaugggcggggccuggg

SEQ ID NO: 107732 - RNA, 45 nt, Mus musculus
gucuguguccugcuuacucggauucuuccaucccugcccccagug

SEQ ID NO: 107733 - RNA, 46 nt, Mus musculus
gcuggaggcauagucagggugaaaccuugccuagaauccuuuagug

SEQ ID NO: 107734 - RNA, 52 nt, Mus musculus
augagggccaucuucacacgcuaugccaagaagcgcaaugugcucaucggcc

SEQ ID NO: 107735 - RNA, 42 nt, Mus musculus
gagcacauugcgcuucuuggcauagcgugugaagauggcccu

SEQ ID NO: 107736 - RNA, 45 nt, Mus musculus
uaggcagcugccaccugcggcgcagagcuggcuccauggcccgcc

SEQ ID NO: 107737 - RNA, 42 nt, Mus musculus
ugcguccugccucgggccccgggccccucgaugaccucaggu

SEQ ID NO: 107738 - RNA, 46 nt, Mus musculus
ccgcgcgcgcggaaacgaguaucagccgagcaacaucaagcgcaag

SEQ ID NO: 107739 - RNA, 46 nt, Mus musculus
acgugaauauuuauuaagucgguaauacuuuggaauggcuggaaac

SEQ ID NO: 107740 - RNA, 42 nt, Mus musculus
ucaucacacacaacaacacaguguaaugaacaggccagucag

SEQ ID NO: 107741 - RNA, 42 nt, Mus musculus
caacccucaaggcucccacucaaauauccccaguccccagaa

SEQ ID NO: 107742 - RNA, 45 nt, Mus musculus
gggcuggauguaggaggcgggccgcgcuuacacacgcggguggga

SEQ ID NO: 107743 - RNA, 42 nt, Mus musculus
cgagcagaccccccacaauacagaaaaauacacaggaugggc

SEQ ID NO: 107744 - RNA, 46 nt, Mus musculus
aguacacuguagcugucuucagacacacaggaagagggcaucagau

SEQ ID NO: 107745 - RNA, 45 nt, Mus musculus
agcuuucaagguaugaggcuggggucaaguugauguggucucagg

SEQ ID NO: 107746 - RNA, 46 nt, Mus musculus
ucaagcucugcacuggccugcagaggcccuuuggccggcgugugga

SEQ ID NO: 107747 - RNA, 46 nt, Mus musculus
gcucacgcaggcagagcuagagagcugcaugaagaaguaugaggug

SEQ ID NO: 107748 - RNA, 45 nt, Mus musculus
gcugagcuguggccucacgaccaggguugucgaaggguugcagga

SEQ ID NO: 107749 - RNA, 45 nt, Mus musculus
augggaggaagguggauuugagguuugagaagggugcauagagga

SEQ ID NO: 107750 - RNA, 46 nt, Mus musculus
cgagaauguggagagcgagcuacgcuucuucacaucgcaggugacc

SEQ ID NO: 107751 - RNA, 42 nt, Mus musculus
ggugucuuugaccuggaaaaauaaaguaauuuaaaaagaaag

SEQ ID NO: 107752 - RNA, 44 nt, Mus musculus
ccagauugggucuuccuccgcagaacuuuaggacuggggagugg

SEQ ID NO: 107753 - RNA, 42 nt, Mus musculus
acagagagacccugucuagaaaaacaacagcagcagcaacag

SEQ ID NO: 107754 - RNA, 45 nt, Mus musculus
ggaguggaaguagggguuuaugucagcagagagcagagggugggu

SEQ ID NO: 107755 - RNA, 54 nt, Mus musculus
ggugucucaagcccuggagcagcaggcccgcaucaaggagcuugagagugagag

SEQ ID NO: 107756 - RNA, 46 nt, Mus musculus
uaaaauugccguuuuggagauuacaccuugguaggacuggguggau

SEQ ID NO: 107757 - RNA, 46 nt, Mus musculus
cgcccagcggcggcagcaguaggagcaguggcagcagcggcagccc

SEQ ID NO: 107758 - RNA, 42 nt, Mus musculus
acagcgccgugcgcucccguggguggcgcagcugcuccaggg

SEQ ID NO: 107759 - RNA, 46 nt, Mus musculus
cgaaguauggcugaaguguugucaguguugugaucuguggccaccc

SEQ ID NO: 107760 - RNA, 46 nt, Mus musculus
uacaggggaucauagaggacuucacagagguggcaggcaaguggau

SEQ ID NO: 107761 - RNA, 56 nt, Mus musculus
ggcgcaguuucaugacaugcucguagcgggaaucggaccaguguuuggggccuucu

SEQ ID NO: 107762 - RNA, 42 nt, Mus musculus
cugugcugaaccugugcggccaaggacccugcagacacauga

SEQ ID NO: 107763 - RNA, 46 nt, Mus musculus
uaaguuccagggcagccagggcuauacagagaaacccugucgaaaa

SEQ ID NO: 107764 - RNA, 50 nt, Mus musculus
gaguccagcaugggggccaccacugucuuguucucagcgaugagcaggcu

SEQ ID NO: 107765 - RNA, 47 nt, Mus musculus
ggguaaaaggccagguuccuggaugcagccuuacgcaggucaaugag

SEQ ID NO: 107766 - RNA, 46 nt, Mus musculus
cucgccggucccgccuccgcuucagguugaucaugaagaccuguag

SEQ ID NO: 107767 - RNA, 41 nt, Mus musculus
aaaaaggagaggggauaggaaagagguugaagaucaggagg

SEQ ID NO: 107768 - RNA, 40 nt, Mus musculus
cucgcacccuucauagcuccugaaaccucagcuguagaac

SEQ ID NO: 107769 - RNA, 45 nt, Mus musculus
ggguucuuuuucuuccaaaauugcaaccccuccccaacaccagac

SEQ ID NO: 107770 - RNA, 44 nt, Mus musculus
gugucccacagaccgggcuggcaggaaauaaaguccauagaagg

SEQ ID NO: 107771 - RNA, 45 nt, Mus musculus
acucugaguggcucuaaguggccgcuaagcaaaaacugcugugga

SEQ ID NO: 107772 - RNA, 42 nt, Mus musculus
aaagggcuggcuucaaggagaaguucaaagugaggggcagaa

SEQ ID NO: 107773 - RNA, 42 nt, Mus musculus
caaaucuguaacagucugugcuaagguccuguggcaggagau

SEQ ID NO: 107774 - RNA, 27 nt, Mus musculus
agcuuggcaagcgagagguggugcugg

SEQ ID NO: 107775 - RNA, 42 nt, Mus musculus
guguguguauuuuaauagcaaacuuacaggaacagcacagaa

SEQ ID NO: 107776 - RNA, 42 nt, Mus musculus
uaucucaaacuucuuuucaaacugcaacaauagcaaccagga

SEQ ID NO: 107777 - RNA, 42 nt, Mus musculus
gugaggggcaguaagcccagugccuagcacagcucggcagga

SEQ ID NO: 107778 - RNA, 42 nt, Mus musculus
gcauccuccgcaucccucacucugggagaaugauccagaacg

SEQ ID NO: 107779 - RNA, 42 nt, Mus musculus
aggaagcucgacucacuggagggaggagcgggaaagggagaa

SEQ ID NO: 107780 - RNA, 45 nt, Mus musculus
agaacacccaguugauucuagguugggacuccuaguggcccagga

SEQ ID NO: 107781 - RNA, 42 nt, Mus musculus
gcaccaugaaacgucauucaucacgugaguagcuggcugggu

SEQ ID NO: 107782 - RNA, 42 nt, Mus musculus
agccuagaaaguucuauguucacaucaagcccgcccccaccc

SEQ ID NO: 107783 - RNA, 65 nt, Mus musculus
gccgcuguauggaccuggagaggcugcguagagagaacaccagccagaaggagauggacaagguu

SEQ ID NO: 107784 - RNA, 58 nt, Mus musculus
gugcagauguugucaggcgucgggcagcuccugccaaagucucgcgagaauuacuuga

SEQ ID NO: 107785 - RNA, 45 nt, Mus musculus
agcuuguguacacaucuguaacuuaguguguauggaugggcccag

SEQ ID NO: 107786 - RNA, 59 nt, Mus musculus
cacgaucuccuuaaggaugugcugcgcuacggcgaggagcagcucaagacccacaagaa

SEQ ID NO: 107787 - RNA, 46 nt, Mus musculus
uugaucuuaucuguguagagggucugugugcauggggcaugugaug

SEQ ID NO: 107788 - RNA, 24 nt, Mus musculus
gcagggaaagguggguguaaugcu

SEQ ID NO: 107789 - RNA, 42 nt, Mus musculus
ugauaguaauuaugauauugcauucauuaaauggggucacag

SEQ ID NO: 107790 - RNA, 45 nt, Mus musculus
agacuggcguucuccagguuccacaagguggaaggagagaccaga

SEQ ID NO: 107791 - RNA, 46 nt, Mus musculus
guaguaaaggaaaaagaaagaaggggcuagugggaugguucagcug

SEQ ID NO: 107792 - RNA, 46 nt, Mus musculus
uccuagaaacacauggucccaccagguuugugcccuucccccagcc

SEQ ID NO: 107793 - RNA, 45 nt, Mus musculus
cagguaccagcuuucugguaauuccagagaacuaaaguucccaag

SEQ ID NO: 107794 - RNA, 46 nt, Mus musculus
cacaccugaaaguccuagaacaaaaagaagcaagcacauccaagag

SEQ ID NO: 107795 - RNA, 43 nt, Mus musculus
aagaucaaaccugagaauaauaggaacagaagagggugaagau

SEQ ID NO: 107796 - RNA, 47 nt, Mus musculus
uagagauaagucuuaaagagauagaaaagaagggagggggaaagaga

SEQ ID NO: 107797 - RNA, 46 nt, Mus musculus
auucacaaggcaauauaggcuuuuaugcucugaagggugggcagau

SEQ ID NO: 107798 - RNA, 45 nt, Mus musculus
aggcugggggaagggcauaagguguuacaggaauauggggagagu

SEQ ID NO: 107799 - RNA, 26 nt, Mus musculus
cuuucuacuuguaaggccagcagucc

SEQ ID NO: 107800 - RNA, 46 nt, Mus musculus
ccauguacuaguuagggggucucaccauuuaaucauggcaucugag

SEQ ID NO: 107801 - RNA, 42 nt, Mus musculus
gauucuaguggggaggggucccagagagaccagaggagagga

SEQ ID NO: 107802 - RNA, 92 nt, Mus musculus
acgagcagguaugcauuugcaugggguacaaaggcuuugagagaaggaggugaagagggaggagaggaaaugagggagugggagacagaaag

SEQ ID NO: 107803 - RNA, 44 nt, Mus musculus
cugcugggcuccggcgacagcugggcggccgcgcccgggcccgc

SEQ ID NO: 107804 - RNA, 42 nt, Mus musculus
uugccagggagucugaggcaagaggauuccuaagaccaggag

SEQ ID NO: 107805 - RNA, 46 nt, Mus musculus
guaugaauucccuugagccugggucccuagguggguuguggcugga

SEQ ID NO: 107806 - RNA, 79 nt, Mus musculus
gauucugcagggcuguggccagcugcuccugagcccgguccaguuccuccuccagcaguuggaugcggcgguugagagc

SEQ ID NO: 107807 - RNA, 86 nt, Mus musculus
ggaggaacuggaccgggcucaggagcagcuggccacagcccugcagaaucuggaagaggcagagaaggcugcugaugagagugaga

SEQ ID NO: 107808 - RNA, 46 nt, Mus musculus
ucuggggugucugaagacagcuacaguguacuuacauacaauaaau

SEQ ID NO: 107809 - RNA, 46 nt, Mus musculus
ugcucacacuaagauaaaccuugccucugggagaaaggacagcaag

SEQ ID NO: 107810 - RNA, 46 nt, Mus musculus
guaucuccaggaaggggguugaagaaauaggauggaggguugagau

SEQ ID NO: 107811 - RNA, 45 nt, Mus musculus
agcucacaaccauccuuaauaagaucugaugcccucuucuagugu

SEQ ID NO: 107812 - RNA, 46 nt, Mus musculus
cugcaagguggaaaccugguaauaagcggaacuucuuacaaaagag

SEQ ID NO: 107813 - RNA, 46 nt, Mus musculus
cugcuggggaauguggaauguuucagugugagauguuaacugagaa

SEQ ID NO: 107814 - RNA, 45 nt, Mus musculus
uuuauuugaccaaaauguagaaaaagugauacuauuacguaugau

SEQ ID NO: 107815 - RNA, 46 nt, Mus musculus
ccugcacagaaacaggacccuggcaucuugcccagcguuaucugag

SEQ ID NO: 107816 - RNA, 42 nt, Mus musculus
ucccugcacaucuggggaagaaagugagcuuagagcugccag

SEQ ID NO: 107817 - RNA, 46 nt, Mus musculus
ucuguguuaccucaggcaggcagcuccaccucucugaacauugcaa

SEQ ID NO: 107818 - RNA, 68 nt, Mus musculus
cugcaggaacuaccguggggauguggacaugucagagguggagcacuucaugcccauucugauggaga

SEQ ID NO: 107819 - RNA, 44 nt, Mus musculus
uuucuggcugcuguguauggccagaggcaggaguggacaaauga

SEQ ID NO: 107820 - RNA, 41 nt, Mus musculus
gccauggggaugggcaccuaugauuugauauccuggccuca

SEQ ID NO: 107821 - RNA, 42 nt, Mus musculus
gcuagaugagcucauggacuuuggcuacccgcagaccacuga

SEQ ID NO: 107822 - RNA, 46 nt, Mus musculus
agccacagucaccaaugcuguguccuggcguucagaaggcaucaag

SEQ ID NO: 107823 - RNA, 42 nt, Mus musculus
gggacuuauaaccacugccagccucacccuugcugugcauag

SEQ ID NO: 107824 - RNA, 43 nt, Mus musculus
cacguuuugagaacgaccgcacuaucuccuucaucccacccga

SEQ ID NO: 107825 - RNA, 83 nt, Mus musculus
aagagccaguucaagaggcggucaacagccaacaauguagagauccauauaccaguccccaacgaugcugauucacccaaguu

SEQ ID NO: 107826 - RNA, 45 nt, Mus musculus
uuuuccuucgagggcacuggggagccaugguaagcugucaagaga

SEQ ID NO: 107827 - RNA, 46 nt, Mus musculus
caagggaagcgcauggggaauggccuaggacugacagaggcugggu

SEQ ID NO: 107828 - RNA, 46 nt, Mus musculus
ugauguggccaaagucaauacccugauaaggcccgacggagagaag

SEQ ID NO: 107829 - RNA, 41 nt, Mus musculus
ucuggcggcccaagacccugcggcuccggaggcagccaaaa

SEQ ID NO: 107830 - RNA, 44 nt, Mus musculus
uauuuuggcugccuccggagccgcagggucuugggccgccagaa

SEQ ID NO: 107831 - RNA, 42 nt, Mus musculus
auaaggccugggugggccgggccacagcacacacagucccug

SEQ ID NO: 107832 - RNA, 45 nt, Mus musculus
aagcgcgccgccacacauacuugcagcuacaccaacugcggcaag

SEQ ID NO: 107833 - RNA, 47 nt, Mus musculus
gccugcuaguggucagcuucaggagcccaagguucucuguuuagauu

SEQ ID NO: 107834 - RNA, 47 nt, Mus musculus
uggcccccacagugacugaaggccccaggaaagaagacaggagucug

SEQ ID NO: 107835 - RNA, 42 nt, Mus musculus
uagaugccuugugagaaaugccuuugaguuuacuguccccaa

SEQ ID NO: 107836 - RNA, 45 nt, Mus musculus
ugguguggcuggggauaggguagguccugaggggacagggagcag

SEQ ID NO: 107837 - RNA, 45 nt, Mus musculus
auucaguggcugacagagaaggccuccagucuccuagcugcagac

SEQ ID NO: 107838 - RNA, 27 nt, Mus musculus
ugguagaauguggcugcagcccuaaag

SEQ ID NO: 107839 - RNA, 45 nt, Mus musculus
agccuguaacuacucuggggcaacgaguuguuagcucagucacag

SEQ ID NO: 107840 - RNA, 45 nt, Mus musculus
agucucacucuaaguauucuuugaauggauacauaguaacuagag

SEQ ID NO: 107841 - RNA, 46 nt, Mus musculus
uucagaauaaacuugaagcccuagacaucuggaagcucagaaauug

SEQ ID NO: 107842 - RNA, 45 nt, Mus musculus
guugaguaucacugcacuguccuuucagaaggccgcugcuccccc

SEQ ID NO: 107843 - RNA, 46 nt, Mus musculus
gaacaggugaggugaaucugugaguaugcuaggcuaguggggagau

SEQ ID NO: 107844 - RNA, 46 nt, Mus musculus
aaccuuggacuugauggugugauguggagacagacugagagcagac

SEQ ID NO: 107845 - RNA, 46 nt, Mus musculus
auaaaagcaggaacuagauucagccuuaacaauacagccaccaaaa

SEQ ID NO: 107846 - RNA, 42 nt, Mus musculus
gcuuuuggcucuuuggauaugagcauggagaaauggccacag

SEQ ID NO: 107847 - RNA, 45 nt, Mus musculus
aaaguuugagucaggcaaucugauuuuucucuucucugccaucac

SEQ ID NO: 107848 - RNA, 42 nt, Mus musculus
uguccuucaucaguucuucaucagagaucauagcagccuugu

SEQ ID NO: 107849 - RNA, 78 nt, Mus musculus
acaugaacugugcucugagacaggcuucacucugcagcccccaugugcugggaucacaggcaugaaccaccaggccgu

SEQ ID NO: 107850 - RNA, 44 nt, Mus musculus
aaagaugaucauuaacuuagggagagguuaaaggugacuggcug

SEQ ID NO: 107851 - RNA, 46 nt, Mus musculus
cagaaauuggaugucuugaaagcucuacauucuccugccuggagau

SEQ ID NO: 107852 - RNA, 42 nt, Mus musculus
gagcuggucaaugugcacuguugcccugggaaccugggugag

SEQ ID NO: 107853 - RNA, 41 nt, Mus musculus
gcccugugcccgccgcccuguccccaccggcgggugccgcg

SEQ ID NO: 107854 - RNA, 46 nt, Mus musculus
uguaugaauguuuugcuugcaucuaugccugugguagaggucagag

SEQ ID NO: 107855 - RNA, 45 nt, Mus musculus
ucuguagcccuggcugucacacuguagaccaggcuggccucagac

SEQ ID NO: 107856 - RNA, 46 nt, Mus musculus
cucucccucucucucuuccuuucuuccucucucugucugucugucu

SEQ ID NO: 107857 - RNA, 45 nt, Mus musculus
ccuucagacagugucagggagcccaggccuagguaguggacaagg

SEQ ID NO: 107858 - RNA, 45 nt, Mus musculus
acucccagcugcagggaauagggauugggggguugggggacuagu

SEQ ID NO: 107859 - RNA, 47 nt, Mus musculus
uggacaagcuuugaauuaauacucugccauuuguguauaaagacuug

SEQ ID NO: 107860 - RNA, 56 nt, Mus musculus
uuccagacagugaaggccucucaucucugucacauuacagaugggaaaucaaggca

SEQ ID NO: 107861 - RNA, 46 nt, Mus musculus
cuaacaagugccuuuucauuuucuuuauuaaguugcauuucuuuug

SEQ ID NO: 107862 - RNA, 46 nt, Mus musculus
cucaagcccgugugcacugaguccugagucugggugugaaauccag

SEQ ID NO: 107863 - RNA, 48 nt, Mus musculus
ccagcucccgugccugugggaacacuuuuacaaacauccagcgcucga

SEQ ID NO: 107864 - RNA, 46 nt, Mus musculus
gaucagggcccuggguucaucccagcacugcagccagaaaggagau

SEQ ID NO: 107865 - RNA, 42 nt, Mus musculus
ggaaagucaaggcaggaaccugaugcagaugccauggaagau

SEQ ID NO: 107866 - RNA, 41 nt, Mus musculus
cauugcuucgaugaaacucuaugagcaaagcaacccggaga

SEQ ID NO: 107867 - RNA, 47 nt, Mus musculus
caccucuguguccaagcauacuuuucugucugccaaggcccuaggaa

SEQ ID NO: 107868 - RNA, 46 nt, Mus musculus
cagugauccuuuuucauccuccagcaucuccucgaaagguucaggu

SEQ ID NO: 107869 - RNA, 44 nt, Mus musculus
uggaggaugaaaaaggaucacuggacucaaaugggucgagcuga

SEQ ID NO: 107870 - RNA, 46 nt, Mus musculus
agugaacgaaaggccugagaagcgaaccacagccagacauagacag

SEQ ID NO: 107871 - RNA, 42 nt, Mus musculus
acuaggacaccagguaccucuggccuuugcaugcacaaucac

SEQ ID NO: 107872 - RNA, 50 nt, Mus musculus
gaugacuucuucaagaaacagacaaagaaugacccauuuaccucagaccc

SEQ ID NO: 107873 - RNA, 46 nt, Mus musculus
cugugguacuggggaacccaggucuuuggacauacuaggcaaucua

SEQ ID NO: 107874 - RNA, 46 nt, Mus musculus
uuacauauaauaaauaaauaaaucuuuaaaaaaaaaaaaaaagguc

SEQ ID NO: 107875 - RNA, 42 nt, Mus musculus
aggugauccuuuccaaagugaucccuucucagagcagcagac

SEQ ID NO: 107876 - RNA, 45 nt, Mus musculus
gcuuuagcagcucccacuacaccagugucaccuuaagccccacuu

SEQ ID NO: 107877 - RNA, 46 nt, Mus musculus
ccugccuuuaaaaacaaacacacacacaguuaaauagcccaguuuu

SEQ ID NO: 107878 - RNA, 42 nt, Mus musculus
aacccaaaaauaaguccaaaauucuaugaaaccugggggcag

SEQ ID NO: 107879 - RNA, 46 nt, Mus musculus
agccgugcaccaucccagcuuaucacucugacuuaccaggacagau

SEQ ID NO: 107880 - RNA, 46 nt, Mus musculus
acauguuagcuaggacucaccacugaccuuugcucccagcccaaaa

SEQ ID NO: 107881 - RNA, 46 nt, Mus musculus
aagguacaacugcccaagaggcaauaggauucuuauaggccauguu

SEQ ID NO: 107882 - RNA, 42 nt, Mus musculus
caauucugguaagcacaguuccuagcugcacaccaugaagag

SEQ ID NO: 107883 - RNA, 46 nt, Mus musculus
auauuaccuagaaacuuaagacuuguguccaaaggaacccacaucu

SEQ ID NO: 107884 - RNA, 45 nt, Mus musculus
agacauauauauauauauauauagagagagagagagagagaaaga

SEQ ID NO: 107885 - RNA, 45 nt, Mus musculus
uuggaugagaaagagaagagaagagagagggaagguagcuguguu

SEQ ID NO: 107886 - RNA, 42 nt, Mus musculus
gcagggcuggagcaacgagagcccuggaagaugaggcggccg

SEQ ID NO: 107887 - RNA, 45 nt, Mus musculus
uucaagucugacuccugagacugaaucuggguuuucaaugaugag

SEQ ID NO: 107888 - RNA, 46 nt, Mus musculus
agcuugaggcucagaaacaggaugcccaggaccgccuggaugagau

SEQ ID NO: 107889 - RNA, 46 nt, Mus musculus
guuucugagccucaagcuccugcagacuacuaguuucccggucuag

SEQ ID NO: 107890 - RNA, 47 nt, Mus musculus
caagacaucagagaaaaggaagaggcaaucagacagaaaaccagcga

SEQ ID NO: 107891 - RNA, 50 nt, Mus musculus
ucugcagguuuaaaaacaauggaugaaaaacucuggaaguucaggaggca

SEQ ID NO: 107892 - RNA, 37 nt, Mus musculus
agcucuuuaacaccagugaacucuccugaugccagag

SEQ ID NO: 107893 - RNA, 46 nt, Mus musculus
aaaggauccccauccccuuagucccacccccaaacguggccuggag

SEQ ID NO: 107894 - RNA, 41 nt, Mus musculus
gggagugccucucucagaggguggcaccaugucaggcgaga

SEQ ID NO: 107895 - RNA, 45 nt, Mus musculus
cugcucuuugcuuaacuugcccguuugucuuguaucagccagggc

SEQ ID NO: 107896 - RNA, 25 nt, Mus musculus
gcugggaaagaggguggggagggcu

SEQ ID NO: 107897 - RNA, 45 nt, Mus musculus
cagaugugugccagaagguucugagugaggccugagugcaugaag

SEQ ID NO: 107898 - RNA, 46 nt, Mus musculus
uggccuggguugugccuguggcagauaagaugcgcuuugaugagau

SEQ ID NO: 107899 - RNA, 35 nt, Mus musculus
agucuuaaacacugaagaagcucccagcccuagcc

SEQ ID NO: 107900 - RNA, 41 nt, Mus musculus
ucaaugaggacuugagcacuagagagcacuguccaggccca

SEQ ID NO: 107901 - RNA, 67 nt, Mus musculus
gccugugcuguugaggcugcuuacgcugccgugggaugguguggagcggaggcugucuuuggguggg

SEQ ID NO: 107902 - RNA, 63 nt, Mus musculus
ggacuagcaggcaggacaggcacagcuccugcaaacacagucuucuuccucuuagaggguggg

SEQ ID NO: 107903 - RNA, 45 nt, Mus musculus
cgcgcccuggagaaggaaccagugcccuccauccugcccccgccc

SEQ ID NO: 107904 - RNA, 45 nt, Mus musculus
aagcugugauuuuugccagugugccuaucaucccaggacucagaa

SEQ ID NO: 107905 - RNA, 42 nt, Mus musculus
aggcaauggggagcuuuccugaccuucauguuuugggcagau

SEQ ID NO: 107906 - RNA, 65 nt, Mus musculus
aggcggggcagugguggcacaugccuuuaaucccagcacccaggaggcagaggcagguagaucuc

SEQ ID NO: 107907 - RNA, 46 nt, Mus musculus
guaccucccauuauaaaauggaagggugccagcaucuucccggggc

SEQ ID NO: 107908 - RNA, 76 nt, Mus musculus
aaacaucacccugcuggccucugcuccccaugacccccagacucaaagugccagggagcuuuuccucccaagccau

SEQ ID NO: 107909 - RNA, 46 nt, Mus musculus
guggugagguuggcacucaaaccuuuacugcauugagccccaucac

SEQ ID NO: 107910 - RNA, 42 nt, Mus musculus
ugaauugagugcuggaaucacaggugaauuauaugugcugcg

SEQ ID NO: 107911 - RNA, 24 nt, Mus musculus
gcuaaggauguagcuugguggcaa

SEQ ID NO: 107912 - RNA, 42 nt, Mus musculus
caaaaacaaaaaaagaugggcuggcugccaaguguggugauc

SEQ ID NO: 107913 - RNA, 42 nt, Mus musculus
gugcauuuugcauuaugauauggcuauaagccuaggggccag

SEQ ID NO: 107914 - RNA, 46 nt, Mus musculus
ccagcagcccacugauggccacacagucaucugcagagacccacug

SEQ ID NO: 107915 - RNA, 46 nt, Mus musculus
ggcuuuuggaagacugaagcacagaugcagggagcaccaaccccag

SEQ ID NO: 107916 - RNA, 46 nt, Mus musculus
caauaaauauaccagccuugggaacccaucacaaaacacaccaggg

SEQ ID NO: 107917 - RNA, 45 nt, Mus musculus
aggucuguggagcaugucuucaaguccuagaacucaggaggcaga

SEQ ID NO: 107918 - RNA, 46 nt, Mus musculus
uagacauggaccaucaguaucauaggcaggccaggcuaaggaagug

SEQ ID NO: 107919 - RNA, 46 nt, Mus musculus
cuccccugccccuaggcuccuucuuaggaugcagucagucccaggg

SEQ ID NO: 107920 - RNA, 32 nt, Mus musculus
uaaccgcugagccaucucuucagccccguaug

SEQ ID NO: 107921 - RNA, 46 nt, Mus musculus
auaauaaauaaauguuaaaaaacaaaacauaacaaauagcaugcag

SEQ ID NO: 107922 - RNA, 46 nt, Mus musculus
agaugaaagugcuggaugcaaaacacugagugagcagugaauagug

SEQ ID NO: 107923 - RNA, 46 nt, Mus musculus
augggaucugaugcccucuucuggugugucugaaacaacaggguac

SEQ ID NO: 107924 - RNA, 46 nt, Mus musculus
gggucaggaacaagauauugacuggguaaacaguucagcagaagau

SEQ ID NO: 107925 - RNA, 46 nt, Mus musculus
gcugacaaauuuuuauuuuucccacacagguuauauaggagcagga

SEQ ID NO: 107926 - RNA, 45 nt, Mus musculus
aaaacaugcugggcgugguggcgcacaccuuuaaucucagcacuc

SEQ ID NO: 107927 - RNA, 45 nt, Mus musculus
gcucacauccaucuguaaugagaucugacacccucuucuggugcg

SEQ ID NO: 107928 - RNA, 57 nt, Mus musculus
ucuacaaugaaaagcgaaacaaaaauugugcauguggcugggugaggggcuuggaaa

SEQ ID NO: 107929 - RNA, 42 nt, Mus musculus
cugggcagugugucucucccaucccuaugcccugggccccaa

SEQ ID NO: 107930 - RNA, 45 nt, Mus musculus
gaauggaagccaucaacucgcacaugcuaggcaaauagcugagga

SEQ ID NO: 107931 - RNA, 49 nt, Mus musculus
uaaauucgaggccacccuggucuacagaacccugucucgaggaaaaaag

SEQ ID NO: 107932 - RNA, 55 nt, Mus musculus
caaugcacauuaaauaaaaauaaguucaaaaaaaaagaaagaaauaggcgggcag

SEQ ID NO: 107933 - RNA, 42 nt, Mus musculus
gcaguaugaucucccuccccaucccucccagaguggggauga

SEQ ID NO: 107934 - RNA, 45 nt, Mus musculus
gguuguaggucaugauuguaucuggugcuguggugaaacccaggc

SEQ ID NO: 107935 - RNA, 46 nt, Mus musculus
ucaugaaggugucacuaaauccccuggacauaagaaaugauaccag

SEQ ID NO: 107936 - RNA, 46 nt, Mus musculus
aagguucuggagucagggaauaguaguuagaagaucccacggugau

SEQ ID NO: 107937 - RNA, 45 nt, Mus musculus
uguccuuugacuaccacaugcaccaugguacauaacggcccccac

SEQ ID NO: 107938 - RNA, 27 nt, Mus musculus
gaaaaugguuaaggacuagacagauag

SEQ ID NO: 107939 - RNA, 46 nt, Mus musculus
ggucgggcgucggggcggguggugucccauacuggagucgcaaggg

SEQ ID NO: 107940 - RNA, 42 nt, Mus musculus
gccugcccugccuuagugcaagaauuaaaagugcgugccacc

SEQ ID NO: 107941 - RNA, 42 nt, Mus musculus
ggugugggaggggguguaccuuuaaccccagugcuggggagg

SEQ ID NO: 107942 - RNA, 46 nt, Mus musculus
uuuucauuuuuaaccauuuauuuauuguaugggacgcggggaaggu

SEQ ID NO: 107943 - RNA, 125 nt, Mus musculus
cuccuucauuuuacagaagaagaaaaugaggcuuaguggaugucuucucacuauuagugcacuuggagcuuuuauuuauuucuuugagauaguaucugccuauuuagaccaggcugaccacagaa

SEQ ID NO: 107944 - RNA, 58 nt, Mus musculus
ggguuuauuugagaauuuauguugcuguucccacguacccuuugaaauugcuuagcca

SEQ ID NO: 107945 - RNA, 57 nt, Mus musculus
cugggcuauaugagagcaacaacaaaacagacuugauccacaguuuacaucugucca

SEQ ID NO: 107946 - RNA, 54 nt, Mus musculus
agcuggggcugccgcucuggcuacagugcuuaccugcaugcaugaaguccuggc

SEQ ID NO: 107947 - RNA, 74 nt, Mus musculus
uaccaagauguuccuauaauuuguguauuaaugcauuuuuccuuuuucagggagcaaaauggcccgucucacuu

SEQ ID NO: 107948 - RNA, 65 nt, Mus musculus
gcagaggucucuaugggugacccugacucagcucuggacucagaaugaauuaugucuuuuaagau

SEQ ID NO: 107949 - RNA, 46 nt, Mus musculus
uggguuacauaaugagacucucucugaaaaaguugaggggcuggug

SEQ ID NO: 107950 - RNA, 45 nt, Mus musculus
uccucagaaccuaaguuucucuggggaacaucuugucggccaugg

SEQ ID NO: 107951 - RNA, 46 nt, Mus musculus
gcuagugcugcccaagggcagacuuauagugaccaucagcccauca

SEQ ID NO: 107952 - RNA, 44 nt, Mus musculus
cuggaagccaacaggagauggcaucugggauaucauggagagga

SEQ ID NO: 107953 - RNA, 41 nt, Mus musculus
ccugaugggcugcaggaugugaucauagcauggacacccac

SEQ ID NO: 107954 - RNA, 45 nt, Mus musculus
ggcuucaugcaugcucagaaugcuccgccuccaagcuguggagau

SEQ ID NO: 107955 - RNA, 41 nt, Mus musculus
ccugcccaccacugauaccucucgaagaaaguggcaguagu

SEQ ID NO: 107956 - RNA, 42 nt, Mus musculus
ugauuuuuguuauagugccuaagguuauugcuuuggggagag

SEQ ID NO: 107957 - RNA, 44 nt, Mus musculus
gcuuuguuuguuucuauauuuauuguuuuauggguaugugacua

SEQ ID NO: 107958 - RNA, 46 nt, Mus musculus
gucacuggggauauuguaccuagcucagggccucacaagugcagga

SEQ ID NO: 107959 - RNA, 46 nt, Mus musculus
cauuuugaaccaaggaaccuuggguugugauuaucuggacauggau

SEQ ID NO: 107960 - RNA, 44 nt, Mus musculus
gcaaaaccacgaaggcaggacuagacuuacaaaacucgauuccc

SEQ ID NO: 107961 - RNA, 46 nt, Mus musculus
gacgaguugagucuuuugucucuuuucuaccaugugcauccaggaa

SEQ ID NO: 107962 - RNA, 81 nt, Mus musculus
gugagcuuccgcucuuuuaaccgcacagguuuaacaccagccucagccaccugcccguccaaguucacuguguagucucga

SEQ ID NO: 107963 - RNA, 68 nt, Mus musculus
cuaagacuuccuacccaaagagagggcaguaccacuaaccaguugucuaaagcacaguucaggaagga

SEQ ID NO: 107964 - RNA, 43 nt, Mus musculus
aagccuccauucuuggagaguugaguaagagccuaacccacag

SEQ ID NO: 107965 - RNA, 42 nt, Mus musculus
ugagcuccagguuugauugagagacccugucucagugaucag

SEQ ID NO: 107966 - RNA, 41 nt, Mus musculus
uuguuccaugugacauaccacaagcaaccuagugaccagaa

SEQ ID NO: 107967 - RNA, 42 nt, Mus musculus
cuaucaucugaaaagcagguuaaguggguagaguaaggccaa

SEQ ID NO: 107968 - RNA, 46 nt, Mus musculus
caugggaccugggguaggcacccagaagcucugggaaaagccccag

SEQ ID NO: 107969 - RNA, 46 nt, Mus musculus
gucagauaucaacaggauaaagucauggccauuucaccagcagcag

SEQ ID NO: 107970 - RNA, 45 nt, Mus musculus
ggacaugauggcaugguguggggaugcuccuggaauuuggggcag

SEQ ID NO: 107971 - RNA, 84 nt, Mus musculus
ucuugggauccaagaguggccaggccggccuugugggggcugcugacuccaggucuguucucugagcaaugggucacagagacu

SEQ ID NO: 107972 - RNA, 114 nt, Mus musculus
gagcugccaccaugauuggaggcuuauucaucuauaaucacaagggggaggugcuuaucucccaggucuacagagaugacaucgggaggaaugcuguggaugccuuucggguca

SEQ ID NO: 107973 - RNA, 76 nt, Mus musculus
gccauggucuucgaauuccucuacaagaugugcgauguaauggcugcuuacuuuggcaagaucagcgaggagaaca

SEQ ID NO: 107974 - RNA, 45 nt, Mus musculus
acugaaaaccuucaucacccagcaggguaucaagagucagcauua

SEQ ID NO: 107975 - RNA, 57 nt, Mus musculus
aguuuggaaugaaugacaagauugucauagaaaagcagggcaaaggcacagcugaug

SEQ ID NO: 107976 - RNA, 69 nt, Mus musculus
aggccaaguacaaggccagcaagaacgccauuguauggaagaucaagcgcauggcaggcaugaaggaau

SEQ ID NO: 107977 - RNA, 46 nt, Mus musculus; identical to SEQ ID NO: 55031

SEQ ID NO: 107978 - RNA, 42 nt, Mus musculus
cgccuaaucucucguuagaaggccuuucugcuccagccacag

SEQ ID NO: 107979 - RNA, 46 nt, Mus musculus
ucugcuucucuaugucuaguccuggaagcuucuagccuacauacaa

SEQ ID NO: 107980 - RNA, 46 nt, Mus musculus
gacuaauauguuuaaaaaaaaaaaucagugaaggcaggcuggagag

SEQ ID NO: 107981 - RNA, 45 nt, Mus musculus
cagccccuaacauuuaaaacuagaguagcaaauauaaaggaggga

SEQ ID NO: 107982 - RNA, 43 nt, Mus musculus
cagcacccacauggugguucacaaccaucuguaaugggaucca

SEQ ID NO: 107983 - RNA, 41 nt, Mus musculus
caucauguaauacucaauuuguacaauaaauuaugaaccua

SEQ ID NO: 107984 - RNA, 47 nt, Mus musculus
gcuucccugugcuagucacugaccaggaagauaaagcccuaagauug

SEQ ID NO: 107985 - RNA, 47 nt, Mus musculus
agaaagaaagaaagaaagaaagaaagaaagaaagaaaaaugcaauau

SEQ ID NO: 107986 - RNA, 42 nt, Mus musculus
gcacacauguggcaaacacacacacacacacacacacacaca

SEQ ID NO: 107987 - RNA, 42 nt, Mus musculus
aagcgggggggagcggccgggccggcgggcgggcaggcugag

SEQ ID NO: 107988 - RNA, 41 nt, Mus musculus
ggacggagggaagcggaggggaccggagcucaggccccgga

SEQ ID NO: 107989 - RNA, 41 nt, Mus musculus
gcgcgacgcugacaccucgggucugcauccgugcggggcug

SEQ ID NO: 107990 - RNA, 42 nt, Mus musculus
uuugcaucucaggugauggaaaacaggaacgccucacggggg

SEQ ID NO: 107991 - RNA, 46 nt, Mus musculus
gggcgggcuccgaguuuagugcacuauacgaaaguggccucgggag

SEQ ID NO: 107992 - RNA, 45 nt, Mus musculus
ucaaaucccagcaaccacauggugguucacaaucauucguaauga

SEQ ID NO: 107993 - RNA, 46 nt, Mus musculus
guccuguuuaaaagugacaccaggggcuggaaagaugucucaguag

SEQ ID NO: 107994 - RNA, 41 nt, Mus musculus
uuguauguaaagaagaagaaauuagauauccugaccgugaa

SEQ ID NO: 107995 - RNA, 42 nt, Mus musculus
aaccaaaacaaucaccaucaauucaaccaagaaauagcccag

SEQ ID NO: 107996 - RNA, 45 nt, Mus musculus
gaugaacagagcaugguggaguacucuugucauucaaacaccuag

SEQ ID NO: 107997 - RNA, 45 nt, Mus musculus
ucauggcccucuaauaccacaucucaacaauaaaaaggaaaaaga

SEQ ID NO: 107998 - RNA, 45 nt, Mus musculus
acugucagagccuggugaagcagcgcggaggcguggcuagaggua

SEQ ID NO: 107999 - RNA, 42 nt, Mus musculus
gcggccuacucacaguuuaaaguugagcacagccccggcguu

SEQ ID NO: 108000 - RNA, 46 nt, Mus musculus
gggacuacagaaauaugaguccaaacacuauaugcaacucacauuu

SEQ ID NO: 108001 - RNA, 47 nt, Mus musculus
gcugccuugaaauaucucacagcugagaacaacagcuagcacuacua

SEQ ID NO: 108002 - RNA, 45 nt, Mus musculus
cugauuuugagccauauguuguugugagacgagacugcccugagu

SEQ ID NO: 108003 - RNA, 42 nt, Mus musculus
aagcaaugauugucccagcauuugaaacgcugcgcuacagac

SEQ ID NO: 108004 - RNA, 45 nt, Mus musculus
gaaggucagaaaagagauagacagauuuugaagauagugccggau

SEQ ID NO: 108005 - RNA, 41 nt, Mus musculus
uguuguguaacauaguaugacaucauuuccuuccugguaaa

SEQ ID NO: 108006 - RNA, 46 nt, Mus musculus
gcauggugacaggaauguaggcaugagacagagcuuacaucuugau

SEQ ID NO: 108007 - RNA, 46 nt, Mus musculus
cacugugucucuguuuacuuucuuuuuccaugaucuguccauugau

SEQ ID NO: 108008 - RNA, 46 nt, Mus musculus
cggcgggagcuguuuggcugccccagugagacugaugucaacaaug

SEQ ID NO: 108009 - RNA, 44 nt, Mus musculus
aggggaaugccuggacuaggaagcaggaguggguggguuggaga

SEQ ID NO: 108010 - RNA, 46 nt, Mus musculus
aaagagauaccagguuuuccauauggaagaaaaaauuagcacagac

SEQ ID NO: 108011 - RNA, 46 nt, Mus musculus
gggugugguaauuggcuggaaacaguuguccuugagccugugggaa

SEQ ID NO: 108012 - RNA, 46 nt, Mus musculus
uuuucaaugcuguuaucaaacaaaaccccuuucugguguaucagcu

SEQ ID NO: 108013 - RNA, 46 nt, Mus musculus
acauggaccuuuggaagaauauuccagaccccagauuacagcagau

SEQ ID NO: 108014 - RNA, 47 nt, Mus musculus
ggagcagauguggagacugacagcagagagggaacucaugggcaugu

SEQ ID NO: 108015 - RNA, 46 nt, Mus musculus
aaguggcagggccaguccgcccauacucacaccuucagggccagcu

SEQ ID NO: 108016 - RNA, 45 nt, Mus musculus
aaauugcaaugugaaaaugugcccuaagaacaggacccagcaagu

SEQ ID NO: 108017 - RNA, 45 nt, Mus musculus
agauggcgcagguguaugacaugaguaucagccuguucucuacau

SEQ ID NO: 108018 - RNA, 46 nt, Mus musculus
acaaauacucuuuuaaaaucaaguauacuaaguuuugcccauagag

SEQ ID NO: 108019 - RNA, 26 nt, Mus musculus
uuggaaggggcuauaacacagguaag

SEQ ID NO: 108020 - RNA, 41 nt, Mus musculus
aaccugaguuuauucccagcaccaauggaaaggccugagua

SEQ ID NO: 108021 - RNA, 46 nt, Mus musculus
uggaugcucacagucagcuguuggauggaacacagggcccccaaug

SEQ ID NO: 108022 - RNA, 42 nt, Mus musculus
agguagggagagagguagcauugaauggagguccaccugggc

SEQ ID NO: 108023 - RNA, 46 nt, Mus musculus
uuauuugacugauuuaucaauuccuccuauuguauuuucugcaacc

SEQ ID NO: 108024 - RNA, 52 nt, Mus musculus
gaucuuaguuaauuguccaguggcuucaccugcucaggagagcgccuuuuag

SEQ ID NO: 108025 - RNA, 42 nt, Mus musculus
uaagccacccauauuaaugagaguggagauagaggucaaauc

SEQ ID NO: 108026 - RNA, 47 nt, Mus musculus
agauuuaauagcacauaauguuucauuuaaaaaugaaaccuagagag

SEQ ID NO: 108027 - RNA, 46 nt, Mus musculus
aaaugggaauaaaauuguuccuguuucuaugacaaaggacccaaag

SEQ ID NO: 108028 - RNA, 46 nt, Mus musculus
agacauuuuguauauaaauaaauaaaaauaaaaugugccaccauug

SEQ ID NO: 108029 - RNA, 41 nt, Mus musculus
ugugugagugugugauugugugagugugugugugugugagu

SEQ ID NO: 108030 - RNA, 76 nt, Mus musculus
gugugugugugugagugugugugagagugugugugugugugagugugugauugugugagugugugugugugugagu

SEQ ID NO: 108031 - RNA, 45 nt, Mus musculus
caauaucaaauaaaauugacuuccaaccaaaacuuaucaaaaaag

SEQ ID NO: 108032 - RNA, 42 nt, Mus musculus
gaucacgggugacuggaacacaacaucagcccccaaagaauc

SEQ ID NO: 108033 - RNA, 47 nt, Mus musculus
uucugaaagaaaaugguguguguguguguguguaugugugugugugu

SEQ ID NO: 108034 - RNA, 45 nt, Mus musculus
uaaguucauaauguuguuccuccuauagaguuacagaccccuuca

SEQ ID NO: 108035 - RNA, 42 nt, Mus musculus
gcaucaaguccaagggcuucccacauugcuaagccugcagua

SEQ ID NO: 108036 - RNA, 46 nt, Mus musculus
aguguuuggaagcuaauuaugagauggaacccuggauauggcagac

SEQ ID NO: 108037 - RNA, 41 nt, Mus musculus
uuuccuaggcuuggggcuggaggagaaccacuagaagaaga

SEQ ID NO: 108038 - RNA, 45 nt, Mus musculus
ucauucugauauuuccauaugcucuacaagguauccuggcggagg

SEQ ID NO: 108039 - RNA, 45 nt, Mus musculus
augagaggaacccaugcccaugcugcuauugugccaccacuguga

SEQ ID NO: 108040 - RNA, 42 nt, Mus musculus
gagugcugacucacuccuuguucacaaccacucacuggagaa

SEQ ID NO: 108041 - RNA, 46 nt, Mus musculus
acuauugcacugcugugguaaaucuccucccaaauaagccccagca

SEQ ID NO: 108042 - RNA, 23 nt, Mus musculus
agaucuagggaggucacaauuug

SEQ ID NO: 108043 - RNA, 46 nt, Mus musculus
uggcccugcuucauggcuaguuccauguaacacacaguucccacac

SEQ ID NO: 108044 - RNA, 41 nt, Mus musculus
accaagacucaauuucugaaaagauacaaucucagcaugac

SEQ ID NO: 108045 - RNA, 46 nt, Mus musculus
cugguagagcuguaguaauuaaagaugugcagaauucucagaagaa

SEQ ID NO: 108046 - RNA, 77 nt, Mus musculus
gaaugcuagagaucugaacuugguucccuuuccuugugcagcacuuuaacaacaaaagaaacacuuuaccccuagca

SEQ ID NO: 108047 - RNA, 46 nt, Mus musculus
uucuccugucugaaccuucccaaccuuccccuucuacccuggaaaa

SEQ ID NO: 108048 - RNA, 44 nt, Mus musculus
uuuguaucccuuugaccuccuuuuguuuucuaauugcucuggcu

SEQ ID NO: 108049 - RNA, 46 nt, Mus musculus
auauuggagauuuuucaaaauuaguaucuuagcauaaauuaucuga

SEQ ID NO: 108050 - RNA, 45 nt, Mus musculus
uguuuguuuuauuucuguuuguucuacuuccaguuccguggagau

SEQ ID NO: 108051 - RNA, 46 nt, Mus musculus
aacaaugagcauuuggacccaaagccuaaaauucuaacacccagac

SEQ ID NO: 108052 - RNA, 46 nt, Mus musculus
ugagacacagcucaggaggaagcaucaucauccugucaucacauaa

SEQ ID NO: 108053 - RNA, 80 nt, Mus musculus
uaaauugguggccuuggggcagggaguggggguucuugaagcagaaagacuguguuaaaugcuaaaaugaugaccaccag

SEQ ID NO: 108054 - RNA, 45 nt, Mus musculus
ggggucacuucauggauuuucagccccacacugccagccccaguu

SEQ ID NO: 108055 - RNA, 50 nt, Mus musculus
ugaacuuccuacauagggucaacucagggacaugcauauuugaccuagau

SEQ ID NO: 108056 - RNA, 44 nt, Mus musculus
ugguggcugcaaggcuccaggacuagaagacugucauagggaaa

SEQ ID NO: 108057 - RNA, 47 nt, Mus musculus
uaucucuuuucaaccuuuucuuguaagcuuuuauugauaccaacaaa

SEQ ID NO: 108058 - RNA, 45 nt, Mus musculus
gggucccucuugccugauuuguucuucagcaaagucuccaccaau

SEQ ID NO: 108059 - RNA, 46 nt, Mus musculus
gucauauucucuacugagacuggaauucucucacauauggcauaau

SEQ ID NO: 108060 - RNA, 61 nt, Mus musculus
uauagggcagcauuguccuucucauuuccaguugaacuccaaaccucagcugccauucuuc

SEQ ID NO: 108061 - RNA, 78 nt, Mus musculus
aggcaggaggcuuuuuuauagauuauaacauauucuagucacagaaaaauuaucccuugcuuuuucuuuguuuagcac

SEQ ID NO: 108062 - RNA, 42 nt, Mus musculus
uguuuuuaccuccuuuuaaaauauucagcacuuuggccagau

SEQ ID NO: 108063 - RNA, 46 nt, Mus musculus
caguugccuguaacuuuaccaaauaggugaggcuggcuggccagca

SEQ ID NO: 108064 - RNA, 46 nt, Mus musculus
ugggccaaugaaaauccaggacuuacuucaucaucauguaguaugg

SEQ ID NO: 108065 - RNA, 46 nt, Mus musculus
gaggccauaguguaccaggcuuucuccaaaccuagcaccuccuaca

SEQ ID NO: 108066 - RNA, 47 nt, Mus musculus
auuguacccccaagcccaucuaacaaaaaccaguuucaugcccauuc

SEQ ID NO: 108067 - RNA, 63 nt, Mus musculus
aggcuuucucuguuuauacuauauccaauguaaagaggccggauuucauuucaauaugaaagu

SEQ ID NO: 108068 - RNA, 45 nt, Mus musculus
uuaacaggaaggggcugcauagacaaccacauauuauaggcagac

SEQ ID NO: 108069 - RNA, 45 nt, Mus musculus
agaacaucagaaaaaagcacaggagagaggugaaaagaacacaua

SEQ ID NO: 108070 - RNA, 42 nt, Mus musculus
acuaaauagauugugagcuccuuuucuauaguccaugugacc

SEQ ID NO: 108071 - RNA, 45 nt, Mus musculus
uccugugauaguauaugaggauguuaucagaacgucuuaaaagau

SEQ ID NO: 108072 - RNA, 45 nt, Mus musculus
uuuauucuaggucauccagaggacaaaccuuaagagccuggaguu

SEQ ID NO: 108073 - RNA, 42 nt, Mus musculus
agaggcucaaugccccaguguagaggaaugccagggugguga

SEQ ID NO: 108074 - RNA, 45 nt, Mus musculus
uggccuccuuguaaccuucuccaccuaaaccaugagucuguauca

SEQ ID NO: 108075 - RNA, 45 nt, Mus musculus
aaaaaaggacguuuucuaguguuuauugauguggauauaagcaga

SEQ ID NO: 108076 - RNA, 45 nt, Mus musculus
caugagugaaaaagaaaagaaaagguaaaauaagcaaucaaaaga

SEQ ID NO: 108077 - RNA, 46 nt, Mus musculus
ccuuggugagaggauuguagagagauguucugugaccugcacugaa

SEQ ID NO: 108078 - RNA, 46 nt, Mus musculus
guagaccugagacauaauggagcuccuuuggauauauaugagagaa

SEQ ID NO: 108079 - RNA, 46 nt, Mus musculus
augaagugauuacugcuaauguuccuaucuuaaccauuugggagag

SEQ ID NO: 108080 - RNA, 41 nt, Mus musculus
cuggacaucagcauggagaaacaaggaggugggccuagaga

SEQ ID NO: 108081 - RNA, 44 nt, Mus musculus
uguggaagccaagcacaugcacuugggaggcagaggcaggugga

SEQ ID NO: 108082 - RNA, 46 nt, Mus musculus
gcuguaggugggucuuaacaaaagaagacaaugcuuggcuguuagg

SEQ ID NO: 108083 - RNA, 44 nt, Mus musculus
aaggggugcuacgauaccuugaauuagaguuaggcaucugacag

SEQ ID NO: 108084 - RNA, 46 nt, Mus musculus
gaaagaaagaaagaaagaaagaaagaaagaaaauuccaagggaaau

SEQ ID NO: 108085 - RNA, 41 nt, Mus musculus
guaggaguuuuacccaaucaaggugaaguucuugugacagc

SEQ ID NO: 108086 - RNA, 47 nt, Mus musculus
gacuaggaguuaggacuggacauccauacaugaguucaaagggcgag

SEQ ID NO: 108087 - RNA, 77 nt, Mus musculus
ugcuauuugggagagaggggugaggaccgaugaucuggaggagagagaaggcuuuggucuccaauguuaacgggcag

SEQ ID NO: 108088 - RNA, 49 nt, Mus musculus
acgguucuguuagggucgauguguaugggggggaaaaaaggucaucuuu

SEQ ID NO: 108089 - RNA, 46 nt, Mus musculus
uuuacauauccagucuguuagccuaugucuuuuuauuggggaauug

SEQ ID NO: 108090 - RNA, 42 nt, Mus musculus
ugauugcucugguuaggacuucgaguacuauacugaauagcu

SEQ ID NO: 108091 - RNA, 46 nt, Mus musculus
ucaagcuaucaucauuuaccucaaaguauaugggacuaccuaaggu

SEQ ID NO: 108092 - RNA, 42 nt, Mus musculus
aaguaaaacugaaaguuguauuucuuuaggaauugaagagau

SEQ ID NO: 108093 - RNA, 67 nt, Mus musculus
cuuagagccuuauaugugccaggcaagcaugcgaccaauuagccauaccccauccagcguuacaucu

SEQ ID NO: 108094 - RNA, 45 nt, Mus musculus
agcuuucagggcacacacuuuaaaucauuuagccaucgucucagu

SEQ ID NO: 108095 - RNA, 63 nt, Mus musculus
acucugccugccaaccuggagagagucauuguccuagacaccgacaucaccuuugcaacagac

SEQ ID NO: 108096 - RNA, 59 nt, Mus musculus
ggauucccaacaaacauuacucuggaauuuauggccugaugaagcugguucugaccaaa

SEQ ID NO: 108097 - RNA, 46 nt, Mus musculus
ugguacacuuaucuguggguauaagaauaaauauuuagaaugcagu

SEQ ID NO: 108098 - RNA, 45 nt, Mus musculus
gagggacgaaaugaagaugaauuccaaaagccagaguuuucaugc

SEQ ID NO: 108099 - RNA, 46 nt, Mus musculus
uauaaaaucuauuuuccuuucccacauagcuccacagcacccaucu

SEQ ID NO: 108100 - RNA, 45 nt, Mus musculus
uuuucaccucccuagguuuucauaaugccuccuaaacccccaccu

SEQ ID NO: 108101 - RNA, 35 nt, Mus musculus
uuuauaauggugugauuucuuuggcaucugcauua

SEQ ID NO: 108102 - RNA, 41 nt, Mus musculus
gucugugucugugucuguguguaugugugugucugugucug

SEQ ID NO: 108103 - RNA, 45 nt, Mus musculus
uguccuuuuauccuuuuggaggccagcucugguaguauguucagu

SEQ ID NO: 108104 - RNA, 45 nt, Mus musculus
aacuauagacccugggauuauccuaguaucugugauauggucaga

SEQ ID NO: 108105 - RNA, 46 nt, Mus musculus
gaaaagggugggagaagugugcuuagcagccaaucagugcagagaa

SEQ ID NO: 108106 - RNA, 42 nt, Mus musculus
ugcucauagucaucuauuggauggaucacagggcccccaaug

SEQ ID NO: 108107 - RNA, 45 nt, Mus musculus
gcuugguuagagucacaccaagguauuuuauauuguuuguaacua

SEQ ID NO: 108108 - RNA, 42 nt, Mus musculus
uuauuguaaauuauaaaaccaaaaagacugagucaggcaaag

SEQ ID NO: 108109 - RNA, 44 nt, Mus musculus
uugcucauagcauugaugccuguucuuuacccacauuacagagg

SEQ ID NO: 108110 - RNA, 46 nt, Mus musculus
uuaaaguucuucuauaacacaaccuugcuuccaugaugguugagau

SEQ ID NO: 108111 - RNA, 45 nt, Mus musculus
cuaauacagacucugcuuuggucagugcaguucuagccaccaagg

SEQ ID NO: 108112 - RNA, 44 nt, Mus musculus
uuucguagaucuccuauagcugggagccuugguggggaguuaga

SEQ ID NO: 108113 - RNA, 46 nt, Mus musculus
aagucuuuggacccauuacaaaagaggcaagcucauauccucagca

SEQ ID NO: 108114 - RNA, 42 nt, Mus musculus
gccuuuaugcaagcaaugauugucucauguuuuggggguagu

SEQ ID NO: 108115 - RNA, 44 nt, Mus musculus
aacaccuggauccuggcggaauggaaugggaaagggaaggaaga

SEQ ID NO: 108116 - RNA, 44 nt, Mus musculus
ggggagggggauagaauuaagaugguagaagaggcagagaggga

SEQ ID NO: 108117 - RNA, 45 nt, Mus musculus
aguaaaaccuucuugcuguccugccccaguuaccguagcagcuag

SEQ ID NO: 108118 - RNA, 45 nt, Mus musculus
ggugcacaaaggucuggcauucagaccggccuccuggcugaagau

SEQ ID NO: 108119 - RNA, 45 nt, Mus musculus
cucuaccagcaucaugagauaugauuuuaaauccgagucuuccuu

SEQ ID NO: 108120 - RNA, 46 nt, Mus musculus
auuuuuguuguuaaaguugggauucuauucuuguggcugucuucuu

SEQ ID NO: 108121 - RNA, 45 nt, Mus musculus
uguugugaauacuuuuuguuauccuagguuuuuuguuauuccaga

SEQ ID NO: 108122 - RNA, 103 nt, Mus musculus
gaugauauugaggaaguggcugggaacagaauaaaagugugguuuagaugaacaucaagggaggcaggggugaucaugguagggugucaggggaaguaggcuc

SEQ ID NO: 108123 - RNA, 45 nt, Mus musculus
auccuugugauacaaaaauuaaaacuguaacugacucccacagcu

SEQ ID NO: 108124 - RNA, 42 nt, Mus musculus
uuuauucauaguggaaggaguauugguuggaagugaagagau

SEQ ID NO: 108125 - RNA, 45 nt, Mus musculus
augcuccaguuuuggucacuaaugcaguggaaggaccaccuauga

SEQ ID NO: 108126 - RNA, 45 nt, Mus musculus
cuguagguacagguuguagagauugaauguauguuaggcagugua

SEQ ID NO: 108127 - RNA, 45 nt, Mus musculus
uuggucaugguaugaacucacgugcaugcauguguggagaucaga

SEQ ID NO: 108128 - RNA, 64 nt, Mus musculus
ggacaggggacagugagaaucugcgagcuggcauuguggcagguaacagcucugagugugggca

SEQ ID NO: 108129 - RNA, 64 nt, Mus musculus
ccccgguacacagccuccagccaacgggagcgggagagccuggaagugcguguucgagaaguug

SEQ ID NO: 108130 - RNA, 45 nt, Mus musculus
ugugcacauaugggcccuauggggggugucaggggaagaagaggg

SEQ ID NO: 108131 - RNA, 41 nt, Mus musculus
uguaaauaaggggauucuagagauggguuuaaccaaggaga

SEQ ID NO: 108132 - RNA, 46 nt, Mus musculus
aacucaccauuuuucagcuaggcuggauggccagcaagccccagug

SEQ ID NO: 108133 - RNA, 43 nt, Mus musculus
ggcaugugcacacaccacuaauguauugugcuuacuggaagug

SEQ ID NO: 108134 - RNA, 45 nt, Mus musculus
gcaacuggaccugcuuuguagaaaacacuaguccagacuagaaga

SEQ ID NO: 108135 - RNA, 71 nt, Mus musculus
aggagaaggggacagaaacauucuuauuggagagcaagcauagugaugcuuguaguggaagaugugccagg

SEQ ID NO: 108136 - RNA, 50 nt, Mus musculus
aguaaacccugauacuuuugaauuuauccuccgaagguccagagaagcaa

SEQ ID NO: 108137 - RNA, 46 nt, Mus musculus
uuagugagacauguucccaccuuguuacugggaagugcagccuuua

SEQ ID NO: 108138 - RNA, 45 nt, Mus musculus
ugaaccuggguggaguuagaaaaacucucauuuaaagcccuccau

SEQ ID NO: 108139 - RNA, 42 nt, Mus musculus
gcaggaggagcgggaaugggaugggagguuuugggggugaac

SEQ ID NO: 108140 - RNA, 46 nt, Mus musculus
ggcaucagugggagaagaggcccuugguccugugaaggcuggauac

SEQ ID NO: 108141 - RNA, 46 nt, Mus musculus
uuacuuuagaaauaugguaacauacauuguuuuuguaggcugaaca

SEQ ID NO: 108142 - RNA, 46 nt, Mus musculus
aaaaauccaaauagguugcuaauuaagcuugucaguugucuucuca

SEQ ID NO: 108143 - RNA, 44 nt, Mus musculus
uuaggaucagaaagacagaaaguagaaugcugacuggcagaggu

SEQ ID NO: 108144 - RNA, 42 nt, Mus musculus
ucaguacucuuaacugcuaagccaucucucuagccccucugu

SEQ ID NO: 108145 - RNA, 36 nt, Mus musculus
auccucaagauagauuuguaucuaaaacugucaaag

SEQ ID NO: 108146 - RNA, 42 nt, Mus musculus
auucauaucagcugcaccagcucuccagcacugccccaggaa

SEQ ID NO: 108147 - RNA, 46 nt, Mus musculus
gauuguuuucuagccuacaugcagauacacacaaauacaggcaaau

SEQ ID NO: 108148 - RNA, 46 nt, Mus musculus
auaaaacaaaacaaacaagugaacaaacaaaaauaaacaugcagau

SEQ ID NO: 108149 - RNA, 41 nt, Mus musculus
auacuaccugagcccagaacucaggugcagcagaggcagac

SEQ ID NO: 108150 - RNA, 46 nt, Mus musculus
cucucuaccugugagaaguaucauuaaaaauauuaagggccaaguc

SEQ ID NO: 108151 - RNA, 46 nt, Mus musculus
cagcauagugucuccaugagaacucaucuauuuuauagggcauuuc

SEQ ID NO: 108152 - RNA, 46 nt, Mus musculus
gaagcagugcauaagugguucgaggaucugcagauaaacugaagac

SEQ ID NO: 108153 - RNA, 45 nt, Mus musculus
ggcauuuuguugagggaguaucgaguaauaguagaauucagaggu

SEQ ID NO: 108154 - RNA, 46 nt, Mus musculus
auguucucuaaggucacacauucccacaucaacauaucgcuaagac

SEQ ID NO: 108155 - RNA, 46 nt, Mus musculus
agaaagagagagagagagagagagugugugugugugugugugugug

SEQ ID NO: 108156 - RNA, 41 nt, Mus musculus
ccaagguuucauuuucaaaacccauaguucagccugcuaau

SEQ ID NO: 108157 - RNA, 45 nt, Mus musculus
uaauucccaugcuugacaguagacauuugggccuuugcaauguuu

SEQ ID NO: 108158 - RNA, 42 nt, Mus musculus
aauggauggaugguagguaguuagguggaugaaugaguagau

SEQ ID NO: 108159 - RNA, 63 nt, Mus musculus
auagucuuaaggucuauugguaugucugucaguuaggaaagaaggaaggacaaaagguaaagg

SEQ ID NO: 108160 - RNA, 45 nt, Mus musculus
ucaccuccacacuaagucuggaggcccuuuauguuuaugacaggu

SEQ ID NO: 108161 - RNA, 26 nt, Mus musculus
uguuuaugcuugauaguagauuagag

SEQ ID NO: 108162 - RNA, 29 nt, Mus musculus
ugugacugacugcucuugugccccuuccc

SEQ ID NO: 108163 - RNA, 42 nt, Mus musculus
gguuaaggagugguaugagcccagacaauggaaggccacaug

SEQ ID NO: 108164 - RNA, 42 nt, Mus musculus
gaugucaugauuacauguuccagaggagguacagaaaugggu

SEQ ID NO: 108165 - RNA, 41 nt, Mus musculus
uagggugggauuuaggagcagguguuuccuauuggcucaga

SEQ ID NO: 108166 - RNA, 45 nt, Mus musculus
ucucucuugcucucccucuuccucuuuuccgugucugugugugug

SEQ ID NO: 108167 - RNA, 42 nt, Mus musculus
ugacagaaggggcgggaguuuacccugaaaauuggaauagga

SEQ ID NO: 108168 - RNA, 51 nt, Mus musculus
aguuucaaacaaggacaagacauguuauauggggcuauuuuggugcaaacg

SEQ ID NO: 108169 - RNA, 46 nt, Mus musculus
ugcuccgguaucugaaggacuugaugcauagaagcaacuggaagau

SEQ ID NO: 108170 - RNA, 46 nt, Mus musculus
acauacauacacacacacagagacacagagagacacacagagagag

SEQ ID NO: 108171 - RNA, 44 nt, Mus musculus
gcaggugccuuaagcuaagaaagcuuaagcucauuaagggagau

SEQ ID NO: 108172 - RNA, 45 nt, Mus musculus
uuaauucaagaaucaagcuaguagacaauaggaaugugcugagau

SEQ ID NO: 108173 - RNA, 46 nt, Mus musculus
auaauuuauuaaugaaaugguuuagugauuaccaauuugacaagau

SEQ ID NO: 108174 - RNA, 45 nt, Mus musculus
guuaaucaccacagucgugagaugguaguguacugggggagaggu

SEQ ID NO: 108175 - RNA, 45 nt, Mus musculus
ugacaucgucaguaaauccggugcugagaauucaaagauaacaga

SEQ ID NO: 108176 - RNA, 45 nt, Mus musculus
aauuagagauuggcacuucugagaggaugcugggaaucugcagag

SEQ ID NO: 108177 - RNA, 45 nt, Mus musculus
auucuugucuccuuaauaagaaaauuuaaaaacugacucgguaga

SEQ ID NO: 108178 - RNA, 53 nt, Mus musculus
uggauaaaaaguaguuagcauggggaagucuagcaugcaggccgggcagcauu

SEQ ID NO: 108179 - RNA, 46 nt, Mus musculus
gauuaacauuagaaauggauguuuuuauuucuuugagccuguuuaa

SEQ ID NO: 108180 - RNA, 42 nt, Mus musculus
ccauuccaugggcaggcaguccugaaauuuaaagggcaagag

SEQ ID NO: 108181 - RNA, 45 nt, Mus musculus
uuucuggaagggaaaugcaagugcucaggcuggggugccagagau

SEQ ID NO: 108182 - RNA, 46 nt, Mus musculus
uguagauuugaaaagaaaugcucauauccaguuauccaccccguaa

SEQ ID NO: 108183 - RNA, 44 nt, Mus musculus
cagagacaguaauggacaucacuuuccuagcuguacgugggagu

SEQ ID NO: 108184 - RNA, 46 nt, Mus musculus
uuuauccaucucuucaguuccagaagcugauuuucugaguguagau

SEQ ID NO: 108185 - RNA, 33 nt, Mus musculus
cuaaucuuuuugugcaucuugugggugugugau

SEQ ID NO: 108186 - RNA, 46 nt, Mus musculus
guuuuuuaaggagagaaaaugagaguugggaaggaccugggaagag

SEQ ID NO: 108187 - RNA, 45 nt, Mus musculus
agauguuugugagccaccaugugguugcugggaacugaacuuagg

SEQ ID NO: 108188 - RNA, 46 nt, Mus musculus
cucaauagucacaaacaguauaaacuacauugaugugacucuaacu

SEQ ID NO: 108189 - RNA, 45 nt, Mus musculus
ggguugaggcuaggaggaaguuguauucccacugucaccccaggc

SEQ ID NO: 108190 - RNA, 85 nt, Mus musculus
gguuucuuucucugguuucuuugauuauauuguuuugcuguuaugaucucacucaaaaacaaaaacaaaaacaaugcccucaacu

SEQ ID NO: 108191 - RNA, 57 nt, Mus musculus
uuucugaaacccugacuaauggguaauguggucuuuuuggaagaggaaguuggaggc

SEQ ID NO: 108192 - RNA, 45 nt, Mus musculus
aaucucauucuaauacauauuaucucauaggacaggguuguagag

SEQ ID NO: 108193 - RNA, 46 nt, Mus musculus
gugccuuauguugagguugcacagaaguuacauguuugggguagau

SEQ ID NO: 108194 - RNA, 41 nt, Mus musculus
uugagaagggaucauggaauaugugguauuaggaaccaagg

SEQ ID NO: 108195 - RNA, 46 nt, Mus musculus
gaauacagugcauucuuggucuugcaaacuuuauaugccccaguac

SEQ ID NO: 108196 - RNA, 45 nt, Mus musculus
uccucuaucauuaucaugagaaauguuuuuaaaucugggucuaga

SEQ ID NO: 108197 - RNA, 45 nt, Mus musculus
ugagacagauacccaaacaugaaguuuguagaucuuuagcucagg

SEQ ID NO: 108198 - RNA, 93 nt, Mus musculus
cugggggaugugucauugguucaguccuuagaauuggaagacaacaaccaggaaaacauuaugacgugagacuuauuugauggaaugggugaa

SEQ ID NO: 108199 - RNA, 42 nt, Mus musculus
ucauugguucacacccuuuuuguuccauucucuggcccucuc

SEQ ID NO: 108200 - RNA, 63 nt, Mus musculus
caaacaaacaauacaaaacaaaagacaaaaagaacaaagaccaaaagaaugaaagccacaguc

SEQ ID NO: 108201 - RNA, 45 nt, Mus musculus
gagcuauguuuauaaaggaggaagguuuucuuuugguucucaggu

SEQ ID NO: 108202 - RNA, 46 nt, Mus musculus
gaaagcuuucauuaguaaucacguuuuacagauggagcauuggggu

SEQ ID NO: 108203 - RNA, 23 nt, Mus musculus
guggcccugcagcugugccagau

SEQ ID NO: 108204 - RNA, 47 nt, Mus musculus
cucuagccagaacugcugaacuccuucucugcccgaagcaugccagg

SEQ ID NO: 108205 - RNA, 48 nt, Mus musculus
aagaggcagaaaagguagaaacuacccucugacuauauaaaggagaaa

SEQ ID NO: 108206 - RNA, 76 nt, Mus musculus
auuagaacuucccccuaggauuuuguuuaaacagaaagaaguuccuacuuuaagaagaggaagaaagaaaggaaag

SEQ ID NO: 108207 - RNA, 74 nt, Mus musculus
ggguaaagacucaaucaauaggauccagaauuuuacaguuguguuccaguccuguuuaccucuguguuuucugc

SEQ ID NO: 108208 - RNA, 46 nt, Mus musculus
cagaagauauggucaguaggcguggaguaagguugcuccuggaggu

SEQ ID NO: 108209 - RNA, 46 nt, Mus musculus
ugagggcugcuaagaguaauaauauauaacuguauagaugugagau

SEQ ID NO: 108210 - RNA, 46 nt, Mus musculus
auaauacuaguaacagcuauaugcuguuaugcuauauguagggucu

SEQ ID NO: 108211 - RNA, 46 nt, Mus musculus
accaaguuuggugugaaaccccagucugcuugaugcuuauuuuagu

SEQ ID NO: 108212 - RNA, 46 nt, Mus musculus
uaccaagagggggcuguggcucuugaucuuucuucacugugcagag

SEQ ID NO: 108213 - RNA, 44 nt, Mus musculus
gaugauggugauguucacuuuuaaucucagaaugagaggaauag

SEQ ID NO: 108214 - RNA, 44 nt, Mus musculus
ggggagcccacgacuuggaggauguugggugcagugagaugagg

SEQ ID NO: 108215 - RNA, 45 nt, Mus musculus
ggucaagacagauuuuuguguaggaaaagauaacggcuaucugau

SEQ ID NO: 108216 - RNA, 45 nt, Mus musculus
uauuacuaccuucuacaugcuagcuucucagccagguccccaggu

SEQ ID NO: 108217 - RNA, 45 nt, Mus musculus
gagaaacuugcccagagccauacaguuggagguuugagcccgaau

SEQ ID NO: 108218 - RNA, 46 nt, Mus musculus
gcuaugaggaaauuccccagaaggaauuagaacaauuaggcgaguu

SEQ ID NO: 108219 - RNA, 46 nt, Mus musculus
aacuacaguguugaacagugugguugauaggaaccaaggcaaagau

SEQ ID NO: 108220 - RNA, 46 nt, Mus musculus
ggguaugauacugcccuugaguucuuugugguaucaggcugucuuc

SEQ ID NO: 108221 - RNA, 46 nt, Mus musculus
ccccuggcaggcugggcugucuuuuuuacccaucccuuggagacua

SEQ ID NO: 108222 - RNA, 46 nt, Mus musculus
ugccuuacccaugaucuuccuaguugucaaugcaaaugcugcuguu

SEQ ID NO: 108223 - RNA, 46 nt, Mus musculus
ugaaacagcugugucugccauuucgagucuucuacugcccugugaa

SEQ ID NO: 108224 - RNA, 66 nt, Mus musculus
uguuuaugucucacagccccaugaaucagaacaguggggagacuugugauucugugugaggaagau

SEQ ID NO: 108225 - RNA, 34 nt, Mus musculus
gaucucuuggagaguuucuaacacaacccuaaug

SEQ ID NO: 108226 - RNA, 42 nt, Mus musculus
caucaccaaggaagucuagacuggaacucaagcaggucagaa

SEQ ID NO: 108227 - RNA, 46 nt, Mus musculus
uuccacacagaacaauaaaauauuaacauauagauagaugauaggg

SEQ ID NO: 108228 - RNA, 46 nt, Mus musculus
uagcagccuagagcugggaguggggcacuucaguuaugaguuagug

SEQ ID NO: 108229 - RNA, 46 nt, Mus musculus
ugucagcauggucacugagaguuuuguagauaaggagugaaaauug

SEQ ID NO: 108230 - RNA, 41 nt, Mus musculus
ggggcucgggagcaguuccuauaauuaaaagcagagcagug

SEQ ID NO: 108231 - RNA, 45 nt, Mus musculus
aagaaaccugauuuaccgcucucuuggaguucuagagggcaagga

SEQ ID NO: 108232 - RNA, 43 nt, Mus musculus
gcuuugugcuuuucauucaugaagcauucacgacacagcaagu

SEQ ID NO: 108233 - RNA, 46 nt, Mus musculus
cucgcuucuuuugggaaagugauacaccauauccaaagcgcuugac

SEQ ID NO: 108234 - RNA, 45 nt, Mus musculus
uagagucugacaaggggcuuguugcagaggaugccaccuugcaga

SEQ ID NO: 108235 - RNA, 45 nt, Mus musculus
uuacuauugugugcuguggagaaggugcugaguaccuugcauaug

SEQ ID NO: 108236 - RNA, 45 nt, Mus musculus
cauauuugguauuugcuccuugacugaacugcugcccaagaagau

SEQ ID NO: 108237 - RNA, 46 nt, Mus musculus
ggacuguagcugcugguuugggccuggugucugccugccuguagag

SEQ ID NO: 108238 - RNA, 42 nt, Mus musculus
gugcuauuuaacauggccauuauccuuuuaauucaagcagcg

SEQ ID NO: 108239 - RNA, 45 nt, Mus musculus
augaguccuauuugaauggcucuccacagugcuccauaggcagau

SEQ ID NO: 108240 - RNA, 45 nt, Mus musculus
ggguguaggcaggcgcuguaaugcauuuuuagauuagugauugau

SEQ ID NO: 108241 - RNA, 46 nt, Mus musculus
uggugggaacuacaugguaugcuggcaggaacagcaagcuggauga

SEQ ID NO: 108242 - RNA, 41 nt, Mus musculus
auggaggagaaagaagagagggaggaaggcaggccacgugc

SEQ ID NO: 108243 - RNA, 31 nt, Mus musculus
acucagguccccaugcuuauguggaaaacac

SEQ ID NO: 108244 - RNA, 51 nt, Mus musculus
ccuagcuuuucugauucucgcuucauaaugacacugauacugccauccugu

SEQ ID NO: 108245 - RNA, 69 nt, Mus musculus
ucugcagcacauuuguuucaucucuuccccucucccauuuuaggaaccaccagucccuaacucuguagu

SEQ ID NO: 108246 - RNA, 65 nt, Mus musculus
gcucauugccagugacuggcaaccaucuacccuucuuaguggacauacaaagcuuuucugaacca

SEQ ID NO: 108247 - RNA, 46 nt, Mus musculus
acccucaugacugccuugcuucucugaaguuucuuccugcuggauu

SEQ ID NO: 108248 - RNA, 45 nt, Mus musculus
aaccuggaaugggccccauguucuuuccucggaauauauagagau

SEQ ID NO: 108249 - RNA, 61 nt, Mus musculus
aggauaagggguggauuuuuuucuaccucuacuguggugacugguucuuaguagcucugca

SEQ ID NO: 108250 - RNA, 42 nt, Mus musculus
gagucuguuauuauuuuaauauugaagcgaaaugggggagua

SEQ ID NO: 108251 - RNA, 46 nt, Mus musculus
cucagguuuccuguguuccuuggauuccaggaaccaucugucagua

SEQ ID NO: 108252 - RNA, 46 nt, Mus musculus
agcagcaagugcuuuuaacugccaugccaucucuucagcccuagac

SEQ ID NO: 108253 - RNA, 46 nt, Mus musculus
aguuauagacaguuggaaacugccaguggguucuagaaacugaguu

SEQ ID NO: 108254 - RNA, 83 nt, Mus musculus
agcaggcagccauucacuccugcaaguuguguacaacugugcagguauguucaaaggaugacuuugaaguuucuacauuagug

SEQ ID NO: 108255 - RNA, 42 nt, Mus musculus
aucuucauaggugcaguaggaccaagggguaagagacugaag

SEQ ID NO: 108256 - RNA, 46 nt, Mus musculus
gcaaaguguuaagggaauaucugguaagauucaaauacagugguuu

SEQ ID NO: 108257 - RNA, 45 nt, Mus musculus
cuugaggagaacgcacauuuauggagcuggggucuguuaauuuca

SEQ ID NO: 108258 - RNA, 45 nt, Mus musculus
ucuccugccuucccaccucaggauucacuuugauagacuccagau

SEQ ID NO: 108259 - RNA, 42 nt, Mus musculus
agagaggucccgggccggcgggcgggagggcugggcgcgcgg

SEQ ID NO: 108260 - RNA, 45 nt, Mus musculus
cucaguuccagcaaucgcuaaucguuaucaucaucccagaacaga

SEQ ID NO: 108261 - RNA, 45 nt, Mus musculus
uaacagccugcuucuccuuucuuauacccugaagaaaagccuugg

SEQ ID NO: 108262 - RNA, 46 nt, Mus musculus
aacaaugaaugagcuuuucuaugcugucauguuuuugcacacuaag

SEQ ID NO: 108263 - RNA, 23 nt, Mus musculus
gcuugagaccuuuucccccuccc

SEQ ID NO: 108264 - RNA, 46 nt, Mus musculus
cuuacccuuugcagccuucccucgcaagucuguaucuaccugccag

SEQ ID NO: 108265 - RNA, 46 nt, Mus musculus
cacaggacagugauuuguucuucuuggggacggacacacacaagaa

SEQ ID NO: 108266 - RNA, 42 nt, Mus musculus
cccuuccccuaccccgacuccaagaaccagagaugugcagac

SEQ ID NO: 108267 - RNA, 46 nt, Mus musculus
cagugguucuuguucugagugccgauaaaccagugugaaggaggag

SEQ ID NO: 108268 - RNA, 46 nt, Mus musculus
aaaagaagaagucuagcccacagucuccggacacagcaauggaccu

SEQ ID NO: 108269 - RNA, 38 nt, Mus musculus
cucucccuggaugacagcaaugcccacaaauccaaaaa

SEQ ID NO: 108270 - RNA, 46 nt, Mus musculus
gcuucaucuuuuuggauuugugggcauugcugucauccagggagag

SEQ ID NO: 108271 - RNA, 45 nt, Mus musculus
aagaugaaacucauucucucaccaaaggagaagggaagcagcuca

SEQ ID NO: 108272 - RNA, 46 nt, Mus musculus
ggagcuggaggccggggagcuggugauagaugacucuuacagggag

SEQ ID NO: 108273 - RNA, 69 nt, Mus musculus
guccccacccugccacuuccugcucuacacacagauggacacggggagaagaaaaagaaaagggaagac

SEQ ID NO: 108274 - RNA, 45 nt, Mus musculus
ucuucccuuuucuuuuucuucuccccguguccaucuguguguaga

SEQ ID NO: 108275 - RNA, 45 nt, Mus musculus
uugugagccaccaugugguuguucggauuugaaaucaggaccuuu

SEQ ID NO: 108276 - RNA, 42 nt, Mus musculus
uuuaaagggaagcagccaucccugacaacuuuuaggugccuu

SEQ ID NO: 108277 - RNA, 46 nt, Mus musculus
ccuguagucuuccuuucccuucagugaauucgaaaucuuagucaag

SEQ ID NO: 108278 - RNA, 46 nt, Mus musculus
uguguguuucuuuuggaaaucugguauacauuaggugggcggugag

SEQ ID NO: 108279 - RNA, 42 nt, Mus musculus
agguccggaguucaaaucccagcaaccacauggugggcucac

SEQ ID NO: 108280 - RNA, 42 nt, Mus musculus
agggagggaaugcagugagagacaucuaaaauucagggggcc

SEQ ID NO: 108281 - RNA, 46 nt, Mus musculus
uuuauucuauuucccuuucccaaugagagaucugucuauaccucag

SEQ ID NO: 108282 - RNA, 45 nt, Mus musculus
cauuggcucugcaaaugguacuguuagaagaaugagcccacagac

SEQ ID NO: 108283 - RNA, 46 nt, Mus musculus
gccuauuuugagacaaguaucucgaaggguauaaaguccgugucaa

SEQ ID NO: 108284 - RNA, 46 nt, Mus musculus
ugaaccugguguuugguuuguuuacauccuguuaagucuccagauu

SEQ ID NO: 108285 - RNA, 42 nt, Mus musculus
ucugccugucacucuguagaccucaacuuggagacccaccgg

SEQ ID NO: 108286 - RNA, 73 nt, Mus musculus
uauuucucugcuuuuggugaaaugaaccaauuuaaaccagauuagauuauaguaaaggcaaguuucuugggaa

SEQ ID NO: 108287 - RNA, 98 nt, Mus musculus
gcugcucucaggcaggcaaguucauuggccccaaggccaagggagucaccauggggaaagauggggugggggaaggagagagaaaguggagagauaag

SEQ ID NO: 108288 - RNA, 67 nt, Mus musculus
agaagggggaggggagagaaaccaaaaugucuggauucuauagggaggagccucugggggagugcaa

SEQ ID NO: 108289 - RNA, 46 nt, Mus musculus
auaugcauacccugagucagaaaccaaacaauuuguaggcagguuu

SEQ ID NO: 108290 - RNA, 46 nt, Mus musculus
agggaagucaccaugggggugggggagaaagggugcuuaugcggag

SEQ ID NO: 108291 - RNA, 56 nt, Mus musculus
uuuagacagcauuguuacaaacccuaaugucucuauuuagcagugagauagauuac

SEQ ID NO: 108292 - RNA, 46 nt, Mus musculus
uucccuccugcguaaucuaucucacugcuaaauagagacauuaggg

SEQ ID NO: 108293 - RNA, 46 nt, Mus musculus
guuagcaugcagauaggugaggauagacucaugcaaguucagguaa

SEQ ID NO: 108294 - RNA, 45 nt, Mus musculus
gcuuggcccauggaaguaguacuaguaaagagguguggccuugcu

SEQ ID NO: 108295 - RNA, 46 nt, Mus musculus
gacuucuuuuggggugacaguacuccuacagaagaggcugagaaga

SEQ ID NO: 108296 - RNA, 42 nt, Mus musculus
uucauauaaaauaauucuuaaaaaaaauuaagugggggggcg

SEQ ID NO: 108297 - RNA, 46 nt, Mus musculus
ugaaauacuguuucaaaaauaaauaaauaaaauaaagaagccagag

SEQ ID NO: 108298 - RNA, 45 nt, Mus musculus
aaggcuaugaauuugagggggggcaugggaggauuuggugggaag

SEQ ID NO: 108299 - RNA, 45 nt, Mus musculus
cugagaacaucuauuuuagauagugauugaaagaagccagcaccg

SEQ ID NO: 108300 - RNA, 45 nt, Mus musculus
uuuuagacagacauuaagaaaugacaaaucuguaugcuccacaug

SEQ ID NO: 108301 - RNA, 41 nt, Mus musculus
aaauguguacaaaucuuuaauacaaauacaacagggcuagg

SEQ ID NO: 108302 - RNA, 45 nt, Mus musculus
ucucucucagucuuccauuucucuuauauuuugugugugugugug

SEQ ID NO: 108303 - RNA, 46 nt, Mus musculus
cuaugagggaucaggaaugccagggugguacuucuccuaaccacag

SEQ ID NO: 108304 - RNA, 46 nt, Mus musculus
cgggucaugacucuuggaagcagagcuacagauaauuaaucaacag

SEQ ID NO: 108305 - RNA, 24 nt, Mus musculus
gcucugcgcgggcaggcuccacuc

SEQ ID NO: 108306 - RNA, 42 nt, Mus musculus
gaggaggaggaggaggaggaggaggaggaggagaagccaagc

SEQ ID NO: 108307 - RNA, 41 nt, Mus musculus
ggucugucuacauagugaaggaaguucagcacagggcuaua

SEQ ID NO: 108308 - RNA, 53 nt, Mus musculus
auggccuucugugcaaucuucuucaggaccugacccccugagaggucacccag

SEQ ID NO: 108309 - RNA, 72 nt, Mus musculus
ucgagcacgauagagcuguuugaacuugguggggcugucgauguucgggaagguaaaaaaagccaggcccuc

SEQ ID NO: 108310 - RNA, 46 nt, Mus musculus
uagggcuugcuugagaucgaccagggaugaggauggagacccaguu

SEQ ID NO: 108311 - RNA, 52 nt, Mus musculus
gccaucugugagggacucuggucuuuguguuccucugucagcaucaccugca

SEQ ID NO: 108312 - RNA, 46 nt, Mus musculus
caagcuguucauucuucuaugccacaucaaaccaaaguccccugau

SEQ ID NO: 108313 - RNA, 45 nt, Mus musculus
ccacuguugccaacaggaagcugagagugaggacccacuggagga

SEQ ID NO: 108314 - RNA, 46 nt, Mus musculus
agggagugggcuagggaccccaaaagcuuucuuagaggcccaagag

SEQ ID NO: 108315 - RNA, 46 nt, Mus musculus
accaugggcacugggcucagaacagcugcuuuuacaggccaguuuu

SEQ ID NO: 108316 - RNA, 44 nt, Mus musculus
acgcggaggcugguuuuucccgcgaaagucggcuuccucuagga

SEQ ID NO: 108317 - RNA, 46 nt, Mus musculus
acccgggcauuuucuacagcgacagcuucgguggcgaccccggugc

SEQ ID NO: 108318 - RNA, 46 nt, Mus musculus
uaccgagugggcaccgaucgcacgggcuucaccuucaaguacaggu

SEQ ID NO: 108319 - RNA, 41 nt, Mus musculus
aagcggcauuacaaccugggugaauacuggaucgaggugga

SEQ ID NO: 108320 - RNA, 45 nt, Mus musculus
ggaagcugccaaggagguggcagaugaggugacccggccccggcc

SEQ ID NO: 108321 - RNA, 64 nt, Mus musculus
gacauccaggucaugcucaagucagaugccagcccgucgagcauucggauucugaagguaggag

SEQ ID NO: 108322 - RNA, 45 nt, Mus musculus
uagaggaaguguuguuggagcugaaauugauugauguguagccag

SEQ ID NO: 108323 - RNA, 47 nt, Mus musculus
gagucuugugcauguguguguucucuaaucuagcccaagaugccccg

SEQ ID NO: 108324 - RNA, 50 nt, Mus musculus
uggaaugugugagaauguuucacuguguauagugaagauaacagagacua

SEQ ID NO: 108325 - RNA, 46 nt, Mus musculus
uuugacuuuacugacuccuaacaguauaugucccugaaaggugagg

SEQ ID NO: 108326 - RNA, 42 nt, Mus musculus
guccggaacuuacuauauagacuggucuggcuuugaacucag

SEQ ID NO: 108327 - RNA, 46 nt, Mus musculus
caugaucauaguaacaucacaauuaacaguuaguguuaguaucuag

SEQ ID NO: 108328 - RNA, 45 nt, Mus musculus
aauuccuuagcacaacugagcguauuguauuagaguauucucuga

SEQ ID NO: 108329 - RNA, 46 nt, Mus musculus
agaacaccuuugaguuuguuaccuugcuugauucccaacagcugag

SEQ ID NO: 108330 - RNA, 48 nt, Mus musculus
caugggcauuuauuccaucaagaaguuuggcuugaaccccagcaaggg

SEQ ID NO: 108331 - RNA, 81 nt, Mus musculus
gcucaugugauaaccuggcauucuugaauugcucaaaccauuaggauaggaugugcuuuacuugugugugugugugugugu

SEQ ID NO: 108332 - RNA, 117 nt, Mus musculus
uaagcaaaaauuuguugcccuaaaaaugucuauuuauugguuuaguuguagcuccugcccugagguuguugauugaguugcaugacucagugcuauagaugggaugugguguguauc

SEQ ID NO: 108333 - RNA, 146 nt, Mus musculus
cugugcugcaucuuaguagguggagagaaaaaagugcaugaggguugagcagacagaaucuaguuggaagagauccccuaaaggauaggugucugacacugagcugcuuuaauugaggucuggaaaaggaacuagagcauuguggg

SEQ ID NO: 108334 - RNA, 71 nt, Mus musculus
aaggcuucaucuaucaggagugucagcaauagcuuugaaggauggaggugcgaaggaggaucuuuucaagu

SEQ ID NO: 108335 - RNA, 65 nt, Mus musculus
aggaucucuaguaggaguuggguugagugguaggggccaaguaaauagccucaacucucagaugg

SEQ ID NO: 108336 - RNA, 41 nt, Mus musculus
uuuaauccccuaaccucagcaagcaugcuguuuggcugcuc

SEQ ID NO: 108337 - RNA, 71 nt, Mus musculus
aggccgaagcuuugcugggucugucagcccacaggaagaggaggaauuucgucgccuggcugcccucccca

SEQ ID NO: 108338 - RNA, 52 nt, Mus musculus
uuugggggcauggauaugaagaaggccauugccugccugcuuuuuggggguu

SEQ ID NO: 108339 - RNA, 42 nt, Mus musculus
ccuuuuucuuuuuccuuaccuuuccuucucucucugucucuc

SEQ ID NO: 108340 - RNA, 45 nt, Mus musculus
ggaagagggcaucagauaauauuacgacugguugugagccaccau

SEQ ID NO: 108341 - RNA, 67 nt, Mus musculus
ucaacuugcugauguugggagacccugguacagccaagucucagcuucugaaguuuguggagaagug

SEQ ID NO: 108342 - RNA, 46 nt, Mus musculus
uccucauucaucuuggcucuggucaggauggcagaggggguuugaa

SEQ ID NO: 108343 - RNA, 45 nt, Mus musculus
gacugagucaggcuugcuuugcuucucagccuggcaguggacuug

SEQ ID NO: 108344 - RNA, 92 nt, Mus musculus
caccgcccggcuggaauucauuuguauaaucuguuuagccuguagucuaauauaagcuuuuuuuucccuuucaguguaguuaaaccccaaau

SEQ ID NO: 108345 - RNA, 46 nt, Mus musculus
aauccccaacccugaggccagcuucaaauauauucuuuucugggga

SEQ ID NO: 108346 - RNA, 47 nt, Mus musculus
uacacaucugggaaagguagcagugcugcuggcuugacugccucagu

SEQ ID NO: 108347 - RNA, 47 nt, Mus musculus
augguucuggccgauggugggguugucuguauugaugaguuugacaa

SEQ ID NO: 108348 - RNA, 46 nt, Mus musculus
gcgggaagaugaccguguugcaauccaugaggcuauggagcagcag

SEQ ID NO: 108349 - RNA, 49 nt, Mus musculus
ggcugcagccaacucaguguuuggccgaugggaugagacaaaaggggag

SEQ ID NO: 108350 - RNA, 41 nt, Mus musculus
ggauauguccaguuuccaugcuuaaguagauaguugcccca

SEQ ID NO: 108351 - RNA, 51 nt, Mus musculus
gcaugugagugcacugacacagacacaggcuguggagggugagaucgaccu

SEQ ID NO: 108352 - RNA, 44 nt, Mus musculus
gcuacaucaucaugcggaguggggcucgucagcaugagagggac

SEQ ID NO: 108353 - RNA, 45 nt, Mus musculus
uccuaauuauuuuguuguguguguuugaggcuggagaugccuggg

SEQ ID NO: 108354 - RNA, 45 nt, Mus musculus
uaccugagcugaauuauaucucuagcauugauugguuacaaguag

SEQ ID NO: 108355 - RNA, 45 nt, Mus musculus
uaugguuuuagaagguauagccaucguguccacauuuugagcaac

SEQ ID NO: 108356 - RNA, 42 nt, Mus musculus
ucaguaagaugaaacugcagcccuuugccacugaggcugaug

SEQ ID NO: 108357 - RNA, 42 nt, Mus musculus
ucauagagaugagacugacagaucuucugucauggucaccag

SEQ ID NO: 108358 - RNA, 62 nt, Mus musculus
acagggguggagggcuucacuacccaggaggaccaggagaugcugagccgcauugagaagca

SEQ ID NO: 108359 - RNA, 42 nt, Mus musculus
cccauugcccaucaacccucaagccugaaaugcugccaccac

SEQ ID NO: 108360 - RNA, 42 nt, Mus musculus
agcuaugaguaccugagcaagcuucagcacaguaggagguau

SEQ ID NO: 108361 - RNA, 42 nt, Mus musculus
aauccaauacccuuccucauccuucguggacugguggcagag

SEQ ID NO: 108362 - RNA, 41 nt, Mus musculus
gagucagagaaacaaggcagagucagagggcagcagggaau

SEQ ID NO: 108363 - RNA, 46 nt, Mus musculus
uuuguguaugugugcaugugagugucuguguccguguguguguccg

SEQ ID NO: 108364 - RNA, 47 nt, Mus musculus
acuuguguaugugugcaugugagugucuguguccgugucuguguccg

SEQ ID NO: 108365 - RNA, 42 nt, Mus musculus
uucuggaggcgcuugaccucaucaaaggacucccggcuaucc

SEQ ID NO: 108366 - RNA, 45 nt, Mus musculus
ugucuccguccucccacaaaggaaccacacucacggcucacagga

SEQ ID NO: 108367 - RNA, 44 nt, Mus musculus
acacugagaccaagcuggucugaacagagggagcagaggccacc

SEQ ID NO: 108368 - RNA, 46 nt, Mus musculus
gccccaggggcuaaauuggggggcaguguacacagcugggccagac

SEQ ID NO: 108369 - RNA, 46 nt, Mus musculus
aaucugguuauucuauuuacaagccauaaguuuauauugggcagau

SEQ ID NO: 108370 - RNA, 46 nt, Mus musculus
auggcugcaaagacuuaguuauugaucuccuaguuagagaucaggc

SEQ ID NO: 108371 - RNA, 41 nt, Mus musculus
gcacugucuaggugaccaggacuucggcacugcuuaugccc

SEQ ID NO: 108372 - RNA, 46 nt, Mus musculus
uguagacaguaguagaauaguguguguuccucuaugcagacagcag

SEQ ID NO: 108373 - RNA, 71 nt, Mus musculus
acagcaguagaauaguguguguuccucuaugcagacagcaguagaauaguguguguuccucuaugcagaca

SEQ ID NO: 108374 - RNA, 45 nt, Mus musculus
guagacagcaguagaauaguguguguuccucuaugcagacagcag

SEQ ID NO: 108375 - RNA, 45 nt, Mus musculus
gagagaggauguuuugcugaagcagacucaugaaagcugcgggga

SEQ ID NO: 108376 - RNA, 42 nt, Mus musculus
agcucugaccaguguggaagaggccccuuuucuguuugccug

SEQ ID NO: 108377 - RNA, 69 nt, Mus musculus
ucccagcauuaggaaggucuagacuauccaugaguccaugcaguuaggacaguugcauauagcaggugg

SEQ ID NO: 108378 - RNA, 45 nt, Mus musculus
caauggaugacugugagcauccacuucuguauuugccaggguuua

SEQ ID NO: 108379 - RNA, 46 nt, Mus musculus
ccagaagagggaucagaucucauuauggaugguugugagccaccau

SEQ ID NO: 108380 - RNA, 46 nt, Mus musculus
ugagagcugauuuguggaggaacucacuaaaacucuugaguagaag

SEQ ID NO: 108381 - RNA, 44 nt, Mus musculus
ugcagugcuguggaagucagaaggcauggcauccuguaggucua

SEQ ID NO: 108382 - RNA, 47 nt, Mus musculus
uuuguacuuguaauguuuuaacuuuuguuauauuuuuagaccaaaga

SEQ ID NO: 108383 - RNA, 45 nt, Mus musculus
accagccggugcuguuauauuugggauggcagucgagugugcaga

SEQ ID NO: 108384 - RNA, 42 nt, Mus musculus
auguacaugagguuuuacuuauagaaaaaugauuagcagcaa

SEQ ID NO: 108385 - RNA, 41 nt, Mus musculus
ugcucggcaagccuuucuaccgugugugugugugugugugu

SEQ ID NO: 108386 - RNA, 42 nt, Mus musculus
cacacucucuuaauguuccugcuauuaaagaaggcgugcuag

SEQ ID NO: 108387 - RNA, 86 nt, Mus musculus
aaaugauaagagggauuaaaucauuacucuguaaagugggagaaaggaggugagagucucuggagggggcacugagagugccugug

SEQ ID NO: 108388 - RNA, 64 nt, Mus musculus
cugcuguucuuuaauacaagucaguucuggcccugcugucuggagguagagguagaaccuguag

SEQ ID NO: 108389 - RNA, 53 nt, Mus musculus
cuauguuuaggaccuuugugcuaaaaacaaacaacgggacaacagaaaaccaa

SEQ ID NO: 108390 - RNA, 46 nt, Mus musculus
caguacuguuaauauguuccuguggcaccacagggagagugagggg

SEQ ID NO: 108391 - RNA, 46 nt, Mus musculus
uaugugcugauguuugggaugcuuguggagucccagacgcugguag

SEQ ID NO: 108392 - RNA, 46 nt, Mus musculus
ggugggaguuuuauagauuggauguagaauaugagaaaggaccagg

SEQ ID NO: 108393 - RNA, 46 nt, Mus musculus
uauuguguauauaagaggugucagagggggucauugagcagcugga

SEQ ID NO: 108394 - RNA, 46 nt, Mus musculus
uuacaugccuacacacaaacacacauacacaucucuaacagaagag

SEQ ID NO: 108395 - RNA, 44 nt, Mus musculus
augguggugaugguggugguggugguggugaugggugccagcca

SEQ ID NO: 108396 - RNA, 41 nt, Mus musculus
gucucccagaguaagagccaccaccaccauccgccccacca

SEQ ID NO: 108397 - RNA, 42 nt, Mus musculus
uauuaauuuuuaugaccugggaugcugccugugcgcguguug

SEQ ID NO: 108398 - RNA, 41 nt, Mus musculus
acccggagcagggcaaccucucgggcagaccuagcgggaga

SEQ ID NO: 108399 - RNA, 46 nt, Mus musculus
ucacgguaaguauaaucucuugguggcggugcauaaucucuggugu

SEQ ID NO: 108400 - RNA, 45 nt, Mus musculus
agcuuuccugggcgaucugcuucaaccaucuugccuuccagcuga

SEQ ID NO: 108401 - RNA, 42 nt, Mus musculus
guccauggaggugaugggcacuugcucagccuugcccugaua

SEQ ID NO: 108402 - RNA, 41 nt, Mus musculus
gaaagcaggagagacuccugcgucagcaugcuugcccuguc

SEQ ID NO: 108403 - RNA, 42 nt, Mus musculus
aagucuggagggucuccauccaaagcauugaccuggugagaa

SEQ ID NO: 108404 - RNA, 41 nt, Mus musculus
aggucucuccaagaauguuuaaagagaaaagaacugggagu

SEQ ID NO: 108405 - RNA, 45 nt, Mus musculus
aaacaggaccagagaggaggaaguaauucagaagcauggacagug

SEQ ID NO: 108406 - RNA, 46 nt, Mus musculus
acagugagcaaacaugacuccuucagagaggugcagcuugccugau

SEQ ID NO: 108407 - RNA, 54 nt, Mus musculus
cauaugcauguaacaauuaauggaaagaugccacggacuuaaaagagagcuagg

SEQ ID NO: 108408 - RNA, 47 nt, Mus musculus
aaggccuccaccguauggcaagaacuacaggcaacucaggacugcug

SEQ ID NO: 108409 - RNA, 46 nt, Mus musculus
cuuuuuuguuguuuuaaguaugugcaagguagugauggguguuuaa

SEQ ID NO: 108410 - RNA, 42 nt, Mus musculus
uccagcacccacaugguggcucacaaccaucugucauggcuu

SEQ ID NO: 108411 - RNA, 45 nt, Mus musculus
ugggggagggcacacaugccaagucaggcauguggaggucagaga

SEQ ID NO: 108412 - RNA, 47 nt, Mus musculus
agguuacaauaaauaguaaaagacucaucaaguugauuccuggguua

SEQ ID NO: 108413 - RNA, 54 nt, Mus musculus
uauauuucuucucuggaagcuugguuagaugucagagaugucucgauugacggu

SEQ ID NO: 108414 - RNA, 41 nt, Mus musculus
aggagaaauguuguagaagaggaaagaugagaccaguuaaa

SEQ ID NO: 108415 - RNA, 45 nt, Mus musculus
cugaagucagcuugucagaggacuucauuccuuucuagaaucuca

SEQ ID NO: 108416 - RNA, 46 nt, Mus musculus
gacaguuaugagugagguacuacauggauagugggaauugaaccua

SEQ ID NO: 108417 - RNA, 42 nt, Mus musculus
ggugggcuuugugaguauagaacuuccugugccagcaugcag

SEQ ID NO: 108418 - RNA, 42 nt, Mus musculus
guaaaauacagcgaauaagucuaauaguuuuuaaaaggccag

SEQ ID NO: 108419 - RNA, 47 nt, Mus musculus
cuggaguucucuggccagccaguguagccagacacgcaagcccuguu

SEQ ID NO: 108420 - RNA, 46 nt, Mus musculus
cagaggguuugggccuagugagaaauuagaauuguuggggggcuag

SEQ ID NO: 108421 - RNA, 72 nt, Mus musculus
aagaagcugucaggugggaaaaggugggaaaaggcgggcaggagaagaagcugucaggugaaaagguaaggc

SEQ ID NO: 108422 - RNA, 45 nt, Mus musculus
cuccgcugcauuuucaucgguuggcucaguuaucaccaaaaagcu

SEQ ID NO: 108423 - RNA, 28 nt, Mus musculus
agcuuggcaucuccucgcuucaggaguu

SEQ ID NO: 108424 - RNA, 44 nt, Mus musculus
uggaccgcggcgagcaaggucugcugaagacagagccaguggcc

SEQ ID NO: 108425 - RNA, 44 nt, Mus musculus
uggaauuaugaggaagguggauuacaaugaacagggcaggcaga

SEQ ID NO: 108426 - RNA, 46 nt, Mus musculus
agcacauucaguagaagguccugucuuaaaagcuaaguggacagua

SEQ ID NO: 108427 - RNA, 46 nt, Mus musculus
uguauauuauauucauguaccaaaugcuuccugguguugcccaucu

SEQ ID NO: 108428 - RNA, 44 nt, Mus musculus
uucuuagcacuguuuauagaauaguaauagugcgcuuacccacc

SEQ ID NO: 108429 - RNA, 44 nt, Mus musculus
caccagcucuagagaggaagaugcaggcagauaaucugugaguu

SEQ ID NO: 108430 - RNA, 45 nt, Mus musculus
cgaaauuacauucagaagagaccccaacaacuacaggccacgaau

SEQ ID NO: 108431 - RNA, 45 nt, Mus musculus
ggcucacaaccauccguaacgaggucugacucccucuucuggagu

SEQ ID NO: 108432 - RNA, 42 nt, Mus musculus
agcuacuaagucaguuucuuguucugugacagcaccccaccc

SEQ ID NO: 108433 - RNA, 46 nt, Mus musculus
uguucuuugauggaacaccaucaaaaacgaugacgcgaucugcuag

SEQ ID NO: 108434 - RNA, 45 nt, Mus musculus
uuuguuguagaacaugacuucaucauggccaccuaucuagcagau

SEQ ID NO: 108435 - RNA, 42 nt, Mus musculus
ccuucugcauauuuggauucugagcaaagauuaauggcagcu

SEQ ID NO: 108436 - RNA, 46 nt, Mus musculus
uacacgcauccgcaguuugugacugauguaaugaagccccuacaga

SEQ ID NO: 108437 - RNA, 48 nt, Mus musculus
acauuuaucagaaugcuugcuggaaggcuuaaaccagaugaaggaggu

SEQ ID NO: 108438 - RNA, 46 nt, Mus musculus
gugaaguaaacuaguaagcagucacuccugcagagggacugaagca

SEQ ID NO: 108439 - RNA, 44 nt, Mus musculus
guucgagcuagcaauuguagcuggagaguucacggacucugaga

SEQ ID NO: 108440 - RNA, 58 nt, Mus musculus
aagaaguuaaaaagaugugcauguauaaauaucccgggaugaagaaaaagaugggaga

SEQ ID NO: 108441 - RNA, 45 nt, Mus musculus
auuuauauaugcgugcagguucucugaacuguacagguggcuauc

SEQ ID NO: 108442 - RNA, 28 nt, Mus musculus
gcuuccaagcagaauguggcauacuacu

SEQ ID NO: 108443 - RNA, 49 nt, Mus musculus
ugaaacucucucuguagaccaggcugcucucaaacucagagagccacac

SEQ ID NO: 108444 - RNA, 45 nt, Mus musculus
uaaacaaaacaaaaaccaaaggcaaagcaaacgagaacaccccuc

SEQ ID NO: 108445 - RNA, 46 nt, Mus musculus
ggagggcaacuccguggagucagguuuuuaucuacuuucccauaag

SEQ ID NO: 108446 - RNA, 46 nt, Mus musculus
gacaacaccauaagcacucgguaccccauauagacagcagaugaag

SEQ ID NO: 108447 - RNA, 46 nt, Mus musculus
uucuuuuauuggaguuacaauauuauuugcuauuuaaaagucauag

SEQ ID NO: 108448 - RNA, 46 nt, Mus musculus
guccuuugucuuacagaaacuccucaguuuuauugagcucccauuu

SEQ ID NO: 108449 - RNA, 45 nt, Mus musculus
auauuagcccuuugucagauguaggguuagugaagaucugaagau

SEQ ID NO: 108450 - RNA, 46 nt, Mus musculus
ggacuggguguagccggggauaggagcaggaaggaucagauaagug

SEQ ID NO: 108451 - RNA, 46 nt, Mus musculus
ugggacuggguguagccggggauaggagcaggaaggaucagauaag

SEQ ID NO: 108452 - RNA, 46 nt, Mus musculus
auaaccaggcaaggcucuuaguaguggaucuuggacaucaacccag

SEQ ID NO: 108453 - RNA, 66 nt, Mus musculus
ugggaguggauacaaagacccacagccaaccacuaggaggagccaggagaaucccacaggaggaag

SEQ ID NO: 108454 - RNA, 45 nt, Mus musculus
cucgcugcuggcaaacaguccaguaaucccuagcuagcgcucaga

SEQ ID NO: 108455 - RNA, 69 nt, Mus musculus
gauuucacaguuaguggcuguaacugaggagauggcauugaaauauaagggagauuugaaaaaugguga

SEQ ID NO: 108456 - RNA, 45 nt, Mus musculus
guuacagagaugcaccuacacucagaaaacucaaacauacacaga

SEQ ID NO: 108457 - RNA, 46 nt, Mus musculus
guuauuuauaccuuacauaaaacuaaagcuuucuguagacuaguua

SEQ ID NO: 108458 - RNA, 46 nt, Mus musculus
gaucugacucccucuucuggugugucugaagacagcuacagcguac

SEQ ID NO: 108459 - RNA, 46 nt, Mus musculus
ugacuuauuuccguggaucugaauuacaaaauuacuuuaccaagau

SEQ ID NO: 108460 - RNA, 46 nt, Mus musculus
acaaaauaaacaaaaguaaaaacuuaggcggguggugguggugcau

SEQ ID NO: 108461 - RNA, 47 nt, Mus musculus
aaugaaguagucugguagucuguaaaugauggaaaccuugaggucua

SEQ ID NO: 108462 - RNA, 25 nt, Mus musculus
caagcuaacccuucuguggaggacg

SEQ ID NO: 108463 - RNA, 42 nt, Mus musculus
uacagcggggcgugcaguagccaaagcagcgcuagccgucag

SEQ ID NO: 108464 - RNA, 45 nt, Mus musculus
cucccacacuccuaaaaguaagucacagguugucacgcagaaguu

SEQ ID NO: 108465 - RNA, 46 nt, Mus musculus
cuauaaacaaggucacaaaauugagguuuggaagauggaaagagau

SEQ ID NO: 108466 - RNA, 46 nt, Mus musculus
auuuuauuauauuuuaaaaauaacuucuaagucuuaguagcaagau

SEQ ID NO: 108467 - RNA, 46 nt, Mus musculus
gucucaucuggaaagauuguaaauugcauucuugcuuauuauagaa

SEQ ID NO: 108468 - RNA, 55 nt, Mus musculus
uaccuuaauuacuuugauugaaagagaaaauauggaacuagaagaaaaggagaag

SEQ ID NO: 108469 - RNA, 45 nt, Mus musculus
gcuaagaauaucauaugguacuaacaaaggaaaaaacuauacuga

SEQ ID NO: 108470 - RNA, 117 nt, Mus musculus
gcuguguucugggaaagaugcaaugagcuucaggacauagagaagauuauggcucagauugaaaggggagaggcaagaauucaaagaagaauaaguaucaagaaagcacuagauaca

SEQ ID NO: 108471 - RNA, 56 nt, Mus musculus
auauagccagagaaguagaaggaaaaacuccagaagaagucauugaauacucaggu

SEQ ID NO: 108472 - RNA, 70 nt, Mus musculus
aauuggaauaagagagauuuuaaccaguuuaucaaggcuaaugagaaguggggucgugaugauauugaaa

SEQ ID NO: 108473 - RNA, 42 nt, Mus musculus
gccagcaggagggaagcagcuaguuaaauuccagcuugaguc

SEQ ID NO: 108474 - RNA, 48 nt, Mus musculus
ccucggaguccugaucuaccuaaugcagcacaggcacagaaagaggaa

SEQ ID NO: 108475 - RNA, 46 nt, Mus musculus
acgaacuuucugaguuuucauuaaggaaaaaauuucaugaguaaua

SEQ ID NO: 108476 - RNA, 92 nt, Mus musculus
ccuccaaaacaaccaaauguucaggauuuccaguucuuuccuccgcguuuauuugaauuacuggaaaaagaaauucuguauuacaggaaaac

SEQ ID NO: 108477 - RNA, 51 nt, Mus musculus
gauugcauucacagaguggauugaaccaccaaaaagagaaagaaaagccaa

SEQ ID NO: 108478 - RNA, 42 nt, Mus musculus
ucccuugcuuauuuacuuauggugugugugugugugugugug

SEQ ID NO: 108479 - RNA, 48 nt, Mus musculus
acuuuacgauggacacagaguccaguguuuauaacuuugaaggagaag

SEQ ID NO: 108480 - RNA, 47 nt, Mus musculus
cucucaauuuaagaagacuuuuuuuuuuucuauguagacugcagaaa

SEQ ID NO: 108481 - RNA, 45 nt, Mus musculus
agccaggcuguagcaggaugaacaguuggcaggggaagcccaaga

SEQ ID NO: 108482 - RNA, 123 nt, Mus musculus
agccagcggcaucuggaggaguccagagcagagaaagaaguagacggaacaugaucagcacagcauauguggccaggcuggagaagcagcagaggguagagaaauaguaaaaauagcaggaac

SEQ ID NO: 108483 - RNA, 50 nt, Mus musculus
aaagugaaaucacugaugaggauauugaugguauuuuagaaagaggugca

SEQ ID NO: 108484 - RNA, 44 nt, Mus musculus
cagggaggcuuguagaucagaaccugaacaaaauugggaaagau

SEQ ID NO: 108485 - RNA, 41 nt, Mus musculus
uccccuuccccuuccccuuccccuuccccuuccccuguuug

SEQ ID NO: 108486 - RNA, 50 nt, Mus musculus
aacugauaacacuguggaagaaagaauaguggaacgugcugagaugaaac

SEQ ID NO: 108487 - RNA, 23 nt, Mus musculus
cccauugccccugccugcucuuc

SEQ ID NO: 108488 - RNA, 46 nt, Mus musculus
cagagaaacccugucucaaaaauacaaaaaacaaacccuaagaacc

SEQ ID NO: 108489 - RNA, 49 nt, Mus musculus
uacauauccagaccagcuagggcuacguagaucgucuuuugagagagag

SEQ ID NO: 108490 - RNA, 42 nt, Mus musculus
guacacaacagauaugcaucuaguuaccaacaguggcaagau

SEQ ID NO: 108491 - RNA, 46 nt, Mus musculus
gugcuccaccacugcucggcgcuucuuuuuaauuuugcccaaaguu

SEQ ID NO: 108492 - RNA, 46 nt, Mus musculus
uuucuucauaguauagaaguucauagguaaaaguugguagguagau

SEQ ID NO: 108493 - RNA, 46 nt, Mus musculus
cuaggacuuugauuccugguuugauacaaauaauugccuuggggau

SEQ ID NO: 108494 - RNA, 45 nt, Mus musculus
gaaaugcuuauuaaagagaagucuguguucaaaaaauucaacugg

SEQ ID NO: 108495 - RNA, 45 nt, Mus musculus
guuuuacaggcugcauuugucagggauguuuuauuaccaggagag

SEQ ID NO: 108496 - RNA, 46 nt, Mus musculus
uauauuaaaggaauuuaauuuuagacuaauaacgaaauaacuggag

SEQ ID NO: 108497 - RNA, 46 nt, Mus musculus
aagaaauggguaccaacacuuaggucuguuugcuugauaggagaua

SEQ ID NO: 108498 - RNA, 42 nt, Mus musculus
aagacacuucaaacaauuucucuucuuggauacaugaaacac

SEQ ID NO: 108499 - RNA, 47 nt, Mus musculus
uuauagcuauagggugcuuauagauagcaugugcaaagcccagagac

SEQ ID NO: 108500 - RNA, 46 nt, Mus musculus
aaaggaaaauuuuuaguaaucuuggauaguuacuggcuguguauaa

SEQ ID NO: 108501 - RNA, 47 nt, Mus musculus
cacggguaaaaaaggaugaaaaacagaauuugcuuucaguuggagag

SEQ ID NO: 108502 - RNA, 45 nt, Mus musculus
caaacugaccgagcaaauagauuugaguauuuauuaaagcagaca

SEQ ID NO: 108503 - RNA, 45 nt, Mus musculus
gaucauggaucaccuggaaagcaaaaagaaauccaagaaccagau

SEQ ID NO: 108504 - RNA, 46 nt, Mus musculus
gcuaaugcuuccuuucuuguauacauuucuauaaaauagcacagua

SEQ ID NO: 108505 - RNA, 41 nt, Mus musculus
aauacuggaggaagcggggagagaguggaaaaugggggagc

SEQ ID NO: 108506 - RNA, 42 nt, Mus musculus
cgggcgccggcgggagcagcagcggcaacaaaggcggccccg

SEQ ID NO: 108507 - RNA, 46 nt, Mus musculus
cggcgccgcgccugcccguggccgcggcgggugacgcagccggaac

SEQ ID NO: 108508 - RNA, 42 nt, Mus musculus
gcgagcggcgcggcugggccggcucgggucgguggcggagcc

SEQ ID NO: 108509 - RNA, 46 nt, Mus musculus
cucugagaaccuuccguuuuccuuucccuuucccucggcccuccgc

SEQ ID NO: 108510 - RNA, 42 nt, Mus musculus
gagagcggguggcguagguagcuguccugguuggcuggagaa

SEQ ID NO: 108511 - RNA, 46 nt, Mus musculus
uaggacgaggaggauucuuugguuuuguucuggggcagagcaagag

SEQ ID NO: 108512 - RNA, 45 nt, Mus musculus
ggagggggaauauuagagaaaaaagaaaucaggggacaauuggag

SEQ ID NO: 108513 - RNA, 46 nt, Mus musculus
guucucuuuggcugcggcggaaaguuuucuaaaacaaagcguuagg

SEQ ID NO: 108514 - RNA, 42 nt, Mus musculus
auaauucacuuaucauucuuuguacaaaaauugaugcuagau

SEQ ID NO: 108515 - RNA, 46 nt, Mus musculus
aucuuugcuaucucccacuaaaguacauaguuaccuuuggaggcag

SEQ ID NO: 108516 - RNA, 42 nt, Mus musculus
ccucucugccuccaaagguaacuauguacuuuagugggagau

SEQ ID NO: 108517 - RNA, 43 nt, Mus musculus
ucaucugauaaacauuguaacauugauaaucuguuuucuucag

SEQ ID NO: 108518 - RNA, 41 nt, Mus musculus
ccagccaguggugucugggccaauggagauccaccccuaca

SEQ ID NO: 108519 - RNA, 46 nt, Mus musculus
cucauuaauaucagugaagucaacaucuacagaccaacucugggac

SEQ ID NO: 108520 - RNA, 42 nt, Mus musculus
cguuacccagugcucaagaugaugggcuaaugcaaaccagug

SEQ ID NO: 108521 - RNA, 42 nt, Mus musculus
gcuucaacuuugugugagguacucccacaguuuaggcagcag

SEQ ID NO: 108522 - RNA, 46 nt, Mus musculus
uacaggugacagugagaagacucuaauagagaaaauguuuggaggg

SEQ ID NO: 108523 - RNA, 46 nt, Mus musculus
aagccuuuuacuugauugaauuaacauguuuauaagcuaccaagau

SEQ ID NO: 108524 - RNA, 46 nt, Mus musculus
gccuuccugccuuccuuccugccuuccugccuucuugccugccugc

SEQ ID NO: 108525 - RNA, 45 nt, Mus musculus
aagaaggcaggaaggcaggaaggaaggcaggaaggcaggcaggca

SEQ ID NO: 108526 - RNA, 42 nt, Mus musculus
aggcaggcaggaaggcaggaaagaaggcaggaaggcaggcag

SEQ ID NO: 108527 - RNA, 46 nt, Mus musculus
gauucucucuguauuugaaauauuuguggcauaaagugacagugcc

SEQ ID NO: 108528 - RNA, 46 nt, Mus musculus
cauuuauguauguuugagccuuagcuagaaguucuuugagagcaag

SEQ ID NO: 108529 - RNA, 46 nt, Mus musculus
uccuucucuuuuuaaaaucauccuaaguucaugauguguuuugaug

SEQ ID NO: 108530 - RNA, 46 nt, Mus musculus
auacaguaggacaguagaggcaaggaaacaggguaaaacacaccag

SEQ ID NO: 108531 - RNA, 46 nt, Mus musculus
aaacaaggaggucauuuuggguauguacgugagguugucucuagag

SEQ ID NO: 108532 - RNA, 41 nt, Mus musculus
uugguucacuguaugauguaccauuacuccggauucccaga

SEQ ID NO: 108533 - RNA, 42 nt, Mus musculus
aucacuucugaaggagugaaccaaguuaacuauaugagggac

SEQ ID NO: 108534 - RNA, 46 nt, Mus musculus
uccucuugugagccaccaugugguugcggggauuugaacucuagac

SEQ ID NO: 108535 - RNA, 46 nt, Mus musculus
auggauauaugugcaggggaaauauccaaaugcauaaaguuaaaau

SEQ ID NO: 108536 - RNA, 46 nt, Mus musculus
uuuuaguuuuaugaaauugucacugagauguguuagaaacguagaa

SEQ ID NO: 108537 - RNA, 42 nt, Mus musculus
ucauguguaugaguguuaccugaaacaaaggugaauacccag

SEQ ID NO: 108538 - RNA, 46 nt, Mus musculus
cucacaugggcuagccaguaccuuguccucggggaaauccacagac

SEQ ID NO: 108539 - RNA, 45 nt, Mus musculus
acuaagcagcauaugagagaggacugcaagagcaccaggucucac

SEQ ID NO: 108540 - RNA, 46 nt, Mus musculus
auagacaguaaaaagagaaggguugcuccaaagacuagggcccaag

SEQ ID NO: 108541 - RNA, 42 nt, Mus musculus
auaauguaauuauauacauaaaauaaauaauucuuuaaaaaa

SEQ ID NO: 108542 - RNA, 45 nt, Mus musculus
uuugaguuuugguuuuucccagugcuaggaauccagcccagaguu

SEQ ID NO: 108543 - RNA, 46 nt, Mus musculus
gcaaaguaacaucuaucaaaauaguaaacuucugaacagcugccag

SEQ ID NO: 108544 - RNA, 46 nt, Mus musculus
auuuccaauguuagauucccccaacuaaugaaucaugaauugagau

SEQ ID NO: 108545 - RNA, 69 nt, Mus musculus
aaguuuauuauuaaugugugagcauguauauaugugugugggaucugaggagugagcuuagguugccag

SEQ ID NO: 108546 - RNA, 42 nt, Mus musculus
uucccagcaaccacaugauggcucacaaccaucuguacucag

SEQ ID NO: 108547 - RNA, 42 nt, Mus musculus
cccagcaaccacaugguggcucacaaccaucuauauuggaau

SEQ ID NO: 108548 - RNA, 44 nt, Mus musculus
cacucucaauacauaaaagauaugacucaccugugagaauguga

SEQ ID NO: 108549 - RNA, 46 nt, Mus musculus
ugugagaugugacguccuuuuguuugugauguuaagugagagaaua

SEQ ID NO: 108550 - RNA, 46 nt, Mus musculus
aauguaguggagguaggacccaacaaccacauugacguugguagag

SEQ ID NO: 108551 - RNA, 49 nt, Mus musculus
aacaguugagaugcucugaaagacaaucuuuuaaacaugggagacacuu

SEQ ID NO: 108552 - RNA, 45 nt, Mus musculus
cuaaaaguacuuaugcauguauuuuaaucuuugagcagccuagau

SEQ ID NO: 108553 - RNA, 43 nt, Mus musculus
agagagccacagcuggaguguuguauagcacuguguugcagag

SEQ ID NO: 108554 - RNA, 41 nt, Mus musculus
cugauggcugcuucuuacuuauaaguagcccgugugggagg

SEQ ID NO: 108555 - RNA, 42 nt, Mus musculus
ugcagguuaccuugucuaugaauuugacaaguuuuggcuuga

SEQ ID NO: 108556 - RNA, 33 nt, Mus musculus
agugggcagacauugguuuccaaggugacgauc

SEQ ID NO: 108557 - RNA, 36 nt, Mus musculus
cugugcaagugugugaggcuguagucgcacccauau

SEQ ID NO: 108558 - RNA, 41 nt, Mus musculus
acgaguugcccagagugaacuggacagguguauagcgaaca

SEQ ID NO: 108559 - RNA, 45 nt, Mus musculus
aauuaauuuuaagauuguaacaucuuuuuuugacaauuucacaga

SEQ ID NO: 108560 - RNA, 46 nt, Mus musculus
ccuccuccccuucguuuagcacccgaaaagaguuuuauugcaagau

SEQ ID NO: 108561 - RNA, 90 nt, Mus musculus
gucauagguggcuccaauacacagagacuugucccaggauacauccccaccaaaacuccugaugaugaaggccaaugcuucacggggcac

SEQ ID NO: 108562 - RNA, 94 nt, Mus musculus
cugugcugucaccucccuaucaguagggaauucaucagccucagccuccucuagagcaggcaccaccacucgggccaggcuggcacugagggca

SEQ ID NO: 108563 - RNA, 41 nt, Mus musculus
ugacccuguaguccacaucugucggaugaucaugggagaaa

SEQ ID NO: 108564 - RNA, 45 nt, Mus musculus
uuaaugucuuugauaagguaaaauguccgggcugcuguggaaccc

SEQ ID NO: 108565 - RNA, 74 nt, Mus musculus
aaagggguguauaugagauugaugaagcugguaccagggagggacagagccccacuuguaagcaggggaaagac

SEQ ID NO: 108566 - RNA, 46 nt, Mus musculus
gaaucugcagaacauuuacccaccugacacccugcuuugcccauag

SEQ ID NO: 108567 - RNA, 42 nt, Mus musculus
cugggugacaugcaacccugcugaggcacgucugggcaccag

SEQ ID NO: 108568 - RNA, 42 nt, Mus musculus
auggucugaauagacauuuggacauaaggguucaggugccag

SEQ ID NO: 108569 - RNA, 46 nt, Mus musculus
acugugcccacuaccucauccggcugcugaagugcaagcgagacag

SEQ ID NO: 108570 - RNA, 85 nt, Mus musculus
caugaaggaguuugaacgugagcggcgacugcuccaaaggaagaagcgaagggcacugaaggaagcacggguagcccaaggccag

SEQ ID NO: 108571 - RNA, 46 nt, Mus musculus
cuguggaccuaucagugaaauaaaagcuuugggucaccugccuaaa

SEQ ID NO: 108572 - RNA, 42 nt, Mus musculus
cugaaggaguuccgcgacuacccgccccugcgcaugcccauu

SEQ ID NO: 108573 - RNA, 45 nt, Mus musculus
gcuuuuucuacagccuauggaguucagcagguuaagcuggcacug

SEQ ID NO: 108574 - RNA, 46 nt, Mus musculus
auggauggcuuauuacaucaaccacccucucuacacacccccuagu

SEQ ID NO: 108575 - RNA, 53 nt, Mus musculus
agguagagccucaggccaccauuucugaaaucaagacccuuuucaccaagaca

SEQ ID NO: 108576 - RNA, 44 nt, Mus musculus
ccaagaagcauaaaaaggcuguccucuucuuugagguggagauu

SEQ ID NO: 108577 - RNA, 86 nt, Mus musculus
aucaugcugcccggcccagcucacagcagcuuugugaggagaggucggaggugggggcuggcgacuggcagugggcaccacagacu

SEQ ID NO: 108578 - RNA, 46 nt, Mus musculus
cucaggggaggacuguggcuccuuugguggggacucgggcugagau

SEQ ID NO: 108579 - RNA, 45 nt, Mus musculus
ucagcuaucacaacauuauuaggguuacuggguauuucuggaaag

SEQ ID NO: 108580 - RNA, 46 nt, Mus musculus
cacauauacuagucagaugcucugccauuaauccguacccaguuuu

SEQ ID NO: 108581 - RNA, 46 nt, Mus musculus
uacacagugaaacgccaugucagcagucacagcaaagcaagcagau

SEQ ID NO: 108582 - RNA, 46 nt, Mus musculus
ggagggaauuauuuucacagccucuggcaggccucugcuuccagac

SEQ ID NO: 108583 - RNA, 42 nt, Mus musculus
aucuuuauuuuugagauaaaguuuuugccauguagcccaggc

SEQ ID NO: 108584 - RNA, 37 nt, Mus musculus
uucuuuuugagacagggucucacugugaagcccuuac

SEQ ID NO: 108585 - RNA, 49 nt, Mus musculus
uggagucacaucuccaguucccacccaccuccccuuuuuuaaaagacag

SEQ ID NO: 108586 - RNA, 45 nt, Mus musculus
ggaucccuggcccugaggaaaacccggcaagcaagcugguacacg

SEQ ID NO: 108587 - RNA, 42 nt, Mus musculus
aggcauaguuucuaaccacuagcagugcgguuccggguaaau

SEQ ID NO: 108588 - RNA, 54 nt, Mus musculus
uggagcugggugguguuuggugcgguacggcggccacucaguugcagcagagca

SEQ ID NO: 108589 - RNA, 48 nt, Mus musculus
gugcauguguguguguguguguauauguguguguguaugugugugugu

SEQ ID NO: 108590 - RNA, 45 nt, Mus musculus
gugugcaugugugcauguguguguguguguaugugugugugcaug

SEQ ID NO: 108591 - RNA, 46 nt, Mus musculus
gguuuuguaagucugggaugauggcggucaaggacggagcugagug

SEQ ID NO: 108592 - RNA, 45 nt, Mus musculus
ccccgucccggacucuauauacccguccggcggaagcuuccagau

SEQ ID NO: 108593 - RNA, 23 nt, Mus musculus
cgguuuccccgccugucaaacgg

SEQ ID NO: 108594 - RNA, 43 nt, Mus musculus
ggguuucugccaccgaagaacucagcaaacauggcaugggggu

SEQ ID NO: 108595 - RNA, 42 nt, Mus musculus
aacguccaaaguucauguuggugaagccacccauacccauug

SEQ ID NO: 108596 - RNA, 66 nt, Mus musculus
gagcauucgaaaugaagauaagauccugaccaucgaagugaagaggggcuggaaagaagggaccaa

SEQ ID NO: 108597 - RNA, 46 nt, Mus musculus
agccaaguggggggagcaggaaacggguuguuccaggggcucagau

SEQ ID NO: 108598 - RNA, 44 nt, Mus musculus
uuacuugugucgcuauuggacgcuuugcucugcccagguuuugu

SEQ ID NO: 108599 - RNA, 46 nt, Mus musculus
agcuggccaaugagccccacacaucuuccuguuuauguccccagug

SEQ ID NO: 108600 - RNA, 42 nt, Mus musculus
ccaccuucucaauggccuucuccucaaaggccgacggcugug

SEQ ID NO: 108601 - RNA, 46 nt, Mus musculus
cugucuggaagcucacaaagaaguuuucugaaaucaacccaaacau

SEQ ID NO: 108602 - RNA, 45 nt, Mus musculus
aaaauggauggcuaugggcaugcaacauagugaguguacugaagu

SEQ ID NO: 108603 - RNA, 42 nt, Mus musculus
ugagaugggucagugaguaaaggugccugcagguagccaacc

SEQ ID NO: 108604 - RNA, 46 nt, Mus musculus
gagccacgucaugagcugauaugugccuucuggaaagcccacaacg

SEQ ID NO: 108605 - RNA, 45 nt, Mus musculus
aaagccuucggaccuuggcucaguuuuuacccaaaggccccuuca

SEQ ID NO: 108606 - RNA, 48 nt, Mus musculus
uccugaguuagacaucgaugacaugccugugacuccagcagguagagg

SEQ ID NO: 108607 - RNA, 45 nt, Mus musculus
uccgugacuucaauccagccacggucaacuacaccauccagguga

SEQ ID NO: 108608 - RNA, 41 nt, Mus musculus
gccaccaauccacccacugcaucaacaaauuggguggcuau

SEQ ID NO: 108609 - RNA, 45 nt, Mus musculus
accugcagaaaccaccaugagguggucacuacauuuguggcagug

SEQ ID NO: 108610 - RNA, 73 nt, Mus musculus
gguccuccacaguucugagagcagcgucacauccuguccugagaaagauuaaaaaauaacaagaggccucggu

SEQ ID NO: 108611 - RNA, 48 nt, Mus musculus
gcacagucuguuagccugaagagggagaucugcagggucccagaagcu

SEQ ID NO: 108612 - RNA, 46 nt, Mus musculus
cuaagggucauauguaguuuucaccccaaaucuucaggcugggaua

SEQ ID NO: 108613 - RNA, 45 nt, Mus musculus
aagucuauguagaacucugcaagggagcaguaccuuguaggagug

SEQ ID NO: 108614 - RNA, 45 nt, Mus musculus
ucuugaagggcuggcuucaguggaauagauguucuuacccucugu

SEQ ID NO: 108615 - RNA, 46 nt, Mus musculus
cugcgccuggaaaucuccccgagcagacaacuacagugcaccagac

SEQ ID NO: 108616 - RNA, 49 nt, Mus musculus
uuccaggacagcagagcuacauaaugagaccauguccuaaagagagaga

SEQ ID NO: 108617 - RNA, 45 nt, Mus musculus
agucuuaagugaucucaaggcagauuuuuaacuuguuggcaagau

SEQ ID NO: 108618 - RNA, 68 nt, Mus musculus
acaguaaggcugguaacauuguucucuuaaggcaggcuaaacuuuaccaagcugagcacacaguagau

SEQ ID NO: 108619 - RNA, 47 nt, Mus musculus
ccucacacacacaaaggcaugcauguacauuauucugggucaggagc

SEQ ID NO: 108620 - RNA, 46 nt, Mus musculus
cugugccugaacuuggcuuuaggaaccagaaggagaaggcugaccu

SEQ ID NO: 108621 - RNA, 46 nt, Mus musculus
ucaguaacagaagcugugucugcaagcccggcuucagcucggagaa

SEQ ID NO: 108622 - RNA, 41 nt, Mus musculus
guaguuggggagcaagauuuacauaacaaaugcugguagau

SEQ ID NO: 108623 - RNA, 42 nt, Mus musculus
guucugaugggugugggagaauuccagcucaguggcccaaga

SEQ ID NO: 108624 - RNA, 42 nt, Mus musculus
uggaggcguaucuaaugggagaucuaguuggccccgggagau

SEQ ID NO: 108625 - RNA, 42 nt, Mus musculus
cgggucuccagggaaagcguacaaggacaagcggugcaagac

SEQ ID NO: 108626 - RNA, 48 nt, Mus musculus
acgggacuggagguugggauuccauaggacacguggaugguuucuuag

SEQ ID NO: 108627 - RNA, 47 nt, Mus musculus
cuaaccuaaaggaagaaggcuuauaggcaacaccauguuguuacggu

SEQ ID NO: 108628 - RNA, 46 nt, Mus musculus
aaaccagugugcuuucagguaaaagaggaagguucuaggcuuaggu

SEQ ID NO: 108629 - RNA, 42 nt, Mus musculus
uuuauugaaaugucuuaaaaaucaaugaguagcugggcagag

SEQ ID NO: 108630 - RNA, 42 nt, Mus musculus
augugugccuggugccuuuggaggccagaagagggcauagau

SEQ ID NO: 108631 - RNA, 45 nt, Mus musculus
uagaggucaguaggucauaagugagaugauucuucuggaccugga

SEQ ID NO: 108632 - RNA, 46 nt, Mus musculus
uauacgagucuagcuaauuaggaauacauuuuacuagugcaccaag

SEQ ID NO: 108633 - RNA, 45 nt, Mus musculus
acaugggaggaugcaggccagggaccagccaauuccugcccccag

SEQ ID NO: 108634 - RNA, 46 nt, Mus musculus
cucuucacucucuggaucgcgucuaggacuuuugaguuuggguuag

SEQ ID NO: 108635 - RNA, 41 nt, Mus musculus
ucccccacagcgagcaggggagauggaaaauugucggugau

SEQ ID NO: 108636 - RNA, 42 nt, Mus musculus
ccagagagccaggucccgcaggugccaguugagcaccggacc

SEQ ID NO: 108637 - RNA, 46 nt, Mus musculus
agaggggcaggugcagagugguggagucaggguucagaggugaggu

SEQ ID NO: 108638 - RNA, 41 nt, Mus musculus
gggcaauucagggucgagguacagaaguggcuacagaaagg

SEQ ID NO: 108639 - RNA, 46 nt, Mus musculus
agagagacaauguggccagcguggagugaaggaaagaugugaagaa

SEQ ID NO: 108640 - RNA, 44 nt, Mus musculus
gggacagggaggucaggaugaugggggaauaacaggacccuuac

SEQ ID NO: 108641 - RNA, 45 nt, Mus musculus
guguggccucugcaucccugccugacuccccugugacaucaagau

SEQ ID NO: 108642 - RNA, 46 nt, Mus musculus
aacccuccaucaaaaucuccucccagucuucgcugagggccacucu

SEQ ID NO: 108643 - RNA, 77 nt, Mus musculus
cucuacuucucucuucucuaccucccaggacgcuucaccuccucugggcugugcuccaaucaaagccucagguucuc

SEQ ID NO: 108644 - RNA, 44 nt, Mus musculus
ccacuuuuccucaucuguugcuaucucugcuggaaaggggcccu

SEQ ID NO: 108645 - RNA, 46 nt, Mus musculus
ucuucuggacucacaucauccuuggcgccugaggucuuguccaccu

SEQ ID NO: 108646 - RNA, 42 nt, Mus musculus
aguauuuuggaaugguuuugggcaaaaggguguugggggcug

SEQ ID NO: 108647 - RNA, 44 nt, Mus musculus
agccagcugaggcuauggaaggaaagaaaaagcaaaggguauga

SEQ ID NO: 108648 - RNA, 46 nt, Mus musculus
uggugaccaccauuauugagcaaggaucuggaggaggccugcguug

SEQ ID NO: 108649 - RNA, 45 nt, Mus musculus
agggggucgggccugucugagcuggcccggccucugagcuuggca

SEQ ID NO: 108650 - RNA, 45 nt, Mus musculus
ggugugucuuccuagcuggccauggggaaggauugaggguggugg

SEQ ID NO: 108651 - RNA, 46 nt, Mus musculus
ccugggaauaauaauaauuaucgaucuauuaauaaaaguuuuugag

SEQ ID NO: 108652 - RNA, 45 nt, Mus musculus
uggcaucauuuuguaacuuuuuuucuuauuuauugaaccccauac

SEQ ID NO: 108653 - RNA, 42 nt, Mus musculus
ccagggaccccguucugucuuccucuugcucugcaccuccau

SEQ ID NO: 108654 - RNA, 39 nt, Mus musculus
aggguaggcuggggacagcucucugcuggccagacccca

SEQ ID NO: 108655 - RNA, 45 nt, Mus musculus
aagggcugggccagagugaaguuaggccuccaacucagugcagca

SEQ ID NO: 108656 - RNA, 42 nt, Mus musculus
agaaaaccugaaacagacguacaagggaaagaagaaguugau

SEQ ID NO: 108657 - RNA, 41 nt, Mus musculus
ccaggcugccugugcuggagacaacauuccccgcuggagaa

SEQ ID NO: 108658 - RNA, 23 nt, Mus musculus
agaggaaggacuuggacagaacg

SEQ ID NO: 108659 - RNA, 46 nt, Mus musculus
uacaguaaacuugagaaugauuaacagcuagggaccccaaacaagc

SEQ ID NO: 108660 - RNA, 43 nt, Mus musculus
ggaggcccuuucagcggcuuuggagaagugauuuuccgggaga

SEQ ID NO: 108661 - RNA, 42 nt, Mus musculus
aguggugcgcaaugaagaacagcuacuggcccugcuggagga

SEQ ID NO: 108662 - RNA, 42 nt, Mus musculus
ucagcagccguggacguguuuuccccagacucagccccagag

SEQ ID NO: 108663 - RNA, 45 nt, Mus musculus
cacugcuuugcauguugcaggaagaugagguggcucacaggcugg

SEQ ID NO: 108664 - RNA, 41 nt, Mus musculus
ccccucaaagccuuugagcuuggcugcagagauggggagua

SEQ ID NO: 108665 - RNA, 90 nt, Mus musculus
ggccaugcugugagugugggugcggcaaguaaagagggauacggaagaaaggcaguagagaggucaggaagaagcaaagauggaggagag

SEQ ID NO: 108666 - RNA, 45 nt, Mus musculus
ugugucauuuugagcccacacugcaaaccagaugagcggucggga

SEQ ID NO: 108667 - RNA, 94 nt, Mus musculus
ggugaguuccaagcuagccugggcuacagagcaagacccugccucagaagaagagcagagauaaucuuaacuugauagucacuugaagagagau

SEQ ID NO: 108668 - RNA, 47 nt, Mus musculus
gaguauggggauaagcagauggguagaucaguacagugcagugaggg

SEQ ID NO: 108669 - RNA, 48 nt, Mus musculus
aagguggauugaaacauagugccacccugucucauguucagagagaga

SEQ ID NO: 108670 - RNA, 45 nt, Mus musculus
augagagagucacaccaggcagaaaaccucaugaaggagauuucu

SEQ ID NO: 108671 - RNA, 45 nt, Mus musculus
agcccaguaguucugaaauagaagaaaagaaaaagaccagagaag

SEQ ID NO: 108672 - RNA, 49 nt, Mus musculus
ucagcucucagaguugcugucauacaucagggggucucagugaggcuga

SEQ ID NO: 108673 - RNA, 45 nt, Mus musculus
gagaaacgaggaagcagggucccagggagggccagaggguugacc

SEQ ID NO: 108674 - RNA, 106 nt, Mus musculus
uggaucccagacuggcucuugcuguagggauugagacauggcugauaauucuagaaugugggcuuuagacuggagacgggauuaugaacugaaggugaagaauguc

SEQ ID NO: 108675 - RNA, 94 nt, Mus musculus
uguuucaaugaggcagauaaaaaaguacuaaaaaguacugaagauaaugauauaguagacuucagagacuagaacauaguggaggcucagcgag

SEQ ID NO: 108676 - RNA, 87 nt, Mus musculus
gagauaccauggcauucuccagguacagcacugggaaggcagaggcaggagauggagaggccagccugagcuuacauaguaagaucc

SEQ ID NO: 108677 - RNA, 42 nt, Mus musculus
gcuuggagaugggggaggcuggaggagagaggugggccaggg

SEQ ID NO: 108678 - RNA, 45 nt, Mus musculus
cuguaucccuuugcuccagccuccagagcccaccaguccucucca

SEQ ID NO: 108679 - RNA, 46 nt, Mus musculus
aaacccugagcccuggcggcugcucaggaaguugaggcagaaagau

SEQ ID NO: 108680 - RNA, 51 nt, Mus musculus
uauguggcugcccccaguucauccugugaccuccaucuggagacuggaaag

SEQ ID NO: 108681 - RNA, 46 nt, Mus musculus
cguguuguugccaauggagacacagccaacaaaauaggcaccuauc

SEQ ID NO: 108682 - RNA, 42 nt, Mus musculus
cagaucccugcaacucucaucacugacagcauggcggcggcu

SEQ ID NO: 108683 - RNA, 42 nt, Mus musculus
cagaacagugcgguugcugugugagaccaaggagcuucaggg

SEQ ID NO: 108684 - RNA, 45 nt, Mus musculus
acagaggagcugagagugacacccccugaguaaguggccacaaga

SEQ ID NO: 108685 - RNA, 45 nt, Mus musculus
ucgccgaggauauguuggagaaggaccucaaagacaaccggagca

SEQ ID NO: 108686 - RNA, 46 nt, Mus musculus
agugaucagaguggaaguguccucaggcucucagaaccccaccuca

SEQ ID NO: 108687 - RNA, 42 nt, Mus musculus
ggcagcccaggaggcggaacgagagggugccacugaagagac

SEQ ID NO: 108688 - RNA, 42 nt, Mus musculus
cggcggucccggacucgcugcucugguggccuucgugcgaga

SEQ ID NO: 108689 - RNA, 45 nt, Mus musculus
guggccccacaaagcccgaugaaggguuugagauacugaccaaga

SEQ ID NO: 108690 - RNA, 45 nt, Mus musculus
gaguaagggagucagaauuccaggaccagaagccaugacgcgucc

SEQ ID NO: 108691 - RNA, 45 nt, Mus musculus
gcacuuggucccuagagccccuguuauuuaaacuggugggaagaa

SEQ ID NO: 108692 - RNA, 46 nt, Mus musculus
ugugccacacccacccacaggagaagaagaaagccaugcaggagga

SEQ ID NO: 108693 - RNA, 46 nt, Mus musculus
cuggaaaucuagcagugagccaccuacagacugaccauguacagag

SEQ ID NO: 108694 - RNA, 48 nt, Mus musculus
aacagacccugccaacugugacuaugucaucgugaguggugccagucg

SEQ ID NO: 108695 - RNA, 46 nt, Mus musculus
aaggaguaaacagauggguaggugggugggugugaggaugccuagg

SEQ ID NO: 108696 - RNA, 46 nt, Mus musculus
gcaucugguggcacuucagggauaggcguggcuucacgggcuaaag

SEQ ID NO: 108697 - RNA, 41 nt, Mus musculus
ggcucaguaccugccacucacaaucagaagauaggacuaua

SEQ ID NO: 108698 - RNA, 46 nt, Mus musculus
gcccacagcccagaccuaccuaaggugugcacuguuggggcagaga

SEQ ID NO: 108699 - RNA, 46 nt, Mus musculus
ugggggagcaauggcucagugggugaaguguugccaagccagagau

SEQ ID NO: 108700 - RNA, 46 nt, Mus musculus
gagacaggagggcuacucaaguccaagaguucaugaacagccagaa

SEQ ID NO: 108701 - RNA, 42 nt, Mus musculus
ugaugagggguaaagaccacguuuacuggucuagacccugga

SEQ ID NO: 108702 - RNA, 81 nt, Mus musculus
acgucucacugcaucuucaugcguugaccaggccaauuucauaguugcagccuugcuagugaggaccuauaggcagcuccc

SEQ ID NO: 108703 - RNA, 46 nt, Mus musculus
caacguguccagauugagccagaccauaugggagagaggagaaggu

SEQ ID NO: 108704 - RNA, 46 nt, Mus musculus
agguaucugggucaggacgugugaugaugacucaguaggugaagac

SEQ ID NO: 108705 - RNA, 46 nt, Mus musculus
agcaggcacuccacaacagucagacccagguccgcagcugguaaag

SEQ ID NO: 108706 - RNA, 73 nt, Mus musculus
cauagcacuucaagcuggguguccacacuaccagcccauacacuuuuucauuauagcaaaccccagagucacu

SEQ ID NO: 108707 - RNA, 46 nt, Mus musculus
cuuuguaguguuucccuucuucuuugucaauaucuucguggccuug

SEQ ID NO: 108708 - RNA, 35 nt, Mus musculus
aaaagaccggguuaccaaaauggcuggauuauaua

SEQ ID NO: 108709 - RNA, 46 nt, Mus musculus
uuuauaaggggccuucaaggacugcagggaucccaucuaggcccag

SEQ ID NO: 108710 - RNA, 42 nt, Mus musculus
uuugccaucagugccaagccgcugaccaggcacaugccccag

SEQ ID NO: 108711 - RNA, 44 nt, Mus musculus
cagaucuucuggcuguauugucaccuccuccugaaacggggaca

SEQ ID NO: 108712 - RNA, 44 nt, Mus musculus
gagguagucaacuaugaagauuuucuaggauccccgacccccac

SEQ ID NO: 108713 - RNA, 54 nt, Mus musculus
accuuggcacaugcccuagggucagaguggcagaaucaaguucaaaccuuagag

SEQ ID NO: 108714 - RNA, 47 nt, Mus musculus
uggguggggcagagaacaaaaaagggugaggggaaaggcggagaaga

SEQ ID NO: 108715 - RNA, 42 nt, Mus musculus
caaagauagacuaccuuguaagccacucuggccgggcacuuc

SEQ ID NO: 108716 - RNA, 63 nt, Mus musculus
gaaggucaucccuggccaucucgaggaugaacugagggagcagauguccuccagggccggggg

SEQ ID NO: 108717 - RNA, 45 nt, Mus musculus
aaggaauucugugucccagacagggguucugucuugcuugguggc

SEQ ID NO: 108718 - RNA, 45 nt, Mus musculus
acaguguccgugcccacuuuccacccauguccagaaagguggaga

SEQ ID NO: 108719 - RNA, 41 nt, Mus musculus
gcaggcccuauggacauugggacuuccaugccacuggguug

SEQ ID NO: 108720 - RNA, 46 nt, Mus musculus
ugucucaaagacacaacagagcuucaggcagucaccaucccaggag

SEQ ID NO: 108721 - RNA, 45 nt, Mus musculus
cuacuggccgggcaaugguggcacacaccuuuaaucccagcacuu

SEQ ID NO: 108722 - RNA, 45 nt, Mus musculus
gcccagaagccucccucuccaccagcgauggagaacggcacccgg

SEQ ID NO: 108723 - RNA, 46 nt, Mus musculus
cagucaagguuccaggagagaaggacucagagaaaauagcugugga

SEQ ID NO: 108724 - RNA, 46 nt, Mus musculus
aaacagaaauaagacaugucuuucuuugccuccuuccaauaggaag

SEQ ID NO: 108725 - RNA, 45 nt, Mus musculus
ugacacacagacauacgugcagacaaaacaccuacacacauaaaa

SEQ ID NO: 108726 - RNA, 46 nt, Mus musculus
gacagcauccuggaguccuuucuuccuuucuaccauuuggauccag

SEQ ID NO: 108727 - RNA, 42 nt, Mus musculus
cacucagcuugugggauaggaucaaaucaccuaugcaggcug

SEQ ID NO: 108728 - RNA, 46 nt, Mus musculus
agccuggaccugcacgccaacugcuaccagcgcuauaucgugccgc

SEQ ID NO: 108729 - RNA, 42 nt, Mus musculus
gggccagguguagacugagacaauaaagagauguaaccugcu

SEQ ID NO: 108730 - RNA, 46 nt, Mus musculus
ggguuugcugcucccacagcacuggaagaccccccaacccucagga

SEQ ID NO: 108731 - RNA, 42 nt, Mus musculus
gcgggcacauggaccccacggauagaaugcuaaccuguggga

SEQ ID NO: 108732 - RNA, 46 nt, Mus musculus
auuucuggguucucaaagguccuguucuugccggcugugggccuga

SEQ ID NO: 108733 - RNA, 45 nt, Mus musculus
ccugguaacaugugggaggauaugcugggcaaggguggcuggcag

SEQ ID NO: 108734 - RNA, 46 nt, Mus musculus
uuugagggauaaaucuauuuguuuuugaugggaaagggggcugcag

SEQ ID NO: 108735 - RNA, 46 nt, Mus musculus
gggcgcagugcauggcagaacuaccagaagcagcagaaaugggcag

SEQ ID NO: 108736 - RNA, 62 nt, Mus musculus
ucgauggacuuggggcgcuuggugcugcugaggaggaggaggaagaagaagaagaagaagca

SEQ ID NO: 108737 - RNA, 46 nt, Mus musculus
caccccuuccccaggacagaaccacaucucugauaaagguuuugac

SEQ ID NO: 108738 - RNA, 45 nt, Mus musculus
gaagaagcaaaggguggcaucagaaccucuggauuuccaaguaga

SEQ ID NO: 108739 - RNA, 46 nt, Mus musculus
ccaguccuggcaucaggcaugucucaucccccaccuaccagcagag

SEQ ID NO: 108740 - RNA, 46 nt, Mus musculus
caggguaucccggcacccccagaggccucacccacugcugucccgg

SEQ ID NO: 108741 - RNA, 41 nt, Mus musculus
uauguaucccauagucucuaaaugggagaguagccaucagg

SEQ ID NO: 108742 - RNA, 46 nt, Mus musculus
ccccuuucucccuugcccccaggacugggccacuuguggggcagcc

SEQ ID NO: 108743 - RNA, 84 nt, Mus musculus
uuuccuucugucccucccuuucuccaucuuuuggucacuacccuccaacucuaggaacagggguguagaggagaagcccuaggc

SEQ ID NO: 108744 - RNA, 69 nt, Mus musculus
uuuuuacugguguuugucuuuaauucuccuucagcccucaucugguuucucauuuuugaaucaacaucu

SEQ ID NO: 108745 - RNA, 48 nt, Mus musculus
caccugccuucagggcuggacugaggccugaacacccugccgcagagc

SEQ ID NO: 108746 - RNA, 100 nt, Mus musculus
ggaugaggagcagaggcuuaaggaagaagaagaggacaagaagcguaaagaggaagaagaagcugaggauaaagaggaugaugaugacagagaugaagau

SEQ ID NO: 108747 - RNA, 51 nt, Mus musculus
gacaauuuccucaucaccaaugaugaggccuaugcagaggaguuuggcaau

SEQ ID NO: 108748 - RNA, 45 nt, Mus musculus
uuauuguuaaagcauuuuuauguguaugguuauauagaggucaga

SEQ ID NO: 108749 - RNA, 79 nt, Mus musculus
ccacgucaaauugacaacccagauuacaaggguaccuggauacacccagaaauugacaacccugaauacucccccgaug

SEQ ID NO: 108750 - RNA, 81 nt, Mus musculus
cccugaugcuaagaagccugaggacugggaugaagagauggauggagagugggaaccaccagugauucaaaauccugaaua

SEQ ID NO: 108751 - RNA, 120 nt, Mus musculus
cuccuuggaggaugauugggacuuucugccacccaagaagauaaaggacccugaugcugccaagccggaagacugggaugaacgagccaagaucgaugaccccacagauuccaagccuga

SEQ ID NO: 108752 - RNA, 53 nt, Mus musculus
ugaugaauucacacaccuauacacacugauugugcggccagacaacaccuaug

SEQ ID NO: 108753 - RNA, 47 nt, Mus musculus
uggcaccaagaagguucaugucaucuuuaacuacaagggcaagaaug

SEQ ID NO: 108754 - RNA, 42 nt, Mus musculus
uguauagagaaccugucucaaaaaaacaaacaaaccccaacc

SEQ ID NO: 108755 - RNA, 45 nt, Mus musculus
uggcaaguaccuaauuuaccacugagccauuugcuggccccagaa

SEQ ID NO: 108756 - RNA, 61 nt, Mus musculus
gggcggcuacgugaagcuguuuccgagugguuuggaccagaaggacaugcauggagacuca

SEQ ID NO: 108757 - RNA, 56 nt, Mus musculus
cagcaauaagggccagacacuggugguacaguucacggugaagcaugagcagaaua

SEQ ID NO: 108758 - RNA, 46 nt, Mus musculus
guuggggcuuuucccaggaacacgggagccaaggacagguggagga

SEQ ID NO: 108759 - RNA, 41 nt, Mus musculus
ggcaaauuuguccucaguucuggcaaauuuuacggggaccu

SEQ ID NO: 108760 - RNA, 45 nt, Mus musculus
gcgguggccgcguccgucaauaccgcagagccgcugccugaagau

SEQ ID NO: 108761 - RNA, 46 nt, Mus musculus
aucccaggacaccuuuaucuggaccuuugucucuaugagccuaguc

SEQ ID NO: 108762 - RNA, 46 nt, Mus musculus
aagugucuuagcugucucuagcaagaccuaauggaguugucuggag

SEQ ID NO: 108763 - RNA, 42 nt, Mus musculus
cugggccacccgcauaggcgcccagagacucaggcggcucga

SEQ ID NO: 108764 - RNA, 41 nt, Mus musculus
ucccagacaauucaagaaggaagggggcgccgugggaccag

SEQ ID NO: 108765 - RNA, 45 nt, Mus musculus
uggggacuucgguguuagaaguggauguguaaggccuggguuaga

SEQ ID NO: 108766 - RNA, 56 nt, Mus musculus
ucaaguaaaaucaguuucaggggcaacugacagaggucccagaguuaagaaaagaa

SEQ ID NO: 108767 - RNA, 45 nt, Mus musculus
uugugagccaccauguggugcugggauuuaaacucaggaccucug

SEQ ID NO: 108768 - RNA, 59 nt, Mus musculus
ccagcaccacaugguggcucacaaccaucuguaaugggauccgaugcccucuucuggug

SEQ ID NO: 108769 - RNA, 47 nt, Mus musculus
ggaagacagcugagggucucccaagcauggcagggcacgcaacaggc

SEQ ID NO: 108770 - RNA, 46 nt, Mus musculus
caugcauaugagcugggcaugguggcacaugccuuugaucccagca

SEQ ID NO: 108771 - RNA, 41 nt, Mus musculus
agagagagagagagagagggagggagagagagaggggagag

SEQ ID NO: 108772 - RNA, 45 nt, Mus musculus
aggaguggagggcggggugcugcaaagagagaaaggaaguccugg

SEQ ID NO: 108773 - RNA, 46 nt, Mus musculus
uucuuuuucucgaccuuaaucccccugguuucaccccuaccacuag

SEQ ID NO: 108774 - RNA, 59 nt, Mus musculus
gggucuauggaaagagaucuaguguguccucugcaagguagagaggggagaggccugag

SEQ ID NO: 108775 - RNA, 45 nt, Mus musculus
aggagagaccuggugguuagcuuuaggaguguaauucauuuuuag

SEQ ID NO: 108776 - RNA, 48 nt, Mus musculus
gcgugagcaagagccggacacacggacguccagacacggguagagaca

SEQ ID NO: 108777 - RNA, 46 nt, Mus musculus
uugauuuccuugaaggcaccauccaccaccgcuguggccgugaagu

SEQ ID NO: 108778 - RNA, 46 nt, Mus musculus
gugaacugagaguccacagacacucccagcaccucgcagccuagcu

SEQ ID NO: 108779 - RNA, 26 nt, Mus musculus
gagggauauucagggggcccaagccu

SEQ ID NO: 108780 - RNA, 45 nt, Mus musculus
ccauauccuauucauucuaccacuucuaccaucaggacauaagau

SEQ ID NO: 108781 - RNA, 25 nt, Mus musculus
auuuuuuaaaggaggagggggggau

SEQ ID NO: 108782 - RNA, 46 nt, Mus musculus
accuagcugggcccaggucuauaggaaaccaauaaaguauuaggga

SEQ ID NO: 108783 - RNA, 41 nt, Mus musculus
auaucuuaccauuaacuauauaaaaugauauguaacagcug

SEQ ID NO: 108784 - RNA, 45 nt, Mus musculus
acgguuuccuuugcgcuuggaucuuccagcuucaagggcacccag

SEQ ID NO: 108785 - RNA, 45 nt, Mus musculus
cuucucccuccauccgcccagcuuggaagaaaaaagagaccacag

SEQ ID NO: 108786 - RNA, 46 nt, Mus musculus
gagacaggcugccagggcuccgaccguaucccgccgcugcguaaga

SEQ ID NO: 108787 - RNA, 46 nt, Mus musculus
ugucuuggucuucuuuccucgguuuuggaccuggaaggaggaauag

SEQ ID NO: 108788 - RNA, 41 nt, Mus musculus
ggcaggccugagcgaaaagaccaggugaggccacgccccuc

SEQ ID NO: 108789 - RNA, 42 nt, Mus musculus
ccaaguuucaccccccugugccaguccccaggaccugagcag

SEQ ID NO: 108790 - RNA, 32 nt, Mus musculus
gagguugaaggugacagguggacucaugacua

SEQ ID NO: 108791 - RNA, 44 nt, Mus musculus
guccagacuccagcacuuaagggcuggacgcagaauaggagaau

SEQ ID NO: 108792 - RNA, 45 nt, Mus musculus
gcacugaccagccuaucccaggaggcacaagcacuaaaggaugag

SEQ ID NO: 108793 - RNA, 36 nt, Mus musculus
uuuuaugugugugaguguuuugccugcaugucugug

SEQ ID NO: 108794 - RNA, 46 nt, Mus musculus
accgaggugcucaaagaggaagaggcagguuggagagaaggcucag

SEQ ID NO: 108795 - RNA, 45 nt, Mus musculus
uggaagagggccaggcagugguggcucaggccuuuaaucccagca

SEQ ID NO: 108796 - RNA, 45 nt, Mus musculus
augaggaccagaccaacuuggggaucacaggauggcgagaugauu

SEQ ID NO: 108797 - RNA, 42 nt, Mus musculus
gcuuugucagaccaaacaacacagagagaggaggggggagag

SEQ ID NO: 108798 - RNA, 38 nt, Mus musculus
ccagacucuccuagaccucacccuaaacacccuucacu

SEQ ID NO: 108799 - RNA, 44 nt, Mus musculus
ggaccuaagauaaaguccaaggggcuuggaccaucagucuagag

SEQ ID NO: 108800 - RNA, 46 nt, Mus musculus
aagauugaguguuguacaggugaaagggauaggaggguguguggga

SEQ ID NO: 108801 - RNA, 44 nt, Mus musculus
gaagaaagguaaaggagaaucugaagaaggccuggaggugucgg

SEQ ID NO: 108802 - RNA, 46 nt, Mus musculus
gacuggcaggcuuugggcaggacuccuggagagagaggggcagagu

SEQ ID NO: 108803 - RNA, 42 nt, Mus musculus
agaucggaugacaggcaacgucucuucuagcuuggaggccag

SEQ ID NO: 108804 - RNA, 42 nt, Mus musculus
cgaggggaccagacucaggcugcugcgaugacggacucccag

SEQ ID NO: 108805 - RNA, 46 nt, Mus musculus
cacaguuaccauuucccucauuaaaaccaagcugucacaggcacug

SEQ ID NO: 108806 - RNA, 46 nt, Mus musculus
ugcgauuuuugucaggcaccaggacacauagcugucacaccagcac

SEQ ID NO: 108807 - RNA, 46 nt, Mus musculus
gccaccuagccuaguguacacagcaguaaacaacagaccaucucac

SEQ ID NO: 108808 - RNA, 46 nt, Mus musculus
ucuguguagcccuggcgguccuggaacucuguagaccaggcuggcc

SEQ ID NO: 108809 - RNA, 46 nt, Mus musculus
aaaaggccuuaugguuggggccggagagauggcuugguguucagag

SEQ ID NO: 108810 - RNA, 45 nt, Mus musculus
caccugucacuaaaacaagaucugccuuauggggaccucaggcag

SEQ ID NO: 108811 - RNA, 42 nt, Mus musculus
ggcuccgcccgucucccucgggcagccauuuuguggccagau

SEQ ID NO: 108812 - RNA, 45 nt, Mus musculus
uuguuugccaacgauggcagcuuccuggagcuguucaagcggaag

SEQ ID NO: 108813 - RNA, 42 nt, Mus musculus
ucuucggauucccugggcccgccgcggcggaggccgguggau

SEQ ID NO: 108814 - RNA, 42 nt, Mus musculus
cccuucccgggcccgacucccccagccaacgcgggccccggc

SEQ ID NO: 108815 - RNA, 61 nt, Mus musculus
cccgcccagaaacaccucugguccggaauccaggcucgagauucucagcaagcgaccggga

SEQ ID NO: 108816 - RNA, 45 nt, Mus musculus
guacccagacuuugaauagugaggcccacauauaaugugggggaa

SEQ ID NO: 108817 - RNA, 46 nt, Mus musculus
gggcguggugguacacgccuuguauuacaagcacuccggaugcaag

SEQ ID NO: 108818 - RNA, 46 nt, Mus musculus
guggcacauacauggaauccuagcacuguggugcuugaggcaggag

SEQ ID NO: 108819 - RNA, 46 nt, Mus musculus
guguguguguguguguguguguguguccaguagugugugccuguag

SEQ ID NO: 108820 - RNA, 63 nt, Mus musculus
cagaagaucgcuuugaaugcaugggauccuagauuccaccugcaguauugcacaaaagcgauu

SEQ ID NO: 108821 - RNA, 82 nt, Mus musculus
gugggaauaguccagcagucacugccuaguuaaaggguaagaacaggauaaucucuugaaggcccccaguuaaagggagaac

SEQ ID NO: 108822 - RNA, 49 nt, Mus musculus
aaaacgccaggccagcucaggguaggagaaugagggaugcuuugugguu

SEQ ID NO: 108823 - RNA, 45 nt, Mus musculus
acggucacagcgcucuguguggucuguagggcucaauagauagug

SEQ ID NO: 108824 - RNA, 42 nt, Mus musculus
caggugcugagucgagugugcuccucucugauugcugcgcag

SEQ ID NO: 108825 - RNA, 27 nt, Mus musculus
acgggaauaguagccaagaagcagaag

SEQ ID NO: 108826 - RNA, 45 nt, Mus musculus
cauguacuuggcccaugcgucaccuuuacuuguuaauaccugugg

SEQ ID NO: 108827 - RNA, 95 nt, Mus musculus
acugauacacagaaggaaacgaaggcgcuugcuguggccgcagaccguucuccaggacucuuuuuuuaccuugagcacuugccuccucagacuuu

SEQ ID NO: 108828 - RNA, 46 nt, Mus musculus
agucugaggaggcaagugcucaagguaaaaaaagaguccuggagaa

SEQ ID NO: 108829 - RNA, 46 nt, Mus musculus
ucucucuggcucugucucuucuugcugucucucuccuuuuagcagu

SEQ ID NO: 108830 - RNA, 42 nt, Mus musculus
gcgggccaguggggcggcuggggucgggcuggaggggcgcug

SEQ ID NO: 108831 - RNA, 45 nt, Mus musculus
aucggguguguguggggaucuguuucggcggggcuugguuggguc

SEQ ID NO: 108832 - RNA, 46 nt, Mus musculus
cuugagaccagagggcuuugcugagucuggcugcgaggcgguggug

SEQ ID NO: 108833 - RNA, 25 nt, Mus musculus
agcuagagaagcuuggccagaucug

SEQ ID NO: 108834 - RNA, 46 nt, Mus musculus
ccauguggcgucuacugagcuuguagagccgguuuagaagagggag

SEQ ID NO: 108835 - RNA, 45 nt, Mus musculus
gaaaucuaggaggcggcuggcaucuaguggagcuggaaggcugga

SEQ ID NO: 108836 - RNA, 42 nt, Mus musculus
cuggagggaggcggaagccgugaggcccguaaccgggggcgg

SEQ ID NO: 108837 - RNA, 47 nt, Mus musculus
cagggccugcagcaggucuugcagcuucucaaagacucgcagucgcc

SEQ ID NO: 108838 - RNA, 46 nt, Mus musculus
ugugggcauggcugugggaaauuuucuugauaauaauugaugcugg

SEQ ID NO: 108839 - RNA, 46 nt, Mus musculus
uguucuuuucuuuuucuuuuucuuucuuucuuuuuuuuagucaugg

SEQ ID NO: 108840 - RNA, 45 nt, Mus musculus
cuuuccuuagcaauauaguguuuuguuuuaaacuuacuugugugg

SEQ ID NO: 108841 - RNA, 46 nt, Mus musculus; identical to SEQ ID NO: 77241

SEQ ID NO: 108842 - RNA, 41 nt, Mus musculus
cugaaggucuucaggguucuggcauucaugugugcauucau

SEQ ID NO: 108843 - RNA, 45 nt, Mus musculus
gaaugggaugaaguacucugaaauugacaucauccuucuuaaggu

SEQ ID NO: 108844 - RNA, 26 nt, Mus musculus
cugcgcuggauguccuugccaauguc

SEQ ID NO: 108845 - RNA, 24 nt, Mus musculus
uaaacuugcuauguuguggugucu

SEQ ID NO: 108846 - RNA, 45 nt, Mus musculus
cagccagccaccugacaugcaccucaagccucugaugacggagcu

SEQ ID NO: 108847 - RNA, 46 nt, Mus musculus
guauucguacuggcugauccuggauacacccucccuagcugccugu

SEQ ID NO: 108848 - RNA, 45 nt, Mus musculus
ucucguuuuugccuuuggcaaauaccagcauaagaaccugcucau

SEQ ID NO: 108849 - RNA, 42 nt, Mus musculus
caggaguacauucagaagcugaugccuccgcugauccagaag

SEQ ID NO: 108850 - RNA, 43 nt, Mus musculus
ucuagauguauacacaacaccccgaacaauaugaggccccaga

SEQ ID NO: 108851 - RNA, 65 nt, Mus musculus
uguugcguuggaccugcuuaguggcuuggcugagggccuggguggccacguggagcagcugguag

SEQ ID NO: 108852 - RNA, 69 nt, Mus musculus
agagcuccuuugcccuucugggagaccuuaccaaagccugcuuuauccacgucaagcccuguaucggua

SEQ ID NO: 108853 - RNA, 96 nt, Mus musculus
uuagcugaguucaugccuauucuggguaccaaccugaacccugaguucaucucugucugcaacaaugcuaccugggccauuggggagaucugcaug

SEQ ID NO: 108854 - RNA, 46 nt, Mus musculus
aagacuggguggaguggucauguuaccuucuggguaaugacuucag

SEQ ID NO: 108855 - RNA, 57 nt, Mus musculus
ugcagccuuaugugcagaugguccucaacaaccugguggagaucauuaacaggccca

SEQ ID NO: 108856 - RNA, 46 nt, Mus musculus
accugaaauagagucgggagggacgaaggaagaauacuggcuuuag

SEQ ID NO: 108857 - RNA, 43 nt, Mus musculus
ugcaggucgccugacgagucccucugccauuccagccaucacc

SEQ ID NO: 108858 - RNA, 42 nt, Mus musculus
ugcaugaugauuggugucaauccuggggguguugugcagguc

SEQ ID NO: 108859 - RNA, 41 nt, Mus musculus
ugugcugcuuccagaagucacugugcccuggucgagggggg

SEQ ID NO: 108860 - RNA, 42 nt, Mus musculus
ugggucaucucgggcagcccacuugggccagcuaugugggag

SEQ ID NO: 108861 - RNA, 75 nt, Mus musculus
agcuaggcugggccaaacgccccaccauuuccucgacugcauggagacaguagaauuagugaacccccaaauuau

SEQ ID NO: 108862 - RNA, 44 nt, Mus musculus
caaaggacgaaguuuacuggguccagcaagauuugaaagcuugg

SEQ ID NO: 108863 - RNA, 65 nt, Mus musculus
aaccuuugaagaaauuuguuggcgaugccaucggggugggaggggcuucccgagaggagaggggc

SEQ ID NO: 108864 - RNA, 46 nt, Mus musculus
aauggggagggggagggaguuccaacuaccuucaggaaacgggagc

SEQ ID NO: 108865 - RNA, 46 nt, Mus musculus
uggacugaccuugaucuguagcccucccugcugccauuccccugag

SEQ ID NO: 108866 - RNA, 45 nt, Mus musculus
ucuguuacugugcugugcuggggacuagcgccuagguggcgugag

SEQ ID NO: 108867 - RNA, 42 nt, Mus musculus
agcuuuacagcagacauaacacaacuuugggucacuaggcag

SEQ ID NO: 108868 - RNA, 46 nt, Mus musculus
auaaacgccgggcgugguggugcacgccuuuaaucccagcacucgg

SEQ ID NO: 108869 - RNA, 42 nt, Mus musculus
ucuuuuccuugaaaggguugguggcagcugggaugcccacaa

SEQ ID NO: 108870 - RNA, 47 nt, Mus musculus
cagugcccaguaccacuaccuggagggaggucugcauacauccggga

SEQ ID NO: 108871 - RNA, 41 nt, Mus musculus
aaaggugauuggugaaaacugccaagaccagaagacccaga

SEQ ID NO: 108872 - RNA, 42 nt, Mus musculus
aggcagaugccuucagagcugagaagaaugaagacuaagaag

SEQ ID NO: 108873 - RNA, 41 nt, Mus musculus
gagcaauaaugacagguauuugugcaggaaccucuggcaga

SEQ ID NO: 108874 - RNA, 46 nt, Mus musculus
ccucaaaaaaggagaaagcugcuuaggggcauuaaggauugggcau

SEQ ID NO: 108875 - RNA, 42 nt, Mus musculus
ugaggggaagacuggcauugcugagguugugcuuucaaaguu

SEQ ID NO: 108876 - RNA, 47 nt, Mus musculus
acagugcuugguggcugucacgguauacuagaugggcacaauggggg

SEQ ID NO: 108877 - RNA, 45 nt, Mus musculus
cgcaucuagcacuucguagccguggccacuguagguccgcagcag

SEQ ID NO: 108878 - RNA, 46 nt, Mus musculus
ucgcuccugauccuugaacaugucgcagguauaagccucccccgag

SEQ ID NO: 108879 - RNA, 44 nt, Mus musculus
cacaugcugaagaucaugccaagaagauucauguaguccggagu

SEQ ID NO: 108880 - RNA, 49 nt, Mus musculus
cugaggauucugcagauaggacaucaccacggcggagauagagagccug

SEQ ID NO: 108881 - RNA, 41 nt, Mus musculus
agccuuuggcugccuccgcccucccucagcugcuguccuaa

SEQ ID NO: 108882 - RNA, 42 nt, Mus musculus
gacuucccuuuuaccuucucccccccccccaaacccggccac

SEQ ID NO: 108883 - RNA, 42 nt, Mus musculus
cugugcuuguaccaucucccugccugcgugugaaaguggaag

SEQ ID NO: 108884 - RNA, 45 nt, Mus musculus
ucacaaccaucuguaaugggauccaaugcccucuugugugucuaa

SEQ ID NO: 108885 - RNA, 47 nt, Mus musculus
uuugauggcuucuuccuugggcgcauugacuaucaagauaaacuuaa

SEQ ID NO: 108886 - RNA, 45 nt, Mus musculus
cccauacauucuugugugugugugugugugugugugugugugugu

SEQ ID NO: 108887 - RNA, 42 nt, Mus musculus
acaaauuuaaaguguuauaaaaugacuuggauucugggucag

SEQ ID NO: 108888 - RNA, 44 nt, Mus musculus
uauuucaucaucuuuguuauuuuaaauauuacagugugugugug

SEQ ID NO: 108889 - RNA, 41 nt, Mus musculus
gucuguggugugugggggauuuggugaugguaugaggaugg

SEQ ID NO: 108890 - RNA, 42 nt, Mus musculus
aaugcagcugaccguguugaccgaccgcucccaggggggcag

SEQ ID NO: 108891 - RNA, 46 nt, Mus musculus
uuucugaugaaaucacugcaagccuguauccaauuucugaacccag

SEQ ID NO: 108892 - RNA, 45 nt, Mus musculus
gcuguugguagaugaugaucguggagugucggaacccuuguugga

SEQ ID NO: 108893 - RNA, 45 nt, Mus musculus
ggcuggcuuaucaagauuaucgagucugaaggaaugacaagaggu

SEQ ID NO: 108894 - RNA, 46 nt, Mus musculus
acccuccuaaucucaagggcuucggaaaauggaagcuauuugggcc

SEQ ID NO: 108895 - RNA, 46 nt, Mus musculus
cuugugaaaauaguucugggucccauuguauuuccggucaguagcc

SEQ ID NO: 108896 - RNA, 44 nt, Mus musculus
gagagggagaguagagaaguagaagaguagaggccagccauaag

SEQ ID NO: 108897 - RNA, 44 nt, Mus musculus
caaauaauauuuuuuuaguauagaauagaguuuauucaggguau

SEQ ID NO: 108898 - RNA, 45 nt, Mus musculus
gagggccuagucuuggguucuauaagaaagaaagcugagcaagac

SEQ ID NO: 108899 - RNA, 42 nt, Mus musculus
ccuccacggcugggucgcggcuggagugaggacgcgcugugu

SEQ ID NO: 108900 - RNA, 44 nt, Mus musculus
uagaauuccuuauuuuguaccccgagaaccuuugauugcuauag

SEQ ID NO: 108901 - RNA, 45 nt, Mus musculus
agaacacaaugcccugcuaagauacuggguuuuaaacugggugag

SEQ ID NO: 108902 - RNA, 58 nt, Mus musculus
agagaaagccugucuggaaaaaucuuaggaagaagggaaagaaggaaggaaggaagga

SEQ ID NO: 108903 - RNA, 45 nt, Mus musculus
ugggaaguucugggucuagcggcagguuagggauugauguaguua

SEQ ID NO: 108904 - RNA, 42 nt, Mus musculus
caagcacuccacgauugaccuagagcuguauucagagcccug

SEQ ID NO: 108905 - RNA, 46 nt, Mus musculus
ugcaggggaagcugagaguuuuacaucuuuaucugaaggcugcuag

SEQ ID NO: 108906 - RNA, 42 nt, Mus musculus
guguuugugcaugcgugcgugcguaaguagaggugcccacag

SEQ ID NO: 108907 - RNA, 46 nt, Mus musculus
aggguguaagcugcagggcaugagugcugcuccuguguucggguug

SEQ ID NO: 108908 - RNA, 45 nt, Mus musculus
uguguguuuguguguguguguuuguguguguguguguguuugugu

SEQ ID NO: 108909 - RNA, 42 nt, Mus musculus
ugcaggguaucaaaaaaccauucacugagguaauccgagcca

SEQ ID NO: 108910 - RNA, 46 nt, Mus musculus
gaauaucaauggcaaaauguugcuugggggcuggagagauggcuua

SEQ ID NO: 108911 - RNA, 45 nt, Mus musculus
guacuuacauauaauaaauaaauaaaucuuuaaaaaaauguugcu

SEQ ID NO: 108912 - RNA, 46 nt, Mus musculus
cucuccugcugcugagagccagcaucuugcucuuugguacccugag

SEQ ID NO: 108913 - RNA, 46 nt, Mus musculus
gauggaugagcccaaauaaguagguaagcaucuugccauagcccag

SEQ ID NO: 108914 - RNA, 45 nt, Mus musculus
cuagaagccacgcucaggauuuaaaucagaacauuggcacuucag

SEQ ID NO: 108915 - RNA, 42 nt, Mus musculus
gccagcaucacaaagcgagcuuugagaaccucucagaccagu

SEQ ID NO: 108916 - RNA, 45 nt, Mus musculus
ugccucuggcuugucuuuuaagucaggauuuuuuacucaggcauu

SEQ ID NO: 108917 - RNA, 46 nt, Mus musculus
cugucucucugagacuaggucuuacuauauagcucugacuguccug

SEQ ID NO: 108918 - RNA, 51 nt, Mus musculus
ccaugucuggccucaugagucauccuuaugagauuaacuuuuaagugggca

SEQ ID NO: 108919 - RNA, 45 nt, Mus musculus
acauaccauagccagcuugguuaaaagaugccaaagagacuugag

SEQ ID NO: 108920 - RNA, 45 nt, Mus musculus
uccugcugggguguccucauaggacaucugugguauguuauagga

SEQ ID NO: 108921 - RNA, 42 nt, Mus musculus
gcccauauuugugacuaguguuuacugagcacuuacccugag

SEQ ID NO: 108922 - RNA, 53 nt, Mus musculus
uacagagggggcuacauggaggugaucaauuugcaccccgagaucaaaggcca

SEQ ID NO: 108923 - RNA, 45 nt, Mus musculus
gaguacacuguagucuguuuucagacacaccagaagaggguauca

SEQ ID NO: 108924 - RNA, 46 nt, Mus musculus
aaagaauucguccuugguaaucuggccaaaaaagcaaagcugacag

SEQ ID NO: 108925 - RNA, 41 nt, Mus musculus
cgagaucagaccccgccugccagagcccgagacuucccgag

SEQ ID NO: 108926 - RNA, 45 nt, Mus musculus
agaggaaggggaagccauugcagguuuucuuucuccuaccccaac

SEQ ID NO: 108927 - RNA, 45 nt, Mus musculus
ccugcaaggcccugcuggauuuagaucccagggcgccguuuucag

SEQ ID NO: 108928 - RNA, 46 nt, Mus musculus
auagauagccaucugcagccagugccuguugaacaguugcugggau

SEQ ID NO: 108929 - RNA, 41 nt, Mus musculus
uuuauaaaagaggaaggaaagaggaggaaaaaaggggccga

SEQ ID NO: 108930 - RNA, 68 nt, Mus musculus
gcuauucuguuuggagaguuccuuugggucuuaagcagccagaguacauggaaaugagauuaugucag

SEQ ID NO: 108931 - RNA, 46 nt, Mus musculus
gugacuugacaugauaagggcugggaauccagaaaucaauagugag

SEQ ID NO: 108932 - RNA, 46 nt, Mus musculus
auguagccuuuuggacaguaagccugcaagucuagugagaacucag

SEQ ID NO: 108933 - RNA, 45 nt, Mus musculus
uaaaacagaacuucaaguuguuaacacucacaagcauugcauuac

SEQ ID NO: 108934 - RNA, 45 nt, Mus musculus
accucauacucagccauuuauuaucacuuugcuuggcugucccau

SEQ ID NO: 108935 - RNA, 41 nt, Mus musculus
aacaacacgguaggaugaaugcucaggacacagcacuccca

SEQ ID NO: 108936 - RNA, 46 nt, Mus musculus
guauuaaaaacuauaggugagcuaagcauggugguauagggcggag

SEQ ID NO: 108937 - RNA, 46 nt, Mus musculus
ccucauguucuuuuuccuguagcaaaagaacaauaucuccagguuc

SEQ ID NO: 108938 - RNA, 46 nt, Mus musculus
ucugcugcaccauuccuggagccagcugucugaucauaaugcgcac

SEQ ID NO: 108939 - RNA, 34 nt, Mus musculus
gcucguucucgcuagcgccgggagggacgcccag

SEQ ID NO: 108940 - RNA, 28 nt, Mus musculus
cggcgcggggaggcaggcggggcugaac

SEQ ID NO: 108941 - RNA, 44 nt, Mus musculus
ggaucaggaagacauuucacauucuauugaugggguagaugaaa

SEQ ID NO: 108942 - RNA, 42 nt, Mus musculus
gcaaggcuuaggcuuaaaggcuggagcugcccaggcgggcgu

SEQ ID NO: 108943 - RNA, 42 nt, Mus musculus
caaaauaaaugaagaccucaucucaaggguuacgggugcuuu

SEQ ID NO: 108944 - RNA, 45 nt, Mus musculus
cugagacucaguccccaguugcgagugaagggguagaaaccuuua

SEQ ID NO: 108945 - RNA, 46 nt, Mus musculus
aucauagcugaccaugugggagguggguuggcuuccaggaauucag

SEQ ID NO: 108946 - RNA, 41 nt, Mus musculus
auccaggaggaucuuccugggugcugucaggauuccuggga

SEQ ID NO: 108947 - RNA, 47 nt, Mus musculus
aaggcaggcagggcuucaguucccaggcuuggggucugaggcagagg

SEQ ID NO: 108948 - RNA, 46 nt, Mus musculus
ggauuauugacagggaaguagacaaaauaccauagugggguugaua

SEQ ID NO: 108949 - RNA, 46 nt, Mus musculus
ccugugagaacucauucaaaucaccacauaggguucucauccccag

SEQ ID NO: 108950 - RNA, 46 nt, Mus musculus
gggcugagugugugugccuugggaggcaugugugaggcucuggcuu

SEQ ID NO: 108951 - RNA, 45 nt, Mus musculus
aggauucugggaaauagugagagaauaaaaggagagacacgggag

SEQ ID NO: 108952 - RNA, 45 nt, Mus musculus
agacaggggagaugaagcuaaaccagccuucaggauagaauagag

SEQ ID NO: 108953 - RNA, 41 nt, Mus musculus
uggccauagggaguggcacuguuaggaggugugaccuuguu

SEQ ID NO: 108954 - RNA, 46 nt, Mus musculus
ugucuuaguuaggguuccauugcugugaggagacaccaugaccaug

SEQ ID NO: 108955 - RNA, 41 nt, Mus musculus
aaucucacuuuauauuccagucuggccucaaacuugcggca

SEQ ID NO: 108956 - RNA, 44 nt, Mus musculus
gggaggcaacacaguacacaguuggcugcagcuacaccggccag

SEQ ID NO: 108957 - RNA, 40 nt, Mus musculus
uucugcucugaacacaaagagaacucagggcugggccuuu

SEQ ID NO: 108958 - RNA, 50 nt, Mus musculus
caugaacagggccuauggggaaccuagaucuggguggcuggaguaaggau

SEQ ID NO: 108959 - RNA, 46 nt, Mus musculus
ugcaaaauggcccucuagaugaacuuggaguccccuggaauuaggg

SEQ ID NO: 108960 - RNA, 72 nt, Mus musculus
aggugagagauggcaggaugcaggcugagguucugggagccaagaucccacaggguuagugagaggacuggu

SEQ ID NO: 108961 - RNA, 49 nt, Mus musculus
uuuccucuaaagcacugaguccaucccucagggcggugacagauugaca

SEQ ID NO: 108962 - RNA, 81 nt, Mus musculus
gggaggggaaagugggaagccagagagaagcauuagcaacagaacgaaggguguuuuaacuaaagggaucagaggaaccaa

SEQ ID NO: 108963 - RNA, 46 nt, Mus musculus
ggacccagcugagguggcucagaaugcugaggagggacagcccugg

SEQ ID NO: 108964 - RNA, 47 nt, Mus musculus
gacuuugacugggaggaggagaaggaggaaggagaucugccgggacg

SEQ ID NO: 108965 - RNA, 46 nt, Mus musculus
cauugguugaggggggaaaagauuuuuuuccuuucaagacccaaaa

SEQ ID NO: 108966 - RNA, 41 nt, Mus musculus
ggagagagaacaaaacucuugcaagaugugagacuggggua

SEQ ID NO: 108967 - RNA, 46 nt, Mus musculus
gcuuucuaaugagagagagagagcaagaaaggguguggauuuggua

SEQ ID NO: 108968 - RNA, 46 nt, Mus musculus
ggaaugugaaacugacuagaugcugacccuagucuccucccacccu

SEQ ID NO: 108969 - RNA, 46 nt, Mus musculus
uaucacucacguucuaaauuuccuaccccucccccacaggccccag

SEQ ID NO: 108970 - RNA, 47 nt, Mus musculus
ugcgcgccgcggaguugcagccagauacgcgcgggcagcggcuccuc

SEQ ID NO: 108971 - RNA, 46 nt, Mus musculus
uggggggagggggaggagagcuaucaguuugucaacccugccugag

SEQ ID NO: 108972 - RNA, 45 nt, Mus musculus
uaacuucucugccagaguuucuuucauugcuuaguuuuaaggggu

SEQ ID NO: 108973 - RNA, 46 nt, Mus musculus
uauuguuccuuggucuguuacgagacauuaaauggaucuaccccag

SEQ ID NO: 108974 - RNA, 45 nt, Mus musculus
agauggugugagccaccaugugguugcuggggauugaacucagga

SEQ ID NO: 108975 - RNA, 45 nt, Mus musculus
cccgggagcgugcaugcgacccaugauggcggaggucuggcagca

SEQ ID NO: 108976 - RNA, 42 nt, Mus musculus
ccaccguucccuucuuuucucuuuucagucucaccgggagag

SEQ ID NO: 108977 - RNA, 46 nt, Mus musculus
cuucuccaggguuuucaugggcugagguucaguuucaaguuucaau

SEQ ID NO: 108978 - RNA, 46 nt, Mus musculus
ggauuaaagcaaaauuaaaauuuggcuauucacacguauguuacag

SEQ ID NO: 108979 - RNA, 45 nt, Mus musculus
cgccaccggaaacuuccuacguguucguagcuacacuggguacca

SEQ ID NO: 108980 - RNA, 87 nt, Mus musculus
guguuuccccucugacuggcacguaucgggaauggaggcaggagagaggcaggaggggagugagaaagaggccgaaaauuaccaggg

SEQ ID NO: 108981 - RNA, 42 nt, Mus musculus
accuucaccccgggccucucccggggucuguggucaggacag

SEQ ID NO: 108982 - RNA, 42 nt, Mus musculus
cuguccacccuacgagauucaaguuuaaaaacaagucugcaa

SEQ ID NO: 108983 - RNA, 62 nt, Mus musculus
ucgggcacacggcacgcggggacauuuguucuggagugcgagggagaggcguaguggcccgg

SEQ ID NO: 108984 - RNA, 41 nt, Mus musculus
aaucugguucauuucuccuuaaaguaaaagggaagguucuu

SEQ ID NO: 108985 - RNA, 46 nt, Mus musculus
gaauuaauaauuuauaggauuaauugagagugcuuuuugaugccag

SEQ ID NO: 108986 - RNA, 24 nt, Mus musculus
cugucccucaagacaguggcccug

SEQ ID NO: 108987 - RNA, 46 nt, Mus musculus
aaagaugagaggugagaggugagagauagagagagagagagagaga

SEQ ID NO: 108988 - RNA, 76 nt, Mus musculus
cauaccauuuccaacuguuaaguucccuuuuguugaaaugugcccguuuuuuguuuuguuuuguuuuccuauaacu

SEQ ID NO: 108989 - RNA, 48 nt, Mus musculus
gcuaucccaaaagucccccauacccaccccccuagucccuuacccacc

SEQ ID NO: 108990 - RNA, 45 nt, Mus musculus
ugauuuaugcccacagccccagugcuuggaagacugaggcaggaa

SEQ ID NO: 108991 - RNA, 42 nt, Mus musculus
agcacagcggugcaaucacaucauggaggacaagaggcagag

SEQ ID NO: 108992 - RNA, 46 nt, Mus musculus
cuugcagcucauggucuagcaaagacuuacacuaacuuuauagaag

SEQ ID NO: 108993 - RNA, 48 nt, Mus musculus
aggaagagaggagaaugaagcuuggcagaaaaagucaaggccaugaau

SEQ ID NO: 108994 - RNA, 46 nt, Mus musculus
agguguucucucuccccucucccucuccaagugugugugugugugu

SEQ ID NO: 108995 - RNA, 65 nt, Mus musculus
cuggccuagaauucaccaccuuccuaucucccaccucagccccccacuuaacuagcacaaccacc

SEQ ID NO: 108996 - RNA, 46 nt, Mus musculus
cagcuacuaccacugccaugucacucccccccucaaaaggccccac

SEQ ID NO: 108997 - RNA, 45 nt, Mus musculus
ucauaucaaugcaacaacccagcaaggguggcaugauguccccgu

SEQ ID NO: 108998 - RNA, 42 nt, Mus musculus
guaaguuaaaguggcuugcacguucccauggggcaggcagga

SEQ ID NO: 108999 - RNA, 86 nt, Mus musculus
ugugugugugugugugugugugugugguauagcauauguggggugugugugugugguguagugguguaguauauguggggugugug

SEQ ID NO: 109000 - RNA, 46 nt, Mus musculus
ucacaucuccuguuuuagauucauuuaugcuaucucuuguccccau

SEQ ID NO: 109001 - RNA, 42 nt, Mus musculus
gaguaacaaaagguaauguuauauaacaggaguuccugggag

SEQ ID NO: 109002 - RNA, 45 nt, Mus musculus
gugcacgugcguguguguguguguguguguguguguguuugugua

SEQ ID NO: 109003 - RNA, 45 nt, Mus musculus
ugugcgcgugcguguguguguguguguguguguguguguguuugu

SEQ ID NO: 109004 - RNA, 46 nt, Mus musculus
uuaugucaucuugauacguugguaaguuggaaucaucugggaagag

SEQ ID NO: 109005 - RNA, 46 nt, Mus musculus
ugauaagcuugcuugcuguaaaaugucaauucuuuuuuaggcuccg

SEQ ID NO: 109006 - RNA, 42 nt, Mus musculus
gaagaaagaugauauagagauauaaaauguguauggggccug

SEQ ID NO: 109007 - RNA, 41 nt, Mus musculus
cugcuguagaguuggugcugcuccagcagagcuuggcccac

SEQ ID NO: 109008 - RNA, 45 nt, Mus musculus
ccugugugccugugugccugugcuuucuucacucccucaucccca

SEQ ID NO: 109009 - RNA, 46 nt, Mus musculus
cagcuugggagaagcugucaacaucugaagggaaguuagaaugaag

SEQ ID NO: 109010 - RNA, 27 nt, Mus musculus
auuugccacugucaccacauccuucac

SEQ ID NO: 109011 - RNA, 46 nt, Mus musculus
gguccugguuucagggguaucaguacauuauggugaggggcuaugg

SEQ ID NO: 109012 - RNA, 41 nt, Mus musculus
uuaauccccagaacccaggagaagcagcagcugaagaggca

SEQ ID NO: 109013 - RNA, 45 nt, Mus musculus
gcagcagcucuauguaccuguaguccuggggcuaaggacgcagag

SEQ ID NO: 109014 - RNA, 48 nt, Mus musculus
cagucuucaaacauccguggguuucaggcucagagagaaaacauguuu

SEQ ID NO: 109015 - RNA, 46 nt, Mus musculus
uuuuuuugucuuuuacuccuacauaguuaccaagcauguccugaag

SEQ ID NO: 109016 - RNA, 45 nt, Mus musculus
agacauaacagaauuccuagcugcccuccaccccugagucugcag

SEQ ID NO: 109017 - RNA, 45 nt, Mus musculus
uccaugcaugcuuucacucagcuucaacaucuccuuauccgccag

SEQ ID NO: 109018 - RNA, 26 nt, Mus musculus
ggacaaaaauaagggaauagagauag

SEQ ID NO: 109019 - RNA, 45 nt, Mus musculus
gcuccacugagagggugucuggaaacugucaaaaagacugggcug

SEQ ID NO: 109020 - RNA, 45 nt, Mus musculus
acaauuuuauuuuuuccccuggaaacucgguacaaaggccccagu

SEQ ID NO: 109021 - RNA, 45 nt, Mus musculus
uccuuccuuccuuccuucucucccugccuccccuuuagccccagg

SEQ ID NO: 109022 - RNA, 45 nt, Mus musculus
gcacuaaacauguuuagcauugugcuuuuucuccuguugcuagaa

SEQ ID NO: 109023 - RNA, 42 nt, Mus musculus
aacuugggucuuuacagaaacaacacuuagucuuggcugcug

SEQ ID NO: 109024 - RNA, 45 nt, Mus musculus
auugugucugagguuucacacagcucuaaccuucuguauggagag

SEQ ID NO: 109025 - RNA, 41 nt, Mus musculus
ugcaguggcagagcagugucuauauucaacaaagaagggug

SEQ ID NO: 109026 - RNA, 46 nt, Mus musculus
ccagggaacuuugguuuguuuggaaugucuuuaaaucuguggcuaa

SEQ ID NO: 109027 - RNA, 46 nt, Mus musculus
uauucuugaaguuuucaucucuauuuacuaagaaacaaagccccau

SEQ ID NO: 109028 - RNA, 45 nt, Mus musculus
uuugaaauuauguuuacaguagcauucauaaguuaucuugccuuu

SEQ ID NO: 109029 - RNA, 46 nt, Mus musculus
uuugcucaugcuggacgagcacucagucauggagccaucaccccag

SEQ ID NO: 109030 - RNA, 46 nt, Mus musculus
uuauuuaguuuauauguaugaguguguuuguacauaugcgugccug

SEQ ID NO: 109031 - RNA, 43 nt, Mus musculus
agaguuacaaaugauuguauguaaggaaaacgaacccaggucc

SEQ ID NO: 109032 - RNA, 46 nt, Mus musculus
guugguucuugucuuauagcguauuguuuacagacagugacggaag

SEQ ID NO: 109033 - RNA, 50 nt, Mus musculus
ugaguuguuucuguaagccugguuggugcauaugaugaagaccagauggg

SEQ ID NO: 109034 - RNA, 45 nt, Mus musculus
aauuuucauuuaaagggucacucagcuggauacugggagugugaa

SEQ ID NO: 109035 - RNA, 46 nt, Mus musculus
ugcuauuuaucagcucucccacaaacuuuuaugacuaaagcaauag

SEQ ID NO: 109036 - RNA, 46 nt, Mus musculus
cucuucuggagugucugaagacagcuacaguguacuuuacauguaa

SEQ ID NO: 109037 - RNA, 45 nt, Mus musculus
cuugcugugcaucuuuagaaaguaugacccuaauguuccaaauag

SEQ ID NO: 109038 - RNA, 45 nt, Mus musculus
auggugcacagacauacagaaggccaaacacucauccgccugaga

SEQ ID NO: 109039 - RNA, 42 nt, Mus musculus
gaugauuuucuagaagccauaaguagugcuuugagggcccuu

SEQ ID NO: 109040 - RNA, 46 nt, Mus musculus
agggcuacacagagaaacccugucuugaaaaaaaaaagaaagaaag

SEQ ID NO: 109041 - RNA, 44 nt, Mus musculus
uucugagaaguugcaacacacaagucugcucagcucagauacag

SEQ ID NO: 109042 - RNA, 45 nt, Mus musculus
guccaaauaugggauuuuugaaggugaguuugguuuuacugucag

SEQ ID NO: 109043 - RNA, 41 nt, Mus musculus
uucuguauucucagcacauggggguaaaagcagaagcauca

SEQ ID NO: 109044 - RNA, 46 nt, Mus musculus
gaagcagcugaaaaggcuucaguucaaauuaaauuguuagcggcuu

SEQ ID NO: 109045 - RNA, 42 nt, Mus musculus
gcgugugagcaaaacauccauacacauaaaagaaagggccug

SEQ ID NO: 109046 - RNA, 45 nt, Mus musculus
aguuaggugauaauguucuccuucucucugaauuucucucaccag

SEQ ID NO: 109047 - RNA, 46 nt, Mus musculus
auuaguagaaaaugcuggacaugguggugcacaccuuuaaucccag

SEQ ID NO: 109048 - RNA, 46 nt, Mus musculus
agagagacccugucucaaaaaaaaaaagaaagaaagaaaagaaaag

SEQ ID NO: 109049 - RNA, 45 nt, Mus musculus
agauccccuggaccuggagugacugcugugagccaucuaucuuga

SEQ ID NO: 109050 - RNA, 46 nt, Mus musculus
ucuugggcccugccaagaaggugcaaaaaagcauauauuuggggag

SEQ ID NO: 109051 - RNA, 42 nt, Mus musculus
auaaucgagacuucaaacccuuucaacucaaagaaguggcug

SEQ ID NO: 109052 - RNA, 46 nt, Mus musculus
cagcuaucaaaacuuugcaaguacuauggaccuuacgugccaucuc

SEQ ID NO: 109053 - RNA, 45 nt, Mus musculus
uucguacaaaaugugacuuuaaaaauggcacaggggcaggugugu

SEQ ID NO: 109054 - RNA, 41 nt, Mus musculus
aguuuguugagggaaggggauauggaaaagggguagaggua

SEQ ID NO: 109055 - RNA, 95 nt, Mus musculus
cgaaucaaugaguucacucagcuauuuaacccucgugcagaagacaggaacuauuccuauccuguuguguuguauaaaccggagguacagugcag

SEQ ID NO: 109056 - RNA, 46 nt, Mus musculus
gaugcuuaaucuugccaacuuaacuggacuuacaauacccugggag

SEQ ID NO: 109057 - RNA, 45 nt, Mus musculus
ugugugugugugugugugugugugucugugugugucuguguuggg

SEQ ID NO: 109058 - RNA, 42 nt, Mus musculus
auuugcacuagaacaguauugaaggaaagugauuugcuggaa

SEQ ID NO: 109059 - RNA, 46 nt, Mus musculus
ucuauugugauuuagaaagcuuucugugguguuuuagaacaaggag

SEQ ID NO: 109060 - RNA, 67 nt, Mus musculus
gaguuguacgcuucagaggaccuuuauuagcggagaggacggugucggggauuuucuuuggaguaga

SEQ ID NO: 109061 - RNA, 41 nt, Mus musculus
ggggcuggagagauggcucagccguuaaagacuaggcucac

SEQ ID NO: 109062 - RNA, 156 nt, Mus musculus
gaagaaggucguggucaagguuucacggaugggguauaucaagggaagcagcuuuuccagugugaugaggacuguggcguguuuguugcauuggacaaacuagaacuuauagaagaugaugacaauggauuggaaagugauuuugcaggcccagga

SEQ ID NO: 109063 - RNA, 87 nt, Mus musculus
cccuuuggaaauaaacuccagaguuucuuugaagguuggagaaaguacagaaucuggaacaguaauauucugugauguuuuaccagg

SEQ ID NO: 109064 - RNA, 46 nt, Mus musculus
gcaaaguguccaaggauauaaaugugugauuaacuuuuaaggguag

SEQ ID NO: 109065 - RNA, 91 nt, Mus musculus
acugggauggaagguuugauggaguacagcucuguaguuuugcaaguguugaaaguacaauucuccugcacaucaaugacaucaucccagg

SEQ ID NO: 109066 - RNA, 46 nt, Mus musculus
accacugacagagacccucaacuggucaggguacaaagaacaagag

SEQ ID NO: 109067 - RNA, 46 nt, Mus musculus
auacuuauauucuucaguaaaauacauuuuuauuuguuuuggccag

SEQ ID NO: 109068 - RNA, 45 nt, Mus musculus
aagagguguaggugacaaagguucaucuagucauaauaaaccaaa

SEQ ID NO: 109069 - RNA, 41 nt, Mus musculus
cauuggucaggagugcguugaguaagugaauucucagagag

SEQ ID NO: 109070 - RNA, 45 nt, Mus musculus
uagaugaacaacuggugccaggugacugagacagaaaaguuugga

SEQ ID NO: 109071 - RNA, 41 nt, Mus musculus
aaaggaagguuuagagauaaugauuggaaagaagaaaggca

SEQ ID NO: 109072 - RNA, 46 nt, Mus musculus
uuauuaauuuauguuacuaaacaauauguuaaauuauauccugaag

SEQ ID NO: 109073 - RNA, 46 nt, Mus musculus
uaguguuaguuuuaaggauuacuacuaagauuuuaagggaugggag

SEQ ID NO: 109074 - RNA, 46 nt, Mus musculus
acuugcgauguacgagugcagggagugcuaugacgauccggacauc

SEQ ID NO: 109075 - RNA, 23 nt, Mus musculus
cuuguguguguauagaccguggu

SEQ ID NO: 109076 - RNA, 45 nt, Mus musculus
agugucuuguucugucugaugaaaggguuggauauguaguuggau

SEQ ID NO: 109077 - RNA, 45 nt, Mus musculus
ugcagccuggguggguggagaagaggcuguuauagugggagccag

SEQ ID NO: 109078 - RNA, 42 nt, Mus musculus
cuccugugugagaaucugugcguugucuuacuggauggggga

SEQ ID NO: 109079 - RNA, 45 nt, Mus musculus
ccacauaugggugcccauguggaccuguaauguggguuggggaag

SEQ ID NO: 109080 - RNA, 45 nt, Mus musculus
cagcgaguuggcgggaaucacugcagaguucugauuggggccgag

SEQ ID NO: 109081 - RNA, 30 nt, Mus musculus
gcaguguuuuuaaauuuaccccggucucug

SEQ ID NO: 109082 - RNA, 45 nt, Mus musculus
agacuccauggacucaggguaguugucagggacugggguguuggg

SEQ ID NO: 109083 - RNA, 42 nt, Mus musculus
ugggucuugagguucccuuucguggugaaagcccggccgcag

SEQ ID NO: 109084 - RNA, 42 nt, Mus musculus
cuaccaguugcugcagcuuggaugucucugaggccugggccg

SEQ ID NO: 109085 - RNA, 44 nt, Mus musculus
ggccccggagucacuuuugacugagccuuggggacuggcagcag

SEQ ID NO: 109086 - RNA, 42 nt, Mus musculus
aagggcgugaggcuugggagaguuggaggcaaugguaggccg

SEQ ID NO: 109087 - RNA, 46 nt, Mus musculus
ggauguggggguacuucucuuuguggcgcuggaaguggacuuucag

SEQ ID NO: 109088 - RNA, 45 nt, Mus musculus
ugucgucaggucccccaguugagguagagagguugugaucgcuga

SEQ ID NO: 109089 - RNA, 42 nt, Mus musculus
gcuaagugacuagcaagacucaaauugggggucaccgggaag

SEQ ID NO: 109090 - RNA, 42 nt, Mus musculus
aauuuaaaaaacaaaaaccaaaaaacaccucucuuuccccag

SEQ ID NO: 109091 - RNA, 42 nt, Mus musculus
agcacucggccgcgaccccaggaugucgcuccuccaccccaa

SEQ ID NO: 109092 - RNA, 45 nt, Mus musculus
gugguaugugugcauauguucauguguaugugugguaugugugug

SEQ ID NO: 109093 - RNA, 46 nt, Mus musculus
cagguaagaugagaggccagaaacugccucuauauggcccggguga

SEQ ID NO: 109094 - RNA, 46 nt, Mus musculus
cguuccggcucuaaaauuccaucagccucuacuuucagacccagaa

SEQ ID NO: 109095 - RNA, 42 nt, Mus musculus
uaucccagggccuuggucuucucuucuguauaacgaagaggc

SEQ ID NO: 109096 - RNA, 46 nt, Mus musculus
cucuuucguuucccuuccccuuucuaauggcgauccgguacgugag

SEQ ID NO: 109097 - RNA, 46 nt, Mus musculus
acugccccagguucagggcucacguaccggaucgccauuagaaagg

SEQ ID NO: 109098 - RNA, 46 nt, Mus musculus
guacuucucuuuaggaauugcugccucugcuaucugccacccuuag

SEQ ID NO: 109099 - RNA, 44 nt, Mus musculus
ggaucaauucaacuuuaccuaaaauacagcgucuugagccacgu

SEQ ID NO: 109100 - RNA, 46 nt, Mus musculus
ggauacagagcacgucgcccaggcugacugcuagucaguaguagag

SEQ ID NO: 109101 - RNA, 51 nt, Mus musculus
gcauucuauaaggacuuaccagauaaggacuugccagaagcacuaagaccu

SEQ ID NO: 109102 - RNA, 41 nt, Mus musculus
agggcuuucagccugggcuuucucuuccuuucuaaccugga

SEQ ID NO: 109103 - RNA, 45 nt, Mus musculus
gcaaagcacuugccuagcacauggggacccuggguuucauucaca

SEQ ID NO: 109104 - RNA, 45 nt, Mus musculus
caggguuuauuacuccuuggaggccauguaggccaugagguccac

SEQ ID NO: 109105 - RNA, 45 nt, Mus musculus
aaugagcuugacaaaguugucauugagagcaaugccagccccugc

SEQ ID NO: 109106 - RNA, 45 nt, Mus musculus
caccggcgucccacacacccccaaagccccguucuuucccuuuag

SEQ ID NO: 109107 - RNA, 24 nt, Mus musculus
gucucggccagugaccagaucuug

SEQ ID NO: 109108 - RNA, 42 nt, Mus musculus
gucguccgagucgcuaguuuugcaguccgaaaugggucccag

SEQ ID NO: 109109 - RNA, 52 nt, Mus musculus
gacgaggagggcaaugcuuaugggagcgagcgggaggaggaggacgaagagg

SEQ ID NO: 109110 - RNA, 41 nt, Mus musculus
guccguaggugcgccgcgggccaccauguccuucccccagc

SEQ ID NO: 109111 - RNA, 42 nt, Mus musculus
cucgcccggccuagaggagggagugcugcgcagagaggaggg

SEQ ID NO: 109112 - RNA, 45 nt, Mus musculus
uggggugaggggggacgcagcgaggggaggggagaggacaggaca

SEQ ID NO: 109113 - RNA, 45 nt, Mus musculus
cgagagaguaaagagauuuaaaagagaggagucagacuaggaaaa

SEQ ID NO: 109114 - RNA, 41 nt, Mus musculus
ugucuucaacuuuaagccgccuuagcucagggugcggagac

SEQ ID NO: 109115 - RNA, 44 nt, Mus musculus
uguggcugcuaauagcggagagagagaaugagaaagccagagag

SEQ ID NO: 109116 - RNA, 48 nt, Mus musculus
guauauauguaauuaaagaagaggucaugaacuugagaaggaggcggg

SEQ ID NO: 109117 - RNA, 46 nt, Mus musculus
caguccaaagcccuuguucugcuuggagaggcugcuucaugcagau

SEQ ID NO: 109118 - RNA, 46 nt, Mus musculus
uccccaagaguacaagccaaaaaaaggucuguuugggaguuggaag

SEQ ID NO: 109119 - RNA, 45 nt, Mus musculus
ugguuuugccauguuggaaaaaguaguucaaaagaagccgaccgg

SEQ ID NO: 109120 - RNA, 45 nt, Mus musculus
cgauuuggaaguauuaaauuucugaaacggccagcgagaugcggu

SEQ ID NO: 109121 - RNA, 46 nt, Mus musculus
uguguauugggacgugggaccccguuaugagcuccugagccccgag

SEQ ID NO: 109122 - RNA, 45 nt, Mus musculus
gugcagcgauggcgcggcccaacaggcagcacaggacgcagagaa

SEQ ID NO: 109123 - RNA, 45 nt, Mus musculus
agagguugcaacucuccuuggggcagccauagaaaguguucaggu

SEQ ID NO: 109124 - RNA, 46 nt, Mus musculus
auguggcaacccagauguggccaacuacaacuucuucccccgcaag

SEQ ID NO: 109125 - RNA, 42 nt, Mus musculus
ugaaggcuggugguauggauaugaguagguaaaacaaugaag

SEQ ID NO: 109126 - RNA, 46 nt, Mus musculus
agcuuuuccauugacucccagugaugcuuauuccauaaaaccccag

SEQ ID NO: 109127 - RNA, 48 nt, Mus musculus
caaggauggacuccuggcacaugccuuugccccgggcacugguguugg

SEQ ID NO: 109128 - RNA, 47 nt, Mus musculus
aacgcugauggcgaguacugcaaguuccccuuccuguucaacggucg

SEQ ID NO: 109129 - RNA, 46 nt, Mus musculus
cgcagugauggcuuccucuggugcuccaccacauacaacuuugaga

SEQ ID NO: 109130 - RNA, 45 nt, Mus musculus
agugagaaaggaugaguaagagaugagacauagaagcgaugcagu

SEQ ID NO: 109131 - RNA, 43 nt, Mus musculus
gaaggugccccaugugucuuccccuucacuuuccugggcaaca

SEQ ID NO: 109132 - RNA, 42 nt, Mus musculus
uguugcccaggaaagugaaggggaagacacauggggcaccuu

SEQ ID NO: 109133 - RNA, 46 nt, Mus musculus
aucaucguaguugguuguggucgcacaccacaccuugccaucguug

SEQ ID NO: 109134 - RNA, 34 nt, Mus musculus
uccuggauccccuugaugucaucaugggauaauc

SEQ ID NO: 109135 - RNA, 46 nt, Mus musculus
cacugguacuggccccacaccaacacugggaccugucacuccggag

SEQ ID NO: 109136 - RNA, 89 nt, Mus musculus
cggaucugagcgaugccaucaaagacaauguccuguuugcagaucuccggagugacaggucccaguguugguguggggccaguaccagu

SEQ ID NO: 109137 - RNA, 42 nt, Mus musculus
cagugcugcuguugagagucacugaggaaggacacaggggag

SEQ ID NO: 109138 - RNA, 46 nt, Mus musculus
gcgucaaucuuuucugggagcucaggccagaauguggccaccagca

SEQ ID NO: 109139 - RNA, 44 nt, Mus musculus
gccugagcucccagaaaagauugacgcuguguaugaggccccac

SEQ ID NO: 109140 - RNA, 46 nt, Mus musculus
uaagaauaggaagcagucacagucacaccauuucuucagcccccag

SEQ ID NO: 109141 - RNA, 85 nt, Mus musculus
ugcccccugauguccagcaaguagaugcugccuuuaacuggaguaagaacaagaagacauacaucuuugcaggagacaaguucug

SEQ ID NO: 109142 - RNA, 46 nt, Mus musculus
guccagaaaauggugcucauaacaauaucuacauuaaaugagaaau

SEQ ID NO: 109143 - RNA, 42 nt, Mus musculus
cgcagacuccuggaaugccaucccugauaaccuggaugccgu

SEQ ID NO: 109144 - RNA, 63 nt, Mus musculus
gugcaugaauuuguacauguguguaaguaugaguguggaccucaguguguguguaugugugug

SEQ ID NO: 109145 - RNA, 59 nt, Mus musculus
uguguuggugaguauaugaguauacguguggguguguguauauaugugugugccuauuu

SEQ ID NO: 109146 - RNA, 46 nt, Mus musculus
ucacugacagcgaagggucauuccucagccucugcugacugcugac

SEQ ID NO: 109147 - RNA, 51 nt, Mus musculus
aggucauagcuacuucuucaagggugcuuauuaccugaagcuggagaacca

SEQ ID NO: 109148 - RNA, 46 nt, Mus musculus
ucagacuggcugggcugcugagcuggcccuguucccacgggcccua

SEQ ID NO: 109149 - RNA, 45 nt, Mus musculus
aucugaagucaccaggugaaggagaaggcugguuaacuacagagg

SEQ ID NO: 109150 - RNA, 46 nt, Mus musculus
cucugagagugcugaaagccauaaaaaggucauagauguugaagaa

SEQ ID NO: 109151 - RNA, 47 nt, Mus musculus
aaucagagacaccugguuucacccuuucugcugcccagacaccugca

SEQ ID NO: 109152 - RNA, 46 nt, Mus musculus
auacaaaagcaacaguuaagguggugcaggugucugggcagcagaa

SEQ ID NO: 109153 - RNA, 47 nt, Mus musculus
gcccgccuagugaugguuccccuccucacucugugcagaucaugccc

SEQ ID NO: 109154 - RNA, 46 nt, Mus musculus
gcucugugugugccguuuggguugggguuuauaaugcuguucaacu

SEQ ID NO: 109155 - RNA, 46 nt, Mus musculus
agcaauuuguuuuuauuguaaagcaacaauaauaaaaaggaaaauc

SEQ ID NO: 109156 - RNA, 46 nt, Mus musculus
uuagacuguugauaaguaacugagaaaggauaacaggcgccuaggu

SEQ ID NO: 109157 - RNA, 45 nt, Mus musculus
aguucccugcuuuuguuccugugggucucauuaaacggaaacaga

SEQ ID NO: 109158 - RNA, 79 nt, Mus musculus
ggauuauucaacauccucuguuuccguuuaaugagacccacaggaacaaaagcagggaacucaagggcuccagggacaa

SEQ ID NO: 109159 - RNA, 46 nt, Mus musculus
gagcaccagagugacggaagugaagccagcuggggacugggcucag

SEQ ID NO: 109160 - RNA, 46 nt, Mus musculus
agcaggacaugguguagaaagaacugguuugguaccuggaguagaa

SEQ ID NO: 109161 - RNA, 41 nt, Mus musculus
auggccucuucugguguugacuggacuuguugggaguaggg

SEQ ID NO: 109162 - RNA, 45 nt, Mus musculus
cagaccuguugccauaagacccagugcugucugugggagggagag

SEQ ID NO: 109163 - RNA, 41 nt, Mus musculus
auuucaucaucacaggcuagaaagcagugagcagggcagag

SEQ ID NO: 109164 - RNA, 42 nt, Mus musculus
agaagcuucucccuccuccaggucagggcugggccucuccac

SEQ ID NO: 109165 - RNA, 41 nt, Mus musculus
cauggggcuaugguuuauggagcacuggcacuccaagagaa

SEQ ID NO: 109166 - RNA, 42 nt, Mus musculus
cuuagaaggacggauucaaguaccuuuccccacgcagguaaa

SEQ ID NO: 109167 - RNA, 46 nt, Mus musculus
aguacgcacacuuggcaggcccuggacacagaggcugacaucauua

SEQ ID NO: 109168 - RNA, 42 nt, Mus musculus
gcuagaaguagaagcaguuugaaugugaaugaauggacagag

SEQ ID NO: 109169 - RNA, 41 nt, Mus musculus
guguccagcaugaggaaagaagagaaggggacagaggcaga

SEQ ID NO: 109170 - RNA, 45 nt, Mus musculus
agcacucuuaguacauucaggccuggauuuaaucuuuuguuccag

SEQ ID NO: 109171 - RNA, 45 nt, Mus musculus
gaauaaugggaugacuacucuaugagucagcugggaacagucaaa

SEQ ID NO: 109172 - RNA, 45 nt, Mus musculus
gacugccaucagcaauauuaagagacauucugcauguuggacaag

SEQ ID NO: 109173 - RNA, 96 nt, Mus musculus
guucuuggcuagaacaagacaccucuuguccaacaugcagaaugucucuuaauauugcugauggcagucgugccagggaagaccaucaaggagaga

SEQ ID NO: 109174 - RNA, 41 nt, Mus musculus
ccacugaagaauuuuaagugaggugcuggauagagaggagu

SEQ ID NO: 109175 - RNA, 46 nt, Mus musculus
cuccuugugccucccauuuuacacccuccugaccugcucugccuuc

SEQ ID NO: 109176 - RNA, 42 nt, Mus musculus
ccacagggcaguuuccuugcagccugcauggagucccagcag

SEQ ID NO: 109177 - RNA, 45 nt, Mus musculus
uugcuacugauuggaagcuccugggguucuucugacauguuuguu

SEQ ID NO: 109178 - RNA, 88 nt, Mus musculus
uagcuuggucaucuuuaugcaacuucguuaccuguuccaugagguacagcgucgaauccgucgacacaagaauuauuugcgaguggua

SEQ ID NO: 109179 - RNA, 41 nt, Mus musculus
uuuaugugugugugcuauuugugugcagcgcccauggaagc

SEQ ID NO: 109180 - RNA, 41 nt, Mus musculus
cauaguacuaccggaggauccagcaauaccucuccggggca

SEQ ID NO: 109181 - RNA, 46 nt, Mus musculus
guugggacaucuucuggauauaugccccggagagguauugcuggau

SEQ ID NO: 109182 - RNA, 41 nt, Mus musculus
uacaggggaaugccaaggccaagaagugggagugagugggu

SEQ ID NO: 109183 - RNA, 42 nt, Mus musculus
ucacgacccacacucauggcucuuaguaucuuuuggggagag

SEQ ID NO: 109184 - RNA, 44 nt, Mus musculus
ucagcacauaacucagguccuuagaaaucuugggagucaggaag

SEQ ID NO: 109185 - RNA, 112 nt, Mus musculus
aauauagugcauauuaugucuggcaaauuaaaugauaaagaucuauaaaucucagcucauguauuuaggucacgguagaauuuggacuuuucuguguuagugugguacccca

SEQ ID NO: 109186 - RNA, 41 nt, Mus musculus
cucacguauucaaaucugucuuugcagagcugaaccaucag

SEQ ID NO: 109187 - RNA, 45 nt, Mus musculus
caaaucccagcaaccacaugguggcucacaacuaccuguaauaag

SEQ ID NO: 109188 - RNA, 42 nt, Mus musculus
aguuaacucagaaaaaaaaagagagagagaaagagagggaag

SEQ ID NO: 109189 - RNA, 45 nt, Mus musculus
caaaauaguucugguuuuguuuuguuuuguuuuguuuuuuuuugg

SEQ ID NO: 109190 - RNA, 45 nt, Mus musculus
gguagauacuucagcaugcguuuuucaagaguagaguuuccugcu

SEQ ID NO: 109191 - RNA, 42 nt, Mus musculus
ucuauuuuuaaaagcaaauuauaauggagggagagagaagag

SEQ ID NO: 109192 - RNA, 46 nt, Mus musculus
augucccaauuaagcuguuggaguuuaguugaucaucuuugccugg

SEQ ID NO: 109193 - RNA, 71 nt, Mus musculus
acaaccaacucccuccacugcacacacacacacacacacacacacacacacaagugguacccagacauaca

SEQ ID NO: 109194 - RNA, 48 nt, Mus musculus
uguaugucuggguaccacuugugugugugugugugugugugugugugu

SEQ ID NO: 109195 - RNA, 42 nt, Mus musculus
cagccgagagacaccucaugagugcugggagcugaacccccu

SEQ ID NO: 109196 - RNA, 45 nt, Mus musculus
uugccuacccagacccugucucacagaaaagaaagggauggggga

SEQ ID NO: 109197 - RNA, 45 nt, Mus musculus
cuacaaacuuauaacauuaaccccucagucauuuacagccuucuc

SEQ ID NO: 109198 - RNA, 42 nt, Mus musculus
aguacuggcuucguuuguuacaucauuuuaggcugggcagau

SEQ ID NO: 109199 - RNA, 73 nt, Mus musculus
uuguauucuagugagggauuaaggcuagagcuaaguuggaagaaaugcaggcauuauacuguuccauugagag

SEQ ID NO: 109200 - RNA, 45 nt, Mus musculus
ggcaacacuaauugguggaaguacaugcaggcuuuuaaucccagc

SEQ ID NO: 109201 - RNA, 42 nt, Mus musculus
auugucauucuaaccauuuauauucuaaauauuggagaguau

SEQ ID NO: 109202 - RNA, 46 nt, Mus musculus
cuauagcaccgguuucagguguucguguuaauguucugggagagug

SEQ ID NO: 109203 - RNA, 46 nt, Mus musculus
ggacguggugagaccccuaucucaacaaaguuuuaagauuggagag

SEQ ID NO: 109204 - RNA, 25 nt, Mus musculus
cucuaugagcacagcuuacacgugu

SEQ ID NO: 109205 - RNA, 46 nt, Mus musculus
cugguagcugcaccauuguuugagcuguaugacaaugcaccggggu

SEQ ID NO: 109206 - RNA, 42 nt, Mus musculus
ccgggcagugguggcagacaccuuuaaucccagcacucggga

SEQ ID NO: 109207 - RNA, 27 nt, Mus musculus
acuggguuagcuuaugaggguaguuga

SEQ ID NO: 109208 - RNA, 46 nt, Mus musculus
uauuauuggagagcuucuuuucuuuucauaacaguauguuccagau

SEQ ID NO: 109209 - RNA, 46 nt, Mus musculus
cucaacaacaucagagcaaaacccccccacaccccuacccccaaga

SEQ ID NO: 109210 - RNA, 112 nt, Mus musculus
uucauccuucaaagauacauuauggagugaaaaaggcagauguggauacagauugagaagugagacaggaaguagcaaaguauagggagaggggaaccagaagcagcaguca

SEQ ID NO: 109211 - RNA, 45 nt, Mus musculus
cacagaaaaccuuaaccucaucaacuacuugguuacucuggagua

SEQ ID NO: 109212 - RNA, 82 nt, Mus musculus
aagacaguugauuuucauaacguuaguguuaacaggucauucauuguugauaacuuccuagagucaugaagucucuggagau

SEQ ID NO: 109213 - RNA, 46 nt, Mus musculus
acugucacuguccagagcagccucggggaaacugauggcauaagua

SEQ ID NO: 109214 - RNA, 45 nt, Mus musculus
gguaaugguugccguuugaacugaaaacugaucugagcucucaga

SEQ ID NO: 109215 - RNA, 46 nt, Mus musculus
cccaggagaagaugaaguugaaggacuaaaacgcuuaaugacagag

SEQ ID NO: 109216 - RNA, 46 nt, Mus musculus
cuguugcagccagauuucagcgcaugagggaggaauuugauaagau

SEQ ID NO: 109217 - RNA, 47 nt, Mus musculus
gaagucugacaccuuaagucacaguuuggguucucuuacacaaggcu

SEQ ID NO: 109218 - RNA, 45 nt, Mus musculus
ucaaaauauucuuacuggggaaaaaaacuauauucaagggguugc

SEQ ID NO: 109219 - RNA, 46 nt, Mus musculus
uauccugaauaaaaggauuugguguucuuauuaacaagccgcagcc

SEQ ID NO: 109220 - RNA, 39 nt, Mus musculus
uugagacgagagucccucaccauccuugaacuugcagag

SEQ ID NO: 109221 - RNA, 46 nt, Mus musculus
guuuagacugguuauuuguuuaaaaugugcaagacauugcugagag

SEQ ID NO: 109222 - RNA, 46 nt, Mus musculus
ggggggucaaccaguucggcaacaaguacauccagcagaccaagcc

SEQ ID NO: 109223 - RNA, 42 nt, Mus musculus
aaccgcugcccgccccgcggacgucuccccgggcccccgcuu

SEQ ID NO: 109224 - RNA, 85 nt, Mus musculus
ggucugugcaccgugagaagaugaacgggaagcggccggcggauccuggcccagcgcggccaaugaagaagggaaagaagcaggu

SEQ ID NO: 109225 - RNA, 46 nt, Mus musculus
caguuguagagaauauaaaugaaauaaugcuuauaaggcaccacug

SEQ ID NO: 109226 - RNA, 42 nt, Mus musculus
caugaaucccuaaaaucacccagugcgcacacccucaggcag

SEQ ID NO: 109227 - RNA, 46 nt, Mus musculus
uuguuuacagcaguaaaacccuaauuaagauagaaguugguaccag

SEQ ID NO: 109228 - RNA, 49 nt, Mus musculus
aagaauuggaaugcuuuaaaugggacuuaauuagccauccuaguaggaa

SEQ ID NO: 109229 - RNA, 46 nt, Mus musculus
ggucagcaggguuucacacacgcaccuuuacacacucagccaucuc

SEQ ID NO: 109230 - RNA, 46 nt, Mus musculus
gccuggguacccugcuuaucauugcagacccuucccacucucaaca

SEQ ID NO: 109231 - RNA, 46 nt, Mus musculus
gugcccaugucagacugcaaaauggaguggucacauagcagaccag

SEQ ID NO: 109232 - RNA, 47 nt, Mus musculus
cccuuuaugaucaagucugaugauuugaagaaccgaaaagagcccca

SEQ ID NO: 109233 - RNA, 46 nt, Mus musculus
uguguugacauuuuuguguuugguaaaggacguaacaaacccuaag

SEQ ID NO: 109234 - RNA, 46 nt, Mus musculus
agaaguauugcuuauguguuagcuguaaaucguauuucauacuaaa

SEQ ID NO: 109235 - RNA, 46 nt, Mus musculus
accugguguuuccuuauaauugagugauucuccuugagacgugcau

SEQ ID NO: 109236 - RNA, 55 nt, Mus musculus
accaggccuccuaccuacuuugagcccccaaucccucgaaacccucacaucccac

SEQ ID NO: 109237 - RNA, 46 nt, Mus musculus
uaagcaugaaauuuuauaugaguggaucaacccugcuuaccuggaa

SEQ ID NO: 109238 - RNA, 46 nt, Mus musculus
gauaguugaucuaauacugaauguuugaccaucaugaggcaacuug

SEQ ID NO: 109239 - RNA, 46 nt, Mus musculus
cauuuagggagaagggcucaaagcuaauggcccgcuuugauugcuc

SEQ ID NO: 109240 - RNA, 42 nt, Mus musculus
gaggcgcucuuccugcugcucuccaaccucacuggccugaag

SEQ ID NO: 109241 - RNA, 46 nt, Mus musculus
gcuggcagucacagucaagagaacggugaacaggcagacccagaag

SEQ ID NO: 109242 - RNA, 45 nt, Mus musculus
caugcugccacagucucugugaauucauacgugcaucaguccugu

SEQ ID NO: 109243 - RNA, 27 nt, Mus musculus
cccugggucuguaccaagaguuggagu

SEQ ID NO: 109244 - RNA, 46 nt, Mus musculus
gagcccgaauauggcggcuuuaccuccuacauugcuaaaggugaag

SEQ ID NO: 109245 - RNA, 60 nt, Mus musculus
agcuagcauucacuccaccagugccaggaacauggggucuucguggagugagggagagug

SEQ ID NO: 109246 - RNA, 68 nt, Mus musculus
ccaaggucaguguggcuuacacggugagacccuguccccaagcaaaacaacucuuggucauccuuuca

SEQ ID NO: 109247 - RNA, 46 nt, Mus musculus
ugguuugguuugguuucuuuugacaggguuguacuauguagcccag

SEQ ID NO: 109248 - RNA, 46 nt, Mus musculus
ugcaggcaugagccacugcaccaguuccugcaugugcaguccgugg

SEQ ID NO: 109249 - RNA, 102 nt, Mus musculus
caccacaucuauuugcugcuuucuugguuccugacuauccuugcagguuucaguguggacuuuacuuaucgguaggaaaaacgcuggaccuuuaaguaucuu

SEQ ID NO: 109250 - RNA, 117 nt, Mus musculus
auucacacuucucugacguccuaaaaguccauccaaaugcauucugucuuuuacauuggcuuucaauuuguuuuguuuacccagucaguaaaacacacuuuaacauucauauccuag

SEQ ID NO: 109251 - RNA, 46 nt, Mus musculus
uugguauuaaucauaaaacaaaguaauuuuuaaauaaugacaugag

SEQ ID NO: 109252 - RNA, 41 nt, Mus musculus
agaggauuaagaguucaagacuauccucagccacacagcga

SEQ ID NO: 109253 - RNA, 42 nt, Mus musculus
ugugugcuguuaaagcgcuaacucccaugugcagacaacaca

SEQ ID NO: 109254 - RNA, 46 nt, Mus musculus
ucguccauguuggaaggcagaaaagcuuccacuuagucuguccaag

SEQ ID NO: 109255 - RNA, 45 nt, Mus musculus
gguaaccacaacaugaagaauuaacuauaucacaggguugcagca

SEQ ID NO: 109256 - RNA, 46 nt, Mus musculus
uuaaaaagaaaaacccugucucaaaaauaaacaaaagcccccaaag

SEQ ID NO: 109257 - RNA, 46 nt, Mus musculus
uaauggucuaggagggcagagucugggauaaucauccuggggaauu

SEQ ID NO: 109258 - RNA, 45 nt, Mus musculus
augaggaaaauaucuaauuaaaaaaaaaguuuauuagggacuaug

SEQ ID NO: 109259 - RNA, 45 nt, Mus musculus
ggaaggagggaaaggggagugugccuugcauguaguugccugugu

SEQ ID NO: 109260 - RNA, 46 nt, Mus musculus
ccagggguuugaggccaaccugggcuaccugagacccuguccuaaa

SEQ ID NO: 109261 - RNA, 45 nt, Mus musculus
caccccagcauucacaaccuuuccagcucccuccggguaccaauu

SEQ ID NO: 109262 - RNA, 45 nt, Mus musculus
ugguuaugggagagcccaaagacgacuaaguaguucuuaugagga

SEQ ID NO: 109263 - RNA, 42 nt, Mus musculus
uaaguaacaugguugaauuauugagugggaugugccccagag

SEQ ID NO: 109264 - RNA, 46 nt, Mus musculus
cuuucuaauggcacaguuggaguuuaugacaaaacagcccgguacu

SEQ ID NO: 109265 - RNA, 42 nt, Mus musculus
guuggccgagucaggcuguggagucagagagcagcugcagug

SEQ ID NO: 109266 - RNA, 46 nt, Mus musculus
cugagugcuagcauguuccacuacaacugacuuuuacugacuggag

SEQ ID NO: 109267 - RNA, 41 nt, Mus musculus
cccaacugcuccugugccuccgguaagggggacugcugacg

SEQ ID NO: 109268 - RNA, 46 nt, Mus musculus
cgcuggcgccugcaaaugcaaacaaugcaaauguacuuccugcaag

SEQ ID NO: 109269 - RNA, 45 nt, Mus musculus
aucucagagccagcgauccugagagguucuaauccacgugcagcg

SEQ ID NO: 109270 - RNA, 42 nt, Mus musculus
uuuguuuuuaugcauacauauauuuuuggcuagauuccacag

SEQ ID NO: 109271 - RNA, 46 nt, Mus musculus
caaggucgauuccaaaucuuuguuauagucaauaaagcagcaagaa

SEQ ID NO: 109272 - RNA, 42 nt, Mus musculus
ccagaagagaugacaagcgcuagggcgagcagaggggcacag

SEQ ID NO: 109273 - RNA, 106 nt, Mus musculus
auggggaaaugacucauuaaggucaaauuacuguuucccugggaggaugaggagaggguacagggacguggggcagaugugugacagccuugggaguuagguguaa

SEQ ID NO: 109274 - RNA, 46 nt, Mus musculus
aguacaguucuggauccgacaggagagggcaaucggguggcugcag

SEQ ID NO: 109275 - RNA, 23 nt, Mus musculus
ccuaacugccaccucccaacaag

SEQ ID NO: 109276 - RNA, 46 nt, Mus musculus
uggucuuuuggggagcagcguuuugagauagggccucucuagccag

SEQ ID NO: 109277 - RNA, 45 nt, Mus musculus
ucugccucaguuacccuugugcugagagucuagauaugagcccag

SEQ ID NO: 109278 - RNA, 46 nt, Mus musculus
uuuuaugauaauagcuacuugugucucugauucucaagggagggag

SEQ ID NO: 109279 - RNA, 89 nt, Mus musculus
ugucacacccaccuggcuaggaacaugaauuuuauaaggaguagagaaguaaacauauuuccuguagaaauuucugucaggaugacuug

SEQ ID NO: 109280 - RNA, 47 nt, Mus musculus
caugaucucuaaagacuuugguuugacaauaaaacacauuugcuuuu

SEQ ID NO: 109281 - RNA, 45 nt, Mus musculus
gcucuguggauucagcacccuaaauuaaguaacauaaacgucaga

SEQ ID NO: 109282 - RNA, 48 nt, Mus musculus
cguuuauguuacuuaauuuagggugcugaauccacagagcagccggac

SEQ ID NO: 109283 - RNA, 83 nt, Mus musculus
agacacagcauccuggggacuccucaagugaugguuuacggcaaagagaaguucuucggaaccuuucucccuccggaugggag

SEQ ID NO: 109284 - RNA, 46 nt, Mus musculus
gaacaugauuguacuucauuugugucaauuuaaaaauaaggcguau

SEQ ID NO: 109285 - RNA, 58 nt, Mus musculus
aaggccagccugaucucagaucgaguuccaggacagccaggacuuacacagagacagg

SEQ ID NO: 109286 - RNA, 45 nt, Mus musculus
gguuuucugagcugcacuugggcuuucucuguaaauuaggcugga

SEQ ID NO: 109287 - RNA, 41 nt, Mus musculus
gggguguguuuucaugacuucuagaacccugucuuuuguag

SEQ ID NO: 109288 - RNA, 42 nt, Mus musculus
ccuguggucucuacaccugcuccggcuccuauacacaaccag

SEQ ID NO: 109289 - RNA, 45 nt, Mus musculus
uucugauuggcuccgggauugacaaccgcuugagcagcugcauuc

SEQ ID NO: 109290 - RNA, 44 nt, Mus musculus
ggaggacagagccccagaaagcugggccuagaaggauaggucuc

SEQ ID NO: 109291 - RNA, 46 nt, Mus musculus
gaggaccaccaucauccgggaaguucugaacuggccucugucugaa

SEQ ID NO: 109292 - RNA, 24 nt, Mus musculus
ucgcggucuggggggaggcgguug

SEQ ID NO: 109293 - RNA, 45 nt, Mus musculus
uauguaacccagacuggccuugaacucuucauccucuugcccugg

SEQ ID NO: 109294 - RNA, 42 nt, Mus musculus
aagcuugaggaucugagguuagcccccaggagccacguggag

SEQ ID NO: 109295 - RNA, 46 nt, Mus musculus
aaagagccucacccaucuggcauuuggucugggacacugccaccau

SEQ ID NO: 109296 - RNA, 42 nt, Mus musculus
gaacuacacaucugucaaaaugggacuugacucugcccccag

SEQ ID NO: 109297 - RNA, 43 nt, Mus musculus
agggaaccugcagacugaagaagcugcaguaagugagggggag

SEQ ID NO: 109298 - RNA, 44 nt, Mus musculus
uggaaggaggaggagaagggagguucuugugugcaagggacuaa

SEQ ID NO: 109299 - RNA, 23 nt, Mus musculus
uacaaacgauuucucuggguaau

SEQ ID NO: 109300 - RNA, 44 nt, Mus musculus
guuuuucaucuuugcuuuucuccccaagcuugagucacaaccag

SEQ ID NO: 109301 - RNA, 44 nt, Mus musculus; identical to SEQ ID NO: 109300

SEQ ID NO: 109302 - RNA, 45 nt, Mus musculus
guggcaagaauugucaucuccuauguccucugggucuuuguguuc

SEQ ID NO: 109303 - RNA, 23 nt, Mus musculus
gggaacaggauuggcccagcugg

SEQ ID NO: 109304 - RNA, 42 nt, Mus musculus
cuacugcugucccacucucucugccaacccucacuucuggag

SEQ ID NO: 109305 - RNA, 46 nt, Mus musculus
uuauuauuauacauaaguacacuauagcugacuucagacacaccag

SEQ ID NO: 109306 - RNA, 45 nt, Mus musculus
gacauaaugucuucuccuuuaggccaugaucucagagcccuguag

SEQ ID NO: 109307 - RNA, 46 nt, Mus musculus
cucagaagaaccucuguuggugcccagcauccuacgaaugccccag

SEQ ID NO: 109308 - RNA, 46 nt, Mus musculus
aguucaaggucaaucuagguaauuuaguaagauccugucucaaaag

SEQ ID NO: 109309 - RNA, 45 nt, Mus musculus
ccugugguaauaucaggagcuagggugccucgaggaagguguugg

SEQ ID NO: 109310 - RNA, 45 nt, Mus musculus
gucugaacuggauucggagucacugcucccagaguaggcgcccaa

SEQ ID NO: 109311 - RNA, 42 nt, Mus musculus
uagaaaauuaugaauagugaaauguucuuggaaugcaggcag

SEQ ID NO: 109312 - RNA, 97 nt, Mus musculus
uugccugggagaacuuguucuugguuucuauggguuucacggccagcuucuucucuacuucuuuauuuucugcagaaauuccaaccuuguugagauu

SEQ ID NO: 109313 - RNA, 45 nt, Mus musculus
uguauguauguauguguguguacauguguguguguacaugugugu

SEQ ID NO: 109314 - RNA, 46 nt, Mus musculus
cugcugcuuccugucuuucuguuccugcagccguucguacagagac

SEQ ID NO: 109315 - RNA, 46 nt, Mus musculus
ggcgcuuuagcagucaagucccgucuaugaaggagggagguggcag

SEQ ID NO: 109316 - RNA, 45 nt, Mus musculus
aaugugagccaugcaggcacuggggaaaugggagucacgcuggac

SEQ ID NO: 109317 - RNA, 46 nt, Mus musculus
uccucccccuacuccuaguaaauaacucacgacaggacaggcccuc

SEQ ID NO: 109318 - RNA, 45 nt, Mus musculus
guggcucacaaccauccguaaagaaaucugacucccucuucugga

SEQ ID NO: 109319 - RNA, 52 nt, Mus musculus
uucaacgaccgguuguguucuaauaaaauaagcacacagccuuguuuccuac

SEQ ID NO: 109320 - RNA, 84 nt, Mus musculus
uugacugaugauuggcugucugagagagagggcuugccacugaggaaggggcguuuccuaggggacugagggagggcccgggcg

SEQ ID NO: 109321 - RNA, 46 nt, Mus musculus
gacugaaggagguccuggggucacccucccgaggagacuggcuaag

SEQ ID NO: 109322 - RNA, 47 nt, Mus musculus
gugggaagccgacuuccccugggauggucugguguugccuuggggug

SEQ ID NO: 109323 - RNA, 46 nt, Mus musculus
aaaaaacccuuggggagggcaguccuuuccguuggaaagcccuaga

SEQ ID NO: 109324 - RNA, 45 nt, Mus musculus
aauggcuacagguagugaagacuaggcagcaucccucaccacuug

SEQ ID NO: 109325 - RNA, 45 nt, Mus musculus
aaggauauuuaaccaaauaaugaaauaaucucucucuuccuuuga

SEQ ID NO: 109326 - RNA, 37 nt, Mus musculus
uuuuccugguauuuaaauuuaaaaauugaaagcagaa

SEQ ID NO: 109327 - RNA, 44 nt, Mus musculus
uuaguuuuaaggcuuaauaaaauaauguauuuguugccccagac

SEQ ID NO: 109328 - RNA, 46 nt, Mus musculus
ggagaugacucagugggcaaacauauuugcucauagacgccugaag

SEQ ID NO: 109329 - RNA, 46 nt, Mus musculus
cacauacauauaacauaugucuguaaucacauaucaacacucacag

SEQ ID NO: 109330 - RNA, 46 nt, Mus musculus
ggaacuccucuguagaccaggcuggcccggccucuaacucacagag

SEQ ID NO: 109331 - RNA, 46 nt, Mus musculus
auccauugcuauguguuccugaugugauaugacuaauuuccucaag

SEQ ID NO: 109332 - RNA, 45 nt, Mus musculus
gcagccucucgccacagagaucuccauuccaaauauuugcccaca

SEQ ID NO: 109333 - RNA, 46 nt, Mus musculus
augaauagaaugcaaguucaguuccacauuaugaaaacaguacucg

SEQ ID NO: 109334 - RNA, 46 nt, Mus musculus
acuacaggugccacugcuacuauggguaauuccugcaucugccgag

SEQ ID NO: 109335 - RNA, 46 nt, Mus musculus
ccaaauaaaccuuauugaaacccuguaaauagcuaaggcccgcagc

SEQ ID NO: 109336 - RNA, 46 nt, Mus musculus
gaucaggaaccuccuuauucaaugauuacauuacaugaaauggcag

SEQ ID NO: 109337 - RNA, 46 nt, Mus musculus
cccuuuuucaaaacaaacaaaaaaggaaugaacagaaauggacuaa

SEQ ID NO: 109338 - RNA, 45 nt, Mus musculus
cagguuuugcuggguuuuuauuuaacaccgccuauguuuagagac

SEQ ID NO: 109339 - RNA, 41 nt, Mus musculus
ugguacuaugaaguaacaguggucacuucuggugucaugca

SEQ ID NO: 109340 - RNA, 45 nt, Mus musculus
ugacucacuuuucuuauuugacuuuuaccuuguaacuaaugggca

SEQ ID NO: 109341 - RNA, 44 nt, Mus musculus
gauuugguacaaugccagaaguaagccucaugugcacccgugcu

SEQ ID NO: 109342 - RNA, 46 nt, Mus musculus
cacacauagagagagagaaagagaggagagagagagagagagagag

SEQ ID NO: 109343 - RNA, 30 nt, Mus musculus
gcuccauuugaucugaccucaaugcccgag

SEQ ID NO: 109344 - RNA, 46 nt, Mus musculus
cuugguuuuauaagcucuacugaccucugcucauuuuuaucuguag

SEQ ID NO: 109345 - RNA, 46 nt, Mus musculus
cuaguuucaugucauaccaacaaugcgaguucaauuuuggagcaag

SEQ ID NO: 109346 - RNA, 46 nt, Mus musculus
auguggcuacuucauuccuucuuagacuggagaacaaaauacccau

SEQ ID NO: 109347 - RNA, 41 nt, Mus musculus
uaaccaguuguacgcacauugaaacuuauagccauggccag

SEQ ID NO: 109348 - RNA, 88 nt, Mus musculus
auauugcacugcaagacuugaaucuauaaacguagcgucgcuuagaucacacaggucauuacuacaaacagcacgaagauccugaaag

SEQ ID NO: 109349 - RNA, 45 nt, Mus musculus
ucagguuuuuuuguuuuguuuuguuuuuaaaaauuuuuuaaucag

SEQ ID NO: 109350 - RNA, 42 nt, Mus musculus
gccucuggguuuuugcugacggccacgauugaggccagagga

SEQ ID NO: 109351 - RNA, 46 nt, Mus musculus
aacauccaaccacagcaucaaauucugcaucagaggcggaggagcu

SEQ ID NO: 109352 - RNA, 45 nt, Mus musculus
gugguugugaaggccgccauguugaagccugggauacgcuccagc

SEQ ID NO: 109353 - RNA, 46 nt, Mus musculus
uagagacaacuaccugcccugccuccucugucuuuugucccccuca

SEQ ID NO: 109354 - RNA, 46 nt, Mus musculus
uaugacuaacuaggaaugggcauagugccaugcuuuuaauccaggu

SEQ ID NO: 109355 - RNA, 42 nt, Mus musculus
gacacacuacacuaccauguugcuggaggacagcccccaggu

SEQ ID NO: 109356 - RNA, 32 nt, Mus musculus
gugugcuugugcaugcuugugugcaguccuuc

SEQ ID NO: 109357 - RNA, 46 nt, Mus musculus
ugguggacugccaccaaacagaaagcauguguaucacaucucuaga

SEQ ID NO: 109358 - RNA, 42 nt, Mus musculus
aguacuuuuguaaaaugaguaaaauuugagguguuuggcaag

SEQ ID NO: 109359 - RNA, 42 nt, Mus musculus
gggagaguuccacaugagggaggggaccuagcgagcuugcug

SEQ ID NO: 109360 - RNA, 46 nt, Mus musculus
ucacuaguccaucuuaccugacccuuuauauuaaacauguccccag

SEQ ID NO: 109361 - RNA, 46 nt, Mus musculus
cuaucugcccuaugucucccucuauccccuguacagagcgcaccac

SEQ ID NO: 109362 - RNA, 45 nt, Mus musculus
aaguaauccaggcagcacucucggccuacauugguggcucgagcu

SEQ ID NO: 109363 - RNA, 45 nt, Mus musculus
uuauauaggaagucuaugucucaaaauaauacgggcuggccuuuu

SEQ ID NO: 109364 - RNA, 44 nt, Mus musculus
ggaaagggaagaaaagaaaggccauguaaacacuuugaaggcag

SEQ ID NO: 109365 - RNA, 41 nt, Mus musculus
ucucucucugugugugugugugugugugugugugggugugg

SEQ ID NO: 109366 - RNA, 46 nt, Mus musculus
gugcgugcacgagagagagagagagagagagagagagagagagaag

SEQ ID NO: 109367 - RNA, 42 nt, Mus musculus
agccugggcuacauauugagagccuaucaagagaagggcugg

SEQ ID NO: 109368 - RNA, 42 nt, Mus musculus
agggaaggcagacuggaaggcgagcuuggcugaacacuugag

SEQ ID NO: 109369 - RNA, 23 nt, Mus musculus
agcauguuugggagcgauggcag

SEQ ID NO: 109370 - RNA, 46 nt, Mus musculus
ggaagacagaccaguuccugagggaugcaguggaaaccagacugag

SEQ ID NO: 109371 - RNA, 71 nt, Mus musculus
ucgagcacccaugggaccaggaaggcauagugcacuuggcagagcuagauucuugcuagggaguagccaua

SEQ ID NO: 109372 - RNA, 44 nt, Mus musculus
gcuuuccucuacugaaggaccucugccagccucauagccaagga

SEQ ID NO: 109373 - RNA, 46 nt, Mus musculus
agcucucuucacacacuccagaagagggagucagaucuuguuacgg

SEQ ID NO: 109374 - RNA, 44 nt, Mus musculus
aguuuugauaaccaaccaaguucaggguaguagugguguccaga

SEQ ID NO: 109375 - RNA, 45 nt, Mus musculus
ccuagcuguucucuugcuuccuguuguccuuaacugacuguccca

SEQ ID NO: 109376 - RNA, 46 nt, Mus musculus
gucuguauucucagcacucaggagacugcuacagcaggauugagag

SEQ ID NO: 109377 - RNA, 44 nt, Mus musculus
ucgagaacacggaccuggcguaaggcggcgaggggagaggcggg

SEQ ID NO: 109378 - RNA, 24 nt, Mus musculus
ggugggggcugagaacacugcggu

SEQ ID NO: 109379 - RNA, 46 nt, Mus musculus
cuguuaaacagcggagggcugcagccuccucauccgggcgguguag

SEQ ID NO: 109380 - RNA, 42 nt, Mus musculus
gaacuuucucuuuauuaaagagagaaagagaaaaagagagag

SEQ ID NO: 109381 - RNA, 45 nt, Mus musculus
ggagaaucugaccaguuuuaucguuuguuuguuuguuuguuuuga

SEQ ID NO: 109382 - RNA, 46 nt, Mus musculus
cucugcucccugagcgccgggcagaguggagacagugcugcugcag

SEQ ID NO: 109383 - RNA, 46 nt, Mus musculus
uugacgccaacuccucgguccuucaugaugaauucaucgcgcacag

SEQ ID NO: 109384 - RNA, 24 nt, Mus musculus
gugucuugcagguuuaaucccccu

SEQ ID NO: 109385 - RNA, 48 nt, Mus musculus
uucuguggaguucacucucgaugugaggugcaaugaagaccagacgcg

SEQ ID NO: 109386 - RNA, 45 nt, Mus musculus
gcuaaagaagaagcugagugauuuacagacucaguuaagccauga

SEQ ID NO: 109387 - RNA, 45 nt, Mus musculus
acuguagugguuuucaggcagcauggggggaaacacacaccagca

SEQ ID NO: 109388 - RNA, 41 nt, Mus musculus
cugcagcuugcacuccccauacacguccagguuggggcagg

SEQ ID NO: 109389 - RNA, 45 nt, Mus musculus
uugauguucaucucuaucgggcuguucuaugaugcucuguguaau

SEQ ID NO: 109390 - RNA, 42 nt, Mus musculus
guguacuuacauauaauaaauaaauaaaucuuugggccggag

SEQ ID NO: 109391 - RNA, 42 nt, Mus musculus
ccuuuuugggaagauucguaguacccgauuuggcaccgagga

SEQ ID NO: 109392 - RNA, 63 nt, Mus musculus
ugaaauuuauacagggcccagacacggaccuggaccugagucaggauuauuggaugcccagcu

SEQ ID NO: 109393 - RNA, 41 nt, Mus musculus
agggccagaacccucaggagagccggaggggaagaacaaga

SEQ ID NO: 109394 - RNA, 45 nt, Mus musculus
gggcauuuggguggguucuggguugauugcugcaugcuggguaga

SEQ ID NO: 109395 - RNA, 46 nt, Mus musculus
gcguggagcagcacgagacggaggucaagaagcugcggcugcgggu

SEQ ID NO: 109396 - RNA, 37 nt, Mus musculus
aguuaacuggugguaaacugaccuuccagaggguaga

SEQ ID NO: 109397 - RNA, 46 nt, Mus musculus
gcagagagcggcuggagacagagaagcugggccuggaacgggagaa

SEQ ID NO: 109398 - RNA, 41 nt, Mus musculus
cucuagcauggaucgcaagauggcugagcugaggggugagg

SEQ ID NO: 109399 - RNA, 43 nt, Mus musculus
agcauccuaaaggagacgcaccaggaugaguugggccgcaugu

SEQ ID NO: 109400 - RNA, 46 nt, Mus musculus
acagacaagcucucugcccucugggugugcagucuugugggcagug

SEQ ID NO: 109401 - RNA, 46 nt, Mus musculus
caaugguagagugcuugccuaucauggaucaaguccugguuccaug

SEQ ID NO: 109402 - RNA, 45 nt, Mus musculus
uauauguguauguguauaccgugugugugucuggcgcccaugggu

SEQ ID NO: 109403 - RNA, 45 nt, Mus musculus
auguaugguacuguaaguaaugagggugguugauuugggcucagu

SEQ ID NO: 109404 - RNA, 42 nt, Mus musculus
ugugugugugcguguguguauguguguguguucagaguucuc

SEQ ID NO: 109405 - RNA, 45 nt, Mus musculus
uugcagguccaucuugcaggguguguaggaguuuacagauguaga

SEQ ID NO: 109406 - RNA, 48 nt, Mus musculus
uuugcccauuuuaguuagaacucucguaauaucccaccgacucauaga

SEQ ID NO: 109407 - RNA, 45 nt, Mus musculus
cccugaccugucgggaagggcuguuuuguggagaggagaaggcug

SEQ ID NO: 109408 - RNA, 41 nt, Mus musculus
guguguguguguguguguguguguguaauguucuugugcca

SEQ ID NO: 109409 - RNA, 45 nt, Mus musculus
ggccuagggacacacagcagaugacacagagcagaucuccaucau

SEQ ID NO: 109410 - RNA, 42 nt, Mus musculus
agggcuggaugaugaugaugaugauguggaagaccuggugag

SEQ ID NO: 109411 - RNA, 42 nt, Mus musculus
gcagucugacagacaucccugcagacaugugcauucugggag

SEQ ID NO: 109412 - RNA, 46 nt, Mus musculus
caucauggacagaugauagauccugagaaucagcccucagcugcag

SEQ ID NO: 109413 - RNA, 45 nt, Mus musculus
gaguuugagacccguugucccagugggaagaaagugauacaguac

SEQ ID NO: 109414 - RNA, 42 nt, Mus musculus
acaaagguucuagagauaaaggagugguaccagaaccgggag

SEQ ID NO: 109415 - RNA, 46 nt, Mus musculus
gaggcaacguaggagcagaguggccacuguauggcucuauggcuag

SEQ ID NO: 109416 - RNA, 42 nt, Mus musculus
ccccgugccucagugcacucauacaagucuaugcuaccugag

SEQ ID NO: 109417 - RNA, 46 nt, Mus musculus
cagagcgguucucccgcaauccagagaagcccgcggaugaggacgu

SEQ ID NO: 109418 - RNA, 70 nt, Mus musculus
gguggugguggggugggcagguacaguuggaugugcagugaggauuagaaguggaguguggguggauggu

SEQ ID NO: 109419 - RNA, 46 nt, Mus musculus
uauugagaacccagaaggacaucaaauccuaggagguagccugcag

SEQ ID NO: 109420 - RNA, 46 nt, Mus musculus
cugauaaccucaggugggagagggauguugcccaaggccacaagga

SEQ ID NO: 109421 - RNA, 45 nt, Mus musculus
aaaaugaccucagguuauguuuauaagguacauauggcacacagg

SEQ ID NO: 109422 - RNA, 48 nt, Mus musculus
acgcuagcaucccugauccccagaucccagauguuucaaauguucaaa

SEQ ID NO: 109423 - RNA, 60 nt, Mus musculus
agucucuaguggagugugcaugugucagcccaccucggcccaggucuucccucuggccaa

SEQ ID NO: 109424 - RNA, 46 nt, Mus musculus
cuuugccauugcacggucuuugcauacuugucaaaaaucgucaggu

SEQ ID NO: 109425 - RNA, 42 nt, Mus musculus
uuuucuguauauuacucuaugguauauggguaagggccagac

SEQ ID NO: 109426 - RNA, 47 nt, Mus musculus
gcagccagugcuuuuagcuucuacaucucgucuccagccccuauacc

SEQ ID NO: 109427 - RNA, 45 nt, Mus musculus
cagaagagggcaucagaucccucggaacuggaguuacacacagau

SEQ ID NO: 109428 - RNA, 45 nt, Mus musculus
ccuggguguccuggaacucacuuuguagaccagacuggccucgaa

SEQ ID NO: 109429 - RNA, 45 nt, Mus musculus
uauuuuuuaaugucuuguuuuuacuuuuauuuucuauguguaugc

SEQ ID NO: 109430 - RNA, 45 nt, Mus musculus
ggaacucacuaacuggugcuggcuauuuuguuguucccaugagcu

SEQ ID NO: 109431 - RNA, 46 nt, Mus musculus
uuucauguaugugaggacacugucgcugucuucagacacaccagaa

SEQ ID NO: 109432 - RNA, 46 nt, Mus musculus
guuuccugcugccugcccuggcccgugagagacgcacgcaacaaac

SEQ ID NO: 109433 - RNA, 49 nt, Mus musculus
acucuggaugugagucuuaguuuaaaaaggaaacuacauggagaccaug

SEQ ID NO: 109434 - RNA, 46 nt, Mus musculus
cagcagaguucaaacucuaucuaccaguucagaacaaggccaaagu

SEQ ID NO: 109435 - RNA, 50 nt, Mus musculus
uccaugcaaacugccguauccgaaggguuuacuucucagacagacucuac

SEQ ID NO: 109436 - RNA, 46 nt, Mus musculus
cucaaacguaagguaaauucuacaagcaaccucccacccccagcaa

SEQ ID NO: 109437 - RNA, 51 nt, Mus musculus
auuucacccggcgggcauauggcacgaacuacaucgagacccugagagugc

SEQ ID NO: 109438 - RNA, 53 nt, Mus musculus
caaaaacguucgucgaagguuucgagcaaguaacuaccagaguaccacucgag

SEQ ID NO: 109439 - RNA, 46 nt, Mus musculus
aauagcacccaaaaaaucuaaucaauagcuacaaaaguccgaagau

SEQ ID NO: 109440 - RNA, 42 nt, Mus musculus
aucaaaaacuugaagaaauauuuuaccuuugaaguccaggug

SEQ ID NO: 109441 - RNA, 61 nt, Mus musculus
cacguguccugcggaccccaagaagacacuggggaucaaacugccuuuccuugucaugauc

SEQ ID NO: 109442 - RNA, 45 nt, Mus musculus
ucacucaggcccaaauauacuguagcugucuucagacacaccaga

SEQ ID NO: 109443 - RNA, 48 nt, Mus musculus
caaacuguacagcaaccgagcugccugcuacaccaagcuccuggaguu

SEQ ID NO: 109444 - RNA, 42 nt, Mus musculus
agcguagaaaucaguuagcuguguauuacuauucggccagag

SEQ ID NO: 109445 - RNA, 47 nt, Mus musculus
aucaaaagaaucacugacaaugacauccagucccuggugcuagagau

SEQ ID NO: 109446 - RNA, 45 nt, Mus musculus
guaugaacuuugcuguugacagaguagagaguaaauguuagauga

SEQ ID NO: 109447 - RNA, 45 nt, Mus musculus
auuugugaagaagaagcaagaaauaagauaucccgauggcgaaga

SEQ ID NO: 109448 - RNA, 43 nt, Mus musculus
cugugugugugugugugucucucucugugugugugugucugug

SEQ ID NO: 109449 - RNA, 45 nt, Mus musculus
ggaaagaacugaacuuauacaagcaaaguauauaaaaaagaaagu

SEQ ID NO: 109450 - RNA, 45 nt, Mus musculus
uaaauuaugcugucuagagaauauaaaucaagaaaguaaaucaga

SEQ ID NO: 109451 - RNA, 46 nt, Mus musculus
aguauugucaggcuccucagugccuucucccuauaugcaaaucuua

SEQ ID NO: 109452 - RNA, 50 nt, Mus musculus
ugucuugacaacccaagaacugcuccccauuggcagagaugagaggccca

SEQ ID NO: 109453 - RNA, 46 nt, Mus musculus
cuguccuugaguguucacgucccggaucaucaucugcaccccacuc

SEQ ID NO: 109454 - RNA, 45 nt, Mus musculus
gcuggugagcauauaucaugaaagaauuagucauaagcuaauuag

SEQ ID NO: 109455 - RNA, 42 nt, Mus musculus
gguugccuuuuugcuuaccaagugagugcaggugccugcaga

SEQ ID NO: 109456 - RNA, 45 nt, Mus musculus
gugugugugugugugugccugugugccugugugugugcgugugca

SEQ ID NO: 109457 - RNA, 45 nt, Mus musculus
aagaccaggaaucaaugagcagagaaaucugacacuaaucuugca

SEQ ID NO: 109458 - RNA, 52 nt, Mus musculus
guggcagaacaacuuaagguaaggaaguuauuuggcucuuggaggagauagu

SEQ ID NO: 109459 - RNA, 58 nt, Mus musculus
ucaucucuaauugccaguaacuuggguucaaaagcccccacauacuuaauguguagga

SEQ ID NO: 109460 - RNA, 46 nt, Mus musculus
aguguucuuuauuaguugcccagcaaccaugaaaagccugggagaa

SEQ ID NO: 109461 - RNA, 45 nt, Mus musculus
cuuaauguaaauugggacaugugucauuaagaggacaugccagau

SEQ ID NO: 109462 - RNA, 42 nt, Mus musculus
aagucugucuggccuccaggaauggaauugagugccuuugga

SEQ ID NO: 109463 - RNA, 46 nt, Mus musculus
acccuucuccugggaacuaaggcaaagcuguaauaaggucagaguc

SEQ ID NO: 109464 - RNA, 41 nt, Mus musculus
ggagaaguuuucuccaacugaggcaagagggggcaagagaa

SEQ ID NO: 109465 - RNA, 46 nt, Mus musculus
cccuggcuuuucucugugauguguuuuauucuuucaagcccgaguu

SEQ ID NO: 109466 - RNA, 48 nt, Mus musculus
uguaaagcagucagaacagggcuggagaacaugcuguuuugagauggg

SEQ ID NO: 109467 - RNA, 44 nt, Mus musculus
agccuugguaucuugccuguucugcacagccagagggcacagag

SEQ ID NO: 109468 - RNA, 75 nt, Mus musculus
gcccucggcuggggaagauggagagaggugauaugccuagugugguguucauagagauguauauagaaugggugg

SEQ ID NO: 109469 - RNA, 47 nt, Mus musculus
uuuuguuuuguuuuugaauauaaaguggucacucuaauguggaagcc

SEQ ID NO: 109470 - RNA, 46 nt, Mus musculus
gaaaccugcaaaaaggugauuguuaggggcuucucgagagccagua

SEQ ID NO: 109471 - RNA, 43 nt, Mus musculus
cuguugcugcacuccauacggagggccuuuuccccggacaucc

SEQ ID NO: 109472 - RNA, 63 nt, Mus musculus
gucccggucaguagaaugggggcagagugcccacagccuagcuugaaacgcauagcacuuuga

SEQ ID NO: 109473 - RNA, 27 nt, Mus musculus
aaccaaaucaaaacgucuuaacgcgug

SEQ ID NO: 109474 - RNA, 41 nt, Mus musculus
cuccaggagcuaaugugucagcagagcuacuugggggacag

SEQ ID NO: 109475 - RNA, 45 nt, Mus musculus
ggagugcgaccgcaagguugccuggacuaaaagccaugcugagaa

SEQ ID NO: 109476 - RNA, 86 nt, Mus musculus
uuaaagaguguguaugaguaguggugaggcuaggaaauuuacccauccaguauccuuuuuauauucuuuuuaaacucaucucauaa

SEQ ID NO: 109477 - RNA, 45 nt, Mus musculus
ccuuucccaaacugcaguguuaguggaccuuuccugccugucuca

SEQ ID NO: 109478 - RNA, 45 nt, Mus musculus
auagauguuugcugccaagacugauggccugaguucagccccaga

SEQ ID NO: 109479 - RNA, 46 nt, Mus musculus
ucuuuggugucagaagauggcacuguaacucucgagaugccaagaa

SEQ ID NO: 109480 - RNA, 46 nt, Mus musculus
aaguuuuagcaaaagucagcagucuauucugacacaccagccucau

SEQ ID NO: 109481 - RNA, 45 nt, Mus musculus
agugugauaaaaagaaauucuaaucauuccuucuaaaggcaaaga

SEQ ID NO: 109482 - RNA, 40 nt, Mus musculus
agaugguuguaagccauguuuuucuugcugggaauugagc

SEQ ID NO: 109483 - RNA, 46 nt, Mus musculus
ccaucaacagagauugaccgccaaagaggccauggagcacccauau

SEQ ID NO: 109484 - RNA, 45 nt, Mus musculus
auuuguuugacauggucuugcugcauagcccuuucuggccucaac

SEQ ID NO: 109485 - RNA, 49 nt, Mus musculus
agaaguaccacauagaccuagauccacacuucaaugauauccugggaca

SEQ ID NO: 109486 - RNA, 46 nt, Mus musculus
gcucaguguucucuaagacucaugggaagcucugugcuuggugguu

SEQ ID NO: 109487 - RNA, 50 nt, Mus musculus
auaagguaucucuuuguugcaguaaaucuccagccccaauauguccgagc

SEQ ID NO: 109488 - RNA, 42 nt, Mus musculus
aaggagccauucuuccacgggcaggacaacuaugaccaggug

SEQ ID NO: 109489 - RNA, 45 nt, Mus musculus
acaagguugaguucugaugaucuggagagaguaaaagaccagggu

SEQ ID NO: 109490 - RNA, 45 nt, Mus musculus
cugucacagccaguguuagcuuaauaaccaguuagagcagugugc

SEQ ID NO: 109491 - RNA, 46 nt, Mus musculus
ugcuucuuagccuagaaaacucacgcuuaugucugccuuguuagaa

SEQ ID NO: 109492 - RNA, 42 nt, Mus musculus
auuuaaagauuuaaauaaauauuucuucaaaggcagcauaua

SEQ ID NO: 109493 - RNA, 46 nt, Mus musculus
ucuugcuacaucuauuguaaagcaaaacaaaaaaauggaaauagaa

SEQ ID NO: 109494 - RNA, 46 nt, Mus musculus
ggugugugcccucacggucccuaguuucauaagacaacugcagaga

SEQ ID NO: 109495 - RNA, 46 nt, Mus musculus
aaacugucuuuuaacaucccuuuuuuguaugagaacaucugcaucu

SEQ ID NO: 109496 - RNA, 45 nt, Mus musculus
gcccccuuggguuuggucauuaggaagcugaaagucccuggcaga

SEQ ID NO: 109497 - RNA, 44 nt, Mus musculus
uaaacuucuucgaccaagaacuccuggggaaaaaaggaggucac

SEQ ID NO: 109498 - RNA, 62 nt, Mus musculus
gagaagggagacuccugauucucucuagaaagcucauaggaugguuuggaagagaaacacug

SEQ ID NO: 109499 - RNA, 53 nt, Mus musculus
ugcgcauugcauaucagauuuacauuacaacagcagcauaaguaguuagggag

SEQ ID NO: 109500 - RNA, 84 nt, Mus musculus
augugcauagccaggcacucaggcaacaugaacauggcucuagcaggagacaaguuuauguucacaacagugaggguuuacuuc

SEQ ID NO: 109501 - RNA, 59 nt, Mus musculus
aaaauggguguagguuacagcugugcaauggagccaugacauauuauauuuggaaaagu

SEQ ID NO: 109502 - RNA, 55 nt, Mus musculus
uagccuuggaagauaggaucuguuuuguuccacuaacuggcaagcauuauaaaag

SEQ ID NO: 109503 - RNA, 73 nt, Mus musculus
uuaugcaaaugugcaaacuguucacuuccugccugcauucugcaguugcuugguuaauaauauucuccacaua

SEQ ID NO: 109504 - RNA, 41 nt, Mus musculus
auacauucaaacaggcuguaguagaacugauuucagggaaa

SEQ ID NO: 109505 - RNA, 46 nt, Mus musculus
agcuguuuccucuaugugaaaguuaaacaguaaaagaaacguagua

SEQ ID NO: 109506 - RNA, 45 nt, Mus musculus
gcuuuguggucuguggcuaugaaacacaaauggauuuggccagau

SEQ ID NO: 109507 - RNA, 42 nt, Mus musculus
uugaauuauauucuagacagugagaacaagaaagggggggag

SEQ ID NO: 109508 - RNA, 46 nt, Mus musculus
aaaggcgcagcaagaauccagaacaaaggaugaaaggcgcccacag

SEQ ID NO: 109509 - RNA, 45 nt, Mus musculus
uuccuuuuucuggaagcguuuaggaauuucucuucauucccaguc

SEQ ID NO: 109510 - RNA, 46 nt, Mus musculus
cagaagagaucaggaauucaacacagaauuauagugaagacaugag

SEQ ID NO: 109511 - RNA, 46 nt, Mus musculus
cagauguugguguccagcauuuauguugcaggugaaauaaaagauc

SEQ ID NO: 109512 - RNA, 46 nt, Mus musculus
uuuagcggguuaacuuugguuuucaugacaucugccauugcuaaaa

SEQ ID NO: 109513 - RNA, 46 nt, Mus musculus
gucaaagacaccagcuuugguauuugaauauaucaauaauacagau

SEQ ID NO: 109514 - RNA, 46 nt, Mus musculus
auguagguggaaaugggaagggaagccuuagcccugaauucgagag

SEQ ID NO: 109515 - RNA, 45 nt, Mus musculus
cacaccauauauauagaaaauguaaauuuagggguauagcugagu

SEQ ID NO: 109516 - RNA, 59 nt, Mus musculus
aggagucucacuucugauuacucuuguguauuuaagccagugaagaaaaagaagauaaa

SEQ ID NO: 109517 - RNA, 46 nt, Mus musculus
acuugggagaaaagcccagaggagaugagggugcugcugaccaguc

SEQ ID NO: 109518 - RNA, 46 nt, Mus musculus
ugcuggggagcuaaggagcaacacaaggcuggagaaaguggcagag

SEQ ID NO: 109519 - RNA, 45 nt, Mus musculus
ggcuaagccuauucccuccuccaucguuuuucauuccuggcacaa

SEQ ID NO: 109520 - RNA, 48 nt, Mus musculus
gagaauaauuucccucaaggaacugguaauguaaguagaauggugaga

SEQ ID NO: 109521 - RNA, 64 nt, Mus musculus
cugauccauuuuauaauguccacagcaggaugugaggagucuucuuuguauccucagcagcaug

SEQ ID NO: 109522 - RNA, 46 nt, Mus musculus
aucucucucuauaaauggcaucucuuaaguugcccaggcuggucuu

SEQ ID NO: 109523 - RNA, 45 nt, Mus musculus
uugacauuauagggacauacguagaggguugagcagaaucacaga

SEQ ID NO: 109524 - RNA, 91 nt, Mus musculus
gcaagcuugagguccuggagcuaguccuuacccuucccccaccuuaacacagcaaacagaauaagauuguagguucuuaaaaggaagauug

SEQ ID NO: 109525 - RNA, 46 nt, Mus musculus
uuucaucuugacuguaagcugucaguucuugaaggugugcccagaa

SEQ ID NO: 109526 - RNA, 75 nt, Mus musculus
ggucugagguuagaccuuaaaacuuuguagugaauagagaagccaugucuuuuauuuuuggggaguggugucaga

SEQ ID NO: 109527 - RNA, 60 nt, Mus musculus
auguaauaacucuuaacaguuucuuuaaugugucugugugaaaaagugagcaugugugca

SEQ ID NO: 109528 - RNA, 45 nt, Mus musculus
guugaggcuauuagaggacuuuacaaauuuaaaaagcugcuagug

SEQ ID NO: 109529 - RNA, 45 nt, Mus musculus
uucauaucagucuuugucauuuugucacaguugggugcguaguga

SEQ ID NO: 109530 - RNA, 46 nt, Mus musculus
uuccucugcucuaaagauccaaugcauauauuuaccacauccagua

SEQ ID NO: 109531 - RNA, 42 nt, Mus musculus
ggaggauugaauuugccaagucuaaagcaauuucagggaaau

SEQ ID NO: 109532 - RNA, 100 nt, Mus musculus
ugcugcccaagacacuggggugagaaggaaggaaugauggcagauagggagcuuggccccgcuaaguaugaguuguacauuggaggucuguaguuauggg

SEQ ID NO: 109533 - RNA, 54 nt, Mus musculus
augcaggauugaaaagcuugugccuuagggcaguucuuauuuaauuguguagau

SEQ ID NO: 109534 - RNA, 70 nt, Mus musculus
ugucacuagugaaagagcacuggagagugguaguguuucaccagauuuucacagugcccagugaacaaaa

SEQ ID NO: 109535 - RNA, 46 nt, Mus musculus
caugaucuuaaugagcaugaagagucagccaaguuucuguacaggu

SEQ ID NO: 109536 - RNA, 42 nt, Mus musculus
ggacaauucccucaguugauauuuucauuucauguagcagua

SEQ ID NO: 109537 - RNA, 46 nt, Mus musculus
gaggggggacuguaucugauauggaauaaagagguauucgcaagag

SEQ ID NO: 109538 - RNA, 45 nt, Mus musculus
gcuucuguguggcucucauuuaagagaaugaguugcugugugaug

SEQ ID NO: 109539 - RNA, 44 nt, Mus musculus
uagauuuuuuugcugaacugucccucaguuuggccgugucuggu

SEQ ID NO: 109540 - RNA, 45 nt, Mus musculus
agcaaccuuaagaucuuaaggguguguuaaaaaggagauugagag

SEQ ID NO: 109541 - RNA, 41 nt, Mus musculus
cccgcgcgccccugccgcucccugcgggguccagcggcggc

SEQ ID NO: 109542 - RNA, 42 nt, Mus musculus
ggcugcgaagggcuccgggugggcuguccuugcaggccggag

SEQ ID NO: 109543 - RNA, 46 nt, Mus musculus
cuaaaccacauagccaaucauaaugccaaucuagaguacucggcag

SEQ ID NO: 109544 - RNA, 41 nt, Mus musculus
gggauguuuaugggccagaggcauaguaagaaaggccccac

SEQ ID NO: 109545 - RNA, 46 nt, Mus musculus
agaaucauggaaacggcuucuucgaaacaguguucuguugacccua

SEQ ID NO: 109546 - RNA, 46 nt, Mus musculus
uuacagguccgcuauggucagaagaugaucuuacaucggguguugg

SEQ ID NO: 109547 - RNA, 42 nt, Mus musculus
cugagaaccuuuuaaggucauguucuguugcuuggagaggag

SEQ ID NO: 109548 - RNA, 41 nt, Mus musculus
augccaucagauuuuuuuagaacuuaauaaacaugggcuga

SEQ ID NO: 109549 - RNA, 42 nt, Mus musculus
gcaugaauucaguauuugcuaaucuuuggaaugucauggaug

SEQ ID NO: 109550 - RNA, 46 nt, Mus musculus
aaaaaaaaugcauuuaaacuuuggaacuugcccacauagacaggag

SEQ ID NO: 109551 - RNA, 41 nt, Mus musculus
aagcagucagugguggugcacaccauccaucccagcacuca

SEQ ID NO: 109552 - RNA, 46 nt, Mus musculus
cuccauaaaggaaauuuaacuauaaucacucuagaaaugcugucag

SEQ ID NO: 109553 - RNA, 54 nt, Mus musculus
caaaucccagcaaccacacgguggcucacaaccauccguaacaagaucugacuc

SEQ ID NO: 109554 - RNA, 46 nt, Mus musculus
ugaugcccuuuccuggugcaucugaagacagcuacaguguacuuag

SEQ ID NO: 109555 - RNA, 46 nt, Mus musculus
gcuacagugagaccuugucucaaacaauggugugugugugugugug

SEQ ID NO: 109556 - RNA, 45 nt, Mus musculus
agaauccacuauaagccacuugagcauuacuguacaugccugaag

SEQ ID NO: 109557 - RNA, 34 nt, Mus musculus
aagauuaggagggcaaagucacccuuggcuacag

SEQ ID NO: 109558 - RNA, 45 nt, Mus musculus
caaacaaaaacaagcaaacaaaacuuaauuuguguauacacacug

SEQ ID NO: 109559 - RNA, 24 nt, Mus musculus
cgcuaaguggacauguugucgaac

SEQ ID NO: 109560 - RNA, 46 nt, Mus musculus
uucauucaaauucucucucucucucucacacacacacacacacaca

SEQ ID NO: 109561 - RNA, 33 nt, Mus musculus
ucuuucaauugcuugccgcacacacugcuucag

SEQ ID NO: 109562 - RNA, 41 nt, Mus musculus
cuauaguauacaucaagaagaaucucuuuuuauugcuggca

SEQ ID NO: 109563 - RNA, 46 nt, Mus musculus
uugaugucgugguagcuguacuguggcugugguggaacuguggcug

SEQ ID NO: 109564 - RNA, 42 nt, Mus musculus
acaauucaauccacuggugcaaugaccacugccuacccccug

SEQ ID NO: 109565 - RNA, 44 nt, Mus musculus
ccauuaaacccauuacugaauuauuauauugcauagugcucucu

SEQ ID NO: 109566 - RNA, 46 nt, Mus musculus
caauaaaauaauguacaaauucucuacuacauauuuauaccaacag

SEQ ID NO: 109567 - RNA, 46 nt, Mus musculus
ggcugaaaagggaaaauaccaaaucucacugcagguuggggaacaa

SEQ ID NO: 109568 - RNA, 46 nt, Mus musculus
caucaucaauuucuuuacuaaagugcugauuugccucuggccacac

SEQ ID NO: 109569 - RNA, 45 nt, Mus musculus
uuaacauucagacaaaccuuucacacuaauagugucaagucagug

SEQ ID NO: 109570 - RNA, 44 nt, Mus musculus
ggaggagggagaggaggaagaggaagaggaggaggagggagagg

SEQ ID NO: 109571 - RNA, 46 nt, Mus musculus
guggcacacagccaucuguuaugggaucuucuagcauguaggcaua

SEQ ID NO: 109572 - RNA, 42 nt, Mus musculus
ugguggcucacaacuaucuguaauaggaucugaugcccccug

SEQ ID NO: 109573 - RNA, 46 nt, Mus musculus
gucugcauucauucacacacacacacacacacacacacacccauaa

SEQ ID NO: 109574 - RNA, 45 nt, Mus musculus
uggaaaucucuccuguuauuuccucuaaaaucucuucaaucccaa

SEQ ID NO: 109575 - RNA, 45 nt, Mus musculus
uucuugauuuccacugacgucugcgucaauguaagaacgcagaag

SEQ ID NO: 109576 - RNA, 42 nt, Mus musculus
uugaucccuaacaccacaaaaauaaaaaaggggggguggggg

SEQ ID NO: 109577 - RNA, 45 nt, Mus musculus
gcuugagaacuuuacucagcugggcaaauaaguggggugcaggcu

SEQ ID NO: 109578 - RNA, 42 nt, Mus musculus
caugugaaaauaggcagcguaauaaaugccugucugccucag

SEQ ID NO: 109579 - RNA, 45 nt, Mus musculus
guauauguaccacauucaugcugagagaucaaagagggugcgaga

SEQ ID NO: 109580 - RNA, 46 nt, Mus musculus
agacaagauacauguugaagcaagaccaugggaagaauguguagug

SEQ ID NO: 109581 - RNA, 31 nt, Mus musculus
acucuccagauuucauuucugucuuaacuca

SEQ ID NO: 109582 - RNA, 83 nt, Mus musculus
guguuuuaauuaaacagucugagucagcacaaagaagugaggcccucagcagacugagaacugcaccuaauggacccugugcc

SEQ ID NO: 109583 - RNA, 46 nt, Mus musculus
aucaggaccucccaaaccuaugacaucacauaggugacagcacgac

SEQ ID NO: 109584 - RNA, 45 nt, Mus musculus
aaguccagcucuaaaauacaaugagaucuauuugaaaggagggag

SEQ ID NO: 109585 - RNA, 46 nt, Mus musculus
uguacauuuucuguauccauuccucucuugaaggauaucagccagg

SEQ ID NO: 109586 - RNA, 47 nt, Mus musculus
accaaacugauuuccagagugguuguaccagcuugcaacccaccaac

SEQ ID NO: 109587 - RNA, 46 nt, Mus musculus
cuguuucaaucuccaugugggagcacaucacacuuagcuggcuacu

SEQ ID NO: 109588 - RNA, 46 nt, Mus musculus
agcuggcuucuuauauguauguucaugugugugugaacacaaggac

SEQ ID NO: 109589 - RNA, 67 nt, Mus musculus
auuguccaccagguagcugauuugagacaaggccagcgagagcgagucaagauucauugcugguugg

SEQ ID NO: 109590 - RNA, 44 nt, Mus musculus
uucuuuaccaagugucuuacucuguucugaaacauggcaccugu

SEQ ID NO: 109591 - RNA, 46 nt, Mus musculus
uucugaauacuguaauauaaaguaauaaauacaaagggcuggugag

SEQ ID NO: 109592 - RNA, 46 nt, Mus musculus
ucaaaucccagcaaccgcaugguggcucacaaccauccgaaacgag

SEQ ID NO: 109593 - RNA, 45 nt, Mus musculus
gaaacuagaguuacaguuggguuguaaacugccaugugaacccag

SEQ ID NO: 109594 - RNA, 46 nt, Mus musculus
ccuuuacaaaauaagcaaaaccagaaccugaaaggagaacauucaa

SEQ ID NO: 109595 - RNA, 46 nt, Mus musculus
aguaaaagccuggcguggugucacacgccuuuaaucccagcacuug

SEQ ID NO: 109596 - RNA, 42 nt, Mus musculus
aaucagaagcauacuaacuaaacaugagcuaggcuggcacag

SEQ ID NO: 109597 - RNA, 45 nt, Mus musculus
cucacaaccauccguaaugagaucugacgcccuuuuccggugcau

SEQ ID NO: 109598 - RNA, 42 nt, Mus musculus
uuguaggcccagagacuaaaucacaacaaggcuaucucagag

SEQ ID NO: 109599 - RNA, 45 nt, Mus musculus
caaaucccagcaaccacauggugguucacaacuaccuguaaugag

SEQ ID NO: 109600 - RNA, 46 nt, Mus musculus
ugguuaauucaagaagcaucaaauggggacaagugcagugcacuag

SEQ ID NO: 109601 - RNA, 87 nt, Mus musculus
ucaagacccacaagcauucugcucacuggugggcaucugccgguaguugccgguuggaggguugggggcguugggacaggcagaacc

SEQ ID NO: 109602 - RNA, 42 nt, Mus musculus
ccaaccgcacagggaccuaggugacuuaaguuggggggcuau

SEQ ID NO: 109603 - RNA, 46 nt, Mus musculus
cucuucgguuaacuccgcuuguuuucucgacaaaauggcgcccgag

SEQ ID NO: 109604 - RNA, 38 nt, Mus musculus
aagggagcucguuaaugcauugccacccugcgcacaaa

SEQ ID NO: 109605 - RNA, 41 nt, Mus musculus
acccuuagcaacugugguugcuaagguuuaggaguggccuu

SEQ ID NO: 109606 - RNA, 51 nt, Mus musculus
agugagcuacagauuccuggcggcuaguguucagauaugcacaguuuuggg

SEQ ID NO: 109607 - RNA, 46 nt, Mus musculus
agcuuggguucaaugggaagccugucuaaaauaauaugcuucagag

SEQ ID NO: 109608 - RNA, 42 nt, Mus musculus
ccgaaggaggaagauggcgguggagucgcgcguuacccagga

SEQ ID NO: 109609 - RNA, 47 nt, Mus musculus
ccgcgggaacgugccuucgagcgagcugcagaucuacaccuggaugg

SEQ ID NO: 109610 - RNA, 51 nt, Mus musculus
caauuuugcaauuguuuuuauggaucuuaaaagaccuggauaucgaguuaa

SEQ ID NO: 109611 - RNA, 46 nt, Mus musculus
acccuacugaagucuauugacuuucuugaaguuauuuuucagccag

SEQ ID NO: 109612 - RNA, 42 nt, Mus musculus
ggugaggucagcauagacacuucucucuugacugccuuagcu

SEQ ID NO: 109613 - RNA, 42 nt, Mus musculus
uaaauaaaucuuaaaaaaaaaaacaagagggagagggaggga

SEQ ID NO: 109614 - RNA, 45 nt, Mus musculus
auuggggacuagaacagggugguaagcagguaucugggguggggc

SEQ ID NO: 109615 - RNA, 45 nt, Mus musculus
ggaagagcagucagugcuuuuaaccgcugagccaucuccccagcc

SEQ ID NO: 109616 - RNA, 46 nt, Mus musculus
ucugaguauggggugccugaggaggcccacgagggauaagacagau

SEQ ID NO: 109617 - RNA, 41 nt, Mus musculus
ggaaggagaugaaagggucuguucugguuuggggguggaga

SEQ ID NO: 109618 - RNA, 41 nt, Mus musculus
gagcuuggugccuagaacaaggguggcacuucuggagaugg

SEQ ID NO: 109619 - RNA, 46 nt, Mus musculus; identical to SEQ ID NO: 95744

SEQ ID NO: 109620 - RNA, 24 nt, Mus musculus
auccccuggacccacuuaaugaaa

SEQ ID NO: 109621 - RNA, 45 nt, Mus musculus
uuugguuuguuuguuuguuuuuuucuuuuucuugagguccugaau

SEQ ID NO: 109622 - RNA, 42 nt, Mus musculus
ggugugugugugugcauguuugguugguuuuuugagacagaa

SEQ ID NO: 109623 - RNA, 46 nt, Mus musculus
accuccuccauugcggugggcugaccuuaucaggaggguuggagag

SEQ ID NO: 109624 - RNA, 45 nt, Mus musculus
ggccagacugguguuucugauucuggccccagcagagggccccag

SEQ ID NO: 109625 - RNA, 45 nt, Mus musculus
gccuuuacuacucaccacugagauuuugcugaguugcuggcuggg

SEQ ID NO: 109626 - RNA, 46 nt, Mus musculus
ccauaccuuuaggcagaggaaacagcccucuucuagauuagcaggu

SEQ ID NO: 109627 - RNA, 58 nt, Mus musculus
cuacaugauuagagcagauggugguuaucuuucccaagggcggagucugagccgggcu

SEQ ID NO: 109628 - RNA, 46 nt, Mus musculus
gccaggauggaugaagagguccagcugggcagaggccccaucccag

SEQ ID NO: 109629 - RNA, 46 nt, Mus musculus
cucuugaaaguuauccucugaccuacacacgugccauaguacacag

SEQ ID NO: 109630 - RNA, 46 nt, Mus musculus
uggguccucaugcugaugaugcggucagccaugccuuucaccucuu

SEQ ID NO: 109631 - RNA, 45 nt, Mus musculus
ggucucagccaggcgagguggugcacggcuuugaucccagcacuu

SEQ ID NO: 109632 - RNA, 46 nt, Mus musculus
gacagccagggcuacacagagaaacccugucuugaacaccgccccc

SEQ ID NO: 109633 - RNA, 45 nt, Mus musculus
ucauaguagcgauaaccuuggagcugcaugccggcaucccugaag

SEQ ID NO: 109634 - RNA, 45 nt, Mus musculus
ugggcagguauucuuuguccaaauuuuuugcagcaaucugggccu

SEQ ID NO: 109635 - RNA, 42 nt, Mus musculus
gacaaaauccaacuaaauguauaaaaggaaugcaggucaggg

SEQ ID NO: 109636 - RNA, 45 nt, Mus musculus
gcuguugguaucucucuugaaggcuucgguaacgcccaggauggg

SEQ ID NO: 109637 - RNA, 45 nt, Mus musculus
aggggggaaugggaaaacaagggagccguuuuaacugggaagcag

SEQ ID NO: 109638 - RNA, 46 nt, Mus musculus
uauguagcucaagguggccuggaacuacuaagccacuugcccacag

SEQ ID NO: 109639 - RNA, 46 nt, Mus musculus
guaguguuagagcacaccuuuaaucccaguuacacaggaggcagag

SEQ ID NO: 109640 - RNA, 28 nt, Mus musculus
gacggcaguggauggugguagagccgag

SEQ ID NO: 109641 - RNA, 42 nt, Mus musculus
cggacgcuuccccagaucucggcucuaccaccauccacugcc

SEQ ID NO: 109642 - RNA, 43 nt, Mus musculus
acgguaaguauaaucucuugguggcggugcauaaucucuggug

SEQ ID NO: 109643 - RNA, 44 nt, Mus musculus
agcgggggucccccuccuaaaagaucaacaccuuccggaccagu

SEQ ID NO: 109644 - RNA, 41 nt, Mus musculus
agguggagcaagcuaccaaaccaucuuuugaaaguggcagg

SEQ ID NO: 109645 - RNA, 45 nt, Mus musculus
uguuaccuucgaaagcccagcagaugcuaaagaugcagcuagaga

SEQ ID NO: 109646 - RNA, 92 nt, Mus musculus
auacagaaacaaaugagaaagcccuugaagcaguauuuggcaaguauggacgaauaguggaaauacuuuugaugaaagaccgggaaaccaac

SEQ ID NO: 109647 - RNA, 45 nt, Mus musculus; identical to SEQ ID NO: 108400

SEQ ID NO: 109648 - RNA, 45 nt, Mus musculus
aggaagaaugagaaaaucauuguaggugaggccguccccgcaguu

SEQ ID NO: 109649 - RNA, 44 nt, Mus musculus
gaaucucauuugccucuuucagagugacgccggcaggggcgacc

SEQ ID NO: 109650 - RNA, 46 nt, Mus musculus
ucacgauucuucuuuaggucuguccgggcaaugauggcuaccagcu

SEQ ID NO: 109651 - RNA, 45 nt, Mus musculus
uuggcuugcgcagcagugacuacauugccuccaaugaccugcaga

SEQ ID NO: 109652 - RNA, 46 nt, Mus musculus
uugauuuugucagcuucacugaaguaucgguucuggcugcugagau

SEQ ID NO: 109653 - RNA, 45 nt, Mus musculus
uggugaugcccaaagccuggaagaaggaggucuucucgggcccca

SEQ ID NO: 109654 - RNA, 42 nt, Mus musculus
agcaguuucuccagagcuggguuguucuccagguggccccug

SEQ ID NO: 109655 - RNA, 86 nt, Mus musculus
aucauccaaaaguuggaugaucuugaggaaguaguuggacuuccaggucgcccugucuucccugggcaucacggcggugcgucagg

SEQ ID NO: 109656 - RNA, 47 nt, Mus musculus
uugccacgcgggguuuaaagacgaugucacuccaacgaggacgccug

SEQ ID NO: 109657 - RNA, 99 nt, Mus musculus
auucucuuuucugaagggaaauaggcgaggaauggaucugggggagaggggaguuaaauaggagaggaaaugggagaaaaggaagugaagaagaaggag

SEQ ID NO: 109658 - RNA, 42 nt, Mus musculus
ucacaaucccaacauaggaguuucagaauaaugcuggggggg

SEQ ID NO: 109659 - RNA, 45 nt, Mus musculus
caaacgggaaccucaaaaaccaugaacccaaauaaaccuucucuu

SEQ ID NO: 109660 - RNA, 43 nt, Mus musculus
uguggacagaacugauuuaagagcuuguauggcuggagggaag

SEQ ID NO: 109661 - RNA, 46 nt, Mus musculus
aaaacccuuucaggaggagaaaguggguguugugagccugggugug

SEQ ID NO: 109662 - RNA, 45 nt, Mus musculus
cucaaggagcaggcaaauggguugugaccagaaaaggcuuccagg

SEQ ID NO: 109663 - RNA, 45 nt, Mus musculus; identical to SEQ ID NO: 105539

SEQ ID NO: 109664 - RNA, 64 nt, Mus musculus
ggaggacuggccuccaaggucaguccccugguggagaaacaucucugaaugaaggagggcaccg

SEQ ID NO: 109665 - RNA, 46 nt, Mus musculus
aucagaacucgcuugaauuguugggugugaaguuggugcugcaauc

SEQ ID NO: 109666 - RNA, 45 nt, Mus musculus
cccaaauuaucuauuuuugcuguauuuugauauuaagggggaaaa

SEQ ID NO: 109667 - RNA, 45 nt, Mus musculus; identical to SEQ ID NO: 105548

SEQ ID NO: 109668 - RNA, 46 nt, Mus musculus; identical to SEQ ID NO: 105549

SEQ ID NO: 109669 - RNA, 41 nt, Mus musculus
uuaaaaacauaacagcuuugggcugaagagauggcucagug

SEQ ID NO: 109670 - RNA, 47 nt, Mus musculus
ugagcagugugagccucaaggauccaucuauguccaccuccaaguug

SEQ ID NO: 109671 - RNA, 46 nt, Mus musculus
aauggggagggugauugugugccuuccucauggguuguugggagaa

SEQ ID NO: 109672 - RNA, 43 nt, Mus musculus
gcaagaacugcauuccugguggugagaacaauggccauuagag

SEQ ID NO: 109673 - RNA, 46 nt, Mus musculus
uggggugguuuugugugugugugugugugugugugugugugugaga

SEQ ID NO: 109674 - RNA, 84 nt, Mus musculus; identical to SEQ ID NO: 105556

SEQ ID NO: 109675 - RNA, 44 nt, Mus musculus
uacugugugccucuguguccuaggcuuuauaacuucucucagau

SEQ ID NO: 109676 - RNA, 41 nt, Mus musculus; identical to SEQ ID NO: 105558

SEQ ID NO: 109677 - RNA, 41 nt, Mus musculus
acuuuauggucuagaagccagagaccccauguagucacagg

SEQ ID NO: 109678 - RNA, 45 nt, Mus musculus
agugugaguacuuuaugugcacaguuguccuugaaggauagauag

SEQ ID NO: 109679 - RNA, 46 nt, Mus musculus
cucccgaaaucugcuaccagagauuaaagaugaggugccgggaaga

SEQ ID NO: 109680 - RNA, 24 nt, Mus musculus
ggcugaggacaagaaaggggacug

SEQ ID NO: 109681 - RNA, 46 nt, Mus musculus
aggcauuggauccucucagacuaaaucuauguacacagcuaacucc

SEQ ID NO: 109682 - RNA, 47 nt, Mus musculus
guggguguguggguguguaggugugagugcauaggugugggugcgua

SEQ ID NO: 109683 - RNA, 46 nt, Mus musculus
auguguguuuguguauauauauuaauauguauauguguguuuaggu

SEQ ID NO: 109684 - RNA, 41 nt, Mus musculus
aagggcucagaacuugacugggcagacaaguugugugcagu

SEQ ID NO: 109685 - RNA, 63 nt, Mus musculus
gcccccugagagguagaggagaggggacuguaguuguaagaauguagagagagccguaggcug

SEQ ID NO: 109686 - RNA, 72 nt, Mus musculus
gucccugggaagcaggagugacaucacaggaagaggaggcuugguuuucaaggcuggagaaauggcucagca

SEQ ID NO: 109687 - RNA, 54 nt, Mus musculus
ugugcccuccuguaccccuugguggggcaguggagguagucaggaggaaggcgu

SEQ ID NO: 109688 - RNA, 41 nt, Mus musculus
aaggcuugaaagagaggcgugacuguugggucugugggcaa

SEQ ID NO: 109689 - RNA, 41 nt, Mus musculus
cacgaguguuuggugccuuugaaggucaaaagagggcauca

SEQ ID NO: 109690 - RNA, 45 nt, Mus musculus
aucuuaagccuaagugcuaggggauaagagaaauaaaaggcagag

SEQ ID NO: 109691 - RNA, 47 nt, Mus musculus
cugugagagccaugaguagcgaaacugaacuggauagagcuggauuu

SEQ ID NO: 109692 - RNA, 45 nt, Mus musculus
ucuagcagucugugagcaguaaaggcagggcagggagaacaugca

SEQ ID NO: 109693 - RNA, 67 nt, Mus musculus
agacaaccuagaugucuuagaggaagacgaagagaugagcuggccgaggagggcagaccgagaggga

SEQ ID NO: 109694 - RNA, 41 nt, Mus musculus
caugcgagcacacaccuauccucagcaucucaggcggcgga

SEQ ID NO: 109695 - RNA, 41 nt, Mus musculus
gucuucgagugaaaauguugacgacaucaccagcuuuggug

SEQ ID NO: 109696 - RNA, 46 nt, Mus musculus
ccaaggggaguuuacccaagacauccagucucauuagccacugcaa

SEQ ID NO: 109697 - RNA, 46 nt, Mus musculus
uaaauaauuaaauaaagucauguguucuaagaggcccucgagguag

SEQ ID NO: 109698 - RNA, 39 nt, Mus musculus
uuuuacuacuuauuaaacuaauuauuuauacauccauau

SEQ ID NO: 109699 - RNA, 41 nt, Mus musculus
cucugguuaguccagcacagaacgaacccaagccuugggca

SEQ ID NO: 109700 - RNA, 45 nt, Mus musculus
ccaagaaggggaaagcacucugaaagaacugaucucgccugguua

SEQ ID NO: 109701 - RNA, 46 nt, Mus musculus
ggagguaggugcuagaaggcugcaugggaaggggugcgagaauggg

SEQ ID NO: 109702 - RNA, 46 nt, Mus musculus
aaggauagucggaggggcaguguagugcaaagauucaugggugggg

SEQ ID NO: 109703 - RNA, 31 nt, Mus musculus
aaggugcagggaaggauccuaaggcuaguga

SEQ ID NO: 109704 - RNA, 45 nt, Mus musculus
ucucugccauuccagucugcuaauuagagauuugcucugcccuca

SEQ ID NO: 109705 - RNA, 46 nt, Mus musculus
aauugacuucuaccugaucuuuaaugaaguggccaaauuccucaag

SEQ ID NO: 109706 - RNA, 46 nt, Mus musculus
gacuaaaggccugucugagcuuaacaacuagagccacucggcccuc

SEQ ID NO: 109707 - RNA, 42 nt, Mus musculus
cuuuucagaaacggacccaaagauuuguuuacuagggcccag

SEQ ID NO: 109708 - RNA, 46 nt, Mus musculus
ugucacugaacacgcacugaaaacaggcgggcagucggaugcgcag

SEQ ID NO: 109709 - RNA, 46 nt, Mus musculus
cgcccgguuaguggaggaaggcagcguccggcagcaucgggcaggc

SEQ ID NO: 109710 - RNA, 45 nt, Mus musculus
gcauaaaaucaagaugucccccacuccccacacacaacgggcuca

SEQ ID NO: 109711 - RNA, 72 nt, Mus musculus
guaaacugaagauuauuuuuguggugaaugaauuaaacaggccccuaugaugcuguaauuuuguuguuagag

SEQ ID NO: 109712 - RNA, 44 nt, Mus musculus
ugcaauuccagcacuuuuaccuucucaggugaaagcggcagagg

SEQ ID NO: 109713 - RNA, 46 nt, Mus musculus
ggugugucccuguaacuuccuugccaggcuuguaugguacagggau

SEQ ID NO: 109714 - RNA, 65 nt, Mus musculus
auaaauggcauugagaagggaaguauaugucacaagacaggagcaccgggaugggacagccagug

SEQ ID NO: 109715 - RNA, 54 nt, Mus musculus
ucaccugacucugagccacccugucauguguauuugugaugagucaaaaccuua

SEQ ID NO: 109716 - RNA, 60 nt, Mus musculus
auucacuuugggaaagguugccuagaguggcccagugacugacagaucugugauggucac

SEQ ID NO: 109717 - RNA, 44 nt, Mus musculus
ugcccguccuucuaaucaaguuuucuuucucuuagcacgucaga

SEQ ID NO: 109718 - RNA, 44 nt, Mus musculus
ucgcaccgagucgagagauguggacagccgcccugagauccagc

SEQ ID NO: 109719 - RNA, 47 nt, Mus musculus
caguagggauacacagagaaacccuaucuugaaaaacagcagcagca

SEQ ID NO: 109720 - RNA, 31 nt, Mus musculus
cuguggagaagaauaaaaucaggccugguag

SEQ ID NO: 109721 - RNA, 41 nt, Mus musculus
gacuaagaaaacuuguaucuguugugugagaugcugggguu

SEQ ID NO: 109722 - RNA, 46 nt, Mus musculus
uuuccuuccagccugggcuuguuuccgcauuaccauguccuaagcu

SEQ ID NO: 109723 - RNA, 46 nt, Mus musculus
agucugccacguagaggaacggcuuguuaaccacaccuccugagca

SEQ ID NO: 109724 - RNA, 46 nt, Mus musculus
acuuucagcaucacccacgaagcugggaccacaaggaggaggaggu

SEQ ID NO: 109725 - RNA, 44 nt, Mus musculus
aaacacacacaccacacacagaccacaccacacaaaagucauga

SEQ ID NO: 109726 - RNA, 46 nt, Mus musculus
cauagagcaagggcuaugggaccaggaagcagaggcaggcggauuu

SEQ ID NO: 109727 - RNA, 45 nt, Mus musculus
caucugucugucccacaugucgucaucgucguccccucugcauga

SEQ ID NO: 109728 - RNA, 45 nt, Mus musculus
aacauguauguguacuauaugugugccuaauuccugcagaaguca

SEQ ID NO: 109729 - RNA, 42 nt, Mus musculus
cuuuauaggaaacugccaggccgauucagagcugccccaucg

SEQ ID NO: 109730 - RNA, 45 nt, Mus musculus
aaggaagccacgucugaggacuggcugugacugacagggagagaa

SEQ ID NO: 109731 - RNA, 46 nt, Mus musculus
guuaugaauuacuggguguuuuuauuuguauuuauuguggguguuu

SEQ ID NO: 109732 - RNA, 45 nt, Mus musculus
cguguguuuagaggcucuguuaguaguuguaugcacguuugggau

SEQ ID NO: 109733 - RNA, 45 nt, Mus musculus
cuaauuauuuaaggacuguguaaacaguuuucuagagugacuaua

SEQ ID NO: 109734 - RNA, 45 nt, Mus musculus
gugcucacgcgcauguuuccuagaaagaugauugcugggucagag

SEQ ID NO: 109735 - RNA, 91 nt, Mus musculus
ggagccgcugcguugagauggauagauggauagauggaugauggauagauggauagauggauagaugguuagauggauagauggauugaug

SEQ ID NO: 109736 - RNA, 41 nt, Mus musculus
cccaccaaccacaugguggcccacaaccaucuguaauggga

SEQ ID NO: 109737 - RNA, 41 nt, Mus musculus
ucacucuugauaugauggaauaagugaccagcuccagaagg

SEQ ID NO: 109738 - RNA, 46 nt, Mus musculus
gaaugcuguguuuuaaagugaguggaauagacugcagggaguaguc

SEQ ID NO: 109739 - RNA, 63 nt, Mus musculus
gacagguaggagaauucccaccugcggcguaagggguuucuuccuuucuucuuucugccccau

SEQ ID NO: 109740 - RNA, 46 nt, Mus musculus
cuucaauccuugcuacccucucaggaaaauuucgaaguuaccagaa

SEQ ID NO: 109741 - RNA, 45 nt, Mus musculus
agggguuugucaaaacaucuguguuccauuacugguucuuggagg

SEQ ID NO: 109742 - RNA, 46 nt, Mus musculus
ucuggguuuaaagaaguguguuaucaccgcccggugaggguuagau

SEQ ID NO: 109743 - RNA, 42 nt, Mus musculus
aagauugcccucuuagcucuguuccucagguuaccuccugau

SEQ ID NO: 109744 - RNA, 45 nt, Mus musculus
aggcacuguguuccuaacugucaacaguucugagucccaggagga

SEQ ID NO: 109745 - RNA, 46 nt, Mus musculus
uauguaauauacauauggagguaguucagucagcaagcaugggaga

SEQ ID NO: 109746 - RNA, 46 nt, Mus musculus
aaauauauuuugaaucugaaucuuauuucugagagcagagggcugg

SEQ ID NO: 109747 - RNA, 46 nt, Mus musculus
cauucuuucucuggguuagagaaauggguggccagagccuugagug

SEQ ID NO: 109748 - RNA, 47 nt, Mus musculus
ugcuaauuccuuagcuuggacuuugcuacuuccagagcagcaguaca

SEQ ID NO: 109749 - RNA, 59 nt, Mus musculus
uugggaagucuugagcuuaguccuuaggaauggugucaguagcaucguaagaaauggug

SEQ ID NO: 109750 - RNA, 48 nt, Mus musculus
gauggaugaaugagugagucgauggauggguggauggauggauggaug

SEQ ID NO: 109751 - RNA, 41 nt, Mus musculus
ggugggugaguggauggguagaugagugaauggguaaaugg

SEQ ID NO: 109752 - RNA, 45 nt, Mus musculus
uucagacucucugaaaccuauuuaaaauuuuuuuuaacaucagau

SEQ ID NO: 109753 - RNA, 36 nt, Mus musculus
gagcuagcuagcuaauguuugagugcgguguagaua

SEQ ID NO: 109754 - RNA, 60 nt, Mus musculus
gggauaccaagcuucuguuagccauugcuauuagcagagagaaugucggugugggagcga

SEQ ID NO: 109755 - RNA, 46 nt, Mus musculus
cguuaaucuuucuugggagaaauaccauauguggacacccuuuaaa

SEQ ID NO: 109756 - RNA, 66 nt, Mus musculus
gcagucauguggaaccuugcuuucuagugcugggggaagagaugucuaauuacuggcuucaauaaa

SEQ ID NO: 109757 - RNA, 45 nt, Mus musculus
uuaaaaccaguguuuaaacugaagagacuguugucuugaugaggg

SEQ ID NO: 109758 - RNA, 46 nt, Mus musculus
cugugaauuggucuuuccuaaaaauccaacauauaugcugcuagau

SEQ ID NO: 109759 - RNA, 46 nt, Mus musculus
ugacaaggcugcucaacugucgaguggcuuuguaaaggucugaaca

SEQ ID NO: 109760 - RNA, 45 nt, Mus musculus
auugauuucucauuuuguaccauguuggcaauguucuagggaaag

SEQ ID NO: 109761 - RNA, 83 nt, Mus musculus
gacccacaugcuugacccaggccaugucccuuguccuuggagagaugucgggcucuaugcagauguaaccuggggcaggcagu

SEQ ID NO: 109762 - RNA, 47 nt, Mus musculus
ucacuuguucuugggaagcagguuaaguagcugacaguccaggaaag

SEQ ID NO: 109763 - RNA, 46 nt, Mus musculus
guggagaaaggaggcccacuuucuaucaggguggagcaaaggagac

SEQ ID NO: 109764 - RNA, 45 nt, Mus musculus
augaacuuuaaaacaauacauauacuucuuuggcuuguccgagug

SEQ ID NO: 109765 - RNA, 46 nt, Mus musculus
uugaggaugcugucacuaggaaagauggguuuugaggccagccuga

SEQ ID NO: 109766 - RNA, 46 nt, Mus musculus
uaguguaccaagugccucccccggaacuucaguaaagaagccagau

SEQ ID NO: 109767 - RNA, 109 nt, Mus musculus
gcacccacaugguggcucacaaccaucugaugaccucuucuggugugucugaaggcagcuacaguguacucauauaaauaaauaaaucuuuaaaaaaaaaaaaaaaaga

SEQ ID NO: 109768 - RNA, 47 nt, Mus musculus
cauacauacauacauacauacacacacacagagagagagagagugag

SEQ ID NO: 109769 - RNA, 46 nt, Mus musculus
gaaaauagcuauuuuacaugaaaauuuuacaaccgugaagccagaa

SEQ ID NO: 109770 - RNA, 45 nt, Mus musculus
uggauggcacccucuuaguaauguaacugugacuaggaguugagg

SEQ ID NO: 109771 - RNA, 46 nt, Mus musculus
ccuucuugaggcuuauagcaucguaggucaugauagauagauagau

SEQ ID NO: 109772 - RNA, 45 nt, Mus musculus
gggccaagggcaucuaugaaaggcugagagccagaagccucagga

SEQ ID NO: 109773 - RNA, 46 nt, Mus musculus
cuggggcaggguagcagggggucaguggaacagggcggggccagag

SEQ ID NO: 109774 - RNA, 42 nt, Mus musculus
ugaauugguuuuccuuaagcaaauugauuagauggagcagcc

SEQ ID NO: 109775 - RNA, 45 nt, Mus musculus
acagggacgagcaccuggacuucauccaggcgcaccugcggagau

SEQ ID NO: 109776 - RNA, 46 nt, Mus musculus
uugcccucccucugggugacaacgugcugacucauaaccuggggau

SEQ ID NO: 109777 - RNA, 42 nt, Mus musculus
aaauuggugaauuccagguucagcaagagacccugugucaaa

SEQ ID NO: 109778 - RNA, 45 nt, Mus musculus
guguuuuacgggagcacauugacaagaugaagauuccaccggagg

SEQ ID NO: 109779 - RNA, 42 nt, Mus musculus
gucucugcgggagacccuggucauuuuuguugccgacauguc

SEQ ID NO: 109780 - RNA, 45 nt, Mus musculus
uaauucaaaauaauaaaaauaaauuaaaaaaaauaauguagagau

SEQ ID NO: 109781 - RNA, 45 nt, Mus musculus
acaacucucaugaccaaacuccaaggagcagaacacggcaaaaaa

SEQ ID NO: 109782 - RNA, 42 nt, Mus musculus
uuuugggguuaguuguguuuugaagaguucuuguggcgaaga

SEQ ID NO: 109783 - RNA, 33 nt, Mus musculus
uccggcaaaaacauucugguguucggugagcag

SEQ ID NO: 109784 - RNA, 46 nt, Mus musculus
aaagaguuuauuucaucuuacccuuccagaucauaauccaucauug

SEQ ID NO: 109785 - RNA, 47 nt, Mus musculus
aauugucuucauauugugcuuugguuuguaaaaaucuguuaaaggac

SEQ ID NO: 109786 - RNA, 45 nt, Mus musculus
guagaagacuuugugcuaugauaaagaagaaaagaaggacuagua

SEQ ID NO: 109787 - RNA, 45 nt, Mus musculus
gaaauguauuucuuacggguuucaaagauucagaugccagcauag

SEQ ID NO: 109788 - RNA, 46 nt, Mus musculus
aucacuuugcucuaguuuaguuagacacuguaacuguaccauagau

SEQ ID NO: 109789 - RNA, 41 nt, Mus musculus
uuguuuccuagaacugauggggcaggaggauucgaggggga

SEQ ID NO: 109790 - RNA, 45 nt, Mus musculus
aaggccuauguguccuuguacccagagagcuaagugaggcucaug

SEQ ID NO: 109791 - RNA, 46 nt, Mus musculus
cucagugccauuuaaucacucaaaauggaaauaaagggcuggaaau

SEQ ID NO: 109792 - RNA, 42 nt, Mus musculus
cugugucccagcuuuucuaucuguauaguuguggcuccuuca

SEQ ID NO: 109793 - RNA, 47 nt, Mus musculus
agcugggcugcagaaugagacuuugucccaaacaacaaagaagagag

SEQ ID NO: 109794 - RNA, 45 nt, Mus musculus
uugacaccuggguaugguggcucacagcuauggggcggacggaca

SEQ ID NO: 109795 - RNA, 46 nt, Mus musculus
cucugcugguuucuuguuggagcugaagcaguuccuuuuuuaagag

SEQ ID NO: 109796 - RNA, 46 nt, Mus musculus
cuucagcuccaacaagaaaccagcagagaggauuaaaggccaacag

SEQ ID NO: 109797 - RNA, 46 nt, Mus musculus
ugucuuauuuuuauauuugucuuuuuaaaauucauugugugugugu

SEQ ID NO: 109798 - RNA, 60 nt, Mus musculus
uuggaugcuguagggaugacaggugucaccuggguacauugaaguuggaugcuguaggga

SEQ ID NO: 109799 - RNA, 116 nt, Mus musculus
ugacaggugucaccuggguacauugaaguuggaugcuguagggauggcaggugucaccuggguacauugaaguuggaugcuguagggaugacaggugucaccuggguacauugaag

SEQ ID NO: 109800 - RNA, 46 nt, Mus musculus
aacuagauauuaaacaaaguuuuucaugacuuauacuauuggguag

SEQ ID NO: 109801 - RNA, 46 nt, Mus musculus
aggaaauuuaccuguccgaggcacaauuccugauaugauugcagau

SEQ ID NO: 109802 - RNA, 85 nt, Mus musculus
gcagagggcacgggcgcagggcacagaguuaaaggaucaguaggaaagucaguacgauugaaggggaaagaaagugauaggcaag

SEQ ID NO: 109803 - RNA, 73 nt, Mus musculus
aguuagaaugugaggaggcaagaaggggucuggguauuggauaggguguaccuagggggcaguguuagagagg

SEQ ID NO: 109804 - RNA, 72 nt, Mus musculus
aaauaaaacagaaaaaugguucuaggaguugggggcaguaaauugaacaauuggauauuaauguaugaacaa

SEQ ID NO: 109805 - RNA, 45 nt, Mus musculus
gggcuacagagugagguuaagcccaacuuagaauacauaaaaagu

SEQ ID NO: 109806 - RNA, 46 nt, Mus musculus
aaaaaaucuauauuauccucauuaaaauuaugucugugcuucagca

SEQ ID NO: 109807 - RNA, 46 nt, Mus musculus
aagaagccaucaaaaaugugaacacagcacuaaauacaacucaggu

SEQ ID NO: 109808 - RNA, 46 nt, Mus musculus
cccugucucaaaaauaaaaaaaauuaaaaaaaaaaagaguuuagga

SEQ ID NO: 109809 - RNA, 46 nt, Mus musculus
aaauggacggauuccuaaaaguuauaaagaaaaagaggacuucaga

SEQ ID NO: 109810 - RNA, 46 nt, Mus musculus
aauacugcuauuuucuucaauuuguguuucuauuuuaggaccauag

SEQ ID NO: 109811 - RNA, 42 nt, Mus musculus
ucuguguguguguguguguaugucuaugucuguguguguaug

SEQ ID NO: 109812 - RNA, 46 nt, Mus musculus
acugaagauguucucucaguucaggaaauggcuuaucuagucguag

SEQ ID NO: 109813 - RNA, 46 nt, Mus musculus
gaaauauaauuguuacuugucuaaagugacauagcaaguggcagac

SEQ ID NO: 109814 - RNA, 61 nt, Mus musculus
gaguggacuuaaaggagccaaguuugcaggggugcgaugggagugagguaaagaagggagg

SEQ ID NO: 109815 - RNA, 45 nt, Mus musculus
ccauuucccaccugucuuuauuuucagucuuauauuggccuuaga

SEQ ID NO: 109816 - RNA, 46 nt, Mus musculus
uggacuaguugguuauaugaggauuauuauaaaagaacacccaggu

SEQ ID NO: 109817 - RNA, 46 nt, Mus musculus
uuuuauaauaauccucauauaaccaacuaguccauauguccuacag

SEQ ID NO: 109818 - RNA, 46 nt, Mus musculus
gcaaguauaugccagacacgggaacugucuaacauaaacaggcaag

SEQ ID NO: 109819 - RNA, 45 nt, Mus musculus
agacaucgcuauuuaguucuuguaagaauuccauggcagcuugag

SEQ ID NO: 109820 - RNA, 45 nt, Mus musculus
aaagauauauuuauuuauuuuauguauaugaguacacuguagcug

SEQ ID NO: 109821 - RNA, 41 nt, Mus musculus
acaugguaaucccaaggacuugagaagcagaggcaggugga

SEQ ID NO: 109822 - RNA, 46 nt, Mus musculus
gcuccuugaguaucuucccuggcugcgccauggccgcgccuggccc

SEQ ID NO: 109823 - RNA, 46 nt, Mus musculus
uacauggcggugucccugaugucccaucagaccuuggagcagaugg

SEQ ID NO: 109824 - RNA, 46 nt, Mus musculus
augaagccuuugcugcccauccugcguuggcucaagcaccccggag

SEQ ID NO: 109825 - RNA, 42 nt, Mus musculus
gcaacagccugcauggcccacgucaauggaguucaccugcau

SEQ ID NO: 109826 - RNA, 46 nt, Mus musculus
aaagaauaggcagacauagguugcugaguaauuaacaaaggaagag

SEQ ID NO: 109827 - RNA, 39 nt, Mus musculus
acgaagacaacgaugaugacaggacaaagacauuaggag

SEQ ID NO: 109828 - RNA, 46 nt, Mus musculus
agggcacuuuucuauaugugugugugugugugugugugugugugug

SEQ ID NO: 109829 - RNA, 80 nt, Mus musculus
guccugggaggugauuucugucuaaucccuaacuccugacacuuuugcugaguaagccguuccccccucccccaccuccc

SEQ ID NO: 109830 - RNA, 46 nt, Mus musculus
cacaggcuacucauaauuuuagguuccuuuugauuauagccccaac

SEQ ID NO: 109831 - RNA, 45 nt, Mus musculus
gacauuuuguugaguuuagauggggcuagcaaaaugacucagugg

SEQ ID NO: 109832 - RNA, 46 nt, Mus musculus
uuucuuaaccuucaucuuuacgccuauccuacauaauaacccccaa

SEQ ID NO: 109833 - RNA, 42 nt, Mus musculus
uguuuuauguguaaacagugccgugcuguugauuuccaaagu

SEQ ID NO: 109834 - RNA, 44 nt, Mus musculus
ccuaggguuccuucuucuguuauccuugaguuguagcugcugga

SEQ ID NO: 109835 - RNA, 45 nt, Mus musculus
ugcuaacagaggagaauuaucagaggacugggagaagcagcagga

SEQ ID NO: 109836 - RNA, 24 nt, Mus musculus
ugggagagaggcagacaggggacu

SEQ ID NO: 109837 - RNA, 46 nt, Mus musculus
cgaaauacgucacagccaguacacaggcauagacacacacacacac

SEQ ID NO: 109838 - RNA, 47 nt, Mus musculus
cuauacagagaaacccugucucaaaaaaccagagagagagagagaga

SEQ ID NO: 109839 - RNA, 46 nt, Mus musculus
gcaggugccuuggaucagcuuuugcuuauuugagggccuuaagaac

SEQ ID NO: 109840 - RNA, 42 nt, Mus musculus
gugaaauaaauggauugagucacaacacagcagaggcccuga

SEQ ID NO: 109841 - RNA, 42 nt, Mus musculus
agggcucauggcuuuguuuucuugaaucacugacaaggagaa

SEQ ID NO: 109842 - RNA, 46 nt, Mus musculus
ccccaaguugaugugacaagaauauuggggggaaaaaacuccagaa

SEQ ID NO: 109843 - RNA, 41 nt, Mus musculus
gcaguggccuucacacccaccaucccacacugcagcauggc

SEQ ID NO: 109844 - RNA, 66 nt, Mus musculus
uauccgcuccauuaaugacccggagcauccacugacacuggaggaauugaacguaguagagcaagu

SEQ ID NO: 109845 - RNA, 54 nt, Mus musculus
ugucaggguagccaggacucuucccauccucgugaucagaggagacuuccucgu

SEQ ID NO: 109846 - RNA, 45 nt, Mus musculus
aagggaacagauaagauauggccacugggaauccaaugagagaag

SEQ ID NO: 109847 - RNA, 46 nt, Mus musculus
gccaauugguauauaacaggcagccaaugagccugucuucacagau

SEQ ID NO: 109848 - RNA, 46 nt, Mus musculus
aaguaagaccugguaauuuuuugggaucccuagcuugcuggcugaa

SEQ ID NO: 109849 - RNA, 44 nt, Mus musculus
ggccugggcaugaagggucauagcugcgguuccgguagccuggg

SEQ ID NO: 109850 - RNA, 46 nt, Mus musculus
acugagcucccaguucagaggaaagccagacaauuaaacagcaguu

SEQ ID NO: 109851 - RNA, 49 nt, Mus musculus
gcagcagcaugucacauaaacuccugagcaggggagaugggagggcgau

SEQ ID NO: 109852 - RNA, 25 nt, Mus musculus
guugacuaaggguuauagacagacg

SEQ ID NO: 109853 - RNA, 44 nt, Mus musculus
ugagcacuccaaggcagggagaggucaagaaguucuggggaaga

SEQ ID NO: 109854 - RNA, 46 nt, Mus musculus
acagccagugaugugggcagacaagcaugcccuaauguguucagaa

SEQ ID NO: 109855 - RNA, 45 nt, Mus musculus
auagcuacaauguacuuauauacauaaaauaaauaguuguuuuaa

SEQ ID NO: 109856 - RNA, 45 nt, Mus musculus
acuuucucucucucucucucucucucucucucucucgugugugug

SEQ ID NO: 109857 - RNA, 46 nt, Mus musculus
ucagagacagcaacaacuacagaaaaagcuuaguuccaggagagag

SEQ ID NO: 109858 - RNA, 44 nt, Mus musculus
gaacaggguuuccagcgggcccucggcucccacccaacuacaga

SEQ ID NO: 109859 - RNA, 62 nt, Mus musculus
ggagcucaaccugcaguacuuccaaaaccaggcggcagauccuccuuuguacgucguccagc

SEQ ID NO: 109860 - RNA, 46 nt, Mus musculus
aggcaucagaucucauuacugguaguugugagccaccaugugguug

SEQ ID NO: 109861 - RNA, 46 nt, Mus musculus
gaauacacuguaccugucuucaacccaccagaagagggcaucagau

SEQ ID NO: 109862 - RNA, 45 nt, Mus musculus
cuguaacauuguuuuuaaagauuacuguaagugaguguuugagug

SEQ ID NO: 109863 - RNA, 42 nt, Mus musculus
gugccaaaggagcuggagucccuccggucccgugagcaguga

SEQ ID NO: 109864 - RNA, 46 nt, Mus musculus
gaggggcgccacccaauggacugugcuagaccgaacgggaugcggg

SEQ ID NO: 109865 - RNA, 45 nt, Mus musculus
gcugcgggguagauaaagcugcagguaaccaggcugguacaggga

SEQ ID NO: 109866 - RNA, 41 nt, Mus musculus
gugaagcuggccauaguggcauauaacuguauuucuagcua

SEQ ID NO: 109867 - RNA, 42 nt, Mus musculus
ugguaaccagagccccacagaaagacugaagucucauucgag

SEQ ID NO: 109868 - RNA, 42 nt, Mus musculus
cauggagcagggcauggcagagugagugucccccaucgccag

SEQ ID NO: 109869 - RNA, 46 nt, Mus musculus
agucuccucaggggaugcagcggagggccccacugcugugugugag

SEQ ID NO: 109870 - RNA, 46 nt, Mus musculus
cggaggagggggacccccagagagugagggcgauagagaugacagg

SEQ ID NO: 109871 - RNA, 49 nt, Mus musculus
gcaguaagaagaaucucuuucaauguggaauaagaaguggaaauagauu

SEQ ID NO: 109872 - RNA, 81 nt, Mus musculus
ggacgggugcucuuucucgaaaaagaaugggaugagucacugugaggaggcagguagcacauguuuuuucggcuuggguga

SEQ ID NO: 109873 - RNA, 46 nt, Mus musculus
gggacgcgguggcuggucaccuuucugaauccggaggagaggcggu

SEQ ID NO: 109874 - RNA, 42 nt, Mus musculus
cuaccugguggcccuguggauccugguggccagcuuagccaa

SEQ ID NO: 109875 - RNA, 45 nt, Mus musculus
ucucccauuuccugcucucuugugggucucccuucuugguuggua

SEQ ID NO: 109876 - RNA, 32 nt, Mus musculus
cgccgcucuccucucaccguuccauccuuaga

SEQ ID NO: 109877 - RNA, 41 nt, Mus musculus
ccuaggcauucugguucugagaaauuuuccugcccuggaga

SEQ ID NO: 109878 - RNA, 46 nt, Mus musculus
gaugggacaugcucagggaagaaggaaaccagagauggggcuggag

SEQ ID NO: 109879 - RNA, 46 nt, Mus musculus
ccuucuuucuuuauugagacugagaguacuauacagcccuggcuag

SEQ ID NO: 109880 - RNA, 84 nt, Mus musculus
ccgagcccucgguauugcuggcgcccucugcuccccuguccccuuccuuuccccucucgccgccccucauccccucaguccaag

SEQ ID NO: 109881 - RNA, 45 nt, Mus musculus
uucccaugccuccccgcagcgcucaccuguccugaccccugccag

SEQ ID NO: 109882 - RNA, 23 nt, Mus musculus
gcucccucauuuuucuauucugg

SEQ ID NO: 109883 - RNA, 42 nt, Mus musculus
aauauacauggaagaaagggccaggaagccagccaaggcgag

SEQ ID NO: 109884 - RNA, 42 nt, Mus musculus
gacacugggauuccuuaguaaggaaagcaaaggugcaggggu

SEQ ID NO: 109885 - RNA, 45 nt, Mus musculus
aaucgguuuucacccuuguccagcugcagugauacuaaccgugga

SEQ ID NO: 109886 - RNA, 46 nt, Mus musculus
gagagucuacgcuauccacggacgaagccucuaugugcaguaccac

SEQ ID NO: 109887 - RNA, 45 nt, Mus musculus
agcugcgagccagaugaacaagugucacucugcacaugacaggua

SEQ ID NO: 109888 - RNA, 42 nt, Mus musculus
agggagccaggcuuucuugcuccaugugacccuggaccccag

SEQ ID NO: 109889 - RNA, 24 nt, Mus musculus
acuggaggcccaggccuggggucc

SEQ ID NO: 109890 - RNA, 73 nt, Mus musculus
cuaaaacggguggugcuguggaccggcugacggacaccaguaaguauacgggcucccacaaagaacgcuuuga

SEQ ID NO: 109891 - RNA, 42 nt, Mus musculus
agggaaccuggcccaucccacccacccccauuucugcugaga

SEQ ID NO: 109892 - RNA, 46 nt, Mus musculus
gaggugcugggcagugguggcgcacgccuuuaaucccagcacuggg

SEQ ID NO: 109893 - RNA, 46 nt, Mus musculus
cugggaugccuaaggguuagcaccuugugucugucuaugcccagag

SEQ ID NO: 109894 - RNA, 46 nt, Mus musculus
gauucuguuccacaucaacagcccccaaauucaucuucccauagac

SEQ ID NO: 109895 - RNA, 44 nt, Mus musculus
guauacauacguccgaagucaaugauuggaauuccaagggcaga

SEQ ID NO: 109896 - RNA, 41 nt, Mus musculus
cagguuuggggugggacacccaugcagcagggacguguggu

SEQ ID NO: 109897 - RNA, 45 nt, Mus musculus
uacuacccaggccguggccuggggcucauguauuucauccaccac

SEQ ID NO: 109898 - RNA, 48 nt, Mus musculus
agacagacagcaggguuuuuaaagagggcaauuuuauugucucagagg

SEQ ID NO: 109899 - RNA, 46 nt, Mus musculus
gagggaaucuugguccauucuugaucaggggagaggugccuaaccc

SEQ ID NO: 109900 - RNA, 91 nt, Mus musculus
ugcacuugggaaccuuaaguuagaaugcuaaaagauggggauguaguugucgaucuuggcgcgauggcgcugggcaaugcacucagcaauc

SEQ ID NO: 109901 - RNA, 44 nt, Mus musculus
gcuaccugcacccucaaaaagcaguuuguauuccuggccgggaa

SEQ ID NO: 109902 - RNA, 46 nt, Mus musculus
auucuugaccuguucauagucaucagcccgcgccagcugagccaag

SEQ ID NO: 109903 - RNA, 41 nt, Mus musculus
agucaguuggcagaguucccccuaguaaggcucaaugggaa

SEQ ID NO: 109904 - RNA, 46 nt, Mus musculus
gccagcccaugucuguugcaccagcugccuacaauucacuugccag

SEQ ID NO: 109905 - RNA, 44 nt, Mus musculus
cagucugcccuuuggguugcccgucugccuaggaaaagcaaugg

SEQ ID NO: 109906 - RNA, 46 nt, Mus musculus
guagcuauaacugugagaagcagacaacaacagggcagacuguuag

SEQ ID NO: 109907 - RNA, 46 nt, Mus musculus
auauuaucagggccacucuggcuccaugggaguugggaguccagag

SEQ ID NO: 109908 - RNA, 42 nt, Mus musculus
agcaccacucacucugcaucuguguagugcccuccuggccug

SEQ ID NO: 109909 - RNA, 46 nt, Mus musculus
guagggacagcaagaaguugcugggcagaaacaagcugaggaugag

SEQ ID NO: 109910 - RNA, 46 nt, Mus musculus
agugggcuggagagccugaaggcuguggguggaggauggucaccug

SEQ ID NO: 109911 - RNA, 44 nt, Mus musculus
uggauggugguagagagaaaggcuauaagccacaaucacccaug

SEQ ID NO: 109912 - RNA, 42 nt, Mus musculus
cucccuccccacaaacuuucuguuccuccuuaccaccccuag

SEQ ID NO: 109913 - RNA, 41 nt, Mus musculus
aagaaagaagaaagaagaaagaagaaagaagaaaggagaaa

SEQ ID NO: 109914 - RNA, 46 nt, Mus musculus
uacucagccagggaacaaugaugcacacuuuuaaucccaacacaua

SEQ ID NO: 109915 - RNA, 45 nt, Mus musculus
acucauuaacucuaaucuagauuucuucuggcaaggccugaggaa

SEQ ID NO: 109916 - RNA, 46 nt, Mus musculus
gggaagucuaaagccuucagaauacagcagcaacaagacaagcaag

SEQ ID NO: 109917 - RNA, 45 nt, Mus musculus
caaagggaacugaagagagucuauacuauggaugaguucugggua

SEQ ID NO: 109918 - RNA, 46 nt, Mus musculus
ucauaucccagccaccacaugguggcucacaaccauccauaaugag

SEQ ID NO: 109919 - RNA, 46 nt, Mus musculus
aacuacaguguacuuacauauaauaaauaaaucuuaaaaaaaaguc

SEQ ID NO: 109920 - RNA, 46 nt, Mus musculus
guaagaaaugccagaagccagaaaaggcaacaguguccaccccuag

SEQ ID NO: 109921 - RNA, 42 nt, Mus musculus
gacucagagaugggaacucaugucucuguccuuuacuaccau

SEQ ID NO: 109922 - RNA, 45 nt, Mus musculus
ucaaaucccagcaacuacaugguggcucacaaccauccguaaaga

SEQ ID NO: 109923 - RNA, 42 nt, Mus musculus
gagaaacccugucucgaaaaaccaagaaagaaagaaagaaac

SEQ ID NO: 109924 - RNA, 45 nt, Mus musculus
cugaaauccgucauguccuagucacacugggugagaagaugacag

SEQ ID NO: 109925 - RNA, 31 nt, Mus musculus; identical to SEQ ID NO: 22720

SEQ ID NO: 109926 - RNA, 53 nt, Mus musculus
aggaggcuuuccagcuguuugaccgaacaggcgauggcaagauccuguacagc

SEQ ID NO: 109927 - RNA, 46 nt, Mus musculus
gacucacccucaggggaaggcaggugugcagcaaauaugcccucca

SEQ ID NO: 109928 - RNA, 42 nt, Mus musculus
guuccucaccacggccuggacgggccgguggucgcaggagau

SEQ ID NO: 109929 - RNA, 45 nt, Mus musculus
aguuccuaauaaagaccaugauuguaguaauguuauccgggugac

SEQ ID NO: 109930 - RNA, 44 nt, Mus musculus
cugucccaaugucuuccagguggcagacucaggccccuggccuc

SEQ ID NO: 109931 - RNA, 45 nt, Mus musculus
cuguuucauucaaguuuuuuaauaaaauaauuucaugcggcagga

SEQ ID NO: 109932 - RNA, 42 nt, Mus musculus
ggagcuggguguagaauugcaggguggagaagugggggccug

SEQ ID NO: 109933 - RNA, 43 nt, Mus musculus
cuuagcuagacacacuagggcuccccgaugauccugguccucc

SEQ ID NO: 109934 - RNA, 41 nt, Mus musculus
cauugaguuuucucugcacaucugaauccugauugcuggga

SEQ ID NO: 109935 - RNA, 45 nt, Mus musculus
uuaccaaccagucaccuguauccggggcugcuccgugggcagcag

SEQ ID NO: 109936 - RNA, 45 nt, Mus musculus
cuaggaucagcucucgaauccagggcuguagggccagcaacccug

SEQ ID NO: 109937 - RNA, 42 nt, Mus musculus
aggugacuugggcauuucaaagcucgggagauggagggguag

SEQ ID NO: 109938 - RNA, 46 nt, Mus musculus
cuggccaucggcucccaaugaccuauguguaucuucuaguguccag

SEQ ID NO: 109939 - RNA, 46 nt, Mus musculus
ucuccaccaguccucuccuuuuacagugaaagaaacagguccagga

SEQ ID NO: 109940 - RNA, 42 nt, Mus musculus
gcuuuuguucugcugguggacacagaaaucaauggcagagcu

SEQ ID NO: 109941 - RNA, 46 nt, Mus musculus
gcccaggaaauauggguuuuggggaaggcuguuuggugggcaaggu

SEQ ID NO: 109942 - RNA, 45 nt, Mus musculus
cuguccccauuugaugccgggcucugggaacaucuaaggguagua

SEQ ID NO: 109943 - RNA, 42 nt, Mus musculus
agccuugagacaagaaugggaucacgugacaggcacccagag

SEQ ID NO: 109944 - RNA, 46 nt, Mus musculus
gcauccaccaagaacaaacagaaccacaguaaauaccccgcaccca

SEQ ID NO: 109945 - RNA, 45 nt, Mus musculus
gcuacccuggcucccccagccucagcccccgacauggccccagua

SEQ ID NO: 109946 - RNA, 47 nt, Mus musculus
guauuguuccacagccacagcuuuugcccgaaugacugaaaccccga

SEQ ID NO: 109947 - RNA, 46 nt, Mus musculus
auuuuugucucaaauuaaaacuuuauugaaaaacugacaccaagau

SEQ ID NO: 109948 - RNA, 46 nt, Mus musculus
agaauggauugggguuccuggaaaaaagugguguuuaguggcacgu

SEQ ID NO: 109949 - RNA, 51 nt, Mus musculus
cgugaaaugagcugacgugagugugggcagugugcugucaagugcuggaaa

SEQ ID NO: 109950 - RNA, 46 nt, Mus musculus
ugggauacugaagguaacagggagggcugucagacagaaaguaaac

SEQ ID NO: 109951 - RNA, 46 nt, Mus musculus
aaagugagaagcaacuucauugucagucucuguauacuaggcaggc

SEQ ID NO: 109952 - RNA, 23 nt, Mus musculus
guaaaauacugguuugaaggcuc

SEQ ID NO: 109953 - RNA, 41 nt, Mus musculus
acucaaacacugagucaguaagaccauuugaaccugugagu

SEQ ID NO: 109954 - RNA, 46 nt, Mus musculus
cagggaaauucagaaugcagauggcuuagcagcugaagaaguaguc

SEQ ID NO: 109955 - RNA, 45 nt, Mus musculus
caggaacuugucugaagcagcugcccaggggcuagggcuagaaga

SEQ ID NO: 109956 - RNA, 57 nt, Mus musculus
ggagagacacagagagacagagagagagacagacagagacagagauacagagagaga

SEQ ID NO: 109957 - RNA, 55 nt, Mus musculus
aacuauauaauaaagagacccugucucagagagagacagagagggagagggagag

SEQ ID NO: 109958 - RNA, 45 nt, Mus musculus
cuggagguaguuuuuauugaaacugcacuauuuaaggcugggugu

SEQ ID NO: 109959 - RNA, 41 nt, Mus musculus
uaggaucucacaauacauccccagguguccagaggcucaga

SEQ ID NO: 109960 - RNA, 45 nt, Mus musculus
uuaauauaucuaaguacacuguagcugucuucagaugcaccagaa

SEQ ID NO: 109961 - RNA, 46 nt, Mus musculus
ccggaacuucaugaagugaccuggacagaauuccugggggagagau

SEQ ID NO: 109962 - RNA, 82 nt, Mus musculus
auagaagagguacagaauugcugagguguaagaggaugacuggaggccagugggacuggguuguacgguuggcaggguccag

SEQ ID NO: 109963 - RNA, 89 nt, Mus musculus
gcgggaugagucaggccaggguugugagaugacacgugguaaggggaggucagauggggaagaaagcuguagguagaauaaagauccug

SEQ ID NO: 109964 - RNA, 42 nt, Mus musculus
guaaagaucaaacuugccccaaggaacucaacgccccuaauc

SEQ ID NO: 109965 - RNA, 41 nt, Mus musculus
ugugacauuuggaauucuggggacuuuucagagggcauaua

SEQ ID NO: 109966 - RNA, 42 nt, Mus musculus
gucagugcucuuacccgcuaagccuccucgccagcccgaaug

SEQ ID NO: 109967 - RNA, 45 nt, Mus musculus
ugguugugagccaccauaugguugcugggauuugaacuuuggacc

SEQ ID NO: 109968 - RNA, 42 nt, Mus musculus
ucuuagaguagaaguagcagcucaaaggcucaggagggacuu

SEQ ID NO: 109969 - RNA, 46 nt, Mus musculus
gcuacagauguacagggagggacucuguguguguguguggugugug

SEQ ID NO: 109970 - RNA, 46 nt, Mus musculus
ccaaaaaaaaaaaauaagccaguugugguagcacaugccgguagga

SEQ ID NO: 109971 - RNA, 56 nt, Mus musculus
aaauugccucuagcaaaucaugcuguaggcaagcauguaggcauuuucuuaaauaa

SEQ ID NO: 109972 - RNA, 45 nt, Mus musculus
cccucuucuggugugucugaagacagcaacaauguacccacauac

SEQ ID NO: 109973 - RNA, 46 nt, Mus musculus
gcuggcucguuuuauaucaauguaauacaacaccuggucaucagaa

SEQ ID NO: 109974 - RNA, 156 nt, Mus musculus
caggauccauauaaaaugucuucauagcuucaagauuuacugugucuuuguugggaccaaaauguggagucauggcugacuugcaaggacuggaggacuugaugauagagcagaggguagucucuugucaccgagaugucagaacaagaugcccug

SEQ ID NO: 109975 - RNA, 68 nt, Mus musculus
guagaguccuggagggggucuuguguggucaaggaucaaguuggaaaaaagacuagugucugagagaa

SEQ ID NO: 109976 - RNA, 73 nt, Mus musculus
cucccaguuagaaggcaagccaggguuugucaggcugagcagagagcaugaauuuagcagaccacuggaaaaa

SEQ ID NO: 109977 - RNA, 42 nt, Mus musculus
cagaguguguguguguuugcauuacaucucauacagggaggu

SEQ ID NO: 109978 - RNA, 42 nt, Mus musculus
gguuacacagggagaccauguuuauuuggaaaaauuggggcc

SEQ ID NO: 109979 - RNA, 46 nt, Mus musculus
aagcaaagacagcaacagaucagccuuguccucagggagcccgugg

SEQ ID NO: 109980 - RNA, 46 nt, Mus musculus
uuaaauuuauaaaaucaugugugauaugugugugugugugugugug

SEQ ID NO: 109981 - RNA, 90 nt, Mus musculus
cuuuucuuuguggccuuuuuucacagauaagggcugagccagugagagacaagagcagguuuucagaaggggaauauuuaaacguagaga

SEQ ID NO: 109982 - RNA, 46 nt, Mus musculus
gagcggagggcacuuuuuuuuguauuguaauuagauagucauagau

SEQ ID NO: 109983 - RNA, 46 nt, Mus musculus
agcacgagacgccgcugccgcgcuccuggagccccaaggacaagua

SEQ ID NO: 109984 - RNA, 42 nt, Mus musculus
gagggcgggcucacaguugagccacgccuccagcccccgccc

SEQ ID NO: 109985 - RNA, 42 nt, Mus musculus
ucaggcguguguguguguguguguguguguguguaugugugu

SEQ ID NO: 109986 - RNA, 33 nt, Mus musculus
cucacagccaccuguuaugagaucugaugcccu

SEQ ID NO: 109987 - RNA, 45 nt, Mus musculus
cuaggcgccgccaagacccccacaaggcuggacugagccccuaug

SEQ ID NO: 109988 - RNA, 45 nt, Mus musculus
cccgagugcugagauuaaaggcauuugccaccacgcccggcgaga

SEQ ID NO: 109989 - RNA, 50 nt, Mus musculus
uccuaggccaguaucuaaucauagguggcuuccuggaggacauuugucgg

SEQ ID NO: 109990 - RNA, 45 nt, Mus musculus
aagugggcauugugcgcuuucaaguccucauagcuauacggauga

SEQ ID NO: 109991 - RNA, 58 nt, Mus musculus
gaauuauccuccagcacacaugacucacucccagcugaacagccacccccgucaccug

SEQ ID NO: 109992 - RNA, 50 nt, Mus musculus
cuucccccuuccuggagccacagccuccgccugcagaaccgagagaagca

SEQ ID NO: 109993 - RNA, 45 nt, Mus musculus
ggccaaggguggaggacuuuuccuauaggggcuggugcguguuag

SEQ ID NO: 109994 - RNA, 46 nt, Mus musculus
ugcaggacaaccaagacuacaaagaggaaacccuaucuuggaagua

SEQ ID NO: 109995 - RNA, 45 nt, Mus musculus
aagcaggcuguguugacugagaaggaauagaccugcuaccgagag

SEQ ID NO: 109996 - RNA, 47 nt, Mus musculus
gguacuuuggucuauuaggguucucuagaggaacauaacuuacagag

SEQ ID NO: 109997 - RNA, 46 nt, Mus musculus
agguaagguuguaaucucuucuagcuuuagggagaagcuaccacuc

SEQ ID NO: 109998 - RNA, 46 nt, Mus musculus
acgucccauccgccagcuugugaaugcuggugcucuuuugcaggau

SEQ ID NO: 109999 - RNA, 46 nt, Mus musculus
agguacuguucccuguucugggguuuauacaguauggucaccagau

SEQ ID NO: 110000 - RNA, 68 nt, Mus musculus
guggcccgguccuccagacgggagagcagucggggaagguacacggugaauuucccucauaggcugag

SEQ ID NO: 110001 - RNA, 44 nt, Mus musculus
ggucagccccacccuuuucuugcucauucuauagccccagaauc

SEQ ID NO: 110002 - RNA, 71 nt, Mus musculus
uacccauagucaguuggcagaucgacucguguucaaggucgugggcgccuggaggaacagacaccccggac

SEQ ID NO: 110003 - RNA, 46 nt, Mus musculus
acgccauacucuaacaggcaggguagccaaacaaagacaagugcua

SEQ ID NO: 110004 - RNA, 45 nt, Mus musculus
ucgguuuucgagacaggguuccucuguguaguccugacuuugggg

SEQ ID NO: 110005 - RNA, 45 nt, Mus musculus
ggaaaggaaaaccgcgucucagaguacagucugagaugcugagau

SEQ ID NO: 110006 - RNA, 46 nt, Mus musculus
ugcuacccuucaucuccuucaucuucacuuccaucagggccaagau

SEQ ID NO: 110007 - RNA, 45 nt, Mus musculus
guuccccccagaaaccugcagaauucgugacuccuuccagcccaa

SEQ ID NO: 110008 - RNA, 46 nt, Mus musculus
gugguucuguggguugguagcagagccauuugcccagcacaggcgg

SEQ ID NO: 110009 - RNA, 45 nt, Mus musculus
ccguggggcuggcacgauggcggcagcggcggcggcaacccagcg

SEQ ID NO: 110010 - RNA, 45 nt, Mus musculus
accgguucuaccgagguagagguuaaguuucgugcacucccagca

SEQ ID NO: 110011 - RNA, 45 nt, Mus musculus
uagcuagagguaaagucccacgaggcauccccucccaccccagaa

SEQ ID NO: 110012 - RNA, 46 nt, Mus musculus
gcucacacaacccaccccagagcuggagucuagucauggauaagau

SEQ ID NO: 110013 - RNA, 45 nt, Mus musculus
auucccagcaaccacaugguggcucacaaucaucugaaaugagau

SEQ ID NO: 110014 - RNA, 42 nt, Mus musculus
ccuggugcccucuucuggccugcaggauacaugcaggcagaa

SEQ ID NO: 110015 - RNA, 46 nt, Mus musculus
uuuggugcacaggugauuagcccaggcagagcccuuucccagaacu

SEQ ID NO: 110016 - RNA, 42 nt, Mus musculus
cugaaggcagaaggaucaggaguguaagguuauauuugacaa

SEQ ID NO: 110017 - RNA, 42 nt, Mus musculus
uauacauaaaauaaauaauucuuuaaaaaaaaaaaaaaccuc

SEQ ID NO: 110018 - RNA, 59 nt, Mus musculus
ugauucaauuuaaacuuacaguuuaaagacagcaugccugaaucuaaaaggcggcagaa

SEQ ID NO: 110019 - RNA, 54 nt, Mus musculus
uauaaucguaaucccagcuuuugggaugcugagguggaaagauuguuggaagau

SEQ ID NO: 110020 - RNA, 46 nt, Mus musculus
aaguacuaagucucuaugaccucaccgaaggccagaggagccagca

SEQ ID NO: 110021 - RNA, 46 nt, Mus musculus
caaucugcucccaaauuggcuugucucccauccuggagggucaccc

SEQ ID NO: 110022 - RNA, 47 nt, Mus musculus
guccugcgccgugaugcuaugcugaauuuucuggaacggaaggcucu

SEQ ID NO: 110023 - RNA, 45 nt, Mus musculus
cuguacgaagggagaaagaacagauucagugaaggggcuaaggaa

SEQ ID NO: 110024 - RNA, 85 nt, Mus musculus
uuguguaugauauuuggagcaucuggaggagugagcuaggauugggaagagggaggaggaaacagcgugacuguggccaggagga

SEQ ID NO: 110025 - RNA, 46 nt, Mus musculus
caaacaucaugcacaacaccguggugacagaagcgcccugcacccg

SEQ ID NO: 110026 - RNA, 46 nt, Mus musculus
cauuacuuaagucuuuccaaggcaugcgcugguacaacacaaacuu

SEQ ID NO: 110027 - RNA, 45 nt, Mus musculus
gcggauugcuggcccagagaccaaccaggagacacuacgggccac

SEQ ID NO: 110028 - RNA, 47 nt, Mus musculus
ccuggaaccacaccuguccugacccgggaagugagaccccugacccu

SEQ ID NO: 110029 - RNA, 46 nt, Mus musculus
uguuuggcuggaaccggucuuccaacagugccacggcugcacccug

SEQ ID NO: 110030 - RNA, 80 nt, Mus musculus
caagugcuauuuauuguauauuuauuguuuggaugucaucauuucagaaaggggaagaggggcacaguaagagggggagc

SEQ ID NO: 110031 - RNA, 46 nt, Mus musculus
cacgaugcccgucugguuuugcugaacaugccuggccccccuaaga

SEQ ID NO: 110032 - RNA, 46 nt, Mus musculus
gagucuguggcaggggccgacaagauccagaugacguggaccagag

SEQ ID NO: 110033 - RNA, 45 nt, Mus musculus
ucucagaugcugcggcagaugagguugaccaaaacugagcgggau

SEQ ID NO: 110034 - RNA, 42 nt, Mus musculus
uuggaagaagugccggaugcgcauuuucaccguggcccagau

SEQ ID NO: 110035 - RNA, 46 nt, Mus musculus
ucacgccagcccuugccucucugaaagcaugaugaauuguuuggag

SEQ ID NO: 110036 - RNA, 45 nt, Mus musculus
cagaugguugugagccaccauaugguugcugggauuugaacccau

SEQ ID NO: 110037 - RNA, 45 nt, Mus musculus
agucuuaagacucaaagaccugcaugaucugaguacugccccaua

SEQ ID NO: 110038 - RNA, 45 nt, Mus musculus
uucuugcucacgugacuuccuccucgcagaggacucacgcgauag

SEQ ID NO: 110039 - RNA, 42 nt, Mus musculus
acggggcaccagcgccggugucccaggucucgcggccugcag

SEQ ID NO: 110040 - RNA, 42 nt, Mus musculus
cgugcggguggcgaggaaagcccgauuuaauuugaggaggag

SEQ ID NO: 110041 - RNA, 46 nt, Mus musculus
cugcaugcauuuguuuucauccugcuguuuuggaacugggccuugg

SEQ ID NO: 110042 - RNA, 46 nt, Mus musculus
gaaauauuaguaagguuauacucuagucuuuuauagaauaacacag

SEQ ID NO: 110043 - RNA, 45 nt, Mus musculus
gccauaugagguucaaguaaccgaggaguaaauuuuauucaggga

SEQ ID NO: 110044 - RNA, 45 nt, Mus musculus
gcuuuuggcaagagagacaacuggagcuauaagauuuaaaaguaa

SEQ ID NO: 110045 - RNA, 42 nt, Mus musculus
uccuucacccuuuaccuggagcaaaccaaagccuggccacac

SEQ ID NO: 110046 - RNA, 46 nt, Mus musculus
uuaaucaaggauauaauaaccuuuuaaaaacauaccaaaaugcuuu

SEQ ID NO: 110047 - RNA, 46 nt, Mus musculus
caggcagaauagauugguuuccacagaguccuacuagagcagggag

SEQ ID NO: 110048 - RNA, 42 nt, Mus musculus
uugaaaauagaagugcaaccuaaaacucaccauagagcccau

SEQ ID NO: 110049 - RNA, 45 nt, Mus musculus
ggcccaugccuuuaaugcuagcacucagaagucagaagcaggcag

SEQ ID NO: 110050 - RNA, 46 nt, Mus musculus
aagaaagcuagcuucaguuucagugagagaacuugucacaaggcag

SEQ ID NO: 110051 - RNA, 46 nt, Mus musculus
ggacagcauggcuaccaaagagacgcugucuuuuaauaagggggau

SEQ ID NO: 110052 - RNA, 45 nt, Mus musculus
acagccgaugauagauauuuacgaccucaugcauuuuaccaggug

SEQ ID NO: 110053 - RNA, 45 nt, Mus musculus
cuauaucaagguccuuucagcaaaaucuugcuggcauaugcgaua

SEQ ID NO: 110054 - RNA, 46 nt, Mus musculus
gaaguauccacacuuuggucuuccuucuucuugaguuuuguguguu

SEQ ID NO: 110055 - RNA, 42 nt, Mus musculus
uagagaaaguacccagggaguugaaggguuuugcagccccau

SEQ ID NO: 110056 - RNA, 46 nt, Mus musculus
gguauuuuaaagcuccgcaacucagauauagaacuucgaaaaggag

SEQ ID NO: 110057 - RNA, 42 nt, Mus musculus
uucuuccagaauccaaaauaauuuuucuugaaaaaggacaag

SEQ ID NO: 110058 - RNA, 46 nt, Mus musculus
ucucuugcuuugauaaaauacccagacauuuagguaacaaaaggag

SEQ ID NO: 110059 - RNA, 46 nt, Mus musculus
ucuagucuugauagugagacuaucuuccuaguguugaaggaaguau

SEQ ID NO: 110060 - RNA, 46 nt, Mus musculus
acggaugguugugagccaccaugugguugcugggauuuuggucuuu

SEQ ID NO: 110061 - RNA, 42 nt, Mus musculus
caaguaggccuccugcuaagguauuuauaguaggggcuggag

SEQ ID NO: 110062 - RNA, 56 nt, Mus musculus
uguuuacuuuuagguugugguuuuuaauuggugguauuugguuggcugauuuuugu

SEQ ID NO: 110063 - RNA, 42 nt, Mus musculus
aguucaccgauuucugggccaucauccccucagcugcagccu

SEQ ID NO: 110064 - RNA, 46 nt, Mus musculus
ccuccagacccagauaguauuagagauugaacccuaggacuugcag

SEQ ID NO: 110065 - RNA, 42 nt, Mus musculus
ggaacaaaugguacauuagaggauaguuuucaaagacacaag

SEQ ID NO: 110066 - RNA, 42 nt, Mus musculus
cacagagaaacccugucuuggggaaaaaaaauacuuggggag

SEQ ID NO: 110067 - RNA, 78 nt, Mus musculus
agagguccuuaguucaauucccagcaaccacauguuggcccacaacuaucuguauugggauacaaugcccucuucugg

SEQ ID NO: 110068 - RNA, 45 nt, Mus musculus
cagccagggcuauaaaauaaagagaccuugucuaaaaggaagaaa

SEQ ID NO: 110069 - RNA, 55 nt, Mus musculus
uucuuggcauauucuggauucuguaaauauaacaauagguuuguaaagucugcuc

SEQ ID NO: 110070 - RNA, 46 nt, Mus musculus
augcuauucuauuuuauaauuuguauccucuuuucaagguacuuag

SEQ ID NO: 110071 - RNA, 46 nt, Mus musculus
guaguaauguagucccagauaguugaacugaacuccuuggcaccuc

SEQ ID NO: 110072 - RNA, 42 nt, Mus musculus
gagaaagcugugcugaauuguuuccuguuguugcugguggag

SEQ ID NO: 110073 - RNA, 41 nt, Mus musculus
agcaguuaccacuuugaugacuaaaucuuaguccacugaga

SEQ ID NO: 110074 - RNA, 46 nt, Mus musculus
acggaggugaugagagacacuccucucccggguccggcgucuccag

SEQ ID NO: 110075 - RNA, 46 nt, Mus musculus
cggacugcucagccugcuucucucccggaacuuaagguccagccag

SEQ ID NO: 110076 - RNA, 46 nt, Mus musculus
caggacuccaguugagaaggcuuaaucuccuguuuacagcccacaa

SEQ ID NO: 110077 - RNA, 45 nt, Mus musculus
augaccuaaaaaccagccuuuccuccacaaggcuuugagacacau

SEQ ID NO: 110078 - RNA, 45 nt, Mus musculus
gaugccuauagcauuagaaaugcuuuccuauuuaaaacagguuag

SEQ ID NO: 110079 - RNA, 45 nt, Mus musculus
gcucaagaugaaaccuuguguuuauagaacggauguuuaggugaa

SEQ ID NO: 110080 - RNA, 46 nt, Mus musculus
ccaggcuccuccucaguuacagugcugacauaauaaacagugacag

SEQ ID NO: 110081 - RNA, 41 nt, Mus musculus
aguucauguagaguugaguggcuggcccuggguaauaggca

SEQ ID NO: 110082 - RNA, 42 nt, Mus musculus
ucuccaccaagcucagcaaaaauaggaccggugagggcauug

SEQ ID NO: 110083 - RNA, 46 nt, Mus musculus
ccagaccccaaagucaucuucgguagcaucuguuucuagucccaag

SEQ ID NO: 110084 - RNA, 46 nt, Mus musculus
uggcggagcaggugcuugggugcugcauauggaauucucugcggag

SEQ ID NO: 110085 - RNA, 42 nt, Mus musculus
uagcaggagggagggacucaggcugcaaagcugguucaucag

SEQ ID NO: 110086 - RNA, 42 nt, Mus musculus
cuaggccaaaugagagcagucgcacauaacccaagcccccau

SEQ ID NO: 110087 - RNA, 41 nt, Mus musculus
aaccuggcaucuguaggucuucucauuaagaacgagaguca

SEQ ID NO: 110088 - RNA, 47 nt, Mus musculus
gugggcagggaaugucaccuggccucaguacagccuagaguaauuag

SEQ ID NO: 110089 - RNA, 51 nt, Mus musculus
ugcaggaaguaagguggcuuggaagauugcuccaggcuggucagcauggaa

SEQ ID NO: 110090 - RNA, 45 nt, Mus musculus
uaagaagacugaggcugagagggaugcaaacuguuugccuaagau

SEQ ID NO: 110091 - RNA, 24 nt, Mus musculus
cugccuguuaucauugacugcugg

SEQ ID NO: 110092 - RNA, 31 nt, Mus musculus
gucuggucuggucuggucagcacuagcuuac

SEQ ID NO: 110093 - RNA, 45 nt, Mus musculus
ccuuaaaaccacaauaaagcaaacugacuuuauugauaaggaaag

SEQ ID NO: 110094 - RNA, 86 nt, Mus musculus
acacuaugguggagagccuugugggcuggggcuacacacggggugaagacguucgaggugcucccuaugauuggcggcgagcccca

SEQ ID NO: 110095 - RNA, 42 nt, Mus musculus
uaaccaaucgacagagcggacccaggacuagggggugcaaag

SEQ ID NO: 110096 - RNA, 71 nt, Mus musculus
gcagaugaaaacgggcccuacuucuuggcccugcgagagaugaucgaggagauguaccagauguauggggg

SEQ ID NO: 110097 - RNA, 45 nt, Mus musculus
ugggcaacguguacaugcucuacuuucugcagcggcagccacaag

SEQ ID NO: 110098 - RNA, 42 nt, Mus musculus
aggcuucuguuuuaaauauccaucucuggggagggggagcag

SEQ ID NO: 110099 - RNA, 44 nt, Mus musculus
ggaucacugggcgagauuaugaaccugacccgaucauuacgaug

SEQ ID NO: 110100 - RNA, 46 nt, Mus musculus
ccgucucaaagcuucccugugaagcccccuuaaaucuuugccucag

SEQ ID NO: 110101 - RNA, 44 nt, Mus musculus
uuccaggagacaacaaucgcauucccgucauugggccacugaag

SEQ ID NO: 110102 - RNA, 42 nt, Mus musculus
ccgggacaucgguuucgaagauggcugguucaugcggcagga

SEQ ID NO: 110103 - RNA, 28 nt, Mus musculus
guauggcacugguguucccacgccaaac

SEQ ID NO: 110104 - RNA, 42 nt, Mus musculus
gugccgucaccaucgccgaagcagauuuuggggucccgauca

SEQ ID NO: 110105 - RNA, 80 nt, Mus musculus
agcguccugcagugccaagccuggcagagccgccaagagcacagaguaucauugcaggagcugccgggaagcgagcacau

SEQ ID NO: 110106 - RNA, 57 nt, Mus musculus
uucuggaaccuugauguccuccgccaggcagggcugcuggauggcuggaccacggag

SEQ ID NO: 110107 - RNA, 47 nt, Mus musculus
agugaguguggacauuugaaggagacugcugcugcugcugcugcuga

SEQ ID NO: 110108 - RNA, 46 nt, Mus musculus
uagaguagaaagaccagagagcuaagaggauugcacgguccaaguu

SEQ ID NO: 110109 - RNA, 42 nt, Mus musculus
gcaggaacucuaccaccucucaacccugugccagcccaagug

SEQ ID NO: 110110 - RNA, 42 nt, Mus musculus
ggcagcugaauggguuuugguuugcaggaaaacaguccagag

SEQ ID NO: 110111 - RNA, 38 nt, Mus musculus
auacaacagccucagcgaggaggaaagaagcugcgagc

SEQ ID NO: 110112 - RNA, 85 nt, Mus musculus
agguaaaugaugaugagcagucagaagauauuuaugaagaugaagaugaugaaaacagugaaaauaacuggcggaaugaguaccc

SEQ ID NO: 110113 - RNA, 42 nt, Mus musculus
ugcugucaccaucuuuagacauaccagaagagggcgucagau

SEQ ID NO: 110114 - RNA, 47 nt, Mus musculus
agcacaaugacgacuauguauaugacauuuacuauauggagauggcc

SEQ ID NO: 110115 - RNA, 45 nt, Mus musculus
aaucccagcaaccacaugguggcucacagccacccauaaugagau

SEQ ID NO: 110116 - RNA, 42 nt, Mus musculus
ggaggcaguaccauguggaucucugaguuccagcccaaaaag

SEQ ID NO: 110117 - RNA, 46 nt, Mus musculus
guauguguguuuucuggagcugcuggaaagguucaaaguuuuuguc

SEQ ID NO: 110118 - RNA, 42 nt, Mus musculus
auaccugcucucacaggaacaaaauuguuagaaacgggggaa

SEQ ID NO: 110119 - RNA, 46 nt, Mus musculus
uugauccuauaaucugacacgauuggcuaauuguugcaaaggggaa

SEQ ID NO: 110120 - RNA, 42 nt, Mus musculus
gcgcgccuguaauccugcuguugggaaguagaaccagaaaga

SEQ ID NO: 110121 - RNA, 47 nt, Mus musculus
gugucugaagacacuacaguguauuuacauauaagaaagaaaggaag

SEQ ID NO: 110122 - RNA, 46 nt, Mus musculus
uauguacaccaacgguugggaaugauuauugggagaauauaugggg

SEQ ID NO: 110123 - RNA, 46 nt, Mus musculus
aucuauuuauuuuacgugugugugugugugugugugugugugugug

SEQ ID NO: 110124 - RNA, 46 nt, Mus musculus
uucauaaaggcgauccuuacuccaaugguacagaccaaggagcuca

SEQ ID NO: 110125 - RNA, 42 nt, Mus musculus
acggcucugaacagacccuucuuggucagcagucccugucuc

SEQ ID NO: 110126 - RNA, 49 nt, Mus musculus
gagaaacccugauaaggagagagagagagagagagagagggagagagag

SEQ ID NO: 110127 - RNA, 42 nt, Mus musculus
ggaaaggcuccaagggauaucuuggaacaucaguccuggcag

SEQ ID NO: 110128 - RNA, 45 nt, Mus musculus
cugggggcgcgcgcgcgcgcgcgcgcacacacacacacacacaca

SEQ ID NO: 110129 - RNA, 39 nt, Mus musculus
agcuguucaauuccgacaggcuuagccucuguccccaag

SEQ ID NO: 110130 - RNA, 42 nt, Mus musculus
gagagggagagauguguguucaugaguaugaguaggggccac

SEQ ID NO: 110131 - RNA, 66 nt, Mus musculus
ugcaaggucaugcguucaaucuccagcauugcagagaggaggggcaggggaugggggagagaugcc

SEQ ID NO: 110132 - RNA, 42 nt, Mus musculus
acuagguacaaggucuuaguacuaggaagguagaggcaggag

SEQ ID NO: 110133 - RNA, 49 nt, Mus musculus
ccagcugcuuuaaugagggcauugaucuuauccuccgugaccgucaccu

SEQ ID NO: 110134 - RNA, 42 nt, Mus musculus
uccucggaaggaccgagcaccuuggcggcagcugaggaaaag

SEQ ID NO: 110135 - RNA, 42 nt, Mus musculus
acagggacccugcucaacccggggacccgggagccggcagcg

SEQ ID NO: 110136 - RNA, 45 nt, Mus musculus
ugcgggugugcguugagaccguucgcggucgaaggaaaguggugu

SEQ ID NO: 110137 - RNA, 42 nt, Mus musculus
gccucucuccaggugccucuccggcaccgggaagguguagac

SEQ ID NO: 110138 - RNA, 41 nt, Mus musculus
gguaagggaaacugaugguguuacucggccgaguggggucg

SEQ ID NO: 110139 - RNA, 124 nt, Mus musculus
agcggcccgacugguuggucuuaacuugcuuuucugagaucugacugguuuuguggagcuuucuuuggguccagaaaggcugcagcccugugguccugagguuggaauggucagggauccuuca

SEQ ID NO: 110140 - RNA, 42 nt, Mus musculus
gccuuucuggacccaaagaaagcuccacaaaaccagucagau

SEQ ID NO: 110141 - RNA, 47 nt, Mus musculus
cagagugaaaugagaccuuuaaaaaaaaaaacaaggaaaaaggaagg

SEQ ID NO: 110142 - RNA, 46 nt, Mus musculus
caccuguguggacuaaauacacccauuucuucuccauucugaagga

SEQ ID NO: 110143 - RNA, 45 nt, Mus musculus
aaagcaaacauggaagccugcuguaggaucaccuuacaccaucag

SEQ ID NO: 110144 - RNA, 45 nt, Mus musculus
uggcaugaguaauuacagaaaguucaggaagccgggggugggaag

SEQ ID NO: 110145 - RNA, 49 nt, Mus musculus
guaaaccgggauuuccauauccaccuggcagagagggcugggcuggagc

SEQ ID NO: 110146 - RNA, 66 nt, Mus musculus
guggagcccugaugacuguccuugaacucagagguccgccuggcucugucuccaaggugcacugcc

SEQ ID NO: 110147 - RNA, 46 nt, Mus musculus
aauuugguccacaggauccacgugguaggaaagaaagaacuuccaa

SEQ ID NO: 110148 - RNA, 46 nt, Mus musculus
cuagggcuacauacuaaacaaggucucaaccuuguuuuaguaagag

SEQ ID NO: 110149 - RNA, 46 nt, Mus musculus
ccuucuguuuccuccuccuccucuuacuaaaacaagguugagaccu

SEQ ID NO: 110150 - RNA, 45 nt, Mus musculus
uccaguggucagugugugugugugugugugugugugugugugugu

SEQ ID NO: 110151 - RNA, 46 nt, Mus musculus
gccucccgagugcugggauuaaaggcaugcgccaccacguccggcc

SEQ ID NO: 110152 - RNA, 46 nt, Mus musculus
ugagcuuucuacaucucucuucuagcuccuuccaagaugcucagac

SEQ ID NO: 110153 - RNA, 41 nt, Mus musculus
gacgcauagggucugcaggggucugcaccaaacgggggaca

SEQ ID NO: 110154 - RNA, 45 nt, Mus musculus
gucuccuaaugcugcccagacucacccuaaauuuccaggcuagau

SEQ ID NO: 110155 - RNA, 42 nt, Mus musculus
ccuauuguucaagcgaaaggauuagcaagagaaggggggaaa

SEQ ID NO: 110156 - RNA, 46 nt, Mus musculus
uccugggcaccugcacuugugcacuuagguauuccuauuguucagg

SEQ ID NO: 110157 - RNA, 46 nt, Mus musculus
cggugagggaacucuguggaguuacguagcuggcaacaauggggag

SEQ ID NO: 110158 - RNA, 24 nt, Mus musculus
uguuaagucugaaacugggagggg

SEQ ID NO: 110159 - RNA, 46 nt, Mus musculus
augggaagcuguucccacagacaaaacuauccaaggccuguuggga

SEQ ID NO: 110160 - RNA, 42 nt, Mus musculus
gggggugaucccccccucacaagauuccagagcaaagggaug

SEQ ID NO: 110161 - RNA, 45 nt, Mus musculus
cguucaaacaucccuuugcucuggaaucuugugagggggggauca

SEQ ID NO: 110162 - RNA, 42 nt, Mus musculus
aucuuguuuguuuguuuguuuguucauucauucugggccuga

SEQ ID NO: 110163 - RNA, 70 nt, Mus musculus
agggcacagccaggacggagccucugagcaaagggcaguguguguagagucagguagguggugggcagca

SEQ ID NO: 110164 - RNA, 45 nt, Mus musculus
guguguguguguguguguguguguacguguguguacgugugugug

SEQ ID NO: 110165 - RNA, 46 nt, Mus musculus
gggaggagaggcagauuaugcagaaucaaucaauagcaaucaauag

SEQ ID NO: 110166 - RNA, 65 nt, Mus musculus
aggacugggcauuuuaacuucacuuauuuuuauagcccugaggguggacaugggaccucuuguag

SEQ ID NO: 110167 - RNA, 42 nt, Mus musculus
uguagcuucgguugaccccaaacucacuauuuuagccaccag

SEQ ID NO: 110168 - RNA, 42 nt, Mus musculus
guguguaugugucugucugucugucugucugccucuuuggau

SEQ ID NO: 110169 - RNA, 44 nt, Mus musculus
uaguuaugcuaugcauuauacaagacagaucuuacccggggagu

SEQ ID NO: 110170 - RNA, 41 nt, Mus musculus
aggugcccagcagagggaauaguaaacacgugacccugagg

SEQ ID NO: 110171 - RNA, 45 nt, Mus musculus
gggauauagugcagagauagaguaccuagcaugugggugguccug

SEQ ID NO: 110172 - RNA, 42 nt, Mus musculus
uugugucagaaacgauccgaggggcauguuugauggggauua

SEQ ID NO: 110173 - RNA, 46 nt, Mus musculus
gagcagcagucaguauuaaagcaaacacuuauucugugugucacag

SEQ ID NO: 110174 - RNA, 45 nt, Mus musculus
gaagaugagguaacauagcaggacccugugucugugugugugugu

SEQ ID NO: 110175 - RNA, 46 nt, Mus musculus
cuuaugaagguccugaguucaaaucccaacaaccacaugauggcuu

SEQ ID NO: 110176 - RNA, 46 nt, Mus musculus
gguguaguggugccugacuuucauugcagcacuugggaggccaacc

SEQ ID NO: 110177 - RNA, 46 nt, Mus musculus
ccagggacaaacagaaucagcuuucucuccuagauugcccgcuuug

SEQ ID NO: 110178 - RNA, 46 nt, Mus musculus
uuguuuuccauccagguuuggagucacaggcuuguaaucauaaaag

SEQ ID NO: 110179 - RNA, 45 nt, Mus musculus
guguguguuccugggagugaagaagauauauauguuugggcagaa

SEQ ID NO: 110180 - RNA, 45 nt, Mus musculus
auagugaggcuaucugggaaagauggaaaacaaaugaaacaucag

SEQ ID NO: 110181 - RNA, 46 nt, Mus musculus
caguggccgagugcugcaggcugcagacugcuagccugggacccag

SEQ ID NO: 110182 - RNA, 46 nt, Mus musculus
aaaaugcuagaccaggcaccagaugugcacagaauacccagagcag

SEQ ID NO: 110183 - RNA, 46 nt, Mus musculus
uuuuggguuugugucugugcacacauaccacguugugcacauggag

SEQ ID NO: 110184 - RNA, 45 nt, Mus musculus
aaauuugucacaaaccugaauuguagggugaauucuuggccagcc

SEQ ID NO: 110185 - RNA, 44 nt, Mus musculus
ucccucaccccugccccccaaauccaauuuaaaugauacaggaa

SEQ ID NO: 110186 - RNA, 45 nt, Mus musculus
acugcaaaagggggugggacuuuuccuguaucauuuaaauuggau

SEQ ID NO: 110187 - RNA, 45 nt, Mus musculus
uaaauaaauaaaucuuuaaaaaacaaacaaacaaacaaacaaaca

SEQ ID NO: 110188 - RNA, 50 nt, Mus musculus
cuauaaaacaaaaacaaauaaaaagguggcugagagauggagagauggcu

SEQ ID NO: 110189 - RNA, 46 nt, Mus musculus
uuccuuugucacacucgaacgucccagaucaaaaagaucuacagau

SEQ ID NO: 110190 - RNA, 41 nt, Mus musculus
caaccaguguuugagcccuacucuugccauuuaugcugugu

SEQ ID NO: 110191 - RNA, 46 nt, Mus musculus
ggacuggguaguuuucaaagcacaccaggacaguaugugcacugua

SEQ ID NO: 110192 - RNA, 25 nt, Mus musculus
gcucauaaggcuacauuaaggacua

SEQ ID NO: 110193 - RNA, 47 nt, Mus musculus
guagagaagcagccuccuuccuaaucaauaagcaaacaagucgugga

SEQ ID NO: 110194 - RNA, 46 nt, Mus musculus
ccauugcugguugcaagccuauguagacuucaauaccuaccagcua

SEQ ID NO: 110195 - RNA, 41 nt, Mus musculus
auauuuuuugagaaagaauccuuacauucuugaggggguga

SEQ ID NO: 110196 - RNA, 42 nt, Mus musculus
gacacuccaucaucacccaggacugcccccccacccccagau

SEQ ID NO: 110197 - RNA, 79 nt, Mus musculus
auguuuuuguugauguuguuuuuugagacagagucucacuaggaguccacucuaggcuccaacuugcucuguagccucu

SEQ ID NO: 110198 - RNA, 45 nt, Mus musculus
gcuacaguguacuuccauauaauaaauaaauaaaucuuaaaaaaa

SEQ ID NO: 110199 - RNA, 42 nt, Mus musculus
acacacagagagagagagagagagagagagagacagacccau

SEQ ID NO: 110200 - RNA, 45 nt, Mus musculus
gcaaggacccucuauagagaggcaaggaaugcaaucaaggagcaa

SEQ ID NO: 110201 - RNA, 42 nt, Mus musculus
cuuaggcaaaguagaaguuccguuguggggagugaugggcaa

SEQ ID NO: 110202 - RNA, 41 nt, Mus musculus
acacacacacacacacacacacacacaccccuuaugcccau

SEQ ID NO: 110203 - RNA, 46 nt, Mus musculus
cuaugacuggagucccgggcgcggacgaggaaacuggucuccagcu

SEQ ID NO: 110204 - RNA, 45 nt, Mus musculus
aagugacgcugaaguccauggggcaccaccaucaccggcaccacc

SEQ ID NO: 110205 - RNA, 54 nt, Mus musculus
uguuggguucuguggcucugguaguauggggugaugaggaagauacuggcccug

SEQ ID NO: 110206 - RNA, 45 nt, Mus musculus
uuccccugugcagacugagugaauuuacacacaggagacaccgag

SEQ ID NO: 110207 - RNA, 55 nt, Mus musculus
uuuuucucuuuuuuggacaggauuucuuauagccacgauggugcccagcucacug

SEQ ID NO: 110208 - RNA, 45 nt, Mus musculus
uuuguggggcucuagggauuaaauacauggguucaugcaugcuag

SEQ ID NO: 110209 - RNA, 52 nt, Mus musculus
uaaaggaugguuuuguguagccaagauuguccccaaacuugaucuauagccc

SEQ ID NO: 110210 - RNA, 45 nt, Mus musculus
agacagaaacgagacugggucaucccucccaucagcugccccgaa

SEQ ID NO: 110211 - RNA, 46 nt, Mus musculus
aacagggacaaagaaacaaagguuuucuacagcaucaccggccaag

SEQ ID NO: 110212 - RNA, 47 nt, Mus musculus
caggcuggcugaaagugacacagccucuggauagagaagccauugcc

SEQ ID NO: 110213 - RNA, 23 nt, Mus musculus
caaguaucaucuagguaagaaau

SEQ ID NO: 110214 - RNA, 88 nt, Mus musculus
augccgugucaucaaauggggaagcgguggaggaucccauggagauagugaucacagugacagaucagaaugacaacaggccagaguu

SEQ ID NO: 110215 - RNA, 46 nt, Mus musculus
cucaugccuccaccucaucccucaggguggcuuucaaagagcaggu

SEQ ID NO: 110216 - RNA, 42 nt, Mus musculus
acaggaaccuccgugaugaaggucucagccaccgaugcagac

SEQ ID NO: 110217 - RNA, 56 nt, Mus musculus
gcugcugaccuucaaggugaaggcuugagcacaacagccaaggcugugaucacugu

SEQ ID NO: 110218 - RNA, 44 nt, Mus musculus
gcccggaucgccacacucaaagugaccgaugaugaugcccccaa

SEQ ID NO: 110219 - RNA, 45 nt, Mus musculus
uaccacguccacagugacaguggcuguggaagggacaagagaccc

SEQ ID NO: 110220 - RNA, 49 nt, Mus musculus
cuguggacgugguagacgugaaugaagcccccaucuuuaugccugcgga

SEQ ID NO: 110221 - RNA, 46 nt, Mus musculus
caaagucuucgggcacuucgacucuccucuccgcaggcauaaagau

SEQ ID NO: 110222 - RNA, 72 nt, Mus musculus
auuuggagggacacugccaacuggcuggagauuaacccagagacuggugccauuuucacgcgcgcugagaug

SEQ ID NO: 110223 - RNA, 39 nt, Mus musculus
ucuucucuguccaucucagcgcgcgugaaaauggcacca

SEQ ID NO: 110224 - RNA, 71 nt, Mus musculus
guuccucuggcagaacugcauguuucgagguucugggaugggagcguugucauugacgucuaacaggacca

SEQ ID NO: 110225 - RNA, 65 nt, Mus musculus
ugcaguucugccagaggaacccacagccucauaucaucaccaucuuggauccagaccuucccccc

SEQ ID NO: 110226 - RNA, 54 nt, Mus musculus
ugcgucauuauacucaaugguccaguugacgcuggccccauggguuagcucagc

SEQ ID NO: 110227 - RNA, 44 nt, Mus musculus
auggagggcugagugagcagcggauggugcccauggcugaaaag

SEQ ID NO: 110228 - RNA, 46 nt, Mus musculus
accuguccugggcuugguaaaaugccaugaggauuucaaugaucaa

SEQ ID NO: 110229 - RNA, 43 nt, Mus musculus
acauugucccggguaucaucaucugguggcagcaggggcucuu

SEQ ID NO: 110230 - RNA, 48 nt, Mus musculus
acaauguguauuacuaugaugaagaaggagguggagaagaagaccagg

SEQ ID NO: 110231 - RNA, 36 nt, Mus musculus
cucacaacaucuguaaaucagugagggccuuuccca

SEQ ID NO: 110232 - RNA, 76 nt, Mus musculus
ggacuuugauuugagccagcugcacaggggccuggaugcccgaccggaagugacucgaaaugauguggcucccacc

SEQ ID NO: 110233 - RNA, 44 nt, Mus musculus
guaaaugccgagcaggcaugguggccuguuuauucuaguguuca

SEQ ID NO: 110234 - RNA, 46 nt, Mus musculus
accaaccaaccaaacagaaaaaugucaagccuuggccaugccuuua

SEQ ID NO: 110235 - RNA, 45 nt, Mus musculus
uaaucgaacaccaacagagagucguaagggggugccguggggucg

SEQ ID NO: 110236 - RNA, 46 nt, Mus musculus
uacgauuaucugaacgaguggggcaaccgauucaagaagcuggcgg

SEQ ID NO: 110237 - RNA, 46 nt, Mus musculus
augcagaauaauuauaucaguggucuuucagcuccuucccugagug

SEQ ID NO: 110238 - RNA, 46 nt, Mus musculus
gauuucaacaaucagugaaaaccauccuaacacagacaguccagua

SEQ ID NO: 110239 - RNA, 44 nt, Mus musculus
ugauuguugaaaucuuuuuuuauuuuuuauuuuuacagugcuga

SEQ ID NO: 110240 - RNA, 87 nt, Mus musculus
uguuucuguuuuuguucuuuugagcuaugaucugccccagacacaacagccccaagccccucacaccucacuaauuuuuuacauugu

SEQ ID NO: 110241 - RNA, 98 nt, Mus musculus
guacuugcccucaauuaccauguuugcuguauucuaauagucacucauguuccugaauucuguugcccugcccaggugauauucuaggaugcagaaau

SEQ ID NO: 110242 - RNA, 98 nt, Mus musculus
gccugggcccuuuuauggugagagacagguaucuuggugugggugcaacugcgcuggauaguguguguguucccaagaucuuucgugguauucccucu

SEQ ID NO: 110243 - RNA, 101 nt, Mus musculus
ccaccuccagagaacucauuuacaguggcauuccuuguucggcuaugugucuggggcagaacaaaaaaaagggaccacuaugcaugcugcacacgucucag

SEQ ID NO: 110244 - RNA, 46 nt, Mus musculus
uguucucugagagagacuggagugccaccaccaaagacagaggaga

SEQ ID NO: 110245 - RNA, 42 nt, Mus musculus
guuucucuccuuuucucuccucugucuuuggugguggcacuc

SEQ ID NO: 110246 - RNA, 47 nt, Mus musculus
gcaccccuccaaugccugcucuugaugguagcuacagaaaaugcugg

SEQ ID NO: 110247 - RNA, 105 nt, Mus musculus
cccugucucugcaaaccaaaagagaaaacugagaauauuacaaauugugcauuuucucaggaagcaggaagagaacauucuaacgggaaaaaggagacaagaccu

SEQ ID NO: 110248 - RNA, 65 nt, Mus musculus
agaacuguugauuucucuguaguuuaaucauguaauguugcuagagugaccuuuguauguaguuu

SEQ ID NO: 110249 - RNA, 45 nt, Mus musculus
cuauuggguugguuuaguuuugauuuguuuuuucccccaguuuug

SEQ ID NO: 110250 - RNA, 27 nt, Mus musculus
gacauggugccucuaaucccagcacuc

SEQ ID NO: 110251 - RNA, 50 nt, Mus musculus
aucacugucuguuuggccacggaaaugggauaaaaucacagggagucgug

SEQ ID NO: 110252 - RNA, 45 nt, Mus musculus
ucaauccuggcaaaccuaaccccaggacuccagaagccgccccug

SEQ ID NO: 110253 - RNA, 46 nt, Mus musculus
gcaggucugugccagcugggauucugcccaaccaaaagaaaaccac

SEQ ID NO: 110254 - RNA, 46 nt, Mus musculus
cccucuagucagagauacuuacugcucauccagucuuaggagcccu

SEQ ID NO: 110255 - RNA, 44 nt, Mus musculus
agauugaacccagguucuuguacaugcuagguaaauagucugug

SEQ ID NO: 110256 - RNA, 42 nt, Mus musculus
gccacagcugccgacuggaggaagugugacuugauugcaaag

SEQ ID NO: 110257 - RNA, 42 nt, Mus musculus
ugucugugcaccacaugcaugcagugccugagaaggccagaa

SEQ ID NO: 110258 - RNA, 45 nt, Mus musculus
uugccucauaaccaguacuuccaggauuugaaugaauaggggcua

SEQ ID NO: 110259 - RNA, 46 nt, Mus musculus
agacgccuguaaucccuaugcucaggaggaucauuguaaagccaaa

SEQ ID NO: 110260 - RNA, 42 nt, Mus musculus
gucacauguccucuguuguuccacugugugccuuaccccaug

SEQ ID NO: 110261 - RNA, 42 nt, Mus musculus
agugauugcucagaacaaaacaagaccagagagagggcucag

SEQ ID NO: 110262 - RNA, 42 nt, Mus musculus
ugcccagaaaugugggucuauccucuguuguaccgcagcccu

SEQ ID NO: 110263 - RNA, 45 nt, Mus musculus
gcugucuucagacacuccagaagagggagucagaucuugugaucg

SEQ ID NO: 110264 - RNA, 46 nt, Mus musculus
caguuuagagccgcuacgcacgguggcaucgugauuaccgccaaag

SEQ ID NO: 110265 - RNA, 44 nt, Mus musculus
ugugugugugugugguguguguguauguguguguguguggugug

SEQ ID NO: 110266 - RNA, 45 nt, Mus musculus
uggucucuaaaaggacuuuggcuaaguaauaucacugagggcuca

SEQ ID NO: 110267 - RNA, 46 nt, Mus musculus
caaagaacuagcaugaaauccguauacucuugaauuacaguugggg

SEQ ID NO: 110268 - RNA, 45 nt, Mus musculus
uaguauaugcaaucauaccuggcuuuuucuuuugugugugugcag

SEQ ID NO: 110269 - RNA, 46 nt, Mus musculus
guagaaaugguucuuccugguguuuuucuuuuuuugacucugugug

SEQ ID NO: 110270 - RNA, 45 nt, Mus musculus
cuggaaaucauaggucagcaucagcagggcagaugugugugcuug

SEQ ID NO: 110271 - RNA, 42 nt, Mus musculus
gugacgugcuugugaugcaaagggggguaguacagacgucag

SEQ ID NO: 110272 - RNA, 77 nt, Mus musculus
gcacacacagaaugaccauuuaaaaauaugauagaauugagucaaaucccuccaaagaagagggacgggaacggagg

SEQ ID NO: 110273 - RNA, 46 nt, Mus musculus
agaugggauuuaacuagaccugaagaggaguaugugugugaguggg

SEQ ID NO: 110274 - RNA, 41 nt, Mus musculus
agggugacuggcuaauugggugacacauuaagcaaggagac

SEQ ID NO: 110275 - RNA, 42 nt, Mus musculus
aacacauacccugacccugucauccaagaacucgccgccgau

SEQ ID NO: 110276 - RNA, 46 nt, Mus musculus
uuggauuauccuccaggaauuuaaauuguugaaaagucagauuaag

SEQ ID NO: 110277 - RNA, 46 nt, Mus musculus
ucaauucccaguacccacaugguggcucacaaccaucuguaauggg

SEQ ID NO: 110278 - RNA, 46 nt, Mus musculus
acauaagcauguucgguuacacuuacauuuuuauuuuguacggcag

SEQ ID NO: 110279 - RNA, 46 nt, Mus musculus
gcucggaggacagauuauaaggagucaguuccugggacggguucag

SEQ ID NO: 110280 - RNA, 41 nt, Mus musculus
uaaucagucaguagcuaauuuggugaugaaaaacagggcag

SEQ ID NO: 110281 - RNA, 46 nt, Mus musculus
uuccaugcugaggguaguggcacaaaccuuuaauucuagcacccag

SEQ ID NO: 110282 - RNA, 46 nt, Mus musculus
aggcaucuuugugaguuucuggucuacauagugaguuugaggccag

SEQ ID NO: 110283 - RNA, 42 nt, Mus musculus
guaggacuuuaaggacaguuuuguuguucaguaaugaaugug

SEQ ID NO: 110284 - RNA, 46 nt, Mus musculus
ccaggcaguggcgcacaccuuuaaucccagcacuuagaaggcagag

SEQ ID NO: 110285 - RNA, 45 nt, Mus musculus
uucuccauuuauguccuugaaacaggaagauuucuuucugcucug

SEQ ID NO: 110286 - RNA, 42 nt, Mus musculus
uggcccaguacaggggaacgccagggccaaagugggaguggg

SEQ ID NO: 110287 - RNA, 45 nt, Mus musculus
cggaggguugugagccaccaugugguugcugggauuugaacucug

SEQ ID NO: 110288 - RNA, 46 nt, Mus musculus
auaaauuauuuuuucaucaguugauaaacagcugaguuguuuguau

SEQ ID NO: 110289 - RNA, 41 nt, Mus musculus
guugugccugugugugugugugugugugugugagagagaga

SEQ ID NO: 110290 - RNA, 46 nt, Mus musculus
gucagucaaaaaccaauauucagauuuauaucagagaacuuagcag

SEQ ID NO: 110291 - RNA, 46 nt, Mus musculus
agugccugucaaucauagcaacccugcagguuucagaaugagggaa

SEQ ID NO: 110292 - RNA, 42 nt, Mus musculus
ugcucagcccucccagcugcuucugaaggucuguaggauuag

SEQ ID NO: 110293 - RNA, 44 nt, Mus musculus
auccauagauaucaaagaagaguagugguuccuagggccuggga

SEQ ID NO: 110294 - RNA, 45 nt, Mus musculus
auagaggagagaguaggcaguggguugucagggagcaugcugggu

SEQ ID NO: 110295 - RNA, 47 nt, Mus musculus
auuucaugguucccagaauuuccuucaaaucucucaccuccuguucc

SEQ ID NO: 110296 - RNA, 42 nt, Mus musculus
aguuacaggugguugugagcugccauauuuaugugugcugag

SEQ ID NO: 110297 - RNA, 41 nt, Mus musculus
gccgucucugccuuucaggacacuaucccauacaccaugag

SEQ ID NO: 110298 - RNA, 42 nt, Mus musculus
gucucucucucugucucucugucucucugucucuuucuuccu

SEQ ID NO: 110299 - RNA, 48 nt, Mus musculus
uuuaauuuauuuuuuauguauauuuuugaaugccucuaugugugugug

SEQ ID NO: 110300 - RNA, 46 nt, Mus musculus
cacuguguaguacaggcugaccuagaguucaccauguagcccaagc

SEQ ID NO: 110301 - RNA, 42 nt, Mus musculus
agauuccacaaguacugugggugguuguucucugcccaggaa

SEQ ID NO: 110302 - RNA, 66 nt, Mus musculus
uggaccacugauucccaaaggaaucccaagguagugucaagagacauagagagacacagcuauaug

SEQ ID NO: 110303 - RNA, 47 nt, Mus musculus
gcuaaagacuggagaaagagaaaauagaaauaaaugcuagcacgaga

SEQ ID NO: 110304 - RNA, 46 nt, Mus musculus
auccacaggcucgcugagugugggccccaaugagagucggccgcag

SEQ ID NO: 110305 - RNA, 85 nt, Mus musculus
cucuuucuuaguaaacaauucauuuaccuuuucuuuaagccacagacauauuuccuaagcgagaauauucccugauuccacccug

SEQ ID NO: 110306 - RNA, 46 nt, Mus musculus
cucugucuauguacugaaggcucguucuagcagacgaggggaucag

SEQ ID NO: 110307 - RNA, 49 nt, Mus musculus
auccugucucaaaaagggaagacccugucucaagaacaaagaaagagca

SEQ ID NO: 110308 - RNA, 45 nt, Mus musculus
auauuguuaaggagacaagaauaaaacagugaauguuugcccgug

SEQ ID NO: 110309 - RNA, 46 nt, Mus musculus
gagcagacucagcugaagggagaacugcauaugacagaacuggagg

SEQ ID NO: 110310 - RNA, 45 nt, Mus musculus
acugaaugaaaagagaaaggggggagauaagaugaaauucugcau

SEQ ID NO: 110311 - RNA, 46 nt, Mus musculus
aacacugcuuagcugcugauuuuuuguuuuguuuuguuuuuaggag

SEQ ID NO: 110312 - RNA, 45 nt, Mus musculus
acgcacaacggcaagucaccuggaaguuacaccuacugagauaag

SEQ ID NO: 110313 - RNA, 67 nt, Mus musculus
acacaaaugacauggacaagcaaaguuuuccguuaagugacaucugagcaaagauguaagggaagag

SEQ ID NO: 110314 - RNA, 46 nt, Mus musculus
agggcuugcgucaucuuugggcuuuuccuuugugugagaugagcag

SEQ ID NO: 110315 - RNA, 48 nt, Mus musculus
gcgagcacaaagcugggacccugugugaagucauacugaugagugcua

SEQ ID NO: 110316 - RNA, 45 nt, Mus musculus
gauaagugcuaggaagaggagacacagucauacugaugagugcua

SEQ ID NO: 110317 - RNA, 45 nt, Mus musculus
gaugagugcuaggaagaggagacacagucauacugaugagugcua

SEQ ID NO: 110318 - RNA, 45 nt, Mus musculus; identical to SEQ ID NO: 110316

SEQ ID NO: 110319 - RNA, 45 nt, Mus musculus; identical to SEQ ID NO: 110316

SEQ ID NO: 110320 - RNA, 41 nt, Mus musculus
agaguucaaaguaucuaauuaaucagugauggcagagagau

SEQ ID NO: 110321 - RNA, 52 nt, Mus musculus
aagagagaaaggaagagggagugaaagaaagggagaggagaagggggagggu

SEQ ID NO: 110322 - RNA, 42 nt, Mus musculus
uggaccuguacaagaagacuggauaucaggacaacggaagga

SEQ ID NO: 110323 - RNA, 44 nt, Mus musculus
ugcucauggaugugaagcccagaaccuguggugauggcaucugg

SEQ ID NO: 110324 - RNA, 46 nt, Mus musculus
cauaggggggaagaugggucucuucuuaacuuuguuuuagcuuuag

SEQ ID NO: 110325 - RNA, 55 nt, Mus musculus
gcugccugcuuuacaaaacaaaacaaaacaacccagagaauccggagaaauggcc

SEQ ID NO: 110326 - RNA, 42 nt, Mus musculus
uuucucuuuguagcccuggcuguccuggaacucacucgguag

SEQ ID NO: 110327 - RNA, 46 nt, Mus musculus
augagugggguagcuacagauacagacagacucagguaagugcuuu

SEQ ID NO: 110328 - RNA, 25 nt, Mus musculus
cccaggagaaggacagaggagcugu

SEQ ID NO: 110329 - RNA, 42 nt, Mus musculus
aaacccuauauggaaagagagaaaaagagagaaggggcugau

SEQ ID NO: 110330 - RNA, 46 nt, Mus musculus
gcaucuugggcagccucuuaacacauugacauugaaguaaugguag

SEQ ID NO: 110331 - RNA, 45 nt, Mus musculus
acacacguugaguuucuuguugauacaucauuguuaagucgucag

SEQ ID NO: 110332 - RNA, 46 nt, Mus musculus
aacaaaaaacaaacaaacaaaaaguuuuucauggggguucagggag

SEQ ID NO: 110333 - RNA, 45 nt, Mus musculus
cauguauuaucucaugcagaggacccagguucaauucccagcacc

SEQ ID NO: 110334 - RNA, 64 nt, Mus musculus
cagguauaggguauguguuguauguguguguagauggcagguguuggggguuauagauggggug

SEQ ID NO: 110335 - RNA, 36 nt, Mus musculus
ucagaggaagucccaugauauggaggaggauuggag

SEQ ID NO: 110336 - RNA, 46 nt, Mus musculus
ggucauuucugcaauucacuauacccaaaguauaaucugcccucug

SEQ ID NO: 110337 - RNA, 46 nt, Mus musculus
ccugaugacgucgccaagcugcaugcccagcuggcccuggaggagc

SEQ ID NO: 110338 - RNA, 46 nt, Mus musculus
gugaugagggacaggcagagcuaucaucugggugugcagcuguggg

SEQ ID NO: 110339 - RNA, 28 nt, Mus musculus
agcagcauugcucagccuacaugaggcc

SEQ ID NO: 110340 - RNA, 41 nt, Mus musculus
uuaaaguugcaggaagaaugaguuagaagggaggauggcga

SEQ ID NO: 110341 - RNA, 42 nt, Mus musculus
ucacagcugggcagugguggcgcacuugggaggcagaggcac

SEQ ID NO: 110342 - RNA, 41 nt, Mus musculus
aaggugggaaagagagcaaaagaaagagaaaagguggggga

SEQ ID NO: 110343 - RNA, 45 nt, Mus musculus
acuguucucaacauuaucuuucaagcuccuacacaacaucccaca

SEQ ID NO: 110344 - RNA, 45 nt, Mus musculus
agagaaacccugucuugaaaaccaaaaaacaaaacaaacaaacaa

SEQ ID NO: 110345 - RNA, 45 nt, Mus musculus
ccacagccacaauaugaaucuuaaagacaggccaaccugagccag

SEQ ID NO: 110346 - RNA, 77 nt, Mus musculus
caaagucaucucugcuucagaaugaguucaaggccagugucggcugcaugggacccuguaacagaaugagcgagggg

SEQ ID NO: 110347 - RNA, 45 nt, Mus musculus
aaacauggcugguaguguccaggcagacuuggugcuggaggagcu

SEQ ID NO: 110348 - RNA, 44 nt, Mus musculus
cacagucagccaguacucuugaggaucugugucuccagcccccu

SEQ ID NO: 110349 - RNA, 32 nt, Mus musculus
ugcccugacuuuucucagugacagagugacag

SEQ ID NO: 110350 - RNA, 46 nt, Mus musculus
caucaaaggcaggaguugcaacuuuagccaggcaagguguccccga

SEQ ID NO: 110351 - RNA, 46 nt, Mus musculus
ccuuuuuuccccuuucucuuucccuuccuuuccccuuuccuuucuc

SEQ ID NO: 110352 - RNA, 45 nt, Mus musculus
cuuguuuuccuugaucuaaaauguugcauauuacaacucugggag

SEQ ID NO: 110353 - RNA, 45 nt, Mus musculus
uuaucuauuuaucguggauguguauaucauuguguagaggucaga

SEQ ID NO: 110354 - RNA, 41 nt, Mus musculus
gauggggaccuaagaggucgggacgugggaaagaaaggugg

SEQ ID NO: 110355 - RNA, 24 nt, Mus musculus
ccgcgggcuccgggagcccuccca

SEQ ID NO: 110356 - RNA, 46 nt, Mus musculus
uccuccuccuugccgguucagagagguccaagggugccuaggagag

SEQ ID NO: 110357 - RNA, 42 nt, Mus musculus
uagcaucccucuuggggacauggacaguaagucuuugggcaa

SEQ ID NO: 110358 - RNA, 46 nt, Mus musculus
aacagguuccccauaacaacagcagcaagagguaggcaacaccaac

SEQ ID NO: 110359 - RNA, 46 nt, Mus musculus
uccugggaacuauugagaacccagaagugugcuaaaauaagugcua

SEQ ID NO: 110360 - RNA, 46 nt, Mus musculus
agcucauagaauauauccuccuagcccagcugaacaugacaaggag

SEQ ID NO: 110361 - RNA, 41 nt, Mus musculus
agguucuuugauugggaggaccagugaggagggagcuggcu

SEQ ID NO: 110362 - RNA, 42 nt, Mus musculus
cuccagguggaugguuuucccauacaggauaugauggcccac

SEQ ID NO: 110363 - RNA, 42 nt, Mus musculus
uguguguguguguguguguguguguguguguaucucagggcu

SEQ ID NO: 110364 - RNA, 81 nt, Mus musculus
uccacccgacucccucgcucccuuccuuccguccuugcccaguucccgguccccaagcgccccuggcuggcggcgggcuag

SEQ ID NO: 110365 - RNA, 45 nt, Mus musculus
guaggugaguucggggagaacuccgggggcagcuaaaacccacug

SEQ ID NO: 110366 - RNA, 89 nt, Mus musculus
ggacguacaaguuccacucccaguaggugugugucagguagcugcuagaucaggcaggcuggaagagaccaccaaguucugucgcugcc

SEQ ID NO: 110367 - RNA, 46 nt, Mus musculus
uaaucagucaaacagauuggcuguuucacgaacagauggcacggug

SEQ ID NO: 110368 - RNA, 46 nt, Mus musculus
cuggaucuuuuggccacuacaagaaagaaagaaaaaaauuguugag

SEQ ID NO: 110369 - RNA, 46 nt, Mus musculus
gcuggacugaacggagaaauccuugaguaugaccuacaggcacuaa

SEQ ID NO: 110370 - RNA, 81 nt, Mus musculus
uugguugugaagauggcuccgugaaacuauuugaagucaccccagaaaaaauccaguuugcaagaaauuuugaucggcaaa

SEQ ID NO: 110371 - RNA, 46 nt, Mus musculus
acccugggcugggccccucccacguuaauuaacaaucaagaaagug

SEQ ID NO: 110372 - RNA, 47 nt, Mus musculus
ugagggucucuccaaaaugacucuggcuuugucaaguugacauagaa

SEQ ID NO: 110373 - RNA, 46 nt, Mus musculus
acuaggcaaccuuuaacucccguccuccggccuccugaaugcugag

SEQ ID NO: 110374 - RNA, 46 nt, Mus musculus
guuguuuauuuggaugucaccuuuuuugcuguuuucuuacuccuaa

SEQ ID NO: 110375 - RNA, 45 nt, Mus musculus
cgucgcagcugguuccuuagacuacauuagcguguuugaugucaa

SEQ ID NO: 110376 - RNA, 46 nt, Mus musculus
cagugccugacuugugugauucuuuguccuuauuacacaugcccac

SEQ ID NO: 110377 - RNA, 67 nt, Mus musculus
ucaguucccaacgcuuuuuauguaagaaagucuucucuggagauagaguuuaguuaauauccggcag

SEQ ID NO: 110378 - RNA, 42 nt, Mus musculus
gauguguacaugcagggugugauguguacaugcaggguguga

SEQ ID NO: 110379 - RNA, 45 nt, Mus musculus
cacacucaugacgugcgugcuguggcccacagcccaacagcccug

SEQ ID NO: 110380 - RNA, 46 nt, Mus musculus
uaaucuuuaccagugaacuacuucuguucuguauauauuccacgag

SEQ ID NO: 110381 - RNA, 50 nt, Mus musculus
uucgagacugugucucaguaaguagacuagauuggcuuugaacucacaga

SEQ ID NO: 110382 - RNA, 25 nt, Mus musculus
augcuaagauguugaaucggggaaa

SEQ ID NO: 110383 - RNA, 45 nt, Mus musculus
ugcuuuuguuuuuuuaaaacugggaaguauuuuaaaaagaggggg

SEQ ID NO: 110384 - RNA, 41 nt, Mus musculus
ucgcacccugcagauacacucacuccuauguuugcagguua

SEQ ID NO: 110385 - RNA, 46 nt, Mus musculus
auuugggaccagagaaguuucaucaugcuugcuuuuguuagcagag

SEQ ID NO: 110386 - RNA, 75 nt, Mus musculus
cgguccuggugcugguaacccccaguacuuuaccuaguaaccccaguacuuuaccuaguaaccccaguacuuuac

SEQ ID NO: 110387 - RNA, 127 nt, Mus musculus
cuaguaaucccaguacuuuaccuaguaacccccaguacuuuaccuaguaaccccaguacuuuaccuaguaaucccaguacuuuaccuaguaaucccaguacuuuaccuaguaaucccaguacuuuac

SEQ ID NO: 110388 - RNA, 113 nt, Mus musculus
cuaguaaucccaguacuuuaccuaguaaucccaguacuuuaccuaguaaucccaguacuuuaccuaguaaucccaguacuuuaccuaguaacccccaguacuuuaccuaguaa

SEQ ID NO: 110389 - RNA, 46 nt, Mus musculus
ccguacuuuaccuaguaacccccaguacuuugccuaguaaccccuu

SEQ ID NO: 110390 - RNA, 45 nt, Mus musculus
cuccaaagggauacucccaucacacacaucagcuuucaucccaag

SEQ ID NO: 110391 - RNA, 45 nt, Mus musculus
ugaauaacauggugauaauggugcaugccuuuauccuagcgcuca

SEQ ID NO: 110392 - RNA, 45 nt, Mus musculus
uagggauauuguucagagugcuugcucuugugugugugugugugu

SEQ ID NO: 110393 - RNA, 46 nt, Mus musculus
gaucuuuuggaugaaaggacacuuguggcaguagagcgaccccugg

SEQ ID NO: 110394 - RNA, 46 nt, Mus musculus
ugucuauccuguuguuuuguuuguuuguuuguuuguuuuuucccaa

SEQ ID NO: 110395 - RNA, 46 nt, Mus musculus
cagggaggcagaggcagaucucaaggccagccagguuuacagugag

SEQ ID NO: 110396 - RNA, 46 nt, Mus musculus
ucacuugguaguggauccaauuaacuuagaaucuuuuauugcccag

SEQ ID NO: 110397 - RNA, 46 nt, Mus musculus
aaaauaaacuuugcugucuauuuaaaagaauaaaagggcuggagaa

SEQ ID NO: 110398 - RNA, 46 nt, Mus musculus
cagggagggauuaaacaaguuugaaaagcugaccucacagguaaua

SEQ ID NO: 110399 - RNA, 45 nt, Mus musculus
uugcaguccccggagccccaauaaucccucuuccuagugccagau

SEQ ID NO: 110400 - RNA, 45 nt, Mus musculus
agaaaaaaaauagguuaugcuuuguaagacuucagaucuggcacu

SEQ ID NO: 110401 - RNA, 46 nt, Mus musculus
uuaaaauuucucaaaucuucuggcuaccaaaucaaagacccaugau

SEQ ID NO: 110402 - RNA, 50 nt, Mus musculus
gggucagcugacuggaccugacugugaggggagcaggagcugugcagaga

SEQ ID NO: 110403 - RNA, 45 nt, Mus musculus
uggaaccaaguaagacuuuaugaaggaagggacuuuagccagagc

SEQ ID NO: 110404 - RNA, 46 nt, Mus musculus
agccaggcuggccucaaacucagagauccacccaccucugccuccu

SEQ ID NO: 110405 - RNA, 46 nt, Mus musculus
ucaaaucccagcaaccacauggugacucacaaccaucccuaaugaa

SEQ ID NO: 110406 - RNA, 42 nt, Mus musculus
aauaugguugagccucccuucccagauaucagcuuuaggcag

SEQ ID NO: 110407 - RNA, 46 nt, Mus musculus
aaggccaaggagagcauucgagcaaagugcaugcaguaccuagaca

SEQ ID NO: 110408 - RNA, 46 nt, Mus musculus
acgaaacaaagagaaacauggcaagaagccagucaaagagaaccag

SEQ ID NO: 110409 - RNA, 46 nt, Mus musculus; identical to SEQ ID NO: 47560

SEQ ID NO: 110410 - RNA, 41 nt, Mus musculus
cuccaaugguaaagaaagcuaguucaaaucugccucggguu

SEQ ID NO: 110411 - RNA, 44 nt, Mus musculus
gcagaaaacagggucugacuucccagaaugaagacagauugaga

SEQ ID NO: 110412 - RNA, 46 nt, Mus musculus
uggagaagccgaacauacgguggaaugauguagcuggacuggaggg

SEQ ID NO: 110413 - RNA, 53 nt, Mus musculus
acuucuugagacacuguccugauacgcagauguaugcaaacuuggaaaagacg

SEQ ID NO: 110414 - RNA, 46 nt, Mus musculus
agauggaacauuuggggcuacaggaaaaucuggaggccagcagcug

SEQ ID NO: 110415 - RNA, 45 nt, Mus musculus
cugagcuguggaccaccaguucacauagguguaguuagacugcag

SEQ ID NO: 110416 - RNA, 24 nt, Mus musculus
agagaccacgauggcaaagucauu

SEQ ID NO: 110417 - RNA, 42 nt, Mus musculus
ccuucucgccacugccgcuggccuccggggucgccaugggau

SEQ ID NO: 110418 - RNA, 24 nt, Mus musculus
uuuaaaaggaggaaaaagccgggc

SEQ ID NO: 110419 - RNA, 46 nt, Mus musculus
ugggccaccuuuaaucucagcacucaagcggcagaggcaggcagau

SEQ ID NO: 110420 - RNA, 46 nt, Mus musculus
ggucuuucucaucucaucuaagagcagccuuccugccugcugaguc

SEQ ID NO: 110421 - RNA, 42 nt, Mus musculus
uaauaaauaaauaaaucuuuaaaaaaaaaaaaaagaggcccu

SEQ ID NO: 110422 - RNA, 42 nt, Mus musculus
gcaaauacauuuacccacugagcuaucucacuggcccaagug

SEQ ID NO: 110423 - RNA, 46 nt, Mus musculus
uugggagguguggccuuguuggaguggguguagccuuguuggagau

SEQ ID NO: 110424 - RNA, 46 nt, Mus musculus
ucugugugacugagaucagagcaugauaccuuaggcauagggagau

SEQ ID NO: 110425 - RNA, 46 nt, Mus musculus
aaacuagccugaugccaaaggguguaagcuggcaaggucaccagac

SEQ ID NO: 110426 - RNA, 46 nt, Mus musculus
auacacagacauacauaaaaauaaaucugaacaaaacccaucacac

SEQ ID NO: 110427 - RNA, 42 nt, Mus musculus
cauuuaaagaguauagcgaagggcugauuagauagcucagua

SEQ ID NO: 110428 - RNA, 46 nt, Mus musculus
agagaaacccugucucggaaaaaaaaaauaaagaaagaaaucgaaa

SEQ ID NO: 110429 - RNA, 45 nt, Mus musculus
ggaagaaggcagaggcugccugagggggagaaguggugcagagaa

SEQ ID NO: 110430 - RNA, 45 nt, Mus musculus
ggcugcucuuccagaggaucuggguucaauuccuagcacccagau

SEQ ID NO: 110431 - RNA, 46 nt, Mus musculus
gaggggaagaggagguaaaggaaaaagauuaccaaacgguccaggg

SEQ ID NO: 110432 - RNA, 46 nt, Mus musculus
gccugcaugucuguuggucuaccaugcauaccuagugcccacagag

SEQ ID NO: 110433 - RNA, 46 nt, Mus musculus
ccaaggggaaagaaaacaacuggcagguuccaaggagggaacaccc

SEQ ID NO: 110434 - RNA, 45 nt, Mus musculus
cgucaggcucuggcggaugaaagacucuggucguacacugaagga

SEQ ID NO: 110435 - RNA, 45 nt, Mus musculus
ggucaccucaagaauaaacaaucaaaccugcccacgcccacaggu

SEQ ID NO: 110436 - RNA, 47 nt, Mus musculus
ucacucgcuccaccucauccugcgugaguucuccagcccucuuggug

SEQ ID NO: 110437 - RNA, 57 nt, Mus musculus; identical to SEQ ID NO: 45344

SEQ ID NO: 110438 - RNA, 24 nt, Mus musculus
uaaauuugcaaagauucaaacgua

SEQ ID NO: 110439 - RNA, 46 nt, Mus musculus
aaggauauuaauuuaauuucuccauuguacagagcugagaaacaag

SEQ ID NO: 110440 - RNA, 45 nt, Mus musculus
gcagaaacaaugcuuucuguguuuuagucaguacuccuuacccaa

SEQ ID NO: 110441 - RNA, 46 nt, Mus musculus
guuacaguauuuggcuuuauuuacuuauuauuauauuauuggguag

SEQ ID NO: 110442 - RNA, 47 nt, Mus musculus
gaaaguguucuaucacugagccuuagcagggaucauaaucagagauu

SEQ ID NO: 110443 - RNA, 46 nt, Mus musculus
ccugaacaacuuuaugagacauugucucaaaauaaaagucugagag

SEQ ID NO: 110444 - RNA, 46 nt, Mus musculus
aggaaauaauagaauaagaaagguaaggauauaugcaaauuagaaa

SEQ ID NO: 110445 - RNA, 42 nt, Mus musculus
aucagacugagccugaggaccccaauggagagcuaggggaag

SEQ ID NO: 110446 - RNA, 46 nt, Mus musculus
auaaugagacuggcucaaaauuaaaaauaaagauggaaacaacuga

SEQ ID NO: 110447 - RNA, 41 nt, Mus musculus
uaaauacucuuuaauuacugagccaucuuucuaauccucga

SEQ ID NO: 110448 - RNA, 46 nt, Mus musculus
uaucuuugcauaagaguuaaauuuuggcugaauuuugauaccacag

SEQ ID NO: 110449 - RNA, 45 nt, Mus musculus
ucuauagaguuagcaaggacaaucuuggguaaaguaagcccggag

SEQ ID NO: 110450 - RNA, 45 nt, Mus musculus
gauagagauaaggauaaagaacuuugagaauucaugaccauggag

SEQ ID NO: 110451 - RNA, 46 nt, Mus musculus
ccuugccuacacagugagacugucaaagauugagguggucagggag

SEQ ID NO: 110452 - RNA, 46 nt, Mus musculus
auuugcaaaauuaagaauacauggaugaagaauugaaaaucauugu

SEQ ID NO: 110453 - RNA, 45 nt, Mus musculus
cuguacagcuauauugucaacuaauuauagaauuuaauagcccaa

SEQ ID NO: 110454 - RNA, 42 nt, Mus musculus
ucuacccaaguauuugauuuuguaagauuugguuuuaagcag

SEQ ID NO: 110455 - RNA, 46 nt, Mus musculus
ggugucauucaaucuuacuuuuauucuuauuucucacuuuggacag

SEQ ID NO: 110456 - RNA, 42 nt, Mus musculus
aucucagcaaccacaugguggcucacaaccauccggaacaag

SEQ ID NO: 110457 - RNA, 41 nt, Mus musculus
aagagcagucagugcucuuaacugcuauuucuccagcccuu

SEQ ID NO: 110458 - RNA, 46 nt, Mus musculus
uauuaucagauugauagccuuggugauacaacuaucaaaagaaaaa

SEQ ID NO: 110459 - RNA, 45 nt, Mus musculus
aaagguaaccaaagaauugauuaaacuauagguuuuauaauucag

SEQ ID NO: 110460 - RNA, 46 nt, Mus musculus
guucucuauacacucccacacgagugaauaccuuccccacccccag

SEQ ID NO: 110461 - RNA, 45 nt, Mus musculus
agaugguugugauccaccauguaguugcuggaauugaacucggga

SEQ ID NO: 110462 - RNA, 49 nt, Mus musculus
guauguagcuauugaugugacagagaaauuaaagauagggaugucuggg

SEQ ID NO: 110463 - RNA, 41 nt, Mus musculus
cuuacauugauuauuguagcauguaaacuuauuuugggugg

SEQ ID NO: 110464 - RNA, 46 nt, Mus musculus
gauuaaaacuaaauuuguaaaguuuuaaacuuuacauuaguguuag

SEQ ID NO: 110465 - RNA, 45 nt, Mus musculus
acuaguuauuuauggacugguaaguuaguuuuccuauugguuuga

SEQ ID NO: 110466 - RNA, 41 nt, Mus musculus
ggcacuucaggcacauaguacugugauauccauacagccaa

SEQ ID NO: 110467 - RNA, 45 nt, Mus musculus
aaacaagcaguaggagggcggugacacauuccuuuaaucccagca

SEQ ID NO: 110468 - RNA, 46 nt, Mus musculus
guuauuuagcaacuucacccaaauuaucuuauuaauacagucucag

SEQ ID NO: 110469 - RNA, 53 nt, Mus musculus
aaauguuuguauucugcauucucaugugcaugguacuuggacucagagaggag

SEQ ID NO: 110470 - RNA, 42 nt, Mus musculus
aaaauuucaugccuacuuuuuuguuaggcuuugaacaguaag

SEQ ID NO: 110471 - RNA, 56 nt, Mus musculus
caccucuuccagcccuaccauuuauucuaccucagucaccgacagcaaggcuaugc

SEQ ID NO: 110472 - RNA, 73 nt, Mus musculus
aacagagggguaagugaaaagcaguuaaccgguaacacaguucagcagcauccaucaaccccgaagaggcaca

SEQ ID NO: 110473 - RNA, 127 nt, Mus musculus
uggauggaggauucccccuccaacuucaguaacaugagcaccaguuccuacaaugauaacacugagguaccucguaaaucacgaaaacgaaauccaaagcagaggccgggggucaaacgacgagauu

SEQ ID NO: 110474 - RNA, 53 nt, Mus musculus
gcaccucacuaugugcuuucucagcuuaccacggacaacaaaggcaacucaaa

SEQ ID NO: 110475 - RNA, 46 nt, Mus musculus
uaaaauaaucaaauuuuacuagaaaaauaauauaaaauagcaguag

SEQ ID NO: 110476 - RNA, 46 nt, Mus musculus
augaacuuauauuuuaaaaguauuuuuaaaauaucuuuaccugcag

SEQ ID NO: 110477 - RNA, 46 nt, Mus musculus
ucuugggggguuuuuuguuuuuguuuuugcuuguuuguuuuuggag

SEQ ID NO: 110478 - RNA, 46 nt, Mus musculus
agaugaaaauauacauuuuuuuccacuuuuacauuuaaacuuagag

SEQ ID NO: 110479 - RNA, 30 nt, Mus musculus
uggacagccaaaagggaacuggaguaaaga

SEQ ID NO: 110480 - RNA, 45 nt, Mus musculus
uauuuuuaaagauuuauuuauuuuauguauaugcguacacuguug

SEQ ID NO: 110481 - RNA, 44 nt, Mus musculus
aggaaugccgauguugaagccagaauuggaauugcuggaucuaa

SEQ ID NO: 110482 - RNA, 42 nt, Mus musculus
guuaauaucacaaggaaagauggcucuacucugacauugcag

SEQ ID NO: 110483 - RNA, 41 nt, Mus musculus
cugagaucuuaaagaaaagcuugcauagcuguucagugaaa

SEQ ID NO: 110484 - RNA, 42 nt, Mus musculus
gaaagcagagagguugaggcaggacuaagacuuucaggccag

SEQ ID NO: 110485 - RNA, 56 nt, Mus musculus
aaguaaaauaaaugugacuggguuaaagagaguacugcuuuaaaaguauagacggg

SEQ ID NO: 110486 - RNA, 46 nt, Mus musculus
cuugccaucugagaagaugaaaauauuauaguuggagagaacaagu

SEQ ID NO: 110487 - RNA, 45 nt, Mus musculus
cuuguagacuguuguaaaaaugagggcuuuacuaugaacggcaua

SEQ ID NO: 110488 - RNA, 46 nt, Mus musculus
ggaagaucucaugauguucagccauuuacguacacuccggauccag

SEQ ID NO: 110489 - RNA, 42 nt, Mus musculus
acaggcuauugauaauguuauucccacauauuucaggaccca

SEQ ID NO: 110490 - RNA, 46 nt, Mus musculus
auuuuaucugcuuauagauaaguauauuuuagagaguagucugcug

SEQ ID NO: 110491 - RNA, 41 nt, Mus musculus
ccaggaaagcacuucccacuagguaggcaauaccagacaca

SEQ ID NO: 110492 - RNA, 46 nt, Mus musculus
gacuggauguaacguagauaaggugacuauccuuccuaaugcccug

SEQ ID NO: 110493 - RNA, 46 nt, Mus musculus
agagacccugacaacuauccagacacaggacaucucacagcccggg

SEQ ID NO: 110494 - RNA, 45 nt, Mus musculus
cagcaauccccacuacaagaacaagcacaaacguuacagcagcag

SEQ ID NO: 110495 - RNA, 45 nt, Mus musculus
caucaacagacugaaaauacacugucuaaucagcagcagcagcaa

SEQ ID NO: 110496 - RNA, 46 nt, Mus musculus
aaacucaagguucaauuuuucauaguccaaauccuauuguccacag

SEQ ID NO: 110497 - RNA, 46 nt, Mus musculus
uucccaaaguucuaucaauaaucuucaaacuaacacaguagcccaa

SEQ ID NO: 110498 - RNA, 42 nt, Mus musculus
caucaaacacugagcagcaagcugcuuuccaacagcagccuc

SEQ ID NO: 110499 - RNA, 41 nt, Mus musculus
uuggcucccugccuccuaauccaaugccucaaaaccagcaa

SEQ ID NO: 110500 - RNA, 52 nt, Mus musculus
agaaccagucaauuuuucaccagcaaaguaauauggccccaaugaaccaaga

SEQ ID NO: 110501 - RNA, 49 nt, Mus musculus
ucuccucagauccaguugguucaagggucaccuaguucucaagaucagc

SEQ ID NO: 110502 - RNA, 42 nt, Mus musculus
auuguagucagcuuuuaaccuccggaccagcuacauugccag

SEQ ID NO: 110503 - RNA, 46 nt, Mus musculus
cagaauaucaggcuagcauauaaggcccuagauccaaucauaguag

SEQ ID NO: 110504 - RNA, 45 nt, Mus musculus
guuugaguaaauggauagauuuccuggcuauaagaguacacccau

SEQ ID NO: 110505 - RNA, 29 nt, Mus musculus
ugacaugccugcaaaacugguuacagcug

SEQ ID NO: 110506 - RNA, 45 nt, Mus musculus
uagcuuaaacugacaguacuuugagccuguugucuucuugcccag

SEQ ID NO: 110507 - RNA, 42 nt, Mus musculus
uguguuugcuggaucuucacucagugagauguuaaagcgcaa

SEQ ID NO: 110508 - RNA, 46 nt, Mus musculus
guuuaauaccacauuuacuucugaguuuucugaauuacuuugugag

SEQ ID NO: 110509 - RNA, 41 nt, Mus musculus
uuauccuuauaaaaugcugauuggcaaugccaagucaccgg

SEQ ID NO: 110510 - RNA, 45 nt, Mus musculus
cccucccucucucccucccucuacauccuuuccuuccucucuccc

SEQ ID NO: 110511 - RNA, 46 nt, Mus musculus
gccucuuucuuucccucccauucucccauccuuucuugcccccucu

SEQ ID NO: 110512 - RNA, 65 nt, Mus musculus
uaacuuaaacuccacaacaaagguguguuccccaugcaaguaugauuguaacuguugguggacug

SEQ ID NO: 110513 - RNA, 49 nt, Mus musculus
aauaaguuugaaauuacuauuuucuaaaggacuuaagaccuugaaaugu

SEQ ID NO: 110514 - RNA, 46 nt, Mus musculus
ugcagaccauuuuagaaauaguaaaauuugacuggcugaugaguau

SEQ ID NO: 110515 - RNA, 42 nt, Mus musculus
aaguaaguaggcaagcuguugggaugcuguagagacccccuc

SEQ ID NO: 110516 - RNA, 46 nt, Mus musculus
uuguagggguggccuauuguuacuauuuuagcuagugagccucagg

SEQ ID NO: 110517 - RNA, 44 nt, Mus musculus
acacugaucaaccacugaccugccuucuugcauuguccugcagu

SEQ ID NO: 110518 - RNA, 45 nt, Mus musculus
ggaacauuuguauacucgcaauuauauuucuguaaacagcugcag

SEQ ID NO: 110519 - RNA, 46 nt, Mus musculus
uguacacagcacacccagguccugggaaaggaauuuuaaaacagau

SEQ ID NO: 110520 - RNA, 46 nt, Mus musculus
gagggacuaacuuguuuagcaguuagcaguuagcuaaagccuguuu

SEQ ID NO: 110521 - RNA, 46 nt, Mus musculus
cuucgggcuagucccaguuagauggcauccaguccuccaucaagau

SEQ ID NO: 110522 - RNA, 46 nt, Mus musculus
uuuuuuugauaguucugccauaacaacaaaaugaaugaagucagau

SEQ ID NO: 110523 - RNA, 41 nt, Mus musculus
gggccaucaccugggcaaguccauuccagcugacaaccaga

SEQ ID NO: 110524 - RNA, 46 nt, Mus musculus
ugguuuacagcauuggccacacuccaccagaugcccgcaugcagau

SEQ ID NO: 110525 - RNA, 31 nt, Mus musculus
aaaaucucgagccagcucuccaccccgcaga

SEQ ID NO: 110526 - RNA, 76 nt, Mus musculus
gccagggcuuauaaccacugagucaucucuccagccucgacucuuuuuaaaaaaguaaauuaauaaaaauugacac

SEQ ID NO: 110527 - RNA, 46 nt, Mus musculus
gaguagacacugucccgagaguacagauggacucuuaagaccaggg

SEQ ID NO: 110528 - RNA, 42 nt, Mus musculus
agcauccuccuagggacuccauugcuccagucagccccaccc

SEQ ID NO: 110529 - RNA, 45 nt, Mus musculus
cugaggacaacccuggccacuguuuuucacacccuuacguggggu

SEQ ID NO: 110530 - RNA, 41 nt, Mus musculus
uuuguguaccugugugcaugugugugccuauaucugugugu

SEQ ID NO: 110531 - RNA, 45 nt, Mus musculus
gaguugggggugugguggcucagguguccgacuucaugaggagaa

SEQ ID NO: 110532 - RNA, 55 nt, Mus musculus
cccuugcuguggcauuguggagaugaguggacaaaaggacggaucucagcccuac

SEQ ID NO: 110533 - RNA, 83 nt, Mus musculus
agauugccaaccgggaugccgagaagaaggagggacaggaaaaggaggagagcaagaaggagagaaaagacgacaaagagaag

SEQ ID NO: 110534 - RNA, 43 nt, Mus musculus
uuggcaaucuuguuguugaugagguuaugcaaggcgaccacag

SEQ ID NO: 110535 - RNA, 46 nt, Mus musculus
cuggagaagguagccagcggcaagcugcccaucaaccaccagauca

SEQ ID NO: 110536 - RNA, 42 nt, Mus musculus
cacugacugauuuaaguugcucaacauuguagcaaagcaggu

SEQ ID NO: 110537 - RNA, 46 nt, Mus musculus
uagugguaggugaaaaugaagucuuucaaguauggcuuauacacag

SEQ ID NO: 110538 - RNA, 47 nt, Mus musculus
aaaaacuuuugagcaugugacuagcgagauuggagcagaggaggcgg

SEQ ID NO: 110539 - RNA, 41 nt, Mus musculus
gaggaaguucaugacguaagucaccugcuuugggcuggaga

SEQ ID NO: 110540 - RNA, 46 nt, Mus musculus
uugcucucucucucucucucuauauauauauauauagagagagaga

SEQ ID NO: 110541 - RNA, 44 nt, Mus musculus
ucucucucucucuauauauauauauauagagagagagagagaga

SEQ ID NO: 110542 - RNA, 46 nt, Mus musculus
uaggucacagcaaaucauaacuuagaacaacacauuacugccaaag

SEQ ID NO: 110543 - RNA, 45 nt, Mus musculus
caugaguucauugauggcgauaucauucuugugcaguuuggggcc

SEQ ID NO: 110544 - RNA, 51 nt, Mus musculus
auaguugggugguaccacacaggccccaaacugcacaagaaugauaucgcc

SEQ ID NO: 110545 - RNA, 46 nt, Mus musculus
gguggaaagccuaaguaagugcugguguucuuauuguuugcgaguc

SEQ ID NO: 110546 - RNA, 46 nt, Mus musculus
uguguguguguguguguguguauguguaugugugugugugucugug

SEQ ID NO: 110547 - RNA, 44 nt, Mus musculus
gucugguuuuuagaccaugauuauuuggaaaacauguaugggau

SEQ ID NO: 110548 - RNA, 42 nt, Mus musculus
ugugacugaccaccuguuuuucucacucagaauuggcaaggu

SEQ ID NO: 110549 - RNA, 54 nt, Mus musculus
aaacugguacuucucuuagaucuucaucccuggagagauuucaguguagcgagg

SEQ ID NO: 110550 - RNA, 58 nt, Mus musculus
aaacccugucucggaaaaaaaaaaaaacaaaaacaaaacaaacaaacaaaaaaaaaca

SEQ ID NO: 110551 - RNA, 45 nt, Mus musculus
ggcauguggaaacucguuguuugaaguaguuuuaguggguuagag

SEQ ID NO: 110552 - RNA, 42 nt, Mus musculus
ucggaaguuuuacaagauaauuagugugaggaguuaacaaau

SEQ ID NO: 110553 - RNA, 44 nt, Mus musculus
aaucaauuaacccguguguuaauuaacgucaagucgacgggagg

SEQ ID NO: 110554 - RNA, 46 nt, Mus musculus; identical to SEQ ID NO: 50694

SEQ ID NO: 110555 - RNA, 45 nt, Mus musculus; identical to SEQ ID NO: 50695

SEQ ID NO: 110556 - RNA, 44 nt, Mus musculus
gucuacacagagagucagccaggauuacagugugacccuguccc

SEQ ID NO: 110557 - RNA, 41 nt, Mus musculus; identical to SEQ ID NO: 50698

SEQ ID NO: 110558 - RNA, 42 nt, Mus musculus
ugcuccucggccaaggccaucuccucuuccauggcagaggcc

SEQ ID NO: 110559 - RNA, 44 nt, Mus musculus
ugccugcuucacacuguagaacauggggccuaacucggccagcc

SEQ ID NO: 110560 - RNA, 46 nt, Mus musculus
agagagggccggguccagugggaacuccaccaucagccgcccugug

SEQ ID NO: 110561 - RNA, 44 nt, Mus musculus
cuucuaucaucagcccauucauuguacuuauaggagggggucgg

SEQ ID NO: 110562 - RNA, 45 nt, Mus musculus
ucucgaucccgaguggacggccgaugaccucgcucagagucccga

SEQ ID NO: 110563 - RNA, 103 nt, Mus musculus
ugcguucccaaaacucuucacucacacccccggggugggacggagucucuacccgagcagaucgguaaugccugaaacagggagagugaagaaaggggucucc

SEQ ID NO: 110564 - RNA, 42 nt, Mus musculus
agccuuccccgcaaauccuuaccagcuccuaccugccaccag

SEQ ID NO: 110565 - RNA, 84 nt, Mus musculus
cuccucucgcucccuccguuucagggacgccaguaaguccagccccagcagugaagggcggggagcaggggcuuugaagacaug

SEQ ID NO: 110566 - RNA, 46 nt, Mus musculus
acauccaaaaggcacagagacacauggacauggaccacacacuagg

SEQ ID NO: 110567 - RNA, 45 nt, Mus musculus
agcacaucccacuucucuagugagacaagaaagaaagaaagaaag

SEQ ID NO: 110568 - RNA, 46 nt, Mus musculus
cucucgaggccuucgguuccugaucuggagacgccagcgcggccac

SEQ ID NO: 110569 - RNA, 45 nt, Mus musculus
gcaucagaucucaaccaugugcuugcugggacuugaacuucagac

SEQ ID NO: 110570 - RNA, 45 nt, Mus musculus
ccugcggaaaaggcaguggucaggccauguguagagagacaagaa

SEQ ID NO: 110571 - RNA, 24 nt, Mus musculus
aaaaaaaaaaguggaaaggccaaa

SEQ ID NO: 110572 - RNA, 42 nt, Mus musculus
aaaguacauugccauugcuauggagacaaauguuggccgaga

SEQ ID NO: 110573 - RNA, 42 nt, Mus musculus
acgccacauuaucauuuccuucucauucugucucuaacagcc

SEQ ID NO: 110574 - RNA, 46 nt, Mus musculus
agaggaccaggaccaaacucauuucuccaaaugcuugcaccuugag

SEQ ID NO: 110575 - RNA, 45 nt, Mus musculus
ugaggacaucugagggggccaaagcuugcuggguguguuugagga

SEQ ID NO: 110576 - RNA, 45 nt, Mus musculus
cuagacugagaaccacucuauugaggcuuugacugaggugcaaau

SEQ ID NO: 110577 - RNA, 46 nt, Mus musculus
auucaaggaggaaaggcaggcacuuccacaucauaguccgucacug

SEQ ID NO: 110578 - RNA, 46 nt, Mus musculus
cuuccauauguguguguguguguguguguguguguguguggugcau

SEQ ID NO: 110579 - RNA, 41 nt, Mus musculus
acagcgguagaacccugagacaguaggaaaugcagcucagu

SEQ ID NO: 110580 - RNA, 41 nt, Mus musculus
ucuggcccauucccaaaaauggaagggggaggggugcagug

SEQ ID NO: 110581 - RNA, 52 nt, Mus musculus
cacaauggggagagacagagucagagacagaaacagagagacagacagaggg

SEQ ID NO: 110582 - RNA, 41 nt, Mus musculus
acagaaauugacuguugauuuauuuugcaugugugugugug

SEQ ID NO: 110583 - RNA, 46 nt, Mus musculus
aagcacugagaagcacuggcuuccagaggaacggaugauuggggca

SEQ ID NO: 110584 - RNA, 42 nt, Mus musculus
ggaggguggaggagaugaaugaggugggagggacugggagga

SEQ ID NO: 110585 - RNA, 46 nt, Mus musculus
ccuguguguauguauguguauugaauguaugucuggagcccaaguu

SEQ ID NO: 110586 - RNA, 27 nt, Mus musculus
acaauuuagaccuuuucauucacggua

SEQ ID NO: 110587 - RNA, 63 nt, Mus musculus
cccuggcaacgcuauaucaauggcaaaagcacaaucaugaagacaaagaaagcaaugggagac

SEQ ID NO: 110588 - RNA, 59 nt, Mus musculus
gguuagugggaggauaccuguaagucaguucuagggcagagaagaggaggaagggggcu

SEQ ID NO: 110589 - RNA, 45 nt, Mus musculus
auuaauauaguagugaaauagcaacaaaaauaacaugguuggggg

SEQ ID NO: 110590 - RNA, 45 nt, Mus musculus
gauggguagacacgagugaggucauagucacacugagaguuaaga

SEQ ID NO: 110591 - RNA, 45 nt, Mus musculus
ugcuuugaaguucccaucaagaggccaacaacagucacuauagau

SEQ ID NO: 110592 - RNA, 46 nt, Mus musculus
aagaagaggugagcacgggugccuaggaagcaguaguugaguagug

SEQ ID NO: 110593 - RNA, 42 nt, Mus musculus
gccagguguccuuuggcagcagggugaggauaugggggaaga

SEQ ID NO: 110594 - RNA, 48 nt, Mus musculus
aauuuuauuuauuuauuuauuuauuuauuuugccaccaugccugcuuu

SEQ ID NO: 110595 - RNA, 45 nt, Mus musculus
ucugucuuccugucacguggauccuugguucuuucccggccauuc

SEQ ID NO: 110596 - RNA, 41 nt, Mus musculus
cagugauucuucagugauccugagagacuaacagcuggaga

SEQ ID NO: 110597 - RNA, 71 nt, Mus musculus
ucuuucccggagauuugaggaacugaaaaagaaaacauaggucucuuaaaccaggcagcauccacauucug

SEQ ID NO: 110598 - RNA, 32 nt, Mus musculus
ucugaugcugaggugcuggcuccagcagaugc

SEQ ID NO: 110599 - RNA, 72 nt, Mus musculus
ggugccagacacacuuccaacugcaucugcuggagccagcaccucagcaucagaagacauagacuuugauga

SEQ ID NO: 110600 - RNA, 46 nt, Mus musculus
acaagucccuggauuugaucuccaguauugaaagaaaaggagaagg

SEQ ID NO: 110601 - RNA, 40 nt, Mus musculus
cucccacucucaugcccuuggggcuggcucaccugugccc

SEQ ID NO: 110602 - RNA, 48 nt, Mus musculus
cccauggugguucauaaccaucuauaaugagaucugaugcccugaaga

SEQ ID NO: 110603 - RNA, 46 nt, Mus musculus
caucaacuagagauggaaaccaacgggaagaaugauaagcaaacuc

SEQ ID NO: 110604 - RNA, 42 nt, Mus musculus
auuccucaggaagcaaggggaaagcaagggaaagcaagggag

SEQ ID NO: 110605 - RNA, 46 nt, Mus musculus
uguaaugagaucugaugcccucuggggugucugaagacugcuacag

SEQ ID NO: 110606 - RNA, 46 nt, Mus musculus
ggcaauuucaaucagguaucucuccacuaggauuuuggguggggcu

SEQ ID NO: 110607 - RNA, 45 nt, Mus musculus
caugacaauaaugaacuaaaccucugaaauuguaagucagcccca

SEQ ID NO: 110608 - RNA, 41 nt, Mus musculus
ucaacucagccacuucugacugaagccgaggcgcagcccag

SEQ ID NO: 110609 - RNA, 42 nt, Mus musculus
aucccagcaaccacauggugauucacaaccauccguaaugag

SEQ ID NO: 110610 - RNA, 64 nt, Mus musculus
gccuacuauuuuuuuuuucuuuuaaagggaaacagaggaauugaucuaggggagaaggaagugg

SEQ ID NO: 110611 - RNA, 46 nt, Mus musculus
aaauguuauuuuaaaaagaaaaaaagaaaaugggggcacagugggg

SEQ ID NO: 110612 - RNA, 46 nt, Mus musculus
caauccccagcaacuacauagaaaguugggcagguagagacaggca

SEQ ID NO: 110613 - RNA, 46 nt, Mus musculus
ugaaguguauguccacagcugagggcuuccagcagcagaggucgag

SEQ ID NO: 110614 - RNA, 46 nt, Mus musculus
ggauuuucccuguccaauuaaauauuagugcagcaggaggccugug

SEQ ID NO: 110615 - RNA, 42 nt, Mus musculus
ugaccgucacugcugggguagacuagagccagaggcggcgag

SEQ ID NO: 110616 - RNA, 42 nt, Mus musculus
gacguuggggacaacaaaguaugaaaaaggaacucauucauu

SEQ ID NO: 110617 - RNA, 46 nt, Mus musculus
gaagugggugcugggaaccagagcugggguuuggaaaagcagucag

SEQ ID NO: 110618 - RNA, 46 nt, Mus musculus
aggcuacuagugcauaggugguucccagcaugagagacacaggcag

SEQ ID NO: 110619 - RNA, 25 nt, Mus musculus
gaaccaacuaauuacuguuaacagg

SEQ ID NO: 110620 - RNA, 42 nt, Mus musculus
guccuacagacuaacgcugggguuccguaaaagcgggacgua

SEQ ID NO: 110621 - RNA, 45 nt, Mus musculus
uuaaugucuuacaaccuuacaacuuuuguuuuguguaugggguag

SEQ ID NO: 110622 - RNA, 45 nt, Mus musculus
auagguacacugugguacagcuauaccuccccacacacagguaag

SEQ ID NO: 110623 - RNA, 46 nt, Mus musculus
gguaauauaguagcaguauuuauggauuauuugcuuaaugagggag

SEQ ID NO: 110624 - RNA, 45 nt, Mus musculus
aaaaccgauuuuccuggagaccuuggcagucagcgacaagcuauc

SEQ ID NO: 110625 - RNA, 45 nt, Mus musculus
caguguacuugucauauauauaaaaaauaaauaaauagucgggca

SEQ ID NO: 110626 - RNA, 45 nt, Mus musculus
uaaaauucugcuacuauauauggaaguauguauuaauguuuguug

SEQ ID NO: 110627 - RNA, 42 nt, Mus musculus
ucaacucugccaguguccccucugccagcuagacugugggag

SEQ ID NO: 110628 - RNA, 47 nt, Mus musculus
ugagccucuggaaguaaggcugcaacgacuugaacgagaacgcacag

SEQ ID NO: 110629 - RNA, 45 nt, Mus musculus
ggcccuaaaaugcuaaaaagccuuauagcggaauggugaggugag

SEQ ID NO: 110630 - RNA, 42 nt, Mus musculus
agccagcugaaugauggcgccuuucaugaaaugggagggcag

SEQ ID NO: 110631 - RNA, 45 nt, Mus musculus
ggcauauggcacaaaguguggaaggugagugguggcaagguuggc

SEQ ID NO: 110632 - RNA, 46 nt, Mus musculus
gcauaaggaaggcuguauggagacccaauaaacugcagugaggugg

SEQ ID NO: 110633 - RNA, 45 nt, Mus musculus
cugcccagccaccacaaccccucgggaccauucagaagcgucacu

SEQ ID NO: 110634 - RNA, 41 nt, Mus musculus
guuguuguuccaggaaacuugacauuccagcuuugaccccg

SEQ ID NO: 110635 - RNA, 46 nt, Mus musculus
gccuagcaugcauccagcccgagguuacaucucuagcaccucacag

SEQ ID NO: 110636 - RNA, 41 nt, Mus musculus
cauccccggccccggagccgccccacacccagcgggcaccc

SEQ ID NO: 110637 - RNA, 44 nt, Mus musculus
uuugucuugaguuugcccgcuuuuauaauuuugggggaacugau

SEQ ID NO: 110638 - RNA, 78 nt, Mus musculus
ccaaacaacacacucacuacaacauucuagaaaacauccugagagagggagggagggaaggaggaagggagggaagga

SEQ ID NO: 110639 - RNA, 29 nt, Mus musculus
uuaacugaacgggagaugugggcagagac

SEQ ID NO: 110640 - RNA, 45 nt, Mus musculus
cacaagcgaggcuugacuauacuacuguggaguauacacgugcaa

SEQ ID NO: 110641 - RNA, 42 nt, Mus musculus
ggggccaaguuacuaccuggagagaaagauuagccugccaug

SEQ ID NO: 110642 - RNA, 41 nt, Mus musculus
gcccacacccacgaaggaugggcagcaguaacuggaccuaa

SEQ ID NO: 110643 - RNA, 42 nt, Mus musculus
gguccaguuacugcugcccauccuucgugggugugggcccag

SEQ ID NO: 110644 - RNA, 41 nt, Mus musculus
caguuagugaagagggagaugcuuguuucuggagugacgca

SEQ ID NO: 110645 - RNA, 46 nt, Mus musculus
gugagucaucucuguugccauuccagcagaaaacggugcuauggau

SEQ ID NO: 110646 - RNA, 45 nt, Mus musculus
uggcacacagguggugacuggggacagggcuaggugggaugggag

SEQ ID NO: 110647 - RNA, 45 nt, Mus musculus
cucucucuacacauacauacacacacacacacacacacacacacc

SEQ ID NO: 110648 - RNA, 46 nt, Mus musculus
uacagggucucccucuccuugcacacaucugaacuauaggcggcag

SEQ ID NO: 110649 - RNA, 45 nt, Mus musculus
guguguguguguguguguguguguguguguguguuacuagggaug

SEQ ID NO: 110650 - RNA, 46 nt, Mus musculus
uccccucuuggcuggggacaguaugaugguugguggugacugucaa

SEQ ID NO: 110651 - RNA, 42 nt, Mus musculus
cuuugaaaugcaaacccaaaauacucucaacaaugacaccag

SEQ ID NO: 110652 - RNA, 45 nt, Mus musculus
aaaguagcugaugaagauucccgcucagguggcagagaggccuuu

SEQ ID NO: 110653 - RNA, 45 nt, Mus musculus
cucucucucucucucucucucucucucuuucuugaucaagaacuc

SEQ ID NO: 110654 - RNA, 41 nt, Mus musculus
gagaacucggacauuggugaacagggaaggaggggccggau

SEQ ID NO: 110655 - RNA, 41 nt, Mus musculus
gggagagacagcagagcugugaguccugggugggggucuau

SEQ ID NO: 110656 - RNA, 46 nt, Mus musculus
cccuagggcagcaagaaccuguuguuucagaagucggugaccuuug

SEQ ID NO: 110657 - RNA, 46 nt, Mus musculus
uuaccuucuucccccuguggccgggccagccucaggagaaguuggg

SEQ ID NO: 110658 - RNA, 46 nt, Mus musculus
uuaggaucgauggaaagacauuuuguacaacaguauuuuaggagag

SEQ ID NO: 110659 - RNA, 46 nt, Mus musculus
aaggagcuugaucuauagggacaaccaagaaggaacuggagagugu

SEQ ID NO: 110660 - RNA, 46 nt, Mus musculus
aaauccggucagcaggaagugagagggggagugccagugccaccga

SEQ ID NO: 110661 - RNA, 46 nt, Mus musculus
uucgcggagaucaugugugaaguggcuuugaagacccaggaaaggu

SEQ ID NO: 110662 - RNA, 45 nt, Mus musculus
aaaugggcaaaauguggccugugaagaacauuuaaugggaguaag

SEQ ID NO: 110663 - RNA, 68 nt, Mus musculus
uucuccacaggguugcaucaguucacacuaacaacggcuuuguaaacccaaaugcugacaaaggggag

SEQ ID NO: 110664 - RNA, 42 nt, Mus musculus
auucaguagugaaaaugaauggacugugguuaaggugcaaga

SEQ ID NO: 110665 - RNA, 82 nt, Mus musculus
uucaccccuccuuaggcaaccugguggucccccgcuccugggaggucaccauauugaucuaaacuuagugcggacaccggau

SEQ ID NO: 110666 - RNA, 42 nt, Mus musculus
cuggaaguuucuuugaaagaccucagguauuccaggcaagua

SEQ ID NO: 110667 - RNA, 41 nt, Mus musculus
ugcuuguuccaagaaguguucauacuuuucauugccugugg

SEQ ID NO: 110668 - RNA, 121 nt, Mus musculus
ggagugagcggcgcaaaauccuucucuggguucaugguggcagcucgcgcugcgccugggagccuccagacaccuuagcccgagguugccugggccgugccagggccgggggagugugcgg

SEQ ID NO: 110669 - RNA, 46 nt, Mus musculus
cuaagcacugcaaugcaaggcaguaaacagaaaagaggggaaaaaa

SEQ ID NO: 110670 - RNA, 42 nt, Mus musculus
cauaggaagaacagcaauauuaaccaaccagacaccccagag

SEQ ID NO: 110671 - RNA, 46 nt, Mus musculus
ucucccacuuccaccagcugcagcuuccuagggggccugcuccucu

SEQ ID NO: 110672 - RNA, 47 nt, Mus musculus
uugagaggcaguaaggaagcucugaagacagcacaggcucccacaaa

SEQ ID NO: 110673 - RNA, 46 nt, Mus musculus
ccaucugagguauuacuuuagaaacauuaacagacaaugcccaggg

SEQ ID NO: 110674 - RNA, 42 nt, Mus musculus
auugcccugcucagcguucagugaggaguaguggggccaguu

SEQ ID NO: 110675 - RNA, 41 nt, Mus musculus
ggcaccgacaccagaaccaggaucugauggaggggaguagg

SEQ ID NO: 110676 - RNA, 42 nt, Mus musculus
acaacucacauuuuccgaaucuccuugccauugucacccagg

SEQ ID NO: 110677 - RNA, 42 nt, Mus musculus
gcaggacagcagucaggaucccagaggaauagggcagcauua

SEQ ID NO: 110678 - RNA, 25 nt, Mus musculus
ugaagguggcuuugaagagcugguu

SEQ ID NO: 110679 - RNA, 48 nt, Mus musculus
ggcauucacccuacuuaugucauggugcgcagggccuggaggcaggug

SEQ ID NO: 110680 - RNA, 42 nt, Mus musculus
gauagucugagucacacuuuuuuucuccuugcaguccaacuu

SEQ ID NO: 110681 - RNA, 46 nt, Mus musculus
aauuccuguggcugcugcuucuaagcacaggcagggcugcacucga

SEQ ID NO: 110682 - RNA, 25 nt, Mus musculus
cuccgucuuccccaugcuuggcucu

SEQ ID NO: 110683 - RNA, 46 nt, Mus musculus
gucacccaggaagaaaacauuaccaggaaggguugccauucuagau

SEQ ID NO: 110684 - RNA, 45 nt, Mus musculus
guacuagaguucuccugcguacuggguuccaugcugagcgccaug

SEQ ID NO: 110685 - RNA, 44 nt, Mus musculus
guacuagaguucuccugcguacuggguuccgugcucagcgccau

SEQ ID NO: 110686 - RNA, 45 nt, Mus musculus
aaaccuguggacuugaggcaggagggagggguuguuuuuguuugu

SEQ ID NO: 110687 - RNA, 42 nt, Mus musculus
ucuugggagaaaugcaaacaccgaguccuauugugaggcugu

SEQ ID NO: 110688 - RNA, 27 nt, Mus musculus
gcaacuagaugagcagugccccaagga

SEQ ID NO: 110689 - RNA, 34 nt, Mus musculus
cugagccuuuugaagcaacaaucaaaaugaagau

SEQ ID NO: 110690 - RNA, 46 nt, Mus musculus
gaguaucuggcagguucacugcuccaggaauggaagagacauaggg

SEQ ID NO: 110691 - RNA, 45 nt, Mus musculus
ccacauagcccugucagauggcaggaguaaaaguuggccccaugu

SEQ ID NO: 110692 - RNA, 46 nt, Mus musculus
cagggccaucaggugcaccugggucauccgucuggccugcagggga

SEQ ID NO: 110693 - RNA, 46 nt, Mus musculus
aucaacuucuuuaugcuugggagggagagaaaacaugcuaacagau

SEQ ID NO: 110694 - RNA, 46 nt, Mus musculus
auaguuucugcaggccaggguaagagucucaccccuucagccucau

SEQ ID NO: 110695 - RNA, 46 nt, Mus musculus
ggagccauugauuucccuguagaugcccugacguugccuucuagaa

SEQ ID NO: 110696 - RNA, 45 nt, Mus musculus
agguaguuccuuucuggucacgaaugaaggagguggggcccagac

SEQ ID NO: 110697 - RNA, 42 nt, Mus musculus
uacugccccuucuucccacagccuagcaauacaccugcagau

SEQ ID NO: 110698 - RNA, 47 nt, Mus musculus
cagggaaugaaauggaauugaaaauucuaccuuugcccuuuucagac

SEQ ID NO: 110699 - RNA, 50 nt, Mus musculus
gcuuuucuccccccacccaugugugugugugugcgugugugugugugugu

SEQ ID NO: 110700 - RNA, 45 nt, Mus musculus
ucuggccuccaggagcuuccguucacugcugaacgucuguagaag

SEQ ID NO: 110701 - RNA, 45 nt, Mus musculus
gccauacaagguuaagagauccucucuggcuguguuggguggagu

SEQ ID NO: 110702 - RNA, 44 nt, Mus musculus
ggcagacaaggccugggcuuguucagcuagcauuagcaugaagg

SEQ ID NO: 110703 - RNA, 42 nt, Mus musculus
ugaaagcauucucuggcaagugcucuuugcaaggcagcaggg

SEQ ID NO: 110704 - RNA, 45 nt, Mus musculus
ucccuaacaggugaggugauaacuacaaagauuuacaggccagag

SEQ ID NO: 110705 - RNA, 46 nt, Mus musculus
gaaagggagggauagagauagauaagauauauauagagggauagag

SEQ ID NO: 110706 - RNA, 46 nt, Mus musculus
gguggucuugcuucuacuccccuaaaguuggcauuugaaucuagau

SEQ ID NO: 110707 - RNA, 46 nt, Mus musculus
cucagacagcagcuuccucuggcagccuagugacuagucucuccuc

SEQ ID NO: 110708 - RNA, 42 nt, Mus musculus
ggagauauggucaaaguugccauucugcauccagggcuggua

SEQ ID NO: 110709 - RNA, 42 nt, Mus musculus
cuguuugucccucaguucaauagaagcuccugccaggcugga

SEQ ID NO: 110710 - RNA, 46 nt, Mus musculus
ucuccugcugucccagagaaccugagaaugcugacggucgguuggu

SEQ ID NO: 110711 - RNA, 41 nt, Mus musculus
uggcugccuagugcugggucagagggaguaccggggucugc

SEQ ID NO: 110712 - RNA, 46 nt, Mus musculus
aggcauuuuaugagacagaugcguccagcuggaagaggggccagag

SEQ ID NO: 110713 - RNA, 46 nt, Mus musculus
ggaaaauucuuacggcuucuguaaaugucugcagggaaccacagga

SEQ ID NO: 110714 - RNA, 45 nt, Mus musculus
cucccugggggauggaugacaaugagaggauacaacuucuggaug

SEQ ID NO: 110715 - RNA, 74 nt, Mus musculus
cuauggcccugacaggaucuuacauguaaagauggggcacucaauuagcugcacgaguuuguccaccucuguga

SEQ ID NO: 110716 - RNA, 41 nt, Mus musculus
auguauauagcugggugcucagaagcccagggccggugaga

SEQ ID NO: 110717 - RNA, 50 nt, Mus musculus
ggauucugaggcuguagucccgacucaggagagaauccaucggucccagg

SEQ ID NO: 110718 - RNA, 45 nt, Mus musculus
cauugucugggcuucggggcgucggggguaugugugugugugugu

SEQ ID NO: 110719 - RNA, 46 nt, Mus musculus
gcccucagguggaguugccaggggugugugugugugugugugugug

SEQ ID NO: 110720 - RNA, 23 nt, Mus musculus
aaguccagccaaucagugcaggu

SEQ ID NO: 110721 - RNA, 46 nt, Mus musculus
cgggcugcuucaccgacccucaaaaacgcccucuuccugcccaguc

SEQ ID NO: 110722 - RNA, 42 nt, Mus musculus
uccaauuuccgggcaguuucuuagaugguccuguccccauag

SEQ ID NO: 110723 - RNA, 45 nt, Mus musculus
cagcugagaguggagcuucgcagccuuggaguugaaguccuccca

SEQ ID NO: 110724 - RNA, 42 nt, Mus musculus
augcgcgugagcgcugagccaaugucccgcguggccccuggc

SEQ ID NO: 110725 - RNA, 46 nt, Mus musculus
acuucuuuuugauuucaugccuggcucguuuauacucugcgcaggg

SEQ ID NO: 110726 - RNA, 48 nt, Mus musculus
caaugcacaaggacagcaacagcagcacacaggagcagugagagagac

SEQ ID NO: 110727 - RNA, 42 nt, Mus musculus
cugcagucagcacuaccaggucgucaaugaugcccugcaggu

SEQ ID NO: 110728 - RNA, 44 nt, Mus musculus
uccgccacccuuggcacugccacugcugcugggggcacugaggg

SEQ ID NO: 110729 - RNA, 45 nt, Mus musculus
cuccgcugcagggugguggcugaggguuguucguggggaccagcc

SEQ ID NO: 110730 - RNA, 46 nt, Mus musculus
ucccucccuccaggcccaccuugggaggggaugguguccucggagc

SEQ ID NO: 110731 - RNA, 45 nt, Mus musculus
cuugguuaugggcucugggguuuggauguagcagggccuggagga

SEQ ID NO: 110732 - RNA, 42 nt, Mus musculus
cagggcaaaggcaagaggaaaugggacaggguccaggcaggg

SEQ ID NO: 110733 - RNA, 46 nt, Mus musculus
cucggggcucuggugacaacugaguuuggugggccaggucucagac

SEQ ID NO: 110734 - RNA, 41 nt, Mus musculus
caggcgaguccccagggcaugguggugcacugggugccccc

SEQ ID NO: 110735 - RNA, 42 nt, Mus musculus
ucaggaacuggugugagacagugacuuugagggucucaggag

SEQ ID NO: 110736 - RNA, 25 nt, Mus musculus
gaaaggacccuaaggaagcugccaa

SEQ ID NO: 110737 - RNA, 46 nt, Mus musculus
uguuuguguguguguggggggggguuucuuauguguggcuuuguug

SEQ ID NO: 110738 - RNA, 46 nt, Mus musculus
agcagcuguguguguucuuggguaaacuaccucccugcgcucaggu

SEQ ID NO: 110739 - RNA, 46 nt, Mus musculus
uugauaagguuuaggaagaguuucauagacuccuuuugaaaggccg

SEQ ID NO: 110740 - RNA, 45 nt, Mus musculus
gccuuucucauacuuggaguguggagaccugaugaggggugugga

SEQ ID NO: 110741 - RNA, 45 nt, Mus musculus
ugcauucacaggcaggggcacaccuugacgaaaguuuguagcagu

SEQ ID NO: 110742 - RNA, 66 nt, Mus musculus
uccagauagcuaccagauucgagcaagguagggaauguaguaggagauuagaggcagccuggugga

SEQ ID NO: 110743 - RNA, 46 nt, Mus musculus
uauuuuugcccagauucccccagugguaauuuguaaacagccagga

SEQ ID NO: 110744 - RNA, 46 nt, Mus musculus
ggagucaauucuaauuggaaaguuuaucaagauaaaagcuaauaca

SEQ ID NO: 110745 - RNA, 43 nt, Mus musculus
ucuugcacaugguaagcaggauuccgaaugugcgugcggaggg

SEQ ID NO: 110746 - RNA, 76 nt, Mus musculus
uuucuuccuagucuugauaccugauauacacgucacguccuuggcccugagagagagagagagagagagagagaga

SEQ ID NO: 110747 - RNA, 46 nt, Mus musculus
ugcuuauacauugcuguuucaggaagccccuccauuuuggccagaa

SEQ ID NO: 110748 - RNA, 42 nt, Mus musculus
acaguucugggcugccaugugagugcugggacuugaccccag

SEQ ID NO: 110749 - RNA, 45 nt, Mus musculus
uauugcuccaucuuguuuugugccuucucacuucucuugcccuuc

SEQ ID NO: 110750 - RNA, 42 nt, Mus musculus
uugccugugagugugcagguguuugagugcuguggggaaguu

SEQ ID NO: 110751 - RNA, 46 nt, Mus musculus
gauaaguucucacuguguagcccuaauugucuuugaacucggaaau

SEQ ID NO: 110752 - RNA, 45 nt, Mus musculus
uagugugaaguguucacacuuguggaagagagagggacaugccga

SEQ ID NO: 110753 - RNA, 46 nt, Mus musculus
cccccacucaacaaccacccaccccccaccccaccccacccccgcu

SEQ ID NO: 110754 - RNA, 35 nt, Mus musculus
cuaggacagccagagcuauguagugagccccuguc

SEQ ID NO: 110755 - RNA, 59 nt, Mus musculus
uggcauaggccugacgggccccucagagaccacgggcugaguagagacuaccuaccuca

SEQ ID NO: 110756 - RNA, 43 nt, Mus musculus
gauaagaagauagaaagacuggacacagaugauuuggacgaga

SEQ ID NO: 110757 - RNA, 42 nt, Mus musculus
agccgggcggugguggcacaguccuuuaaucccagcacuugg

SEQ ID NO: 110758 - RNA, 46 nt, Mus musculus
uugaagccagguguggugguugcaugccuuuaauuucaguacucag

SEQ ID NO: 110759 - RNA, 45 nt, Mus musculus
uuccaggccagccuggucuacagaggaaaaggaaaagaaaugaaa

SEQ ID NO: 110760 - RNA, 45 nt, Mus musculus
ugucuguaugugagcaugugccauggguguacagguggaggucag

SEQ ID NO: 110761 - RNA, 41 nt, Mus musculus
cccugucucgaaaaaaccaaaaagaaaaaagaaaaaaaaga

SEQ ID NO: 110762 - RNA, 46 nt, Mus musculus
uucaccaacccaaggaguuccacugguucagucuuuugcaugccag

SEQ ID NO: 110763 - RNA, 45 nt, Mus musculus
ccuucuuucagagccuggccuaucaaagguugcacugcauucuca

SEQ ID NO: 110764 - RNA, 45 nt, Mus musculus
gagccugcucccucccuucagggaagcaguucagcaccgagccug

SEQ ID NO: 110765 - RNA, 42 nt, Mus musculus
aaaaaaaucaaguauccugggcaugacuuugucaccucccag

SEQ ID NO: 110766 - RNA, 46 nt, Mus musculus
agaaggaaugcuauauaggagaaugccaugugaagugagggcagag

SEQ ID NO: 110767 - RNA, 46 nt, Mus musculus
acucaccauuggugucugcuuugacuuucucuuccuugaucugcaa

SEQ ID NO: 110768 - RNA, 46 nt, Mus musculus
ggaugccugguaagagguuagcgacacuacugcagagcuggcuggg

SEQ ID NO: 110769 - RNA, 46 nt, Mus musculus
cuacgacaaaugauuuauguucccagagcccugggucuguccccca

SEQ ID NO: 110770 - RNA, 46 nt, Mus musculus
ggcucagcagguaagagcacccgacuguucuucugaagguccugag

SEQ ID NO: 110771 - RNA, 42 nt, Mus musculus
aaacauaagauauuaaaagaaaguauuugaggcgaccccgag

SEQ ID NO: 110772 - RNA, 45 nt, Mus musculus
ggcugugucaaaaacacaggcagcaaagcuguaacucauacacuu

SEQ ID NO: 110773 - RNA, 42 nt, Mus musculus
agagaugcuccgcgccccgccaacaccagcgccgaacgcaag

SEQ ID NO: 110774 - RNA, 45 nt, Mus musculus
ggguucacaggauaaaaugcugcugcugcugcugcuguucaguuu

SEQ ID NO: 110775 - RNA, 93 nt, Mus musculus
agcucuuggacgaaggagcucagggaaagaaagaagggagaagcucagggaaagacauauuuuuguguaaugaaaaguuuugugaugcucauu

SEQ ID NO: 110776 - RNA, 45 nt, Mus musculus
auguauugagcuuacagagccuugaucccagggauuugacuguua

SEQ ID NO: 110777 - RNA, 46 nt, Mus musculus
caccuuuuaaaaaggugaguccuacauugugaauggcucuggcaug

SEQ ID NO: 110778 - RNA, 41 nt, Mus musculus
cacaauaaacagagaacuucucacacuggcuaggccauaga

SEQ ID NO: 110779 - RNA, 46 nt, Mus musculus
auuccuugcuuuguuugcaguuccugaaagauuaguccugucagag

SEQ ID NO: 110780 - RNA, 75 nt, Mus musculus
uggaguuugcaggccagccucguggaagugacagcacagaacagagagcacguagaggcagaguccucagggagg

SEQ ID NO: 110781 - RNA, 88 nt, Mus musculus
aaaugaugagggaugguagaaauguguuuacacaacuuuggaagauuaggcaugaauacacagaaauuuaccuuuucaagucccaucu

SEQ ID NO: 110782 - RNA, 59 nt, Mus musculus; identical to SEQ ID NO: 110755

SEQ ID NO: 110783 - RNA, 43 nt, Mus musculus; identical to SEQ ID NO: 110756

SEQ ID NO: 110784 - RNA, 70 nt, Mus musculus
uggcaagaggggucuggcggucaacaugguggacagcaagcacagcaugaauauccucaacaggauccag

SEQ ID NO: 110785 - RNA, 46 nt, Mus musculus
aggugucugucgucaucaauuuugaccucccuguggacaaggacgg

SEQ ID NO: 110786 - RNA, 50 nt, Mus musculus
aaacugccagaugcugcuuuucucggccaccuuugaagacucggugugga

SEQ ID NO: 110787 - RNA, 42 nt, Mus musculus
aaugaaacuaacaacuuauuuuauuuuugaaaaccuucagac

SEQ ID NO: 110788 - RNA, 45 nt, Mus musculus
gagagauguuuuguaugcuacauuuuuuuuccuuuggccucagau

SEQ ID NO: 110789 - RNA, 45 nt, Mus musculus
gaggccacauuggucuauguauguagcaagaccuuggccccaaaa

SEQ ID NO: 110790 - RNA, 46 nt, Mus musculus
gaauggugguacaugccuauaauuccuaaauuugagaagcugagac

SEQ ID NO: 110791 - RNA, 46 nt, Mus musculus
uugcauccgggaggacugcuaaggggcuugacguuuacuuguagaa

SEQ ID NO: 110792 - RNA, 46 nt, Mus musculus
cuguccuaaaacuuauguagaccaagauggucuugaacucacagag

SEQ ID NO: 110793 - RNA, 45 nt, Mus musculus
agggggcugauaagaauucuacauccaggucagcacgcaacagga

SEQ ID NO: 110794 - RNA, 46 nt, Mus musculus
uaugcuagcuagcuuuuugugaacuucauguaagcuuaguucaucu

SEQ ID NO: 110795 - RNA, 47 nt, Mus musculus
guagggguggguguuugaguguguguguaugugugugugugugugug

SEQ ID NO: 110796 - RNA, 46 nt, Mus musculus
augaagacaaaugagguuccuccaucugcagcuagccacccauuua

SEQ ID NO: 110797 - RNA, 42 nt, Mus musculus
uccugguaggauacugggagugcuuuagcaauggccccagug

SEQ ID NO: 110798 - RNA, 45 nt, Mus musculus
aaaauuaggcagggcgugguggcacacaccuuuaaucccagcacu

SEQ ID NO: 110799 - RNA, 46 nt, Mus musculus
aauuacucagaaccaauugauauugauauaaauugcccaccuagau

SEQ ID NO: 110800 - RNA, 46 nt, Mus musculus
gggacugacugacuuuuaaauuacuuuuuggcaauuucauaaaggg

SEQ ID NO: 110801 - RNA, 46 nt, Mus musculus
uagacauucagggucuggauuagucugcuaggcaagagcaccacuu

SEQ ID NO: 110802 - RNA, 45 nt, Mus musculus
ugcucugaacaaucucacuagcccuaggcuagccuucaacucagu

SEQ ID NO: 110803 - RNA, 45 nt, Mus musculus
gcaggugugcaccaaucaaauguucuuauuguuaucgcguauaga

SEQ ID NO: 110804 - RNA, 42 nt, Mus musculus
ucccgaggguccggguccccagguccuuccuugcccggagcc

SEQ ID NO: 110805 - RNA, 27 nt, Mus musculus
acccuuagcucuggguggcgacugaag

SEQ ID NO: 110806 - RNA, 44 nt, Mus musculus
uaaaccgcucucggaucucucgugcuguuaaaguggcauccauu

SEQ ID NO: 110807 - RNA, 43 nt, Mus musculus
gcgaagagcagaguggggucauccagagggaugguggcggaag

SEQ ID NO: 110808 - RNA, 46 nt, Mus musculus
gugccaggaauugaacccugguccucuggacaagaagcaagcagcc

SEQ ID NO: 110809 - RNA, 46 nt, Mus musculus
uagaaauaaaucaguuuuuaaaaaaaaagacuugaaggggcuagau

SEQ ID NO: 110810 - RNA, 47 nt, Mus musculus
auuucuggguauuggcagcucugcucagcuucgccauagggugagau

SEQ ID NO: 110811 - RNA, 46 nt, Mus musculus
gguauaguuauauaccuaaguguauauuuggaacucacuguaaaga

SEQ ID NO: 110812 - RNA, 85 nt, Mus musculus
cauauucuuucuuucuuuccuuuuugugguuggugguaagagaaauagggguuguuucuucuucagaaagagaaguggucccaag

SEQ ID NO: 110813 - RNA, 45 nt, Mus musculus
cguccacaaacaucuuuucccgacgcagagcaagcacgguagcca

SEQ ID NO: 110814 - RNA, 45 nt, Mus musculus
guuaccauauaucguuccuaugugcagcacguacccgccucggac

SEQ ID NO: 110815 - RNA, 45 nt, Mus musculus
gggaacaucuggaucgcugagccuccaugacagaaagccauggua

SEQ ID NO: 110816 - RNA, 45 nt, Mus musculus
ugucuuuuggaacuuucuacuagugugugugugugugugugugug

SEQ ID NO: 110817 - RNA, 45 nt, Mus musculus
acguucuugccuguggccugggcggacauguccuugccaccgccu

SEQ ID NO: 110818 - RNA, 71 nt, Mus musculus
gauggcgaguugcuuucccgagagggcuucccucccaucaguucuucacaucucccagacggagcugggca

SEQ ID NO: 110819 - RNA, 52 nt, Mus musculus
caguaauggaggggggcaaugaaucacaggacagcuccaggcguguucccau

SEQ ID NO: 110820 - RNA, 43 nt, Mus musculus
gagggucccggggugaggcucaggccgcagcccaccaccagau

SEQ ID NO: 110821 - RNA, 42 nt, Mus musculus
uccaaucaggguggggcggcggcaccccuccggcgggcagcc

SEQ ID NO: 110822 - RNA, 46 nt, Mus musculus
gccaacggugcauuuguugaaaauuacagcauccugaacuugcaug

SEQ ID NO: 110823 - RNA, 47 nt, Mus musculus
cucuaccuccuuuuccugugaaacuugcuugcuuuuacugccagacc

SEQ ID NO: 110824 - RNA, 44 nt, Mus musculus
uuccugaaucuccuguuuguccuuuucuuccugucuugccgaga

SEQ ID NO: 110825 - RNA, 41 nt, Mus musculus
agguaaugagauguaaggagacuugauaucuuguguuugua

SEQ ID NO: 110826 - RNA, 46 nt, Mus musculus
agguucugugcuggcauccuaagcacugcuaggcauucaagcguug

SEQ ID NO: 110827 - RNA, 45 nt, Mus musculus
ucauagcucaacucauaaaacucuaccgauuaauauuaugggaua

SEQ ID NO: 110828 - RNA, 45 nt, Mus musculus
aaggaucaccagguuguaaaacuacaucauucguggcauucccgg

SEQ ID NO: 110829 - RNA, 46 nt, Mus musculus
uucucuacuuguaguuuguugaggcagggugucuuguuugugccau

SEQ ID NO: 110830 - RNA, 46 nt, Mus musculus
accugccaucuugccauagaaaugcugcaauuguagaugccagcca

SEQ ID NO: 110831 - RNA, 46 nt, Mus musculus
aauggcaugugacaggauuuugucaaguaaguggaacacgaggacu

SEQ ID NO: 110832 - RNA, 46 nt, Mus musculus
ggcugaggacguagucuuugacugauauaugugaagcucuaaguuu

SEQ ID NO: 110833 - RNA, 46 nt, Mus musculus
aaagcuacugagauugauaggugggaaacaguauauaacagcugca

SEQ ID NO: 110834 - RNA, 41 nt, Mus musculus
ugguacugggcaguggcugagaacuugcaucugauuugcaa

SEQ ID NO: 110835 - RNA, 42 nt, Mus musculus
auacauacauacaaacaauguaugugccuggugccuguggag

SEQ ID NO: 110836 - RNA, 42 nt, Mus musculus
aaucacuuaauuccaggaaacuuccagcuacaaaaaggcuag

SEQ ID NO: 110837 - RNA, 45 nt, Mus musculus
uagaccaggcuggccucaagcucacagagauccaccugccucugc

SEQ ID NO: 110838 - RNA, 46 nt, Mus musculus
uuaggguagucauagaaacagaaagaaaaauagugguugccggggg

SEQ ID NO: 110839 - RNA, 41 nt, Mus musculus
gccagacuggacacuuagugauuucuauugagccuggguua

SEQ ID NO: 110840 - RNA, 45 nt, Mus musculus
gggcaucuggggagccugugagauggcugaguggggaagggcguu

SEQ ID NO: 110841 - RNA, 46 nt, Mus musculus
uucuucucucuguccuaucugaggcccaacagccuucugucuccau

SEQ ID NO: 110842 - RNA, 45 nt, Mus musculus
gcuucggagcccuccagagcagccgcaccuuucugcgccaccggg

SEQ ID NO: 110843 - RNA, 42 nt, Mus musculus
guaucugcagagagguuguucuuaccccgacucuacccccuu

SEQ ID NO: 110844 - RNA, 45 nt, Mus musculus
cuagcucugauauaugaucugaagguuccccguugggauuuccag

SEQ ID NO: 110845 - RNA, 34 nt, Mus musculus
ccaaacucaaguccucaugcuugcauagcaagcu

SEQ ID NO: 110846 - RNA, 46 nt, Mus musculus
agcaagacuuucuacaagccagauugguuugauauuguggagucag

SEQ ID NO: 110847 - RNA, 42 nt, Mus musculus
ugaccuugauguaccuguaggccacaucguucauacuggcau

SEQ ID NO: 110848 - RNA, 46 nt, Mus musculus
ucagcagguccacuguugggccuggcuuaacaaauacuugccgaaa

SEQ ID NO: 110849 - RNA, 45 nt, Mus musculus
ggugguucacaaccaucuguaaugggaucugacacccucuccugg

SEQ ID NO: 110850 - RNA, 46 nt, Mus musculus
cuacaucucucugugccucucagccaaacaguugugaugugucuaa

SEQ ID NO: 110851 - RNA, 46 nt, Mus musculus
caugacacagaccuugauuuguggccuugguggggagaacccauuu

SEQ ID NO: 110852 - RNA, 35 nt, Mus musculus
ugccuggguuauguacacaauuuuucugaggacag

SEQ ID NO: 110853 - RNA, 45 nt, Mus musculus
uaaacugauaucaauagaaauccuuucauuucuuuagagcagcuc

SEQ ID NO: 110854 - RNA, 46 nt, Mus musculus
uacuuggcuuucaagauuuuaaaugauuaaaaggacacacaauuag

SEQ ID NO: 110855 - RNA, 46 nt, Mus musculus
ggaaguuuucugugauacuccaugaaggcucuuuucucuuagccag

SEQ ID NO: 110856 - RNA, 46 nt, Mus musculus
aucauguuucaaaagaucuaugccaagauuucuuuugcacaccaag

SEQ ID NO: 110857 - RNA, 46 nt, Mus musculus
uguuacugagauucugaacauaaugugcauuuuuuucuguacagau

SEQ ID NO: 110858 - RNA, 42 nt, Mus musculus
gcagagcgcacagcaugcugugcagggucuugggccucuaac

SEQ ID NO: 110859 - RNA, 46 nt, Mus musculus
aagggguuuucucugacaucuucaccugggcacugagcaccaggca

SEQ ID NO: 110860 - RNA, 46 nt, Mus musculus
aguaaccaagucuaaagccaaauuucccuucuugcuacccagaccu

SEQ ID NO: 110861 - RNA, 47 nt, Mus musculus
uuucccuaccccaaaacaaaacaagcuuuuuccacuugcccccaguu

SEQ ID NO: 110862 - RNA, 49 nt, Mus musculus
ggcaucuguggaccaggucagaaaucugucaaugagccaagaaccagac

SEQ ID NO: 110863 - RNA, 72 nt, Mus musculus
acaaaacaaaacaaaacaaaacacagaccuacagugcgagccaaagucugagccucacccuucacuguccug

SEQ ID NO: 110864 - RNA, 45 nt, Mus musculus
agaauagaaaaaaaaaauagcuacuaguguuuuaaauugcuuagu

SEQ ID NO: 110865 - RNA, 42 nt, Mus musculus
uccugcucuguaagcaaccuccuccacugcuagcuggcugag

SEQ ID NO: 110866 - RNA, 60 nt, Mus musculus
auauaauauauauuuuauuaaccuguuagauguccacagaguauuauaaaucaugugccu

SEQ ID NO: 110867 - RNA, 87 nt, Mus musculus
ucuucccucacuccuccagugugaagaugacagggccggagcauaggagggaggagcccaggcacugcaguuccccuuuggcgaguu

SEQ ID NO: 110868 - RNA, 67 nt, Mus musculus
gaccaacaagcuccuuugugccucuaaaugaagggauguggaaagugauugcauuaaaagauggagg

SEQ ID NO: 110869 - RNA, 44 nt, Mus musculus
gguguaggacuugcuucacuuaguuugcugaacaauaguacagg

SEQ ID NO: 110870 - RNA, 41 nt, Mus musculus
gcacagccagcaggggcccagccauccucuuccuccaagau

SEQ ID NO: 110871 - RNA, 42 nt, Mus musculus
gcuucuacugcagugugaugccuucuacccucuaccccagac

SEQ ID NO: 110872 - RNA, 42 nt, Mus musculus
gucagcaggacuuggaggagcgaugcauaucccgugccugau

SEQ ID NO: 110873 - RNA, 96 nt, Mus musculus
ugaucagcgggagcaucugcauacucuuccugauuggccugauguguggacggaucaccaagagagugacacgagagcugaaggacagguagaggc

SEQ ID NO: 110874 - RNA, 42 nt, Mus musculus
guucuucacacagcaugugccuuggacauuaaacaccacugu

SEQ ID NO: 110875 - RNA, 92 nt, Mus musculus
gugcugaagaagcagcagcccaggagcaaacaggccaaguggaagagugccugaaggucaaccugcucaagaucaagacagagcuguguaaa

SEQ ID NO: 110876 - RNA, 46 nt, Mus musculus
aaggacgauucagagcuagaaggccaaguuaucucaugccucaagc

SEQ ID NO: 110877 - RNA, 41 nt, Mus musculus
caggugcccugagcugagucacauugcugguguuggggaga

SEQ ID NO: 110878 - RNA, 46 nt, Mus musculus
aauugauggaucccaaaugcaaacagaugauaaccaagcgccagau

SEQ ID NO: 110879 - RNA, 42 nt, Mus musculus
guaugaauggauacaguauaugugccuggggcccacugagac

SEQ ID NO: 110880 - RNA, 46 nt, Mus musculus
gggcgaccuaagugacaauagcagugugauccuuucccguuguguc

SEQ ID NO: 110881 - RNA, 54 nt, Mus musculus
cagcugaguacccguugccaccagaaaguauuuaagcugcaggagacggagaug

SEQ ID NO: 110882 - RNA, 47 nt, Mus musculus
ugacaucaagaacuacuguucuacagugcaauauggaaaugcucagg

SEQ ID NO: 110883 - RNA, 50 nt, Mus musculus
aggaggccaaggagcaccgaguaucacucaagugccgcaagcagcuucgu

SEQ ID NO: 110884 - RNA, 46 nt, Mus musculus
acuugcauaccuaugacaaaguuuagcacauaaauuagccacagaa

SEQ ID NO: 110885 - RNA, 67 nt, Mus musculus
gauuuucgauucucuuacaaguucaaaauggccugcaaggaggauguguuaaagcuuugccccaaca

SEQ ID NO: 110886 - RNA, 47 nt, Mus musculus
gggaccugauggagugucugauccagaacaagcaccagaaggacaug

SEQ ID NO: 110887 - RNA, 47 nt, Mus musculus
auauacaaauagaagcuuugcugaugagagccugugagccuaucauu

SEQ ID NO: 110888 - RNA, 46 nt, Mus musculus
gagcagauugucuugucaauuuaaucccaacacuggggaggcagag

SEQ ID NO: 110889 - RNA, 74 nt, Mus musculus
ccuucaggaccaucucgaugacuuagcuguggaaugcagagacaucgugggcaaccucaccgaguuagaguccg

SEQ ID NO: 110890 - RNA, 36 nt, Mus musculus
uccugcccuccaggacaagugccucauagaccuagg

SEQ ID NO: 110891 - RNA, 45 nt, Mus musculus
cuuucucugucuccucuuccccucucccucccucuccgugugugu

SEQ ID NO: 110892 - RNA, 63 nt, Mus musculus
cagugaacuuaugcccccuggagcuguguuuucuugccuauacagacaugccuaccgcacaga

SEQ ID NO: 110893 - RNA, 57 nt, Mus musculus
ccgaaaaugccagggagaugcuucccgccuuugccauacccaugguuggaaugagac

SEQ ID NO: 110894 - RNA, 46 nt, Mus musculus
cauucagagugaggugugccugcuaaugccuguaagaucaguuuag

SEQ ID NO: 110895 - RNA, 51 nt, Mus musculus
uaguggaaggcacugccucauucuguucccuuguguggucaauaucaaaag

SEQ ID NO: 110896 - RNA, 65 nt, Mus musculus
gugaacaccggcucuuagagcuacaguauuuuaucucucgggauuggaagugaguauuuuaaaaa

SEQ ID NO: 110897 - RNA, 46 nt, Mus musculus
uggacacacaccaaacuuuugcuaaaacuaauauugagacugagac

SEQ ID NO: 110898 - RNA, 45 nt, Mus musculus
gaagcuugugagucuguaauacagacagccugcaaacacauacga

SEQ ID NO: 110899 - RNA, 46 nt, Mus musculus
cuauuuuucuuucucuauuuaagauucccacuccacagccccaucu

SEQ ID NO: 110900 - RNA, 46 nt, Mus musculus
gaaggauagagucguccuuugucuucuauauuaucuagccuuaguc

SEQ ID NO: 110901 - RNA, 45 nt, Mus musculus
gagaucugacgcccucuucugggguuucugaagacagcugcagug

SEQ ID NO: 110902 - RNA, 41 nt, Mus musculus
ggaaaggggagaaggagagcaagagguaagagacaaggaga

SEQ ID NO: 110903 - RNA, 58 nt, Mus musculus
ccccgagaucauccugagcugucgaggggagauugaacaccauuguucuggauuacau

SEQ ID NO: 110904 - RNA, 69 nt, Mus musculus
ggugagcagugagugccaaggugagaugcuggauuaccgacgcaugcugauggaagacuucucucugag

SEQ ID NO: 110905 - RNA, 42 nt, Mus musculus
ucuccuaccuucugaugugccuggagucagcagugcacagag

SEQ ID NO: 110906 - RNA, 46 nt, Mus musculus
cacgcgcgcgcacacacacacacacacacacacacacacuauaaau

SEQ ID NO: 110907 - RNA, 42 nt, Mus musculus
caccagcccccaucuccugugaauuuuaaauagugucuagau

SEQ ID NO: 110908 - RNA, 45 nt, Mus musculus
uaucagagccacugauuauaaaguuuuauugacugugguaucaaa

SEQ ID NO: 110909 - RNA, 66 nt, Mus musculus
cuuaggguggcugagcuguccucggaugacuuucauuuagaccggcauuuguauuuugcuugccga

SEQ ID NO: 110910 - RNA, 46 nt, Mus musculus
auucacaaggugaggugguaucauguuuggaaaaaggccugguaaa

SEQ ID NO: 110911 - RNA, 46 nt, Mus musculus
gucaacuauuuccgagguaaagugugaaauaauuguguggcuauug

SEQ ID NO: 110912 - RNA, 46 nt, Mus musculus
gauuguuucucauauguaccuuucugguaaauuugcccucagagau

SEQ ID NO: 110913 - RNA, 45 nt, Mus musculus
gaacuggaguuacaaaugguugugggcagccaugugagugcuaga

SEQ ID NO: 110914 - RNA, 46 nt, Mus musculus
cagggcugucuuggacucagauuuuccaaaucagcuggcaccuuga

SEQ ID NO: 110915 - RNA, 46 nt, Mus musculus
ugugugugugugugagagagaagagagagagagagagagaggagag

SEQ ID NO: 110916 - RNA, 46 nt, Mus musculus
acuuugaacagugagaaugauugaaguaacuuagugguggccauga

SEQ ID NO: 110917 - RNA, 46 nt, Mus musculus
cuguuuauuuuucucagaccauuccuguaucucucuugccugacuc

SEQ ID NO: 110918 - RNA, 30 nt, Mus musculus
cagguaaccaaaaugguuagauuauacugg

SEQ ID NO: 110919 - RNA, 42 nt, Mus musculus
ccuuuaaccgcugagccaucucuccaucuccuggcccuagau

SEQ ID NO: 110920 - RNA, 46 nt, Mus musculus
agagauuagaaugggagaggagcaaaagagaaaagggaaccaaccu

SEQ ID NO: 110921 - RNA, 45 nt, Mus musculus
ucugauauauuauaaacacauccuuaaaauuaauagggucucaga

SEQ ID NO: 110922 - RNA, 46 nt, Mus musculus
acugaaguuaacagugcuucagaaaaucuugaacaagcccccagag

SEQ ID NO: 110923 - RNA, 46 nt, Mus musculus
ugggguaaagaagguucuggguuugauauucugcacuucaagggau

SEQ ID NO: 110924 - RNA, 45 nt, Mus musculus
uuccaagugguggucuaacacacuauugccaaaagcuggcagaga

SEQ ID NO: 110925 - RNA, 46 nt, Mus musculus
uuuggaagagaggagagguauuggauucacuagggacuggaguugc

SEQ ID NO: 110926 - RNA, 45 nt, Mus musculus
cugguuuacagagugaguuccaagacagccagggcuauacagaga

SEQ ID NO: 110927 - RNA, 42 nt, Mus musculus
caccguagcuguccucagacacaccagacgagggcgucagau

SEQ ID NO: 110928 - RNA, 42 nt, Mus musculus
uuauuuaugaccuagaccuuuguuuggaaagaugguagugcu

SEQ ID NO: 110929 - RNA, 46 nt, Mus musculus
guugugaaaaccaaggaaaggagaguuucagagugagagucaagga

SEQ ID NO: 110930 - RNA, 37 nt, Mus musculus
ggaaaauuacagcuuugauaagugcuaugaaagagag

SEQ ID NO: 110931 - RNA, 46 nt, Mus musculus
agcauuaauuuacugacaugagaugauguuagguugaguacuaggg

SEQ ID NO: 110932 - RNA, 45 nt, Mus musculus
uuuauuuuauuuauuauauguaaauacacuguagcugucuucagg

SEQ ID NO: 110933 - RNA, 46 nt, Mus musculus
aggauuuacauauauaauugucucaugauuucuugcucauucagag

SEQ ID NO: 110934 - RNA, 42 nt, Mus musculus
cacaacugcuuugauuacagguaggagcaaacacgccaggcu

SEQ ID NO: 110935 - RNA, 45 nt, Mus musculus
uugagucaucaaaaaagugagugaugggaacuagauugggguccu

SEQ ID NO: 110936 - RNA, 45 nt, Mus musculus
cuauuauucauuuuuaaauaauuuauuuuuccuuuaaucccagaa

SEQ ID NO: 110937 - RNA, 46 nt, Mus musculus
gagggaaucguuuacucuucaaguuacuguuugcaguuagggagau

SEQ ID NO: 110938 - RNA, 46 nt, Mus musculus
aggguaguguugggagacugauauauuuuaaagcauacaccagaug

SEQ ID NO: 110939 - RNA, 42 nt, Mus musculus
cccugggacucaaacuaaagucaucuauaagagcagcaagug

SEQ ID NO: 110940 - RNA, 45 nt, Mus musculus
ugguugugagccaccaugugguugcugggauuugaaccugggacc

SEQ ID NO: 110941 - RNA, 46 nt, Mus musculus
gucccaucuguuaguagauacauuguuacuguauugauguagaaau

SEQ ID NO: 110942 - RNA, 46 nt, Mus musculus
ggcccuuuuuuuuuauggcacauccuguuaauucuggaacuugaga

SEQ ID NO: 110943 - RNA, 45 nt, Mus musculus
uuaaaaaacauugacaacuucuuuucuauauuugaugcugcagac

SEQ ID NO: 110944 - RNA, 47 nt, Mus musculus
aacucaucaugauuuucagggguuucacuugucuauaccagggaaga

SEQ ID NO: 110945 - RNA, 46 nt, Mus musculus
ugugagugagugagugagugagagagagagagagagagagagagag

SEQ ID NO: 110946 - RNA, 46 nt, Mus musculus
uaggugguugugagccuccaugugggcugagaaccaagcuccgguc

SEQ ID NO: 110947 - RNA, 45 nt, Mus musculus
auguguuuacacauaccuguaauucuagcccuuggugucuggaga

SEQ ID NO: 110948 - RNA, 45 nt, Mus musculus
ccuccagucucccgagacaacggccaucucccucuguggaaagau

SEQ ID NO: 110949 - RNA, 46 nt, Mus musculus
ucccagcacccacauggcagaucacaacugucuguaacuccaagau

SEQ ID NO: 110950 - RNA, 24 nt, Mus musculus
uuggggagcugggggggggucaag

SEQ ID NO: 110951 - RNA, 46 nt, Mus musculus
ggaccacacagugaauuuccugcuagcuagggcuacaaaaggagau

SEQ ID NO: 110952 - RNA, 41 nt, Mus musculus
uaaguacauagcaaacuaagcaaaugaaagaaugaggcagu

SEQ ID NO: 110953 - RNA, 45 nt, Mus musculus
ccuugucucaaaaacaauaaaacauuaaaaaagcauauuuuauau

SEQ ID NO: 110954 - RNA, 46 nt, Mus musculus
gcuauuguuuaucaagcccaugguaagcacaguggagcccguggca

SEQ ID NO: 110955 - RNA, 46 nt, Mus musculus
ccaauacccagcaguuugacgacuuuaagaagugcuacggagagau

SEQ ID NO: 110956 - RNA, 46 nt, Mus musculus
ggagucugaccuacagugacccccgggagcgggaacgagaccagca

SEQ ID NO: 110957 - RNA, 64 nt, Mus musculus
ggcgacaacugcuggagucccuguagguucugagagcuaaaagugaggagaaugaguggagggg

SEQ ID NO: 110958 - RNA, 46 nt, Mus musculus
ugguugugagcuaccaugugguugcugggauuugaacuuuggaccu

SEQ ID NO: 110959 - RNA, 45 nt, Mus musculus
uguuuuacugaucucuauaacccugcaauugggauugucugcaga

SEQ ID NO: 110960 - RNA, 46 nt, Mus musculus
aauugcauggagcuuucaaaagccugccuuuggcauggggggagca

SEQ ID NO: 110961 - RNA, 46 nt, Mus musculus
cugccugacuuagguugaauuugcauucacccaguguucucuagau

SEQ ID NO: 110962 - RNA, 46 nt, Mus musculus
agguaaaugaaggcuuuauuuaguaucagggcuaguuugaagagau

SEQ ID NO: 110963 - RNA, 54 nt, Mus musculus
cugugucuggcacagaccuccuucaggcacccaccaaacucuaucucccacaag

SEQ ID NO: 110964 - RNA, 54 nt, Mus musculus
gccaaacagggauguggcucuaguuauugucaugccugccuucaguccuccaca

SEQ ID NO: 110965 - RNA, 90 nt, Mus musculus
agaauucuucagcuucccacaaaacagggauaaugacugucaguaauuagaauuugcuuuaacaacggaaucauuuaaaauccaagggau

SEQ ID NO: 110966 - RNA, 46 nt, Mus musculus
aguacauuguagcugucaucagacacaccagaagagggcaucagau

SEQ ID NO: 110967 - RNA, 46 nt, Mus musculus
gaguuugugucugcuuaaagccuuaauucuuucaccucuccuagau

SEQ ID NO: 110968 - RNA, 45 nt, Mus musculus
gcucucaauguggaacagugugugugugugugucugugucugugu

SEQ ID NO: 110969 - RNA, 45 nt, Mus musculus
ucccccagacucugcaacaggaguucuccuugaucaacgugcaga

SEQ ID NO: 110970 - RNA, 42 nt, Mus musculus
ccucaagacauagaucaccagcccagcuuaagccauggagag

SEQ ID NO: 110971 - RNA, 55 nt, Mus musculus
gcccaggacaaggaguagaauggagaguuggugaaggcaggaagaggcuguguga

SEQ ID NO: 110972 - RNA, 42 nt, Mus musculus
ggucauuaggagagaaauugcaaagcaggcugaggcuagaag

SEQ ID NO: 110973 - RNA, 52 nt, Mus musculus
uuggcuuuggucggcacugugggaauggaucaggacguggcagcuaagggaa

SEQ ID NO: 110974 - RNA, 42 nt, Mus musculus
gaaaacaaaaacaaaaaacaaacaaaaaaaaagaaagaauag

SEQ ID NO: 110975 - RNA, 41 nt, Mus musculus
cguggcagggacuuucauuguuuuaccccaccagcagggag

SEQ ID NO: 110976 - RNA, 46 nt, Mus musculus
gaugcagauccuagaccaggcugugagagcagguauaguaagaggu

SEQ ID NO: 110977 - RNA, 45 nt, Mus musculus
aaaaaaaagaaaaggaagcugugcuuuuuuggaucaggacucaga

SEQ ID NO: 110978 - RNA, 51 nt, Mus musculus
cuuguuuugucuguuuauucagagagaggggagaaggagagaguagggcga

SEQ ID NO: 110979 - RNA, 46 nt, Mus musculus
auauuuaaugagaagcaaguggaugccuucauuucuguguguagug

SEQ ID NO: 110980 - RNA, 46 nt, Mus musculus
uggaacccucaugacagcuucgcacacuauuuugcagcuucgguga

SEQ ID NO: 110981 - RNA, 46 nt, Mus musculus
cugaguagccagcuccagagagccaucugucuccuccuccccagga

SEQ ID NO: 110982 - RNA, 46 nt, Mus musculus
aaaauuauagauaugaaguacuaaugcaauaauuuuacgguugggg

SEQ ID NO: 110983 - RNA, 42 nt, Mus musculus
gcgaucauuugccaaagugaauguaagaucugggugggagcc

SEQ ID NO: 110984 - RNA, 78 nt, Mus musculus
acuuagaauaugcugucuugguuguguauaguccugguguaugugugugaguguguguauaugugugucugugugugu

SEQ ID NO: 110985 - RNA, 45 nt, Mus musculus
aauaaaauacuguaacuaaagagaggguuuauuugggcuuguggu

SEQ ID NO: 110986 - RNA, 40 nt, Mus musculus
uuaaggaugccuuucuucuaugguucuuacuuagucgugu

SEQ ID NO: 110987 - RNA, 44 nt, Mus musculus
agggcuggcaggaauucaucuuaaagaauugauaauggcuggca

SEQ ID NO: 110988 - RNA, 46 nt, Mus musculus
caagugcugagcuuacaggaauguauugucacgcccagcccaagau

SEQ ID NO: 110989 - RNA, 46 nt, Mus musculus
agacagcuuuggcagcaaugucagccucuauaauuuaucuagagau

SEQ ID NO: 110990 - RNA, 46 nt, Mus musculus
guggguaucugugugugugugugugugugugugugugugugugugu

SEQ ID NO: 110991 - RNA, 46 nt, Mus musculus
ucucauugcuuuagccuguauauuguauauaaauuagcuguugauu

SEQ ID NO: 110992 - RNA, 45 nt, Mus musculus
gaggggaaaaggggcccaguuuuuauaggccuucagggggaaagg

SEQ ID NO: 110993 - RNA, 46 nt, Mus musculus
uccucucaaaggugagcccauacuuggcgggagacucugggcuaag

SEQ ID NO: 110994 - RNA, 42 nt, Mus musculus
gggagaggagcuggccugccugauacacaccccaccaaggag

SEQ ID NO: 110995 - RNA, 46 nt, Mus musculus
uucuuccccaggguaccuuguuuaacugccccuaucccgcccccac

SEQ ID NO: 110996 - RNA, 45 nt, Mus musculus
acccccagcacuccucccucagccuccgcccuccccagcccccaa

SEQ ID NO: 110997 - RNA, 42 nt, Mus musculus
gccgggagauggguacacacacguccguggaauaggccugaa

SEQ ID NO: 110998 - RNA, 45 nt, Mus musculus
uccuggcugaguccacccugcaggggagaaaagugcgaggggguc

SEQ ID NO: 110999 - RNA, 42 nt, Mus musculus
gaaagguagcauaauuuaagauuggcagguuuuuagggugag

SEQ ID NO: 111000 - RNA, 44 nt, Mus musculus
ucacucuucuuauccuaguguacugugagacagcugggcagcaa

SEQ ID NO: 111001 - RNA, 42 nt, Mus musculus
gagguuaauaagggcauugauuauaugcccugugaggaggag

SEQ ID NO: 111002 - RNA, 46 nt, Mus musculus
caggagggauccuguuuuuucuguuagucuauggcuuuuugggggg

SEQ ID NO: 111003 - RNA, 46 nt, Mus musculus
uuuuaggauguaucuguuucuccuauugugucuuuagugccugaga

SEQ ID NO: 111004 - RNA, 46 nt, Mus musculus
uagcauucauccuuuuuuuuuuccuuguaauuuccaucuuugccga

SEQ ID NO: 111005 - RNA, 42 nt, Mus musculus
guuuauuuuccaucucugauguauguauguauuaccaacaag

SEQ ID NO: 111006 - RNA, 42 nt, Mus musculus
guuuuuggugaucuuauggacagguacuaggaaaaggggcau

SEQ ID NO: 111007 - RNA, 42 nt, Mus musculus
uggaggacaacaauguuuuugggguucccgcaaucagcaaga

SEQ ID NO: 111008 - RNA, 42 nt, Mus musculus
ggccugccugucccuguguguguguagagucuguaugugcaa

SEQ ID NO: 111009 - RNA, 46 nt, Mus musculus
gggauccguuucauucacugauguaacuguggacuucacccaggag

SEQ ID NO: 111010 - RNA, 45 nt, Mus musculus
ugcccacuuuaaggucauuuuguccucgggaaacacacacagcag

SEQ ID NO: 111011 - RNA, 45 nt, Mus musculus
gguggggucacuuacaaccaucaagaaccaaccaccaacugaaga

SEQ ID NO: 111012 - RNA, 45 nt, Mus musculus
acaauucagacuuacuuagcaguagaaacuguguaagaaagaaag

SEQ ID NO: 111013 - RNA, 79 nt, Mus musculus
aagcaagagaaaccccacgcuggacuggaauacucagaauauaauggaaacggaagggcucucagccauaaggaugcca

SEQ ID NO: 111014 - RNA, 46 nt, Mus musculus
ucccauaaggccaaccucaucaaacaucagagaauucacaccggag

SEQ ID NO: 111015 - RNA, 54 nt, Mus musculus
acaccagaggauucacacaggagagcggcccuacgaguguaacgaaugcgcaaa

SEQ ID NO: 111016 - RNA, 55 nt, Mus musculus
aaccuucuuuaagaaaucaaaccucaucauacaucagaagauucacacgggggag

SEQ ID NO: 111017 - RNA, 81 nt, Mus musculus
gcccuacgagugcaccgaguguggcaagaccuucagccagaggucaacgcugaggcugcaccugagaauccacacgggaga

SEQ ID NO: 111018 - RNA, 46 nt, Mus musculus
aguccugaggcucaggcaggcugcugcagaaaaccugucaggccag

SEQ ID NO: 111019 - RNA, 46 nt, Mus musculus
guacauauccaaauauauguauguaucucaguauguguauauccag

SEQ ID NO: 111020 - RNA, 45 nt, Mus musculus
uccuuucaagguagucaucuuuaacgcuggaccuuuaacuucgag

SEQ ID NO: 111021 - RNA, 46 nt, Mus musculus
gaugacagaugaaacccuagccagaucaaucuuuucaucggccuag

SEQ ID NO: 111022 - RNA, 49 nt, Mus musculus
acaagaggaaguacuugguccccucggacaucacuguggcucaguucau

SEQ ID NO: 111023 - RNA, 45 nt, Mus musculus
ggcauaugcaauagugucuggguuugguaacugauuaugggaugg

SEQ ID NO: 111024 - RNA, 44 nt, Mus musculus
ccugagucauauuucagcuuucaugugucuccccaguggggauu

SEQ ID NO: 111025 - RNA, 46 nt, Mus musculus
gaauuccuauacagugacccugggcucuacagugacucuaucaaaa

SEQ ID NO: 111026 - RNA, 42 nt, Mus musculus
agagagagagagagaaagaaagaagaaaagaaaaaguuccaa

SEQ ID NO: 111027 - RNA, 41 nt, Mus musculus
ucuuuguaaaucuuuguacuaucuauuucuggucucuggua

SEQ ID NO: 111028 - RNA, 42 nt, Mus musculus
cgacauucaugccaugcuugcagcuugcacaguggcugggga

SEQ ID NO: 111029 - RNA, 23 nt, Mus musculus
agaggggcaguggugcuugaggu

SEQ ID NO: 111030 - RNA, 45 nt, Mus musculus
uccacccccagguuuaguuaaggaauccuauuuuuggagguucuu

SEQ ID NO: 111031 - RNA, 47 nt, Mus musculus
acgagaaggaaaaagaugaagauggauucuuguauguggccuacagc

SEQ ID NO: 111032 - RNA, 45 nt, Mus musculus
uauuggaagguuuuguuuccuuagauuaguaaauuaucauacaga

SEQ ID NO: 111033 - RNA, 82 nt, Mus musculus
ggcugaugcauaguucuggauuauguugaaaguguuagauggcuaaguauuaaaagcacccagauuaaauccuuagcaauca

SEQ ID NO: 111034 - RNA, 46 nt, Mus musculus
ugcugggaauugaacccagguccuguggaaaagcagccaguacuag

SEQ ID NO: 111035 - RNA, 46 nt, Mus musculus
gacuucauucucagacaagugaugcuuaucugcuuugcaccucuag

SEQ ID NO: 111036 - RNA, 48 nt, Mus musculus
aucacgcccagaguuauauagaagaaccauuugugugugugugugugu

SEQ ID NO: 111037 - RNA, 45 nt, Mus musculus
cuacuuggagugacuuuccgccucugccucccccccgccccccaa

SEQ ID NO: 111038 - RNA, 46 nt, Mus musculus
ucucucacacacacacacacacacacacacacacacacacgcagag

SEQ ID NO: 111039 - RNA, 53 nt, Mus musculus
gaagcaaaguuugaggugacacuuagaggcagaggugggaagaucagaguuca

SEQ ID NO: 111040 - RNA, 45 nt, Mus musculus
uaaguacugauuucaguuuuauuuuaguaaguuuuguuagugaag

SEQ ID NO: 111041 - RNA, 43 nt, Mus musculus
uccaaaaagccaaaacaggcugggcaguguuggcgccgggcag

SEQ ID NO: 111042 - RNA, 42 nt, Mus musculus
aaacaaacaauguaugaauguaguuaaaaucucucagcccgg

SEQ ID NO: 111043 - RNA, 24 nt, Mus musculus
cgcuaucaaaacagggagcagcag

SEQ ID NO: 111044 - RNA, 46 nt, Mus musculus
aacagagaaaguaaguguagcaaaggagggauuuccaagggccaag

SEQ ID NO: 111045 - RNA, 46 nt, Mus musculus
uacugcggaaguacacagaagaaagccgauaauguacagccuuaac

SEQ ID NO: 111046 - RNA, 42 nt, Mus musculus
agaaaugcaaacugugaggcuggagagacagcucgguggcag

SEQ ID NO: 111047 - RNA, 45 nt, Mus musculus
agaaaaaggauaaacagcacacuucugugguaaagagagcucuca

SEQ ID NO: 111048 - RNA, 46 nt, Mus musculus
caccaagccacuuccauacaaccuaacagaacauuaugcagaucag

SEQ ID NO: 111049 - RNA, 45 nt, Mus musculus
cgauuauauaaaaagcuccguagaugagcucacgcgauggcuaga

SEQ ID NO: 111050 - RNA, 42 nt, Mus musculus
gaaacauggugagccgaucaaugcccaugccccagcccgcug

SEQ ID NO: 111051 - RNA, 46 nt, Mus musculus
ugugaugguacauaucuguaguucaaauuacuaggagggcugagac

SEQ ID NO: 111052 - RNA, 42 nt, Mus musculus
gcgcccaauuucauaaacccggucaaugccaccaaccaccag

SEQ ID NO: 111053 - RNA, 45 nt, Mus musculus
ucauguccagcucauugugauaggugaugaaaggcuuggccacag

SEQ ID NO: 111054 - RNA, 45 nt, Mus musculus
agcccagcucauccaagaaacuucuuauguaugugaugaucuuag

SEQ ID NO: 111055 - RNA, 74 nt, Mus musculus
uuugaggccaaagugaagaugaggcagcaugugcaagcagggggacagcagcgugaucuccugggggaugaugc

SEQ ID NO: 111056 - RNA, 47 nt, Mus musculus
uggaguuggccaugacuuguaacuugacccccucuccucgcagguca

SEQ ID NO: 111057 - RNA, 46 nt, Mus musculus
gggucuuccugaaucuuuacauaaaaauucaguagcuagggacuag

SEQ ID NO: 111058 - RNA, 45 nt, Mus musculus
uggcuuguccaggccuucagagguuuaugaccgucaucucugcag

SEQ ID NO: 111059 - RNA, 46 nt, Mus musculus
uggcucacaaccauccuuaaugacaucugacucccucuccuggugu

SEQ ID NO: 111060 - RNA, 27 nt, Mus musculus
ccauaugaauuuagcaaaauuuaaaga

SEQ ID NO: 111061 - RNA, 44 nt, Mus musculus
gaagguaaugggcaccaaccuucuucuaucagaaaguggcuggu

SEQ ID NO: 111062 - RNA, 42 nt, Mus musculus
ggagccgugcuucucgcccagcccggggaggcgcuggccgag

SEQ ID NO: 111063 - RNA, 42 nt, Mus musculus
cucauuuauuucauuuggccuagaacucacuuagagccccag

SEQ ID NO: 111064 - RNA, 52 nt, Mus musculus
ccacagaacaagagagcgccagacuugccugaggaggagugugugaaaggag

SEQ ID NO: 111065 - RNA, 49 nt, Mus musculus
ccuggcuuuaggcuucacaaagccuuuaauauuuggcaggauaggauaa

SEQ ID NO: 111066 - RNA, 46 nt, Mus musculus
acagugcuguuugucugugaccccagcacuuuagagaugaagacag

SEQ ID NO: 111067 - RNA, 46 nt, Mus musculus
aguauuuaguauaaaagaaggaaauuaaguuuguauaaaugguaag

SEQ ID NO: 111068 - RNA, 46 nt, Mus musculus
ugauccacccacacccgaggaagacucagaaacacagccagacgag

SEQ ID NO: 111069 - RNA, 46 nt, Mus musculus
uuuuggauggacugugucccccguuguacaggugccaggagccaag

SEQ ID NO: 111070 - RNA, 45 nt, Mus musculus
uuuggaacuagaugcacugaaaaaaaaaagguuguuuguuuagag

SEQ ID NO: 111071 - RNA, 46 nt, Mus musculus
ccuucagaucaugcaaacaauaugguguugacgagaacggccccag

SEQ ID NO: 111072 - RNA, 42 nt, Mus musculus
gacuccucccccgcagguuacugugcacugccagagagagag

SEQ ID NO: 111073 - RNA, 45 nt, Mus musculus
uuuagguguaaugucagccuuuauuauacaaaaacaggugucuga

SEQ ID NO: 111074 - RNA, 85 nt, Mus musculus
uggagaugacaaaaggacaguuguucauagucaccaaggcucaugagaucaaggcuagggucuuaggagugcaagugaggggcaa

SEQ ID NO: 111075 - RNA, 46 nt, Mus musculus
ggaaauacuauaauuuugauauauauuuguuggugccaaacugcaa

SEQ ID NO: 111076 - RNA, 45 nt, Mus musculus
uacauccaaccauggaaacugaugcugucauuuuaggccuagcaa

SEQ ID NO: 111077 - RNA, 47 nt, Mus musculus
agggacucaguugagacaaccucucauugcuuccauaaaacaccuua

SEQ ID NO: 111078 - RNA, 47 nt, Mus musculus
gaaagagucaggaaagaagauauuuaagcccuccaccaaguaagauu

SEQ ID NO: 111079 - RNA, 45 nt, Mus musculus
aggaugccuuccuaggcucauaguuugauacuuugaaugugggag

SEQ ID NO: 111080 - RNA, 46 nt, Mus musculus
gaacagucacuugacaguuuuugccauagcuugcuccuaccccuuu

SEQ ID NO: 111081 - RNA, 45 nt, Mus musculus
aggccagaggagugucuuuggugacaaugaggugugugugggggg

SEQ ID NO: 111082 - RNA, 45 nt, Mus musculus
aucaccuaaacaccaacaauuaaaguuagaaaauuguucucagaa

SEQ ID NO: 111083 - RNA, 46 nt, Mus musculus
ucuuccacuggaggagauucuaggaguuuugaagaagcccccauau

SEQ ID NO: 111084 - RNA, 41 nt, Mus musculus
gagaccaaggguucaaauguccaaaaguaacaggggccauu

SEQ ID NO: 111085 - RNA, 45 nt, Mus musculus
agcuucaaauaauguucugaagcaauccauggaauaggugcacag

SEQ ID NO: 111086 - RNA, 46 nt, Mus musculus
uccuagugucuucccgauauuccuaauauugaacauggcuggagcu

SEQ ID NO: 111087 - RNA, 46 nt, Mus musculus
gugauuagcuugaauuuucuaaaugcaacuucaucauucuguagau

SEQ ID NO: 111088 - RNA, 45 nt, Mus musculus
ucugccacuucuugaccauggagcacauuuugucccggguaagau

SEQ ID NO: 111089 - RNA, 41 nt, Mus musculus
gcccgucucgucuccagcugcuuugccagagcugccgccuu

SEQ ID NO: 111090 - RNA, 45 nt, Mus musculus
uaauguggguuugugugauugaacucagguuuuuguguuuguggg

SEQ ID NO: 111091 - RNA, 30 nt, Mus musculus
agcaggugagcucacuguccagucuuguau

SEQ ID NO: 111092 - RNA, 45 nt, Mus musculus
caugcaggugaagaagcaggugagaaagcaggcaaggaagcaggu

SEQ ID NO: 111093 - RNA, 46 nt, Mus musculus
caagcaggugagcaugugggugaagaagcaguugagcaggcaggug

SEQ ID NO: 111094 - RNA, 46 nt, Mus musculus
guaugcaagugaggaagcagguaagcaggcaggugaagaagcaggu

SEQ ID NO: 111095 - RNA, 45 nt, Mus musculus
gugaguaugcaaugcagaugaagaagcaggugagcaggcagguga

SEQ ID NO: 111096 - RNA, 46 nt, Mus musculus
acuauugaccagcagcugccauguugaaucagcagguuggguagau

SEQ ID NO: 111097 - RNA, 45 nt, Mus musculus
gccgccaaggcugcauuggguccugauguaauuucucaacaagau

SEQ ID NO: 111098 - RNA, 42 nt, Mus musculus
auguugucugagaaccucaaauaguccacauaaggggcaggc

SEQ ID NO: 111099 - RNA, 81 nt, Mus musculus
ugguguauguguguguguguguauguggugugugauguguggugugugauguguguguggugugugugugugugugugugg

SEQ ID NO: 111100 - RNA, 72 nt, Mus musculus
gugguguguguguguguguguguguguggugugugugaugugugguguguguguguauguggugugugugug

SEQ ID NO: 111101 - RNA, 53 nt, Mus musculus
gaugugugugugugugaugugugugugugugaugugugguguguggugugugu

SEQ ID NO: 111102 - RNA, 46 nt, Mus musculus
ugugugaugugugugugugugauguguggugugugugugugugguu

SEQ ID NO: 111103 - RNA, 70 nt, Mus musculus
guguguguguggugugugugugguauguguguuuguguguggugugugaugugugugugaugugugugua

SEQ ID NO: 111104 - RNA, 62 nt, Mus musculus
cagucacucagucucuuuguauaugcaccaaucucugucucucugucuuucugugugugugu

SEQ ID NO: 111105 - RNA, 45 nt, Mus musculus
ggaccuuccaguugccuuugugacucguugaaguaugagggagaa

SEQ ID NO: 111106 - RNA, 46 nt, Mus musculus
agugcucuccaagggcccguggacccucaagccccgugcccacagu

SEQ ID NO: 111107 - RNA, 44 nt, Mus musculus
gaucccucccucuccugcucuggugggaacuccccuguccugac

SEQ ID NO: 111108 - RNA, 46 nt, Mus musculus
ucucuguuucugucugucugucugucugucugucucugccucucug

SEQ ID NO: 111109 - RNA, 46 nt, Mus musculus
ucuuucucugacccaaaccuaaggaucuagugccauuugaccagug

SEQ ID NO: 111110 - RNA, 25 nt, Mus musculus
ucaagcacugggggaagcggaggca

SEQ ID NO: 111111 - RNA, 46 nt, Mus musculus
ggaccuuuuuccuccucagucuggugucuugcuaucuucuccagau

SEQ ID NO: 111112 - RNA, 46 nt, Mus musculus
gcucuggcgacccgccuugaaugccaacucgcuaauggggccagau

SEQ ID NO: 111113 - RNA, 27 nt, Mus musculus
acucccccugccagacuugcagcuucc

SEQ ID NO: 111114 - RNA, 68 nt, Mus musculus
cccguuugauguucgcgugacagcugcuagcaguugcagaaucccccucccccauuggugcaggaagg

SEQ ID NO: 111115 - RNA, 46 nt, Mus musculus
ucaaacacccuuguguauacccacaggcaucuucauauacagagau

SEQ ID NO: 111116 - RNA, 47 nt, Mus musculus
aaacgggucccaucagccggaucuggaguugaacgaccagcuuggag

SEQ ID NO: 111117 - RNA, 70 nt, Mus musculus
uccuauaggacuacccccaguggcuuacagaucaugccccugaagaaggcucagaacggccuggagaacg

SEQ ID NO: 111118 - RNA, 48 nt, Mus musculus
cccgcggccugccaguggaaagacucucccaucggccucuggaacccg

SEQ ID NO: 111119 - RNA, 50 nt, Mus musculus
ucgacgaguucaacgggcuccacuuguccaaggauaagagggugaaguca

SEQ ID NO: 111120 - RNA, 103 nt, Mus musculus
ugaaaggauuguggacaagaggaagaacaagaaggggaaaugggaauaucuuauccgauggaaaggcuacggcagcacggaggacacgugggaaccggagcau

SEQ ID NO: 111121 - RNA, 44 nt, Mus musculus
aggagaaugggaaggguggguguguuguuuuuuuggucccgaga

SEQ ID NO: 111122 - RNA, 46 nt, Mus musculus
gaguacuuacugaguuguauaagaaagcagguugagaaagccauga

SEQ ID NO: 111123 - RNA, 45 nt, Mus musculus
caaaaacaaaacaauaaacaaagcaaaaccaacaccagggacgag

SEQ ID NO: 111124 - RNA, 23 nt, Mus musculus
auggaaaaacacuuuucaggaau

SEQ ID NO: 111125 - RNA, 45 nt, Mus musculus
ggaggagaugagaggagggacgauggagggauggaggagaugaga

SEQ ID NO: 111126 - RNA, 46 nt, Mus musculus
acaugcccuucuguccagcccacaaaucguuucucuguauccuuga

SEQ ID NO: 111127 - RNA, 39 nt, Mus musculus
uacugggauuagagaugugcgccaccaccgccuggcuaa

SEQ ID NO: 111128 - RNA, 42 nt, Mus musculus
gucugacaaggagacagaaaagcucccucugacuggcaccag

SEQ ID NO: 111129 - RNA, 23 nt, Mus musculus
agagaguggggaaagcccuccag

SEQ ID NO: 111130 - RNA, 69 nt, Mus musculus
uugccgaguuucuccggaggaccauccugaaaaucccucugagugagaugaagagcauccuagaagccu

SEQ ID NO: 111131 - RNA, 69 nt, Mus musculus
gggacuuuuugucugaagaccaacuacaaaccauaaaccugaagcagagaaaggacuaucuagcccagg

SEQ ID NO: 111132 - RNA, 39 nt, Mus musculus
aagcgugcaagucuugaugacgugguccuuuuagacauc

SEQ ID NO: 111133 - RNA, 46 nt, Mus musculus
acugggguuuaucugaggagaaagguuaccuaucucagagauaccu

SEQ ID NO: 111134 - RNA, 91 nt, Mus musculus
gagccaaaagaugaguucgcaguagccaggcagagcagagaagcugaggagggggaagcugccagggauggggugggagaagaguaccuga

SEQ ID NO: 111135 - RNA, 46 nt, Mus musculus
uuguuuguuuuuuguuuguguuuuuuuguuuuugucuuuugggggg

SEQ ID NO: 111136 - RNA, 45 nt, Mus musculus
agcuaggugcuugguuuuugagagagcauguugguuacagcagaa

SEQ ID NO: 111137 - RNA, 45 nt, Mus musculus
cggcaccagaagcuuuggaauguuuuucagaugaguaaggaacca

SEQ ID NO: 111138 - RNA, 46 nt, Mus musculus
aaggauccaagccuucuuggauuucuaugaaauucaguuuaaugau

SEQ ID NO: 111139 - RNA, 46 nt, Mus musculus
cgguguggauccgaguugccuggggaacacaguauucacagccaaa

SEQ ID NO: 111140 - RNA, 42 nt, Mus musculus
ccuucauuucuuccugccaucugaagaacacugugccccuuc

SEQ ID NO: 111141 - RNA, 48 nt, Mus musculus
auaaguguuuugccuggauguguauguguguccagugcagaguccaga

SEQ ID NO: 111142 - RNA, 46 nt, Mus musculus
gaacagcaagugcucuuaaccacugagcccuuucuccagcccugag

SEQ ID NO: 111143 - RNA, 46 nt, Mus musculus
gcuucuaaucuuuaggcuagacuccuccccaguuuccuagcagcag

SEQ ID NO: 111144 - RNA, 46 nt, Mus musculus
ccuauaacagaugcuuucugccugugcaguuaaguuaaaugggcuu

SEQ ID NO: 111145 - RNA, 42 nt, Mus musculus
ccccuagccccacuagcucccuuugaccacucucccgaccag

SEQ ID NO: 111146 - RNA, 77 nt, Mus musculus
cuugagcugcaaguuucacgaggcugcugagaucaacucugcgcaggaaggagaggggagggagguuucucccgugg

SEQ ID NO: 111147 - RNA, 41 nt, Mus musculus
cucugcugagcccacugcaggcgcggcuggcugaugacaug

SEQ ID NO: 111148 - RNA, 41 nt, Mus musculus
gugagccaccaugugguugcugggauuugaacguaggaccu

SEQ ID NO: 111149 - RNA, 45 nt, Mus musculus
uuaaccagagaaaacugagaaaacggucggucggggccucgagga

SEQ ID NO: 111150 - RNA, 77 nt, Mus musculus
uggacuggugccacuguuugguugcguuuagacgcucgguguaguuggugaaaguaaggcacuggagcuggccuuug

SEQ ID NO: 111151 - RNA, 46 nt, Mus musculus
gugaguuggcuagauuuaugucaacuucacauaaacuagcguuauc

SEQ ID NO: 111152 - RNA, 46 nt, Mus musculus
gugugucgaacaucucaaggcccaggaagccugaccccgcucugaa

SEQ ID NO: 111153 - RNA, 46 nt, Mus musculus
gagcagggcaggcuccuucaguuugggucucugugucagaggaguc

SEQ ID NO: 111154 - RNA, 44 nt, Mus musculus
uuccacggagcugaacugggacuccaucguauuccaggccagau

SEQ ID NO: 111155 - RNA, 46 nt, Mus musculus
guugugagccaccaugugguugugggauuugaacucuggaccucug

SEQ ID NO: 111156 - RNA, 44 nt, Mus musculus
aagcagaucaaacaagaaagccaaaauaagagagagcaggagag

SEQ ID NO: 111157 - RNA, 46 nt, Mus musculus
ggcaugauucagagggcaucgugugugugugugugugugugugugu

SEQ ID NO: 111158 - RNA, 45 nt, Mus musculus
ggcccgaacucuuuguuucugaaaacagauccugcugccccggau

SEQ ID NO: 111159 - RNA, 45 nt, Mus musculus
gagacuagauuacccaggggcccaguggagguacaagggggccuc

SEQ ID NO: 111160 - RNA, 46 nt, Mus musculus
guuaaagccugccagagagccccucagcccucggguaaacagugag

SEQ ID NO: 111161 - RNA, 65 nt, Mus musculus
ucaucagagcauccucaguaaacucugcuggcuuucaagcccucauacccuucuccccaccuggc

SEQ ID NO: 111162 - RNA, 66 nt, Mus musculus
uuccuaguugcuugaacugugucaaaaagaaacaaggaaaggaaagccagcaaagaagcuuaacag

SEQ ID NO: 111163 - RNA, 42 nt, Mus musculus
ugccuuguuuagcucugacuuaaauacaccucgaacccccaa

SEQ ID NO: 111164 - RNA, 46 nt, Mus musculus
aauaaauagagaagaaagcacaagccccuguaacuuaacugaguag

SEQ ID NO: 111165 - RNA, 42 nt, Mus musculus
uuggacaaaaugaauugucuucaagcuguuucauuaacuaau

SEQ ID NO: 111166 - RNA, 46 nt, Mus musculus
aacagcuggaccuuggaggaccaacucuccuaugggguauacaggg

SEQ ID NO: 111167 - RNA, 46 nt, Mus musculus
gccaacugucuguaaaaagaaaugagguuggucugccucgggacac

SEQ ID NO: 111168 - RNA, 42 nt, Mus musculus
gggggagauuugugcuaaaccaacauaaaaagggcuggaguc

SEQ ID NO: 111169 - RNA, 44 nt, Mus musculus
uggauuuuuauugaugcuuaaaauuacucggugcuuggccuccc

SEQ ID NO: 111170 - RNA, 46 nt, Mus musculus
uacaguugugagcugccaugugggugcugggaauugagcccggggc

SEQ ID NO: 111171 - RNA, 42 nt, Mus musculus
cauggucaacguggacacccuuccagaauaugagaagaguca

SEQ ID NO: 111172 - RNA, 55 nt, Mus musculus
aaauccaccccagagcggaggacaguacagaugaucauggagacucggcaggugg

SEQ ID NO: 111173 - RNA, 46 nt, Mus musculus
ggugugagccaccgugugguugcugggaauugaacucaggaccccu

SEQ ID NO: 111174 - RNA, 45 nt, Mus musculus
ugugcauaauagacaagcacucugccaaaugagcuauguccccag

SEQ ID NO: 111175 - RNA, 42 nt, Mus musculus
gaggagggagaggaggaggagggagaggaggaggagaaggug

SEQ ID NO: 111176 - RNA, 46 nt, Mus musculus
cuauuugguugcauaauuaugaauuaguuuacauauugaauaugag

SEQ ID NO: 111177 - RNA, 45 nt, Mus musculus
aucuuuauuuguuuugugugugugugugugugugugugugugugu

SEQ ID NO: 111178 - RNA, 24 nt, Mus musculus
cccauuccuccauuccuccagcuc

SEQ ID NO: 111179 - RNA, 46 nt, Mus musculus
guguauguguguguggauguauauauguguguauguagguguguau

SEQ ID NO: 111180 - RNA, 45 nt, Mus musculus
uagggauauguguguauagguguguguauguguagguguguguau

SEQ ID NO: 111181 - RNA, 45 nt, Mus musculus
auguguguauauagauauguguauauguagggguaugugugugug

SEQ ID NO: 111182 - RNA, 42 nt, Mus musculus
ugaggccggccuuuugucaucccugcuacacagaagccugag

SEQ ID NO: 111183 - RNA, 46 nt, Mus musculus
uuguuuuguuuuuuugguguuuuugagacagcguuucucuguguag

SEQ ID NO: 111184 - RNA, 44 nt, Mus musculus
ccagagguuguccucugaccucuguacguggucgguggugcaga

SEQ ID NO: 111185 - RNA, 45 nt, Mus musculus
cuuugguguuuugggacugucuagaagacagugcuaaggaccuuc

SEQ ID NO: 111186 - RNA, 46 nt, Mus musculus
gcuuggccggcgcuguggguagaggaaauguuuagaauggguugug

SEQ ID NO: 111187 - RNA, 46 nt, Mus musculus
ugggcugcccaaaccaucucucuggcucaggggagcacugacaaga

SEQ ID NO: 111188 - RNA, 48 nt, Mus musculus
ucaguaggcaaggugcucacauuggaagugucaggacugggauuuaga

SEQ ID NO: 111189 - RNA, 26 nt, Mus musculus
cuagaauuaaagaguaaagccacagc

SEQ ID NO: 111190 - RNA, 46 nt, Mus musculus
ugggacaaagaaggagaaacacuguccuugcuucaaaagacaucag

SEQ ID NO: 111191 - RNA, 45 nt, Mus musculus
cucgcucucugauuauuggagcacacagggguuuugccuuggcuu

SEQ ID NO: 111192 - RNA, 44 nt, Mus musculus
guaucagugggugugagugccagagaaaggggaucgggucgggg

SEQ ID NO: 111193 - RNA, 42 nt, Mus musculus
aguguugauggggaugcaccacaaggguggggaggacaggaa

SEQ ID NO: 111194 - RNA, 46 nt, Mus musculus
ugauaugugauguguguguaugugugugugcauauguaugugugua

SEQ ID NO: 111195 - RNA, 45 nt, Mus musculus
guguggugugugcgacaugguguagaggugguggggagauggcuc

SEQ ID NO: 111196 - RNA, 46 nt, Mus musculus
ggugguggugccuccagguuccugcccuguuuaaguuccuguccug

SEQ ID NO: 111197 - RNA, 42 nt, Mus musculus
uccuacucagcacagguguaccuugaaaaggucaugccaugg

SEQ ID NO: 111198 - RNA, 44 nt, Mus musculus
aucaguuuggagauacuaugaguuuuagaaauugugucccaaga

SEQ ID NO: 111199 - RNA, 48 nt, Mus musculus
cgccacaaggcagaauguugcuucaccauccucuacggcacccaguuu

SEQ ID NO: 111200 - RNA, 45 nt, Mus musculus
uguagccuugaaggcacccaggacccagccaggcuuuauagugau

SEQ ID NO: 111201 - RNA, 45 nt, Mus musculus
ugcuggggaguacuccuguuagguauguguuucuagagaugggag

SEQ ID NO: 111202 - RNA, 42 nt, Mus musculus
ugcuucuaguugguuuucucauggaggggugccaaggugggg

SEQ ID NO: 111203 - RNA, 42 nt, Mus musculus
gccgcaaccaugguggagcuguaggagacacgucagggcaug

SEQ ID NO: 111204 - RNA, 30 nt, Mus musculus
agaacuugcuauguagcccagguuggcccc

SEQ ID NO: 111205 - RNA, 79 nt, Mus musculus
acaaaaaguguguuucuguguaggcuugugugcaugugagagagaggagagagggagaggaaggggagggaggauggua

SEQ ID NO: 111206 - RNA, 45 nt, Mus musculus
uguguauauauguguaaugugugcuguuuuugugaugugugcuug

SEQ ID NO: 111207 - RNA, 41 nt, Mus musculus
uaugggguauguauacuauguguguguaguauguugugugu

SEQ ID NO: 111208 - RNA, 46 nt, Mus musculus
uauggcuugcaggguggggcagguuagaggaccauacggggacgag

SEQ ID NO: 111209 - RNA, 45 nt, Mus musculus
cgguguauaacuuuugggacccuccuuucauggaugaggcuguau

SEQ ID NO: 111210 - RNA, 45 nt, Mus musculus
ccaaggcaggaacauggcaguguccaggcaggaaugaugcaggca

SEQ ID NO: 111211 - RNA, 42 nt, Mus musculus
cccuggggcaggaacagcugggaggcauuuuuaaggcuggag

SEQ ID NO: 111212 - RNA, 45 nt, Mus musculus
ggagagggagagggaaagagagagagacuucaguuuuggugggag

SEQ ID NO: 111213 - RNA, 42 nt, Mus musculus
gccuuuuuuccucaccucuuuggcucuuuguguguaugugug

SEQ ID NO: 111214 - RNA, 45 nt, Mus musculus
ggccugaugggaagcccauuaucuaccacggcuggacacggacca

SEQ ID NO: 111215 - RNA, 42 nt, Mus musculus
gucaucuugucuaucgaggagcacugcaguguggagcagcaa

SEQ ID NO: 111216 - RNA, 42 nt, Mus musculus
agugcugaccagcugcccucgcccagucagcuucgugagaag

SEQ ID NO: 111217 - RNA, 42 nt, Mus musculus
aaagucagaguuagaauuuagcauggaggaagggaccuggga

SEQ ID NO: 111218 - RNA, 42 nt, Mus musculus
ccaccaccaucaucaucaucuuuuucuuccuccuacuccccc

SEQ ID NO: 111219 - RNA, 45 nt, Mus musculus
ucauauguggacucucuauuuuuaagaaaauuuaaauaucugggg

SEQ ID NO: 111220 - RNA, 46 nt, Mus musculus
ucauggauaugagugguauaaaaguuuauaucacuauuuguuggga

SEQ ID NO: 111221 - RNA, 23 nt, Mus musculus
ugugauggaggcgccccaugccc

SEQ ID NO: 111222 - RNA, 45 nt, Mus musculus
uuauuccuauacccccagcuacuugggaggcugagcugcaggugg

SEQ ID NO: 111223 - RNA, 45 nt, Mus musculus
ugcaccccaaaaacucagcuauuagcuauugcacaauaauuccaa

SEQ ID NO: 111224 - RNA, 45 nt, Mus musculus
ggccaccguuuacaaagacucuguccccaugcgacugauagugga

SEQ ID NO: 111225 - RNA, 42 nt, Mus musculus
uggugcccaggggaagagaguauguguagaaacccccgugag

SEQ ID NO: 111226 - RNA, 46 nt, Mus musculus
cgugguucuaaugugaacuuuccuaaaauucuaacucuuguuugag

SEQ ID NO: 111227 - RNA, 45 nt, Mus musculus
uccugaaauacagguggcgcccaugcuuaugaugauucauagaaa

SEQ ID NO: 111228 - RNA, 48 nt, Mus musculus
caacauaggccugugugugugugugugugugugugugugugugugccu

SEQ ID NO: 111229 - RNA, 42 nt, Mus musculus
gagaugggcacaggaaggcacagccuaagucagggugcggug

SEQ ID NO: 111230 - RNA, 42 nt, Mus musculus
ggggcugaguaugacagcaacaaauucaagacgacgguugug

SEQ ID NO: 111231 - RNA, 42 nt, Mus musculus
guggauuaauaaugggagccuccuccccguucuaaccaggag

SEQ ID NO: 111232 - RNA, 45 nt, Mus musculus
ggcaagcuccuccuuucuggauguguuucucaccuguuggccuug

SEQ ID NO: 111233 - RNA, 46 nt, Mus musculus
aguguuuuagcauuaugauauuacguguuauauuuaauuuggggag

SEQ ID NO: 111234 - RNA, 41 nt, Mus musculus
aaauccugucucaaaaaacaaaugagagagagagagagaga

SEQ ID NO: 111235 - RNA, 44 nt, Mus musculus
acgagcgcaucuggguacgggagagccuuauaaacagcccccag

SEQ ID NO: 111236 - RNA, 46 nt, Mus musculus
cuauuuuuccaccuuggacaacuuucuuaacuuauacuaccccuga

SEQ ID NO: 111237 - RNA, 41 nt, Mus musculus
cgagacaucgccgccaagcugggcaccggggagauggccga

SEQ ID NO: 111238 - RNA, 47 nt, Mus musculus
cgaugaucuggucugacaugaucugaaacuugucuugcaucugcugc

SEQ ID NO: 111239 - RNA, 44 nt, Mus musculus
uugcagcagaugcaagacaaguuucagaucaugucagaccagau

SEQ ID NO: 111240 - RNA, 42 nt, Mus musculus
ggcagcaucaccucaccucggccucucccccccaggcccccg

SEQ ID NO: 111241 - RNA, 45 nt, Mus musculus
ucgcugaccucaugacccaggcuggaguagaagaacuggacccug

SEQ ID NO: 111242 - RNA, 45 nt, Mus musculus
auuuuacguauaugaguacgcuguagcuguacagaugguugugag

SEQ ID NO: 111243 - RNA, 41 nt, Mus musculus
aaagaaagaaauaaagaaagaaagaaagaaaggaaggaagg

SEQ ID NO: 111244 - RNA, 46 nt, Mus musculus
cauguacgcugucacucucuucagacacaccagaagagggcaucag

SEQ ID NO: 111245 - RNA, 46 nt, Mus musculus
gaagaaauucaccucaguaggugguuuuagaguaaaggcgucaagu

SEQ ID NO: 111246 - RNA, 46 nt, Mus musculus
ugccuuguuggccuagaacuugcuguauagaccagaacggccucag

SEQ ID NO: 111247 - RNA, 46 nt, Mus musculus
acuaaauccuugguaaacuucauuaagaaauuaggacucugcagau

SEQ ID NO: 111248 - RNA, 45 nt, Mus musculus
uuaaagauguucaccggauggguauauacaaagaaggaaauggaa

SEQ ID NO: 111249 - RNA, 42 nt, Mus musculus
aggcugccgguacugaauccagaauguuguugucccgagcca

SEQ ID NO: 111250 - RNA, 44 nt, Mus musculus
aacgugcauucuuaucacagccugcauagccuagaguaccccua

SEQ ID NO: 111251 - RNA, 46 nt, Mus musculus
aaccgccaaaauuuuaguguuuaauaauuaauagaacugaccagga

SEQ ID NO: 111252 - RNA, 46 nt, Mus musculus
uaauaguuguuugugccgaagcgucucucagaguuuugcaugagau

SEQ ID NO: 111253 - RNA, 46 nt, Mus musculus
aucagagcccagugacccuguccucccuucaagcuacugacugaaa

SEQ ID NO: 111254 - RNA, 42 nt, Mus musculus
cacuguccccacaaagugauuucauacaauaaaaaccaagag

SEQ ID NO: 111255 - RNA, 69 nt, Mus musculus
guccggguggaguuggggucuuggacgggggugucccugcgggaagaagaggucccagcuaugggaugu

SEQ ID NO: 111256 - RNA, 46 nt, Mus musculus
gccacgauggaaggggaguagcguggguccgugcuauguaauuagu

SEQ ID NO: 111257 - RNA, 45 nt, Mus musculus
agcaguucucggggacugggcuaucggaugcggggaugcgggaau

SEQ ID NO: 111258 - RNA, 45 nt, Mus musculus
ccuaucguagggacucaagugaugguuugguuaggaccugaagag

SEQ ID NO: 111259 - RNA, 46 nt, Mus musculus
ugguagcaaccguguacccacaccaccacuagucucugggcccccc

SEQ ID NO: 111260 - RNA, 46 nt, Mus musculus
guguguaugugucuguguguguguuuuugucugugugugucuuugu

SEQ ID NO: 111261 - RNA, 60 nt, Mus musculus
ugucuguguuuguguguguaucugugugucuguguguguauguaucucugugugugugua

SEQ ID NO: 111262 - RNA, 77 nt, Mus musculus
guguguguguguaugugucuaugcaugugugucugugucuguguguaugugucucugugugugucugugucuguaug

SEQ ID NO: 111263 - RNA, 46 nt, Mus musculus
cuacuacaacagaaaucaagguaacagaauucaguaaccagcagag

SEQ ID NO: 111264 - RNA, 46 nt, Mus musculus
ggucacacacacacacacacacacacacacacacacagggauagug

SEQ ID NO: 111265 - RNA, 32 nt, Mus musculus
ucaaaaccaccuguaaugagaucugaugcccu

SEQ ID NO: 111266 - RNA, 46 nt, Mus musculus
gaguaaggauguuuccagagauguuucuugugugugugugugugug

SEQ ID NO: 111267 - RNA, 44 nt, Mus musculus
uucgauggcuucuacagcacuuuccacagagcugagcagcgacu

SEQ ID NO: 111268 - RNA, 46 nt, Mus musculus
agcuucuguuccccagagaucaauggauauacuagucucaauccag

SEQ ID NO: 111269 - RNA, 46 nt, Mus musculus
gagaaaggcacgggucaaauccacgugcugagaucacagcacggag

SEQ ID NO: 111270 - RNA, 46 nt, Mus musculus
uguccaucacugaaccaagcauagcggcagcuuugaaaggggaggg

SEQ ID NO: 111271 - RNA, 42 nt, Mus musculus
agcagccuacagaugaagauauagaacucuuagcucccccag

SEQ ID NO: 111272 - RNA, 46 nt, Mus musculus
uuuuaaagguuuauuuuauguaugugaguacagaagagggcaucag

SEQ ID NO: 111273 - RNA, 41 nt, Mus musculus
ggaaggaaaagaagggaucaaggucuuugagaguuggggca

SEQ ID NO: 111274 - RNA, 23 nt, Mus musculus
gcaguuggagucuccauacagca

SEQ ID NO: 111275 - RNA, 46 nt, Mus musculus
ucagggaaguacucuuccucacuguccaccagcagcaaagugccug

SEQ ID NO: 111276 - RNA, 42 nt, Mus musculus
agccacacagccacagagccaggacaacugcccaggagacua

SEQ ID NO: 111277 - RNA, 46 nt, Mus musculus
gcucuuacgaagguccugaguucaaaucccagcaacuacaugguag

SEQ ID NO: 111278 - RNA, 41 nt, Mus musculus
gcaaaaaaaggaaaaagaaaagcugacaucaaaugccccaa

SEQ ID NO: 111279 - RNA, 28 nt, Mus musculus
uaaguacauucagucacgccuugcucuu

SEQ ID NO: 111280 - RNA, 46 nt, Mus musculus
ucacccgcuugauguuggggugaucuucaagugugagcagccccgc

SEQ ID NO: 111281 - RNA, 45 nt, Mus musculus
gaauuccaccuucaaagucaggugggagcagcuggggcacggggc

SEQ ID NO: 111282 - RNA, 94 nt, Mus musculus
guucuggcuaaaagcugcagccuuacugaucagccauccuacagacuuguccaacauaaagaaaaccucagucccauggucacccacgguuugg

SEQ ID NO: 111283 - RNA, 83 nt, Mus musculus
ucuuggacaggggcuucucucauugaggccgaguccacugaguccuaaacuccauuugcgccacagacccaaaucuagcagga

SEQ ID NO: 111284 - RNA, 46 nt, Mus musculus
aaaaacuaggagagaagugaagagacuaaagauggacgagagcuag

SEQ ID NO: 111285 - RNA, 45 nt, Mus musculus
cagguagacagucaguuucuauaggauguacccugugcaggagag

SEQ ID NO: 111286 - RNA, 42 nt, Mus musculus
aauacucagcuggacuuugcggcacaugcacaaugccagcag

SEQ ID NO: 111287 - RNA, 58 nt, Mus musculus
aagcaaaggagaucaaccacaaaccaacuaccaggccaaauucgggaggaaaaaggug

SEQ ID NO: 111288 - RNA, 46 nt, Mus musculus
aauacagacuauacauaaggaccaacagggcauccugugugaggag

SEQ ID NO: 111289 - RNA, 42 nt, Mus musculus
ccuagacaaacccucgaacagcuugucuuccaguguggggag

SEQ ID NO: 111290 - RNA, 47 nt, Mus musculus
uauaaaaagcauaccuacuaaagaagaccuuuccacccguggcuucc

SEQ ID NO: 111291 - RNA, 49 nt, Mus musculus
ggaaagacaccugcaccccagggacagaugcaacagguacagugugaca

SEQ ID NO: 111292 - RNA, 46 nt, Mus musculus
aaaacaccuacagcaaaugcgaguccgagccgcgaugugcacugag

SEQ ID NO: 111293 - RNA, 45 nt, Mus musculus
cacaacaccauugaaucccgguccucauuaaguccagguucucgu

SEQ ID NO: 111294 - RNA, 46 nt, Mus musculus
uuacaucacggaaguaagcaaaaugaaaauggcugaugggggcuag

SEQ ID NO: 111295 - RNA, 46 nt, Mus musculus
guaacaauaaaagcaucacuguuuccuucaggucccgccaccagag

SEQ ID NO: 111296 - RNA, 44 nt, Mus musculus
cuugauagacaagucugaauacugggccacaggaccuuacacag

SEQ ID NO: 111297 - RNA, 46 nt, Mus musculus
uucauguccucagaucaugggcagacuaccaugcuuggagacagag

SEQ ID NO: 111298 - RNA, 42 nt, Mus musculus
guggcuuaaccaagcuucuccccagccuccuggcucaggcuu

SEQ ID NO: 111299 - RNA, 44 nt, Mus musculus
uacaggguagagacgcuuguccugguggcagacuucagcagagg

SEQ ID NO: 111300 - RNA, 46 nt, Mus musculus
gccuuccaggggccaccgauggcauugggaaggccuaugcggagga

SEQ ID NO: 111301 - RNA, 46 nt, Mus musculus
uuuuccggugugcauucuucucugaugagaucaacagggagugggu

SEQ ID NO: 111302 - RNA, 46 nt, Mus musculus
ccccagccccuccuucccgcccccuacaugucuuuccugcuuugug

SEQ ID NO: 111303 - RNA, 46 nt, Mus musculus
uguuggaagcauugacuuaacgcacaccccagacagaaaggccacc

SEQ ID NO: 111304 - RNA, 42 nt, Mus musculus
ggcagacagcagagacacagcagcaagcugugaggcccagac

SEQ ID NO: 111305 - RNA, 45 nt, Mus musculus
agccucccagauucugagaugauguguucccaucacuacuccagg

SEQ ID NO: 111306 - RNA, 32 nt, Mus musculus
cuguagcaccaggcucagcgcuggcagcaggg

SEQ ID NO: 111307 - RNA, 45 nt, Mus musculus
augacuggacauuuccacguguccuucgauggggacaggaaggug

SEQ ID NO: 111308 - RNA, 35 nt, Mus musculus
ucccaugcgcgcgcaugcuccucagagcccauaga

SEQ ID NO: 111309 - RNA, 46 nt, Mus musculus
cccucucaagcucaccaagcaucauucuuugagacccgcccccccu

SEQ ID NO: 111310 - RNA, 45 nt, Mus musculus
gcccaccagggaggagaagccaugagaggcaccagcgccaccagu

SEQ ID NO: 111311 - RNA, 46 nt, Mus musculus
aauuuugcaaaggaauuugugaucagcgaccggaaggagcuagagg

SEQ ID NO: 111312 - RNA, 46 nt, Mus musculus
gugcucccuccuguaaucuuaugagauagggucucacugcgcaguu

SEQ ID NO: 111313 - RNA, 42 nt, Mus musculus
agccaugcauuuuggaacgguuaguagaauucacacccuaga

SEQ ID NO: 111314 - RNA, 45 nt, Mus musculus
aagccaggcuuuguagcggacaccucuaaucacagcaccagagag

SEQ ID NO: 111315 - RNA, 42 nt, Mus musculus
gggcaagugacuugugcaaagcgaaaagauggggcaggagag

SEQ ID NO: 111316 - RNA, 91 nt, Mus musculus
gcgcuucaccaccggcgacgccaugagcaaaagauccaaguuugcccucaucacauggaucggggaggacgugaguggacugcagcgugcc

SEQ ID NO: 111317 - RNA, 41 nt, Mus musculus
caccguauugaggggaaggcuguuaaaguuccugaauugga

SEQ ID NO: 111318 - RNA, 46 nt, Mus musculus
ucauucauucauuuucuugugcuagggauggagucugcagacuaua

SEQ ID NO: 111319 - RNA, 41 nt, Mus musculus
acuuuucuguuuuucaguaagucccauuagaccgaccacau

SEQ ID NO: 111320 - RNA, 45 nt, Mus musculus
gcugaugagaacucagccggaaugguuugggcugaugcuggggug

SEQ ID NO: 111321 - RNA, 45 nt, Mus musculus
cugaguaacagcccuuuggguguuuggugucaucgugcucacagu

SEQ ID NO: 111322 - RNA, 42 nt, Mus musculus
auuuaugucauggaugcacuucggaauuaacuugcaguagau

SEQ ID NO: 111323 - RNA, 46 nt, Mus musculus
ugggaaugcauccaguguucuggugucgauuuuagagucugcgggg

SEQ ID NO: 111324 - RNA, 46 nt, Mus musculus
ccucaaaugucccugaguaggacuagcauuuuauuuggggacagag

SEQ ID NO: 111325 - RNA, 45 nt, Mus musculus
agauacgacggcgccaccauuguccccggcgaucagggagcagau

SEQ ID NO: 111326 - RNA, 42 nt, Mus musculus
acugguuccggcaguguccucgcggcggccauggccacgaag

SEQ ID NO: 111327 - RNA, 45 nt, Mus musculus
agggcucauuuugugcuguccaugagacagaagcagguaggagaa

SEQ ID NO: 111328 - RNA, 45 nt, Mus musculus
uuaaaaaaacauucugaaaaaacaaaaaccaucuaucaugaccua

SEQ ID NO: 111329 - RNA, 46 nt, Mus musculus
caauucccaccaaccacaugguggcucacaaccaucuguaauguga

SEQ ID NO: 111330 - RNA, 45 nt, Mus musculus
uccacuaacuguuggugcugaguucccaacaaggagagcugagag

SEQ ID NO: 111331 - RNA, 28 nt, Mus musculus
caccuuggggcuggggagauggcucagu

SEQ ID NO: 111332 - RNA, 41 nt, Mus musculus
agcacggugccacacuacugugaucucagcacuggggaagu

SEQ ID NO: 111333 - RNA, 46 nt, Mus musculus
gaccacuaacccuccaguccuccagcucccacccaggcacccagac

SEQ ID NO: 111334 - RNA, 46 nt, Mus musculus
cucuggagaagacagaagaaacauuucagguuaaggggcuguagag

SEQ ID NO: 111335 - RNA, 41 nt, Mus musculus
acagugaguucuaggacagccagagcugcagaggggagagg

SEQ ID NO: 111336 - RNA, 42 nt, Mus musculus
gcagaagcaucagccugugaaaacccagagacauccugagga

SEQ ID NO: 111337 - RNA, 59 nt, Mus musculus
ccucuucugaccuuagagaguaccauggggugugugugugugugugugugugugugugu

SEQ ID NO: 111338 - RNA, 46 nt, Mus musculus
aaauaaauaaauaaauaaauaaauaaauaaauaaaugugggcaggu

SEQ ID NO: 111339 - RNA, 42 nt, Mus musculus
cccccaagugaacuggugagacugaggauaacgugagcagau

SEQ ID NO: 111340 - RNA, 45 nt, Mus musculus
acaauaugcugauaaacugcaaaaggcagagaaagcuccugggag

SEQ ID NO: 111341 - RNA, 45 nt, Mus musculus
aucaccucgacaaauauguacgugacaacaauuuuucuuaccuca

SEQ ID NO: 111342 - RNA, 45 nt, Mus musculus
ugugaugcacgccugcagccucaguacucgggaaguggagucagg

SEQ ID NO: 111343 - RNA, 46 nt, Mus musculus
aucagccacgugugguggcacaugccuuuaaucccagcacucggga

SEQ ID NO: 111344 - RNA, 42 nt, Mus musculus
cagccuguaugcuacacagagucccacuguauggagggagcu

SEQ ID NO: 111345 - RNA, 46 nt, Mus musculus
aagagagaccuacauaugugacucugaauagcucagcaccgcauaa

SEQ ID NO: 111346 - RNA, 47 nt, Mus musculus
cggacuccuccacugaacacucggacugaggucuagaugccccccug

SEQ ID NO: 111347 - RNA, 23 nt, Mus musculus
uggggauggcgccagaggcagag

SEQ ID NO: 111348 - RNA, 42 nt, Mus musculus
agggggggaacacuuaguuuccacauacgccaugggugagga

SEQ ID NO: 111349 - RNA, 45 nt, Mus musculus
gauggggggugaugcauuauuuuuagaguaccuucuucuguagau

SEQ ID NO: 111350 - RNA, 41 nt, Mus musculus
ugcgauacaaagugaaacugaaaagaaaaaugggcuggaga

SEQ ID NO: 111351 - RNA, 45 nt, Mus musculus
caagcuccuaggaucucccugucucugagcccagugacagcguca

SEQ ID NO: 111352 - RNA, 45 nt, Mus musculus
ugauacuucaggagaagcuccaugcccugcccuuugcccccagac

SEQ ID NO: 111353 - RNA, 46 nt, Mus musculus
uaaaaauuacuccauuguucuuggggcuggagaaacggcucagcac

SEQ ID NO: 111354 - RNA, 46 nt, Mus musculus
caaaccucuguggaccagagugaccucaacagccugggggcuccca

SEQ ID NO: 111355 - RNA, 45 nt, Mus musculus
acucugacaccacgagaugccuuuggcaagcaugcacacccacuc

SEQ ID NO: 111356 - RNA, 45 nt, Mus musculus
cuguuuuccuagugaaggcaaagccuucuugcgucaguugaaggu

SEQ ID NO: 111357 - RNA, 42 nt, Mus musculus
ggaagccaguguacacugcucagugggaugccuggcccagga

SEQ ID NO: 111358 - RNA, 41 nt, Mus musculus
ugcacuuuugaguacagaggaaugaacuucaucaggugaua

SEQ ID NO: 111359 - RNA, 46 nt, Mus musculus
gagggggaaggggagcaggcugaugacaauaaaaccaugucgaugg

SEQ ID NO: 111360 - RNA, 46 nt, Mus musculus
ucacauccuaacgccucccucugcuagaaguuggcuggcugcagau

SEQ ID NO: 111361 - RNA, 46 nt, Mus musculus
ggcacgguuacagcagguccacgcggcgguaauauaggagguaggc

SEQ ID NO: 111362 - RNA, 46 nt, Mus musculus
gcagggcaaauuuuccugagaccacacagugcugauuucucccuag

SEQ ID NO: 111363 - RNA, 46 nt, Mus musculus
aucguugacgagguugguggcuaugcagaugugaugcccguggaca

SEQ ID NO: 111364 - RNA, 45 nt, Mus musculus
uuaaaauaauuuuuauuuaucuuuacauugugugugugugugugu

SEQ ID NO: 111365 - RNA, 47 nt, Mus musculus
ggaguguaugugugccacagugugugugugugugugugugugugugu

SEQ ID NO: 111366 - RNA, 45 nt, Mus musculus
uggcccuugcuggccuacuaugaauguauccuacaguguccagau

SEQ ID NO: 111367 - RNA, 42 nt, Mus musculus
uccuugugugucugugugguguguguguguguguguguguga

SEQ ID NO: 111368 - RNA, 46 nt, Mus musculus
cauccgugcucaguggccugcgugcacagcagccuugugggcagau

SEQ ID NO: 111369 - RNA, 43 nt, Mus musculus
ucggcacccagauccacucgauaugcaaugaugaaacagugag

SEQ ID NO: 111370 - RNA, 44 nt, Mus musculus
ccacugggucucccacagcaggacagugguguggugaggagagc

SEQ ID NO: 111371 - RNA, 44 nt, Mus musculus; identical to SEQ ID NO: 111370

SEQ ID NO: 111372 - RNA, 44 nt, Mus musculus; identical to SEQ ID NO: 111370

SEQ ID NO: 111373 - RNA, 45 nt, Mus musculus
cacagcauggggacccauugggucucccacagcaggacaguggug

SEQ ID NO: 111374 - RNA, 44 nt, Mus musculus; identical to SEQ ID NO: 111370

SEQ ID NO: 111375 - RNA, 46 nt, Mus musculus
ccacagcauggggacccacugggucuccuacagcaggacaguggug

SEQ ID NO: 111376 - RNA, 44 nt, Mus musculus; identical to SEQ ID NO: 111370

SEQ ID NO: 111377 - RNA, 44 nt, Mus musculus
ugugguggugcaugcuauuaguucuagugcuuuggaggcagaag

SEQ ID NO: 111378 - RNA, 63 nt, Mus musculus
ccaguagcauaggccacacaagaagagaagaggaaggcuguagauguggcugucaccagggca

SEQ ID NO: 111379 - RNA, 46 nt, Mus musculus
cccugcggucagcucagugugaggccaggggcccaaguggucaguc

SEQ ID NO: 111380 - RNA, 42 nt, Mus musculus
cagccccagguggugaggugcgucucugucugcugcagaggu

SEQ ID NO: 111381 - RNA, 44 nt, Mus musculus
gaagccaggaggagcuuaccaaaugaguaccuuguggggagagg

SEQ ID NO: 111382 - RNA, 44 nt, Mus musculus
guuauaaaaacacucguuucuaccuccgcaaaacucuggccggu

SEQ ID NO: 111383 - RNA, 43 nt, Mus musculus
caguccgaacauggcucagguuagaauuccauaguggccagag

SEQ ID NO: 111384 - RNA, 49 nt, Mus musculus
ucaggugacccauucuuuauuuacacagggagccucagaccgagaagga

SEQ ID NO: 111385 - RNA, 46 nt, Mus musculus
ggaggacacuugcaucugccuggagggggaggagaauggaggcugu

SEQ ID NO: 111386 - RNA, 42 nt, Mus musculus
uagccagacagacugucccuggcagagccagccuggggccag

SEQ ID NO: 111387 - RNA, 45 nt, Mus musculus
uuuauauguuuaccucggcauuuugcagccaaggacaccugccag

SEQ ID NO: 111388 - RNA, 64 nt, Mus musculus
ucggcacuggguggcuagagccccccucacucccccaaaaaagagaagauguuagcguaguggg

SEQ ID NO: 111389 - RNA, 42 nt, Mus musculus
gaggcaccagggaugguauggcugucggggaguggggggaaa

SEQ ID NO: 111390 - RNA, 45 nt, Mus musculus
gcaccuuugggaacuggagggugguagagugguaguaggggguua

SEQ ID NO: 111391 - RNA, 42 nt, Mus musculus
aguccugccuugaggguuuacagugggccuguguagcugccc

SEQ ID NO: 111392 - RNA, 46 nt, Mus musculus
cucugcugagccugagcgccuggugugugugugugugugugugugu

SEQ ID NO: 111393 - RNA, 46 nt, Mus musculus
cucugcugagccugagcaccuggugggugugugugugugugugugu

SEQ ID NO: 111394 - RNA, 42 nt, Mus musculus
ugaggcugguguguaugugugugugugugugugugugugugu

SEQ ID NO: 111395 - RNA, 42 nt, Mus musculus
augcaugggcucuccgaaucccuuuuuucacgcauggcccag

SEQ ID NO: 111396 - RNA, 45 nt, Mus musculus
augcccucuucuggugugucugaagacagcuacaguguaacagug

SEQ ID NO: 111397 - RNA, 45 nt, Mus musculus
cugugcagggucuggggugcugugcagggugugucugcucugugu

SEQ ID NO: 111398 - RNA, 42 nt, Mus musculus
gacauugagguccuucaccugggaccuccuguggucagggaa

SEQ ID NO: 111399 - RNA, 42 nt, Mus musculus
guuccuucugugguggggaaacuugggguccaagucgugaag

SEQ ID NO: 111400 - RNA, 42 nt, Mus musculus
caaagaguugggaauuuuugaguaccugcuguauacccccau

SEQ ID NO: 111401 - RNA, 46 nt, Mus musculus
agggugggugucggggcuguggagagauccagugauccggcguuca

SEQ ID NO: 111402 - RNA, 50 nt, Mus musculus
aagcuguggauuuuccugcucuugaaugguucuuuggauauuuauuggag

SEQ ID NO: 111403 - RNA, 53 nt, Mus musculus
cggauaguccaaucucccaaguugagcgacugcugcggguaggaugcugauag

SEQ ID NO: 111404 - RNA, 42 nt, Mus musculus
aagggaaggggaagaggacgacaggaaggagaggaggggggc

SEQ ID NO: 111405 - RNA, 45 nt, Mus musculus
caggaagaaggaaaaggagauaggaagcaggggaauaagccagga

SEQ ID NO: 111406 - RNA, 94 nt, Mus musculus
uucuugccuaguucuccugccugcuuuucauuaccucggccuucuagagcaggaaggauggaguccugcccccuccccagccgucagcccccag

SEQ ID NO: 111407 - RNA, 46 nt, Mus musculus
uggagaauucagguaagcaucucagaggaugggguccccucgagga

SEQ ID NO: 111408 - RNA, 41 nt, Mus musculus
caacugagauuugggaggacagcagaccaagaguagcccag

SEQ ID NO: 111409 - RNA, 46 nt, Mus musculus
gggcuucauacaggcuaggucaaccgagccacagcccccaacccag

SEQ ID NO: 111410 - RNA, 45 nt, Mus musculus
gagaguccccugagugauccaucuucugucuccagcacuuacggg

SEQ ID NO: 111411 - RNA, 48 nt, Mus musculus
gaaggagaaucauuaacagugacccaggccaucugaacccaagaacug

SEQ ID NO: 111412 - RNA, 46 nt, Mus musculus
ggggcaacaucaggccucgaacucagucuuacacugacccccacag

SEQ ID NO: 111413 - RNA, 45 nt, Mus musculus
gaugcuaaguggguguggccugguggaacugggacucugaguggg

SEQ ID NO: 111414 - RNA, 44 nt, Mus musculus
gcagacagauggaagaaagaugggaaaagggugacuggcacacg

SEQ ID NO: 111415 - RNA, 42 nt, Mus musculus
cuggauagcuggaugaauaauugaauggauagaugacuggau

SEQ ID NO: 111416 - RNA, 42 nt, Mus musculus
cccagcaggagaacugaauagcuggggccuacaauggcagau

SEQ ID NO: 111417 - RNA, 51 nt, Mus musculus
caggugaugucugggugggagcagauggagagacagagaggaggagggggg

SEQ ID NO: 111418 - RNA, 41 nt, Mus musculus
aaagcaaagugguggagaagggguacaggcagccauggagu

SEQ ID NO: 111419 - RNA, 42 nt, Mus musculus
gagggaaguccccuuugucaccaagucccuggggagccugag

SEQ ID NO: 111420 - RNA, 41 nt, Mus musculus
gggcugagagccacgagguaaugcagcugcagugucuuuaa

SEQ ID NO: 111421 - RNA, 42 nt, Mus musculus
gucagugcuuuuaaccgcugagccaucuauccagccccaggg

SEQ ID NO: 111422 - RNA, 46 nt, Mus musculus
aaccccaugguggcucacaaccaucuguaaugagaucuggugcccu

SEQ ID NO: 111423 - RNA, 46 nt, Mus musculus
ugucugugcucucuuuuccaaguugcuggucugaugguuguaccau

SEQ ID NO: 111424 - RNA, 45 nt, Mus musculus
acuaccuggcaggccugaguggaaagagagagagagagagagaga

SEQ ID NO: 111425 - RNA, 42 nt, Mus musculus
accgguaagaccagccuggaaaggugaguuccagaggcagag

SEQ ID NO: 111426 - RNA, 45 nt, Mus musculus
cucagaaaggccacagggcagauaccagaggcccacaggcgggca

SEQ ID NO: 111427 - RNA, 42 nt, Mus musculus
augugcacucaggccagaaaaggcuggcagucaccaggagau

SEQ ID NO: 111428 - RNA, 45 nt, Mus musculus
ugcgguggccuccgggcuugaaagucugaaaguggaggaucauua

SEQ ID NO: 111429 - RNA, 41 nt, Mus musculus
gugugugugugugugugugugugugugugugcgccuugaug

SEQ ID NO: 111430 - RNA, 42 nt, Mus musculus
ucuccugggaucuuagggcaagagagcauguuuaaccugcag

SEQ ID NO: 111431 - RNA, 45 nt, Mus musculus
ggcugugcggcagaccugccgagucacuuuaauuucugcccccau

SEQ ID NO: 111432 - RNA, 46 nt, Mus musculus
ccccucggugccugucucucugugcccaccuuuuagaggccaggag

SEQ ID NO: 111433 - RNA, 41 nt, Mus musculus
aacagcagcgcaccuuuaaccccagcccuugcuggcaaaga

SEQ ID NO: 111434 - RNA, 45 nt, Mus musculus
accuccucccccuagggauaaugacuggguuugugcuggccuaag

SEQ ID NO: 111435 - RNA, 46 nt, Mus musculus
ugauggugucccuguaauuuauuucaacacagagccagguccucau

SEQ ID NO: 111436 - RNA, 42 nt, Mus musculus
cuccccccacccccauccccguaaaagggacaagcccaggau

SEQ ID NO: 111437 - RNA, 46 nt, Mus musculus
aauaaauaacucuuuaaagaaaaauuaaaaccccaaagggccagug

SEQ ID NO: 111438 - RNA, 46 nt, Mus musculus
cuuugagcagccacuccuaacuaaugccccucccuaguaccaugca

SEQ ID NO: 111439 - RNA, 45 nt, Mus musculus
gaggcgaggacacccugaggucccuagucccuguccccgucccca

SEQ ID NO: 111440 - RNA, 42 nt, Mus musculus
acucacuuaggcauggcggaggacggagggagggagggagca

SEQ ID NO: 111441 - RNA, 47 nt, Mus musculus
ugugggucaggggaggaaugaggcagccaggcagaaugagggaggga

SEQ ID NO: 111442 - RNA, 42 nt, Mus musculus
gcagagcagagcagagcagauggugacuccugacccaagacc

SEQ ID NO: 111443 - RNA, 45 nt, Mus musculus
gagccuguguagagugcccaagaguccacuuagauuuaggcugac

SEQ ID NO: 111444 - RNA, 44 nt, Mus musculus
augccaggcacagaauagacacuauaccuaguggcccuaggccc

SEQ ID NO: 111445 - RNA, 45 nt, Mus musculus
ugugcaauaugcaauauauuaaacugccccaagcuugguguaggg

SEQ ID NO: 111446 - RNA, 45 nt, Mus musculus
uggccaccaucuccuaccaccugggggagauuggauaugagcaga

SEQ ID NO: 111447 - RNA, 42 nt, Mus musculus
cagucucuuccucacucugcucauauccaaucucccccaggu

SEQ ID NO: 111448 - RNA, 46 nt, Mus musculus
uguugcugaggugacauguuguacggauacuaaagcuacugcgcgg

SEQ ID NO: 111449 - RNA, 41 nt, Mus musculus
aggcuggccauggacaauuagcagccuaaucccgucggagg

SEQ ID NO: 111450 - RNA, 46 nt, Mus musculus
gagguccccuagggcuuuguguguccauacuuccuuggcaugagau

SEQ ID NO: 111451 - RNA, 45 nt, Mus musculus
gcagcuuaguucuugggagugucgguuccaacagaacuugguagu

SEQ ID NO: 111452 - RNA, 42 nt, Mus musculus
gaggggaaggagagcaccucuccccgcuggggcagggcagga

SEQ ID NO: 111453 - RNA, 45 nt, Mus musculus
ugcccggagccugucacuauccucagaggauccuuacugccucag

SEQ ID NO: 111454 - RNA, 42 nt, Mus musculus
guguggcuccagggugaccaggcaguggaagccgcgugagag

SEQ ID NO: 111455 - RNA, 42 nt, Mus musculus
accuauacgguacugugugaauguuucuccugaggagggcag

SEQ ID NO: 111456 - RNA, 46 nt, Mus musculus
gguguguguguguccugacucuaugaccacccuguuuugccuauag

SEQ ID NO: 111457 - RNA, 46 nt, Mus musculus
uggggggcaccacauggugcacaggccgcuggaggcugugggaggg

SEQ ID NO: 111458 - RNA, 41 nt, Mus musculus
cugagguccucagcggggccuggcuuggugguggcgggaug

SEQ ID NO: 111459 - RNA, 64 nt, Mus musculus
gggaggccgaccgggagcgggagaaggagcgggagcgggagcagcgggagaaggagcgggagaa

SEQ ID NO: 111460 - RNA, 41 nt, Mus musculus
agcgggagaaggaacgggagcgcgagcuggagcggcagcgg

SEQ ID NO: 111461 - RNA, 45 nt, Mus musculus
gcagaugcagcuccugccugggucuggaagaggccguggaccaag

SEQ ID NO: 111462 - RNA, 42 nt, Mus musculus
aggagguugccugggaaagagagggccgcugcuggcccaaga

SEQ ID NO: 111463 - RNA, 45 nt, Mus musculus
guuggguggucaagccaaaaaguugcaagaacucuagcuucuaga

SEQ ID NO: 111464 - RNA, 42 nt, Mus musculus
agaguucuugcaacuuuuuggcuugaccacccaacagcagaa

SEQ ID NO: 111465 - RNA, 46 nt, Mus musculus
cucuguccacccgcuacagccccgacgagaugaacaacagccccaa

SEQ ID NO: 111466 - RNA, 45 nt, Mus musculus
gucggggucccugccuccuugucagaugucccaaagaccacggag

SEQ ID NO: 111467 - RNA, 46 nt, Mus musculus
ugcuuugcuaucugcagagcagagccacaaagucgacacggcaauc

SEQ ID NO: 111468 - RNA, 41 nt, Mus musculus
acagugaacugguaaacccaauaaucccaaaaugugggaga

SEQ ID NO: 111469 - RNA, 46 nt, Mus musculus
cguagacugacagacacucgucagccguggagcaaacaaaguagga

SEQ ID NO: 111470 - RNA, 45 nt, Mus musculus
cgaugcggccaggcaguggggaaaacugggaaaaacugcgauguc

SEQ ID NO: 111471 - RNA, 45 nt, Mus musculus
uggggucagccugggacgcauaguaagguccuguguuaggaauaa

SEQ ID NO: 111472 - RNA, 44 nt, Mus musculus
gcagcaguacacacugguucucugggagccuguggugccggaag

SEQ ID NO: 111473 - RNA, 45 nt, Mus musculus
ugacgcgcaucuucuccccaggagcuucggagucagaaacagaag

SEQ ID NO: 111474 - RNA, 46 nt, Mus musculus
ucaccgaggcaccugucucagcuaggacucaguuucucuuucugag

SEQ ID NO: 111475 - RNA, 41 nt, Mus musculus
gguggacgucagugucggaggaggaugacguggggggagag

SEQ ID NO: 111476 - RNA, 153 nt, Mus musculus
auaaauaccuaauuacuacauucaacaaauaauauuacaauacaguuaauucaaacaaguacacuuagaacggguuuaauuucacagcaucuaaacugcccccagagcgaccgaggcacccgucggcccuccugccugggucuggguccaggg

SEQ ID NO: 111477 - RNA, 66 nt, Mus musculus
ggggguggugauacaaaaagaugaauuucgucuuaacaugauuuaggaagauuuuauuuuucggga

SEQ ID NO: 111478 - RNA, 64 nt, Mus musculus
agcucaagugucuucaagcuuggcccguggaaagcuguauguaguugaggcugagcgugagggu

SEQ ID NO: 111479 - RNA, 28 nt, Mus musculus
uuugucagaggucagccauacugcaagu

SEQ ID NO: 111480 - RNA, 45 nt, Mus musculus
agugcuucugacaacauccccaaagcagacaccauccggacacug

SEQ ID NO: 111481 - RNA, 45 nt, Mus musculus
cuggcaaaguugugggggcagugcugggaaaggggagagccuuga

SEQ ID NO: 111482 - RNA, 57 nt, Mus musculus
ugaggagcggaaggaggagacauucaccccagugcccagcccgcacuacauggagau

SEQ ID NO: 111483 - RNA, 46 nt, Mus musculus
cguggagaauuggcuucaggcaugaguagaaggcaggcagcuaggu

SEQ ID NO: 111484 - RNA, 46 nt, Mus musculus
gugacagucaccuuuaucuauggagccaucuccccaguccccaggu

SEQ ID NO: 111485 - RNA, 42 nt, Mus musculus
gugucugcacaugugccguguguggcgcaggggugagcagag

SEQ ID NO: 111486 - RNA, 53 nt, Mus musculus
acagagacagaagugccgccuguuaccuccggaauggauggaugugggugagc

SEQ ID NO: 111487 - RNA, 42 nt, Mus musculus
cauggaugcggccgagguggaguuuuuggccgaaaaggaguu

SEQ ID NO: 111488 - RNA, 41 nt, Mus musculus
accgccgcgaccgcccucuacacccuggggugcucgcgacc

SEQ ID NO: 111489 - RNA, 41 nt, Mus musculus
uguagagggcggucgcggcggucgccugggcagcgguggca

SEQ ID NO: 111490 - RNA, 46 nt, Mus musculus
uccagagguccugaguucaaaucccagcaaccacccguaaugagau

SEQ ID NO: 111491 - RNA, 46 nt, Mus musculus
ugucucagguccugugcugggauuuuuuuaacaaagaugccuggua

SEQ ID NO: 111492 - RNA, 44 nt, Mus musculus
ugcuguguccuguugcucuccccggggcaccauaggugcaggcu

SEQ ID NO: 111493 - RNA, 46 nt, Mus musculus
ugcuggggcacugcugucaguugagguauucauggugugaggugac

SEQ ID NO: 111494 - RNA, 46 nt, Mus musculus
caguugcuugugugacuaacaacccucagcccugguccugccccug

SEQ ID NO: 111495 - RNA, 86 nt, Mus musculus
uaugcuuuccccacuuacgcugaucggcgugacuaccccuugccugauguggcccaugucacgaugcugucugccagccagaaggc

SEQ ID NO: 111496 - RNA, 46 nt, Mus musculus
ccagucggccuucuccuucuccuucagcgccuucuggcuggcagac

SEQ ID NO: 111497 - RNA, 48 nt, Mus musculus
cacaguuguguguucuagccuagccugugcagucccugggauggguuu

SEQ ID NO: 111498 - RNA, 51 nt, Mus musculus
cgagagcuucgccgagaugaacaggggcaccaaugaauggaagacaguugu

SEQ ID NO: 111499 - RNA, 79 nt, Mus musculus
uguuggggucuuauguggccuccaagcccacauagauagagaugcugugaucauggcaacaguuaugagcugcagcgug

SEQ ID NO: 111500 - RNA, 85 nt, Mus musculus
aauuaagccucauguccacagaggacugcauagugugagcuaggagacccauuggcugcguggcuggcuguucccaagcaucugg

SEQ ID NO: 111501 - RNA, 48 nt, Mus musculus
agguuguguugcauuccgagcaggcccuccccuccugagugugauugc

SEQ ID NO: 111502 - RNA, 86 nt, Mus musculus
cguaggauuucccugcugaccuuucacaaucgagggagguucugagauaggaguuacagugcccuggauuaaagcccgugugagag

SEQ ID NO: 111503 - RNA, 197 nt, Mus musculus
caaguuguucuguuccacaguguauggccccaucccucauacuuucgaucgugacuggguggccaugcagaccaagcgaaugcuggacaugaaggccaaccccauucagggcuucuccgccaagugggacuaugacaagaaugaguggaagaagugagagcccgcugccugccggcucccugccucccucacucccu

SEQ ID NO: 111504 - RNA, 45 nt, Mus musculus
ccguauccaaugguccaugcuaauaaaagaccaguuuacguggug

SEQ ID NO: 111505 - RNA, 46 nt, Mus musculus
ucagugaagagucacccagcacucaccuacugggccugagaaagga

SEQ ID NO: 111506 - RNA, 46 nt, Mus musculus
ugcuaaacagccuaugaagaaagcccuuucuuuugccuuuuuauuu

SEQ ID NO: 111507 - RNA, 27 nt, Mus musculus
auggaccccgcggcggcgggccccacc

SEQ ID NO: 111508 - RNA, 49 nt, Mus musculus
ugugguauguauggugugugccuguguaugucuguguaucuguguguag

SEQ ID NO: 111509 - RNA, 46 nt, Mus musculus
uguguaucucuauguuuaucuaugugugugguauguaugugugaug

SEQ ID NO: 111510 - RNA, 41 nt, Mus musculus
gauaucugucugucuguguuacauguguggugugugauuug

SEQ ID NO: 111511 - RNA, 42 nt, Mus musculus
agaggaagaggagaccucuuacuaggcccaaacacuaggaag

SEQ ID NO: 111512 - RNA, 45 nt, Mus musculus
aaggaccuguguuccaucuccagcaccagcagguguaagggccag

SEQ ID NO: 111513 - RNA, 41 nt, Mus musculus
accgcccuugcauggcucuuucugaguuccuguugcccuga

SEQ ID NO: 111514 - RNA, 46 nt, Mus musculus
agaaggaagaaggaggaggaagaaggaggaagaaggaggaggagga

SEQ ID NO: 111515 - RNA, 49 nt, Mus musculus
gggaagaagaggaaggggaagaagaggaagaggaagaagaggaagagga

SEQ ID NO: 111516 - RNA, 46 nt, Mus musculus; identical to SEQ ID NO: 111514

SEQ ID NO: 111517 - RNA, 49 nt, Mus musculus; identical to SEQ ID NO: 111515

SEQ ID NO: 111518 - RNA, 46 nt, Mus musculus
aagaagaaggaagaagaagaagaagaggaagaagaagaggaagaag

SEQ ID NO: 111519 - RNA, 102 nt, Mus musculus
gaagaggaggaagaggaagaagaggaggaagaggaagaagaggaggaagaggaagaagaggaggaagaggaggaagaggaagaagaggaggaagaggaagaa

SEQ ID NO: 111520 - RNA, 66 nt, Mus musculus
gagaaagaggaagaggaagaagaagagaaagaggaagaggaagaagaggaagaagaagaagagaaa

SEQ ID NO: 111521 - RNA, 42 nt, Mus musculus
gaagaggaggaagaagaagaggaggaagaagaagaggaagaa

SEQ ID NO: 111522 - RNA, 27 nt, Mus musculus
ggaggggaagaagaaaaggaagaagaa

SEQ ID NO: 111523 - RNA, 42 nt, Mus musculus; identical to SEQ ID NO: 111521

SEQ ID NO: 111524 - RNA, 46 nt, Mus musculus
gaagaagaagaaggaggaggaggaggaggaggaggggaagaagaaa

SEQ ID NO: 111525 - RNA, 45 nt, Mus musculus
uaagacauaagagaacagggggugcagcaaaauaaagggggacag

SEQ ID NO: 111526 - RNA, 77 nt, Mus musculus
cccccuuugguccgguccuaccucccucugucucuuuacaggggaucgggaccggguaguccuacgcgcgcacagau

SEQ ID NO: 111527 - RNA, 46 nt, Mus musculus
ggaccaaaggggguccccaugggcuaaauuccucuuugggucgcag

SEQ ID NO: 111528 - RNA, 45 nt, Mus musculus
ccugcugccaagccugacaaccugaguucgaucccgggacccaca

SEQ ID NO: 111529 - RNA, 46 nt, Mus musculus
aagacaaccacucagaaaguuuccacugagccuuccgcacccggag

SEQ ID NO: 111530 - RNA, 50 nt, Mus musculus
auagagggagcacauggcaccguggagcagcaaggagcaccgucggggaa

SEQ ID NO: 111531 - RNA, 46 nt, Mus musculus
uccuuccugugcgggagggaaagcaagauggugcagccacugucag

SEQ ID NO: 111532 - RNA, 45 nt, Mus musculus
agaggccuccaugcagccccauccuuagugcuagagacauuuaga

SEQ ID NO: 111533 - RNA, 42 nt, Mus musculus
cuacuuggaggauugcgacaaacacaccagguuaccaggcag

SEQ ID NO: 111534 - RNA, 46 nt, Mus musculus
auggcucacaaccaucuguaacaagaucugacgcccucuuccagag

SEQ ID NO: 111535 - RNA, 46 nt, Mus musculus
guuaggauaaaaccaaaauagaaagcacugggcaaaauggcggugg

SEQ ID NO: 111536 - RNA, 43 nt, Mus musculus
ucccugcccuuuaacccaggcuguaucuggggacacaccccag

SEQ ID NO: 111537 - RNA, 45 nt, Mus musculus
gucccuccagcagaucagcuccuucagugaugugcuggcuggacc

SEQ ID NO: 111538 - RNA, 45 nt, Mus musculus
ggugcuuggugccuauuuuucugaacaauggcuaaggguggggcu

SEQ ID NO: 111539 - RNA, 46 nt, Mus musculus
aagguugggguuccaucucuagggucccagaaaacuaaaguccaag

SEQ ID NO: 111540 - RNA, 38 nt, Mus musculus
agccaaugccacacuccaugggugucuuccagaaugac

SEQ ID NO: 111541 - RNA, 42 nt, Mus musculus
uucccaacuacauauugugcugggcacagacucagggcccug

SEQ ID NO: 111542 - RNA, 45 nt, Mus musculus
agaaaccagacaauaguaugucauuauacuguacacacagucauu

SEQ ID NO: 111543 - RNA, 42 nt, Mus musculus
aacccccuuaggcucacagauuugcauacucagcugguggga

SEQ ID NO: 111544 - RNA, 46 nt, Mus musculus
agaggccagguuggacacccuguggagaacugcagacaggacccag

SEQ ID NO: 111545 - RNA, 46 nt, Mus musculus
cgaagaggccgcuguacaaagccaacacaauguuccccacguccag

SEQ ID NO: 111546 - RNA, 45 nt, Mus musculus
uggaccagcaguuucacagcauucugcauguaugcaaugucccau

SEQ ID NO: 111547 - RNA, 46 nt, Mus musculus
guguggucaaaguccaggcaguuugaaccagcugcuccucaugccg

SEQ ID NO: 111548 - RNA, 42 nt, Mus musculus
agcaugaguccccgcagggcaggcgauccagucccgguccgg

SEQ ID NO: 111549 - RNA, 42 nt, Mus musculus
gccuuggucaaacauuaaccaguacagccugaguggccccag

SEQ ID NO: 111550 - RNA, 42 nt, Mus musculus
guaagaggagacugugggaugaacacaggcccccacccccug

SEQ ID NO: 111551 - RNA, 45 nt, Mus musculus
cgccuuggucaacgguuuugugaacuauucaugucuggggcccca

SEQ ID NO: 111552 - RNA, 42 nt, Mus musculus
cauacccguucccaccccccaucuucucuagcagcuacucgg

SEQ ID NO: 111553 - RNA, 42 nt, Mus musculus
ccccaggcggcgcagaggacuugucaagggagaaagcaccgg

SEQ ID NO: 111554 - RNA, 23 nt, Mus musculus
aucuaggauaagugggggugggu

SEQ ID NO: 111555 - RNA, 45 nt, Mus musculus
auuuucuguccaaaggaguccccaggaaaacucacagacaagcag

SEQ ID NO: 111556 - RNA, 45 nt, Mus musculus
uuauaaccaugaugauggugauagauguguuggugaugaugguga

SEQ ID NO: 111557 - RNA, 43 nt, Mus musculus
cgccggagacauguccaggaggaaacagagcaauccccggcag

SEQ ID NO: 111558 - RNA, 46 nt, Mus musculus
cugcaagucccauccugauaagaucgcucugucgggacgggcugaa

SEQ ID NO: 111559 - RNA, 42 nt, Mus musculus
ugcugggggacauguggagauccgacccaccaacugccccua

SEQ ID NO: 111560 - RNA, 42 nt, Mus musculus
uugcggggccucuuggcugcucuaggagcgaguaagcacaca

SEQ ID NO: 111561 - RNA, 42 nt, Mus musculus
guguuucaguuugaugagaaaugcagauagcuagggcaggga

SEQ ID NO: 111562 - RNA, 45 nt, Mus musculus
gguuuccaccaaccuggcugcuuuugggaagcccaggaggugcuc

SEQ ID NO: 111563 - RNA, 46 nt, Mus musculus
gcaaauuagugguagccacaggaugacuaacucauuccaagcccag

SEQ ID NO: 111564 - RNA, 42 nt, Mus musculus
ggagggaaugggguggguguguuccgcccucccaggccccca

SEQ ID NO: 111565 - RNA, 42 nt, Mus musculus
aaggacacacaacacagggccucauguguaagcagggcaggg

SEQ ID NO: 111566 - RNA, 44 nt, Mus musculus
gcagcagcagcucagggcagggaagcccaccauauucuggccau

SEQ ID NO: 111567 - RNA, 41 nt, Mus musculus
auaggacuggccucagguucccuuacucuucuuugccccca

SEQ ID NO: 111568 - RNA, 45 nt, Mus musculus
gccagcaguccugggaggcugcagcugugauaguuuccauuggua

SEQ ID NO: 111569 - RNA, 41 nt, Mus musculus
aagccccagacccagaggccccagccauagaggagccccca

SEQ ID NO: 111570 - RNA, 71 nt, Mus musculus
ggaguccccagaagauccugaggacauggaggggcaggaguuggagaugaggccccaggaugaagagaaag

SEQ ID NO: 111571 - RNA, 46 nt, Mus musculus
ggcuucccucagcucgcggcugaauucuaacugggaggaaggauag

SEQ ID NO: 111572 - RNA, 45 nt, Mus musculus
agagcucugggaauuuauccagaaagccaggaguguggacagcag

SEQ ID NO: 111573 - RNA, 46 nt, Mus musculus
acugacacucacagagccaccaaacugcagagucucccaaacccag

SEQ ID NO: 111574 - RNA, 42 nt, Mus musculus
agggcuggcagucuacgaagcuagacaccucuuuccucugag

SEQ ID NO: 111575 - RNA, 41 nt, Mus musculus
ggaaguggaugggggugggggguuucuuucuguuccuggga

SEQ ID NO: 111576 - RNA, 42 nt, Mus musculus
gggucagcccuuuaccaggacaguguccugggugagcugcag

SEQ ID NO: 111577 - RNA, 24 nt, Mus musculus
gagcuggcacugcaggaugggcag

SEQ ID NO: 111578 - RNA, 44 nt, Mus musculus
guugauccccuugccugcuggcagcaucaugaauuaagagggag

SEQ ID NO: 111579 - RNA, 42 nt, Mus musculus
gggugaguggaugaauggauggguggaagagucgaugagcag

SEQ ID NO: 111580 - RNA, 45 nt, Mus musculus
aaccaaaagaaaaaaaaaaaaaagaaaagaaaagaaaagaaaaaa

SEQ ID NO: 111581 - RNA, 45 nt, Mus musculus
ucucagagaugguuucugaugguuucugaugguuaucagcccgca

SEQ ID NO: 111582 - RNA, 53 nt, Mus musculus
aguggcugaugucauccagggcuggggggagggagaguuggagccaggaggga

SEQ ID NO: 111583 - RNA, 44 nt, Mus musculus
ccgggggccgggagcugaacuccuccuccgaggccuaccugaga

SEQ ID NO: 111584 - RNA, 45 nt, Mus musculus
caaccuauccugaugcagggcaaugacauucacacacacacacac

SEQ ID NO: 111585 - RNA, 42 nt, Mus musculus
cccuuacagucagcagccuguuucuccuccuguuccagccug

SEQ ID NO: 111586 - RNA, 41 nt, Mus musculus
ugcugccccagguccuaacugaagaagccgccaacucagag

SEQ ID NO: 111587 - RNA, 46 nt, Mus musculus
ccagguccccaggcuccgucucggacaccuucaccacacagcccca

SEQ ID NO: 111588 - RNA, 42 nt, Mus musculus
cucuucucggggacuaagggugccacgugcuuugagugcgag

SEQ ID NO: 111589 - RNA, 46 nt, Mus musculus
gggagcaagaggucaaaggaccuguguguccucauagucccaagaa

SEQ ID NO: 111590 - RNA, 45 nt, Mus musculus
guuugaaagugaugucuaauugaguggcagaaaaagugacgaauc

SEQ ID NO: 111591 - RNA, 53 nt, Mus musculus
ugacuaugcuuggguuaggaagugguguuauuaggagguguggccugguugga

SEQ ID NO: 111592 - RNA, 46 nt, Mus musculus
ucugucacggccuugcugcaugagucugaccuaaugcugaguaggg

SEQ ID NO: 111593 - RNA, 41 nt, Mus musculus
augucaaguugacgaaagaaagaaagaaagaaagaaagaaa

SEQ ID NO: 111594 - RNA, 42 nt, Mus musculus
caagagugagaagaggggacuuugguauuaacucaggcaaga

SEQ ID NO: 111595 - RNA, 43 nt, Mus musculus
ucauaagauguugguggccaccgcagaaaugcaaucaguagag

SEQ ID NO: 111596 - RNA, 46 nt, Mus musculus
cuccccagggagguuacacugggucacgguaauuuaacgaugccag

SEQ ID NO: 111597 - RNA, 27 nt, Mus musculus
uccucacuggcuccggcuuugggcacg

SEQ ID NO: 111598 - RNA, 46 nt, Mus musculus
cccucaaaugggucugaagauuacucuuguuaauaagugccaagaa

SEQ ID NO: 111599 - RNA, 46 nt, Mus musculus
guccuggaacucacuauguagaccaagcuagcuggaacuaagagac

SEQ ID NO: 111600 - RNA, 46 nt, Mus musculus
ucuuucuggggcucugguacaaguugguuugcuuuuaguuucaguc

SEQ ID NO: 111601 - RNA, 46 nt, Mus musculus
auaaaaccugucucaaaaauaaaauaagcugggcgugguggugcac

SEQ ID NO: 111602 - RNA, 46 nt, Mus musculus
ggauccaguucagggcucucggccacauccaucaggacccacagau

SEQ ID NO: 111603 - RNA, 46 nt, Mus musculus
gguugcauuuuccuccuccuccaaaucagacgcccuuuccccagcu

SEQ ID NO: 111604 - RNA, 45 nt, Mus musculus
uccucaacaucaucccccuccucgcauggggaucccgcugggccc

SEQ ID NO: 111605 - RNA, 46 nt, Mus musculus
uucaugcucauccaguucccgggucaccgaggaggcuucgucccug

SEQ ID NO: 111606 - RNA, 45 nt, Mus musculus
ucucccacacuuugaacaucaggcuucccuuccucuccgggagcc

SEQ ID NO: 111607 - RNA, 48 nt, Mus musculus
cccagccuaccacugacccucucucuaggaacaagggagccugagagu

SEQ ID NO: 111608 - RNA, 46 nt, Mus musculus
uguaccuuuaaccuggccucugagugguauggaauuugguauuggu

SEQ ID NO: 111609 - RNA, 25 nt, Mus musculus
gaaagacaaggggaacaagcaguaa

SEQ ID NO: 111610 - RNA, 45 nt, Mus musculus
uuuagagucaugaaggacacaguaaagugguuguagaaucucaag

SEQ ID NO: 111611 - RNA, 44 nt, Mus musculus
cuuuauauguguguaccauguguguguccuuggugccuguggag

SEQ ID NO: 111612 - RNA, 41 nt, Mus musculus
cucaggauuaucggcaggagguggauuaaccauguggcggu

SEQ ID NO: 111613 - RNA, 44 nt, Mus musculus
ggacagagaaaagcgggaaaaggagauucaccauaccuggagga

SEQ ID NO: 111614 - RNA, 42 nt, Mus musculus
gaggugagcagggcaggucugggccaaugguucaggccaggc

SEQ ID NO: 111615 - RNA, 45 nt, Mus musculus
ggcucuggaggggguggaggcaaaauuucaucaaccacuggccca

SEQ ID NO: 111616 - RNA, 41 nt, Mus musculus
aaggccacuggaaggaacacaaggaacccgagcccugcaga

SEQ ID NO: 111617 - RNA, 46 nt, Mus musculus
cugaugacaagacuggcaagaggagcccagagagguggaaacacag

SEQ ID NO: 111618 - RNA, 46 nt, Mus musculus
accaacauggcaaggccagccagaggcacaucuguaaccagcagau

SEQ ID NO: 111619 - RNA, 44 nt, Mus musculus
gacugaacagagaacaaguacuguaccgggcacccuaccuccag

SEQ ID NO: 111620 - RNA, 55 nt, Mus musculus
caaaucccagcaaccacaugguggcucccaaccgucuguaacaaaaucugaugcc

SEQ ID NO: 111621 - RNA, 46 nt, Mus musculus
uuucuccacucugcccuaaagaacacagaaggcgggcuggcgagau

SEQ ID NO: 111622 - RNA, 42 nt, Mus musculus
ggggagacggacacgccaagcuucuucuugggagacuuggau

SEQ ID NO: 111623 - RNA, 41 nt, Mus musculus
ccauucggaguuccuuccccugaggugcagacacagcuccu

SEQ ID NO: 111624 - RNA, 42 nt, Mus musculus
cagccgccugaaacagcacagugagggcgguagggcccagau

SEQ ID NO: 111625 - RNA, 48 nt, Mus musculus
caaucaaucaaucaaucaaucuuugggccggagcgagugaggcgagaa

SEQ ID NO: 111626 - RNA, 30 nt, Mus musculus
cuauuguccugggacugcgccccgcuugcu

SEQ ID NO: 111627 - RNA, 48 nt, Mus musculus
gagggugaagaggaggcagccucagcuggaggaccccagguuaaccca

SEQ ID NO: 111628 - RNA, 42 nt, Mus musculus
uacucuauguauccuucuacuggggaccaggaagguggggug

SEQ ID NO: 111629 - RNA, 46 nt, Mus musculus
agcccuggcuguccuggaagucccucuguagaccaggcuggccuug

SEQ ID NO: 111630 - RNA, 45 nt, Mus musculus
guugccguagcgagagggaaacugaauccagagaugagcugaugg

SEQ ID NO: 111631 - RNA, 42 nt, Mus musculus
ccgggcugcugcgugugcgcaggguccucgucauggggcaga

SEQ ID NO: 111632 - RNA, 45 nt, Mus musculus
auauuuuuaaaaaaaaaaaucaaaaacaugugggaugaguguaga

SEQ ID NO: 111633 - RNA, 47 nt, Mus musculus
caaagacaaagcaguuacucuucuaucgcaauacccagguuugacua

SEQ ID NO: 111634 - RNA, 46 nt, Mus musculus
ggauaagauagaaaaacgcaggguuccuaaauaucacaaaagccag

SEQ ID NO: 111635 - RNA, 46 nt, Mus musculus
gaccgggugggcuggcagccuuggcugggcaccucuuccccuggcc

SEQ ID NO: 111636 - RNA, 45 nt, Mus musculus
gagcagcaaccuagagcuggggcuucuggaagggacccuggugag

SEQ ID NO: 111637 - RNA, 46 nt, Mus musculus
agagugcacagucccuccugucacugagcuuugauucgcaggacac

SEQ ID NO: 111638 - RNA, 67 nt, Mus musculus
uguuuuagcagacagugaacaauuaauuuccucagucaaagguagaagaggcaguucagggagccgg

SEQ ID NO: 111639 - RNA, 45 nt, Mus musculus
cugaucuaguuuuauguuccuuccaccauuauccuacacacguaa

SEQ ID NO: 111640 - RNA, 50 nt, Mus musculus
acuugccauucugugcagaggucaccucuuaaaaccucaagcuuccacau

SEQ ID NO: 111641 - RNA, 60 nt, Mus musculus
cugcacagaauggcaagugcucauuaauagcaccggguaggaggagggggagugacucag

SEQ ID NO: 111642 - RNA, 45 nt, Mus musculus
cacgcccggcuaaggacauuuucuugagaucucaaagugcuagaa

SEQ ID NO: 111643 - RNA, 46 nt, Mus musculus
ggcuccuacucccucucacguguccacuuaaucauggucucuggag

SEQ ID NO: 111644 - RNA, 25 nt, Mus musculus
cgccaagcucaucuuccuguaccga

SEQ ID NO: 111645 - RNA, 46 nt, Mus musculus
gaugaggaagaggacuaccuuggugugcgcauccagcugcggaggg

SEQ ID NO: 111646 - RNA, 46 nt, Mus musculus
ucccaaugggccugaagccaacccugugaagcagcugcagccaggu

SEQ ID NO: 111647 - RNA, 46 nt, Mus musculus
gguuggcuucaggcccauugggagcacgaauguacuuggggaagag

SEQ ID NO: 111648 - RNA, 50 nt, Mus musculus
gggggcgcuguggcgcaucagcccacccagccgagcccagaugaagcagg

SEQ ID NO: 111649 - RNA, 42 nt, Mus musculus
cuguucaccaugagcgcccagcagccauccauugugccauuc

SEQ ID NO: 111650 - RNA, 46 nt, Mus musculus
agggugacggugacaucaaugggcugguugacgaccccgaccacag

SEQ ID NO: 111651 - RNA, 47 nt, Mus musculus
acugauccgcucuguggucggggucgucaaccagcccauugauguca

SEQ ID NO: 111652 - RNA, 35 nt, Mus musculus
gaagaagaaaauugucaaguaugguaugggaggcc

SEQ ID NO: 111653 - RNA, 46 nt, Mus musculus
aaaugguucuguguaaacaggcaaacucacgucaaggagacuacag

SEQ ID NO: 111654 - RNA, 98 nt, Mus musculus
cugucccuguccaacuggauguguguggaagacaucuaugccaacaucuuuaucaucaagugcagccgagagacagagaaggugccagggcagagagg

SEQ ID NO: 111655 - RNA, 54 nt, Mus musculus
ugaugauaaagauguuggcauagaugucuuccacacacauccaguuggacaggg

SEQ ID NO: 111656 - RNA, 44 nt, Mus musculus
acccaguccaugacggcccgcagcuccaccaggaacggcacuag

SEQ ID NO: 111657 - RNA, 41 nt, Mus musculus
aucuugggcaacuuccucaccaagaaauacaaccaucuaaa

SEQ ID NO: 111658 - RNA, 42 nt, Mus musculus
guggcgauucacaucuggauguucuuuaucuuaccggcuguc

SEQ ID NO: 111659 - RNA, 42 nt, Mus musculus
ggcugcagagugcuucuguagcagaggguacaaguuggggag

SEQ ID NO: 111660 - RNA, 42 nt, Mus musculus
cggcugcagagcuucugugugucacugugaguggccuggcua

SEQ ID NO: 111661 - RNA, 49 nt, Mus musculus
aaacuacagagagaaagaggccgcgucacacucaagaaaaaucgaaguu

SEQ ID NO: 111662 - RNA, 48 nt, Mus musculus
uucaggaggcgcaaggagacuccaggacccaaaggaacagcagucaug

SEQ ID NO: 111663 - RNA, 42 nt, Mus musculus
gcagcccccugagcacaggcuauaacacccgcaguggcagug

SEQ ID NO: 111664 - RNA, 46 nt, Mus musculus
ugcaguuccugugggugcugggccaggccacgguagacgggcugac

SEQ ID NO: 111665 - RNA, 42 nt, Mus musculus
cuuagcacacgcugcaucauguggcuacggccuauagagagg

SEQ ID NO: 111666 - RNA, 45 nt, Mus musculus
ggugacuugaacccagauguggaaccaguagaugucccagaagau

SEQ ID NO: 111667 - RNA, 43 nt, Mus musculus
ucaccuggaaggcacucugagcugcaggccugggguccucagg

SEQ ID NO: 111668 - RNA, 41 nt, Mus musculus
acucuggcgacuacuuccuguuugagucagauagcgaggag

SEQ ID NO: 111669 - RNA, 44 nt, Mus musculus
guccagccaggggcgccaccacugucuccguggcggggaggagc

SEQ ID NO: 111670 - RNA, 41 nt, Mus musculus
ugcaggggcuuugcccucuacaaugcagccaaccugaagag

SEQ ID NO: 111671 - RNA, 45 nt, Mus musculus
gcgcugacaugcaggaaguaguggcugagaaagaugcgccguugc

SEQ ID NO: 111672 - RNA, 49 nt, Mus musculus
cuuccugcucuugcaacggcgcaucuuucucagccacuacuuccugcau

SEQ ID NO: 111673 - RNA, 45 nt, Mus musculus
augcggguggcccccgcaacaaacaccacaacgagcaccagccag

SEQ ID NO: 111674 - RNA, 46 nt, Mus musculus
cucaucaaguggcuguaccuaccugacuucuucagagcccccaacu

SEQ ID NO: 111675 - RNA, 42 nt, Mus musculus
uaguuaggccagaggcgggcgauggccucacggcgccggcgu

SEQ ID NO: 111676 - RNA, 46 nt, Mus musculus
ggcacccgccagagguuggaccaggaccuacuuagcugccucaagu

SEQ ID NO: 111677 - RNA, 49 nt, Mus musculus
uugcagcccuuccccaacaauaccaacuugcagccuuuggagaucaacc

SEQ ID NO: 111678 - RNA, 46 nt, Mus musculus
aauucccagcacccacaugguggcucacaacuaucuguaaugggau

SEQ ID NO: 111679 - RNA, 46 nt, Mus musculus
ugaaccugcugcugguggugcuaugggccuucgccuugcccuaucc

SEQ ID NO: 111680 - RNA, 42 nt, Mus musculus
gcggccagcuucucggcuguccucacccgaauccagguguuc

SEQ ID NO: 111681 - RNA, 65 nt, Mus musculus
gcgaagagauagacagaagugauaaggggugaggcuuaggaaggaaagggaaacuuagugggguu

SEQ ID NO: 111682 - RNA, 43 nt, Mus musculus
cuugagcaucaggaggaagaggaagucuucagggaagaugggc

SEQ ID NO: 111683 - RNA, 48 nt, Mus musculus
ccugcuggccugcauccugcagcugcacuacuuccacagaccguucau

SEQ ID NO: 111684 - RNA, 45 nt, Mus musculus
cagguugggcgaccugggccuggagcaguucagugugucggagcu

SEQ ID NO: 111685 - RNA, 42 nt, Mus musculus
cacacagacccagacgcugcugcggagccugggggagcuggu

SEQ ID NO: 111686 - RNA, 42 nt, Mus musculus
guggugggcagcucaggaaguuccauggcccacacguaccuc

SEQ ID NO: 111687 - RNA, 46 nt, Mus musculus
gucucaagaacuucguagaccucccuaacuacuccagccccaacgc

SEQ ID NO: 111688 - RNA, 42 nt, Mus musculus
gccccagccguggggcugaagggagccccugcccuggcaacc

SEQ ID NO: 111689 - RNA, 41 nt, Mus musculus
ucccgaagccuugggaggugggggcugaguggagcaguaaa

SEQ ID NO: 111690 - RNA, 46 nt, Mus musculus
acuucagcuuggcugaugcccacaagugacaguucccguugcacag

SEQ ID NO: 111691 - RNA, 50 nt, Mus musculus
uacaguguauucaucuaaauaauaauaaauaaauaauauuaaaugggggg

SEQ ID NO: 111692 - RNA, 46 nt, Mus musculus
cggaugcucuguccuacaugagguccuaacagucaugcccacaggg

SEQ ID NO: 111693 - RNA, 45 nt, Mus musculus
gguuccucagggucccuguccauccuuagcauccuugcccuugua

SEQ ID NO: 111694 - RNA, 25 nt, Mus musculus
ggccaccaggaagaggaggcugagg

SEQ ID NO: 111695 - RNA, 74 nt, Mus musculus
ugguggugaagaugguggaggugguggugaugguggucaugguugugaugguaaagguggugguggugguguga

SEQ ID NO: 111696 - RNA, 42 nt, Mus musculus
augugagcugggccagggugugcugccucggguucuagggag

SEQ ID NO: 111697 - RNA, 25 nt, Mus musculus
cucuggacccccuccugagucacug

SEQ ID NO: 111698 - RNA, 42 nt, Mus musculus
gucuaggacagucaguuucugaaaauagcaauugcccgaggu

SEQ ID NO: 111699 - RNA, 45 nt, Mus musculus
uuggcaagcuuaaaauucagaccccgagguucuguguguguugag

SEQ ID NO: 111700 - RNA, 41 nt, Mus musculus
acacugucgaugucuucagacacaccagaagagggccccag

SEQ ID NO: 111701 - RNA, 46 nt, Mus musculus
guucaauucccagcaaccacaugguggcuuacaaccauaaugagau

SEQ ID NO: 111702 - RNA, 25 nt, Mus musculus
cuguacaguguugggaccgcucuac

SEQ ID NO: 111703 - RNA, 26 nt, Mus musculus
uuucccucuuccucccccacccccau

SEQ ID NO: 111704 - RNA, 45 nt, Mus musculus
auccuugaucucuuugccugaugcagcccugguugagagccaggg

SEQ ID NO: 111705 - RNA, 46 nt, Mus musculus
ccaacucccucccaaaugggauagggacuauuuucugcacccaugu

SEQ ID NO: 111706 - RNA, 25 nt, Mus musculus
aggcuuuccuagguagagccucccu

SEQ ID NO: 111707 - RNA, 46 nt, Mus musculus
ggaggggccgugcccacagugccucaguuucccucaucugacagau

SEQ ID NO: 111708 - RNA, 42 nt, Mus musculus
cuccccaccccacuugucuuguuagagcacccccauccuuug

SEQ ID NO: 111709 - RNA, 46 nt, Mus musculus
uguguuggggugggaccaagaauggcuaccaguguggcgguuagaa

SEQ ID NO: 111710 - RNA, 46 nt, Mus musculus
cucgaacucagaaaucccccugccucugccucccaaaugcugggau

SEQ ID NO: 111711 - RNA, 46 nt, Mus musculus
gugggugccaucucugggcugguagucuugguucuauaagagagca

SEQ ID NO: 111712 - RNA, 51 nt, Mus musculus
ccagcaaccacaugguggcucacaaccauccguaacuagaucugacucccu

SEQ ID NO: 111713 - RNA, 45 nt, Mus musculus
uaagcuguccuaauuucauuuugguggcugugauaaaggauccag

SEQ ID NO: 111714 - RNA, 47 nt, Mus musculus
uuggcuuaguggggucaaggaaggcugggaguugccauccuguaggu

SEQ ID NO: 111715 - RNA, 46 nt, Mus musculus
aacaagaaaccacagaugcaugacacugggcacaggcagguaggag

SEQ ID NO: 111716 - RNA, 42 nt, Mus musculus
cacaugcaugccuguaaugccagccuuugggugugggugcaa

SEQ ID NO: 111717 - RNA, 46 nt, Mus musculus
cucuuucuucucucuguguguguguguguguguguguguguaugug

SEQ ID NO: 111718 - RNA, 45 nt, Mus musculus
cagcaacaucccgacaauguuccagggaauuuuaaaagggcagug

SEQ ID NO: 111719 - RNA, 42 nt, Mus musculus
gguggccaagacuuggagggcaaagauggcuucuagacacag

SEQ ID NO: 111720 - RNA, 46 nt, Mus musculus
gaguuuggccccagaaggcuuauauauuugaaaauuugguccccag

SEQ ID NO: 111721 - RNA, 23 nt, Mus musculus
cgggcugacagggucagccacga

SEQ ID NO: 111722 - RNA, 23 nt, Mus musculus
uuuccuccuucuugguggccagg

SEQ ID NO: 111723 - RNA, 46 nt, Mus musculus
aaaggggaucucagaggcacagagaggcgguucccauggggcccag

SEQ ID NO: 111724 - RNA, 45 nt, Mus musculus
cacuauucccaugggacuagggcaucaccuugccugacuuuccag

SEQ ID NO: 111725 - RNA, 46 nt, Mus musculus
aggcuccuucacugacugucaacacuugggaacaaggagggcaggg

SEQ ID NO: 111726 - RNA, 45 nt, Mus musculus
cucucuuuuggugucauaggugcugggcuccauugccgcccuccc

SEQ ID NO: 111727 - RNA, 45 nt, Mus musculus
cacagggcgccccaggaggcucugccugaugucagaacuggagau

SEQ ID NO: 111728 - RNA, 46 nt, Mus musculus
aauuucugacuugaaaagcuccaggcagaacgccaccuucucccag

SEQ ID NO: 111729 - RNA, 41 nt, Mus musculus
gcauugcugacguaggcagaggguaccugggcuuccgggga

SEQ ID NO: 111730 - RNA, 46 nt, Mus musculus; identical to SEQ ID NO: 55813

SEQ ID NO: 111731 - RNA, 45 nt, Mus musculus
cuccauagacaggcacccccuagcgccugacuccugcccuccgag

SEQ ID NO: 111732 - RNA, 48 nt, Mus musculus
ugccuucuuaaucgccaggacuccugccccaguucucugccugagccc

SEQ ID NO: 111733 - RNA, 99 nt, Mus musculus
gaaguugggagcccaggcacgggcccugagagcccgaguccaagagaaugcuguggagccuaguaccccagaugccaaggugcccacagagcaaccaug

SEQ ID NO: 111734 - RNA, 44 nt, Mus musculus
uuugggguucugggucacaguguccucuccuacccuguggucug

SEQ ID NO: 111735 - RNA, 50 nt, Mus musculus
agaugaugcgcaagugaguggugugggggaggggaccuagcugcccccag

SEQ ID NO: 111736 - RNA, 42 nt, Mus musculus
aucaaaaccguguaucccacgucguaucgcuuccgccaggag

SEQ ID NO: 111737 - RNA, 45 nt, Mus musculus
gcccaggaagugcuggcccgugcccggagcuugaugacacccaag

SEQ ID NO: 111738 - RNA, 46 nt, Mus musculus
uggcuuuuaauaaagucauguaagauuuaaauaaaauacuacugag

SEQ ID NO: 111739 - RNA, 42 nt, Mus musculus
acagaucuguggucagccuccacauuuuccuuggagguccua

SEQ ID NO: 111740 - RNA, 41 nt, Mus musculus
aguuugagauggccuucaggccccucuagaauggagggcag

SEQ ID NO: 111741 - RNA, 45 nt, Mus musculus
ccacuguccaagggaucgcugaugauuacgauaaaaagaaacuag

SEQ ID NO: 111742 - RNA, 42 nt, Mus musculus
auacgaucaaaaugguggagucaucugcuuuggacugcaucg

SEQ ID NO: 111743 - RNA, 46 nt, Mus musculus
agaaagaaaaccaugggaguuuagaggagcuauggaauucauggag

SEQ ID NO: 111744 - RNA, 42 nt, Mus musculus
ccuaagaaggaugggggaguggggcucaguuaagauggccag

SEQ ID NO: 111745 - RNA, 46 nt, Mus musculus
cuauguacucauauacauuaaauaaauaaauuuuuaaccagcacuc

SEQ ID NO: 111746 - RNA, 45 nt, Mus musculus
gauaucccacaaaaucauggugacugcugcauacauguggugugg

SEQ ID NO: 111747 - RNA, 46 nt, Mus musculus
gaagaaagucuguaacuauuuccuaucugguuugguauggggguca

SEQ ID NO: 111748 - RNA, 46 nt, Mus musculus
uuauuauuauaucuaaguacacuguagcugucugcagaugcaccag

SEQ ID NO: 111749 - RNA, 45 nt, Mus musculus
cuuggacuuggguggcucuacccuggaggaccccacggaccugga

SEQ ID NO: 111750 - RNA, 24 nt, Mus musculus
aucuaugacuacgagggagauggc

SEQ ID NO: 111751 - RNA, 87 nt, Mus musculus
cucugugagguccaagagaggacugagucaggaguggugggagaaucuggagcauggacuaggcagcuagagggagcacuguccugg

SEQ ID NO: 111752 - RNA, 42 nt, Mus musculus
uaaagaguggauuucaauuaaaagcauacuauuugguggauc

SEQ ID NO: 111753 - RNA, 42 nt, Mus musculus
cuucuacuuaauccugucacagaagauccucuuugcccucag

SEQ ID NO: 111754 - RNA, 44 nt, Mus musculus
gucuuuucaggcuuccagcucaacacagcccaguccuuggccuu

SEQ ID NO: 111755 - RNA, 25 nt, Mus musculus
caucagggggauucugaaacgguuu

SEQ ID NO: 111756 - RNA, 42 nt, Mus musculus
gcacaaguggucuuagcuacugagccaucucucuggccccag

SEQ ID NO: 111757 - RNA, 64 nt, Mus musculus
cuauuauuauaucugauuacaccguugcugucuucagaugcaccagaagagggcgucagaucuc

SEQ ID NO: 111758 - RNA, 42 nt, Mus musculus
uuccagaggauccagguucaauucccagcaccaacacggcag

SEQ ID NO: 111759 - RNA, 41 nt, Mus musculus
acucaccccaacacacacacacacacacacacagagaaaga

SEQ ID NO: 111760 - RNA, 44 nt, Mus musculus
cuuaggaggagaauggcaaucucaugcugcccagucacccgggg

SEQ ID NO: 111761 - RNA, 42 nt, Mus musculus
gacuucuggccuauuggccuguucacggagaguagcccacac

SEQ ID NO: 111762 - RNA, 46 nt, Mus musculus
gcagcugggucagguguacgcaccuaugccaaaggagcacuguggg

SEQ ID NO: 111763 - RNA, 45 nt, Mus musculus
uugaacuguguaaaucauuuuuguugucucuaucacuaugcaucg

SEQ ID NO: 111764 - RNA, 46 nt, Mus musculus
agggaggaacaaacaagggagcuggcuacaaaauccagcuguguag

SEQ ID NO: 111765 - RNA, 32 nt, Mus musculus
cugccucaacaucugaagcaucuuuggccugg

SEQ ID NO: 111766 - RNA, 45 nt, Mus musculus
cuuugacuucuucuagggcuggcucaggggccggcaaaggguaag

SEQ ID NO: 111767 - RNA, 45 nt, Mus musculus
gcucagcaguucaccucuaggggaaggggaagacuuuggugguag

SEQ ID NO: 111768 - RNA, 45 nt, Mus musculus
guguccaccuugggcgaggggauaccauagucuggggaguaguag

SEQ ID NO: 111769 - RNA, 32 nt, Mus musculus
acuggggagucaaaacuagagggcgcagggac

SEQ ID NO: 111770 - RNA, 46 nt, Mus musculus
uguccuucugauauccacagauaucgagcgauaaagguuuguggag

SEQ ID NO: 111771 - RNA, 59 nt, Mus musculus
uuuuccuucuuggcucuuucacgcucguggcuuuucuuagaggaggaagaggaaugccg

SEQ ID NO: 111772 - RNA, 48 nt, Mus musculus
ugucucuuggcuucucugugugcugccugucagaagaggacuuccggu

SEQ ID NO: 111773 - RNA, 43 nt, Mus musculus
cgcugggugucgcuggccucuguggccuugaagcugccggcca

SEQ ID NO: 111774 - RNA, 58 nt, Mus musculus
cuuuaaagcauuuuucaaauucuuugucuuucugacacuugucaaggguggacuuguc

SEQ ID NO: 111775 - RNA, 47 nt, Mus musculus
ugcacuucuucagaccgaauccgcccaucccuccugucccggccccc

SEQ ID NO: 111776 - RNA, 46 nt, Mus musculus
gcauccuugauucucuucagcaccuucucauccuuaaagagccagu

SEQ ID NO: 111777 - RNA, 45 nt, Mus musculus
cuucagcuuauucucaguggagaggucacucucuaaaaggauggc

SEQ ID NO: 111778 - RNA, 50 nt, Mus musculus
cuuguccagcuuggggacagcgccauccguacagggguggaaggagcucc

SEQ ID NO: 111779 - RNA, 46 nt, Mus musculus
guccuugaggagucugacaaagaacucaccucagaccaggcuggag

SEQ ID NO: 111780 - RNA, 48 nt, Mus musculus
ucuuucgcuucuuuuucaauuuauucuuuucuuuuugcugccuagaac

SEQ ID NO: 111781 - RNA, 46 nt, Mus musculus
gaaaacuagcuaggacagagaaacaugaagcuguagaauaguccag

SEQ ID NO: 111782 - RNA, 49 nt, Mus musculus
aucuuugguuuuugaggcagaguuggggguccccuucugacacacugua

SEQ ID NO: 111783 - RNA, 41 nt, Mus musculus
ucauuccacccaacacuuacagagcaacaaggaaggccuau

SEQ ID NO: 111784 - RNA, 46 nt, Mus musculus
cccaaccuccaacaccuuacuaccaaguguucugacagacuguuag

SEQ ID NO: 111785 - RNA, 42 nt, Mus musculus
auguggucaacaccaaagaccuggucuggaagaggcccugag

SEQ ID NO: 111786 - RNA, 41 nt, Mus musculus
guggcucguucucucaccuccuucccgccaucacugcgguc

SEQ ID NO: 111787 - RNA, 42 nt, Mus musculus
gauagccccgcugccugugcauucuauuccauccgaggccug

SEQ ID NO: 111788 - RNA, 42 nt, Mus musculus
cucuggagaauucuuuaacagacaagagcagcagucagccag

SEQ ID NO: 111789 - RNA, 46 nt, Mus musculus
gaaagggugguaaauaauagaacccaauaaagugguccaaacccag

SEQ ID NO: 111790 - RNA, 45 nt, Mus musculus
auccuuacgagaacccucugccagcaggaacaggugcccccaucc

SEQ ID NO: 111791 - RNA, 46 nt, Mus musculus
gacaauagucaaaauuugaccauuuugccuuuucagggucugugag

SEQ ID NO: 111792 - RNA, 46 nt, Mus musculus
ucucuaacuuguuuauuuauuuauguauaagagcacucugccugca

SEQ ID NO: 111793 - RNA, 32 nt, Mus musculus
gcuuugugggaaggggcuguaaaaaugugaag

SEQ ID NO: 111794 - RNA, 41 nt, Mus musculus
cagaucuugaagugcaguguccaugaaaaguuuaggcccag

SEQ ID NO: 111795 - RNA, 45 nt, Mus musculus
uguaugcccaagaguacaagagaauaaaacagaaagauuaugguu

SEQ ID NO: 111796 - RNA, 46 nt, Mus musculus
gugaguuccagaacagccggggcuacacagagaaaccgugugucuc

SEQ ID NO: 111797 - RNA, 46 nt, Mus musculus
uuucuaugcauuuaugcacauaaugaaaaucaaagagccucaguag

SEQ ID NO: 111798 - RNA, 46 nt, Mus musculus
uaaaaauuuuaaaagaacugauaggagagggaggaacuaagugcag

SEQ ID NO: 111799 - RNA, 46 nt, Mus musculus
gaacuaucaacaaggcacugaaaccaaccuagaacuugacccccag

SEQ ID NO: 111800 - RNA, 42 nt, Mus musculus
uaugacaauggugcucaagaaaugcuaacugacuugcccaag

SEQ ID NO: 111801 - RNA, 41 nt, Mus musculus
cuuuaauaugcagcacuguguauguuaauaguaugcagagg

SEQ ID NO: 111802 - RNA, 46 nt, Mus musculus
ucaauucccagcaaccacaugguggcucacaaccaucugcaguagg

SEQ ID NO: 111803 - RNA, 45 nt, Mus musculus
ggguuccaacguuaccauaaccuugaauuauuuacugggauggaa

SEQ ID NO: 111804 - RNA, 46 nt, Mus musculus
uuucccuuaagcagcaaaugcucacucugcgccccucccccucaag

SEQ ID NO: 111805 - RNA, 42 nt, Mus musculus
uaguauggcuguuuuccuaaaaaacagaaacuuaggauacag

SEQ ID NO: 111806 - RNA, 42 nt, Mus musculus
gucaacaaaccuuuuucauggguaagaaaucaacaggagggg

SEQ ID NO: 111807 - RNA, 41 nt, Mus musculus
cccaggcuccucuaccauuuagaccauaugauccagcagac

SEQ ID NO: 111808 - RNA, 46 nt, Mus musculus
uuuuaaaagauuauuuuauguauaugaguaugugguagcuguacag

SEQ ID NO: 111809 - RNA, 42 nt, Mus musculus
cacaaccauccguaaugagaucugauguacuuuuccggggug

SEQ ID NO: 111810 - RNA, 46 nt, Mus musculus
gccaaaaagauaaauagcauuuugcuuuuccuuguuacucauuaag

SEQ ID NO: 111811 - RNA, 46 nt, Mus musculus
guuuaaggucauccuuggcuacaucacaaacucaagacucacgugg

SEQ ID NO: 111812 - RNA, 46 nt, Mus musculus
ugucuugccuguaugugcaccauguacaugcguggugucucuggag

SEQ ID NO: 111813 - RNA, 42 nt, Mus musculus
aacguggcaagaguccaugcugggguuguucccggugucaau

SEQ ID NO: 111814 - RNA, 46 nt, Mus musculus
cugucagucaggaacaguggcuccucucuauaaucccugcccucag

SEQ ID NO: 111815 - RNA, 46 nt, Mus musculus
ggaguaacaacaagaauggcaucaacuuccuaaaaagcgucccgag

SEQ ID NO: 111816 - RNA, 46 nt, Mus musculus
caagucacccuaaaucuugcaggccaaaucuaaucucuuugcugag

SEQ ID NO: 111817 - RNA, 45 nt, Mus musculus
aggcuaagggcugugaguauagcaucugaggucaaaaccaaacac

SEQ ID NO: 111818 - RNA, 46 nt, Mus musculus
auuugagaagaaaucuacuucuuuuuuucuuccuuuuuuuggggga

SEQ ID NO: 111819 - RNA, 41 nt, Mus musculus
guaagccaggcacagccauacaccugucaccugagcacaca

SEQ ID NO: 111820 - RNA, 24 nt, Mus musculus
cgaauggagagacagucuguaucu

SEQ ID NO: 111821 - RNA, 41 nt, Mus musculus
aaggggaggaggaagaggaggggagggggaggaggagaaga

SEQ ID NO: 111822 - RNA, 42 nt, Mus musculus
uccaagcuacagacugagcaugccaaaagguguuggggggag

SEQ ID NO: 111823 - RNA, 46 nt, Mus musculus
ugacagccagaaguacauggugagacuuuggaaaaauuaggaaaag

SEQ ID NO: 111824 - RNA, 45 nt, Mus musculus
agagaaggcagcuuccuucuauacagaucaaaacuccacagggag

SEQ ID NO: 111825 - RNA, 46 nt, Mus musculus
uuucaccaaugugacaagagucugagaucuuauuuggggcccuaag

SEQ ID NO: 111826 - RNA, 46 nt, Mus musculus
uguucguuguuuguauuugacaguaugaagccaaggacaauuucug

SEQ ID NO: 111827 - RNA, 46 nt, Mus musculus
gcuucacuggcuaucuaucagaccaacagaugguuacucacccaag

SEQ ID NO: 111828 - RNA, 42 nt, Mus musculus
uguagcuauacagcacauggguguauacacaaugacagcaag

SEQ ID NO: 111829 - RNA, 45 nt, Mus musculus
auguguagccaauccucugagcuuacaaaugaguaagggucccag

SEQ ID NO: 111830 - RNA, 45 nt, Mus musculus
gccuccagcccugucggucaagcaccucuuaggaaagugcuccag

SEQ ID NO: 111831 - RNA, 42 nt, Mus musculus
ucuaucucgaaaaaccaaaaaaaaaggaaggagaagggggag

SEQ ID NO: 111832 - RNA, 44 nt, Mus musculus
cuagacuagcuugagauauauaaagagauccugacaagaaagga

SEQ ID NO: 111833 - RNA, 45 nt, Mus musculus
cgggcauagugucccaccauggguuuuaauuaauccaaucacugg

SEQ ID NO: 111834 - RNA, 42 nt, Mus musculus
agacccuuaucuccaaaaaaauguaaaaagacagacagacag

SEQ ID NO: 111835 - RNA, 97 nt, Mus musculus
gaggggacagaagaggggacagaagagggggcagaagagggggcagaagaggggacagaagaggggacagaagaggggacagaagagggggcagaag

SEQ ID NO: 111836 - RNA, 51 nt, Mus musculus
gaagagggggcagaagugggagaagaggaaucaggagaaggaaggagggag

SEQ ID NO: 111837 - RNA, 45 nt, Mus musculus
gcccuagguucauuccgucuccagcgguauaaacuaggcauggac

SEQ ID NO: 111838 - RNA, 46 nt, Mus musculus
gggauacauggcucaauacuaaagcaaaaaaccccaaaaguacuag

SEQ ID NO: 111839 - RNA, 45 nt, Mus musculus
guauuucucuuuuguuaaucacuggaagggggagagggcggcaga

SEQ ID NO: 111840 - RNA, 42 nt, Mus musculus
gccuucggggugagugagugugugcacagccuucagggugag

SEQ ID NO: 111841 - RNA, 42 nt, Mus musculus; identical to SEQ ID NO: 111840

SEQ ID NO: 111842 - RNA, 42 nt, Mus musculus; identical to SEQ ID NO: 111840

SEQ ID NO: 111843 - RNA, 46 nt, Mus musculus
aaguaaacagaacccuugccuagugaccacaaaccccacugcugag

SEQ ID NO: 111844 - RNA, 46 nt, Mus musculus
cugcuacacuuuaaagacuagugugauauacuuaagaucuugucag

SEQ ID NO: 111845 - RNA, 46 nt, Mus musculus
uucuaagccuaaaagauuuuccaugccaauuauccaacugccugag

SEQ ID NO: 111846 - RNA, 45 nt, Mus musculus
ggagggggugagaaggacuggaaggcuguucuuuccccugcugcu

SEQ ID NO: 111847 - RNA, 45 nt, Mus musculus
gaacucaacacagcaggcaauguuuaagcaaauggcuuagggagu

SEQ ID NO: 111848 - RNA, 43 nt, Mus musculus
acuugcugugaaccaauggacugcugugacgugacugggguga

SEQ ID NO: 111849 - RNA, 46 nt, Mus musculus
gcuugcgguauggaaguuaguacguaacuguauuaaggacagggag

SEQ ID NO: 111850 - RNA, 41 nt, Mus musculus
gaaugagguuuugaaccaaguaagaggagagaucacaggag

SEQ ID NO: 111851 - RNA, 42 nt, Mus musculus
ggccccuggaaaggaaagggggauuggagaaauggcucagag

SEQ ID NO: 111852 - RNA, 45 nt, Mus musculus
ugaauugggucagcccuggguucaaaugaaagaugcugccgccau

SEQ ID NO: 111853 - RNA, 41 nt, Mus musculus
caacuugcucaugacagacaagggcuguguaaagacaggug

SEQ ID NO: 111854 - RNA, 42 nt, Mus musculus
cgaagguagcuuucugcaagguuuuuuaggggguaaggggag

SEQ ID NO: 111855 - RNA, 45 nt, Mus musculus
cccuggaggucagcccuggucagggggagcaggauugguguggua

SEQ ID NO: 111856 - RNA, 46 nt, Mus musculus
ggcagagcugcuggcccauaagccccuccucccuggcacuuccgag

SEQ ID NO: 111857 - RNA, 42 nt, Mus musculus
uguacagcuguuggggacaccgagugagaauaucuggccggu

SEQ ID NO: 111858 - RNA, 45 nt, Mus musculus
ggacaccuuaaacccaaauccaugaugcacuuuuucuggucucgg

SEQ ID NO: 111859 - RNA, 45 nt, Mus musculus
acuaggagcugcccaggacagaugggcuauagugaccccgggcag

SEQ ID NO: 111860 - RNA, 46 nt, Mus musculus
uaaauuuugggugguguguacaugccauguagaaagugugugagau

SEQ ID NO: 111861 - RNA, 42 nt, Mus musculus
caagugcuggggucaaaggcgugggcuaucacggccccacga

SEQ ID NO: 111862 - RNA, 27 nt, Mus musculus
cugcccuacaagggaaauuugggcggg

SEQ ID NO: 111863 - RNA, 46 nt, Mus musculus
uggucacaggugccaggcuuucccuggacgaacaucugcuccugaa

SEQ ID NO: 111864 - RNA, 43 nt, Mus musculus
uccugucugugccccaucagcugccagaacacacccaccccag

SEQ ID NO: 111865 - RNA, 45 nt, Mus musculus
uuauauguugauauguuucucguguuaaaaucaaaacaccggaua

SEQ ID NO: 111866 - RNA, 46 nt, Mus musculus
uguagucuagggacaggcaggagacucaaugauacauccuuagcag

SEQ ID NO: 111867 - RNA, 72 nt, Mus musculus
uguccgaguaccagcaguaccaggacgccacugcggaggaggagggggagauguaugaagaugaugacgagg

SEQ ID NO: 111868 - RNA, 42 nt, Mus musculus
gcucgcagcugggguguggggccaaguggcagccagggccaa

SEQ ID NO: 111869 - RNA, 46 nt, Mus musculus
auucggggggagggguauacuuaauaaaguuacugcugucugucag

SEQ ID NO: 111870 - RNA, 42 nt, Mus musculus
cagauccacagugucggagccucccaaccgaacauugggcag

SEQ ID NO: 111871 - RNA, 45 nt, Mus musculus
ucgagauagugggugcagaccuggugaaaacacagaaagguacag

SEQ ID NO: 111872 - RNA, 41 nt, Mus musculus
agaauguugauuuccuagcaauugggaggcagaggcaggca

SEQ ID NO: 111873 - RNA, 41 nt, Mus musculus
ggcaucccaauaccagcaccaggguuccugcaggucacaga

SEQ ID NO: 111874 - RNA, 42 nt, Mus musculus
guguguccagcaccccacugggugauggcuccaggcacugga

SEQ ID NO: 111875 - RNA, 45 nt, Mus musculus
gugggguguggggaaugaugaggaggcugcugggggggugugcca

SEQ ID NO: 111876 - RNA, 45 nt, Mus musculus
uacauacccaucgucccaaacuagggagguggagucagggcuugg

SEQ ID NO: 111877 - RNA, 45 nt, Mus musculus
gcuuguucuuucuuuccucagagaaagaaagaaagaaagaaagaa

SEQ ID NO: 111878 - RNA, 42 nt, Mus musculus
cccagcaaccacgugguggcucacaaccauccguaacaagau

SEQ ID NO: 111879 - RNA, 45 nt, Mus musculus
ucuuuaauuucauucauuugauaaucauuaagaagaauuuuuauc

SEQ ID NO: 111880 - RNA, 45 nt, Mus musculus
uaugagauggggucugugucugugaggugguaucugcugugucug

SEQ ID NO: 111881 - RNA, 45 nt, Mus musculus
ugugaggugauggcugugucugugaggugaugucugugucuguga

SEQ ID NO: 111882 - RNA, 65 nt, Mus musculus
ggugaugucugugucugugaggugauuuuugugucugugagguggugucugugucuguuaggugg

SEQ ID NO: 111883 - RNA, 79 nt, Mus musculus
ucugugaaguugggucuaugucugugaggugaugucugugucugugaggugauguaugugucugugaagugaugucugu

SEQ ID NO: 111884 - RNA, 84 nt, Mus musculus
agguaguaucugugucugugaggugaugucugugucugugagguggugucugugucugugaaguggugucugugaggugguguc

SEQ ID NO: 111885 - RNA, 46 nt, Mus musculus
gucaaugaggugaugucugugucugugaggugaugucugugucugu

SEQ ID NO: 111886 - RNA, 46 nt, Mus musculus
cuuacagagaagguauacagugugaaauggaaacucaggcucagau

SEQ ID NO: 111887 - RNA, 45 nt, Mus musculus
ucccggcucuccacgcucgguuccucucgcucugcggagacugga

SEQ ID NO: 111888 - RNA, 46 nt, Mus musculus
ccagccauucucaaugcacgugcugggugcucccccucccccaguc

SEQ ID NO: 111889 - RNA, 46 nt, Mus musculus
uaucuuuagaaagaggcacaaucccuaaggucccuaaggcuaccac

SEQ ID NO: 111890 - RNA, 46 nt, Mus musculus
ucaauucccagcaaccacaugguggcuuacaaccauccauaaugag

SEQ ID NO: 111891 - RNA, 42 nt, Mus musculus
agccaagguacccuagcacagauggcaacuaacuaccaggaa

SEQ ID NO: 111892 - RNA, 46 nt, Mus musculus
ugugcaguaaaauauaaaaugacacaagacacauauuacaggguag

SEQ ID NO: 111893 - RNA, 69 nt, Mus musculus
uaaaaaagauaaaagaaaaggaaccauguuauauaacaggacauaagggaaggaagcaugguguacuua

SEQ ID NO: 111894 - RNA, 51 nt, Mus musculus
ccugguucugcagccgccagcuucuggggugcuccuggagagacugugaga

SEQ ID NO: 111895 - RNA, 46 nt, Mus musculus
cugggugggguaacccacaccuguaaucacaauacuugggaggcag

SEQ ID NO: 111896 - RNA, 46 nt, Mus musculus
ugaugagggugugugugugugugugugugugugugugugugucucg

SEQ ID NO: 111897 - RNA, 42 nt, Mus musculus
cacuaguucucaagccagcuggccugacacaugcugcguuag

SEQ ID NO: 111898 - RNA, 45 nt, Mus musculus
caaaggauucuucaauaggacucuguuugcugguagaguagccag

SEQ ID NO: 111899 - RNA, 42 nt, Mus musculus
ucggucaggaggaugcgguacuggcacuggguauccguguag

SEQ ID NO: 111900 - RNA, 46 nt, Mus musculus
cgaccgggaagucaccuuccucgaagccuccagguucgcacaagag

SEQ ID NO: 111901 - RNA, 45 nt, Mus musculus
ccaggcuugguguuuugggcuugcaauccuuguacuuaggaggca

SEQ ID NO: 111902 - RNA, 41 nt, Mus musculus
cuccaagcccgaggacaucaauuucaucccuguggcccaca

SEQ ID NO: 111903 - RNA, 45 nt, Mus musculus
ggaaaggaaaggaaaggaaaggaaaggaaaggaaaggaauccagg

SEQ ID NO: 111904 - RNA, 46 nt, Mus musculus
ccauuuaguuccaaagcuagucugggcuacgugaaacccugucuca

SEQ ID NO: 111905 - RNA, 45 nt, Mus musculus
accuuugaauuagcaggcaacccucagugagacacaacugcaaag

SEQ ID NO: 111906 - RNA, 42 nt, Mus musculus
cugccgagaacccauggcugacagaguauaugcggugcuacu

SEQ ID NO: 111907 - RNA, 41 nt, Mus musculus
uauaucuaaguacacuguaacugucuucagacgcaccaggu

SEQ ID NO: 111908 - RNA, 45 nt, Mus musculus
uaugugccagaggaaguaagaaagccaccagaagcccacagagau

SEQ ID NO: 111909 - RNA, 46 nt, Mus musculus
gaguccuuggacucaguuggacagccaccuccuuguaggcacagau

SEQ ID NO: 111910 - RNA, 44 nt, Mus musculus
cucacagaaaggcauuauuguucucucccggcuuuccugggaga

SEQ ID NO: 111911 - RNA, 45 nt, Mus musculus
uguuccauccuuccuucaugccuaggauaccucggguucauagau

SEQ ID NO: 111912 - RNA, 43 nt, Mus musculus
gugcuucuucaucuuuagccaguacucuggcauucagggagga

SEQ ID NO: 111913 - RNA, 45 nt, Mus musculus
cugucacuuuggcgacccguagcugggacaauuccaccuucagau

SEQ ID NO: 111914 - RNA, 42 nt, Mus musculus
auuauuuuuauuuuauuucacuuauuucuucuuggggggggu

SEQ ID NO: 111915 - RNA, 46 nt, Mus musculus
uguuuguauauguguccauguaccaugugcaugcaguacucucaga

SEQ ID NO: 111916 - RNA, 42 nt, Mus musculus
auauacuuuuauggcugcccccaccccaccccacccccaguu

SEQ ID NO: 111917 - RNA, 42 nt, Mus musculus
uguaaacaaagccaugggagcuugggauccauggucggaguc

SEQ ID NO: 111918 - RNA, 42 nt, Mus musculus
cagccuugguaacaugagauuugucucaaaaagggggcagag

SEQ ID NO: 111919 - RNA, 49 nt, Mus musculus
aggugaggcggcucauaccugcuaauuccagcacuugugagguuggcgg

SEQ ID NO: 111920 - RNA, 45 nt, Mus musculus
uacauccaugccccaaauguaagcacccccaaagcugaccauagu

SEQ ID NO: 111921 - RNA, 46 nt, Mus musculus
cagacugaugcuaauacaagccuaggcugcaacaggacugagggau

SEQ ID NO: 111922 - RNA, 46 nt, Mus musculus
ccagcuccuuacgcucggccgcccagcccgaauucaguccccagug

SEQ ID NO: 111923 - RNA, 45 nt, Mus musculus
uuguguaaauauuugcuuauuaaaaaaaaauauugaggccaaaaa

SEQ ID NO: 111924 - RNA, 46 nt, Mus musculus
aguuuguucugaaagcaaauuaugaguauuauguccaaggacagau

SEQ ID NO: 111925 - RNA, 45 nt, Mus musculus
gaauuguucaacucauaacaauuauaaaaagauggugcuagauag

SEQ ID NO: 111926 - RNA, 46 nt, Mus musculus
auauccauuuuagacauuaagacuaaaauucgauuuagaaaaagaa

SEQ ID NO: 111927 - RNA, 45 nt, Mus musculus
cugcugcgaacaccaggcacacguguggugcacacacagggagag

SEQ ID NO: 111928 - RNA, 45 nt, Mus musculus
agcccccaugugguugcugggauuugaacucaggaccuucggaag

SEQ ID NO: 111929 - RNA, 46 nt, Mus musculus
acauuccuucauggaagcuuuagugaguuacaguguguccccauag

SEQ ID NO: 111930 - RNA, 46 nt, Mus musculus
augucacagccguguccuguguccucacccagaacagcuugccuuu

SEQ ID NO: 111931 - RNA, 40 nt, Mus musculus
cugguuggcuucaauuugcauuuuaaugaugauggcagaa

SEQ ID NO: 111932 - RNA, 62 nt, Mus musculus
ugcaagguggcuuagcaccugcugaccugagucagauucuagagccuccguggugggaagag

SEQ ID NO: 111933 - RNA, 53 nt, Mus musculus
agugaccaagaacgauacagcagucuggaaguggaguaccugcagaaaagauc

SEQ ID NO: 111934 - RNA, 46 nt, Mus musculus
aagugguccauccgguauccgcacagcagucaugcgccagcacggg

SEQ ID NO: 111935 - RNA, 47 nt, Mus musculus
acaggcugccacucacuaccgccuaaacaaaagcucuauguacaguc

SEQ ID NO: 111936 - RNA, 50 nt, Mus musculus
cuaucugugagugccuccuggagcaugaggaacaaguccugcgugaaguu

SEQ ID NO: 111937 - RNA, 46 nt, Mus musculus
uggcacagcagagggcugggucugcaccacuggacacuggugagag

SEQ ID NO: 111938 - RNA, 45 nt, Mus musculus
gacuccugccgaugucuucuuucgagaggucagcugcgcccuagu

SEQ ID NO: 111939 - RNA, 49 nt, Mus musculus
cucgacugccagaccuggugaacucagcuauccugcucgcccugaacaa

SEQ ID NO: 111940 - RNA, 46 nt, Mus musculus
gugccuucugagaacaagugcuuguuguauuuuguuuuugugaggu

SEQ ID NO: 111941 - RNA, 42 nt, Mus musculus
ugcuggucucccuguccuguccacaugggggcaccaccagau

SEQ ID NO: 111942 - RNA, 45 nt, Mus musculus
cagagcagcgaggcuguagguagcaugguugcugguucuggcagu

SEQ ID NO: 111943 - RNA, 42 nt, Mus musculus
gcaguugggcaagucccagcugugcucucguugugcccagau

SEQ ID NO: 111944 - RNA, 47 nt, Mus musculus
guauuagcagcuaauuuaguccccaauaacaaacagagaaaccaaga

SEQ ID NO: 111945 - RNA, 45 nt, Mus musculus
aaacguccucugcaagagcaagagccgcuccuaaccaccccagca

SEQ ID NO: 111946 - RNA, 44 nt, Mus musculus
uugguuguuuuguuuuuucaagauuuuuuuaucugugcagggac

SEQ ID NO: 111947 - RNA, 45 nt, Mus musculus
uuuacauggagaaugcugucuuugugugcuccacaggcacuggga

SEQ ID NO: 111948 - RNA, 46 nt, Mus musculus
acagucucacuuuaauguuauuuuggggacgagagauggcuuagug

SEQ ID NO: 111949 - RNA, 44 nt, Mus musculus
uuggauucaaauuuuggggggugugcguugguuuguaguugaga

SEQ ID NO: 111950 - RNA, 41 nt, Mus musculus
gcauacacucggcagaguuuaaaccucacauagguggcagu

SEQ ID NO: 111951 - RNA, 46 nt, Mus musculus
ggaaauacucauaaauccaacuuaaaaacagagauggcccagaggu

SEQ ID NO: 111952 - RNA, 30 nt, Mus musculus
acaugcagacacacauuucuuacaaagcua

SEQ ID NO: 111953 - RNA, 46 nt, Mus musculus
agagguccauuuuagcguccaugugucccugacuuuguuguugauc

SEQ ID NO: 111954 - RNA, 42 nt, Mus musculus
cuuccuacuuuaaacuccaaaaggauuaucagguggggagaa

SEQ ID NO: 111955 - RNA, 45 nt, Mus musculus
gucaguuuagucuacauagucuugaauuucaagacaaccagggaa

SEQ ID NO: 111956 - RNA, 46 nt, Mus musculus
gcacuuugugugugugugugugugugugugugugugugagagagag

SEQ ID NO: 111957 - RNA, 45 nt, Mus musculus
uccacaguccaggagaaacgugcgcaugcguaauggagccuuuaa

SEQ ID NO: 111958 - RNA, 46 nt, Mus musculus
auuaaacaaggagguaauaaaaaaauagaagcuuuccaguuuacag

SEQ ID NO: 111959 - RNA, 45 nt, Mus musculus
agguaauggaggauggacgcgucaaacuuucccucaguggcccua

SEQ ID NO: 111960 - RNA, 46 nt, Mus musculus
guguggaguggugugugugugaaguguguguguggaguggugugug

SEQ ID NO: 111961 - RNA, 44 nt, Mus musculus
cucucucucucucccucucccucucucucucucucucucucugu

SEQ ID NO: 111962 - RNA, 46 nt, Mus musculus
auaguccggguuaaacucagugggacacaaaacaaaaauccaugag

SEQ ID NO: 111963 - RNA, 45 nt, Mus musculus
caagaacgaaauaaaaaugauaaaaagguauuauuaaucugagga

SEQ ID NO: 111964 - RNA, 42 nt, Mus musculus
aaagguccugaguucaaaucccagcaaccacgugguggcgca

SEQ ID NO: 111965 - RNA, 41 nt, Mus musculus
ucccagcaaccacauggucgcucacaaccaucuguaacaag

SEQ ID NO: 111966 - RNA, 42 nt, Mus musculus
gggugagacaaggaggugaaggcagaaagagaggggggggag

SEQ ID NO: 111967 - RNA, 63 nt, Mus musculus
cugugaugucauauguuuggaagguccugaugccaacagaaagagaaagaggagagggagaga

SEQ ID NO: 111968 - RNA, 43 nt, Mus musculus
agggagagagggagggaagggagggagggagggagagagagag

SEQ ID NO: 111969 - RNA, 42 nt, Mus musculus
acuuacuuaaugcagacuccacagcaugcuggcagggcagga

SEQ ID NO: 111970 - RNA, 41 nt, Mus musculus
acauggcagcucacaacugucuauaacuccaguuccagggg

SEQ ID NO: 111971 - RNA, 41 nt, Mus musculus
uaugaugaaaguaaauaauucauuuaaagagauuaaggaaa

SEQ ID NO: 111972 - RNA, 42 nt, Mus musculus
cgcacggcagggccccgacgcggaaucagcaguagcgcccua

SEQ ID NO: 111973 - RNA, 45 nt, Mus musculus
uuuuucucuggcaucuucaaguuauuccuagcugcagguacggag

SEQ ID NO: 111974 - RNA, 46 nt, Mus musculus
gcaugccauguguguccuuaaagcgacugaagaaaaugaaggguag

SEQ ID NO: 111975 - RNA, 46 nt, Mus musculus
uuugcaaacaguagcuucuuugccaccuggccaccgagucauggag

SEQ ID NO: 111976 - RNA, 42 nt, Mus musculus
uucugauggugugcuguaguuucuugccgcuuccccggacag

SEQ ID NO: 111977 - RNA, 45 nt, Mus musculus
ccaaaguaccuuucuucuacgcuacuucugguggguaauggguua

SEQ ID NO: 111978 - RNA, 62 nt, Mus musculus
ccacaagacaaguuccccaggaccaaaaugaaacaaagucagaaauggaaggguuuucaguu

SEQ ID NO: 111979 - RNA, 25 nt, Mus musculus
cuaguggggggggggggaacggcag

SEQ ID NO: 111980 - RNA, 44 nt, Mus musculus
aacggcuucccagaggagggcagugauggcaggaagaagcagga

SEQ ID NO: 111981 - RNA, 42 nt, Mus musculus
uccaggccagcugagagugacagucauguuccauaguugcag

SEQ ID NO: 111982 - RNA, 66 nt, Mus musculus
gagagcacaggugugggauaagagcacagguguggaugagagcacaggugugggaugagagcacag

SEQ ID NO: 111983 - RNA, 62 nt, Mus musculus
gugugggauaagagcacagguguggaugagagcacaggugugggauaagagcacaggugugg

SEQ ID NO: 111984 - RNA, 42 nt, Mus musculus
gugggaugagagcacaggugugggauaagagcacaggugugg

SEQ ID NO: 111985 - RNA, 42 nt, Mus musculus
aagugccauuacuggcugagccauuuaggcugaggggcuuac

SEQ ID NO: 111986 - RNA, 45 nt, Mus musculus
acugucauuguuuuuuaucucuguaaggcuugagccucauggcag

SEQ ID NO: 111987 - RNA, 42 nt, Mus musculus
uuaggugaucuuuggcuuuaguggggagcauugucagcccag

SEQ ID NO: 111988 - RNA, 45 nt, Mus musculus
ggauaaugcugaugaauaauccauggugugugcuuguguguucgu

SEQ ID NO: 111989 - RNA, 42 nt, Mus musculus
cgcagcucugccucuugucuuggcugaugcugcccuguucag

SEQ ID NO: 111990 - RNA, 46 nt, Mus musculus
uggagaugggaugugaucagaguccccugcuuccucuggccuguag

SEQ ID NO: 111991 - RNA, 45 nt, Mus musculus
cugcuuggauggcugaagccagcugagaguagaugggaucacuaa

SEQ ID NO: 111992 - RNA, 41 nt, Mus musculus
cagagacuagcugcgcggaacaggagugauugcaaccccag

SEQ ID NO: 111993 - RNA, 68 nt, Mus musculus
aacaccucaagaguucgugggacagagcaaaauggcagaccaggucgggagacucagggaccaaauag

SEQ ID NO: 111994 - RNA, 42 nt, Mus musculus
ucucccaguuaugggcagagcauggcucugugaggcccgcag

SEQ ID NO: 111995 - RNA, 41 nt, Mus musculus
cugguuagauugagauccaccagacuuuccuaaugggggga

SEQ ID NO: 111996 - RNA, 46 nt, Mus musculus
guauucuucaugacacauaccaggauguaguagugccagacgucag

SEQ ID NO: 111997 - RNA, 44 nt, Mus musculus
gugaguguuugaggcugacauggacagacaaacuucugguagug

SEQ ID NO: 111998 - RNA, 46 nt, Mus musculus
aauggauguggaugccaugcccaggucacacccagcucacccacgg

SEQ ID NO: 111999 - RNA, 45 nt, Mus musculus
aggccuccuguuuggguuaugcacagaaacacuuuucguucacag

SEQ ID NO: 112000 - RNA, 46 nt, Mus musculus
gacaucgacuccauuaagaagaaagaccuucaccacagcagaggag

SEQ ID NO: 112001 - RNA, 46 nt, Mus musculus
gacuggcugugaggagacuaaaggagggagagaugaugcugacuag

SEQ ID NO: 112002 - RNA, 46 nt, Mus musculus
guagguuggcugguugguagguauguugugacugguagguuggugg

SEQ ID NO: 112003 - RNA, 45 nt, Mus musculus
ggggagcccauaucugugccgaacucagagccuuggagccccuau

SEQ ID NO: 112004 - RNA, 42 nt, Mus musculus
cucagugcagacaggccuuccguggagcuuucugguccccag

SEQ ID NO: 112005 - RNA, 61 nt, Mus musculus
uucgcucugggcaggacccguacgcacgcaacaaguucaaccagguggagagugacaagcu

SEQ ID NO: 112006 - RNA, 24 nt, Mus musculus
gacuuacuggucaugccggguguc

SEQ ID NO: 112007 - RNA, 31 nt, Mus musculus
gauaggcuuugcagauaacguaggcagauca

SEQ ID NO: 112008 - RNA, 47 nt, Mus musculus
ugcaaaccaugugcccuagagauacuggacuuuagugauagacccca

SEQ ID NO: 112009 - RNA, 46 nt, Mus musculus
gucuccgcucccaggauugccccuuggcugcugugugcuccgggag

SEQ ID NO: 112010 - RNA, 71 nt, Mus musculus
aagaucacacagacagacacuugcacauugacaauuacagcagcgguagucacagcagccacguuacagag

SEQ ID NO: 112011 - RNA, 46 nt, Mus musculus
gaggaaacagaggacugugugcagcuucucucagauacgcccccaa

SEQ ID NO: 112012 - RNA, 45 nt, Mus musculus
gggcuugcgguggggugagaugagagcaggagcgaaucacggcaa

SEQ ID NO: 112013 - RNA, 42 nt, Mus musculus
ggaaaaucgagaaggugcggguccucagaaaugaccggagag

SEQ ID NO: 112014 - RNA, 30 nt, Mus musculus
ucgucacgugggcccacagcaggcaggcag

SEQ ID NO: 112015 - RNA, 45 nt, Mus musculus
auacgggaacacagagcgagucagauuguuccgaacggcugcugu

SEQ ID NO: 112016 - RNA, 46 nt, Mus musculus
ggaccaagcaucuccagugucuaugaccgccggaucgccagcagau

SEQ ID NO: 112017 - RNA, 45 nt, Mus musculus
ucagacucucuuccaggucuccauguguggcuccaggcacagcag

SEQ ID NO: 112018 - RNA, 46 nt, Mus musculus
gcccagcaagaaucuuuuucuuuuuaauauuuaaaaauuccgugug

SEQ ID NO: 112019 - RNA, 45 nt, Mus musculus
ugagcagucagccugaggcagcacugagcaggaaggucagaggag

SEQ ID NO: 112020 - RNA, 62 nt, Mus musculus
gccugagcuaugcuggugcagcucacgagagggcaacaggcauaucgugguugcgcuuaguu

SEQ ID NO: 112021 - RNA, 42 nt, Mus musculus
aguaucuuuccuuccuuugucccccucaggacaggacccgag

SEQ ID NO: 112022 - RNA, 47 nt, Mus musculus
ucucucucuccccucuccccucuccucucucucuccccacuuucccc

SEQ ID NO: 112023 - RNA, 53 nt, Mus musculus
gagaguggggagagagagaggggaaaguggggagagagagaggagaggggaga

SEQ ID NO: 112024 - RNA, 42 nt, Mus musculus
ggagagaggagagaggggagaggggagagaggggagagaggg

SEQ ID NO: 112025 - RNA, 47 nt, Mus musculus
gcaacugcagauucuccuagcuuuaguuauagcagcuccgggaggga

SEQ ID NO: 112026 - RNA, 42 nt, Mus musculus
uacgacaugaugauggacguguggggaggagagaacuugggu

SEQ ID NO: 112027 - RNA, 45 nt, Mus musculus
gucagagaucucauuccgaguguggcagugugguggcagccugga

SEQ ID NO: 112028 - RNA, 46 nt, Mus musculus
aggagacaucaaggcucaucacugauggauuaccaaucagcaauag

SEQ ID NO: 112029 - RNA, 45 nt, Mus musculus
aggagaggcagagggaguuaggggaaccuaguucacuuucccagc

SEQ ID NO: 112030 - RNA, 47 nt, Mus musculus
cugggucacucaucaggcugcagggcugccgggagaacgacagcaga

SEQ ID NO: 112031 - RNA, 41 nt, Mus musculus
agagcacggcucagcauccuuucauccaccugauugcacaa

SEQ ID NO: 112032 - RNA, 44 nt, Mus musculus
ggaaccuuauugcguguauaaaacaauaacuagagccacagacc

SEQ ID NO: 112033 - RNA, 44 nt, Mus musculus
agccguuaaagacuaggcucacaauccaaaauauaagagaaaga

SEQ ID NO: 112034 - RNA, 45 nt, Mus musculus
ccggcccugucacaacaguggaaguucucacucaaccugcagcaa

SEQ ID NO: 112035 - RNA, 44 nt, Mus musculus
gcccagagcaaaggugcaucucuggggccucaccagccggccca

SEQ ID NO: 112036 - RNA, 45 nt, Mus musculus
guuagaaagucugcuuugugcccauugucaucuguaaaacuaaau

SEQ ID NO: 112037 - RNA, 46 nt, Mus musculus
uuugagacccuguauguugggucuuugguacuaagcugccggcaga

SEQ ID NO: 112038 - RNA, 55 nt, Mus musculus
acaggugcaaagcugucaaggacaaggcaggaguuugcuggaguccggucaccac

SEQ ID NO: 112039 - RNA, 72 nt, Mus musculus
uucuuguuuccucagacaggguggaagauggaggaauaagguccauuaaaggcugcaguuucaaaccguggu

SEQ ID NO: 112040 - RNA, 65 nt, Mus musculus
acuggauuacguuguguuugugugcgagcuaguuuugcuuucagguguaagagcguuuagaacgu

SEQ ID NO: 112041 - RNA, 44 nt, Mus musculus
aacacggauuccaccccacggugucuaaagaaacucuagccaga

SEQ ID NO: 112042 - RNA, 41 nt, Mus musculus
cgucucugauacugauggcagggucuuguaggaaggggaaa

SEQ ID NO: 112043 - RNA, 46 nt, Mus musculus
gcugauggccaguggcaaagaaguggcugggaagauccccaaaggg

SEQ ID NO: 112044 - RNA, 45 nt, Mus musculus
aaucuuauccuuaguguauuacuuuuauaauuuaaugccccuguc

SEQ ID NO: 112045 - RNA, 46 nt, Mus musculus
cauuaaauuauaaaaguaauacacuaaggauaagauuaaguugcag

SEQ ID NO: 112046 - RNA, 62 nt, Mus musculus
aaauucagcaggacacacagacacacauacauacacagagagagggggggagagagagagag

SEQ ID NO: 112047 - RNA, 65 nt, Mus musculus
agagagagagagagagagagugggggccuugugggaagaaggguuuagugggaauaacugggggg

SEQ ID NO: 112048 - RNA, 85 nt, Mus musculus
aaggacggguucaccgugaacaccaaaguccccagccucaaagaucaagggaaggaauaugacggcuucaccaucaccaucacag

SEQ ID NO: 112049 - RNA, 45 nt, Mus musculus
gucacugccugcccuauuccagcuccauccaucccagccagaguc

SEQ ID NO: 112050 - RNA, 42 nt, Mus musculus
auccuugccacaaacagaccagguaugaaugcacagucccag

SEQ ID NO: 112051 - RNA, 46 nt, Mus musculus
cagucacauaugugcuuugguuuucuuuuauacaauuccuccugag

SEQ ID NO: 112052 - RNA, 45 nt, Mus musculus
ugcagacaaaacacacauacacuuaaauugaaaauauaucucagg

SEQ ID NO: 112053 - RNA, 46 nt, Mus musculus
guauguguguuuugucugcauguaugucugugcacccuacaugccc

SEQ ID NO: 112054 - RNA, 46 nt, Mus musculus
auuggaagucagagaagcucuggaaaagguacacaaaguggaagac

SEQ ID NO: 112055 - RNA, 81 nt, Mus musculus
ccuucaagagaggggaagaagaaaacaaacaaacaaaacaaaaaacggaaugggcaugugaggaguauagugucuccagag

SEQ ID NO: 112056 - RNA, 47 nt, Mus musculus
gccacaguugucccagucagucuaagaguaguaggagaaaaagcgag

SEQ ID NO: 112057 - RNA, 41 nt, Mus musculus
guggacucucgaaggauggagggugucaguuuucaagaagu

SEQ ID NO: 112058 - RNA, 46 nt, Mus musculus
cacaucaacuuaaucagguaggggccugugugcuuucuuguguuug

SEQ ID NO: 112059 - RNA, 42 nt, Mus musculus
ccaaugagaggugccugcugucaaacccugaaucacccccag

SEQ ID NO: 112060 - RNA, 56 nt, Mus musculus
cacuggaagucaugcaggccguacaucguaccuggaccaacucaaagguucgcaug

SEQ ID NO: 112061 - RNA, 46 nt, Mus musculus
uguguguacauauaaagagaguuuguguauauaagauguguguacc

SEQ ID NO: 112062 - RNA, 46 nt, Mus musculus
accuuccaaagcauccucacacaucuuccaauauacacacucagac

SEQ ID NO: 112063 - RNA, 46 nt, Mus musculus; identical to SEQ ID NO: 112062

SEQ ID NO: 112064 - RNA, 46 nt, Mus musculus; identical to SEQ ID NO: 112062

SEQ ID NO: 112065 - RNA, 46 nt, Mus musculus; identical to SEQ ID NO: 112062

SEQ ID NO: 112066 - RNA, 46 nt, Mus musculus; identical to SEQ ID NO: 112062

SEQ ID NO: 112067 - RNA, 46 nt, Mus musculus; identical to SEQ ID NO: 112062

SEQ ID NO: 112068 - RNA, 46 nt, Mus musculus; identical to SEQ ID NO: 112062

SEQ ID NO: 112069 - RNA, 42 nt, Mus musculus
gcugaaugacccucuuccaggccagaaggccagcccagagua

SEQ ID NO: 112070 - RNA, 41 nt, Mus musculus
gaaccguacaacgaagugugccaguacaugaaggggcugag

SEQ ID NO: 112071 - RNA, 75 nt, Mus musculus
gaagccaucgaggccuucaaagaagcucugaaacagaaaguugacuuuaucgaugcauauaaaagucugggacag

SEQ ID NO: 112072 - RNA, 45 nt, Mus musculus
ccaccaacaccuaguuggacagaagugguguugucucaagucagg

SEQ ID NO: 112073 - RNA, 45 nt, Mus musculus
ggggggcugagcagggaggcugggucagugggcaucugggcaaga

SEQ ID NO: 112074 - RNA, 42 nt, Mus musculus
cagggacgcucaccuugaccuuucaucaucucuugcccagau

SEQ ID NO: 112075 - RNA, 47 nt, Mus musculus
auucagagacauuucugaaggcagacaggaucugguggcagcagguu

SEQ ID NO: 112076 - RNA, 42 nt, Mus musculus
cguggccacuacacuugccuuccuaaccugcugccaccagau

SEQ ID NO: 112077 - RNA, 37 nt, Mus musculus
uuuuggcuccuugccuauccauaaaguagacccaacc

SEQ ID NO: 112078 - RNA, 25 nt, Mus musculus
uaagugguguucacagaggccuaau

SEQ ID NO: 112079 - RNA, 46 nt, Mus musculus
accgcugggacagacagacucgucccuggcagucacagucccugug

SEQ ID NO: 112080 - RNA, 46 nt, Mus musculus
ggacauuaagaacgcugagcuugcuuuguuugaacugagccgagua

SEQ ID NO: 112081 - RNA, 46 nt, Mus musculus
aauggcugggaaguaguucugguuuucugagcauggaguggaagug

SEQ ID NO: 112082 - RNA, 42 nt, Mus musculus
gcucccuacccacaccaucaccagcucugcugccgccgaggu

SEQ ID NO: 112083 - RNA, 46 nt, Mus musculus
ugagaaagcucagaguagguuagcgacaucaggcugagcuagcggg

SEQ ID NO: 112084 - RNA, 45 nt, Mus musculus
ugugagcaaaaaucaugucuuuugugguaccaacagccugcagau

SEQ ID NO: 112085 - RNA, 46 nt, Mus musculus
gcuuauguccuggugggcagcggucucuacgaugaagccauaagac

SEQ ID NO: 112086 - RNA, 44 nt, Mus musculus
gugaucagauacagaauaggaaaccagguggagggagaacuugg

SEQ ID NO: 112087 - RNA, 41 nt, Mus musculus
ucaggggccccagaguagccagaaggacugaugcccacaga

SEQ ID NO: 112088 - RNA, 45 nt, Mus musculus
cucaacuuuacagacagauuuugucuuaaccaccaaaggcucuua

SEQ ID NO: 112089 - RNA, 43 nt, Mus musculus
cuacccaaacacuaccuaguuucuuagcugagaugcagucuca

SEQ ID NO: 112090 - RNA, 45 nt, Mus musculus
aagcaaggaugugcuugaagacugccuaggccauagauguucuaa

SEQ ID NO: 112091 - RNA, 56 nt, Mus musculus
gacuccagcacuccacucgcaugccaggcaggaggagaaucacgaguuggacucca

SEQ ID NO: 112092 - RNA, 47 nt, Mus musculus
gugauggagagagaugugauucacuaaggaaauaggaauuguagcag

SEQ ID NO: 112093 - RNA, 46 nt, Mus musculus
gguacuguagagaguucuuagaagaaaacugugucuuaucggggua

SEQ ID NO: 112094 - RNA, 47 nt, Mus musculus
ccacgccuguaaucccugcaauugggagauggaggcaggagguccag

SEQ ID NO: 112095 - RNA, 46 nt, Mus musculus
uccucuuuauacucuuaagugaaggcaggaggaagcaguggagaga

SEQ ID NO: 112096 - RNA, 47 nt, Mus musculus
agauggcaugcugucuuagccuucuaaacugucaggucccugagguu

SEQ ID NO: 112097 - RNA, 46 nt, Mus musculus
ccaaauuugucugccuccuuguccugacauuugggauacuguccag

SEQ ID NO: 112098 - RNA, 46 nt, Mus musculus
uuaaaggcgugugccaccacugcccagcuagagauugacauuugag

SEQ ID NO: 112099 - RNA, 46 nt, Mus musculus
gggcuuagguugcuaacacugcacccugaucuuugcccuccuggag

SEQ ID NO: 112100 - RNA, 40 nt, Mus musculus
uuuuaagauuuauuuauuuauuuauuuuaugugugugcac

SEQ ID NO: 112101 - RNA, 46 nt, Mus musculus
cauccacccuucccuccuaggccaguccuguuugcaaacaccccua

SEQ ID NO: 112102 - RNA, 46 nt, Mus musculus
uuuguuuuuccaacagcuaguauuuuauucagauaagcagucucau

SEQ ID NO: 112103 - RNA, 42 nt, Mus musculus
aaaauguggccagucaaggauccagguaaauaauggcaucag

SEQ ID NO: 112104 - RNA, 46 nt, Mus musculus
uuugacaaucagaauccaacacagaauaggaaacaguuguacccag

SEQ ID NO: 112105 - RNA, 44 nt, Mus musculus
auacauccccacuguugguacugagauagcucaguuugcaggaa

SEQ ID NO: 112106 - RNA, 46 nt, Mus musculus
caacacuuuaagagggaggccaaccuggucuacaaaaugaguuagu

SEQ ID NO: 112107 - RNA, 42 nt, Mus musculus
uccagugaguucaccggcuccaaaggauugaggccaggggag

SEQ ID NO: 112108 - RNA, 41 nt, Mus musculus
gggaagaggaagagagaaagggggcuagggcacagagggaa

SEQ ID NO: 112109 - RNA, 45 nt, Mus musculus
gugucucaggcucauuaaaguguuuguccugaccucaaauuucca

SEQ ID NO: 112110 - RNA, 46 nt, Mus musculus
uaggaggggcagcaccuuuuguugccagugcuuuaugaauggccgu

SEQ ID NO: 112111 - RNA, 45 nt, Mus musculus
agguacuggaaucgugucauccgcccaucccacauaaggcaccaa

SEQ ID NO: 112112 - RNA, 42 nt, Mus musculus
uucacagagcugcugcagcucugucaaaauguucccguuggu

SEQ ID NO: 112113 - RNA, 76 nt, Mus musculus
ugggugggccuguucuucccagaucccucuccuggccagugcugcguccuguccccugccugauacuugguguaug

SEQ ID NO: 112114 - RNA, 73 nt, Mus musculus
caagaguauugcccuccguccgauaugcccacacuccagcugcuacugguucccuccuauagaaagcugccac

SEQ ID NO: 112115 - RNA, 45 nt, Mus musculus
gucagugcucacugccaaagggaguagagcucucaccugugggug

SEQ ID NO: 112116 - RNA, 74 nt, Mus musculus
gugugcugggaucugcaccuaugaagggagaggaggcaugugcuccauccgucucagugagccccuguuaaaac

SEQ ID NO: 112117 - RNA, 46 nt, Mus musculus
gccucuacccaaggguuuacagcugugcaccaccauuccuggccag

SEQ ID NO: 112118 - RNA, 45 nt, Mus musculus
uauuugucacuaauaaugauaaagaccgggaaggacacggcccag

SEQ ID NO: 112119 - RNA, 56 nt, Mus musculus
gaaaacuuguggaggcacuuacauaaaaaucaaggagccagagaacuauucgaaga

SEQ ID NO: 112120 - RNA, 46 nt, Mus musculus
gccagacgaaauuuaaauuaucuaucuuuugggaagugugugcuuu

SEQ ID NO: 112121 - RNA, 45 nt, Mus musculus
cugucaccucuacaguccccuuagaaagccagaguuugcacagau

SEQ ID NO: 112122 - RNA, 42 nt, Mus musculus
aaaauaacaucaaucuauuuuuguaaaccucuucaugcuauu

SEQ ID NO: 112123 - RNA, 45 nt, Mus musculus
ucauuucaucucuuuuuuauaucaaguuuugaauucggggaauuu

SEQ ID NO: 112124 - RNA, 46 nt, Mus musculus
ucagagccuguugcuucaugagugaaugccucuuuuucuugcaggu

SEQ ID NO: 112125 - RNA, 45 nt, Mus musculus
cagaggugcagucaggagaggggccaccgggccagauuccaggug

SEQ ID NO: 112126 - RNA, 46 nt, Mus musculus
uuaaaaagaaaagggcaguuuuucagaaguaauucagagagcagaa

SEQ ID NO: 112127 - RNA, 41 nt, Mus musculus
uccccgcagagagcggagguugagguacacgggugggauga

SEQ ID NO: 112128 - RNA, 106 nt, Mus musculus
uuacccaggcaacggaacaggcuauguccgucacguugauaacccaaauggagauggaagaugcgugacauguauauauuaucuaaauaaagacugggacgccaag

SEQ ID NO: 112129 - RNA, 42 nt, Mus musculus
uuuauaauggcuuagaaugguuuuaccucuccuuaccacaga

SEQ ID NO: 112130 - RNA, 46 nt, Mus musculus
uagcauucgucugucauaggugcggagagaaagggaggcacaagga

SEQ ID NO: 112131 - RNA, 23 nt, Mus musculus
gcaaagauagggcuccucugaaa

SEQ ID NO: 112132 - RNA, 46 nt, Mus musculus
caugugcccucugccgugggcugagacaguggcaggagagagagug

SEQ ID NO: 112133 - RNA, 46 nt, Mus musculus
aguugugugugugugugugugugugugugugugugugucuggauga

SEQ ID NO: 112134 - RNA, 46 nt, Mus musculus
uuuguaagguuuacuauuacuauaaauauaccacuaagcuguaaac

SEQ ID NO: 112135 - RNA, 45 nt, Mus musculus
ugcuagcacccagugacuuaaccuucacuguccucuggccuagau

SEQ ID NO: 112136 - RNA, 42 nt, Mus musculus
ugucuuagucaggguuucuauuccugcacaaaacauccugac

SEQ ID NO: 112137 - RNA, 45 nt, Mus musculus
aaacaaaacaaaacaaaacaaaaaaaggaggcugaggcaggagaa

SEQ ID NO: 112138 - RNA, 46 nt, Mus musculus
uguuuagucacuaagcugugcuguuuuaagucugucucucuaaggg

SEQ ID NO: 112139 - RNA, 46 nt, Mus musculus
ggccagggcccaccauuuaggcaccugggucagguucaagccagau

SEQ ID NO: 112140 - RNA, 46 nt, Mus musculus
cgcggagguuggaggacagcuuuucagaauugauucuccuguggag

SEQ ID NO: 112141 - RNA, 44 nt, Mus musculus
cggagguuggaggacagcuuuccagaauugauucuccuguggag

SEQ ID NO: 112142 - RNA, 44 nt, Mus musculus; identical to SEQ ID NO: 112141

SEQ ID NO: 112143 - RNA, 44 nt, Mus musculus; identical to SEQ ID NO: 112141

SEQ ID NO: 112144 - RNA, 46 nt, Mus musculus
cugacccucacaucuuaaaaauuacauuuauuacugagugugugug

SEQ ID NO: 112145 - RNA, 56 nt, Mus musculus
gacgaccugauccgccacugcagcgggaagcugggcaacuacaggauaaacggccg

SEQ ID NO: 112146 - RNA, 41 nt, Mus musculus
cgggcggaugcggcugaaguugauaaagacaugagcagagu

SEQ ID NO: 112147 - RNA, 46 nt, Mus musculus
gcccccgaugcugagugccagcaggauccuguguccgacaccagau

SEQ ID NO: 112148 - RNA, 25 nt, Mus musculus
aggagaagcaggacaaggcggugcu

SEQ ID NO: 112149 - RNA, 49 nt, Mus musculus
uguaugucuauaucugugugugucuguauguguuugugugucugugugu

SEQ ID NO: 112150 - RNA, 42 nt, Mus musculus
ggugacauaauugaguauuuauugcaagacacaauaggggau

SEQ ID NO: 112151 - RNA, 45 nt, Mus musculus
ggucccaagugguacaaacagagcaagauggaguugaugugagag

SEQ ID NO: 112152 - RNA, 84 nt, Mus musculus
agagcaguagagugcuguguagacagagcaguagaguguuguguagacagagcaguagaguguuguguagacagagcaguagag

SEQ ID NO: 112153 - RNA, 84 nt, Mus musculus
cacuguguagacagagcaguagaguguuguguagacagagcaguagagugcuguguagacagagcaguagagugcuguguagac

SEQ ID NO: 112154 - RNA, 45 nt, Mus musculus
ucugucucgggugauagcaucucaggggucccuguuuuggcagau

SEQ ID NO: 112155 - RNA, 42 nt, Mus musculus
ugacaauaggaauccacaagacugguauccagacauagagag

SEQ ID NO: 112156 - RNA, 46 nt, Mus musculus
gcaaggcaaaagcucagacagacaccucugucccuaacccccaccc

SEQ ID NO: 112157 - RNA, 46 nt, Mus musculus
uguuacuuuaaaagaaaaaaacugagaagagaaaaggggauuuauu

SEQ ID NO: 112158 - RNA, 51 nt, Mus musculus
auugaugcuaaagaaauuggaagaaagacaaauguauucuuagcaaaauaa

SEQ ID NO: 112159 - RNA, 45 nt, Mus musculus
cucguacaaucucaagcacauuuguaaauauacaauaggccagug

SEQ ID NO: 112160 - RNA, 42 nt, Mus musculus
acagucaggggacuguuuccuaggacagcaucagcccuggaa

SEQ ID NO: 112161 - RNA, 45 nt, Mus musculus
augaagcaaguuuggcuuugguggaagggaaugaaguuagaaggu

SEQ ID NO: 112162 - RNA, 46 nt, Mus musculus
uagaagcuucuggggauugcuuuguucagguauuuugucaauagug

SEQ ID NO: 112163 - RNA, 45 nt, Mus musculus
agcuucgugcaccaugccuuugucugucgccugacucccugaagu

SEQ ID NO: 112164 - RNA, 45 nt, Mus musculus
ucagauaccuuccaggucacuugaagggacagagggguggcugag

SEQ ID NO: 112165 - RNA, 41 nt, Mus musculus
cguucugaagacauccgagaaauagugcaacgacugcuagu

SEQ ID NO: 112166 - RNA, 35 nt, Mus musculus
gcaaaauucagcuucaucacgcugggggcaaagaa

SEQ ID NO: 112167 - RNA, 42 nt, Mus musculus
cuuugaugacuaaaggccugagugugcuucagagcccaagac

SEQ ID NO: 112168 - RNA, 46 nt, Mus musculus
uucaugcucuggacagcgagacaugcucuguaggcaacuaauaaac

SEQ ID NO: 112169 - RNA, 46 nt, Mus musculus
uugggauccuguacugcagagcugggcagagcacggaggaggagau

SEQ ID NO: 112170 - RNA, 42 nt, Mus musculus
ggcucggcugcugcuaggaugcucaaggccucugcuggcaag

SEQ ID NO: 112171 - RNA, 82 nt, Mus musculus
ugagugugucuuggcucucaggucccagugaguguguccuggcucucaggucccagugaguguguccuggcucucagguccc

SEQ ID NO: 112172 - RNA, 68 nt, Mus musculus
cucaggucccagugaguguguccuggcucucaggucccagugaguguguccuggcucucaggucccag

SEQ ID NO: 112173 - RNA, 42 nt, Mus musculus
cucaggucccagugagugugucuuggcucucaggucccagug

SEQ ID NO: 112174 - RNA, 48 nt, Mus musculus
gaaaaucuuggcccuguggcggucagcauccggagggagaagguggaa

SEQ ID NO: 112175 - RNA, 45 nt, Mus musculus
uugagcggggugugugugugugugugugugugugugugugugugu

SEQ ID NO: 112176 - RNA, 46 nt, Mus musculus
cagacacagaauuaaaggcagcacuuuguuuugaugguuaagagau

SEQ ID NO: 112177 - RNA, 41 nt, Mus musculus
gaaaucuggacagcaggagcuugaagcagucaggaaacaga

SEQ ID NO: 112178 - RNA, 46 nt, Mus musculus
ggaggaccucaacuccaaggagaacccagaugcugaugagggcgau

SEQ ID NO: 112179 - RNA, 56 nt, Mus musculus
ugcccauuacgaugugcagaguauccuguucaacaucaaugaagccauggccacga

SEQ ID NO: 112180 - RNA, 45 nt, Mus musculus
cagagcugcugccaaacucaaggacccuuccagaaccaugcaggc

SEQ ID NO: 112181 - RNA, 45 nt, Mus musculus
aguguuugcuuuuuugcugucgcucccuugguuuccaggaacugu

SEQ ID NO: 112182 - RNA, 45 nt, Mus musculus
ucaggauaucaauccagguccucaugcugucauauaagcacacuu

SEQ ID NO: 112183 - RNA, 41 nt, Mus musculus
uuuucgauuuuugucacguggcugcuucugguauugccugu

SEQ ID NO: 112184 - RNA, 46 nt, Mus musculus
gcuucuccagcauccaguguucugucacacagcuaucugcccagcc

SEQ ID NO: 112185 - RNA, 25 nt, Mus musculus
caaggagagagaaaguagccaacau

SEQ ID NO: 112186 - RNA, 42 nt, Mus musculus
aaccucccagaugcacucagaguucagagaaggcagccaggg

SEQ ID NO: 112187 - RNA, 46 nt, Mus musculus
cuagguggcagcugaagcagggagggaagggaagcaugacucagag

SEQ ID NO: 112188 - RNA, 46 nt, Mus musculus
uauaguuuuugcacuuuucuauuuaaucuuuuuuuuccgagugauu

SEQ ID NO: 112189 - RNA, 49 nt, Mus musculus
acauguaugcauugucugcugaugccagagagggcguuggaucuggacc

SEQ ID NO: 112190 - RNA, 46 nt, Mus musculus
acccugugauaucauuuaacuuggguuaccacauacguccagaguc

SEQ ID NO: 112191 - RNA, 46 nt, Mus musculus
caaagcuugacuguaaaaaguggauuauguaauuaccucucuagaa

SEQ ID NO: 112192 - RNA, 46 nt, Mus musculus
uggguuccaaguucauugugaauugagcaaaggcugccaggagaca

SEQ ID NO: 112193 - RNA, 45 nt, Mus musculus
cacuaccgcagugcuggcuugcuaccagucugagcaagggcuuag

SEQ ID NO: 112194 - RNA, 46 nt, Mus musculus
guuccuagcaacaaacaauucauuuggcuaguuagcccuuuguguu

SEQ ID NO: 112195 - RNA, 41 nt, Mus musculus
caccugcucugugggcagguggaguaaagauggccccugag

SEQ ID NO: 112196 - RNA, 45 nt, Mus musculus
cugaucucuucacauggaggugggccuccucuggggagcgggagg

SEQ ID NO: 112197 - RNA, 42 nt, Mus musculus
aagcuguuuagugauuuccaaacaucaucuuggccccuagau

SEQ ID NO: 112198 - RNA, 42 nt, Mus musculus
acacuggcauucaccucagcagcucuguuaguugggagagga

SEQ ID NO: 112199 - RNA, 50 nt, Mus musculus
gguaugauggaggagaaagucuauuacagauauaugggagagucaagggu

SEQ ID NO: 112200 - RNA, 37 nt, Mus musculus
ggguccagguucuaaaugaaugagugaaagagaaaga

SEQ ID NO: 112201 - RNA, 46 nt, Mus musculus
ccagguguguccuuauuagcucugcucugagacgagaggggcaggu

SEQ ID NO: 112202 - RNA, 60 nt, Mus musculus
auggccaaguacugaaaggcugagagaaugcccugggagaugaagugcugucagacuaag

SEQ ID NO: 112203 - RNA, 90 nt, Mus musculus
caugccagagaaguggagagugaaggucuuuaaagccauggaggaugcuacacagaccugagagggcccugugagggaagguauaggccc

SEQ ID NO: 112204 - RNA, 46 nt, Mus musculus
uggcuggacagaggguuagaaggcuguuugccuuuuguguucauua

SEQ ID NO: 112205 - RNA, 46 nt, Mus musculus
cucugcagugcaaauagcuggauaauuuucugguuuagucugggaa

SEQ ID NO: 112206 - RNA, 46 nt, Mus musculus
aggggcccugcccuggcaggcugccucuggaggaauggagugagca

SEQ ID NO: 112207 - RNA, 42 nt, Mus musculus
ccugucuccaaaacaaaacaaaacaaaacaagagcagcagca

SEQ ID NO: 112208 - RNA, 91 nt, Mus musculus
uacuccacauauuuuugaagugacaucuaacacuuucaucacacauuuaaauagugguucaugggacauaggaaaagaccaaagccaagau

SEQ ID NO: 112209 - RNA, 42 nt, Mus musculus
uaaccccuagcgcuaauccuaaccauaacccuuggcccuaac

SEQ ID NO: 112210 - RNA, 46 nt, Mus musculus
guucuaacuuagaaacaguaucucacaagucacuguaaccucagua

SEQ ID NO: 112211 - RNA, 46 nt, Mus musculus
ucauuuaugucaauuuaauaccuugcuauuuaauggugugggagaa

SEQ ID NO: 112212 - RNA, 49 nt, Mus musculus
aaacagccacagcuggcuucuguauaaaaguacugaauaaagaucgauu

SEQ ID NO: 112213 - RNA, 114 nt, Mus musculus
agagaccaugacucuagaagaagaagggggagaggguguggggaggaagaagaaagagagagagaguaggaaaggaauggaaaggaaaggaaagaaagaaagaaaaaagagaga

SEQ ID NO: 112214 - RNA, 47 nt, Mus musculus
agagcacaugcugcuacccagguauacuggcacacauccucagcccc

SEQ ID NO: 112215 - RNA, 50 nt, Mus musculus
aucuguagcacaugugcaccccuucaccacauaaauaaaugcaaaauuaa

SEQ ID NO: 112216 - RNA, 74 nt, Mus musculus
gaggugcuuagugguuaaagacaguaccaagcuuagugacccaaguucagucccuggaauccaccugguagacg

SEQ ID NO: 112217 - RNA, 80 nt, Mus musculus
caaguuacuguccaaacuucagucaccauggauucugggaacagugaagucucagacaaauagccccaauguagagacua

SEQ ID NO: 112218 - RNA, 45 nt, Mus musculus
gggauaagcuugcuugcuucuugcuuggugauuaauugggguugg

SEQ ID NO: 112219 - RNA, 50 nt, Mus musculus
gcuugggcccucucaauuggggugaauuaauuuggcagaguaaaaacauu

SEQ ID NO: 112220 - RNA, 46 nt, Mus musculus
uuucucuaggaguugaguugugaggaccugggacccuccccaagau

SEQ ID NO: 112221 - RNA, 42 nt, Mus musculus
acacuguaaggggugugugugugugugugugugugugugugu

SEQ ID NO: 112222 - RNA, 46 nt, Mus musculus
cagauuucagaucugcugugcugaggugauacuggcgaaugcagga

SEQ ID NO: 112223 - RNA, 45 nt, Mus musculus
uguucuugaggagauauaaauagcaacucaguuacaagggucaca

SEQ ID NO: 112224 - RNA, 47 nt, Mus musculus
gaggcaaagcucgggccaccgugugugugugugugugugugugugug

SEQ ID NO: 112225 - RNA, 42 nt, Mus musculus
accacagcuucugguucucucuagaauaagccuggggcagag

SEQ ID NO: 112226 - RNA, 80 nt, Mus musculus
caaggcagcuuucaguacgucauggcaagagagauaaauugaagagaaggaagaaagaagguggggggguaaagaaaggu

SEQ ID NO: 112227 - RNA, 46 nt, Mus musculus
gagucucucgucaucauaaccaucaucauccauaaccgcagcagag

SEQ ID NO: 112228 - RNA, 42 nt, Mus musculus
auggggugugugugugugugugugugugugugaaugugugug

SEQ ID NO: 112229 - RNA, 46 nt, Mus musculus
agucuggccuacagaguuggggcuccaucucaaaacaacgaaagag

SEQ ID NO: 112230 - RNA, 46 nt, Mus musculus
uuggucaaagcuauggaguauacauuuggaaggugcaaccccucuc

SEQ ID NO: 112231 - RNA, 42 nt, Mus musculus
aauggaagaggaagaaagaaagugaagggagguggaaaagaa

SEQ ID NO: 112232 - RNA, 42 nt, Mus musculus
aggcuggagggaguucccuugguucuugcuggauugccagag

SEQ ID NO: 112233 - RNA, 30 nt, Mus musculus
aguaugagagagaaagugugugugugugug

SEQ ID NO: 112234 - RNA, 46 nt, Mus musculus
agucagaaucucaccagacuuguucuguugucuuacucuugcccag

SEQ ID NO: 112235 - RNA, 41 nt, Mus musculus
ggacucugcucaagucuucccaguguugcugacaggggagc

SEQ ID NO: 112236 - RNA, 42 nt, Mus musculus
cacaguuugauaucuuuaccaggaagcuugagggggcaacau

SEQ ID NO: 112237 - RNA, 45 nt, Mus musculus
uccuggcuguaggcugcacugugugugcugggacagcuccugauu

SEQ ID NO: 112238 - RNA, 45 nt, Mus musculus
agccugggcuaccuggccagccuggguuacauaguaaguucuggg

SEQ ID NO: 112239 - RNA, 42 nt, Mus musculus
gcaaggguauagugcagaacuuggaagugccuucugggguag

SEQ ID NO: 112240 - RNA, 27 nt, Mus musculus
aggcuccagcuguggccccaaacacag

SEQ ID NO: 112241 - RNA, 52 nt, Mus musculus
gacuguccaguaggcacaagugugcugagacaggauagaguggugaugggca

SEQ ID NO: 112242 - RNA, 46 nt, Mus musculus
uaggcagcuguggccacaagcuguaagacccaagugucuugggcag

SEQ ID NO: 112243 - RNA, 46 nt, Mus musculus
cccacccuaaggugagggugcgcgcagggauguguugcaccccgcg

SEQ ID NO: 112244 - RNA, 47 nt, Mus musculus
gcaccagccacccugagcugugguucucuugucccugcauagcacau

SEQ ID NO: 112245 - RNA, 42 nt, Mus musculus
ugugagacuagaaaaugcugcucuuguuaaaagccuucagug

SEQ ID NO: 112246 - RNA, 46 nt, Mus musculus
cccucacuuuaauuaaggcaguccuucauaguuuggaugaugagau

SEQ ID NO: 112247 - RNA, 46 nt, Mus musculus
ggaaaauaaacaauguauuuuuauaauaaacuuuuuauauaaugau

SEQ ID NO: 112248 - RNA, 46 nt, Mus musculus
uucaugugccuuaaaguauauaucauuauauauauuguccccuuuu

SEQ ID NO: 112249 - RNA, 45 nt, Mus musculus
aagggcauuacaagaacagccaggugagaaaaggaaaaccagcag

SEQ ID NO: 112250 - RNA, 46 nt, Mus musculus
cuggacacacugagccacuggcuuuacagggaagccugauugucac

SEQ ID NO: 112251 - RNA, 45 nt, Mus musculus
guuaaauauucccuuccaagguuuacaagccagacacugccagag

SEQ ID NO: 112252 - RNA, 46 nt, Mus musculus
caacgucacagggucaaggggacagaggaugaaccucaucguagcg

SEQ ID NO: 112253 - RNA, 46 nt, Mus musculus
ucuuuucaguucucugaauaccuagauacuugccccauguccccag

SEQ ID NO: 112254 - RNA, 46 nt, Mus musculus
ccaggcgccacacuccucaaacugcaguguuuuacacagaugccag

SEQ ID NO: 112255 - RNA, 43 nt, Mus musculus
uuagaccuagagucacagaagggacaagacuucgggcacacag

SEQ ID NO: 112256 - RNA, 83 nt, Mus musculus
uuggucugcucucuuccuccugaugcaccagcgugucaggagccacugcuucccucuccguccacuacagauggggcagccac

SEQ ID NO: 112257 - RNA, 42 nt, Mus musculus
guccuauuggccuucuugucacagcagcaggggagguggccc

SEQ ID NO: 112258 - RNA, 45 nt, Mus musculus
gugguggugcuuucucagcaggaaggagaggcagacccacugauc

SEQ ID NO: 112259 - RNA, 46 nt, Mus musculus
cugaaaacagcucugaguuuuacaacacagcuuccagacgcagaag

SEQ ID NO: 112260 - RNA, 45 nt, Mus musculus
auguguucuccacacaucaaacaguagcagcugcccccuugucag

SEQ ID NO: 112261 - RNA, 42 nt, Mus musculus
gagaaccugaagaaaucagccaaaguuguccucugcccugug

SEQ ID NO: 112262 - RNA, 45 nt, Mus musculus
gguaaaugaagaagugguaccaggaccugaagaacaucaugcuua

SEQ ID NO: 112263 - RNA, 60 nt, Mus musculus
gagagugcagucaggauacccguagucuuaaguuguguucgcagagauggcccugagaug

SEQ ID NO: 112264 - RNA, 45 nt, Mus musculus
cucucucucucucucucucuaaguauugauuguaucugugugugu

SEQ ID NO: 112265 - RNA, 45 nt, Mus musculus
gguuaguguggugugguguggugugguguggugugguguggugug

SEQ ID NO: 112266 - RNA, 46 nt, Mus musculus
aguguguguauggauguguuuguaguuaauguggugugguguggug

SEQ ID NO: 112267 - RNA, 46 nt, Mus musculus
ucagagauccucugacaucagucaugcccagaagggacaagcccag

SEQ ID NO: 112268 - RNA, 23 nt, Mus musculus
aacacucagucuagcucaggcaa

SEQ ID NO: 112269 - RNA, 46 nt, Mus musculus
acaggaucaaaugcucacccaaaauuguuauguaaaaagcacaccc

SEQ ID NO: 112270 - RNA, 45 nt, Mus musculus
agucuugggcacacaguucuaagccaucuuuggaccccguggaga

SEQ ID NO: 112271 - RNA, 45 nt, Mus musculus
uuucuuuugagacaggguuuuucuguguauuuauagcuguccugg

SEQ ID NO: 112272 - RNA, 52 nt, Mus musculus
uccugugcuguugaagcuguccacaucucauuccuaaagguccucucucucu

SEQ ID NO: 112273 - RNA, 45 nt, Mus musculus
ggauuggagaacaucuggcuugguguguauuugcagaacugaaug

SEQ ID NO: 112274 - RNA, 45 nt, Mus musculus
uaacacccaacugagauaaaagcaguuuuaaguguugccauggga

SEQ ID NO: 112275 - RNA, 45 nt, Mus musculus
auagaaacaaauguugcaccccagcucaccugaaguuaaauagau

SEQ ID NO: 112276 - RNA, 45 nt, Mus musculus; identical to SEQ ID NO: 112275

SEQ ID NO: 112277 - RNA, 48 nt, Mus musculus
uacagagguacucugcagugugcacuggaugcccuggcccuggaaguu

SEQ ID NO: 112278 - RNA, 45 nt, Mus musculus
acuugucugagauugacaucacuguagaguccuaugcagcccaga

SEQ ID NO: 112279 - RNA, 46 nt, Mus musculus
ugauuaauuuaucuuacacagugacagcggcgugccaucuugacgg

SEQ ID NO: 112280 - RNA, 46 nt, Mus musculus
ucuaaagacuagaacauuuuauuguauguuguaaaauuggguagaa

SEQ ID NO: 112281 - RNA, 81 nt, Mus musculus
ucuuaagacaugcaauucaaauguaaauacaguagaguauuacuuagguagaaacucguggugauuuuaagauuggaaaag

SEQ ID NO: 112282 - RNA, 73 nt, Mus musculus
gaaaaguauuuugauagagcuuuucauuuuauaaauacacugaguuaaccaaauaucauggauuuccguuugu

SEQ ID NO: 112283 - RNA, 42 nt, Mus musculus
cucagagcuuggcugaagaugauguggaaugagccagauacc

SEQ ID NO: 112284 - RNA, 42 nt, Mus musculus
acuuuguauggucauaccccucccucaccaccaccaccaauc

SEQ ID NO: 112285 - RNA, 52 nt, Mus musculus
ugccauugcuguguguggacagccucagcagcugcugcaaguguuacagcag

SEQ ID NO: 112286 - RNA, 46 nt, Mus musculus
gagaaaguuucucauugaguuuguucaguugauuucaucaagaguu

SEQ ID NO: 112287 - RNA, 45 nt, Mus musculus
aaagcacauaaacuuuaaaaauuguaugugugaauugcuuaagug

SEQ ID NO: 112288 - RNA, 48 nt, Mus musculus
auuggcauuguguuauucuuggguuuuuuuccccucaguagauucaga

SEQ ID NO: 112289 - RNA, 85 nt, Mus musculus
uugcuaucauuaauaaaauuggaauugugucucuggacagugguagcacauaccuuuaagcccagcacuugagggagaagcaggu

SEQ ID NO: 112290 - RNA, 164 nt, Mus musculus
uuaugugauccagauuuuagauaauuacuuugggccucauuuacuuguauugaaaggugauuuuguuuuauuuuuuguucuagaauugggcagcauuuuguuccauacaauagaauggucccauuguuuaguaguuuuuaaucucaaaaguaguuuugaaguug

SEQ ID NO: 112291 - RNA, 41 nt, Mus musculus
cucagaaaucgccugccucugccucccaaaugccgggauua

SEQ ID NO: 112292 - RNA, 42 nt, Mus musculus
acaaccaggauuaaccaccacaccagguauugauagcucuuc

SEQ ID NO: 112293 - RNA, 46 nt, Mus musculus
aguaacugaauacggcugagccugccagcccucaccuaguccaggu

SEQ ID NO: 112294 - RNA, 47 nt, Mus musculus
agaugcugaagcaguucagaaauucuuccuugaagagauacagcuug

SEQ ID NO: 112295 - RNA, 45 nt, Mus musculus
uaguuuauaauggcaacaaaauagcauuguauagaugauagagag

SEQ ID NO: 112296 - RNA, 45 nt, Mus musculus
augaugaggagacaacuuaggaucucuguaugugugagucugaca

SEQ ID NO: 112297 - RNA, 46 nt, Mus musculus
acaguaaccuuuaauccuaguuugagaagcucuguuagaggcagcc

SEQ ID NO: 112298 - RNA, 46 nt, Mus musculus
uauguuaauuggguaagcagcaagaugagagucuccagagauggac

SEQ ID NO: 112299 - RNA, 45 nt, Mus musculus
ggcuuuccaagguaaugaaaauagucuuguguuuuugcguguaga

SEQ ID NO: 112300 - RNA, 46 nt, Mus musculus
gaaacaccaguucacucgccagggaggcagggauucuggaggcagg

SEQ ID NO: 112301 - RNA, 46 nt, Mus musculus
uacagagaaacccugucucgaaaaaccaaaaaaaaaggggggggau

SEQ ID NO: 112302 - RNA, 46 nt, Mus musculus
uugucaaucaaaugucuuacuuuuacugaaccauuuggcuuaagaa

SEQ ID NO: 112303 - RNA, 42 nt, Mus musculus
cucugguguaaguguaaggcacugaauauaaaccuggcagug

SEQ ID NO: 112304 - RNA, 45 nt, Mus musculus
uaauuuuuuugauguacauguacaucugcaaugaaaggauggugu

SEQ ID NO: 112305 - RNA, 46 nt, Mus musculus
cgaagaaugcaucuuggauuuauagacugcguuuuggggaccagau

SEQ ID NO: 112306 - RNA, 46 nt, Mus musculus
auuucuaaaugaguuuuuuaauuuuucguaguuauauauggucgga

SEQ ID NO: 112307 - RNA, 46 nt, Mus musculus
ggaauaaucuggccuuuuuuguuucgcuuucuugggggcugcaguc

SEQ ID NO: 112308 - RNA, 44 nt, Mus musculus
ugcuuccaagauaugagugaaugcuagacaaagugcgggggagu

SEQ ID NO: 112309 - RNA, 50 nt, Mus musculus
uacuucgaccgcaaaaggcggagugaccccaacuucaagaacaggcuucg

SEQ ID NO: 112310 - RNA, 42 nt, Mus musculus
ucccagcaaccacaugguggcucacaaccaucuguccgaugc

SEQ ID NO: 112311 - RNA, 41 nt, Mus musculus
gugggggaagcaggaagccaaggcugauucaggcaggcaga

SEQ ID NO: 112312 - RNA, 45 nt, Mus musculus
cuaauucguugccagugacuacaguggucaaugauguccuuggcu

SEQ ID NO: 112313 - RNA, 46 nt, Mus musculus
caugcaugugagauucauuuuuauuauuuuuaacauggaugcauau

SEQ ID NO: 112314 - RNA, 45 nt, Mus musculus
ccguggcuauggcuccuuguuuguacaugcugacaguacuaaguc

SEQ ID NO: 112315 - RNA, 41 nt, Mus musculus
cguggcagugaggaucgugagaaacccacuuacaggagucg

SEQ ID NO: 112316 - RNA, 45 nt, Mus musculus
cuuauuagcaagagccuguggaaaggaacuaaggauaugagcagg

SEQ ID NO: 112317 - RNA, 51 nt, Mus musculus
aagacagccagauaugguaggucaugccuguaauccaugcaucaggagggu

SEQ ID NO: 112318 - RNA, 45 nt, Mus musculus
uucauccugaccagaaaagcaucaaugcauauguaguguucaagg

SEQ ID NO: 112319 - RNA, 41 nt, Mus musculus
ccagcaaaguccaggcugugagaaauaaugaaggacagaga

SEQ ID NO: 112320 - RNA, 46 nt, Mus musculus
uacccaggcuggccuccagcucacagagauccaccugccucugcuu

SEQ ID NO: 112321 - RNA, 46 nt, Mus musculus
ucaucuaauaaaucacagcuuucuucucaauagaaaacagccagau

SEQ ID NO: 112322 - RNA, 46 nt, Mus musculus
uucugagagagaggggguggggcgagaggagagacagacagcaggu

SEQ ID NO: 112323 - RNA, 28 nt, Mus musculus
uagucuuuuccucuugugugugugugug

SEQ ID NO: 112324 - RNA, 44 nt, Mus musculus
gugauguuguuguuguugucuauacuugugccuuuguuguuaga

SEQ ID NO: 112325 - RNA, 46 nt, Mus musculus
uguucuuguuuguuuugagacagaaucucacuauguagccccagcu

SEQ ID NO: 112326 - RNA, 41 nt, Mus musculus
ucucaccaugccgcaggcagccugacuagugcgugggcaga

SEQ ID NO: 112327 - RNA, 59 nt, Mus musculus
cacagauguucaggguguuggcuaacauguacguguauauuguuuauuuuagaagcuga

SEQ ID NO: 112328 - RNA, 44 nt, Mus musculus
uuuugugucaucucccuaugaaucucauguaccccaggccagag

SEQ ID NO: 112329 - RNA, 46 nt, Mus musculus
uccccuucucauagaauagcaaguaaaggcugcauaauaaggagua

SEQ ID NO: 112330 - RNA, 110 nt, Mus musculus
ugggggccaaagaacaaaaaucccagucaaccccgaagaggagcgguuaaaaaacgagaggacuguguuuguuggcaauuugccugucacauguaauaaaaaggugagug

SEQ ID NO: 112331 - RNA, 63 nt, Mus musculus
aagagcuucaucaggaccaagggcagggaagaaggagaaggucucagucucgggguaaagugg

SEQ ID NO: 112332 - RNA, 43 nt, Mus musculus
aagaggagacacaaguggcccauaggcaaauggcaguuuaaaa

SEQ ID NO: 112333 - RNA, 31 nt, Mus musculus
ugagggagaaggggagggcaacaagggagau

SEQ ID NO: 112334 - RNA, 46 nt, Mus musculus
aguacagccuguccgugugguccagguuggcuucuagugcccaagu

SEQ ID NO: 112335 - RNA, 42 nt, Mus musculus
ggaaacaucuaaaaaaagaaaacuugaugaugaugaugauga

SEQ ID NO: 112336 - RNA, 45 nt, Mus musculus
gaagaagaagaugaugaugaugaauaaguugguucuagcgcaguu

SEQ ID NO: 112337 - RNA, 46 nt, Mus musculus
ucugugccucgcggaggaaaaucaacuaaacaugggcaaagaagau

SEQ ID NO: 112338 - RNA, 45 nt, Mus musculus
cuguccuaugcagaccuacaguguggggugaauauaaauguccac

SEQ ID NO: 112339 - RNA, 46 nt, Mus musculus
caagcagaccuuauuccaaaauguguuuuuaucuaucaagccacag

SEQ ID NO: 112340 - RNA, 45 nt, Mus musculus
gcuacaguugccacaugaggguguugcuaagauucaaagcaucag

SEQ ID NO: 112341 - RNA, 42 nt, Mus musculus
uaggcaagcacucugcuguuugcuuacacuuccccagcccau

SEQ ID NO: 112342 - RNA, 46 nt, Mus musculus
uaagccccugggcuuggcccugcuaggaaagccccucccagcagag

SEQ ID NO: 112343 - RNA, 43 nt, Mus musculus
gggucucgggccggcgucggcgggccucggcuucucgguuggu

SEQ ID NO: 112344 - RNA, 42 nt, Mus musculus
ccuccgaaaggccgagguccgccgacaccgacccgagacccu

SEQ ID NO: 112345 - RNA, 46 nt, Mus musculus
ggcggcccgggcuccgccgcguuccgccucucggagggucucgggu

SEQ ID NO: 112346 - RNA, 46 nt, Mus musculus
ggacugccuaucucauuuuacaaaggaagaaacugaggugcaggag

SEQ ID NO: 112347 - RNA, 46 nt, Mus musculus
agaauggacuaagaaauuuuaguuuagaguuaccucuugcauacug

SEQ ID NO: 112348 - RNA, 46 nt, Mus musculus
auaucauaguuuguugucuggagaaaauaauuuuauuaguguuccg

SEQ ID NO: 112349 - RNA, 39 nt, Mus musculus
augucuagcauauaugucaucauaaaauguauacgugag

SEQ ID NO: 112350 - RNA, 42 nt, Mus musculus
ugcuauaaaauauauguuuuaauuuauaaauaaugggugcau

SEQ ID NO: 112351 - RNA, 24 nt, Mus musculus
uauagaucccaagugguagccagu

SEQ ID NO: 112352 - RNA, 46 nt, Mus musculus
uuguaguagcacugccucccuggguaaaugcaccaccuggccauuc

SEQ ID NO: 112353 - RNA, 42 nt, Mus musculus
uugauaguauaggcugcaaaauaaaagcaccggaguguagag

SEQ ID NO: 112354 - RNA, 45 nt, Mus musculus
auuuuucacacccauucccccagagcagugaucagagcugcaguu

SEQ ID NO: 112355 - RNA, 58 nt, Mus musculus
guggcuuaagugguuuuggaaggcuugauggagaagaugaggucugagugaggaaugg

SEQ ID NO: 112356 - RNA, 42 nt, Mus musculus
guguucauacuugagaggcccuggguucaaucucuagcacag
